United States Patent 7,314,750 (ADDRESSABLE OLIGONUCLEOTIDE ARRAY OF THE RAT GENOME) - sequence listing, part 3

SEQ ID NO: 74990 - DNA, 25 bp, Rattus norvegicus
acagagttcctctgcgtaggacaca

SEQ ID NO: 74991 - DNA, 25 bp, Rattus norvegicus
acagagttctccagcatgtcttaga

SEQ ID NO: 74992 - DNA, 25 bp, Rattus norvegicus
acagagttctcctgcatgtcttaga

SEQ ID NO: 74993 - DNA, 25 bp, Rattus norvegicus
acagagttgaccctcgtaccaggct

SEQ ID NO: 74994 - DNA, 25 bp, Rattus norvegicus
acagagttgaccgtcgtaccaggct

SEQ ID NO: 74995 - DNA, 25 bp, Rattus norvegicus
acagagttgtctcctgattatcaaa

SEQ ID NO: 74996 - DNA, 25 bp, Rattus norvegicus
acagagttgtctgctgattatcaaa

SEQ ID NO: 74997 - DNA, 25 bp, Rattus norvegicus
acagagtttccacactgaggtgctg

SEQ ID NO: 74998 - DNA, 25 bp, Rattus norvegicus
acagagtttccagactgaggtgctg

SEQ ID NO: 74999 - DNA, 25 bp, Rattus norvegicus
acagagtttgatccacaccagacat

SEQ ID NO: 75000 - DNA, 25 bp, Rattus norvegicus
acagagtttgatgcacaccagacat

SEQ ID NO: 75001 - DNA, 25 bp, Rattus norvegicus
acagagttttggactctcgtcagat

SEQ ID NO: 75002 - DNA, 25 bp, Rattus norvegicus
acagagttttggtctctcgtcagat

SEQ ID NO: 75003 - DNA, 25 bp, Rattus norvegicus
acagagttttgtagataacagtcaa

SEQ ID NO: 75004 - DNA, 25 bp, Rattus norvegicus
acagagttttgttgataacagtcaa

SEQ ID NO: 75005 - DNA, 25 bp, Rattus norvegicus
acagataactctcttcatgtattca

SEQ ID NO: 75006 - DNA, 25 bp, Rattus norvegicus
acagataactctgttcatgtattca

SEQ ID NO: 75007 - DNA, 25 bp, Rattus norvegicus
acagataactgaagcctacactcca

SEQ ID NO: 75008 - DNA, 25 bp, Rattus norvegicus
acagataactgatgcctacactcca

SEQ ID NO: 75009 - DNA, 25 bp, Rattus norvegicus
acagataagccgcagtccatctctg

SEQ ID NO: 75010 - DNA, 25 bp, Rattus norvegicus
acagataagccggagtccatctctg

SEQ ID NO: 75011 - DNA, 25 bp, Rattus norvegicus
acagatacagacacttaaccagggt

SEQ ID NO: 75012 - DNA, 25 bp, Rattus norvegicus
acagatacagactcttaaccagggt

SEQ ID NO: 75013 - DNA, 25 bp, Rattus norvegicus
acagatacagtgactacgctgctgc

SEQ ID NO: 75014 - DNA, 25 bp, Rattus norvegicus
acagatacagtgtctacgctgctgc

SEQ ID NO: 75015 - DNA, 25 bp, Rattus norvegicus
acagatacctgtcattgtgttattt

SEQ ID NO: 75016 - DNA, 25 bp, Rattus norvegicus
acagatacctgtgattgtgttattt

SEQ ID NO: 75017 - DNA, 25 bp, Rattus norvegicus
acagatacgtgcatggatccttctc

SEQ ID NO: 75018 - DNA, 25 bp, Rattus norvegicus
acagatacgtgcttggatccttctc

SEQ ID NO: 75019 - DNA, 25 bp, Rattus norvegicus
acagatagaccgcacattgattaga

SEQ ID NO: 75020 - DNA, 25 bp, Rattus norvegicus
acagatagaccggacattgattaga

SEQ ID NO: 75021 - DNA, 25 bp, Rattus norvegicus
acagatagcaaaccggctgccactg

SEQ ID NO: 75022 - DNA, 25 bp, Rattus norvegicus
acagatagcaaagcggctgccactg

SEQ ID NO: 75023 - DNA, 25 bp, Rattus norvegicus
acagatagggtgacgccctgtgaga

SEQ ID NO: 75024 - DNA, 25 bp, Rattus norvegicus
acagatagggtgtcgccctgtgaga

SEQ ID NO: 75025 - DNA, 25 bp, Rattus norvegicus
acagataggtgacgcgtctggctct

SEQ ID NO: 75026 - DNA, 25 bp, Rattus norvegicus
acagataggtgaggcgtctggctct

SEQ ID NO: 75027 - DNA, 25 bp, Rattus norvegicus
acagatagtctaccgatcccatagt

SEQ ID NO: 75028 - DNA, 25 bp, Rattus norvegicus
acagatagtctagcgatcccatagt

SEQ ID NO: 75029 - DNA, 25 bp, Rattus norvegicus
acagatatccccaaagtgcctaata

SEQ ID NO: 75030 - DNA, 25 bp, Rattus norvegicus
acagatatcccctaagtgcctaata

SEQ ID NO: 75031 - DNA, 25 bp, Rattus norvegicus
acagatatgtgacggcctgtttctt

SEQ ID NO: 75032 - DNA, 25 bp, Rattus norvegicus
acagatatgtgagggcctgtttctt

SEQ ID NO: 75033 - DNA, 25 bp, Rattus norvegicus
acagatatgtggaccccgagagcaa

SEQ ID NO: 75034 - DNA, 25 bp, Rattus norvegicus
acagatatgtggtccccgagagcaa

SEQ ID NO: 75035 - DNA, 25 bp, Rattus norvegicus
acagatcaacatccgtgtccaggaa

SEQ ID NO: 75036 - DNA, 25 bp, Rattus norvegicus
acagatcaacatgcgtgtccaggaa

SEQ ID NO: 75037 - DNA, 25 bp, Rattus norvegicus
acagatcaagttctaggacaaccag

SEQ ID NO: 75038 - DNA, 25 bp, Rattus norvegicus
acagatcaagttgtaggacaaccag

SEQ ID NO: 75039 - DNA, 25 bp, Rattus norvegicus
acagatcagttcctataggtgtcac

SEQ ID NO: 75040 - DNA, 25 bp, Rattus norvegicus
acagatcagttcgtataggtgtcac

SEQ ID NO: 75041 - DNA, 25 bp, Rattus norvegicus
acagatcatcctccattcgtctctt

SEQ ID NO: 75042 - DNA, 25 bp, Rattus norvegicus
acagatcatcctgcattcgtctctt

SEQ ID NO: 75043 - DNA, 25 bp, Rattus norvegicus
acagatccagtgcagtcagcttgaa

SEQ ID NO: 75044 - DNA, 25 bp, Rattus norvegicus
acagatccagtggagtcagcttgaa

SEQ ID NO: 75045 - DNA, 25 bp, Rattus norvegicus
acagatcccaggactgctgtgactg

SEQ ID NO: 75046 - DNA, 25 bp, Rattus norvegicus
acagatcccaggtctgctgtgactg

SEQ ID NO: 75047 - DNA, 25 bp, Rattus norvegicus
acagatcccgctccagtaggttgac

SEQ ID NO: 75048 - DNA, 25 bp, Rattus norvegicus
acagatcccgctgcagtaggttgac

SEQ ID NO: 75049 - DNA, 25 bp, Rattus norvegicus
acagatcctccgcaaccagaattac

SEQ ID NO: 75050 - DNA, 25 bp, Rattus norvegicus
acagatcctccggaaccagaattac

SEQ ID NO: 75051 - DNA, 25 bp, Rattus norvegicus
acagatccttccaggaggctctcat

SEQ ID NO: 75052 - DNA, 25 bp, Rattus norvegicus
acagatccttcctggaggctctcat

SEQ ID NO: 75053 - DNA, 25 bp, Rattus norvegicus
acagatccttctaggcctgcgatat

SEQ ID NO: 75054 - DNA, 25 bp, Rattus norvegicus
acagatccttcttggcctgcgatat

SEQ ID NO: 75055 - DNA, 25 bp, Rattus norvegicus
acagatcgccgaaagcagcaagcat

SEQ ID NO: 75056 - DNA, 25 bp, Rattus norvegicus
acagatcgccgatagcagcaagcat

SEQ ID NO: 75057 - DNA, 25 bp, Rattus norvegicus
acagatcgctgtagtgccttggacc

SEQ ID NO: 75058 - DNA, 25 bp, Rattus norvegicus
acagatcgctgttgtgccttggacc

SEQ ID NO: 75059 - DNA, 25 bp, Rattus norvegicus
acagatctatctccatacagcctgc

SEQ ID NO: 75060 - DNA, 25 bp, Rattus norvegicus
acagatctatctgcatacagcctgc

SEQ ID NO: 75061 - DNA, 25 bp, Rattus norvegicus
acagatctattgagaccctgaccct

SEQ ID NO: 75062 - DNA, 25 bp, Rattus norvegicus
acagatctattgtgaccctgaccct

SEQ ID NO: 75063 - DNA, 25 bp, Rattus norvegicus
acagatctcctaacgcttgggcaga

SEQ ID NO: 75064 - DNA, 25 bp, Rattus norvegicus
acagatctcctatcgcttgggcaga

SEQ ID NO: 75065 - DNA, 25 bp, Rattus norvegicus
acagatctcttaagtcatccaggcc

SEQ ID NO: 75066 - DNA, 25 bp, Rattus norvegicus
acagatctcttatgtcatccaggcc

SEQ ID NO: 75067 - DNA, 25 bp, Rattus norvegicus
acagatctgatgctgaaggacctat

SEQ ID NO: 75068 - DNA, 25 bp, Rattus norvegicus
acagatctgatggtgaaggacctat

SEQ ID NO: 75069 - DNA, 25 bp, Rattus norvegicus
acagatctgcaactcgtttcctttg

SEQ ID NO: 75070 - DNA, 25 bp, Rattus norvegicus
acagatctgcaagtcgtttcctttg

SEQ ID NO: 75071 - DNA, 25 bp, Rattus norvegicus
acagatctgccgctgtaccctggag

SEQ ID NO: 75072 - DNA, 25 bp, Rattus norvegicus
acagatctgccggtgtaccctggag

SEQ ID NO: 75073 - DNA, 25 bp, Rattus norvegicus
acagatctgggcatcaatggtcaga

SEQ ID NO: 75074 - DNA, 25 bp, Rattus norvegicus
acagatctgggcttcaatggtcaga

SEQ ID NO: 75075 - DNA, 25 bp, Rattus norvegicus
acagatcttcatcagccggtaccag

SEQ ID NO: 75076 - DNA, 25 bp, Rattus norvegicus
acagatcttcatctgtgtctgccac

SEQ ID NO: 75077 - DNA, 25 bp, Rattus norvegicus
acagatcttcatgagccggtaccag

SEQ ID NO: 75078 - DNA, 25 bp, Rattus norvegicus
acagatcttcatgtgtgtctgccac

SEQ ID NO: 75079 - DNA, 25 bp, Rattus norvegicus
acagatctttctagttcgatgtcat

SEQ ID NO: 75080 - DNA, 25 bp, Rattus norvegicus
acagatctttcttgttcgatgtcat

SEQ ID NO: 75081 - DNA, 25 bp, Rattus norvegicus
acagatgaacttccgacacagccaa

SEQ ID NO: 75082 - DNA, 25 bp, Rattus norvegicus
acagatgaacttgcgacacagccaa

SEQ ID NO: 75083 - DNA, 25 bp, Rattus norvegicus
acagatgaagcacaaggtccaaagc

SEQ ID NO: 75084 - DNA, 25 bp, Rattus norvegicus
acagatgaagcagaaggtccaaagc

SEQ ID NO: 75085 - DNA, 25 bp, Rattus norvegicus
acagatgaagctcacctggtccttg

SEQ ID NO: 75086 - DNA, 25 bp, Rattus norvegicus
acagatgaagctgacctggtccttg

SEQ ID NO: 75087 - DNA, 25 bp, Rattus norvegicus
acagatgacctgatgtagtgtaatg

SEQ ID NO: 75088 - DNA, 25 bp, Rattus norvegicus
acagatgacctgttgtagtgtaatg

SEQ ID NO: 75089 - DNA, 25 bp, Rattus norvegicus
acagatgactatcgcctggacaact

SEQ ID NO: 75090 - DNA, 25 bp, Rattus norvegicus
acagatgactatggcctggacaact

SEQ ID NO: 75091 - DNA, 25 bp, Rattus norvegicus
acagatgagaggaaccccaggccac

SEQ ID NO: 75092 - DNA, 25 bp, Rattus norvegicus
acagatgagaggtaccccaggccac

SEQ ID NO: 75093 - DNA, 25 bp, Rattus norvegicus
acagatgagcccctgaagacgaggt

SEQ ID NO: 75094 - DNA, 25 bp, Rattus norvegicus
acagatgagcccgtgaagacgaggt

SEQ ID NO: 75095 - DNA, 25 bp, Rattus norvegicus
acagatgaggctccggcgcctcaat

SEQ ID NO: 75096 - DNA, 25 bp, Rattus norvegicus
acagatgaggctgcggcgcctcaat

SEQ ID NO: 75097 - DNA, 25 bp, Rattus norvegicus
acagatgcacttctagccctggtgt

SEQ ID NO: 75098 - DNA, 25 bp, Rattus norvegicus
acagatgcacttgtagccctggtgt

SEQ ID NO: 75099 - DNA, 25 bp, Rattus norvegicus
acagatgcagtaaagtgcccactac

SEQ ID NO: 75100 - DNA, 25 bp, Rattus norvegicus
acagatgcagtatagtgcccactac

SEQ ID NO: 75101 - DNA, 25 bp, Rattus norvegicus
acagatgccattcaccagtcacggt

SEQ ID NO: 75102 - DNA, 25 bp, Rattus norvegicus
acagatgccattgaccagtcacggt

SEQ ID NO: 75103 - DNA, 25 bp, Rattus norvegicus
acagatgcccttcggtgattttcac

SEQ ID NO: 75104 - DNA, 25 bp, Rattus norvegicus
acagatgcccttgggtgattttcac

SEQ ID NO: 75105 - DNA, 25 bp, Rattus norvegicus
acagatgcgtggacttctggccaag

SEQ ID NO: 75106 - DNA, 25 bp, Rattus norvegicus
acagatgcgtggtcttctggccaag

SEQ ID NO: 75107 - DNA, 25 bp, Rattus norvegicus
acagatgctagtccacgaatgttga

SEQ ID NO: 75108 - DNA, 25 bp, Rattus norvegicus
acagatgctagtgcacgaatgttga

SEQ ID NO: 75109 - DNA, 25 bp, Rattus norvegicus
acagatgctcctcgagttctggcac

SEQ ID NO: 75110 - DNA, 25 bp, Rattus norvegicus
acagatgctcctggagttctggcac

SEQ ID NO: 75111 - DNA, 25 bp, Rattus norvegicus
acagatgctcttcgttctgtttccc

SEQ ID NO: 75112 - DNA, 25 bp, Rattus norvegicus
acagatgctcttggttctgtttccc

SEQ ID NO: 75113 - DNA, 25 bp, Rattus norvegicus
acagatggacccactatgtcaaagg

SEQ ID NO: 75114 - DNA, 25 bp, Rattus norvegicus
acagatggaccctctatgtcaaagg

SEQ ID NO: 75115 - DNA, 25 bp, Rattus norvegicus
acagatggagcactagcccgaggcc

SEQ ID NO: 75116 - DNA, 25 bp, Rattus norvegicus
acagatggagcagtagcccgaggcc

SEQ ID NO: 75117 - DNA, 25 bp, Rattus norvegicus
acagatggagtaacttcttcagaaa

SEQ ID NO: 75118 - DNA, 25 bp, Rattus norvegicus
acagatggagtatcttcttcagaaa

SEQ ID NO: 75119 - DNA, 25 bp, Rattus norvegicus
acagatggatccagctcctgcgctg

SEQ ID NO: 75120 - DNA, 25 bp, Rattus norvegicus
acagatggatcctgctcctgcgctg

SEQ ID NO: 75121 - DNA, 25 bp, Rattus norvegicus
acagatggcggtctgtttgcctaac

SEQ ID NO: 75122 - DNA, 25 bp, Rattus norvegicus
acagatggcggtgtgtttgcctaac

SEQ ID NO: 75123 - DNA, 25 bp, Rattus norvegicus
acagatggtctcaatccagagtccc

SEQ ID NO: 75124 - DNA, 25 bp, Rattus norvegicus
acagatggtctctatccagagtccc

SEQ ID NO: 75125 - DNA, 25 bp, Rattus norvegicus
acagatggttgtcctctggcagcct

SEQ ID NO: 75126 - DNA, 25 bp, Rattus norvegicus
acagatggttgtgctctggcagcct

SEQ ID NO: 75127 - DNA, 25 bp, Rattus norvegicus
acagatgtacggcagtcctcagaac

SEQ ID NO: 75128 - DNA, 25 bp, Rattus norvegicus
acagatgtacgggagtcctcagaac

SEQ ID NO: 75129 - DNA, 25 bp, Rattus norvegicus
acagatgtcattagtgtcctggcca

SEQ ID NO: 75130 - DNA, 25 bp, Rattus norvegicus
acagatgtcatttgtgtcctggcca

SEQ ID NO: 75131 - DNA, 25 bp, Rattus norvegicus
acagatgtccacaactgtgttccag

SEQ ID NO: 75132 - DNA, 25 bp, Rattus norvegicus
acagatgtccacctgcttctgacgt

SEQ ID NO: 75133 - DNA, 25 bp, Rattus norvegicus
acagatgtccacgtgcttctgacgt

SEQ ID NO: 75134 - DNA, 25 bp, Rattus norvegicus
acagatgtccactactgtgttccag

SEQ ID NO: 75135 - DNA, 25 bp, Rattus norvegicus
acagatgtcgttatgttgtcacagc

SEQ ID NO: 75136 - DNA, 25 bp, Rattus norvegicus
acagatgtcgttttgttgtcacagc

SEQ ID NO: 75137 - DNA, 25 bp, Rattus norvegicus
acagatgtctcacgtgtgtgtggaa

SEQ ID NO: 75138 - DNA, 25 bp, Rattus norvegicus
acagatgtctcaggtgtgtgtggaa

SEQ ID NO: 75139 - DNA, 25 bp, Rattus norvegicus
acagatgtgactatgttgttacctc

SEQ ID NO: 75140 - DNA, 25 bp, Rattus norvegicus
acagatgtgactttgttgttacctc

SEQ ID NO: 75141 - DNA, 25 bp, Rattus norvegicus
acagatgtgagaacgctggcaaaca

SEQ ID NO: 75142 - DNA, 25 bp, Rattus norvegicus
acagatgtgagatcgctggcaaaca

SEQ ID NO: 75143 - DNA, 25 bp, Rattus norvegicus
acagatgtgagccattttacccagc

SEQ ID NO: 75144 - DNA, 25 bp, Rattus norvegicus
acagatgtgagcgattttacccagc

SEQ ID NO: 75145 - DNA, 25 bp, Rattus norvegicus
acagatgtgagtctgcacctgagga

SEQ ID NO: 75146 - DNA, 25 bp, Rattus norvegicus
acagatgtgagtgtgcacctgagga

SEQ ID NO: 75147 - DNA, 25 bp, Rattus norvegicus
acagatgtgatgagcaaccccttct

SEQ ID NO: 75148 - DNA, 25 bp, Rattus norvegicus
acagatgtgatgtgcaaccccttct

SEQ ID NO: 75149 - DNA, 25 bp, Rattus norvegicus
acagatgtgcgcaacggtgcttggc

SEQ ID NO: 75150 - DNA, 25 bp, Rattus norvegicus
acagatgtgcgctacggtgcttggc

SEQ ID NO: 75151 - DNA, 25 bp, Rattus norvegicus
acagatgtggagacccaggtactaa

SEQ ID NO: 75152 - DNA, 25 bp, Rattus norvegicus
acagatgtggagtcccaggtactaa

SEQ ID NO: 75153 - DNA, 25 bp, Rattus norvegicus
acagatgtggttcctgatgtcccca

SEQ ID NO: 75154 - DNA, 25 bp, Rattus norvegicus
acagatgtggttgctgatgtcccca

SEQ ID NO: 75155 - DNA, 25 bp, Rattus norvegicus
acagatgtgtgactggccccggccc

SEQ ID NO: 75156 - DNA, 25 bp, Rattus norvegicus
acagatgtgtgagtggccccggccc

SEQ ID NO: 75157 - DNA, 25 bp, Rattus norvegicus
acagatgtttgcacttggctcagta

SEQ ID NO: 75158 - DNA, 25 bp, Rattus norvegicus
acagatgtttgctcttggctcagta

SEQ ID NO: 75159 - DNA, 25 bp, Rattus norvegicus
acagatgtttgtcaactacccttta

SEQ ID NO: 75160 - DNA, 25 bp, Rattus norvegicus
acagatgtttgtgaactacccttta

SEQ ID NO: 75161 - DNA, 25 bp, Rattus norvegicus
acagattatccacttgctcccagtt

SEQ ID NO: 75162 - DNA, 25 bp, Rattus norvegicus
acagattatccagttgctcccagtt

SEQ ID NO: 75163 - DNA, 25 bp, Rattus norvegicus
acagattcacagcattgttatccag

SEQ ID NO: 75164 - DNA, 25 bp, Rattus norvegicus
acagattcacaggattgttatccag

SEQ ID NO: 75165 - DNA, 25 bp, Rattus norvegicus
acagattcaggaatgggcctggcat

SEQ ID NO: 75166 - DNA, 25 bp, Rattus norvegicus
acagattcaggattgggcctggcat

SEQ ID NO: 75167 - DNA, 25 bp, Rattus norvegicus
acagattcaggtagaggtgcatgcc

SEQ ID NO: 75168 - DNA, 25 bp, Rattus norvegicus
acagattcaggttgaggtgcatgcc

SEQ ID NO: 75169 - DNA, 25 bp, Rattus norvegicus
acagattcatgtagcagttccccaa

SEQ ID NO: 75170 - DNA, 25 bp, Rattus norvegicus
acagattcatgttgcagttccccaa

SEQ ID NO: 75171 - DNA, 25 bp, Rattus norvegicus
acagattcctctcgatgctgtcact

SEQ ID NO: 75172 - DNA, 25 bp, Rattus norvegicus
acagattcctctggatgctgtcact

SEQ ID NO: 75173 - DNA, 25 bp, Rattus norvegicus
acagattcgatgattgggccaggac

SEQ ID NO: 75174 - DNA, 25 bp, Rattus norvegicus
acagattcgatgtttgggccaggac

SEQ ID NO: 75175 - DNA, 25 bp, Rattus norvegicus
acagattcgtgtccgttgcttgttc

SEQ ID NO: 75176 - DNA, 25 bp, Rattus norvegicus
acagattcgtgtgcgttgcttgttc

SEQ ID NO: 75177 - DNA, 25 bp, Rattus norvegicus
acagattctgcacccgaagacaaca

SEQ ID NO: 75178 - DNA, 25 bp, Rattus norvegicus
acagattctgcagccgaagacaaca

SEQ ID NO: 75179 - DNA, 25 bp, Rattus norvegicus
acagattgaccccaggaagaaagca

SEQ ID NO: 75180 - DNA, 25 bp, Rattus norvegicus
acagattgacccgaggaagaaagca

SEQ ID NO: 75181 - DNA, 25 bp, Rattus norvegicus
acagattgtcttctttaccccaggg

SEQ ID NO: 75182 - DNA, 25 bp, Rattus norvegicus
acagattgtcttgtttaccccaggg

SEQ ID NO: 75183 - DNA, 25 bp, Rattus norvegicus
acagattgtgaaaggttgatttctc

SEQ ID NO: 75184 - DNA, 25 bp, Rattus norvegicus
acagattgtgaatggttgatttctc

SEQ ID NO: 75185 - DNA, 25 bp, Rattus norvegicus
acagattgtggtccagaggcttact

SEQ ID NO: 75186 - DNA, 25 bp, Rattus norvegicus
acagattgtggtgcagaggcttact

SEQ ID NO: 75187 - DNA, 25 bp, Rattus norvegicus
acagattgtgttagcacctgacaaa

SEQ ID NO: 75188 - DNA, 25 bp, Rattus norvegicus
acagattgtgtttgcacctgacaaa

SEQ ID NO: 75189 - DNA, 25 bp, Rattus norvegicus
acagatttaattctcccacttggcg

SEQ ID NO: 75190 - DNA, 25 bp, Rattus norvegicus
acagatttaattgtcccacttggcg

SEQ ID NO: 75191 - DNA, 25 bp, Rattus norvegicus
acagatttactgcatttatggacct

SEQ ID NO: 75192 - DNA, 25 bp, Rattus norvegicus
acagatttactggatttatggacct

SEQ ID NO: 75193 - DNA, 25 bp, Rattus norvegicus
acagatttcaatcactaggttggga

SEQ ID NO: 75194 - DNA, 25 bp, Rattus norvegicus
acagatttcaatgactaggttggga

SEQ ID NO: 75195 - DNA, 25 bp, Rattus norvegicus
acagatttctgtagcctctaagtct

SEQ ID NO: 75196 - DNA, 25 bp, Rattus norvegicus
acagatttctgttgcctctaagtct

SEQ ID NO: 75197 - DNA, 25 bp, Rattus norvegicus
acagatttcttaacagtttcaaatg

SEQ ID NO: 75198 - DNA, 25 bp, Rattus norvegicus
acagatttcttatcagtttcaaatg

SEQ ID NO: 75199 - DNA, 25 bp, Rattus norvegicus
acagatttgtgaactcagccaagca

SEQ ID NO: 75200 - DNA, 25 bp, Rattus norvegicus
acagatttgtgatctcagccaagca

SEQ ID NO: 75201 - DNA, 25 bp, Rattus norvegicus
acagatttgtggctttctttacatg

SEQ ID NO: 75202 - DNA, 25 bp, Rattus norvegicus
acagatttgtgggtttctttacatg

SEQ ID NO: 75203 - DNA, 25 bp, Rattus norvegicus
acagattttcacagcggtagacgca

SEQ ID NO: 75204 - DNA, 25 bp, Rattus norvegicus
acagattttcactgcggtagacgca

SEQ ID NO: 75205 - DNA, 25 bp, Rattus norvegicus
acagattttcctctgagcttctcac

SEQ ID NO: 75206 - DNA, 25 bp, Rattus norvegicus
acagattttcctgtgagcttctcac

SEQ ID NO: 75207 - DNA, 25 bp, Rattus norvegicus
acagcaaaacagagctacccaccaa

SEQ ID NO: 75208 - DNA, 25 bp, Rattus norvegicus
acagcaaaacagtgctacccaccaa

SEQ ID NO: 75209 - DNA, 25 bp, Rattus norvegicus
acagcaaacaggcaagcgcatctga

SEQ ID NO: 75210 - DNA, 25 bp, Rattus norvegicus
acagcaaacagggaagcgcatctga

SEQ ID NO: 75211 - DNA, 25 bp, Rattus norvegicus
acagcaaaccctcccattggatggt

SEQ ID NO: 75212 - DNA, 25 bp, Rattus norvegicus
acagcaaaccctgccattggatggt

SEQ ID NO: 75213 - DNA, 25 bp, Rattus norvegicus
acagcaaagagaccgcggcagcaca

SEQ ID NO: 75214 - DNA, 25 bp, Rattus norvegicus
acagcaaagagagcgcggcagcaca

SEQ ID NO: 75215 - DNA, 25 bp, Rattus norvegicus
acagcaaagagtctgccttcctgac

SEQ ID NO: 75216 - DNA, 25 bp, Rattus norvegicus
acagcaaagagtgtgccttcctgac

SEQ ID NO: 75217 - DNA, 25 bp, Rattus norvegicus
acagcaaagcagacatcaacagttt

SEQ ID NO: 75218 - DNA, 25 bp, Rattus norvegicus
acagcaaagcagtcatcaacagttt

SEQ ID NO: 75219 - DNA, 25 bp, Rattus norvegicus
acagcaacagcaacaccagcaatca

SEQ ID NO: 75220 - DNA, 25 bp, Rattus norvegicus
acagcaacagcatcaccagcaatca

SEQ ID NO: 75221 - DNA, 25 bp, Rattus norvegicus
acagcaacagctctgcgggctggaa

SEQ ID NO: 75222 - DNA, 25 bp, Rattus norvegicus
acagcaacagctgtgcgggctggaa

SEQ ID NO: 75223 - DNA, 25 bp, Rattus norvegicus
acagcaacaggaacgcaggcaagat

SEQ ID NO: 75224 - DNA, 25 bp, Rattus norvegicus
acagcaacaggatcgcaggcaagat

SEQ ID NO: 75225 - DNA, 25 bp, Rattus norvegicus
acagcaacagtgacaccaccatggt

SEQ ID NO: 75226 - DNA, 25 bp, Rattus norvegicus
acagcaacagtgtcaccaccatggt

SEQ ID NO: 75227 - DNA, 25 bp, Rattus norvegicus
acagcaacccatactttttggaggt

SEQ ID NO: 75228 - DNA, 25 bp, Rattus norvegicus
acagcaacccattctttttggaggt

SEQ ID NO: 75229 - DNA, 25 bp, Rattus norvegicus
acagcaacctgtatctacttggcgg

SEQ ID NO: 75230 - DNA, 25 bp, Rattus norvegicus
acagcaacctgtttctacttggcgg

SEQ ID NO: 75231 - DNA, 25 bp, Rattus norvegicus
acagcaacgtctagaacaggcgctg

SEQ ID NO: 75232 - DNA, 25 bp, Rattus norvegicus
acagcaacgtcttgaacaggcgctg

SEQ ID NO: 75233 - DNA, 25 bp, Rattus norvegicus
acagcaactggcactactttgaccg

SEQ ID NO: 75234 - DNA, 25 bp, Rattus norvegicus
acagcaactggctctactttgaccg

SEQ ID NO: 75235 - DNA, 25 bp, Rattus norvegicus
acagcaactttgaactggagtacca

SEQ ID NO: 75236 - DNA, 25 bp, Rattus norvegicus
acagcaactttgtactggagtacca

SEQ ID NO: 75237 - DNA, 25 bp, Rattus norvegicus
acagcaagaaagactccgggttatt

SEQ ID NO: 75238 - DNA, 25 bp, Rattus norvegicus
acagcaagaaagtctccgggttatt

SEQ ID NO: 75239 - DNA, 25 bp, Rattus norvegicus
acagcaagaggacctggcacttggt

SEQ ID NO: 75240 - DNA, 25 bp, Rattus norvegicus
acagcaagaggagctggcacttggt

SEQ ID NO: 75241 - DNA, 25 bp, Rattus norvegicus
acagcaagatgccaagtcagtcatg

SEQ ID NO: 75242 - DNA, 25 bp, Rattus norvegicus
acagcaagatgcgaagtcagtcatg

SEQ ID NO: 75243 - DNA, 25 bp, Rattus norvegicus
acagcaagcgccagagcagtgtgac

SEQ ID NO: 75244 - DNA, 25 bp, Rattus norvegicus
acagcaagcgcctgagcagtgtgac

SEQ ID NO: 75245 - DNA, 25 bp, Rattus norvegicus
acagcaaggcacactgatggtcacc

SEQ ID NO: 75246 - DNA, 25 bp, Rattus norvegicus
acagcaaggcactctgatggtcacc

SEQ ID NO: 75247 - DNA, 25 bp, Rattus norvegicus
acagcaagtccccattcatgagaaa

SEQ ID NO: 75248 - DNA, 25 bp, Rattus norvegicus
acagcaagtcccgattcatgagaaa

SEQ ID NO: 75249 - DNA, 25 bp, Rattus norvegicus
acagcaagtctcacacaatcggtgg

SEQ ID NO: 75250 - DNA, 25 bp, Rattus norvegicus
acagcaagtctctcacaatcggtgg

SEQ ID NO: 75251 - DNA, 25 bp, Rattus norvegicus
acagcaagtggccttatgtcttttg

SEQ ID NO: 75252 - DNA, 25 bp, Rattus norvegicus
acagcaagtggcgttatgtcttttg

SEQ ID NO: 75253 - DNA, 25 bp, Rattus norvegicus
acagcaagtgggatacctggtacat

SEQ ID NO: 75254 - DNA, 25 bp, Rattus norvegicus
acagcaagtgggttacctggtacat

SEQ ID NO: 75255 - DNA, 25 bp, Rattus norvegicus
acagcaagttcacactggcccgatg

SEQ ID NO: 75256 - DNA, 25 bp, Rattus norvegicus
acagcaagttcagactggcccgatg

SEQ ID NO: 75257 - DNA, 25 bp, Rattus norvegicus
acagcaagttttctagcccacaagt

SEQ ID NO: 75258 - DNA, 25 bp, Rattus norvegicus
acagcaagttttgtagcccacaagt

SEQ ID NO: 75259 - DNA, 25 bp, Rattus norvegicus
acagcaataagaacttcctctctcc

SEQ ID NO: 75260 - DNA, 25 bp, Rattus norvegicus
acagcaataagatcttcctctctcc

SEQ ID NO: 75261 - DNA, 25 bp, Rattus norvegicus
acagcaatcttaacgcgatgttttt

SEQ ID NO: 75262 - DNA, 25 bp, Rattus norvegicus
acagcaatcttatcgcgatgttttt

SEQ ID NO: 75263 - DNA, 25 bp, Rattus norvegicus
acagcaatcttcaataccctcatga

SEQ ID NO: 75264 - DNA, 25 bp, Rattus norvegicus
acagcaatcttctataccctcatga

SEQ ID NO: 75265 - DNA, 25 bp, Rattus norvegicus
acagcaatctttccctactttgaaa

SEQ ID NO: 75266 - DNA, 25 bp, Rattus norvegicus
acagcaatctttgcctactttgaaa

SEQ ID NO: 75267 - DNA, 25 bp, Rattus norvegicus
acagcaatgagacctctgccagttc

SEQ ID NO: 75268 - DNA, 25 bp, Rattus norvegicus
acagcaatgagagctctgccagttc

SEQ ID NO: 75269 - DNA, 25 bp, Rattus norvegicus
acagcaatgggcaccttgacagctt

SEQ ID NO: 75270 - DNA, 25 bp, Rattus norvegicus
acagcaatgggctccttgacagctt

SEQ ID NO: 75271 - DNA, 25 bp, Rattus norvegicus
acagcaattttgatattggcttgca

SEQ ID NO: 75272 - DNA, 25 bp, Rattus norvegicus
acagcaattttgttattggcttgca

SEQ ID NO: 75273 - DNA, 25 bp, Rattus norvegicus
acagcacaagctaagggcttccatt

SEQ ID NO: 75274 - DNA, 25 bp, Rattus norvegicus
acagcacaagcttagggcttccatt

SEQ ID NO: 75275 - DNA, 25 bp, Rattus norvegicus
acagcacaatgtagcctaaggcacg

SEQ ID NO: 75276 - DNA, 25 bp, Rattus norvegicus
acagcacaatgttgcctaaggcacg

SEQ ID NO: 75277 - DNA, 25 bp, Rattus norvegicus
acagcacaccatatgcactctgata

SEQ ID NO: 75278 - DNA, 25 bp, Rattus norvegicus
acagcacaccatttgcactctgata

SEQ ID NO: 75279 - DNA, 25 bp, Rattus norvegicus
acagcacactgtatgtctctaaagc

SEQ ID NO: 75280 - DNA, 25 bp, Rattus norvegicus
acagcacactgtttgtctctaaagc

SEQ ID NO: 75281 - DNA, 25 bp, Rattus norvegicus
acagcacagaagagcgcatcgacct

SEQ ID NO: 75282 - DNA, 25 bp, Rattus norvegicus
acagcacagaagtgcgcatcgacct

SEQ ID NO: 75283 - DNA, 25 bp, Rattus norvegicus
acagcacagagcaaacagagtccct

SEQ ID NO: 75284 - DNA, 25 bp, Rattus norvegicus
acagcacagagctaacagagtccct

SEQ ID NO: 75285 - DNA, 25 bp, Rattus norvegicus
acagcacagcaaccttcacagtgaa

SEQ ID NO: 75286 - DNA, 25 bp, Rattus norvegicus
acagcacagcaagcttcacagtgaa

SEQ ID NO: 75287 - DNA, 25 bp, Rattus norvegicus
acagcacagcgaaatcattccgatg

SEQ ID NO: 75288 - DNA, 25 bp, Rattus norvegicus
acagcacagcgatatcattccgatg

SEQ ID NO: 75289 - DNA, 25 bp, Rattus norvegicus
acagcacagcttatcacgggctctg

SEQ ID NO: 75290 - DNA, 25 bp, Rattus norvegicus
acagcacagcttttcacgggctctg

SEQ ID NO: 75291 - DNA, 25 bp, Rattus norvegicus
acagcacagtgtcctgcacaagttc

SEQ ID NO: 75292 - DNA, 25 bp, Rattus norvegicus
acagcacagtgtgctgcacaagttc

SEQ ID NO: 75293 - DNA, 25 bp, Rattus norvegicus
acagcacatgtaactgtgtctttga

SEQ ID NO: 75294 - DNA, 25 bp, Rattus norvegicus
acagcacatgtatctgtgtctttga

SEQ ID NO: 75295 - DNA, 25 bp, Rattus norvegicus
acagcacattgcatgagacactcct

SEQ ID NO: 75296 - DNA, 25 bp, Rattus norvegicus
acagcacattgcttgagacactcct

SEQ ID NO: 75297 - DNA, 25 bp, Rattus norvegicus
acagcaccaccaactagaggcagtt

SEQ ID NO: 75298 - DNA, 25 bp, Rattus norvegicus
acagcaccaccatctagaggcagtt

SEQ ID NO: 75299 - DNA, 25 bp, Rattus norvegicus
acagcaccaggtccatttacgaggc

SEQ ID NO: 75300 - DNA, 25 bp, Rattus norvegicus
acagcaccaggtgcatttacgaggc

SEQ ID NO: 75301 - DNA, 25 bp, Rattus norvegicus
acagcacctctgatttctaattaca

SEQ ID NO: 75302 - DNA, 25 bp, Rattus norvegicus
acagcacctctgttttctaattaca

SEQ ID NO: 75303 - DNA, 25 bp, Rattus norvegicus
acagcacctgtcagcagcgtttgct

SEQ ID NO: 75304 - DNA, 25 bp, Rattus norvegicus
acagcacctgtctgcagcgtttgct

SEQ ID NO: 75305 - DNA, 25 bp, Rattus norvegicus
acagcaccttgtagtgtccgggatg

SEQ ID NO: 75306 - DNA, 25 bp, Rattus norvegicus
acagcaccttgttgtgtccgggatg

SEQ ID NO: 75307 - DNA, 25 bp, Rattus norvegicus
acagcaccttttctgggtatgcgtg

SEQ ID NO: 75308 - DNA, 25 bp, Rattus norvegicus
acagcaccttttgtgggtatgcgtg

SEQ ID NO: 75309 - DNA, 25 bp, Rattus norvegicus
acagcacgaaggcagcaagtcccta

SEQ ID NO: 75310 - DNA, 25 bp, Rattus norvegicus
acagcacgaagggagcaagtcccta

SEQ ID NO: 75311 - DNA, 25 bp, Rattus norvegicus
acagcacggataactgcatactcat

SEQ ID NO: 75312 - DNA, 25 bp, Rattus norvegicus
acagcacggatatctgcatactcat

SEQ ID NO: 75313 - DNA, 25 bp, Rattus norvegicus
acagcacggctcatgatgaaatcat

SEQ ID NO: 75314 - DNA, 25 bp, Rattus norvegicus
acagcacggctcttgatgaaatcat

SEQ ID NO: 75315 - DNA, 25 bp, Rattus norvegicus
acagcacgggtcctgggtcttacaa

SEQ ID NO: 75316 - DNA, 25 bp, Rattus norvegicus
acagcacgggtcgtgggtcttacaa

SEQ ID NO: 75317 - DNA, 25 bp, Rattus norvegicus
acagcactcctcctgtgttggcaaa

SEQ ID NO: 75318 - DNA, 25 bp, Rattus norvegicus
acagcactcctcgtgtgttggcaaa

SEQ ID NO: 75319 - DNA, 25 bp, Rattus norvegicus
acagcactgagtaaggttctgcctg

SEQ ID NO: 75320 - DNA, 25 bp, Rattus norvegicus
acagcactgagttaggttctgcctg

SEQ ID NO: 75321 - DNA, 25 bp, Rattus norvegicus
acagcactgattaggaccctgactc

SEQ ID NO: 75322 - DNA, 25 bp, Rattus norvegicus
acagcactgatttggaccctgactc

SEQ ID NO: 75323 - DNA, 25 bp, Rattus norvegicus
acagcactggccatcaggcagggag

SEQ ID NO: 75324 - DNA, 25 bp, Rattus norvegicus
acagcactggccttcaggcagggag

SEQ ID NO: 75325 - DNA, 25 bp, Rattus norvegicus
acagcactgggtacccaggcagggt

SEQ ID NO: 75326 - DNA, 25 bp, Rattus norvegicus
acagcactgggttcccaggcagggt

SEQ ID NO: 75327 - DNA, 25 bp, Rattus norvegicus
acagcactggtgcagattctgggcc

SEQ ID NO: 75328 - DNA, 25 bp, Rattus norvegicus
acagcactggtgctctactatacac

SEQ ID NO: 75329 - DNA, 25 bp, Rattus norvegicus
acagcactggtggagattctgggcc

SEQ ID NO: 75330 - DNA, 25 bp, Rattus norvegicus
acagcactggtggtctactatacac

SEQ ID NO: 75331 - DNA, 25 bp, Rattus norvegicus
acagcactgtgtacatcatggccat

SEQ ID NO: 75332 - DNA, 25 bp, Rattus norvegicus
acagcactgtgttcatcatggccat

SEQ ID NO: 75333 - DNA, 25 bp, Rattus norvegicus
acagcactgttgaagcttctggcag

SEQ ID NO: 75334 - DNA, 25 bp, Rattus norvegicus
acagcactgttgtagcttctggcag

SEQ ID NO: 75335 - DNA, 25 bp, Rattus norvegicus
acagcacttctgagtgtcagatcct

SEQ ID NO: 75336 - DNA, 25 bp, Rattus norvegicus
acagcacttctgtgtgtcagatcct

SEQ ID NO: 75337 - DNA, 25 bp, Rattus norvegicus
acagcacttgccaggccgcatgagg

SEQ ID NO: 75338 - DNA, 25 bp, Rattus norvegicus
acagcacttgcctggccgcatgagg

SEQ ID NO: 75339 - DNA, 25 bp, Rattus norvegicus
acagcacttgctaatattttccaaa

SEQ ID NO: 75340 - DNA, 25 bp, Rattus norvegicus
acagcacttgcttatattttccaaa

SEQ ID NO: 75341 - DNA, 25 bp, Rattus norvegicus
acagcactttccagggtgacagctc

SEQ ID NO: 75342 - DNA, 25 bp, Rattus norvegicus
acagcactttcctgggtgacagctc

SEQ ID NO: 75343 - DNA, 25 bp, Rattus norvegicus
acagcactttggctttaatttgaca

SEQ ID NO: 75344 - DNA, 25 bp, Rattus norvegicus
acagcactttgggtttaatttgaca

SEQ ID NO: 75345 - DNA, 25 bp, Rattus norvegicus
acagcagaacgtcttgcctgggcca

SEQ ID NO: 75346 - DNA, 25 bp, Rattus norvegicus
acagcagaacgtgttgcctgggcca

SEQ ID NO: 75347 - DNA, 25 bp, Rattus norvegicus
acagcagaagagacccgtgaagcac

SEQ ID NO: 75348 - DNA, 25 bp, Rattus norvegicus
acagcagaagagtcccgtgaagcac

SEQ ID NO: 75349 - DNA, 25 bp, Rattus norvegicus
acagcagacgtgaatgctacatgct

SEQ ID NO: 75350 - DNA, 25 bp, Rattus norvegicus
acagcagacgtgtatgctacatgct

SEQ ID NO: 75351 - DNA, 25 bp, Rattus norvegicus
acagcagactaacagacctaccggg

SEQ ID NO: 75352 - DNA, 25 bp, Rattus norvegicus
acagcagactaagagacctaccggg

SEQ ID NO: 75353 - DNA, 25 bp, Rattus norvegicus
acagcagagcatccgttcccagcag

SEQ ID NO: 75354 - DNA, 25 bp, Rattus norvegicus
acagcagagcatgcgttcccagcag

SEQ ID NO: 75355 - DNA, 25 bp, Rattus norvegicus
acagcagagctcctaggaccacaga

SEQ ID NO: 75356 - DNA, 25 bp, Rattus norvegicus
acagcagagctcgtaggaccacaga

SEQ ID NO: 75357 - DNA, 25 bp, Rattus norvegicus
acagcagagtttatctgtacaaaca

SEQ ID NO: 75358 - DNA, 25 bp, Rattus norvegicus
acagcagagtttttctgtacaaaca

SEQ ID NO: 75359 - DNA, 25 bp, Rattus norvegicus
acagcagatacaagtcatctctaga

SEQ ID NO: 75360 - DNA, 25 bp, Rattus norvegicus
acagcagatacatgtcatctctaga

SEQ ID NO: 75361 - DNA, 25 bp, Rattus norvegicus
acagcagatgaaaatggtaaaaccc

SEQ ID NO: 75362 - DNA, 25 bp, Rattus norvegicus
acagcagatgaatatggtaaaaccc

SEQ ID NO: 75363 - DNA, 25 bp, Rattus norvegicus
acagcagcaacaacggtggcatcac

SEQ ID NO: 75364 - DNA, 25 bp, Rattus norvegicus
acagcagcaacatcggtggcatcac

SEQ ID NO: 75365 - DNA, 25 bp, Rattus norvegicus
acagcagcactcaatgtggcaggac

SEQ ID NO: 75366 - DNA, 25 bp, Rattus norvegicus
acagcagcactctatgtggcaggac

SEQ ID NO: 75367 - DNA, 25 bp, Rattus norvegicus
acagcagcactgatctttagacact

SEQ ID NO: 75368 - DNA, 25 bp, Rattus norvegicus
acagcagcactgttctttagacact

SEQ ID NO: 75369 - DNA, 25 bp, Rattus norvegicus
acagcagcagagaccggcagcatct

SEQ ID NO: 75370 - DNA, 25 bp, Rattus norvegicus
acagcagcagagtccggcagcatct

SEQ ID NO: 75371 - DNA, 25 bp, Rattus norvegicus
acagcagcagccagggttgggtcct

SEQ ID NO: 75372 - DNA, 25 bp, Rattus norvegicus
acagcagcagcctgggttgggtcct

SEQ ID NO: 75373 - DNA, 25 bp, Rattus norvegicus
acagcagcagggatcacagtggcag

SEQ ID NO: 75374 - DNA, 25 bp, Rattus norvegicus
acagcagcagggttcacagtggcag

SEQ ID NO: 75375 - DNA, 25 bp, Rattus norvegicus
acagcagcatggatggtttctcttt

SEQ ID NO: 75376 - DNA, 25 bp, Rattus norvegicus
acagcagcatggttggtttctcttt

SEQ ID NO: 75377 - DNA, 25 bp, Rattus norvegicus
acagcagccagacgctgtgcagaag

SEQ ID NO: 75378 - DNA, 25 bp, Rattus norvegicus
acagcagccagaggctgtgcagaag

SEQ ID NO: 75379 - DNA, 25 bp, Rattus norvegicus
acagcagccagcaggagacgaggac

SEQ ID NO: 75380 - DNA, 25 bp, Rattus norvegicus
acagcagccagctggagacgaggac

SEQ ID NO: 75381 - DNA, 25 bp, Rattus norvegicus
acagcagccagtcaccaagggacag

SEQ ID NO: 75382 - DNA, 25 bp, Rattus norvegicus
acagcagccagtgaccaagggacag

SEQ ID NO: 75383 - DNA, 25 bp, Rattus norvegicus
acagcagccattctggagtgggtca

SEQ ID NO: 75384 - DNA, 25 bp, Rattus norvegicus
acagcagccattgtggagtgggtca

SEQ ID NO: 75385 - DNA, 25 bp, Rattus norvegicus
acagcagccgtaaccccagcagatg

SEQ ID NO: 75386 - DNA, 25 bp, Rattus norvegicus
acagcagccgtatccccagcagatg

SEQ ID NO: 75387 - DNA, 25 bp, Rattus norvegicus
acagcagccttgctgtacagacatt

SEQ ID NO: 75388 - DNA, 25 bp, Rattus norvegicus
acagcagccttggtgtacagacatt

SEQ ID NO: 75389 - DNA, 25 bp, Rattus norvegicus
acagcagcggtcagttttctgagca

SEQ ID NO: 75390 - DNA, 25 bp, Rattus norvegicus
acagcagcggtctgttttctgagca

SEQ ID NO: 75391 - DNA, 25 bp, Rattus norvegicus
acagcagctcaacggttgtgccaaa

SEQ ID NO: 75392 - DNA, 25 bp, Rattus norvegicus
acagcagctcaagggttgtgccaaa

SEQ ID NO: 75393 - DNA, 25 bp, Rattus norvegicus
acagcagctcgcagatttaaaggaa

SEQ ID NO: 75394 - DNA, 25 bp, Rattus norvegicus
acagcagctcgctgatttaaaggaa

SEQ ID NO: 75395 - DNA, 25 bp, Rattus norvegicus
acagcagctggactagcccctggag

SEQ ID NO: 75396 - DNA, 25 bp, Rattus norvegicus
acagcagctggagtagcccctggag

SEQ ID NO: 75397 - DNA, 25 bp, Rattus norvegicus
acagcagcttacatgttcctggtta

SEQ ID NO: 75398 - DNA, 25 bp, Rattus norvegicus
acagcagcttacttgttcctggtta

SEQ ID NO: 75399 - DNA, 25 bp, Rattus norvegicus
acagcagcttagactggtgtgacct

SEQ ID NO: 75400 - DNA, 25 bp, Rattus norvegicus
acagcagcttagtctggtgtgacct

SEQ ID NO: 75401 - DNA, 25 bp, Rattus norvegicus
acagcagcttatcgtacccgtcggg

SEQ ID NO: 75402 - DNA, 25 bp, Rattus norvegicus
acagcagcttatggtacccgtcggg

SEQ ID NO: 75403 - DNA, 25 bp, Rattus norvegicus
acagcaggacataaggcccatcaag

SEQ ID NO: 75404 - DNA, 25 bp, Rattus norvegicus
acagcaggacattaggcccatcaag

SEQ ID NO: 75405 - DNA, 25 bp, Rattus norvegicus
acagcaggacttcttcgggctcttg

SEQ ID NO: 75406 - DNA, 25 bp, Rattus norvegicus
acagcaggacttgttcgggctcttg

SEQ ID NO: 75407 - DNA, 25 bp, Rattus norvegicus
acagcaggagcacgctgtctctgac

SEQ ID NO: 75408 - DNA, 25 bp, Rattus norvegicus
acagcaggagcaggctgtctctgac

SEQ ID NO: 75409 - DNA, 25 bp, Rattus norvegicus
acagcaggataaccctcctttcttc

SEQ ID NO: 75410 - DNA, 25 bp, Rattus norvegicus
acagcaggataagcctcctttcttc

SEQ ID NO: 75411 - DNA, 25 bp, Rattus norvegicus
acagcaggatggctaccctcagcac

SEQ ID NO: 75412 - DNA, 25 bp, Rattus norvegicus
acagcaggatgggtaccctcagcac

SEQ ID NO: 75413 - DNA, 25 bp, Rattus norvegicus
acagcaggcccaccagaaaatccgg

SEQ ID NO: 75414 - DNA, 25 bp, Rattus norvegicus
acagcaggcccagcagaaaatccgg

SEQ ID NO: 75415 - DNA, 25 bp, Rattus norvegicus
acagcaggcgtacggcataccagtg

SEQ ID NO: 75416 - DNA, 25 bp, Rattus norvegicus
acagcaggcgtagggcataccagtg

SEQ ID NO: 75417 - DNA, 25 bp, Rattus norvegicus
acagcaggctcgcacctggtgaaca

SEQ ID NO: 75418 - DNA, 25 bp, Rattus norvegicus
acagcaggctcggacctggtgaaca

SEQ ID NO: 75419 - DNA, 25 bp, Rattus norvegicus
acagcaggctctcctatgatccaga

SEQ ID NO: 75420 - DNA, 25 bp, Rattus norvegicus
acagcaggctctgctatgatccaga

SEQ ID NO: 75421 - DNA, 25 bp, Rattus norvegicus
acagcagggaatagcctcaaaggac

SEQ ID NO: 75422 - DNA, 25 bp, Rattus norvegicus
acagcagggaattgcctcaaaggac

SEQ ID NO: 75423 - DNA, 25 bp, Rattus norvegicus
acagcagggcatatctcttgacatt

SEQ ID NO: 75424 - DNA, 25 bp, Rattus norvegicus
acagcagggcatttctcttgacatt

SEQ ID NO: 75425 - DNA, 25 bp, Rattus norvegicus
acagcagggccacaagctgccgagt

SEQ ID NO: 75426 - DNA, 25 bp, Rattus norvegicus
acagcagggccagaagctgccgagt

SEQ ID NO: 75427 - DNA, 25 bp, Rattus norvegicus
acagcagggctcacctcagatggga

SEQ ID NO: 75428 - DNA, 25 bp, Rattus norvegicus
acagcagggctcagcttacagcgaa

SEQ ID NO: 75429 - DNA, 25 bp, Rattus norvegicus
acagcagggctctcctcagatggga

SEQ ID NO: 75430 - DNA, 25 bp, Rattus norvegicus
acagcagggctctgcttacagcgaa

SEQ ID NO: 75431 - DNA, 25 bp, Rattus norvegicus
acagcagggctgcagtttttcagac

SEQ ID NO: 75432 - DNA, 25 bp, Rattus norvegicus
acagcagggctggagtttttcagac

SEQ ID NO: 75433 - DNA, 25 bp, Rattus norvegicus
acagcaggtgccaccctgtctgctg

SEQ ID NO: 75434 - DNA, 25 bp, Rattus norvegicus
acagcaggtgcctccctgtctgctg

SEQ ID NO: 75435 - DNA, 25 bp, Rattus norvegicus
acagcaggtggaacagcattgcctt

SEQ ID NO: 75436 - DNA, 25 bp, Rattus norvegicus
acagcaggtggatcagcattgcctt

SEQ ID NO: 75437 - DNA, 25 bp, Rattus norvegicus
acagcaggttttatccagattcaca

SEQ ID NO: 75438 - DNA, 25 bp, Rattus norvegicus
acagcaggttttttccagattcaca

SEQ ID NO: 75439 - DNA, 25 bp, Rattus norvegicus
acagcagtaggcaccctagagggaa

SEQ ID NO: 75440 - DNA, 25 bp, Rattus norvegicus
acagcagtaggctccctagagggaa

SEQ ID NO: 75441 - DNA, 25 bp, Rattus norvegicus
acagcagtagggactttaccttcct

SEQ ID NO: 75442 - DNA, 25 bp, Rattus norvegicus
acagcagtagggtctttaccttcct

SEQ ID NO: 75443 - DNA, 25 bp, Rattus norvegicus
acagcagtatgcatggatccagcct

SEQ ID NO: 75444 - DNA, 25 bp, Rattus norvegicus
acagcagtatgcttggatccagcct

SEQ ID NO: 75445 - DNA, 25 bp, Rattus norvegicus
acagcagtatgtacagccaaggact

SEQ ID NO: 75446 - DNA, 25 bp, Rattus norvegicus
acagcagtatgttcagccaaggact

SEQ ID NO: 75447 - DNA, 25 bp, Rattus norvegicus
acagcagtatttcaggcatcctcct

SEQ ID NO: 75448 - DNA, 25 bp, Rattus norvegicus
acagcagtatttgaggcatcctcct

SEQ ID NO: 75449 - DNA, 25 bp, Rattus norvegicus
acagcagtccccaagtatgtgagac

SEQ ID NO: 75450 - DNA, 25 bp, Rattus norvegicus
acagcagtcccctagtatgtgagac

SEQ ID NO: 75451 - DNA, 25 bp, Rattus norvegicus
acagcagtcgtcctaggcacagggt

SEQ ID NO: 75452 - DNA, 25 bp, Rattus norvegicus
acagcagtcgtcgtaggcacagggt

SEQ ID NO: 75453 - DNA, 25 bp, Rattus norvegicus
acagcagtctgtctacactgggact

SEQ ID NO: 75454 - DNA, 25 bp, Rattus norvegicus
acagcagtctgtgtacactgggact

SEQ ID NO: 75455 - DNA, 25 bp, Rattus norvegicus
acagcagtgaggcaagctccctgag

SEQ ID NO: 75456 - DNA, 25 bp, Rattus norvegicus
acagcagtgagggaagctccctgag

SEQ ID NO: 75457 - DNA, 25 bp, Rattus norvegicus
acagcagtgagtccacagctcggaa

SEQ ID NO: 75458 - DNA, 25 bp, Rattus norvegicus
acagcagtgagtgcacagctcggaa

SEQ ID NO: 75459 - DNA, 25 bp, Rattus norvegicus
acagcagtgcacatggagcagccat

SEQ ID NO: 75460 - DNA, 25 bp, Rattus norvegicus
acagcagtgcacttggagcagccat

SEQ ID NO: 75461 - DNA, 25 bp, Rattus norvegicus
acagcagtgcatacatcaggcccag

SEQ ID NO: 75462 - DNA, 25 bp, Rattus norvegicus
acagcagtgcattcatcaggcccag

SEQ ID NO: 75463 - DNA, 25 bp, Rattus norvegicus
acagcagtgcctactgagtggtttt

SEQ ID NO: 75464 - DNA, 25 bp, Rattus norvegicus
acagcagtgcctcgctctcagacag

SEQ ID NO: 75465 - DNA, 25 bp, Rattus norvegicus
acagcagtgcctggctctcagacag

SEQ ID NO: 75466 - DNA, 25 bp, Rattus norvegicus
acagcagtgccttctgagtggtttt

SEQ ID NO: 75467 - DNA, 25 bp, Rattus norvegicus
acagcagtgggaaagccacgcctct

SEQ ID NO: 75468 - DNA, 25 bp, Rattus norvegicus
acagcagtgggatagccacgcctct

SEQ ID NO: 75469 - DNA, 25 bp, Rattus norvegicus
acagcagtggtgaccatgggctctg

SEQ ID NO: 75470 - DNA, 25 bp, Rattus norvegicus
acagcagtggtgtccatgggctctg

SEQ ID NO: 75471 - DNA, 25 bp, Rattus norvegicus
acagcagttccgagggtcccggctc

SEQ ID NO: 75472 - DNA, 25 bp, Rattus norvegicus
acagcagttccgtgggtcccggctc

SEQ ID NO: 75473 - DNA, 25 bp, Rattus norvegicus
acagcagttctgaagactccttaaa

SEQ ID NO: 75474 - DNA, 25 bp, Rattus norvegicus
acagcagttctgagccttttcactg

SEQ ID NO: 75475 - DNA, 25 bp, Rattus norvegicus
acagcagttctgtagactccttaaa

SEQ ID NO: 75476 - DNA, 25 bp, Rattus norvegicus
acagcagttctgtgccttttcactg

SEQ ID NO: 75477 - DNA, 25 bp, Rattus norvegicus
acagcagttgtcagtggttttcctg

SEQ ID NO: 75478 - DNA, 25 bp, Rattus norvegicus
acagcagttgtctgtggttttcctg

SEQ ID NO: 75479 - DNA, 25 bp, Rattus norvegicus
acagcagtttgtctccttggtgatt

SEQ ID NO: 75480 - DNA, 25 bp, Rattus norvegicus
acagcagtttgtctgtccctgggaa

SEQ ID NO: 75481 - DNA, 25 bp, Rattus norvegicus
acagcagtttgtgtccttggtgatt

SEQ ID NO: 75482 - DNA, 25 bp, Rattus norvegicus
acagcagtttgtgtgtccctgggaa

SEQ ID NO: 75483 - DNA, 25 bp, Rattus norvegicus
acagcatacactcacggtggagcat

SEQ ID NO: 75484 - DNA, 25 bp, Rattus norvegicus
acagcatacactgacggtggagcat

SEQ ID NO: 75485 - DNA, 25 bp, Rattus norvegicus
acagcatagcaacactgatggcttt

SEQ ID NO: 75486 - DNA, 25 bp, Rattus norvegicus
acagcatagcaagactgatggcttt

SEQ ID NO: 75487 - DNA, 25 bp, Rattus norvegicus
acagcatccctgaggcagtggaggt

SEQ ID NO: 75488 - DNA, 25 bp, Rattus norvegicus
acagcatccctgtggcagtggaggt

SEQ ID NO: 75489 - DNA, 25 bp, Rattus norvegicus
acagcatcctcaaagcacacggttt

SEQ ID NO: 75490 - DNA, 25 bp, Rattus norvegicus
acagcatcctcatagcacacggttt

SEQ ID NO: 75491 - DNA, 25 bp, Rattus norvegicus
acagcatccttaattggcccaaagc

SEQ ID NO: 75492 - DNA, 25 bp, Rattus norvegicus
acagcatccttatttggcccaaagc

SEQ ID NO: 75493 - DNA, 25 bp, Rattus norvegicus
acagcatccttgagtccttagcgtc

SEQ ID NO: 75494 - DNA, 25 bp, Rattus norvegicus
acagcatccttgtgtccttagcgtc

SEQ ID NO: 75495 - DNA, 25 bp, Rattus norvegicus
acagcatcggttctctgtctttcag

SEQ ID NO: 75496 - DNA, 25 bp, Rattus norvegicus
acagcatcggttgtctgtctttcag

SEQ ID NO: 75497 - DNA, 25 bp, Rattus norvegicus
acagcatctcagctcgtctttactg

SEQ ID NO: 75498 - DNA, 25 bp, Rattus norvegicus
acagcatctcaggtcgtctttactg

SEQ ID NO: 75499 - DNA, 25 bp, Rattus norvegicus
acagcatctctgaatctaccaagac

SEQ ID NO: 75500 - DNA, 25 bp, Rattus norvegicus
acagcatctctgtatctaccaagac

SEQ ID NO: 75501 - DNA, 25 bp, Rattus norvegicus
acagcatctgaaaactcatggcaat

SEQ ID NO: 75502 - DNA, 25 bp, Rattus norvegicus
acagcatctgaaagtggcatagact

SEQ ID NO: 75503 - DNA, 25 bp, Rattus norvegicus
acagcatctgaatactcatggcaat

SEQ ID NO: 75504 - DNA, 25 bp, Rattus norvegicus
acagcatctgaatgtggcatagact

SEQ ID NO: 75505 - DNA, 25 bp, Rattus norvegicus
acagcatgaactcctgtcacctggg

SEQ ID NO: 75506 - DNA, 25 bp, Rattus norvegicus
acagcatgaactgctgtcacctggg

SEQ ID NO: 75507 - DNA, 25 bp, Rattus norvegicus
acagcatgaggaagcaggcattcca

SEQ ID NO: 75508 - DNA, 25 bp, Rattus norvegicus
acagcatgaggatgcaggcattcca

SEQ ID NO: 75509 - DNA, 25 bp, Rattus norvegicus
acagcatgcctgagtcaggtctttt

SEQ ID NO: 75510 - DNA, 25 bp, Rattus norvegicus
acagcatgcctgtgtcaggtctttt

SEQ ID NO: 75511 - DNA, 25 bp, Rattus norvegicus
acagcatgcgtcctgactgggcagc

SEQ ID NO: 75512 - DNA, 25 bp, Rattus norvegicus
acagcatgcgtcgtgactgggcagc

SEQ ID NO: 75513 - DNA, 25 bp, Rattus norvegicus
acagcatggactatggtcctcaaca

SEQ ID NO: 75514 - DNA, 25 bp, Rattus norvegicus
acagcatggactttggtcctcaaca

SEQ ID NO: 75515 - DNA, 25 bp, Rattus norvegicus
acagcatggagtattcctcccaaaa

SEQ ID NO: 75516 - DNA, 25 bp, Rattus norvegicus
acagcatggagttttcctcccaaaa

SEQ ID NO: 75517 - DNA, 25 bp, Rattus norvegicus
acagcatggcggacgttttctctag

SEQ ID NO: 75518 - DNA, 25 bp, Rattus norvegicus
acagcatggcggtcgttttctctag

SEQ ID NO: 75519 - DNA, 25 bp, Rattus norvegicus
acagcatggcttcggttgtggacct

SEQ ID NO: 75520 - DNA, 25 bp, Rattus norvegicus
acagcatggcttgggttgtggacct

SEQ ID NO: 75521 - DNA, 25 bp, Rattus norvegicus
acagcatgtactctggcggcttgag

SEQ ID NO: 75522 - DNA, 25 bp, Rattus norvegicus
acagcatgtactgtggcggcttgag

SEQ ID NO: 75523 - DNA, 25 bp, Rattus norvegicus
acagcatgtctgactcctcggtgga

SEQ ID NO: 75524 - DNA, 25 bp, Rattus norvegicus
acagcatgtctgagttttgtataga

SEQ ID NO: 75525 - DNA, 25 bp, Rattus norvegicus
acagcatgtctgtctcctcggtgga

SEQ ID NO: 75526 - DNA, 25 bp, Rattus norvegicus
acagcatgtctgtgttttgtataga

SEQ ID NO: 75527 - DNA, 25 bp, Rattus norvegicus
acagcatgtggcatttcagaccata

SEQ ID NO: 75528 - DNA, 25 bp, Rattus norvegicus
acagcatgtggcttttcagaccata

SEQ ID NO: 75529 - DNA, 25 bp, Rattus norvegicus
acagcatgtgggatttctagactca

SEQ ID NO: 75530 - DNA, 25 bp, Rattus norvegicus
acagcatgtgggttttctagactca

SEQ ID NO: 75531 - DNA, 25 bp, Rattus norvegicus
acagcatgtggtcggcatggcccct

SEQ ID NO: 75532 - DNA, 25 bp, Rattus norvegicus
acagcatgtggtgggcatggcccct

SEQ ID NO: 75533 - DNA, 25 bp, Rattus norvegicus
acagcattaccaatgtctggacagc

SEQ ID NO: 75534 - DNA, 25 bp, Rattus norvegicus
acagcattaccattgtctggacagc

SEQ ID NO: 75535 - DNA, 25 bp, Rattus norvegicus
acagcattcagaccactggatcaac

SEQ ID NO: 75536 - DNA, 25 bp, Rattus norvegicus
acagcattcagagcactggatcaac

SEQ ID NO: 75537 - DNA, 25 bp, Rattus norvegicus
acagcattcagtaggctcgtgtcaa

SEQ ID NO: 75538 - DNA, 25 bp, Rattus norvegicus
acagcattcagttggctcgtgtcaa

SEQ ID NO: 75539 - DNA, 25 bp, Rattus norvegicus
acagcattcatcagtactctctttc

SEQ ID NO: 75540 - DNA, 25 bp, Rattus norvegicus
acagcattcatctgtactctctttc

SEQ ID NO: 75541 - DNA, 25 bp, Rattus norvegicus
acagcattcatgctgactttgcaat

SEQ ID NO: 75542 - DNA, 25 bp, Rattus norvegicus
acagcattcatggtgactttgcaat

SEQ ID NO: 75543 - DNA, 25 bp, Rattus norvegicus
acagcattcccaattccttgtggag

SEQ ID NO: 75544 - DNA, 25 bp, Rattus norvegicus
acagcattcccatttccttgtggag

SEQ ID NO: 75545 - DNA, 25 bp, Rattus norvegicus
acagcattcctgcaggagacacaaa

SEQ ID NO: 75546 - DNA, 25 bp, Rattus norvegicus
acagcattcctggaggagacacaaa

SEQ ID NO: 75547 - DNA, 25 bp, Rattus norvegicus
acagcattgcgtacctggacgagga

SEQ ID NO: 75548 - DNA, 25 bp, Rattus norvegicus
acagcattgcgttcctggacgagga

SEQ ID NO: 75549 - DNA, 25 bp, Rattus norvegicus
acagcattgggtagtggatcagcac

SEQ ID NO: 75550 - DNA, 25 bp, Rattus norvegicus
acagcattgggttgtggatcagcac

SEQ ID NO: 75551 - DNA, 25 bp, Rattus norvegicus
acagcattggtcactcagctgagaa

SEQ ID NO: 75552 - DNA, 25 bp, Rattus norvegicus
acagcattggtctctcagctgagaa

SEQ ID NO: 75553 - DNA, 25 bp, Rattus norvegicus
acagcattgtggacgcctacaaaca

SEQ ID NO: 75554 - DNA, 25 bp, Rattus norvegicus
acagcattgtggtcgcctacaaaca

SEQ ID NO: 75555 - DNA, 25 bp, Rattus norvegicus
acagcatttcaactgccccagagtt

SEQ ID NO: 75556 - DNA, 25 bp, Rattus norvegicus
acagcatttcaagtgccccagagtt

SEQ ID NO: 75557 - DNA, 25 bp, Rattus norvegicus
acagcatttcatcccagaaggccag

SEQ ID NO: 75558 - DNA, 25 bp, Rattus norvegicus
acagcatttcatgccagaaggccag

SEQ ID NO: 75559 - DNA, 25 bp, Rattus norvegicus
acagcatttctcactgggaggtgag

SEQ ID NO: 75560 - DNA, 25 bp, Rattus norvegicus
acagcatttctctctgggaggtgag

SEQ ID NO: 75561 - DNA, 25 bp, Rattus norvegicus
acagcatttgcaacgtgaccataga

SEQ ID NO: 75562 - DNA, 25 bp, Rattus norvegicus
acagcatttgcatcgtgaccataga

SEQ ID NO: 75563 - DNA, 25 bp, Rattus norvegicus
acagcatttgtgacgaccacggaga

SEQ ID NO: 75564 - DNA, 25 bp, Rattus norvegicus
acagcatttgtgtcgaccacggaga

SEQ ID NO: 75565 - DNA, 25 bp, Rattus norvegicus
acagcatttgttcgagagcctccct

SEQ ID NO: 75566 - DNA, 25 bp, Rattus norvegicus
acagcatttgttggagagcctccct

SEQ ID NO: 75567 - DNA, 25 bp, Rattus norvegicus
acagcattttcaacaccactggaat

SEQ ID NO: 75568 - DNA, 25 bp, Rattus norvegicus
acagcattttcatcaccactggaat

SEQ ID NO: 75569 - DNA, 25 bp, Rattus norvegicus
acagccaaaagcctggccatccgta

SEQ ID NO: 75570 - DNA, 25 bp, Rattus norvegicus
acagccaaaagcgtggccatccgta

SEQ ID NO: 75571 - DNA, 25 bp, Rattus norvegicus
acagccaaacagagtctccaaaacc

SEQ ID NO: 75572 - DNA, 25 bp, Rattus norvegicus
acagccaaacagtgtctccaaaacc

SEQ ID NO: 75573 - DNA, 25 bp, Rattus norvegicus
acagccaaacttctgttgccatagt

SEQ ID NO: 75574 - DNA, 25 bp, Rattus norvegicus
acagccaaacttgtgttgccatagt

SEQ ID NO: 75575 - DNA, 25 bp, Rattus norvegicus
acagccaaatccatgaatcggttga

SEQ ID NO: 75576 - DNA, 25 bp, Rattus norvegicus
acagccaaatccttgaatcggttga

SEQ ID NO: 75577 - DNA, 25 bp, Rattus norvegicus
acagccaacttaagtcccagcaatg

SEQ ID NO: 75578 - DNA, 25 bp, Rattus norvegicus
acagccaacttatgtcccagcaatg

SEQ ID NO: 75579 - DNA, 25 bp, Rattus norvegicus
acagccaacttgagcgaaaccgcct

SEQ ID NO: 75580 - DNA, 25 bp, Rattus norvegicus
acagccaacttgtgcgaaaccgcct

SEQ ID NO: 75581 - DNA, 25 bp, Rattus norvegicus
acagccaagactatatagagaaacc

SEQ ID NO: 75582 - DNA, 25 bp, Rattus norvegicus
acagccaagactttatagagaaacc

SEQ ID NO: 75583 - DNA, 25 bp, Rattus norvegicus
acagccaagcacatccaggaattct

SEQ ID NO: 75584 - DNA, 25 bp, Rattus norvegicus
acagccaagcacttccaggaattct

SEQ ID NO: 75585 - DNA, 25 bp, Rattus norvegicus
acagccaagcttctgtgctggcaat

SEQ ID NO: 75586 - DNA, 25 bp, Rattus norvegicus
acagccaagcttgtgtgctggcaat

SEQ ID NO: 75587 - DNA, 25 bp, Rattus norvegicus
acagccaatagcacagccgtgacca

SEQ ID NO: 75588 - DNA, 25 bp, Rattus norvegicus
acagccaatagctcagccgtgacca

SEQ ID NO: 75589 - DNA, 25 bp, Rattus norvegicus
acagccaatgccctctttgtggacc

SEQ ID NO: 75590 - DNA, 25 bp, Rattus norvegicus
acagccaatgccgtctttgtggacc

SEQ ID NO: 75591 - DNA, 25 bp, Rattus norvegicus
acagccacaagcatcttagccataa

SEQ ID NO: 75592 - DNA, 25 bp, Rattus norvegicus
acagccacaagcttcttagccataa

SEQ ID NO: 75593 - DNA, 25 bp, Rattus norvegicus
acagccacactaacctcaggtgaag

SEQ ID NO: 75594 - DNA, 25 bp, Rattus norvegicus
acagccacactatcctcaggtgaag

SEQ ID NO: 75595 - DNA, 25 bp, Rattus norvegicus
acagccacagtcctctggtggaaat

SEQ ID NO: 75596 - DNA, 25 bp, Rattus norvegicus
acagccacagtcgtctggtggaaat

SEQ ID NO: 75597 - DNA, 25 bp, Rattus norvegicus
acagccacataccatatcatcagga

SEQ ID NO: 75598 - DNA, 25 bp, Rattus norvegicus
acagccacatacgatatcatcagga

SEQ ID NO: 75599 - DNA, 25 bp, Rattus norvegicus
acagccaccccgagtgagcagaaga

SEQ ID NO: 75600 - DNA, 25 bp, Rattus norvegicus
acagccaccccgtgtgagcagaaga

SEQ ID NO: 75601 - DNA, 25 bp, Rattus norvegicus
acagccacggccatggagaccagct

SEQ ID NO: 75602 - DNA, 25 bp, Rattus norvegicus
acagccacggccttggagaccagct

SEQ ID NO: 75603 - DNA, 25 bp, Rattus norvegicus
acagccacggttctgagagccgaga

SEQ ID NO: 75604 - DNA, 25 bp, Rattus norvegicus
acagccacggttgtgagagccgaga

SEQ ID NO: 75605 - DNA, 25 bp, Rattus norvegicus
acagccactaatctcacagcagttt

SEQ ID NO: 75606 - DNA, 25 bp, Rattus norvegicus
acagccactaatgtcacagcagttt

SEQ ID NO: 75607 - DNA, 25 bp, Rattus norvegicus
acagccactcgccagtgtttaaaga

SEQ ID NO: 75608 - DNA, 25 bp, Rattus norvegicus
acagccactcgcgagtgtttaaaga

SEQ ID NO: 75609 - DNA, 25 bp, Rattus norvegicus
acagccactgagaactaggattaga

SEQ ID NO: 75610 - DNA, 25 bp, Rattus norvegicus
acagccactgagtactaggattaga

SEQ ID NO: 75611 - DNA, 25 bp, Rattus norvegicus
acagccactgatctgacttcactat

SEQ ID NO: 75612 - DNA, 25 bp, Rattus norvegicus
acagccactgatgtgacttcactat

SEQ ID NO: 75613 - DNA, 25 bp, Rattus norvegicus
acagccactggtactgctggttgca

SEQ ID NO: 75614 - DNA, 25 bp, Rattus norvegicus
acagccactggttctgctggttgca

SEQ ID NO: 75615 - DNA, 25 bp, Rattus norvegicus
acagccagaagcatcagacaggtct

SEQ ID NO: 75616 - DNA, 25 bp, Rattus norvegicus
acagccagaagcttcagacaggtct

SEQ ID NO: 75617 - DNA, 25 bp, Rattus norvegicus
acagccagcagtatgtcttctctga

SEQ ID NO: 75618 - DNA, 25 bp, Rattus norvegicus
acagccagcagtttgtcttctctga

SEQ ID NO: 75619 - DNA, 25 bp, Rattus norvegicus
acagccagcattcaggtaaaccttt

SEQ ID NO: 75620 - DNA, 25 bp, Rattus norvegicus
acagccagcattgaggtaaaccttt

SEQ ID NO: 75621 - DNA, 25 bp, Rattus norvegicus
acagccagccgacgcctggaaggca

SEQ ID NO: 75622 - DNA, 25 bp, Rattus norvegicus
acagccagccgactcatgaagattc

SEQ ID NO: 75623 - DNA, 25 bp, Rattus norvegicus
acagccagccgaggcctggaaggca

SEQ ID NO: 75624 - DNA, 25 bp, Rattus norvegicus
acagccagccgagtcatgaagattc

SEQ ID NO: 75625 - DNA, 25 bp, Rattus norvegicus
acagccagcgctacaaagttgacta

SEQ ID NO: 75626 - DNA, 25 bp, Rattus norvegicus
acagccagcgctactctcgggagga

SEQ ID NO: 75627 - DNA, 25 bp, Rattus norvegicus
acagccagcgcttcaaagttgacta

SEQ ID NO: 75628 - DNA, 25 bp, Rattus norvegicus
acagccagcgcttctctcgggagga

SEQ ID NO: 75629 - DNA, 25 bp, Rattus norvegicus
acagccagcgtgctgatgaagacct

SEQ ID NO: 75630 - DNA, 25 bp, Rattus norvegicus
acagccagcgtggtgatgaagacct

SEQ ID NO: 75631 - DNA, 25 bp, Rattus norvegicus
acagccagctccactttgatgaagg

SEQ ID NO: 75632 - DNA, 25 bp, Rattus norvegicus
acagccagctcctctttgatgaagg

SEQ ID NO: 75633 - DNA, 25 bp, Rattus norvegicus
acagccagctcgaaaacagggtcct

SEQ ID NO: 75634 - DNA, 25 bp, Rattus norvegicus
acagccagctcgtaaacagggtcct

SEQ ID NO: 75635 - DNA, 25 bp, Rattus norvegicus
acagccaggagtctaccagcagaaa

SEQ ID NO: 75636 - DNA, 25 bp, Rattus norvegicus
acagccaggagtgtaccagcagaaa

SEQ ID NO: 75637 - DNA, 25 bp, Rattus norvegicus
acagccaggccaaggatgtctcatt

SEQ ID NO: 75638 - DNA, 25 bp, Rattus norvegicus
acagccaggccaattctttggtttt

SEQ ID NO: 75639 - DNA, 25 bp, Rattus norvegicus
acagccaggccatggatgtctcatt

SEQ ID NO: 75640 - DNA, 25 bp, Rattus norvegicus
acagccaggccatttctttggtttt

SEQ ID NO: 75641 - DNA, 25 bp, Rattus norvegicus
acagccaggcggaagcagcaagttt

SEQ ID NO: 75642 - DNA, 25 bp, Rattus norvegicus
acagccaggcggtagcagcaagttt

SEQ ID NO: 75643 - DNA, 25 bp, Rattus norvegicus
acagccaggcttaccctgtggtttt

SEQ ID NO: 75644 - DNA, 25 bp, Rattus norvegicus
acagccaggctttccctgtggtttt

SEQ ID NO: 75645 - DNA, 25 bp, Rattus norvegicus
acagccagggcaacaagtactcttt

SEQ ID NO: 75646 - DNA, 25 bp, Rattus norvegicus
acagccagggcatcaagtactcttt

SEQ ID NO: 75647 - DNA, 25 bp, Rattus norvegicus
acagccagggctacgtagaaataca

SEQ ID NO: 75648 - DNA, 25 bp, Rattus norvegicus
acagccagggcttcgtagaaataca

SEQ ID NO: 75649 - DNA, 25 bp, Rattus norvegicus
acagccagtgtgcacgagccttcga

SEQ ID NO: 75650 - DNA, 25 bp, Rattus norvegicus
acagccagtgtggacgagccttcga

SEQ ID NO: 75651 - DNA, 25 bp, Rattus norvegicus
acagccatagttcttcatttacaga

SEQ ID NO: 75652 - DNA, 25 bp, Rattus norvegicus
acagccatagttgttcatttacaga

SEQ ID NO: 75653 - DNA, 25 bp, Rattus norvegicus
acagccatcaggacgttgtgtcaaa

SEQ ID NO: 75654 - DNA, 25 bp, Rattus norvegicus
acagccatcaggtcgttgtgtcaaa

SEQ ID NO: 75655 - DNA, 25 bp, Rattus norvegicus
acagccatccatctattctctctgg

SEQ ID NO: 75656 - DNA, 25 bp, Rattus norvegicus
acagccatccatgtattctctctgg

SEQ ID NO: 75657 - DNA, 25 bp, Rattus norvegicus
acagccatcgagatctgcgtctgag

SEQ ID NO: 75658 - DNA, 25 bp, Rattus norvegicus
acagccatcgagttctgcgtctgag

SEQ ID NO: 75659 - DNA, 25 bp, Rattus norvegicus
acagccatcgggatgccagcggaga

SEQ ID NO: 75660 - DNA, 25 bp, Rattus norvegicus
acagccatcgggttgccagcggaga

SEQ ID NO: 75661 - DNA, 25 bp, Rattus norvegicus
acagccatctccaagtatttctcag

SEQ ID NO: 75662 - DNA, 25 bp, Rattus norvegicus
acagccatctcctagtatttctcag

SEQ ID NO: 75663 - DNA, 25 bp, Rattus norvegicus
acagccatctctatcgtgacatatt

SEQ ID NO: 75664 - DNA, 25 bp, Rattus norvegicus
acagccatctctttcgtgacatatt

SEQ ID NO: 75665 - DNA, 25 bp, Rattus norvegicus
acagccatgcagagcaccaaactgg

SEQ ID NO: 75666 - DNA, 25 bp, Rattus norvegicus
acagccatgcagtgcaccaaactgg

SEQ ID NO: 75667 - DNA, 25 bp, Rattus norvegicus
acagccatgcatattcagtcaggaa

SEQ ID NO: 75668 - DNA, 25 bp, Rattus norvegicus
acagccatgcattttcagtcaggaa

SEQ ID NO: 75669 - DNA, 25 bp, Rattus norvegicus
acagccatggacagcacctttggat

SEQ ID NO: 75670 - DNA, 25 bp, Rattus norvegicus
acagccatggactgcacctttggat

SEQ ID NO: 75671 - DNA, 25 bp, Rattus norvegicus
acagccatgtaacttctaggtcaat

SEQ ID NO: 75672 - DNA, 25 bp, Rattus norvegicus
acagccatgtaagttctaggtcaat

SEQ ID NO: 75673 - DNA, 25 bp, Rattus norvegicus
acagccattgtaattcctaagtact

SEQ ID NO: 75674 - DNA, 25 bp, Rattus norvegicus
acagccattgtatttcctaagtact

SEQ ID NO: 75675 - DNA, 25 bp, Rattus norvegicus
acagccatttggcaggcactgccac

SEQ ID NO: 75676 - DNA, 25 bp, Rattus norvegicus
acagccatttggctaccttttcatt

SEQ ID NO: 75677 - DNA, 25 bp, Rattus norvegicus
acagccatttgggaggcactgccac

SEQ ID NO: 75678 - DNA, 25 bp, Rattus norvegicus
acagccatttgggtaccttttcatt

SEQ ID NO: 75679 - DNA, 25 bp, Rattus norvegicus
acagcccaactacctcaagtgaaat

SEQ ID NO: 75680 - DNA, 25 bp, Rattus norvegicus
acagcccaactagctcaagtgaaat

SEQ ID NO: 75681 - DNA, 25 bp, Rattus norvegicus
acagcccaactgctacagcgagtag

SEQ ID NO: 75682 - DNA, 25 bp, Rattus norvegicus
acagcccaactggtacagcgagtag

SEQ ID NO: 75683 - DNA, 25 bp, Rattus norvegicus
acagcccacacacccttggaattct

SEQ ID NO: 75684 - DNA, 25 bp, Rattus norvegicus
acagcccacacagccttggaattct

SEQ ID NO: 75685 - DNA, 25 bp, Rattus norvegicus
acagcccacagtacaatgtcagcag

SEQ ID NO: 75686 - DNA, 25 bp, Rattus norvegicus
acagcccacagttcaatgtcagcag

SEQ ID NO: 75687 - DNA, 25 bp, Rattus norvegicus
acagcccacctgagcaatcatagga

SEQ ID NO: 75688 - DNA, 25 bp, Rattus norvegicus
acagcccacctgtgcaatcatagga

SEQ ID NO: 75689 - DNA, 25 bp, Rattus norvegicus
acagcccagcagagttgttggtttt

SEQ ID NO: 75690 - DNA, 25 bp, Rattus norvegicus
acagcccagcagtgttgttggtttt

SEQ ID NO: 75691 - DNA, 25 bp, Rattus norvegicus
acagcccaggtaaaggactatcagt

SEQ ID NO: 75692 - DNA, 25 bp, Rattus norvegicus
acagcccaggtataggactatcagt

SEQ ID NO: 75693 - DNA, 25 bp, Rattus norvegicus
acagcccaggtcaaagcatccagct

SEQ ID NO: 75694 - DNA, 25 bp, Rattus norvegicus
acagcccaggtctaagcatccagct

SEQ ID NO: 75695 - DNA, 25 bp, Rattus norvegicus
acagcccatgaaacgcacggtgtca

SEQ ID NO: 75696 - DNA, 25 bp, Rattus norvegicus
acagcccatgaatcgcacggtgtca

SEQ ID NO: 75697 - DNA, 25 bp, Rattus norvegicus
acagcccatgctcaagagcttttga

SEQ ID NO: 75698 - DNA, 25 bp, Rattus norvegicus
acagcccatgctgaagagcttttga

SEQ ID NO: 75699 - DNA, 25 bp, Rattus norvegicus
acagcccatgttctttggcaagcag

SEQ ID NO: 75700 - DNA, 25 bp, Rattus norvegicus
acagcccatgttgtttggcaagcag

SEQ ID NO: 75701 - DNA, 25 bp, Rattus norvegicus
acagccccagacacaaggttgtata

SEQ ID NO: 75702 - DNA, 25 bp, Rattus norvegicus
acagccccagactcaaggttgtata

SEQ ID NO: 75703 - DNA, 25 bp, Rattus norvegicus
acagcccctctgaattgcagtgtgg

SEQ ID NO: 75704 - DNA, 25 bp, Rattus norvegicus
acagcccctctgtattgcagtgtgg

SEQ ID NO: 75705 - DNA, 25 bp, Rattus norvegicus
acagcccctcttcataggatatctg

SEQ ID NO: 75706 - DNA, 25 bp, Rattus norvegicus
acagcccctcttgataggatatctg

SEQ ID NO: 75707 - DNA, 25 bp, Rattus norvegicus
acagcccctgaaccactcagtggtg

SEQ ID NO: 75708 - DNA, 25 bp, Rattus norvegicus
acagcccctgaagcactcagtggtg

SEQ ID NO: 75709 - DNA, 25 bp, Rattus norvegicus
acagcccctgatcgtgactattgga

SEQ ID NO: 75710 - DNA, 25 bp, Rattus norvegicus
acagcccctgatggtgactattgga

SEQ ID NO: 75711 - DNA, 25 bp, Rattus norvegicus
acagcccgaaggaccagcatcaaaa

SEQ ID NO: 75712 - DNA, 25 bp, Rattus norvegicus
acagcccgaaggtccagcatcaaaa

SEQ ID NO: 75713 - DNA, 25 bp, Rattus norvegicus
acagcccgcgcaagtggcagaacag

SEQ ID NO: 75714 - DNA, 25 bp, Rattus norvegicus
acagcccgcgcatgtggcagaacag

SEQ ID NO: 75715 - DNA, 25 bp, Rattus norvegicus
acagcccggcggaaggatgccaaat

SEQ ID NO: 75716 - DNA, 25 bp, Rattus norvegicus
acagcccggcggtaggatgccaaat

SEQ ID NO: 75717 - DNA, 25 bp, Rattus norvegicus
acagccctaacaattgccaagtctt

SEQ ID NO: 75718 - DNA, 25 bp, Rattus norvegicus
acagccctaacatttgccaagtctt

SEQ ID NO: 75719 - DNA, 25 bp, Rattus norvegicus
acagccctagacatttgctttcggt

SEQ ID NO: 75720 - DNA, 25 bp, Rattus norvegicus
acagccctagacttttgctttcggt

SEQ ID NO: 75721 - DNA, 25 bp, Rattus norvegicus
acagccctcagcctggaacatgatg

SEQ ID NO: 75722 - DNA, 25 bp, Rattus norvegicus
acagccctcagcgtggaacatgatg

SEQ ID NO: 75723 - DNA, 25 bp, Rattus norvegicus
acagccctcctaaggccaagataga

SEQ ID NO: 75724 - DNA, 25 bp, Rattus norvegicus
acagccctcctatggccaagataga

SEQ ID NO: 75725 - DNA, 25 bp, Rattus norvegicus
acagccctcggaagacagaagcagt

SEQ ID NO: 75726 - DNA, 25 bp, Rattus norvegicus
acagccctcggatgacagaagcagt

SEQ ID NO: 75727 - DNA, 25 bp, Rattus norvegicus
acagccctcgggacaaattgggcca

SEQ ID NO: 75728 - DNA, 25 bp, Rattus norvegicus
acagccctcgggtcaaattgggcca

SEQ ID NO: 75729 - DNA, 25 bp, Rattus norvegicus
acagccctctgtaacaacagttcca

SEQ ID NO: 75730 - DNA, 25 bp, Rattus norvegicus
acagccctctgttacaacagttcca

SEQ ID NO: 75731 - DNA, 25 bp, Rattus norvegicus
acagccctgacacacatattactgc

SEQ ID NO: 75732 - DNA, 25 bp, Rattus norvegicus
acagccctgacagacatattactgc

SEQ ID NO: 75733 - DNA, 25 bp, Rattus norvegicus
acagccctgcctatattaagcacaa

SEQ ID NO: 75734 - DNA, 25 bp, Rattus norvegicus
acagccctgcctttattaagcacaa

SEQ ID NO: 75735 - DNA, 25 bp, Rattus norvegicus
acagccctggctattggcagaactt

SEQ ID NO: 75736 - DNA, 25 bp, Rattus norvegicus
acagccctggctcacaattttgcca

SEQ ID NO: 75737 - DNA, 25 bp, Rattus norvegicus
acagccctggctgacaattttgcca

SEQ ID NO: 75738 - DNA, 25 bp, Rattus norvegicus
acagccctggcttttggcagaactt

SEQ ID NO: 75739 - DNA, 25 bp, Rattus norvegicus
acagccctgggtcctagtcatgaat

SEQ ID NO: 75740 - DNA, 25 bp, Rattus norvegicus
acagccctgggtgctagtcatgaat

SEQ ID NO: 75741 - DNA, 25 bp, Rattus norvegicus
acagccctgtcactttcctgtaagt

SEQ ID NO: 75742 - DNA, 25 bp, Rattus norvegicus
acagccctgtcagtttcctgtaagt

SEQ ID NO: 75743 - DNA, 25 bp, Rattus norvegicus
acagccctgtccaagatgactgcta

SEQ ID NO: 75744 - DNA, 25 bp, Rattus norvegicus
acagccctgtcctagatgactgcta

SEQ ID NO: 75745 - DNA, 25 bp, Rattus norvegicus
acagccctgtttaaactctgtgggt

SEQ ID NO: 75746 - DNA, 25 bp, Rattus norvegicus
acagccctgttttaactctgtgggt

SEQ ID NO: 75747 - DNA, 25 bp, Rattus norvegicus
acagccgagcaaacaatctagcaaa

SEQ ID NO: 75748 - DNA, 25 bp, Rattus norvegicus
acagccgagcaatcaatctagcaaa

SEQ ID NO: 75749 - DNA, 25 bp, Rattus norvegicus
acagccgagtgtccaatcagtcact

SEQ ID NO: 75750 - DNA, 25 bp, Rattus norvegicus
acagccgagtgtgcaatcagtcact

SEQ ID NO: 75751 - DNA, 25 bp, Rattus norvegicus
acagccgatatcaacatgacattct

SEQ ID NO: 75752 - DNA, 25 bp, Rattus norvegicus
acagccgatatctacatgacattct

SEQ ID NO: 75753 - DNA, 25 bp, Rattus norvegicus
acagccgatccaccttaaatgccaa

SEQ ID NO: 75754 - DNA, 25 bp, Rattus norvegicus
acagccgatccagcttaaatgccaa

SEQ ID NO: 75755 - DNA, 25 bp, Rattus norvegicus
acagccgattgcaggtcagtggcag

SEQ ID NO: 75756 - DNA, 25 bp, Rattus norvegicus
acagccgattgctggtcagtggcag

SEQ ID NO: 75757 - DNA, 25 bp, Rattus norvegicus
acagccgccagtctctttaaggaga

SEQ ID NO: 75758 - DNA, 25 bp, Rattus norvegicus
acagccgccagtgtctttaaggaga

SEQ ID NO: 75759 - DNA, 25 bp, Rattus norvegicus
acagccgccattatgtagtgggtcc

SEQ ID NO: 75760 - DNA, 25 bp, Rattus norvegicus
acagccgccattttgtagtgggtcc

SEQ ID NO: 75761 - DNA, 25 bp, Rattus norvegicus
acagccgctctcacgaattcaagtc

SEQ ID NO: 75762 - DNA, 25 bp, Rattus norvegicus
acagccgctctctcgaattcaagtc

SEQ ID NO: 75763 - DNA, 25 bp, Rattus norvegicus
acagccgcttctagaagtctgactt

SEQ ID NO: 75764 - DNA, 25 bp, Rattus norvegicus
acagccgcttcttgaagtctgactt

SEQ ID NO: 75765 - DNA, 25 bp, Rattus norvegicus
acagccggaccgaggatcatgagtg

SEQ ID NO: 75766 - DNA, 25 bp, Rattus norvegicus
acagccggaccgtggatcatgagtg

SEQ ID NO: 75767 - DNA, 25 bp, Rattus norvegicus
acagccggagagagtactttctaca

SEQ ID NO: 75768 - DNA, 25 bp, Rattus norvegicus
acagccggagagtgtactttctaca

SEQ ID NO: 75769 - DNA, 25 bp, Rattus norvegicus
acagccggcatgcagagaccaccgt

SEQ ID NO: 75770 - DNA, 25 bp, Rattus norvegicus
acagccggcatggagagaccaccgt

SEQ ID NO: 75771 - DNA, 25 bp, Rattus norvegicus
acagccggctttcttatgatgccca

SEQ ID NO: 75772 - DNA, 25 bp, Rattus norvegicus
acagccggctttgttatgatgccca

SEQ ID NO: 75773 - DNA, 25 bp, Rattus norvegicus
acagccgggctcatttgtgtagaaa

SEQ ID NO: 75774 - DNA, 25 bp, Rattus norvegicus
acagccgggctcttttgtgtagaaa

SEQ ID NO: 75775 - DNA, 25 bp, Rattus norvegicus
acagccgtagaactctggtgcacgt

SEQ ID NO: 75776 - DNA, 25 bp, Rattus norvegicus
acagccgtagaagtctggtgcacgt

SEQ ID NO: 75777 - DNA, 25 bp, Rattus norvegicus
acagccgtagccacagcagaagccg

SEQ ID NO: 75778 - DNA, 25 bp, Rattus norvegicus
acagccgtagccctttatgttcttc

SEQ ID NO: 75779 - DNA, 25 bp, Rattus norvegicus
acagccgtagccgtttatgttcttc

SEQ ID NO: 75780 - DNA, 25 bp, Rattus norvegicus
acagccgtagcctcagcagaagccg

SEQ ID NO: 75781 - DNA, 25 bp, Rattus norvegicus
acagccgtagtcatggcggcgccgc

SEQ ID NO: 75782 - DNA, 25 bp, Rattus norvegicus
acagccgtagtcttggcggcgccgc

SEQ ID NO: 75783 - DNA, 25 bp, Rattus norvegicus
acagccgtcctgattcatcatgtga

SEQ ID NO: 75784 - DNA, 25 bp, Rattus norvegicus
acagccgtcctgtttcatcatgtga

SEQ ID NO: 75785 - DNA, 25 bp, Rattus norvegicus
acagccgtctgcatttcaaggaagg

SEQ ID NO: 75786 - DNA, 25 bp, Rattus norvegicus
acagccgtctgcttttcaaggaagg

SEQ ID NO: 75787 - DNA, 25 bp, Rattus norvegicus
acagccgtgacacgtgacacccata

SEQ ID NO: 75788 - DNA, 25 bp, Rattus norvegicus
acagccgtgacaggtgacacccata

SEQ ID NO: 75789 - DNA, 25 bp, Rattus norvegicus
acagccgtggagatggagatcgccc

SEQ ID NO: 75790 - DNA, 25 bp, Rattus norvegicus
acagccgtggagttggagatcgccc

SEQ ID NO: 75791 - DNA, 25 bp, Rattus norvegicus
acagccgttcagctgccagatggaa

SEQ ID NO: 75792 - DNA, 25 bp, Rattus norvegicus
acagccgttcaggtgccagatggaa

SEQ ID NO: 75793 - DNA, 25 bp, Rattus norvegicus
acagccgtttctctttcaggagaca

SEQ ID NO: 75794 - DNA, 25 bp, Rattus norvegicus
acagccgtttctgtttcaggagaca

SEQ ID NO: 75795 - DNA, 25 bp, Rattus norvegicus
acagcctaaaggattcccattatga

SEQ ID NO: 75796 - DNA, 25 bp, Rattus norvegicus
acagcctaaaggtttcccattatga

SEQ ID NO: 75797 - DNA, 25 bp, Rattus norvegicus
acagcctaactgaaagtcggttgtt

SEQ ID NO: 75798 - DNA, 25 bp, Rattus norvegicus
acagcctaactgatgtgccatgtct

SEQ ID NO: 75799 - DNA, 25 bp, Rattus norvegicus
acagcctaactgtaagtcggttgtt

SEQ ID NO: 75800 - DNA, 25 bp, Rattus norvegicus
acagcctaactgttgtgccatgtct

SEQ ID NO: 75801 - DNA, 25 bp, Rattus norvegicus
acagcctaatagcaccaacttcaga

SEQ ID NO: 75802 - DNA, 25 bp, Rattus norvegicus
acagcctaataggaccaacttcaga

SEQ ID NO: 75803 - DNA, 25 bp, Rattus norvegicus
acagcctagctgctggacttagttt

SEQ ID NO: 75804 - DNA, 25 bp, Rattus norvegicus
acagcctagctggtggacttagttt

SEQ ID NO: 75805 - DNA, 25 bp, Rattus norvegicus
acagcctaggacagggccgagttca

SEQ ID NO: 75806 - DNA, 25 bp, Rattus norvegicus
acagcctaggactgggccgagttca

SEQ ID NO: 75807 - DNA, 25 bp, Rattus norvegicus
acagcctagtcaaccatgacgtccg

SEQ ID NO: 75808 - DNA, 25 bp, Rattus norvegicus
acagcctagtcatccatgacgtccg

SEQ ID NO: 75809 - DNA, 25 bp, Rattus norvegicus
acagcctatgataagccgcttgcag

SEQ ID NO: 75810 - DNA, 25 bp, Rattus norvegicus
acagcctatgattagccgcttgcag

SEQ ID NO: 75811 - DNA, 25 bp, Rattus norvegicus
acagcctcaactaagcatggtggta

SEQ ID NO: 75812 - DNA, 25 bp, Rattus norvegicus
acagcctcaacttagcatggtggta

SEQ ID NO: 75813 - DNA, 25 bp, Rattus norvegicus
acagcctcaattccctagacgagaa

SEQ ID NO: 75814 - DNA, 25 bp, Rattus norvegicus
acagcctcaattgcctagacgagaa

SEQ ID NO: 75815 - DNA, 25 bp, Rattus norvegicus
acagcctcacaaccagcagctttga

SEQ ID NO: 75816 - DNA, 25 bp, Rattus norvegicus
acagcctcacaagcagcagctttga

SEQ ID NO: 75817 - DNA, 25 bp, Rattus norvegicus
acagcctcagagctagctgttccaa

SEQ ID NO: 75818 - DNA, 25 bp, Rattus norvegicus
acagcctcagaggtagctgttccaa

SEQ ID NO: 75819 - DNA, 25 bp, Rattus norvegicus
acagcctcagctacttttaaatcca

SEQ ID NO: 75820 - DNA, 25 bp, Rattus norvegicus
acagcctcagcttcttttaaatcca

SEQ ID NO: 75821 - DNA, 25 bp, Rattus norvegicus
acagcctcaggcactgaaccagagt

SEQ ID NO: 75822 - DNA, 25 bp, Rattus norvegicus
acagcctcaggctctgaaccagagt

SEQ ID NO: 75823 - DNA, 25 bp, Rattus norvegicus
acagcctcaggtaggagtgctcctt

SEQ ID NO: 75824 - DNA, 25 bp, Rattus norvegicus
acagcctcaggttggagtgctcctt

SEQ ID NO: 75825 - DNA, 25 bp, Rattus norvegicus
acagcctcatagaccttccttggat

SEQ ID NO: 75826 - DNA, 25 bp, Rattus norvegicus
acagcctcatagtccttccttggat

SEQ ID NO: 75827 - DNA, 25 bp, Rattus norvegicus
acagcctccaaaatgggtccctggg

SEQ ID NO: 75828 - DNA, 25 bp, Rattus norvegicus
acagcctccaaattgggtccctggg

SEQ ID NO: 75829 - DNA, 25 bp, Rattus norvegicus
acagcctccctacagagtttccaga

SEQ ID NO: 75830 - DNA, 25 bp, Rattus norvegicus
acagcctccctagagagtttccaga

SEQ ID NO: 75831 - DNA, 25 bp, Rattus norvegicus
acagcctccgagacttagcaatggt

SEQ ID NO: 75832 - DNA, 25 bp, Rattus norvegicus
acagcctccgagtcttagcaatggt

SEQ ID NO: 75833 - DNA, 25 bp, Rattus norvegicus
acagcctcctcactgaaggttgaca

SEQ ID NO: 75834 - DNA, 25 bp, Rattus norvegicus
acagcctcctcagtgaaggttgaca

SEQ ID NO: 75835 - DNA, 25 bp, Rattus norvegicus
acagcctcgcctctagtgtcagaat

SEQ ID NO: 75836 - DNA, 25 bp, Rattus norvegicus
acagcctcgcctgtagtgtcagaat

SEQ ID NO: 75837 - DNA, 25 bp, Rattus norvegicus
acagcctcgttcataagctctgggc

SEQ ID NO: 75838 - DNA, 25 bp, Rattus norvegicus
acagcctcgttcttaagctctgggc

SEQ ID NO: 75839 - DNA, 25 bp, Rattus norvegicus
acagcctctaggatggaaagtcacg

SEQ ID NO: 75840 - DNA, 25 bp, Rattus norvegicus
acagcctctaggttggaaagtcacg

SEQ ID NO: 75841 - DNA, 25 bp, Rattus norvegicus
acagcctctggcctttgttcttttt

SEQ ID NO: 75842 - DNA, 25 bp, Rattus norvegicus
acagcctctggcgtttgttcttttt

SEQ ID NO: 75843 - DNA, 25 bp, Rattus norvegicus
acagcctctgtacgtagagctgccc

SEQ ID NO: 75844 - DNA, 25 bp, Rattus norvegicus
acagcctctgtaggtagagctgccc

SEQ ID NO: 75845 - DNA, 25 bp, Rattus norvegicus
acagcctctgtcaggctgccatggc

SEQ ID NO: 75846 - DNA, 25 bp, Rattus norvegicus
acagcctctgtctggctgccatggc

SEQ ID NO: 75847 - DNA, 25 bp, Rattus norvegicus
acagcctcttccagatgaggatcct

SEQ ID NO: 75848 - DNA, 25 bp, Rattus norvegicus
acagcctcttcctgatgaggatcct

SEQ ID NO: 75849 - DNA, 25 bp, Rattus norvegicus
acagcctcttcgctatcctggaatt

SEQ ID NO: 75850 - DNA, 25 bp, Rattus norvegicus
acagcctcttcggtatcctggaatt

SEQ ID NO: 75851 - DNA, 25 bp, Rattus norvegicus
acagcctgaaagcagttctgtgggt

SEQ ID NO: 75852 - DNA, 25 bp, Rattus norvegicus
acagcctgaaaggagttctgtgggt

SEQ ID NO: 75853 - DNA, 25 bp, Rattus norvegicus
acagcctgacagagcatgaacgtgg

SEQ ID NO: 75854 - DNA, 25 bp, Rattus norvegicus
acagcctgacagtgcatgaacgtgg

SEQ ID NO: 75855 - DNA, 25 bp, Rattus norvegicus
acagcctgagctatgaggacttcct

SEQ ID NO: 75856 - DNA, 25 bp, Rattus norvegicus
acagcctgagctttgaggacttcct

SEQ ID NO: 75857 - DNA, 25 bp, Rattus norvegicus
acagcctgatgaccctaacagaggt

SEQ ID NO: 75858 - DNA, 25 bp, Rattus norvegicus
acagcctgatgagcctaacagaggt

SEQ ID NO: 75859 - DNA, 25 bp, Rattus norvegicus
acagcctgctctccataagtaaacg

SEQ ID NO: 75860 - DNA, 25 bp, Rattus norvegicus
acagcctgctctgcataagtaaacg

SEQ ID NO: 75861 - DNA, 25 bp, Rattus norvegicus
acagcctgcttcaaataccttcttt

SEQ ID NO: 75862 - DNA, 25 bp, Rattus norvegicus
acagcctgcttctaataccttcttt

SEQ ID NO: 75863 - DNA, 25 bp, Rattus norvegicus
acagcctggaggagtgcccagtgct

SEQ ID NO: 75864 - DNA, 25 bp, Rattus norvegicus
acagcctggaggtgtgcccagtgct

SEQ ID NO: 75865 - DNA, 25 bp, Rattus norvegicus
acagcctggcagctgtgcgttgaca

SEQ ID NO: 75866 - DNA, 25 bp, Rattus norvegicus
acagcctggcaggtgtgcgttgaca

SEQ ID NO: 75867 - DNA, 25 bp, Rattus norvegicus
acagcctgtccaatgctggagccct

SEQ ID NO: 75868 - DNA, 25 bp, Rattus norvegicus
acagcctgtccattgctggagccct

SEQ ID NO: 75869 - DNA, 25 bp, Rattus norvegicus
acagcctgtgaaccttgataactac

SEQ ID NO: 75870 - DNA, 25 bp, Rattus norvegicus
acagcctgtgaagcttgataactac

SEQ ID NO: 75871 - DNA, 25 bp, Rattus norvegicus
acagcctgtgctctcggattctgta

SEQ ID NO: 75872 - DNA, 25 bp, Rattus norvegicus
acagcctgtgctgtcggattctgta

SEQ ID NO: 75873 - DNA, 25 bp, Rattus norvegicus
acagcctgtgtcaagagagccatga

SEQ ID NO: 75874 - DNA, 25 bp, Rattus norvegicus
acagcctgtgtcagccaagagggta

SEQ ID NO: 75875 - DNA, 25 bp, Rattus norvegicus
acagcctgtgtctagagagccatga

SEQ ID NO: 75876 - DNA, 25 bp, Rattus norvegicus
acagcctgtgtctgccaagagggta

SEQ ID NO: 75877 - DNA, 25 bp, Rattus norvegicus
acagcctgttctcatggctgcagaa

SEQ ID NO: 75878 - DNA, 25 bp, Rattus norvegicus
acagcctgttctgatggctgcagaa

SEQ ID NO: 75879 - DNA, 25 bp, Rattus norvegicus
acagccttaccaactctgtgcagtg

SEQ ID NO: 75880 - DNA, 25 bp, Rattus norvegicus
acagccttaccatctctgtgcagtg

SEQ ID NO: 75881 - DNA, 25 bp, Rattus norvegicus
acagccttacttacgagagccttac

SEQ ID NO: 75882 - DNA, 25 bp, Rattus norvegicus
acagccttactttcgagagccttac

SEQ ID NO: 75883 - DNA, 25 bp, Rattus norvegicus
acagccttcctcaacagattcagaa

SEQ ID NO: 75884 - DNA, 25 bp, Rattus norvegicus
acagccttcctctacagattcagaa

SEQ ID NO: 75885 - DNA, 25 bp, Rattus norvegicus
acagccttcgtaagttggctcagct

SEQ ID NO: 75886 - DNA, 25 bp, Rattus norvegicus
acagccttcgtatgttggctcagct

SEQ ID NO: 75887 - DNA, 25 bp, Rattus norvegicus
acagccttctgtcagtatttcttat

SEQ ID NO: 75888 - DNA, 25 bp, Rattus norvegicus
acagccttctgtgagtatttcttat

SEQ ID NO: 75889 - DNA, 25 bp, Rattus norvegicus
acagccttcttaactccagtttcag

SEQ ID NO: 75890 - DNA, 25 bp, Rattus norvegicus
acagccttcttatctccagtttcag

SEQ ID NO: 75891 - DNA, 25 bp, Rattus norvegicus
acagccttgcctagtgaggatcata

SEQ ID NO: 75892 - DNA, 25 bp, Rattus norvegicus
acagccttgccttgtgaggatcata

SEQ ID NO: 75893 - DNA, 25 bp, Rattus norvegicus
acagccttggacaccggaaatcaca

SEQ ID NO: 75894 - DNA, 25 bp, Rattus norvegicus
acagccttggactccggaaatcaca

SEQ ID NO: 75895 - DNA, 25 bp, Rattus norvegicus
acagccttgtttcgagtcttgcctt

SEQ ID NO: 75896 - DNA, 25 bp, Rattus norvegicus
acagccttgtttggagtcttgcctt

SEQ ID NO: 75897 - DNA, 25 bp, Rattus norvegicus
acagcctttagacctcttcatgtgt

SEQ ID NO: 75898 - DNA, 25 bp, Rattus norvegicus
acagcctttagagctcttcatgtgt

SEQ ID NO: 75899 - DNA, 25 bp, Rattus norvegicus
acagcctttctgagatgaacatgtc

SEQ ID NO: 75900 - DNA, 25 bp, Rattus norvegicus
acagcctttctgtgatgaacatgtc

SEQ ID NO: 75901 - DNA, 25 bp, Rattus norvegicus
acagcctttgtaatgtgttaaccac

SEQ ID NO: 75902 - DNA, 25 bp, Rattus norvegicus
acagcctttgtattgtgttaaccac

SEQ ID NO: 75903 - DNA, 25 bp, Rattus norvegicus
acagcctttgtgactatagcaagct

SEQ ID NO: 75904 - DNA, 25 bp, Rattus norvegicus
acagcctttgtgtctatagcaagct

SEQ ID NO: 75905 - DNA, 25 bp, Rattus norvegicus
acagccttttaaaccaattcctggg

SEQ ID NO: 75906 - DNA, 25 bp, Rattus norvegicus
acagccttttaatccaattcctggg

SEQ ID NO: 75907 - DNA, 25 bp, Rattus norvegicus
acagccttttgcacgttgtgccaaa

SEQ ID NO: 75908 - DNA, 25 bp, Rattus norvegicus
acagccttttgctcgttgtgccaaa

SEQ ID NO: 75909 - DNA, 25 bp, Rattus norvegicus
acagcgacacggatccaagtacttg

SEQ ID NO: 75910 - DNA, 25 bp, Rattus norvegicus
acagcgacacggttccaagtacttg

SEQ ID NO: 75911 - DNA, 25 bp, Rattus norvegicus
acagcgacgtcaagcgcttctggaa

SEQ ID NO: 75912 - DNA, 25 bp, Rattus norvegicus
acagcgacgtcatgcgcttctggaa

SEQ ID NO: 75913 - DNA, 25 bp, Rattus norvegicus
acagcgactcgaacagcaacagcca

SEQ ID NO: 75914 - DNA, 25 bp, Rattus norvegicus
acagcgactcgatcagcaacagcca

SEQ ID NO: 75915 - DNA, 25 bp, Rattus norvegicus
acagcgagcctgagtctgagagcga

SEQ ID NO: 75916 - DNA, 25 bp, Rattus norvegicus
acagcgagcctgtgtctgagagcga

SEQ ID NO: 75917 - DNA, 25 bp, Rattus norvegicus
acagcgagcgctcgaaagccatcaa

SEQ ID NO: 75918 - DNA, 25 bp, Rattus norvegicus
acagcgagcgctggaaagccatcaa

SEQ ID NO: 75919 - DNA, 25 bp, Rattus norvegicus
acagcgaggactattgcacagccga

SEQ ID NO: 75920 - DNA, 25 bp, Rattus norvegicus
acagcgaggacttttgcacagccga

SEQ ID NO: 75921 - DNA, 25 bp, Rattus norvegicus
acagcgagggttactcgtggtgcct

SEQ ID NO: 75922 - DNA, 25 bp, Rattus norvegicus
acagcgagggtttctcgtggtgcct

SEQ ID NO: 75923 - DNA, 25 bp, Rattus norvegicus
acagcgagtcacacttgcacagctt

SEQ ID NO: 75924 - DNA, 25 bp, Rattus norvegicus
acagcgagtcactcttgcacagctt

SEQ ID NO: 75925 - DNA, 25 bp, Rattus norvegicus
acagcgagttctattattccaacac

SEQ ID NO: 75926 - DNA, 25 bp, Rattus norvegicus
acagcgagttcttttattccaacac

SEQ ID NO: 75927 - DNA, 25 bp, Rattus norvegicus
acagcgatcgctctagtacatttca

SEQ ID NO: 75928 - DNA, 25 bp, Rattus norvegicus
acagcgatcgctgtagtacatttca

SEQ ID NO: 75929 - DNA, 25 bp, Rattus norvegicus
acagcgatctgtaccactctctggc

SEQ ID NO: 75930 - DNA, 25 bp, Rattus norvegicus
acagcgatctgttccactctctggc

SEQ ID NO: 75931 - DNA, 25 bp, Rattus norvegicus
acagcgatgtcactggtctcttctc

SEQ ID NO: 75932 - DNA, 25 bp, Rattus norvegicus
acagcgatgtcagtggtctcttctc

SEQ ID NO: 75933 - DNA, 25 bp, Rattus norvegicus
acagcgatgttgatgcgctcgcgtc

SEQ ID NO: 75934 - DNA, 25 bp, Rattus norvegicus
acagcgatgttgttgcgctcgcgtc

SEQ ID NO: 75935 - DNA, 25 bp, Rattus norvegicus
acagcgatgtttccaaacccatatg

SEQ ID NO: 75936 - DNA, 25 bp, Rattus norvegicus
acagcgatgtttgcaaacccatatg

SEQ ID NO: 75937 - DNA, 25 bp, Rattus norvegicus
acagcgcagagaacctggcagccta

SEQ ID NO: 75938 - DNA, 25 bp, Rattus norvegicus
acagcgcagagatcctggcagccta

SEQ ID NO: 75939 - DNA, 25 bp, Rattus norvegicus
acagcgcagcacacttagttctcaa

SEQ ID NO: 75940 - DNA, 25 bp, Rattus norvegicus
acagcgcagcactcttagttctcaa

SEQ ID NO: 75941 - DNA, 25 bp, Rattus norvegicus
acagcgccaggtccttcgatcagag

SEQ ID NO: 75942 - DNA, 25 bp, Rattus norvegicus
acagcgccaggtgcttcgatcagag

SEQ ID NO: 75943 - DNA, 25 bp, Rattus norvegicus
acagcgcccatcaggaaccagaagg

SEQ ID NO: 75944 - DNA, 25 bp, Rattus norvegicus
acagcgcccatctggaaccagaagg

SEQ ID NO: 75945 - DNA, 25 bp, Rattus norvegicus
acagcgcctgggaagggccatcctt

SEQ ID NO: 75946 - DNA, 25 bp, Rattus norvegicus
acagcgcctgggtagggccatcctt

SEQ ID NO: 75947 - DNA, 25 bp, Rattus norvegicus
acagcgccttacctgtctgcaaaca

SEQ ID NO: 75948 - DNA, 25 bp, Rattus norvegicus
acagcgccttacgtgtctgcaaaca

SEQ ID NO: 75949 - DNA, 25 bp, Rattus norvegicus
acagcgccttcacatgtctcagtta

SEQ ID NO: 75950 - DNA, 25 bp, Rattus norvegicus
acagcgccttcagatgtctcagtta

SEQ ID NO: 75951 - DNA, 25 bp, Rattus norvegicus
acagcgcgcggaagttgtgcagctc

SEQ ID NO: 75952 - DNA, 25 bp, Rattus norvegicus
acagcgcgcggatgttgtgcagctc

SEQ ID NO: 75953 - DNA, 25 bp, Rattus norvegicus
acagcgcgctgtagtgaaccttttg

SEQ ID NO: 75954 - DNA, 25 bp, Rattus norvegicus
acagcgcgctgttgtgaaccttttg

SEQ ID NO: 75955 - DNA, 25 bp, Rattus norvegicus
acagcgctacatagctaacctaggg

SEQ ID NO: 75956 - DNA, 25 bp, Rattus norvegicus
acagcgctacattgctaacctaggg

SEQ ID NO: 75957 - DNA, 25 bp, Rattus norvegicus
acagcgctctggcatggtgcagaca

SEQ ID NO: 75958 - DNA, 25 bp, Rattus norvegicus
acagcgctctgggatggtgcagaca

SEQ ID NO: 75959 - DNA, 25 bp, Rattus norvegicus
acagcgctctgtcctagtggcagca

SEQ ID NO: 75960 - DNA, 25 bp, Rattus norvegicus
acagcgctctgtgctagtggcagca

SEQ ID NO: 75961 - DNA, 25 bp, Rattus norvegicus
acagcgctgcagaaggcccatggtg

SEQ ID NO: 75962 - DNA, 25 bp, Rattus norvegicus
acagcgctgcagagcctgccaggtt

SEQ ID NO: 75963 - DNA, 25 bp, Rattus norvegicus
acagcgctgcagtaggcccatggtg

SEQ ID NO: 75964 - DNA, 25 bp, Rattus norvegicus
acagcgctgcagtgcctgccaggtt

SEQ ID NO: 75965 - DNA, 25 bp, Rattus norvegicus
acagcgctggctcacaagtcggtgc

SEQ ID NO: 75966 - DNA, 25 bp, Rattus norvegicus
acagcgctggctgacaagtcggtgc

SEQ ID NO: 75967 - DNA, 25 bp, Rattus norvegicus
acagcgcttctgctctatagagaca

SEQ ID NO: 75968 - DNA, 25 bp, Rattus norvegicus
acagcgcttctggtctatagagaca

SEQ ID NO: 75969 - DNA, 25 bp, Rattus norvegicus
acagcgcttgctcatctgagtcctg

SEQ ID NO: 75970 - DNA, 25 bp, Rattus norvegicus
acagcgcttgctgatctgagtcctg

SEQ ID NO: 75971 - DNA, 25 bp, Rattus norvegicus
acagcgctttgtaagcttttccaga

SEQ ID NO: 75972 - DNA, 25 bp, Rattus norvegicus
acagcgctttgttagcttttccaga

SEQ ID NO: 75973 - DNA, 25 bp, Rattus norvegicus
acagcggagcacagagactgccctg

SEQ ID NO: 75974 - DNA, 25 bp, Rattus norvegicus
acagcggagcactgagactgccctg

SEQ ID NO: 75975 - DNA, 25 bp, Rattus norvegicus
acagcggagctgatcctttctggga

SEQ ID NO: 75976 - DNA, 25 bp, Rattus norvegicus
acagcggagctgttcctttctggga

SEQ ID NO: 75977 - DNA, 25 bp, Rattus norvegicus
acagcggatgtcactaattttggca

SEQ ID NO: 75978 - DNA, 25 bp, Rattus norvegicus
acagcggatgtctctaattttggca

SEQ ID NO: 75979 - DNA, 25 bp, Rattus norvegicus
acagcggcacgcacagaatgggcgc

SEQ ID NO: 75980 - DNA, 25 bp, Rattus norvegicus
acagcggcacgctcagaatgggcgc

SEQ ID NO: 75981 - DNA, 25 bp, Rattus norvegicus
acagcggcatttcaagtccatgagt

SEQ ID NO: 75982 - DNA, 25 bp, Rattus norvegicus
acagcggcatttgaagtccatgagt

SEQ ID NO: 75983 - DNA, 25 bp, Rattus norvegicus
acagcggcgtggacaggtagcacaa

SEQ ID NO: 75984 - DNA, 25 bp, Rattus norvegicus
acagcggcgtggtcaggtagcacaa

SEQ ID NO: 75985 - DNA, 25 bp, Rattus norvegicus
acagcggctttcagcttgtgaagtc

SEQ ID NO: 75986 - DNA, 25 bp, Rattus norvegicus
acagcggctttctgcttgtgaagtc

SEQ ID NO: 75987 - DNA, 25 bp, Rattus norvegicus
acagcggtaagaacgtgatcaacgt

SEQ ID NO: 75988 - DNA, 25 bp, Rattus norvegicus
acagcggtaagatcgtgatcaacgt

SEQ ID NO: 75989 - DNA, 25 bp, Rattus norvegicus
acagcggtccggcaggcagcagcag

SEQ ID NO: 75990 - DNA, 25 bp, Rattus norvegicus
acagcggtccgggaggcagcagcag

SEQ ID NO: 75991 - DNA, 25 bp, Rattus norvegicus
acagcggtggccacagtttctcaaa

SEQ ID NO: 75992 - DNA, 25 bp, Rattus norvegicus
acagcggtggcctcagtttctcaaa

SEQ ID NO: 75993 - DNA, 25 bp, Rattus norvegicus
acagcgtaaggacaccacagcttat

SEQ ID NO: 75994 - DNA, 25 bp, Rattus norvegicus
acagcgtaaggagaccacagcttat

SEQ ID NO: 75995 - DNA, 25 bp, Rattus norvegicus
acagcgtaagtgaggacatcattcc

SEQ ID NO: 75996 - DNA, 25 bp, Rattus norvegicus
acagcgtaagtgtggacatcattcc

SEQ ID NO: 75997 - DNA, 25 bp, Rattus norvegicus
acagcgtatatccaatcacatttta

SEQ ID NO: 75998 - DNA, 25 bp, Rattus norvegicus
acagcgtatatcgaatcacatttta

SEQ ID NO: 75999 - DNA, 25 bp, Rattus norvegicus
acagcgtattgtcctctgtgatggg

SEQ ID NO: 76000 - DNA, 25 bp, Rattus norvegicus
acagcgtattgtgctctgtgatggg

SEQ ID NO: 76001 - DNA, 25 bp, Rattus norvegicus
acagcgtccgcaccgtgttcaagga

SEQ ID NO: 76002 - DNA, 25 bp, Rattus norvegicus
acagcgtccgcagcgtgttcaagga

SEQ ID NO: 76003 - DNA, 25 bp, Rattus norvegicus
acagcgtcttttaaactttcaggag

SEQ ID NO: 76004 - DNA, 25 bp, Rattus norvegicus
acagcgtctttttaactttcaggag

SEQ ID NO: 76005 - DNA, 25 bp, Rattus norvegicus
acagcgtgaattacccactgctttt

SEQ ID NO: 76006 - DNA, 25 bp, Rattus norvegicus
acagcgtgaatttcccactgctttt

SEQ ID NO: 76007 - DNA, 25 bp, Rattus norvegicus
acagcgtgaggaagagtgccctgac

SEQ ID NO: 76008 - DNA, 25 bp, Rattus norvegicus
acagcgtgaggatgagtgccctgac

SEQ ID NO: 76009 - DNA, 25 bp, Rattus norvegicus
acagcgtgcaaacctcagggtctaa

SEQ ID NO: 76010 - DNA, 25 bp, Rattus norvegicus
acagcgtgcaaagctcagggtctaa

SEQ ID NO: 76011 - DNA, 25 bp, Rattus norvegicus
acagcgtgcaagatacgatttgtgc

SEQ ID NO: 76012 - DNA, 25 bp, Rattus norvegicus
acagcgtgcaagttacgatttgtgc

SEQ ID NO: 76013 - DNA, 25 bp, Rattus norvegicus
acagcgtgcaccaggaccattagga

SEQ ID NO: 76014 - DNA, 25 bp, Rattus norvegicus
acagcgtgcacctggaccattagga

SEQ ID NO: 76015 - DNA, 25 bp, Rattus norvegicus
acagcgtgccaccttgcgaaaagaa

SEQ ID NO: 76016 - DNA, 25 bp, Rattus norvegicus
acagcgtgccacgttgcgaaaagaa

SEQ ID NO: 76017 - DNA, 25 bp, Rattus norvegicus
acagcgtgctcaaacacggttcatg

SEQ ID NO: 76018 - DNA, 25 bp, Rattus norvegicus
acagcgtgctcatacacggttcatg

SEQ ID NO: 76019 - DNA, 25 bp, Rattus norvegicus
acagcgtggagcagtacacagcctt

SEQ ID NO: 76020 - DNA, 25 bp, Rattus norvegicus
acagcgtggagctgtacacagcctt

SEQ ID NO: 76021 - DNA, 25 bp, Rattus norvegicus
acagcgtggctgagtaactgcccaa

SEQ ID NO: 76022 - DNA, 25 bp, Rattus norvegicus
acagcgtggctgtgtaactgcccaa

SEQ ID NO: 76023 - DNA, 25 bp, Rattus norvegicus
acagcgtgggccaaccagtgtctaa

SEQ ID NO: 76024 - DNA, 25 bp, Rattus norvegicus
acagcgtgggcctaccagtgtctaa

SEQ ID NO: 76025 - DNA, 25 bp, Rattus norvegicus
acagcgtggtccctttcgtagggct

SEQ ID NO: 76026 - DNA, 25 bp, Rattus norvegicus
acagcgtggtccgtttcgtagggct

SEQ ID NO: 76027 - DNA, 25 bp, Rattus norvegicus
acagcgtgtcaccttgttcagacag

SEQ ID NO: 76028 - DNA, 25 bp, Rattus norvegicus
acagcgtgtcacgttgttcagacag

SEQ ID NO: 76029 - DNA, 25 bp, Rattus norvegicus
acagcgtgttggctttctggaaaca

SEQ ID NO: 76030 - DNA, 25 bp, Rattus norvegicus
acagcgtgttgggtttctggaaaca

SEQ ID NO: 76031 - DNA, 25 bp, Rattus norvegicus
acagcgttatcccacagattcagaa

SEQ ID NO: 76032 - DNA, 25 bp, Rattus norvegicus
acagcgttatccgacagattcagaa

SEQ ID NO: 76033 - DNA, 25 bp, Rattus norvegicus
acagcgttctgtacctacggactaa

SEQ ID NO: 76034 - DNA, 25 bp, Rattus norvegicus
acagcgttctgtcaatgacctcacc

SEQ ID NO: 76035 - DNA, 25 bp, Rattus norvegicus
acagcgttctgtgaatgacctcacc

SEQ ID NO: 76036 - DNA, 25 bp, Rattus norvegicus
acagcgttctgttcctacggactaa

SEQ ID NO: 76037 - DNA, 25 bp, Rattus norvegicus
acagcgtttgacaccgtgttgacct

SEQ ID NO: 76038 - DNA, 25 bp, Rattus norvegicus
acagcgtttgactccgtgttgacct

SEQ ID NO: 76039 - DNA, 25 bp, Rattus norvegicus
acagcgtttggtcttgattcgagcg

SEQ ID NO: 76040 - DNA, 25 bp, Rattus norvegicus
acagcgtttggtgttgattcgagcg

SEQ ID NO: 76041 - DNA, 25 bp, Rattus norvegicus
acagcgtttttgcaaagcatagctt

SEQ ID NO: 76042 - DNA, 25 bp, Rattus norvegicus
acagcgtttttggaaagcatagctt

SEQ ID NO: 76043 - DNA, 25 bp, Rattus norvegicus
acagctaaagctcttgccagttgaa

SEQ ID NO: 76044 - DNA, 25 bp, Rattus norvegicus
acagctaaagctgttgccagttgaa

SEQ ID NO: 76045 - DNA, 25 bp, Rattus norvegicus
acagctaataatcggcttctccgca

SEQ ID NO: 76046 - DNA, 25 bp, Rattus norvegicus
acagctaataatgggcttctccgca

SEQ ID NO: 76047 - DNA, 25 bp, Rattus norvegicus
acagctaatgtgctcttccttggca

SEQ ID NO: 76048 - DNA, 25 bp, Rattus norvegicus
acagctaatgtggtcttccttggca

SEQ ID NO: 76049 - DNA, 25 bp, Rattus norvegicus
acagctaccatgagggccctgcaga

SEQ ID NO: 76050 - DNA, 25 bp, Rattus norvegicus
acagctaccatgtgggccctgcaga

SEQ ID NO: 76051 - DNA, 25 bp, Rattus norvegicus
acagctaccctcagtatggctatac

SEQ ID NO: 76052 - DNA, 25 bp, Rattus norvegicus
acagctaccctctgtatggctatac

SEQ ID NO: 76053 - DNA, 25 bp, Rattus norvegicus
acagctacctacatgttgggttaga

SEQ ID NO: 76054 - DNA, 25 bp, Rattus norvegicus
acagctacctacttgttgggttaga

SEQ ID NO: 76055 - DNA, 25 bp, Rattus norvegicus
acagctacctgtagcgctagctcta

SEQ ID NO: 76056 - DNA, 25 bp, Rattus norvegicus
acagctacctgttgcgctagctcta

SEQ ID NO: 76057 - DNA, 25 bp, Rattus norvegicus
acagctacggataatacagaagtca

SEQ ID NO: 76058 - DNA, 25 bp, Rattus norvegicus
acagctacggattatacagaagtca

SEQ ID NO: 76059 - DNA, 25 bp, Rattus norvegicus
acagctacgggcactttggcgttga

SEQ ID NO: 76060 - DNA, 25 bp, Rattus norvegicus
acagctacgggctctttggcgttga

SEQ ID NO: 76061 - DNA, 25 bp, Rattus norvegicus
acagctactactacccggcggcggg

SEQ ID NO: 76062 - DNA, 25 bp, Rattus norvegicus
acagctactacttcccggcggcggg

SEQ ID NO: 76063 - DNA, 25 bp, Rattus norvegicus
acagctagaacgctctttggcactc

SEQ ID NO: 76064 - DNA, 25 bp, Rattus norvegicus
acagctagaacggtctttggcactc

SEQ ID NO: 76065 - DNA, 25 bp, Rattus norvegicus
acagctagaccgaggactgtcgcgg

SEQ ID NO: 76066 - DNA, 25 bp, Rattus norvegicus
acagctagaccgtggactgtcgcgg

SEQ ID NO: 76067 - DNA, 25 bp, Rattus norvegicus
acagctagcagtctaccttgtgcaa

SEQ ID NO: 76068 - DNA, 25 bp, Rattus norvegicus
acagctagcagtgtaccttgtgcaa

SEQ ID NO: 76069 - DNA, 25 bp, Rattus norvegicus
acagctagctatccaaggactgaaa

SEQ ID NO: 76070 - DNA, 25 bp, Rattus norvegicus
acagctagctatgcaaggactgaaa

SEQ ID NO: 76071 - DNA, 25 bp, Rattus norvegicus
acagctaggttcatcatggagtcag

SEQ ID NO: 76072 - DNA, 25 bp, Rattus norvegicus
acagctaggttcttcatggagtcag

SEQ ID NO: 76073 - DNA, 25 bp, Rattus norvegicus
acagctagtagccttcactcatttg

SEQ ID NO: 76074 - DNA, 25 bp, Rattus norvegicus
acagctagtagcgttcactcatttg

SEQ ID NO: 76075 - DNA, 25 bp, Rattus norvegicus
acagctatagtgacaccatgcctca

SEQ ID NO: 76076 - DNA, 25 bp, Rattus norvegicus
acagctatagtgtcaccatgcctca

SEQ ID NO: 76077 - DNA, 25 bp, Rattus norvegicus
acagctatattaaggctagccacaa

SEQ ID NO: 76078 - DNA, 25 bp, Rattus norvegicus
acagctatattatggctagccacaa

SEQ ID NO: 76079 - DNA, 25 bp, Rattus norvegicus
acagctatgaggaactacggtgtca

SEQ ID NO: 76080 - DNA, 25 bp, Rattus norvegicus
acagctatgaggtactacggtgtca

SEQ ID NO: 76081 - DNA, 25 bp, Rattus norvegicus
acagctatgtgaactggtggtccac

SEQ ID NO: 76082 - DNA, 25 bp, Rattus norvegicus
acagctatgtgatctggtggtccac

SEQ ID NO: 76083 - DNA, 25 bp, Rattus norvegicus
acagctatgtgcctttttgccaaag

SEQ ID NO: 76084 - DNA, 25 bp, Rattus norvegicus
acagctatgtgcgtttttgccaaag

SEQ ID NO: 76085 - DNA, 25 bp, Rattus norvegicus
acagctatttcacttcttggactca

SEQ ID NO: 76086 - DNA, 25 bp, Rattus norvegicus
acagctatttcagttcttggactca

SEQ ID NO: 76087 - DNA, 25 bp, Rattus norvegicus
acagctcactggcaggtgttatcaa

SEQ ID NO: 76088 - DNA, 25 bp, Rattus norvegicus
acagctcactgggaggtgttatcaa

SEQ ID NO: 76089 - DNA, 25 bp, Rattus norvegicus
acagctcagaccacagagattcgtg

SEQ ID NO: 76090 - DNA, 25 bp, Rattus norvegicus
acagctcagacctcagagattcgtg

SEQ ID NO: 76091 - DNA, 25 bp, Rattus norvegicus
acagctcagagaatcagtccatttt

SEQ ID NO: 76092 - DNA, 25 bp, Rattus norvegicus
acagctcagagattcagtccatttt

SEQ ID NO: 76093 - DNA, 25 bp, Rattus norvegicus
acagctcagctaaggcgttactcag

SEQ ID NO: 76094 - DNA, 25 bp, Rattus norvegicus
acagctcagctatggcgttactcag

SEQ ID NO: 76095 - DNA, 25 bp, Rattus norvegicus
acagctcagctgcatgtgtttgctc

SEQ ID NO: 76096 - DNA, 25 bp, Rattus norvegicus
acagctcagctggatgtgtttgctc

SEQ ID NO: 76097 - DNA, 25 bp, Rattus norvegicus
acagctcagtacaagtgcccagtgg

SEQ ID NO: 76098 - DNA, 25 bp, Rattus norvegicus
acagctcagtactagtgcccagtgg

SEQ ID NO: 76099 - DNA, 25 bp, Rattus norvegicus
acagctcagtatccataaggcccta

SEQ ID NO: 76100 - DNA, 25 bp, Rattus norvegicus
acagctcagtatgcataaggcccta

SEQ ID NO: 76101 - DNA, 25 bp, Rattus norvegicus
acagctcatctgagtgtactccagg

SEQ ID NO: 76102 - DNA, 25 bp, Rattus norvegicus
acagctcatctgtgtgtactccagg

SEQ ID NO: 76103 - DNA, 25 bp, Rattus norvegicus
acagctcatgttaggtaactgctaa

SEQ ID NO: 76104 - DNA, 25 bp, Rattus norvegicus
acagctcatgtttggtaactgctaa

SEQ ID NO: 76105 - DNA, 25 bp, Rattus norvegicus
acagctcccactcagaagtcactgg

SEQ ID NO: 76106 - DNA, 25 bp, Rattus norvegicus
acagctcccactgagaagtcactgg

SEQ ID NO: 76107 - DNA, 25 bp, Rattus norvegicus
acagctccccagagaaagtgctttt

SEQ ID NO: 76108 - DNA, 25 bp, Rattus norvegicus
acagctccccagtgaaagtgctttt

SEQ ID NO: 76109 - DNA, 25 bp, Rattus norvegicus
acagctcccctgaaacccaagagaa

SEQ ID NO: 76110 - DNA, 25 bp, Rattus norvegicus
acagctcccctgtaacccaagagaa

SEQ ID NO: 76111 - DNA, 25 bp, Rattus norvegicus
acagctcccgtcctctggctttggt

SEQ ID NO: 76112 - DNA, 25 bp, Rattus norvegicus
acagctcccgtcgtctggctttggt

SEQ ID NO: 76113 - DNA, 25 bp, Rattus norvegicus
acagctcccttgaggatttctagtg

SEQ ID NO: 76114 - DNA, 25 bp, Rattus norvegicus
acagctcccttgtggatttctagtg

SEQ ID NO: 76115 - DNA, 25 bp, Rattus norvegicus
acagctcctccaaaagcagtcacaa

SEQ ID NO: 76116 - DNA, 25 bp, Rattus norvegicus
acagctcctccataagcagtcacaa

SEQ ID NO: 76117 - DNA, 25 bp, Rattus norvegicus
acagctcctgccacaagtgtgcaga

SEQ ID NO: 76118 - DNA, 25 bp, Rattus norvegicus
acagctcctgcctcaagtgtgcaga

SEQ ID NO: 76119 - DNA, 25 bp, Rattus norvegicus
acagctcctgctcatggttaccact

SEQ ID NO: 76120 - DNA, 25 bp, Rattus norvegicus
acagctcctgctgatggttaccact

SEQ ID NO: 76121 - DNA, 25 bp, Rattus norvegicus
acagctcctggtcttctgcgttttg

SEQ ID NO: 76122 - DNA, 25 bp, Rattus norvegicus
acagctcctggtgttctgcgttttg

SEQ ID NO: 76123 - DNA, 25 bp, Rattus norvegicus
acagctcctgtcactactgagattt

SEQ ID NO: 76124 - DNA, 25 bp, Rattus norvegicus
acagctcctgtctctactgagattt

SEQ ID NO: 76125 - DNA, 25 bp, Rattus norvegicus
acagctccttccagtggagaccaat

SEQ ID NO: 76126 - DNA, 25 bp, Rattus norvegicus
acagctccttcctgtggagaccaat

SEQ ID NO: 76127 - DNA, 25 bp, Rattus norvegicus
acagctcgagacagtgcctttcaca

SEQ ID NO: 76128 - DNA, 25 bp, Rattus norvegicus
acagctcgagactgtgcctttcaca

SEQ ID NO: 76129 - DNA, 25 bp, Rattus norvegicus
acagctcgaggcctggctcatgtac

SEQ ID NO: 76130 - DNA, 25 bp, Rattus norvegicus
acagctcgaggcgtggctcatgtac

SEQ ID NO: 76131 - DNA, 25 bp, Rattus norvegicus
acagctcgatgtacttcagtaagtt

SEQ ID NO: 76132 - DNA, 25 bp, Rattus norvegicus
acagctcgatgttcttcagtaagtt

SEQ ID NO: 76133 - DNA, 25 bp, Rattus norvegicus
acagctcgctgaaccctgttatcta

SEQ ID NO: 76134 - DNA, 25 bp, Rattus norvegicus
acagctcgctgatccctgttatcta

SEQ ID NO: 76135 - DNA, 25 bp, Rattus norvegicus
acagctcgtcagagcatccgtgctt

SEQ ID NO: 76136 - DNA, 25 bp, Rattus norvegicus
acagctcgtcagtgcatccgtgctt

SEQ ID NO: 76137 - DNA, 25 bp, Rattus norvegicus
acagctcgtcgtcctcagaagatga

SEQ ID NO: 76138 - DNA, 25 bp, Rattus norvegicus
acagctcgtcgtgctcagaagatga

SEQ ID NO: 76139 - DNA, 25 bp, Rattus norvegicus
acagctctaaaacaccaagccctag

SEQ ID NO: 76140 - DNA, 25 bp, Rattus norvegicus
acagctctaaaagaccaagccctag

SEQ ID NO: 76141 - DNA, 25 bp, Rattus norvegicus
acagctctacctaggcttgtggaaa

SEQ ID NO: 76142 - DNA, 25 bp, Rattus norvegicus
acagctctaccttggcttgtggaaa

SEQ ID NO: 76143 - DNA, 25 bp, Rattus norvegicus
acagctctcagactacaaccggatt

SEQ ID NO: 76144 - DNA, 25 bp, Rattus norvegicus
acagctctcagagtacaaccggatt

SEQ ID NO: 76145 - DNA, 25 bp, Rattus norvegicus
acagctctcagtccaaactgtccta

SEQ ID NO: 76146 - DNA, 25 bp, Rattus norvegicus
acagctctcagtcttactacgtttt

SEQ ID NO: 76147 - DNA, 25 bp, Rattus norvegicus
acagctctcagtgcaaactgtccta

SEQ ID NO: 76148 - DNA, 25 bp, Rattus norvegicus
acagctctcagtgttactacgtttt

SEQ ID NO: 76149 - DNA, 25 bp, Rattus norvegicus
acagctctccccaggtggtatgagg

SEQ ID NO: 76150 - DNA, 25 bp, Rattus norvegicus
acagctctcccctggtggtatgagg

SEQ ID NO: 76151 - DNA, 25 bp, Rattus norvegicus
acagctctccttccaaatcatgtgg

SEQ ID NO: 76152 - DNA, 25 bp, Rattus norvegicus
acagctctccttgcaaatcatgtgg

SEQ ID NO: 76153 - DNA, 25 bp, Rattus norvegicus
acagctctctcacgatgggcacaga

SEQ ID NO: 76154 - DNA, 25 bp, Rattus norvegicus
acagctctctcaggatgggcacaga

SEQ ID NO: 76155 - DNA, 25 bp, Rattus norvegicus
acagctctcttcactgaggaaataa

SEQ ID NO: 76156 - DNA, 25 bp, Rattus norvegicus
acagctctcttctctgaggaaataa

SEQ ID NO: 76157 - DNA, 25 bp, Rattus norvegicus
acagctctgagccagccaagaagaa

SEQ ID NO: 76158 - DNA, 25 bp, Rattus norvegicus
acagctctgagcgagccaagaagaa

SEQ ID NO: 76159 - DNA, 25 bp, Rattus norvegicus
acagctctgcagaagcccgtggaaa

SEQ ID NO: 76160 - DNA, 25 bp, Rattus norvegicus
acagctctgcagtagcccgtggaaa

SEQ ID NO: 76161 - DNA, 25 bp, Rattus norvegicus
acagctctgctcatacacattcgtc

SEQ ID NO: 76162 - DNA, 25 bp, Rattus norvegicus
acagctctgctcttacacattcgtc

SEQ ID NO: 76163 - DNA, 25 bp, Rattus norvegicus
acagctctgctgacgtctgcaggtg

SEQ ID NO: 76164 - DNA, 25 bp, Rattus norvegicus
acagctctgctgtcgtctgcaggtg

SEQ ID NO: 76165 - DNA, 25 bp, Rattus norvegicus
acagctctggagaagtgccacacca

SEQ ID NO: 76166 - DNA, 25 bp, Rattus norvegicus
acagctctggagtagtgccacacca

SEQ ID NO: 76167 - DNA, 25 bp, Rattus norvegicus
acagctctggatacactgtgcggtg

SEQ ID NO: 76168 - DNA, 25 bp, Rattus norvegicus
acagctctggattcactgtgcggtg

SEQ ID NO: 76169 - DNA, 25 bp, Rattus norvegicus
acagctctgggacagtcaggtttca

SEQ ID NO: 76170 - DNA, 25 bp, Rattus norvegicus
acagctctgggagagtcaggtttca

SEQ ID NO: 76171 - DNA, 25 bp, Rattus norvegicus
acagctctgtggaaaacagccccag

SEQ ID NO: 76172 - DNA, 25 bp, Rattus norvegicus
acagctctgtggaacagtctgtgcc

SEQ ID NO: 76173 - DNA, 25 bp, Rattus norvegicus
acagctctgtggtaaacagccccag

SEQ ID NO: 76174 - DNA, 25 bp, Rattus norvegicus
acagctctgtggtacagtctgtgcc

SEQ ID NO: 76175 - DNA, 25 bp, Rattus norvegicus
acagctcttattcctttgtgttcta

SEQ ID NO: 76176 - DNA, 25 bp, Rattus norvegicus
acagctcttattgctttgtgttcta

SEQ ID NO: 76177 - DNA, 25 bp, Rattus norvegicus
acagctcttcttatatgcttatggc

SEQ ID NO: 76178 - DNA, 25 bp, Rattus norvegicus
acagctcttcttttatgcttatggc

SEQ ID NO: 76179 - DNA, 25 bp, Rattus norvegicus
acagctcttgttctttgttagataa

SEQ ID NO: 76180 - DNA, 25 bp, Rattus norvegicus
acagctcttgttgtttgttagataa

SEQ ID NO: 76181 - DNA, 25 bp, Rattus norvegicus
acagctctttcacatgatgctcaag

SEQ ID NO: 76182 - DNA, 25 bp, Rattus norvegicus
acagctctttcagatgatgctcaag

SEQ ID NO: 76183 - DNA, 25 bp, Rattus norvegicus
acagctctttttcttggctcatcag

SEQ ID NO: 76184 - DNA, 25 bp, Rattus norvegicus
acagctctttttgttggctcatcag

SEQ ID NO: 76185 - DNA, 25 bp, Rattus norvegicus
acagctgacactagggcccgatttg

SEQ ID NO: 76186 - DNA, 25 bp, Rattus norvegicus
acagctgacacttgggcccgatttg

SEQ ID NO: 76187 - DNA, 25 bp, Rattus norvegicus
acagctgacagactccaacagaagt

SEQ ID NO: 76188 - DNA, 25 bp, Rattus norvegicus
acagctgacagagtccaacagaagt

SEQ ID NO: 76189 - DNA, 25 bp, Rattus norvegicus
acagctgaccaccttttcctgaagg

SEQ ID NO: 76190 - DNA, 25 bp, Rattus norvegicus
acagctgaccacgttttcctgaagg

SEQ ID NO: 76191 - DNA, 25 bp, Rattus norvegicus
acagctgacccgagggtgctctggt

SEQ ID NO: 76192 - DNA, 25 bp, Rattus norvegicus
acagctgacccgtgggtgctctggt

SEQ ID NO: 76193 - DNA, 25 bp, Rattus norvegicus
acagctgactcgcagcaggcactga

SEQ ID NO: 76194 - DNA, 25 bp, Rattus norvegicus
acagctgactcggagcaggcactga

SEQ ID NO: 76195 - DNA, 25 bp, Rattus norvegicus
acagctgagtgcatctgggccgtca

SEQ ID NO: 76196 - DNA, 25 bp, Rattus norvegicus
acagctgagtgcttctgggccgtca

SEQ ID NO: 76197 - DNA, 25 bp, Rattus norvegicus
acagctgatacgctaggctaatcta

SEQ ID NO: 76198 - DNA, 25 bp, Rattus norvegicus
acagctgatacggtaggctaatcta

SEQ ID NO: 76199 - DNA, 25 bp, Rattus norvegicus
acagctgatctgcatgcccgctatg

SEQ ID NO: 76200 - DNA, 25 bp, Rattus norvegicus
acagctgatctggatgcccgctatg

SEQ ID NO: 76201 - DNA, 25 bp, Rattus norvegicus
acagctgatggtccgggccaccatg

SEQ ID NO: 76202 - DNA, 25 bp, Rattus norvegicus
acagctgatggtgcgggccaccatg

SEQ ID NO: 76203 - DNA, 25 bp, Rattus norvegicus
acagctgatgtccatgctcatgatg

SEQ ID NO: 76204 - DNA, 25 bp, Rattus norvegicus
acagctgatgtcgatgctcatgatg

SEQ ID NO: 76205 - DNA, 25 bp, Rattus norvegicus
acagctgattgtctggtaccgtgta

SEQ ID NO: 76206 - DNA, 25 bp, Rattus norvegicus
acagctgattgtgtggtaccgtgta

SEQ ID NO: 76207 - DNA, 25 bp, Rattus norvegicus
acagctgcaaacattttatccagat

SEQ ID NO: 76208 - DNA, 25 bp, Rattus norvegicus
acagctgcaaactttttatccagat

SEQ ID NO: 76209 - DNA, 25 bp, Rattus norvegicus
acagctgcaacccttggagttagac

SEQ ID NO: 76210 - DNA, 25 bp, Rattus norvegicus
acagctgcaaccctttatactttga

SEQ ID NO: 76211 - DNA, 25 bp, Rattus norvegicus
acagctgcaaccgttggagttagac

SEQ ID NO: 76212 - DNA, 25 bp, Rattus norvegicus
acagctgcaaccgtttatactttga

SEQ ID NO: 76213 - DNA, 25 bp, Rattus norvegicus
acagctgcacacaatctgcattttg

SEQ ID NO: 76214 - DNA, 25 bp, Rattus norvegicus
acagctgcacactatctgcattttg

SEQ ID NO: 76215 - DNA, 25 bp, Rattus norvegicus
acagctgcacctattttctctttta

SEQ ID NO: 76216 - DNA, 25 bp, Rattus norvegicus
acagctgcaccttttttctctttta

SEQ ID NO: 76217 - DNA, 25 bp, Rattus norvegicus
acagctgcagcaacagggcatcgag

SEQ ID NO: 76218 - DNA, 25 bp, Rattus norvegicus
acagctgcagcatcagggcatcgag

SEQ ID NO: 76219 - DNA, 25 bp, Rattus norvegicus
acagctgcagttatgggctcctttt

SEQ ID NO: 76220 - DNA, 25 bp, Rattus norvegicus
acagctgcagttttgggctcctttt

SEQ ID NO: 76221 - DNA, 25 bp, Rattus norvegicus
acagctgcatccagttactctgtgc

SEQ ID NO: 76222 - DNA, 25 bp, Rattus norvegicus
acagctgcatcctgttactctgtgc

SEQ ID NO: 76223 - DNA, 25 bp, Rattus norvegicus
acagctgcatgtactgggccgggac

SEQ ID NO: 76224 - DNA, 25 bp, Rattus norvegicus
acagctgcatgtcaactactaccat

SEQ ID NO: 76225 - DNA, 25 bp, Rattus norvegicus
acagctgcatgtgaactactaccat

SEQ ID NO: 76226 - DNA, 25 bp, Rattus norvegicus
acagctgcatgttctgggccgggac

SEQ ID NO: 76227 - DNA, 25 bp, Rattus norvegicus
acagctgccaagatcattggagctg

SEQ ID NO: 76228 - DNA, 25 bp, Rattus norvegicus
acagctgccaagttcattggagctg

SEQ ID NO: 76229 - DNA, 25 bp, Rattus norvegicus
acagctgccacccaggagagagagc

SEQ ID NO: 76230 - DNA, 25 bp, Rattus norvegicus
acagctgccaccgaggagagagagc

SEQ ID NO: 76231 - DNA, 25 bp, Rattus norvegicus
acagctgccagtatgcctttaaaca

SEQ ID NO: 76232 - DNA, 25 bp, Rattus norvegicus
acagctgccagtttgcctttaaaca

SEQ ID NO: 76233 - DNA, 25 bp, Rattus norvegicus
acagctgcccctctgtcaaagcagg

SEQ ID NO: 76234 - DNA, 25 bp, Rattus norvegicus
acagctgcccctgtgtcaaagcagg

SEQ ID NO: 76235 - DNA, 25 bp, Rattus norvegicus
acagctgccgtgagccaagtccttg

SEQ ID NO: 76236 - DNA, 25 bp, Rattus norvegicus
acagctgccgtgtgccaagtccttg

SEQ ID NO: 76237 - DNA, 25 bp, Rattus norvegicus
acagctgcctagacaaggactcaga

SEQ ID NO: 76238 - DNA, 25 bp, Rattus norvegicus
acagctgcctagtcaaggactcaga

SEQ ID NO: 76239 - DNA, 25 bp, Rattus norvegicus
acagctgcctcaattcagggtctga

SEQ ID NO: 76240 - DNA, 25 bp, Rattus norvegicus
acagctgcctcatttcagggtctga

SEQ ID NO: 76241 - DNA, 25 bp, Rattus norvegicus
acagctgcctccaaattctgcccca

SEQ ID NO: 76242 - DNA, 25 bp, Rattus norvegicus
acagctgcctccagtgtatttattc

SEQ ID NO: 76243 - DNA, 25 bp, Rattus norvegicus
acagctgcctcctaattctgcccca

SEQ ID NO: 76244 - DNA, 25 bp, Rattus norvegicus
acagctgcctcctgtgtatttattc

SEQ ID NO: 76245 - DNA, 25 bp, Rattus norvegicus
acagctgcctgtatcttgatctgca

SEQ ID NO: 76246 - DNA, 25 bp, Rattus norvegicus
acagctgcctgtttcttgatctgca

SEQ ID NO: 76247 - DNA, 25 bp, Rattus norvegicus
acagctgcgactcaggttagtcagt

SEQ ID NO: 76248 - DNA, 25 bp, Rattus norvegicus
acagctgcgactgaggttagtcagt

SEQ ID NO: 76249 - DNA, 25 bp, Rattus norvegicus
acagctgcggttctgttcatgggca

SEQ ID NO: 76250 - DNA, 25 bp, Rattus norvegicus
acagctgcggttgtgttcatgggca

SEQ ID NO: 76251 - DNA, 25 bp, Rattus norvegicus
acagctgcgttccttggtgacttat

SEQ ID NO: 76252 - DNA, 25 bp, Rattus norvegicus
acagctgcgttcgttggtgacttat

SEQ ID NO: 76253 - DNA, 25 bp, Rattus norvegicus
acagctgctaggactaacacacgaa

SEQ ID NO: 76254 - DNA, 25 bp, Rattus norvegicus
acagctgctaggtctaacacacgaa

SEQ ID NO: 76255 - DNA, 25 bp, Rattus norvegicus
acagctgctcacaacgagatccttg

SEQ ID NO: 76256 - DNA, 25 bp, Rattus norvegicus
acagctgctcactacgagatccttg

SEQ ID NO: 76257 - DNA, 25 bp, Rattus norvegicus
acagctgctctcatgtacatattga

SEQ ID NO: 76258 - DNA, 25 bp, Rattus norvegicus
acagctgctctcttgtacatattga

SEQ ID NO: 76259 - DNA, 25 bp, Rattus norvegicus
acagctgctgtgctcgaacagccta

SEQ ID NO: 76260 - DNA, 25 bp, Rattus norvegicus
acagctgctgtggtcgaacagccta

SEQ ID NO: 76261 - DNA, 25 bp, Rattus norvegicus
acagctgcttacacacagcctgtgg

SEQ ID NO: 76262 - DNA, 25 bp, Rattus norvegicus
acagctgcttactcacagcctgtgg

SEQ ID NO: 76263 - DNA, 25 bp, Rattus norvegicus
acagctggaactctcagtgtggtga

SEQ ID NO: 76264 - DNA, 25 bp, Rattus norvegicus
acagctggaactgtcagtgtggtga

SEQ ID NO: 76265 - DNA, 25 bp, Rattus norvegicus
acagctggaagcacacatctcagga

SEQ ID NO: 76266 - DNA, 25 bp, Rattus norvegicus
acagctggaagcatgtagcctggta

SEQ ID NO: 76267 - DNA, 25 bp, Rattus norvegicus
acagctggaagctcacatctcagga

SEQ ID NO: 76268 - DNA, 25 bp, Rattus norvegicus
acagctggaagcttgtagcctggta

SEQ ID NO: 76269 - DNA, 25 bp, Rattus norvegicus
acagctggaccgagagcatggcatt

SEQ ID NO: 76270 - DNA, 25 bp, Rattus norvegicus
acagctggaccgtgagcatggcatt

SEQ ID NO: 76271 - DNA, 25 bp, Rattus norvegicus
acagctggagacaaatagggccttt

SEQ ID NO: 76272 - DNA, 25 bp, Rattus norvegicus
acagctggagactaatagggccttt

SEQ ID NO: 76273 - DNA, 25 bp, Rattus norvegicus
acagctggagcaactggaagttgca

SEQ ID NO: 76274 - DNA, 25 bp, Rattus norvegicus
acagctggagcatctggaagttgca

SEQ ID NO: 76275 - DNA, 25 bp, Rattus norvegicus
acagctggatgaccttccttggtca

SEQ ID NO: 76276 - DNA, 25 bp, Rattus norvegicus
acagctggatgagcttccttggtca

SEQ ID NO: 76277 - DNA, 25 bp, Rattus norvegicus
acagctggcaatcgtcagggcaact

SEQ ID NO: 76278 - DNA, 25 bp, Rattus norvegicus
acagctggcaatggtcagggcaact

SEQ ID NO: 76279 - DNA, 25 bp, Rattus norvegicus
acagctggctgcagttgcctctcct

SEQ ID NO: 76280 - DNA, 25 bp, Rattus norvegicus
acagctggctgctgttgcctctcct

SEQ ID NO: 76281 - DNA, 25 bp, Rattus norvegicus
acagctgggcctcagcaagcaggtt

SEQ ID NO: 76282 - DNA, 25 bp, Rattus norvegicus
acagctgggcctgagcaagcaggtt

SEQ ID NO: 76283 - DNA, 25 bp, Rattus norvegicus
acagctgggttgatctccatctggg

SEQ ID NO: 76284 - DNA, 25 bp, Rattus norvegicus
acagctgggttgcagctcatctcta

SEQ ID NO: 76285 - DNA, 25 bp, Rattus norvegicus
acagctgggttggagctcatctcta

SEQ ID NO: 76286 - DNA, 25 bp, Rattus norvegicus
acagctgggttgttctccatctggg

SEQ ID NO: 76287 - DNA, 25 bp, Rattus norvegicus
acagctggtcagagattgttcccaa

SEQ ID NO: 76288 - DNA, 25 bp, Rattus norvegicus
acagctggtcagtgattgttcccaa

SEQ ID NO: 76289 - DNA, 25 bp, Rattus norvegicus
acagctggtccacagagagccgatt

SEQ ID NO: 76290 - DNA, 25 bp, Rattus norvegicus
acagctggtccagagagagccgatt

SEQ ID NO: 76291 - DNA, 25 bp, Rattus norvegicus
acagctggtctacagggaccactgt

SEQ ID NO: 76292 - DNA, 25 bp, Rattus norvegicus
acagctggtctagagggaccactgt

SEQ ID NO: 76293 - DNA, 25 bp, Rattus norvegicus
acagctggtttgacagtgacatcat

SEQ ID NO: 76294 - DNA, 25 bp, Rattus norvegicus
acagctggtttgtcagtgacatcat

SEQ ID NO: 76295 - DNA, 25 bp, Rattus norvegicus
acagctgtacggcaggcttcgcctt

SEQ ID NO: 76296 - DNA, 25 bp, Rattus norvegicus
acagctgtacgggaggcttcgcctt

SEQ ID NO: 76297 - DNA, 25 bp, Rattus norvegicus
acagctgtaggtaactgggcctcct

SEQ ID NO: 76298 - DNA, 25 bp, Rattus norvegicus
acagctgtaggttactgggcctcct

SEQ ID NO: 76299 - DNA, 25 bp, Rattus norvegicus
acagctgtatttcgctctggcttga

SEQ ID NO: 76300 - DNA, 25 bp, Rattus norvegicus
acagctgtatttggctctggcttga

SEQ ID NO: 76301 - DNA, 25 bp, Rattus norvegicus
acagctgtcatgactgtcgagtccg

SEQ ID NO: 76302 - DNA, 25 bp, Rattus norvegicus
acagctgtcatgtctgtcgagtccg

SEQ ID NO: 76303 - DNA, 25 bp, Rattus norvegicus
acagctgtccacattctgtgaaaca

SEQ ID NO: 76304 - DNA, 25 bp, Rattus norvegicus
acagctgtccactttctgtgaaaca

SEQ ID NO: 76305 - DNA, 25 bp, Rattus norvegicus
acagctgtccccaggagtctttttt

SEQ ID NO: 76306 - DNA, 25 bp, Rattus norvegicus
acagctgtcccctggagtctttttt

SEQ ID NO: 76307 - DNA, 25 bp, Rattus norvegicus
acagctgtcgcacatgcccagaaga

SEQ ID NO: 76308 - DNA, 25 bp, Rattus norvegicus
acagctgtcgcagatgcccagaaga

SEQ ID NO: 76309 - DNA, 25 bp, Rattus norvegicus
acagctgtcgtgagttttgaggcct

SEQ ID NO: 76310 - DNA, 25 bp, Rattus norvegicus
acagctgtcgtgtgttttgaggcct

SEQ ID NO: 76311 - DNA, 25 bp, Rattus norvegicus
acagctgtctgaacagatgtggcca

SEQ ID NO: 76312 - DNA, 25 bp, Rattus norvegicus
acagctgtctgatcagatgtggcca

SEQ ID NO: 76313 - DNA, 25 bp, Rattus norvegicus
acagctgtctggcttggtggcacat

SEQ ID NO: 76314 - DNA, 25 bp, Rattus norvegicus
acagctgtctgggttggtggcacat

SEQ ID NO: 76315 - DNA, 25 bp, Rattus norvegicus
acagctgtcttcatgcgttctactg

SEQ ID NO: 76316 - DNA, 25 bp, Rattus norvegicus
acagctgtcttcttgcgttctactg

SEQ ID NO: 76317 - DNA, 25 bp, Rattus norvegicus
acagctgtgatcacctcgcaggcag

SEQ ID NO: 76318 - DNA, 25 bp, Rattus norvegicus
acagctgtgatctcctcgcaggcag

SEQ ID NO: 76319 - DNA, 25 bp, Rattus norvegicus
acagctgtgcacagtcttgtgtttg

SEQ ID NO: 76320 - DNA, 25 bp, Rattus norvegicus
acagctgtgcactgtcttgtgtttg

SEQ ID NO: 76321 - DNA, 25 bp, Rattus norvegicus
acagctgtgctaaccttattaaatg

SEQ ID NO: 76322 - DNA, 25 bp, Rattus norvegicus
acagctgtgctatccttattaaatg

SEQ ID NO: 76323 - DNA, 25 bp, Rattus norvegicus
acagctgtgctcaccggtgcgaaga

SEQ ID NO: 76324 - DNA, 25 bp, Rattus norvegicus
acagctgtgctctccggtgcgaaga

SEQ ID NO: 76325 - DNA, 25 bp, Rattus norvegicus
acagctgtggacaagggcagggcca

SEQ ID NO: 76326 - DNA, 25 bp, Rattus norvegicus
acagctgtggactagggcagggcca

SEQ ID NO: 76327 - DNA, 25 bp, Rattus norvegicus
acagctgtggccactgctaagaaga

SEQ ID NO: 76328 - DNA, 25 bp, Rattus norvegicus
acagctgtggcctctgctaagaaga

SEQ ID NO: 76329 - DNA, 25 bp, Rattus norvegicus
acagctgtgtccaaaggtttcattt

SEQ ID NO: 76330 - DNA, 25 bp, Rattus norvegicus
acagctgtgtcctaaggtttcattt

SEQ ID NO: 76331 - DNA, 25 bp, Rattus norvegicus
acagctgtgtgacccgctagctcct

SEQ ID NO: 76332 - DNA, 25 bp, Rattus norvegicus
acagctgtgtgagccgctagctcct

SEQ ID NO: 76333 - DNA, 25 bp, Rattus norvegicus
acagctgtgttacctagaattccat

SEQ ID NO: 76334 - DNA, 25 bp, Rattus norvegicus
acagctgtgttagctagaattccat

SEQ ID NO: 76335 - DNA, 25 bp, Rattus norvegicus
acagctgttatgcatcctttataga

SEQ ID NO: 76336 - DNA, 25 bp, Rattus norvegicus
acagctgttatggatcctttataga

SEQ ID NO: 76337 - DNA, 25 bp, Rattus norvegicus
acagctgttggtcttgttgcagaac

SEQ ID NO: 76338 - DNA, 25 bp, Rattus norvegicus
acagctgttggtgttgttgcagaac

SEQ ID NO: 76339 - DNA, 25 bp, Rattus norvegicus
acagctgttgtaataatgacctatt

SEQ ID NO: 76340 - DNA, 25 bp, Rattus norvegicus
acagctgttgtattaatgacctatt

SEQ ID NO: 76341 - DNA, 25 bp, Rattus norvegicus
acagctgttgtccacgtcaaaccgt

SEQ ID NO: 76342 - DNA, 25 bp, Rattus norvegicus
acagctgttgtcgacgtcaaaccgt

SEQ ID NO: 76343 - DNA, 25 bp, Rattus norvegicus
acagctgttgttctggtgtctgcag

SEQ ID NO: 76344 - DNA, 25 bp, Rattus norvegicus
acagctgttgttgtggtgtctgcag

SEQ ID NO: 76345 - DNA, 25 bp, Rattus norvegicus
acagcttaagcactcagaacagggt

SEQ ID NO: 76346 - DNA, 25 bp, Rattus norvegicus
acagcttaagcagtcagaacagggt

SEQ ID NO: 76347 - DNA, 25 bp, Rattus norvegicus
acagcttaatgaaaccgtggttcct

SEQ ID NO: 76348 - DNA, 25 bp, Rattus norvegicus
acagcttaatgataccgtggttcct

SEQ ID NO: 76349 - DNA, 25 bp, Rattus norvegicus
acagcttactggagtcgatcctttc

SEQ ID NO: 76350 - DNA, 25 bp, Rattus norvegicus
acagcttactggtgtcgatcctttc

SEQ ID NO: 76351 - DNA, 25 bp, Rattus norvegicus
acagcttaggaacaggtgcgttaac

SEQ ID NO: 76352 - DNA, 25 bp, Rattus norvegicus
acagcttaggaagaggtgcgttaac

SEQ ID NO: 76353 - DNA, 25 bp, Rattus norvegicus
acagcttaggctctaactccgcagc

SEQ ID NO: 76354 - DNA, 25 bp, Rattus norvegicus
acagcttaggctgtaactccgcagc

SEQ ID NO: 76355 - DNA, 25 bp, Rattus norvegicus
acagcttcaagacgtcttcgctggt

SEQ ID NO: 76356 - DNA, 25 bp, Rattus norvegicus
acagcttcaagaggtcttcgctggt

SEQ ID NO: 76357 - DNA, 25 bp, Rattus norvegicus
acagcttcactgacggtgggaatgt

SEQ ID NO: 76358 - DNA, 25 bp, Rattus norvegicus
acagcttcactgtcggtgggaatgt

SEQ ID NO: 76359 - DNA, 25 bp, Rattus norvegicus
acagcttcagaaagcttccagaaca

SEQ ID NO: 76360 - DNA, 25 bp, Rattus norvegicus
acagcttcagaatgcttccagaaca

SEQ ID NO: 76361 - DNA, 25 bp, Rattus norvegicus
acagcttcagatatccgctttacca

SEQ ID NO: 76362 - DNA, 25 bp, Rattus norvegicus
acagcttcagatttccgctttacca

SEQ ID NO: 76363 - DNA, 25 bp, Rattus norvegicus
acagcttcatccaagggtacacggg

SEQ ID NO: 76364 - DNA, 25 bp, Rattus norvegicus
acagcttcatcctagggtacacggg

SEQ ID NO: 76365 - DNA, 25 bp, Rattus norvegicus
acagcttccaaacccttgttgttga

SEQ ID NO: 76366 - DNA, 25 bp, Rattus norvegicus
acagcttccaaagccttgttgttga

SEQ ID NO: 76367 - DNA, 25 bp, Rattus norvegicus
acagcttcccagagcaaggagcgaa

SEQ ID NO: 76368 - DNA, 25 bp, Rattus norvegicus
acagcttcccagtgcaaggagcgaa

SEQ ID NO: 76369 - DNA, 25 bp, Rattus norvegicus
acagcttcccatccctaatagggtg

SEQ ID NO: 76370 - DNA, 25 bp, Rattus norvegicus
acagcttcccatgcctaatagggtg

SEQ ID NO: 76371 - DNA, 25 bp, Rattus norvegicus
acagcttcccctagagtgatgatgg

SEQ ID NO: 76372 - DNA, 25 bp, Rattus norvegicus
acagcttccccttgagtgatgatgg

SEQ ID NO: 76373 - DNA, 25 bp, Rattus norvegicus
acagcttccgtcaaatttcttgcaa

SEQ ID NO: 76374 - DNA, 25 bp, Rattus norvegicus
acagcttccgtctaatttcttgcaa

SEQ ID NO: 76375 - DNA, 25 bp, Rattus norvegicus
acagcttccgtgactgcaaaggcaa

SEQ ID NO: 76376 - DNA, 25 bp, Rattus norvegicus
acagcttccgtgtctgcaaaggcaa

SEQ ID NO: 76377 - DNA, 25 bp, Rattus norvegicus
acagcttcctctagccaggtaggaa

SEQ ID NO: 76378 - DNA, 25 bp, Rattus norvegicus
acagcttcctcttgccaggtaggaa

SEQ ID NO: 76379 - DNA, 25 bp, Rattus norvegicus
acagcttcctgaagcgggtgaagga

SEQ ID NO: 76380 - DNA, 25 bp, Rattus norvegicus
acagcttcctgatgcgggtgaagga

SEQ ID NO: 76381 - DNA, 25 bp, Rattus norvegicus
acagcttcggtgctcattgctctct

SEQ ID NO: 76382 - DNA, 25 bp, Rattus norvegicus
acagcttcggtggtcattgctctct

SEQ ID NO: 76383 - DNA, 25 bp, Rattus norvegicus
acagcttctatgaaggcggtcagga

SEQ ID NO: 76384 - DNA, 25 bp, Rattus norvegicus
acagcttctatgtaggcggtcagga

SEQ ID NO: 76385 - DNA, 25 bp, Rattus norvegicus
acagcttctattccaccacattgta

SEQ ID NO: 76386 - DNA, 25 bp, Rattus norvegicus
acagcttctattgcaccacattgta

SEQ ID NO: 76387 - DNA, 25 bp, Rattus norvegicus
acagcttctcaaaccggcttgatgt

SEQ ID NO: 76388 - DNA, 25 bp, Rattus norvegicus
acagcttctcaatccggcttgatgt

SEQ ID NO: 76389 - DNA, 25 bp, Rattus norvegicus
acagcttctccaagactatgcaggt

SEQ ID NO: 76390 - DNA, 25 bp, Rattus norvegicus
acagcttctccatgactatgcaggt

SEQ ID NO: 76391 - DNA, 25 bp, Rattus norvegicus
acagcttcttcaaccacgaccagat

SEQ ID NO: 76392 - DNA, 25 bp, Rattus norvegicus
acagcttcttcatccacgaccagat

SEQ ID NO: 76393 - DNA, 25 bp, Rattus norvegicus
acagcttcttgaaccacttgtggtt

SEQ ID NO: 76394 - DNA, 25 bp, Rattus norvegicus
acagcttcttgatccacttgtggtt

SEQ ID NO: 76395 - DNA, 25 bp, Rattus norvegicus
acagcttgatccatctcagggagag

SEQ ID NO: 76396 - DNA, 25 bp, Rattus norvegicus
acagcttgatccttctcagggagag

SEQ ID NO: 76397 - DNA, 25 bp, Rattus norvegicus
acagcttgatggaggcgtttttgaa

SEQ ID NO: 76398 - DNA, 25 bp, Rattus norvegicus
acagcttgatggtggcgtttttgaa

SEQ ID NO: 76399 - DNA, 25 bp, Rattus norvegicus
acagcttgcattctgtgctcacttt

SEQ ID NO: 76400 - DNA, 25 bp, Rattus norvegicus
acagcttgcattgtgtgctcacttt

SEQ ID NO: 76401 - DNA, 25 bp, Rattus norvegicus
acagcttgcctgatttggttttctc

SEQ ID NO: 76402 - DNA, 25 bp, Rattus norvegicus
acagcttgcctgttttggttttctc

SEQ ID NO: 76403 - DNA, 25 bp, Rattus norvegicus
acagcttgcttcactcattattgga

SEQ ID NO: 76404 - DNA, 25 bp, Rattus norvegicus
acagcttgcttctctcattattgga

SEQ ID NO: 76405 - DNA, 25 bp, Rattus norvegicus
acagcttgctttacgttttcttaag

SEQ ID NO: 76406 - DNA, 25 bp, Rattus norvegicus
acagcttgcttttcgttttcttaag

SEQ ID NO: 76407 - DNA, 25 bp, Rattus norvegicus
acagcttggagcagatccggagcaa

SEQ ID NO: 76408 - DNA, 25 bp, Rattus norvegicus
acagcttggagctgatccggagcaa

SEQ ID NO: 76409 - DNA, 25 bp, Rattus norvegicus
acagcttggattccgtgcagagtcc

SEQ ID NO: 76410 - DNA, 25 bp, Rattus norvegicus
acagcttggattgcgtgcagagtcc

SEQ ID NO: 76411 - DNA, 25 bp, Rattus norvegicus
acagcttggctgaaatctcattcca

SEQ ID NO: 76412 - DNA, 25 bp, Rattus norvegicus
acagcttggctgagttcagaaccta

SEQ ID NO: 76413 - DNA, 25 bp, Rattus norvegicus
acagcttggctgtaatctcattcca

SEQ ID NO: 76414 - DNA, 25 bp, Rattus norvegicus
acagcttggctgtgttcagaaccta

SEQ ID NO: 76415 - DNA, 25 bp, Rattus norvegicus
acagcttgggagcttgtctgtgctt

SEQ ID NO: 76416 - DNA, 25 bp, Rattus norvegicus
acagcttgggaggttgtctgtgctt

SEQ ID NO: 76417 - DNA, 25 bp, Rattus norvegicus
acagcttgggtgagatcctgctcga

SEQ ID NO: 76418 - DNA, 25 bp, Rattus norvegicus
acagcttgggtgtgatcctgctcga

SEQ ID NO: 76419 - DNA, 25 bp, Rattus norvegicus
acagcttggtgccatccgggatgca

SEQ ID NO: 76420 - DNA, 25 bp, Rattus norvegicus
acagcttggtgcgatccgggatgca

SEQ ID NO: 76421 - DNA, 25 bp, Rattus norvegicus
acagcttgtaacatggtcctatttt

SEQ ID NO: 76422 - DNA, 25 bp, Rattus norvegicus
acagcttgtaacttggtcctatttt

SEQ ID NO: 76423 - DNA, 25 bp, Rattus norvegicus
acagcttgtcatcgaatcagcctgg

SEQ ID NO: 76424 - DNA, 25 bp, Rattus norvegicus
acagcttgtcatggaatcagcctgg

SEQ ID NO: 76425 - DNA, 25 bp, Rattus norvegicus
acagcttgtcgacacttcctatgga

SEQ ID NO: 76426 - DNA, 25 bp, Rattus norvegicus
acagcttgtcgagacttcctatgga

SEQ ID NO: 76427 - DNA, 25 bp, Rattus norvegicus
acagcttgtctcattgtcaactgaa

SEQ ID NO: 76428 - DNA, 25 bp, Rattus norvegicus
acagcttgtctctttgtcaactgaa

SEQ ID NO: 76429 - DNA, 25 bp, Rattus norvegicus
acagctttaaagactggcctgtcgc

SEQ ID NO: 76430 - DNA, 25 bp, Rattus norvegicus
acagctttaaagtctggcctgtcgc

SEQ ID NO: 76431 - DNA, 25 bp, Rattus norvegicus
acagctttaacaactgaggccaaaa

SEQ ID NO: 76432 - DNA, 25 bp, Rattus norvegicus
acagctttaacatctgaggccaaaa

SEQ ID NO: 76433 - DNA, 25 bp, Rattus norvegicus
acagctttaaggataagaatggcca

SEQ ID NO: 76434 - DNA, 25 bp, Rattus norvegicus
acagctttaaggttaagaatggcca

SEQ ID NO: 76435 - DNA, 25 bp, Rattus norvegicus
acagctttattgagaacagtccata

SEQ ID NO: 76436 - DNA, 25 bp, Rattus norvegicus
acagctttattgtgaacagtccata

SEQ ID NO: 76437 - DNA, 25 bp, Rattus norvegicus
acagctttccccagatgaggcaaaa

SEQ ID NO: 76438 - DNA, 25 bp, Rattus norvegicus
acagctttcccctgatgaggcaaaa

SEQ ID NO: 76439 - DNA, 25 bp, Rattus norvegicus
acagctttctggaagtggctttctt

SEQ ID NO: 76440 - DNA, 25 bp, Rattus norvegicus
acagctttctggtagtggctttctt

SEQ ID NO: 76441 - DNA, 25 bp, Rattus norvegicus
acagctttgaataccttaaagccat

SEQ ID NO: 76442 - DNA, 25 bp, Rattus norvegicus
acagctttgaattccttaaagccat

SEQ ID NO: 76443 - DNA, 25 bp, Rattus norvegicus
acagctttgctacctttaagtgaca

SEQ ID NO: 76444 - DNA, 25 bp, Rattus norvegicus
acagctttgctagctttaagtgaca

SEQ ID NO: 76445 - DNA, 25 bp, Rattus norvegicus
acagctttgggaacttgtcctctgc

SEQ ID NO: 76446 - DNA, 25 bp, Rattus norvegicus
acagctttgggatcttgtcctctgc

SEQ ID NO: 76447 - DNA, 25 bp, Rattus norvegicus
acagctttgggcaccctggaggaga

SEQ ID NO: 76448 - DNA, 25 bp, Rattus norvegicus
acagctttgggctccctggaggaga

SEQ ID NO: 76449 - DNA, 25 bp, Rattus norvegicus
acagcttttacgaatatgccataca

SEQ ID NO: 76450 - DNA, 25 bp, Rattus norvegicus
acagcttttacgtatatgccataca

SEQ ID NO: 76451 - DNA, 25 bp, Rattus norvegicus
acagcttttagcacgtgtggaccac

SEQ ID NO: 76452 - DNA, 25 bp, Rattus norvegicus
acagcttttagctcgtgtggaccac

SEQ ID NO: 76453 - DNA, 25 bp, Rattus norvegicus
acagcttttatgaactgactccata

SEQ ID NO: 76454 - DNA, 25 bp, Rattus norvegicus
acagcttttatgtactgactccata

SEQ ID NO: 76455 - DNA, 25 bp, Rattus norvegicus
acagcttttgtaccagttgccacca

SEQ ID NO: 76456 - DNA, 25 bp, Rattus norvegicus
acagcttttgtagcagttgccacca

SEQ ID NO: 76457 - DNA, 25 bp, Rattus norvegicus
acagcttttttgagccattgcccat

SEQ ID NO: 76458 - DNA, 25 bp, Rattus norvegicus
acagcttttttgtgccattgcccat

SEQ ID NO: 76459 - DNA, 25 bp, Rattus norvegicus
acaggaaaagcccacgcgtgcactc

SEQ ID NO: 76460 - DNA, 25 bp, Rattus norvegicus
acaggaaaagccgacgcgtgcactc

SEQ ID NO: 76461 - DNA, 25 bp, Rattus norvegicus
acaggaaacccaatcgatccagcag

SEQ ID NO: 76462 - DNA, 25 bp, Rattus norvegicus
acaggaaacccacaattgccagcag

SEQ ID NO: 76463 - DNA, 25 bp, Rattus norvegicus
acaggaaacccagaattgccagcag

SEQ ID NO: 76464 - DNA, 25 bp, Rattus norvegicus
acaggaaacccattcgatccagcag

SEQ ID NO: 76465 - DNA, 25 bp, Rattus norvegicus
acaggaaactctctggtgagctcat

SEQ ID NO: 76466 - DNA, 25 bp, Rattus norvegicus
acaggaaactctgtggtgagctcat

SEQ ID NO: 76467 - DNA, 25 bp, Rattus norvegicus
acaggaaactgtcctgcctgcagca

SEQ ID NO: 76468 - DNA, 25 bp, Rattus norvegicus
acaggaaactgtgctgcctgcagca

SEQ ID NO: 76469 - DNA, 25 bp, Rattus norvegicus
acaggaaagacccactaatgcagct

SEQ ID NO: 76470 - DNA, 25 bp, Rattus norvegicus
acaggaaagaccgactaatgcagct

SEQ ID NO: 76471 - DNA, 25 bp, Rattus norvegicus
acaggaaagcataccgtgccttgca

SEQ ID NO: 76472 - DNA, 25 bp, Rattus norvegicus
acaggaaagcattccgtgccttgca

SEQ ID NO: 76473 - DNA, 25 bp, Rattus norvegicus
acaggaaatatcacctgcccatggg

SEQ ID NO: 76474 - DNA, 25 bp, Rattus norvegicus
acaggaaatatctcctgcccatggg

SEQ ID NO: 76475 - DNA, 25 bp, Rattus norvegicus
acaggaaatcagcttggcagtgcac

SEQ ID NO: 76476 - DNA, 25 bp, Rattus norvegicus
acaggaaatcaggttggcagtgcac

SEQ ID NO: 76477 - DNA, 25 bp, Rattus norvegicus
acaggaaattcaaatcccgctgcca

SEQ ID NO: 76478 - DNA, 25 bp, Rattus norvegicus
acaggaaattcatatcccgctgcca

SEQ ID NO: 76479 - DNA, 25 bp, Rattus norvegicus
acaggaaattggacggccctgccga

SEQ ID NO: 76480 - DNA, 25 bp, Rattus norvegicus
acaggaaattggtcggccctgccga

SEQ ID NO: 76481 - DNA, 25 bp, Rattus norvegicus
acaggaacacagacctcttatccat

SEQ ID NO: 76482 - DNA, 25 bp, Rattus norvegicus
acaggaacacagtcctcttatccat

SEQ ID NO: 76483 - DNA, 25 bp, Rattus norvegicus
acaggaaccccgagaagagcaactc

SEQ ID NO: 76484 - DNA, 25 bp, Rattus norvegicus
acaggaaccccgtgaagagcaactc

SEQ ID NO: 76485 - DNA, 25 bp, Rattus norvegicus
acaggaacctaaccgatgatatcat

SEQ ID NO: 76486 - DNA, 25 bp, Rattus norvegicus
acaggaacctaagcgatgatatcat

SEQ ID NO: 76487 - DNA, 25 bp, Rattus norvegicus
acaggaacctcactgccataggcta

SEQ ID NO: 76488 - DNA, 25 bp, Rattus norvegicus
acaggaacctcagtgccataggcta

SEQ ID NO: 76489 - DNA, 25 bp, Rattus norvegicus
acaggaactactaggccttccagga

SEQ ID NO: 76490 - DNA, 25 bp, Rattus norvegicus
acaggaactacttggccttccagga

SEQ ID NO: 76491 - DNA, 25 bp, Rattus norvegicus
acaggaactccaagcgtcagaactc

SEQ ID NO: 76492 - DNA, 25 bp, Rattus norvegicus
acaggaactccatgcgtcagaactc

SEQ ID NO: 76493 - DNA, 25 bp, Rattus norvegicus
acaggaactggccaagtacttcttg

SEQ ID NO: 76494 - DNA, 25 bp, Rattus norvegicus
acaggaactggcgaagtacttcttg

SEQ ID NO: 76495 - DNA, 25 bp, Rattus norvegicus
acaggaagaaccaactgcgactgca

SEQ ID NO: 76496 - DNA, 25 bp, Rattus norvegicus
acaggaagaacctactgcgactgca

SEQ ID NO: 76497 - DNA, 25 bp, Rattus norvegicus
acaggaagacggactccgagttctg

SEQ ID NO: 76498 - DNA, 25 bp, Rattus norvegicus
acaggaagacggtctccgagttctg

SEQ ID NO: 76499 - DNA, 25 bp, Rattus norvegicus
acaggaagactgacagagcgctcag

SEQ ID NO: 76500 - DNA, 25 bp, Rattus norvegicus
acaggaagactgtcagagcgctcag

SEQ ID NO: 76501 - DNA, 25 bp, Rattus norvegicus
acaggaagagatcgttcacactttc

SEQ ID NO: 76502 - DNA, 25 bp, Rattus norvegicus
acaggaagagatggttcacactttc

SEQ ID NO: 76503 - DNA, 25 bp, Rattus norvegicus
acaggaagatccattcttttttctc

SEQ ID NO: 76504 - DNA, 25 bp, Rattus norvegicus
acaggaagatcctttcttttttctc

SEQ ID NO: 76505 - DNA, 25 bp, Rattus norvegicus
acaggaagattcacagggtcacact

SEQ ID NO: 76506 - DNA, 25 bp, Rattus norvegicus
acaggaagattctcagggtcacact

SEQ ID NO: 76507 - DNA, 25 bp, Rattus norvegicus
acaggaagcagtatgagccgcccac

SEQ ID NO: 76508 - DNA, 25 bp, Rattus norvegicus
acaggaagcagtttgagccgcccac

SEQ ID NO: 76509 - DNA, 25 bp, Rattus norvegicus
acaggaagcctcctgtaaggagaag

SEQ ID NO: 76510 - DNA, 25 bp, Rattus norvegicus
acaggaagcctcgtgtaaggagaag

SEQ ID NO: 76511 - DNA, 25 bp, Rattus norvegicus
acaggaagcctgagatcggccagaa

SEQ ID NO: 76512 - DNA, 25 bp, Rattus norvegicus
acaggaagcctgtgatcggccagaa

SEQ ID NO: 76513 - DNA, 25 bp, Rattus norvegicus
acaggaagctttagccacatggcag

SEQ ID NO: 76514 - DNA, 25 bp, Rattus norvegicus
acaggaagcttttgccacatggcag

SEQ ID NO: 76515 - DNA, 25 bp, Rattus norvegicus
acaggaagggatccaggcctcactt

SEQ ID NO: 76516 - DNA, 25 bp, Rattus norvegicus
acaggaagggatgcaggcctcactt

SEQ ID NO: 76517 - DNA, 25 bp, Rattus norvegicus
acaggaagggccacatagctgccat

SEQ ID NO: 76518 - DNA, 25 bp, Rattus norvegicus
acaggaagggcctcatagctgccat

SEQ ID NO: 76519 - DNA, 25 bp, Rattus norvegicus
acaggaaggttcagctcattctctg

SEQ ID NO: 76520 - DNA, 25 bp, Rattus norvegicus
acaggaaggttctgctcattctctg

SEQ ID NO: 76521 - DNA, 25 bp, Rattus norvegicus
acaggaagtacaccatggcctctca

SEQ ID NO: 76522 - DNA, 25 bp, Rattus norvegicus
acaggaagtacagcatggcctctca

SEQ ID NO: 76523 - DNA, 25 bp, Rattus norvegicus
acaggaagtaccactgccatgctta

SEQ ID NO: 76524 - DNA, 25 bp, Rattus norvegicus
acaggaagtacctctgccatgctta

SEQ ID NO: 76525 - DNA, 25 bp, Rattus norvegicus
acaggaagtcccaatcataaacaag

SEQ ID NO: 76526 - DNA, 25 bp, Rattus norvegicus
acaggaagtccctatcataaacaag

SEQ ID NO: 76527 - DNA, 25 bp, Rattus norvegicus
acaggaagtcgaatacgtgctaaac

SEQ ID NO: 76528 - DNA, 25 bp, Rattus norvegicus
acaggaagtcgattacgtgctaaac

SEQ ID NO: 76529 - DNA, 25 bp, Rattus norvegicus
acaggaagtgggactgcctttacat

SEQ ID NO: 76530 - DNA, 25 bp, Rattus norvegicus
acaggaagtgggtctgcctttacat

SEQ ID NO: 76531 - DNA, 25 bp, Rattus norvegicus
acaggaagttctcattctccgggaa

SEQ ID NO: 76532 - DNA, 25 bp, Rattus norvegicus
acaggaagttctgattctccgggaa

SEQ ID NO: 76533 - DNA, 25 bp, Rattus norvegicus
acaggaataaggacaaacagtagtt

SEQ ID NO: 76534 - DNA, 25 bp, Rattus norvegicus
acaggaataaggtcaaacagtagtt

SEQ ID NO: 76535 - DNA, 25 bp, Rattus norvegicus
acaggaatcacaagttcctctcctc

SEQ ID NO: 76536 - DNA, 25 bp, Rattus norvegicus
acaggaatcacatgttcctctcctc

SEQ ID NO: 76537 - DNA, 25 bp, Rattus norvegicus
acaggaatccccagtcacagagagt

SEQ ID NO: 76538 - DNA, 25 bp, Rattus norvegicus
acaggaatcccctgtcacagagagt

SEQ ID NO: 76539 - DNA, 25 bp, Rattus norvegicus
acaggaatctccaatcttgggtggg

SEQ ID NO: 76540 - DNA, 25 bp, Rattus norvegicus
acaggaatctcctatcttgggtggg

SEQ ID NO: 76541 - DNA, 25 bp, Rattus norvegicus
acaggaatctggaccggccgagctt

SEQ ID NO: 76542 - DNA, 25 bp, Rattus norvegicus
acaggaatctggtccggccgagctt

SEQ ID NO: 76543 - DNA, 25 bp, Rattus norvegicus
acaggaatgctgaacgtgcgttgct

SEQ ID NO: 76544 - DNA, 25 bp, Rattus norvegicus
acaggaatgctgtacgtgcgttgct

SEQ ID NO: 76545 - DNA, 25 bp, Rattus norvegicus
acaggaatgtctctggacctcactt

SEQ ID NO: 76546 - DNA, 25 bp, Rattus norvegicus
acaggaatgtctgtggacctcactt

SEQ ID NO: 76547 - DNA, 25 bp, Rattus norvegicus
acaggaattctgaactggttatttt

SEQ ID NO: 76548 - DNA, 25 bp, Rattus norvegicus
acaggaattctgactctgccacagc

SEQ ID NO: 76549 - DNA, 25 bp, Rattus norvegicus
acaggaattctgatgcgccgctata

SEQ ID NO: 76550 - DNA, 25 bp, Rattus norvegicus
acaggaattctgtactggttatttt

SEQ ID NO: 76551 - DNA, 25 bp, Rattus norvegicus
acaggaattctgtctctgccacagc

SEQ ID NO: 76552 - DNA, 25 bp, Rattus norvegicus
acaggaattctgttgcgccgctata

SEQ ID NO: 76553 - DNA, 25 bp, Rattus norvegicus
acaggacacatgctttgcttggccc

SEQ ID NO: 76554 - DNA, 25 bp, Rattus norvegicus
acaggacacatggtttgcttggccc

SEQ ID NO: 76555 - DNA, 25 bp, Rattus norvegicus
acaggacactcaattggtgcagcat

SEQ ID NO: 76556 - DNA, 25 bp, Rattus norvegicus
acaggacactcatttggtgcagcat

SEQ ID NO: 76557 - DNA, 25 bp, Rattus norvegicus
acaggacagcacatgcagagtgagg

SEQ ID NO: 76558 - DNA, 25 bp, Rattus norvegicus
acaggacagcacttgcagagtgagg

SEQ ID NO: 76559 - DNA, 25 bp, Rattus norvegicus
acaggacaggcaagtgagcagtgag

SEQ ID NO: 76560 - DNA, 25 bp, Rattus norvegicus
acaggacaggcatgtgagcagtgag

SEQ ID NO: 76561 - DNA, 25 bp, Rattus norvegicus
acaggacatgttctcttgtgtgtgt

SEQ ID NO: 76562 - DNA, 25 bp, Rattus norvegicus
acaggacatgttcttatcgtggatg

SEQ ID NO: 76563 - DNA, 25 bp, Rattus norvegicus
acaggacatgttgtcttgtgtgtgt

SEQ ID NO: 76564 - DNA, 25 bp, Rattus norvegicus
acaggacatgttgttatcgtggatg

SEQ ID NO: 76565 - DNA, 25 bp, Rattus norvegicus
acaggaccagatacagaacgcacag

SEQ ID NO: 76566 - DNA, 25 bp, Rattus norvegicus
acaggaccagattcagaacgcacag

SEQ ID NO: 76567 - DNA, 25 bp, Rattus norvegicus
acaggaccatgtacagttgcccagg

SEQ ID NO: 76568 - DNA, 25 bp, Rattus norvegicus
acaggaccatgttcagttgcccagg

SEQ ID NO: 76569 - DNA, 25 bp, Rattus norvegicus
acaggaccatttcaccgggtaatag

SEQ ID NO: 76570 - DNA, 25 bp, Rattus norvegicus
acaggaccatttgaccgggtaatag

SEQ ID NO: 76571 - DNA, 25 bp, Rattus norvegicus
acaggaccctgaacagaatcctcac

SEQ ID NO: 76572 - DNA, 25 bp, Rattus norvegicus
acaggaccctgatcagaatcctcac

SEQ ID NO: 76573 - DNA, 25 bp, Rattus norvegicus
acaggaccctgcccatgcactgtgg

SEQ ID NO: 76574 - DNA, 25 bp, Rattus norvegicus
acaggaccctgcgcatgcactgtgg

SEQ ID NO: 76575 - DNA, 25 bp, Rattus norvegicus
acaggacctagtacagtgctacatc

SEQ ID NO: 76576 - DNA, 25 bp, Rattus norvegicus
acaggacctagtcggctgcacccat

SEQ ID NO: 76577 - DNA, 25 bp, Rattus norvegicus
acaggacctagtgggctgcacccat

SEQ ID NO: 76578 - DNA, 25 bp, Rattus norvegicus
acaggacctagttcagtgctacatc

SEQ ID NO: 76579 - DNA, 25 bp, Rattus norvegicus
acaggacctgggagtctgagcaatt

SEQ ID NO: 76580 - DNA, 25 bp, Rattus norvegicus
acaggacctgggtgtctgagcaatt

SEQ ID NO: 76581 - DNA, 25 bp, Rattus norvegicus
acaggacctttcatcaagtgacgaa

SEQ ID NO: 76582 - DNA, 25 bp, Rattus norvegicus
acaggacctttcttcaagtgacgaa

SEQ ID NO: 76583 - DNA, 25 bp, Rattus norvegicus
acaggacgacctaactggctcagga

SEQ ID NO: 76584 - DNA, 25 bp, Rattus norvegicus
acaggacgaccttactggctcagga

SEQ ID NO: 76585 - DNA, 25 bp, Rattus norvegicus
acaggacgcctactcaaggccaaaa

SEQ ID NO: 76586 - DNA, 25 bp, Rattus norvegicus
acaggacgcctagtcaaggccaaaa

SEQ ID NO: 76587 - DNA, 25 bp, Rattus norvegicus
acaggacgctagacaaatcgttggg

SEQ ID NO: 76588 - DNA, 25 bp, Rattus norvegicus
acaggacgctagtcaaatcgttggg

SEQ ID NO: 76589 - DNA, 25 bp, Rattus norvegicus
acaggacgctgtctaggcacatggc

SEQ ID NO: 76590 - DNA, 25 bp, Rattus norvegicus
acaggacgctgtgtaggcacatggc

SEQ ID NO: 76591 - DNA, 25 bp, Rattus norvegicus
acaggacggaacagtgaagtacaca

SEQ ID NO: 76592 - DNA, 25 bp, Rattus norvegicus
acaggacggaactgtgaagtacaca

SEQ ID NO: 76593 - DNA, 25 bp, Rattus norvegicus
acaggactcagaatccctacagcaa

SEQ ID NO: 76594 - DNA, 25 bp, Rattus norvegicus
acaggactcagattccctacagcaa

SEQ ID NO: 76595 - DNA, 25 bp, Rattus norvegicus
acaggactgagtaaatgccacattc

SEQ ID NO: 76596 - DNA, 25 bp, Rattus norvegicus
acaggactgagttaatgccacattc

SEQ ID NO: 76597 - DNA, 25 bp, Rattus norvegicus
acaggactgcatagaggctttttca

SEQ ID NO: 76598 - DNA, 25 bp, Rattus norvegicus
acaggactgcattgaggctttttca

SEQ ID NO: 76599 - DNA, 25 bp, Rattus norvegicus
acaggactggcgaagcacggtgcac

SEQ ID NO: 76600 - DNA, 25 bp, Rattus norvegicus
acaggactggcgtagcacggtgcac

SEQ ID NO: 76601 - DNA, 25 bp, Rattus norvegicus
acaggactgtccattcggatttgta

SEQ ID NO: 76602 - DNA, 25 bp, Rattus norvegicus
acaggactgtcctttcggatttgta

SEQ ID NO: 76603 - DNA, 25 bp, Rattus norvegicus
acaggactgtctagggtggccagac

SEQ ID NO: 76604 - DNA, 25 bp, Rattus norvegicus
acaggactgtcttgggtggccagac

SEQ ID NO: 76605 - DNA, 25 bp, Rattus norvegicus
acaggacttagcctcagatgtttcc

SEQ ID NO: 76606 - DNA, 25 bp, Rattus norvegicus
acaggacttagcgtcagatgtttcc

SEQ ID NO: 76607 - DNA, 25 bp, Rattus norvegicus
acaggacttctgagcattgtaaaca

SEQ ID NO: 76608 - DNA, 25 bp, Rattus norvegicus
acaggacttctgtgcattgtaaaca

SEQ ID NO: 76609 - DNA, 25 bp, Rattus norvegicus
acaggacttgaactcagctgcttct

SEQ ID NO: 76610 - DNA, 25 bp, Rattus norvegicus
acaggacttgaagtcagctgcttct

SEQ ID NO: 76611 - DNA, 25 bp, Rattus norvegicus
acaggacttgcccttggtgttggcc

SEQ ID NO: 76612 - DNA, 25 bp, Rattus norvegicus
acaggacttgccgttggtgttggcc

SEQ ID NO: 76613 - DNA, 25 bp, Rattus norvegicus
acaggacttgttcccatggtgggca

SEQ ID NO: 76614 - DNA, 25 bp, Rattus norvegicus
acaggacttgttgccatggtgggca

SEQ ID NO: 76615 - DNA, 25 bp, Rattus norvegicus
acaggactttccaagggcttctgga

SEQ ID NO: 76616 - DNA, 25 bp, Rattus norvegicus
acaggactttcctagggcttctgga

SEQ ID NO: 76617 - DNA, 25 bp, Rattus norvegicus
acaggagaactgcagttgtaggcca

SEQ ID NO: 76618 - DNA, 25 bp, Rattus norvegicus
acaggagaactggagttgtaggcca

SEQ ID NO: 76619 - DNA, 25 bp, Rattus norvegicus
acaggagaccctaccttatgatcat

SEQ ID NO: 76620 - DNA, 25 bp, Rattus norvegicus
acaggagacccttccttatgatcat

SEQ ID NO: 76621 - DNA, 25 bp, Rattus norvegicus
acaggagagcttccagggtctctga

SEQ ID NO: 76622 - DNA, 25 bp, Rattus norvegicus
acaggagagcttgcagggtctctga

SEQ ID NO: 76623 - DNA, 25 bp, Rattus norvegicus
acaggagataggcttgccctctcat

SEQ ID NO: 76624 - DNA, 25 bp, Rattus norvegicus
acaggagatagggttgccctctcat

SEQ ID NO: 76625 - DNA, 25 bp, Rattus norvegicus
acaggagatccacccttggtgagtt

SEQ ID NO: 76626 - DNA, 25 bp, Rattus norvegicus
acaggagatccagccttggtgagtt

SEQ ID NO: 76627 - DNA, 25 bp, Rattus norvegicus
acaggagatgctacgtgcctcggga

SEQ ID NO: 76628 - DNA, 25 bp, Rattus norvegicus
acaggagatgcttcgtgcctcggga

SEQ ID NO: 76629 - DNA, 25 bp, Rattus norvegicus
acaggagattggagcccacttctgg

SEQ ID NO: 76630 - DNA, 25 bp, Rattus norvegicus
acaggagattggtgcccacttctgg

SEQ ID NO: 76631 - DNA, 25 bp, Rattus norvegicus
acaggagatttgatcattctggaaa

SEQ ID NO: 76632 - DNA, 25 bp, Rattus norvegicus
acaggagatttgttcattctggaaa

SEQ ID NO: 76633 - DNA, 25 bp, Rattus norvegicus
acaggagcacatatcagtgattcta

SEQ ID NO: 76634 - DNA, 25 bp, Rattus norvegicus
acaggagcacatttcagtgattcta

SEQ ID NO: 76635 - DNA, 25 bp, Rattus norvegicus
acaggagcacccatagctatattat

SEQ ID NO: 76636 - DNA, 25 bp, Rattus norvegicus
acaggagcacccttagctatattat

SEQ ID NO: 76637 - DNA, 25 bp, Rattus norvegicus
acaggagcagacatctctggtccct

SEQ ID NO: 76638 - DNA, 25 bp, Rattus norvegicus
acaggagcagacttctctggtccct

SEQ ID NO: 76639 - DNA, 25 bp, Rattus norvegicus
acaggagcagcccaactcttagttg

SEQ ID NO: 76640 - DNA, 25 bp, Rattus norvegicus
acaggagcagccgaactcttagttg

SEQ ID NO: 76641 - DNA, 25 bp, Rattus norvegicus
acaggagcagctactacgttcgatt

SEQ ID NO: 76642 - DNA, 25 bp, Rattus norvegicus
acaggagcagcttctacgttcgatt

SEQ ID NO: 76643 - DNA, 25 bp, Rattus norvegicus
acaggagcaggacacatggctcaaa

SEQ ID NO: 76644 - DNA, 25 bp, Rattus norvegicus
acaggagcaggagacatggctcaaa

SEQ ID NO: 76645 - DNA, 25 bp, Rattus norvegicus
acaggagccctgaaacttaatacca

SEQ ID NO: 76646 - DNA, 25 bp, Rattus norvegicus
acaggagccctgtaacttaatacca

SEQ ID NO: 76647 - DNA, 25 bp, Rattus norvegicus
acaggagcccttcagaatctacact

SEQ ID NO: 76648 - DNA, 25 bp, Rattus norvegicus
acaggagcccttgagaatctacact

SEQ ID NO: 76649 - DNA, 25 bp, Rattus norvegicus
acaggagcctatcctggttacaggc

SEQ ID NO: 76650 - DNA, 25 bp, Rattus norvegicus
acaggagcctatgctggttacaggc

SEQ ID NO: 76651 - DNA, 25 bp, Rattus norvegicus
acaggagcctcaaattctacagtct

SEQ ID NO: 76652 - DNA, 25 bp, Rattus norvegicus
acaggagcctcatattctacagtct

SEQ ID NO: 76653 - DNA, 25 bp, Rattus norvegicus
acaggagcctttcagttccttccct

SEQ ID NO: 76654 - DNA, 25 bp, Rattus norvegicus
acaggagcctttgagttccttccct

SEQ ID NO: 76655 - DNA, 25 bp, Rattus norvegicus
acaggagcgcaaaggaactctgatt

SEQ ID NO: 76656 - DNA, 25 bp, Rattus norvegicus
acaggagcgcaatggaactctgatt

SEQ ID NO: 76657 - DNA, 25 bp, Rattus norvegicus
acaggagcgggcaactttgtgcaat

SEQ ID NO: 76658 - DNA, 25 bp, Rattus norvegicus
acaggagcgggctactttgtgcaat

SEQ ID NO: 76659 - DNA, 25 bp, Rattus norvegicus
acaggagcgtgtctgtcttatcaat

SEQ ID NO: 76660 - DNA, 25 bp, Rattus norvegicus
acaggagcgtgtgtgtcttatcaat

SEQ ID NO: 76661 - DNA, 25 bp, Rattus norvegicus
acaggagctgctatctaccacaaat

SEQ ID NO: 76662 - DNA, 25 bp, Rattus norvegicus
acaggagctgctttctaccacaaat

SEQ ID NO: 76663 - DNA, 25 bp, Rattus norvegicus
acaggagcttatccggatgccctct

SEQ ID NO: 76664 - DNA, 25 bp, Rattus norvegicus
acaggagcttatgcggatgccctct

SEQ ID NO: 76665 - DNA, 25 bp, Rattus norvegicus
acaggaggacctcctgtcttgcagt

SEQ ID NO: 76666 - DNA, 25 bp, Rattus norvegicus
acaggaggacctgctgtcttgcagt

SEQ ID NO: 76667 - DNA, 25 bp, Rattus norvegicus
acaggaggcagcacccgacgcctgg

SEQ ID NO: 76668 - DNA, 25 bp, Rattus norvegicus
acaggaggcagctcccgacgcctgg

SEQ ID NO: 76669 - DNA, 25 bp, Rattus norvegicus
acaggaggccccagcccagcgggtt

SEQ ID NO: 76670 - DNA, 25 bp, Rattus norvegicus
acaggaggcccctgcccagcgggtt

SEQ ID NO: 76671 - DNA, 25 bp, Rattus norvegicus
acaggaggccggattgtcccaaggt

SEQ ID NO: 76672 - DNA, 25 bp, Rattus norvegicus
acaggaggccggtttgtcccaaggt

SEQ ID NO: 76673 - DNA, 25 bp, Rattus norvegicus
acaggaggcctgaaaatccagtgct

SEQ ID NO: 76674 - DNA, 25 bp, Rattus norvegicus
acaggaggcctgtaaatccagtgct

SEQ ID NO: 76675 - DNA, 25 bp, Rattus norvegicus
acaggaggctgcagggactgtcaca

SEQ ID NO: 76676 - DNA, 25 bp, Rattus norvegicus
acaggaggctgctgggactgtcaca

SEQ ID NO: 76677 - DNA, 25 bp, Rattus norvegicus
acaggaggctgtactccctgggttc

SEQ ID NO: 76678 - DNA, 25 bp, Rattus norvegicus
acaggaggctgttctccctgggttc

SEQ ID NO: 76679 - DNA, 25 bp, Rattus norvegicus
acaggagggcttcagtttcccactc

SEQ ID NO: 76680 - DNA, 25 bp, Rattus norvegicus
acaggagggcttgagtttcccactc

SEQ ID NO: 76681 - DNA, 25 bp, Rattus norvegicus
acaggaggtcttaatctatgttaag

SEQ ID NO: 76682 - DNA, 25 bp, Rattus norvegicus
acaggaggtctttatctatgttaag

SEQ ID NO: 76683 - DNA, 25 bp, Rattus norvegicus
acaggaggtgcacggacttccttac

SEQ ID NO: 76684 - DNA, 25 bp, Rattus norvegicus
acaggaggtgcagggacttccttac

SEQ ID NO: 76685 - DNA, 25 bp, Rattus norvegicus
acaggaggttctcacgctctgatga

SEQ ID NO: 76686 - DNA, 25 bp, Rattus norvegicus
acaggaggttctgacgctctgatga

SEQ ID NO: 76687 - DNA, 25 bp, Rattus norvegicus
acaggagtagctcatgtccagccaa

SEQ ID NO: 76688 - DNA, 25 bp, Rattus norvegicus
acaggagtagctgatgtccagccaa

SEQ ID NO: 76689 - DNA, 25 bp, Rattus norvegicus
acaggagtcatcacttcaaaggcag

SEQ ID NO: 76690 - DNA, 25 bp, Rattus norvegicus
acaggagtcatctcttcaaaggcag

SEQ ID NO: 76691 - DNA, 25 bp, Rattus norvegicus
acaggagtcgaaagacccgtccaga

SEQ ID NO: 76692 - DNA, 25 bp, Rattus norvegicus
acaggagtcgaatgacccgtccaga

SEQ ID NO: 76693 - DNA, 25 bp, Rattus norvegicus
acaggagtcgatagcggcagttgat

SEQ ID NO: 76694 - DNA, 25 bp, Rattus norvegicus
acaggagtcgattgcggcagttgat

SEQ ID NO: 76695 - DNA, 25 bp, Rattus norvegicus
acaggagtctcacaatcgtccgatt

SEQ ID NO: 76696 - DNA, 25 bp, Rattus norvegicus
acaggagtctcagaatcgtccgatt

SEQ ID NO: 76697 - DNA, 25 bp, Rattus norvegicus
acaggagtctgtcaggaaagcatct

SEQ ID NO: 76698 - DNA, 25 bp, Rattus norvegicus
acaggagtctgtgaggaaagcatct

SEQ ID NO: 76699 - DNA, 25 bp, Rattus norvegicus
acaggagtgcgaaatgagagagtac

SEQ ID NO: 76700 - DNA, 25 bp, Rattus norvegicus
acaggagtgcgatatgagagagtac

SEQ ID NO: 76701 - DNA, 25 bp, Rattus norvegicus
acaggagtgcgtcatgttctttgga

SEQ ID NO: 76702 - DNA, 25 bp, Rattus norvegicus
acaggagtgcgtgatgttctttgga

SEQ ID NO: 76703 - DNA, 25 bp, Rattus norvegicus
acaggagtgtggcttgtagtactta

SEQ ID NO: 76704 - DNA, 25 bp, Rattus norvegicus
acaggagtgtgggttgtagtactta

SEQ ID NO: 76705 - DNA, 25 bp, Rattus norvegicus
acaggagtgtgtatgtcccagagca

SEQ ID NO: 76706 - DNA, 25 bp, Rattus norvegicus
acaggagtgtgtttgtcccagagca

SEQ ID NO: 76707 - DNA, 25 bp, Rattus norvegicus
acaggagttacacccttgcaggcct

SEQ ID NO: 76708 - DNA, 25 bp, Rattus norvegicus
acaggagttacagccttgcaggcct

SEQ ID NO: 76709 - DNA, 25 bp, Rattus norvegicus
acaggagttattagggcttcagttc

SEQ ID NO: 76710 - DNA, 25 bp, Rattus norvegicus
acaggagttatttgggcttcagttc

SEQ ID NO: 76711 - DNA, 25 bp, Rattus norvegicus
acaggagttcatctggtgtggcata

SEQ ID NO: 76712 - DNA, 25 bp, Rattus norvegicus
acaggagttcatgtggtgtggcata

SEQ ID NO: 76713 - DNA, 25 bp, Rattus norvegicus
acaggagttcctcagtcagttccca

SEQ ID NO: 76714 - DNA, 25 bp, Rattus norvegicus
acaggagttcctgagtcagttccca

SEQ ID NO: 76715 - DNA, 25 bp, Rattus norvegicus
acaggatagcggaccctggcgacaa

SEQ ID NO: 76716 - DNA, 25 bp, Rattus norvegicus
acaggatagcggtccctggcgacaa

SEQ ID NO: 76717 - DNA, 25 bp, Rattus norvegicus
acaggatattccattagtggtggaa

SEQ ID NO: 76718 - DNA, 25 bp, Rattus norvegicus
acaggatattcctttagtggtggaa

SEQ ID NO: 76719 - DNA, 25 bp, Rattus norvegicus
acaggatcagaccagccgtgttcat

SEQ ID NO: 76720 - DNA, 25 bp, Rattus norvegicus
acaggatcagacgagccgtgttcat

SEQ ID NO: 76721 - DNA, 25 bp, Rattus norvegicus
acaggatccagcacactctaagcca

SEQ ID NO: 76722 - DNA, 25 bp, Rattus norvegicus
acaggatccagctcactctaagcca

SEQ ID NO: 76723 - DNA, 25 bp, Rattus norvegicus
acaggatcccagaggaacagttcca

SEQ ID NO: 76724 - DNA, 25 bp, Rattus norvegicus
acaggatcccagtggaacagttcca

SEQ ID NO: 76725 - DNA, 25 bp, Rattus norvegicus
acaggatcctgtccatggattttca

SEQ ID NO: 76726 - DNA, 25 bp, Rattus norvegicus
acaggatcctgtgcatggattttca

SEQ ID NO: 76727 - DNA, 25 bp, Rattus norvegicus
acaggatctccaagatgcacgacaa

SEQ ID NO: 76728 - DNA, 25 bp, Rattus norvegicus
acaggatctccaaggaatcccagat

SEQ ID NO: 76729 - DNA, 25 bp, Rattus norvegicus
acaggatctccatgatgcacgacaa

SEQ ID NO: 76730 - DNA, 25 bp, Rattus norvegicus
acaggatctccatggaatcccagat

SEQ ID NO: 76731 - DNA, 25 bp, Rattus norvegicus
acaggatctcctctcacacatgtga

SEQ ID NO: 76732 - DNA, 25 bp, Rattus norvegicus
acaggatctcctgtcacacatgtga

SEQ ID NO: 76733 - DNA, 25 bp, Rattus norvegicus
acaggatctctcaatagaccagaaa

SEQ ID NO: 76734 - DNA, 25 bp, Rattus norvegicus
acaggatctctctatagaccagaaa

SEQ ID NO: 76735 - DNA, 25 bp, Rattus norvegicus
acaggatctgcgatgaactcattgc

SEQ ID NO: 76736 - DNA, 25 bp, Rattus norvegicus
acaggatctgcgttgaactcattgc

SEQ ID NO: 76737 - DNA, 25 bp, Rattus norvegicus
acaggatcttcaacagacgctccat

SEQ ID NO: 76738 - DNA, 25 bp, Rattus norvegicus
acaggatcttcatcagacgctccat

SEQ ID NO: 76739 - DNA, 25 bp, Rattus norvegicus
acaggatgagcacgcctgtcttcct

SEQ ID NO: 76740 - DNA, 25 bp, Rattus norvegicus
acaggatgagcaggcctgtcttcct

SEQ ID NO: 76741 - DNA, 25 bp, Rattus norvegicus
acaggatgcaagaagccgtcagctc

SEQ ID NO: 76742 - DNA, 25 bp, Rattus norvegicus
acaggatgcaagtagccgtcagctc

SEQ ID NO: 76743 - DNA, 25 bp, Rattus norvegicus
acaggatggtctctttgccgtcctt

SEQ ID NO: 76744 - DNA, 25 bp, Rattus norvegicus
acaggatggtctgtttgccgtcctt

SEQ ID NO: 76745 - DNA, 25 bp, Rattus norvegicus
acaggatgtaccaccagaacccaag

SEQ ID NO: 76746 - DNA, 25 bp, Rattus norvegicus
acaggatgtacctccagaacccaag

SEQ ID NO: 76747 - DNA, 25 bp, Rattus norvegicus
acaggatgttccacatagcttttta

SEQ ID NO: 76748 - DNA, 25 bp, Rattus norvegicus
acaggatgttcctcatagcttttta

SEQ ID NO: 76749 - DNA, 25 bp, Rattus norvegicus
acaggattaacacctttgtgagttg

SEQ ID NO: 76750 - DNA, 25 bp, Rattus norvegicus
acaggattaacagctttgtgagttg

SEQ ID NO: 76751 - DNA, 25 bp, Rattus norvegicus
acaggattccaaagacgtcgtataa

SEQ ID NO: 76752 - DNA, 25 bp, Rattus norvegicus
acaggattccaatgacgtcgtataa

SEQ ID NO: 76753 - DNA, 25 bp, Rattus norvegicus
acaggattccttacgagctgatcat

SEQ ID NO: 76754 - DNA, 25 bp, Rattus norvegicus
acaggattcctttcgagctgatcat

SEQ ID NO: 76755 - DNA, 25 bp, Rattus norvegicus
acaggattcttgctgtgctctggcc

SEQ ID NO: 76756 - DNA, 25 bp, Rattus norvegicus
acaggattcttggtgtgctctggcc

SEQ ID NO: 76757 - DNA, 25 bp, Rattus norvegicus
acaggattctttccccaaggctatg

SEQ ID NO: 76758 - DNA, 25 bp, Rattus norvegicus
acaggattctttgcccaaggctatg

SEQ ID NO: 76759 - DNA, 25 bp, Rattus norvegicus
acaggattgagtatagtgttttcta

SEQ ID NO: 76760 - DNA, 25 bp, Rattus norvegicus
acaggattgagtttagtgttttcta

SEQ ID NO: 76761 - DNA, 25 bp, Rattus norvegicus
acaggattggcgcttttgggtacat

SEQ ID NO: 76762 - DNA, 25 bp, Rattus norvegicus
acaggattggcggttttgggtacat

SEQ ID NO: 76763 - DNA, 25 bp, Rattus norvegicus
acaggattggctactgcccaggctg

SEQ ID NO: 76764 - DNA, 25 bp, Rattus norvegicus
acaggattggcttctgcccaggctg

SEQ ID NO: 76765 - DNA, 25 bp, Rattus norvegicus
acaggattgtcaccctactatcggt

SEQ ID NO: 76766 - DNA, 25 bp, Rattus norvegicus
acaggattgtcagcctactatcggt

SEQ ID NO: 76767 - DNA, 25 bp, Rattus norvegicus
acaggattgtctcgcctgtggctta

SEQ ID NO: 76768 - DNA, 25 bp, Rattus norvegicus
acaggattgtctggcctgtggctta

SEQ ID NO: 76769 - DNA, 25 bp, Rattus norvegicus
acaggattgtgtactctagagcttc

SEQ ID NO: 76770 - DNA, 25 bp, Rattus norvegicus
acaggattgtgttctctagagcttc

SEQ ID NO: 76771 - DNA, 25 bp, Rattus norvegicus
acaggatttgtgcttctcccagaaa

SEQ ID NO: 76772 - DNA, 25 bp, Rattus norvegicus
acaggatttgtggttctcccagaaa

SEQ ID NO: 76773 - DNA, 25 bp, Rattus norvegicus
acaggcaaagtgaccttgttaaagg

SEQ ID NO: 76774 - DNA, 25 bp, Rattus norvegicus
acaggcaaagtgtccttgttaaagg

SEQ ID NO: 76775 - DNA, 25 bp, Rattus norvegicus
acaggcaaatgtacaagttcaaggc

SEQ ID NO: 76776 - DNA, 25 bp, Rattus norvegicus
acaggcaaatgttcaagttcaaggc

SEQ ID NO: 76777 - DNA, 25 bp, Rattus norvegicus
acaggcaacatgacttggcttcaga

SEQ ID NO: 76778 - DNA, 25 bp, Rattus norvegicus
acaggcaacatgtcttggcttcaga

SEQ ID NO: 76779 - DNA, 25 bp, Rattus norvegicus
acaggcaatgatattctggaatcac

SEQ ID NO: 76780 - DNA, 25 bp, Rattus norvegicus
acaggcaatgattttctggaatcac

SEQ ID NO: 76781 - DNA, 25 bp, Rattus norvegicus
acaggcaattccagagagcgaggct

SEQ ID NO: 76782 - DNA, 25 bp, Rattus norvegicus
acaggcaattcctgagagcgaggct

SEQ ID NO: 76783 - DNA, 25 bp, Rattus norvegicus
acaggcacaactctcttctcagaac

SEQ ID NO: 76784 - DNA, 25 bp, Rattus norvegicus
acaggcacaactgtcttctcagaac

SEQ ID NO: 76785 - DNA, 25 bp, Rattus norvegicus
acaggcacacgcactagcataatca

SEQ ID NO: 76786 - DNA, 25 bp, Rattus norvegicus
acaggcacacgctctagcataatca

SEQ ID NO: 76787 - DNA, 25 bp, Rattus norvegicus
acaggcacactccactgtttgcagc

SEQ ID NO: 76788 - DNA, 25 bp, Rattus norvegicus
acaggcacactcgactgtttgcagc

SEQ ID NO: 76789 - DNA, 25 bp, Rattus norvegicus
acaggcacactgacggcggcgagaa

SEQ ID NO: 76790 - DNA, 25 bp, Rattus norvegicus
acaggcacactgtcggcggcgagaa

SEQ ID NO: 76791 - DNA, 25 bp, Rattus norvegicus
acaggcacatccacagtgctgtttg

SEQ ID NO: 76792 - DNA, 25 bp, Rattus norvegicus
acaggcacatcctcagtgctgtttg

SEQ ID NO: 76793 - DNA, 25 bp, Rattus norvegicus
acaggcaccacgagacagctatgaa

SEQ ID NO: 76794 - DNA, 25 bp, Rattus norvegicus
acaggcaccacgtgacagctatgaa

SEQ ID NO: 76795 - DNA, 25 bp, Rattus norvegicus
acaggcaccagccacctaaacggtt

SEQ ID NO: 76796 - DNA, 25 bp, Rattus norvegicus
acaggcaccagcgacctaaacggtt

SEQ ID NO: 76797 - DNA, 25 bp, Rattus norvegicus
acaggcaccgggaatgaggcattag

SEQ ID NO: 76798 - DNA, 25 bp, Rattus norvegicus
acaggcaccgggtatgaggcattag

SEQ ID NO: 76799 - DNA, 25 bp, Rattus norvegicus
acaggcactgcgatctcaggatgga

SEQ ID NO: 76800 - DNA, 25 bp, Rattus norvegicus
acaggcactgcgttctcaggatgga

SEQ ID NO: 76801 - DNA, 25 bp, Rattus norvegicus
acaggcactgctcgccaatgagagt

SEQ ID NO: 76802 - DNA, 25 bp, Rattus norvegicus
acaggcactgctggccaatgagagt

SEQ ID NO: 76803 - DNA, 25 bp, Rattus norvegicus
acaggcactggaatgtggactcaac

SEQ ID NO: 76804 - DNA, 25 bp, Rattus norvegicus
acaggcactggattgtggactcaac

SEQ ID NO: 76805 - DNA, 25 bp, Rattus norvegicus
acaggcagagccagcgagaaccaca

SEQ ID NO: 76806 - DNA, 25 bp, Rattus norvegicus
acaggcagagcctgcgagaaccaca

SEQ ID NO: 76807 - DNA, 25 bp, Rattus norvegicus
acaggcagcagcatttgcgcttgat

SEQ ID NO: 76808 - DNA, 25 bp, Rattus norvegicus
acaggcagcagcttttgcgcttgat

SEQ ID NO: 76809 - DNA, 25 bp, Rattus norvegicus
acaggcagccgacgtgatcaggaca

SEQ ID NO: 76810 - DNA, 25 bp, Rattus norvegicus
acaggcagccgaggtgatcaggaca

SEQ ID NO: 76811 - DNA, 25 bp, Rattus norvegicus
acaggcagcgtgcagggattccctc

SEQ ID NO: 76812 - DNA, 25 bp, Rattus norvegicus
acaggcagcgtggagggattccctc

SEQ ID NO: 76813 - DNA, 25 bp, Rattus norvegicus
acaggcagctgtcgccagctacaat

SEQ ID NO: 76814 - DNA, 25 bp, Rattus norvegicus
acaggcagctgtggccagctacaat

SEQ ID NO: 76815 - DNA, 25 bp, Rattus norvegicus
acaggcagctttacaacgggttcag

SEQ ID NO: 76816 - DNA, 25 bp, Rattus norvegicus
acaggcagcttttcaacgggttcag

SEQ ID NO: 76817 - DNA, 25 bp, Rattus norvegicus
acaggcaggcgaactgtgacagagc

SEQ ID NO: 76818 - DNA, 25 bp, Rattus norvegicus
acaggcaggcgatctgtgacagagc

SEQ ID NO: 76819 - DNA, 25 bp, Rattus norvegicus
acaggcaggctacgtgggtttcaca

SEQ ID NO: 76820 - DNA, 25 bp, Rattus norvegicus
acaggcaggctaggtgggtttcaca

SEQ ID NO: 76821 - DNA, 25 bp, Rattus norvegicus
acaggcaggtctacccttgttgtaa

SEQ ID NO: 76822 - DNA, 25 bp, Rattus norvegicus
acaggcaggtctctctgtttttgag

SEQ ID NO: 76823 - DNA, 25 bp, Rattus norvegicus
acaggcaggtctgtctgtttttgag

SEQ ID NO: 76824 - DNA, 25 bp, Rattus norvegicus
acaggcaggtcttcccttgttgtaa

SEQ ID NO: 76825 - DNA, 25 bp, Rattus norvegicus
acaggcaggtgtacactgtgtacct

SEQ ID NO: 76826 - DNA, 25 bp, Rattus norvegicus
acaggcaggtgttcactgtgtacct

SEQ ID NO: 76827 - DNA, 25 bp, Rattus norvegicus
acaggcagtcttcttcaaccggaac

SEQ ID NO: 76828 - DNA, 25 bp, Rattus norvegicus
acaggcagtcttgttcaaccggaac

SEQ ID NO: 76829 - DNA, 25 bp, Rattus norvegicus
acaggcagtgctcgccacagagcac

SEQ ID NO: 76830 - DNA, 25 bp, Rattus norvegicus
acaggcagtgctggccacagagcac

SEQ ID NO: 76831 - DNA, 25 bp, Rattus norvegicus
acaggcagttcaccaactgtgggct

SEQ ID NO: 76832 - DNA, 25 bp, Rattus norvegicus
acaggcagttcagcaactgtgggct

SEQ ID NO: 76833 - DNA, 25 bp, Rattus norvegicus
acaggcagttttctctgagcccagc

SEQ ID NO: 76834 - DNA, 25 bp, Rattus norvegicus
acaggcagttttgtctgagcccagc

SEQ ID NO: 76835 - DNA, 25 bp, Rattus norvegicus
acaggcatattcaactatacccagt

SEQ ID NO: 76836 - DNA, 25 bp, Rattus norvegicus
acaggcatattctactatacccagt

SEQ ID NO: 76837 - DNA, 25 bp, Rattus norvegicus
acaggcatcatgagggtcattcaga

SEQ ID NO: 76838 - DNA, 25 bp, Rattus norvegicus
acaggcatcatgtgggtcattcaga

SEQ ID NO: 76839 - DNA, 25 bp, Rattus norvegicus
acaggcatcctcctcgaagaaagta

SEQ ID NO: 76840 - DNA, 25 bp, Rattus norvegicus
acaggcatcctcgtcgaagaaagta

SEQ ID NO: 76841 - DNA, 25 bp, Rattus norvegicus
acaggcatcttgaatttccctaaag

SEQ ID NO: 76842 - DNA, 25 bp, Rattus norvegicus
acaggcatcttgtatttccctaaag

SEQ ID NO: 76843 - DNA, 25 bp, Rattus norvegicus
acaggcatgagaccttacaggaaat

SEQ ID NO: 76844 - DNA, 25 bp, Rattus norvegicus
acaggcatgagagcttacaggaaat

SEQ ID NO: 76845 - DNA, 25 bp, Rattus norvegicus
acaggcatgcctctgacctggcaaa

SEQ ID NO: 76846 - DNA, 25 bp, Rattus norvegicus
acaggcatgcctgtgacctggcaaa

SEQ ID NO: 76847 - DNA, 25 bp, Rattus norvegicus
acaggcatggaaaccttgccttact

SEQ ID NO: 76848 - DNA, 25 bp, Rattus norvegicus
acaggcatggaatccttgccttact

SEQ ID NO: 76849 - DNA, 25 bp, Rattus norvegicus
acaggcattaacactccgttactga

SEQ ID NO: 76850 - DNA, 25 bp, Rattus norvegicus
acaggcattaactctccgttactga

SEQ ID NO: 76851 - DNA, 25 bp, Rattus norvegicus
acaggcattcatcacaatggctgca

SEQ ID NO: 76852 - DNA, 25 bp, Rattus norvegicus
acaggcattcatgacaatggctgca

SEQ ID NO: 76853 - DNA, 25 bp, Rattus norvegicus
acaggcattcccattgtaacttagg

SEQ ID NO: 76854 - DNA, 25 bp, Rattus norvegicus
acaggcattccctttgtaacttagg

SEQ ID NO: 76855 - DNA, 25 bp, Rattus norvegicus
acaggcatttgcagcttcgtagttc

SEQ ID NO: 76856 - DNA, 25 bp, Rattus norvegicus
acaggcatttgctgcttcgtagttc

SEQ ID NO: 76857 - DNA, 25 bp, Rattus norvegicus
acaggccaacgaagtagctaccagc

SEQ ID NO: 76858 - DNA, 25 bp, Rattus norvegicus
acaggccaacgatgtagctaccagc

SEQ ID NO: 76859 - DNA, 25 bp, Rattus norvegicus
acaggccaactgaacagacgtgtgg

SEQ ID NO: 76860 - DNA, 25 bp, Rattus norvegicus
acaggccaactgtacagacgtgtgg

SEQ ID NO: 76861 - DNA, 25 bp, Rattus norvegicus
acaggccaagacatcgagcgttttt

SEQ ID NO: 76862 - DNA, 25 bp, Rattus norvegicus
acaggccaagacttcgagcgttttt

SEQ ID NO: 76863 - DNA, 25 bp, Rattus norvegicus
acaggccaagtgcagagtttctctc

SEQ ID NO: 76864 - DNA, 25 bp, Rattus norvegicus
acaggccaagtggagagtttctctc

SEQ ID NO: 76865 - DNA, 25 bp, Rattus norvegicus
acaggccacagtatagagtagtaag

SEQ ID NO: 76866 - DNA, 25 bp, Rattus norvegicus
acaggccacagtttagagtagtaag

SEQ ID NO: 76867 - DNA, 25 bp, Rattus norvegicus
acaggccagcttaataattatttat

SEQ ID NO: 76868 - DNA, 25 bp, Rattus norvegicus
acaggccagctttataattatttat

SEQ ID NO: 76869 - DNA, 25 bp, Rattus norvegicus
acaggccagggcatgagactcagga

SEQ ID NO: 76870 - DNA, 25 bp, Rattus norvegicus
acaggccagggcttgagactcagga

SEQ ID NO: 76871 - DNA, 25 bp, Rattus norvegicus
acaggccatggcacttagctgaaag

SEQ ID NO: 76872 - DNA, 25 bp, Rattus norvegicus
acaggccatggctcttagctgaaag

SEQ ID NO: 76873 - DNA, 25 bp, Rattus norvegicus
acaggcccaagcaggaaggaattta

SEQ ID NO: 76874 - DNA, 25 bp, Rattus norvegicus
acaggcccaagctggaaggaattta

SEQ ID NO: 76875 - DNA, 25 bp, Rattus norvegicus
acaggcccattaaggtgaacctcct

SEQ ID NO: 76876 - DNA, 25 bp, Rattus norvegicus
acaggcccattatggtgaacctcct

SEQ ID NO: 76877 - DNA, 25 bp, Rattus norvegicus
acaggccctcaaaggctgtgagcgg

SEQ ID NO: 76878 - DNA, 25 bp, Rattus norvegicus
acaggccctcaatggctgtgagcgg

SEQ ID NO: 76879 - DNA, 25 bp, Rattus norvegicus
acaggccctttgcttctgctgagaa

SEQ ID NO: 76880 - DNA, 25 bp, Rattus norvegicus
acaggccctttggttctgctgagaa

SEQ ID NO: 76881 - DNA, 25 bp, Rattus norvegicus
acaggccgagccactgtccaaggag

SEQ ID NO: 76882 - DNA, 25 bp, Rattus norvegicus
acaggccgagcctctgtccaaggag

SEQ ID NO: 76883 - DNA, 25 bp, Rattus norvegicus
acaggccgcagcattgccgtgcaca

SEQ ID NO: 76884 - DNA, 25 bp, Rattus norvegicus
acaggccgcagctttgccgtgcaca

SEQ ID NO: 76885 - DNA, 25 bp, Rattus norvegicus
acaggccgccacagaggaccaaaga

SEQ ID NO: 76886 - DNA, 25 bp, Rattus norvegicus
acaggccgccactgaggaccaaaga

SEQ ID NO: 76887 - DNA, 25 bp, Rattus norvegicus
acaggccggcctcaggttcacagtc

SEQ ID NO: 76888 - DNA, 25 bp, Rattus norvegicus
acaggccggcctgaggttcacagtc

SEQ ID NO: 76889 - DNA, 25 bp, Rattus norvegicus
acaggccggctgagtctttgtgcat

SEQ ID NO: 76890 - DNA, 25 bp, Rattus norvegicus
acaggccggctgtgtctttgtgcat

SEQ ID NO: 76891 - DNA, 25 bp, Rattus norvegicus
acaggccgtgtaacttgagatagca

SEQ ID NO: 76892 - DNA, 25 bp, Rattus norvegicus
acaggccgtgtatcttgagatagca

SEQ ID NO: 76893 - DNA, 25 bp, Rattus norvegicus
acaggccgtgttcctaactctttca

SEQ ID NO: 76894 - DNA, 25 bp, Rattus norvegicus
acaggccgtgttgctaactctttca

SEQ ID NO: 76895 - DNA, 25 bp, Rattus norvegicus
acaggcctacggaaggccaatcagc

SEQ ID NO: 76896 - DNA, 25 bp, Rattus norvegicus
acaggcctacggtaggccaatcagc

SEQ ID NO: 76897 - DNA, 25 bp, Rattus norvegicus
acaggcctcaggacatcatcgtgtt

SEQ ID NO: 76898 - DNA, 25 bp, Rattus norvegicus
acaggcctcaggtcatcatcgtgtt

SEQ ID NO: 76899 - DNA, 25 bp, Rattus norvegicus
acaggcctcctgctaataggccata

SEQ ID NO: 76900 - DNA, 25 bp, Rattus norvegicus
acaggcctcctggtaataggccata

SEQ ID NO: 76901 - DNA, 25 bp, Rattus norvegicus
acaggcctcgatcgtagcatgcgct

SEQ ID NO: 76902 - DNA, 25 bp, Rattus norvegicus
acaggcctcgatggtagcatgcgct

SEQ ID NO: 76903 - DNA, 25 bp, Rattus norvegicus
acaggcctctctatacctgaggaaa

SEQ ID NO: 76904 - DNA, 25 bp, Rattus norvegicus
acaggcctctctttacctgaggaaa

SEQ ID NO: 76905 - DNA, 25 bp, Rattus norvegicus
acaggcctctgcacgccagaggaca

SEQ ID NO: 76906 - DNA, 25 bp, Rattus norvegicus
acaggcctctgctcgccagaggaca

SEQ ID NO: 76907 - DNA, 25 bp, Rattus norvegicus
acaggcctctggcaaaccttcttgg

SEQ ID NO: 76908 - DNA, 25 bp, Rattus norvegicus
acaggcctctgggaaaccttcttgg

SEQ ID NO: 76909 - DNA, 25 bp, Rattus norvegicus
acaggcctgcgactactatttccgt

SEQ ID NO: 76910 - DNA, 25 bp, Rattus norvegicus
acaggcctgcgagtactatttccgt

SEQ ID NO: 76911 - DNA, 25 bp, Rattus norvegicus
acaggcctgctgattggtgtccatg

SEQ ID NO: 76912 - DNA, 25 bp, Rattus norvegicus
acaggcctgctgcaactgacacatc

SEQ ID NO: 76913 - DNA, 25 bp, Rattus norvegicus
acaggcctgctggaactgacacatc

SEQ ID NO: 76914 - DNA, 25 bp, Rattus norvegicus
acaggcctgctgtttggtgtccatg

SEQ ID NO: 76915 - DNA, 25 bp, Rattus norvegicus
acaggcctggctaggctctgtgcag

SEQ ID NO: 76916 - DNA, 25 bp, Rattus norvegicus
acaggcctggcttggctctgtgcag

SEQ ID NO: 76917 - DNA, 25 bp, Rattus norvegicus
acaggcctgggcatgggcagcacca

SEQ ID NO: 76918 - DNA, 25 bp, Rattus norvegicus
acaggcctgggcttgggcagcacca

SEQ ID NO: 76919 - DNA, 25 bp, Rattus norvegicus
acaggcctggtgatgagacgcgtat

SEQ ID NO: 76920 - DNA, 25 bp, Rattus norvegicus
acaggcctggtgttgagacgcgtat

SEQ ID NO: 76921 - DNA, 25 bp, Rattus norvegicus
acaggcctgtgactcccagggaaag

SEQ ID NO: 76922 - DNA, 25 bp, Rattus norvegicus
acaggcctgtgagtcccagggaaag

SEQ ID NO: 76923 - DNA, 25 bp, Rattus norvegicus
acaggccttcccagagactcaggag

SEQ ID NO: 76924 - DNA, 25 bp, Rattus norvegicus
acaggccttcccagtatggactaat

SEQ ID NO: 76925 - DNA, 25 bp, Rattus norvegicus
acaggccttccctgagactcaggag

SEQ ID NO: 76926 - DNA, 25 bp, Rattus norvegicus
acaggccttccctgtatggactaat

SEQ ID NO: 76927 - DNA, 25 bp, Rattus norvegicus
acaggccttgatcaacttggtatta

SEQ ID NO: 76928 - DNA, 25 bp, Rattus norvegicus
acaggccttgatgaacttggtatta

SEQ ID NO: 76929 - DNA, 25 bp, Rattus norvegicus
acaggccttgcacctaggttccgag

SEQ ID NO: 76930 - DNA, 25 bp, Rattus norvegicus
acaggccttgcagctaggttccgag

SEQ ID NO: 76931 - DNA, 25 bp, Rattus norvegicus
acaggccttgtcactgatgtaccag

SEQ ID NO: 76932 - DNA, 25 bp, Rattus norvegicus
acaggccttgtctctgatgtaccag

SEQ ID NO: 76933 - DNA, 25 bp, Rattus norvegicus
acaggcctttgaaagtagtactcag

SEQ ID NO: 76934 - DNA, 25 bp, Rattus norvegicus
acaggcctttgaacttcctctttgg

SEQ ID NO: 76935 - DNA, 25 bp, Rattus norvegicus
acaggcctttgatagtagtactcag

SEQ ID NO: 76936 - DNA, 25 bp, Rattus norvegicus
acaggcctttgatcttcctctttgg

SEQ ID NO: 76937 - DNA, 25 bp, Rattus norvegicus
acaggcgaccgtccgtgactgaact

SEQ ID NO: 76938 - DNA, 25 bp, Rattus norvegicus
acaggcgaccgtgcgtgactgaact

SEQ ID NO: 76939 - DNA, 25 bp, Rattus norvegicus
acaggcgagctgaacggcagcctag

SEQ ID NO: 76940 - DNA, 25 bp, Rattus norvegicus
acaggcgagctgtacggcagcctag

SEQ ID NO: 76941 - DNA, 25 bp, Rattus norvegicus
acaggcgcagacctggtggacctca

SEQ ID NO: 76942 - DNA, 25 bp, Rattus norvegicus
acaggcgcagacgtggtggacctca

SEQ ID NO: 76943 - DNA, 25 bp, Rattus norvegicus
acaggcgccatgagtattgattata

SEQ ID NO: 76944 - DNA, 25 bp, Rattus norvegicus
acaggcgccatgtgtattgattata

SEQ ID NO: 76945 - DNA, 25 bp, Rattus norvegicus
acaggcgcctatcgatgggtccaca

SEQ ID NO: 76946 - DNA, 25 bp, Rattus norvegicus
acaggcgcctatggatgggtccaca

SEQ ID NO: 76947 - DNA, 25 bp, Rattus norvegicus
acaggcgcgcgaaaatccgcacagg

SEQ ID NO: 76948 - DNA, 25 bp, Rattus norvegicus
acaggcgcgcgataatccgcacagg

SEQ ID NO: 76949 - DNA, 25 bp, Rattus norvegicus
acaggcgctgatcaccccggacacc

SEQ ID NO: 76950 - DNA, 25 bp, Rattus norvegicus
acaggcgctgatgaccccggacacc

SEQ ID NO: 76951 - DNA, 25 bp, Rattus norvegicus
acaggcgctgtcagccagtgaggca

SEQ ID NO: 76952 - DNA, 25 bp, Rattus norvegicus
acaggcgctgtctgccagtgaggca

SEQ ID NO: 76953 - DNA, 25 bp, Rattus norvegicus
acaggcgctgtgcagttatcgtctc

SEQ ID NO: 76954 - DNA, 25 bp, Rattus norvegicus
acaggcgctgtggagttatcgtctc

SEQ ID NO: 76955 - DNA, 25 bp, Rattus norvegicus
acaggcggcatcatcactgagctgg

SEQ ID NO: 76956 - DNA, 25 bp, Rattus norvegicus
acaggcggcatcttcactgagctgg

SEQ ID NO: 76957 - DNA, 25 bp, Rattus norvegicus
acaggcggcctgcacatcagcaaaa

SEQ ID NO: 76958 - DNA, 25 bp, Rattus norvegicus
acaggcggcctggacatcagcaaaa

SEQ ID NO: 76959 - DNA, 25 bp, Rattus norvegicus
acaggcggctcaagggtttgtctct

SEQ ID NO: 76960 - DNA, 25 bp, Rattus norvegicus
acaggcggctcatgggtttgtctct

SEQ ID NO: 76961 - DNA, 25 bp, Rattus norvegicus
acaggcgggctaaggcttgactcta

SEQ ID NO: 76962 - DNA, 25 bp, Rattus norvegicus
acaggcgggctatggcttgactcta

SEQ ID NO: 76963 - DNA, 25 bp, Rattus norvegicus
acaggcggtcgcagtgccactgaaa

SEQ ID NO: 76964 - DNA, 25 bp, Rattus norvegicus
acaggcggtcgctgtgccactgaaa

SEQ ID NO: 76965 - DNA, 25 bp, Rattus norvegicus
acaggcgtatgtccttgcttaggga

SEQ ID NO: 76966 - DNA, 25 bp, Rattus norvegicus
acaggcgtatgtgcttgcttaggga

SEQ ID NO: 76967 - DNA, 25 bp, Rattus norvegicus
acaggcgtcatgaacgtgctatggg

SEQ ID NO: 76968 - DNA, 25 bp, Rattus norvegicus
acaggcgtcatgtacgtgctatggg

SEQ ID NO: 76969 - DNA, 25 bp, Rattus norvegicus
acaggcgtccagagcaaagcccctt

SEQ ID NO: 76970 - DNA, 25 bp, Rattus norvegicus
acaggcgtccagtgcaaagcccctt

SEQ ID NO: 76971 - DNA, 25 bp, Rattus norvegicus
acaggcgtggaaagtgcagtctcac

SEQ ID NO: 76972 - DNA, 25 bp, Rattus norvegicus
acaggcgtggaatgtgcagtctcac

SEQ ID NO: 76973 - DNA, 25 bp, Rattus norvegicus
acaggcgtggtcactgtggcatcag

SEQ ID NO: 76974 - DNA, 25 bp, Rattus norvegicus
acaggcgtggtctctgtggcatcag

SEQ ID NO: 76975 - DNA, 25 bp, Rattus norvegicus
acaggctaagcactggattgtccaa

SEQ ID NO: 76976 - DNA, 25 bp, Rattus norvegicus
acaggctaagcagtggattgtccaa

SEQ ID NO: 76977 - DNA, 25 bp, Rattus norvegicus
acaggctaagtgatctctgacatgc

SEQ ID NO: 76978 - DNA, 25 bp, Rattus norvegicus
acaggctaagtgttctctgacatgc

SEQ ID NO: 76979 - DNA, 25 bp, Rattus norvegicus
acaggctaatgcagggtttacccca

SEQ ID NO: 76980 - DNA, 25 bp, Rattus norvegicus
acaggctaatgctgggtttacccca

SEQ ID NO: 76981 - DNA, 25 bp, Rattus norvegicus
acaggctacggcagtaaaggaaaca

SEQ ID NO: 76982 - DNA, 25 bp, Rattus norvegicus
acaggctacggctgtaaaggaaaca

SEQ ID NO: 76983 - DNA, 25 bp, Rattus norvegicus
acaggctactgcatgctttgttact

SEQ ID NO: 76984 - DNA, 25 bp, Rattus norvegicus
acaggctactgcttgctttgttact

SEQ ID NO: 76985 - DNA, 25 bp, Rattus norvegicus
acaggctactggaatgtcaccgtgt

SEQ ID NO: 76986 - DNA, 25 bp, Rattus norvegicus
acaggctactggtatgtcaccgtgt

SEQ ID NO: 76987 - DNA, 25 bp, Rattus norvegicus
acaggctatagcatttttaccgatt

SEQ ID NO: 76988 - DNA, 25 bp, Rattus norvegicus
acaggctatagcttttttaccgatt

SEQ ID NO: 76989 - DNA, 25 bp, Rattus norvegicus
acaggctcaatcaagtccatgggaa

SEQ ID NO: 76990 - DNA, 25 bp, Rattus norvegicus
acaggctcaatctagtccatgggaa

SEQ ID NO: 76991 - DNA, 25 bp, Rattus norvegicus
acaggctcagcgacaaggccagata

SEQ ID NO: 76992 - DNA, 25 bp, Rattus norvegicus
acaggctcagcgtcaaggccagata

SEQ ID NO: 76993 - DNA, 25 bp, Rattus norvegicus
acaggctcagtgcaacggcgcagta

SEQ ID NO: 76994 - DNA, 25 bp, Rattus norvegicus
acaggctcagtggaacggcgcagta

SEQ ID NO: 76995 - DNA, 25 bp, Rattus norvegicus
acaggctcatccaggtgggtctcac

SEQ ID NO: 76996 - DNA, 25 bp, Rattus norvegicus
acaggctcatcctggtgggtctcac

SEQ ID NO: 76997 - DNA, 25 bp, Rattus norvegicus
acaggctcattcaggccgggaaatg

SEQ ID NO: 76998 - DNA, 25 bp, Rattus norvegicus
acaggctcattctggccgggaaatg

SEQ ID NO: 76999 - DNA, 25 bp, Rattus norvegicus
acaggctccccaagtaagtcccaca

SEQ ID NO: 77000 - DNA, 25 bp, Rattus norvegicus
acaggctccccatgtaagtcccaca

SEQ ID NO: 77001 - DNA, 25 bp, Rattus norvegicus
acaggctccctaagctttagttggt

SEQ ID NO: 77002 - DNA, 25 bp, Rattus norvegicus
acaggctccctatgctttagttggt

SEQ ID NO: 77003 - DNA, 25 bp, Rattus norvegicus
acaggctcctgtcatgccaagctgg

SEQ ID NO: 77004 - DNA, 25 bp, Rattus norvegicus
acaggctcctgtgatgccaagctgg

SEQ ID NO: 77005 - DNA, 25 bp, Rattus norvegicus
acaggctctcatcatgtagtccagg

SEQ ID NO: 77006 - DNA, 25 bp, Rattus norvegicus
acaggctctcatgatgtagtccagg

SEQ ID NO: 77007 - DNA, 25 bp, Rattus norvegicus
acaggctctctgatcttcagggtca

SEQ ID NO: 77008 - DNA, 25 bp, Rattus norvegicus
acaggctctctgttcttcagggtca

SEQ ID NO: 77009 - DNA, 25 bp, Rattus norvegicus
acaggctcttcgaggccccgggtga

SEQ ID NO: 77010 - DNA, 25 bp, Rattus norvegicus
acaggctcttcgtggccccgggtga

SEQ ID NO: 77011 - DNA, 25 bp, Rattus norvegicus
acaggctgacatctgtccatattgt

SEQ ID NO: 77012 - DNA, 25 bp, Rattus norvegicus
acaggctgacatgtgtccatattgt

SEQ ID NO: 77013 - DNA, 25 bp, Rattus norvegicus
acaggctgagagactctggcaggct

SEQ ID NO: 77014 - DNA, 25 bp, Rattus norvegicus
acaggctgagagtctctggcaggct

SEQ ID NO: 77015 - DNA, 25 bp, Rattus norvegicus
acaggctgagccagggagacattga

SEQ ID NO: 77016 - DNA, 25 bp, Rattus norvegicus
acaggctgagcctgggagacattga

SEQ ID NO: 77017 - DNA, 25 bp, Rattus norvegicus
acaggctgatcaccccgatgatgaa

SEQ ID NO: 77018 - DNA, 25 bp, Rattus norvegicus
acaggctgatcagcccgatgatgaa

SEQ ID NO: 77019 - DNA, 25 bp, Rattus norvegicus
acaggctgcacaacagagcggcaca

SEQ ID NO: 77020 - DNA, 25 bp, Rattus norvegicus
acaggctgcacatcagagcggcaca

SEQ ID NO: 77021 - DNA, 25 bp, Rattus norvegicus
acaggctgcagacgacactaaaggt

SEQ ID NO: 77022 - DNA, 25 bp, Rattus norvegicus
acaggctgcagaggacactaaaggt

SEQ ID NO: 77023 - DNA, 25 bp, Rattus norvegicus
acaggctgcagtcccgtgtacagag

SEQ ID NO: 77024 - DNA, 25 bp, Rattus norvegicus
acaggctgcagtgccgtgtacagag

SEQ ID NO: 77025 - DNA, 25 bp, Rattus norvegicus
acaggctgcgtacaagggtgactcc

SEQ ID NO: 77026 - DNA, 25 bp, Rattus norvegicus
acaggctgcgtagaagggtgactcc

SEQ ID NO: 77027 - DNA, 25 bp, Rattus norvegicus
acaggctgctggactgagatggact

SEQ ID NO: 77028 - DNA, 25 bp, Rattus norvegicus
acaggctgctggtctgagatggact

SEQ ID NO: 77029 - DNA, 25 bp, Rattus norvegicus
acaggctgctgtagatgcggtctcg

SEQ ID NO: 77030 - DNA, 25 bp, Rattus norvegicus
acaggctgctgttgatgcggtctcg

SEQ ID NO: 77031 - DNA, 25 bp, Rattus norvegicus
acaggctgcttcaggtgtgtcgtca

SEQ ID NO: 77032 - DNA, 25 bp, Rattus norvegicus
acaggctgcttctggtgtgtcgtca

SEQ ID NO: 77033 - DNA, 25 bp, Rattus norvegicus
acaggctggacactgccttgagctg

SEQ ID NO: 77034 - DNA, 25 bp, Rattus norvegicus
acaggctggacagtgccttgagctg

SEQ ID NO: 77035 - DNA, 25 bp, Rattus norvegicus
acaggctggcccctcagaaaaggag

SEQ ID NO: 77036 - DNA, 25 bp, Rattus norvegicus
acaggctggcccgtcagaaaaggag

SEQ ID NO: 77037 - DNA, 25 bp, Rattus norvegicus
acaggctgggcactgagtcccttta

SEQ ID NO: 77038 - DNA, 25 bp, Rattus norvegicus
acaggctgggcagtgagtcccttta

SEQ ID NO: 77039 - DNA, 25 bp, Rattus norvegicus
acaggctggttacctgacttcctca

SEQ ID NO: 77040 - DNA, 25 bp, Rattus norvegicus
acaggctggttagctgacttcctca

SEQ ID NO: 77041 - DNA, 25 bp, Rattus norvegicus
acaggctgtcgtccggtgaaaccta

SEQ ID NO: 77042 - DNA, 25 bp, Rattus norvegicus
acaggctgtcgtgcggtgaaaccta

SEQ ID NO: 77043 - DNA, 25 bp, Rattus norvegicus
acaggctgtgtcactagttattcca

SEQ ID NO: 77044 - DNA, 25 bp, Rattus norvegicus
acaggctgtgtctctagttattcca

SEQ ID NO: 77045 - DNA, 25 bp, Rattus norvegicus
acaggctgtttcagtcttgtgctga

SEQ ID NO: 77046 - DNA, 25 bp, Rattus norvegicus
acaggctgtttctgtcttgtgctga

SEQ ID NO: 77047 - DNA, 25 bp, Rattus norvegicus
acaggcttacatcaggaacaggatc

SEQ ID NO: 77048 - DNA, 25 bp, Rattus norvegicus
acaggcttacatgaggaacaggatc

SEQ ID NO: 77049 - DNA, 25 bp, Rattus norvegicus
acaggcttacggcttttccaggcac

SEQ ID NO: 77050 - DNA, 25 bp, Rattus norvegicus
acaggcttacgggttttccaggcac

SEQ ID NO: 77051 - DNA, 25 bp, Rattus norvegicus
acaggcttatttctaaaccatcatt

SEQ ID NO: 77052 - DNA, 25 bp, Rattus norvegicus
acaggcttatttgtaaaccatcatt

SEQ ID NO: 77053 - DNA, 25 bp, Rattus norvegicus
acaggcttcaagctcggtatcaact

SEQ ID NO: 77054 - DNA, 25 bp, Rattus norvegicus
acaggcttcaaggtcggtatcaact

SEQ ID NO: 77055 - DNA, 25 bp, Rattus norvegicus
acaggcttcactcgcgactcaggtg

SEQ ID NO: 77056 - DNA, 25 bp, Rattus norvegicus
acaggcttcactggcgactcaggtg

SEQ ID NO: 77057 - DNA, 25 bp, Rattus norvegicus
acaggcttcatgactttcagcgcga

SEQ ID NO: 77058 - DNA, 25 bp, Rattus norvegicus
acaggcttcatgtctttcagcgcga

SEQ ID NO: 77059 - DNA, 25 bp, Rattus norvegicus
acaggcttctttagctggctgcgca

SEQ ID NO: 77060 - DNA, 25 bp, Rattus norvegicus
acaggcttcttttgctggctgcgca

SEQ ID NO: 77061 - DNA, 25 bp, Rattus norvegicus
acaggcttgcacaggcgttgagact

SEQ ID NO: 77062 - DNA, 25 bp, Rattus norvegicus
acaggcttgcacatacatgttcaga

SEQ ID NO: 77063 - DNA, 25 bp, Rattus norvegicus
acaggcttgcactggcgttgagact

SEQ ID NO: 77064 - DNA, 25 bp, Rattus norvegicus
acaggcttgcacttacatgttcaga

SEQ ID NO: 77065 - DNA, 25 bp, Rattus norvegicus
acaggcttgcatacccatttctaga

SEQ ID NO: 77066 - DNA, 25 bp, Rattus norvegicus
acaggcttgcattcccatttctaga

SEQ ID NO: 77067 - DNA, 25 bp, Rattus norvegicus
acaggcttgcccaaatttcatctat

SEQ ID NO: 77068 - DNA, 25 bp, Rattus norvegicus
acaggcttgccctaatttcatctat

SEQ ID NO: 77069 - DNA, 25 bp, Rattus norvegicus
acaggcttgcttcactgttcagttc

SEQ ID NO: 77070 - DNA, 25 bp, Rattus norvegicus
acaggcttgcttctctgagcagagt

SEQ ID NO: 77071 - DNA, 25 bp, Rattus norvegicus
acaggcttgcttgactgttcagttc

SEQ ID NO: 77072 - DNA, 25 bp, Rattus norvegicus
acaggcttgcttgtctgagcagagt

SEQ ID NO: 77073 - DNA, 25 bp, Rattus norvegicus
acaggctttacgatctactcagatc

SEQ ID NO: 77074 - DNA, 25 bp, Rattus norvegicus
acaggctttacgttctactcagatc

SEQ ID NO: 77075 - DNA, 25 bp, Rattus norvegicus
acaggctttctgagcatgtactaga

SEQ ID NO: 77076 - DNA, 25 bp, Rattus norvegicus
acaggctttctgtgcatgtactaga

SEQ ID NO: 77077 - DNA, 25 bp, Rattus norvegicus
acaggctttgcgcagtgggcataaa

SEQ ID NO: 77078 - DNA, 25 bp, Rattus norvegicus
acaggctttgcggagtgggcataaa

SEQ ID NO: 77079 - DNA, 25 bp, Rattus norvegicus
acaggcttttgcatcctaaatttca

SEQ ID NO: 77080 - DNA, 25 bp, Rattus norvegicus
acaggcttttgcttcctaaatttca

SEQ ID NO: 77081 - DNA, 25 bp, Rattus norvegicus
acaggcttttgtaacttgcttagag

SEQ ID NO: 77082 - DNA, 25 bp, Rattus norvegicus
acaggcttttgttacttgcttagag

SEQ ID NO: 77083 - DNA, 25 bp, Rattus norvegicus
acaggctttttcattggacaatctt

SEQ ID NO: 77084 - DNA, 25 bp, Rattus norvegicus
acaggctttttctttggacaatctt

SEQ ID NO: 77085 - DNA, 25 bp, Rattus norvegicus
acagggaacatcacaatttaatagt

SEQ ID NO: 77086 - DNA, 25 bp, Rattus norvegicus
acagggaacatctcaatttaatagt

SEQ ID NO: 77087 - DNA, 25 bp, Rattus norvegicus
acagggaaccacagttctctgtgtg

SEQ ID NO: 77088 - DNA, 25 bp, Rattus norvegicus
acagggaaccactgttctctgtgtg

SEQ ID NO: 77089 - DNA, 25 bp, Rattus norvegicus
acagggaaccagagagtccccagga

SEQ ID NO: 77090 - DNA, 25 bp, Rattus norvegicus
acagggaaccagtgagtccccagga

SEQ ID NO: 77091 - DNA, 25 bp, Rattus norvegicus
acagggaactcaagccccaaacagg

SEQ ID NO: 77092 - DNA, 25 bp, Rattus norvegicus
acagggaactcatgccccaaacagg

SEQ ID NO: 77093 - DNA, 25 bp, Rattus norvegicus
acagggaagcccaggtttcagtctt

SEQ ID NO: 77094 - DNA, 25 bp, Rattus norvegicus
acagggaagccctggtttcagtctt

SEQ ID NO: 77095 - DNA, 25 bp, Rattus norvegicus
acagggaatattcaaggactctttt

SEQ ID NO: 77096 - DNA, 25 bp, Rattus norvegicus
acagggaatattgaaggactctttt

SEQ ID NO: 77097 - DNA, 25 bp, Rattus norvegicus
acagggaatccgctatcaagggcat

SEQ ID NO: 77098 - DNA, 25 bp, Rattus norvegicus
acagggaatccggtatcaagggcat

SEQ ID NO: 77099 - DNA, 25 bp, Rattus norvegicus
acagggaatgcactggctggtccat

SEQ ID NO: 77100 - DNA, 25 bp, Rattus norvegicus
acagggaatgcagtggctggtccat

SEQ ID NO: 77101 - DNA, 25 bp, Rattus norvegicus
acagggacaaagaccggcagagcct

SEQ ID NO: 77102 - DNA, 25 bp, Rattus norvegicus
acagggacaaagtccggcagagcct

SEQ ID NO: 77103 - DNA, 25 bp, Rattus norvegicus
acagggacaagcacagcagggctga

SEQ ID NO: 77104 - DNA, 25 bp, Rattus norvegicus
acagggacaagctcagcagggctga

SEQ ID NO: 77105 - DNA, 25 bp, Rattus norvegicus
acagggacacaccaaccatgggttt

SEQ ID NO: 77106 - DNA, 25 bp, Rattus norvegicus
acagggacacacgaaccatgggttt

SEQ ID NO: 77107 - DNA, 25 bp, Rattus norvegicus
acagggacaccacgaggagctctct

SEQ ID NO: 77108 - DNA, 25 bp, Rattus norvegicus
acagggacaccaggaggagctctct

SEQ ID NO: 77109 - DNA, 25 bp, Rattus norvegicus
acagggacactgattgtgctctgtc

SEQ ID NO: 77110 - DNA, 25 bp, Rattus norvegicus
acagggacactgtttgtgctctgtc

SEQ ID NO: 77111 - DNA, 25 bp, Rattus norvegicus
acagggacagccctatgaaccactt

SEQ ID NO: 77112 - DNA, 25 bp, Rattus norvegicus
acagggacagccgtatgaaccactt

SEQ ID NO: 77113 - DNA, 25 bp, Rattus norvegicus
acagggacaggtacccagtgtgctc

SEQ ID NO: 77114 - DNA, 25 bp, Rattus norvegicus
acagggacaggttcccagtgtgctc

SEQ ID NO: 77115 - DNA, 25 bp, Rattus norvegicus
acagggacccagcacaatcagatat

SEQ ID NO: 77116 - DNA, 25 bp, Rattus norvegicus
acagggacccaggacaatcagatat

SEQ ID NO: 77117 - DNA, 25 bp, Rattus norvegicus
acagggacccataatgtgaaaaaca

SEQ ID NO: 77118 - DNA, 25 bp, Rattus norvegicus
acagggacccattatgtgaaaaaca

SEQ ID NO: 77119 - DNA, 25 bp, Rattus norvegicus
acagggacctcaccagtacgcgggc

SEQ ID NO: 77120 - DNA, 25 bp, Rattus norvegicus
acagggacctcagcagtacgcgggc

SEQ ID NO: 77121 - DNA, 25 bp, Rattus norvegicus
acagggaccttgactccctatgtag

SEQ ID NO: 77122 - DNA, 25 bp, Rattus norvegicus
acagggaccttgatgagaggtagca

SEQ ID NO: 77123 - DNA, 25 bp, Rattus norvegicus
acagggaccttgctggtgtagtctt

SEQ ID NO: 77124 - DNA, 25 bp, Rattus norvegicus
acagggaccttggtggtgtagtctt

SEQ ID NO: 77125 - DNA, 25 bp, Rattus norvegicus
acagggaccttgtctccctatgtag

SEQ ID NO: 77126 - DNA, 25 bp, Rattus norvegicus
acagggaccttgttgagaggtagca

SEQ ID NO: 77127 - DNA, 25 bp, Rattus norvegicus
acagggactaaacgcaggccgagtt

SEQ ID NO: 77128 - DNA, 25 bp, Rattus norvegicus
acagggactaaaggcaggccgagtt

SEQ ID NO: 77129 - DNA, 25 bp, Rattus norvegicus
acagggactgccacaacatgaagct

SEQ ID NO: 77130 - DNA, 25 bp, Rattus norvegicus
acagggactgcctcaacatgaagct

SEQ ID NO: 77131 - DNA, 25 bp, Rattus norvegicus
acagggactgggatgacgctgctca

SEQ ID NO: 77132 - DNA, 25 bp, Rattus norvegicus
acagggactgggttgacgctgctca

SEQ ID NO: 77133 - DNA, 25 bp, Rattus norvegicus
acagggactgtcaccagcgaacttg

SEQ ID NO: 77134 - DNA, 25 bp, Rattus norvegicus
acagggactgtctccagcgaacttg

SEQ ID NO: 77135 - DNA, 25 bp, Rattus norvegicus
acagggagagtcacgggactgctca

SEQ ID NO: 77136 - DNA, 25 bp, Rattus norvegicus
acagggagagtctcgggactgctca

SEQ ID NO: 77137 - DNA, 25 bp, Rattus norvegicus
acagggagagtgatgtccattctta

SEQ ID NO: 77138 - DNA, 25 bp, Rattus norvegicus
acagggagagtgttgtccattctta

SEQ ID NO: 77139 - DNA, 25 bp, Rattus norvegicus
acagggagccacaggagtcctacaa

SEQ ID NO: 77140 - DNA, 25 bp, Rattus norvegicus
acagggagccactggagtcctacaa

SEQ ID NO: 77141 - DNA, 25 bp, Rattus norvegicus
acagggatagtcatatggaagagaa

SEQ ID NO: 77142 - DNA, 25 bp, Rattus norvegicus
acagggatagtcttatggaagagaa

SEQ ID NO: 77143 - DNA, 25 bp, Rattus norvegicus
acagggatccagactcagttgtaca

SEQ ID NO: 77144 - DNA, 25 bp, Rattus norvegicus
acagggatccagtctcagttgtaca

SEQ ID NO: 77145 - DNA, 25 bp, Rattus norvegicus
acagggattcccaaggccagggcaa

SEQ ID NO: 77146 - DNA, 25 bp, Rattus norvegicus
acagggattccctaggccagggcaa

SEQ ID NO: 77147 - DNA, 25 bp, Rattus norvegicus
acagggattccgactggtgttaatg

SEQ ID NO: 77148 - DNA, 25 bp, Rattus norvegicus
acagggattccgtctggtgttaatg

SEQ ID NO: 77149 - DNA, 25 bp, Rattus norvegicus
acagggcaaagacaccatccttggg

SEQ ID NO: 77150 - DNA, 25 bp, Rattus norvegicus
acagggcaaagagaccatccttggg

SEQ ID NO: 77151 - DNA, 25 bp, Rattus norvegicus
acagggcaacctcgtttcttctgtt

SEQ ID NO: 77152 - DNA, 25 bp, Rattus norvegicus
acagggcaacctggtttcttctgtt

SEQ ID NO: 77153 - DNA, 25 bp, Rattus norvegicus
acagggcacagtatcacagccgtgt

SEQ ID NO: 77154 - DNA, 25 bp, Rattus norvegicus
acagggcacagtttcacagccgtgt

SEQ ID NO: 77155 - DNA, 25 bp, Rattus norvegicus
acagggcaggtgacccagcccataa

SEQ ID NO: 77156 - DNA, 25 bp, Rattus norvegicus
acagggcaggtgtcccagcccataa

SEQ ID NO: 77157 - DNA, 25 bp, Rattus norvegicus
acagggcagtagctccaggcataac

SEQ ID NO: 77158 - DNA, 25 bp, Rattus norvegicus
acagggcagtaggtccaggcataac

SEQ ID NO: 77159 - DNA, 25 bp, Rattus norvegicus
acagggcatcaaccaggtttagcgc

SEQ ID NO: 77160 - DNA, 25 bp, Rattus norvegicus
acagggcatcaagcaggtttagcgc

SEQ ID NO: 77161 - DNA, 25 bp, Rattus norvegicus
acagggcatcctagagcagtgtaat

SEQ ID NO: 77162 - DNA, 25 bp, Rattus norvegicus
acagggcatcctcggcgcgcggagc

SEQ ID NO: 77163 - DNA, 25 bp, Rattus norvegicus
acagggcatcctgggcgcgcggagc

SEQ ID NO: 77164 - DNA, 25 bp, Rattus norvegicus
acagggcatccttgagcagtgtaat

SEQ ID NO: 77165 - DNA, 25 bp, Rattus norvegicus
acagggcattgtcagccagcactgc

SEQ ID NO: 77166 - DNA, 25 bp, Rattus norvegicus
acagggcattgtccagtcatttcag

SEQ ID NO: 77167 - DNA, 25 bp, Rattus norvegicus
acagggcattgtgagccagcactgc

SEQ ID NO: 77168 - DNA, 25 bp, Rattus norvegicus
acagggcattgtgcagtcatttcag

SEQ ID NO: 77169 - DNA, 25 bp, Rattus norvegicus
acagggccaacaatcgtgtcggact

SEQ ID NO: 77170 - DNA, 25 bp, Rattus norvegicus
acagggccaacattcgtgtcggact

SEQ ID NO: 77171 - DNA, 25 bp, Rattus norvegicus
acagggccacttcggaggattgcac

SEQ ID NO: 77172 - DNA, 25 bp, Rattus norvegicus
acagggccacttgggaggattgcac

SEQ ID NO: 77173 - DNA, 25 bp, Rattus norvegicus
acagggccagcaatcggagcggtta

SEQ ID NO: 77174 - DNA, 25 bp, Rattus norvegicus
acagggccagcattcggagcggtta

SEQ ID NO: 77175 - DNA, 25 bp, Rattus norvegicus
acagggcccaggcacaaatgtgcat

SEQ ID NO: 77176 - DNA, 25 bp, Rattus norvegicus
acagggcccaggcaccacagtggct

SEQ ID NO: 77177 - DNA, 25 bp, Rattus norvegicus
acagggcccagggacaaatgtgcat

SEQ ID NO: 77178 - DNA, 25 bp, Rattus norvegicus
acagggcccagggaccacagtggct

SEQ ID NO: 77179 - DNA, 25 bp, Rattus norvegicus
acagggccccataagagtgagggtc

SEQ ID NO: 77180 - DNA, 25 bp, Rattus norvegicus
acagggccccattagagtgagggtc

SEQ ID NO: 77181 - DNA, 25 bp, Rattus norvegicus
acagggccctgacctagatgctgat

SEQ ID NO: 77182 - DNA, 25 bp, Rattus norvegicus
acagggccctgagctagatgctgat

SEQ ID NO: 77183 - DNA, 25 bp, Rattus norvegicus
acagggccgtgtctttgcattttaa

SEQ ID NO: 77184 - DNA, 25 bp, Rattus norvegicus
acagggccgtgtgtttgcattttaa

SEQ ID NO: 77185 - DNA, 25 bp, Rattus norvegicus
acagggcctgacatttacagctttt

SEQ ID NO: 77186 - DNA, 25 bp, Rattus norvegicus
acagggcctgacttttacagctttt

SEQ ID NO: 77187 - DNA, 25 bp, Rattus norvegicus
acagggcctgttactaaatagtcta

SEQ ID NO: 77188 - DNA, 25 bp, Rattus norvegicus
acagggcctgtttctaaatagtcta

SEQ ID NO: 77189 - DNA, 25 bp, Rattus norvegicus
acagggccttagagctcatccgcaa

SEQ ID NO: 77190 - DNA, 25 bp, Rattus norvegicus
acagggccttagtgctcatccgcaa

SEQ ID NO: 77191 - DNA, 25 bp, Rattus norvegicus
acagggccttatacttcacttggag

SEQ ID NO: 77192 - DNA, 25 bp, Rattus norvegicus
acagggccttattcttcacttggag

SEQ ID NO: 77193 - DNA, 25 bp, Rattus norvegicus
acagggccttgcacttgtagccctt

SEQ ID NO: 77194 - DNA, 25 bp, Rattus norvegicus
acagggccttgctcttgtagccctt

SEQ ID NO: 77195 - DNA, 25 bp, Rattus norvegicus
acagggcctttcctcttcgcaagta

SEQ ID NO: 77196 - DNA, 25 bp, Rattus norvegicus
acagggcctttcgtcttcgcaagta

SEQ ID NO: 77197 - DNA, 25 bp, Rattus norvegicus
acagggcgcatcctgatgagatcaa

SEQ ID NO: 77198 - DNA, 25 bp, Rattus norvegicus
acagggcgcatcgtgatgagatcaa

SEQ ID NO: 77199 - DNA, 25 bp, Rattus norvegicus
acagggctacagactattgtcttaa

SEQ ID NO: 77200 - DNA, 25 bp, Rattus norvegicus
acagggctacagtctattgtcttaa

SEQ ID NO: 77201 - DNA, 25 bp, Rattus norvegicus
acagggctacccatatctattgaag

SEQ ID NO: 77202 - DNA, 25 bp, Rattus norvegicus
acagggctacccttatctattgaag

SEQ ID NO: 77203 - DNA, 25 bp, Rattus norvegicus
acagggctccccaatgaactacagg

SEQ ID NO: 77204 - DNA, 25 bp, Rattus norvegicus
acagggctcccctatgaactacagg

SEQ ID NO: 77205 - DNA, 25 bp, Rattus norvegicus
acagggctccgtcaggacttctgaa

SEQ ID NO: 77206 - DNA, 25 bp, Rattus norvegicus
acagggctccgtgaggacttctgaa

SEQ ID NO: 77207 - DNA, 25 bp, Rattus norvegicus
acagggctcgggagggcttcttcct

SEQ ID NO: 77208 - DNA, 25 bp, Rattus norvegicus
acagggctcgggtgggcttcttcct

SEQ ID NO: 77209 - DNA, 25 bp, Rattus norvegicus
acagggctcttacttgctccttggt

SEQ ID NO: 77210 - DNA, 25 bp, Rattus norvegicus
acagggctcttagttgctccttggt

SEQ ID NO: 77211 - DNA, 25 bp, Rattus norvegicus
acagggctcttgagtttcaccacct

SEQ ID NO: 77212 - DNA, 25 bp, Rattus norvegicus
acagggctcttgtgtttcaccacct

SEQ ID NO: 77213 - DNA, 25 bp, Rattus norvegicus
acagggctgaacacatcgattcgtt

SEQ ID NO: 77214 - DNA, 25 bp, Rattus norvegicus
acagggctgaactcatcgattcgtt

SEQ ID NO: 77215 - DNA, 25 bp, Rattus norvegicus
acagggctgcagctggtgtctggct

SEQ ID NO: 77216 - DNA, 25 bp, Rattus norvegicus
acagggctgcaggtggtgtctggct

SEQ ID NO: 77217 - DNA, 25 bp, Rattus norvegicus
acagggctgccccatggaacagttc

SEQ ID NO: 77218 - DNA, 25 bp, Rattus norvegicus
acagggctgcccgatggaacagttc

SEQ ID NO: 77219 - DNA, 25 bp, Rattus norvegicus
acagggctgcctccatttcagaaga

SEQ ID NO: 77220 - DNA, 25 bp, Rattus norvegicus
acagggctgcctgcatttcagaaga

SEQ ID NO: 77221 - DNA, 25 bp, Rattus norvegicus
acagggctgctgattgttcctttca

SEQ ID NO: 77222 - DNA, 25 bp, Rattus norvegicus
acagggctgctgtttgttcctttca

SEQ ID NO: 77223 - DNA, 25 bp, Rattus norvegicus
acagggctgtcccttgtagaagcca

SEQ ID NO: 77224 - DNA, 25 bp, Rattus norvegicus
acagggctgtccgttgtagaagcca

SEQ ID NO: 77225 - DNA, 25 bp, Rattus norvegicus
acagggctgtgcaactttgtggaga

SEQ ID NO: 77226 - DNA, 25 bp, Rattus norvegicus
acagggctgtgctactttgtggaga

SEQ ID NO: 77227 - DNA, 25 bp, Rattus norvegicus
acagggctgttcactttgtgcaaag

SEQ ID NO: 77228 - DNA, 25 bp, Rattus norvegicus
acagggctgttcatctttagcaagc

SEQ ID NO: 77229 - DNA, 25 bp, Rattus norvegicus
acagggctgttctctttgtgcaaag

SEQ ID NO: 77230 - DNA, 25 bp, Rattus norvegicus
acagggctgttcttctttagcaagc

SEQ ID NO: 77231 - DNA, 25 bp, Rattus norvegicus
acagggcttcgtactgtctctgtgc

SEQ ID NO: 77232 - DNA, 25 bp, Rattus norvegicus
acagggcttcgttctgtctctgtgc

SEQ ID NO: 77233 - DNA, 25 bp, Rattus norvegicus
acagggcttctgcagcagcacaaat

SEQ ID NO: 77234 - DNA, 25 bp, Rattus norvegicus
acagggcttctggagcagcacaaat

SEQ ID NO: 77235 - DNA, 25 bp, Rattus norvegicus
acagggcttggcattgacctcggat

SEQ ID NO: 77236 - DNA, 25 bp, Rattus norvegicus
acagggcttggctttgacctcggat

SEQ ID NO: 77237 - DNA, 25 bp, Rattus norvegicus
acagggcttgggacctcttctggca

SEQ ID NO: 77238 - DNA, 25 bp, Rattus norvegicus
acagggcttgggtcctcttctggca

SEQ ID NO: 77239 - DNA, 25 bp, Rattus norvegicus
acagggctttgacgacctgctctca

SEQ ID NO: 77240 - DNA, 25 bp, Rattus norvegicus
acagggctttgaggacctgctctca

SEQ ID NO: 77241 - DNA, 25 bp, Rattus norvegicus
acagggctttggcacgctttcacag

SEQ ID NO: 77242 - DNA, 25 bp, Rattus norvegicus
acagggctttgggacgctttcacag

SEQ ID NO: 77243 - DNA, 25 bp, Rattus norvegicus
acagggctttgtcgaggtgccttct

SEQ ID NO: 77244 - DNA, 25 bp, Rattus norvegicus
acagggctttgtggaggtgccttct

SEQ ID NO: 77245 - DNA, 25 bp, Rattus norvegicus
acagggtcagccactggacacttgg

SEQ ID NO: 77246 - DNA, 25 bp, Rattus norvegicus
acagggtcagcctctggacacttgg

SEQ ID NO: 77247 - DNA, 25 bp, Rattus norvegicus
acagggtcagggacatagccgcttt

SEQ ID NO: 77248 - DNA, 25 bp, Rattus norvegicus
acagggtcagggtcatagccgcttt

SEQ ID NO: 77249 - DNA, 25 bp, Rattus norvegicus
acagggtcagtacagcagtgtcact

SEQ ID NO: 77250 - DNA, 25 bp, Rattus norvegicus
acagggtcagtagagcagtgtcact

SEQ ID NO: 77251 - DNA, 25 bp, Rattus norvegicus
acagggtcagtgatgccagcagaat

SEQ ID NO: 77252 - DNA, 25 bp, Rattus norvegicus
acagggtcagtgttgccagcagaat

SEQ ID NO: 77253 - DNA, 25 bp, Rattus norvegicus
acagggtctctccatatatcccagg

SEQ ID NO: 77254 - DNA, 25 bp, Rattus norvegicus
acagggtctctcgatatatcccagg

SEQ ID NO: 77255 - DNA, 25 bp, Rattus norvegicus
acagggtctctgagtacttgagcca

SEQ ID NO: 77256 - DNA, 25 bp, Rattus norvegicus
acagggtctctgtgtacttgagcca

SEQ ID NO: 77257 - DNA, 25 bp, Rattus norvegicus
acagggtgacctaatgtccattatg

SEQ ID NO: 77258 - DNA, 25 bp, Rattus norvegicus
acagggtgaccttatgtccattatg

SEQ ID NO: 77259 - DNA, 25 bp, Rattus norvegicus
acagggtgacgtaagtcctcagctc

SEQ ID NO: 77260 - DNA, 25 bp, Rattus norvegicus
acagggtgacgttagtcctcagctc

SEQ ID NO: 77261 - DNA, 25 bp, Rattus norvegicus
acagggtgagccacttctccgccga

SEQ ID NO: 77262 - DNA, 25 bp, Rattus norvegicus
acagggtgagcctcttctccgccga

SEQ ID NO: 77263 - DNA, 25 bp, Rattus norvegicus
acagggtgatccaacatgccagtgc

SEQ ID NO: 77264 - DNA, 25 bp, Rattus norvegicus
acagggtgatcctacatgccagtgc

SEQ ID NO: 77265 - DNA, 25 bp, Rattus norvegicus
acagggtgcaacataagatttcctt

SEQ ID NO: 77266 - DNA, 25 bp, Rattus norvegicus
acagggtgcaacttaagatttcctt

SEQ ID NO: 77267 - DNA, 25 bp, Rattus norvegicus
acagggtgccacagtgtaagctgcg

SEQ ID NO: 77268 - DNA, 25 bp, Rattus norvegicus
acagggtgccactgtgtaagctgcg

SEQ ID NO: 77269 - DNA, 25 bp, Rattus norvegicus
acagggtgctcgagaaccttgaccg

SEQ ID NO: 77270 - DNA, 25 bp, Rattus norvegicus
acagggtgctcgtgaaccttgaccg

SEQ ID NO: 77271 - DNA, 25 bp, Rattus norvegicus
acagggtggaccatccggtgtttag

SEQ ID NO: 77272 - DNA, 25 bp, Rattus norvegicus
acagggtggaccttccggtgtttag

SEQ ID NO: 77273 - DNA, 25 bp, Rattus norvegicus
acagggtggcacaataaggaagcaa

SEQ ID NO: 77274 - DNA, 25 bp, Rattus norvegicus
acagggtggcactataaggaagcaa

SEQ ID NO: 77275 - DNA, 25 bp, Rattus norvegicus
acagggtgggtaaagtcctctgcct

SEQ ID NO: 77276 - DNA, 25 bp, Rattus norvegicus
acagggtgggtatagtcctctgcct

SEQ ID NO: 77277 - DNA, 25 bp, Rattus norvegicus
acagggtgtcaccactggagccaga

SEQ ID NO: 77278 - DNA, 25 bp, Rattus norvegicus
acagggtgtcacgactggagccaga

SEQ ID NO: 77279 - DNA, 25 bp, Rattus norvegicus
acagggtgtcagagccagtcaatca

SEQ ID NO: 77280 - DNA, 25 bp, Rattus norvegicus
acagggtgtcagtgccagtcaatca

SEQ ID NO: 77281 - DNA, 25 bp, Rattus norvegicus
acagggtgtgccacattcatggcag

SEQ ID NO: 77282 - DNA, 25 bp, Rattus norvegicus
acagggtgtgcctcattcatggcag

SEQ ID NO: 77283 - DNA, 25 bp, Rattus norvegicus
acagggtgtgctcggacctttctga

SEQ ID NO: 77284 - DNA, 25 bp, Rattus norvegicus
acagggtgtgctgggacctttctga

SEQ ID NO: 77285 - DNA, 25 bp, Rattus norvegicus
acagggtgttggacatagtgcatgc

SEQ ID NO: 77286 - DNA, 25 bp, Rattus norvegicus
acagggtgttggtcatagtgcatgc

SEQ ID NO: 77287 - DNA, 25 bp, Rattus norvegicus
acagggtgtttgagtctcggtgcca

SEQ ID NO: 77288 - DNA, 25 bp, Rattus norvegicus
acagggtgtttgtgtctcggtgcca

SEQ ID NO: 77289 - DNA, 25 bp, Rattus norvegicus
acagggttatgtcatgttactctct

SEQ ID NO: 77290 - DNA, 25 bp, Rattus norvegicus
acagggttatgtgatgttactctct

SEQ ID NO: 77291 - DNA, 25 bp, Rattus norvegicus
acagggttccttactgtgacagcca

SEQ ID NO: 77292 - DNA, 25 bp, Rattus norvegicus
acagggttcctttctgtgacagcca

SEQ ID NO: 77293 - DNA, 25 bp, Rattus norvegicus
acagggttgtgtagatttcccaaat

SEQ ID NO: 77294 - DNA, 25 bp, Rattus norvegicus
acagggttgtgttgatttcccaaat

SEQ ID NO: 77295 - DNA, 25 bp, Rattus norvegicus
acagggtttgtcatcagtattggca

SEQ ID NO: 77296 - DNA, 25 bp, Rattus norvegicus
acagggtttgtcttcagtattggca

SEQ ID NO: 77297 - DNA, 25 bp, Rattus norvegicus
acaggtaaccccagctctgctttgg

SEQ ID NO: 77298 - DNA, 25 bp, Rattus norvegicus
acaggtaacccctgctctgctttgg

SEQ ID NO: 77299 - DNA, 25 bp, Rattus norvegicus
acaggtaacttcatgaccaactgaa

SEQ ID NO: 77300 - DNA, 25 bp, Rattus norvegicus
acaggtaacttcttgaccaactgaa

SEQ ID NO: 77301 - DNA, 25 bp, Rattus norvegicus
acaggtaatcctacagctgtaatta

SEQ ID NO: 77302 - DNA, 25 bp, Rattus norvegicus
acaggtaatccttcagctgtaatta

SEQ ID NO: 77303 - DNA, 25 bp, Rattus norvegicus
acaggtaattgcaggctttaatcgc

SEQ ID NO: 77304 - DNA, 25 bp, Rattus norvegicus
acaggtaattgctggctttaatcgc

SEQ ID NO: 77305 - DNA, 25 bp, Rattus norvegicus
acaggtacacagcaggacatgccct

SEQ ID NO: 77306 - DNA, 25 bp, Rattus norvegicus
acaggtacacaggaggacatgccct

SEQ ID NO: 77307 - DNA, 25 bp, Rattus norvegicus
acaggtaccatcagctgcagctgga

SEQ ID NO: 77308 - DNA, 25 bp, Rattus norvegicus
acaggtaccatctgctgcagctgga

SEQ ID NO: 77309 - DNA, 25 bp, Rattus norvegicus
acaggtaccatgaaagcagcaccca

SEQ ID NO: 77310 - DNA, 25 bp, Rattus norvegicus
acaggtaccatgtaagcagcaccca

SEQ ID NO: 77311 - DNA, 25 bp, Rattus norvegicus
acaggtaccctcaggcaaaggctgg

SEQ ID NO: 77312 - DNA, 25 bp, Rattus norvegicus
acaggtaccctctggcaaaggctgg

SEQ ID NO: 77313 - DNA, 25 bp, Rattus norvegicus
acaggtaccgtcatgtatgcacata

SEQ ID NO: 77314 - DNA, 25 bp, Rattus norvegicus
acaggtaccgtcttgtatgcacata

SEQ ID NO: 77315 - DNA, 25 bp, Rattus norvegicus
acaggtacctatctggcccatggct

SEQ ID NO: 77316 - DNA, 25 bp, Rattus norvegicus
acaggtacctatgtggcccatggct

SEQ ID NO: 77317 - DNA, 25 bp, Rattus norvegicus
acaggtagagcaagccaaagtcccc

SEQ ID NO: 77318 - DNA, 25 bp, Rattus norvegicus
acaggtagagcatgccaaagtcccc

SEQ ID NO: 77319 - DNA, 25 bp, Rattus norvegicus
acaggtagatgtagatggagccgct

SEQ ID NO: 77320 - DNA, 25 bp, Rattus norvegicus
acaggtagatgttgatggagccgct

SEQ ID NO: 77321 - DNA, 25 bp, Rattus norvegicus
acaggtagctaaagtttttcttcat

SEQ ID NO: 77322 - DNA, 25 bp, Rattus norvegicus
acaggtagctaatgtttttcttcat

SEQ ID NO: 77323 - DNA, 25 bp, Rattus norvegicus
acaggtagctgtagttctaactgag

SEQ ID NO: 77324 - DNA, 25 bp, Rattus norvegicus
acaggtagctgttgttctaactgag

SEQ ID NO: 77325 - DNA, 25 bp, Rattus norvegicus
acaggtaggcccaggcaacagctgt

SEQ ID NO: 77326 - DNA, 25 bp, Rattus norvegicus
acaggtaggccctggcaacagctgt

SEQ ID NO: 77327 - DNA, 25 bp, Rattus norvegicus
acaggtagttgtccctcagctgctg

SEQ ID NO: 77328 - DNA, 25 bp, Rattus norvegicus
acaggtagttgtgcctcagctgctg

SEQ ID NO: 77329 - DNA, 25 bp, Rattus norvegicus
acaggtatagcaccgtgcccttcac

SEQ ID NO: 77330 - DNA, 25 bp, Rattus norvegicus
acaggtatagcagcgtgcccttcac

SEQ ID NO: 77331 - DNA, 25 bp, Rattus norvegicus
acaggtatcccaccaaggtcaggtg

SEQ ID NO: 77332 - DNA, 25 bp, Rattus norvegicus
acaggtatcccagcaaggtcaggtg

SEQ ID NO: 77333 - DNA, 25 bp, Rattus norvegicus
acaggtatcgatcccagaagccatg

SEQ ID NO: 77334 - DNA, 25 bp, Rattus norvegicus
acaggtatcgatgccagaagccatg

SEQ ID NO: 77335 - DNA, 25 bp, Rattus norvegicus
acaggtatctaactgcattccaaaa

SEQ ID NO: 77336 - DNA, 25 bp, Rattus norvegicus
acaggtatctaagtgcattccaaaa

SEQ ID NO: 77337 - DNA, 25 bp, Rattus norvegicus
acaggtatctgcatgttaacatttc

SEQ ID NO: 77338 - DNA, 25 bp, Rattus norvegicus
acaggtatctgcttgttaacatttc

SEQ ID NO: 77339 - DNA, 25 bp, Rattus norvegicus
acaggtatgcatcaccgtgctcagt

SEQ ID NO: 77340 - DNA, 25 bp, Rattus norvegicus
acaggtatgcatgaccgtgctcagt

SEQ ID NO: 77341 - DNA, 25 bp, Rattus norvegicus
acaggtatgcttcacccaggacaat

SEQ ID NO: 77342 - DNA, 25 bp, Rattus norvegicus
acaggtatgcttgacccaggacaat

SEQ ID NO: 77343 - DNA, 25 bp, Rattus norvegicus
acaggtattattactgaatgccagc

SEQ ID NO: 77344 - DNA, 25 bp, Rattus norvegicus
acaggtattatttctgaatgccagc

SEQ ID NO: 77345 - DNA, 25 bp, Rattus norvegicus
acaggtattcgacagctctggttcc

SEQ ID NO: 77346 - DNA, 25 bp, Rattus norvegicus
acaggtattcgagagctctggttcc

SEQ ID NO: 77347 - DNA, 25 bp, Rattus norvegicus
acaggtatttcgacagtttgtaaga

SEQ ID NO: 77348 - DNA, 25 bp, Rattus norvegicus
acaggtatttcgtcagtttgtaaga

SEQ ID NO: 77349 - DNA, 25 bp, Rattus norvegicus
acaggtattttccaagactggtcat

SEQ ID NO: 77350 - DNA, 25 bp, Rattus norvegicus
acaggtattttcgaagactggtcat

SEQ ID NO: 77351 - DNA, 25 bp, Rattus norvegicus
acaggtcaagtcaaaaggcagtaac

SEQ ID NO: 77352 - DNA, 25 bp, Rattus norvegicus
acaggtcaagtctaaaggcagtaac

SEQ ID NO: 77353 - DNA, 25 bp, Rattus norvegicus
acaggtcaatgcaaagtgggtacaa

SEQ ID NO: 77354 - DNA, 25 bp, Rattus norvegicus
acaggtcaatgctaagtgggtacaa

SEQ ID NO: 77355 - DNA, 25 bp, Rattus norvegicus
acaggtcacaccctggtgactgctg

SEQ ID NO: 77356 - DNA, 25 bp, Rattus norvegicus
acaggtcacaccgtggtgactgctg

SEQ ID NO: 77357 - DNA, 25 bp, Rattus norvegicus
acaggtcacagactctccaacgatt

SEQ ID NO: 77358 - DNA, 25 bp, Rattus norvegicus
acaggtcacagagtctccaacgatt

SEQ ID NO: 77359 - DNA, 25 bp, Rattus norvegicus
acaggtcacagcaacatgtctcaca

SEQ ID NO: 77360 - DNA, 25 bp, Rattus norvegicus
acaggtcacagctacatgtctcaca

SEQ ID NO: 77361 - DNA, 25 bp, Rattus norvegicus
acaggtcacttcatctgtgcggtgc

SEQ ID NO: 77362 - DNA, 25 bp, Rattus norvegicus
acaggtcacttcttctgtgcggtgc

SEQ ID NO: 77363 - DNA, 25 bp, Rattus norvegicus
acaggtcagggtcctttcctcaaaa

SEQ ID NO: 77364 - DNA, 25 bp, Rattus norvegicus
acaggtcagggtgctttcctcaaaa

SEQ ID NO: 77365 - DNA, 25 bp, Rattus norvegicus
acaggtcagtgcatgtggcctaaaa

SEQ ID NO: 77366 - DNA, 25 bp, Rattus norvegicus
acaggtcagtgcttgtggcctaaaa

SEQ ID NO: 77367 - DNA, 25 bp, Rattus norvegicus
acaggtcagtgtctgcaagttgcca

SEQ ID NO: 77368 - DNA, 25 bp, Rattus norvegicus
acaggtcagtgtgtgcaagttgcca

SEQ ID NO: 77369 - DNA, 25 bp, Rattus norvegicus
acaggtcatcaaccttgttcagcaa

SEQ ID NO: 77370 - DNA, 25 bp, Rattus norvegicus
acaggtcatcaagcttgttcagcaa

SEQ ID NO: 77371 - DNA, 25 bp, Rattus norvegicus
acaggtcatcgtagcactgatcctc

SEQ ID NO: 77372 - DNA, 25 bp, Rattus norvegicus
acaggtcatcgttgcactgatcctc

SEQ ID NO: 77373 - DNA, 25 bp, Rattus norvegicus
acaggtcatgctaatatatctctat

SEQ ID NO: 77374 - DNA, 25 bp, Rattus norvegicus
acaggtcatgcttatatatctctat

SEQ ID NO: 77375 - DNA, 25 bp, Rattus norvegicus
acaggtcatggcacgtttaacaaaa

SEQ ID NO: 77376 - DNA, 25 bp, Rattus norvegicus
acaggtcatggctcgtttaacaaaa

SEQ ID NO: 77377 - DNA, 25 bp, Rattus norvegicus
acaggtccaaggactgcagctgggc

SEQ ID NO: 77378 - DNA, 25 bp, Rattus norvegicus
acaggtccaaggtctgcagctgggc

SEQ ID NO: 77379 - DNA, 25 bp, Rattus norvegicus
acaggtccaagtaagagtgatgtgt

SEQ ID NO: 77380 - DNA, 25 bp, Rattus norvegicus
acaggtccaagttagagtgatgtgt

SEQ ID NO: 77381 - DNA, 25 bp, Rattus norvegicus
acaggtccaccacggtctacaggtt

SEQ ID NO: 77382 - DNA, 25 bp, Rattus norvegicus
acaggtccaccagggtctacaggtt

SEQ ID NO: 77383 - DNA, 25 bp, Rattus norvegicus
acaggtccatgtcacactgggagct

SEQ ID NO: 77384 - DNA, 25 bp, Rattus norvegicus
acaggtccatgtgacactgggagct

SEQ ID NO: 77385 - DNA, 25 bp, Rattus norvegicus
acaggtcccaaacacgagtacggat

SEQ ID NO: 77386 - DNA, 25 bp, Rattus norvegicus
acaggtcccaaagacgagtacggat

SEQ ID NO: 77387 - DNA, 25 bp, Rattus norvegicus
acaggtcccaatcgcttcttgcagc

SEQ ID NO: 77388 - DNA, 25 bp, Rattus norvegicus
acaggtcccaatggcttcttgcagc

SEQ ID NO: 77389 - DNA, 25 bp, Rattus norvegicus
acaggtcccagcaccgatggcattc

SEQ ID NO: 77390 - DNA, 25 bp, Rattus norvegicus
acaggtcccagctccgatggcattc

SEQ ID NO: 77391 - DNA, 25 bp, Rattus norvegicus
acaggtcccaggatagcttttctag

SEQ ID NO: 77392 - DNA, 25 bp, Rattus norvegicus
acaggtcccaggttagcttttctag

SEQ ID NO: 77393 - DNA, 25 bp, Rattus norvegicus
acaggtccccgccaagaatgatggt

SEQ ID NO: 77394 - DNA, 25 bp, Rattus norvegicus
acaggtccccgcgaagaatgatggt

SEQ ID NO: 77395 - DNA, 25 bp, Rattus norvegicus
acaggtcctgccctctacatgagga

SEQ ID NO: 77396 - DNA, 25 bp, Rattus norvegicus
acaggtcctgccgtctacatgagga

SEQ ID NO: 77397 - DNA, 25 bp, Rattus norvegicus
acaggtctcagcaggcctaaaggcc

SEQ ID NO: 77398 - DNA, 25 bp, Rattus norvegicus
acaggtctcagctggcctaaaggcc

SEQ ID NO: 77399 - DNA, 25 bp, Rattus norvegicus
acaggtctccagagtgtgacagtca

SEQ ID NO: 77400 - DNA, 25 bp, Rattus norvegicus
acaggtctccagtgtgtgacagtca

SEQ ID NO: 77401 - DNA, 25 bp, Rattus norvegicus
acaggtctctgtcaaattgggtgca

SEQ ID NO: 77402 - DNA, 25 bp, Rattus norvegicus
acaggtctctgtgaaattgggtgca

SEQ ID NO: 77403 - DNA, 25 bp, Rattus norvegicus
acaggtctggcccagccagcagatt

SEQ ID NO: 77404 - DNA, 25 bp, Rattus norvegicus
acaggtctggccgagccagcagatt

SEQ ID NO: 77405 - DNA, 25 bp, Rattus norvegicus
acaggtctgtgtctgatgcctattg

SEQ ID NO: 77406 - DNA, 25 bp, Rattus norvegicus
acaggtctgtgtgtgatgcctattg

SEQ ID NO: 77407 - DNA, 25 bp, Rattus norvegicus
acaggtctttcactttgcagtcaaa

SEQ ID NO: 77408 - DNA, 25 bp, Rattus norvegicus
acaggtctttcagtttgcagtcaaa

SEQ ID NO: 77409 - DNA, 25 bp, Rattus norvegicus
acaggtctttctccttctactgtat

SEQ ID NO: 77410 - DNA, 25 bp, Rattus norvegicus
acaggtctttctgcttctactgtat

SEQ ID NO: 77411 - DNA, 25 bp, Rattus norvegicus
acaggtctttgtaatatcatcatta

SEQ ID NO: 77412 - DNA, 25 bp, Rattus norvegicus
acaggtctttgttatatcatcatta

SEQ ID NO: 77413 - DNA, 25 bp, Rattus norvegicus
acaggtgaagtgcaacatgttgtca

SEQ ID NO: 77414 - DNA, 25 bp, Rattus norvegicus
acaggtgaagtggaacatgttgtca

SEQ ID NO: 77415 - DNA, 25 bp, Rattus norvegicus
acaggtgacagaactctctacacgc

SEQ ID NO: 77416 - DNA, 25 bp, Rattus norvegicus
acaggtgacagatctctctacacgc

SEQ ID NO: 77417 - DNA, 25 bp, Rattus norvegicus
acaggtgacagcagtgatggtgaca

SEQ ID NO: 77418 - DNA, 25 bp, Rattus norvegicus
acaggtgacagctgtgatggtgaca

SEQ ID NO: 77419 - DNA, 25 bp, Rattus norvegicus
acaggtgaccctcagtgactgagaa

SEQ ID NO: 77420 - DNA, 25 bp, Rattus norvegicus
acaggtgaccctgagtgactgagaa

SEQ ID NO: 77421 - DNA, 25 bp, Rattus norvegicus
acaggtgacgtgattcagcggcttc

SEQ ID NO: 77422 - DNA, 25 bp, Rattus norvegicus
acaggtgacgtgtttcagcggcttc

SEQ ID NO: 77423 - DNA, 25 bp, Rattus norvegicus
acaggtgactcaagcgacgctgcca

SEQ ID NO: 77424 - DNA, 25 bp, Rattus norvegicus
acaggtgactcatgcgacgctgcca

SEQ ID NO: 77425 - DNA, 25 bp, Rattus norvegicus
acaggtgataggaacttggcctcag

SEQ ID NO: 77426 - DNA, 25 bp, Rattus norvegicus
acaggtgataggtacttggcctcag

SEQ ID NO: 77427 - DNA, 25 bp, Rattus norvegicus
acaggtgatagtccgtgtctgccca

SEQ ID NO: 77428 - DNA, 25 bp, Rattus norvegicus
acaggtgatagtgcgtgtctgccca

SEQ ID NO: 77429 - DNA, 25 bp, Rattus norvegicus
acaggtgatgggaatcctggagcca

SEQ ID NO: 77430 - DNA, 25 bp, Rattus norvegicus
acaggtgatgggtatcctggagcca

SEQ ID NO: 77431 - DNA, 25 bp, Rattus norvegicus
acaggtgcaagacaatcccagccaa

SEQ ID NO: 77432 - DNA, 25 bp, Rattus norvegicus
acaggtgcaagagaatcccagccaa

SEQ ID NO: 77433 - DNA, 25 bp, Rattus norvegicus
acaggtgcaagcacaggctcctgaa

SEQ ID NO: 77434 - DNA, 25 bp, Rattus norvegicus
acaggtgcaagctcaggctcctgaa

SEQ ID NO: 77435 - DNA, 25 bp, Rattus norvegicus
acaggtgcagcaccttcaggtgttt

SEQ ID NO: 77436 - DNA, 25 bp, Rattus norvegicus
acaggtgcagcagcttcaggtgttt

SEQ ID NO: 77437 - DNA, 25 bp, Rattus norvegicus
acaggtgcagctattcattagtact

SEQ ID NO: 77438 - DNA, 25 bp, Rattus norvegicus
acaggtgcagcttttcattagtact

SEQ ID NO: 77439 - DNA, 25 bp, Rattus norvegicus
acaggtgcagtgcttggagaaccaa

SEQ ID NO: 77440 - DNA, 25 bp, Rattus norvegicus
acaggtgcagtggttggagaaccaa

SEQ ID NO: 77441 - DNA, 25 bp, Rattus norvegicus
acaggtgcctgacctggctgcagac

SEQ ID NO: 77442 - DNA, 25 bp, Rattus norvegicus
acaggtgcctgagctggctgcagac

SEQ ID NO: 77443 - DNA, 25 bp, Rattus norvegicus
acaggtgcctggagctatggcgaca

SEQ ID NO: 77444 - DNA, 25 bp, Rattus norvegicus
acaggtgcctggtgctatggcgaca

SEQ ID NO: 77445 - DNA, 25 bp, Rattus norvegicus
acaggtgcctttaggatggtcatgc

SEQ ID NO: 77446 - DNA, 25 bp, Rattus norvegicus
acaggtgccttttggatggtcatgc

SEQ ID NO: 77447 - DNA, 25 bp, Rattus norvegicus
acaggtgcgcaccattacacttggt

SEQ ID NO: 77448 - DNA, 25 bp, Rattus norvegicus
acaggtgcgcacgattacacttggt

SEQ ID NO: 77449 - DNA, 25 bp, Rattus norvegicus
acaggtgcgcgcacaaccacgggaa

SEQ ID NO: 77450 - DNA, 25 bp, Rattus norvegicus
acaggtgcgcgctcaaccacgggaa

SEQ ID NO: 77451 - DNA, 25 bp, Rattus norvegicus
acaggtgctcagagccaccaaggca

SEQ ID NO: 77452 - DNA, 25 bp, Rattus norvegicus
acaggtgctcagatttggcttcgta

SEQ ID NO: 77453 - DNA, 25 bp, Rattus norvegicus
acaggtgctcagtgccaccaaggca

SEQ ID NO: 77454 - DNA, 25 bp, Rattus norvegicus
acaggtgctcagttttggcttcgta

SEQ ID NO: 77455 - DNA, 25 bp, Rattus norvegicus
acaggtgctctgcatggagccttct

SEQ ID NO: 77456 - DNA, 25 bp, Rattus norvegicus
acaggtgctctggatggagccttct

SEQ ID NO: 77457 - DNA, 25 bp, Rattus norvegicus
acaggtgctgagagtccacagcgca

SEQ ID NO: 77458 - DNA, 25 bp, Rattus norvegicus
acaggtgctgagtgtccacagcgca

SEQ ID NO: 77459 - DNA, 25 bp, Rattus norvegicus
acaggtgctgcaaagagtttgagct

SEQ ID NO: 77460 - DNA, 25 bp, Rattus norvegicus
acaggtgctgcatagagtttgagct

SEQ ID NO: 77461 - DNA, 25 bp, Rattus norvegicus
acaggtggcgttcggcacactaaca

SEQ ID NO: 77462 - DNA, 25 bp, Rattus norvegicus
acaggtggcgttgggcacactaaca

SEQ ID NO: 77463 - DNA, 25 bp, Rattus norvegicus
acaggtggctagaccagatcttcaa

SEQ ID NO: 77464 - DNA, 25 bp, Rattus norvegicus
acaggtggctagtccagatcttcaa

SEQ ID NO: 77465 - DNA, 25 bp, Rattus norvegicus
acaggtgggaagaggctttctcatt

SEQ ID NO: 77466 - DNA, 25 bp, Rattus norvegicus
acaggtgggaagtggctttctcatt

SEQ ID NO: 77467 - DNA, 25 bp, Rattus norvegicus
acaggtgggcgtcaatgtccccatt

SEQ ID NO: 77468 - DNA, 25 bp, Rattus norvegicus
acaggtgggcgtgaatgtccccatt

SEQ ID NO: 77469 - DNA, 25 bp, Rattus norvegicus
acaggtgggtttcctgctgtccaag

SEQ ID NO: 77470 - DNA, 25 bp, Rattus norvegicus
acaggtgggtttgctgctgtccaag

SEQ ID NO: 77471 - DNA, 25 bp, Rattus norvegicus
acaggtgtaaggaccagcggcttcc

SEQ ID NO: 77472 - DNA, 25 bp, Rattus norvegicus
acaggtgtaaggtccagcggcttcc

SEQ ID NO: 77473 - DNA, 25 bp, Rattus norvegicus
acaggtgtacctcgcagagtctgct

SEQ ID NO: 77474 - DNA, 25 bp, Rattus norvegicus
acaggtgtacctggcagagtctgct

SEQ ID NO: 77475 - DNA, 25 bp, Rattus norvegicus
acaggtgtcactccagtggcactta

SEQ ID NO: 77476 - DNA, 25 bp, Rattus norvegicus
acaggtgtcactgcagtggcactta

SEQ ID NO: 77477 - DNA, 25 bp, Rattus norvegicus
acaggtgtcctgaagcggtccagct

SEQ ID NO: 77478 - DNA, 25 bp, Rattus norvegicus
acaggtgtcctgtagcggtccagct

SEQ ID NO: 77479 - DNA, 25 bp, Rattus norvegicus
acaggtgtctcaacaggaactccag

SEQ ID NO: 77480 - DNA, 25 bp, Rattus norvegicus
acaggtgtctcatcaggaactccag

SEQ ID NO: 77481 - DNA, 25 bp, Rattus norvegicus
acaggtgtctgtcgatataccatta

SEQ ID NO: 77482 - DNA, 25 bp, Rattus norvegicus
acaggtgtctgtggatataccatta

SEQ ID NO: 77483 - DNA, 25 bp, Rattus norvegicus
acaggtgtgtttcgtgcgtacttca

SEQ ID NO: 77484 - DNA, 25 bp, Rattus norvegicus
acaggtgtgtttggtgcgtacttca

SEQ ID NO: 77485 - DNA, 25 bp, Rattus norvegicus
acaggttaagagaccaccacaccca

SEQ ID NO: 77486 - DNA, 25 bp, Rattus norvegicus
acaggttaagagtccaccacaccca

SEQ ID NO: 77487 - DNA, 25 bp, Rattus norvegicus
acaggttattgtcaggcagtgccat

SEQ ID NO: 77488 - DNA, 25 bp, Rattus norvegicus
acaggttattgtgaggcagtgccat

SEQ ID NO: 77489 - DNA, 25 bp, Rattus norvegicus
acaggttcaataaccctatttccgc

SEQ ID NO: 77490 - DNA, 25 bp, Rattus norvegicus
acaggttcaatatccctatttccgc

SEQ ID NO: 77491 - DNA, 25 bp, Rattus norvegicus
acaggttcaccaccagaaaggccct

SEQ ID NO: 77492 - DNA, 25 bp, Rattus norvegicus
acaggttcaccagcagaaaggccct

SEQ ID NO: 77493 - DNA, 25 bp, Rattus norvegicus
acaggttcatggagtagctggccca

SEQ ID NO: 77494 - DNA, 25 bp, Rattus norvegicus
acaggttcatggatctctgctttga

SEQ ID NO: 77495 - DNA, 25 bp, Rattus norvegicus
acaggttcatggtgtagctggccca

SEQ ID NO: 77496 - DNA, 25 bp, Rattus norvegicus
acaggttcatggttctctgctttga

SEQ ID NO: 77497 - DNA, 25 bp, Rattus norvegicus
acaggttccatccaggcccacaagg

SEQ ID NO: 77498 - DNA, 25 bp, Rattus norvegicus
acaggttccatcgaggcccacaagg

SEQ ID NO: 77499 - DNA, 25 bp, Rattus norvegicus
acaggttccttgcatcaaatgcagg

SEQ ID NO: 77500 - DNA, 25 bp, Rattus norvegicus
acaggttccttggatcaaatgcagg

SEQ ID NO: 77501 - DNA, 25 bp, Rattus norvegicus
acaggttctcagctgccgcttgatt

SEQ ID NO: 77502 - DNA, 25 bp, Rattus norvegicus
acaggttctcaggtgccgcttgatt

SEQ ID NO: 77503 - DNA, 25 bp, Rattus norvegicus
acaggttctcggcaaggttcagatg

SEQ ID NO: 77504 - DNA, 25 bp, Rattus norvegicus
acaggttctcgggaaggttcagatg

SEQ ID NO: 77505 - DNA, 25 bp, Rattus norvegicus
acaggttctctgattctggagtttg

SEQ ID NO: 77506 - DNA, 25 bp, Rattus norvegicus
acaggttctctgtttctggagtttg

SEQ ID NO: 77507 - DNA, 25 bp, Rattus norvegicus
acaggttctgctctggaccagagcc

SEQ ID NO: 77508 - DNA, 25 bp, Rattus norvegicus
acaggttctgctgtggaccagagcc

SEQ ID NO: 77509 - DNA, 25 bp, Rattus norvegicus
acaggttcttccacaagcatttagg

SEQ ID NO: 77510 - DNA, 25 bp, Rattus norvegicus
acaggttcttcctcaagcatttagg

SEQ ID NO: 77511 - DNA, 25 bp, Rattus norvegicus
acaggttcttgactggttgtcccct

SEQ ID NO: 77512 - DNA, 25 bp, Rattus norvegicus
acaggttcttgagtggttgtcccct

SEQ ID NO: 77513 - DNA, 25 bp, Rattus norvegicus
acaggttcttgcattgttgcttaag

SEQ ID NO: 77514 - DNA, 25 bp, Rattus norvegicus
acaggttcttgctttgttgcttaag

SEQ ID NO: 77515 - DNA, 25 bp, Rattus norvegicus
acaggttcttttagccttggcacag

SEQ ID NO: 77516 - DNA, 25 bp, Rattus norvegicus
acaggttctttttgccttggcacag

SEQ ID NO: 77517 - DNA, 25 bp, Rattus norvegicus
acaggttgacagacacttacgcacc

SEQ ID NO: 77518 - DNA, 25 bp, Rattus norvegicus
acaggttgacagtcacttacgcacc

SEQ ID NO: 77519 - DNA, 25 bp, Rattus norvegicus
acaggttgatgtcatcgcctggcat

SEQ ID NO: 77520 - DNA, 25 bp, Rattus norvegicus
acaggttgatgtgatcgcctggcat

SEQ ID NO: 77521 - DNA, 25 bp, Rattus norvegicus
acaggttgcaatccgtgcgtggctt

SEQ ID NO: 77522 - DNA, 25 bp, Rattus norvegicus
acaggttgcaatgcgtgcgtggctt

SEQ ID NO: 77523 - DNA, 25 bp, Rattus norvegicus
acaggttgcaccaccaagaccttgg

SEQ ID NO: 77524 - DNA, 25 bp, Rattus norvegicus
acaggttgcacctccaagaccttgg

SEQ ID NO: 77525 - DNA, 25 bp, Rattus norvegicus
acaggttgccccacgcgttgcggcg

SEQ ID NO: 77526 - DNA, 25 bp, Rattus norvegicus
acaggttgcccctcgcgttgcggcg

SEQ ID NO: 77527 - DNA, 25 bp, Rattus norvegicus
acaggttgctataaatatgttctta

SEQ ID NO: 77528 - DNA, 25 bp, Rattus norvegicus
acaggttgctattaatatgttctta

SEQ ID NO: 77529 - DNA, 25 bp, Rattus norvegicus
acaggttgctggacagccttaccaa

SEQ ID NO: 77530 - DNA, 25 bp, Rattus norvegicus
acaggttgctggtcagccttaccaa

SEQ ID NO: 77531 - DNA, 25 bp, Rattus norvegicus
acaggttggactcctctactcctag

SEQ ID NO: 77532 - DNA, 25 bp, Rattus norvegicus
acaggttggactgctctactcctag

SEQ ID NO: 77533 - DNA, 25 bp, Rattus norvegicus
acaggttgtctcctaagtgtcaaag

SEQ ID NO: 77534 - DNA, 25 bp, Rattus norvegicus
acaggttgtctcgtaagtgtcaaag

SEQ ID NO: 77535 - DNA, 25 bp, Rattus norvegicus
acaggtttacgcagctgtcctctga

SEQ ID NO: 77536 - DNA, 25 bp, Rattus norvegicus
acaggtttacgctgctgtcctctga

SEQ ID NO: 77537 - DNA, 25 bp, Rattus norvegicus
acaggtttagaactgtgggcttgca

SEQ ID NO: 77538 - DNA, 25 bp, Rattus norvegicus
acaggtttagaagtgtgggcttgca

SEQ ID NO: 77539 - DNA, 25 bp, Rattus norvegicus
acaggtttcagtcagggtggtccac

SEQ ID NO: 77540 - DNA, 25 bp, Rattus norvegicus
acaggtttcagtgagggtggtccac

SEQ ID NO: 77541 - DNA, 25 bp, Rattus norvegicus
acaggtttccaaccagcagtcctta

SEQ ID NO: 77542 - DNA, 25 bp, Rattus norvegicus
acaggtttccaagcagcagtcctta

SEQ ID NO: 77543 - DNA, 25 bp, Rattus norvegicus
acaggtttccccatgacagcttggc

SEQ ID NO: 77544 - DNA, 25 bp, Rattus norvegicus
acaggtttccccttgacagcttggc

SEQ ID NO: 77545 - DNA, 25 bp, Rattus norvegicus
acaggtttccgacatgtcacgagaa

SEQ ID NO: 77546 - DNA, 25 bp, Rattus norvegicus
acaggtttccgagatgtcacgagaa

SEQ ID NO: 77547 - DNA, 25 bp, Rattus norvegicus
acaggtttcctgaatgtatttcata

SEQ ID NO: 77548 - DNA, 25 bp, Rattus norvegicus
acaggtttcctgtatgtatttcata

SEQ ID NO: 77549 - DNA, 25 bp, Rattus norvegicus
acaggtttcggacggagcggagctc

SEQ ID NO: 77550 - DNA, 25 bp, Rattus norvegicus
acaggtttcggagggagcggagctc

SEQ ID NO: 77551 - DNA, 25 bp, Rattus norvegicus
acaggtttctccagtaaacaacaca

SEQ ID NO: 77552 - DNA, 25 bp, Rattus norvegicus
acaggtttctcctgtaaacaacaca

SEQ ID NO: 77553 - DNA, 25 bp, Rattus norvegicus
acaggtttctctcttttgactatat

SEQ ID NO: 77554 - DNA, 25 bp, Rattus norvegicus
acaggtttctctgttttgactatat

SEQ ID NO: 77555 - DNA, 25 bp, Rattus norvegicus
acaggtttgctgatgctaactttca

SEQ ID NO: 77556 - DNA, 25 bp, Rattus norvegicus
acaggtttgctgttgctaactttca

SEQ ID NO: 77557 - DNA, 25 bp, Rattus norvegicus
acaggttttactatggacgccaggt

SEQ ID NO: 77558 - DNA, 25 bp, Rattus norvegicus
acaggttttactttggacgccaggt

SEQ ID NO: 77559 - DNA, 25 bp, Rattus norvegicus
acaggttttatacttcacaagtcaa

SEQ ID NO: 77560 - DNA, 25 bp, Rattus norvegicus
acaggttttatagttcacaagtcaa

SEQ ID NO: 77561 - DNA, 25 bp, Rattus norvegicus
acaggttttgaactcattaccataa

SEQ ID NO: 77562 - DNA, 25 bp, Rattus norvegicus
acaggttttgaagtcattaccataa

SEQ ID NO: 77563 - DNA, 25 bp, Rattus norvegicus
acagtaaataccagctcctaaccca

SEQ ID NO: 77564 - DNA, 25 bp, Rattus norvegicus
acagtaaataccaggccagccaggg

SEQ ID NO: 77565 - DNA, 25 bp, Rattus norvegicus
acagtaaatacctgctcctaaccca

SEQ ID NO: 77566 - DNA, 25 bp, Rattus norvegicus
acagtaaatacctggccagccaggg

SEQ ID NO: 77567 - DNA, 25 bp, Rattus norvegicus
acagtaaatgtcacttggcttgcta

SEQ ID NO: 77568 - DNA, 25 bp, Rattus norvegicus
acagtaaatgtctcttggcttgcta

SEQ ID NO: 77569 - DNA, 25 bp, Rattus norvegicus
acagtaacagcacgacctcctgggt

SEQ ID NO: 77570 - DNA, 25 bp, Rattus norvegicus
acagtaacagcaggacctcctgggt

SEQ ID NO: 77571 - DNA, 25 bp, Rattus norvegicus
acagtaaccctgaaatacctcccat

SEQ ID NO: 77572 - DNA, 25 bp, Rattus norvegicus
acagtaaccctgtaatacctcccat

SEQ ID NO: 77573 - DNA, 25 bp, Rattus norvegicus
acagtaactcttactgggccaggta

SEQ ID NO: 77574 - DNA, 25 bp, Rattus norvegicus
acagtaactctttctgggccaggta

SEQ ID NO: 77575 - DNA, 25 bp, Rattus norvegicus
acagtaatcactagctttagcccat

SEQ ID NO: 77576 - DNA, 25 bp, Rattus norvegicus
acagtaatcacttgctttagcccat

SEQ ID NO: 77577 - DNA, 25 bp, Rattus norvegicus
acagtaatttccactttgtgcacat

SEQ ID NO: 77578 - DNA, 25 bp, Rattus norvegicus
acagtaatttcctctttgtgcacat

SEQ ID NO: 77579 - DNA, 25 bp, Rattus norvegicus
acagtacaccttcctctggagaaag

SEQ ID NO: 77580 - DNA, 25 bp, Rattus norvegicus
acagtacaccttgctctggagaaag

SEQ ID NO: 77581 - DNA, 25 bp, Rattus norvegicus
acagtacagtgacagaattgctttc

SEQ ID NO: 77582 - DNA, 25 bp, Rattus norvegicus
acagtacagtgagagaattgctttc

SEQ ID NO: 77583 - DNA, 25 bp, Rattus norvegicus
acagtacagtttcgtcctttgcctt

SEQ ID NO: 77584 - DNA, 25 bp, Rattus norvegicus
acagtacagtttggtcctttgcctt

SEQ ID NO: 77585 - DNA, 25 bp, Rattus norvegicus
acagtacatactccttggtccatta

SEQ ID NO: 77586 - DNA, 25 bp, Rattus norvegicus
acagtacatactgcttggtccatta

SEQ ID NO: 77587 - DNA, 25 bp, Rattus norvegicus
acagtacatcgacggccagggcaga

SEQ ID NO: 77588 - DNA, 25 bp, Rattus norvegicus
acagtacatcgagggccagggcaga

SEQ ID NO: 77589 - DNA, 25 bp, Rattus norvegicus
acagtacattttcgtggctctcaaa

SEQ ID NO: 77590 - DNA, 25 bp, Rattus norvegicus
acagtacattttggtggctctcaaa

SEQ ID NO: 77591 - DNA, 25 bp, Rattus norvegicus
acagtaccaagtcactgatggtgga

SEQ ID NO: 77592 - DNA, 25 bp, Rattus norvegicus
acagtaccaagtgactgatggtgga

SEQ ID NO: 77593 - DNA, 25 bp, Rattus norvegicus
acagtaccagtcagaattctccatg

SEQ ID NO: 77594 - DNA, 25 bp, Rattus norvegicus
acagtaccagtctgaattctccatg

SEQ ID NO: 77595 - DNA, 25 bp, Rattus norvegicus
acagtaccatcgaatgtatatggaa

SEQ ID NO: 77596 - DNA, 25 bp, Rattus norvegicus
acagtaccatcgtatgtatatggaa

SEQ ID NO: 77597 - DNA, 25 bp, Rattus norvegicus
acagtacctatgcagtgcgattctt

SEQ ID NO: 77598 - DNA, 25 bp, Rattus norvegicus
acagtacctatggagtgcgattctt

SEQ ID NO: 77599 - DNA, 25 bp, Rattus norvegicus
acagtacctattattcttagcccag

SEQ ID NO: 77600 - DNA, 25 bp, Rattus norvegicus
acagtacctatttttcttagcccag

SEQ ID NO: 77601 - DNA, 25 bp, Rattus norvegicus
acagtacctcagcatcatggccggt

SEQ ID NO: 77602 - DNA, 25 bp, Rattus norvegicus
acagtacctcaggatcatggccggt

SEQ ID NO: 77603 - DNA, 25 bp, Rattus norvegicus
acagtacctgagacttgtggtgcca

SEQ ID NO: 77604 - DNA, 25 bp, Rattus norvegicus
acagtacctgagtcttgtggtgcca

SEQ ID NO: 77605 - DNA, 25 bp, Rattus norvegicus
acagtacctgtacactaccgtcggg

SEQ ID NO: 77606 - DNA, 25 bp, Rattus norvegicus
acagtacctgtagactaccgtcggg

SEQ ID NO: 77607 - DNA, 25 bp, Rattus norvegicus
acagtactactgcagcctacggagt

SEQ ID NO: 77608 - DNA, 25 bp, Rattus norvegicus
acagtactactggagcctacggagt

SEQ ID NO: 77609 - DNA, 25 bp, Rattus norvegicus
acagtactagcactcagtccttgtc

SEQ ID NO: 77610 - DNA, 25 bp, Rattus norvegicus
acagtactagcagtcagtccttgtc

SEQ ID NO: 77611 - DNA, 25 bp, Rattus norvegicus
acagtactcgtgagtgatcccgtgg

SEQ ID NO: 77612 - DNA, 25 bp, Rattus norvegicus
acagtactcgtgtgtgatcccgtgg

SEQ ID NO: 77613 - DNA, 25 bp, Rattus norvegicus
acagtactgacaagtgtgaccactt

SEQ ID NO: 77614 - DNA, 25 bp, Rattus norvegicus
acagtactgacatgtgtgaccactt

SEQ ID NO: 77615 - DNA, 25 bp, Rattus norvegicus
acagtactgagaccacaggcgccgt

SEQ ID NO: 77616 - DNA, 25 bp, Rattus norvegicus
acagtactgagagcacaggcgccgt

SEQ ID NO: 77617 - DNA, 25 bp, Rattus norvegicus
acagtactgccactcattgtgtgca

SEQ ID NO: 77618 - DNA, 25 bp, Rattus norvegicus
acagtactgccagtcattgtgtgca

SEQ ID NO: 77619 - DNA, 25 bp, Rattus norvegicus
acagtactggcacgagaggcactct

SEQ ID NO: 77620 - DNA, 25 bp, Rattus norvegicus
acagtactggcaggagaggcactct

SEQ ID NO: 77621 - DNA, 25 bp, Rattus norvegicus
acagtactggtgattgtgggcctct

SEQ ID NO: 77622 - DNA, 25 bp, Rattus norvegicus
acagtactggtgtttgtgggcctct

SEQ ID NO: 77623 - DNA, 25 bp, Rattus norvegicus
acagtactgtacatcatggtgggca

SEQ ID NO: 77624 - DNA, 25 bp, Rattus norvegicus
acagtactgtacttcatggtgggca

SEQ ID NO: 77625 - DNA, 25 bp, Rattus norvegicus
acagtacttgaaacgagttgcattt

SEQ ID NO: 77626 - DNA, 25 bp, Rattus norvegicus
acagtacttgaatcgagttgcattt

SEQ ID NO: 77627 - DNA, 25 bp, Rattus norvegicus
acagtacttgataagcagccgggct

SEQ ID NO: 77628 - DNA, 25 bp, Rattus norvegicus
acagtacttgattagcagccgggct

SEQ ID NO: 77629 - DNA, 25 bp, Rattus norvegicus
acagtacttgctctgttggcttaca

SEQ ID NO: 77630 - DNA, 25 bp, Rattus norvegicus
acagtacttgctgtgttggcttaca

SEQ ID NO: 77631 - DNA, 25 bp, Rattus norvegicus
acagtacttttgaatttcttgggat

SEQ ID NO: 77632 - DNA, 25 bp, Rattus norvegicus
acagtacttttgtatttcttgggat

SEQ ID NO: 77633 - DNA, 25 bp, Rattus norvegicus
acagtagacactccttgcttcctct

SEQ ID NO: 77634 - DNA, 25 bp, Rattus norvegicus
acagtagacactgcttgcttcctct

SEQ ID NO: 77635 - DNA, 25 bp, Rattus norvegicus
acagtagagcaactccttcggcagc

SEQ ID NO: 77636 - DNA, 25 bp, Rattus norvegicus
acagtagagcaagtccttcggcagc

SEQ ID NO: 77637 - DNA, 25 bp, Rattus norvegicus
acagtagcaatcatctcctcttaga

SEQ ID NO: 77638 - DNA, 25 bp, Rattus norvegicus
acagtagcaatcttctcctcttaga

SEQ ID NO: 77639 - DNA, 25 bp, Rattus norvegicus
acagtagcagccagccccggccagg

SEQ ID NO: 77640 - DNA, 25 bp, Rattus norvegicus
acagtagcagcctgccccggccagg

SEQ ID NO: 77641 - DNA, 25 bp, Rattus norvegicus
acagtagcatagactcattggcaaa

SEQ ID NO: 77642 - DNA, 25 bp, Rattus norvegicus
acagtagcatagtctcattggcaaa

SEQ ID NO: 77643 - DNA, 25 bp, Rattus norvegicus
acagtagccatcacctttgttatct

SEQ ID NO: 77644 - DNA, 25 bp, Rattus norvegicus
acagtagccatctcctttgttatct

SEQ ID NO: 77645 - DNA, 25 bp, Rattus norvegicus
acagtagcccagagtagctcaggaa

SEQ ID NO: 77646 - DNA, 25 bp, Rattus norvegicus
acagtagcccagtgtagctcaggaa

SEQ ID NO: 77647 - DNA, 25 bp, Rattus norvegicus
acagtagccccaatgctatgttcta

SEQ ID NO: 77648 - DNA, 25 bp, Rattus norvegicus
acagtagccccattgctatgttcta

SEQ ID NO: 77649 - DNA, 25 bp, Rattus norvegicus
acagtagcctcgcttgctgctcaga

SEQ ID NO: 77650 - DNA, 25 bp, Rattus norvegicus
acagtagcctcggttgctgctcaga

SEQ ID NO: 77651 - DNA, 25 bp, Rattus norvegicus
acagtagcctggcagacctgaccac

SEQ ID NO: 77652 - DNA, 25 bp, Rattus norvegicus
acagtagcctgggagacctgaccac

SEQ ID NO: 77653 - DNA, 25 bp, Rattus norvegicus
acagtagctaccatcctagtcaaga

SEQ ID NO: 77654 - DNA, 25 bp, Rattus norvegicus
acagtagctaccttcctagtcaaga

SEQ ID NO: 77655 - DNA, 25 bp, Rattus norvegicus
acagtagctcaaagttaccggcacc

SEQ ID NO: 77656 - DNA, 25 bp, Rattus norvegicus
acagtagctcaatgttaccggcacc

SEQ ID NO: 77657 - DNA, 25 bp, Rattus norvegicus
acagtaggaactctggcccaccaca

SEQ ID NO: 77658 - DNA, 25 bp, Rattus norvegicus
acagtaggaactgtggcccaccaca

SEQ ID NO: 77659 - DNA, 25 bp, Rattus norvegicus
acagtaggaccgctgcgcttcgcag

SEQ ID NO: 77660 - DNA, 25 bp, Rattus norvegicus
acagtaggaccggtgcgcttcgcag

SEQ ID NO: 77661 - DNA, 25 bp, Rattus norvegicus
acagtaggcccgatatgcagccttg

SEQ ID NO: 77662 - DNA, 25 bp, Rattus norvegicus
acagtaggcccgttatgcagccttg

SEQ ID NO: 77663 - DNA, 25 bp, Rattus norvegicus
acagtaggccttcactttaccacag

SEQ ID NO: 77664 - DNA, 25 bp, Rattus norvegicus
acagtaggccttgactttaccacag

SEQ ID NO: 77665 - DNA, 25 bp, Rattus norvegicus
acagtaggtatcatcttcctggaga

SEQ ID NO: 77666 - DNA, 25 bp, Rattus norvegicus
acagtaggtatcttcttcctggaga

SEQ ID NO: 77667 - DNA, 25 bp, Rattus norvegicus
acagtaggtgaacctagccccacac

SEQ ID NO: 77668 - DNA, 25 bp, Rattus norvegicus
acagtaggtgaagctagccccacac

SEQ ID NO: 77669 - DNA, 25 bp, Rattus norvegicus
acagtagtatcaacacaagtttaag

SEQ ID NO: 77670 - DNA, 25 bp, Rattus norvegicus
acagtagtatcatcacaagtttaag

SEQ ID NO: 77671 - DNA, 25 bp, Rattus norvegicus
acagtagtgcctctggtttagccca

SEQ ID NO: 77672 - DNA, 25 bp, Rattus norvegicus
acagtagtgcctgtggtttagccca

SEQ ID NO: 77673 - DNA, 25 bp, Rattus norvegicus
acagtagtgtagatgggtgaataaa

SEQ ID NO: 77674 - DNA, 25 bp, Rattus norvegicus
acagtagtgtagttgggtgaataaa

SEQ ID NO: 77675 - DNA, 25 bp, Rattus norvegicus
acagtagtttcaatggagtggtgcc

SEQ ID NO: 77676 - DNA, 25 bp, Rattus norvegicus
acagtagtttcattggagtggtgcc

SEQ ID NO: 77677 - DNA, 25 bp, Rattus norvegicus
acagtagtttttcgtcttgagtaca

SEQ ID NO: 77678 - DNA, 25 bp, Rattus norvegicus
acagtagtttttggtcttgagtaca

SEQ ID NO: 77679 - DNA, 25 bp, Rattus norvegicus
acagtataccggatgttaagtcgat

SEQ ID NO: 77680 - DNA, 25 bp, Rattus norvegicus
acagtataccggttgttaagtcgat

SEQ ID NO: 77681 - DNA, 25 bp, Rattus norvegicus
acagtatactgcatctggctctgct

SEQ ID NO: 77682 - DNA, 25 bp, Rattus norvegicus
acagtatactgcttctggctctgct

SEQ ID NO: 77683 - DNA, 25 bp, Rattus norvegicus
acagtatagcttcctggtccagggt

SEQ ID NO: 77684 - DNA, 25 bp, Rattus norvegicus
acagtatagcttgctggtccagggt

SEQ ID NO: 77685 - DNA, 25 bp, Rattus norvegicus
acagtatatgcacccacatgtgaca

SEQ ID NO: 77686 - DNA, 25 bp, Rattus norvegicus
acagtatatgcagccacatgtgaca

SEQ ID NO: 77687 - DNA, 25 bp, Rattus norvegicus
acagtatcaccgcatccttaagagg

SEQ ID NO: 77688 - DNA, 25 bp, Rattus norvegicus
acagtatcaccggatccttaagagg

SEQ ID NO: 77689 - DNA, 25 bp, Rattus norvegicus
acagtatcatgaaccgctgctggaa

SEQ ID NO: 77690 - DNA, 25 bp, Rattus norvegicus
acagtatcatgatccgctgctggaa

SEQ ID NO: 77691 - DNA, 25 bp, Rattus norvegicus
acagtatccatgacgcggtcttggg

SEQ ID NO: 77692 - DNA, 25 bp, Rattus norvegicus
acagtatccatgtcgcggtcttggg

SEQ ID NO: 77693 - DNA, 25 bp, Rattus norvegicus
acagtatcccgtacagactatggct

SEQ ID NO: 77694 - DNA, 25 bp, Rattus norvegicus
acagtatcccgttcagactatggct

SEQ ID NO: 77695 - DNA, 25 bp, Rattus norvegicus
acagtatcgctacccctattctttt

SEQ ID NO: 77696 - DNA, 25 bp, Rattus norvegicus
acagtatcgctagccctattctttt

SEQ ID NO: 77697 - DNA, 25 bp, Rattus norvegicus
acagtatctaacattttgcctcctc

SEQ ID NO: 77698 - DNA, 25 bp, Rattus norvegicus
acagtatctaactttttgcctcctc

SEQ ID NO: 77699 - DNA, 25 bp, Rattus norvegicus
acagtatctctcagccgagctttag

SEQ ID NO: 77700 - DNA, 25 bp, Rattus norvegicus
acagtatctctctgccgagctttag

SEQ ID NO: 77701 - DNA, 25 bp, Rattus norvegicus
acagtatgctacagccagcaactac

SEQ ID NO: 77702 - DNA, 25 bp, Rattus norvegicus
acagtatgctactgccagcaactac

SEQ ID NO: 77703 - DNA, 25 bp, Rattus norvegicus
acagtatgtatacttggcccacaac

SEQ ID NO: 77704 - DNA, 25 bp, Rattus norvegicus
acagtatgtatagttggcccacaac

SEQ ID NO: 77705 - DNA, 25 bp, Rattus norvegicus
acagtatgtatgaggcttcgtgcta

SEQ ID NO: 77706 - DNA, 25 bp, Rattus norvegicus
acagtatgtatgtggcttcgtgcta

SEQ ID NO: 77707 - DNA, 25 bp, Rattus norvegicus
acagtatgtgctaaggctgcctttt

SEQ ID NO: 77708 - DNA, 25 bp, Rattus norvegicus
acagtatgtgcttaggctgcctttt

SEQ ID NO: 77709 - DNA, 25 bp, Rattus norvegicus
acagtatgtggcacttgcctgtagt

SEQ ID NO: 77710 - DNA, 25 bp, Rattus norvegicus
acagtatgtggctcttgcctgtagt

SEQ ID NO: 77711 - DNA, 25 bp, Rattus norvegicus
acagtatgtggtacctccagggacc

SEQ ID NO: 77712 - DNA, 25 bp, Rattus norvegicus
acagtatgtggttcctccagggacc

SEQ ID NO: 77713 - DNA, 25 bp, Rattus norvegicus
acagtattcactcctgtacctgcag

SEQ ID NO: 77714 - DNA, 25 bp, Rattus norvegicus
acagtattcactgctgtacctgcag

SEQ ID NO: 77715 - DNA, 25 bp, Rattus norvegicus
acagtattctgtatggaaccttcca

SEQ ID NO: 77716 - DNA, 25 bp, Rattus norvegicus
acagtattctgtttggaaccttcca

SEQ ID NO: 77717 - DNA, 25 bp, Rattus norvegicus
acagtattgaatccctccacatgga

SEQ ID NO: 77718 - DNA, 25 bp, Rattus norvegicus
acagtattgaatgcctccacatgga

SEQ ID NO: 77719 - DNA, 25 bp, Rattus norvegicus
acagtattgcatcttaacgaatcat

SEQ ID NO: 77720 - DNA, 25 bp, Rattus norvegicus
acagtattgcatgttaacgaatcat

SEQ ID NO: 77721 - DNA, 25 bp, Rattus norvegicus
acagtattgtacatctgttcagaag

SEQ ID NO: 77722 - DNA, 25 bp, Rattus norvegicus
acagtattgtacttctgttcagaag

SEQ ID NO: 77723 - DNA, 25 bp, Rattus norvegicus
acagtatttctcagtgccggtgtca

SEQ ID NO: 77724 - DNA, 25 bp, Rattus norvegicus
acagtatttctctgtgccggtgtca

SEQ ID NO: 77725 - DNA, 25 bp, Rattus norvegicus
acagtattttggaggttgaggagaa

SEQ ID NO: 77726 - DNA, 25 bp, Rattus norvegicus
acagtattttggtggttgaggagaa

SEQ ID NO: 77727 - DNA, 25 bp, Rattus norvegicus
acagtcaaatgtagccctgcttggc

SEQ ID NO: 77728 - DNA, 25 bp, Rattus norvegicus
acagtcaaatgttgccctgcttggc

SEQ ID NO: 77729 - DNA, 25 bp, Rattus norvegicus
acagtcaacttacacgcacagcaat

SEQ ID NO: 77730 - DNA, 25 bp, Rattus norvegicus
acagtcaacttagacgcacagcaat

SEQ ID NO: 77731 - DNA, 25 bp, Rattus norvegicus
acagtcaatgtcatctccaaatagg

SEQ ID NO: 77732 - DNA, 25 bp, Rattus norvegicus
acagtcaatgtcttctccaaatagg

SEQ ID NO: 77733 - DNA, 25 bp, Rattus norvegicus
acagtcacaaggacatggtagctga

SEQ ID NO: 77734 - DNA, 25 bp, Rattus norvegicus
acagtcacaaggtcatggtagctga

SEQ ID NO: 77735 - DNA, 25 bp, Rattus norvegicus
acagtcacactcctgctgaaaacag

SEQ ID NO: 77736 - DNA, 25 bp, Rattus norvegicus
acagtcacactcgtgctgaaaacag

SEQ ID NO: 77737 - DNA, 25 bp, Rattus norvegicus
acagtcacagcgattcatttcaact

SEQ ID NO: 77738 - DNA, 25 bp, Rattus norvegicus
acagtcacagcgtttcatttcaact

SEQ ID NO: 77739 - DNA, 25 bp, Rattus norvegicus
acagtcacctgcctggtgaagggtt

SEQ ID NO: 77740 - DNA, 25 bp, Rattus norvegicus
acagtcacctgcgtggtgaagggtt

SEQ ID NO: 77741 - DNA, 25 bp, Rattus norvegicus
acagtcacggttccacggtgattcc

SEQ ID NO: 77742 - DNA, 25 bp, Rattus norvegicus
acagtcacggttgcacggtgattcc

SEQ ID NO: 77743 - DNA, 25 bp, Rattus norvegicus
acagtcacgtagaagattgccagaa

SEQ ID NO: 77744 - DNA, 25 bp, Rattus norvegicus
acagtcacgtagtagattgccagaa

SEQ ID NO: 77745 - DNA, 25 bp, Rattus norvegicus
acagtcactagcatgtcctgagaag

SEQ ID NO: 77746 - DNA, 25 bp, Rattus norvegicus
acagtcactagcttgtcctgagaag

SEQ ID NO: 77747 - DNA, 25 bp, Rattus norvegicus
acagtcactcggagtatccaaagcc

SEQ ID NO: 77748 - DNA, 25 bp, Rattus norvegicus
acagtcactcggtgtatccaaagcc

SEQ ID NO: 77749 - DNA, 25 bp, Rattus norvegicus
acagtcactgaaattcatggcagat

SEQ ID NO: 77750 - DNA, 25 bp, Rattus norvegicus
acagtcactgaatttcatggcagat

SEQ ID NO: 77751 - DNA, 25 bp, Rattus norvegicus
acagtcactgccatattttgggcct

SEQ ID NO: 77752 - DNA, 25 bp, Rattus norvegicus
acagtcactgccttattttgggcct

SEQ ID NO: 77753 - DNA, 25 bp, Rattus norvegicus
acagtcagacggattttagctattt

SEQ ID NO: 77754 - DNA, 25 bp, Rattus norvegicus
acagtcagacggtttttagctattt

SEQ ID NO: 77755 - DNA, 25 bp, Rattus norvegicus
acagtcagagagaagacccagaggg

SEQ ID NO: 77756 - DNA, 25 bp, Rattus norvegicus
acagtcagagagtagacccagaggg

SEQ ID NO: 77757 - DNA, 25 bp, Rattus norvegicus
acagtcagcactcagattgcacctg

SEQ ID NO: 77758 - DNA, 25 bp, Rattus norvegicus
acagtcagcactgagattgcacctg

SEQ ID NO: 77759 - DNA, 25 bp, Rattus norvegicus
acagtcagccggatcacctgaggaa

SEQ ID NO: 77760 - DNA, 25 bp, Rattus norvegicus
acagtcagccggttcacctgaggaa

SEQ ID NO: 77761 - DNA, 25 bp, Rattus norvegicus
acagtcagcgacatccacagagttg

SEQ ID NO: 77762 - DNA, 25 bp, Rattus norvegicus
acagtcagcgacttccacagagttg

SEQ ID NO: 77763 - DNA, 25 bp, Rattus norvegicus
acagtcagctatagtccagtacaaa

SEQ ID NO: 77764 - DNA, 25 bp, Rattus norvegicus
acagtcagctatatacagttatggg

SEQ ID NO: 77765 - DNA, 25 bp, Rattus norvegicus
acagtcagctattgtccagtacaaa

SEQ ID NO: 77766 - DNA, 25 bp, Rattus norvegicus
acagtcagctatttacagttatggg

SEQ ID NO: 77767 - DNA, 25 bp, Rattus norvegicus
acagtcagctggctggccccgtgaa

SEQ ID NO: 77768 - DNA, 25 bp, Rattus norvegicus
acagtcagctggcttttcctattgc

SEQ ID NO: 77769 - DNA, 25 bp, Rattus norvegicus
acagtcagctgggtggccccgtgaa

SEQ ID NO: 77770 - DNA, 25 bp, Rattus norvegicus
acagtcagctgggttttcctattgc

SEQ ID NO: 77771 - DNA, 25 bp, Rattus norvegicus
acagtcaggcctcggaagaacccat

SEQ ID NO: 77772 - DNA, 25 bp, Rattus norvegicus
acagtcaggcctgggaagaacccat

SEQ ID NO: 77773 - DNA, 25 bp, Rattus norvegicus
acagtcagtctacaggaaacctcca

SEQ ID NO: 77774 - DNA, 25 bp, Rattus norvegicus
acagtcagtctagaggaaacctcca

SEQ ID NO: 77775 - DNA, 25 bp, Rattus norvegicus
acagtcagttagagcctagagtcct

SEQ ID NO: 77776 - DNA, 25 bp, Rattus norvegicus
acagtcagttagtgcctagagtcct

SEQ ID NO: 77777 - DNA, 25 bp, Rattus norvegicus
acagtcatcacccatgagctggctg

SEQ ID NO: 77778 - DNA, 25 bp, Rattus norvegicus
acagtcatcaccgatgagctggctg

SEQ ID NO: 77779 - DNA, 25 bp, Rattus norvegicus
acagtcatctgcagaacttgcctct

SEQ ID NO: 77780 - DNA, 25 bp, Rattus norvegicus
acagtcatctgctgaacttgcctct

SEQ ID NO: 77781 - DNA, 25 bp, Rattus norvegicus
acagtcatgatgcttggctttcaaa

SEQ ID NO: 77782 - DNA, 25 bp, Rattus norvegicus
acagtcatgatggttggctttcaaa

SEQ ID NO: 77783 - DNA, 25 bp, Rattus norvegicus
acagtcattataattttagcttcag

SEQ ID NO: 77784 - DNA, 25 bp, Rattus norvegicus
acagtcattatatttttagcttcag

SEQ ID NO: 77785 - DNA, 25 bp, Rattus norvegicus
acagtcattcccatatcctcagtat

SEQ ID NO: 77786 - DNA, 25 bp, Rattus norvegicus
acagtcattcccttatcctcagtat

SEQ ID NO: 77787 - DNA, 25 bp, Rattus norvegicus
acagtcattgacattccaattcagt

SEQ ID NO: 77788 - DNA, 25 bp, Rattus norvegicus
acagtcattgactttccaattcagt

SEQ ID NO: 77789 - DNA, 25 bp, Rattus norvegicus
acagtcatttccagcacatacatac

SEQ ID NO: 77790 - DNA, 25 bp, Rattus norvegicus
acagtcatttcctgcacatacatac

SEQ ID NO: 77791 - DNA, 25 bp, Rattus norvegicus
acagtccaaatcatcttcaagttca

SEQ ID NO: 77792 - DNA, 25 bp, Rattus norvegicus
acagtccaaatcttcttcaagttca

SEQ ID NO: 77793 - DNA, 25 bp, Rattus norvegicus
acagtccacataccctcttgctgga

SEQ ID NO: 77794 - DNA, 25 bp, Rattus norvegicus
acagtccacatagcctcttgctgga

SEQ ID NO: 77795 - DNA, 25 bp, Rattus norvegicus
acagtccacatgaagggcagcgccc

SEQ ID NO: 77796 - DNA, 25 bp, Rattus norvegicus
acagtccacatgtagggcagcgccc

SEQ ID NO: 77797 - DNA, 25 bp, Rattus norvegicus
acagtccagcctaagcgttctgata

SEQ ID NO: 77798 - DNA, 25 bp, Rattus norvegicus
acagtccagccttagcgttctgata

SEQ ID NO: 77799 - DNA, 25 bp, Rattus norvegicus
acagtccagttgagttcttggccaa

SEQ ID NO: 77800 - DNA, 25 bp, Rattus norvegicus
acagtccagttgtgttcttggccaa

SEQ ID NO: 77801 - DNA, 25 bp, Rattus norvegicus
acagtccatttcctagtgtgtgtga

SEQ ID NO: 77802 - DNA, 25 bp, Rattus norvegicus
acagtccatttcgtagtgtgtgtga

SEQ ID NO: 77803 - DNA, 25 bp, Rattus norvegicus
acagtcccactgcagagtttcgaag

SEQ ID NO: 77804 - DNA, 25 bp, Rattus norvegicus
acagtcccactggagagtttcgaag

SEQ ID NO: 77805 - DNA, 25 bp, Rattus norvegicus
acagtcccagtacttttgtgtcctg

SEQ ID NO: 77806 - DNA, 25 bp, Rattus norvegicus
acagtcccagtagttttgtgtcctg

SEQ ID NO: 77807 - DNA, 25 bp, Rattus norvegicus
acagtcccagttcctgtaacagcca

SEQ ID NO: 77808 - DNA, 25 bp, Rattus norvegicus
acagtcccagttgctgtaacagcca

SEQ ID NO: 77809 - DNA, 25 bp, Rattus norvegicus
acagtcccgggaatttattcttcag

SEQ ID NO: 77810 - DNA, 25 bp, Rattus norvegicus
acagtcccgggattttattcttcag

SEQ ID NO: 77811 - DNA, 25 bp, Rattus norvegicus
acagtccctcggagtcatgatgaat

SEQ ID NO: 77812 - DNA, 25 bp, Rattus norvegicus
acagtccctcggtgtcatgatgaat

SEQ ID NO: 77813 - DNA, 25 bp, Rattus norvegicus
acagtccctggaatataagttcaca

SEQ ID NO: 77814 - DNA, 25 bp, Rattus norvegicus
acagtccctggattataagttcaca

SEQ ID NO: 77815 - DNA, 25 bp, Rattus norvegicus
acagtccctgggagatggcgaccta

SEQ ID NO: 77816 - DNA, 25 bp, Rattus norvegicus
acagtccctgggtgatggcgaccta

SEQ ID NO: 77817 - DNA, 25 bp, Rattus norvegicus
acagtccctgtacagagtagtacct

SEQ ID NO: 77818 - DNA, 25 bp, Rattus norvegicus
acagtccctgtagagagtagtacct

SEQ ID NO: 77819 - DNA, 25 bp, Rattus norvegicus
acagtccctttgagggattaggacg

SEQ ID NO: 77820 - DNA, 25 bp, Rattus norvegicus
acagtccctttgtgggattaggacg

SEQ ID NO: 77821 - DNA, 25 bp, Rattus norvegicus
acagtccgccctctgataagaagga

SEQ ID NO: 77822 - DNA, 25 bp, Rattus norvegicus
acagtccgccctgtgataagaagga

SEQ ID NO: 77823 - DNA, 25 bp, Rattus norvegicus
acagtcctcatcatcatggcaacag

SEQ ID NO: 77824 - DNA, 25 bp, Rattus norvegicus
acagtcctcatcttcatggcaacag

SEQ ID NO: 77825 - DNA, 25 bp, Rattus norvegicus
acagtcctcccaagggaagtcggga

SEQ ID NO: 77826 - DNA, 25 bp, Rattus norvegicus
acagtcctcccatgggaagtcggga

SEQ ID NO: 77827 - DNA, 25 bp, Rattus norvegicus
acagtcctctagatgcctgtctgga

SEQ ID NO: 77828 - DNA, 25 bp, Rattus norvegicus
acagtcctctagttgcctgtctgga

SEQ ID NO: 77829 - DNA, 25 bp, Rattus norvegicus
acagtcctcttgaatttcgtgcaga

SEQ ID NO: 77830 - DNA, 25 bp, Rattus norvegicus
acagtcctcttgtatttcgtgcaga

SEQ ID NO: 77831 - DNA, 25 bp, Rattus norvegicus
acagtcctgaaactgacgcccgtgg

SEQ ID NO: 77832 - DNA, 25 bp, Rattus norvegicus
acagtcctgaaagtgacgcccgtgg

SEQ ID NO: 77833 - DNA, 25 bp, Rattus norvegicus
acagtcctgaagcacgtgtgtccag

SEQ ID NO: 77834 - DNA, 25 bp, Rattus norvegicus
acagtcctgaaggacgtgtgtccag

SEQ ID NO: 77835 - DNA, 25 bp, Rattus norvegicus
acagtcctgacgagttggtgttaac

SEQ ID NO: 77836 - DNA, 25 bp, Rattus norvegicus
acagtcctgacgtgttggtgttaac

SEQ ID NO: 77837 - DNA, 25 bp, Rattus norvegicus
acagtcctgaggaggtcaaagacct

SEQ ID NO: 77838 - DNA, 25 bp, Rattus norvegicus
acagtcctgaggtggtcaaagacct

SEQ ID NO: 77839 - DNA, 25 bp, Rattus norvegicus
acagtcctgatcatggcggcgctgg

SEQ ID NO: 77840 - DNA, 25 bp, Rattus norvegicus
acagtcctgatcttggcggcgctgg

SEQ ID NO: 77841 - DNA, 25 bp, Rattus norvegicus
acagtcctgtcaatgtactcatggg

SEQ ID NO: 77842 - DNA, 25 bp, Rattus norvegicus
acagtcctgtcattgtactcatggg

SEQ ID NO: 77843 - DNA, 25 bp, Rattus norvegicus
acagtcctgtgtagtgttccaggca

SEQ ID NO: 77844 - DNA, 25 bp, Rattus norvegicus
acagtcctgtgttgtgttccaggca

SEQ ID NO: 77845 - DNA, 25 bp, Rattus norvegicus
acagtcctgttgagggtagcgagac

SEQ ID NO: 77846 - DNA, 25 bp, Rattus norvegicus
acagtcctgttgtgggtagcgagac

SEQ ID NO: 77847 - DNA, 25 bp, Rattus norvegicus
acagtccttaataatctcagttgaa

SEQ ID NO: 77848 - DNA, 25 bp, Rattus norvegicus
acagtccttaattatctcagttgaa

SEQ ID NO: 77849 - DNA, 25 bp, Rattus norvegicus
acagtccttccgcatggcaatggga

SEQ ID NO: 77850 - DNA, 25 bp, Rattus norvegicus
acagtccttccggatggcaatggga

SEQ ID NO: 77851 - DNA, 25 bp, Rattus norvegicus
acagtccttgatacatccaagctgc

SEQ ID NO: 77852 - DNA, 25 bp, Rattus norvegicus
acagtccttgattcatccaagctgc

SEQ ID NO: 77853 - DNA, 25 bp, Rattus norvegicus
acagtccttgccatgctgtttggga

SEQ ID NO: 77854 - DNA, 25 bp, Rattus norvegicus
acagtccttgccttgctgtttggga

SEQ ID NO: 77855 - DNA, 25 bp, Rattus norvegicus
acagtcctttctagatattctcggg

SEQ ID NO: 77856 - DNA, 25 bp, Rattus norvegicus
acagtcctttcttgatattctcggg

SEQ ID NO: 77857 - DNA, 25 bp, Rattus norvegicus
acagtcctttggatgcagacaagag

SEQ ID NO: 77858 - DNA, 25 bp, Rattus norvegicus
acagtcctttggttgcagacaagag

SEQ ID NO: 77859 - DNA, 25 bp, Rattus norvegicus
acagtcgactgcatagaatcttcat

SEQ ID NO: 77860 - DNA, 25 bp, Rattus norvegicus
acagtcgactgcttagaatcttcat

SEQ ID NO: 77861 - DNA, 25 bp, Rattus norvegicus
acagtcggaaaccatcagcaagcag

SEQ ID NO: 77862 - DNA, 25 bp, Rattus norvegicus
acagtcggaaacgatcagcaagcag

SEQ ID NO: 77863 - DNA, 25 bp, Rattus norvegicus
acagtcggggtgacccaacgcgcga

SEQ ID NO: 77864 - DNA, 25 bp, Rattus norvegicus
acagtcggggtgtcccaacgcgcga

SEQ ID NO: 77865 - DNA, 25 bp, Rattus norvegicus
acagtcggtgggagtgtcacttcag

SEQ ID NO: 77866 - DNA, 25 bp, Rattus norvegicus
acagtcggtgggtgtgtcacttcag

SEQ ID NO: 77867 - DNA, 25 bp, Rattus norvegicus
acagtcgtagatcgcttattcccag

SEQ ID NO: 77868 - DNA, 25 bp, Rattus norvegicus
acagtcgtagatggcttattcccag

SEQ ID NO: 77869 - DNA, 25 bp, Rattus norvegicus
acagtcgtccagatctttggtgttg

SEQ ID NO: 77870 - DNA, 25 bp, Rattus norvegicus
acagtcgtccagttctttggtgttg

SEQ ID NO: 77871 - DNA, 25 bp, Rattus norvegicus
acagtcgtctgtcggcaccaggaca

SEQ ID NO: 77872 - DNA, 25 bp, Rattus norvegicus
acagtcgtctgtgggcaccaggaca

SEQ ID NO: 77873 - DNA, 25 bp, Rattus norvegicus
acagtcgttcttagggtgtcagcta

SEQ ID NO: 77874 - DNA, 25 bp, Rattus norvegicus
acagtcgttctttgggtgtcagcta

SEQ ID NO: 77875 - DNA, 25 bp, Rattus norvegicus
acagtctaactcatgaatgcttcta

SEQ ID NO: 77876 - DNA, 25 bp, Rattus norvegicus
acagtctaactcttgaatgcttcta

SEQ ID NO: 77877 - DNA, 25 bp, Rattus norvegicus
acagtctactgtattggtctttctc

SEQ ID NO: 77878 - DNA, 25 bp, Rattus norvegicus
acagtctactgttttggtctttctc

SEQ ID NO: 77879 - DNA, 25 bp, Rattus norvegicus
acagtctatagtactaggctccctt

SEQ ID NO: 77880 - DNA, 25 bp, Rattus norvegicus
acagtctatagttctaggctccctt

SEQ ID NO: 77881 - DNA, 25 bp, Rattus norvegicus
acagtctatctccacagcaagttta

SEQ ID NO: 77882 - DNA, 25 bp, Rattus norvegicus
acagtctatctcgacagcaagttta

SEQ ID NO: 77883 - DNA, 25 bp, Rattus norvegicus
acagtctcaagtcgcactcaagcat

SEQ ID NO: 77884 - DNA, 25 bp, Rattus norvegicus
acagtctcaagtggcactcaagcat

SEQ ID NO: 77885 - DNA, 25 bp, Rattus norvegicus
acagtctcaataatcaactctcatg

SEQ ID NO: 77886 - DNA, 25 bp, Rattus norvegicus
acagtctcaatattcaactctcatg

SEQ ID NO: 77887 - DNA, 25 bp, Rattus norvegicus
acagtctcacagctggcttcatggt

SEQ ID NO: 77888 - DNA, 25 bp, Rattus norvegicus
acagtctcacaggtggcttcatggt

SEQ ID NO: 77889 - DNA, 25 bp, Rattus norvegicus
acagtctcagaaattggccaccaac

SEQ ID NO: 77890 - DNA, 25 bp, Rattus norvegicus
acagtctcagaatttggccaccaac

SEQ ID NO: 77891 - DNA, 25 bp, Rattus norvegicus
acagtctcagcgagtgtggtcttcc

SEQ ID NO: 77892 - DNA, 25 bp, Rattus norvegicus
acagtctcagcgtgtgtggtcttcc

SEQ ID NO: 77893 - DNA, 25 bp, Rattus norvegicus
acagtctcatatctcctaggctgac

SEQ ID NO: 77894 - DNA, 25 bp, Rattus norvegicus
acagtctcatatgtcctaggctgac

SEQ ID NO: 77895 - DNA, 25 bp, Rattus norvegicus
acagtctcccagaaccaataatcgg

SEQ ID NO: 77896 - DNA, 25 bp, Rattus norvegicus
acagtctcccagtaccaataatcgg

SEQ ID NO: 77897 - DNA, 25 bp, Rattus norvegicus
acagtctcggagcagcaggtcctgt

SEQ ID NO: 77898 - DNA, 25 bp, Rattus norvegicus
acagtctcggaggagcaggtcctgt

SEQ ID NO: 77899 - DNA, 25 bp, Rattus norvegicus
acagtctcgtctattttcttcagaa

SEQ ID NO: 77900 - DNA, 25 bp, Rattus norvegicus
acagtctcgtcttttttcttcagaa

SEQ ID NO: 77901 - DNA, 25 bp, Rattus norvegicus
acagtctctctcagagtgagccaga

SEQ ID NO: 77902 - DNA, 25 bp, Rattus norvegicus
acagtctctctctgagtgagccaga

SEQ ID NO: 77903 - DNA, 25 bp, Rattus norvegicus
acagtctctgtgattctggaagcca

SEQ ID NO: 77904 - DNA, 25 bp, Rattus norvegicus
acagtctctgtgtttctggaagcca

SEQ ID NO: 77905 - DNA, 25 bp, Rattus norvegicus
acagtctgaaatctttcccttggaa

SEQ ID NO: 77906 - DNA, 25 bp, Rattus norvegicus
acagtctgaaatgtttcccttggaa

SEQ ID NO: 77907 - DNA, 25 bp, Rattus norvegicus
acagtctgaactccttccgtgacca

SEQ ID NO: 77908 - DNA, 25 bp, Rattus norvegicus
acagtctgaactgcttccgtgacca

SEQ ID NO: 77909 - DNA, 25 bp, Rattus norvegicus
acagtctgccgtctccaaggctgga

SEQ ID NO: 77910 - DNA, 25 bp, Rattus norvegicus
acagtctgccgtgtccaaggctgga

SEQ ID NO: 77911 - DNA, 25 bp, Rattus norvegicus
acagtctgctttctgttgaaaccca

SEQ ID NO: 77912 - DNA, 25 bp, Rattus norvegicus
acagtctgctttgtgttgaaaccca

SEQ ID NO: 77913 - DNA, 25 bp, Rattus norvegicus
acagtctggcctagtcactgacttt

SEQ ID NO: 77914 - DNA, 25 bp, Rattus norvegicus
acagtctggccttgtcactgacttt

SEQ ID NO: 77915 - DNA, 25 bp, Rattus norvegicus
acagtctggtctcactgttgtccta

SEQ ID NO: 77916 - DNA, 25 bp, Rattus norvegicus
acagtctggtctgactgttgtccta

SEQ ID NO: 77917 - DNA, 25 bp, Rattus norvegicus
acagtctgtataatttcctagttca

SEQ ID NO: 77918 - DNA, 25 bp, Rattus norvegicus
acagtctgtatattttcctagttca

SEQ ID NO: 77919 - DNA, 25 bp, Rattus norvegicus
acagtctgtatcactagtttcaggg

SEQ ID NO: 77920 - DNA, 25 bp, Rattus norvegicus
acagtctgtatctctagtttcaggg

SEQ ID NO: 77921 - DNA, 25 bp, Rattus norvegicus
acagtctgtctgagcatgctaccaa

SEQ ID NO: 77922 - DNA, 25 bp, Rattus norvegicus
acagtctgtctgtgcatgctaccaa

SEQ ID NO: 77923 - DNA, 25 bp, Rattus norvegicus
acagtctgtgccaagcatgcttaag

SEQ ID NO: 77924 - DNA, 25 bp, Rattus norvegicus
acagtctgtgcctagcatgcttaag

SEQ ID NO: 77925 - DNA, 25 bp, Rattus norvegicus
acagtctgttggctgagaccgagat

SEQ ID NO: 77926 - DNA, 25 bp, Rattus norvegicus
acagtctgttgggtgagaccgagat

SEQ ID NO: 77927 - DNA, 25 bp, Rattus norvegicus
acagtcttagtgaaatcccagttag

SEQ ID NO: 77928 - DNA, 25 bp, Rattus norvegicus
acagtcttagtgtaatcccagttag

SEQ ID NO: 77929 - DNA, 25 bp, Rattus norvegicus
acagtcttcagtctctgttcctatg

SEQ ID NO: 77930 - DNA, 25 bp, Rattus norvegicus
acagtcttcagtgtctgttcctatg

SEQ ID NO: 77931 - DNA, 25 bp, Rattus norvegicus
acagtcttcgttctacccagaggag

SEQ ID NO: 77932 - DNA, 25 bp, Rattus norvegicus
acagtcttcgttgtacccagaggag

SEQ ID NO: 77933 - DNA, 25 bp, Rattus norvegicus
acagtcttctcacctaggcaggaat

SEQ ID NO: 77934 - DNA, 25 bp, Rattus norvegicus
acagtcttctcagctaggcaggaat

SEQ ID NO: 77935 - DNA, 25 bp, Rattus norvegicus
acagtcttgtcacaggttaccttcc

SEQ ID NO: 77936 - DNA, 25 bp, Rattus norvegicus
acagtcttgtcacagtcacctttat

SEQ ID NO: 77937 - DNA, 25 bp, Rattus norvegicus
acagtcttgtcagaggttaccttcc

SEQ ID NO: 77938 - DNA, 25 bp, Rattus norvegicus
acagtcttgtcagagtcacctttat

SEQ ID NO: 77939 - DNA, 25 bp, Rattus norvegicus
acagtcttgttacgccggtgacgca

SEQ ID NO: 77940 - DNA, 25 bp, Rattus norvegicus
acagtcttgttaggccggtgacgca

SEQ ID NO: 77941 - DNA, 25 bp, Rattus norvegicus
acagtctttggcctctcagaagtgt

SEQ ID NO: 77942 - DNA, 25 bp, Rattus norvegicus
acagtctttggcgtctcagaagtgt

SEQ ID NO: 77943 - DNA, 25 bp, Rattus norvegicus
acagtgaaacgcaactttacctagt

SEQ ID NO: 77944 - DNA, 25 bp, Rattus norvegicus
acagtgaaacgctactttacctagt

SEQ ID NO: 77945 - DNA, 25 bp, Rattus norvegicus
acagtgaaacttaccagtggaccaa

SEQ ID NO: 77946 - DNA, 25 bp, Rattus norvegicus
acagtgaaactttccagtggaccaa

SEQ ID NO: 77947 - DNA, 25 bp, Rattus norvegicus
acagtgaagaccctggttcctgatg

SEQ ID NO: 77948 - DNA, 25 bp, Rattus norvegicus
acagtgaagaccgtggttcctgatg

SEQ ID NO: 77949 - DNA, 25 bp, Rattus norvegicus
acagtgaagcaactcatttggacaa

SEQ ID NO: 77950 - DNA, 25 bp, Rattus norvegicus
acagtgaagcaagtcatttggacaa

SEQ ID NO: 77951 - DNA, 25 bp, Rattus norvegicus
acagtgaaggtgcttcggacccagc

SEQ ID NO: 77952 - DNA, 25 bp, Rattus norvegicus
acagtgaaggtggttcggacccagc

SEQ ID NO: 77953 - DNA, 25 bp, Rattus norvegicus
acagtgaatctgagtgtttctacat

SEQ ID NO: 77954 - DNA, 25 bp, Rattus norvegicus
acagtgaatctgtgtgtttctacat

SEQ ID NO: 77955 - DNA, 25 bp, Rattus norvegicus
acagtgacaagtcacagccgtgaca

SEQ ID NO: 77956 - DNA, 25 bp, Rattus norvegicus
acagtgacaagtgacagccgtgaca

SEQ ID NO: 77957 - DNA, 25 bp, Rattus norvegicus
acagtgacaatgcacggcagtgaca

SEQ ID NO: 77958 - DNA, 25 bp, Rattus norvegicus
acagtgacaatggacggcagtgaca

SEQ ID NO: 77959 - DNA, 25 bp, Rattus norvegicus
acagtgacagctacttctccagtat

SEQ ID NO: 77960 - DNA, 25 bp, Rattus norvegicus
acagtgacagcttcttctccagtat

SEQ ID NO: 77961 - DNA, 25 bp, Rattus norvegicus
acagtgacagtcagaccttgctgca

SEQ ID NO: 77962 - DNA, 25 bp, Rattus norvegicus
acagtgacagtctgaccttgctgca

SEQ ID NO: 77963 - DNA, 25 bp, Rattus norvegicus
acagtgacatgcagcctgcaacgag

SEQ ID NO: 77964 - DNA, 25 bp, Rattus norvegicus
acagtgacatgctgcctgcaacgag

SEQ ID NO: 77965 - DNA, 25 bp, Rattus norvegicus
acagtgaccatgaatcagttttcca

SEQ ID NO: 77966 - DNA, 25 bp, Rattus norvegicus
acagtgaccatgaggccagaggcca

SEQ ID NO: 77967 - DNA, 25 bp, Rattus norvegicus
acagtgaccatgtatcagttttcca

SEQ ID NO: 77968 - DNA, 25 bp, Rattus norvegicus
acagtgaccatgtggccagaggcca

SEQ ID NO: 77969 - DNA, 25 bp, Rattus norvegicus
acagtgaccctgaatatagctcctt

SEQ ID NO: 77970 - DNA, 25 bp, Rattus norvegicus
acagtgaccctgtatatagctcctt

SEQ ID NO: 77971 - DNA, 25 bp, Rattus norvegicus
acagtgacctcaaagctgccaggag

SEQ ID NO: 77972 - DNA, 25 bp, Rattus norvegicus
acagtgacctcatagctgccaggag

SEQ ID NO: 77973 - DNA, 25 bp, Rattus norvegicus
acagtgacgggacggcgccaactac

SEQ ID NO: 77974 - DNA, 25 bp, Rattus norvegicus
acagtgacgggagggcgccaactac

SEQ ID NO: 77975 - DNA, 25 bp, Rattus norvegicus
acagtgactgcaacagctgaggagc

SEQ ID NO: 77976 - DNA, 25 bp, Rattus norvegicus
acagtgactgcatcagctgaggagc

SEQ ID NO: 77977 - DNA, 25 bp, Rattus norvegicus
acagtgactgctcaggaatcccttc

SEQ ID NO: 77978 - DNA, 25 bp, Rattus norvegicus
acagtgactgctctgctggtttgaa

SEQ ID NO: 77979 - DNA, 25 bp, Rattus norvegicus
acagtgactgctgaggaatcccttc

SEQ ID NO: 77980 - DNA, 25 bp, Rattus norvegicus
acagtgactgctgtgctggtttgaa

SEQ ID NO: 77981 - DNA, 25 bp, Rattus norvegicus
acagtgactgtcactccagatggat

SEQ ID NO: 77982 - DNA, 25 bp, Rattus norvegicus
acagtgactgtctctccagatggat

SEQ ID NO: 77983 - DNA, 25 bp, Rattus norvegicus
acagtgactgtgctgggcatccctc

SEQ ID NO: 77984 - DNA, 25 bp, Rattus norvegicus
acagtgactgtggtgggcatccctc

SEQ ID NO: 77985 - DNA, 25 bp, Rattus norvegicus
acagtgacttccagtcagcttcacg

SEQ ID NO: 77986 - DNA, 25 bp, Rattus norvegicus
acagtgacttcctgtcagcttcacg

SEQ ID NO: 77987 - DNA, 25 bp, Rattus norvegicus
acagtgagcataactggtatatgtc

SEQ ID NO: 77988 - DNA, 25 bp, Rattus norvegicus
acagtgagcatatctggtatatgtc

SEQ ID NO: 77989 - DNA, 25 bp, Rattus norvegicus
acagtgaggaaccagccagctatct

SEQ ID NO: 77990 - DNA, 25 bp, Rattus norvegicus
acagtgaggaacgagccagctatct

SEQ ID NO: 77991 - DNA, 25 bp, Rattus norvegicus
acagtgagggatcgcacgacgtcat

SEQ ID NO: 77992 - DNA, 25 bp, Rattus norvegicus
acagtgagggatggcacgacgtcat

SEQ ID NO: 77993 - DNA, 25 bp, Rattus norvegicus
acagtgagtgctcgcgctgctcctg

SEQ ID NO: 77994 - DNA, 25 bp, Rattus norvegicus
acagtgagtgctggcgctgctcctg

SEQ ID NO: 77995 - DNA, 25 bp, Rattus norvegicus
acagtgagttctacacgggcagcaa

SEQ ID NO: 77996 - DNA, 25 bp, Rattus norvegicus
acagtgagttcttcacgggcagcaa

SEQ ID NO: 77997 - DNA, 25 bp, Rattus norvegicus
acagtgagttggaagccagcttgct

SEQ ID NO: 77998 - DNA, 25 bp, Rattus norvegicus
acagtgagttggtagccagcttgct

SEQ ID NO: 77999 - DNA, 25 bp, Rattus norvegicus
acagtgagtttgaggcctttggact

SEQ ID NO: 78000 - DNA, 25 bp, Rattus norvegicus
acagtgagtttgtggcctttggact

SEQ ID NO: 78001 - DNA, 25 bp, Rattus norvegicus
acagtgatcttcatcctcagagaga

SEQ ID NO: 78002 - DNA, 25 bp, Rattus norvegicus
acagtgatcttcttcctcagagaga

SEQ ID NO: 78003 - DNA, 25 bp, Rattus norvegicus
acagtgattctgaatgccgctggga

SEQ ID NO: 78004 - DNA, 25 bp, Rattus norvegicus
acagtgattctgtatgccgctggga

SEQ ID NO: 78005 - DNA, 25 bp, Rattus norvegicus
acagtgattggcattcctgaattca

SEQ ID NO: 78006 - DNA, 25 bp, Rattus norvegicus
acagtgattggctttcctgaattca

SEQ ID NO: 78007 - DNA, 25 bp, Rattus norvegicus
acagtgcaaacaactccttcgaaat

SEQ ID NO: 78008 - DNA, 25 bp, Rattus norvegicus
acagtgcaaacatctccttcgaaat

SEQ ID NO: 78009 - DNA, 25 bp, Rattus norvegicus
acagtgcaagaactggtccctgcca

SEQ ID NO: 78010 - DNA, 25 bp, Rattus norvegicus
acagtgcaagaagtggtccctgcca

SEQ ID NO: 78011 - DNA, 25 bp, Rattus norvegicus
acagtgcaatctcagcaggaagttt

SEQ ID NO: 78012 - DNA, 25 bp, Rattus norvegicus
acagtgcaatctgagcaggaagttt

SEQ ID NO: 78013 - DNA, 25 bp, Rattus norvegicus
acagtgcaccctagtatagccaaga

SEQ ID NO: 78014 - DNA, 25 bp, Rattus norvegicus
acagtgcacccttgtatagccaaga

SEQ ID NO: 78015 - DNA, 25 bp, Rattus norvegicus
acagtgcacttgcttacagcccaga

SEQ ID NO: 78016 - DNA, 25 bp, Rattus norvegicus
acagtgcacttggttacagcccaga

SEQ ID NO: 78017 - DNA, 25 bp, Rattus norvegicus
acagtgcagagcagcttcgtttcca

SEQ ID NO: 78018 - DNA, 25 bp, Rattus norvegicus
acagtgcagagctgcttcgtttcca

SEQ ID NO: 78019 - DNA, 25 bp, Rattus norvegicus
acagtgcagcagaaatggagttcct

SEQ ID NO: 78020 - DNA, 25 bp, Rattus norvegicus
acagtgcagcagtaatggagttcct

SEQ ID NO: 78021 - DNA, 25 bp, Rattus norvegicus
acagtgcagctgcatatcataagga

SEQ ID NO: 78022 - DNA, 25 bp, Rattus norvegicus
acagtgcagctggatatcataagga

SEQ ID NO: 78023 - DNA, 25 bp, Rattus norvegicus
acagtgcagcttctgtggccttcca

SEQ ID NO: 78024 - DNA, 25 bp, Rattus norvegicus
acagtgcagcttgtgtggccttcca

SEQ ID NO: 78025 - DNA, 25 bp, Rattus norvegicus
acagtgcagttcctattgaccgtaa

SEQ ID NO: 78026 - DNA, 25 bp, Rattus norvegicus
acagtgcagttcgtattgaccgtaa

SEQ ID NO: 78027 - DNA, 25 bp, Rattus norvegicus
acagtgcatcgcagtgccatggtct

SEQ ID NO: 78028 - DNA, 25 bp, Rattus norvegicus
acagtgcatcgctgtgccatggtct

SEQ ID NO: 78029 - DNA, 25 bp, Rattus norvegicus
acagtgcatcggctcttctgagaga

SEQ ID NO: 78030 - DNA, 25 bp, Rattus norvegicus
acagtgcatcgggtcttctgagaga

SEQ ID NO: 78031 - DNA, 25 bp, Rattus norvegicus
acagtgcatcttctcccaagaaaat

SEQ ID NO: 78032 - DNA, 25 bp, Rattus norvegicus
acagtgcatcttgtcccaagaaaat

SEQ ID NO: 78033 - DNA, 25 bp, Rattus norvegicus
acagtgcatgctcctcagatgctgt

SEQ ID NO: 78034 - DNA, 25 bp, Rattus norvegicus
acagtgcatgctgctcagatgctgt

SEQ ID NO: 78035 - DNA, 25 bp, Rattus norvegicus
acagtgcattggacattgtcttaca

SEQ ID NO: 78036 - DNA, 25 bp, Rattus norvegicus
acagtgcattggtcattgtcttaca

SEQ ID NO: 78037 - DNA, 25 bp, Rattus norvegicus
acagtgcattttctattggtctttg

SEQ ID NO: 78038 - DNA, 25 bp, Rattus norvegicus
acagtgcattttgtattggtctttg

SEQ ID NO: 78039 - DNA, 25 bp, Rattus norvegicus
acagtgccaaaaatcagtcccaacc

SEQ ID NO: 78040 - DNA, 25 bp, Rattus norvegicus
acagtgccaaaattcagtcccaacc

SEQ ID NO: 78041 - DNA, 25 bp, Rattus norvegicus
acagtgccaatcacgacatcacagg

SEQ ID NO: 78042 - DNA, 25 bp, Rattus norvegicus
acagtgccaatctcgacatcacagg

SEQ ID NO: 78043 - DNA, 25 bp, Rattus norvegicus
acagtgccacacaagttgtttcagt

SEQ ID NO: 78044 - DNA, 25 bp, Rattus norvegicus
acagtgccacactagttgtttcagt

SEQ ID NO: 78045 - DNA, 25 bp, Rattus norvegicus
acagtgccactgattgtgggcttga

SEQ ID NO: 78046 - DNA, 25 bp, Rattus norvegicus
acagtgccactgtttgtgggcttga

SEQ ID NO: 78047 - DNA, 25 bp, Rattus norvegicus
acagtgccagtgacgttttgtactt

SEQ ID NO: 78048 - DNA, 25 bp, Rattus norvegicus
acagtgccagtgtcgttttgtactt

SEQ ID NO: 78049 - DNA, 25 bp, Rattus norvegicus
acagtgcccaagctgccagaacaga

SEQ ID NO: 78050 - DNA, 25 bp, Rattus norvegicus
acagtgcccaaggtgccagaacaga

SEQ ID NO: 78051 - DNA, 25 bp, Rattus norvegicus
acagtgcccagacgctgagcatcgc

SEQ ID NO: 78052 - DNA, 25 bp, Rattus norvegicus
acagtgcccagaggctgagcatcgc

SEQ ID NO: 78053 - DNA, 25 bp, Rattus norvegicus
acagtgccccaaacatgcgttttat

SEQ ID NO: 78054 - DNA, 25 bp, Rattus norvegicus
acagtgccccaatcatgcgttttat

SEQ ID NO: 78055 - DNA, 25 bp, Rattus norvegicus
acagtgccctggacagatgtctctg

SEQ ID NO: 78056 - DNA, 25 bp, Rattus norvegicus
acagtgccctggtcagatgtctctg

SEQ ID NO: 78057 - DNA, 25 bp, Rattus norvegicus
acagtgcctaaaatcgagagtcccg

SEQ ID NO: 78058 - DNA, 25 bp, Rattus norvegicus
acagtgcctaaattcgagagtcccg

SEQ ID NO: 78059 - DNA, 25 bp, Rattus norvegicus
acagtgcctattagcagctcccgag

SEQ ID NO: 78060 - DNA, 25 bp, Rattus norvegicus
acagtgcctatttgcagctcccgag

SEQ ID NO: 78061 - DNA, 25 bp, Rattus norvegicus
acagtgcctctgaatgctttgtatt

SEQ ID NO: 78062 - DNA, 25 bp, Rattus norvegicus
acagtgcctctgatcctgagaagca

SEQ ID NO: 78063 - DNA, 25 bp, Rattus norvegicus
acagtgcctctgtatgctttgtatt

SEQ ID NO: 78064 - DNA, 25 bp, Rattus norvegicus
acagtgcctctgttcctgagaagca

SEQ ID NO: 78065 - DNA, 25 bp, Rattus norvegicus
acagtgcctgacctcaagcggaaaa

SEQ ID NO: 78066 - DNA, 25 bp, Rattus norvegicus
acagtgcctgacgtcaagcggaaaa

SEQ ID NO: 78067 - DNA, 25 bp, Rattus norvegicus
acagtgcctgcaaagtaactagtgt

SEQ ID NO: 78068 - DNA, 25 bp, Rattus norvegicus
acagtgcctgcatagtaactagtgt

SEQ ID NO: 78069 - DNA, 25 bp, Rattus norvegicus
acagtgccttatccagaggtggtca

SEQ ID NO: 78070 - DNA, 25 bp, Rattus norvegicus
acagtgccttatgcagaggtggtca

SEQ ID NO: 78071 - DNA, 25 bp, Rattus norvegicus
acagtgccttcaaaacaaccctctt

SEQ ID NO: 78072 - DNA, 25 bp, Rattus norvegicus
acagtgccttcataacaaccctctt

SEQ ID NO: 78073 - DNA, 25 bp, Rattus norvegicus
acagtgcgcaggcagaccccaggaa

SEQ ID NO: 78074 - DNA, 25 bp, Rattus norvegicus
acagtgcgcagggagaccccaggaa

SEQ ID NO: 78075 - DNA, 25 bp, Rattus norvegicus
acagtgcgccgccagcgttacctga

SEQ ID NO: 78076 - DNA, 25 bp, Rattus norvegicus
acagtgcgccgcgagcgttacctga

SEQ ID NO: 78077 - DNA, 25 bp, Rattus norvegicus
acagtgctaagtctgttcagtagac

SEQ ID NO: 78078 - DNA, 25 bp, Rattus norvegicus
acagtgctaagtgtgttcagtagac

SEQ ID NO: 78079 - DNA, 25 bp, Rattus norvegicus
acagtgctaccgcatcaacctgcaa

SEQ ID NO: 78080 - DNA, 25 bp, Rattus norvegicus
acagtgctaccggatcaacctgcaa

SEQ ID NO: 78081 - DNA, 25 bp, Rattus norvegicus
acagtgctagccactatttactaca

SEQ ID NO: 78082 - DNA, 25 bp, Rattus norvegicus
acagtgctagcctctatttactaca

SEQ ID NO: 78083 - DNA, 25 bp, Rattus norvegicus
acagtgctcatacaagtcagttcaa

SEQ ID NO: 78084 - DNA, 25 bp, Rattus norvegicus
acagtgctcatagaagtcagttcaa

SEQ ID NO: 78085 - DNA, 25 bp, Rattus norvegicus
acagtgctccacaggttcatgtcat

SEQ ID NO: 78086 - DNA, 25 bp, Rattus norvegicus
acagtgctccactggttcatgtcat

SEQ ID NO: 78087 - DNA, 25 bp, Rattus norvegicus
acagtgctcctgctggagttgtcac

SEQ ID NO: 78088 - DNA, 25 bp, Rattus norvegicus
acagtgctcctggtggagttgtcac

SEQ ID NO: 78089 - DNA, 25 bp, Rattus norvegicus
acagtgctcgccatactttaaagct

SEQ ID NO: 78090 - DNA, 25 bp, Rattus norvegicus
acagtgctcgccttactttaaagct

SEQ ID NO: 78091 - DNA, 25 bp, Rattus norvegicus
acagtgctctgtatgccttcatctt

SEQ ID NO: 78092 - DNA, 25 bp, Rattus norvegicus
acagtgctctgtttgccttcatctt

SEQ ID NO: 78093 - DNA, 25 bp, Rattus norvegicus
acagtgctgaggctctgtcctgttg

SEQ ID NO: 78094 - DNA, 25 bp, Rattus norvegicus
acagtgctgagggtctgtcctgttg

SEQ ID NO: 78095 - DNA, 25 bp, Rattus norvegicus
acagtgctgcgtcaggtggacacta

SEQ ID NO: 78096 - DNA, 25 bp, Rattus norvegicus
acagtgctgcgtgaggtggacacta

SEQ ID NO: 78097 - DNA, 25 bp, Rattus norvegicus
acagtgctgcttcattacttgtagg

SEQ ID NO: 78098 - DNA, 25 bp, Rattus norvegicus
acagtgctgcttgattacttgtagg

SEQ ID NO: 78099 - DNA, 25 bp, Rattus norvegicus
acagtgctggcccaaaccttgcggg

SEQ ID NO: 78100 - DNA, 25 bp, Rattus norvegicus
acagtgctggccgaaaccttgcggg

SEQ ID NO: 78101 - DNA, 25 bp, Rattus norvegicus
acagtgctgggccaggtgaacatta

SEQ ID NO: 78102 - DNA, 25 bp, Rattus norvegicus
acagtgctgggccttggttcccaca

SEQ ID NO: 78103 - DNA, 25 bp, Rattus norvegicus
acagtgctgggcgaggtgaacatta

SEQ ID NO: 78104 - DNA, 25 bp, Rattus norvegicus
acagtgctgggcgttggttcccaca

SEQ ID NO: 78105 - DNA, 25 bp, Rattus norvegicus
acagtgcttcagcttcctacacaaa

SEQ ID NO: 78106 - DNA, 25 bp, Rattus norvegicus
acagtgcttcaggttcctacacaaa

SEQ ID NO: 78107 - DNA, 25 bp, Rattus norvegicus
acagtgcttctgcttctttttattt

SEQ ID NO: 78108 - DNA, 25 bp, Rattus norvegicus
acagtgcttctggttctttttattt

SEQ ID NO: 78109 - DNA, 25 bp, Rattus norvegicus
acagtgcttgacctctgagtcattg

SEQ ID NO: 78110 - DNA, 25 bp, Rattus norvegicus
acagtgcttgacgtctgagtcattg

SEQ ID NO: 78111 - DNA, 25 bp, Rattus norvegicus
acagtgcttgagactttggcttgct

SEQ ID NO: 78112 - DNA, 25 bp, Rattus norvegicus
acagtgcttgagtctttggcttgct

SEQ ID NO: 78113 - DNA, 25 bp, Rattus norvegicus
acagtgcttgctaagcaggactgca

SEQ ID NO: 78114 - DNA, 25 bp, Rattus norvegicus
acagtgcttgcttagcaggactgca

SEQ ID NO: 78115 - DNA, 25 bp, Rattus norvegicus
acagtgcttgtgacttgtctcgtgg

SEQ ID NO: 78116 - DNA, 25 bp, Rattus norvegicus
acagtgcttgtgtcttgtctcgtgg

SEQ ID NO: 78117 - DNA, 25 bp, Rattus norvegicus
acagtggaattgctctgctcaccaa

SEQ ID NO: 78118 - DNA, 25 bp, Rattus norvegicus
acagtggaattggtctgctcaccaa

SEQ ID NO: 78119 - DNA, 25 bp, Rattus norvegicus
acagtggaccgtctctgcttgtttg

SEQ ID NO: 78120 - DNA, 25 bp, Rattus norvegicus
acagtggaccgtgtctgcttgtttg

SEQ ID NO: 78121 - DNA, 25 bp, Rattus norvegicus
acagtggacctgcttacttcagcca

SEQ ID NO: 78122 - DNA, 25 bp, Rattus norvegicus
acagtggacctggttacttcagcca

SEQ ID NO: 78123 - DNA, 25 bp, Rattus norvegicus
acagtggactctacctcggcatgaa

SEQ ID NO: 78124 - DNA, 25 bp, Rattus norvegicus
acagtggactcttcctcggcatgaa

SEQ ID NO: 78125 - DNA, 25 bp, Rattus norvegicus
acagtggactgtctccctgagccgt

SEQ ID NO: 78126 - DNA, 25 bp, Rattus norvegicus
acagtggactgtgtccctgagccgt

SEQ ID NO: 78127 - DNA, 25 bp, Rattus norvegicus
acagtggacttccaggcttttggct

SEQ ID NO: 78128 - DNA, 25 bp, Rattus norvegicus
acagtggacttcgaggcttttggct

SEQ ID NO: 78129 - DNA, 25 bp, Rattus norvegicus
acagtggagcctacgtgtatggtgc

SEQ ID NO: 78130 - DNA, 25 bp, Rattus norvegicus
acagtggagccttcgtgtatggtgc

SEQ ID NO: 78131 - DNA, 25 bp, Rattus norvegicus
acagtggaggacaccgtgcaggcct

SEQ ID NO: 78132 - DNA, 25 bp, Rattus norvegicus
acagtggaggactccgtgcaggcct

SEQ ID NO: 78133 - DNA, 25 bp, Rattus norvegicus
acagtggatcttaatctctggtaga

SEQ ID NO: 78134 - DNA, 25 bp, Rattus norvegicus
acagtggatctttatctctggtaga

SEQ ID NO: 78135 - DNA, 25 bp, Rattus norvegicus
acagtggatgtcagagctatctctc

SEQ ID NO: 78136 - DNA, 25 bp, Rattus norvegicus
acagtggatgtctgagctatctctc

SEQ ID NO: 78137 - DNA, 25 bp, Rattus norvegicus
acagtggcagccagttggccgtttt

SEQ ID NO: 78138 - DNA, 25 bp, Rattus norvegicus
acagtggcagcctgttggccgtttt

SEQ ID NO: 78139 - DNA, 25 bp, Rattus norvegicus
acagtggcaggcctacagcatgcat

SEQ ID NO: 78140 - DNA, 25 bp, Rattus norvegicus
acagtggcaggcgtacagcatgcat

SEQ ID NO: 78141 - DNA, 25 bp, Rattus norvegicus
acagtggcatgtattcttatcaaag

SEQ ID NO: 78142 - DNA, 25 bp, Rattus norvegicus
acagtggcatgttttcttatcaaag

SEQ ID NO: 78143 - DNA, 25 bp, Rattus norvegicus
acagtggccaagcagcagtcctcaa

SEQ ID NO: 78144 - DNA, 25 bp, Rattus norvegicus
acagtggccaaggagcagtcctcaa

SEQ ID NO: 78145 - DNA, 25 bp, Rattus norvegicus
acagtggccaccatgcgtggtgtga

SEQ ID NO: 78146 - DNA, 25 bp, Rattus norvegicus
acagtggccaccttgcgtggtgtga

SEQ ID NO: 78147 - DNA, 25 bp, Rattus norvegicus
acagtggccccacttgtggctggcc

SEQ ID NO: 78148 - DNA, 25 bp, Rattus norvegicus
acagtggccccagttgtggctggcc

SEQ ID NO: 78149 - DNA, 25 bp, Rattus norvegicus
acagtggcctggattacatcaaaat

SEQ ID NO: 78150 - DNA, 25 bp, Rattus norvegicus
acagtggcctggtttacatcaaaat

SEQ ID NO: 78151 - DNA, 25 bp, Rattus norvegicus
acagtggccttgaccgccaaggaag

SEQ ID NO: 78152 - DNA, 25 bp, Rattus norvegicus
acagtggccttgtccgccaaggaag

SEQ ID NO: 78153 - DNA, 25 bp, Rattus norvegicus
acagtggcgactctagaactctggc

SEQ ID NO: 78154 - DNA, 25 bp, Rattus norvegicus
acagtggcgactgtagaactctggc

SEQ ID NO: 78155 - DNA, 25 bp, Rattus norvegicus
acagtggcgcttaggctagtggatc

SEQ ID NO: 78156 - DNA, 25 bp, Rattus norvegicus
acagtggcgctttggctagtggatc

SEQ ID NO: 78157 - DNA, 25 bp, Rattus norvegicus
acagtggctccgagtgtcataaaac

SEQ ID NO: 78158 - DNA, 25 bp, Rattus norvegicus
acagtggctccgtgtgtcataaaac

SEQ ID NO: 78159 - DNA, 25 bp, Rattus norvegicus
acagtggctgcgattatttttccag

SEQ ID NO: 78160 - DNA, 25 bp, Rattus norvegicus
acagtggctgcgtttatttttccag

SEQ ID NO: 78161 - DNA, 25 bp, Rattus norvegicus
acagtggcttttctccatggtcata

SEQ ID NO: 78162 - DNA, 25 bp, Rattus norvegicus
acagtggcttttgtccatggtcata

SEQ ID NO: 78163 - DNA, 25 bp, Rattus norvegicus
acagtgggaagcattgccctcccga

SEQ ID NO: 78164 - DNA, 25 bp, Rattus norvegicus
acagtgggaagctttgccctcccga

SEQ ID NO: 78165 - DNA, 25 bp, Rattus norvegicus
acagtgggaccgctgtcacgttgca

SEQ ID NO: 78166 - DNA, 25 bp, Rattus norvegicus
acagtgggaccggtgtcacgttgca

SEQ ID NO: 78167 - DNA, 25 bp, Rattus norvegicus
acagtgggagacacattgctgccct

SEQ ID NO: 78168 - DNA, 25 bp, Rattus norvegicus
acagtgggagactcattgctgccct

SEQ ID NO: 78169 - DNA, 25 bp, Rattus norvegicus
acagtgggagctacagttcccttgt

SEQ ID NO: 78170 - DNA, 25 bp, Rattus norvegicus
acagtgggagcttcagttcccttgt

SEQ ID NO: 78171 - DNA, 25 bp, Rattus norvegicus
acagtgggctttacagaggcttctt

SEQ ID NO: 78172 - DNA, 25 bp, Rattus norvegicus
acagtgggcttttcagaggcttctt

SEQ ID NO: 78173 - DNA, 25 bp, Rattus norvegicus
acagtgggtcatagccaggctggac

SEQ ID NO: 78174 - DNA, 25 bp, Rattus norvegicus
acagtgggtcattgccaggctggac

SEQ ID NO: 78175 - DNA, 25 bp, Rattus norvegicus
acagtgggtctcacccaaggagcag

SEQ ID NO: 78176 - DNA, 25 bp, Rattus norvegicus
acagtgggtctctcccaaggagcag

SEQ ID NO: 78177 - DNA, 25 bp, Rattus norvegicus
acagtggtccacacttggagttctc

SEQ ID NO: 78178 - DNA, 25 bp, Rattus norvegicus
acagtggtccactcttggagttctc

SEQ ID NO: 78179 - DNA, 25 bp, Rattus norvegicus
acagtggtcctcctcacagatgtga

SEQ ID NO: 78180 - DNA, 25 bp, Rattus norvegicus
acagtggtcctcgtcacagatgtga

SEQ ID NO: 78181 - DNA, 25 bp, Rattus norvegicus
acagtggtcctgacgggaagccagc

SEQ ID NO: 78182 - DNA, 25 bp, Rattus norvegicus
acagtggtcctgacttctgaattgc

SEQ ID NO: 78183 - DNA, 25 bp, Rattus norvegicus
acagtggtcctgtcgggaagccagc

SEQ ID NO: 78184 - DNA, 25 bp, Rattus norvegicus
acagtggtcctgtcttctgaattgc

SEQ ID NO: 78185 - DNA, 25 bp, Rattus norvegicus
acagtggtcgggagctccacagaag

SEQ ID NO: 78186 - DNA, 25 bp, Rattus norvegicus
acagtggtcgggtgctccacagaag

SEQ ID NO: 78187 - DNA, 25 bp, Rattus norvegicus
acagtggtctaaagcccttcgtgtg

SEQ ID NO: 78188 - DNA, 25 bp, Rattus norvegicus
acagtggtctaatgcccttcgtgtg

SEQ ID NO: 78189 - DNA, 25 bp, Rattus norvegicus
acagtggtctagcagcctgaaccca

SEQ ID NO: 78190 - DNA, 25 bp, Rattus norvegicus
acagtggtctaggagcctgaaccca

SEQ ID NO: 78191 - DNA, 25 bp, Rattus norvegicus
acagtggtctccaagtcacctaaaa

SEQ ID NO: 78192 - DNA, 25 bp, Rattus norvegicus
acagtggtctcctagtcacctaaaa

SEQ ID NO: 78193 - DNA, 25 bp, Rattus norvegicus
acagtggtcttcaatacacgagaga

SEQ ID NO: 78194 - DNA, 25 bp, Rattus norvegicus
acagtggtcttctatacacgagaga

SEQ ID NO: 78195 - DNA, 25 bp, Rattus norvegicus
acagtggtggcaattagggccgaat

SEQ ID NO: 78196 - DNA, 25 bp, Rattus norvegicus
acagtggtggcatttagggccgaat

SEQ ID NO: 78197 - DNA, 25 bp, Rattus norvegicus
acagtggtggccaatcaggacctat

SEQ ID NO: 78198 - DNA, 25 bp, Rattus norvegicus
acagtggtggcctatcaggacctat

SEQ ID NO: 78199 - DNA, 25 bp, Rattus norvegicus
acagtggttctaattctggtgcccc

SEQ ID NO: 78200 - DNA, 25 bp, Rattus norvegicus
acagtggttctatttctggtgcccc

SEQ ID NO: 78201 - DNA, 25 bp, Rattus norvegicus
acagtggttgtgcacatgcttcaaa

SEQ ID NO: 78202 - DNA, 25 bp, Rattus norvegicus
acagtggttgtggacatgcttcaaa

SEQ ID NO: 78203 - DNA, 25 bp, Rattus norvegicus
acagtgtaactcagccaactgaggg

SEQ ID NO: 78204 - DNA, 25 bp, Rattus norvegicus
acagtgtaactctgccaactgaggg

SEQ ID NO: 78205 - DNA, 25 bp, Rattus norvegicus
acagtgtaacttagtttgttcagtc

SEQ ID NO: 78206 - DNA, 25 bp, Rattus norvegicus
acagtgtaactttgtttgttcagtc

SEQ ID NO: 78207 - DNA, 25 bp, Rattus norvegicus
acagtgtaagcaatgtgaccgccaa

SEQ ID NO: 78208 - DNA, 25 bp, Rattus norvegicus
acagtgtaagcattgtgaccgccaa

SEQ ID NO: 78209 - DNA, 25 bp, Rattus norvegicus
acagtgtactcaagtgcgcttgcaa

SEQ ID NO: 78210 - DNA, 25 bp, Rattus norvegicus
acagtgtactcatgtgcgcttgcaa

SEQ ID NO: 78211 - DNA, 25 bp, Rattus norvegicus
acagtgtactgtccccaattattaa

SEQ ID NO: 78212 - DNA, 25 bp, Rattus norvegicus
acagtgtactgtgcccaattattaa

SEQ ID NO: 78213 - DNA, 25 bp, Rattus norvegicus
acagtgtagtgcatcctcggagtat

SEQ ID NO: 78214 - DNA, 25 bp, Rattus norvegicus
acagtgtagtgcttcctcggagtat

SEQ ID NO: 78215 - DNA, 25 bp, Rattus norvegicus
acagtgtagtgtcccttcaggagac

SEQ ID NO: 78216 - DNA, 25 bp, Rattus norvegicus
acagtgtagtgtgccttcaggagac

SEQ ID NO: 78217 - DNA, 25 bp, Rattus norvegicus
acagtgtatctgacaggtcctggct

SEQ ID NO: 78218 - DNA, 25 bp, Rattus norvegicus
acagtgtatctgtcaggtcctggct

SEQ ID NO: 78219 - DNA, 25 bp, Rattus norvegicus
acagtgtcacagaataaaagctttt

SEQ ID NO: 78220 - DNA, 25 bp, Rattus norvegicus
acagtgtcacagtataaaagctttt

SEQ ID NO: 78221 - DNA, 25 bp, Rattus norvegicus
acagtgtccagcaatgcagaggaaa

SEQ ID NO: 78222 - DNA, 25 bp, Rattus norvegicus
acagtgtccagctatgcagaggaaa

SEQ ID NO: 78223 - DNA, 25 bp, Rattus norvegicus
acagtgtccagtacaagctgccgga

SEQ ID NO: 78224 - DNA, 25 bp, Rattus norvegicus
acagtgtccagttcaagctgccgga

SEQ ID NO: 78225 - DNA, 25 bp, Rattus norvegicus
acagtgtcccatagagtggtttcac

SEQ ID NO: 78226 - DNA, 25 bp, Rattus norvegicus
acagtgtcccattgagtggtttcac

SEQ ID NO: 78227 - DNA, 25 bp, Rattus norvegicus
acagtgtccccgatgaagagtctaa

SEQ ID NO: 78228 - DNA, 25 bp, Rattus norvegicus
acagtgtccccgttgaagagtctaa

SEQ ID NO: 78229 - DNA, 25 bp, Rattus norvegicus
acagtgtcctgtcttgagccccagt

SEQ ID NO: 78230 - DNA, 25 bp, Rattus norvegicus
acagtgtcctgtgttgagccccagt

SEQ ID NO: 78231 - DNA, 25 bp, Rattus norvegicus
acagtgtcgttgcatgagtcgctct

SEQ ID NO: 78232 - DNA, 25 bp, Rattus norvegicus
acagtgtcgttggatgagtcgctct

SEQ ID NO: 78233 - DNA, 25 bp, Rattus norvegicus
acagtgtctcagataaaggtcttag

SEQ ID NO: 78234 - DNA, 25 bp, Rattus norvegicus
acagtgtctcagttaaaggtcttag

SEQ ID NO: 78235 - DNA, 25 bp, Rattus norvegicus
acagtgtctcttagtgttgttgtaa

SEQ ID NO: 78236 - DNA, 25 bp, Rattus norvegicus
acagtgtctctttgtgttgttgtaa

SEQ ID NO: 78237 - DNA, 25 bp, Rattus norvegicus
acagtgtctgcccatgtggatgcac

SEQ ID NO: 78238 - DNA, 25 bp, Rattus norvegicus
acagtgtctgccgatgtggatgcac

SEQ ID NO: 78239 - DNA, 25 bp, Rattus norvegicus
acagtgtcttttaacgattagccaa

SEQ ID NO: 78240 - DNA, 25 bp, Rattus norvegicus
acagtgtctttttacgattagccaa

SEQ ID NO: 78241 - DNA, 25 bp, Rattus norvegicus
acagtgtgaacgacgggtcccattt

SEQ ID NO: 78242 - DNA, 25 bp, Rattus norvegicus
acagtgtgaacgtcgggtcccattt

SEQ ID NO: 78243 - DNA, 25 bp, Rattus norvegicus
acagtgtgacataccctggcttctt

SEQ ID NO: 78244 - DNA, 25 bp, Rattus norvegicus
acagtgtgacattccctggcttctt

SEQ ID NO: 78245 - DNA, 25 bp, Rattus norvegicus
acagtgtgatcaacctttgtctgcc

SEQ ID NO: 78246 - DNA, 25 bp, Rattus norvegicus
acagtgtgatcatcctttgtctgcc

SEQ ID NO: 78247 - DNA, 25 bp, Rattus norvegicus
acagtgtgcctcatgagccacgagc

SEQ ID NO: 78248 - DNA, 25 bp, Rattus norvegicus
acagtgtgcctcttgagccacgagc

SEQ ID NO: 78249 - DNA, 25 bp, Rattus norvegicus
acagtgtgctgaccccagagaacat

SEQ ID NO: 78250 - DNA, 25 bp, Rattus norvegicus
acagtgtgctgagcccagagaacat

SEQ ID NO: 78251 - DNA, 25 bp, Rattus norvegicus
acagtgtggaaaccatgtgcccctc

SEQ ID NO: 78252 - DNA, 25 bp, Rattus norvegicus
acagtgtggaaagcatgtgcccctc

SEQ ID NO: 78253 - DNA, 25 bp, Rattus norvegicus
acagtgtggaacatgcatctgatat

SEQ ID NO: 78254 - DNA, 25 bp, Rattus norvegicus
acagtgtggaacttgcatctgatat

SEQ ID NO: 78255 - DNA, 25 bp, Rattus norvegicus
acagtgtggcacctcccaaaacatg

SEQ ID NO: 78256 - DNA, 25 bp, Rattus norvegicus
acagtgtggcacgtcccaaaacatg

SEQ ID NO: 78257 - DNA, 25 bp, Rattus norvegicus
acagtgtggctgaccattatgtaca

SEQ ID NO: 78258 - DNA, 25 bp, Rattus norvegicus
acagtgtggctgtccattatgtaca

SEQ ID NO: 78259 - DNA, 25 bp, Rattus norvegicus
acagtgtggcttcgtactggtacac

SEQ ID NO: 78260 - DNA, 25 bp, Rattus norvegicus
acagtgtggcttggtactggtacac

SEQ ID NO: 78261 - DNA, 25 bp, Rattus norvegicus
acagtgtgtgtactcctacccagga

SEQ ID NO: 78262 - DNA, 25 bp, Rattus norvegicus
acagtgtgtgtagtcctacccagga

SEQ ID NO: 78263 - DNA, 25 bp, Rattus norvegicus
acagtgtgttacctacccagttgga

SEQ ID NO: 78264 - DNA, 25 bp, Rattus norvegicus
acagtgtgttacgtacccagttgga

SEQ ID NO: 78265 - DNA, 25 bp, Rattus norvegicus
acagtgtgttgaaacctcacgtacc

SEQ ID NO: 78266 - DNA, 25 bp, Rattus norvegicus
acagtgtgttgatacctcacgtacc

SEQ ID NO: 78267 - DNA, 25 bp, Rattus norvegicus
acagtgtgtttcaaaaatcccaaat

SEQ ID NO: 78268 - DNA, 25 bp, Rattus norvegicus
acagtgtgtttctaaaatcccaaat

SEQ ID NO: 78269 - DNA, 25 bp, Rattus norvegicus
acagtgttagcaacctgaatacggg

SEQ ID NO: 78270 - DNA, 25 bp, Rattus norvegicus
acagtgttagcatcctgaatacggg

SEQ ID NO: 78271 - DNA, 25 bp, Rattus norvegicus
acagtgttcacacatgtcttcctcg

SEQ ID NO: 78272 - DNA, 25 bp, Rattus norvegicus
acagtgttcacagatgtcttcctcg

SEQ ID NO: 78273 - DNA, 25 bp, Rattus norvegicus
acagtgttcaccagcgggctgagga

SEQ ID NO: 78274 - DNA, 25 bp, Rattus norvegicus
acagtgttcacctgcgggctgagga

SEQ ID NO: 78275 - DNA, 25 bp, Rattus norvegicus
acagtgttcactctggccatcaggt

SEQ ID NO: 78276 - DNA, 25 bp, Rattus norvegicus
acagtgttcactgtggccatcaggt

SEQ ID NO: 78277 - DNA, 25 bp, Rattus norvegicus
acagtgttccccaagtgatcgagag

SEQ ID NO: 78278 - DNA, 25 bp, Rattus norvegicus
acagtgttcccctagtgatcgagag

SEQ ID NO: 78279 - DNA, 25 bp, Rattus norvegicus
acagtgttcgagacgctggacctgg

SEQ ID NO: 78280 - DNA, 25 bp, Rattus norvegicus
acagtgttcgagtcgctggacctgg

SEQ ID NO: 78281 - DNA, 25 bp, Rattus norvegicus
acagtgttctgtccatcttatcaaa

SEQ ID NO: 78282 - DNA, 25 bp, Rattus norvegicus
acagtgttctgtgcatcttatcaaa

SEQ ID NO: 78283 - DNA, 25 bp, Rattus norvegicus
acagtgttgaacagctcatcagaaa

SEQ ID NO: 78284 - DNA, 25 bp, Rattus norvegicus
acagtgttgaactgctcatcagaaa

SEQ ID NO: 78285 - DNA, 25 bp, Rattus norvegicus
acagtgttgggcacctgtattggga

SEQ ID NO: 78286 - DNA, 25 bp, Rattus norvegicus
acagtgttgggctcctgtattggga

SEQ ID NO: 78287 - DNA, 25 bp, Rattus norvegicus
acagtgtttatactctccactctga

SEQ ID NO: 78288 - DNA, 25 bp, Rattus norvegicus
acagtgtttatagtctccactctga

SEQ ID NO: 78289 - DNA, 25 bp, Rattus norvegicus
acagtgtttctaattgcccttgaag

SEQ ID NO: 78290 - DNA, 25 bp, Rattus norvegicus
acagtgtttctatttgcccttgaag

SEQ ID NO: 78291 - DNA, 25 bp, Rattus norvegicus
acagtgtttctgagttttgtacaat

SEQ ID NO: 78292 - DNA, 25 bp, Rattus norvegicus
acagtgtttctgtgttttgtacaat

SEQ ID NO: 78293 - DNA, 25 bp, Rattus norvegicus
acagtgtttcttaatgaacctgcaa

SEQ ID NO: 78294 - DNA, 25 bp, Rattus norvegicus
acagtgtttctttatgaacctgcaa

SEQ ID NO: 78295 - DNA, 25 bp, Rattus norvegicus
acagtgtttggaaccatggtcccta

SEQ ID NO: 78296 - DNA, 25 bp, Rattus norvegicus
acagtgtttggatccatggtcccta

SEQ ID NO: 78297 - DNA, 25 bp, Rattus norvegicus
acagtgtttgtgcatccctatgagg

SEQ ID NO: 78298 - DNA, 25 bp, Rattus norvegicus
acagtgtttgtggatccctatgagg

SEQ ID NO: 78299 - DNA, 25 bp, Rattus norvegicus
acagtgttttacatctgccttaaga

SEQ ID NO: 78300 - DNA, 25 bp, Rattus norvegicus
acagtgttttacttctgccttaaga

SEQ ID NO: 78301 - DNA, 25 bp, Rattus norvegicus
acagttaaactgaggctcttagctg

SEQ ID NO: 78302 - DNA, 25 bp, Rattus norvegicus
acagttaaactgtggctcttagctg

SEQ ID NO: 78303 - DNA, 25 bp, Rattus norvegicus
acagttaaagttcgcgtgtcttgga

SEQ ID NO: 78304 - DNA, 25 bp, Rattus norvegicus
acagttaaagttggcgtgtcttgga

SEQ ID NO: 78305 - DNA, 25 bp, Rattus norvegicus
acagttaagcctcctgtagtttaaa

SEQ ID NO: 78306 - DNA, 25 bp, Rattus norvegicus
acagttaagcctgctgtagtttaaa

SEQ ID NO: 78307 - DNA, 25 bp, Rattus norvegicus
acagttacagaaaccccggagccag

SEQ ID NO: 78308 - DNA, 25 bp, Rattus norvegicus
acagttacagaatccccggagccag

SEQ ID NO: 78309 - DNA, 25 bp, Rattus norvegicus
acagttacgtgcacagcccatggaa

SEQ ID NO: 78310 - DNA, 25 bp, Rattus norvegicus
acagttacgtgctcagcccatggaa

SEQ ID NO: 78311 - DNA, 25 bp, Rattus norvegicus
acagttactccccaattccatgttt

SEQ ID NO: 78312 - DNA, 25 bp, Rattus norvegicus
acagttactcccgaattccatgttt

SEQ ID NO: 78313 - DNA, 25 bp, Rattus norvegicus
acagttactgcgcttcaaggattgc

SEQ ID NO: 78314 - DNA, 25 bp, Rattus norvegicus
acagttactgcggttcaaggattgc

SEQ ID NO: 78315 - DNA, 25 bp, Rattus norvegicus
acagttagaactctcatatttccaa

SEQ ID NO: 78316 - DNA, 25 bp, Rattus norvegicus
acagttagaactgtcatatttccaa

SEQ ID NO: 78317 - DNA, 25 bp, Rattus norvegicus
acagttaggccgctgacacattagt

SEQ ID NO: 78318 - DNA, 25 bp, Rattus norvegicus
acagttaggccggtgacacattagt

SEQ ID NO: 78319 - DNA, 25 bp, Rattus norvegicus
acagttagggtgacatattttctag

SEQ ID NO: 78320 - DNA, 25 bp, Rattus norvegicus
acagttagggtgtcatattttctag

SEQ ID NO: 78321 - DNA, 25 bp, Rattus norvegicus
acagttatatgaagatgccagttca

SEQ ID NO: 78322 - DNA, 25 bp, Rattus norvegicus
acagttatatgatgatgccagttca

SEQ ID NO: 78323 - DNA, 25 bp, Rattus norvegicus
acagttatctgtctgtctctgtaac

SEQ ID NO: 78324 - DNA, 25 bp, Rattus norvegicus
acagttatctgtgtgtctctgtaac

SEQ ID NO: 78325 - DNA, 25 bp, Rattus norvegicus
acagttatgggaatcttctgcattc

SEQ ID NO: 78326 - DNA, 25 bp, Rattus norvegicus
acagttatgggattcttctgcattc

SEQ ID NO: 78327 - DNA, 25 bp, Rattus norvegicus
acagttattattcaatgtcaccata

SEQ ID NO: 78328 - DNA, 25 bp, Rattus norvegicus
acagttattattgaatgtcaccata

SEQ ID NO: 78329 - DNA, 25 bp, Rattus norvegicus
acagttatttgtaaccatgcccaca

SEQ ID NO: 78330 - DNA, 25 bp, Rattus norvegicus
acagttatttgtaagcatttgccag

SEQ ID NO: 78331 - DNA, 25 bp, Rattus norvegicus
acagttatttgttaccatgcccaca

SEQ ID NO: 78332 - DNA, 25 bp, Rattus norvegicus
acagttatttgttagcatttgccag

SEQ ID NO: 78333 - DNA, 25 bp, Rattus norvegicus
acagttattttcaatttttactcag

SEQ ID NO: 78334 - DNA, 25 bp, Rattus norvegicus
acagttattttctatttttactcag

SEQ ID NO: 78335 - DNA, 25 bp, Rattus norvegicus
acagttcaatggacgctgtggctca

SEQ ID NO: 78336 - DNA, 25 bp, Rattus norvegicus
acagttcaatggtcgctgtggctca

SEQ ID NO: 78337 - DNA, 25 bp, Rattus norvegicus
acagttcacactattggatttacat

SEQ ID NO: 78338 - DNA, 25 bp, Rattus norvegicus
acagttcacacttttggatttacat

SEQ ID NO: 78339 - DNA, 25 bp, Rattus norvegicus
acagttcactttatcaggctctttt

SEQ ID NO: 78340 - DNA, 25 bp, Rattus norvegicus
acagttcactttttcaggctctttt

SEQ ID NO: 78341 - DNA, 25 bp, Rattus norvegicus
acagttcagctaacccagtttaatt

SEQ ID NO: 78342 - DNA, 25 bp, Rattus norvegicus
acagttcagctatcccagtttaatt

SEQ ID NO: 78343 - DNA, 25 bp, Rattus norvegicus
acagttcataataatctctcttcga

SEQ ID NO: 78344 - DNA, 25 bp, Rattus norvegicus
acagttcataattatctctcttcga

SEQ ID NO: 78345 - DNA, 25 bp, Rattus norvegicus
acagttcatgctcactcttcctgga

SEQ ID NO: 78346 - DNA, 25 bp, Rattus norvegicus
acagttcatgctgactcttcctgga

SEQ ID NO: 78347 - DNA, 25 bp, Rattus norvegicus
acagttccaacaccagtgcaggctg

SEQ ID NO: 78348 - DNA, 25 bp, Rattus norvegicus
acagttccaacagcagtgcaggctg

SEQ ID NO: 78349 - DNA, 25 bp, Rattus norvegicus
acagttccaactcaggttcctaaga

SEQ ID NO: 78350 - DNA, 25 bp, Rattus norvegicus
acagttccaactgaggttcctaaga

SEQ ID NO: 78351 - DNA, 25 bp, Rattus norvegicus
acagttccacaacaagttcccgtca

SEQ ID NO: 78352 - DNA, 25 bp, Rattus norvegicus
acagttccacaagaagttcccgtca

SEQ ID NO: 78353 - DNA, 25 bp, Rattus norvegicus
acagttccactgacgactctgagga

SEQ ID NO: 78354 - DNA, 25 bp, Rattus norvegicus
acagttccactgtcgactctgagga

SEQ ID NO: 78355 - DNA, 25 bp, Rattus norvegicus
acagttccagaaccttgcaaatgaa

SEQ ID NO: 78356 - DNA, 25 bp, Rattus norvegicus
acagttccagaagcttgcaaatgaa

SEQ ID NO: 78357 - DNA, 25 bp, Rattus norvegicus
acagttccagtaacagagcccacat

SEQ ID NO: 78358 - DNA, 25 bp, Rattus norvegicus
acagttccagtatcagagcccacat

SEQ ID NO: 78359 - DNA, 25 bp, Rattus norvegicus
acagttccatggcagcagttcccag

SEQ ID NO: 78360 - DNA, 25 bp, Rattus norvegicus
acagttccatgggagcagttcccag

SEQ ID NO: 78361 - DNA, 25 bp, Rattus norvegicus
acagttccctggcttgcattgcgat

SEQ ID NO: 78362 - DNA, 25 bp, Rattus norvegicus
acagttccctgggttgcattgcgat

SEQ ID NO: 78363 - DNA, 25 bp, Rattus norvegicus
acagttcctacccaaggcttcaagg

SEQ ID NO: 78364 - DNA, 25 bp, Rattus norvegicus
acagttcctaccgaaggcttcaagg

SEQ ID NO: 78365 - DNA, 25 bp, Rattus norvegicus
acagttcctccaagctttgtgagca

SEQ ID NO: 78366 - DNA, 25 bp, Rattus norvegicus
acagttcctccatgctttgtgagca

SEQ ID NO: 78367 - DNA, 25 bp, Rattus norvegicus
acagttcctgtcacatttgtcttag

SEQ ID NO: 78368 - DNA, 25 bp, Rattus norvegicus
acagttcctgtctcatttgtcttag

SEQ ID NO: 78369 - DNA, 25 bp, Rattus norvegicus
acagttcctttaaacagtggttgag

SEQ ID NO: 78370 - DNA, 25 bp, Rattus norvegicus
acagttcctttatacagtggttgag

SEQ ID NO: 78371 - DNA, 25 bp, Rattus norvegicus
acagttcgccttctgcaggccatgg

SEQ ID NO: 78372 - DNA, 25 bp, Rattus norvegicus
acagttcgccttgtgcaggccatgg

SEQ ID NO: 78373 - DNA, 25 bp, Rattus norvegicus
acagttcggtttctggtgatggcca

SEQ ID NO: 78374 - DNA, 25 bp, Rattus norvegicus
acagttcggtttgtggtgatggcca

SEQ ID NO: 78375 - DNA, 25 bp, Rattus norvegicus
acagttctacctagagcttgagtgt

SEQ ID NO: 78376 - DNA, 25 bp, Rattus norvegicus
acagttctaccttgagcttgagtgt

SEQ ID NO: 78377 - DNA, 25 bp, Rattus norvegicus
acagttctacttatatgatacttaa

SEQ ID NO: 78378 - DNA, 25 bp, Rattus norvegicus
acagttctacttttatgatacttaa

SEQ ID NO: 78379 - DNA, 25 bp, Rattus norvegicus
acagttctagagcatggctgcacta

SEQ ID NO: 78380 - DNA, 25 bp, Rattus norvegicus
acagttctagaggatggctgcacta

SEQ ID NO: 78381 - DNA, 25 bp, Rattus norvegicus
acagttctatttactagtgtgttga

SEQ ID NO: 78382 - DNA, 25 bp, Rattus norvegicus
acagttctattttctagtgtgttga

SEQ ID NO: 78383 - DNA, 25 bp, Rattus norvegicus
acagttctcaatatcagctgcagcc

SEQ ID NO: 78384 - DNA, 25 bp, Rattus norvegicus
acagttctcaatttcagctgcagcc

SEQ ID NO: 78385 - DNA, 25 bp, Rattus norvegicus
acagttctctggctttctggaaaac

SEQ ID NO: 78386 - DNA, 25 bp, Rattus norvegicus
acagttctctgggtttctggaaaac

SEQ ID NO: 78387 - DNA, 25 bp, Rattus norvegicus
acagttctgctaaccttctatgagt

SEQ ID NO: 78388 - DNA, 25 bp, Rattus norvegicus
acagttctgctatccttctatgagt

SEQ ID NO: 78389 - DNA, 25 bp, Rattus norvegicus
acagttctgcttacttttgttctga

SEQ ID NO: 78390 - DNA, 25 bp, Rattus norvegicus
acagttctgctttcttttgttctga

SEQ ID NO: 78391 - DNA, 25 bp, Rattus norvegicus
acagttctggaaaggctgcatgccc

SEQ ID NO: 78392 - DNA, 25 bp, Rattus norvegicus
acagttctggaatggctgcatgccc

SEQ ID NO: 78393 - DNA, 25 bp, Rattus norvegicus
acagttctggagctggtttctagca

SEQ ID NO: 78394 - DNA, 25 bp, Rattus norvegicus
acagttctggaggtggtttctagca

SEQ ID NO: 78395 - DNA, 25 bp, Rattus norvegicus
acagttctgtgcatgtcccgtcggc

SEQ ID NO: 78396 - DNA, 25 bp, Rattus norvegicus
acagttctgtgcttgtcccgtcggc

SEQ ID NO: 78397 - DNA, 25 bp, Rattus norvegicus
acagttcttcagaggtctagctagc

SEQ ID NO: 78398 - DNA, 25 bp, Rattus norvegicus
acagttcttcagtggtctagctagc

SEQ ID NO: 78399 - DNA, 25 bp, Rattus norvegicus
acagttcttcatcgtaatcccgacc

SEQ ID NO: 78400 - DNA, 25 bp, Rattus norvegicus
acagttcttcatggtaatcccgacc

SEQ ID NO: 78401 - DNA, 25 bp, Rattus norvegicus
acagttctttgtatccggtattttg

SEQ ID NO: 78402 - DNA, 25 bp, Rattus norvegicus
acagttctttgtttccggtattttg

SEQ ID NO: 78403 - DNA, 25 bp, Rattus norvegicus
acagttcttttgaccttacagtaat

SEQ ID NO: 78404 - DNA, 25 bp, Rattus norvegicus
acagttcttttgtccttacagtaat

SEQ ID NO: 78405 - DNA, 25 bp, Rattus norvegicus
acagttgaactcagccttgctaggt

SEQ ID NO: 78406 - DNA, 25 bp, Rattus norvegicus
acagttgaactctgccttgctaggt

SEQ ID NO: 78407 - DNA, 25 bp, Rattus norvegicus
acagttgaaggtacgccattactat

SEQ ID NO: 78408 - DNA, 25 bp, Rattus norvegicus
acagttgaaggttcgccattactat

SEQ ID NO: 78409 - DNA, 25 bp, Rattus norvegicus
acagttgaatccagcgtgagcctgc

SEQ ID NO: 78410 - DNA, 25 bp, Rattus norvegicus
acagttgaatcctgcgtgagcctgc

SEQ ID NO: 78411 - DNA, 25 bp, Rattus norvegicus
acagttgacaacacactctgacgcc

SEQ ID NO: 78412 - DNA, 25 bp, Rattus norvegicus
acagttgacaactcactctgacgcc

SEQ ID NO: 78413 - DNA, 25 bp, Rattus norvegicus
acagttgacagtagatcttccaggt

SEQ ID NO: 78414 - DNA, 25 bp, Rattus norvegicus
acagttgacagttgatcttccaggt

SEQ ID NO: 78415 - DNA, 25 bp, Rattus norvegicus
acagttgacattagcatggttttgt

SEQ ID NO: 78416 - DNA, 25 bp, Rattus norvegicus
acagttgacatttgcatggttttgt

SEQ ID NO: 78417 - DNA, 25 bp, Rattus norvegicus
acagttgactggattgttgcagaca

SEQ ID NO: 78418 - DNA, 25 bp, Rattus norvegicus
acagttgactggtttgttgcagaca

SEQ ID NO: 78419 - DNA, 25 bp, Rattus norvegicus
acagttgactgtaccttgtaaatta

SEQ ID NO: 78420 - DNA, 25 bp, Rattus norvegicus
acagttgactgttccttgtaaatta

SEQ ID NO: 78421 - DNA, 25 bp, Rattus norvegicus
acagttgaggatccttctgtcctct

SEQ ID NO: 78422 - DNA, 25 bp, Rattus norvegicus
acagttgaggatgcttctgtcctct

SEQ ID NO: 78423 - DNA, 25 bp, Rattus norvegicus
acagttgataacattcccctacata

SEQ ID NO: 78424 - DNA, 25 bp, Rattus norvegicus
acagttgataactttcccctacata

SEQ ID NO: 78425 - DNA, 25 bp, Rattus norvegicus
acagttgataatcctgtccaggctt

SEQ ID NO: 78426 - DNA, 25 bp, Rattus norvegicus
acagttgataatgctgtccaggctt

SEQ ID NO: 78427 - DNA, 25 bp, Rattus norvegicus
acagttgatgttcggagcggctaaa

SEQ ID NO: 78428 - DNA, 25 bp, Rattus norvegicus
acagttgatgttgggagcggctaaa

SEQ ID NO: 78429 - DNA, 25 bp, Rattus norvegicus
acagttgcaagaattggatgttgcc

SEQ ID NO: 78430 - DNA, 25 bp, Rattus norvegicus
acagttgcaagatttggatgttgcc

SEQ ID NO: 78431 - DNA, 25 bp, Rattus norvegicus
acagttgcagctatctcactgataa

SEQ ID NO: 78432 - DNA, 25 bp, Rattus norvegicus
acagttgcagctttctcactgataa

SEQ ID NO: 78433 - DNA, 25 bp, Rattus norvegicus
acagttgcatatcaccacacaagct

SEQ ID NO: 78434 - DNA, 25 bp, Rattus norvegicus
acagttgcatatgaccacacaagct

SEQ ID NO: 78435 - DNA, 25 bp, Rattus norvegicus
acagttgcattgactagtttcctgc

SEQ ID NO: 78436 - DNA, 25 bp, Rattus norvegicus
acagttgcattgtctagtttcctgc

SEQ ID NO: 78437 - DNA, 25 bp, Rattus norvegicus
acagttgccctcctggtctggataa

SEQ ID NO: 78438 - DNA, 25 bp, Rattus norvegicus
acagttgccctcgtggtctggataa

SEQ ID NO: 78439 - DNA, 25 bp, Rattus norvegicus
acagttgcctttcgccttacctgtt

SEQ ID NO: 78440 - DNA, 25 bp, Rattus norvegicus
acagttgcctttggccttacctgtt

SEQ ID NO: 78441 - DNA, 25 bp, Rattus norvegicus
acagttgcgatcagtaaattacatg

SEQ ID NO: 78442 - DNA, 25 bp, Rattus norvegicus
acagttgcgatctgtaaattacatg

SEQ ID NO: 78443 - DNA, 25 bp, Rattus norvegicus
acagttgcgattcttgcagcatcaa

SEQ ID NO: 78444 - DNA, 25 bp, Rattus norvegicus
acagttgcgattgttgcagcatcaa

SEQ ID NO: 78445 - DNA, 25 bp, Rattus norvegicus
acagttgcgtctaaaaattcacaca

SEQ ID NO: 78446 - DNA, 25 bp, Rattus norvegicus
acagttgcgtcttaaaattcacaca

SEQ ID NO: 78447 - DNA, 25 bp, Rattus norvegicus
acagttgctgataggaggtccatgg

SEQ ID NO: 78448 - DNA, 25 bp, Rattus norvegicus
acagttgctgattggaggtccatgg

SEQ ID NO: 78449 - DNA, 25 bp, Rattus norvegicus
acagttgctgtcagggtatgcttac

SEQ ID NO: 78450 - DNA, 25 bp, Rattus norvegicus
acagttgctgtctgggtatgcttac

SEQ ID NO: 78451 - DNA, 25 bp, Rattus norvegicus
acagttgctgtgatctttgcgttta

SEQ ID NO: 78452 - DNA, 25 bp, Rattus norvegicus
acagttgctgtgttctttgcgttta

SEQ ID NO: 78453 - DNA, 25 bp, Rattus norvegicus
acagttgctgttagaatttccattt

SEQ ID NO: 78454 - DNA, 25 bp, Rattus norvegicus
acagttgctgtttgaatttccattt

SEQ ID NO: 78455 - DNA, 25 bp, Rattus norvegicus
acagttgcttctagtctggccagtg

SEQ ID NO: 78456 - DNA, 25 bp, Rattus norvegicus
acagttgcttcttgtctggccagtg

SEQ ID NO: 78457 - DNA, 25 bp, Rattus norvegicus
acagttggatccactacgggtagct

SEQ ID NO: 78458 - DNA, 25 bp, Rattus norvegicus
acagttggatcctctacgggtagct

SEQ ID NO: 78459 - DNA, 25 bp, Rattus norvegicus
acagttggatgccaggagacattta

SEQ ID NO: 78460 - DNA, 25 bp, Rattus norvegicus
acagttggatgcgaggagacattta

SEQ ID NO: 78461 - DNA, 25 bp, Rattus norvegicus
acagttggccctcatacactcagag

SEQ ID NO: 78462 - DNA, 25 bp, Rattus norvegicus
acagttggccctgatacactcagag

SEQ ID NO: 78463 - DNA, 25 bp, Rattus norvegicus
acagttggctaaagggattgtcacc

SEQ ID NO: 78464 - DNA, 25 bp, Rattus norvegicus
acagttggctaatgggattgtcacc

SEQ ID NO: 78465 - DNA, 25 bp, Rattus norvegicus
acagttggctgtcacccgaggactc

SEQ ID NO: 78466 - DNA, 25 bp, Rattus norvegicus
acagttggctgtgacccgaggactc

SEQ ID NO: 78467 - DNA, 25 bp, Rattus norvegicus
acagttggctttcgcagtatcccac

SEQ ID NO: 78468 - DNA, 25 bp, Rattus norvegicus
acagttggctttggcagtatcccac

SEQ ID NO: 78469 - DNA, 25 bp, Rattus norvegicus
acagttgggacgctcaggctttcct

SEQ ID NO: 78470 - DNA, 25 bp, Rattus norvegicus
acagttgggacggtcaggctttcct

SEQ ID NO: 78471 - DNA, 25 bp, Rattus norvegicus
acagttgggaggcttcatgctcagc

SEQ ID NO: 78472 - DNA, 25 bp, Rattus norvegicus
acagttgggagggttcatgctcagc

SEQ ID NO: 78473 - DNA, 25 bp, Rattus norvegicus
acagttgggctcctggaagagtcta

SEQ ID NO: 78474 - DNA, 25 bp, Rattus norvegicus
acagttgggctcgtggaagagtcta

SEQ ID NO: 78475 - DNA, 25 bp, Rattus norvegicus
acagttgggctgagtcatatgcaca

SEQ ID NO: 78476 - DNA, 25 bp, Rattus norvegicus
acagttgggctgtgtcatatgcaca

SEQ ID NO: 78477 - DNA, 25 bp, Rattus norvegicus
acagttggtcaactaggtaccattg

SEQ ID NO: 78478 - DNA, 25 bp, Rattus norvegicus
acagttggtcaagtaggtaccattg

SEQ ID NO: 78479 - DNA, 25 bp, Rattus norvegicus
acagttgtaaggagtgcccatcgag

SEQ ID NO: 78480 - DNA, 25 bp, Rattus norvegicus
acagttgtaaggtgtgcccatcgag

SEQ ID NO: 78481 - DNA, 25 bp, Rattus norvegicus
acagttgtatggattgctgggtcaa

SEQ ID NO: 78482 - DNA, 25 bp, Rattus norvegicus
acagttgtatggtttgctgggtcaa

SEQ ID NO: 78483 - DNA, 25 bp, Rattus norvegicus
acagttgtctggatgtgcttacatt

SEQ ID NO: 78484 - DNA, 25 bp, Rattus norvegicus
acagttgtctggttgtgcttacatt

SEQ ID NO: 78485 - DNA, 25 bp, Rattus norvegicus
acagttgtctgtaccttatttaatt

SEQ ID NO: 78486 - DNA, 25 bp, Rattus norvegicus
acagttgtctgttccttatttaatt

SEQ ID NO: 78487 - DNA, 25 bp, Rattus norvegicus
acagttgtgaggattcaggcccagc

SEQ ID NO: 78488 - DNA, 25 bp, Rattus norvegicus
acagttgtgaggtttcaggcccagc

SEQ ID NO: 78489 - DNA, 25 bp, Rattus norvegicus
acagttgtgatacaccagaccgaaa

SEQ ID NO: 78490 - DNA, 25 bp, Rattus norvegicus
acagttgtgatagaccagaccgaaa

SEQ ID NO: 78491 - DNA, 25 bp, Rattus norvegicus
acagttgtgcagagcctggagtgta

SEQ ID NO: 78492 - DNA, 25 bp, Rattus norvegicus
acagttgtgcagtgcctggagtgta

SEQ ID NO: 78493 - DNA, 25 bp, Rattus norvegicus
acagttgtgccgctctgttgtgcag

SEQ ID NO: 78494 - DNA, 25 bp, Rattus norvegicus
acagttgtgccggtctgttgtgcag

SEQ ID NO: 78495 - DNA, 25 bp, Rattus norvegicus
acagttgttccaatgttgctgctcc

SEQ ID NO: 78496 - DNA, 25 bp, Rattus norvegicus
acagttgttccattgttgctgctcc

SEQ ID NO: 78497 - DNA, 25 bp, Rattus norvegicus
acagttgtttccaatgttagcttga

SEQ ID NO: 78498 - DNA, 25 bp, Rattus norvegicus
acagttgtttcctatgttagcttga

SEQ ID NO: 78499 - DNA, 25 bp, Rattus norvegicus
acagtttaatgcacgaatcctccag

SEQ ID NO: 78500 - DNA, 25 bp, Rattus norvegicus
acagtttaatgctcgaatcctccag

SEQ ID NO: 78501 - DNA, 25 bp, Rattus norvegicus
acagtttacattacatacttccgag

SEQ ID NO: 78502 - DNA, 25 bp, Rattus norvegicus
acagtttacatttcatacttccgag

SEQ ID NO: 78503 - DNA, 25 bp, Rattus norvegicus
acagtttacgatatgccacatttgg

SEQ ID NO: 78504 - DNA, 25 bp, Rattus norvegicus
acagtttacgatttgccacatttgg

SEQ ID NO: 78505 - DNA, 25 bp, Rattus norvegicus
acagtttagctcactccatacttgg

SEQ ID NO: 78506 - DNA, 25 bp, Rattus norvegicus
acagtttagctctctccatacttgg

SEQ ID NO: 78507 - DNA, 25 bp, Rattus norvegicus
acagtttagggcaggctggctttag

SEQ ID NO: 78508 - DNA, 25 bp, Rattus norvegicus
acagtttagggctggctggctttag

SEQ ID NO: 78509 - DNA, 25 bp, Rattus norvegicus
acagtttagggtcgtctcatggatt

SEQ ID NO: 78510 - DNA, 25 bp, Rattus norvegicus
acagtttagggtggtctcatggatt

SEQ ID NO: 78511 - DNA, 25 bp, Rattus norvegicus
acagtttattacagcatttccaggg

SEQ ID NO: 78512 - DNA, 25 bp, Rattus norvegicus
acagtttattactgcatttccaggg

SEQ ID NO: 78513 - DNA, 25 bp, Rattus norvegicus
acagtttcacccattatctacatag

SEQ ID NO: 78514 - DNA, 25 bp, Rattus norvegicus
acagtttcaccctttatctacatag

SEQ ID NO: 78515 - DNA, 25 bp, Rattus norvegicus
acagtttccctgattagccctggat

SEQ ID NO: 78516 - DNA, 25 bp, Rattus norvegicus
acagtttccctgtttagccctggat

SEQ ID NO: 78517 - DNA, 25 bp, Rattus norvegicus
acagtttccggaagcctacgggaag

SEQ ID NO: 78518 - DNA, 25 bp, Rattus norvegicus
acagtttccggatgcctacgggaag

SEQ ID NO: 78519 - DNA, 25 bp, Rattus norvegicus
acagtttcctaaaggccctcagttt

SEQ ID NO: 78520 - DNA, 25 bp, Rattus norvegicus
acagtttcctaatggccctcagttt

SEQ ID NO: 78521 - DNA, 25 bp, Rattus norvegicus
acagtttcctggaaggccttcgaga

SEQ ID NO: 78522 - DNA, 25 bp, Rattus norvegicus
acagtttcctggtaggccttcgaga

SEQ ID NO: 78523 - DNA, 25 bp, Rattus norvegicus
acagtttcctgtcggctctagggaa

SEQ ID NO: 78524 - DNA, 25 bp, Rattus norvegicus
acagtttcctgtgggctctagggaa

SEQ ID NO: 78525 - DNA, 25 bp, Rattus norvegicus
acagtttcctttatccacagacaat

SEQ ID NO: 78526 - DNA, 25 bp, Rattus norvegicus
acagtttcctttttccacagacaat

SEQ ID NO: 78527 - DNA, 25 bp, Rattus norvegicus
acagtttcgctgagtagtctcggac

SEQ ID NO: 78528 - DNA, 25 bp, Rattus norvegicus
acagtttcgctgtgtagtctcggac

SEQ ID NO: 78529 - DNA, 25 bp, Rattus norvegicus
acagtttcggctctgggaccataga

SEQ ID NO: 78530 - DNA, 25 bp, Rattus norvegicus
acagtttcggctgtgggaccataga

SEQ ID NO: 78531 - DNA, 25 bp, Rattus norvegicus
acagtttctaaaacggcggtatcta

SEQ ID NO: 78532 - DNA, 25 bp, Rattus norvegicus
acagtttctaaatcggcggtatcta

SEQ ID NO: 78533 - DNA, 25 bp, Rattus norvegicus
acagtttctattagtccgccgagag

SEQ ID NO: 78534 - DNA, 25 bp, Rattus norvegicus
acagtttctatttgtccgccgagag

SEQ ID NO: 78535 - DNA, 25 bp, Rattus norvegicus
acagtttctccgcactgtgcatgga

SEQ ID NO: 78536 - DNA, 25 bp, Rattus norvegicus
acagtttctccggactgtgcatgga

SEQ ID NO: 78537 - DNA, 25 bp, Rattus norvegicus
acagtttctgggactgcctgggcta

SEQ ID NO: 78538 - DNA, 25 bp, Rattus norvegicus
acagtttctgggtctgcctgggcta

SEQ ID NO: 78539 - DNA, 25 bp, Rattus norvegicus
acagtttcttataccttcataccag

SEQ ID NO: 78540 - DNA, 25 bp, Rattus norvegicus
acagtttcttattccttcataccag

SEQ ID NO: 78541 - DNA, 25 bp, Rattus norvegicus
acagtttgctataatccagtcctct

SEQ ID NO: 78542 - DNA, 25 bp, Rattus norvegicus
acagtttgctattatccagtcctct

SEQ ID NO: 78543 - DNA, 25 bp, Rattus norvegicus
acagtttgctctattctttgttgct

SEQ ID NO: 78544 - DNA, 25 bp, Rattus norvegicus
acagtttgctcttttctttgttgct

SEQ ID NO: 78545 - DNA, 25 bp, Rattus norvegicus
acagtttgctgtaggtgtcttcatt

SEQ ID NO: 78546 - DNA, 25 bp, Rattus norvegicus
acagtttgctgttggtgtcttcatt

SEQ ID NO: 78547 - DNA, 25 bp, Rattus norvegicus
acagtttgctttctactggcataca

SEQ ID NO: 78548 - DNA, 25 bp, Rattus norvegicus
acagtttgctttgtactggcataca

SEQ ID NO: 78549 - DNA, 25 bp, Rattus norvegicus
acagtttgggttagatcactccccg

SEQ ID NO: 78550 - DNA, 25 bp, Rattus norvegicus
acagtttgggtttgatcactccccg

SEQ ID NO: 78551 - DNA, 25 bp, Rattus norvegicus
acagtttgtacacgctgacttctga

SEQ ID NO: 78552 - DNA, 25 bp, Rattus norvegicus
acagtttgtacaggctgacttctga

SEQ ID NO: 78553 - DNA, 25 bp, Rattus norvegicus
acagtttgtcggctaatatctgagc

SEQ ID NO: 78554 - DNA, 25 bp, Rattus norvegicus
acagtttgtcgggtaatatctgagc

SEQ ID NO: 78555 - DNA, 25 bp, Rattus norvegicus
acagtttgtctgacccattcctgaa

SEQ ID NO: 78556 - DNA, 25 bp, Rattus norvegicus
acagtttgtctgtcccattcctgaa

SEQ ID NO: 78557 - DNA, 25 bp, Rattus norvegicus
acagtttgtgttctactaacttcta

SEQ ID NO: 78558 - DNA, 25 bp, Rattus norvegicus
acagtttgtgttgtactaacttcta

SEQ ID NO: 78559 - DNA, 25 bp, Rattus norvegicus
acagtttgttgtaggtcagattcac

SEQ ID NO: 78560 - DNA, 25 bp, Rattus norvegicus
acagtttgttgttggtcagattcac

SEQ ID NO: 78561 - DNA, 25 bp, Rattus norvegicus
acagttttaaccacaagtcatgttt

SEQ ID NO: 78562 - DNA, 25 bp, Rattus norvegicus
acagttttaacctcaagtcatgttt

SEQ ID NO: 78563 - DNA, 25 bp, Rattus norvegicus
acagttttccaacaagggcatccat

SEQ ID NO: 78564 - DNA, 25 bp, Rattus norvegicus
acagttttccaagaagggcatccat

SEQ ID NO: 78565 - DNA, 25 bp, Rattus norvegicus
acagttttcctcagttgcatgcatt

SEQ ID NO: 78566 - DNA, 25 bp, Rattus norvegicus
acagttttcctctgttgcatgcatt

SEQ ID NO: 78567 - DNA, 25 bp, Rattus norvegicus
acagttttctgcaggacgtctgaat

SEQ ID NO: 78568 - DNA, 25 bp, Rattus norvegicus
acagttttctgctggacgtctgaat

SEQ ID NO: 78569 - DNA, 25 bp, Rattus norvegicus
acagttttgcagaccactggctcag

SEQ ID NO: 78570 - DNA, 25 bp, Rattus norvegicus
acagttttgcagatcctatacagtt

SEQ ID NO: 78571 - DNA, 25 bp, Rattus norvegicus
acagttttgcagtccactggctcag

SEQ ID NO: 78572 - DNA, 25 bp, Rattus norvegicus
acagttttgcagttcctatacagtt

SEQ ID NO: 78573 - DNA, 25 bp, Rattus norvegicus
acagttttggagacctggaagccca

SEQ ID NO: 78574 - DNA, 25 bp, Rattus norvegicus
acagttttggagtcctggaagccca

SEQ ID NO: 78575 - DNA, 25 bp, Rattus norvegicus
acagttttgtctattctaatccttg

SEQ ID NO: 78576 - DNA, 25 bp, Rattus norvegicus
acagttttgtcttttctaatccttg

SEQ ID NO: 78577 - DNA, 25 bp, Rattus norvegicus
acagttttgtgaatcctggaccaag

SEQ ID NO: 78578 - DNA, 25 bp, Rattus norvegicus
acagttttgtgattcctggaccaag

SEQ ID NO: 78579 - DNA, 25 bp, Rattus norvegicus
acagttttgttgctgtggaaacctt

SEQ ID NO: 78580 - DNA, 25 bp, Rattus norvegicus
acagttttgttggtgtggaaacctt

SEQ ID NO: 78581 - DNA, 25 bp, Rattus norvegicus
acagtttttactctgtggccactgg

SEQ ID NO: 78582 - DNA, 25 bp, Rattus norvegicus
acagtttttactgtgtggccactgg

SEQ ID NO: 78583 - DNA, 25 bp, Rattus norvegicus
acagtttttatccaggacacatgat

SEQ ID NO: 78584 - DNA, 25 bp, Rattus norvegicus
acagtttttatcgaggacacatgat

SEQ ID NO: 78585 - DNA, 25 bp, Rattus norvegicus
acagtttttcatactcgttctccat

SEQ ID NO: 78586 - DNA, 25 bp, Rattus norvegicus
acagtttttcattctcgttctccat

SEQ ID NO: 78587 - DNA, 25 bp, Rattus norvegicus
acagtttttcttcttgcacagtcct

SEQ ID NO: 78588 - DNA, 25 bp, Rattus norvegicus
acagtttttcttgttgcacagtcct

SEQ ID NO: 78589 - DNA, 25 bp, Rattus norvegicus
acagtttttgcaatccagccttgtg

SEQ ID NO: 78590 - DNA, 25 bp, Rattus norvegicus
acagtttttgcattccagccttgtg

SEQ ID NO: 78591 - DNA, 25 bp, Rattus norvegicus
acataaaagcggaatgccctttgtg

SEQ ID NO: 78592 - DNA, 25 bp, Rattus norvegicus
acataaaagcggtatgccctttgtg

SEQ ID NO: 78593 - DNA, 25 bp, Rattus norvegicus
acataaacaccacacaagactctgc

SEQ ID NO: 78594 - DNA, 25 bp, Rattus norvegicus
acataaacaccagacaagactctgc

SEQ ID NO: 78595 - DNA, 25 bp, Rattus norvegicus
acataaacgtttctctgtatctctc

SEQ ID NO: 78596 - DNA, 25 bp, Rattus norvegicus
acataaacgtttgtctgtatctctc

SEQ ID NO: 78597 - DNA, 25 bp, Rattus norvegicus
acataaagcgttctgtggtgtgaca

SEQ ID NO: 78598 - DNA, 25 bp, Rattus norvegicus
acataaagcgttgtgtggtgtgaca

SEQ ID NO: 78599 - DNA, 25 bp, Rattus norvegicus
acataaattattactccacctctcg

SEQ ID NO: 78600 - DNA, 25 bp, Rattus norvegicus
acataaattatttctccacctctcg

SEQ ID NO: 78601 - DNA, 25 bp, Rattus norvegicus
acataacatagtactgagatggaga

SEQ ID NO: 78602 - DNA, 25 bp, Rattus norvegicus
acataacatagttctgagatggaga

SEQ ID NO: 78603 - DNA, 25 bp, Rattus norvegicus
acataacatcttctgtctgtagcgt

SEQ ID NO: 78604 - DNA, 25 bp, Rattus norvegicus
acataacatcttgtgtctgtagcgt

SEQ ID NO: 78605 - DNA, 25 bp, Rattus norvegicus
acataaccggaccttcctttagcat

SEQ ID NO: 78606 - DNA, 25 bp, Rattus norvegicus
acataaccggacgttcctttagcat

SEQ ID NO: 78607 - DNA, 25 bp, Rattus norvegicus
acataacgaagtcgagcgccgccgc

SEQ ID NO: 78608 - DNA, 25 bp, Rattus norvegicus
acataacgaagtggagcgccgccgc

SEQ ID NO: 78609 - DNA, 25 bp, Rattus norvegicus
acataactagtgagctcattagcca

SEQ ID NO: 78610 - DNA, 25 bp, Rattus norvegicus
acataactagtgtgctcattagcca

SEQ ID NO: 78611 - DNA, 25 bp, Rattus norvegicus
acataactcgtgagctctgtgtgtt

SEQ ID NO: 78612 - DNA, 25 bp, Rattus norvegicus
acataactcgtgtgctctgtgtgtt

SEQ ID NO: 78613 - DNA, 25 bp, Rattus norvegicus
acataactgctaatcctcaaggtct

SEQ ID NO: 78614 - DNA, 25 bp, Rattus norvegicus
acataactgctattcctcaaggtct

SEQ ID NO: 78615 - DNA, 25 bp, Rattus norvegicus
acataacttagtctggcctggaacc

SEQ ID NO: 78616 - DNA, 25 bp, Rattus norvegicus
acataacttagtgtggcctggaacc

SEQ ID NO: 78617 - DNA, 25 bp, Rattus norvegicus
acataagaagacatacacgcaagca

SEQ ID NO: 78618 - DNA, 25 bp, Rattus norvegicus
acataagaagacttacacgcaagca

SEQ ID NO: 78619 - DNA, 25 bp, Rattus norvegicus
acataagatattacctgcagccctc

SEQ ID NO: 78620 - DNA, 25 bp, Rattus norvegicus
acataagatatttcctgcagccctc

SEQ ID NO: 78621 - DNA, 25 bp, Rattus norvegicus
acataagcaggtctctccaaccaca

SEQ ID NO: 78622 - DNA, 25 bp, Rattus norvegicus
acataagcaggtgtctccaaccaca

SEQ ID NO: 78623 - DNA, 25 bp, Rattus norvegicus
acataagccgtcagcagagggtggt

SEQ ID NO: 78624 - DNA, 25 bp, Rattus norvegicus
acataagccgtctgcagagggtggt

SEQ ID NO: 78625 - DNA, 25 bp, Rattus norvegicus
acataagtaactcgtgtgtgtgcac

SEQ ID NO: 78626 - DNA, 25 bp, Rattus norvegicus
acataagtaactggtgtgtgtgcac

SEQ ID NO: 78627 - DNA, 25 bp, Rattus norvegicus
acataagtcatcactagccattggg

SEQ ID NO: 78628 - DNA, 25 bp, Rattus norvegicus
acataagtcatctctagccattggg

SEQ ID NO: 78629 - DNA, 25 bp, Rattus norvegicus
acataagtctgcactggacatggat

SEQ ID NO: 78630 - DNA, 25 bp, Rattus norvegicus
acataagtctgctctggacatggat

SEQ ID NO: 78631 - DNA, 25 bp, Rattus norvegicus
acataagtctttagcgtactcccgc

SEQ ID NO: 78632 - DNA, 25 bp, Rattus norvegicus
acataagtcttttgcgtactcccgc

SEQ ID NO: 78633 - DNA, 25 bp, Rattus norvegicus
acataagttggaaggtaagggcaca

SEQ ID NO: 78634 - DNA, 25 bp, Rattus norvegicus
acataagttggatggtaagggcaca

SEQ ID NO: 78635 - DNA, 25 bp, Rattus norvegicus
acataatcggtaactgcactttccc

SEQ ID NO: 78636 - DNA, 25 bp, Rattus norvegicus
acataatcggtatctgcactttccc

SEQ ID NO: 78637 - DNA, 25 bp, Rattus norvegicus
acataatgaagtcggcctgaggcct

SEQ ID NO: 78638 - DNA, 25 bp, Rattus norvegicus
acataatgaagtgggcctgaggcct

SEQ ID NO: 78639 - DNA, 25 bp, Rattus norvegicus
acataatgggttagatccttggaaa

SEQ ID NO: 78640 - DNA, 25 bp, Rattus norvegicus
acataatgggtttgatccttggaaa

SEQ ID NO: 78641 - DNA, 25 bp, Rattus norvegicus
acataatgtcgtcggtcttcgtcct

SEQ ID NO: 78642 - DNA, 25 bp, Rattus norvegicus
acataatgtcgtgggtcttcgtcct

SEQ ID NO: 78643 - DNA, 25 bp, Rattus norvegicus
acataattctgtcctgaagttctgt

SEQ ID NO: 78644 - DNA, 25 bp, Rattus norvegicus
acataattctgtgctgaagttctgt

SEQ ID NO: 78645 - DNA, 25 bp, Rattus norvegicus
acataattgtctatgtgtatttcca

SEQ ID NO: 78646 - DNA, 25 bp, Rattus norvegicus
acataattgtctttgtgtatttcca

SEQ ID NO: 78647 - DNA, 25 bp, Rattus norvegicus
acataattgtgcactactgtactta

SEQ ID NO: 78648 - DNA, 25 bp, Rattus norvegicus
acataattgtgctctactgtactta

SEQ ID NO: 78649 - DNA, 25 bp, Rattus norvegicus
acataatttactacaggtctctgca

SEQ ID NO: 78650 - DNA, 25 bp, Rattus norvegicus
acataatttacttcaggtctctgca

SEQ ID NO: 78651 - DNA, 25 bp, Rattus norvegicus
acataatttctgaacatcccaaagg

SEQ ID NO: 78652 - DNA, 25 bp, Rattus norvegicus
acataatttctgtacatcccaaagg

SEQ ID NO: 78653 - DNA, 25 bp, Rattus norvegicus
acataatttgtcagtggctatacca

SEQ ID NO: 78654 - DNA, 25 bp, Rattus norvegicus
acataatttgtctgtggctatacca

SEQ ID NO: 78655 - DNA, 25 bp, Rattus norvegicus
acatacaaaggtcactctagcaaca

SEQ ID NO: 78656 - DNA, 25 bp, Rattus norvegicus
acatacaaaggtgactctagcaaca

SEQ ID NO: 78657 - DNA, 25 bp, Rattus norvegicus
acatacaagtcacatcgtcagcgtg

SEQ ID NO: 78658 - DNA, 25 bp, Rattus norvegicus
acatacaagtcagatcgtcagcgtg

SEQ ID NO: 78659 - DNA, 25 bp, Rattus norvegicus
acatacaatttgacccttcacactt

SEQ ID NO: 78660 - DNA, 25 bp, Rattus norvegicus
acatacaatttgtcccttcacactt

SEQ ID NO: 78661 - DNA, 25 bp, Rattus norvegicus
acatacacacacatccagttttgta

SEQ ID NO: 78662 - DNA, 25 bp, Rattus norvegicus
acatacacacacttccagttttgta

SEQ ID NO: 78663 - DNA, 25 bp, Rattus norvegicus
acatacacatcccaattccgtggtg

SEQ ID NO: 78664 - DNA, 25 bp, Rattus norvegicus
acatacacatccgaattccgtggtg

SEQ ID NO: 78665 - DNA, 25 bp, Rattus norvegicus
acatacacatgactgcgtctcttga

SEQ ID NO: 78666 - DNA, 25 bp, Rattus norvegicus
acatacacatgagtgcgtctcttga

SEQ ID NO: 78667 - DNA, 25 bp, Rattus norvegicus
acatacacgggcacttttccaacag

SEQ ID NO: 78668 - DNA, 25 bp, Rattus norvegicus
acatacacgggctcttttccaacag

SEQ ID NO: 78669 - DNA, 25 bp, Rattus norvegicus
acatacactcctatagacctgcttt

SEQ ID NO: 78670 - DNA, 25 bp, Rattus norvegicus
acatacactcctttagacctgcttt

SEQ ID NO: 78671 - DNA, 25 bp, Rattus norvegicus
acatacatacgtccacagaccatag

SEQ ID NO: 78672 - DNA, 25 bp, Rattus norvegicus
acatacatacgtgcacagaccatag

SEQ ID NO: 78673 - DNA, 25 bp, Rattus norvegicus
acatacatagtccagtttgccatag

SEQ ID NO: 78674 - DNA, 25 bp, Rattus norvegicus
acatacatagtcgagtttgccatag

SEQ ID NO: 78675 - DNA, 25 bp, Rattus norvegicus
acatacatccagacacagctcttgg

SEQ ID NO: 78676 - DNA, 25 bp, Rattus norvegicus
acatacatccagtcacagctcttgg

SEQ ID NO: 78677 - DNA, 25 bp, Rattus norvegicus
acatacatcctaacatacttacctc

SEQ ID NO: 78678 - DNA, 25 bp, Rattus norvegicus
acatacatcctatcatacttacctc

SEQ ID NO: 78679 - DNA, 25 bp, Rattus norvegicus
acatacatgcagacacaatgcccat

SEQ ID NO: 78680 - DNA, 25 bp, Rattus norvegicus
acatacatgcagtcacaatgcccat

SEQ ID NO: 78681 - DNA, 25 bp, Rattus norvegicus
acatacatgtacaccagcgagcagt

SEQ ID NO: 78682 - DNA, 25 bp, Rattus norvegicus
acatacatgtactccagcgagcagt

SEQ ID NO: 78683 - DNA, 25 bp, Rattus norvegicus
acatacattccaagttacccttggg

SEQ ID NO: 78684 - DNA, 25 bp, Rattus norvegicus
acatacattccatgttacccttggg

SEQ ID NO: 78685 - DNA, 25 bp, Rattus norvegicus
acatacattggtaccctcttcttaa

SEQ ID NO: 78686 - DNA, 25 bp, Rattus norvegicus
acatacattggttccctcttcttaa

SEQ ID NO: 78687 - DNA, 25 bp, Rattus norvegicus
acataccacaacctctttcctgatt

SEQ ID NO: 78688 - DNA, 25 bp, Rattus norvegicus
acataccacaacgtctttcctgatt

SEQ ID NO: 78689 - DNA, 25 bp, Rattus norvegicus
acataccacagcagtcatataggga

SEQ ID NO: 78690 - DNA, 25 bp, Rattus norvegicus
acataccacagctgtcatataggga

SEQ ID NO: 78691 - DNA, 25 bp, Rattus norvegicus
acataccaccctacatagctgatta

SEQ ID NO: 78692 - DNA, 25 bp, Rattus norvegicus
acataccacccttcatagctgatta

SEQ ID NO: 78693 - DNA, 25 bp, Rattus norvegicus
acataccagacaagtgccgtcctgt

SEQ ID NO: 78694 - DNA, 25 bp, Rattus norvegicus
acataccagacatgtgccgtcctgt

SEQ ID NO: 78695 - DNA, 25 bp, Rattus norvegicus
acataccatgtaagattgatagaga

SEQ ID NO: 78696 - DNA, 25 bp, Rattus norvegicus
acataccatgtatgattgatagaga

SEQ ID NO: 78697 - DNA, 25 bp, Rattus norvegicus
acatacccagcaagggagcctagaa

SEQ ID NO: 78698 - DNA, 25 bp, Rattus norvegicus
acatacccagcatgggagcctagaa

SEQ ID NO: 78699 - DNA, 25 bp, Rattus norvegicus
acatacccttttccctttgaggact

SEQ ID NO: 78700 - DNA, 25 bp, Rattus norvegicus
acatacccttttgcctttgaggact

SEQ ID NO: 78701 - DNA, 25 bp, Rattus norvegicus
acatacctctaacaatgctgtgcca

SEQ ID NO: 78702 - DNA, 25 bp, Rattus norvegicus
acatacctctaagaatgctgtgcca

SEQ ID NO: 78703 - DNA, 25 bp, Rattus norvegicus
acatacctgagcacgtgtacacact

SEQ ID NO: 78704 - DNA, 25 bp, Rattus norvegicus
acatacctgagctcgtgtacacact

SEQ ID NO: 78705 - DNA, 25 bp, Rattus norvegicus
acatacctgtaaacgtgtcctcacg

SEQ ID NO: 78706 - DNA, 25 bp, Rattus norvegicus
acatacctgtaatcgtgtcctcacg

SEQ ID NO: 78707 - DNA, 25 bp, Rattus norvegicus
acataccttatgagtacctgcggcc

SEQ ID NO: 78708 - DNA, 25 bp, Rattus norvegicus
acataccttatgtgtacctgcggcc

SEQ ID NO: 78709 - DNA, 25 bp, Rattus norvegicus
acatacgcgtagactctgagattct

SEQ ID NO: 78710 - DNA, 25 bp, Rattus norvegicus
acatacgcgtagtctctgagattct

SEQ ID NO: 78711 - DNA, 25 bp, Rattus norvegicus
acatacgttctaaacaacagaggaa

SEQ ID NO: 78712 - DNA, 25 bp, Rattus norvegicus
acatacgttctatacaacagaggaa

SEQ ID NO: 78713 - DNA, 25 bp, Rattus norvegicus
acatactacctaaagggaacctgca

SEQ ID NO: 78714 - DNA, 25 bp, Rattus norvegicus
acatactacctatagggaacctgca

SEQ ID NO: 78715 - DNA, 25 bp, Rattus norvegicus
acatactcagataaggctcactcca

SEQ ID NO: 78716 - DNA, 25 bp, Rattus norvegicus
acatactcagattaggctcactcca

SEQ ID NO: 78717 - DNA, 25 bp, Rattus norvegicus
acatactccagccaacttgtgtgta

SEQ ID NO: 78718 - DNA, 25 bp, Rattus norvegicus
acatactccagcgaacttgtgtgta

SEQ ID NO: 78719 - DNA, 25 bp, Rattus norvegicus
acatactccattctttgctgtcaca

SEQ ID NO: 78720 - DNA, 25 bp, Rattus norvegicus
acatactccattgtttgctgtcaca

SEQ ID NO: 78721 - DNA, 25 bp, Rattus norvegicus
acatactccgagcacatacagacat

SEQ ID NO: 78722 - DNA, 25 bp, Rattus norvegicus
acatactccgaggacatacagacat

SEQ ID NO: 78723 - DNA, 25 bp, Rattus norvegicus
acatactccttacgagaccaggcag

SEQ ID NO: 78724 - DNA, 25 bp, Rattus norvegicus
acatactccttaggagaccaggcag

SEQ ID NO: 78725 - DNA, 25 bp, Rattus norvegicus
acatactctgcaaactgtctgatta

SEQ ID NO: 78726 - DNA, 25 bp, Rattus norvegicus
acatactctgcatactgtctgatta

SEQ ID NO: 78727 - DNA, 25 bp, Rattus norvegicus
acatactgaatgctggtgacaaact

SEQ ID NO: 78728 - DNA, 25 bp, Rattus norvegicus
acatactgaatggtggtgacaaact

SEQ ID NO: 78729 - DNA, 25 bp, Rattus norvegicus
acatactgcaccaaaggcctgtagc

SEQ ID NO: 78730 - DNA, 25 bp, Rattus norvegicus
acatactgcacctaaggcctgtagc

SEQ ID NO: 78731 - DNA, 25 bp, Rattus norvegicus
acatactgtagaatttgccttcaac

SEQ ID NO: 78732 - DNA, 25 bp, Rattus norvegicus
acatactgtagattttgccttcaac

SEQ ID NO: 78733 - DNA, 25 bp, Rattus norvegicus
acatactgtgaaatccatctcggtt

SEQ ID NO: 78734 - DNA, 25 bp, Rattus norvegicus
acatactgtgaattccatctcggtt

SEQ ID NO: 78735 - DNA, 25 bp, Rattus norvegicus
acatacttcagtcgagggaggcctt

SEQ ID NO: 78736 - DNA, 25 bp, Rattus norvegicus
acatacttcagtggagggaggcctt

SEQ ID NO: 78737 - DNA, 25 bp, Rattus norvegicus
acatacttcgtcagagtgctctggc

SEQ ID NO: 78738 - DNA, 25 bp, Rattus norvegicus
acatacttcgtctgagtgctctggc

SEQ ID NO: 78739 - DNA, 25 bp, Rattus norvegicus
acatacttctgtccagtcagtacac

SEQ ID NO: 78740 - DNA, 25 bp, Rattus norvegicus
acatacttctgtgcagtcagtacac

SEQ ID NO: 78741 - DNA, 25 bp, Rattus norvegicus
acatagacacttacttctcagctgg

SEQ ID NO: 78742 - DNA, 25 bp, Rattus norvegicus
acatagacactttcttctcagctgg

SEQ ID NO: 78743 - DNA, 25 bp, Rattus norvegicus
acatagacattgatcttccctgcaa

SEQ ID NO: 78744 - DNA, 25 bp, Rattus norvegicus
acatagacattgttcttccctgcaa

SEQ ID NO: 78745 - DNA, 25 bp, Rattus norvegicus
acatagaccgttcccctgagatgca

SEQ ID NO: 78746 - DNA, 25 bp, Rattus norvegicus
acatagaccgttgccctgagatgca

SEQ ID NO: 78747 - DNA, 25 bp, Rattus norvegicus
acatagacgtgcctgtcactgacag

SEQ ID NO: 78748 - DNA, 25 bp, Rattus norvegicus
acatagacgtgcgtgtcactgacag

SEQ ID NO: 78749 - DNA, 25 bp, Rattus norvegicus
acatagagaacaccccgccaatcag

SEQ ID NO: 78750 - DNA, 25 bp, Rattus norvegicus
acatagagaacagcccgccaatcag

SEQ ID NO: 78751 - DNA, 25 bp, Rattus norvegicus
acatagagcattctgttggcataga

SEQ ID NO: 78752 - DNA, 25 bp, Rattus norvegicus
acatagagcattgtgttggcataga

SEQ ID NO: 78753 - DNA, 25 bp, Rattus norvegicus
acatagagtccaagtgcagtgtagc

SEQ ID NO: 78754 - DNA, 25 bp, Rattus norvegicus
acatagagtccatgtgcagtgtagc

SEQ ID NO: 78755 - DNA, 25 bp, Rattus norvegicus
acatagagtctgcagggcagtacca

SEQ ID NO: 78756 - DNA, 25 bp, Rattus norvegicus
acatagagtctggagggcagtacca

SEQ ID NO: 78757 - DNA, 25 bp, Rattus norvegicus
acatagatcactcactgcccaagct

SEQ ID NO: 78758 - DNA, 25 bp, Rattus norvegicus
acatagatcactgactgcccaagct

SEQ ID NO: 78759 - DNA, 25 bp, Rattus norvegicus
acatagatgtggaccagcctgggaa

SEQ ID NO: 78760 - DNA, 25 bp, Rattus norvegicus
acatagatgtggtccagcctgggaa

SEQ ID NO: 78761 - DNA, 25 bp, Rattus norvegicus
acatagattctgagctccttgggag

SEQ ID NO: 78762 - DNA, 25 bp, Rattus norvegicus
acatagattctgtgctccttgggag

SEQ ID NO: 78763 - DNA, 25 bp, Rattus norvegicus
acatagcaacatctgggccagccag

SEQ ID NO: 78764 - DNA, 25 bp, Rattus norvegicus
acatagcaacatgtgggccagccag

SEQ ID NO: 78765 - DNA, 25 bp, Rattus norvegicus
acatagcaccttctatatggctcct

SEQ ID NO: 78766 - DNA, 25 bp, Rattus norvegicus
acatagcaccttgtatatggctcct

SEQ ID NO: 78767 - DNA, 25 bp, Rattus norvegicus
acatagcattgtatccttggaggat

SEQ ID NO: 78768 - DNA, 25 bp, Rattus norvegicus
acatagcattgtttccttggaggat

SEQ ID NO: 78769 - DNA, 25 bp, Rattus norvegicus
acatagcccagcatggtcccaaagt

SEQ ID NO: 78770 - DNA, 25 bp, Rattus norvegicus
acatagcccagcttggtcccaaagt

SEQ ID NO: 78771 - DNA, 25 bp, Rattus norvegicus
acatagccttgacgagtcctggagg

SEQ ID NO: 78772 - DNA, 25 bp, Rattus norvegicus
acatagccttgaggagtcctggagg

SEQ ID NO: 78773 - DNA, 25 bp, Rattus norvegicus
acatagcgacccatgcagcaaagaa

SEQ ID NO: 78774 - DNA, 25 bp, Rattus norvegicus
acatagcgacccttgcagcaaagaa

SEQ ID NO: 78775 - DNA, 25 bp, Rattus norvegicus
acatagcgagttccaagtcagttaa

SEQ ID NO: 78776 - DNA, 25 bp, Rattus norvegicus
acatagcgagttgcaagtcagttaa

SEQ ID NO: 78777 - DNA, 25 bp, Rattus norvegicus
acatagctcttcatacggacttcct

SEQ ID NO: 78778 - DNA, 25 bp, Rattus norvegicus
acatagctcttcttacggacttcct

SEQ ID NO: 78779 - DNA, 25 bp, Rattus norvegicus
acatagctgaccaggatcaaccggg

SEQ ID NO: 78780 - DNA, 25 bp, Rattus norvegicus
acatagctgacctggatcaaccggg

SEQ ID NO: 78781 - DNA, 25 bp, Rattus norvegicus
acatagctgagtactgggccagtga

SEQ ID NO: 78782 - DNA, 25 bp, Rattus norvegicus
acatagctgagttctgggccagtga

SEQ ID NO: 78783 - DNA, 25 bp, Rattus norvegicus
acatagctgcctcttatcgatctac

SEQ ID NO: 78784 - DNA, 25 bp, Rattus norvegicus
acatagctgcctgttatcgatctac

SEQ ID NO: 78785 - DNA, 25 bp, Rattus norvegicus
acatagctgtggacccgcaggaagc

SEQ ID NO: 78786 - DNA, 25 bp, Rattus norvegicus
acatagctgtggtcccgcaggaagc

SEQ ID NO: 78787 - DNA, 25 bp, Rattus norvegicus
acatagcttgctatacactcgtttt

SEQ ID NO: 78788 - DNA, 25 bp, Rattus norvegicus
acatagcttgctttacactcgtttt

SEQ ID NO: 78789 - DNA, 25 bp, Rattus norvegicus
acataggatcgccaggcggagtccc

SEQ ID NO: 78790 - DNA, 25 bp, Rattus norvegicus
acataggatcgcgaggcggagtccc

SEQ ID NO: 78791 - DNA, 25 bp, Rattus norvegicus
acataggcaatccaatccctccaag

SEQ ID NO: 78792 - DNA, 25 bp, Rattus norvegicus
acataggcaatcgaatccctccaag

SEQ ID NO: 78793 - DNA, 25 bp, Rattus norvegicus
acataggctctgctgacagctgctc

SEQ ID NO: 78794 - DNA, 25 bp, Rattus norvegicus
acataggctctggtgacagctgctc

SEQ ID NO: 78795 - DNA, 25 bp, Rattus norvegicus
acataggctgtcacagtcgaggctg

SEQ ID NO: 78796 - DNA, 25 bp, Rattus norvegicus
acataggctgtctcagtcgaggctg

SEQ ID NO: 78797 - DNA, 25 bp, Rattus norvegicus
acatagggtggcctgcttttcctcc

SEQ ID NO: 78798 - DNA, 25 bp, Rattus norvegicus
acatagggtggcgtgcttttcctcc

SEQ ID NO: 78799 - DNA, 25 bp, Rattus norvegicus
acataggtctatagtcacacgagga

SEQ ID NO: 78800 - DNA, 25 bp, Rattus norvegicus
acataggtctattgtcacacgagga

SEQ ID NO: 78801 - DNA, 25 bp, Rattus norvegicus
acataggtggagcatgcctgtgcat

SEQ ID NO: 78802 - DNA, 25 bp, Rattus norvegicus
acataggtggaggatgcctgtgcat

SEQ ID NO: 78803 - DNA, 25 bp, Rattus norvegicus
acatagtactgtctctgtgtggtcc

SEQ ID NO: 78804 - DNA, 25 bp, Rattus norvegicus
acatagtactgtgtctgtgtggtcc

SEQ ID NO: 78805 - DNA, 25 bp, Rattus norvegicus
acatagtaggcaagcactgtacccc

SEQ ID NO: 78806 - DNA, 25 bp, Rattus norvegicus
acatagtaggcatgcactgtacccc

SEQ ID NO: 78807 - DNA, 25 bp, Rattus norvegicus
acatagtcagagctccttccaagtt

SEQ ID NO: 78808 - DNA, 25 bp, Rattus norvegicus
acatagtcagaggtccttccaagtt

SEQ ID NO: 78809 - DNA, 25 bp, Rattus norvegicus
acatagtcccctacgggttagtatg

SEQ ID NO: 78810 - DNA, 25 bp, Rattus norvegicus
acatagtccccttcgggttagtatg

SEQ ID NO: 78811 - DNA, 25 bp, Rattus norvegicus
acatagtctcctacatagctactct

SEQ ID NO: 78812 - DNA, 25 bp, Rattus norvegicus
acatagtctccttcatagctactct

SEQ ID NO: 78813 - DNA, 25 bp, Rattus norvegicus
acatagtctgttagcttaaggagcc

SEQ ID NO: 78814 - DNA, 25 bp, Rattus norvegicus
acatagtctgtttgcttaaggagcc

SEQ ID NO: 78815 - DNA, 25 bp, Rattus norvegicus
acatagtgaatgagccacctcccaa

SEQ ID NO: 78816 - DNA, 25 bp, Rattus norvegicus
acatagtgaatgtgccacctcccaa

SEQ ID NO: 78817 - DNA, 25 bp, Rattus norvegicus
acatagtgaattaagggtcaacctg

SEQ ID NO: 78818 - DNA, 25 bp, Rattus norvegicus
acatagtgaatttagggtcaacctg

SEQ ID NO: 78819 - DNA, 25 bp, Rattus norvegicus
acatagtgacttctgcatctaaccc

SEQ ID NO: 78820 - DNA, 25 bp, Rattus norvegicus
acatagtgacttgtgcatctaaccc

SEQ ID NO: 78821 - DNA, 25 bp, Rattus norvegicus
acatagtgatatcctgtcccaaagg

SEQ ID NO: 78822 - DNA, 25 bp, Rattus norvegicus
acatagtgatatgctgtcccaaagg

SEQ ID NO: 78823 - DNA, 25 bp, Rattus norvegicus
acatagtggcatagcattctgctga

SEQ ID NO: 78824 - DNA, 25 bp, Rattus norvegicus
acatagtggcattgcattctgctga

SEQ ID NO: 78825 - DNA, 25 bp, Rattus norvegicus
acatagtgtagaaccgctgagccca

SEQ ID NO: 78826 - DNA, 25 bp, Rattus norvegicus
acatagtgtagatccgctgagccca

SEQ ID NO: 78827 - DNA, 25 bp, Rattus norvegicus
acatagtgtggacgcctgttgatga

SEQ ID NO: 78828 - DNA, 25 bp, Rattus norvegicus
acatagtgtggaggcctgttgatga

SEQ ID NO: 78829 - DNA, 25 bp, Rattus norvegicus
acatagttcttgattcctgactgat

SEQ ID NO: 78830 - DNA, 25 bp, Rattus norvegicus
acatagttcttgtttcctgactgat

SEQ ID NO: 78831 - DNA, 25 bp, Rattus norvegicus
acatagttgcccaaactcatactct

SEQ ID NO: 78832 - DNA, 25 bp, Rattus norvegicus
acatagttgccctaactcatactct

SEQ ID NO: 78833 - DNA, 25 bp, Rattus norvegicus
acatagttgtcccaccagttgcttg

SEQ ID NO: 78834 - DNA, 25 bp, Rattus norvegicus
acatagttgtccgaccagttgcttg

SEQ ID NO: 78835 - DNA, 25 bp, Rattus norvegicus
acatagttgttgactctgttaataa

SEQ ID NO: 78836 - DNA, 25 bp, Rattus norvegicus
acatagttgttgtctctgttaataa

SEQ ID NO: 78837 - DNA, 25 bp, Rattus norvegicus
acatagtttccgatgcttagcgact

SEQ ID NO: 78838 - DNA, 25 bp, Rattus norvegicus
acatagtttccgttgcttagcgact

SEQ ID NO: 78839 - DNA, 25 bp, Rattus norvegicus
acatagttttatcaagtgtgtccat

SEQ ID NO: 78840 - DNA, 25 bp, Rattus norvegicus
acatagttttatcgtagtccttttg

SEQ ID NO: 78841 - DNA, 25 bp, Rattus norvegicus
acatagttttatgaagtgtgtccat

SEQ ID NO: 78842 - DNA, 25 bp, Rattus norvegicus
acatagttttatggtagtccttttg

SEQ ID NO: 78843 - DNA, 25 bp, Rattus norvegicus
acatagttttgtatctgcctaaagt

SEQ ID NO: 78844 - DNA, 25 bp, Rattus norvegicus
acatagttttgtttctgcctaaagt

SEQ ID NO: 78845 - DNA, 25 bp, Rattus norvegicus
acatataagccacgtcatgctgcct

SEQ ID NO: 78846 - DNA, 25 bp, Rattus norvegicus
acatataagccaggtcatgctgcct

SEQ ID NO: 78847 - DNA, 25 bp, Rattus norvegicus
acatatacaacaatacactgtctgt

SEQ ID NO: 78848 - DNA, 25 bp, Rattus norvegicus
acatatacaacattacactgtctgt

SEQ ID NO: 78849 - DNA, 25 bp, Rattus norvegicus
acatatacgtagcttatccccagag

SEQ ID NO: 78850 - DNA, 25 bp, Rattus norvegicus
acatatacgtaggttatccccagag

SEQ ID NO: 78851 - DNA, 25 bp, Rattus norvegicus
acatatactctgctccgacatgcat

SEQ ID NO: 78852 - DNA, 25 bp, Rattus norvegicus
acatatactctggtccgacatgcat

SEQ ID NO: 78853 - DNA, 25 bp, Rattus norvegicus
acatatactgtaaaggccacctgta

SEQ ID NO: 78854 - DNA, 25 bp, Rattus norvegicus
acatatactgtataggccacctgta

SEQ ID NO: 78855 - DNA, 25 bp, Rattus norvegicus
acatatagaatcattccactggaaa

SEQ ID NO: 78856 - DNA, 25 bp, Rattus norvegicus
acatatagaatctttccactggaaa

SEQ ID NO: 78857 - DNA, 25 bp, Rattus norvegicus
acatatagcagtcaaatccgcccct

SEQ ID NO: 78858 - DNA, 25 bp, Rattus norvegicus
acatatagcagtgaaatccgcccct

SEQ ID NO: 78859 - DNA, 25 bp, Rattus norvegicus
acatatagcataccctgcttaggaa

SEQ ID NO: 78860 - DNA, 25 bp, Rattus norvegicus
acatatagcatagcctgcttaggaa

SEQ ID NO: 78861 - DNA, 25 bp, Rattus norvegicus
acatatagctttatctgtgagtcta

SEQ ID NO: 78862 - DNA, 25 bp, Rattus norvegicus
acatatagctttttctgtgagtcta

SEQ ID NO: 78863 - DNA, 25 bp, Rattus norvegicus
acatatatacaactcgcatcgcaca

SEQ ID NO: 78864 - DNA, 25 bp, Rattus norvegicus
acatatatacaagtcgcatcgcaca

SEQ ID NO: 78865 - DNA, 25 bp, Rattus norvegicus
acatatatacatcctgctgagctct

SEQ ID NO: 78866 - DNA, 25 bp, Rattus norvegicus
acatatatacatgctgctgagctct

SEQ ID NO: 78867 - DNA, 25 bp, Rattus norvegicus
acatatatatataggtcccgagcta

SEQ ID NO: 78868 - DNA, 25 bp, Rattus norvegicus
acatatatatattggtcccgagcta

SEQ ID NO: 78869 - DNA, 25 bp, Rattus norvegicus
acatatatgtacacgcacgcaccca

SEQ ID NO: 78870 - DNA, 25 bp, Rattus norvegicus
acatatatgtactcgcacgcaccca

SEQ ID NO: 78871 - DNA, 25 bp, Rattus norvegicus
acatatattaaactcccagggtggg

SEQ ID NO: 78872 - DNA, 25 bp, Rattus norvegicus
acatatattaaagtcccagggtggg

SEQ ID NO: 78873 - DNA, 25 bp, Rattus norvegicus
acatatcatttaacttcgaaggcat

SEQ ID NO: 78874 - DNA, 25 bp, Rattus norvegicus
acatatcatttatcttcgaaggcat

SEQ ID NO: 78875 - DNA, 25 bp, Rattus norvegicus
acatatccaaagcacaataggcatt

SEQ ID NO: 78876 - DNA, 25 bp, Rattus norvegicus
acatatccaaaggacaataggcatt

SEQ ID NO: 78877 - DNA, 25 bp, Rattus norvegicus
acatatccatagcaacatcctttat

SEQ ID NO: 78878 - DNA, 25 bp, Rattus norvegicus
acatatccataggaacatcctttat

SEQ ID NO: 78879 - DNA, 25 bp, Rattus norvegicus
acatatcccacacttcttttcttgt

SEQ ID NO: 78880 - DNA, 25 bp, Rattus norvegicus
acatatcccacagttcttttcttgt

SEQ ID NO: 78881 - DNA, 25 bp, Rattus norvegicus
acatatcccattcaaggaacactgg

SEQ ID NO: 78882 - DNA, 25 bp, Rattus norvegicus
acatatcccattgaaggaacactgg

SEQ ID NO: 78883 - DNA, 25 bp, Rattus norvegicus
acatatctaattcatcaggctaagg

SEQ ID NO: 78884 - DNA, 25 bp, Rattus norvegicus
acatatctaattgatcaggctaagg

SEQ ID NO: 78885 - DNA, 25 bp, Rattus norvegicus
acatatctagcaatctgtctgcatg

SEQ ID NO: 78886 - DNA, 25 bp, Rattus norvegicus
acatatctagcattctgtctgcatg

SEQ ID NO: 78887 - DNA, 25 bp, Rattus norvegicus
acatatctagtcaatttttacccaa

SEQ ID NO: 78888 - DNA, 25 bp, Rattus norvegicus
acatatctagtctatttttacccaa

SEQ ID NO: 78889 - DNA, 25 bp, Rattus norvegicus
acatatctccgtctacatgtgtgca

SEQ ID NO: 78890 - DNA, 25 bp, Rattus norvegicus
acatatctccgtgtacatgtgtgca

SEQ ID NO: 78891 - DNA, 25 bp, Rattus norvegicus
acatatctctaacctacctttgcct

SEQ ID NO: 78892 - DNA, 25 bp, Rattus norvegicus
acatatctctaagctacctttgcct

SEQ ID NO: 78893 - DNA, 25 bp, Rattus norvegicus
acatatctctgtccagttctctgtt

SEQ ID NO: 78894 - DNA, 25 bp, Rattus norvegicus
acatatctctgtgcagttctctgtt

SEQ ID NO: 78895 - DNA, 25 bp, Rattus norvegicus
acatatctggcaccatgtatcccac

SEQ ID NO: 78896 - DNA, 25 bp, Rattus norvegicus
acatatctggcagcatgtatcccac

SEQ ID NO: 78897 - DNA, 25 bp, Rattus norvegicus
acatatcttcaaattagtgcttgga

SEQ ID NO: 78898 - DNA, 25 bp, Rattus norvegicus
acatatcttcaatttagtgcttgga

SEQ ID NO: 78899 - DNA, 25 bp, Rattus norvegicus
acatatcttgtcacacagagcttta

SEQ ID NO: 78900 - DNA, 25 bp, Rattus norvegicus
acatatcttgtcctgggcttggaac

SEQ ID NO: 78901 - DNA, 25 bp, Rattus norvegicus
acatatcttgtcgtgggcttggaac

SEQ ID NO: 78902 - DNA, 25 bp, Rattus norvegicus
acatatcttgtctcacagagcttta

SEQ ID NO: 78903 - DNA, 25 bp, Rattus norvegicus
acatatgacctgacaacgcttgcct

SEQ ID NO: 78904 - DNA, 25 bp, Rattus norvegicus
acatatgacctgtcaacgcttgcct

SEQ ID NO: 78905 - DNA, 25 bp, Rattus norvegicus
acatatgagcgcatgccttttattt

SEQ ID NO: 78906 - DNA, 25 bp, Rattus norvegicus
acatatgagcgcttgccttttattt

SEQ ID NO: 78907 - DNA, 25 bp, Rattus norvegicus
acatatgctcacaactgggtgtgca

SEQ ID NO: 78908 - DNA, 25 bp, Rattus norvegicus
acatatgctcactactgggtgtgca

SEQ ID NO: 78909 - DNA, 25 bp, Rattus norvegicus
acatatgctcagaggtggctacaga

SEQ ID NO: 78910 - DNA, 25 bp, Rattus norvegicus
acatatgctcagtggtggctacaga

SEQ ID NO: 78911 - DNA, 25 bp, Rattus norvegicus
acatatggccccagtgtcattgttg

SEQ ID NO: 78912 - DNA, 25 bp, Rattus norvegicus
acatatggcccctgtgtcattgttg

SEQ ID NO: 78913 - DNA, 25 bp, Rattus norvegicus
acatatggctttctacattacagtt

SEQ ID NO: 78914 - DNA, 25 bp, Rattus norvegicus
acatatggctttgtacattacagtt

SEQ ID NO: 78915 - DNA, 25 bp, Rattus norvegicus
acatatggtctcagggcatcatggc

SEQ ID NO: 78916 - DNA, 25 bp, Rattus norvegicus
acatatggtctctgggcatcatggc

SEQ ID NO: 78917 - DNA, 25 bp, Rattus norvegicus
acatatggtctgagactccgtgtat

SEQ ID NO: 78918 - DNA, 25 bp, Rattus norvegicus
acatatggtctgctgttcacagtct

SEQ ID NO: 78919 - DNA, 25 bp, Rattus norvegicus
acatatggtctggtgttcacagtct

SEQ ID NO: 78920 - DNA, 25 bp, Rattus norvegicus
acatatggtctgtgactccgtgtat

SEQ ID NO: 78921 - DNA, 25 bp, Rattus norvegicus
acatatgtatatagtgggttggtct

SEQ ID NO: 78922 - DNA, 25 bp, Rattus norvegicus
acatatgtatattgtgggttggtct

SEQ ID NO: 78923 - DNA, 25 bp, Rattus norvegicus
acatatgtcacactcaagtacggct

SEQ ID NO: 78924 - DNA, 25 bp, Rattus norvegicus
acatatgtcacagtcaagtacggct

SEQ ID NO: 78925 - DNA, 25 bp, Rattus norvegicus
acatatgtccagagacagctaggaa

SEQ ID NO: 78926 - DNA, 25 bp, Rattus norvegicus
acatatgtccagtgacagctaggaa

SEQ ID NO: 78927 - DNA, 25 bp, Rattus norvegicus
acatatgtcctgagtctagtctaaa

SEQ ID NO: 78928 - DNA, 25 bp, Rattus norvegicus
acatatgtcctgtgtctagtctaaa

SEQ ID NO: 78929 - DNA, 25 bp, Rattus norvegicus
acatatgtgaaactgccgagtccag

SEQ ID NO: 78930 - DNA, 25 bp, Rattus norvegicus
acatatgtgaaagtgccgagtccag

SEQ ID NO: 78931 - DNA, 25 bp, Rattus norvegicus
acatatgtgactcgagctatgggtc

SEQ ID NO: 78932 - DNA, 25 bp, Rattus norvegicus
acatatgtgactggagctatgggtc

SEQ ID NO: 78933 - DNA, 25 bp, Rattus norvegicus
acatatgttcctcctctataatctt

SEQ ID NO: 78934 - DNA, 25 bp, Rattus norvegicus
acatatgttcctgctctataatctt

SEQ ID NO: 78935 - DNA, 25 bp, Rattus norvegicus
acatatgttgtaacttgggccagtg

SEQ ID NO: 78936 - DNA, 25 bp, Rattus norvegicus
acatatgttgtatcttgggccagtg

SEQ ID NO: 78937 - DNA, 25 bp, Rattus norvegicus
acatatgtttatattgttcttgaaa

SEQ ID NO: 78938 - DNA, 25 bp, Rattus norvegicus
acatatgtttattttgttcttgaaa

SEQ ID NO: 78939 - DNA, 25 bp, Rattus norvegicus
acatattaataacatccccagcgga

SEQ ID NO: 78940 - DNA, 25 bp, Rattus norvegicus
acatattaataagatccccagcgga

SEQ ID NO: 78941 - DNA, 25 bp, Rattus norvegicus
acatattacgcaaatggcctccatc

SEQ ID NO: 78942 - DNA, 25 bp, Rattus norvegicus
acatattacgcatatggcctccatc

SEQ ID NO: 78943 - DNA, 25 bp, Rattus norvegicus
acatattccacaaaccccattgtat

SEQ ID NO: 78944 - DNA, 25 bp, Rattus norvegicus
acatattccacaaggccagttcaat

SEQ ID NO: 78945 - DNA, 25 bp, Rattus norvegicus
acatattccacataccccattgtat

SEQ ID NO: 78946 - DNA, 25 bp, Rattus norvegicus
acatattccacatggccagttcaat

SEQ ID NO: 78947 - DNA, 25 bp, Rattus norvegicus
acatattccatgaatccttgtggga

SEQ ID NO: 78948 - DNA, 25 bp, Rattus norvegicus
acatattccatgtatccttgtggga

SEQ ID NO: 78949 - DNA, 25 bp, Rattus norvegicus
acatattcccaacatttccactgtt

SEQ ID NO: 78950 - DNA, 25 bp, Rattus norvegicus
acatattcccaagatttccactgtt

SEQ ID NO: 78951 - DNA, 25 bp, Rattus norvegicus
acatattcgtctcgtttggctgggc

SEQ ID NO: 78952 - DNA, 25 bp, Rattus norvegicus
acatattcgtctggtttggctgggc

SEQ ID NO: 78953 - DNA, 25 bp, Rattus norvegicus
acatattctctcagaaatgactctg

SEQ ID NO: 78954 - DNA, 25 bp, Rattus norvegicus
acatattctctctgaaatgactctg

SEQ ID NO: 78955 - DNA, 25 bp, Rattus norvegicus
acatattgcctgatttttgtatcca

SEQ ID NO: 78956 - DNA, 25 bp, Rattus norvegicus
acatattgcctgttttttgtatcca

SEQ ID NO: 78957 - DNA, 25 bp, Rattus norvegicus
acatattgcgcaacaagccctacag

SEQ ID NO: 78958 - DNA, 25 bp, Rattus norvegicus
acatattgcgcatcaagccctacag

SEQ ID NO: 78959 - DNA, 25 bp, Rattus norvegicus
acatattgctgtattcctccctttt

SEQ ID NO: 78960 - DNA, 25 bp, Rattus norvegicus
acatattgctgttttcctccctttt

SEQ ID NO: 78961 - DNA, 25 bp, Rattus norvegicus
acatattgtgggaatggcttttccc

SEQ ID NO: 78962 - DNA, 25 bp, Rattus norvegicus
acatattgtgggtatggcttttccc

SEQ ID NO: 78963 - DNA, 25 bp, Rattus norvegicus
acatatttctgtctagctataacta

SEQ ID NO: 78964 - DNA, 25 bp, Rattus norvegicus
acatatttctgtgtagctataacta

SEQ ID NO: 78965 - DNA, 25 bp, Rattus norvegicus
acatatttgactagttgctctccgg

SEQ ID NO: 78966 - DNA, 25 bp, Rattus norvegicus
acatatttgacttgttgctctccgg

SEQ ID NO: 78967 - DNA, 25 bp, Rattus norvegicus
acatatttgtggaaaacatttctgt

SEQ ID NO: 78968 - DNA, 25 bp, Rattus norvegicus
acatatttgtggtaaacatttctgt

SEQ ID NO: 78969 - DNA, 25 bp, Rattus norvegicus
acatattttgttcccgttgctcagg

SEQ ID NO: 78970 - DNA, 25 bp, Rattus norvegicus
acatattttgttgccgttgctcagg

SEQ ID NO: 78971 - DNA, 25 bp, Rattus norvegicus
acatcaaaaaggctcctgggttgaa

SEQ ID NO: 78972 - DNA, 25 bp, Rattus norvegicus
acatcaaaaagggtcctgggttgaa

SEQ ID NO: 78973 - DNA, 25 bp, Rattus norvegicus
acatcaacccatcaccgtttataaa

SEQ ID NO: 78974 - DNA, 25 bp, Rattus norvegicus
acatcaacccatgaccgtttataaa

SEQ ID NO: 78975 - DNA, 25 bp, Rattus norvegicus
acatcaactcttagcttcacttttg

SEQ ID NO: 78976 - DNA, 25 bp, Rattus norvegicus
acatcaactctttgcttcacttttg

SEQ ID NO: 78977 - DNA, 25 bp, Rattus norvegicus
acatcaagaagaccggcccatccga

SEQ ID NO: 78978 - DNA, 25 bp, Rattus norvegicus
acatcaagaagagcggcccatccga

SEQ ID NO: 78979 - DNA, 25 bp, Rattus norvegicus
acatcaagacagaggccctgaacct

SEQ ID NO: 78980 - DNA, 25 bp, Rattus norvegicus
acatcaagacagtggccctgaacct

SEQ ID NO: 78981 - DNA, 25 bp, Rattus norvegicus
acatcaagatgacctgcgcacggcg

SEQ ID NO: 78982 - DNA, 25 bp, Rattus norvegicus
acatcaagatgagctgcgcacggcg

SEQ ID NO: 78983 - DNA, 25 bp, Rattus norvegicus
acatcaagcaacacactggtgccac

SEQ ID NO: 78984 - DNA, 25 bp, Rattus norvegicus
acatcaagcaactcactggtgccac

SEQ ID NO: 78985 - DNA, 25 bp, Rattus norvegicus
acatcaagtgtgatcttttctattt

SEQ ID NO: 78986 - DNA, 25 bp, Rattus norvegicus
acatcaagtgtgttcttttctattt

SEQ ID NO: 78987 - DNA, 25 bp, Rattus norvegicus
acatcaagttctatccttacggaga

SEQ ID NO: 78988 - DNA, 25 bp, Rattus norvegicus
acatcaagttctcagtggaaagcct

SEQ ID NO: 78989 - DNA, 25 bp, Rattus norvegicus
acatcaagttctgagtggaaagcct

SEQ ID NO: 78990 - DNA, 25 bp, Rattus norvegicus
acatcaagttctttccttacggaga

SEQ ID NO: 78991 - DNA, 25 bp, Rattus norvegicus
acatcaatctctaccaggtgctgcc

SEQ ID NO: 78992 - DNA, 25 bp, Rattus norvegicus
acatcaatctctctccaggctattt

SEQ ID NO: 78993 - DNA, 25 bp, Rattus norvegicus
acatcaatctctgtccaggctattt

SEQ ID NO: 78994 - DNA, 25 bp, Rattus norvegicus
acatcaatctcttccaggtgctgcc

SEQ ID NO: 78995 - DNA, 25 bp, Rattus norvegicus
acatcaatgagcaagttgccacagg

SEQ ID NO: 78996 - DNA, 25 bp, Rattus norvegicus
acatcaatgagctagttgccacagg

SEQ ID NO: 78997 - DNA, 25 bp, Rattus norvegicus
acatcacaagctagagtgttgggct

SEQ ID NO: 78998 - DNA, 25 bp, Rattus norvegicus
acatcacaagcttgagtgttgggct

SEQ ID NO: 78999 - DNA, 25 bp, Rattus norvegicus
acatcacaatacagaaccattccaa

SEQ ID NO: 79000 - DNA, 25 bp, Rattus norvegicus
acatcacaatactgaaccattccaa

SEQ ID NO: 79001 - DNA, 25 bp, Rattus norvegicus
acatcacaccacattgggaccggga

SEQ ID NO: 79002 - DNA, 25 bp, Rattus norvegicus
acatcacaccactttgggaccggga

SEQ ID NO: 79003 - DNA, 25 bp, Rattus norvegicus
acatcacacgttcatgctttctttg

SEQ ID NO: 79004 - DNA, 25 bp, Rattus norvegicus
acatcacacgttgatgctttctttg

SEQ ID NO: 79005 - DNA, 25 bp, Rattus norvegicus
acatcacagaggctcccctagggag

SEQ ID NO: 79006 - DNA, 25 bp, Rattus norvegicus
acatcacagagggtcccctagggag

SEQ ID NO: 79007 - DNA, 25 bp, Rattus norvegicus
acatcacaggagactacctgcagct

SEQ ID NO: 79008 - DNA, 25 bp, Rattus norvegicus
acatcacaggagtctacctgcagct

SEQ ID NO: 79009 - DNA, 25 bp, Rattus norvegicus
acatcacaggtcatcggtgttgcca

SEQ ID NO: 79010 - DNA, 25 bp, Rattus norvegicus
acatcacaggtcttcggtgttgcca

SEQ ID NO: 79011 - DNA, 25 bp, Rattus norvegicus
acatcacaggtgacgtgtcccatga

SEQ ID NO: 79012 - DNA, 25 bp, Rattus norvegicus
acatcacaggtgtcgtgtcccatga

SEQ ID NO: 79013 - DNA, 25 bp, Rattus norvegicus
acatcacagtgaaatcctccattaa

SEQ ID NO: 79014 - DNA, 25 bp, Rattus norvegicus
acatcacagtgatatcctccattaa

SEQ ID NO: 79015 - DNA, 25 bp, Rattus norvegicus
acatcacatcatcgctgagcatcgt

SEQ ID NO: 79016 - DNA, 25 bp, Rattus norvegicus
acatcacatcatggctgagcatcgt

SEQ ID NO: 79017 - DNA, 25 bp, Rattus norvegicus
acatcacatgtacctggatgtgcat

SEQ ID NO: 79018 - DNA, 25 bp, Rattus norvegicus
acatcacatgtagctggatgtgcat

SEQ ID NO: 79019 - DNA, 25 bp, Rattus norvegicus
acatcaccctgaatgttgacggaca

SEQ ID NO: 79020 - DNA, 25 bp, Rattus norvegicus
acatcaccctgattgttgacggaca

SEQ ID NO: 79021 - DNA, 25 bp, Rattus norvegicus
acatcaccgtgtaccttgttaacat

SEQ ID NO: 79022 - DNA, 25 bp, Rattus norvegicus
acatcaccgtgttccttgttaacat

SEQ ID NO: 79023 - DNA, 25 bp, Rattus norvegicus
acatcacctcctagttatgtgcaag

SEQ ID NO: 79024 - DNA, 25 bp, Rattus norvegicus
acatcacctccttgttatgtgcaag

SEQ ID NO: 79025 - DNA, 25 bp, Rattus norvegicus
acatcacctgttattagttccgtaa

SEQ ID NO: 79026 - DNA, 25 bp, Rattus norvegicus
acatcacctgtttttagttccgtaa

SEQ ID NO: 79027 - DNA, 25 bp, Rattus norvegicus
acatcaccttccaatttcccaagtt

SEQ ID NO: 79028 - DNA, 25 bp, Rattus norvegicus
acatcaccttcctatttcccaagtt

SEQ ID NO: 79029 - DNA, 25 bp, Rattus norvegicus
acatcactcatgctgtaggcgccag

SEQ ID NO: 79030 - DNA, 25 bp, Rattus norvegicus
acatcactcatggtgtaggcgccag

SEQ ID NO: 79031 - DNA, 25 bp, Rattus norvegicus
acatcactccctaatgatctctgaa

SEQ ID NO: 79032 - DNA, 25 bp, Rattus norvegicus
acatcactcccttatgatctctgaa

SEQ ID NO: 79033 - DNA, 25 bp, Rattus norvegicus
acatcactctccattggtccagaaa

SEQ ID NO: 79034 - DNA, 25 bp, Rattus norvegicus
acatcactctcctttggtccagaaa

SEQ ID NO: 79035 - DNA, 25 bp, Rattus norvegicus
acatcactctggatgtgctctttgt

SEQ ID NO: 79036 - DNA, 25 bp, Rattus norvegicus
acatcactctggttgtgctctttgt

SEQ ID NO: 79037 - DNA, 25 bp, Rattus norvegicus
acatcactcttactgttcaccagca

SEQ ID NO: 79038 - DNA, 25 bp, Rattus norvegicus
acatcactcttagtgttcaccagca

SEQ ID NO: 79039 - DNA, 25 bp, Rattus norvegicus
acatcactgccaaaggtttctattt

SEQ ID NO: 79040 - DNA, 25 bp, Rattus norvegicus
acatcactgccataggtttctattt

SEQ ID NO: 79041 - DNA, 25 bp, Rattus norvegicus
acatcactgcggctggagaacttcc

SEQ ID NO: 79042 - DNA, 25 bp, Rattus norvegicus
acatcactgcgggtggagaacttcc

SEQ ID NO: 79043 - DNA, 25 bp, Rattus norvegicus
acatcactggacaggaagccttctg

SEQ ID NO: 79044 - DNA, 25 bp, Rattus norvegicus
acatcactggactggaagccttctg

SEQ ID NO: 79045 - DNA, 25 bp, Rattus norvegicus
acatcactggctctttgtctgtgtg

SEQ ID NO: 79046 - DNA, 25 bp, Rattus norvegicus
acatcactggctgtttgtctgtgtg

SEQ ID NO: 79047 - DNA, 25 bp, Rattus norvegicus
acatcacttctcaatcacaggacag

SEQ ID NO: 79048 - DNA, 25 bp, Rattus norvegicus
acatcacttctctatcacaggacag

SEQ ID NO: 79049 - DNA, 25 bp, Rattus norvegicus
acatcacttctgctaaccacagggt

SEQ ID NO: 79050 - DNA, 25 bp, Rattus norvegicus
acatcacttctggtaaccacagggt

SEQ ID NO: 79051 - DNA, 25 bp, Rattus norvegicus
acatcacttgatcctatattcattt

SEQ ID NO: 79052 - DNA, 25 bp, Rattus norvegicus
acatcacttgatgctatattcattt

SEQ ID NO: 79053 - DNA, 25 bp, Rattus norvegicus
acatcactttacaccatctttgtca

SEQ ID NO: 79054 - DNA, 25 bp, Rattus norvegicus
acatcactttactccatctttgtca

SEQ ID NO: 79055 - DNA, 25 bp, Rattus norvegicus
acatcagacgaccattccgggtgcg

SEQ ID NO: 79056 - DNA, 25 bp, Rattus norvegicus
acatcagacgacgattccgggtgcg

SEQ ID NO: 79057 - DNA, 25 bp, Rattus norvegicus
acatcagagcatactcaagagtcat

SEQ ID NO: 79058 - DNA, 25 bp, Rattus norvegicus
acatcagagcattctcaagagtcat

SEQ ID NO: 79059 - DNA, 25 bp, Rattus norvegicus
acatcagagttgacggcatcgctgt

SEQ ID NO: 79060 - DNA, 25 bp, Rattus norvegicus
acatcagagttgtcggcatcgctgt

SEQ ID NO: 79061 - DNA, 25 bp, Rattus norvegicus
acatcagatggtactgtctttgttc

SEQ ID NO: 79062 - DNA, 25 bp, Rattus norvegicus
acatcagatggttctgtctttgttc

SEQ ID NO: 79063 - DNA, 25 bp, Rattus norvegicus
acatcagattctcgcttagcttccc

SEQ ID NO: 79064 - DNA, 25 bp, Rattus norvegicus
acatcagattctggcttagcttccc

SEQ ID NO: 79065 - DNA, 25 bp, Rattus norvegicus
acatcagcacacagtagcctgcagc

SEQ ID NO: 79066 - DNA, 25 bp, Rattus norvegicus
acatcagcacactgtagcctgcagc

SEQ ID NO: 79067 - DNA, 25 bp, Rattus norvegicus
acatcagcacccatatccgggagag

SEQ ID NO: 79068 - DNA, 25 bp, Rattus norvegicus
acatcagcacccttatccgggagag

SEQ ID NO: 79069 - DNA, 25 bp, Rattus norvegicus
acatcagcactgcagatgccttcgc

SEQ ID NO: 79070 - DNA, 25 bp, Rattus norvegicus
acatcagcactggagatgccttcgc

SEQ ID NO: 79071 - DNA, 25 bp, Rattus norvegicus
acatcagcatagagttcttgagctt

SEQ ID NO: 79072 - DNA, 25 bp, Rattus norvegicus
acatcagcatagtgttcttgagctt

SEQ ID NO: 79073 - DNA, 25 bp, Rattus norvegicus
acatcagccaagagcctagcctgag

SEQ ID NO: 79074 - DNA, 25 bp, Rattus norvegicus
acatcagccaagtgcctagcctgag

SEQ ID NO: 79075 - DNA, 25 bp, Rattus norvegicus
acatcagccctgagagcaacatgga

SEQ ID NO: 79076 - DNA, 25 bp, Rattus norvegicus
acatcagccctgtgagcaacatgga

SEQ ID NO: 79077 - DNA, 25 bp, Rattus norvegicus
acatcagcctccatttactcaagag

SEQ ID NO: 79078 - DNA, 25 bp, Rattus norvegicus
acatcagcctccttttactcaagag

SEQ ID NO: 79079 - DNA, 25 bp, Rattus norvegicus
acatcagctcttatagtttccagtt

SEQ ID NO: 79080 - DNA, 25 bp, Rattus norvegicus
acatcagctcttttagtttccagtt

SEQ ID NO: 79081 - DNA, 25 bp, Rattus norvegicus
acatcagctggcagaggtcgaggca

SEQ ID NO: 79082 - DNA, 25 bp, Rattus norvegicus
acatcagctggctgaggtcgaggca

SEQ ID NO: 79083 - DNA, 25 bp, Rattus norvegicus
acatcagcttctcctgacactggag

SEQ ID NO: 79084 - DNA, 25 bp, Rattus norvegicus
acatcagcttctgctgacactggag

SEQ ID NO: 79085 - DNA, 25 bp, Rattus norvegicus
acatcaggaacaatgtccactggaa

SEQ ID NO: 79086 - DNA, 25 bp, Rattus norvegicus
acatcaggaacattgtccactggaa

SEQ ID NO: 79087 - DNA, 25 bp, Rattus norvegicus
acatcaggactgagctatggaccct

SEQ ID NO: 79088 - DNA, 25 bp, Rattus norvegicus
acatcaggactgcacaccagggctt

SEQ ID NO: 79089 - DNA, 25 bp, Rattus norvegicus
acatcaggactggacaccagggctt

SEQ ID NO: 79090 - DNA, 25 bp, Rattus norvegicus
acatcaggactgtgctatggaccct

SEQ ID NO: 79091 - DNA, 25 bp, Rattus norvegicus
acatcaggagcaacggctactcgga

SEQ ID NO: 79092 - DNA, 25 bp, Rattus norvegicus
acatcaggagcatcggctactcgga

SEQ ID NO: 79093 - DNA, 25 bp, Rattus norvegicus
acatcaggagccatctgtagcccgg

SEQ ID NO: 79094 - DNA, 25 bp, Rattus norvegicus
acatcaggagccttctgtagcccgg

SEQ ID NO: 79095 - DNA, 25 bp, Rattus norvegicus
acatcaggcaacaggctctggtttc

SEQ ID NO: 79096 - DNA, 25 bp, Rattus norvegicus
acatcaggcaactggctctggtttc

SEQ ID NO: 79097 - DNA, 25 bp, Rattus norvegicus
acatcaggcaagctgtgtctgtata

SEQ ID NO: 79098 - DNA, 25 bp, Rattus norvegicus
acatcaggcaaggtgtgtctgtata

SEQ ID NO: 79099 - DNA, 25 bp, Rattus norvegicus
acatcaggcataatactagtggctt

SEQ ID NO: 79100 - DNA, 25 bp, Rattus norvegicus
acatcaggcatattactagtggctt

SEQ ID NO: 79101 - DNA, 25 bp, Rattus norvegicus
acatcaggccttcggagctagggct

SEQ ID NO: 79102 - DNA, 25 bp, Rattus norvegicus
acatcaggccttgggagctagggct

SEQ ID NO: 79103 - DNA, 25 bp, Rattus norvegicus
acatcaggctggaattcaacattgg

SEQ ID NO: 79104 - DNA, 25 bp, Rattus norvegicus
acatcaggctggtattcaacattgg

SEQ ID NO: 79105 - DNA, 25 bp, Rattus norvegicus
acatcaggctttctgcagcgacttg

SEQ ID NO: 79106 - DNA, 25 bp, Rattus norvegicus
acatcaggctttgtgcagcgacttg

SEQ ID NO: 79107 - DNA, 25 bp, Rattus norvegicus
acatcagggaatccatactggtgag

SEQ ID NO: 79108 - DNA, 25 bp, Rattus norvegicus
acatcagggaatgcatactggtgag

SEQ ID NO: 79109 - DNA, 25 bp, Rattus norvegicus
acatcagggcacacctaatgggcaa

SEQ ID NO: 79110 - DNA, 25 bp, Rattus norvegicus
acatcagggcactcctaatgggcaa

SEQ ID NO: 79111 - DNA, 25 bp, Rattus norvegicus
acatcagggcctacaggatggctgc

SEQ ID NO: 79112 - DNA, 25 bp, Rattus norvegicus
acatcagggccttcaggatggctgc

SEQ ID NO: 79113 - DNA, 25 bp, Rattus norvegicus
acatcagggtccctttcagggttca

SEQ ID NO: 79114 - DNA, 25 bp, Rattus norvegicus
acatcagggtccgtttcagggttca

SEQ ID NO: 79115 - DNA, 25 bp, Rattus norvegicus
acatcaggtttcacatttcaagcaa

SEQ ID NO: 79116 - DNA, 25 bp, Rattus norvegicus
acatcaggtttctcatttcaagcaa

SEQ ID NO: 79117 - DNA, 25 bp, Rattus norvegicus
acatcagtaactcacaactgcccat

SEQ ID NO: 79118 - DNA, 25 bp, Rattus norvegicus
acatcagtaactgacaactgcccat

SEQ ID NO: 79119 - DNA, 25 bp, Rattus norvegicus
acatcagtacagcatcatcgccaag

SEQ ID NO: 79120 - DNA, 25 bp, Rattus norvegicus
acatcagtacaggatcatcgccaag

SEQ ID NO: 79121 - DNA, 25 bp, Rattus norvegicus
acatcagtacgtaatgcctttgcac

SEQ ID NO: 79122 - DNA, 25 bp, Rattus norvegicus
acatcagtacgttatgcctttgcac

SEQ ID NO: 79123 - DNA, 25 bp, Rattus norvegicus
acatcagtatgtcggccctgttctc

SEQ ID NO: 79124 - DNA, 25 bp, Rattus norvegicus
acatcagtatgtgggccctgttctc

SEQ ID NO: 79125 - DNA, 25 bp, Rattus norvegicus
acatcagtgaggatcccagctgggc

SEQ ID NO: 79126 - DNA, 25 bp, Rattus norvegicus
acatcagtgaggttcccagctgggc

SEQ ID NO: 79127 - DNA, 25 bp, Rattus norvegicus
acatcagtgatgattgggacccaag

SEQ ID NO: 79128 - DNA, 25 bp, Rattus norvegicus
acatcagtgatgtttgggacccaag

SEQ ID NO: 79129 - DNA, 25 bp, Rattus norvegicus
acatcagtgcggcagaactgcgcca

SEQ ID NO: 79130 - DNA, 25 bp, Rattus norvegicus
acatcagtgcgggagaactgcgcca

SEQ ID NO: 79131 - DNA, 25 bp, Rattus norvegicus
acatcagtgctgaggagctggccca

SEQ ID NO: 79132 - DNA, 25 bp, Rattus norvegicus
acatcagtgctgtggagctggccca

SEQ ID NO: 79133 - DNA, 25 bp, Rattus norvegicus
acatcagtgtgcagtgcagtcacgc

SEQ ID NO: 79134 - DNA, 25 bp, Rattus norvegicus
acatcagtgtgctgtgcagtcacgc

SEQ ID NO: 79135 - DNA, 25 bp, Rattus norvegicus
acatcagtgtttcttggatccgttt

SEQ ID NO: 79136 - DNA, 25 bp, Rattus norvegicus
acatcagtgtttgttggatccgttt

SEQ ID NO: 79137 - DNA, 25 bp, Rattus norvegicus
acatcagttctgaaggccaaggcca

SEQ ID NO: 79138 - DNA, 25 bp, Rattus norvegicus
acatcagttctgtaggccaaggcca

SEQ ID NO: 79139 - DNA, 25 bp, Rattus norvegicus
acatcatactcaaaattcaccacgc

SEQ ID NO: 79140 - DNA, 25 bp, Rattus norvegicus
acatcatactcataattcaccacgc

SEQ ID NO: 79141 - DNA, 25 bp, Rattus norvegicus
acatcatagctccatgtcggtggtt

SEQ ID NO: 79142 - DNA, 25 bp, Rattus norvegicus
acatcatagctcgatgtcggtggtt

SEQ ID NO: 79143 - DNA, 25 bp, Rattus norvegicus
acatcatattcaccccatcacgctg

SEQ ID NO: 79144 - DNA, 25 bp, Rattus norvegicus
acatcatattcagcccatcacgctg

SEQ ID NO: 79145 - DNA, 25 bp, Rattus norvegicus
acatcatcaactccatcttgtgacc

SEQ ID NO: 79146 - DNA, 25 bp, Rattus norvegicus
acatcatcaactgcatcttgtgacc

SEQ ID NO: 79147 - DNA, 25 bp, Rattus norvegicus
acatcatcactgaccttagactgga

SEQ ID NO: 79148 - DNA, 25 bp, Rattus norvegicus
acatcatcactgtccttagactgga

SEQ ID NO: 79149 - DNA, 25 bp, Rattus norvegicus
acatcatcatcaatcgctttaaagg

SEQ ID NO: 79150 - DNA, 25 bp, Rattus norvegicus
acatcatcatcattcgctttaaagg

SEQ ID NO: 79151 - DNA, 25 bp, Rattus norvegicus
acatcatcattactgggtggtccca

SEQ ID NO: 79152 - DNA, 25 bp, Rattus norvegicus
acatcatcattagtgggtggtccca

SEQ ID NO: 79153 - DNA, 25 bp, Rattus norvegicus
acatcatcccgtctctgtttaaaag

SEQ ID NO: 79154 - DNA, 25 bp, Rattus norvegicus
acatcatcccgtgtctgtttaaaag

SEQ ID NO: 79155 - DNA, 25 bp, Rattus norvegicus
acatcatcctgcctcataatgcaat

SEQ ID NO: 79156 - DNA, 25 bp, Rattus norvegicus
acatcatcctgcgtcataatgcaat

SEQ ID NO: 79157 - DNA, 25 bp, Rattus norvegicus
acatcatctactactccctgaagga

SEQ ID NO: 79158 - DNA, 25 bp, Rattus norvegicus
acatcatctacttctccctgaagga

SEQ ID NO: 79159 - DNA, 25 bp, Rattus norvegicus
acatcatctgtgattacagtcactg

SEQ ID NO: 79160 - DNA, 25 bp, Rattus norvegicus
acatcatctgtgtttacagtcactg

SEQ ID NO: 79161 - DNA, 25 bp, Rattus norvegicus
acatcatgaaccattctttcctgtg

SEQ ID NO: 79162 - DNA, 25 bp, Rattus norvegicus
acatcatgaacctttctttcctgtg

SEQ ID NO: 79163 - DNA, 25 bp, Rattus norvegicus
acatcatgaagacagcagccgtgca

SEQ ID NO: 79164 - DNA, 25 bp, Rattus norvegicus
acatcatgaagagagcagccgtgca

SEQ ID NO: 79165 - DNA, 25 bp, Rattus norvegicus
acatcatgccgaattgtctaccaag

SEQ ID NO: 79166 - DNA, 25 bp, Rattus norvegicus
acatcatgccgatttgtctaccaag

SEQ ID NO: 79167 - DNA, 25 bp, Rattus norvegicus
acatcatgctctcaatcatttcacg

SEQ ID NO: 79168 - DNA, 25 bp, Rattus norvegicus
acatcatgctctgaatcatttcacg

SEQ ID NO: 79169 - DNA, 25 bp, Rattus norvegicus
acatcatgcttgagcagcgccagat

SEQ ID NO: 79170 - DNA, 25 bp, Rattus norvegicus
acatcatgcttgtgcagcgccagat

SEQ ID NO: 79171 - DNA, 25 bp, Rattus norvegicus
acatcatggagtagtagggttcagc

SEQ ID NO: 79172 - DNA, 25 bp, Rattus norvegicus
acatcatggagttgtagggttcagc

SEQ ID NO: 79173 - DNA, 25 bp, Rattus norvegicus
acatcatgggcaacggacctgccta

SEQ ID NO: 79174 - DNA, 25 bp, Rattus norvegicus
acatcatgggcatcggacctgccta

SEQ ID NO: 79175 - DNA, 25 bp, Rattus norvegicus
acatcatggtggctggacaacaaaa

SEQ ID NO: 79176 - DNA, 25 bp, Rattus norvegicus
acatcatggtgggtggacaacaaaa

SEQ ID NO: 79177 - DNA, 25 bp, Rattus norvegicus
acatcatggttcagagtccctggga

SEQ ID NO: 79178 - DNA, 25 bp, Rattus norvegicus
acatcatggttctgagtccctggga

SEQ ID NO: 79179 - DNA, 25 bp, Rattus norvegicus
acatcatgtccaagaagtaccgggt

SEQ ID NO: 79180 - DNA, 25 bp, Rattus norvegicus
acatcatgtccatgaagtaccgggt

SEQ ID NO: 79181 - DNA, 25 bp, Rattus norvegicus
acatcatgtctgatttcctgaggaa

SEQ ID NO: 79182 - DNA, 25 bp, Rattus norvegicus
acatcatgtctgttttcctgaggaa

SEQ ID NO: 79183 - DNA, 25 bp, Rattus norvegicus
acatcattgataaaccccagctctt

SEQ ID NO: 79184 - DNA, 25 bp, Rattus norvegicus
acatcattgatataccccagctctt

SEQ ID NO: 79185 - DNA, 25 bp, Rattus norvegicus
acatcattgcacacggtccataaag

SEQ ID NO: 79186 - DNA, 25 bp, Rattus norvegicus
acatcattgcactcggtccataaag

SEQ ID NO: 79187 - DNA, 25 bp, Rattus norvegicus
acatcattgcctcttcaggaggcca

SEQ ID NO: 79188 - DNA, 25 bp, Rattus norvegicus
acatcattgcctgttcaggaggcca

SEQ ID NO: 79189 - DNA, 25 bp, Rattus norvegicus
acatcattgcttctggcgctaatcc

SEQ ID NO: 79190 - DNA, 25 bp, Rattus norvegicus
acatcattgcttgtggcgctaatcc

SEQ ID NO: 79191 - DNA, 25 bp, Rattus norvegicus
acatcattggataccattacgcttg

SEQ ID NO: 79192 - DNA, 25 bp, Rattus norvegicus
acatcattggattccattacgcttg

SEQ ID NO: 79193 - DNA, 25 bp, Rattus norvegicus
acatcatttcagaacccgctattaa

SEQ ID NO: 79194 - DNA, 25 bp, Rattus norvegicus
acatcatttcagtacccgctattaa

SEQ ID NO: 79195 - DNA, 25 bp, Rattus norvegicus
acatcatttccaactcacatatctt

SEQ ID NO: 79196 - DNA, 25 bp, Rattus norvegicus
acatcatttccatctcacatatctt

SEQ ID NO: 79197 - DNA, 25 bp, Rattus norvegicus
acatcatttcctcttcttggttgtg

SEQ ID NO: 79198 - DNA, 25 bp, Rattus norvegicus
acatcatttcctgttcttggttgtg

SEQ ID NO: 79199 - DNA, 25 bp, Rattus norvegicus
acatcattttagattgagcactctt

SEQ ID NO: 79200 - DNA, 25 bp, Rattus norvegicus
acatcattttagtttgagcactctt

SEQ ID NO: 79201 - DNA, 25 bp, Rattus norvegicus
acatccaagatcacttttgaaagtt

SEQ ID NO: 79202 - DNA, 25 bp, Rattus norvegicus
acatccaagatctcttttgaaagtt

SEQ ID NO: 79203 - DNA, 25 bp, Rattus norvegicus
acatccaagctgagttctctttcct

SEQ ID NO: 79204 - DNA, 25 bp, Rattus norvegicus
acatccaagctgtgttctctttcct

SEQ ID NO: 79205 - DNA, 25 bp, Rattus norvegicus
acatccacaattccaaccacttaga

SEQ ID NO: 79206 - DNA, 25 bp, Rattus norvegicus
acatccacaattgcaaccacttaga

SEQ ID NO: 79207 - DNA, 25 bp, Rattus norvegicus
acatccacagccactttttcttttt

SEQ ID NO: 79208 - DNA, 25 bp, Rattus norvegicus
acatccacagcctctttttcttttt

SEQ ID NO: 79209 - DNA, 25 bp, Rattus norvegicus
acatccaccctaaagtgcgaagctg

SEQ ID NO: 79210 - DNA, 25 bp, Rattus norvegicus
acatccaccctatagtgcgaagctg

SEQ ID NO: 79211 - DNA, 25 bp, Rattus norvegicus
acatccaccctgaactcagttgaag

SEQ ID NO: 79212 - DNA, 25 bp, Rattus norvegicus
acatccaccctgtactcagttgaag

SEQ ID NO: 79213 - DNA, 25 bp, Rattus norvegicus
acatccacctgcatgtgcctgaggg

SEQ ID NO: 79214 - DNA, 25 bp, Rattus norvegicus
acatccacctgcttgtgcctgaggg

SEQ ID NO: 79215 - DNA, 25 bp, Rattus norvegicus
acatccacgtgtcccatagaggtgc

SEQ ID NO: 79216 - DNA, 25 bp, Rattus norvegicus
acatccacgtgtgccatagaggtgc

SEQ ID NO: 79217 - DNA, 25 bp, Rattus norvegicus
acatccactaaaaactcattcacct

SEQ ID NO: 79218 - DNA, 25 bp, Rattus norvegicus
acatccactaaatactcattcacct

SEQ ID NO: 79219 - DNA, 25 bp, Rattus norvegicus
acatccactgaacgcaggcgctgta

SEQ ID NO: 79220 - DNA, 25 bp, Rattus norvegicus
acatccactgaaggcaggcgctgta

SEQ ID NO: 79221 - DNA, 25 bp, Rattus norvegicus
acatccactttacccatgtgtgact

SEQ ID NO: 79222 - DNA, 25 bp, Rattus norvegicus
acatccactttagccatgtgtgact

SEQ ID NO: 79223 - DNA, 25 bp, Rattus norvegicus
acatccagccctatgaaacttttag

SEQ ID NO: 79224 - DNA, 25 bp, Rattus norvegicus
acatccagccctttgaaacttttag

SEQ ID NO: 79225 - DNA, 25 bp, Rattus norvegicus
acatccagcgtgcagtctcaaaacg

SEQ ID NO: 79226 - DNA, 25 bp, Rattus norvegicus
acatccagcgtggagtctcaaaacg

SEQ ID NO: 79227 - DNA, 25 bp, Rattus norvegicus
acatccagctctactgtttacttat

SEQ ID NO: 79228 - DNA, 25 bp, Rattus norvegicus
acatccagctcttctgtttacttat

SEQ ID NO: 79229 - DNA, 25 bp, Rattus norvegicus
acatccagggacacttcacttgaat

SEQ ID NO: 79230 - DNA, 25 bp, Rattus norvegicus
acatccagggactcttcacttgaat

SEQ ID NO: 79231 - DNA, 25 bp, Rattus norvegicus
acatccagggctccgtcgggcacga

SEQ ID NO: 79232 - DNA, 25 bp, Rattus norvegicus
acatccagggctgcgtcgggcacga

SEQ ID NO: 79233 - DNA, 25 bp, Rattus norvegicus
acatccaggtgtatgagggcgccga

SEQ ID NO: 79234 - DNA, 25 bp, Rattus norvegicus
acatccaggtgtttgagggcgccga

SEQ ID NO: 79235 - DNA, 25 bp, Rattus norvegicus
acatccatcatgaagggctcattag

SEQ ID NO: 79236 - DNA, 25 bp, Rattus norvegicus
acatccatcatgtagggctcattag

SEQ ID NO: 79237 - DNA, 25 bp, Rattus norvegicus
acatccatcccaaaagtgcactgtt

SEQ ID NO: 79238 - DNA, 25 bp, Rattus norvegicus
acatccatcccataagtgcactgtt

SEQ ID NO: 79239 - DNA, 25 bp, Rattus norvegicus
acatccatccggaaggttgggacat

SEQ ID NO: 79240 - DNA, 25 bp, Rattus norvegicus
acatccatccggtaggttgggacat

SEQ ID NO: 79241 - DNA, 25 bp, Rattus norvegicus
acatccatcttgaactacctgtgtt

SEQ ID NO: 79242 - DNA, 25 bp, Rattus norvegicus
acatccatcttgtactacctgtgtt

SEQ ID NO: 79243 - DNA, 25 bp, Rattus norvegicus
acatccatgaggaagcagaggacat

SEQ ID NO: 79244 - DNA, 25 bp, Rattus norvegicus
acatccatgaggtagcagaggacat

SEQ ID NO: 79245 - DNA, 25 bp, Rattus norvegicus
acatccatgagtacactaaccctga

SEQ ID NO: 79246 - DNA, 25 bp, Rattus norvegicus
acatccatgagttcactaaccctga

SEQ ID NO: 79247 - DNA, 25 bp, Rattus norvegicus
acatccatgcaccaaggctggctca

SEQ ID NO: 79248 - DNA, 25 bp, Rattus norvegicus
acatccatgcacgaaggctggctca

SEQ ID NO: 79249 - DNA, 25 bp, Rattus norvegicus
acatccatggacatcagccctaagg

SEQ ID NO: 79250 - DNA, 25 bp, Rattus norvegicus
acatccatggacttcagccctaagg

SEQ ID NO: 79251 - DNA, 25 bp, Rattus norvegicus
acatccatggccattatttgctttg

SEQ ID NO: 79252 - DNA, 25 bp, Rattus norvegicus
acatccatggcctttatttgctttg

SEQ ID NO: 79253 - DNA, 25 bp, Rattus norvegicus
acatccatggctcgctacattaaat

SEQ ID NO: 79254 - DNA, 25 bp, Rattus norvegicus
acatccatggctggctacattaaat

SEQ ID NO: 79255 - DNA, 25 bp, Rattus norvegicus
acatccatgtctaaggcacgtttcg

SEQ ID NO: 79256 - DNA, 25 bp, Rattus norvegicus
acatccatgtcttaggcacgtttcg

SEQ ID NO: 79257 - DNA, 25 bp, Rattus norvegicus
acatccatgtggataaactgtgaag

SEQ ID NO: 79258 - DNA, 25 bp, Rattus norvegicus
acatccatgtggttaaactgtgaag

SEQ ID NO: 79259 - DNA, 25 bp, Rattus norvegicus
acatccatttctctactcgctggga

SEQ ID NO: 79260 - DNA, 25 bp, Rattus norvegicus
acatccatttctgtactcgctggga

SEQ ID NO: 79261 - DNA, 25 bp, Rattus norvegicus
acatcccaagttacccaagcaaata

SEQ ID NO: 79262 - DNA, 25 bp, Rattus norvegicus
acatcccaagtttcccaagcaaata

SEQ ID NO: 79263 - DNA, 25 bp, Rattus norvegicus
acatcccaatgaaaaacgtccccgg

SEQ ID NO: 79264 - DNA, 25 bp, Rattus norvegicus
acatcccaatgataaacgtccccgg

SEQ ID NO: 79265 - DNA, 25 bp, Rattus norvegicus
acatcccaccatccagatgctgaaa

SEQ ID NO: 79266 - DNA, 25 bp, Rattus norvegicus
acatcccaccatgcagatgctgaaa

SEQ ID NO: 79267 - DNA, 25 bp, Rattus norvegicus
acatcccagatcacggacagcaaag

SEQ ID NO: 79268 - DNA, 25 bp, Rattus norvegicus
acatcccagatctcggacagcaaag

SEQ ID NO: 79269 - DNA, 25 bp, Rattus norvegicus
acatcccagggcagggcctctttgg

SEQ ID NO: 79270 - DNA, 25 bp, Rattus norvegicus
acatcccagggctgggcctctttgg

SEQ ID NO: 79271 - DNA, 25 bp, Rattus norvegicus
acatcccatgataattctgccagtt

SEQ ID NO: 79272 - DNA, 25 bp, Rattus norvegicus
acatcccatgattattctgccagtt

SEQ ID NO: 79273 - DNA, 25 bp, Rattus norvegicus
acatcccattaaatttttcctatat

SEQ ID NO: 79274 - DNA, 25 bp, Rattus norvegicus
acatcccattaaccccagtgagaca

SEQ ID NO: 79275 - DNA, 25 bp, Rattus norvegicus
acatcccattaagcccagtgagaca

SEQ ID NO: 79276 - DNA, 25 bp, Rattus norvegicus
acatcccattaattttttcctatat

SEQ ID NO: 79277 - DNA, 25 bp, Rattus norvegicus
acatccccagtaagctctttgttcc

SEQ ID NO: 79278 - DNA, 25 bp, Rattus norvegicus
acatccccagtatgctctttgttcc

SEQ ID NO: 79279 - DNA, 25 bp, Rattus norvegicus
acatccccatggcatagtctgagat

SEQ ID NO: 79280 - DNA, 25 bp, Rattus norvegicus
acatccccatgggatagtctgagat

SEQ ID NO: 79281 - DNA, 25 bp, Rattus norvegicus
acatcccggtgcatgcgggcggcgg

SEQ ID NO: 79282 - DNA, 25 bp, Rattus norvegicus
acatcccggtgcttgcgggcggcgg

SEQ ID NO: 79283 - DNA, 25 bp, Rattus norvegicus
acatcccgtacgctggagagacatt

SEQ ID NO: 79284 - DNA, 25 bp, Rattus norvegicus
acatcccgtacggtggagagacatt

SEQ ID NO: 79285 - DNA, 25 bp, Rattus norvegicus
acatcccgtataccagtgctgtgcg

SEQ ID NO: 79286 - DNA, 25 bp, Rattus norvegicus
acatcccgtatagcagtgctgtgcg

SEQ ID NO: 79287 - DNA, 25 bp, Rattus norvegicus
acatccctaaggatgtgtctggccc

SEQ ID NO: 79288 - DNA, 25 bp, Rattus norvegicus
acatccctaaggttgtgtctggccc

SEQ ID NO: 79289 - DNA, 25 bp, Rattus norvegicus
acatccctcagtatgcccaaagtga

SEQ ID NO: 79290 - DNA, 25 bp, Rattus norvegicus
acatccctcagtttgcccaaagtga

SEQ ID NO: 79291 - DNA, 25 bp, Rattus norvegicus
acatccctggatactgatacttaag

SEQ ID NO: 79292 - DNA, 25 bp, Rattus norvegicus
acatccctggattctgatacttaag

SEQ ID NO: 79293 - DNA, 25 bp, Rattus norvegicus
acatccctggtaactgctgtgagtg

SEQ ID NO: 79294 - DNA, 25 bp, Rattus norvegicus
acatccctggtatctgctgtgagtg

SEQ ID NO: 79295 - DNA, 25 bp, Rattus norvegicus
acatccctgtctcgtgggtgctggt

SEQ ID NO: 79296 - DNA, 25 bp, Rattus norvegicus
acatccctgtctggtgggtgctggt

SEQ ID NO: 79297 - DNA, 25 bp, Rattus norvegicus
acatccctgtggataatcccatcga

SEQ ID NO: 79298 - DNA, 25 bp, Rattus norvegicus
acatccctgtggttaatcccatcga

SEQ ID NO: 79299 - DNA, 25 bp, Rattus norvegicus
acatccctgtttcgtcttccatata

SEQ ID NO: 79300 - DNA, 25 bp, Rattus norvegicus
acatccctgtttggtcttccatata

SEQ ID NO: 79301 - DNA, 25 bp, Rattus norvegicus
acatcccttcttcggcagggcagca

SEQ ID NO: 79302 - DNA, 25 bp, Rattus norvegicus
acatcccttcttgggcagggcagca

SEQ ID NO: 79303 - DNA, 25 bp, Rattus norvegicus
acatccgacaggcatacaacctaga

SEQ ID NO: 79304 - DNA, 25 bp, Rattus norvegicus
acatccgacagggatacaacctaga

SEQ ID NO: 79305 - DNA, 25 bp, Rattus norvegicus
acatccgaccttatcagaggctttt

SEQ ID NO: 79306 - DNA, 25 bp, Rattus norvegicus
acatccgaccttttcagaggctttt

SEQ ID NO: 79307 - DNA, 25 bp, Rattus norvegicus
acatccgagtccaacagcagtgagg

SEQ ID NO: 79308 - DNA, 25 bp, Rattus norvegicus
acatccgagtcctacagcagtgagg

SEQ ID NO: 79309 - DNA, 25 bp, Rattus norvegicus
acatccgatctcaggagcatgctat

SEQ ID NO: 79310 - DNA, 25 bp, Rattus norvegicus
acatccgatctctggagcatgctat

SEQ ID NO: 79311 - DNA, 25 bp, Rattus norvegicus
acatccgcaagtaccactgtgagtt

SEQ ID NO: 79312 - DNA, 25 bp, Rattus norvegicus
acatccgcaagttccactgtgagtt

SEQ ID NO: 79313 - DNA, 25 bp, Rattus norvegicus
acatccgcgtgcatacgggcgaaaa

SEQ ID NO: 79314 - DNA, 25 bp, Rattus norvegicus
acatccgcgtgcttacgggcgaaaa

SEQ ID NO: 79315 - DNA, 25 bp, Rattus norvegicus
acatccgctacgaggtggacgtgtc

SEQ ID NO: 79316 - DNA, 25 bp, Rattus norvegicus
acatccgctacgtggtggacgtgtc

SEQ ID NO: 79317 - DNA, 25 bp, Rattus norvegicus
acatccgctcccaaagtactgtgag

SEQ ID NO: 79318 - DNA, 25 bp, Rattus norvegicus
acatccgctccctaagtactgtgag

SEQ ID NO: 79319 - DNA, 25 bp, Rattus norvegicus
acatccgctgggagtgcgaggacat

SEQ ID NO: 79320 - DNA, 25 bp, Rattus norvegicus
acatccgctgggtgtgcgaggacat

SEQ ID NO: 79321 - DNA, 25 bp, Rattus norvegicus
acatccgcttccagttttgttgtga

SEQ ID NO: 79322 - DNA, 25 bp, Rattus norvegicus
acatccgcttcctgttttgttgtga

SEQ ID NO: 79323 - DNA, 25 bp, Rattus norvegicus
acatccggaaggctctgtcagaaag

SEQ ID NO: 79324 - DNA, 25 bp, Rattus norvegicus
acatccggaagggtctgtcagaaag

SEQ ID NO: 79325 - DNA, 25 bp, Rattus norvegicus
acatccggcaggaaaggcggcccga

SEQ ID NO: 79326 - DNA, 25 bp, Rattus norvegicus
acatccggcaggtaaggcggcccga

SEQ ID NO: 79327 - DNA, 25 bp, Rattus norvegicus
acatccggcctgcatcagaaaattt

SEQ ID NO: 79328 - DNA, 25 bp, Rattus norvegicus
acatccggcctggatcagaaaattt

SEQ ID NO: 79329 - DNA, 25 bp, Rattus norvegicus
acatccgggacgctcataggcgcga

SEQ ID NO: 79330 - DNA, 25 bp, Rattus norvegicus
acatccgggacggtcataggcgcga

SEQ ID NO: 79331 - DNA, 25 bp, Rattus norvegicus
acatccgggtccacttgtaggagca

SEQ ID NO: 79332 - DNA, 25 bp, Rattus norvegicus
acatccgggtcctcttgtaggagca

SEQ ID NO: 79333 - DNA, 25 bp, Rattus norvegicus
acatccggttacaacacttgcagtg

SEQ ID NO: 79334 - DNA, 25 bp, Rattus norvegicus
acatccggttactacacttgcagtg

SEQ ID NO: 79335 - DNA, 25 bp, Rattus norvegicus
acatccgtaaagacctctatgccaa

SEQ ID NO: 79336 - DNA, 25 bp, Rattus norvegicus
acatccgtaaagtcctctatgccaa

SEQ ID NO: 79337 - DNA, 25 bp, Rattus norvegicus
acatccgtgcctcgtgcctctagag

SEQ ID NO: 79338 - DNA, 25 bp, Rattus norvegicus
acatccgtgcctggtgcctctagag

SEQ ID NO: 79339 - DNA, 25 bp, Rattus norvegicus
acatccgtggagctctctttacatt

SEQ ID NO: 79340 - DNA, 25 bp, Rattus norvegicus
acatccgtggaggtctctttacatt

SEQ ID NO: 79341 - DNA, 25 bp, Rattus norvegicus
acatccgtgtgtaccattcgcattt

SEQ ID NO: 79342 - DNA, 25 bp, Rattus norvegicus
acatccgtgtgttccattcgcattt

SEQ ID NO: 79343 - DNA, 25 bp, Rattus norvegicus
acatcctacccacctatttattaat

SEQ ID NO: 79344 - DNA, 25 bp, Rattus norvegicus
acatcctacccagctatttattaat

SEQ ID NO: 79345 - DNA, 25 bp, Rattus norvegicus
acatcctactggacagacttctgga

SEQ ID NO: 79346 - DNA, 25 bp, Rattus norvegicus
acatcctactggtcagacttctgga

SEQ ID NO: 79347 - DNA, 25 bp, Rattus norvegicus
acatcctagatgatgcacggcagct

SEQ ID NO: 79348 - DNA, 25 bp, Rattus norvegicus
acatcctagatgttgcacggcagct

SEQ ID NO: 79349 - DNA, 25 bp, Rattus norvegicus
acatcctagcccagctgctgcaaat

SEQ ID NO: 79350 - DNA, 25 bp, Rattus norvegicus
acatcctagccctgctgctgcaaat

SEQ ID NO: 79351 - DNA, 25 bp, Rattus norvegicus
acatcctagctacagggccgctgat

SEQ ID NO: 79352 - DNA, 25 bp, Rattus norvegicus
acatcctagctagagggccgctgat

SEQ ID NO: 79353 - DNA, 25 bp, Rattus norvegicus
acatcctcactcctgttaaccggaa

SEQ ID NO: 79354 - DNA, 25 bp, Rattus norvegicus
acatcctcactcgtgttaaccggaa

SEQ ID NO: 79355 - DNA, 25 bp, Rattus norvegicus
acatcctcagagacagttattattg

SEQ ID NO: 79356 - DNA, 25 bp, Rattus norvegicus
acatcctcagagtcagttattattg

SEQ ID NO: 79357 - DNA, 25 bp, Rattus norvegicus
acatcctcgacaaacattctctctg

SEQ ID NO: 79358 - DNA, 25 bp, Rattus norvegicus
acatcctcgacatacattctctctg

SEQ ID NO: 79359 - DNA, 25 bp, Rattus norvegicus
acatcctcgtcaccgagtttgggaa

SEQ ID NO: 79360 - DNA, 25 bp, Rattus norvegicus
acatcctcgtcagcgagtttgggaa

SEQ ID NO: 79361 - DNA, 25 bp, Rattus norvegicus
acatcctctcctcgctatttgaaag

SEQ ID NO: 79362 - DNA, 25 bp, Rattus norvegicus
acatcctctcctggctatttgaaag

SEQ ID NO: 79363 - DNA, 25 bp, Rattus norvegicus
acatcctctgaacatcctgtaacct

SEQ ID NO: 79364 - DNA, 25 bp, Rattus norvegicus
acatcctctgaagatcctgtaacct

SEQ ID NO: 79365 - DNA, 25 bp, Rattus norvegicus
acatcctcttccacaaagaaggctc

SEQ ID NO: 79366 - DNA, 25 bp, Rattus norvegicus
acatcctcttcctcaaagaaggctc

SEQ ID NO: 79367 - DNA, 25 bp, Rattus norvegicus
acatcctcttggattatcagatatg

SEQ ID NO: 79368 - DNA, 25 bp, Rattus norvegicus
acatcctcttggtttatcagatatg

SEQ ID NO: 79369 - DNA, 25 bp, Rattus norvegicus
acatcctcttgtcggttgttggttt

SEQ ID NO: 79370 - DNA, 25 bp, Rattus norvegicus
acatcctcttgtgggttgttggttt

SEQ ID NO: 79371 - DNA, 25 bp, Rattus norvegicus
acatcctgatgtctgtggacggcgc

SEQ ID NO: 79372 - DNA, 25 bp, Rattus norvegicus
acatcctgatgtgtgtggacggcgc

SEQ ID NO: 79373 - DNA, 25 bp, Rattus norvegicus
acatcctgcagaacctcaagcgcag

SEQ ID NO: 79374 - DNA, 25 bp, Rattus norvegicus
acatcctgcagatcctcaagcgcag

SEQ ID NO: 79375 - DNA, 25 bp, Rattus norvegicus
acatcctgcagtcgtgattcgacaa

SEQ ID NO: 79376 - DNA, 25 bp, Rattus norvegicus
acatcctgcagtggtgattcgacaa

SEQ ID NO: 79377 - DNA, 25 bp, Rattus norvegicus
acatcctgcatgagtccctgggaca

SEQ ID NO: 79378 - DNA, 25 bp, Rattus norvegicus
acatcctgcatgtgtccctgggaca

SEQ ID NO: 79379 - DNA, 25 bp, Rattus norvegicus
acatcctgccttccttggttgccaa

SEQ ID NO: 79380 - DNA, 25 bp, Rattus norvegicus
acatcctgccttgcttggttgccaa

SEQ ID NO: 79381 - DNA, 25 bp, Rattus norvegicus
acatcctgcgtaaagtacctgtagt

SEQ ID NO: 79382 - DNA, 25 bp, Rattus norvegicus
acatcctgcgtatagtacctgtagt

SEQ ID NO: 79383 - DNA, 25 bp, Rattus norvegicus
acatcctggcagatctcgggtttgg

SEQ ID NO: 79384 - DNA, 25 bp, Rattus norvegicus
acatcctggcagttctcgggtttgg

SEQ ID NO: 79385 - DNA, 25 bp, Rattus norvegicus
acatcctggcttacctaaggcaaga

SEQ ID NO: 79386 - DNA, 25 bp, Rattus norvegicus
acatcctggctttcctaaggcaaga

SEQ ID NO: 79387 - DNA, 25 bp, Rattus norvegicus
acatcctgggagaatctgacaccat

SEQ ID NO: 79388 - DNA, 25 bp, Rattus norvegicus
acatcctgggagtatctgacaccat

SEQ ID NO: 79389 - DNA, 25 bp, Rattus norvegicus
acatcctgtacaaaccagttctctc

SEQ ID NO: 79390 - DNA, 25 bp, Rattus norvegicus
acatcctgtacataccagttctctc

SEQ ID NO: 79391 - DNA, 25 bp, Rattus norvegicus
acatcctgtattctgtggcaagatc

SEQ ID NO: 79392 - DNA, 25 bp, Rattus norvegicus
acatcctgtattgtgtggcaagatc

SEQ ID NO: 79393 - DNA, 25 bp, Rattus norvegicus
acatcctgtggtactgtgggatcca

SEQ ID NO: 79394 - DNA, 25 bp, Rattus norvegicus
acatcctgtggttctgtgggatcca

SEQ ID NO: 79395 - DNA, 25 bp, Rattus norvegicus
acatcctgtgtcagtcactgcctaa

SEQ ID NO: 79396 - DNA, 25 bp, Rattus norvegicus
acatcctgtgtctgtcactgcctaa

SEQ ID NO: 79397 - DNA, 25 bp, Rattus norvegicus
acatcctgtttgagcctcagcgtga

SEQ ID NO: 79398 - DNA, 25 bp, Rattus norvegicus
acatcctgtttgtgcctcagcgtga

SEQ ID NO: 79399 - DNA, 25 bp, Rattus norvegicus
acatccttagctagcacatgggtga

SEQ ID NO: 79400 - DNA, 25 bp, Rattus norvegicus
acatccttagcttgcacatgggtga

SEQ ID NO: 79401 - DNA, 25 bp, Rattus norvegicus
acatccttcaatagttgtattacta

SEQ ID NO: 79402 - DNA, 25 bp, Rattus norvegicus
acatccttcaattgttgtattacta

SEQ ID NO: 79403 - DNA, 25 bp, Rattus norvegicus
acatccttcagtacttgtctctggt

SEQ ID NO: 79404 - DNA, 25 bp, Rattus norvegicus
acatccttcagttcttgtctctggt

SEQ ID NO: 79405 - DNA, 25 bp, Rattus norvegicus
acatccttcatacagttggctacag

SEQ ID NO: 79406 - DNA, 25 bp, Rattus norvegicus
acatccttcatagagttggctacag

SEQ ID NO: 79407 - DNA, 25 bp, Rattus norvegicus
acatccttcgtcatcgaggaacaga

SEQ ID NO: 79408 - DNA, 25 bp, Rattus norvegicus
acatccttcgtcttcgaggaacaga

SEQ ID NO: 79409 - DNA, 25 bp, Rattus norvegicus
acatccttctggcttttggtgggct

SEQ ID NO: 79410 - DNA, 25 bp, Rattus norvegicus
acatccttctgggttttggtgggct

SEQ ID NO: 79411 - DNA, 25 bp, Rattus norvegicus
acatccttctttcttgctggtgtat

SEQ ID NO: 79412 - DNA, 25 bp, Rattus norvegicus
acatccttctttgttgctggtgtat

SEQ ID NO: 79413 - DNA, 25 bp, Rattus norvegicus
acatccttgagccttacgtgaaggg

SEQ ID NO: 79414 - DNA, 25 bp, Rattus norvegicus
acatccttgagcgttacgtgaaggg

SEQ ID NO: 79415 - DNA, 25 bp, Rattus norvegicus
acatccttgggtagagtgtttcatt

SEQ ID NO: 79416 - DNA, 25 bp, Rattus norvegicus
acatccttgggttgagtgtttcatt

SEQ ID NO: 79417 - DNA, 25 bp, Rattus norvegicus
acatccttggtgacccagggaggaa

SEQ ID NO: 79418 - DNA, 25 bp, Rattus norvegicus
acatccttggtgtcccagggaggaa

SEQ ID NO: 79419 - DNA, 25 bp, Rattus norvegicus
acatcctttacaagttgggtctgtt

SEQ ID NO: 79420 - DNA, 25 bp, Rattus norvegicus
acatcctttacatgttgggtctgtt

SEQ ID NO: 79421 - DNA, 25 bp, Rattus norvegicus
acatcctttagtcggttccacttgg

SEQ ID NO: 79422 - DNA, 25 bp, Rattus norvegicus
acatcctttagtgggttccacttgg

SEQ ID NO: 79423 - DNA, 25 bp, Rattus norvegicus
acatcctttgaaattgtgcttgatt

SEQ ID NO: 79424 - DNA, 25 bp, Rattus norvegicus
acatcctttgaatttgtgcttgatt

SEQ ID NO: 79425 - DNA, 25 bp, Rattus norvegicus
acatcctttggccagttactctcta

SEQ ID NO: 79426 - DNA, 25 bp, Rattus norvegicus
acatcctttggcgagttactctcta

SEQ ID NO: 79427 - DNA, 25 bp, Rattus norvegicus
acatcctttgtcacaatgttctttt

SEQ ID NO: 79428 - DNA, 25 bp, Rattus norvegicus
acatcctttgtctcaatgttctttt

SEQ ID NO: 79429 - DNA, 25 bp, Rattus norvegicus
acatcctttgtgaaccagggctgca

SEQ ID NO: 79430 - DNA, 25 bp, Rattus norvegicus
acatcctttgtgtaccagggctgca

SEQ ID NO: 79431 - DNA, 25 bp, Rattus norvegicus
acatccttttggctcctatgaagta

SEQ ID NO: 79432 - DNA, 25 bp, Rattus norvegicus
acatccttttgggtcctatgaagta

SEQ ID NO: 79433 - DNA, 25 bp, Rattus norvegicus
acatcgaagtgaatccagcgttgct

SEQ ID NO: 79434 - DNA, 25 bp, Rattus norvegicus
acatcgaagtgattccagcgttgct

SEQ ID NO: 79435 - DNA, 25 bp, Rattus norvegicus
acatcgacagccctggaattcacaa

SEQ ID NO: 79436 - DNA, 25 bp, Rattus norvegicus
acatcgacagccgtggaattcacaa

SEQ ID NO: 79437 - DNA, 25 bp, Rattus norvegicus
acatcgaccgagcaaacttcaacaa

SEQ ID NO: 79438 - DNA, 25 bp, Rattus norvegicus
acatcgaccgaggaaacttcaacaa

SEQ ID NO: 79439 - DNA, 25 bp, Rattus norvegicus
acatcgacgcatccacacgggtgaa

SEQ ID NO: 79440 - DNA, 25 bp, Rattus norvegicus
acatcgacgcatgcacacgggtgaa

SEQ ID NO: 79441 - DNA, 25 bp, Rattus norvegicus
acatcgacgtgacctgtaatgtcta

SEQ ID NO: 79442 - DNA, 25 bp, Rattus norvegicus
acatcgacgtgagctgtaatgtcta

SEQ ID NO: 79443 - DNA, 25 bp, Rattus norvegicus
acatcgagagctctctgtgccaggg

SEQ ID NO: 79444 - DNA, 25 bp, Rattus norvegicus
acatcgagagctgtctgtgccaggg

SEQ ID NO: 79445 - DNA, 25 bp, Rattus norvegicus
acatcgagctggcttgggccttctc

SEQ ID NO: 79446 - DNA, 25 bp, Rattus norvegicus
acatcgagctgggttgggccttctc

SEQ ID NO: 79447 - DNA, 25 bp, Rattus norvegicus
acatcgagtcggacgcctggcagga

SEQ ID NO: 79448 - DNA, 25 bp, Rattus norvegicus
acatcgagtcggtcgcctggcagga

SEQ ID NO: 79449 - DNA, 25 bp, Rattus norvegicus
acatcgagtcgtagtgcacaggaga

SEQ ID NO: 79450 - DNA, 25 bp, Rattus norvegicus
acatcgagtcgttgtgcacaggaga

SEQ ID NO: 79451 - DNA, 25 bp, Rattus norvegicus
acatcgagtttgaggccgacaggct

SEQ ID NO: 79452 - DNA, 25 bp, Rattus norvegicus
acatcgagtttgtggccgacaggct

SEQ ID NO: 79453 - DNA, 25 bp, Rattus norvegicus
acatcgatttttcaaagcgctttta

SEQ ID NO: 79454 - DNA, 25 bp, Rattus norvegicus
acatcgatttttgaaagcgctttta

SEQ ID NO: 79455 - DNA, 25 bp, Rattus norvegicus
acatcgcaagtcattcgcattacaa

SEQ ID NO: 79456 - DNA, 25 bp, Rattus norvegicus
acatcgcaagtctttcgcattacaa

SEQ ID NO: 79457 - DNA, 25 bp, Rattus norvegicus
acatcgcagacaagggaggcctcaa

SEQ ID NO: 79458 - DNA, 25 bp, Rattus norvegicus
acatcgcagacatgggaggcctcaa

SEQ ID NO: 79459 - DNA, 25 bp, Rattus norvegicus
acatcgcagtgcacgtggtcccgga

SEQ ID NO: 79460 - DNA, 25 bp, Rattus norvegicus
acatcgcagtgctcgtggtcccgga

SEQ ID NO: 79461 - DNA, 25 bp, Rattus norvegicus
acatcgcatgcgcacagagaccaaa

SEQ ID NO: 79462 - DNA, 25 bp, Rattus norvegicus
acatcgcatgcggacagagaccaaa

SEQ ID NO: 79463 - DNA, 25 bp, Rattus norvegicus
acatcgccaacaattctggagggca

SEQ ID NO: 79464 - DNA, 25 bp, Rattus norvegicus
acatcgccaacatttctggagggca

SEQ ID NO: 79465 - DNA, 25 bp, Rattus norvegicus
acatcgccccaaagcaagcaggaag

SEQ ID NO: 79466 - DNA, 25 bp, Rattus norvegicus
acatcgccccaatgcaagcaggaag

SEQ ID NO: 79467 - DNA, 25 bp, Rattus norvegicus
acatcgccttggacacttgggtgcg

SEQ ID NO: 79468 - DNA, 25 bp, Rattus norvegicus
acatcgccttggtcacttgggtgcg

SEQ ID NO: 79469 - DNA, 25 bp, Rattus norvegicus
acatcgcgggatcgcggcgccgagg

SEQ ID NO: 79470 - DNA, 25 bp, Rattus norvegicus
acatcgcgggatggcggcgccgagg

SEQ ID NO: 79471 - DNA, 25 bp, Rattus norvegicus
acatcgcggtgcaagtgttgctctt

SEQ ID NO: 79472 - DNA, 25 bp, Rattus norvegicus
acatcgcggtgctagtgttgctctt

SEQ ID NO: 79473 - DNA, 25 bp, Rattus norvegicus
acatcgctagcaacgtgatggccaa

SEQ ID NO: 79474 - DNA, 25 bp, Rattus norvegicus
acatcgctagcatcgtgatggccaa

SEQ ID NO: 79475 - DNA, 25 bp, Rattus norvegicus
acatcgctcacaaaatctcaggctt

SEQ ID NO: 79476 - DNA, 25 bp, Rattus norvegicus
acatcgctcacaatgttgccgactg

SEQ ID NO: 79477 - DNA, 25 bp, Rattus norvegicus
acatcgctcacataatctcaggctt

SEQ ID NO: 79478 - DNA, 25 bp, Rattus norvegicus
acatcgctcacattgttgccgactg

SEQ ID NO: 79479 - DNA, 25 bp, Rattus norvegicus
acatcgctctgcactagggtctgtt

SEQ ID NO: 79480 - DNA, 25 bp, Rattus norvegicus
acatcgctctgctctagggtctgtt

SEQ ID NO: 79481 - DNA, 25 bp, Rattus norvegicus
acatcgctgaggaggctgaccggaa

SEQ ID NO: 79482 - DNA, 25 bp, Rattus norvegicus
acatcgctgaggtggctgaccggaa

SEQ ID NO: 79483 - DNA, 25 bp, Rattus norvegicus
acatcggaaccaacgttaggcattt

SEQ ID NO: 79484 - DNA, 25 bp, Rattus norvegicus
acatcggaaccatcgttaggcattt

SEQ ID NO: 79485 - DNA, 25 bp, Rattus norvegicus
acatcggaagtcattagcttgttta

SEQ ID NO: 79486 - DNA, 25 bp, Rattus norvegicus
acatcggaagtctttagcttgttta

SEQ ID NO: 79487 - DNA, 25 bp, Rattus norvegicus
acatcggcccggcagacaaagaccg

SEQ ID NO: 79488 - DNA, 25 bp, Rattus norvegicus
acatcggcccgggagacaaagaccg

SEQ ID NO: 79489 - DNA, 25 bp, Rattus norvegicus
acatcggctgcccttattttaaaga

SEQ ID NO: 79490 - DNA, 25 bp, Rattus norvegicus
acatcggctgccgttattttaaaga

SEQ ID NO: 79491 - DNA, 25 bp, Rattus norvegicus
acatcgggaggccttctatcagaag

SEQ ID NO: 79492 - DNA, 25 bp, Rattus norvegicus
acatcgggaggcgttctatcagaag

SEQ ID NO: 79493 - DNA, 25 bp, Rattus norvegicus
acatcgggtgtcacatttggtggga

SEQ ID NO: 79494 - DNA, 25 bp, Rattus norvegicus
acatcgggtgtctcatttggtggga

SEQ ID NO: 79495 - DNA, 25 bp, Rattus norvegicus
acatcggtcctcagattcgaatcat

SEQ ID NO: 79496 - DNA, 25 bp, Rattus norvegicus
acatcggtcctctgattcgaatcat

SEQ ID NO: 79497 - DNA, 25 bp, Rattus norvegicus
acatcggtctgtcttctgggtgtga

SEQ ID NO: 79498 - DNA, 25 bp, Rattus norvegicus
acatcggtctgtgttctgggtgtga

SEQ ID NO: 79499 - DNA, 25 bp, Rattus norvegicus
acatcggtgaaaaggctgcctgcaa

SEQ ID NO: 79500 - DNA, 25 bp, Rattus norvegicus
acatcggtgaaatggctgcctgcaa

SEQ ID NO: 79501 - DNA, 25 bp, Rattus norvegicus
acatcggtgcgtatggcagacttca

SEQ ID NO: 79502 - DNA, 25 bp, Rattus norvegicus
acatcggtgcgtttggcagacttca

SEQ ID NO: 79503 - DNA, 25 bp, Rattus norvegicus
acatcggtgtgcctgtgctcatacg

SEQ ID NO: 79504 - DNA, 25 bp, Rattus norvegicus
acatcggtgtgcgtgtgctcatacg

SEQ ID NO: 79505 - DNA, 25 bp, Rattus norvegicus
acatcggttaggagccaggaacacc

SEQ ID NO: 79506 - DNA, 25 bp, Rattus norvegicus
acatcggttaggtgccaggaacacc

SEQ ID NO: 79507 - DNA, 25 bp, Rattus norvegicus
acatcgtaatttaaggagttgcctt

SEQ ID NO: 79508 - DNA, 25 bp, Rattus norvegicus
acatcgtaattttaggagttgcctt

SEQ ID NO: 79509 - DNA, 25 bp, Rattus norvegicus
acatcgtactatctccaaagaggag

SEQ ID NO: 79510 - DNA, 25 bp, Rattus norvegicus
acatcgtactatgtccaaagaggag

SEQ ID NO: 79511 - DNA, 25 bp, Rattus norvegicus
acatcgtagccacggaccaggtcga

SEQ ID NO: 79512 - DNA, 25 bp, Rattus norvegicus
acatcgtagccagggaccaggtcga

SEQ ID NO: 79513 - DNA, 25 bp, Rattus norvegicus
acatcgtcagggagtctgctttgta

SEQ ID NO: 79514 - DNA, 25 bp, Rattus norvegicus
acatcgtcagggtgtctgctttgta

SEQ ID NO: 79515 - DNA, 25 bp, Rattus norvegicus
acatcgtcgcttctccgggcagcag

SEQ ID NO: 79516 - DNA, 25 bp, Rattus norvegicus
acatcgtcgcttctttttcattcaa

SEQ ID NO: 79517 - DNA, 25 bp, Rattus norvegicus
acatcgtcgcttgtccgggcagcag

SEQ ID NO: 79518 - DNA, 25 bp, Rattus norvegicus
acatcgtcgcttgtttttcattcaa

SEQ ID NO: 79519 - DNA, 25 bp, Rattus norvegicus
acatcgtgctatactgttttgccag

SEQ ID NO: 79520 - DNA, 25 bp, Rattus norvegicus
acatcgtgctattctgttttgccag

SEQ ID NO: 79521 - DNA, 25 bp, Rattus norvegicus
acatcgtgctcactggcagtggcaa

SEQ ID NO: 79522 - DNA, 25 bp, Rattus norvegicus
acatcgtgctcagtggcagtggcaa

SEQ ID NO: 79523 - DNA, 25 bp, Rattus norvegicus
acatcgtgggcaagtcaggcaggat

SEQ ID NO: 79524 - DNA, 25 bp, Rattus norvegicus
acatcgtgggcaatcggactcctga

SEQ ID NO: 79525 - DNA, 25 bp, Rattus norvegicus
acatcgtgggcatgtcaggcaggat

SEQ ID NO: 79526 - DNA, 25 bp, Rattus norvegicus
acatcgtgggcattcggactcctga

SEQ ID NO: 79527 - DNA, 25 bp, Rattus norvegicus
acatcgttatttacactcacctgtg

SEQ ID NO: 79528 - DNA, 25 bp, Rattus norvegicus
acatcgttattttcactcacctgtg

SEQ ID NO: 79529 - DNA, 25 bp, Rattus norvegicus
acatcgttcatccttgaggcttagc

SEQ ID NO: 79530 - DNA, 25 bp, Rattus norvegicus
acatcgttcatcgttgaggcttagc

SEQ ID NO: 79531 - DNA, 25 bp, Rattus norvegicus
acatctaacagtaacgccatgcctt

SEQ ID NO: 79532 - DNA, 25 bp, Rattus norvegicus
acatctaacagttacgccatgcctt

SEQ ID NO: 79533 - DNA, 25 bp, Rattus norvegicus
acatctaagcagcacttcggccaga

SEQ ID NO: 79534 - DNA, 25 bp, Rattus norvegicus
acatctaagcaggacttcggccaga

SEQ ID NO: 79535 - DNA, 25 bp, Rattus norvegicus
acatctaagcttactgtccaagacc

SEQ ID NO: 79536 - DNA, 25 bp, Rattus norvegicus
acatctaagctttctgtccaagacc

SEQ ID NO: 79537 - DNA, 25 bp, Rattus norvegicus
acatctaatgacatgtatctctcat

SEQ ID NO: 79538 - DNA, 25 bp, Rattus norvegicus
acatctaatgacttgtatctctcat

SEQ ID NO: 79539 - DNA, 25 bp, Rattus norvegicus
acatctacagtgaccagttctcatt

SEQ ID NO: 79540 - DNA, 25 bp, Rattus norvegicus
acatctacagtgtccagttctcatt

SEQ ID NO: 79541 - DNA, 25 bp, Rattus norvegicus
acatctaccgagctgcaagcagcca

SEQ ID NO: 79542 - DNA, 25 bp, Rattus norvegicus
acatctaccgaggtgcaagcagcca

SEQ ID NO: 79543 - DNA, 25 bp, Rattus norvegicus
acatctactcatacactcggatacc

SEQ ID NO: 79544 - DNA, 25 bp, Rattus norvegicus
acatctactcattcactcggatacc

SEQ ID NO: 79545 - DNA, 25 bp, Rattus norvegicus
acatctactcttacactgctggtgt

SEQ ID NO: 79546 - DNA, 25 bp, Rattus norvegicus
acatctactctttcactgctggtgt

SEQ ID NO: 79547 - DNA, 25 bp, Rattus norvegicus
acatctactgtaatattgctgaata

SEQ ID NO: 79548 - DNA, 25 bp, Rattus norvegicus
acatctactgtattattgctgaata

SEQ ID NO: 79549 - DNA, 25 bp, Rattus norvegicus
acatctactttgatgctttctaaaa

SEQ ID NO: 79550 - DNA, 25 bp, Rattus norvegicus
acatctactttgttgctttctaaaa

SEQ ID NO: 79551 - DNA, 25 bp, Rattus norvegicus
acatctagacgtcagtgctgctgga

SEQ ID NO: 79552 - DNA, 25 bp, Rattus norvegicus
acatctagacgtgagtgctgctgga

SEQ ID NO: 79553 - DNA, 25 bp, Rattus norvegicus
acatctagagtaagtccagtttttt

SEQ ID NO: 79554 - DNA, 25 bp, Rattus norvegicus
acatctagagtatgtccagtttttt

SEQ ID NO: 79555 - DNA, 25 bp, Rattus norvegicus
acatctagctcccacacatggcagg

SEQ ID NO: 79556 - DNA, 25 bp, Rattus norvegicus
acatctagctccgacacatggcagg

SEQ ID NO: 79557 - DNA, 25 bp, Rattus norvegicus
acatctagtgctacaggttggtgct

SEQ ID NO: 79558 - DNA, 25 bp, Rattus norvegicus
acatctagtgcttcaggttggtgct

SEQ ID NO: 79559 - DNA, 25 bp, Rattus norvegicus
acatctataccactcccaagggctg

SEQ ID NO: 79560 - DNA, 25 bp, Rattus norvegicus
acatctataccagtcccaagggctg

SEQ ID NO: 79561 - DNA, 25 bp, Rattus norvegicus
acatctatatcacacacaggcgcat

SEQ ID NO: 79562 - DNA, 25 bp, Rattus norvegicus
acatctatatcagacacaggcgcat

SEQ ID NO: 79563 - DNA, 25 bp, Rattus norvegicus
acatctatcagtatcctgctgttca

SEQ ID NO: 79564 - DNA, 25 bp, Rattus norvegicus
acatctatcagtttcctgctgttca

SEQ ID NO: 79565 - DNA, 25 bp, Rattus norvegicus
acatctatcatgctaccctttgaga

SEQ ID NO: 79566 - DNA, 25 bp, Rattus norvegicus
acatctatcatggtaccctttgaga

SEQ ID NO: 79567 - DNA, 25 bp, Rattus norvegicus
acatctatgactactgtgcccagtt

SEQ ID NO: 79568 - DNA, 25 bp, Rattus norvegicus
acatctatgacttctgtgcccagtt

SEQ ID NO: 79569 - DNA, 25 bp, Rattus norvegicus
acatctatgggcaatgcttcctccg

SEQ ID NO: 79570 - DNA, 25 bp, Rattus norvegicus
acatctatgggcagtgattcccctt

SEQ ID NO: 79571 - DNA, 25 bp, Rattus norvegicus
acatctatgggctatgcttcctccg

SEQ ID NO: 79572 - DNA, 25 bp, Rattus norvegicus
acatctatgggctgtgattcccctt

SEQ ID NO: 79573 - DNA, 25 bp, Rattus norvegicus
acatctatgtccagtagttctgtaa

SEQ ID NO: 79574 - DNA, 25 bp, Rattus norvegicus
acatctatgtcctgtagttctgtaa

SEQ ID NO: 79575 - DNA, 25 bp, Rattus norvegicus
acatctattatgcaacctggaccag

SEQ ID NO: 79576 - DNA, 25 bp, Rattus norvegicus
acatctattatggaacctggaccag

SEQ ID NO: 79577 - DNA, 25 bp, Rattus norvegicus
acatctattgttcctttctctgcca

SEQ ID NO: 79578 - DNA, 25 bp, Rattus norvegicus
acatctattgttgctttctctgcca

SEQ ID NO: 79579 - DNA, 25 bp, Rattus norvegicus
acatctcaagcacacttctcattta

SEQ ID NO: 79580 - DNA, 25 bp, Rattus norvegicus
acatctcaagcagacttctcattta

SEQ ID NO: 79581 - DNA, 25 bp, Rattus norvegicus
acatctcaagtcatccgtgtagcag

SEQ ID NO: 79582 - DNA, 25 bp, Rattus norvegicus
acatctcaagtcttccgtgtagcag

SEQ ID NO: 79583 - DNA, 25 bp, Rattus norvegicus
acatctcactttagtctctttcgtt

SEQ ID NO: 79584 - DNA, 25 bp, Rattus norvegicus
acatctcacttttgtctctttcgtt

SEQ ID NO: 79585 - DNA, 25 bp, Rattus norvegicus
acatctcagctgatttgtcaaggga

SEQ ID NO: 79586 - DNA, 25 bp, Rattus norvegicus
acatctcagctgttttgtcaaggga

SEQ ID NO: 79587 - DNA, 25 bp, Rattus norvegicus
acatctcaggatctacgtgtacgca

SEQ ID NO: 79588 - DNA, 25 bp, Rattus norvegicus
acatctcaggatgtacgtgtacgca

SEQ ID NO: 79589 - DNA, 25 bp, Rattus norvegicus
acatctcagtgaatacttctccttg

SEQ ID NO: 79590 - DNA, 25 bp, Rattus norvegicus
acatctcagtgattacttctccttg

SEQ ID NO: 79591 - DNA, 25 bp, Rattus norvegicus
acatctcagtgtaacagactcctgc

SEQ ID NO: 79592 - DNA, 25 bp, Rattus norvegicus
acatctcagtgttacagactcctgc

SEQ ID NO: 79593 - DNA, 25 bp, Rattus norvegicus
acatctcagttcaagaaggccaatg

SEQ ID NO: 79594 - DNA, 25 bp, Rattus norvegicus
acatctcagttctagaaggccaatg

SEQ ID NO: 79595 - DNA, 25 bp, Rattus norvegicus
acatctcatccaaccttgcaggaga

SEQ ID NO: 79596 - DNA, 25 bp, Rattus norvegicus
acatctcatccatccttgcaggaga

SEQ ID NO: 79597 - DNA, 25 bp, Rattus norvegicus
acatctcatgatatcactctgggca

SEQ ID NO: 79598 - DNA, 25 bp, Rattus norvegicus
acatctcatgatttcactctgggca

SEQ ID NO: 79599 - DNA, 25 bp, Rattus norvegicus
acatctcatgtaatagctatcctta

SEQ ID NO: 79600 - DNA, 25 bp, Rattus norvegicus
acatctcatgtattagctatcctta

SEQ ID NO: 79601 - DNA, 25 bp, Rattus norvegicus
acatctcatttaaatcagcagtcct

SEQ ID NO: 79602 - DNA, 25 bp, Rattus norvegicus
acatctcatttatatcagcagtcct

SEQ ID NO: 79603 - DNA, 25 bp, Rattus norvegicus
acatctccatgaattaagcgtgctg

SEQ ID NO: 79604 - DNA, 25 bp, Rattus norvegicus
acatctccatgatttaagcgtgctg

SEQ ID NO: 79605 - DNA, 25 bp, Rattus norvegicus
acatctccatgtctggccaagattt

SEQ ID NO: 79606 - DNA, 25 bp, Rattus norvegicus
acatctccatgtgtggccaagattt

SEQ ID NO: 79607 - DNA, 25 bp, Rattus norvegicus
acatctcccaaacacagggttctta

SEQ ID NO: 79608 - DNA, 25 bp, Rattus norvegicus
acatctcccaaagacagggttctta

SEQ ID NO: 79609 - DNA, 25 bp, Rattus norvegicus
acatctcccatcactgtcgagatga

SEQ ID NO: 79610 - DNA, 25 bp, Rattus norvegicus
acatctcccatctctgtcgagatga

SEQ ID NO: 79611 - DNA, 25 bp, Rattus norvegicus
acatctcccgcaacaaggagcaggg

SEQ ID NO: 79612 - DNA, 25 bp, Rattus norvegicus
acatctcccgcatcaaggagcaggg

SEQ ID NO: 79613 - DNA, 25 bp, Rattus norvegicus
acatctccgctgacaacaagtggga

SEQ ID NO: 79614 - DNA, 25 bp, Rattus norvegicus
acatctccgctgtcaacaagtggga

SEQ ID NO: 79615 - DNA, 25 bp, Rattus norvegicus
acatctccgtgtcatggtacgtcat

SEQ ID NO: 79616 - DNA, 25 bp, Rattus norvegicus
acatctccgtgtcttctgtgaggtc

SEQ ID NO: 79617 - DNA, 25 bp, Rattus norvegicus
acatctccgtgtgatggtacgtcat

SEQ ID NO: 79618 - DNA, 25 bp, Rattus norvegicus
acatctccgtgtgttctgtgaggtc

SEQ ID NO: 79619 - DNA, 25 bp, Rattus norvegicus
acatctcctccacggaagggaccaa

SEQ ID NO: 79620 - DNA, 25 bp, Rattus norvegicus
acatctcctccagggaagggaccaa

SEQ ID NO: 79621 - DNA, 25 bp, Rattus norvegicus
acatctcctggaccgaagctataca

SEQ ID NO: 79622 - DNA, 25 bp, Rattus norvegicus
acatctcctggagcgaagctataca

SEQ ID NO: 79623 - DNA, 25 bp, Rattus norvegicus
acatctcctgttcgttcgtgatcca

SEQ ID NO: 79624 - DNA, 25 bp, Rattus norvegicus
acatctcctgttggttcgtgatcca

SEQ ID NO: 79625 - DNA, 25 bp, Rattus norvegicus
acatctctacatatactctacacag

SEQ ID NO: 79626 - DNA, 25 bp, Rattus norvegicus
acatctctacatttactctacacag

SEQ ID NO: 79627 - DNA, 25 bp, Rattus norvegicus
acatctctagtactcgcagttcata

SEQ ID NO: 79628 - DNA, 25 bp, Rattus norvegicus
acatctctagtagtcgcagttcata

SEQ ID NO: 79629 - DNA, 25 bp, Rattus norvegicus
acatctctatcactgtgccaggttt

SEQ ID NO: 79630 - DNA, 25 bp, Rattus norvegicus
acatctctatcagtgtgccaggttt

SEQ ID NO: 79631 - DNA, 25 bp, Rattus norvegicus
acatctctcattctcaataactggg

SEQ ID NO: 79632 - DNA, 25 bp, Rattus norvegicus
acatctctcattgtcaataactggg

SEQ ID NO: 79633 - DNA, 25 bp, Rattus norvegicus
acatctctctcaagaccggaaatca

SEQ ID NO: 79634 - DNA, 25 bp, Rattus norvegicus
acatctctctcatgaccggaaatca

SEQ ID NO: 79635 - DNA, 25 bp, Rattus norvegicus
acatctctggaaacgactgtcccaa

SEQ ID NO: 79636 - DNA, 25 bp, Rattus norvegicus
acatctctggaatcgactgtcccaa

SEQ ID NO: 79637 - DNA, 25 bp, Rattus norvegicus
acatctctggagcagcaatacttgg

SEQ ID NO: 79638 - DNA, 25 bp, Rattus norvegicus
acatctctggaggagcaatacttgg

SEQ ID NO: 79639 - DNA, 25 bp, Rattus norvegicus
acatctctggatccaactgggaacc

SEQ ID NO: 79640 - DNA, 25 bp, Rattus norvegicus
acatctctggatgcaactgggaacc

SEQ ID NO: 79641 - DNA, 25 bp, Rattus norvegicus
acatctctggcaatgctcatgttgg

SEQ ID NO: 79642 - DNA, 25 bp, Rattus norvegicus
acatctctggcattgctcatgttgg

SEQ ID NO: 79643 - DNA, 25 bp, Rattus norvegicus
acatctctggctatagaatactggg

SEQ ID NO: 79644 - DNA, 25 bp, Rattus norvegicus
acatctctggctttagaatactggg

SEQ ID NO: 79645 - DNA, 25 bp, Rattus norvegicus
acatctctggttccggtctggctat

SEQ ID NO: 79646 - DNA, 25 bp, Rattus norvegicus
acatctctggttgcggtctggctat

SEQ ID NO: 79647 - DNA, 25 bp, Rattus norvegicus
acatctctgtgtatccagattttgg

SEQ ID NO: 79648 - DNA, 25 bp, Rattus norvegicus
acatctctgtgtctcgtgtatgcta

SEQ ID NO: 79649 - DNA, 25 bp, Rattus norvegicus
acatctctgtgtgtcgtgtatgcta

SEQ ID NO: 79650 - DNA, 25 bp, Rattus norvegicus
acatctctgtgtttccagattttgg

SEQ ID NO: 79651 - DNA, 25 bp, Rattus norvegicus
acatctctgttcacatgaagatcac

SEQ ID NO: 79652 - DNA, 25 bp, Rattus norvegicus
acatctctgttctcatgaagatcac

SEQ ID NO: 79653 - DNA, 25 bp, Rattus norvegicus
acatctgaactaccatcatctggat

SEQ ID NO: 79654 - DNA, 25 bp, Rattus norvegicus
acatctgaactagcatcatctggat

SEQ ID NO: 79655 - DNA, 25 bp, Rattus norvegicus
acatctgacatcaccaagaactctg

SEQ ID NO: 79656 - DNA, 25 bp, Rattus norvegicus
acatctgacatctccaagaactctg

SEQ ID NO: 79657 - DNA, 25 bp, Rattus norvegicus
acatctgacgctcgtagcagcagca

SEQ ID NO: 79658 - DNA, 25 bp, Rattus norvegicus
acatctgacgctggtagcagcagca

SEQ ID NO: 79659 - DNA, 25 bp, Rattus norvegicus
acatctgactggaagctattcatga

SEQ ID NO: 79660 - DNA, 25 bp, Rattus norvegicus
acatctgactggtagctattcatga

SEQ ID NO: 79661 - DNA, 25 bp, Rattus norvegicus
acatctgatgtcaggttgcctaatg

SEQ ID NO: 79662 - DNA, 25 bp, Rattus norvegicus
acatctgatgtctggttgcctaatg

SEQ ID NO: 79663 - DNA, 25 bp, Rattus norvegicus
acatctgatttgatctctggcgctt

SEQ ID NO: 79664 - DNA, 25 bp, Rattus norvegicus
acatctgatttgttctctggcgctt

SEQ ID NO: 79665 - DNA, 25 bp, Rattus norvegicus
acatctgcatcacacttgttagagg

SEQ ID NO: 79666 - DNA, 25 bp, Rattus norvegicus
acatctgcatcagacttgttagagg

SEQ ID NO: 79667 - DNA, 25 bp, Rattus norvegicus
acatctgcatccagaacctttgtgc

SEQ ID NO: 79668 - DNA, 25 bp, Rattus norvegicus
acatctgcatccagttactctgtgc

SEQ ID NO: 79669 - DNA, 25 bp, Rattus norvegicus
acatctgcatcctgaacctttgtgc

SEQ ID NO: 79670 - DNA, 25 bp, Rattus norvegicus
acatctgcatcctgttactctgtgc

SEQ ID NO: 79671 - DNA, 25 bp, Rattus norvegicus
acatctgcccaaccaagtctaaagg

SEQ ID NO: 79672 - DNA, 25 bp, Rattus norvegicus
acatctgcccaagcaagtctaaagg

SEQ ID NO: 79673 - DNA, 25 bp, Rattus norvegicus
acatctgcccagcttggtgatggcg

SEQ ID NO: 79674 - DNA, 25 bp, Rattus norvegicus
acatctgcccaggttggtgatggcg

SEQ ID NO: 79675 - DNA, 25 bp, Rattus norvegicus
acatctgcccttcaaatttctttgg

SEQ ID NO: 79676 - DNA, 25 bp, Rattus norvegicus
acatctgcccttgaaatttctttgg

SEQ ID NO: 79677 - DNA, 25 bp, Rattus norvegicus
acatctgcctggacatcctcaagga

SEQ ID NO: 79678 - DNA, 25 bp, Rattus norvegicus
acatctgcctggtcatcctcaagga

SEQ ID NO: 79679 - DNA, 25 bp, Rattus norvegicus
acatctgcctgtctgtgtgctgttc

SEQ ID NO: 79680 - DNA, 25 bp, Rattus norvegicus
acatctgcctgtgtgtgtgctgttc

SEQ ID NO: 79681 - DNA, 25 bp, Rattus norvegicus
acatctgccttgactttgacgggaa

SEQ ID NO: 79682 - DNA, 25 bp, Rattus norvegicus
acatctgccttgtctttgacgggaa

SEQ ID NO: 79683 - DNA, 25 bp, Rattus norvegicus
acatctgcctttactgtcctttaag

SEQ ID NO: 79684 - DNA, 25 bp, Rattus norvegicus
acatctgccttttctgtcctttaag

SEQ ID NO: 79685 - DNA, 25 bp, Rattus norvegicus
acatctgctaaactctccatctgct

SEQ ID NO: 79686 - DNA, 25 bp, Rattus norvegicus
acatctgctaaagtctccatctgct

SEQ ID NO: 79687 - DNA, 25 bp, Rattus norvegicus
acatctgctaatcagtgcttctgga

SEQ ID NO: 79688 - DNA, 25 bp, Rattus norvegicus
acatctgctaatgagtgcttctgga

SEQ ID NO: 79689 - DNA, 25 bp, Rattus norvegicus
acatctgctcttatgtcatggtccc

SEQ ID NO: 79690 - DNA, 25 bp, Rattus norvegicus
acatctgctcttttgtcatggtccc

SEQ ID NO: 79691 - DNA, 25 bp, Rattus norvegicus
acatctgctgggaaatgactcctag

SEQ ID NO: 79692 - DNA, 25 bp, Rattus norvegicus
acatctgctgggattacaatcatag

SEQ ID NO: 79693 - DNA, 25 bp, Rattus norvegicus
acatctgctgggtaatgactcctag

SEQ ID NO: 79694 - DNA, 25 bp, Rattus norvegicus
acatctgctgggtttacaatcatag

SEQ ID NO: 79695 - DNA, 25 bp, Rattus norvegicus
acatctgctgtgacttcttatccag

SEQ ID NO: 79696 - DNA, 25 bp, Rattus norvegicus
acatctgctgtgtcttcttatccag

SEQ ID NO: 79697 - DNA, 25 bp, Rattus norvegicus
acatctgctgttctaagtattccca

SEQ ID NO: 79698 - DNA, 25 bp, Rattus norvegicus
acatctgctgttgtaagtattccca

SEQ ID NO: 79699 - DNA, 25 bp, Rattus norvegicus
acatctgcttccatgttgtttgata

SEQ ID NO: 79700 - DNA, 25 bp, Rattus norvegicus
acatctgcttccttgttgtttgata

SEQ ID NO: 79701 - DNA, 25 bp, Rattus norvegicus
acatctggacctcatggttcctgaa

SEQ ID NO: 79702 - DNA, 25 bp, Rattus norvegicus
acatctggacctgatggttcctgaa

SEQ ID NO: 79703 - DNA, 25 bp, Rattus norvegicus
acatctggacgacaaggccttccgt

SEQ ID NO: 79704 - DNA, 25 bp, Rattus norvegicus
acatctggacgagaaggccttccgt

SEQ ID NO: 79705 - DNA, 25 bp, Rattus norvegicus
acatctggatgcagttccaactctt

SEQ ID NO: 79706 - DNA, 25 bp, Rattus norvegicus
acatctggatgctgttccaactctt

SEQ ID NO: 79707 - DNA, 25 bp, Rattus norvegicus
acatctggccgcatgcgtaaggaag

SEQ ID NO: 79708 - DNA, 25 bp, Rattus norvegicus
acatctggccgcttgcgtaaggaag

SEQ ID NO: 79709 - DNA, 25 bp, Rattus norvegicus
acatctggctcaagttacacatttt

SEQ ID NO: 79710 - DNA, 25 bp, Rattus norvegicus
acatctggctcatgttacacatttt

SEQ ID NO: 79711 - DNA, 25 bp, Rattus norvegicus
acatctggctgtaatcaaacttgat

SEQ ID NO: 79712 - DNA, 25 bp, Rattus norvegicus
acatctggctgttatcaaacttgat

SEQ ID NO: 79713 - DNA, 25 bp, Rattus norvegicus
acatctgggacaagtgtgggcccca

SEQ ID NO: 79714 - DNA, 25 bp, Rattus norvegicus
acatctgggacaatggaaccctggt

SEQ ID NO: 79715 - DNA, 25 bp, Rattus norvegicus
acatctgggacatgtgtgggcccca

SEQ ID NO: 79716 - DNA, 25 bp, Rattus norvegicus
acatctgggacattggaaccctggt

SEQ ID NO: 79717 - DNA, 25 bp, Rattus norvegicus
acatctgggagcacagggtctgttt

SEQ ID NO: 79718 - DNA, 25 bp, Rattus norvegicus
acatctgggagctcagggtctgttt

SEQ ID NO: 79719 - DNA, 25 bp, Rattus norvegicus
acatctgggcagatgtaccgtgcat

SEQ ID NO: 79720 - DNA, 25 bp, Rattus norvegicus
acatctgggcagttgtaccgtgcat

SEQ ID NO: 79721 - DNA, 25 bp, Rattus norvegicus
acatctgggccgcatacgataggaa

SEQ ID NO: 79722 - DNA, 25 bp, Rattus norvegicus
acatctgggccggatacgataggaa

SEQ ID NO: 79723 - DNA, 25 bp, Rattus norvegicus
acatctgggtttagggccattgcct

SEQ ID NO: 79724 - DNA, 25 bp, Rattus norvegicus
acatctgggttttgggccattgcct

SEQ ID NO: 79725 - DNA, 25 bp, Rattus norvegicus
acatctggtatgagtgtctttagaa

SEQ ID NO: 79726 - DNA, 25 bp, Rattus norvegicus
acatctggtatgtgtgtctttagaa

SEQ ID NO: 79727 - DNA, 25 bp, Rattus norvegicus
acatctggtccacagggaatctgaa

SEQ ID NO: 79728 - DNA, 25 bp, Rattus norvegicus
acatctggtccagagggaatctgaa

SEQ ID NO: 79729 - DNA, 25 bp, Rattus norvegicus
acatctggtcccagtgagcataggc

SEQ ID NO: 79730 - DNA, 25 bp, Rattus norvegicus
acatctggtccctgtgagcataggc

SEQ ID NO: 79731 - DNA, 25 bp, Rattus norvegicus
acatctggttcaatttactactagg

SEQ ID NO: 79732 - DNA, 25 bp, Rattus norvegicus
acatctggttcattttactactagg

SEQ ID NO: 79733 - DNA, 25 bp, Rattus norvegicus
acatctgtacaacacctgcaggaca

SEQ ID NO: 79734 - DNA, 25 bp, Rattus norvegicus
acatctgtacaagacctgcaggaca

SEQ ID NO: 79735 - DNA, 25 bp, Rattus norvegicus
acatctgtacacagtgtcgcactac

SEQ ID NO: 79736 - DNA, 25 bp, Rattus norvegicus
acatctgtacactgtgtcgcactac

SEQ ID NO: 79737 - DNA, 25 bp, Rattus norvegicus
acatctgtcactacagtccagggaa

SEQ ID NO: 79738 - DNA, 25 bp, Rattus norvegicus
acatctgtcacttcagtccagggaa

SEQ ID NO: 79739 - DNA, 25 bp, Rattus norvegicus
acatctgtcctcaccagagatttat

SEQ ID NO: 79740 - DNA, 25 bp, Rattus norvegicus
acatctgtcctctccagagatttat

SEQ ID NO: 79741 - DNA, 25 bp, Rattus norvegicus
acatctgtccttcatttgtgcttgc

SEQ ID NO: 79742 - DNA, 25 bp, Rattus norvegicus
acatctgtccttgatttgtgcttgc

SEQ ID NO: 79743 - DNA, 25 bp, Rattus norvegicus
acatctgtctccatatctatttgca

SEQ ID NO: 79744 - DNA, 25 bp, Rattus norvegicus
acatctgtctccttatctatttgca

SEQ ID NO: 79745 - DNA, 25 bp, Rattus norvegicus
acatctgtctgtactccttgtgata

SEQ ID NO: 79746 - DNA, 25 bp, Rattus norvegicus
acatctgtctgttctccttgtgata

SEQ ID NO: 79747 - DNA, 25 bp, Rattus norvegicus
acatctgtgacaatgcttggctcgc

SEQ ID NO: 79748 - DNA, 25 bp, Rattus norvegicus
acatctgtgacattgcttggctcgc

SEQ ID NO: 79749 - DNA, 25 bp, Rattus norvegicus
acatctgtgactagtgccgaagctt

SEQ ID NO: 79750 - DNA, 25 bp, Rattus norvegicus
acatctgtgactccagcactcagga

SEQ ID NO: 79751 - DNA, 25 bp, Rattus norvegicus
acatctgtgactgcagcactcagga

SEQ ID NO: 79752 - DNA, 25 bp, Rattus norvegicus
acatctgtgacttgtgccgaagctt

SEQ ID NO: 79753 - DNA, 25 bp, Rattus norvegicus
acatctgtgagtatctcgttcttga

SEQ ID NO: 79754 - DNA, 25 bp, Rattus norvegicus
acatctgtgagtttctcgttcttga

SEQ ID NO: 79755 - DNA, 25 bp, Rattus norvegicus
acatctgtgccgaggccgtggagta

SEQ ID NO: 79756 - DNA, 25 bp, Rattus norvegicus
acatctgtgccgtggccgtggagta

SEQ ID NO: 79757 - DNA, 25 bp, Rattus norvegicus
acatctgtgctgaagcttgcggagg

SEQ ID NO: 79758 - DNA, 25 bp, Rattus norvegicus
acatctgtgctgtagcttgcggagg

SEQ ID NO: 79759 - DNA, 25 bp, Rattus norvegicus
acatctgtgtatctctagggctttc

SEQ ID NO: 79760 - DNA, 25 bp, Rattus norvegicus
acatctgtgtatgtctagggctttc

SEQ ID NO: 79761 - DNA, 25 bp, Rattus norvegicus
acatctgtgttgaagaaccttttga

SEQ ID NO: 79762 - DNA, 25 bp, Rattus norvegicus
acatctgtgttgtagaaccttttga

SEQ ID NO: 79763 - DNA, 25 bp, Rattus norvegicus
acatctgttaatatgctgtggtatg

SEQ ID NO: 79764 - DNA, 25 bp, Rattus norvegicus
acatctgttaatttgctgtggtatg

SEQ ID NO: 79765 - DNA, 25 bp, Rattus norvegicus
acatctgttcagacacatcccataa

SEQ ID NO: 79766 - DNA, 25 bp, Rattus norvegicus
acatctgttcagtcacatcccataa

SEQ ID NO: 79767 - DNA, 25 bp, Rattus norvegicus
acatctgttttgaagtggagcattg

SEQ ID NO: 79768 - DNA, 25 bp, Rattus norvegicus
acatctgttttgtagtggagcattg

SEQ ID NO: 79769 - DNA, 25 bp, Rattus norvegicus
acatctgtttttcaacctgcttcat

SEQ ID NO: 79770 - DNA, 25 bp, Rattus norvegicus
acatctgtttttgaacctgcttcat

SEQ ID NO: 79771 - DNA, 25 bp, Rattus norvegicus
acatcttaagccctctgccagagag

SEQ ID NO: 79772 - DNA, 25 bp, Rattus norvegicus
acatcttaagccgtctgccagagag

SEQ ID NO: 79773 - DNA, 25 bp, Rattus norvegicus
acatcttacaggattcagggaccat

SEQ ID NO: 79774 - DNA, 25 bp, Rattus norvegicus
acatcttacaggtttcagggaccat

SEQ ID NO: 79775 - DNA, 25 bp, Rattus norvegicus
acatcttcacttctctatgtggaga

SEQ ID NO: 79776 - DNA, 25 bp, Rattus norvegicus
acatcttcacttgtctatgtggaga

SEQ ID NO: 79777 - DNA, 25 bp, Rattus norvegicus
acatcttcagatccaagcaggagca

SEQ ID NO: 79778 - DNA, 25 bp, Rattus norvegicus
acatcttcagatgcaagcaggagca

SEQ ID NO: 79779 - DNA, 25 bp, Rattus norvegicus
acatcttcagtcacatcaccatgaa

SEQ ID NO: 79780 - DNA, 25 bp, Rattus norvegicus
acatcttcagtctcatcaccatgaa

SEQ ID NO: 79781 - DNA, 25 bp, Rattus norvegicus
acatcttcagtgagctatcttctat

SEQ ID NO: 79782 - DNA, 25 bp, Rattus norvegicus
acatcttcagtgtgctatcttctat

SEQ ID NO: 79783 - DNA, 25 bp, Rattus norvegicus
acatcttcagttatattgctttcag

SEQ ID NO: 79784 - DNA, 25 bp, Rattus norvegicus
acatcttcagttcctttgttgcctt

SEQ ID NO: 79785 - DNA, 25 bp, Rattus norvegicus
acatcttcagttgctttgttgcctt

SEQ ID NO: 79786 - DNA, 25 bp, Rattus norvegicus
acatcttcagttttattgctttcag

SEQ ID NO: 79787 - DNA, 25 bp, Rattus norvegicus
acatcttcatcgcaactgtgtggca

SEQ ID NO: 79788 - DNA, 25 bp, Rattus norvegicus
acatcttcatcggaactgtgtggca

SEQ ID NO: 79789 - DNA, 25 bp, Rattus norvegicus
acatcttcccggatgagttggtgtt

SEQ ID NO: 79790 - DNA, 25 bp, Rattus norvegicus
acatcttcccggttgagttggtgtt

SEQ ID NO: 79791 - DNA, 25 bp, Rattus norvegicus
acatcttcctgtccacacgaagtca

SEQ ID NO: 79792 - DNA, 25 bp, Rattus norvegicus
acatcttcctgtgcacacgaagtca

SEQ ID NO: 79793 - DNA, 25 bp, Rattus norvegicus
acatcttccttcctacaggcaaaaa

SEQ ID NO: 79794 - DNA, 25 bp, Rattus norvegicus
acatcttccttcgtacaggcaaaaa

SEQ ID NO: 79795 - DNA, 25 bp, Rattus norvegicus
acatcttccttgcatctcagtataa

SEQ ID NO: 79796 - DNA, 25 bp, Rattus norvegicus
acatcttccttgctggcatgaatgt

SEQ ID NO: 79797 - DNA, 25 bp, Rattus norvegicus
acatcttccttggatctcagtataa

SEQ ID NO: 79798 - DNA, 25 bp, Rattus norvegicus
acatcttccttggtggcatgaatgt

SEQ ID NO: 79799 - DNA, 25 bp, Rattus norvegicus
acatcttcgcttcctgttcaacgaa

SEQ ID NO: 79800 - DNA, 25 bp, Rattus norvegicus
acatcttcgcttgctgttcaacgaa

SEQ ID NO: 79801 - DNA, 25 bp, Rattus norvegicus
acatcttcggctctgtctgtatgaa

SEQ ID NO: 79802 - DNA, 25 bp, Rattus norvegicus
acatcttcggctgtgtctgtatgaa

SEQ ID NO: 79803 - DNA, 25 bp, Rattus norvegicus
acatcttctaacattctatggactg

SEQ ID NO: 79804 - DNA, 25 bp, Rattus norvegicus
acatcttctaactttctatggactg

SEQ ID NO: 79805 - DNA, 25 bp, Rattus norvegicus
acatcttctacaactacagtctgtc

SEQ ID NO: 79806 - DNA, 25 bp, Rattus norvegicus
acatcttctacatctacagtctgtc

SEQ ID NO: 79807 - DNA, 25 bp, Rattus norvegicus
acatcttctagcataggtcatttga

SEQ ID NO: 79808 - DNA, 25 bp, Rattus norvegicus
acatcttctagcttaggtcatttga

SEQ ID NO: 79809 - DNA, 25 bp, Rattus norvegicus
acatcttctcttacctaggctagta

SEQ ID NO: 79810 - DNA, 25 bp, Rattus norvegicus
acatcttctctttcctaggctagta

SEQ ID NO: 79811 - DNA, 25 bp, Rattus norvegicus
acatcttctgcaaccgtggtgtcaa

SEQ ID NO: 79812 - DNA, 25 bp, Rattus norvegicus
acatcttctgcatccgtggtgtcaa

SEQ ID NO: 79813 - DNA, 25 bp, Rattus norvegicus
acatcttcttggaacgggagacccg

SEQ ID NO: 79814 - DNA, 25 bp, Rattus norvegicus
acatcttcttggtacgggagacccg

SEQ ID NO: 79815 - DNA, 25 bp, Rattus norvegicus
acatcttgaagacatctcctggctc

SEQ ID NO: 79816 - DNA, 25 bp, Rattus norvegicus
acatcttgaagagatctcctggctc

SEQ ID NO: 79817 - DNA, 25 bp, Rattus norvegicus
acatcttgcaatcatctacctaaca

SEQ ID NO: 79818 - DNA, 25 bp, Rattus norvegicus
acatcttgcaatgatctacctaaca

SEQ ID NO: 79819 - DNA, 25 bp, Rattus norvegicus
acatcttgcattagtctgagaaggc

SEQ ID NO: 79820 - DNA, 25 bp, Rattus norvegicus
acatcttgcatttgtctgagaaggc

SEQ ID NO: 79821 - DNA, 25 bp, Rattus norvegicus
acatcttgctcgcagattctgctgt

SEQ ID NO: 79822 - DNA, 25 bp, Rattus norvegicus
acatcttgctcggagattctgctgt

SEQ ID NO: 79823 - DNA, 25 bp, Rattus norvegicus
acatcttgcttcagggcgtctcagg

SEQ ID NO: 79824 - DNA, 25 bp, Rattus norvegicus
acatcttgcttctgggcgtctcagg

SEQ ID NO: 79825 - DNA, 25 bp, Rattus norvegicus
acatcttggacgagagggactaaca

SEQ ID NO: 79826 - DNA, 25 bp, Rattus norvegicus
acatcttggacgtgagggactaaca

SEQ ID NO: 79827 - DNA, 25 bp, Rattus norvegicus
acatcttggtggcatgcaaggcttt

SEQ ID NO: 79828 - DNA, 25 bp, Rattus norvegicus
acatcttggtgggatgcaaggcttt

SEQ ID NO: 79829 - DNA, 25 bp, Rattus norvegicus
acatcttgtatactagttctactta

SEQ ID NO: 79830 - DNA, 25 bp, Rattus norvegicus
acatcttgtatagtagttctactta

SEQ ID NO: 79831 - DNA, 25 bp, Rattus norvegicus
acatcttgtgtgagtcagagggact

SEQ ID NO: 79832 - DNA, 25 bp, Rattus norvegicus
acatcttgtgtgtgtcagagggact

SEQ ID NO: 79833 - DNA, 25 bp, Rattus norvegicus
acatcttgttcaagtgagacaccca

SEQ ID NO: 79834 - DNA, 25 bp, Rattus norvegicus
acatcttgttcatgtgagacaccca

SEQ ID NO: 79835 - DNA, 25 bp, Rattus norvegicus
acatctttaacaagctccagagtgg

SEQ ID NO: 79836 - DNA, 25 bp, Rattus norvegicus
acatctttaacatgctccagagtgg

SEQ ID NO: 79837 - DNA, 25 bp, Rattus norvegicus
acatctttcatactttcagtctttt

SEQ ID NO: 79838 - DNA, 25 bp, Rattus norvegicus
acatctttcatagtttcagtctttt

SEQ ID NO: 79839 - DNA, 25 bp, Rattus norvegicus
acatctttcatgcttattgctacac

SEQ ID NO: 79840 - DNA, 25 bp, Rattus norvegicus
acatctttcatggttattgctacac

SEQ ID NO: 79841 - DNA, 25 bp, Rattus norvegicus
acatctttcctgagttgccctccag

SEQ ID NO: 79842 - DNA, 25 bp, Rattus norvegicus
acatctttcctgtgttgccctccag

SEQ ID NO: 79843 - DNA, 25 bp, Rattus norvegicus
acatctttctgcagctgcatgtgta

SEQ ID NO: 79844 - DNA, 25 bp, Rattus norvegicus
acatctttctgctgctgcatgtgta

SEQ ID NO: 79845 - DNA, 25 bp, Rattus norvegicus
acatctttcttgaccaggccgtcga

SEQ ID NO: 79846 - DNA, 25 bp, Rattus norvegicus
acatctttcttgtccaggccgtcga

SEQ ID NO: 79847 - DNA, 25 bp, Rattus norvegicus
acatctttgaaaccaagtgtcggga

SEQ ID NO: 79848 - DNA, 25 bp, Rattus norvegicus
acatctttgaaagcaagtgtcggga

SEQ ID NO: 79849 - DNA, 25 bp, Rattus norvegicus
acatctttgctaacttttagtcctg

SEQ ID NO: 79850 - DNA, 25 bp, Rattus norvegicus
acatctttgctatcttttagtcctg

SEQ ID NO: 79851 - DNA, 25 bp, Rattus norvegicus
acatctttgggcagctcatgcagct

SEQ ID NO: 79852 - DNA, 25 bp, Rattus norvegicus
acatctttgggcagtcttcagtttt

SEQ ID NO: 79853 - DNA, 25 bp, Rattus norvegicus
acatctttgggctgctcatgcagct

SEQ ID NO: 79854 - DNA, 25 bp, Rattus norvegicus
acatctttgggctgtcttcagtttt

SEQ ID NO: 79855 - DNA, 25 bp, Rattus norvegicus
acatctttgtggatgctggtgcctt

SEQ ID NO: 79856 - DNA, 25 bp, Rattus norvegicus
acatctttgtggttgctggtgcctt

SEQ ID NO: 79857 - DNA, 25 bp, Rattus norvegicus
acatctttgttgagtccagggctga

SEQ ID NO: 79858 - DNA, 25 bp, Rattus norvegicus
acatctttgttgtgtccagggctga

SEQ ID NO: 79859 - DNA, 25 bp, Rattus norvegicus
acatcttttacaaatctgtcttgga

SEQ ID NO: 79860 - DNA, 25 bp, Rattus norvegicus
acatcttttacatatctgtcttgga

SEQ ID NO: 79861 - DNA, 25 bp, Rattus norvegicus
acatcttttgtcctgtaacacgctg

SEQ ID NO: 79862 - DNA, 25 bp, Rattus norvegicus
acatcttttgtcgtgtaacacgctg

SEQ ID NO: 79863 - DNA, 25 bp, Rattus norvegicus
acatgaaaatccacgtggcggtggc

SEQ ID NO: 79864 - DNA, 25 bp, Rattus norvegicus
acatgaaaatcctcgtggcggtggc

SEQ ID NO: 79865 - DNA, 25 bp, Rattus norvegicus
acatgaaataccatgtgcccatccc

SEQ ID NO: 79866 - DNA, 25 bp, Rattus norvegicus
acatgaaataccttgtgcccatccc

SEQ ID NO: 79867 - DNA, 25 bp, Rattus norvegicus
acatgaacccggcagagcagagtcc

SEQ ID NO: 79868 - DNA, 25 bp, Rattus norvegicus
acatgaacccgggagagcagagtcc

SEQ ID NO: 79869 - DNA, 25 bp, Rattus norvegicus
acatgaacctgacattgaatgactt

SEQ ID NO: 79870 - DNA, 25 bp, Rattus norvegicus
acatgaacctgagattgaatgactt

SEQ ID NO: 79871 - DNA, 25 bp, Rattus norvegicus
acatgaacgtccaccgtggcgttaa

SEQ ID NO: 79872 - DNA, 25 bp, Rattus norvegicus
acatgaacgtcctccgtggcgttaa

SEQ ID NO: 79873 - DNA, 25 bp, Rattus norvegicus
acatgaactcataatacctcagtgg

SEQ ID NO: 79874 - DNA, 25 bp, Rattus norvegicus
acatgaactcattatacctcagtgg

SEQ ID NO: 79875 - DNA, 25 bp, Rattus norvegicus
acatgaacttgtctgcccaggatca

SEQ ID NO: 79876 - DNA, 25 bp, Rattus norvegicus
acatgaacttgtgtgcccaggatca

SEQ ID NO: 79877 - DNA, 25 bp, Rattus norvegicus
acatgaacttttcacaccacctcca

SEQ ID NO: 79878 - DNA, 25 bp, Rattus norvegicus
acatgaacttttgacaccacctcca

SEQ ID NO: 79879 - DNA, 25 bp, Rattus norvegicus
acatgaagccctccatcacctgtga

SEQ ID NO: 79880 - DNA, 25 bp, Rattus norvegicus
acatgaagccctgcatcacctgtga

SEQ ID NO: 79881 - DNA, 25 bp, Rattus norvegicus
acatgaagctaaacgagtccctcca

SEQ ID NO: 79882 - DNA, 25 bp, Rattus norvegicus
acatgaagctaatcgagtccctcca

SEQ ID NO: 79883 - DNA, 25 bp, Rattus norvegicus
acatgaagctccactaacagttaac

SEQ ID NO: 79884 - DNA, 25 bp, Rattus norvegicus
acatgaagctcctctaacagttaac

SEQ ID NO: 79885 - DNA, 25 bp, Rattus norvegicus
acatgaagctgcaggccggtgtgaa

SEQ ID NO: 79886 - DNA, 25 bp, Rattus norvegicus
acatgaagctgctggccggtgtgaa

SEQ ID NO: 79887 - DNA, 25 bp, Rattus norvegicus
acatgaagctggagtttctattctt

SEQ ID NO: 79888 - DNA, 25 bp, Rattus norvegicus
acatgaagctggtgtttctattctt

SEQ ID NO: 79889 - DNA, 25 bp, Rattus norvegicus
acatgaaggtctccgccacttgtca

SEQ ID NO: 79890 - DNA, 25 bp, Rattus norvegicus
acatgaaggtctgcgccacttgtca

SEQ ID NO: 79891 - DNA, 25 bp, Rattus norvegicus
acatgaaggtgcctcagccaggaac

SEQ ID NO: 79892 - DNA, 25 bp, Rattus norvegicus
acatgaaggtgcgtcagccaggaac

SEQ ID NO: 79893 - DNA, 25 bp, Rattus norvegicus
acatgaagtcctcggagcaagagac

SEQ ID NO: 79894 - DNA, 25 bp, Rattus norvegicus
acatgaagtcctgggagcaagagac

SEQ ID NO: 79895 - DNA, 25 bp, Rattus norvegicus
acatgaagttccactggcagtggca

SEQ ID NO: 79896 - DNA, 25 bp, Rattus norvegicus
acatgaagttcctctggcagtggca

SEQ ID NO: 79897 - DNA, 25 bp, Rattus norvegicus
acatgaagtttgcaagtctccaccc

SEQ ID NO: 79898 - DNA, 25 bp, Rattus norvegicus
acatgaagtttggaagtctccaccc

SEQ ID NO: 79899 - DNA, 25 bp, Rattus norvegicus
acatgaatctgtcacctgcgttaag

SEQ ID NO: 79900 - DNA, 25 bp, Rattus norvegicus
acatgaatctgtgacctgcgttaag

SEQ ID NO: 79901 - DNA, 25 bp, Rattus norvegicus
acatgaatgtacatagtcccttgaa

SEQ ID NO: 79902 - DNA, 25 bp, Rattus norvegicus
acatgaatgtacttagtcccttgaa

SEQ ID NO: 79903 - DNA, 25 bp, Rattus norvegicus
acatgaattgtcagccattgtgtgg

SEQ ID NO: 79904 - DNA, 25 bp, Rattus norvegicus
acatgaattgtctgccattgtgtgg

SEQ ID NO: 79905 - DNA, 25 bp, Rattus norvegicus
acatgacaacatacttcattggtga

SEQ ID NO: 79906 - DNA, 25 bp, Rattus norvegicus
acatgacaacattcttcattggtga

SEQ ID NO: 79907 - DNA, 25 bp, Rattus norvegicus
acatgacacctcagtgacatcagat

SEQ ID NO: 79908 - DNA, 25 bp, Rattus norvegicus
acatgacacctctgtgacatcagat

SEQ ID NO: 79909 - DNA, 25 bp, Rattus norvegicus
acatgacactgtacatcacaaaagt

SEQ ID NO: 79910 - DNA, 25 bp, Rattus norvegicus
acatgacactgttcatcacaaaagt

SEQ ID NO: 79911 - DNA, 25 bp, Rattus norvegicus
acatgacacttgatggtgaccctcg

SEQ ID NO: 79912 - DNA, 25 bp, Rattus norvegicus
acatgacacttgttggtgaccctcg

SEQ ID NO: 79913 - DNA, 25 bp, Rattus norvegicus
acatgacatacaactgagccccaga

SEQ ID NO: 79914 - DNA, 25 bp, Rattus norvegicus
acatgacatacatctgagccccaga

SEQ ID NO: 79915 - DNA, 25 bp, Rattus norvegicus
acatgaccaaggacatgatgccggg

SEQ ID NO: 79916 - DNA, 25 bp, Rattus norvegicus
acatgaccaaggtcatgatgccggg

SEQ ID NO: 79917 - DNA, 25 bp, Rattus norvegicus
acatgaccacatctgtccttggtga

SEQ ID NO: 79918 - DNA, 25 bp, Rattus norvegicus
acatgaccacatgtgtccttggtga

SEQ ID NO: 79919 - DNA, 25 bp, Rattus norvegicus
acatgaccagtgatcggcgccagtg

SEQ ID NO: 79920 - DNA, 25 bp, Rattus norvegicus
acatgaccagtgttcggcgccagtg

SEQ ID NO: 79921 - DNA, 25 bp, Rattus norvegicus
acatgaccatgacggccacactgaa

SEQ ID NO: 79922 - DNA, 25 bp, Rattus norvegicus
acatgaccatgagggccacactgaa

SEQ ID NO: 79923 - DNA, 25 bp, Rattus norvegicus
acatgaccatttcactgttcactga

SEQ ID NO: 79924 - DNA, 25 bp, Rattus norvegicus
acatgaccatttgactgttcactga

SEQ ID NO: 79925 - DNA, 25 bp, Rattus norvegicus
acatgacccacaaggcttgctagga

SEQ ID NO: 79926 - DNA, 25 bp, Rattus norvegicus
acatgacccacatggcttgctagga

SEQ ID NO: 79927 - DNA, 25 bp, Rattus norvegicus
acatgaccgttcataactgtctgta

SEQ ID NO: 79928 - DNA, 25 bp, Rattus norvegicus
acatgaccgttcttaactgtctgta

SEQ ID NO: 79929 - DNA, 25 bp, Rattus norvegicus
acatgacctctgagcccaggctcgt

SEQ ID NO: 79930 - DNA, 25 bp, Rattus norvegicus
acatgacctctgtgcccaggctcgt

SEQ ID NO: 79931 - DNA, 25 bp, Rattus norvegicus
acatgacgatacatttctctgtggg

SEQ ID NO: 79932 - DNA, 25 bp, Rattus norvegicus
acatgacgatacttttctctgtggg

SEQ ID NO: 79933 - DNA, 25 bp, Rattus norvegicus
acatgacgctctatgtgtggtgaag

SEQ ID NO: 79934 - DNA, 25 bp, Rattus norvegicus
acatgacgctctttgtgtggtgaag

SEQ ID NO: 79935 - DNA, 25 bp, Rattus norvegicus
acatgacgttgaacatttgggcaaa

SEQ ID NO: 79936 - DNA, 25 bp, Rattus norvegicus
acatgacgttgatcatttgggcaaa

SEQ ID NO: 79937 - DNA, 25 bp, Rattus norvegicus
acatgactaagcatcgaggcccaaa

SEQ ID NO: 79938 - DNA, 25 bp, Rattus norvegicus
acatgactaagcttcgaggcccaaa

SEQ ID NO: 79939 - DNA, 25 bp, Rattus norvegicus
acatgactccggcttgcaatttgca

SEQ ID NO: 79940 - DNA, 25 bp, Rattus norvegicus
acatgactccgggttgcaatttgca

SEQ ID NO: 79941 - DNA, 25 bp, Rattus norvegicus
acatgactcttcacaaccaatgctg

SEQ ID NO: 79942 - DNA, 25 bp, Rattus norvegicus
acatgactcttctcaaccaatgctg

SEQ ID NO: 79943 - DNA, 25 bp, Rattus norvegicus
acatgactgcttatcctccttggat

SEQ ID NO: 79944 - DNA, 25 bp, Rattus norvegicus
acatgactgcttttcctccttggat

SEQ ID NO: 79945 - DNA, 25 bp, Rattus norvegicus
acatgactggtacctgttgttttct

SEQ ID NO: 79946 - DNA, 25 bp, Rattus norvegicus
acatgactggtagctgttgttttct

SEQ ID NO: 79947 - DNA, 25 bp, Rattus norvegicus
acatgactggtcactggtcttatcc

SEQ ID NO: 79948 - DNA, 25 bp, Rattus norvegicus
acatgactggtctctggtcttatcc

SEQ ID NO: 79949 - DNA, 25 bp, Rattus norvegicus
acatgacttcttacggctgagcttt

SEQ ID NO: 79950 - DNA, 25 bp, Rattus norvegicus
acatgacttcttaggctcttttcaa

SEQ ID NO: 79951 - DNA, 25 bp, Rattus norvegicus
acatgacttctttcggctgagcttt

SEQ ID NO: 79952 - DNA, 25 bp, Rattus norvegicus
acatgacttctttggctcttttcaa

SEQ ID NO: 79953 - DNA, 25 bp, Rattus norvegicus
acatgacttttcctcgactactgca

SEQ ID NO: 79954 - DNA, 25 bp, Rattus norvegicus
acatgacttttccttgtttctcgga

SEQ ID NO: 79955 - DNA, 25 bp, Rattus norvegicus
acatgacttttcgtcgactactgca

SEQ ID NO: 79956 - DNA, 25 bp, Rattus norvegicus
acatgacttttcgttgtttctcgga

SEQ ID NO: 79957 - DNA, 25 bp, Rattus norvegicus
acatgagacagcatttctctcctgg

SEQ ID NO: 79958 - DNA, 25 bp, Rattus norvegicus
acatgagacagcttttctctcctgg

SEQ ID NO: 79959 - DNA, 25 bp, Rattus norvegicus
acatgagacccaagtatccgcacta

SEQ ID NO: 79960 - DNA, 25 bp, Rattus norvegicus
acatgagacccatgtatccgcacta

SEQ ID NO: 79961 - DNA, 25 bp, Rattus norvegicus
acatgagagcccctgcagaattttt

SEQ ID NO: 79962 - DNA, 25 bp, Rattus norvegicus
acatgagagcccgtgcagaattttt

SEQ ID NO: 79963 - DNA, 25 bp, Rattus norvegicus
acatgagagcttccagcttccccga

SEQ ID NO: 79964 - DNA, 25 bp, Rattus norvegicus
acatgagagcttgcagcttccccga

SEQ ID NO: 79965 - DNA, 25 bp, Rattus norvegicus
acatgagagggaacttcctggcctt

SEQ ID NO: 79966 - DNA, 25 bp, Rattus norvegicus
acatgagagggatcttcctggcctt

SEQ ID NO: 79967 - DNA, 25 bp, Rattus norvegicus
acatgagaggttatgctagggccta

SEQ ID NO: 79968 - DNA, 25 bp, Rattus norvegicus
acatgagaggttttgctagggccta

SEQ ID NO: 79969 - DNA, 25 bp, Rattus norvegicus
acatgagatcgaactgtctccgaat

SEQ ID NO: 79970 - DNA, 25 bp, Rattus norvegicus
acatgagatcgatctgtctccgaat

SEQ ID NO: 79971 - DNA, 25 bp, Rattus norvegicus
acatgagatctaccactgtgtcagt

SEQ ID NO: 79972 - DNA, 25 bp, Rattus norvegicus
acatgagatctagcactgtgtcagt

SEQ ID NO: 79973 - DNA, 25 bp, Rattus norvegicus
acatgagatgacacataaccatcta

SEQ ID NO: 79974 - DNA, 25 bp, Rattus norvegicus
acatgagatgactcataaccatcta

SEQ ID NO: 79975 - DNA, 25 bp, Rattus norvegicus
acatgagatgtgactgccctttggt

SEQ ID NO: 79976 - DNA, 25 bp, Rattus norvegicus
acatgagatgtgtctgccctttggt

SEQ ID NO: 79977 - DNA, 25 bp, Rattus norvegicus
acatgagcaccaaacagttccacac

SEQ ID NO: 79978 - DNA, 25 bp, Rattus norvegicus
acatgagcaccatacagttccacac

SEQ ID NO: 79979 - DNA, 25 bp, Rattus norvegicus
acatgagcaggcaccttctggcaaa

SEQ ID NO: 79980 - DNA, 25 bp, Rattus norvegicus
acatgagcaggctccttctggcaaa

SEQ ID NO: 79981 - DNA, 25 bp, Rattus norvegicus
acatgagcagtcagatggccccaca

SEQ ID NO: 79982 - DNA, 25 bp, Rattus norvegicus
acatgagcagtctgatggccccaca

SEQ ID NO: 79983 - DNA, 25 bp, Rattus norvegicus
acatgagcatgtctaccatcgtcga

SEQ ID NO: 79984 - DNA, 25 bp, Rattus norvegicus
acatgagcatgtgtaccatcgtcga

SEQ ID NO: 79985 - DNA, 25 bp, Rattus norvegicus
acatgagccagacctgcagtcccat

SEQ ID NO: 79986 - DNA, 25 bp, Rattus norvegicus
acatgagccagagctgcagtcccat

SEQ ID NO: 79987 - DNA, 25 bp, Rattus norvegicus
acatgagcctacatactagtctgaa

SEQ ID NO: 79988 - DNA, 25 bp, Rattus norvegicus
acatgagcctacttactagtctgaa

SEQ ID NO: 79989 - DNA, 25 bp, Rattus norvegicus
acatgagcctagctgtccaaggttc

SEQ ID NO: 79990 - DNA, 25 bp, Rattus norvegicus
acatgagcctaggtgtccaaggttc

SEQ ID NO: 79991 - DNA, 25 bp, Rattus norvegicus
acatgagcctccagggccatgtgcc

SEQ ID NO: 79992 - DNA, 25 bp, Rattus norvegicus
acatgagcctcctgggccatgtgcc

SEQ ID NO: 79993 - DNA, 25 bp, Rattus norvegicus
acatgagcctctagccacagagcca

SEQ ID NO: 79994 - DNA, 25 bp, Rattus norvegicus
acatgagcctcttgccacagagcca

SEQ ID NO: 79995 - DNA, 25 bp, Rattus norvegicus
acatgagcgtctcacttactgtctt

SEQ ID NO: 79996 - DNA, 25 bp, Rattus norvegicus
acatgagcgtctgacttactgtctt

SEQ ID NO: 79997 - DNA, 25 bp, Rattus norvegicus
acatgagctatccatggctttcccc

SEQ ID NO: 79998 - DNA, 25 bp, Rattus norvegicus
acatgagctatcgatggctttcccc

SEQ ID NO: 79999 - DNA, 25 bp, Rattus norvegicus
acatgagctatgaagacctgggtgg

SEQ ID NO: 80000 - DNA, 25 bp, Rattus norvegicus
acatgagctatgtagacctgggtgg

SEQ ID NO: 80001 - DNA, 25 bp, Rattus norvegicus
acatgagctgataggttccgggcaa

SEQ ID NO: 80002 - DNA, 25 bp, Rattus norvegicus
acatgagctgattggttccgggcaa

SEQ ID NO: 80003 - DNA, 25 bp, Rattus norvegicus
acatgaggaacacttaagagggaat

SEQ ID NO: 80004 - DNA, 25 bp, Rattus norvegicus
acatgaggaacagttaagagggaat

SEQ ID NO: 80005 - DNA, 25 bp, Rattus norvegicus
acatgaggacccaggcttggtttcc

SEQ ID NO: 80006 - DNA, 25 bp, Rattus norvegicus
acatgaggaccctggcttggtttcc

SEQ ID NO: 80007 - DNA, 25 bp, Rattus norvegicus
acatgaggagtcacgcagaggcgga

SEQ ID NO: 80008 - DNA, 25 bp, Rattus norvegicus
acatgaggagtctcgcagaggcgga

SEQ ID NO: 80009 - DNA, 25 bp, Rattus norvegicus
acatgaggcctcaacagttctccat

SEQ ID NO: 80010 - DNA, 25 bp, Rattus norvegicus
acatgaggcctctacagttctccat

SEQ ID NO: 80011 - DNA, 25 bp, Rattus norvegicus
acatgagggtacatgccacccatct

SEQ ID NO: 80012 - DNA, 25 bp, Rattus norvegicus
acatgagggtacttgccacccatct

SEQ ID NO: 80013 - DNA, 25 bp, Rattus norvegicus
acatgaggtgtacagccgctctgga

SEQ ID NO: 80014 - DNA, 25 bp, Rattus norvegicus
acatgaggtgtagagccgctctgga

SEQ ID NO: 80015 - DNA, 25 bp, Rattus norvegicus
acatgaggttctcacttctgagccc

SEQ ID NO: 80016 - DNA, 25 bp, Rattus norvegicus
acatgaggttctgacttctgagccc

SEQ ID NO: 80017 - DNA, 25 bp, Rattus norvegicus
acatgagtcactagtccttgcacat

SEQ ID NO: 80018 - DNA, 25 bp, Rattus norvegicus
acatgagtcacttgtccttgcacat

SEQ ID NO: 80019 - DNA, 25 bp, Rattus norvegicus
acatgagtctgtattgtcggaggga

SEQ ID NO: 80020 - DNA, 25 bp, Rattus norvegicus
acatgagtctgttttgtcggaggga

SEQ ID NO: 80021 - DNA, 25 bp, Rattus norvegicus
acatgagtgagtccagttcgctagc

SEQ ID NO: 80022 - DNA, 25 bp, Rattus norvegicus
acatgagtgagtgcagttcgctagc

SEQ ID NO: 80023 - DNA, 25 bp, Rattus norvegicus
acatgagtgggcacgtgctgtcatc

SEQ ID NO: 80024 - DNA, 25 bp, Rattus norvegicus
acatgagtgggctcgtgctgtcatc

SEQ ID NO: 80025 - DNA, 25 bp, Rattus norvegicus
acatgagttttgaaacaccctgcta

SEQ ID NO: 80026 - DNA, 25 bp, Rattus norvegicus
acatgagttttgtaacaccctgcta

SEQ ID NO: 80027 - DNA, 25 bp, Rattus norvegicus
acatgatacccacccagagtcagca

SEQ ID NO: 80028 - DNA, 25 bp, Rattus norvegicus
acatgatacccagccagagtcagca

SEQ ID NO: 80029 - DNA, 25 bp, Rattus norvegicus
acatgatagtggcttggctacccaa

SEQ ID NO: 80030 - DNA, 25 bp, Rattus norvegicus
acatgatagtgggttggctacccaa

SEQ ID NO: 80031 - DNA, 25 bp, Rattus norvegicus
acatgatcctgcagtttccaaaggc

SEQ ID NO: 80032 - DNA, 25 bp, Rattus norvegicus
acatgatcctgctgtttccaaaggc

SEQ ID NO: 80033 - DNA, 25 bp, Rattus norvegicus
acatgatctgcacttgtcactccat

SEQ ID NO: 80034 - DNA, 25 bp, Rattus norvegicus
acatgatctgcagttgtcactccat

SEQ ID NO: 80035 - DNA, 25 bp, Rattus norvegicus
acatgatcttcaaggcgtaccgcac

SEQ ID NO: 80036 - DNA, 25 bp, Rattus norvegicus
acatgatcttcatggcgtaccgcac

SEQ ID NO: 80037 - DNA, 25 bp, Rattus norvegicus
acatgatgagtacctctccacttga

SEQ ID NO: 80038 - DNA, 25 bp, Rattus norvegicus
acatgatgagtagctctccacttga

SEQ ID NO: 80039 - DNA, 25 bp, Rattus norvegicus
acatgatgccagctcaagattcttc

SEQ ID NO: 80040 - DNA, 25 bp, Rattus norvegicus
acatgatgccaggtcaagattcttc

SEQ ID NO: 80041 - DNA, 25 bp, Rattus norvegicus
acatgatgccttatcaaactgctcc

SEQ ID NO: 80042 - DNA, 25 bp, Rattus norvegicus
acatgatgccttttcaaactgctcc

SEQ ID NO: 80043 - DNA, 25 bp, Rattus norvegicus
acatgatgctgccagtagggttaca

SEQ ID NO: 80044 - DNA, 25 bp, Rattus norvegicus
acatgatgctgcgagtagggttaca

SEQ ID NO: 80045 - DNA, 25 bp, Rattus norvegicus
acatgatgctgtactttcttgctca

SEQ ID NO: 80046 - DNA, 25 bp, Rattus norvegicus
acatgatgctgttctttcttgctca

SEQ ID NO: 80047 - DNA, 25 bp, Rattus norvegicus
acatgatggagtcgcagacgctgct

SEQ ID NO: 80048 - DNA, 25 bp, Rattus norvegicus
acatgatggagtggcagacgctgct

SEQ ID NO: 80049 - DNA, 25 bp, Rattus norvegicus
acatgatggcgtatcagttgggccc

SEQ ID NO: 80050 - DNA, 25 bp, Rattus norvegicus
acatgatggcgtttcagttgggccc

SEQ ID NO: 80051 - DNA, 25 bp, Rattus norvegicus
acatgatgggcacacttcttacccc

SEQ ID NO: 80052 - DNA, 25 bp, Rattus norvegicus
acatgatgggcagacttcttacccc

SEQ ID NO: 80053 - DNA, 25 bp, Rattus norvegicus
acatgatgtgaaagaggtggtcccc

SEQ ID NO: 80054 - DNA, 25 bp, Rattus norvegicus
acatgatgtgaatgaggtggtcccc

SEQ ID NO: 80055 - DNA, 25 bp, Rattus norvegicus
acatgattccctctattgcgtgcac

SEQ ID NO: 80056 - DNA, 25 bp, Rattus norvegicus
acatgattccctgtattgcgtgcac

SEQ ID NO: 80057 - DNA, 25 bp, Rattus norvegicus
acatgattcggtatctcccagctaa

SEQ ID NO: 80058 - DNA, 25 bp, Rattus norvegicus
acatgattcggtttctcccagctaa

SEQ ID NO: 80059 - DNA, 25 bp, Rattus norvegicus
acatgattctgtaaccttgactggg

SEQ ID NO: 80060 - DNA, 25 bp, Rattus norvegicus
acatgattctgttaccttgactggg

SEQ ID NO: 80061 - DNA, 25 bp, Rattus norvegicus
acatgattgccacaccttgcttctc

SEQ ID NO: 80062 - DNA, 25 bp, Rattus norvegicus
acatgattgccagaccttgcttctc

SEQ ID NO: 80063 - DNA, 25 bp, Rattus norvegicus
acatgattgtcaccttagtggcccg

SEQ ID NO: 80064 - DNA, 25 bp, Rattus norvegicus
acatgattgtcagcttagtggcccg

SEQ ID NO: 80065 - DNA, 25 bp, Rattus norvegicus
acatgatttaacacccataatgaac

SEQ ID NO: 80066 - DNA, 25 bp, Rattus norvegicus
acatgatttaactcccataatgaac

SEQ ID NO: 80067 - DNA, 25 bp, Rattus norvegicus
acatgatttcctcaagtacctggca

SEQ ID NO: 80068 - DNA, 25 bp, Rattus norvegicus
acatgatttcctgaagtacctggca

SEQ ID NO: 80069 - DNA, 25 bp, Rattus norvegicus
acatgatttgatccctcagccttta

SEQ ID NO: 80070 - DNA, 25 bp, Rattus norvegicus
acatgatttgatctgagcgtctccc

SEQ ID NO: 80071 - DNA, 25 bp, Rattus norvegicus
acatgatttgatgcctcagccttta

SEQ ID NO: 80072 - DNA, 25 bp, Rattus norvegicus
acatgatttgatgtgagcgtctccc

SEQ ID NO: 80073 - DNA, 25 bp, Rattus norvegicus
acatgatttgtaaactggttccagc

SEQ ID NO: 80074 - DNA, 25 bp, Rattus norvegicus
acatgatttgtaagtgaccttcact

SEQ ID NO: 80075 - DNA, 25 bp, Rattus norvegicus
acatgatttgtatactggttccagc

SEQ ID NO: 80076 - DNA, 25 bp, Rattus norvegicus
acatgatttgtatgtgaccttcact

SEQ ID NO: 80077 - DNA, 25 bp, Rattus norvegicus
acatgcaaatggactaccccttggt

SEQ ID NO: 80078 - DNA, 25 bp, Rattus norvegicus
acatgcaaatggtctaccccttggt

SEQ ID NO: 80079 - DNA, 25 bp, Rattus norvegicus
acatgcaactctctattggtaccca

SEQ ID NO: 80080 - DNA, 25 bp, Rattus norvegicus
acatgcaactctgtattggtaccca

SEQ ID NO: 80081 - DNA, 25 bp, Rattus norvegicus
acatgcacacagagcactccgtatg

SEQ ID NO: 80082 - DNA, 25 bp, Rattus norvegicus
acatgcacacagtgcactccgtatg

SEQ ID NO: 80083 - DNA, 25 bp, Rattus norvegicus
acatgcacacccacctagagagatg

SEQ ID NO: 80084 - DNA, 25 bp, Rattus norvegicus
acatgcacaccctcctagagagatg

SEQ ID NO: 80085 - DNA, 25 bp, Rattus norvegicus
acatgcacacgtctggttccacgtg

SEQ ID NO: 80086 - DNA, 25 bp, Rattus norvegicus
acatgcacacgtgtggttccacgtg

SEQ ID NO: 80087 - DNA, 25 bp, Rattus norvegicus
acatgcacagcaacgacaagccctt

SEQ ID NO: 80088 - DNA, 25 bp, Rattus norvegicus
acatgcacagcatcgacaagccctt

SEQ ID NO: 80089 - DNA, 25 bp, Rattus norvegicus
acatgcacccttaacagctggtata

SEQ ID NO: 80090 - DNA, 25 bp, Rattus norvegicus
acatgcaccctttacagctggtata

SEQ ID NO: 80091 - DNA, 25 bp, Rattus norvegicus
acatgcacgtccacacctcagataa

SEQ ID NO: 80092 - DNA, 25 bp, Rattus norvegicus
acatgcacgtcctcacctcagataa

SEQ ID NO: 80093 - DNA, 25 bp, Rattus norvegicus
acatgcactagcagtcatcggtttg

SEQ ID NO: 80094 - DNA, 25 bp, Rattus norvegicus
acatgcactagctgtcatcggtttg

SEQ ID NO: 80095 - DNA, 25 bp, Rattus norvegicus
acatgcactgaactgtttccactac

SEQ ID NO: 80096 - DNA, 25 bp, Rattus norvegicus
acatgcactgaagtgtttccactac

SEQ ID NO: 80097 - DNA, 25 bp, Rattus norvegicus
acatgcactttgagtgtctccttga

SEQ ID NO: 80098 - DNA, 25 bp, Rattus norvegicus
acatgcactttgtgtgtctccttga

SEQ ID NO: 80099 - DNA, 25 bp, Rattus norvegicus
acatgcagaaccaactgtcagctct

SEQ ID NO: 80100 - DNA, 25 bp, Rattus norvegicus
acatgcagaacctactgtcagctct

SEQ ID NO: 80101 - DNA, 25 bp, Rattus norvegicus
acatgcagaagccacactgggcagt

SEQ ID NO: 80102 - DNA, 25 bp, Rattus norvegicus
acatgcagaagcgacactgggcagt

SEQ ID NO: 80103 - DNA, 25 bp, Rattus norvegicus
acatgcagacccacgtatacacata

SEQ ID NO: 80104 - DNA, 25 bp, Rattus norvegicus
acatgcagaccctcgtatacacata

SEQ ID NO: 80105 - DNA, 25 bp, Rattus norvegicus
acatgcagagtcacagtagggcgga

SEQ ID NO: 80106 - DNA, 25 bp, Rattus norvegicus
acatgcagagtctcagtagggcgga

SEQ ID NO: 80107 - DNA, 25 bp, Rattus norvegicus
acatgcagcacgctgtggtcacagc

SEQ ID NO: 80108 - DNA, 25 bp, Rattus norvegicus
acatgcagcacggtgtggtcacagc

SEQ ID NO: 80109 - DNA, 25 bp, Rattus norvegicus
acatgcagcactcggtgttcacctg

SEQ ID NO: 80110 - DNA, 25 bp, Rattus norvegicus
acatgcagcactgggtgttcacctg

SEQ ID NO: 80111 - DNA, 25 bp, Rattus norvegicus
acatgcagccgcatgggctgggact

SEQ ID NO: 80112 - DNA, 25 bp, Rattus norvegicus
acatgcagccgcttgggctgggact

SEQ ID NO: 80113 - DNA, 25 bp, Rattus norvegicus
acatgcagctctcggtgtggcagcc

SEQ ID NO: 80114 - DNA, 25 bp, Rattus norvegicus
acatgcagctctgggtgtggcagcc

SEQ ID NO: 80115 - DNA, 25 bp, Rattus norvegicus
acatgcagggctctgggaccatcca

SEQ ID NO: 80116 - DNA, 25 bp, Rattus norvegicus
acatgcagggctgtgggaccatcca

SEQ ID NO: 80117 - DNA, 25 bp, Rattus norvegicus
acatgcagtgcaacgaggacccagt

SEQ ID NO: 80118 - DNA, 25 bp, Rattus norvegicus
acatgcagtgcatcgaggacccagt

SEQ ID NO: 80119 - DNA, 25 bp, Rattus norvegicus
acatgcagtggcagtgttacctcct

SEQ ID NO: 80120 - DNA, 25 bp, Rattus norvegicus
acatgcagtggctgtgttacctcct

SEQ ID NO: 80121 - DNA, 25 bp, Rattus norvegicus
acatgcatacgtatctttccttgtc

SEQ ID NO: 80122 - DNA, 25 bp, Rattus norvegicus
acatgcatacgtttctttccttgtc

SEQ ID NO: 80123 - DNA, 25 bp, Rattus norvegicus
acatgcatccagagatagccttggt

SEQ ID NO: 80124 - DNA, 25 bp, Rattus norvegicus
acatgcatccagtgatagccttggt

SEQ ID NO: 80125 - DNA, 25 bp, Rattus norvegicus
acatgcatgcttcctttagtcttct

SEQ ID NO: 80126 - DNA, 25 bp, Rattus norvegicus
acatgcatgcttgctttagtcttct

SEQ ID NO: 80127 - DNA, 25 bp, Rattus norvegicus
acatgcatggtgctttcggacatta

SEQ ID NO: 80128 - DNA, 25 bp, Rattus norvegicus
acatgcatggtggtttcggacatta

SEQ ID NO: 80129 - DNA, 25 bp, Rattus norvegicus
acatgcatgtaaatttgagtttcaa

SEQ ID NO: 80130 - DNA, 25 bp, Rattus norvegicus
acatgcatgtaattttgagtttcaa

SEQ ID NO: 80131 - DNA, 25 bp, Rattus norvegicus
acatgcatgtatacatttctctctt

SEQ ID NO: 80132 - DNA, 25 bp, Rattus norvegicus
acatgcatgtattcatttctctctt

SEQ ID NO: 80133 - DNA, 25 bp, Rattus norvegicus
acatgcattcataggagtaaattct

SEQ ID NO: 80134 - DNA, 25 bp, Rattus norvegicus
acatgcattcattggagtaaattct

SEQ ID NO: 80135 - DNA, 25 bp, Rattus norvegicus
acatgcatttgtacagtgggccctg

SEQ ID NO: 80136 - DNA, 25 bp, Rattus norvegicus
acatgcatttgtccacgagggcgct

SEQ ID NO: 80137 - DNA, 25 bp, Rattus norvegicus
acatgcatttgtgcacgagggcgct

SEQ ID NO: 80138 - DNA, 25 bp, Rattus norvegicus
acatgcatttgttcagtgggccctg

SEQ ID NO: 80139 - DNA, 25 bp, Rattus norvegicus
acatgccaacacatccagactgaag

SEQ ID NO: 80140 - DNA, 25 bp, Rattus norvegicus
acatgccaacacttccagactgaag

SEQ ID NO: 80141 - DNA, 25 bp, Rattus norvegicus
acatgccacgcaatgcagatgctgg

SEQ ID NO: 80142 - DNA, 25 bp, Rattus norvegicus
acatgccacgcattgcagatgctgg

SEQ ID NO: 80143 - DNA, 25 bp, Rattus norvegicus
acatgccagctcatgtccagtaagt

SEQ ID NO: 80144 - DNA, 25 bp, Rattus norvegicus
acatgccagctcttgtccagtaagt

SEQ ID NO: 80145 - DNA, 25 bp, Rattus norvegicus
acatgccagtccagcttgccagctt

SEQ ID NO: 80146 - DNA, 25 bp, Rattus norvegicus
acatgccagtcctgcttgccagctt

SEQ ID NO: 80147 - DNA, 25 bp, Rattus norvegicus
acatgccagtgactgtgcctttggg

SEQ ID NO: 80148 - DNA, 25 bp, Rattus norvegicus
acatgccagtgagtgtgcctttggg

SEQ ID NO: 80149 - DNA, 25 bp, Rattus norvegicus
acatgccattaacctagcactttag

SEQ ID NO: 80150 - DNA, 25 bp, Rattus norvegicus
acatgccattaagctagcactttag

SEQ ID NO: 80151 - DNA, 25 bp, Rattus norvegicus
acatgcccaaacctggcctggaagt

SEQ ID NO: 80152 - DNA, 25 bp, Rattus norvegicus
acatgcccaaacgtggcctggaagt

SEQ ID NO: 80153 - DNA, 25 bp, Rattus norvegicus
acatgcccaagcacatctagaagta

SEQ ID NO: 80154 - DNA, 25 bp, Rattus norvegicus
acatgcccaagctcatctagaagta

SEQ ID NO: 80155 - DNA, 25 bp, Rattus norvegicus
acatgcccagcacaggtgtgcagtt

SEQ ID NO: 80156 - DNA, 25 bp, Rattus norvegicus
acatgcccagcacttgtgtttaagc

SEQ ID NO: 80157 - DNA, 25 bp, Rattus norvegicus
acatgcccagcagaggtgtgcagtt

SEQ ID NO: 80158 - DNA, 25 bp, Rattus norvegicus
acatgcccagcagttgtgtttaagc

SEQ ID NO: 80159 - DNA, 25 bp, Rattus norvegicus
acatgcccagttcgtgatgcctctg

SEQ ID NO: 80160 - DNA, 25 bp, Rattus norvegicus
acatgcccagttctttcagtgatgc

SEQ ID NO: 80161 - DNA, 25 bp, Rattus norvegicus
acatgcccagttggtgatgcctctg

SEQ ID NO: 80162 - DNA, 25 bp, Rattus norvegicus
acatgcccagttgtttcagtgatgc

SEQ ID NO: 80163 - DNA, 25 bp, Rattus norvegicus
acatgccctaagatttatcggagtt

SEQ ID NO: 80164 - DNA, 25 bp, Rattus norvegicus
acatgccctaagttttatcggagtt

SEQ ID NO: 80165 - DNA, 25 bp, Rattus norvegicus
acatgccctgaacatactatcagat

SEQ ID NO: 80166 - DNA, 25 bp, Rattus norvegicus
acatgccctgaagatactatcagat

SEQ ID NO: 80167 - DNA, 25 bp, Rattus norvegicus
acatgccctgcgcttgcactgggtg

SEQ ID NO: 80168 - DNA, 25 bp, Rattus norvegicus
acatgccctgcggttgcactgggtg

SEQ ID NO: 80169 - DNA, 25 bp, Rattus norvegicus
acatgccctgggaagtagccgggta

SEQ ID NO: 80170 - DNA, 25 bp, Rattus norvegicus
acatgccctgggtagtagccgggta

SEQ ID NO: 80171 - DNA, 25 bp, Rattus norvegicus
acatgccctgtgaccaggtgtgatg

SEQ ID NO: 80172 - DNA, 25 bp, Rattus norvegicus
acatgccctgtgtccaggtgtgatg

SEQ ID NO: 80173 - DNA, 25 bp, Rattus norvegicus
acatgccgggtacgtgtgtgccacc

SEQ ID NO: 80174 - DNA, 25 bp, Rattus norvegicus
acatgccgggtaggtgtgtgccacc

SEQ ID NO: 80175 - DNA, 25 bp, Rattus norvegicus
acatgccgtgtgctgtttgtatcct

SEQ ID NO: 80176 - DNA, 25 bp, Rattus norvegicus
acatgccgtgtggtgtttgtatcct

SEQ ID NO: 80177 - DNA, 25 bp, Rattus norvegicus
acatgccgttgaatccagcactcaa

SEQ ID NO: 80178 - DNA, 25 bp, Rattus norvegicus
acatgccgttgattccagcactcaa

SEQ ID NO: 80179 - DNA, 25 bp, Rattus norvegicus
acatgcctacaacgacacgtgtgtc

SEQ ID NO: 80180 - DNA, 25 bp, Rattus norvegicus
acatgcctacaaggacacgtgtgtc

SEQ ID NO: 80181 - DNA, 25 bp, Rattus norvegicus
acatgcctacacagtattgctacag

SEQ ID NO: 80182 - DNA, 25 bp, Rattus norvegicus
acatgcctacactgtattgctacag

SEQ ID NO: 80183 - DNA, 25 bp, Rattus norvegicus
acatgcctaggcacagtgctgctac

SEQ ID NO: 80184 - DNA, 25 bp, Rattus norvegicus
acatgcctaggctcagtgctgctac

SEQ ID NO: 80185 - DNA, 25 bp, Rattus norvegicus
acatgcctgactattctttcatact

SEQ ID NO: 80186 - DNA, 25 bp, Rattus norvegicus
acatgcctgacttttctttcatact

SEQ ID NO: 80187 - DNA, 25 bp, Rattus norvegicus
acatgcctgcctatttacctacatg

SEQ ID NO: 80188 - DNA, 25 bp, Rattus norvegicus
acatgcctgcctttttacctacatg

SEQ ID NO: 80189 - DNA, 25 bp, Rattus norvegicus
acatgccttctcattggtaaactca

SEQ ID NO: 80190 - DNA, 25 bp, Rattus norvegicus
acatgccttctctttggtaaactca

SEQ ID NO: 80191 - DNA, 25 bp, Rattus norvegicus
acatgccttgctcattagacacgcc

SEQ ID NO: 80192 - DNA, 25 bp, Rattus norvegicus
acatgccttgctgattagacacgcc

SEQ ID NO: 80193 - DNA, 25 bp, Rattus norvegicus
acatgccttgtgatttactcaacaa

SEQ ID NO: 80194 - DNA, 25 bp, Rattus norvegicus
acatgccttgtgttttactcaacaa

SEQ ID NO: 80195 - DNA, 25 bp, Rattus norvegicus
acatgccttgttaaacttggagtct

SEQ ID NO: 80196 - DNA, 25 bp, Rattus norvegicus
acatgccttgtttaacttggagtct

SEQ ID NO: 80197 - DNA, 25 bp, Rattus norvegicus
acatgcgacaagattttggcgatga

SEQ ID NO: 80198 - DNA, 25 bp, Rattus norvegicus
acatgcgacaagtttttggcgatga

SEQ ID NO: 80199 - DNA, 25 bp, Rattus norvegicus
acatgcgactctacaagaatggtgc

SEQ ID NO: 80200 - DNA, 25 bp, Rattus norvegicus
acatgcgactcttcaagaatggtgc

SEQ ID NO: 80201 - DNA, 25 bp, Rattus norvegicus
acatgcgcacacataggcctgaacg

SEQ ID NO: 80202 - DNA, 25 bp, Rattus norvegicus
acatgcgcacacttaggcctgaacg

SEQ ID NO: 80203 - DNA, 25 bp, Rattus norvegicus
acatgcgccactagcggcaaaggtt

SEQ ID NO: 80204 - DNA, 25 bp, Rattus norvegicus
acatgcgccacttgcggcaaaggtt

SEQ ID NO: 80205 - DNA, 25 bp, Rattus norvegicus
acatgcgccagaacgaccagatggt

SEQ ID NO: 80206 - DNA, 25 bp, Rattus norvegicus
acatgcgccagatcgaccagatggt

SEQ ID NO: 80207 - DNA, 25 bp, Rattus norvegicus
acatgcgccaggctgtagtcgccag

SEQ ID NO: 80208 - DNA, 25 bp, Rattus norvegicus
acatgcgccagggtgtagtcgccag

SEQ ID NO: 80209 - DNA, 25 bp, Rattus norvegicus
acatgcgcgaccattagatggcgct

SEQ ID NO: 80210 - DNA, 25 bp, Rattus norvegicus
acatgcgcgacctttagatggcgct

SEQ ID NO: 80211 - DNA, 25 bp, Rattus norvegicus
acatgcggatctctggccagccaag

SEQ ID NO: 80212 - DNA, 25 bp, Rattus norvegicus
acatgcggatctgtggccagccaag

SEQ ID NO: 80213 - DNA, 25 bp, Rattus norvegicus
acatgcgggcccaggcgaatgacgt

SEQ ID NO: 80214 - DNA, 25 bp, Rattus norvegicus
acatgcgggccctggcgaatgacgt

SEQ ID NO: 80215 - DNA, 25 bp, Rattus norvegicus
acatgcgggctaagtctctctggaa

SEQ ID NO: 80216 - DNA, 25 bp, Rattus norvegicus
acatgcgggctatgtctctctggaa

SEQ ID NO: 80217 - DNA, 25 bp, Rattus norvegicus
acatgcgggctgaggactgctctga

SEQ ID NO: 80218 - DNA, 25 bp, Rattus norvegicus
acatgcgggctgtggactgctctga

SEQ ID NO: 80219 - DNA, 25 bp, Rattus norvegicus
acatgcgtactgagcgctttgggca

SEQ ID NO: 80220 - DNA, 25 bp, Rattus norvegicus
acatgcgtactgtgcgctttgggca

SEQ ID NO: 80221 - DNA, 25 bp, Rattus norvegicus
acatgcgtatccacacgctggacaa

SEQ ID NO: 80222 - DNA, 25 bp, Rattus norvegicus
acatgcgtatcctcacgctggacaa

SEQ ID NO: 80223 - DNA, 25 bp, Rattus norvegicus
acatgctaagttattctttcatcag

SEQ ID NO: 80224 - DNA, 25 bp, Rattus norvegicus
acatgctaagtttttctttcatcag

SEQ ID NO: 80225 - DNA, 25 bp, Rattus norvegicus
acatgctacagaagttattggctaa

SEQ ID NO: 80226 - DNA, 25 bp, Rattus norvegicus
acatgctacagatgttattggctaa

SEQ ID NO: 80227 - DNA, 25 bp, Rattus norvegicus
acatgctacccacacacagcaggta

SEQ ID NO: 80228 - DNA, 25 bp, Rattus norvegicus
acatgctacccagacacagcaggta

SEQ ID NO: 80229 - DNA, 25 bp, Rattus norvegicus
acatgctactataggccatccagga

SEQ ID NO: 80230 - DNA, 25 bp, Rattus norvegicus
acatgctactattggccatccagga

SEQ ID NO: 80231 - DNA, 25 bp, Rattus norvegicus
acatgctagctccttgacactggaa

SEQ ID NO: 80232 - DNA, 25 bp, Rattus norvegicus
acatgctagctcgttgacactggaa

SEQ ID NO: 80233 - DNA, 25 bp, Rattus norvegicus
acatgctaggcacgaggtacactct

SEQ ID NO: 80234 - DNA, 25 bp, Rattus norvegicus
acatgctaggcaggaggtacactct

SEQ ID NO: 80235 - DNA, 25 bp, Rattus norvegicus
acatgctagtgtacgtttattttgc

SEQ ID NO: 80236 - DNA, 25 bp, Rattus norvegicus
acatgctagtgttcgtttattttgc

SEQ ID NO: 80237 - DNA, 25 bp, Rattus norvegicus
acatgctatccaaagacgtaacaca

SEQ ID NO: 80238 - DNA, 25 bp, Rattus norvegicus
acatgctatccatagacgtaacaca

SEQ ID NO: 80239 - DNA, 25 bp, Rattus norvegicus
acatgctatcttagttctgtggtat

SEQ ID NO: 80240 - DNA, 25 bp, Rattus norvegicus
acatgctatctttgttctgtggtat

SEQ ID NO: 80241 - DNA, 25 bp, Rattus norvegicus
acatgctcacacagactgcgttaga

SEQ ID NO: 80242 - DNA, 25 bp, Rattus norvegicus
acatgctcacactgactgcgttaga

SEQ ID NO: 80243 - DNA, 25 bp, Rattus norvegicus
acatgctccagtctcccatgaggag

SEQ ID NO: 80244 - DNA, 25 bp, Rattus norvegicus
acatgctccagtgtcccatgaggag

SEQ ID NO: 80245 - DNA, 25 bp, Rattus norvegicus
acatgctcccggagggtggcaaagc

SEQ ID NO: 80246 - DNA, 25 bp, Rattus norvegicus
acatgctcccggtgggtggcaaagc

SEQ ID NO: 80247 - DNA, 25 bp, Rattus norvegicus
acatgctccctgaacagtgttgtgc

SEQ ID NO: 80248 - DNA, 25 bp, Rattus norvegicus
acatgctccctgtacagtgttgtgc

SEQ ID NO: 80249 - DNA, 25 bp, Rattus norvegicus
acatgctcctgaatctcttttttca

SEQ ID NO: 80250 - DNA, 25 bp, Rattus norvegicus
acatgctcctgattctcttttttca

SEQ ID NO: 80251 - DNA, 25 bp, Rattus norvegicus
acatgctccttcactggcaattata

SEQ ID NO: 80252 - DNA, 25 bp, Rattus norvegicus
acatgctccttctctggcaattata

SEQ ID NO: 80253 - DNA, 25 bp, Rattus norvegicus
acatgctcggtgaggtcgcttctgc

SEQ ID NO: 80254 - DNA, 25 bp, Rattus norvegicus
acatgctcggtgtggtcgcttctgc

SEQ ID NO: 80255 - DNA, 25 bp, Rattus norvegicus
acatgctctaataatttactcaaag

SEQ ID NO: 80256 - DNA, 25 bp, Rattus norvegicus
acatgctctaatctcagcctgagga

SEQ ID NO: 80257 - DNA, 25 bp, Rattus norvegicus
acatgctctaatgtcagcctgagga

SEQ ID NO: 80258 - DNA, 25 bp, Rattus norvegicus
acatgctctaattatttactcaaag

SEQ ID NO: 80259 - DNA, 25 bp, Rattus norvegicus
acatgctctattctggtcttgacca

SEQ ID NO: 80260 - DNA, 25 bp, Rattus norvegicus
acatgctctattgtggtcttgacca

SEQ ID NO: 80261 - DNA, 25 bp, Rattus norvegicus
acatgctctgacctgacttaaaatt

SEQ ID NO: 80262 - DNA, 25 bp, Rattus norvegicus
acatgctctgacgtgacttaaaatt

SEQ ID NO: 80263 - DNA, 25 bp, Rattus norvegicus
acatgctctgcactggtggtaactt

SEQ ID NO: 80264 - DNA, 25 bp, Rattus norvegicus
acatgctctgcagtggtggtaactt

SEQ ID NO: 80265 - DNA, 25 bp, Rattus norvegicus
acatgctctggtagtgtagcttact

SEQ ID NO: 80266 - DNA, 25 bp, Rattus norvegicus
acatgctctggttgtgtagcttact

SEQ ID NO: 80267 - DNA, 25 bp, Rattus norvegicus
acatgctctgttcagctattgcccc

SEQ ID NO: 80268 - DNA, 25 bp, Rattus norvegicus
acatgctctgttgagctattgcccc

SEQ ID NO: 80269 - DNA, 25 bp, Rattus norvegicus
acatgctcttctctggaaggagagt

SEQ ID NO: 80270 - DNA, 25 bp, Rattus norvegicus
acatgctcttctgtggaaggagagt

SEQ ID NO: 80271 - DNA, 25 bp, Rattus norvegicus
acatgctctttaagctgtgctgtgt

SEQ ID NO: 80272 - DNA, 25 bp, Rattus norvegicus
acatgctctttatgctgtgctgtgt

SEQ ID NO: 80273 - DNA, 25 bp, Rattus norvegicus
acatgctctttgattatttgggctt

SEQ ID NO: 80274 - DNA, 25 bp, Rattus norvegicus
acatgctctttgtttatttgggctt

SEQ ID NO: 80275 - DNA, 25 bp, Rattus norvegicus
acatgctgaatcactggtggaaaca

SEQ ID NO: 80276 - DNA, 25 bp, Rattus norvegicus
acatgctgaatctctggtggaaaca

SEQ ID NO: 80277 - DNA, 25 bp, Rattus norvegicus
acatgctgcagtagtccatagaaaa

SEQ ID NO: 80278 - DNA, 25 bp, Rattus norvegicus
acatgctgcagttgtccatagaaaa

SEQ ID NO: 80279 - DNA, 25 bp, Rattus norvegicus
acatgctgcatgacactgaggctga

SEQ ID NO: 80280 - DNA, 25 bp, Rattus norvegicus
acatgctgcatgtcactgaggctga

SEQ ID NO: 80281 - DNA, 25 bp, Rattus norvegicus
acatgctgcccacttacagtgcaac

SEQ ID NO: 80282 - DNA, 25 bp, Rattus norvegicus
acatgctgcccagttacagtgcaac

SEQ ID NO: 80283 - DNA, 25 bp, Rattus norvegicus
acatgctgctttagcttagctctta

SEQ ID NO: 80284 - DNA, 25 bp, Rattus norvegicus
acatgctgcttttgcttagctctta

SEQ ID NO: 80285 - DNA, 25 bp, Rattus norvegicus
acatgctggactataatagttgagc

SEQ ID NO: 80286 - DNA, 25 bp, Rattus norvegicus
acatgctggactttaatagttgagc

SEQ ID NO: 80287 - DNA, 25 bp, Rattus norvegicus
acatgctggagtcaccagacccttg

SEQ ID NO: 80288 - DNA, 25 bp, Rattus norvegicus
acatgctggagtgaccagacccttg

SEQ ID NO: 80289 - DNA, 25 bp, Rattus norvegicus
acatgctggcatctcagggaatccc

SEQ ID NO: 80290 - DNA, 25 bp, Rattus norvegicus
acatgctggcatgtcagggaatccc

SEQ ID NO: 80291 - DNA, 25 bp, Rattus norvegicus
acatgctgtatgactcaacatttgc

SEQ ID NO: 80292 - DNA, 25 bp, Rattus norvegicus
acatgctgtatgtctcaacatttgc

SEQ ID NO: 80293 - DNA, 25 bp, Rattus norvegicus
acatgctgtcccaaggctcagtggt

SEQ ID NO: 80294 - DNA, 25 bp, Rattus norvegicus
acatgctgtccctaggctcagtggt

SEQ ID NO: 80295 - DNA, 25 bp, Rattus norvegicus
acatgctgtgttctgcttccttttg

SEQ ID NO: 80296 - DNA, 25 bp, Rattus norvegicus
acatgctgtgttgtgcttccttttg

SEQ ID NO: 80297 - DNA, 25 bp, Rattus norvegicus
acatgctgttctctttgaccacgtt

SEQ ID NO: 80298 - DNA, 25 bp, Rattus norvegicus
acatgctgttctgtttgaccacgtt

SEQ ID NO: 80299 - DNA, 25 bp, Rattus norvegicus
acatgctgtttcaaggtgccaccga

SEQ ID NO: 80300 - DNA, 25 bp, Rattus norvegicus
acatgctgtttctaggtgccaccga

SEQ ID NO: 80301 - DNA, 25 bp, Rattus norvegicus
acatgcttatgcatcacgtaatatc

SEQ ID NO: 80302 - DNA, 25 bp, Rattus norvegicus
acatgcttatgcttcacgtaatatc

SEQ ID NO: 80303 - DNA, 25 bp, Rattus norvegicus
acatgcttcagtcgtgtgtcaacta

SEQ ID NO: 80304 - DNA, 25 bp, Rattus norvegicus
acatgcttcagtggtgtgtcaacta

SEQ ID NO: 80305 - DNA, 25 bp, Rattus norvegicus
acatgcttcatgaacagcgcggcgc

SEQ ID NO: 80306 - DNA, 25 bp, Rattus norvegicus
acatgcttcatgtacagcgcggcgc

SEQ ID NO: 80307 - DNA, 25 bp, Rattus norvegicus
acatgcttccctaaacggttttgtg

SEQ ID NO: 80308 - DNA, 25 bp, Rattus norvegicus
acatgcttccctagcttactgtttc

SEQ ID NO: 80309 - DNA, 25 bp, Rattus norvegicus
acatgcttccctagggcttgcctat

SEQ ID NO: 80310 - DNA, 25 bp, Rattus norvegicus
acatgcttcccttaacggttttgtg

SEQ ID NO: 80311 - DNA, 25 bp, Rattus norvegicus
acatgcttcccttgcttactgtttc

SEQ ID NO: 80312 - DNA, 25 bp, Rattus norvegicus
acatgcttcccttgggcttgcctat

SEQ ID NO: 80313 - DNA, 25 bp, Rattus norvegicus
acatgcttctgtcgaggcgcgaaca

SEQ ID NO: 80314 - DNA, 25 bp, Rattus norvegicus
acatgcttctgtggaggcgcgaaca

SEQ ID NO: 80315 - DNA, 25 bp, Rattus norvegicus
acatgcttcttcagaaccctaagta

SEQ ID NO: 80316 - DNA, 25 bp, Rattus norvegicus
acatgcttcttctgaaccctaagta

SEQ ID NO: 80317 - DNA, 25 bp, Rattus norvegicus
acatgcttgcctccacagagagcat

SEQ ID NO: 80318 - DNA, 25 bp, Rattus norvegicus
acatgcttgcctgcacagagagcat

SEQ ID NO: 80319 - DNA, 25 bp, Rattus norvegicus
acatgcttgtgtcaggttcctcaga

SEQ ID NO: 80320 - DNA, 25 bp, Rattus norvegicus
acatgcttgtgtgaggttcctcaga

SEQ ID NO: 80321 - DNA, 25 bp, Rattus norvegicus
acatgcttgttgacccagtgctggg

SEQ ID NO: 80322 - DNA, 25 bp, Rattus norvegicus
acatgcttgttgtcccagtgctggg

SEQ ID NO: 80323 - DNA, 25 bp, Rattus norvegicus
acatgctttctaacttgtgcacacc

SEQ ID NO: 80324 - DNA, 25 bp, Rattus norvegicus
acatgctttctactgtttcagctga

SEQ ID NO: 80325 - DNA, 25 bp, Rattus norvegicus
acatgctttctagtgtttcagctga

SEQ ID NO: 80326 - DNA, 25 bp, Rattus norvegicus
acatgctttctatcttgtgcacacc

SEQ ID NO: 80327 - DNA, 25 bp, Rattus norvegicus
acatgctttcttactgtaccattca

SEQ ID NO: 80328 - DNA, 25 bp, Rattus norvegicus
acatgctttctttctgtaccattca

SEQ ID NO: 80329 - DNA, 25 bp, Rattus norvegicus
acatgcttttgcacattattcccaa

SEQ ID NO: 80330 - DNA, 25 bp, Rattus norvegicus
acatgcttttgctcattattcccaa

SEQ ID NO: 80331 - DNA, 25 bp, Rattus norvegicus
acatgcttttgtctgcatcctgaga

SEQ ID NO: 80332 - DNA, 25 bp, Rattus norvegicus
acatgcttttgtgtgcatcctgaga

SEQ ID NO: 80333 - DNA, 25 bp, Rattus norvegicus
acatggaaacctatgtactttgcac

SEQ ID NO: 80334 - DNA, 25 bp, Rattus norvegicus
acatggaaacctttgtactttgcac

SEQ ID NO: 80335 - DNA, 25 bp, Rattus norvegicus
acatggaaggacagcttaggaaact

SEQ ID NO: 80336 - DNA, 25 bp, Rattus norvegicus
acatggaaggactgcttaggaaact

SEQ ID NO: 80337 - DNA, 25 bp, Rattus norvegicus
acatggacacgcctgctctcggatt

SEQ ID NO: 80338 - DNA, 25 bp, Rattus norvegicus
acatggacacgcgtgctctcggatt

SEQ ID NO: 80339 - DNA, 25 bp, Rattus norvegicus
acatggacatggagaggctaacagc

SEQ ID NO: 80340 - DNA, 25 bp, Rattus norvegicus
acatggacatggtgaggctaacagc

SEQ ID NO: 80341 - DNA, 25 bp, Rattus norvegicus
acatggacatgtccacctacataca

SEQ ID NO: 80342 - DNA, 25 bp, Rattus norvegicus
acatggacatgtgcacctacataca

SEQ ID NO: 80343 - DNA, 25 bp, Rattus norvegicus
acatggacatttactgttctcacaa

SEQ ID NO: 80344 - DNA, 25 bp, Rattus norvegicus
acatggacattttctgttctcacaa

SEQ ID NO: 80345 - DNA, 25 bp, Rattus norvegicus
acatggactatcatacctcactatc

SEQ ID NO: 80346 - DNA, 25 bp, Rattus norvegicus
acatggactatcttacctcactatc

SEQ ID NO: 80347 - DNA, 25 bp, Rattus norvegicus
acatggactcctatgacattgtgtt

SEQ ID NO: 80348 - DNA, 25 bp, Rattus norvegicus
acatggactcctttgacattgtgtt

SEQ ID NO: 80349 - DNA, 25 bp, Rattus norvegicus
acatggactgtgaggcctctgctgg

SEQ ID NO: 80350 - DNA, 25 bp, Rattus norvegicus
acatggactgtgtggcctctgctgg

SEQ ID NO: 80351 - DNA, 25 bp, Rattus norvegicus
acatggacttcacagaacccacaga

SEQ ID NO: 80352 - DNA, 25 bp, Rattus norvegicus
acatggacttcagagaacccacaga

SEQ ID NO: 80353 - DNA, 25 bp, Rattus norvegicus
acatggactttcactccgggctgga

SEQ ID NO: 80354 - DNA, 25 bp, Rattus norvegicus
acatggactttctctccgggctgga

SEQ ID NO: 80355 - DNA, 25 bp, Rattus norvegicus
acatggagaggaataccctgcagca

SEQ ID NO: 80356 - DNA, 25 bp, Rattus norvegicus
acatggagaggattaccctgcagca

SEQ ID NO: 80357 - DNA, 25 bp, Rattus norvegicus
acatggagcaggatgtggcgcctca

SEQ ID NO: 80358 - DNA, 25 bp, Rattus norvegicus
acatggagcaggttgtggcgcctca

SEQ ID NO: 80359 - DNA, 25 bp, Rattus norvegicus
acatggagccaaattgtctgtaact

SEQ ID NO: 80360 - DNA, 25 bp, Rattus norvegicus
acatggagccaatttgtctgtaact

SEQ ID NO: 80361 - DNA, 25 bp, Rattus norvegicus
acatggagctgtctgctagctgaaa

SEQ ID NO: 80362 - DNA, 25 bp, Rattus norvegicus
acatggagctgtgtgctagctgaaa

SEQ ID NO: 80363 - DNA, 25 bp, Rattus norvegicus
acatggaggttcctgtcccctagga

SEQ ID NO: 80364 - DNA, 25 bp, Rattus norvegicus
acatggaggttcgtgtcccctagga

SEQ ID NO: 80365 - DNA, 25 bp, Rattus norvegicus
acatggagtgtacctgatgactgtt

SEQ ID NO: 80366 - DNA, 25 bp, Rattus norvegicus
acatggagtgtagctgatgactgtt

SEQ ID NO: 80367 - DNA, 25 bp, Rattus norvegicus
acatggagttctatagtgggtcaca

SEQ ID NO: 80368 - DNA, 25 bp, Rattus norvegicus
acatggagttctttagtgggtcaca

SEQ ID NO: 80369 - DNA, 25 bp, Rattus norvegicus
acatggagttgcagttatcgcctgt

SEQ ID NO: 80370 - DNA, 25 bp, Rattus norvegicus
acatggagttgctgttatcgcctgt

SEQ ID NO: 80371 - DNA, 25 bp, Rattus norvegicus
acatggagtttgaccactgactcag

SEQ ID NO: 80372 - DNA, 25 bp, Rattus norvegicus
acatggagtttgtccactgactcag

SEQ ID NO: 80373 - DNA, 25 bp, Rattus norvegicus
acatggatcaagagagcctgctcat

SEQ ID NO: 80374 - DNA, 25 bp, Rattus norvegicus
acatggatcaagtgagcctgctcat

SEQ ID NO: 80375 - DNA, 25 bp, Rattus norvegicus
acatggatccatccttgccttggga

SEQ ID NO: 80376 - DNA, 25 bp, Rattus norvegicus
acatggatccatgcttgccttggga

SEQ ID NO: 80377 - DNA, 25 bp, Rattus norvegicus
acatggatctccctcgtcagatgtc

SEQ ID NO: 80378 - DNA, 25 bp, Rattus norvegicus
acatggatctccgtcgtcagatgtc

SEQ ID NO: 80379 - DNA, 25 bp, Rattus norvegicus
acatggatcttgatagggccagcct

SEQ ID NO: 80380 - DNA, 25 bp, Rattus norvegicus
acatggatcttgttagggccagcct

SEQ ID NO: 80381 - DNA, 25 bp, Rattus norvegicus
acatggatgcccacggctcaaatat

SEQ ID NO: 80382 - DNA, 25 bp, Rattus norvegicus
acatggatgccctcggctcaaatat

SEQ ID NO: 80383 - DNA, 25 bp, Rattus norvegicus
acatggatgtgaccctacggtgcaa

SEQ ID NO: 80384 - DNA, 25 bp, Rattus norvegicus
acatggatgtgagcctacggtgcaa

SEQ ID NO: 80385 - DNA, 25 bp, Rattus norvegicus
acatggatgtgtatcccctgttctg

SEQ ID NO: 80386 - DNA, 25 bp, Rattus norvegicus
acatggatgtgtttcccctgttctg

SEQ ID NO: 80387 - DNA, 25 bp, Rattus norvegicus
acatggattaacatatcgggttttc

SEQ ID NO: 80388 - DNA, 25 bp, Rattus norvegicus
acatggattaacttatcgggttttc

SEQ ID NO: 80389 - DNA, 25 bp, Rattus norvegicus
acatggattatgaccacaggatcac

SEQ ID NO: 80390 - DNA, 25 bp, Rattus norvegicus
acatggattatgtccacaggatcac

SEQ ID NO: 80391 - DNA, 25 bp, Rattus norvegicus
acatggattcagacttcctactctt

SEQ ID NO: 80392 - DNA, 25 bp, Rattus norvegicus
acatggattcagtcttcctactctt

SEQ ID NO: 80393 - DNA, 25 bp, Rattus norvegicus
acatggattctgattgctgtcctgt

SEQ ID NO: 80394 - DNA, 25 bp, Rattus norvegicus
acatggattctgtttgctgtcctgt

SEQ ID NO: 80395 - DNA, 25 bp, Rattus norvegicus
acatggattcttcagactcgtgctc

SEQ ID NO: 80396 - DNA, 25 bp, Rattus norvegicus
acatggattcttgagactcgtgctc

SEQ ID NO: 80397 - DNA, 25 bp, Rattus norvegicus
acatggcagcagagtgtggaaccct

SEQ ID NO: 80398 - DNA, 25 bp, Rattus norvegicus
acatggcagcagtgtgtggaaccct

SEQ ID NO: 80399 - DNA, 25 bp, Rattus norvegicus
acatggcagcatccaagcaggcaaa

SEQ ID NO: 80400 - DNA, 25 bp, Rattus norvegicus
acatggcagcatgcaagcaggcaaa

SEQ ID NO: 80401 - DNA, 25 bp, Rattus norvegicus
acatggcagctaactgacaccctca

SEQ ID NO: 80402 - DNA, 25 bp, Rattus norvegicus
acatggcagctatctgacaccctca

SEQ ID NO: 80403 - DNA, 25 bp, Rattus norvegicus
acatggcagcttcaggctgtccgtt

SEQ ID NO: 80404 - DNA, 25 bp, Rattus norvegicus
acatggcagcttgaggctgtccgtt

SEQ ID NO: 80405 - DNA, 25 bp, Rattus norvegicus
acatggcagggcaagggtaagacaa

SEQ ID NO: 80406 - DNA, 25 bp, Rattus norvegicus
acatggcagggctagggtaagacaa

SEQ ID NO: 80407 - DNA, 25 bp, Rattus norvegicus
acatggcaggtaaatgtcatctctc

SEQ ID NO: 80408 - DNA, 25 bp, Rattus norvegicus
acatggcaggtacgtgatagagaca

SEQ ID NO: 80409 - DNA, 25 bp, Rattus norvegicus
acatggcaggtaggtgatagagaca

SEQ ID NO: 80410 - DNA, 25 bp, Rattus norvegicus
acatggcaggtatatgtcatctctc

SEQ ID NO: 80411 - DNA, 25 bp, Rattus norvegicus
acatggcaggtcctaaccatctgta

SEQ ID NO: 80412 - DNA, 25 bp, Rattus norvegicus
acatggcaggtcgtaaccatctgta

SEQ ID NO: 80413 - DNA, 25 bp, Rattus norvegicus
acatggcagtgcaggaggcatccgt

SEQ ID NO: 80414 - DNA, 25 bp, Rattus norvegicus
acatggcagtgctggaggcatccgt

SEQ ID NO: 80415 - DNA, 25 bp, Rattus norvegicus
acatggcagtttcttctccgaggac

SEQ ID NO: 80416 - DNA, 25 bp, Rattus norvegicus
acatggcagtttgttctccgaggac

SEQ ID NO: 80417 - DNA, 25 bp, Rattus norvegicus
acatggcatcatcagcttatggagc

SEQ ID NO: 80418 - DNA, 25 bp, Rattus norvegicus
acatggcatcatgagcttatggagc

SEQ ID NO: 80419 - DNA, 25 bp, Rattus norvegicus
acatggcattgtcctcctgttggaa

SEQ ID NO: 80420 - DNA, 25 bp, Rattus norvegicus
acatggcattgtgctcctgttggaa

SEQ ID NO: 80421 - DNA, 25 bp, Rattus norvegicus
acatggccagtgctgctgtcatcca

SEQ ID NO: 80422 - DNA, 25 bp, Rattus norvegicus
acatggccagtggtgctgtcatcca

SEQ ID NO: 80423 - DNA, 25 bp, Rattus norvegicus
acatggccattcatgaccacagcag

SEQ ID NO: 80424 - DNA, 25 bp, Rattus norvegicus
acatggccattcttgaccacagcag

SEQ ID NO: 80425 - DNA, 25 bp, Rattus norvegicus
acatggcccagcactaccagagcgg

SEQ ID NO: 80426 - DNA, 25 bp, Rattus norvegicus
acatggcccagctctaccagagcgg

SEQ ID NO: 80427 - DNA, 25 bp, Rattus norvegicus
acatggcccaggagctggaccagaa

SEQ ID NO: 80428 - DNA, 25 bp, Rattus norvegicus
acatggcccaggtgctggaccagaa

SEQ ID NO: 80429 - DNA, 25 bp, Rattus norvegicus
acatggccccatcgttcaagttcat

SEQ ID NO: 80430 - DNA, 25 bp, Rattus norvegicus
acatggccccatggttcaagttcat

SEQ ID NO: 80431 - DNA, 25 bp, Rattus norvegicus
acatggcccgagctggctcagtgta

SEQ ID NO: 80432 - DNA, 25 bp, Rattus norvegicus
acatggcccgaggtggctcagtgta

SEQ ID NO: 80433 - DNA, 25 bp, Rattus norvegicus
acatggccgagaccccgagtctgtg

SEQ ID NO: 80434 - DNA, 25 bp, Rattus norvegicus
acatggccgagagcccgagtctgtg

SEQ ID NO: 80435 - DNA, 25 bp, Rattus norvegicus
acatggccgtggctgtttctaagaa

SEQ ID NO: 80436 - DNA, 25 bp, Rattus norvegicus
acatggccgtgggtgtttctaagaa

SEQ ID NO: 80437 - DNA, 25 bp, Rattus norvegicus
acatggcctattccagtcttggtta

SEQ ID NO: 80438 - DNA, 25 bp, Rattus norvegicus
acatggcctattgcagtcttggtta

SEQ ID NO: 80439 - DNA, 25 bp, Rattus norvegicus
acatggcctgctctgctaatgataa

SEQ ID NO: 80440 - DNA, 25 bp, Rattus norvegicus
acatggcctgctgtgctaatgataa

SEQ ID NO: 80441 - DNA, 25 bp, Rattus norvegicus
acatggcctgggataagttcttagt

SEQ ID NO: 80442 - DNA, 25 bp, Rattus norvegicus
acatggcctgggttaagttcttagt

SEQ ID NO: 80443 - DNA, 25 bp, Rattus norvegicus
acatggcgcgacatctggagcagtg

SEQ ID NO: 80444 - DNA, 25 bp, Rattus norvegicus
acatggcgcgacttctggagcagtg

SEQ ID NO: 80445 - DNA, 25 bp, Rattus norvegicus
acatggcgcgtgagcatttcaagaa

SEQ ID NO: 80446 - DNA, 25 bp, Rattus norvegicus
acatggcgcgtgtgcatttcaagaa

SEQ ID NO: 80447 - DNA, 25 bp, Rattus norvegicus
acatggcggctaatagacttcttga

SEQ ID NO: 80448 - DNA, 25 bp, Rattus norvegicus
acatggcggctattagacttcttga

SEQ ID NO: 80449 - DNA, 25 bp, Rattus norvegicus
acatggcggtgacacgcttagtgac

SEQ ID NO: 80450 - DNA, 25 bp, Rattus norvegicus
acatggcggtgagacgcttagtgac

SEQ ID NO: 80451 - DNA, 25 bp, Rattus norvegicus
acatggcggttcacaaccacctcta

SEQ ID NO: 80452 - DNA, 25 bp, Rattus norvegicus
acatggcggttctcaaccacctcta

SEQ ID NO: 80453 - DNA, 25 bp, Rattus norvegicus
acatggctagccactctggacagat

SEQ ID NO: 80454 - DNA, 25 bp, Rattus norvegicus
acatggctagcctctctggacagat

SEQ ID NO: 80455 - DNA, 25 bp, Rattus norvegicus
acatggctagctacacactaagggt

SEQ ID NO: 80456 - DNA, 25 bp, Rattus norvegicus
acatggctagcttcacactaagggt

SEQ ID NO: 80457 - DNA, 25 bp, Rattus norvegicus
acatggctagtcaatgcctgtttcc

SEQ ID NO: 80458 - DNA, 25 bp, Rattus norvegicus
acatggctagtctatgcctgtttcc

SEQ ID NO: 80459 - DNA, 25 bp, Rattus norvegicus
acatggctcaacagtgacagcaaga

SEQ ID NO: 80460 - DNA, 25 bp, Rattus norvegicus
acatggctcaactgtgacagcaaga

SEQ ID NO: 80461 - DNA, 25 bp, Rattus norvegicus
acatggctgtccaggcatctatgtc

SEQ ID NO: 80462 - DNA, 25 bp, Rattus norvegicus
acatggctgtcctggcatctatgtc

SEQ ID NO: 80463 - DNA, 25 bp, Rattus norvegicus
acatggctgtgaccccacagtgtca

SEQ ID NO: 80464 - DNA, 25 bp, Rattus norvegicus
acatggctgtgagcccacagtgtca

SEQ ID NO: 80465 - DNA, 25 bp, Rattus norvegicus
acatggctgtgtacttgatggcttg

SEQ ID NO: 80466 - DNA, 25 bp, Rattus norvegicus
acatggctgtgttcttgatggcttg

SEQ ID NO: 80467 - DNA, 25 bp, Rattus norvegicus
acatggctgttcatagtggattcaa

SEQ ID NO: 80468 - DNA, 25 bp, Rattus norvegicus
acatggctgttcttagtggattcaa

SEQ ID NO: 80469 - DNA, 25 bp, Rattus norvegicus
acatggcttacgacttcagtggcgc

SEQ ID NO: 80470 - DNA, 25 bp, Rattus norvegicus
acatggcttacgtcttcagtggcgc

SEQ ID NO: 80471 - DNA, 25 bp, Rattus norvegicus
acatggcttagtccaaagccacctc

SEQ ID NO: 80472 - DNA, 25 bp, Rattus norvegicus
acatggcttagtgcaaagccacctc

SEQ ID NO: 80473 - DNA, 25 bp, Rattus norvegicus
acatggcttataacctcagtacttc

SEQ ID NO: 80474 - DNA, 25 bp, Rattus norvegicus
acatggcttatatcctcagtacttc

SEQ ID NO: 80475 - DNA, 25 bp, Rattus norvegicus
acatggcttcaaatcctagcacttg

SEQ ID NO: 80476 - DNA, 25 bp, Rattus norvegicus
acatggcttcaattcctagcacttg

SEQ ID NO: 80477 - DNA, 25 bp, Rattus norvegicus
acatggcttctgactctgagcttgc

SEQ ID NO: 80478 - DNA, 25 bp, Rattus norvegicus
acatggcttctgtctctgagcttgc

SEQ ID NO: 80479 - DNA, 25 bp, Rattus norvegicus
acatgggaaaacacagcactggtgg

SEQ ID NO: 80480 - DNA, 25 bp, Rattus norvegicus
acatgggaaaactcagcactggtgg

SEQ ID NO: 80481 - DNA, 25 bp, Rattus norvegicus
acatgggaaactactgttagcgttc

SEQ ID NO: 80482 - DNA, 25 bp, Rattus norvegicus
acatgggaaacttctgttagcgttc

SEQ ID NO: 80483 - DNA, 25 bp, Rattus norvegicus
acatgggaagctctgttatccctcc

SEQ ID NO: 80484 - DNA, 25 bp, Rattus norvegicus
acatgggaagctgtgttatccctcc

SEQ ID NO: 80485 - DNA, 25 bp, Rattus norvegicus
acatgggaagtcagccgggtagcca

SEQ ID NO: 80486 - DNA, 25 bp, Rattus norvegicus
acatgggaagtctgccgggtagcca

SEQ ID NO: 80487 - DNA, 25 bp, Rattus norvegicus
acatgggaatacattctctcttaat

SEQ ID NO: 80488 - DNA, 25 bp, Rattus norvegicus
acatgggaatactttctctcttaat

SEQ ID NO: 80489 - DNA, 25 bp, Rattus norvegicus
acatgggactcccttgccatgggtc

SEQ ID NO: 80490 - DNA, 25 bp, Rattus norvegicus
acatgggactccgttgccatgggtc

SEQ ID NO: 80491 - DNA, 25 bp, Rattus norvegicus
acatgggacttcatttgctgacagt

SEQ ID NO: 80492 - DNA, 25 bp, Rattus norvegicus
acatgggacttcttttgctgacagt

SEQ ID NO: 80493 - DNA, 25 bp, Rattus norvegicus
acatgggcacagagcagtgtcaaat

SEQ ID NO: 80494 - DNA, 25 bp, Rattus norvegicus
acatgggcacagtgcagtgtcaaat

SEQ ID NO: 80495 - DNA, 25 bp, Rattus norvegicus
acatgggcacatatccagaggcgat

SEQ ID NO: 80496 - DNA, 25 bp, Rattus norvegicus
acatgggcacatttccagaggcgat

SEQ ID NO: 80497 - DNA, 25 bp, Rattus norvegicus
acatgggcactgaccgagtagccag

SEQ ID NO: 80498 - DNA, 25 bp, Rattus norvegicus
acatgggcactgtccgagtagccag

SEQ ID NO: 80499 - DNA, 25 bp, Rattus norvegicus
acatgggcagccattgatatcataa

SEQ ID NO: 80500 - DNA, 25 bp, Rattus norvegicus
acatgggcagcctttgatatcataa

SEQ ID NO: 80501 - DNA, 25 bp, Rattus norvegicus
acatgggcatctctgatagcgctgg

SEQ ID NO: 80502 - DNA, 25 bp, Rattus norvegicus
acatgggcatctgtgatagcgctgg

SEQ ID NO: 80503 - DNA, 25 bp, Rattus norvegicus
acatgggccagtatatgtctgctat

SEQ ID NO: 80504 - DNA, 25 bp, Rattus norvegicus
acatgggccagtttatgtctgctat

SEQ ID NO: 80505 - DNA, 25 bp, Rattus norvegicus
acatgggccgctcaactgtgtccag

SEQ ID NO: 80506 - DNA, 25 bp, Rattus norvegicus
acatgggccgctgaactgtgtccag

SEQ ID NO: 80507 - DNA, 25 bp, Rattus norvegicus
acatgggcggcgatgtcccactgga

SEQ ID NO: 80508 - DNA, 25 bp, Rattus norvegicus
acatgggcggcgttgtcccactgga

SEQ ID NO: 80509 - DNA, 25 bp, Rattus norvegicus
acatgggctcaaacttggcctgaga

SEQ ID NO: 80510 - DNA, 25 bp, Rattus norvegicus
acatgggctcaatcttggcctgaga

SEQ ID NO: 80511 - DNA, 25 bp, Rattus norvegicus
acatgggctcacctttccaagtggg

SEQ ID NO: 80512 - DNA, 25 bp, Rattus norvegicus
acatgggctcacgtttccaagtggg

SEQ ID NO: 80513 - DNA, 25 bp, Rattus norvegicus
acatgggctccaagatcttccacat

SEQ ID NO: 80514 - DNA, 25 bp, Rattus norvegicus
acatgggctccatgatcttccacat

SEQ ID NO: 80515 - DNA, 25 bp, Rattus norvegicus
acatgggctcctctcggcctgtagg

SEQ ID NO: 80516 - DNA, 25 bp, Rattus norvegicus
acatgggctcctgtcggcctgtagg

SEQ ID NO: 80517 - DNA, 25 bp, Rattus norvegicus
acatgggcttcaacagtcgcctgtt

SEQ ID NO: 80518 - DNA, 25 bp, Rattus norvegicus
acatgggcttcatcagtcgcctgtt

SEQ ID NO: 80519 - DNA, 25 bp, Rattus norvegicus
acatgggcttccattagtggctaga

SEQ ID NO: 80520 - DNA, 25 bp, Rattus norvegicus
acatgggcttcctttagtggctaga

SEQ ID NO: 80521 - DNA, 25 bp, Rattus norvegicus
acatggggttctatagtgagtcaca

SEQ ID NO: 80522 - DNA, 25 bp, Rattus norvegicus
acatggggttctttagtgagtcaca

SEQ ID NO: 80523 - DNA, 25 bp, Rattus norvegicus
acatgggtatctacctggacttcca

SEQ ID NO: 80524 - DNA, 25 bp, Rattus norvegicus
acatgggtatcttcctggacttcca

SEQ ID NO: 80525 - DNA, 25 bp, Rattus norvegicus
acatgggtcctacttatcaggtcta

SEQ ID NO: 80526 - DNA, 25 bp, Rattus norvegicus
acatgggtcctagttatcaggtcta

SEQ ID NO: 80527 - DNA, 25 bp, Rattus norvegicus
acatgggtcctcatacttacagaat

SEQ ID NO: 80528 - DNA, 25 bp, Rattus norvegicus
acatgggtcctcttacttacagaat

SEQ ID NO: 80529 - DNA, 25 bp, Rattus norvegicus
acatgggtcctgacatccttcagat

SEQ ID NO: 80530 - DNA, 25 bp, Rattus norvegicus
acatgggtcctgcttagtgccgtag

SEQ ID NO: 80531 - DNA, 25 bp, Rattus norvegicus
acatgggtcctggttagtgccgtag

SEQ ID NO: 80532 - DNA, 25 bp, Rattus norvegicus
acatgggtcctgtcatccttcagat

SEQ ID NO: 80533 - DNA, 25 bp, Rattus norvegicus
acatgggtctctccactgtgtggat

SEQ ID NO: 80534 - DNA, 25 bp, Rattus norvegicus
acatgggtctctgcactgtgtggat

SEQ ID NO: 80535 - DNA, 25 bp, Rattus norvegicus
acatgggtctgaatttactcgtcgt

SEQ ID NO: 80536 - DNA, 25 bp, Rattus norvegicus
acatgggtctgattttactcgtcgt

SEQ ID NO: 80537 - DNA, 25 bp, Rattus norvegicus
acatgggtgtcacgctggtgttctc

SEQ ID NO: 80538 - DNA, 25 bp, Rattus norvegicus
acatgggtgtcaggctggtgttctc

SEQ ID NO: 80539 - DNA, 25 bp, Rattus norvegicus
acatgggtgtgacgacacatttcat

SEQ ID NO: 80540 - DNA, 25 bp, Rattus norvegicus
acatgggtgtgaggacacatttcat

SEQ ID NO: 80541 - DNA, 25 bp, Rattus norvegicus
acatgggttccaaaaatgagtttca

SEQ ID NO: 80542 - DNA, 25 bp, Rattus norvegicus
acatgggttccacaatcattcattt

SEQ ID NO: 80543 - DNA, 25 bp, Rattus norvegicus
acatgggttccagaatcattcattt

SEQ ID NO: 80544 - DNA, 25 bp, Rattus norvegicus
acatgggttccataaatgagtttca

SEQ ID NO: 80545 - DNA, 25 bp, Rattus norvegicus
acatggtaagagacccttgtcccac

SEQ ID NO: 80546 - DNA, 25 bp, Rattus norvegicus
acatggtaagagtcccttgtcccac

SEQ ID NO: 80547 - DNA, 25 bp, Rattus norvegicus
acatggtactgcatattcaactggg

SEQ ID NO: 80548 - DNA, 25 bp, Rattus norvegicus
acatggtactgcttattcaactggg

SEQ ID NO: 80549 - DNA, 25 bp, Rattus norvegicus
acatggtagagtcccctgaacccta

SEQ ID NO: 80550 - DNA, 25 bp, Rattus norvegicus
acatggtagagtgccctgaacccta

SEQ ID NO: 80551 - DNA, 25 bp, Rattus norvegicus
acatggtatacaagcctgcaggcaa

SEQ ID NO: 80552 - DNA, 25 bp, Rattus norvegicus
acatggtatacatgcctgcaggcaa

SEQ ID NO: 80553 - DNA, 25 bp, Rattus norvegicus
acatggtatccacagttgctagaat

SEQ ID NO: 80554 - DNA, 25 bp, Rattus norvegicus
acatggtatccagagttgctagaat

SEQ ID NO: 80555 - DNA, 25 bp, Rattus norvegicus
acatggtatttcacctggagcagca

SEQ ID NO: 80556 - DNA, 25 bp, Rattus norvegicus
acatggtatttctcctggagcagca

SEQ ID NO: 80557 - DNA, 25 bp, Rattus norvegicus
acatggtcaaacatcaatcattcaa

SEQ ID NO: 80558 - DNA, 25 bp, Rattus norvegicus
acatggtcaaacttcaatcattcaa

SEQ ID NO: 80559 - DNA, 25 bp, Rattus norvegicus
acatggtcacatataggtcacactg

SEQ ID NO: 80560 - DNA, 25 bp, Rattus norvegicus
acatggtcacatcctctgtacagag

SEQ ID NO: 80561 - DNA, 25 bp, Rattus norvegicus
acatggtcacatgctctgtacagag

SEQ ID NO: 80562 - DNA, 25 bp, Rattus norvegicus
acatggtcacatttaggtcacactg

SEQ ID NO: 80563 - DNA, 25 bp, Rattus norvegicus
acatggtcagcgcttcttttatttc

SEQ ID NO: 80564 - DNA, 25 bp, Rattus norvegicus
acatggtcagcggttcttttatttc

SEQ ID NO: 80565 - DNA, 25 bp, Rattus norvegicus
acatggtcatgaagtggctggtgcc

SEQ ID NO: 80566 - DNA, 25 bp, Rattus norvegicus
acatggtcatgatgtggctggtgcc

SEQ ID NO: 80567 - DNA, 25 bp, Rattus norvegicus
acatggtcccctctgtagcttgcta

SEQ ID NO: 80568 - DNA, 25 bp, Rattus norvegicus
acatggtcccctgtgtagcttgcta

SEQ ID NO: 80569 - DNA, 25 bp, Rattus norvegicus
acatggtccctgacatgtgacctat

SEQ ID NO: 80570 - DNA, 25 bp, Rattus norvegicus
acatggtccctgtcatgtgacctat

SEQ ID NO: 80571 - DNA, 25 bp, Rattus norvegicus
acatggtcctgtatgcatcacttaa

SEQ ID NO: 80572 - DNA, 25 bp, Rattus norvegicus
acatggtcctgtttgcatcacttaa

SEQ ID NO: 80573 - DNA, 25 bp, Rattus norvegicus
acatggtctactcggtggtttattt

SEQ ID NO: 80574 - DNA, 25 bp, Rattus norvegicus
acatggtctactgggtggtttattt

SEQ ID NO: 80575 - DNA, 25 bp, Rattus norvegicus
acatggtcttaaatgtatttgcaga

SEQ ID NO: 80576 - DNA, 25 bp, Rattus norvegicus
acatggtcttaattgtatttgcaga

SEQ ID NO: 80577 - DNA, 25 bp, Rattus norvegicus
acatggtgacccataggtctaccat

SEQ ID NO: 80578 - DNA, 25 bp, Rattus norvegicus
acatggtgacccttaggtctaccat

SEQ ID NO: 80579 - DNA, 25 bp, Rattus norvegicus
acatggtgagcacacatgcgtgcag

SEQ ID NO: 80580 - DNA, 25 bp, Rattus norvegicus
acatggtgagcagacatgcgtgcag

SEQ ID NO: 80581 - DNA, 25 bp, Rattus norvegicus
acatggtgcaacacaggagcagcta

SEQ ID NO: 80582 - DNA, 25 bp, Rattus norvegicus
acatggtgcaactcaggagcagcta

SEQ ID NO: 80583 - DNA, 25 bp, Rattus norvegicus
acatggtgcagtatgtagaggaaac

SEQ ID NO: 80584 - DNA, 25 bp, Rattus norvegicus
acatggtgcagtttgtagaggaaac

SEQ ID NO: 80585 - DNA, 25 bp, Rattus norvegicus
acatggtgctctacttcttcgagaa

SEQ ID NO: 80586 - DNA, 25 bp, Rattus norvegicus
acatggtgctcttcttcttcgagaa

SEQ ID NO: 80587 - DNA, 25 bp, Rattus norvegicus
acatggtgcttcctagccacaaatg

SEQ ID NO: 80588 - DNA, 25 bp, Rattus norvegicus
acatggtgcttcgtagccacaaatg

SEQ ID NO: 80589 - DNA, 25 bp, Rattus norvegicus
acatggtggccaacttgtcagacct

SEQ ID NO: 80590 - DNA, 25 bp, Rattus norvegicus
acatggtggccatcttgtcagacct

SEQ ID NO: 80591 - DNA, 25 bp, Rattus norvegicus
acatggtggtccacaactacctata

SEQ ID NO: 80592 - DNA, 25 bp, Rattus norvegicus
acatggtggtcctcaactacctata

SEQ ID NO: 80593 - DNA, 25 bp, Rattus norvegicus
acatggtgtcataactgcttcctca

SEQ ID NO: 80594 - DNA, 25 bp, Rattus norvegicus
acatggtgtcattactgcttcctca

SEQ ID NO: 80595 - DNA, 25 bp, Rattus norvegicus
acatggtgtctaaagcaacgagctc

SEQ ID NO: 80596 - DNA, 25 bp, Rattus norvegicus
acatggtgtctatagcaacgagctc

SEQ ID NO: 80597 - DNA, 25 bp, Rattus norvegicus
acatggtgtggtctcaggctctgct

SEQ ID NO: 80598 - DNA, 25 bp, Rattus norvegicus
acatggtgtggtgtcaggctctgct

SEQ ID NO: 80599 - DNA, 25 bp, Rattus norvegicus
acatggtgttcacgcgtttcgtgga

SEQ ID NO: 80600 - DNA, 25 bp, Rattus norvegicus
acatggtgttcaggcgtttcgtgga

SEQ ID NO: 80601 - DNA, 25 bp, Rattus norvegicus
acatggtgttctagggtggcgcagt

SEQ ID NO: 80602 - DNA, 25 bp, Rattus norvegicus
acatggtgttcttgggtggcgcagt

SEQ ID NO: 80603 - DNA, 25 bp, Rattus norvegicus
acatggttcccaaatatacattcag

SEQ ID NO: 80604 - DNA, 25 bp, Rattus norvegicus
acatggttcccatatatacattcag

SEQ ID NO: 80605 - DNA, 25 bp, Rattus norvegicus
acatggttccttcattcctctgtac

SEQ ID NO: 80606 - DNA, 25 bp, Rattus norvegicus
acatggttccttgattcctctgtac

SEQ ID NO: 80607 - DNA, 25 bp, Rattus norvegicus
acatggttcttgatagcatccttgg

SEQ ID NO: 80608 - DNA, 25 bp, Rattus norvegicus
acatggttcttgttagcatccttgg

SEQ ID NO: 80609 - DNA, 25 bp, Rattus norvegicus
acatggttgttcaagttttcactta

SEQ ID NO: 80610 - DNA, 25 bp, Rattus norvegicus
acatggttgttctagttttcactta

SEQ ID NO: 80611 - DNA, 25 bp, Rattus norvegicus
acatggtttagcctactctgtttta

SEQ ID NO: 80612 - DNA, 25 bp, Rattus norvegicus
acatggtttagcgtactctgtttta

SEQ ID NO: 80613 - DNA, 25 bp, Rattus norvegicus
acatggttttgtctcattctgcctc

SEQ ID NO: 80614 - DNA, 25 bp, Rattus norvegicus
acatggttttgtgtcattctgcctc

SEQ ID NO: 80615 - DNA, 25 bp, Rattus norvegicus
acatgtaacgctcttccgagtggct

SEQ ID NO: 80616 - DNA, 25 bp, Rattus norvegicus
acatgtaacgctgttccgagtggct

SEQ ID NO: 80617 - DNA, 25 bp, Rattus norvegicus
acatgtaagtaactcagccccagtt

SEQ ID NO: 80618 - DNA, 25 bp, Rattus norvegicus
acatgtaagtaagtcagccccagtt

SEQ ID NO: 80619 - DNA, 25 bp, Rattus norvegicus
acatgtaatccgagcctaaaccaga

SEQ ID NO: 80620 - DNA, 25 bp, Rattus norvegicus
acatgtaatccgtgcctaaaccaga

SEQ ID NO: 80621 - DNA, 25 bp, Rattus norvegicus
acatgtaccaggagaactgcgttta

SEQ ID NO: 80622 - DNA, 25 bp, Rattus norvegicus
acatgtaccaggtgaactgcgttta

SEQ ID NO: 80623 - DNA, 25 bp, Rattus norvegicus
acatgtacccgaaggtgtcctggac

SEQ ID NO: 80624 - DNA, 25 bp, Rattus norvegicus
acatgtacccgatggtgtcctggac

SEQ ID NO: 80625 - DNA, 25 bp, Rattus norvegicus
acatgtagaatgcttgctctcctct

SEQ ID NO: 80626 - DNA, 25 bp, Rattus norvegicus
acatgtagaatggttgctctcctct

SEQ ID NO: 80627 - DNA, 25 bp, Rattus norvegicus
acatgtagagaactgcctcctgacc

SEQ ID NO: 80628 - DNA, 25 bp, Rattus norvegicus
acatgtagagaagtgcctcctgacc

SEQ ID NO: 80629 - DNA, 25 bp, Rattus norvegicus
acatgtagcacaacctcctttcctt

SEQ ID NO: 80630 - DNA, 25 bp, Rattus norvegicus
acatgtagcacatcctcctttcctt

SEQ ID NO: 80631 - DNA, 25 bp, Rattus norvegicus
acatgtagccacagtacttttctgt

SEQ ID NO: 80632 - DNA, 25 bp, Rattus norvegicus
acatgtagccactgtacttttctgt

SEQ ID NO: 80633 - DNA, 25 bp, Rattus norvegicus
acatgtagccatctttcttttcact

SEQ ID NO: 80634 - DNA, 25 bp, Rattus norvegicus
acatgtagccatgtttcttttcact

SEQ ID NO: 80635 - DNA, 25 bp, Rattus norvegicus
acatgtaggaagaagttggtcccac

SEQ ID NO: 80636 - DNA, 25 bp, Rattus norvegicus
acatgtaggaagtagttggtcccac

SEQ ID NO: 80637 - DNA, 25 bp, Rattus norvegicus
acatgtaggcttctgccagttgcac

SEQ ID NO: 80638 - DNA, 25 bp, Rattus norvegicus
acatgtaggcttgtgccagttgcac

SEQ ID NO: 80639 - DNA, 25 bp, Rattus norvegicus
acatgtagtgcaaagcttccttccc

SEQ ID NO: 80640 - DNA, 25 bp, Rattus norvegicus
acatgtagtgcatagcttccttccc

SEQ ID NO: 80641 - DNA, 25 bp, Rattus norvegicus
acatgtatcctaacacagtgcctgg

SEQ ID NO: 80642 - DNA, 25 bp, Rattus norvegicus
acatgtatcctatcacagtgcctgg

SEQ ID NO: 80643 - DNA, 25 bp, Rattus norvegicus
acatgtatctgtcaactgcgttaag

SEQ ID NO: 80644 - DNA, 25 bp, Rattus norvegicus
acatgtatctgtgaactgcgttaag

SEQ ID NO: 80645 - DNA, 25 bp, Rattus norvegicus
acatgtatgtatcgagtctgtgctc

SEQ ID NO: 80646 - DNA, 25 bp, Rattus norvegicus
acatgtatgtatggagtctgtgctc

SEQ ID NO: 80647 - DNA, 25 bp, Rattus norvegicus
acatgtattccacagttgtagtttg

SEQ ID NO: 80648 - DNA, 25 bp, Rattus norvegicus
acatgtattccagagttgtagtttg

SEQ ID NO: 80649 - DNA, 25 bp, Rattus norvegicus
acatgtcacaggaccatcatttccc

SEQ ID NO: 80650 - DNA, 25 bp, Rattus norvegicus
acatgtcacaggtccatcatttccc

SEQ ID NO: 80651 - DNA, 25 bp, Rattus norvegicus
acatgtcacataccttttctgcctg

SEQ ID NO: 80652 - DNA, 25 bp, Rattus norvegicus
acatgtcacatagcttttctgcctg

SEQ ID NO: 80653 - DNA, 25 bp, Rattus norvegicus
acatgtcagttgctaagaatttcct

SEQ ID NO: 80654 - DNA, 25 bp, Rattus norvegicus
acatgtcagttggtaagaatttcct

SEQ ID NO: 80655 - DNA, 25 bp, Rattus norvegicus
acatgtcataaactttctcctccac

SEQ ID NO: 80656 - DNA, 25 bp, Rattus norvegicus
acatgtcataaagtttctcctccac

SEQ ID NO: 80657 - DNA, 25 bp, Rattus norvegicus
acatgtcatagtagacttaagcgca

SEQ ID NO: 80658 - DNA, 25 bp, Rattus norvegicus
acatgtcatagttgacttaagcgca

SEQ ID NO: 80659 - DNA, 25 bp, Rattus norvegicus
acatgtccaatccttcttggtcaca

SEQ ID NO: 80660 - DNA, 25 bp, Rattus norvegicus
acatgtccaatcgttcttggtcaca

SEQ ID NO: 80661 - DNA, 25 bp, Rattus norvegicus
acatgtccagaccttgagctctgtt

SEQ ID NO: 80662 - DNA, 25 bp, Rattus norvegicus
acatgtccagacgttgagctctgtt

SEQ ID NO: 80663 - DNA, 25 bp, Rattus norvegicus
acatgtccagtaaaggttctctccc

SEQ ID NO: 80664 - DNA, 25 bp, Rattus norvegicus
acatgtccagtataggttctctccc

SEQ ID NO: 80665 - DNA, 25 bp, Rattus norvegicus
acatgtccattccagtagtaccagc

SEQ ID NO: 80666 - DNA, 25 bp, Rattus norvegicus
acatgtccattcgagtagtaccagc

SEQ ID NO: 80667 - DNA, 25 bp, Rattus norvegicus
acatgtcccatacctagcgtcttag

SEQ ID NO: 80668 - DNA, 25 bp, Rattus norvegicus
acatgtcccatagctagcgtcttag

SEQ ID NO: 80669 - DNA, 25 bp, Rattus norvegicus
acatgtccccgtctgaatggctcac

SEQ ID NO: 80670 - DNA, 25 bp, Rattus norvegicus
acatgtccccgtgtgaatggctcac

SEQ ID NO: 80671 - DNA, 25 bp, Rattus norvegicus
acatgtccggccattgatttaggat

SEQ ID NO: 80672 - DNA, 25 bp, Rattus norvegicus
acatgtccggcctttgatttaggat

SEQ ID NO: 80673 - DNA, 25 bp, Rattus norvegicus
acatgtccgtctcctggatcaacag

SEQ ID NO: 80674 - DNA, 25 bp, Rattus norvegicus
acatgtccgtctgctggatcaacag

SEQ ID NO: 80675 - DNA, 25 bp, Rattus norvegicus
acatgtcctcccctttaggaggaag

SEQ ID NO: 80676 - DNA, 25 bp, Rattus norvegicus
acatgtcctcccgtttaggaggaag

SEQ ID NO: 80677 - DNA, 25 bp, Rattus norvegicus
acatgtcctgtgacctggagactaa

SEQ ID NO: 80678 - DNA, 25 bp, Rattus norvegicus
acatgtcctgtgtcctggagactaa

SEQ ID NO: 80679 - DNA, 25 bp, Rattus norvegicus
acatgtcgatgcactctgcaagtta

SEQ ID NO: 80680 - DNA, 25 bp, Rattus norvegicus
acatgtcgatgctctctgcaagtta

SEQ ID NO: 80681 - DNA, 25 bp, Rattus norvegicus
acatgtcgctacagagcccttgaaa

SEQ ID NO: 80682 - DNA, 25 bp, Rattus norvegicus
acatgtcgctactgagcccttgaaa

SEQ ID NO: 80683 - DNA, 25 bp, Rattus norvegicus
acatgtcggcaactgacttcatcat

SEQ ID NO: 80684 - DNA, 25 bp, Rattus norvegicus
acatgtcggcaagtgacttcatcat

SEQ ID NO: 80685 - DNA, 25 bp, Rattus norvegicus
acatgtctaaggagtgagcagggca

SEQ ID NO: 80686 - DNA, 25 bp, Rattus norvegicus
acatgtctaaggtgtgagcagggca

SEQ ID NO: 80687 - DNA, 25 bp, Rattus norvegicus
acatgtctagctctgacttcttcgc

SEQ ID NO: 80688 - DNA, 25 bp, Rattus norvegicus
acatgtctagctgtgacttcttcgc

SEQ ID NO: 80689 - DNA, 25 bp, Rattus norvegicus
acatgtctcacaccgaaagggatca

SEQ ID NO: 80690 - DNA, 25 bp, Rattus norvegicus
acatgtctcacagcgaaagggatca

SEQ ID NO: 80691 - DNA, 25 bp, Rattus norvegicus
acatgtctctccacatctgctaaag

SEQ ID NO: 80692 - DNA, 25 bp, Rattus norvegicus
acatgtctctcccacggaagaaagt

SEQ ID NO: 80693 - DNA, 25 bp, Rattus norvegicus
acatgtctctccgacggaagaaagt

SEQ ID NO: 80694 - DNA, 25 bp, Rattus norvegicus
acatgtctctcctcatctgctaaag

SEQ ID NO: 80695 - DNA, 25 bp, Rattus norvegicus
acatgtctctgacccatgtttttgc

SEQ ID NO: 80696 - DNA, 25 bp, Rattus norvegicus
acatgtctctgagccatgtttttgc

SEQ ID NO: 80697 - DNA, 25 bp, Rattus norvegicus
acatgtctgactcaattgtggtggt

SEQ ID NO: 80698 - DNA, 25 bp, Rattus norvegicus
acatgtctgactgaattgtggtggt

SEQ ID NO: 80699 - DNA, 25 bp, Rattus norvegicus
acatgtctgcacctgagtgctcatg

SEQ ID NO: 80700 - DNA, 25 bp, Rattus norvegicus
acatgtctgcacgtgagtgctcatg

SEQ ID NO: 80701 - DNA, 25 bp, Rattus norvegicus
acatgtctgctaaggaacgcttccg

SEQ ID NO: 80702 - DNA, 25 bp, Rattus norvegicus
acatgtctgctatggaacgcttccg

SEQ ID NO: 80703 - DNA, 25 bp, Rattus norvegicus
acatgtctggacatgttctgagttt

SEQ ID NO: 80704 - DNA, 25 bp, Rattus norvegicus
acatgtctggacttgttctgagttt

SEQ ID NO: 80705 - DNA, 25 bp, Rattus norvegicus
acatgtctggctataatatactggg

SEQ ID NO: 80706 - DNA, 25 bp, Rattus norvegicus
acatgtctggctttaatatactggg

SEQ ID NO: 80707 - DNA, 25 bp, Rattus norvegicus
acatgtctgtcactgagggttgctt

SEQ ID NO: 80708 - DNA, 25 bp, Rattus norvegicus
acatgtctgtcagtgagggttgctt

SEQ ID NO: 80709 - DNA, 25 bp, Rattus norvegicus
acatgtctgtggctgggctatgcaa

SEQ ID NO: 80710 - DNA, 25 bp, Rattus norvegicus
acatgtctgtgggtgggctatgcaa

SEQ ID NO: 80711 - DNA, 25 bp, Rattus norvegicus
acatgtcttcaaacccagtacttgg

SEQ ID NO: 80712 - DNA, 25 bp, Rattus norvegicus
acatgtcttcaatcccagtacttgg

SEQ ID NO: 80713 - DNA, 25 bp, Rattus norvegicus
acatgtcttgagattcctggtgcta

SEQ ID NO: 80714 - DNA, 25 bp, Rattus norvegicus
acatgtcttgagtttcctggtgcta

SEQ ID NO: 80715 - DNA, 25 bp, Rattus norvegicus
acatgtgaaatgagcactctcgtgt

SEQ ID NO: 80716 - DNA, 25 bp, Rattus norvegicus
acatgtgaaatgtgcactctcgtgt

SEQ ID NO: 80717 - DNA, 25 bp, Rattus norvegicus
acatgtgacttgaccatttccggct

SEQ ID NO: 80718 - DNA, 25 bp, Rattus norvegicus
acatgtgacttgtccatttccggct

SEQ ID NO: 80719 - DNA, 25 bp, Rattus norvegicus
acatgtgagactctggctcccatct

SEQ ID NO: 80720 - DNA, 25 bp, Rattus norvegicus
acatgtgagactgtggctcccatct

SEQ ID NO: 80721 - DNA, 25 bp, Rattus norvegicus
acatgtgagcagagcctgtggaaac

SEQ ID NO: 80722 - DNA, 25 bp, Rattus norvegicus
acatgtgagcagtgcctgtggaaac

SEQ ID NO: 80723 - DNA, 25 bp, Rattus norvegicus
acatgtgagccaacttgtcaaccca

SEQ ID NO: 80724 - DNA, 25 bp, Rattus norvegicus
acatgtgagccatcttgtcaaccca

SEQ ID NO: 80725 - DNA, 25 bp, Rattus norvegicus
acatgtgaggagactgtgccctcga

SEQ ID NO: 80726 - DNA, 25 bp, Rattus norvegicus
acatgtgaggagtctgtgccctcga

SEQ ID NO: 80727 - DNA, 25 bp, Rattus norvegicus
acatgtgagtctctgcccttgaccg

SEQ ID NO: 80728 - DNA, 25 bp, Rattus norvegicus
acatgtgagtctgtgcccttgaccg

SEQ ID NO: 80729 - DNA, 25 bp, Rattus norvegicus
acatgtgatggccaacgcctgtgac

SEQ ID NO: 80730 - DNA, 25 bp, Rattus norvegicus
acatgtgatggcgaacgcctgtgac

SEQ ID NO: 80731 - DNA, 25 bp, Rattus norvegicus
acatgtgatgttattcttttatgag

SEQ ID NO: 80732 - DNA, 25 bp, Rattus norvegicus
acatgtgatgtttttcttttatgag

SEQ ID NO: 80733 - DNA, 25 bp, Rattus norvegicus
acatgtgattctctcaactaaagat

SEQ ID NO: 80734 - DNA, 25 bp, Rattus norvegicus
acatgtgattctgtcaactaaagat

SEQ ID NO: 80735 - DNA, 25 bp, Rattus norvegicus
acatgtgcacctacacatgcacata

SEQ ID NO: 80736 - DNA, 25 bp, Rattus norvegicus
acatgtgcacctacttcaggatttt

SEQ ID NO: 80737 - DNA, 25 bp, Rattus norvegicus
acatgtgcaccttcacatgcacata

SEQ ID NO: 80738 - DNA, 25 bp, Rattus norvegicus
acatgtgcaccttcttcaggatttt

SEQ ID NO: 80739 - DNA, 25 bp, Rattus norvegicus
acatgtgcacttctgcgcatgtgca

SEQ ID NO: 80740 - DNA, 25 bp, Rattus norvegicus
acatgtgcacttgtgcgcatgtgca

SEQ ID NO: 80741 - DNA, 25 bp, Rattus norvegicus
acatgtgcatccacaaccagccatg

SEQ ID NO: 80742 - DNA, 25 bp, Rattus norvegicus
acatgtgcatcctcaaccagccatg

SEQ ID NO: 80743 - DNA, 25 bp, Rattus norvegicus
acatgtgcatgtatctccctgtaga

SEQ ID NO: 80744 - DNA, 25 bp, Rattus norvegicus
acatgtgcatgtttctccctgtaga

SEQ ID NO: 80745 - DNA, 25 bp, Rattus norvegicus
acatgtgccccaacacagggcggaa

SEQ ID NO: 80746 - DNA, 25 bp, Rattus norvegicus
acatgtgccccatcacagggcggaa

SEQ ID NO: 80747 - DNA, 25 bp, Rattus norvegicus
acatgtgctaatcctcaggtataca

SEQ ID NO: 80748 - DNA, 25 bp, Rattus norvegicus
acatgtgctaatgctcaggtataca

SEQ ID NO: 80749 - DNA, 25 bp, Rattus norvegicus
acatgtgctactatagtaactcata

SEQ ID NO: 80750 - DNA, 25 bp, Rattus norvegicus
acatgtgctactttagtaactcata

SEQ ID NO: 80751 - DNA, 25 bp, Rattus norvegicus
acatgtgctcctactgaagcgttac

SEQ ID NO: 80752 - DNA, 25 bp, Rattus norvegicus
acatgtgctccttctgaagcgttac

SEQ ID NO: 80753 - DNA, 25 bp, Rattus norvegicus
acatgtgctgtcctgtatgggagtc

SEQ ID NO: 80754 - DNA, 25 bp, Rattus norvegicus
acatgtgctgtcgtgtatgggagtc

SEQ ID NO: 80755 - DNA, 25 bp, Rattus norvegicus
acatgtggacccagtgtttggcttc

SEQ ID NO: 80756 - DNA, 25 bp, Rattus norvegicus
acatgtggaccctgtgtttggcttc

SEQ ID NO: 80757 - DNA, 25 bp, Rattus norvegicus
acatgtggagttatgccgtgcttct

SEQ ID NO: 80758 - DNA, 25 bp, Rattus norvegicus
acatgtggagttttgccgtgcttct

SEQ ID NO: 80759 - DNA, 25 bp, Rattus norvegicus
acatgtggccgcagtctgtgcaagg

SEQ ID NO: 80760 - DNA, 25 bp, Rattus norvegicus
acatgtggccgctgtctgtgcaagg

SEQ ID NO: 80761 - DNA, 25 bp, Rattus norvegicus
acatgtgggagcactgaggccttga

SEQ ID NO: 80762 - DNA, 25 bp, Rattus norvegicus
acatgtgggagctctgaggccttga

SEQ ID NO: 80763 - DNA, 25 bp, Rattus norvegicus
acatgtgggctcattcatcagagta

SEQ ID NO: 80764 - DNA, 25 bp, Rattus norvegicus
acatgtgggctctttcatcagagta

SEQ ID NO: 80765 - DNA, 25 bp, Rattus norvegicus
acatgtgggtagacgtcaggctgca

SEQ ID NO: 80766 - DNA, 25 bp, Rattus norvegicus
acatgtgggtagtcgtcaggctgca

SEQ ID NO: 80767 - DNA, 25 bp, Rattus norvegicus
acatgtggtcggaaagctgccctgg

SEQ ID NO: 80768 - DNA, 25 bp, Rattus norvegicus
acatgtggtcggtaagctgccctgg

SEQ ID NO: 80769 - DNA, 25 bp, Rattus norvegicus
acatgtggtcgtcaatctctgggca

SEQ ID NO: 80770 - DNA, 25 bp, Rattus norvegicus
acatgtggtcgtgaatctctgggca

SEQ ID NO: 80771 - DNA, 25 bp, Rattus norvegicus
acatgtggtgatattactgctaaac

SEQ ID NO: 80772 - DNA, 25 bp, Rattus norvegicus
acatgtggtgattttactgctaaac

SEQ ID NO: 80773 - DNA, 25 bp, Rattus norvegicus
acatgtggtgtcaggaatcctcatc

SEQ ID NO: 80774 - DNA, 25 bp, Rattus norvegicus
acatgtggtgtctggaatcctcatc

SEQ ID NO: 80775 - DNA, 25 bp, Rattus norvegicus
acatgtggttccagggctgtttgtc

SEQ ID NO: 80776 - DNA, 25 bp, Rattus norvegicus
acatgtggttcctgggctgtttgtc

SEQ ID NO: 80777 - DNA, 25 bp, Rattus norvegicus
acatgtgtactcattgcattcctag

SEQ ID NO: 80778 - DNA, 25 bp, Rattus norvegicus
acatgtgtactctttgcattcctag

SEQ ID NO: 80779 - DNA, 25 bp, Rattus norvegicus
acatgtgtagatctgccgcagcact

SEQ ID NO: 80780 - DNA, 25 bp, Rattus norvegicus
acatgtgtagatgtgccgcagcact

SEQ ID NO: 80781 - DNA, 25 bp, Rattus norvegicus
acatgtgtaggaacatctctccacc

SEQ ID NO: 80782 - DNA, 25 bp, Rattus norvegicus
acatgtgtaggatcatctctccacc

SEQ ID NO: 80783 - DNA, 25 bp, Rattus norvegicus
acatgtgtatacaacttgggtcctg

SEQ ID NO: 80784 - DNA, 25 bp, Rattus norvegicus
acatgtgtatactacttgggtcctg

SEQ ID NO: 80785 - DNA, 25 bp, Rattus norvegicus
acatgtgtatgcatggtactactat

SEQ ID NO: 80786 - DNA, 25 bp, Rattus norvegicus
acatgtgtatgcttggtactactat

SEQ ID NO: 80787 - DNA, 25 bp, Rattus norvegicus
acatgtgtccctctccagagtaatc

SEQ ID NO: 80788 - DNA, 25 bp, Rattus norvegicus
acatgtgtccctgtccagagtaatc

SEQ ID NO: 80789 - DNA, 25 bp, Rattus norvegicus
acatgtgtctggagtggttcttcaa

SEQ ID NO: 80790 - DNA, 25 bp, Rattus norvegicus
acatgtgtctggtgtggttcttcaa

SEQ ID NO: 80791 - DNA, 25 bp, Rattus norvegicus
acatgtgtctttacatcttccttgc

SEQ ID NO: 80792 - DNA, 25 bp, Rattus norvegicus
acatgtgtcttttcatcttccttgc

SEQ ID NO: 80793 - DNA, 25 bp, Rattus norvegicus
acatgtgtgaccatgagtgtctccc

SEQ ID NO: 80794 - DNA, 25 bp, Rattus norvegicus
acatgtgtgaccttgagtgtctccc

SEQ ID NO: 80795 - DNA, 25 bp, Rattus norvegicus
acatgtgtgcatctttccaggctcc

SEQ ID NO: 80796 - DNA, 25 bp, Rattus norvegicus
acatgtgtgcatgtttccaggctcc

SEQ ID NO: 80797 - DNA, 25 bp, Rattus norvegicus
acatgtgtgccaagatgcccggcaa

SEQ ID NO: 80798 - DNA, 25 bp, Rattus norvegicus
acatgtgtgccatgatgcccggcaa

SEQ ID NO: 80799 - DNA, 25 bp, Rattus norvegicus
acatgtgtgcccaggtggaaactat

SEQ ID NO: 80800 - DNA, 25 bp, Rattus norvegicus
acatgtgtgccctggtggaaactat

SEQ ID NO: 80801 - DNA, 25 bp, Rattus norvegicus
acatgtgtgtgccagaactcaagag

SEQ ID NO: 80802 - DNA, 25 bp, Rattus norvegicus
acatgtgtgtgcgagaactcaagag

SEQ ID NO: 80803 - DNA, 25 bp, Rattus norvegicus
acatgtgtgtggattcaacactact

SEQ ID NO: 80804 - DNA, 25 bp, Rattus norvegicus
acatgtgtgtggtttcaacactact

SEQ ID NO: 80805 - DNA, 25 bp, Rattus norvegicus
acatgtgttcacatacattaggaaa

SEQ ID NO: 80806 - DNA, 25 bp, Rattus norvegicus
acatgtgttcaccagcctacgtata

SEQ ID NO: 80807 - DNA, 25 bp, Rattus norvegicus
acatgtgttcacgagcctacgtata

SEQ ID NO: 80808 - DNA, 25 bp, Rattus norvegicus
acatgtgttcacttacattaggaaa

SEQ ID NO: 80809 - DNA, 25 bp, Rattus norvegicus
acatgtgttcagatgcctcttaggc

SEQ ID NO: 80810 - DNA, 25 bp, Rattus norvegicus
acatgtgttcagttgcctcttaggc

SEQ ID NO: 80811 - DNA, 25 bp, Rattus norvegicus
acatgtgtttatactctttgctttt

SEQ ID NO: 80812 - DNA, 25 bp, Rattus norvegicus
acatgtgtttattctctttgctttt

SEQ ID NO: 80813 - DNA, 25 bp, Rattus norvegicus
acatgtgttttcattggttcctgca

SEQ ID NO: 80814 - DNA, 25 bp, Rattus norvegicus
acatgtgttttctttggttcctgca

SEQ ID NO: 80815 - DNA, 25 bp, Rattus norvegicus
acatgttacgttcttctgtctccat

SEQ ID NO: 80816 - DNA, 25 bp, Rattus norvegicus
acatgttacgttgttctgtctccat

SEQ ID NO: 80817 - DNA, 25 bp, Rattus norvegicus
acatgttagtcaattcggtcagttg

SEQ ID NO: 80818 - DNA, 25 bp, Rattus norvegicus
acatgttagtcatttcggtcagttg

SEQ ID NO: 80819 - DNA, 25 bp, Rattus norvegicus
acatgttatggcaccatgggtctgc

SEQ ID NO: 80820 - DNA, 25 bp, Rattus norvegicus
acatgttatggctccatgggtctgc

SEQ ID NO: 80821 - DNA, 25 bp, Rattus norvegicus
acatgttattggagtctccttttcc

SEQ ID NO: 80822 - DNA, 25 bp, Rattus norvegicus
acatgttattggtgtctccttttcc

SEQ ID NO: 80823 - DNA, 25 bp, Rattus norvegicus
acatgttcacagcatattgtgagga

SEQ ID NO: 80824 - DNA, 25 bp, Rattus norvegicus
acatgttcacaggatattgtgagga

SEQ ID NO: 80825 - DNA, 25 bp, Rattus norvegicus
acatgttcaggccagcaacagctgc

SEQ ID NO: 80826 - DNA, 25 bp, Rattus norvegicus
acatgttcaggcgagcaacagctgc

SEQ ID NO: 80827 - DNA, 25 bp, Rattus norvegicus
acatgttcaggtctggttgattcca

SEQ ID NO: 80828 - DNA, 25 bp, Rattus norvegicus
acatgttcaggtgtggttgattcca

SEQ ID NO: 80829 - DNA, 25 bp, Rattus norvegicus
acatgttccccaagttctatttcct

SEQ ID NO: 80830 - DNA, 25 bp, Rattus norvegicus
acatgttccccatgttctatttcct

SEQ ID NO: 80831 - DNA, 25 bp, Rattus norvegicus
acatgttccctcctaagtgcagtgg

SEQ ID NO: 80832 - DNA, 25 bp, Rattus norvegicus
acatgttccctcgtaagtgcagtgg

SEQ ID NO: 80833 - DNA, 25 bp, Rattus norvegicus
acatgttcctatcgtttggcagcct

SEQ ID NO: 80834 - DNA, 25 bp, Rattus norvegicus
acatgttcctatggtttggcagcct

SEQ ID NO: 80835 - DNA, 25 bp, Rattus norvegicus
acatgttctctcacagaccagggtg

SEQ ID NO: 80836 - DNA, 25 bp, Rattus norvegicus
acatgttctctctcagaccagggtg

SEQ ID NO: 80837 - DNA, 25 bp, Rattus norvegicus
acatgttctggcagcccgagctgac

SEQ ID NO: 80838 - DNA, 25 bp, Rattus norvegicus
acatgttctggctgcccgagctgac

SEQ ID NO: 80839 - DNA, 25 bp, Rattus norvegicus
acatgttctgggaagctggattgcc

SEQ ID NO: 80840 - DNA, 25 bp, Rattus norvegicus
acatgttctgggtagctggattgcc

SEQ ID NO: 80841 - DNA, 25 bp, Rattus norvegicus
acatgttctgtgaggtctgaatgca

SEQ ID NO: 80842 - DNA, 25 bp, Rattus norvegicus
acatgttctgtgtggtctgaatgca

SEQ ID NO: 80843 - DNA, 25 bp, Rattus norvegicus
acatgttgattcacaatcctctgta

SEQ ID NO: 80844 - DNA, 25 bp, Rattus norvegicus
acatgttgattctcaatcctctgta

SEQ ID NO: 80845 - DNA, 25 bp, Rattus norvegicus
acatgttgcattactttcccatttg

SEQ ID NO: 80846 - DNA, 25 bp, Rattus norvegicus
acatgttgcatttctttcccatttg

SEQ ID NO: 80847 - DNA, 25 bp, Rattus norvegicus
acatgttgccagctgcaaagctcag

SEQ ID NO: 80848 - DNA, 25 bp, Rattus norvegicus
acatgttgccaggtgcaaagctcag

SEQ ID NO: 80849 - DNA, 25 bp, Rattus norvegicus
acatgttggacaaggctccactgct

SEQ ID NO: 80850 - DNA, 25 bp, Rattus norvegicus
acatgttggacatggctccactgct

SEQ ID NO: 80851 - DNA, 25 bp, Rattus norvegicus
acatgttgggccctcctgtggctgt

SEQ ID NO: 80852 - DNA, 25 bp, Rattus norvegicus
acatgttgggccgtcctgtggctgt

SEQ ID NO: 80853 - DNA, 25 bp, Rattus norvegicus
acatgttgtcatattgtccccagca

SEQ ID NO: 80854 - DNA, 25 bp, Rattus norvegicus
acatgttgtcattttgtccccagca

SEQ ID NO: 80855 - DNA, 25 bp, Rattus norvegicus
acatgttgtctcacagtctgtctgc

SEQ ID NO: 80856 - DNA, 25 bp, Rattus norvegicus
acatgttgtctcactagtttgcccg

SEQ ID NO: 80857 - DNA, 25 bp, Rattus norvegicus
acatgttgtctctcagtctgtctgc

SEQ ID NO: 80858 - DNA, 25 bp, Rattus norvegicus
acatgttgtctctctagtttgcccg

SEQ ID NO: 80859 - DNA, 25 bp, Rattus norvegicus
acatgttgtgctagtttacgctgaa

SEQ ID NO: 80860 - DNA, 25 bp, Rattus norvegicus
acatgttgtgcttgtttacgctgaa

SEQ ID NO: 80861 - DNA, 25 bp, Rattus norvegicus
acatgttgttcaagtttcttcttcc

SEQ ID NO: 80862 - DNA, 25 bp, Rattus norvegicus
acatgttgttcatgtttcttcttcc

SEQ ID NO: 80863 - DNA, 25 bp, Rattus norvegicus
acatgtttccatctcgctttgagaa

SEQ ID NO: 80864 - DNA, 25 bp, Rattus norvegicus
acatgtttccatctgctgttggcag

SEQ ID NO: 80865 - DNA, 25 bp, Rattus norvegicus
acatgtttccatgtcgctttgagaa

SEQ ID NO: 80866 - DNA, 25 bp, Rattus norvegicus
acatgtttccatgtgctgttggcag

SEQ ID NO: 80867 - DNA, 25 bp, Rattus norvegicus
acatgtttcctgaggttgggatttc

SEQ ID NO: 80868 - DNA, 25 bp, Rattus norvegicus
acatgtttcctgtggttgggatttc

SEQ ID NO: 80869 - DNA, 25 bp, Rattus norvegicus
acatgtttcgtgagttatggacagc

SEQ ID NO: 80870 - DNA, 25 bp, Rattus norvegicus
acatgtttcgtgtgttatggacagc

SEQ ID NO: 80871 - DNA, 25 bp, Rattus norvegicus
acatgtttctttcttactcctgacc

SEQ ID NO: 80872 - DNA, 25 bp, Rattus norvegicus
acatgtttctttgttactcctgacc

SEQ ID NO: 80873 - DNA, 25 bp, Rattus norvegicus
acatgtttgcccctcactgtttgga

SEQ ID NO: 80874 - DNA, 25 bp, Rattus norvegicus
acatgtttgcccgtcactgtttgga

SEQ ID NO: 80875 - DNA, 25 bp, Rattus norvegicus
acatgtttgcctctcacaactttag

SEQ ID NO: 80876 - DNA, 25 bp, Rattus norvegicus
acatgtttgcctgtcacaactttag

SEQ ID NO: 80877 - DNA, 25 bp, Rattus norvegicus
acatgtttgtacatccaacgttagg

SEQ ID NO: 80878 - DNA, 25 bp, Rattus norvegicus
acatgtttgtacttccaacgttagg

SEQ ID NO: 80879 - DNA, 25 bp, Rattus norvegicus
acatgtttgtctccggtgatgtcac

SEQ ID NO: 80880 - DNA, 25 bp, Rattus norvegicus
acatgtttgtctgcggtgatgtcac

SEQ ID NO: 80881 - DNA, 25 bp, Rattus norvegicus
acatgtttgtgtaagccgcaggcca

SEQ ID NO: 80882 - DNA, 25 bp, Rattus norvegicus
acatgtttgtgttagccgcaggcca

SEQ ID NO: 80883 - DNA, 25 bp, Rattus norvegicus
acatgttttgttacgttattgaggt

SEQ ID NO: 80884 - DNA, 25 bp, Rattus norvegicus
acatgttttgtttcgttattgaggt

SEQ ID NO: 80885 - DNA, 25 bp, Rattus norvegicus
acatgtttttatctgcagttgtgtc

SEQ ID NO: 80886 - DNA, 25 bp, Rattus norvegicus
acatgtttttatgtgcagttgtgtc

SEQ ID NO: 80887 - DNA, 25 bp, Rattus norvegicus
acatgtttttgtatctggcctccag

SEQ ID NO: 80888 - DNA, 25 bp, Rattus norvegicus
acatgtttttgtttctggcctccag

SEQ ID NO: 80889 - DNA, 25 bp, Rattus norvegicus
acatgttttttccaggtacagccct

SEQ ID NO: 80890 - DNA, 25 bp, Rattus norvegicus
acatgttttttcgaggtacagccct

SEQ ID NO: 80891 - DNA, 25 bp, Rattus norvegicus
acattaagcgtcaccgtcagcggat

SEQ ID NO: 80892 - DNA, 25 bp, Rattus norvegicus
acattaagcgtctccgtcagcggat

SEQ ID NO: 80893 - DNA, 25 bp, Rattus norvegicus
acattaattactctaggctgctcac

SEQ ID NO: 80894 - DNA, 25 bp, Rattus norvegicus
acattaattactgtaggctgctcac

SEQ ID NO: 80895 - DNA, 25 bp, Rattus norvegicus
acattacaacttatattgaccttga

SEQ ID NO: 80896 - DNA, 25 bp, Rattus norvegicus
acattacaacttttattgaccttga

SEQ ID NO: 80897 - DNA, 25 bp, Rattus norvegicus
acattacatacccttgacagtctaa

SEQ ID NO: 80898 - DNA, 25 bp, Rattus norvegicus
acattacataccgttgacagtctaa

SEQ ID NO: 80899 - DNA, 25 bp, Rattus norvegicus
acattaccagctaaattgcctcttc

SEQ ID NO: 80900 - DNA, 25 bp, Rattus norvegicus
acattaccagcttaattgcctcttc

SEQ ID NO: 80901 - DNA, 25 bp, Rattus norvegicus
acattaccctataatccagttttat

SEQ ID NO: 80902 - DNA, 25 bp, Rattus norvegicus
acattaccctattatccagttttat

SEQ ID NO: 80903 - DNA, 25 bp, Rattus norvegicus
acattacctacccttgatcttacta

SEQ ID NO: 80904 - DNA, 25 bp, Rattus norvegicus
acattacctaccgttgatcttacta

SEQ ID NO: 80905 - DNA, 25 bp, Rattus norvegicus
acattaccttctaagtcgacacgtt

SEQ ID NO: 80906 - DNA, 25 bp, Rattus norvegicus
acattaccttcttagtcgacacgtt

SEQ ID NO: 80907 - DNA, 25 bp, Rattus norvegicus
acattacggcaacaccatggctggg

SEQ ID NO: 80908 - DNA, 25 bp, Rattus norvegicus
acattacggcaagaccatggctggg

SEQ ID NO: 80909 - DNA, 25 bp, Rattus norvegicus
acattactaggaccgcaggtttgaa

SEQ ID NO: 80910 - DNA, 25 bp, Rattus norvegicus
acattactaggagcgcaggtttgaa

SEQ ID NO: 80911 - DNA, 25 bp, Rattus norvegicus
acattactctgtagcggcgtcggcg

SEQ ID NO: 80912 - DNA, 25 bp, Rattus norvegicus
acattactctgttgcggcgtcggcg

SEQ ID NO: 80913 - DNA, 25 bp, Rattus norvegicus
acattactgaaaattctgaaactga

SEQ ID NO: 80914 - DNA, 25 bp, Rattus norvegicus
acattactgaaatttctgaaactga

SEQ ID NO: 80915 - DNA, 25 bp, Rattus norvegicus
acattactgactcggttactcctaa

SEQ ID NO: 80916 - DNA, 25 bp, Rattus norvegicus
acattactgactgggttactcctaa

SEQ ID NO: 80917 - DNA, 25 bp, Rattus norvegicus
acattactgtgcacacaatctgtga

SEQ ID NO: 80918 - DNA, 25 bp, Rattus norvegicus
acattactgtgctcacaatctgtga

SEQ ID NO: 80919 - DNA, 25 bp, Rattus norvegicus
acattacttgtcatagtcgtttgaa

SEQ ID NO: 80920 - DNA, 25 bp, Rattus norvegicus
acattacttgtcttagtcgtttgaa

SEQ ID NO: 80921 - DNA, 25 bp, Rattus norvegicus
acattagagcgcacgtggtctttcc

SEQ ID NO: 80922 - DNA, 25 bp, Rattus norvegicus
acattagagcgctcgtggtctttcc

SEQ ID NO: 80923 - DNA, 25 bp, Rattus norvegicus
acattagagtcccagtacccacggg

SEQ ID NO: 80924 - DNA, 25 bp, Rattus norvegicus
acattagagtccgagtacccacggg

SEQ ID NO: 80925 - DNA, 25 bp, Rattus norvegicus
acattagcattccacggttcagggc

SEQ ID NO: 80926 - DNA, 25 bp, Rattus norvegicus
acattagcattcgacggttcagggc

SEQ ID NO: 80927 - DNA, 25 bp, Rattus norvegicus
acattagtactaaaccgagagcccg

SEQ ID NO: 80928 - DNA, 25 bp, Rattus norvegicus
acattagtactataccgagagcccg

SEQ ID NO: 80929 - DNA, 25 bp, Rattus norvegicus
acattagtccccacaattcataact

SEQ ID NO: 80930 - DNA, 25 bp, Rattus norvegicus
acattagtcccctcaattcataact

SEQ ID NO: 80931 - DNA, 25 bp, Rattus norvegicus
acattagtgagtatcgttccaaaat

SEQ ID NO: 80932 - DNA, 25 bp, Rattus norvegicus
acattagtgagtttcgttccaaaat

SEQ ID NO: 80933 - DNA, 25 bp, Rattus norvegicus
acattagtgattctggagggttaaa

SEQ ID NO: 80934 - DNA, 25 bp, Rattus norvegicus
acattagtgattgtggagggttaaa

SEQ ID NO: 80935 - DNA, 25 bp, Rattus norvegicus
acattataccacagatctatccctc

SEQ ID NO: 80936 - DNA, 25 bp, Rattus norvegicus
acattataccactgatctatccctc

SEQ ID NO: 80937 - DNA, 25 bp, Rattus norvegicus
acattatcctgcatgtctacttaaa

SEQ ID NO: 80938 - DNA, 25 bp, Rattus norvegicus
acattatcctgcttgtctacttaaa

SEQ ID NO: 80939 - DNA, 25 bp, Rattus norvegicus
acattatcgactacaggccactcaa

SEQ ID NO: 80940 - DNA, 25 bp, Rattus norvegicus
acattatcgacttcaggccactcaa

SEQ ID NO: 80941 - DNA, 25 bp, Rattus norvegicus
acattatctccacagtgtcttgtga

SEQ ID NO: 80942 - DNA, 25 bp, Rattus norvegicus
acattatctccagagtgtcttgtga

SEQ ID NO: 80943 - DNA, 25 bp, Rattus norvegicus
acattatcttttcaccatttctgcc

SEQ ID NO: 80944 - DNA, 25 bp, Rattus norvegicus
acattatcttttgaccatttctgcc

SEQ ID NO: 80945 - DNA, 25 bp, Rattus norvegicus
acattattccccatatattcaccct

SEQ ID NO: 80946 - DNA, 25 bp, Rattus norvegicus
acattattccccttatattcaccct

SEQ ID NO: 80947 - DNA, 25 bp, Rattus norvegicus
acattattgcttactgatctggact

SEQ ID NO: 80948 - DNA, 25 bp, Rattus norvegicus
acattattgctttctgatctggact

SEQ ID NO: 80949 - DNA, 25 bp, Rattus norvegicus
acattattgggtccctttgtttgta

SEQ ID NO: 80950 - DNA, 25 bp, Rattus norvegicus
acattattgggtgcctttgtttgta

SEQ ID NO: 80951 - DNA, 25 bp, Rattus norvegicus
acattattgtgtcaccacggagcta

SEQ ID NO: 80952 - DNA, 25 bp, Rattus norvegicus
acattattgtgtgaccacggagcta

SEQ ID NO: 80953 - DNA, 25 bp, Rattus norvegicus
acattcacggatatcctggctttca

SEQ ID NO: 80954 - DNA, 25 bp, Rattus norvegicus
acattcacggatttcctggctttca

SEQ ID NO: 80955 - DNA, 25 bp, Rattus norvegicus
acattcacgttcagactgaaggaca

SEQ ID NO: 80956 - DNA, 25 bp, Rattus norvegicus
acattcacgttctgactgaaggaca

SEQ ID NO: 80957 - DNA, 25 bp, Rattus norvegicus
acattcacttacactgtaccctaaa

SEQ ID NO: 80958 - DNA, 25 bp, Rattus norvegicus
acattcacttacattcagtttcatg

SEQ ID NO: 80959 - DNA, 25 bp, Rattus norvegicus
acattcacttactctgtaccctaaa

SEQ ID NO: 80960 - DNA, 25 bp, Rattus norvegicus
acattcacttactttcagtttcatg

SEQ ID NO: 80961 - DNA, 25 bp, Rattus norvegicus
acattcacttctagtgctttaggaa

SEQ ID NO: 80962 - DNA, 25 bp, Rattus norvegicus
acattcacttctccaggtaacccaa

SEQ ID NO: 80963 - DNA, 25 bp, Rattus norvegicus
acattcacttctgcaggtaacccaa

SEQ ID NO: 80964 - DNA, 25 bp, Rattus norvegicus
acattcacttcttgtgctttaggaa

SEQ ID NO: 80965 - DNA, 25 bp, Rattus norvegicus
acattcagaggtcaccaggcagtct

SEQ ID NO: 80966 - DNA, 25 bp, Rattus norvegicus
acattcagaggtgaccaggcagtct

SEQ ID NO: 80967 - DNA, 25 bp, Rattus norvegicus
acattcagatgacggctggctgccg

SEQ ID NO: 80968 - DNA, 25 bp, Rattus norvegicus
acattcagatgagggctggctgccg

SEQ ID NO: 80969 - DNA, 25 bp, Rattus norvegicus
acattcaggaaccaggcagtggcct

SEQ ID NO: 80970 - DNA, 25 bp, Rattus norvegicus
acattcaggaacgaggcagtggcct

SEQ ID NO: 80971 - DNA, 25 bp, Rattus norvegicus
acattcaggccacggtgttcagcac

SEQ ID NO: 80972 - DNA, 25 bp, Rattus norvegicus
acattcaggccagggtgttcagcac

SEQ ID NO: 80973 - DNA, 25 bp, Rattus norvegicus
acattcaggcttacagcaatggctt

SEQ ID NO: 80974 - DNA, 25 bp, Rattus norvegicus
acattcaggctttcagcaatggctt

SEQ ID NO: 80975 - DNA, 25 bp, Rattus norvegicus
acattcagggctattgtgcgtgcta

SEQ ID NO: 80976 - DNA, 25 bp, Rattus norvegicus
acattcagggcttttgtgcgtgcta

SEQ ID NO: 80977 - DNA, 25 bp, Rattus norvegicus
acattcatagtcacaggtccccaga

SEQ ID NO: 80978 - DNA, 25 bp, Rattus norvegicus
acattcatagtctcaggtccccaga

SEQ ID NO: 80979 - DNA, 25 bp, Rattus norvegicus
acattcatcgtgctgcagaagcggc

SEQ ID NO: 80980 - DNA, 25 bp, Rattus norvegicus
acattcatcgtggtgcagaagcggc

SEQ ID NO: 80981 - DNA, 25 bp, Rattus norvegicus
acattcatctcacaaaggcacctgg

SEQ ID NO: 80982 - DNA, 25 bp, Rattus norvegicus
acattcatctcagaaaggcacctgg

SEQ ID NO: 80983 - DNA, 25 bp, Rattus norvegicus
acattcatgcaccacttccttaaat

SEQ ID NO: 80984 - DNA, 25 bp, Rattus norvegicus
acattcatgcacgacttccttaaat

SEQ ID NO: 80985 - DNA, 25 bp, Rattus norvegicus
acattcatgcccacaggttggactc

SEQ ID NO: 80986 - DNA, 25 bp, Rattus norvegicus
acattcatgccctcaggttggactc

SEQ ID NO: 80987 - DNA, 25 bp, Rattus norvegicus
acattcatgctcaagttgttacgga

SEQ ID NO: 80988 - DNA, 25 bp, Rattus norvegicus
acattcatgctctagttgttacgga

SEQ ID NO: 80989 - DNA, 25 bp, Rattus norvegicus
acattcattccacagtttgcacaac

SEQ ID NO: 80990 - DNA, 25 bp, Rattus norvegicus
acattcattccagagtttgcacaac

SEQ ID NO: 80991 - DNA, 25 bp, Rattus norvegicus
acattcattcctatcatttcatgcc

SEQ ID NO: 80992 - DNA, 25 bp, Rattus norvegicus
acattcattcctttcatttcatgcc

SEQ ID NO: 80993 - DNA, 25 bp, Rattus norvegicus
acattcattctgaagaggtaccact

SEQ ID NO: 80994 - DNA, 25 bp, Rattus norvegicus
acattcattctgtagaggtaccact

SEQ ID NO: 80995 - DNA, 25 bp, Rattus norvegicus
acattcattttacattgcccaccta

SEQ ID NO: 80996 - DNA, 25 bp, Rattus norvegicus
acattcattttagattgcccaccta

SEQ ID NO: 80997 - DNA, 25 bp, Rattus norvegicus
acattccaatgtattccttagaggt

SEQ ID NO: 80998 - DNA, 25 bp, Rattus norvegicus
acattccaatgttttccttagaggt

SEQ ID NO: 80999 - DNA, 25 bp, Rattus norvegicus
acattccacagtcacatggtcgcgt

SEQ ID NO: 81000 - DNA, 25 bp, Rattus norvegicus
acattccacagtgacatggtcgcgt

SEQ ID NO: 81001 - DNA, 25 bp, Rattus norvegicus
acattccaccctcaagattctacaa

SEQ ID NO: 81002 - DNA, 25 bp, Rattus norvegicus
acattccaccctgaagattctacaa

SEQ ID NO: 81003 - DNA, 25 bp, Rattus norvegicus
acattccagaaccagattgcggcta

SEQ ID NO: 81004 - DNA, 25 bp, Rattus norvegicus
acattccagaacgagattgcggcta

SEQ ID NO: 81005 - DNA, 25 bp, Rattus norvegicus
acattccagccacggctctggtgta

SEQ ID NO: 81006 - DNA, 25 bp, Rattus norvegicus
acattccagccagggctctggtgta

SEQ ID NO: 81007 - DNA, 25 bp, Rattus norvegicus
acattccagtccatgcagaggtcag

SEQ ID NO: 81008 - DNA, 25 bp, Rattus norvegicus
acattccagtccttgcagaggtcag

SEQ ID NO: 81009 - DNA, 25 bp, Rattus norvegicus
acattccagtgtctctgaacgacct

SEQ ID NO: 81010 - DNA, 25 bp, Rattus norvegicus
acattccagtgtgtctgaacgacct

SEQ ID NO: 81011 - DNA, 25 bp, Rattus norvegicus
acattccatgccatctagaaagagg

SEQ ID NO: 81012 - DNA, 25 bp, Rattus norvegicus
acattccatgccttctagaaagagg

SEQ ID NO: 81013 - DNA, 25 bp, Rattus norvegicus
acattccattgccttcctttttatt

SEQ ID NO: 81014 - DNA, 25 bp, Rattus norvegicus
acattccattgcgttcctttttatt

SEQ ID NO: 81015 - DNA, 25 bp, Rattus norvegicus
acattccatttcatggacccctgta

SEQ ID NO: 81016 - DNA, 25 bp, Rattus norvegicus
acattccatttcttggacccctgta

SEQ ID NO: 81017 - DNA, 25 bp, Rattus norvegicus
acattcccaattagccctacttaat

SEQ ID NO: 81018 - DNA, 25 bp, Rattus norvegicus
acattcccaatttgccctacttaat

SEQ ID NO: 81019 - DNA, 25 bp, Rattus norvegicus
acattcccaccgacagtgaagctgt

SEQ ID NO: 81020 - DNA, 25 bp, Rattus norvegicus
acattcccaccgtcagtgaagctgt

SEQ ID NO: 81021 - DNA, 25 bp, Rattus norvegicus
acattcccagaaaagctccagtttg

SEQ ID NO: 81022 - DNA, 25 bp, Rattus norvegicus
acattcccagaatagctccagtttg

SEQ ID NO: 81023 - DNA, 25 bp, Rattus norvegicus
acattcccagcactgaatcactaag

SEQ ID NO: 81024 - DNA, 25 bp, Rattus norvegicus
acattcccagcagtgaatcactaag

SEQ ID NO: 81025 - DNA, 25 bp, Rattus norvegicus
acattcccatgactttccaaatact

SEQ ID NO: 81026 - DNA, 25 bp, Rattus norvegicus
acattcccatgagtttccaaatact

SEQ ID NO: 81027 - DNA, 25 bp, Rattus norvegicus
acattcccatgtcaagagagatata

SEQ ID NO: 81028 - DNA, 25 bp, Rattus norvegicus
acattcccatgtcagaggcttcttc

SEQ ID NO: 81029 - DNA, 25 bp, Rattus norvegicus
acattcccatgtgaagagagatata

SEQ ID NO: 81030 - DNA, 25 bp, Rattus norvegicus
acattcccatgtgagaggcttcttc

SEQ ID NO: 81031 - DNA, 25 bp, Rattus norvegicus
acattcccatttaaactctgttcta

SEQ ID NO: 81032 - DNA, 25 bp, Rattus norvegicus
acattcccatttcctgtggatgaaa

SEQ ID NO: 81033 - DNA, 25 bp, Rattus norvegicus
acattcccatttgctgtggatgaaa

SEQ ID NO: 81034 - DNA, 25 bp, Rattus norvegicus
acattcccattttaactctgttcta

SEQ ID NO: 81035 - DNA, 25 bp, Rattus norvegicus
acattcccctgcaaacgattcaaag

SEQ ID NO: 81036 - DNA, 25 bp, Rattus norvegicus
acattcccctgctaacgattcaaag

SEQ ID NO: 81037 - DNA, 25 bp, Rattus norvegicus
acattcccgacacgtgggtcctgca

SEQ ID NO: 81038 - DNA, 25 bp, Rattus norvegicus
acattcccgacaggtgggtcctgca

SEQ ID NO: 81039 - DNA, 25 bp, Rattus norvegicus
acattcccgggcactgaattgggcc

SEQ ID NO: 81040 - DNA, 25 bp, Rattus norvegicus
acattcccgggctctgaattgggcc

SEQ ID NO: 81041 - DNA, 25 bp, Rattus norvegicus
acattccgtgtccagagcatcatag

SEQ ID NO: 81042 - DNA, 25 bp, Rattus norvegicus
acattccgtgtcgagagcatcatag

SEQ ID NO: 81043 - DNA, 25 bp, Rattus norvegicus
acattcctagctactctgaggcatg

SEQ ID NO: 81044 - DNA, 25 bp, Rattus norvegicus
acattcctagcttctctgaggcatg

SEQ ID NO: 81045 - DNA, 25 bp, Rattus norvegicus
acattcctcaaactcagcgtcttgg

SEQ ID NO: 81046 - DNA, 25 bp, Rattus norvegicus
acattcctcaaagtcagcgtcttgg

SEQ ID NO: 81047 - DNA, 25 bp, Rattus norvegicus
acattcctcaccacgtacagtagtg

SEQ ID NO: 81048 - DNA, 25 bp, Rattus norvegicus
acattcctcacctcgtacagtagtg

SEQ ID NO: 81049 - DNA, 25 bp, Rattus norvegicus
acattcctctgccttggttctacaa

SEQ ID NO: 81050 - DNA, 25 bp, Rattus norvegicus
acattcctctgcgttggttctacaa

SEQ ID NO: 81051 - DNA, 25 bp, Rattus norvegicus
acattcctgcctagtaaggcctcat

SEQ ID NO: 81052 - DNA, 25 bp, Rattus norvegicus
acattcctgccttgtaaggcctcat

SEQ ID NO: 81053 - DNA, 25 bp, Rattus norvegicus
acattcctgctgacttcagtttcat

SEQ ID NO: 81054 - DNA, 25 bp, Rattus norvegicus
acattcctgctgtcttcagtttcat

SEQ ID NO: 81055 - DNA, 25 bp, Rattus norvegicus
acattcctgcttcctttggttttag

SEQ ID NO: 81056 - DNA, 25 bp, Rattus norvegicus
acattcctgcttgctttggttttag

SEQ ID NO: 81057 - DNA, 25 bp, Rattus norvegicus
acattcctgggcactactggtaaat

SEQ ID NO: 81058 - DNA, 25 bp, Rattus norvegicus
acattcctgggctctactggtaaat

SEQ ID NO: 81059 - DNA, 25 bp, Rattus norvegicus
acattcctggtcctttcagctatta

SEQ ID NO: 81060 - DNA, 25 bp, Rattus norvegicus
acattcctggtcgtttcagctatta

SEQ ID NO: 81061 - DNA, 25 bp, Rattus norvegicus
acattcctgtccactgtgtaagagc

SEQ ID NO: 81062 - DNA, 25 bp, Rattus norvegicus
acattcctgtcctctgtgtaagagc

SEQ ID NO: 81063 - DNA, 25 bp, Rattus norvegicus
acattcctgtgacccggagccctgt

SEQ ID NO: 81064 - DNA, 25 bp, Rattus norvegicus
acattcctgtgagccggagccctgt

SEQ ID NO: 81065 - DNA, 25 bp, Rattus norvegicus
acattcctgtggcatctgcggcaag

SEQ ID NO: 81066 - DNA, 25 bp, Rattus norvegicus
acattcctgtgggatctgcggcaag

SEQ ID NO: 81067 - DNA, 25 bp, Rattus norvegicus
acattccttagaacgttagtcctca

SEQ ID NO: 81068 - DNA, 25 bp, Rattus norvegicus
acattccttagatcgttagtcctca

SEQ ID NO: 81069 - DNA, 25 bp, Rattus norvegicus
acattccttatgatgtccctttaca

SEQ ID NO: 81070 - DNA, 25 bp, Rattus norvegicus
acattccttatgttgtccctttaca

SEQ ID NO: 81071 - DNA, 25 bp, Rattus norvegicus
acattccttcagagataatccggat

SEQ ID NO: 81072 - DNA, 25 bp, Rattus norvegicus
acattccttcagtgataatccggat

SEQ ID NO: 81073 - DNA, 25 bp, Rattus norvegicus
acattccttgtaatctggttctgct

SEQ ID NO: 81074 - DNA, 25 bp, Rattus norvegicus
acattccttgtattctggttctgct

SEQ ID NO: 81075 - DNA, 25 bp, Rattus norvegicus
acattcctttgacgttgaccatgaa

SEQ ID NO: 81076 - DNA, 25 bp, Rattus norvegicus
acattcctttgaggttgaccatgaa

SEQ ID NO: 81077 - DNA, 25 bp, Rattus norvegicus
acattcctttgtctcttgttctaag

SEQ ID NO: 81078 - DNA, 25 bp, Rattus norvegicus
acattcctttgtgtcttgttctaag

SEQ ID NO: 81079 - DNA, 25 bp, Rattus norvegicus
acattcgagtcccttttcataacag

SEQ ID NO: 81080 - DNA, 25 bp, Rattus norvegicus
acattcgagtccgttttcataacag

SEQ ID NO: 81081 - DNA, 25 bp, Rattus norvegicus
acattcgagttcacaccccaggggg

SEQ ID NO: 81082 - DNA, 25 bp, Rattus norvegicus
acattcgagttctcaccccaggggg

SEQ ID NO: 81083 - DNA, 25 bp, Rattus norvegicus
acattcggactcaggcgtgagggcc

SEQ ID NO: 81084 - DNA, 25 bp, Rattus norvegicus
acattcggactctggcgtgagggcc

SEQ ID NO: 81085 - DNA, 25 bp, Rattus norvegicus
acattcggcctccacatagtagtct

SEQ ID NO: 81086 - DNA, 25 bp, Rattus norvegicus
acattcggcctcgacatagtagtct

SEQ ID NO: 81087 - DNA, 25 bp, Rattus norvegicus
acattcgtactaagccagtctttcc

SEQ ID NO: 81088 - DNA, 25 bp, Rattus norvegicus
acattcgtactatgccagtctttcc

SEQ ID NO: 81089 - DNA, 25 bp, Rattus norvegicus
acattcgtctcaatgctgcagtgaa

SEQ ID NO: 81090 - DNA, 25 bp, Rattus norvegicus
acattcgtctcattgctgcagtgaa

SEQ ID NO: 81091 - DNA, 25 bp, Rattus norvegicus
acattcgtgcacaatggcagtcggt

SEQ ID NO: 81092 - DNA, 25 bp, Rattus norvegicus
acattcgtgcactatggcagtcggt

SEQ ID NO: 81093 - DNA, 25 bp, Rattus norvegicus
acattcgtgcgcatggtgcagtgcc

SEQ ID NO: 81094 - DNA, 25 bp, Rattus norvegicus
acattcgtgcgcttggtgcagtgcc

SEQ ID NO: 81095 - DNA, 25 bp, Rattus norvegicus
acattcgtgggtacaggacagcaat

SEQ ID NO: 81096 - DNA, 25 bp, Rattus norvegicus
acattcgtgggttcaggacagcaat

SEQ ID NO: 81097 - DNA, 25 bp, Rattus norvegicus
acattcgtgtacaaacttccttaat

SEQ ID NO: 81098 - DNA, 25 bp, Rattus norvegicus
acattcgtgtactaacttccttaat

SEQ ID NO: 81099 - DNA, 25 bp, Rattus norvegicus
acattctaatggctggatccgagcc

SEQ ID NO: 81100 - DNA, 25 bp, Rattus norvegicus
acattctaatgggtggatccgagcc

SEQ ID NO: 81101 - DNA, 25 bp, Rattus norvegicus
acattctacaacacttttgctttga

SEQ ID NO: 81102 - DNA, 25 bp, Rattus norvegicus
acattctacaactcttttgctttga

SEQ ID NO: 81103 - DNA, 25 bp, Rattus norvegicus
acattctagaacagacctgtctcgt

SEQ ID NO: 81104 - DNA, 25 bp, Rattus norvegicus
acattctagaactgacctgtctcgt

SEQ ID NO: 81105 - DNA, 25 bp, Rattus norvegicus
acattctcactcaaaaactccaaac

SEQ ID NO: 81106 - DNA, 25 bp, Rattus norvegicus
acattctcactctaaaactccaaac

SEQ ID NO: 81107 - DNA, 25 bp, Rattus norvegicus
acattctcagatcctgggagctccc

SEQ ID NO: 81108 - DNA, 25 bp, Rattus norvegicus
acattctcagatgctgggagctccc

SEQ ID NO: 81109 - DNA, 25 bp, Rattus norvegicus
acattctcaggaattctaactcaag

SEQ ID NO: 81110 - DNA, 25 bp, Rattus norvegicus
acattctcaggatttctaactcaag

SEQ ID NO: 81111 - DNA, 25 bp, Rattus norvegicus
acattctcaggtctcacaggtttta

SEQ ID NO: 81112 - DNA, 25 bp, Rattus norvegicus
acattctcaggtgtcacaggtttta

SEQ ID NO: 81113 - DNA, 25 bp, Rattus norvegicus
acattctcatataaggtctctccta

SEQ ID NO: 81114 - DNA, 25 bp, Rattus norvegicus
acattctcatattaggtctctccta

SEQ ID NO: 81115 - DNA, 25 bp, Rattus norvegicus
acattctcattaatggtcctatcca

SEQ ID NO: 81116 - DNA, 25 bp, Rattus norvegicus
acattctcattattggtcctatcca

SEQ ID NO: 81117 - DNA, 25 bp, Rattus norvegicus
acattctcctgaccccagacaagaa

SEQ ID NO: 81118 - DNA, 25 bp, Rattus norvegicus
acattctcctgagcccagacaagaa

SEQ ID NO: 81119 - DNA, 25 bp, Rattus norvegicus
acattctcctttctcttgcattttt

SEQ ID NO: 81120 - DNA, 25 bp, Rattus norvegicus
acattctcctttgtcttgcattttt

SEQ ID NO: 81121 - DNA, 25 bp, Rattus norvegicus
acattctcgaagctgtcagatgagc

SEQ ID NO: 81122 - DNA, 25 bp, Rattus norvegicus
acattctcgaaggtgtcagatgagc

SEQ ID NO: 81123 - DNA, 25 bp, Rattus norvegicus
acattctctaccctcatggagttga

SEQ ID NO: 81124 - DNA, 25 bp, Rattus norvegicus
acattctctaccgtcatggagttga

SEQ ID NO: 81125 - DNA, 25 bp, Rattus norvegicus
acattctctatacagttgcctttga

SEQ ID NO: 81126 - DNA, 25 bp, Rattus norvegicus
acattctctatagagttgcctttga

SEQ ID NO: 81127 - DNA, 25 bp, Rattus norvegicus
acattctctcagcatgtactctgcg

SEQ ID NO: 81128 - DNA, 25 bp, Rattus norvegicus
acattctctcaggatgtactctgcg

SEQ ID NO: 81129 - DNA, 25 bp, Rattus norvegicus
acattctctgccaatgtcagcttga

SEQ ID NO: 81130 - DNA, 25 bp, Rattus norvegicus
acattctctgcctatgtcagcttga

SEQ ID NO: 81131 - DNA, 25 bp, Rattus norvegicus
acattctgaagtccgtggcacaaat

SEQ ID NO: 81132 - DNA, 25 bp, Rattus norvegicus
acattctgaagtgcgtggcacaaat

SEQ ID NO: 81133 - DNA, 25 bp, Rattus norvegicus
acattctgattcatttgtccttccg

SEQ ID NO: 81134 - DNA, 25 bp, Rattus norvegicus
acattctgattcttttgtccttccg

SEQ ID NO: 81135 - DNA, 25 bp, Rattus norvegicus
acattctgcaaacgtgctctggctc

SEQ ID NO: 81136 - DNA, 25 bp, Rattus norvegicus
acattctgcaaaggtgctctggctc

SEQ ID NO: 81137 - DNA, 25 bp, Rattus norvegicus
acattctgctttcttgtgcacttgg

SEQ ID NO: 81138 - DNA, 25 bp, Rattus norvegicus
acattctgctttgttgtgcacttgg

SEQ ID NO: 81139 - DNA, 25 bp, Rattus norvegicus
acattctggaggcttctcctaacct

SEQ ID NO: 81140 - DNA, 25 bp, Rattus norvegicus
acattctggagggttctcctaacct

SEQ ID NO: 81141 - DNA, 25 bp, Rattus norvegicus
acattctgggtgcttattccttagt

SEQ ID NO: 81142 - DNA, 25 bp, Rattus norvegicus
acattctgggtggttattccttagt

SEQ ID NO: 81143 - DNA, 25 bp, Rattus norvegicus
acattctgtatcctggtgcctgaaa

SEQ ID NO: 81144 - DNA, 25 bp, Rattus norvegicus
acattctgtatcgtggtgcctgaaa

SEQ ID NO: 81145 - DNA, 25 bp, Rattus norvegicus
acattcttatatactctcgaacagg

SEQ ID NO: 81146 - DNA, 25 bp, Rattus norvegicus
acattcttatattctctcgaacagg

SEQ ID NO: 81147 - DNA, 25 bp, Rattus norvegicus
acattcttcaacctaagtgtcctct

SEQ ID NO: 81148 - DNA, 25 bp, Rattus norvegicus
acattcttcaacgtaagtgtcctct

SEQ ID NO: 81149 - DNA, 25 bp, Rattus norvegicus
acattcttccatcgtcactgtaaag

SEQ ID NO: 81150 - DNA, 25 bp, Rattus norvegicus
acattcttccatggtcactgtaaag

SEQ ID NO: 81151 - DNA, 25 bp, Rattus norvegicus
acattcttcggtctagaggtctaca

SEQ ID NO: 81152 - DNA, 25 bp, Rattus norvegicus
acattcttcggtgtagaggtctaca

SEQ ID NO: 81153 - DNA, 25 bp, Rattus norvegicus
acattcttggagagtgaccctgaga

SEQ ID NO: 81154 - DNA, 25 bp, Rattus norvegicus
acattcttggagtgtgaccctgaga

SEQ ID NO: 81155 - DNA, 25 bp, Rattus norvegicus
acattcttggtcagtatctccttcc

SEQ ID NO: 81156 - DNA, 25 bp, Rattus norvegicus
acattcttggtctgtatctccttcc

SEQ ID NO: 81157 - DNA, 25 bp, Rattus norvegicus
acattctttattcccagctgttcag

SEQ ID NO: 81158 - DNA, 25 bp, Rattus norvegicus
acattctttattgccagctgttcag

SEQ ID NO: 81159 - DNA, 25 bp, Rattus norvegicus
acattctttcccacgtacagtggaa

SEQ ID NO: 81160 - DNA, 25 bp, Rattus norvegicus
acattctttccctcgtacagtggaa

SEQ ID NO: 81161 - DNA, 25 bp, Rattus norvegicus
acattcttttatctatcaaacatgg

SEQ ID NO: 81162 - DNA, 25 bp, Rattus norvegicus
acattcttttatgtatcaaacatgg

SEQ ID NO: 81163 - DNA, 25 bp, Rattus norvegicus
acattcttttgtcggacatttcctt

SEQ ID NO: 81164 - DNA, 25 bp, Rattus norvegicus
acattcttttgtgggacatttcctt

SEQ ID NO: 81165 - DNA, 25 bp, Rattus norvegicus
acattctttttcattactttgcaca

SEQ ID NO: 81166 - DNA, 25 bp, Rattus norvegicus
acattctttttctttactttgcaca

SEQ ID NO: 81167 - DNA, 25 bp, Rattus norvegicus
acattgaactgtcccgtgcgagctg

SEQ ID NO: 81168 - DNA, 25 bp, Rattus norvegicus
acattgaactgtgccgtgcgagctg

SEQ ID NO: 81169 - DNA, 25 bp, Rattus norvegicus
acattgaatgcacagtttttaggaa

SEQ ID NO: 81170 - DNA, 25 bp, Rattus norvegicus
acattgaatgcagagtttttaggaa

SEQ ID NO: 81171 - DNA, 25 bp, Rattus norvegicus
acattgaccccactgctagaagcat

SEQ ID NO: 81172 - DNA, 25 bp, Rattus norvegicus
acattgaccccagtgctagaagcat

SEQ ID NO: 81173 - DNA, 25 bp, Rattus norvegicus
acattgaccctcactggctggttga

SEQ ID NO: 81174 - DNA, 25 bp, Rattus norvegicus
acattgaccctctctggctggttga

SEQ ID NO: 81175 - DNA, 25 bp, Rattus norvegicus
acattgacgtctctgagctggactc

SEQ ID NO: 81176 - DNA, 25 bp, Rattus norvegicus
acattgacgtctgtgagctggactc

SEQ ID NO: 81177 - DNA, 25 bp, Rattus norvegicus
acattgacttacaccctgagcagcg

SEQ ID NO: 81178 - DNA, 25 bp, Rattus norvegicus
acattgacttactccctgagcagcg

SEQ ID NO: 81179 - DNA, 25 bp, Rattus norvegicus
acattgagcctaatccacttacgta

SEQ ID NO: 81180 - DNA, 25 bp, Rattus norvegicus
acattgagcctattccacttacgta

SEQ ID NO: 81181 - DNA, 25 bp, Rattus norvegicus
acattgagctgtctgatgatcctta

SEQ ID NO: 81182 - DNA, 25 bp, Rattus norvegicus
acattgagctgtgtgatgatcctta

SEQ ID NO: 81183 - DNA, 25 bp, Rattus norvegicus
acattgaggaacatgtggaacccgt

SEQ ID NO: 81184 - DNA, 25 bp, Rattus norvegicus
acattgaggaacttgtggaacccgt

SEQ ID NO: 81185 - DNA, 25 bp, Rattus norvegicus
acattgaggagcacctgcagcgcgt

SEQ ID NO: 81186 - DNA, 25 bp, Rattus norvegicus
acattgaggagctcctgcagcgcgt

SEQ ID NO: 81187 - DNA, 25 bp, Rattus norvegicus
acattgagggccacctgcagcggct

SEQ ID NO: 81188 - DNA, 25 bp, Rattus norvegicus
acattgagggcctcctgcagcggct

SEQ ID NO: 81189 - DNA, 25 bp, Rattus norvegicus
acattgagtctccaaggtgctgctg

SEQ ID NO: 81190 - DNA, 25 bp, Rattus norvegicus
acattgagtctcgaaggtgctgctg

SEQ ID NO: 81191 - DNA, 25 bp, Rattus norvegicus
acattgagtgtcctaagccttgtga

SEQ ID NO: 81192 - DNA, 25 bp, Rattus norvegicus
acattgagtgtcgtaagccttgtga

SEQ ID NO: 81193 - DNA, 25 bp, Rattus norvegicus
acattgagttttcatctttcccctt

SEQ ID NO: 81194 - DNA, 25 bp, Rattus norvegicus
acattgagttttgatctttcccctt

SEQ ID NO: 81195 - DNA, 25 bp, Rattus norvegicus
acattgatcaaacggaacattcgac

SEQ ID NO: 81196 - DNA, 25 bp, Rattus norvegicus
acattgatcaaagggaacattcgac

SEQ ID NO: 81197 - DNA, 25 bp, Rattus norvegicus
acattgatgagtcactgacgtggca

SEQ ID NO: 81198 - DNA, 25 bp, Rattus norvegicus
acattgatgagtgactgacgtggca

SEQ ID NO: 81199 - DNA, 25 bp, Rattus norvegicus
acattgatgcaaatcgggttcccat

SEQ ID NO: 81200 - DNA, 25 bp, Rattus norvegicus
acattgatgcaattcgggttcccat

SEQ ID NO: 81201 - DNA, 25 bp, Rattus norvegicus
acattgatgccgaggagctggctga

SEQ ID NO: 81202 - DNA, 25 bp, Rattus norvegicus
acattgatgccgtggagctggctga

SEQ ID NO: 81203 - DNA, 25 bp, Rattus norvegicus
acattgatggttccacttacgtgaa

SEQ ID NO: 81204 - DNA, 25 bp, Rattus norvegicus
acattgatggttgcacttacgtgaa

SEQ ID NO: 81205 - DNA, 25 bp, Rattus norvegicus
acattgatgttcagatctcccgcag

SEQ ID NO: 81206 - DNA, 25 bp, Rattus norvegicus
acattgatgttctgatctcccgcag

SEQ ID NO: 81207 - DNA, 25 bp, Rattus norvegicus
acattgattgtgatacccctgtctt

SEQ ID NO: 81208 - DNA, 25 bp, Rattus norvegicus
acattgattgtgttacccctgtctt

SEQ ID NO: 81209 - DNA, 25 bp, Rattus norvegicus
acattgattgttacttcctacccct

SEQ ID NO: 81210 - DNA, 25 bp, Rattus norvegicus
acattgattgtttcttcctacccct

SEQ ID NO: 81211 - DNA, 25 bp, Rattus norvegicus
acattgcaaaaaattctctatcttt

SEQ ID NO: 81212 - DNA, 25 bp, Rattus norvegicus
acattgcaaaaatttctctatcttt

SEQ ID NO: 81213 - DNA, 25 bp, Rattus norvegicus
acattgcaaaccataagccactctt

SEQ ID NO: 81214 - DNA, 25 bp, Rattus norvegicus
acattgcaaaccttaagccactctt

SEQ ID NO: 81215 - DNA, 25 bp, Rattus norvegicus
acattgcacaccaaacactcagttt

SEQ ID NO: 81216 - DNA, 25 bp, Rattus norvegicus
acattgcacacctaacactcagttt

SEQ ID NO: 81217 - DNA, 25 bp, Rattus norvegicus
acattgcacctgaaggccaaccgag

SEQ ID NO: 81218 - DNA, 25 bp, Rattus norvegicus
acattgcacctgtaggccaaccgag

SEQ ID NO: 81219 - DNA, 25 bp, Rattus norvegicus
acattgcactgccactgtggtatta

SEQ ID NO: 81220 - DNA, 25 bp, Rattus norvegicus
acattgcactgcgactgtggtatta

SEQ ID NO: 81221 - DNA, 25 bp, Rattus norvegicus
acattgcaggctcatctcctcttaa

SEQ ID NO: 81222 - DNA, 25 bp, Rattus norvegicus
acattgcaggctgatctcctcttaa

SEQ ID NO: 81223 - DNA, 25 bp, Rattus norvegicus
acattgcagttgcttcacaggctgt

SEQ ID NO: 81224 - DNA, 25 bp, Rattus norvegicus
acattgcagttggttcacaggctgt

SEQ ID NO: 81225 - DNA, 25 bp, Rattus norvegicus
acattgcatcataaggttgccttag

SEQ ID NO: 81226 - DNA, 25 bp, Rattus norvegicus
acattgcatcattaggttgccttag

SEQ ID NO: 81227 - DNA, 25 bp, Rattus norvegicus
acattgcatgcaattttggtctact

SEQ ID NO: 81228 - DNA, 25 bp, Rattus norvegicus
acattgcatgcatttttggtctact

SEQ ID NO: 81229 - DNA, 25 bp, Rattus norvegicus
acattgcccatgaatgtgactctgt

SEQ ID NO: 81230 - DNA, 25 bp, Rattus norvegicus
acattgcccatgtatgtgactctgt

SEQ ID NO: 81231 - DNA, 25 bp, Rattus norvegicus
acattgcccttcatcctttaagaga

SEQ ID NO: 81232 - DNA, 25 bp, Rattus norvegicus
acattgcccttcttcctttaagaga

SEQ ID NO: 81233 - DNA, 25 bp, Rattus norvegicus
acattgcctaatcccatacgtcatg

SEQ ID NO: 81234 - DNA, 25 bp, Rattus norvegicus
acattgcctaatgccatacgtcatg

SEQ ID NO: 81235 - DNA, 25 bp, Rattus norvegicus
acattgcctctaaggactctcttat

SEQ ID NO: 81236 - DNA, 25 bp, Rattus norvegicus
acattgcctctatggactctcttat

SEQ ID NO: 81237 - DNA, 25 bp, Rattus norvegicus
acattgctaatgactgacacttgga

SEQ ID NO: 81238 - DNA, 25 bp, Rattus norvegicus
acattgctaatgtctgacacttgga

SEQ ID NO: 81239 - DNA, 25 bp, Rattus norvegicus
acattgctcagtcctggtctgctga

SEQ ID NO: 81240 - DNA, 25 bp, Rattus norvegicus
acattgctcagtgctggtctgctga

SEQ ID NO: 81241 - DNA, 25 bp, Rattus norvegicus
acattgctccatagaatttgccacg

SEQ ID NO: 81242 - DNA, 25 bp, Rattus norvegicus
acattgctccattgaatttgccacg

SEQ ID NO: 81243 - DNA, 25 bp, Rattus norvegicus
acattgctgaaaatcccttgcattt

SEQ ID NO: 81244 - DNA, 25 bp, Rattus norvegicus
acattgctgaaattcccttgcattt

SEQ ID NO: 81245 - DNA, 25 bp, Rattus norvegicus
acattgctgcaaatcgtgttcccac

SEQ ID NO: 81246 - DNA, 25 bp, Rattus norvegicus
acattgctgcaattcgtgttcccac

SEQ ID NO: 81247 - DNA, 25 bp, Rattus norvegicus
acattgctgcaccagtgttgggcca

SEQ ID NO: 81248 - DNA, 25 bp, Rattus norvegicus
acattgctgcacgagtgttgggcca

SEQ ID NO: 81249 - DNA, 25 bp, Rattus norvegicus
acattgctgcatctagctcttgctt

SEQ ID NO: 81250 - DNA, 25 bp, Rattus norvegicus
acattgctgcatgtagctcttgctt

SEQ ID NO: 81251 - DNA, 25 bp, Rattus norvegicus
acattgctgctgctattctgtacaa

SEQ ID NO: 81252 - DNA, 25 bp, Rattus norvegicus
acattgctgctggtattctgtacaa

SEQ ID NO: 81253 - DNA, 25 bp, Rattus norvegicus
acattgcttccaaaattgccaacga

SEQ ID NO: 81254 - DNA, 25 bp, Rattus norvegicus
acattgcttccataattgccaacga

SEQ ID NO: 81255 - DNA, 25 bp, Rattus norvegicus
acattggaagtgatgtagatcctac

SEQ ID NO: 81256 - DNA, 25 bp, Rattus norvegicus
acattggaagtgttgtagatcctac

SEQ ID NO: 81257 - DNA, 25 bp, Rattus norvegicus
acattggacattatgtggtcttcag

SEQ ID NO: 81258 - DNA, 25 bp, Rattus norvegicus
acattggacattttgtggtcttcag

SEQ ID NO: 81259 - DNA, 25 bp, Rattus norvegicus
acattggacccaaattgcagatgcc

SEQ ID NO: 81260 - DNA, 25 bp, Rattus norvegicus
acattggacccatattgcagatgcc

SEQ ID NO: 81261 - DNA, 25 bp, Rattus norvegicus
acattggactagacacagacctgtg

SEQ ID NO: 81262 - DNA, 25 bp, Rattus norvegicus
acattggactagtcacagacctgtg

SEQ ID NO: 81263 - DNA, 25 bp, Rattus norvegicus
acattggactgcagtagttacactt

SEQ ID NO: 81264 - DNA, 25 bp, Rattus norvegicus
acattggactgctgtagttacactt

SEQ ID NO: 81265 - DNA, 25 bp, Rattus norvegicus
acattggatatgattactgcttttg

SEQ ID NO: 81266 - DNA, 25 bp, Rattus norvegicus
acattggatatgattgtgccattga

SEQ ID NO: 81267 - DNA, 25 bp, Rattus norvegicus
acattggatatgtttactgcttttg

SEQ ID NO: 81268 - DNA, 25 bp, Rattus norvegicus
acattggatatgtttgtgccattga

SEQ ID NO: 81269 - DNA, 25 bp, Rattus norvegicus
acattggatcctccaggcaccctgg

SEQ ID NO: 81270 - DNA, 25 bp, Rattus norvegicus
acattggatcctgcaggcaccctgg

SEQ ID NO: 81271 - DNA, 25 bp, Rattus norvegicus
acattggcaagcacaggttcacttt

SEQ ID NO: 81272 - DNA, 25 bp, Rattus norvegicus
acattggcaagctcaggttcacttt

SEQ ID NO: 81273 - DNA, 25 bp, Rattus norvegicus
acattggcacctcgctgttggacag

SEQ ID NO: 81274 - DNA, 25 bp, Rattus norvegicus
acattggcacctggctgttggacag

SEQ ID NO: 81275 - DNA, 25 bp, Rattus norvegicus
acattggccagcacttgtgttggga

SEQ ID NO: 81276 - DNA, 25 bp, Rattus norvegicus
acattggccagctcttgtgttggga

SEQ ID NO: 81277 - DNA, 25 bp, Rattus norvegicus
acattggccctaagacttagtctta

SEQ ID NO: 81278 - DNA, 25 bp, Rattus norvegicus
acattggccctatgacttagtctta

SEQ ID NO: 81279 - DNA, 25 bp, Rattus norvegicus
acattggccctgattgctttttata

SEQ ID NO: 81280 - DNA, 25 bp, Rattus norvegicus
acattggccctgtttgctttttata

SEQ ID NO: 81281 - DNA, 25 bp, Rattus norvegicus
acattggccgcaaggactacctggc

SEQ ID NO: 81282 - DNA, 25 bp, Rattus norvegicus
acattggccgcatggactacctggc

SEQ ID NO: 81283 - DNA, 25 bp, Rattus norvegicus
acattggctggtctagaactggcta

SEQ ID NO: 81284 - DNA, 25 bp, Rattus norvegicus
acattggctggtgtagaactggcta

SEQ ID NO: 81285 - DNA, 25 bp, Rattus norvegicus
acattggctgtgatcatcctctact

SEQ ID NO: 81286 - DNA, 25 bp, Rattus norvegicus
acattggctgtgttcatcctctact

SEQ ID NO: 81287 - DNA, 25 bp, Rattus norvegicus
acattgggactgagatacgggctga

SEQ ID NO: 81288 - DNA, 25 bp, Rattus norvegicus
acattgggactgtgatacgggctga

SEQ ID NO: 81289 - DNA, 25 bp, Rattus norvegicus
acattgggccaacaacgatcctcat

SEQ ID NO: 81290 - DNA, 25 bp, Rattus norvegicus
acattgggccaagaacgatcctcat

SEQ ID NO: 81291 - DNA, 25 bp, Rattus norvegicus
acattggtactgattggtatttgca

SEQ ID NO: 81292 - DNA, 25 bp, Rattus norvegicus
acattggtactgtttggtatttgca

SEQ ID NO: 81293 - DNA, 25 bp, Rattus norvegicus
acattggtaggtatctcagtttgga

SEQ ID NO: 81294 - DNA, 25 bp, Rattus norvegicus
acattggtaggtttctcagtttgga

SEQ ID NO: 81295 - DNA, 25 bp, Rattus norvegicus
acattggtcactactcccttgttgg

SEQ ID NO: 81296 - DNA, 25 bp, Rattus norvegicus
acattggtcacttctcccttgttgg

SEQ ID NO: 81297 - DNA, 25 bp, Rattus norvegicus
acattggtccttattctgggtcata

SEQ ID NO: 81298 - DNA, 25 bp, Rattus norvegicus
acattggtcctttttctgggtcata

SEQ ID NO: 81299 - DNA, 25 bp, Rattus norvegicus
acattggtgctgaactgtggttaga

SEQ ID NO: 81300 - DNA, 25 bp, Rattus norvegicus
acattggtgctgtactgtggttaga

SEQ ID NO: 81301 - DNA, 25 bp, Rattus norvegicus
acattggtttacactgctttcctca

SEQ ID NO: 81302 - DNA, 25 bp, Rattus norvegicus
acattggtttactctgctttcctca

SEQ ID NO: 81303 - DNA, 25 bp, Rattus norvegicus
acattgtaaagaacctgccatccct

SEQ ID NO: 81304 - DNA, 25 bp, Rattus norvegicus
acattgtaaagatcctgccatccct

SEQ ID NO: 81305 - DNA, 25 bp, Rattus norvegicus
acattgtagcccagttccttcaaat

SEQ ID NO: 81306 - DNA, 25 bp, Rattus norvegicus
acattgtagccctgttccttcaaat

SEQ ID NO: 81307 - DNA, 25 bp, Rattus norvegicus
acattgtagcttaggagttttccac

SEQ ID NO: 81308 - DNA, 25 bp, Rattus norvegicus
acattgtagctttggagttttccac

SEQ ID NO: 81309 - DNA, 25 bp, Rattus norvegicus
acattgtaggttacacagtgtgtca

SEQ ID NO: 81310 - DNA, 25 bp, Rattus norvegicus
acattgtaggtttcacagtgtgtca

SEQ ID NO: 81311 - DNA, 25 bp, Rattus norvegicus
acattgtatcttattagtttccaag

SEQ ID NO: 81312 - DNA, 25 bp, Rattus norvegicus
acattgtatctttttagtttccaag

SEQ ID NO: 81313 - DNA, 25 bp, Rattus norvegicus
acattgtcactcctgctctggagaa

SEQ ID NO: 81314 - DNA, 25 bp, Rattus norvegicus
acattgtcactcgtgctctggagaa

SEQ ID NO: 81315 - DNA, 25 bp, Rattus norvegicus
acattgtcacttccgcatttgtaat

SEQ ID NO: 81316 - DNA, 25 bp, Rattus norvegicus
acattgtcacttgcgcatttgtaat

SEQ ID NO: 81317 - DNA, 25 bp, Rattus norvegicus
acattgtcagtcaaaaccacccgtg

SEQ ID NO: 81318 - DNA, 25 bp, Rattus norvegicus
acattgtcagtctaaaccacccgtg

SEQ ID NO: 81319 - DNA, 25 bp, Rattus norvegicus
acattgtcatatatagtcctgctca

SEQ ID NO: 81320 - DNA, 25 bp, Rattus norvegicus
acattgtcatatttagtcctgctca

SEQ ID NO: 81321 - DNA, 25 bp, Rattus norvegicus
acattgtcatcgaactggcagctgc

SEQ ID NO: 81322 - DNA, 25 bp, Rattus norvegicus
acattgtcatcgtactggcagctgc

SEQ ID NO: 81323 - DNA, 25 bp, Rattus norvegicus
acattgtcatgtcggttcttgccat

SEQ ID NO: 81324 - DNA, 25 bp, Rattus norvegicus
acattgtcatgtgggttcttgccat

SEQ ID NO: 81325 - DNA, 25 bp, Rattus norvegicus
acattgtcatttccacgcacacatt

SEQ ID NO: 81326 - DNA, 25 bp, Rattus norvegicus
acattgtcatttgcacgcacacatt

SEQ ID NO: 81327 - DNA, 25 bp, Rattus norvegicus
acattgtccgtgagcttgtgaccaa

SEQ ID NO: 81328 - DNA, 25 bp, Rattus norvegicus
acattgtccgtgtgcttgtgaccaa

SEQ ID NO: 81329 - DNA, 25 bp, Rattus norvegicus
acattgtcgacccaggcgtggttga

SEQ ID NO: 81330 - DNA, 25 bp, Rattus norvegicus
acattgtcgaccgaggcgtggttga

SEQ ID NO: 81331 - DNA, 25 bp, Rattus norvegicus
acattgtctctaacttcactcacat

SEQ ID NO: 81332 - DNA, 25 bp, Rattus norvegicus
acattgtctctatcttcactcacat

SEQ ID NO: 81333 - DNA, 25 bp, Rattus norvegicus
acattgtcttgtccaaagtttctcc

SEQ ID NO: 81334 - DNA, 25 bp, Rattus norvegicus
acattgtcttgtgcaaagtttctcc

SEQ ID NO: 81335 - DNA, 25 bp, Rattus norvegicus
acattgtgagggacgtcatccgcca

SEQ ID NO: 81336 - DNA, 25 bp, Rattus norvegicus
acattgtgagggtcgtcatccgcca

SEQ ID NO: 81337 - DNA, 25 bp, Rattus norvegicus
acattgtgcatgactgctctgaacc

SEQ ID NO: 81338 - DNA, 25 bp, Rattus norvegicus
acattgtgcatgtctgctctgaacc

SEQ ID NO: 81339 - DNA, 25 bp, Rattus norvegicus
acattgtgctgtacatctgtctcca

SEQ ID NO: 81340 - DNA, 25 bp, Rattus norvegicus
acattgtgctgtccgaatattccta

SEQ ID NO: 81341 - DNA, 25 bp, Rattus norvegicus
acattgtgctgtgcgaatattccta

SEQ ID NO: 81342 - DNA, 25 bp, Rattus norvegicus
acattgtgctgttcatctgtctcca

SEQ ID NO: 81343 - DNA, 25 bp, Rattus norvegicus
acattgtgcttgctgttcttcaaac

SEQ ID NO: 81344 - DNA, 25 bp, Rattus norvegicus
acattgtgcttggtgttcttcaaac

SEQ ID NO: 81345 - DNA, 25 bp, Rattus norvegicus
acattgtggagactgttctggactt

SEQ ID NO: 81346 - DNA, 25 bp, Rattus norvegicus
acattgtggagagtgttctggactt

SEQ ID NO: 81347 - DNA, 25 bp, Rattus norvegicus
acattgtggctgagtaggtgaaccc

SEQ ID NO: 81348 - DNA, 25 bp, Rattus norvegicus
acattgtggctgtgtaggtgaaccc

SEQ ID NO: 81349 - DNA, 25 bp, Rattus norvegicus
acattgtggttgcagaccctcctta

SEQ ID NO: 81350 - DNA, 25 bp, Rattus norvegicus
acattgtggttggagaccctcctta

SEQ ID NO: 81351 - DNA, 25 bp, Rattus norvegicus
acattgtgtacactggttctgcctt

SEQ ID NO: 81352 - DNA, 25 bp, Rattus norvegicus
acattgtgtacagtggttctgcctt

SEQ ID NO: 81353 - DNA, 25 bp, Rattus norvegicus
acattgtgtactagtggttccgtcc

SEQ ID NO: 81354 - DNA, 25 bp, Rattus norvegicus
acattgtgtacttgtggttccgtcc

SEQ ID NO: 81355 - DNA, 25 bp, Rattus norvegicus
acattgtgtgctacaccgctgtaag

SEQ ID NO: 81356 - DNA, 25 bp, Rattus norvegicus
acattgtgtgcttcaccgctgtaag

SEQ ID NO: 81357 - DNA, 25 bp, Rattus norvegicus
acattgtgttgtaaactctgtttaa

SEQ ID NO: 81358 - DNA, 25 bp, Rattus norvegicus
acattgtgttgttaactctgtttaa

SEQ ID NO: 81359 - DNA, 25 bp, Rattus norvegicus
acattgttaattcctgttccctgca

SEQ ID NO: 81360 - DNA, 25 bp, Rattus norvegicus
acattgttaattgctgttccctgca

SEQ ID NO: 81361 - DNA, 25 bp, Rattus norvegicus
acattgttacacctagttacaccta

SEQ ID NO: 81362 - DNA, 25 bp, Rattus norvegicus
acattgttacacgtagttacaccta

SEQ ID NO: 81363 - DNA, 25 bp, Rattus norvegicus
acattgttatgaccttaagttgcac

SEQ ID NO: 81364 - DNA, 25 bp, Rattus norvegicus
acattgttatgagcttaagttgcac

SEQ ID NO: 81365 - DNA, 25 bp, Rattus norvegicus
acattgttatgcatgccacatccat

SEQ ID NO: 81366 - DNA, 25 bp, Rattus norvegicus
acattgttatgcttgccacatccat

SEQ ID NO: 81367 - DNA, 25 bp, Rattus norvegicus
acattgttcagcacgtcacgatggt

SEQ ID NO: 81368 - DNA, 25 bp, Rattus norvegicus
acattgttcagctcgtcacgatggt

SEQ ID NO: 81369 - DNA, 25 bp, Rattus norvegicus
acattgttccaccaagaggccagat

SEQ ID NO: 81370 - DNA, 25 bp, Rattus norvegicus
acattgttccacgaagaggccagat

SEQ ID NO: 81371 - DNA, 25 bp, Rattus norvegicus
acattgttcccaacactgtttacag

SEQ ID NO: 81372 - DNA, 25 bp, Rattus norvegicus
acattgttcccatcactgtttacag

SEQ ID NO: 81373 - DNA, 25 bp, Rattus norvegicus
acattgttcctccttctgaagacag

SEQ ID NO: 81374 - DNA, 25 bp, Rattus norvegicus
acattgttcctcgttctgaagacag

SEQ ID NO: 81375 - DNA, 25 bp, Rattus norvegicus
acattgttgttactgccctgtgtgg

SEQ ID NO: 81376 - DNA, 25 bp, Rattus norvegicus
acattgttgttagtgccctgtgtgg

SEQ ID NO: 81377 - DNA, 25 bp, Rattus norvegicus
acattgtttctacgtccaactcctt

SEQ ID NO: 81378 - DNA, 25 bp, Rattus norvegicus
acattgtttctaggtccaactcctt

SEQ ID NO: 81379 - DNA, 25 bp, Rattus norvegicus
acattgtttctgagttcgtttgata

SEQ ID NO: 81380 - DNA, 25 bp, Rattus norvegicus
acattgtttctgtgttcgtttgata

SEQ ID NO: 81381 - DNA, 25 bp, Rattus norvegicus
acattgtttcttctcaggatccggg

SEQ ID NO: 81382 - DNA, 25 bp, Rattus norvegicus
acattgtttcttgtcaggatccggg

SEQ ID NO: 81383 - DNA, 25 bp, Rattus norvegicus
acattgtttgagagcgttcctgtca

SEQ ID NO: 81384 - DNA, 25 bp, Rattus norvegicus
acattgtttgagtgcgttcctgtca

SEQ ID NO: 81385 - DNA, 25 bp, Rattus norvegicus
acatttaacaaaccgagtgctcaca

SEQ ID NO: 81386 - DNA, 25 bp, Rattus norvegicus
acatttaacaaagcgagtgctcaca

SEQ ID NO: 81387 - DNA, 25 bp, Rattus norvegicus
acatttaagcccatgtcctgtcaca

SEQ ID NO: 81388 - DNA, 25 bp, Rattus norvegicus
acatttaagcccttgtcctgtcaca

SEQ ID NO: 81389 - DNA, 25 bp, Rattus norvegicus
acatttaatccccagtgtaacatgg

SEQ ID NO: 81390 - DNA, 25 bp, Rattus norvegicus
acatttaatcccgagtgtaacatgg

SEQ ID NO: 81391 - DNA, 25 bp, Rattus norvegicus
acatttaatgtaaccaggtgtgtcc

SEQ ID NO: 81392 - DNA, 25 bp, Rattus norvegicus
acatttaatgtatccaggtgtgtcc

SEQ ID NO: 81393 - DNA, 25 bp, Rattus norvegicus
acatttacctgcaccttcataatct

SEQ ID NO: 81394 - DNA, 25 bp, Rattus norvegicus
acatttacctgctccttcataatct

SEQ ID NO: 81395 - DNA, 25 bp, Rattus norvegicus
acatttacctgtatcttgagcctga

SEQ ID NO: 81396 - DNA, 25 bp, Rattus norvegicus
acatttacctgtttcttgagcctga

SEQ ID NO: 81397 - DNA, 25 bp, Rattus norvegicus
acatttagactccttgtggctcttg

SEQ ID NO: 81398 - DNA, 25 bp, Rattus norvegicus
acatttagactcgttgtggctcttg

SEQ ID NO: 81399 - DNA, 25 bp, Rattus norvegicus
acatttagccttaccatgtgtccag

SEQ ID NO: 81400 - DNA, 25 bp, Rattus norvegicus
acatttagcctttccatgtgtccag

SEQ ID NO: 81401 - DNA, 25 bp, Rattus norvegicus
acatttagtgtcactggtgggttga

SEQ ID NO: 81402 - DNA, 25 bp, Rattus norvegicus
acatttagtgtctctggtgggttga

SEQ ID NO: 81403 - DNA, 25 bp, Rattus norvegicus
acatttatcgcccttaatttccaag

SEQ ID NO: 81404 - DNA, 25 bp, Rattus norvegicus
acatttatcgccgttaatttccaag

SEQ ID NO: 81405 - DNA, 25 bp, Rattus norvegicus
acatttatgagaacagggccagcct

SEQ ID NO: 81406 - DNA, 25 bp, Rattus norvegicus
acatttatgagatcagggccagcct

SEQ ID NO: 81407 - DNA, 25 bp, Rattus norvegicus
acatttatggaacagcccctgtgcc

SEQ ID NO: 81408 - DNA, 25 bp, Rattus norvegicus
acatttatggaacgatcctaccaga

SEQ ID NO: 81409 - DNA, 25 bp, Rattus norvegicus
acatttatggaagagcccctgtgcc

SEQ ID NO: 81410 - DNA, 25 bp, Rattus norvegicus
acatttatggaaggatcctaccaga

SEQ ID NO: 81411 - DNA, 25 bp, Rattus norvegicus
acatttattcatcccggtctgttgc

SEQ ID NO: 81412 - DNA, 25 bp, Rattus norvegicus
acatttattcatgccggtctgttgc

SEQ ID NO: 81413 - DNA, 25 bp, Rattus norvegicus
acatttattcctcgttctcgtgaag

SEQ ID NO: 81414 - DNA, 25 bp, Rattus norvegicus
acatttattcctggttctcgtgaag

SEQ ID NO: 81415 - DNA, 25 bp, Rattus norvegicus
acatttattgagaaccttcggtgcc

SEQ ID NO: 81416 - DNA, 25 bp, Rattus norvegicus
acatttattgagtaccttcggtgcc

SEQ ID NO: 81417 - DNA, 25 bp, Rattus norvegicus
acatttcacagacaacctcagtggt

SEQ ID NO: 81418 - DNA, 25 bp, Rattus norvegicus
acatttcacagagaacctcagtggt

SEQ ID NO: 81419 - DNA, 25 bp, Rattus norvegicus
acatttcaccatctggctgttgggc

SEQ ID NO: 81420 - DNA, 25 bp, Rattus norvegicus
acatttcaccatgtggctgttgggc

SEQ ID NO: 81421 - DNA, 25 bp, Rattus norvegicus
acatttcagctcataactgcctgta

SEQ ID NO: 81422 - DNA, 25 bp, Rattus norvegicus
acatttcagctcttaactgcctgta

SEQ ID NO: 81423 - DNA, 25 bp, Rattus norvegicus
acatttcagtccctgtagcttctgg

SEQ ID NO: 81424 - DNA, 25 bp, Rattus norvegicus
acatttcagtccgtgtagcttctgg

SEQ ID NO: 81425 - DNA, 25 bp, Rattus norvegicus
acatttcagttgctcccagagtaac

SEQ ID NO: 81426 - DNA, 25 bp, Rattus norvegicus
acatttcagttggtcccagagtaac

SEQ ID NO: 81427 - DNA, 25 bp, Rattus norvegicus
acatttcataccaccattgttcggg

SEQ ID NO: 81428 - DNA, 25 bp, Rattus norvegicus
acatttcatacctccattgttcggg

SEQ ID NO: 81429 - DNA, 25 bp, Rattus norvegicus
acatttcatagtagaggaccctctt

SEQ ID NO: 81430 - DNA, 25 bp, Rattus norvegicus
acatttcatagttgaggaccctctt

SEQ ID NO: 81431 - DNA, 25 bp, Rattus norvegicus
acatttcattgcacatctcccatct

SEQ ID NO: 81432 - DNA, 25 bp, Rattus norvegicus
acatttcattgctcatctcccatct

SEQ ID NO: 81433 - DNA, 25 bp, Rattus norvegicus
acatttccaaagaagatgctgtagt

SEQ ID NO: 81434 - DNA, 25 bp, Rattus norvegicus
acatttccaaagtagatgctgtagt

SEQ ID NO: 81435 - DNA, 25 bp, Rattus norvegicus
acatttccacagatttgcttcacat

SEQ ID NO: 81436 - DNA, 25 bp, Rattus norvegicus
acatttccacagttttgcttcacat

SEQ ID NO: 81437 - DNA, 25 bp, Rattus norvegicus
acatttccaggtccccattgtgaac

SEQ ID NO: 81438 - DNA, 25 bp, Rattus norvegicus
acatttccaggtgcccattgtgaac

SEQ ID NO: 81439 - DNA, 25 bp, Rattus norvegicus
acatttccatcgcagtattgaccat

SEQ ID NO: 81440 - DNA, 25 bp, Rattus norvegicus
acatttccatcggagtattgaccat

SEQ ID NO: 81441 - DNA, 25 bp, Rattus norvegicus
acatttccatgcactatgcattgca

SEQ ID NO: 81442 - DNA, 25 bp, Rattus norvegicus
acatttccatgctctatgcattgca

SEQ ID NO: 81443 - DNA, 25 bp, Rattus norvegicus
acatttcccaaaaactctctcaatc

SEQ ID NO: 81444 - DNA, 25 bp, Rattus norvegicus
acatttcccaaatactctctcaatc

SEQ ID NO: 81445 - DNA, 25 bp, Rattus norvegicus
acatttcccatgagactgctgcaga

SEQ ID NO: 81446 - DNA, 25 bp, Rattus norvegicus
acatttcccatgtgactgctgcaga

SEQ ID NO: 81447 - DNA, 25 bp, Rattus norvegicus
acatttccctcaccactgatttgag

SEQ ID NO: 81448 - DNA, 25 bp, Rattus norvegicus
acatttccctcagcactgatttgag

SEQ ID NO: 81449 - DNA, 25 bp, Rattus norvegicus
acatttccctgccacgatgaaaaga

SEQ ID NO: 81450 - DNA, 25 bp, Rattus norvegicus
acatttccctgcgacgatgaaaaga

SEQ ID NO: 81451 - DNA, 25 bp, Rattus norvegicus
acatttccggttctgcccagaggca

SEQ ID NO: 81452 - DNA, 25 bp, Rattus norvegicus
acatttccggttgtgcccagaggca

SEQ ID NO: 81453 - DNA, 25 bp, Rattus norvegicus
acatttcctaagaccatctttgcca

SEQ ID NO: 81454 - DNA, 25 bp, Rattus norvegicus
acatttcctaagtccatctttgcca

SEQ ID NO: 81455 - DNA, 25 bp, Rattus norvegicus
acatttcctattatactctgcttcg

SEQ ID NO: 81456 - DNA, 25 bp, Rattus norvegicus
acatttcctattttactctgcttcg

SEQ ID NO: 81457 - DNA, 25 bp, Rattus norvegicus
acatttcctcaaaaacccagtatat

SEQ ID NO: 81458 - DNA, 25 bp, Rattus norvegicus
acatttcctcaataacccagtatat

SEQ ID NO: 81459 - DNA, 25 bp, Rattus norvegicus
acatttcctttcaggtggatgtcta

SEQ ID NO: 81460 - DNA, 25 bp, Rattus norvegicus
acatttcctttctggtggatgtcta

SEQ ID NO: 81461 - DNA, 25 bp, Rattus norvegicus
acatttcggtccagtgtagctgtac

SEQ ID NO: 81462 - DNA, 25 bp, Rattus norvegicus
acatttcggtcctgtgtagctgtac

SEQ ID NO: 81463 - DNA, 25 bp, Rattus norvegicus
acatttcgttccaaggtgactaaca

SEQ ID NO: 81464 - DNA, 25 bp, Rattus norvegicus
acatttcgttcctaggtgactaaca

SEQ ID NO: 81465 - DNA, 25 bp, Rattus norvegicus
acatttctctctcttgtatttaaga

SEQ ID NO: 81466 - DNA, 25 bp, Rattus norvegicus
acatttctctctgttgtatttaaga

SEQ ID NO: 81467 - DNA, 25 bp, Rattus norvegicus
acatttctggataatgtccggccac

SEQ ID NO: 81468 - DNA, 25 bp, Rattus norvegicus
acatttctggattatgtccggccac

SEQ ID NO: 81469 - DNA, 25 bp, Rattus norvegicus
acatttctgtaccagctgggagtcc

SEQ ID NO: 81470 - DNA, 25 bp, Rattus norvegicus
acatttctgtacgagctgggagtcc

SEQ ID NO: 81471 - DNA, 25 bp, Rattus norvegicus
acatttctgtagatccttcgtatta

SEQ ID NO: 81472 - DNA, 25 bp, Rattus norvegicus
acatttctgtagttccttcgtatta

SEQ ID NO: 81473 - DNA, 25 bp, Rattus norvegicus
acatttcttctcatgccatttacac

SEQ ID NO: 81474 - DNA, 25 bp, Rattus norvegicus
acatttcttctcttgccatttacac

SEQ ID NO: 81475 - DNA, 25 bp, Rattus norvegicus
acatttcttggcaaggtgtctctga

SEQ ID NO: 81476 - DNA, 25 bp, Rattus norvegicus
acatttcttggctaggtgtctctga

SEQ ID NO: 81477 - DNA, 25 bp, Rattus norvegicus
acatttcttgtacgtttcacagcta

SEQ ID NO: 81478 - DNA, 25 bp, Rattus norvegicus
acatttcttgtaggtttcacagcta

SEQ ID NO: 81479 - DNA, 25 bp, Rattus norvegicus
acatttcttttcatgagttgatcac

SEQ ID NO: 81480 - DNA, 25 bp, Rattus norvegicus
acatttcttttcttgagttgatcac

SEQ ID NO: 81481 - DNA, 25 bp, Rattus norvegicus
acatttgaaccgacaacacctacct

SEQ ID NO: 81482 - DNA, 25 bp, Rattus norvegicus
acatttgaaccgtcaacacctacct

SEQ ID NO: 81483 - DNA, 25 bp, Rattus norvegicus
acatttgagcgcatgacttccgtgg

SEQ ID NO: 81484 - DNA, 25 bp, Rattus norvegicus
acatttgagcgcttgacttccgtgg

SEQ ID NO: 81485 - DNA, 25 bp, Rattus norvegicus
acatttgaggatagtaagtgcttca

SEQ ID NO: 81486 - DNA, 25 bp, Rattus norvegicus
acatttgaggattgtaagtgcttca

SEQ ID NO: 81487 - DNA, 25 bp, Rattus norvegicus
acatttgagtacaaacccagccctt

SEQ ID NO: 81488 - DNA, 25 bp, Rattus norvegicus
acatttgagtactaacccagccctt

SEQ ID NO: 81489 - DNA, 25 bp, Rattus norvegicus
acatttgatcacaagccaggtcggt

SEQ ID NO: 81490 - DNA, 25 bp, Rattus norvegicus
acatttgatcactagccaggtcggt

SEQ ID NO: 81491 - DNA, 25 bp, Rattus norvegicus
acatttgatgtcagcctgttgctaa

SEQ ID NO: 81492 - DNA, 25 bp, Rattus norvegicus
acatttgatgtctgcctgttgctaa

SEQ ID NO: 81493 - DNA, 25 bp, Rattus norvegicus
acatttgcaggaagtccattggttt

SEQ ID NO: 81494 - DNA, 25 bp, Rattus norvegicus
acatttgcaggatgtccattggttt

SEQ ID NO: 81495 - DNA, 25 bp, Rattus norvegicus
acatttgcagggagatgactccatc

SEQ ID NO: 81496 - DNA, 25 bp, Rattus norvegicus
acatttgcagggtgatgactccatc

SEQ ID NO: 81497 - DNA, 25 bp, Rattus norvegicus
acatttgccaatctccagagactta

SEQ ID NO: 81498 - DNA, 25 bp, Rattus norvegicus
acatttgccaatgtccagagactta

SEQ ID NO: 81499 - DNA, 25 bp, Rattus norvegicus
acatttgccatgaagttgtaaaacc

SEQ ID NO: 81500 - DNA, 25 bp, Rattus norvegicus
acatttgccatgtagttgtaaaacc

SEQ ID NO: 81501 - DNA, 25 bp, Rattus norvegicus
acatttgcccagagtcacataggtg

SEQ ID NO: 81502 - DNA, 25 bp, Rattus norvegicus
acatttgcccagtgtcacataggtg

SEQ ID NO: 81503 - DNA, 25 bp, Rattus norvegicus
acatttgccctgatggtttggacat

SEQ ID NO: 81504 - DNA, 25 bp, Rattus norvegicus
acatttgccctgttggtttggacat

SEQ ID NO: 81505 - DNA, 25 bp, Rattus norvegicus
acatttgccggaattgccagctgct

SEQ ID NO: 81506 - DNA, 25 bp, Rattus norvegicus
acatttgccggatttgccagctgct

SEQ ID NO: 81507 - DNA, 25 bp, Rattus norvegicus
acatttgcctctcgtgtatttcctc

SEQ ID NO: 81508 - DNA, 25 bp, Rattus norvegicus
acatttgcctctggtgtatttcctc

SEQ ID NO: 81509 - DNA, 25 bp, Rattus norvegicus
acatttgcctgtcgtatgactctta

SEQ ID NO: 81510 - DNA, 25 bp, Rattus norvegicus
acatttgcctgtggtatgactctta

SEQ ID NO: 81511 - DNA, 25 bp, Rattus norvegicus
acatttgctaacattttctcacaga

SEQ ID NO: 81512 - DNA, 25 bp, Rattus norvegicus
acatttgctaactttttctcacaga

SEQ ID NO: 81513 - DNA, 25 bp, Rattus norvegicus
acatttgctactactgagggcctct

SEQ ID NO: 81514 - DNA, 25 bp, Rattus norvegicus
acatttgctacttctgagggcctct

SEQ ID NO: 81515 - DNA, 25 bp, Rattus norvegicus
acatttgctattaccgcttcacaga

SEQ ID NO: 81516 - DNA, 25 bp, Rattus norvegicus
acatttgctatttccgcttcacaga

SEQ ID NO: 81517 - DNA, 25 bp, Rattus norvegicus
acatttgctggcacagaagctctct

SEQ ID NO: 81518 - DNA, 25 bp, Rattus norvegicus
acatttgctggctcagaagctctct

SEQ ID NO: 81519 - DNA, 25 bp, Rattus norvegicus
acatttgcttcaccggattacccac

SEQ ID NO: 81520 - DNA, 25 bp, Rattus norvegicus
acatttgcttcagcggattacccac

SEQ ID NO: 81521 - DNA, 25 bp, Rattus norvegicus
acatttggaggactgctcttggcca

SEQ ID NO: 81522 - DNA, 25 bp, Rattus norvegicus
acatttggaggagtgctcttggcca

SEQ ID NO: 81523 - DNA, 25 bp, Rattus norvegicus
acatttggcagcacagagtgggtaa

SEQ ID NO: 81524 - DNA, 25 bp, Rattus norvegicus
acatttggcagctcagagtgggtaa

SEQ ID NO: 81525 - DNA, 25 bp, Rattus norvegicus
acatttggcctcagtcctgattata

SEQ ID NO: 81526 - DNA, 25 bp, Rattus norvegicus
acatttggcctctgtcctgattata

SEQ ID NO: 81527 - DNA, 25 bp, Rattus norvegicus
acatttggctgaacttgaagggcaa

SEQ ID NO: 81528 - DNA, 25 bp, Rattus norvegicus
acatttggctgatcttgaagggcaa

SEQ ID NO: 81529 - DNA, 25 bp, Rattus norvegicus
acatttggctgtcgttgtctccatc

SEQ ID NO: 81530 - DNA, 25 bp, Rattus norvegicus
acatttggctgtggttgtctccatc

SEQ ID NO: 81531 - DNA, 25 bp, Rattus norvegicus
acatttgggattatactctagtata

SEQ ID NO: 81532 - DNA, 25 bp, Rattus norvegicus
acatttgggattttactctagtata

SEQ ID NO: 81533 - DNA, 25 bp, Rattus norvegicus
acatttgggctcagggttggccatt

SEQ ID NO: 81534 - DNA, 25 bp, Rattus norvegicus
acatttgggctctgggttggccatt

SEQ ID NO: 81535 - DNA, 25 bp, Rattus norvegicus
acatttgggtttcgagagatagctt

SEQ ID NO: 81536 - DNA, 25 bp, Rattus norvegicus
acatttgggtttggagagatagctt

SEQ ID NO: 81537 - DNA, 25 bp, Rattus norvegicus
acatttggtccaagggctcagggct

SEQ ID NO: 81538 - DNA, 25 bp, Rattus norvegicus
acatttggtccatgggctcagggct

SEQ ID NO: 81539 - DNA, 25 bp, Rattus norvegicus
acatttggttggagacctattgaac

SEQ ID NO: 81540 - DNA, 25 bp, Rattus norvegicus
acatttggttggtgacctattgaac

SEQ ID NO: 81541 - DNA, 25 bp, Rattus norvegicus
acatttgtccccatttcagtgaaat

SEQ ID NO: 81542 - DNA, 25 bp, Rattus norvegicus
acatttgtccccttttcagtgaaat

SEQ ID NO: 81543 - DNA, 25 bp, Rattus norvegicus
acatttgtcttgattgggtccaata

SEQ ID NO: 81544 - DNA, 25 bp, Rattus norvegicus
acatttgtcttgtttgggtccaata

SEQ ID NO: 81545 - DNA, 25 bp, Rattus norvegicus
acatttgtgcaacgcccctagttaa

SEQ ID NO: 81546 - DNA, 25 bp, Rattus norvegicus
acatttgtgcaaggcccctagttaa

SEQ ID NO: 81547 - DNA, 25 bp, Rattus norvegicus
acatttgtggtgaaagagttccgga

SEQ ID NO: 81548 - DNA, 25 bp, Rattus norvegicus
acatttgtggtgtaagagttccgga

SEQ ID NO: 81549 - DNA, 25 bp, Rattus norvegicus
acatttgtggttattgcgctgacca

SEQ ID NO: 81550 - DNA, 25 bp, Rattus norvegicus
acatttgtggtttttgcgctgacca

SEQ ID NO: 81551 - DNA, 25 bp, Rattus norvegicus
acatttgtgtagctgcctgtcattc

SEQ ID NO: 81552 - DNA, 25 bp, Rattus norvegicus
acatttgtgtaggtgcctgtcattc

SEQ ID NO: 81553 - DNA, 25 bp, Rattus norvegicus
acatttgtgtcgatgcttggatttc

SEQ ID NO: 81554 - DNA, 25 bp, Rattus norvegicus
acatttgtgtcgttgcttggatttc

SEQ ID NO: 81555 - DNA, 25 bp, Rattus norvegicus
acatttgtgtggaggtagcagtgat

SEQ ID NO: 81556 - DNA, 25 bp, Rattus norvegicus
acatttgtgtggtggtagcagtgat

SEQ ID NO: 81557 - DNA, 25 bp, Rattus norvegicus
acatttgtgttgatgctgagcccct

SEQ ID NO: 81558 - DNA, 25 bp, Rattus norvegicus
acatttgtgttgttgctgagcccct

SEQ ID NO: 81559 - DNA, 25 bp, Rattus norvegicus
acatttgttcagagtccagacccgg

SEQ ID NO: 81560 - DNA, 25 bp, Rattus norvegicus
acatttgttcagtgtccagacccgg

SEQ ID NO: 81561 - DNA, 25 bp, Rattus norvegicus
acattttaacggattccagctacat

SEQ ID NO: 81562 - DNA, 25 bp, Rattus norvegicus
acattttaacggtttccagctacat

SEQ ID NO: 81563 - DNA, 25 bp, Rattus norvegicus
acattttatctcagcttagaagaac

SEQ ID NO: 81564 - DNA, 25 bp, Rattus norvegicus
acattttatctctgcttagaagaac

SEQ ID NO: 81565 - DNA, 25 bp, Rattus norvegicus
acattttatttcattgctccttccc

SEQ ID NO: 81566 - DNA, 25 bp, Rattus norvegicus
acattttatttctttgctccttccc

SEQ ID NO: 81567 - DNA, 25 bp, Rattus norvegicus
acattttcagggagcacttcatcaa

SEQ ID NO: 81568 - DNA, 25 bp, Rattus norvegicus
acattttcagggtgcacttcatcaa

SEQ ID NO: 81569 - DNA, 25 bp, Rattus norvegicus
acattttcatagatggttcctggag

SEQ ID NO: 81570 - DNA, 25 bp, Rattus norvegicus
acattttcatagttggttcctggag

SEQ ID NO: 81571 - DNA, 25 bp, Rattus norvegicus
acattttcatttatctttacatctg

SEQ ID NO: 81572 - DNA, 25 bp, Rattus norvegicus
acattttcatttctggacgtggcct

SEQ ID NO: 81573 - DNA, 25 bp, Rattus norvegicus
acattttcatttgtggacgtggcct

SEQ ID NO: 81574 - DNA, 25 bp, Rattus norvegicus
acattttcatttttctttacatctg

SEQ ID NO: 81575 - DNA, 25 bp, Rattus norvegicus
acattttccacactgcgccacaata

SEQ ID NO: 81576 - DNA, 25 bp, Rattus norvegicus
acattttccacagtgcgccacaata

SEQ ID NO: 81577 - DNA, 25 bp, Rattus norvegicus
acattttcctgcctaatgcagctga

SEQ ID NO: 81578 - DNA, 25 bp, Rattus norvegicus
acattttcctgcgtaatgcagctga

SEQ ID NO: 81579 - DNA, 25 bp, Rattus norvegicus
acattttcctttccagcctttcaag

SEQ ID NO: 81580 - DNA, 25 bp, Rattus norvegicus
acattttcctttgcagcctttcaag

SEQ ID NO: 81581 - DNA, 25 bp, Rattus norvegicus
acattttctagtccatatcccgctg

SEQ ID NO: 81582 - DNA, 25 bp, Rattus norvegicus
acattttctagtgcatatcccgctg

SEQ ID NO: 81583 - DNA, 25 bp, Rattus norvegicus
acattttctcctatgaggcttcctt

SEQ ID NO: 81584 - DNA, 25 bp, Rattus norvegicus
acattttctcctttgaggcttcctt

SEQ ID NO: 81585 - DNA, 25 bp, Rattus norvegicus
acattttctctactgtacttgcttg

SEQ ID NO: 81586 - DNA, 25 bp, Rattus norvegicus
acattttctctagtgtacttgcttg

SEQ ID NO: 81587 - DNA, 25 bp, Rattus norvegicus
acattttctctgatttattttccat

SEQ ID NO: 81588 - DNA, 25 bp, Rattus norvegicus
acattttctctgttttattttccat

SEQ ID NO: 81589 - DNA, 25 bp, Rattus norvegicus
acattttctgacattacctcactgc

SEQ ID NO: 81590 - DNA, 25 bp, Rattus norvegicus
acattttctgactttacctcactgc

SEQ ID NO: 81591 - DNA, 25 bp, Rattus norvegicus
acattttctggtcatttccttctga

SEQ ID NO: 81592 - DNA, 25 bp, Rattus norvegicus
acattttctggtgatttccttctga

SEQ ID NO: 81593 - DNA, 25 bp, Rattus norvegicus
acattttctgttatctagtcggagc

SEQ ID NO: 81594 - DNA, 25 bp, Rattus norvegicus
acattttctgttttctagtcggagc

SEQ ID NO: 81595 - DNA, 25 bp, Rattus norvegicus
acattttcttctatggtctctacct

SEQ ID NO: 81596 - DNA, 25 bp, Rattus norvegicus
acattttcttctttggtctctacct

SEQ ID NO: 81597 - DNA, 25 bp, Rattus norvegicus
acattttcttgccttattctactca

SEQ ID NO: 81598 - DNA, 25 bp, Rattus norvegicus
acattttcttgcgttattctactca

SEQ ID NO: 81599 - DNA, 25 bp, Rattus norvegicus
acattttgtaacattgtgctgcctt

SEQ ID NO: 81600 - DNA, 25 bp, Rattus norvegicus
acattttgtaactttgtgctgcctt

SEQ ID NO: 81601 - DNA, 25 bp, Rattus norvegicus
acattttgtacactggtccaggaaa

SEQ ID NO: 81602 - DNA, 25 bp, Rattus norvegicus
acattttgtacagtggtccaggaaa

SEQ ID NO: 81603 - DNA, 25 bp, Rattus norvegicus
acattttgtatgctcgtgggttttt

SEQ ID NO: 81604 - DNA, 25 bp, Rattus norvegicus
acattttgtatggtcgtgggttttt

SEQ ID NO: 81605 - DNA, 25 bp, Rattus norvegicus
acattttgtgtcaccaattccaggt

SEQ ID NO: 81606 - DNA, 25 bp, Rattus norvegicus
acattttgtgtctccaattccaggt

SEQ ID NO: 81607 - DNA, 25 bp, Rattus norvegicus
acattttgtgttataggctgcattc

SEQ ID NO: 81608 - DNA, 25 bp, Rattus norvegicus
acattttgtgttttaggctgcattc

SEQ ID NO: 81609 - DNA, 25 bp, Rattus norvegicus
acatttttacttacagcccatctga

SEQ ID NO: 81610 - DNA, 25 bp, Rattus norvegicus
acatttttactttcagcccatctga

SEQ ID NO: 81611 - DNA, 25 bp, Rattus norvegicus
acatttttaggtatctcagatgaga

SEQ ID NO: 81612 - DNA, 25 bp, Rattus norvegicus
acatttttaggtttctcagatgaga

SEQ ID NO: 81613 - DNA, 25 bp, Rattus norvegicus
acatttttcacacttttccagcgtt

SEQ ID NO: 81614 - DNA, 25 bp, Rattus norvegicus
acatttttcacagttttccagcgtt

SEQ ID NO: 81615 - DNA, 25 bp, Rattus norvegicus
acatttttcagcacccagcaaatag

SEQ ID NO: 81616 - DNA, 25 bp, Rattus norvegicus
acatttttcagctcccagcaaatag

SEQ ID NO: 81617 - DNA, 25 bp, Rattus norvegicus
acatttttccatagtttcttgcgac

SEQ ID NO: 81618 - DNA, 25 bp, Rattus norvegicus
acatttttccattgtttcttgcgac

SEQ ID NO: 81619 - DNA, 25 bp, Rattus norvegicus
acatttttgcctagctatcacactg

SEQ ID NO: 81620 - DNA, 25 bp, Rattus norvegicus
acatttttgccttgctatcacactg

SEQ ID NO: 81621 - DNA, 25 bp, Rattus norvegicus
acatttttggcaagtaccattgcag

SEQ ID NO: 81622 - DNA, 25 bp, Rattus norvegicus
acatttttggcacggaagacggatt

SEQ ID NO: 81623 - DNA, 25 bp, Rattus norvegicus
acatttttggcagggaagacggatt

SEQ ID NO: 81624 - DNA, 25 bp, Rattus norvegicus
acatttttggcatgtaccattgcag

SEQ ID NO: 81625 - DNA, 25 bp, Rattus norvegicus
accaaaacagcaagcgttccctggg

SEQ ID NO: 81626 - DNA, 25 bp, Rattus norvegicus
accaaaacagcatgcgttccctggg

SEQ ID NO: 81627 - DNA, 25 bp, Rattus norvegicus
accaaaactcctccctgagaatttt

SEQ ID NO: 81628 - DNA, 25 bp, Rattus norvegicus
accaaaactcctgcctgagaatttt

SEQ ID NO: 81629 - DNA, 25 bp, Rattus norvegicus
accaaaatcaataagtcgtgccaag

SEQ ID NO: 81630 - DNA, 25 bp, Rattus norvegicus
accaaaatcaattagtcgtgccaag

SEQ ID NO: 81631 - DNA, 25 bp, Rattus norvegicus
accaaacattaacacatatttgtgg

SEQ ID NO: 81632 - DNA, 25 bp, Rattus norvegicus
accaaacattaagacatatttgtgg

SEQ ID NO: 81633 - DNA, 25 bp, Rattus norvegicus
accaaactccttagaagagctccaa

SEQ ID NO: 81634 - DNA, 25 bp, Rattus norvegicus
accaaactcctttgaagagctccaa

SEQ ID NO: 81635 - DNA, 25 bp, Rattus norvegicus
accaaactggccagaaactcaagat

SEQ ID NO: 81636 - DNA, 25 bp, Rattus norvegicus
accaaactggcctgaaactcaagat

SEQ ID NO: 81637 - DNA, 25 bp, Rattus norvegicus
accaaactgggcaacagactgtctc

SEQ ID NO: 81638 - DNA, 25 bp, Rattus norvegicus
accaaactgggctacagactgtctc

SEQ ID NO: 81639 - DNA, 25 bp, Rattus norvegicus
accaaactggtgaagtcgggagagt

SEQ ID NO: 81640 - DNA, 25 bp, Rattus norvegicus
accaaactggtgtagtcgggagagt

SEQ ID NO: 81641 - DNA, 25 bp, Rattus norvegicus
accaaacttgatcacctgtgtctga

SEQ ID NO: 81642 - DNA, 25 bp, Rattus norvegicus
accaaacttgatgacctgtgtctga

SEQ ID NO: 81643 - DNA, 25 bp, Rattus norvegicus
accaaactttttcctgaggctgtgc

SEQ ID NO: 81644 - DNA, 25 bp, Rattus norvegicus
accaaactttttgctgaggctgtgc

SEQ ID NO: 81645 - DNA, 25 bp, Rattus norvegicus
accaaagagtagatcaatgcataat

SEQ ID NO: 81646 - DNA, 25 bp, Rattus norvegicus
accaaagagtagttcaatgcataat

SEQ ID NO: 81647 - DNA, 25 bp, Rattus norvegicus
accaaagagtgcaccacagacacgc

SEQ ID NO: 81648 - DNA, 25 bp, Rattus norvegicus
accaaagagtgctccacagacacgc

SEQ ID NO: 81649 - DNA, 25 bp, Rattus norvegicus
accaaagatgtaatcacctaggttt

SEQ ID NO: 81650 - DNA, 25 bp, Rattus norvegicus
accaaagatgtattcacctaggttt

SEQ ID NO: 81651 - DNA, 25 bp, Rattus norvegicus
accaaagcacccaaaggccattgtt

SEQ ID NO: 81652 - DNA, 25 bp, Rattus norvegicus
accaaagcaccctaaggccattgtt

SEQ ID NO: 81653 - DNA, 25 bp, Rattus norvegicus
accaaagcctttctatcctcaacat

SEQ ID NO: 81654 - DNA, 25 bp, Rattus norvegicus
accaaagcctttgtatcctcaacat

SEQ ID NO: 81655 - DNA, 25 bp, Rattus norvegicus
accaaagctgtgatcagagccctag

SEQ ID NO: 81656 - DNA, 25 bp, Rattus norvegicus
accaaagctgtgttcagagccctag

SEQ ID NO: 81657 - DNA, 25 bp, Rattus norvegicus
accaaagcttgcctgttgcaatgtg

SEQ ID NO: 81658 - DNA, 25 bp, Rattus norvegicus
accaaagcttgcgtgttgcaatgtg

SEQ ID NO: 81659 - DNA, 25 bp, Rattus norvegicus
accaaagcttttccatcgtatggaa

SEQ ID NO: 81660 - DNA, 25 bp, Rattus norvegicus
accaaagcttttgcatcgtatggaa

SEQ ID NO: 81661 - DNA, 25 bp, Rattus norvegicus
accaaaggacttcggctgtgccgct

SEQ ID NO: 81662 - DNA, 25 bp, Rattus norvegicus
accaaaggacttgggctgtgccgct

SEQ ID NO: 81663 - DNA, 25 bp, Rattus norvegicus
accaaaggccttaagttctcatgca

SEQ ID NO: 81664 - DNA, 25 bp, Rattus norvegicus
accaaaggcctttagttctcatgca

SEQ ID NO: 81665 - DNA, 25 bp, Rattus norvegicus
accaaagggacaacctgttctgctg

SEQ ID NO: 81666 - DNA, 25 bp, Rattus norvegicus
accaaagggacatcctgttctgctg

SEQ ID NO: 81667 - DNA, 25 bp, Rattus norvegicus
accaaagggattctgttctgtgact

SEQ ID NO: 81668 - DNA, 25 bp, Rattus norvegicus
accaaagggattgtgttctgtgact

SEQ ID NO: 81669 - DNA, 25 bp, Rattus norvegicus
accaaagtaaagcatgccccagcca

SEQ ID NO: 81670 - DNA, 25 bp, Rattus norvegicus
accaaagtaaaggatgccccagcca

SEQ ID NO: 81671 - DNA, 25 bp, Rattus norvegicus
accaaagttcctctagatctgcatg

SEQ ID NO: 81672 - DNA, 25 bp, Rattus norvegicus
accaaagttcctgtagatctgcatg

SEQ ID NO: 81673 - DNA, 25 bp, Rattus norvegicus
accaaagttggcatgtgtccttttt

SEQ ID NO: 81674 - DNA, 25 bp, Rattus norvegicus
accaaagttggcttgtgtccttttt

SEQ ID NO: 81675 - DNA, 25 bp, Rattus norvegicus
accaaatacaccagcgctaagtaaa

SEQ ID NO: 81676 - DNA, 25 bp, Rattus norvegicus
accaaatacacctgcgctaagtaaa

SEQ ID NO: 81677 - DNA, 25 bp, Rattus norvegicus
accaaataggctagctgctttcttc

SEQ ID NO: 81678 - DNA, 25 bp, Rattus norvegicus
accaaataggcttgctgctttcttc

SEQ ID NO: 81679 - DNA, 25 bp, Rattus norvegicus
accaaatatgataagtctgttctaa

SEQ ID NO: 81680 - DNA, 25 bp, Rattus norvegicus
accaaatatgattagtctgttctaa

SEQ ID NO: 81681 - DNA, 25 bp, Rattus norvegicus
accaaatatgttaccttcccagtga

SEQ ID NO: 81682 - DNA, 25 bp, Rattus norvegicus
accaaatatgtttccttcccagtga

SEQ ID NO: 81683 - DNA, 25 bp, Rattus norvegicus
accaaatcctctcttaaggcagttg

SEQ ID NO: 81684 - DNA, 25 bp, Rattus norvegicus
accaaatcctctgttaaggcagttg

SEQ ID NO: 81685 - DNA, 25 bp, Rattus norvegicus
accaaatctgttaccccggttgatg

SEQ ID NO: 81686 - DNA, 25 bp, Rattus norvegicus
accaaatctgtttccccggttgatg

SEQ ID NO: 81687 - DNA, 25 bp, Rattus norvegicus
accaaattcctaaacccattcaagt

SEQ ID NO: 81688 - DNA, 25 bp, Rattus norvegicus
accaaattcctatacccattcaagt

SEQ ID NO: 81689 - DNA, 25 bp, Rattus norvegicus
accaaatttgacagacccctacatt

SEQ ID NO: 81690 - DNA, 25 bp, Rattus norvegicus
accaaatttgactgacccctacatt

SEQ ID NO: 81691 - DNA, 25 bp, Rattus norvegicus
accaaatttgtgatcttatgaataa

SEQ ID NO: 81692 - DNA, 25 bp, Rattus norvegicus
accaaatttgtgttcttatgaataa

SEQ ID NO: 81693 - DNA, 25 bp, Rattus norvegicus
accaacaatgtcactttccatatgc

SEQ ID NO: 81694 - DNA, 25 bp, Rattus norvegicus
accaacaatgtctctttccatatgc

SEQ ID NO: 81695 - DNA, 25 bp, Rattus norvegicus
accaacacggagctgctcaagaaca

SEQ ID NO: 81696 - DNA, 25 bp, Rattus norvegicus
accaacacggaggtgctcaagaaca

SEQ ID NO: 81697 - DNA, 25 bp, Rattus norvegicus
accaacagcaacacagttccacggg

SEQ ID NO: 81698 - DNA, 25 bp, Rattus norvegicus
accaacagcaactcagttccacggg

SEQ ID NO: 81699 - DNA, 25 bp, Rattus norvegicus
accaacagctctccaagggctgggt

SEQ ID NO: 81700 - DNA, 25 bp, Rattus norvegicus
accaacagctctgcaagggctgggt

SEQ ID NO: 81701 - DNA, 25 bp, Rattus norvegicus
accaacagggtcatctccatagcaa

SEQ ID NO: 81702 - DNA, 25 bp, Rattus norvegicus
accaacagggtcttctccatagcaa

SEQ ID NO: 81703 - DNA, 25 bp, Rattus norvegicus
accaacatgaagagcctgactccag

SEQ ID NO: 81704 - DNA, 25 bp, Rattus norvegicus
accaacatgaagtgcctgactccag

SEQ ID NO: 81705 - DNA, 25 bp, Rattus norvegicus
accaacattctcctggttgacgaga

SEQ ID NO: 81706 - DNA, 25 bp, Rattus norvegicus
accaacattctcgtggttgacgaga

SEQ ID NO: 81707 - DNA, 25 bp, Rattus norvegicus
accaaccacagcactccggctagca

SEQ ID NO: 81708 - DNA, 25 bp, Rattus norvegicus
accaaccacagctctccggctagca

SEQ ID NO: 81709 - DNA, 25 bp, Rattus norvegicus
accaaccagacgctgctgtgaattt

SEQ ID NO: 81710 - DNA, 25 bp, Rattus norvegicus
accaaccagacggtgctgtgaattt

SEQ ID NO: 81711 - DNA, 25 bp, Rattus norvegicus
accaaccagttaaatcctaccatct

SEQ ID NO: 81712 - DNA, 25 bp, Rattus norvegicus
accaaccagttatatcctaccatct

SEQ ID NO: 81713 - DNA, 25 bp, Rattus norvegicus
accaaccatggacgcttgctacatt

SEQ ID NO: 81714 - DNA, 25 bp, Rattus norvegicus
accaaccatggaggcttgctacatt

SEQ ID NO: 81715 - DNA, 25 bp, Rattus norvegicus
accaaccccagacagcattttaaat

SEQ ID NO: 81716 - DNA, 25 bp, Rattus norvegicus
accaaccccagagagcattttaaat

SEQ ID NO: 81717 - DNA, 25 bp, Rattus norvegicus
accaacccggttctcagatatgcaa

SEQ ID NO: 81718 - DNA, 25 bp, Rattus norvegicus
accaacccggttgtcagatatgcaa

SEQ ID NO: 81719 - DNA, 25 bp, Rattus norvegicus
accaacctatagcaactccagtggg

SEQ ID NO: 81720 - DNA, 25 bp, Rattus norvegicus
accaacctataggaactccagtggg

SEQ ID NO: 81721 - DNA, 25 bp, Rattus norvegicus
accaacctctagcagtccactgaaa

SEQ ID NO: 81722 - DNA, 25 bp, Rattus norvegicus
accaacctctaggagtccactgaaa

SEQ ID NO: 81723 - DNA, 25 bp, Rattus norvegicus
accaacctggttactgtgagggaca

SEQ ID NO: 81724 - DNA, 25 bp, Rattus norvegicus
accaacctggtttctgtgagggaca

SEQ ID NO: 81725 - DNA, 25 bp, Rattus norvegicus
accaacctgtccaagttccgcaagg

SEQ ID NO: 81726 - DNA, 25 bp, Rattus norvegicus
accaacctgtcctagttccgcaagg

SEQ ID NO: 81727 - DNA, 25 bp, Rattus norvegicus
accaaccttggtaacagtgtagtgt

SEQ ID NO: 81728 - DNA, 25 bp, Rattus norvegicus
accaaccttggtattatgcttcttg

SEQ ID NO: 81729 - DNA, 25 bp, Rattus norvegicus
accaaccttggttacagtgtagtgt

SEQ ID NO: 81730 - DNA, 25 bp, Rattus norvegicus
accaaccttggttttatgcttcttg

SEQ ID NO: 81731 - DNA, 25 bp, Rattus norvegicus
accaacggtttaccgattccacttg

SEQ ID NO: 81732 - DNA, 25 bp, Rattus norvegicus
accaacggtttagcgattccacttg

SEQ ID NO: 81733 - DNA, 25 bp, Rattus norvegicus
accaacgtccggcatgctgtaagca

SEQ ID NO: 81734 - DNA, 25 bp, Rattus norvegicus
accaacgtccgggatgctgtaagca

SEQ ID NO: 81735 - DNA, 25 bp, Rattus norvegicus
accaactacatgcttccgtgagaac

SEQ ID NO: 81736 - DNA, 25 bp, Rattus norvegicus
accaactacatggttccgtgagaac

SEQ ID NO: 81737 - DNA, 25 bp, Rattus norvegicus
accaactactctaaaggctgcaggc

SEQ ID NO: 81738 - DNA, 25 bp, Rattus norvegicus
accaactactcttaaggctgcaggc

SEQ ID NO: 81739 - DNA, 25 bp, Rattus norvegicus
accaactcactcacagtctgaatta

SEQ ID NO: 81740 - DNA, 25 bp, Rattus norvegicus
accaactcactctcagtctgaatta

SEQ ID NO: 81741 - DNA, 25 bp, Rattus norvegicus
accaactcacttcaatgcccaggtg

SEQ ID NO: 81742 - DNA, 25 bp, Rattus norvegicus
accaactcacttgaatgcccaggtg

SEQ ID NO: 81743 - DNA, 25 bp, Rattus norvegicus
accaactctaatattgcttcttgtg

SEQ ID NO: 81744 - DNA, 25 bp, Rattus norvegicus
accaactctaattttgcttcttgtg

SEQ ID NO: 81745 - DNA, 25 bp, Rattus norvegicus
accaactgatttaaatctactgcag

SEQ ID NO: 81746 - DNA, 25 bp, Rattus norvegicus
accaactgattttaatctactgcag

SEQ ID NO: 81747 - DNA, 25 bp, Rattus norvegicus
accaactgcgtcatagatcctgtta

SEQ ID NO: 81748 - DNA, 25 bp, Rattus norvegicus
accaactgcgtcttagatcctgtta

SEQ ID NO: 81749 - DNA, 25 bp, Rattus norvegicus
accaactgctctagtaatgctttaa

SEQ ID NO: 81750 - DNA, 25 bp, Rattus norvegicus
accaactgctcttgtaatgctttaa

SEQ ID NO: 81751 - DNA, 25 bp, Rattus norvegicus
accaactgggtaaatgccatccgcc

SEQ ID NO: 81752 - DNA, 25 bp, Rattus norvegicus
accaactgggtatatgccatccgcc

SEQ ID NO: 81753 - DNA, 25 bp, Rattus norvegicus
accaactggtgcagtgaaggacgaa

SEQ ID NO: 81754 - DNA, 25 bp, Rattus norvegicus
accaactggtgctgtgaaggacgaa

SEQ ID NO: 81755 - DNA, 25 bp, Rattus norvegicus
accaacttaggtcaacagggcaaat

SEQ ID NO: 81756 - DNA, 25 bp, Rattus norvegicus
accaacttaggtgaacagggcaaat

SEQ ID NO: 81757 - DNA, 25 bp, Rattus norvegicus
accaacttctatacttctcagggag

SEQ ID NO: 81758 - DNA, 25 bp, Rattus norvegicus
accaacttctattcttctcagggag

SEQ ID NO: 81759 - DNA, 25 bp, Rattus norvegicus
accaacttgtcaattgtcctctttg

SEQ ID NO: 81760 - DNA, 25 bp, Rattus norvegicus
accaacttgtcatttgtcctctttg

SEQ ID NO: 81761 - DNA, 25 bp, Rattus norvegicus
accaactttcaaccgcttgtagagc

SEQ ID NO: 81762 - DNA, 25 bp, Rattus norvegicus
accaactttcaagcgcttgtagagc

SEQ ID NO: 81763 - DNA, 25 bp, Rattus norvegicus
accaactttttcactcatcaaatct

SEQ ID NO: 81764 - DNA, 25 bp, Rattus norvegicus
accaactttttctctcatcaaatct

SEQ ID NO: 81765 - DNA, 25 bp, Rattus norvegicus
accaagaaagaccaacacggtgctg

SEQ ID NO: 81766 - DNA, 25 bp, Rattus norvegicus
accaagaaagacgaacacggtgctg

SEQ ID NO: 81767 - DNA, 25 bp, Rattus norvegicus
accaagaaatggaagactcaagttt

SEQ ID NO: 81768 - DNA, 25 bp, Rattus norvegicus
accaagaaatggtagactcaagttt

SEQ ID NO: 81769 - DNA, 25 bp, Rattus norvegicus
accaagacctcgaaggactcggcat

SEQ ID NO: 81770 - DNA, 25 bp, Rattus norvegicus
accaagacctcgtaggactcggcat

SEQ ID NO: 81771 - DNA, 25 bp, Rattus norvegicus
accaagacggtgatttgagctgact

SEQ ID NO: 81772 - DNA, 25 bp, Rattus norvegicus
accaagacggtgttttgagctgact

SEQ ID NO: 81773 - DNA, 25 bp, Rattus norvegicus
accaagactctaacacccacttggg

SEQ ID NO: 81774 - DNA, 25 bp, Rattus norvegicus
accaagactctatcacccacttggg

SEQ ID NO: 81775 - DNA, 25 bp, Rattus norvegicus
accaagagtgagagccccagatacc

SEQ ID NO: 81776 - DNA, 25 bp, Rattus norvegicus
accaagagtgagtgccccagatacc

SEQ ID NO: 81777 - DNA, 25 bp, Rattus norvegicus
accaagatgctgaaattgtttttta

SEQ ID NO: 81778 - DNA, 25 bp, Rattus norvegicus
accaagatgctgtaattgtttttta

SEQ ID NO: 81779 - DNA, 25 bp, Rattus norvegicus
accaagcagattaagtccgagagag

SEQ ID NO: 81780 - DNA, 25 bp, Rattus norvegicus
accaagcagatttagtccgagagag

SEQ ID NO: 81781 - DNA, 25 bp, Rattus norvegicus
accaagcaggagaacgacgaggccg

SEQ ID NO: 81782 - DNA, 25 bp, Rattus norvegicus
accaagcaggagtacgacgaggccg

SEQ ID NO: 81783 - DNA, 25 bp, Rattus norvegicus
accaagcagttgactatgtccctca

SEQ ID NO: 81784 - DNA, 25 bp, Rattus norvegicus
accaagcagttgtctatgtccctca

SEQ ID NO: 81785 - DNA, 25 bp, Rattus norvegicus
accaagccattgataagtcccagta

SEQ ID NO: 81786 - DNA, 25 bp, Rattus norvegicus
accaagccattgttaagtcccagta

SEQ ID NO: 81787 - DNA, 25 bp, Rattus norvegicus
accaagcccgggagctcagggaaag

SEQ ID NO: 81788 - DNA, 25 bp, Rattus norvegicus
accaagcccgggtgctcagggaaag

SEQ ID NO: 81789 - DNA, 25 bp, Rattus norvegicus
accaagccctcactccgtaagaagg

SEQ ID NO: 81790 - DNA, 25 bp, Rattus norvegicus
accaagccctcagtccgtaagaagg

SEQ ID NO: 81791 - DNA, 25 bp, Rattus norvegicus
accaagccctcgctctacagaatga

SEQ ID NO: 81792 - DNA, 25 bp, Rattus norvegicus
accaagccctcggtctacagaatga

SEQ ID NO: 81793 - DNA, 25 bp, Rattus norvegicus
accaagccctttccagtgtggtttg

SEQ ID NO: 81794 - DNA, 25 bp, Rattus norvegicus
accaagccctttgcagtgtggtttg

SEQ ID NO: 81795 - DNA, 25 bp, Rattus norvegicus
accaagcctatcaaacctgggtttg

SEQ ID NO: 81796 - DNA, 25 bp, Rattus norvegicus
accaagcctatctaacctgggtttg

SEQ ID NO: 81797 - DNA, 25 bp, Rattus norvegicus
accaagcctgagagaagtctgagca

SEQ ID NO: 81798 - DNA, 25 bp, Rattus norvegicus
accaagcctgagtgaagtctgagca

SEQ ID NO: 81799 - DNA, 25 bp, Rattus norvegicus
accaagcgaagccacagggctcaca

SEQ ID NO: 81800 - DNA, 25 bp, Rattus norvegicus
accaagcgaagcgacagggctcaca

SEQ ID NO: 81801 - DNA, 25 bp, Rattus norvegicus
accaagcgatgtcacttttcccaaa

SEQ ID NO: 81802 - DNA, 25 bp, Rattus norvegicus
accaagcgatgtgacttttcccaaa

SEQ ID NO: 81803 - DNA, 25 bp, Rattus norvegicus
accaagcggctgaatgcacatggca

SEQ ID NO: 81804 - DNA, 25 bp, Rattus norvegicus
accaagcggctgtatgcacatggca

SEQ ID NO: 81805 - DNA, 25 bp, Rattus norvegicus
accaagcgggacagcggcacgtcgt

SEQ ID NO: 81806 - DNA, 25 bp, Rattus norvegicus
accaagcgggactgcggcacgtcgt

SEQ ID NO: 81807 - DNA, 25 bp, Rattus norvegicus
accaagcggtgccacgaatcagtgt

SEQ ID NO: 81808 - DNA, 25 bp, Rattus norvegicus
accaagcggtgcgacgaatcagtgt

SEQ ID NO: 81809 - DNA, 25 bp, Rattus norvegicus
accaagcgtcacatcaggctgaggt

SEQ ID NO: 81810 - DNA, 25 bp, Rattus norvegicus
accaagcgtcacttcaggctgaggt

SEQ ID NO: 81811 - DNA, 25 bp, Rattus norvegicus
accaagcgtcggaacaatgtgccat

SEQ ID NO: 81812 - DNA, 25 bp, Rattus norvegicus
accaagcgtcggtacaatgtgccat

SEQ ID NO: 81813 - DNA, 25 bp, Rattus norvegicus
accaagctacatctccctagaagat

SEQ ID NO: 81814 - DNA, 25 bp, Rattus norvegicus
accaagctacatgtccctagaagat

SEQ ID NO: 81815 - DNA, 25 bp, Rattus norvegicus
accaagctcggcaacctagtgttaa

SEQ ID NO: 81816 - DNA, 25 bp, Rattus norvegicus
accaagctcggctacctagtgttaa

SEQ ID NO: 81817 - DNA, 25 bp, Rattus norvegicus
accaagctcttaagttttctatcaa

SEQ ID NO: 81818 - DNA, 25 bp, Rattus norvegicus
accaagctcttatgttttctatcaa

SEQ ID NO: 81819 - DNA, 25 bp, Rattus norvegicus
accaagcttccaaccattagtcaga

SEQ ID NO: 81820 - DNA, 25 bp, Rattus norvegicus
accaagcttccatccattagtcaga

SEQ ID NO: 81821 - DNA, 25 bp, Rattus norvegicus
accaaggaacgcagtggctggctca

SEQ ID NO: 81822 - DNA, 25 bp, Rattus norvegicus
accaaggaacgctgtggctggctca

SEQ ID NO: 81823 - DNA, 25 bp, Rattus norvegicus
accaaggaccgcacttttgacgaca

SEQ ID NO: 81824 - DNA, 25 bp, Rattus norvegicus
accaaggaccgctcttttgacgaca

SEQ ID NO: 81825 - DNA, 25 bp, Rattus norvegicus
accaaggaccttccacaacggcgtg

SEQ ID NO: 81826 - DNA, 25 bp, Rattus norvegicus
accaaggaccttgcacaacggcgtg

SEQ ID NO: 81827 - DNA, 25 bp, Rattus norvegicus
accaaggcacttacccgttcatggt

SEQ ID NO: 81828 - DNA, 25 bp, Rattus norvegicus
accaaggcactttcccgttcatggt

SEQ ID NO: 81829 - DNA, 25 bp, Rattus norvegicus
accaaggcagtacctatgattctag

SEQ ID NO: 81830 - DNA, 25 bp, Rattus norvegicus
accaaggcagtagctatgattctag

SEQ ID NO: 81831 - DNA, 25 bp, Rattus norvegicus
accaaggcctggcaggagtactaca

SEQ ID NO: 81832 - DNA, 25 bp, Rattus norvegicus
accaaggcctgggaggagtactaca

SEQ ID NO: 81833 - DNA, 25 bp, Rattus norvegicus
accaaggctctaaactgggttcaag

SEQ ID NO: 81834 - DNA, 25 bp, Rattus norvegicus
accaaggctctatactgggttcaag

SEQ ID NO: 81835 - DNA, 25 bp, Rattus norvegicus
accaaggctgacatcggtgttggtg

SEQ ID NO: 81836 - DNA, 25 bp, Rattus norvegicus
accaaggctgacttcggtgttggtg

SEQ ID NO: 81837 - DNA, 25 bp, Rattus norvegicus
accaagggagctctgtttgtaccag

SEQ ID NO: 81838 - DNA, 25 bp, Rattus norvegicus
accaagggagctgtgtttgtaccag

SEQ ID NO: 81839 - DNA, 25 bp, Rattus norvegicus
accaagggatggatgaatcaaaact

SEQ ID NO: 81840 - DNA, 25 bp, Rattus norvegicus
accaagggatggttgaatcaaaact

SEQ ID NO: 81841 - DNA, 25 bp, Rattus norvegicus
accaaggtccaacgcgatccagaga

SEQ ID NO: 81842 - DNA, 25 bp, Rattus norvegicus
accaaggtccaaggcgatccagaga

SEQ ID NO: 81843 - DNA, 25 bp, Rattus norvegicus
accaaggtccagctctgtgggagaa

SEQ ID NO: 81844 - DNA, 25 bp, Rattus norvegicus
accaaggtccagctgtcaaagtatt

SEQ ID NO: 81845 - DNA, 25 bp, Rattus norvegicus
accaaggtccaggtctgtgggagaa

SEQ ID NO: 81846 - DNA, 25 bp, Rattus norvegicus
accaaggtccaggtgtcaaagtatt

SEQ ID NO: 81847 - DNA, 25 bp, Rattus norvegicus
accaaggtccctacagagcagaaac

SEQ ID NO: 81848 - DNA, 25 bp, Rattus norvegicus
accaaggtcccttcagagcagaaac

SEQ ID NO: 81849 - DNA, 25 bp, Rattus norvegicus
accaaggtcctgatctgcagacaca

SEQ ID NO: 81850 - DNA, 25 bp, Rattus norvegicus
accaaggtcctgttctgcagacaca

SEQ ID NO: 81851 - DNA, 25 bp, Rattus norvegicus
accaaggttggcatctatgccatgt

SEQ ID NO: 81852 - DNA, 25 bp, Rattus norvegicus
accaaggttggcttctatgccatgt

SEQ ID NO: 81853 - DNA, 25 bp, Rattus norvegicus
accaagtaatttcatcgccgccttt

SEQ ID NO: 81854 - DNA, 25 bp, Rattus norvegicus
accaagtaatttgatcgccgccttt

SEQ ID NO: 81855 - DNA, 25 bp, Rattus norvegicus
accaagtctcttatggctgttttgt

SEQ ID NO: 81856 - DNA, 25 bp, Rattus norvegicus
accaagtctcttttggctgttttgt

SEQ ID NO: 81857 - DNA, 25 bp, Rattus norvegicus
accaagtcttgtaagctatttccag

SEQ ID NO: 81858 - DNA, 25 bp, Rattus norvegicus
accaagtcttgttagctatttccag

SEQ ID NO: 81859 - DNA, 25 bp, Rattus norvegicus
accaagtgactactggtgggccaga

SEQ ID NO: 81860 - DNA, 25 bp, Rattus norvegicus
accaagtgactagtggtgggccaga

SEQ ID NO: 81861 - DNA, 25 bp, Rattus norvegicus
accaagtgcatcaatagcccacctg

SEQ ID NO: 81862 - DNA, 25 bp, Rattus norvegicus
accaagtgcatctatagcccacctg

SEQ ID NO: 81863 - DNA, 25 bp, Rattus norvegicus
accaagtgcgttatagtcgcgcgaa

SEQ ID NO: 81864 - DNA, 25 bp, Rattus norvegicus
accaagtgcgttttagtcgcgcgaa

SEQ ID NO: 81865 - DNA, 25 bp, Rattus norvegicus
accaagtgtccgagggctgacccat

SEQ ID NO: 81866 - DNA, 25 bp, Rattus norvegicus
accaagtgtccgtgggctgacccat

SEQ ID NO: 81867 - DNA, 25 bp, Rattus norvegicus
accaagttcttgcttttctgaaaag

SEQ ID NO: 81868 - DNA, 25 bp, Rattus norvegicus
accaagttcttggttttctgaaaag

SEQ ID NO: 81869 - DNA, 25 bp, Rattus norvegicus
accaagttgatcacaatgagtgtgt

SEQ ID NO: 81870 - DNA, 25 bp, Rattus norvegicus
accaagttgatctcaatgagtgtgt

SEQ ID NO: 81871 - DNA, 25 bp, Rattus norvegicus
accaagttgcaaatcctttcttctc

SEQ ID NO: 81872 - DNA, 25 bp, Rattus norvegicus
accaagttgcaattcctttcttctc

SEQ ID NO: 81873 - DNA, 25 bp, Rattus norvegicus
accaagttggtccagctgtatcgga

SEQ ID NO: 81874 - DNA, 25 bp, Rattus norvegicus
accaagttggtcgagctgtatcgga

SEQ ID NO: 81875 - DNA, 25 bp, Rattus norvegicus
accaataatcatctagttcttactg

SEQ ID NO: 81876 - DNA, 25 bp, Rattus norvegicus
accaataatcatgtagttcttactg

SEQ ID NO: 81877 - DNA, 25 bp, Rattus norvegicus
accaatagatggctctttccagctc

SEQ ID NO: 81878 - DNA, 25 bp, Rattus norvegicus
accaatagatggcttcgacagaaca

SEQ ID NO: 81879 - DNA, 25 bp, Rattus norvegicus
accaatagatgggtctttccagctc

SEQ ID NO: 81880 - DNA, 25 bp, Rattus norvegicus
accaatagatgggttcgacagaaca

SEQ ID NO: 81881 - DNA, 25 bp, Rattus norvegicus
accaatagcagcagagtgtcctgga

SEQ ID NO: 81882 - DNA, 25 bp, Rattus norvegicus
accaatagcagctgagtgtcctgga

SEQ ID NO: 81883 - DNA, 25 bp, Rattus norvegicus
accaatcaagtgatattctgctcat

SEQ ID NO: 81884 - DNA, 25 bp, Rattus norvegicus
accaatcaagtgttattctgctcat

SEQ ID NO: 81885 - DNA, 25 bp, Rattus norvegicus
accaatcaggcgatgatgcgtgccc

SEQ ID NO: 81886 - DNA, 25 bp, Rattus norvegicus
accaatcaggcgttgatgcgtgccc

SEQ ID NO: 81887 - DNA, 25 bp, Rattus norvegicus
accaatcccctgaggtggatgcctc

SEQ ID NO: 81888 - DNA, 25 bp, Rattus norvegicus
accaatcccctgtggtggatgcctc

SEQ ID NO: 81889 - DNA, 25 bp, Rattus norvegicus
accaatcctttgagagctattgatt

SEQ ID NO: 81890 - DNA, 25 bp, Rattus norvegicus
accaatcctttgtgagctattgatt

SEQ ID NO: 81891 - DNA, 25 bp, Rattus norvegicus
accaatcgtacaactgataaaggac

SEQ ID NO: 81892 - DNA, 25 bp, Rattus norvegicus
accaatcgtacatctgataaaggac

SEQ ID NO: 81893 - DNA, 25 bp, Rattus norvegicus
accaatctgtgcatcggtgtagact

SEQ ID NO: 81894 - DNA, 25 bp, Rattus norvegicus
accaatctgtgcttcggtgtagact

SEQ ID NO: 81895 - DNA, 25 bp, Rattus norvegicus
accaatcttggtcttaagctgcatt

SEQ ID NO: 81896 - DNA, 25 bp, Rattus norvegicus
accaatcttggtgttaagctgcatt

SEQ ID NO: 81897 - DNA, 25 bp, Rattus norvegicus
accaatgcagtgatagctttcctct

SEQ ID NO: 81898 - DNA, 25 bp, Rattus norvegicus
accaatgcagtgttagctttcctct

SEQ ID NO: 81899 - DNA, 25 bp, Rattus norvegicus
accaatgcctgcaacatggaggaga

SEQ ID NO: 81900 - DNA, 25 bp, Rattus norvegicus
accaatgcctgctacatggaggaga

SEQ ID NO: 81901 - DNA, 25 bp, Rattus norvegicus
accaatgcgttcagtcacatcggga

SEQ ID NO: 81902 - DNA, 25 bp, Rattus norvegicus
accaatgcgttctgtcacatcggga

SEQ ID NO: 81903 - DNA, 25 bp, Rattus norvegicus
accaatgctggtcttctgggcaccc

SEQ ID NO: 81904 - DNA, 25 bp, Rattus norvegicus
accaatgctggtgttctgggcaccc

SEQ ID NO: 81905 - DNA, 25 bp, Rattus norvegicus
accaatggacaacgatctgctgatt

SEQ ID NO: 81906 - DNA, 25 bp, Rattus norvegicus
accaatggacaaggatctgctgatt

SEQ ID NO: 81907 - DNA, 25 bp, Rattus norvegicus
accaatggcaggatgcgtcccaaat

SEQ ID NO: 81908 - DNA, 25 bp, Rattus norvegicus
accaatggcaggttgcgtcccaaat

SEQ ID NO: 81909 - DNA, 25 bp, Rattus norvegicus
accaatggccggcactcctgggagt

SEQ ID NO: 81910 - DNA, 25 bp, Rattus norvegicus
accaatggccgggactcctgggagt

SEQ ID NO: 81911 - DNA, 25 bp, Rattus norvegicus
accaatgggatcatctccacccagg

SEQ ID NO: 81912 - DNA, 25 bp, Rattus norvegicus
accaatgggatcttctccacccagg

SEQ ID NO: 81913 - DNA, 25 bp, Rattus norvegicus
accaatgggcgtagaacctctgtat

SEQ ID NO: 81914 - DNA, 25 bp, Rattus norvegicus
accaatgggcgttgaacctctgtat

SEQ ID NO: 81915 - DNA, 25 bp, Rattus norvegicus
accaatgtatgcagggatgcgtcct

SEQ ID NO: 81916 - DNA, 25 bp, Rattus norvegicus
accaatgtatgctgggatgcgtcct

SEQ ID NO: 81917 - DNA, 25 bp, Rattus norvegicus
accaatgtcacccttcatcataaag

SEQ ID NO: 81918 - DNA, 25 bp, Rattus norvegicus
accaatgtcaccgttcatcataaag

SEQ ID NO: 81919 - DNA, 25 bp, Rattus norvegicus
accaatgtccaccagagggagaact

SEQ ID NO: 81920 - DNA, 25 bp, Rattus norvegicus
accaatgtccacgagagggagaact

SEQ ID NO: 81921 - DNA, 25 bp, Rattus norvegicus
accaatgtggtaagtgtcttgtcat

SEQ ID NO: 81922 - DNA, 25 bp, Rattus norvegicus
accaatgtggtatgtgtcttgtcat

SEQ ID NO: 81923 - DNA, 25 bp, Rattus norvegicus
accaatgttcagatcccagagggag

SEQ ID NO: 81924 - DNA, 25 bp, Rattus norvegicus
accaatgttcagttcccagagggag

SEQ ID NO: 81925 - DNA, 25 bp, Rattus norvegicus
accaatgttttaaggagccttcctg

SEQ ID NO: 81926 - DNA, 25 bp, Rattus norvegicus
accaatgttttatggagccttcctg

SEQ ID NO: 81927 - DNA, 25 bp, Rattus norvegicus
accaatgttttcagccttcacttca

SEQ ID NO: 81928 - DNA, 25 bp, Rattus norvegicus
accaatgttttctgccttcacttca

SEQ ID NO: 81929 - DNA, 25 bp, Rattus norvegicus
accaattagggtcggctttgtgatc

SEQ ID NO: 81930 - DNA, 25 bp, Rattus norvegicus
accaattagggtgggctttgtgatc

SEQ ID NO: 81931 - DNA, 25 bp, Rattus norvegicus
accaattagttaagggcggtccaca

SEQ ID NO: 81932 - DNA, 25 bp, Rattus norvegicus
accaattagttatgggcggtccaca

SEQ ID NO: 81933 - DNA, 25 bp, Rattus norvegicus
accaattattcaatgctgccagaga

SEQ ID NO: 81934 - DNA, 25 bp, Rattus norvegicus
accaattattcattgctgccagaga

SEQ ID NO: 81935 - DNA, 25 bp, Rattus norvegicus
accaattcagttagcagcacaccct

SEQ ID NO: 81936 - DNA, 25 bp, Rattus norvegicus
accaattcagtttgcagcacaccct

SEQ ID NO: 81937 - DNA, 25 bp, Rattus norvegicus
accaattccaggagttctgcttatc

SEQ ID NO: 81938 - DNA, 25 bp, Rattus norvegicus
accaattccaggtgttctgcttatc

SEQ ID NO: 81939 - DNA, 25 bp, Rattus norvegicus
accaattctcttatagtagctgagc

SEQ ID NO: 81940 - DNA, 25 bp, Rattus norvegicus
accaattctcttttagtagctgagc

SEQ ID NO: 81941 - DNA, 25 bp, Rattus norvegicus
accaattgcatcactactttaaatc

SEQ ID NO: 81942 - DNA, 25 bp, Rattus norvegicus
accaattgcatctctactttaaatc

SEQ ID NO: 81943 - DNA, 25 bp, Rattus norvegicus
accaattggtctctatgtcactgca

SEQ ID NO: 81944 - DNA, 25 bp, Rattus norvegicus
accaattggtctgtatgtcactgca

SEQ ID NO: 81945 - DNA, 25 bp, Rattus norvegicus
accaattgttggacgacgcgcggct

SEQ ID NO: 81946 - DNA, 25 bp, Rattus norvegicus
accaattgttggtcgacgcgcggct

SEQ ID NO: 81947 - DNA, 25 bp, Rattus norvegicus
accaatttcaacatcccattcaata

SEQ ID NO: 81948 - DNA, 25 bp, Rattus norvegicus
accaatttcaacttcccattcaata

SEQ ID NO: 81949 - DNA, 25 bp, Rattus norvegicus
accaatttgatcacagtcctgtatt

SEQ ID NO: 81950 - DNA, 25 bp, Rattus norvegicus
accaatttgatctcagtcctgtatt

SEQ ID NO: 81951 - DNA, 25 bp, Rattus norvegicus
accaatttgtgtctagtctctctca

SEQ ID NO: 81952 - DNA, 25 bp, Rattus norvegicus
accaatttgtgtgtagtctctctca

SEQ ID NO: 81953 - DNA, 25 bp, Rattus norvegicus
accaattttcagagaaggcctccct

SEQ ID NO: 81954 - DNA, 25 bp, Rattus norvegicus
accaattttcagtgaaggcctccct

SEQ ID NO: 81955 - DNA, 25 bp, Rattus norvegicus
accacaaaagtccttctcgggcagg

SEQ ID NO: 81956 - DNA, 25 bp, Rattus norvegicus
accacaaaagtcgttctcgggcagg

SEQ ID NO: 81957 - DNA, 25 bp, Rattus norvegicus
accacaaatacaattccacttctag

SEQ ID NO: 81958 - DNA, 25 bp, Rattus norvegicus
accacaaatacatttccacttctag

SEQ ID NO: 81959 - DNA, 25 bp, Rattus norvegicus
accacaacatgtctcctgggcagta

SEQ ID NO: 81960 - DNA, 25 bp, Rattus norvegicus
accacaacatgtgtcctgggcagta

SEQ ID NO: 81961 - DNA, 25 bp, Rattus norvegicus
accacaacattcctaaagggccctg

SEQ ID NO: 81962 - DNA, 25 bp, Rattus norvegicus
accacaacattcgtaaagggccctg

SEQ ID NO: 81963 - DNA, 25 bp, Rattus norvegicus
accacaacatttcctttttgtccag

SEQ ID NO: 81964 - DNA, 25 bp, Rattus norvegicus
accacaacatttgctttttgtccag

SEQ ID NO: 81965 - DNA, 25 bp, Rattus norvegicus
accacaagatgtcgtcctgaccctg

SEQ ID NO: 81966 - DNA, 25 bp, Rattus norvegicus
accacaagatgtggtcctgaccctg

SEQ ID NO: 81967 - DNA, 25 bp, Rattus norvegicus
accacaagtggtccagcctggagga

SEQ ID NO: 81968 - DNA, 25 bp, Rattus norvegicus
accacaagtggtgcagcctggagga

SEQ ID NO: 81969 - DNA, 25 bp, Rattus norvegicus
accacaatagtgactctgtgcttgt

SEQ ID NO: 81970 - DNA, 25 bp, Rattus norvegicus
accacaatagtgtctctgtgcttgt

SEQ ID NO: 81971 - DNA, 25 bp, Rattus norvegicus
accacaatccttcgcttctgttgcc

SEQ ID NO: 81972 - DNA, 25 bp, Rattus norvegicus
accacaatccttggcttctgttgcc

SEQ ID NO: 81973 - DNA, 25 bp, Rattus norvegicus
accacaatgaaaagactcaacactg

SEQ ID NO: 81974 - DNA, 25 bp, Rattus norvegicus
accacaatgaaatgactcaacactg

SEQ ID NO: 81975 - DNA, 25 bp, Rattus norvegicus
accacaatgacaacgggcactgcat

SEQ ID NO: 81976 - DNA, 25 bp, Rattus norvegicus
accacaatgacatcgggcactgcat

SEQ ID NO: 81977 - DNA, 25 bp, Rattus norvegicus
accacaatgctgcaccaaagccggg

SEQ ID NO: 81978 - DNA, 25 bp, Rattus norvegicus
accacaatgctggaccaaagccggg

SEQ ID NO: 81979 - DNA, 25 bp, Rattus norvegicus
accacaatgtgtaccctgagctgaa

SEQ ID NO: 81980 - DNA, 25 bp, Rattus norvegicus
accacaatgtgttccctgagctgaa

SEQ ID NO: 81981 - DNA, 25 bp, Rattus norvegicus
accacaattgatcgagctggctttg

SEQ ID NO: 81982 - DNA, 25 bp, Rattus norvegicus
accacaattgatggagctggctttg

SEQ ID NO: 81983 - DNA, 25 bp, Rattus norvegicus
accacaattgtgactgatttccctt

SEQ ID NO: 81984 - DNA, 25 bp, Rattus norvegicus
accacaattgtgtctgatttccctt

SEQ ID NO: 81985 - DNA, 25 bp, Rattus norvegicus
accacacaagtcagaggctggcctg

SEQ ID NO: 81986 - DNA, 25 bp, Rattus norvegicus
accacacaagtctgaggctggcctg

SEQ ID NO: 81987 - DNA, 25 bp, Rattus norvegicus
accacacacatacctactaagactt

SEQ ID NO: 81988 - DNA, 25 bp, Rattus norvegicus
accacacacatagctactaagactt

SEQ ID NO: 81989 - DNA, 25 bp, Rattus norvegicus
accacacagcacattcctgttaaat

SEQ ID NO: 81990 - DNA, 25 bp, Rattus norvegicus
accacacagcactttcctgttaaat

SEQ ID NO: 81991 - DNA, 25 bp, Rattus norvegicus
accacacagtgccagtttgcttatg

SEQ ID NO: 81992 - DNA, 25 bp, Rattus norvegicus
accacacagtgcgagtttgcttatg

SEQ ID NO: 81993 - DNA, 25 bp, Rattus norvegicus
accacacagtggagatgcacgcctt

SEQ ID NO: 81994 - DNA, 25 bp, Rattus norvegicus
accacacagtggtgatgcacgcctt

SEQ ID NO: 81995 - DNA, 25 bp, Rattus norvegicus
accacacatggcatcttagcaatgt

SEQ ID NO: 81996 - DNA, 25 bp, Rattus norvegicus
accacacatggcttcttagcaatgt

SEQ ID NO: 81997 - DNA, 25 bp, Rattus norvegicus
accacaccaagtacgtgcagttctg

SEQ ID NO: 81998 - DNA, 25 bp, Rattus norvegicus
accacaccaagttcgtgcagttctg

SEQ ID NO: 81999 - DNA, 25 bp, Rattus norvegicus
accacaccacctcttagatcataag

SEQ ID NO: 82000 - DNA, 25 bp, Rattus norvegicus
accacaccacctgttagatcataag

SEQ ID NO: 82001 - DNA, 25 bp, Rattus norvegicus
accacaccactgctttggtgggaaa

SEQ ID NO: 82002 - DNA, 25 bp, Rattus norvegicus
accacaccactggtttggtgggaaa

SEQ ID NO: 82003 - DNA, 25 bp, Rattus norvegicus
accacaccagccagtttaattttct

SEQ ID NO: 82004 - DNA, 25 bp, Rattus norvegicus
accacaccagcctgtttaattttct

SEQ ID NO: 82005 - DNA, 25 bp, Rattus norvegicus
accacaccaggcacaaagtctgcat

SEQ ID NO: 82006 - DNA, 25 bp, Rattus norvegicus
accacaccaggctcaaagtctgcat

SEQ ID NO: 82007 - DNA, 25 bp, Rattus norvegicus
accacaccagtaatgccttctgaaa

SEQ ID NO: 82008 - DNA, 25 bp, Rattus norvegicus
accacaccagtattgccttctgaaa

SEQ ID NO: 82009 - DNA, 25 bp, Rattus norvegicus
accacacccaaaatctgagcttcag

SEQ ID NO: 82010 - DNA, 25 bp, Rattus norvegicus
accacacccaaattctgagcttcag

SEQ ID NO: 82011 - DNA, 25 bp, Rattus norvegicus
accacacccagcaagatttgagtca

SEQ ID NO: 82012 - DNA, 25 bp, Rattus norvegicus
accacacccagctagatttgagtca

SEQ ID NO: 82013 - DNA, 25 bp, Rattus norvegicus
accacacctaaaattctttgctcac

SEQ ID NO: 82014 - DNA, 25 bp, Rattus norvegicus
accacacctaaatttctttgctcac

SEQ ID NO: 82015 - DNA, 25 bp, Rattus norvegicus
accacaccttgcagctgtatttttt

SEQ ID NO: 82016 - DNA, 25 bp, Rattus norvegicus
accacaccttgctgctgtatttttt

SEQ ID NO: 82017 - DNA, 25 bp, Rattus norvegicus
accacacggacacttgttcaactat

SEQ ID NO: 82018 - DNA, 25 bp, Rattus norvegicus
accacacggacagttgttcaactat

SEQ ID NO: 82019 - DNA, 25 bp, Rattus norvegicus
accacacggagtacaggaaggagga

SEQ ID NO: 82020 - DNA, 25 bp, Rattus norvegicus
accacacggagttcaggaaggagga

SEQ ID NO: 82021 - DNA, 25 bp, Rattus norvegicus
accacacgggaaaactgggcttatt

SEQ ID NO: 82022 - DNA, 25 bp, Rattus norvegicus
accacacgggaatactgggcttatt

SEQ ID NO: 82023 - DNA, 25 bp, Rattus norvegicus
accacacggtgaaggagtccccata

SEQ ID NO: 82024 - DNA, 25 bp, Rattus norvegicus
accacacggtgatggagtccccata

SEQ ID NO: 82025 - DNA, 25 bp, Rattus norvegicus
accacactcagcatttatctttttt

SEQ ID NO: 82026 - DNA, 25 bp, Rattus norvegicus
accacactcagcttttatctttttt

SEQ ID NO: 82027 - DNA, 25 bp, Rattus norvegicus
accacactcatgatcagccttgtaa

SEQ ID NO: 82028 - DNA, 25 bp, Rattus norvegicus
accacactcatgttcagccttgtaa

SEQ ID NO: 82029 - DNA, 25 bp, Rattus norvegicus
accacactgatgaccagaaccgttt

SEQ ID NO: 82030 - DNA, 25 bp, Rattus norvegicus
accacactgatgtccagaaccgttt

SEQ ID NO: 82031 - DNA, 25 bp, Rattus norvegicus
accacactgcatcgtctgacaggat

SEQ ID NO: 82032 - DNA, 25 bp, Rattus norvegicus
accacactgcatggtctgacaggat

SEQ ID NO: 82033 - DNA, 25 bp, Rattus norvegicus
accacactgcctcctgaatagtagt

SEQ ID NO: 82034 - DNA, 25 bp, Rattus norvegicus
accacactgcctgctgaatagtagt

SEQ ID NO: 82035 - DNA, 25 bp, Rattus norvegicus
accacactgtatcgctacattccag

SEQ ID NO: 82036 - DNA, 25 bp, Rattus norvegicus
accacactgtatggctacattccag

SEQ ID NO: 82037 - DNA, 25 bp, Rattus norvegicus
accacactgttgagatggacacact

SEQ ID NO: 82038 - DNA, 25 bp, Rattus norvegicus
accacactgttgtgatggacacact

SEQ ID NO: 82039 - DNA, 25 bp, Rattus norvegicus
accacactgtttccttaacttcaag

SEQ ID NO: 82040 - DNA, 25 bp, Rattus norvegicus
accacactgtttgcttaacttcaag

SEQ ID NO: 82041 - DNA, 25 bp, Rattus norvegicus
accacagaccagagcttgcaggctg

SEQ ID NO: 82042 - DNA, 25 bp, Rattus norvegicus
accacagaccagtgcttgcaggctg

SEQ ID NO: 82043 - DNA, 25 bp, Rattus norvegicus
accacagagcgaaggctggagccca

SEQ ID NO: 82044 - DNA, 25 bp, Rattus norvegicus
accacagagcgatggctggagccca

SEQ ID NO: 82045 - DNA, 25 bp, Rattus norvegicus
accacagagcttcgctacagtagca

SEQ ID NO: 82046 - DNA, 25 bp, Rattus norvegicus
accacagagcttggctacagtagca

SEQ ID NO: 82047 - DNA, 25 bp, Rattus norvegicus
accacagaggccactgttcagatgg

SEQ ID NO: 82048 - DNA, 25 bp, Rattus norvegicus
accacagaggcctctgttcagatgg

SEQ ID NO: 82049 - DNA, 25 bp, Rattus norvegicus
accacagagtggcatgcttgctgga

SEQ ID NO: 82050 - DNA, 25 bp, Rattus norvegicus
accacagagtgggatgcttgctgga

SEQ ID NO: 82051 - DNA, 25 bp, Rattus norvegicus
accacagatttccttgtatgtttga

SEQ ID NO: 82052 - DNA, 25 bp, Rattus norvegicus
accacagatttcgttgtatgtttga

SEQ ID NO: 82053 - DNA, 25 bp, Rattus norvegicus
accacagcacttactttatctcgag

SEQ ID NO: 82054 - DNA, 25 bp, Rattus norvegicus
accacagcactttctttatctcgag

SEQ ID NO: 82055 - DNA, 25 bp, Rattus norvegicus
accacagcagacatggcagtcattt

SEQ ID NO: 82056 - DNA, 25 bp, Rattus norvegicus
accacagcagacttggcagtcattt

SEQ ID NO: 82057 - DNA, 25 bp, Rattus norvegicus
accacagccaagatctagcacaagc

SEQ ID NO: 82058 - DNA, 25 bp, Rattus norvegicus
accacagccaagttctagcacaagc

SEQ ID NO: 82059 - DNA, 25 bp, Rattus norvegicus
accacagctacaaggacatgcgcca

SEQ ID NO: 82060 - DNA, 25 bp, Rattus norvegicus
accacagctacatggacatgcgcca

SEQ ID NO: 82061 - DNA, 25 bp, Rattus norvegicus
accacagctctacctttctgaggat

SEQ ID NO: 82062 - DNA, 25 bp, Rattus norvegicus
accacagctctagctttctgaggat

SEQ ID NO: 82063 - DNA, 25 bp, Rattus norvegicus
accacagctgagacagggcctggat

SEQ ID NO: 82064 - DNA, 25 bp, Rattus norvegicus
accacagctgagtcagggcctggat

SEQ ID NO: 82065 - DNA, 25 bp, Rattus norvegicus
accacaggaacgcaggcgggacaca

SEQ ID NO: 82066 - DNA, 25 bp, Rattus norvegicus
accacaggaacggaggcgggacaca

SEQ ID NO: 82067 - DNA, 25 bp, Rattus norvegicus
accacaggccctacaaaacagtttg

SEQ ID NO: 82068 - DNA, 25 bp, Rattus norvegicus
accacaggcccttcaaaacagtttg

SEQ ID NO: 82069 - DNA, 25 bp, Rattus norvegicus
accacagggttcacatgccaaggga

SEQ ID NO: 82070 - DNA, 25 bp, Rattus norvegicus
accacagggttctcatgccaaggga

SEQ ID NO: 82071 - DNA, 25 bp, Rattus norvegicus
accacaggtggtcgccaagacagga

SEQ ID NO: 82072 - DNA, 25 bp, Rattus norvegicus
accacaggtggtcgctattggctaa

SEQ ID NO: 82073 - DNA, 25 bp, Rattus norvegicus
accacaggtggtggccaagacagga

SEQ ID NO: 82074 - DNA, 25 bp, Rattus norvegicus
accacaggtggtggctattggctaa

SEQ ID NO: 82075 - DNA, 25 bp, Rattus norvegicus
accacagtatctagaaagagccctt

SEQ ID NO: 82076 - DNA, 25 bp, Rattus norvegicus
accacagtatcttgaaagagccctt

SEQ ID NO: 82077 - DNA, 25 bp, Rattus norvegicus
accacagtccagattttgaccacga

SEQ ID NO: 82078 - DNA, 25 bp, Rattus norvegicus
accacagtccagtttttgaccacga

SEQ ID NO: 82079 - DNA, 25 bp, Rattus norvegicus
accacagtctgtcactcagtcactg

SEQ ID NO: 82080 - DNA, 25 bp, Rattus norvegicus
accacagtctgtgactcagtcactg

SEQ ID NO: 82081 - DNA, 25 bp, Rattus norvegicus
accacagtgaacagcagggcagagg

SEQ ID NO: 82082 - DNA, 25 bp, Rattus norvegicus
accacagtgaactgcagggcagagg

SEQ ID NO: 82083 - DNA, 25 bp, Rattus norvegicus
accacagtgagcaaccaggaggact

SEQ ID NO: 82084 - DNA, 25 bp, Rattus norvegicus
accacagtgagctaccaggaggact

SEQ ID NO: 82085 - DNA, 25 bp, Rattus norvegicus
accacagtgcagaatgcttgcctca

SEQ ID NO: 82086 - DNA, 25 bp, Rattus norvegicus
accacagtgcagtatgcttgcctca

SEQ ID NO: 82087 - DNA, 25 bp, Rattus norvegicus
accacagtgcgaagacaaatttgac

SEQ ID NO: 82088 - DNA, 25 bp, Rattus norvegicus
accacagtgcgatgacaaatttgac

SEQ ID NO: 82089 - DNA, 25 bp, Rattus norvegicus
accacagtgctacttgagtcataca

SEQ ID NO: 82090 - DNA, 25 bp, Rattus norvegicus
accacagtgctagttgagtcataca

SEQ ID NO: 82091 - DNA, 25 bp, Rattus norvegicus
accacagtgctgattctgaagaggc

SEQ ID NO: 82092 - DNA, 25 bp, Rattus norvegicus
accacagtgctgtttctgaagaggc

SEQ ID NO: 82093 - DNA, 25 bp, Rattus norvegicus
accacagtggctcacagctacctgg

SEQ ID NO: 82094 - DNA, 25 bp, Rattus norvegicus
accacagtggctgacagctacctgg

SEQ ID NO: 82095 - DNA, 25 bp, Rattus norvegicus
accacagtgggcagtgggttcgcct

SEQ ID NO: 82096 - DNA, 25 bp, Rattus norvegicus
accacagtgggctgtgggttcgcct

SEQ ID NO: 82097 - DNA, 25 bp, Rattus norvegicus
accacagtggtccaagcaatgccca

SEQ ID NO: 82098 - DNA, 25 bp, Rattus norvegicus
accacagtggtcgaagcaatgccca

SEQ ID NO: 82099 - DNA, 25 bp, Rattus norvegicus
accacagtggtgaccggctcggaga

SEQ ID NO: 82100 - DNA, 25 bp, Rattus norvegicus
accacagtggtgtccggctcggaga

SEQ ID NO: 82101 - DNA, 25 bp, Rattus norvegicus
accacagtgttgagcttcattatta

SEQ ID NO: 82102 - DNA, 25 bp, Rattus norvegicus
accacagtgttgtgcttcattatta

SEQ ID NO: 82103 - DNA, 25 bp, Rattus norvegicus
accacatactgtactggcagggcca

SEQ ID NO: 82104 - DNA, 25 bp, Rattus norvegicus
accacatactgttctggcagggcca

SEQ ID NO: 82105 - DNA, 25 bp, Rattus norvegicus
accacatagtggactctgcagaggg

SEQ ID NO: 82106 - DNA, 25 bp, Rattus norvegicus
accacatagtggtctctgcagaggg

SEQ ID NO: 82107 - DNA, 25 bp, Rattus norvegicus
accacatcagccagaggaccaaaca

SEQ ID NO: 82108 - DNA, 25 bp, Rattus norvegicus
accacatcagcctgaggaccaaaca

SEQ ID NO: 82109 - DNA, 25 bp, Rattus norvegicus
accacatccgtaatgctttgattta

SEQ ID NO: 82110 - DNA, 25 bp, Rattus norvegicus
accacatccgtattgctttgattta

SEQ ID NO: 82111 - DNA, 25 bp, Rattus norvegicus
accacatcctgaaggtgtccatgaa

SEQ ID NO: 82112 - DNA, 25 bp, Rattus norvegicus
accacatcctgatggtgtccatgaa

SEQ ID NO: 82113 - DNA, 25 bp, Rattus norvegicus
accacatccttgagccttacgtgaa

SEQ ID NO: 82114 - DNA, 25 bp, Rattus norvegicus
accacatccttgtgccttacgtgaa

SEQ ID NO: 82115 - DNA, 25 bp, Rattus norvegicus
accacatcctttagcaagtctgttt

SEQ ID NO: 82116 - DNA, 25 bp, Rattus norvegicus
accacatccttttgcaagtctgttt

SEQ ID NO: 82117 - DNA, 25 bp, Rattus norvegicus
accacatctactacccagaggtgag

SEQ ID NO: 82118 - DNA, 25 bp, Rattus norvegicus
accacatctacttcccagaggtgag

SEQ ID NO: 82119 - DNA, 25 bp, Rattus norvegicus
accacatcttcacctggcattcaga

SEQ ID NO: 82120 - DNA, 25 bp, Rattus norvegicus
accacatcttcagctggcattcaga

SEQ ID NO: 82121 - DNA, 25 bp, Rattus norvegicus
accacatgcaaactagttaccactt

SEQ ID NO: 82122 - DNA, 25 bp, Rattus norvegicus
accacatgcaaagtagttaccactt

SEQ ID NO: 82123 - DNA, 25 bp, Rattus norvegicus
accacatgcagactctacgctttga

SEQ ID NO: 82124 - DNA, 25 bp, Rattus norvegicus
accacatgcagagtctacgctttga

SEQ ID NO: 82125 - DNA, 25 bp, Rattus norvegicus
accacatgctgtccctgattgagga

SEQ ID NO: 82126 - DNA, 25 bp, Rattus norvegicus
accacatgctgtgcctgattgagga

SEQ ID NO: 82127 - DNA, 25 bp, Rattus norvegicus
accacatgcttcattctgattctaa

SEQ ID NO: 82128 - DNA, 25 bp, Rattus norvegicus
accacatgcttctttctgattctaa

SEQ ID NO: 82129 - DNA, 25 bp, Rattus norvegicus
accacatgctttccagtgctgaaca

SEQ ID NO: 82130 - DNA, 25 bp, Rattus norvegicus
accacatgctttgcagtgctgaaca

SEQ ID NO: 82131 - DNA, 25 bp, Rattus norvegicus
accacatggccaagggttggaggtt

SEQ ID NO: 82132 - DNA, 25 bp, Rattus norvegicus
accacatggccatgggttggaggtt

SEQ ID NO: 82133 - DNA, 25 bp, Rattus norvegicus
accacatgtctcaatgagcaggctg

SEQ ID NO: 82134 - DNA, 25 bp, Rattus norvegicus
accacatgtctctatgagcaggctg

SEQ ID NO: 82135 - DNA, 25 bp, Rattus norvegicus
accacatgtgtgagttccttagtcc

SEQ ID NO: 82136 - DNA, 25 bp, Rattus norvegicus
accacatgtgtgtgttccttagtcc

SEQ ID NO: 82137 - DNA, 25 bp, Rattus norvegicus
accacattccagcaacttacctagg

SEQ ID NO: 82138 - DNA, 25 bp, Rattus norvegicus
accacattccaggaacttacctagg

SEQ ID NO: 82139 - DNA, 25 bp, Rattus norvegicus
accacattcctgagtcactgtagcc

SEQ ID NO: 82140 - DNA, 25 bp, Rattus norvegicus
accacattcctgtgtcactgtagcc

SEQ ID NO: 82141 - DNA, 25 bp, Rattus norvegicus
accacattgcatagacttcttcttc

SEQ ID NO: 82142 - DNA, 25 bp, Rattus norvegicus
accacattgcattgacttcttcttc

SEQ ID NO: 82143 - DNA, 25 bp, Rattus norvegicus
accacattgtgcctctgctttaggg

SEQ ID NO: 82144 - DNA, 25 bp, Rattus norvegicus
accacattgtgcgtctgctttaggg

SEQ ID NO: 82145 - DNA, 25 bp, Rattus norvegicus
accacatttaacatcagcttcaggg

SEQ ID NO: 82146 - DNA, 25 bp, Rattus norvegicus
accacatttaacttcagcttcaggg

SEQ ID NO: 82147 - DNA, 25 bp, Rattus norvegicus
accacatttagaagtcctgcctttg

SEQ ID NO: 82148 - DNA, 25 bp, Rattus norvegicus
accacatttagatgtcctgcctttg

SEQ ID NO: 82149 - DNA, 25 bp, Rattus norvegicus
accaccaaatttcattgccacaatc

SEQ ID NO: 82150 - DNA, 25 bp, Rattus norvegicus
accaccaaatttgattgccacaatc

SEQ ID NO: 82151 - DNA, 25 bp, Rattus norvegicus
accaccaaggttatggaggctctgg

SEQ ID NO: 82152 - DNA, 25 bp, Rattus norvegicus
accaccaaggttttggaggctctgg

SEQ ID NO: 82153 - DNA, 25 bp, Rattus norvegicus
accaccaagtgcaaaggaccatcct

SEQ ID NO: 82154 - DNA, 25 bp, Rattus norvegicus
accaccaagtgctaaggaccatcct

SEQ ID NO: 82155 - DNA, 25 bp, Rattus norvegicus
accaccaatttgaatccccgtatca

SEQ ID NO: 82156 - DNA, 25 bp, Rattus norvegicus
accaccaatttgtatccccgtatca

SEQ ID NO: 82157 - DNA, 25 bp, Rattus norvegicus
accaccacagataatgttgacgtat

SEQ ID NO: 82158 - DNA, 25 bp, Rattus norvegicus
accaccacagattatgttgacgtat

SEQ ID NO: 82159 - DNA, 25 bp, Rattus norvegicus
accaccaccaatcaattttcaggaa

SEQ ID NO: 82160 - DNA, 25 bp, Rattus norvegicus
accaccaccaatgaattttcaggaa

SEQ ID NO: 82161 - DNA, 25 bp, Rattus norvegicus
accaccaccatcagacagctttagg

SEQ ID NO: 82162 - DNA, 25 bp, Rattus norvegicus
accaccaccatctgacagctttagg

SEQ ID NO: 82163 - DNA, 25 bp, Rattus norvegicus
accaccaccctgcttattatgtttg

SEQ ID NO: 82164 - DNA, 25 bp, Rattus norvegicus
accaccaccctggttattatgtttg

SEQ ID NO: 82165 - DNA, 25 bp, Rattus norvegicus
accaccacccttacttacatggaag

SEQ ID NO: 82166 - DNA, 25 bp, Rattus norvegicus
accaccaccctttcttacatggaag

SEQ ID NO: 82167 - DNA, 25 bp, Rattus norvegicus
accaccaccgtgaagtctgataact

SEQ ID NO: 82168 - DNA, 25 bp, Rattus norvegicus
accaccaccgtgtagtctgataact

SEQ ID NO: 82169 - DNA, 25 bp, Rattus norvegicus
accaccacctttacaattggcttat

SEQ ID NO: 82170 - DNA, 25 bp, Rattus norvegicus
accaccaccttttcaattggcttat

SEQ ID NO: 82171 - DNA, 25 bp, Rattus norvegicus
accaccactggcctaagacgtttgg

SEQ ID NO: 82172 - DNA, 25 bp, Rattus norvegicus
accaccactggcgtaagacgtttgg

SEQ ID NO: 82173 - DNA, 25 bp, Rattus norvegicus
accaccacttgcctatttccaaggg

SEQ ID NO: 82174 - DNA, 25 bp, Rattus norvegicus
accaccacttgcgtatttccaaggg

SEQ ID NO: 82175 - DNA, 25 bp, Rattus norvegicus
accaccagaggtcagttagtttgta

SEQ ID NO: 82176 - DNA, 25 bp, Rattus norvegicus
accaccagaggtgagttagtttgta

SEQ ID NO: 82177 - DNA, 25 bp, Rattus norvegicus
accaccagatggcaaaagattagct

SEQ ID NO: 82178 - DNA, 25 bp, Rattus norvegicus
accaccagatgggaaaagattagct

SEQ ID NO: 82179 - DNA, 25 bp, Rattus norvegicus
accaccagcatgaaattgtccacac

SEQ ID NO: 82180 - DNA, 25 bp, Rattus norvegicus
accaccagcatgtaattgtccacac

SEQ ID NO: 82181 - DNA, 25 bp, Rattus norvegicus
accaccagcccaatagcagttgagg

SEQ ID NO: 82182 - DNA, 25 bp, Rattus norvegicus
accaccagcccattagcagttgagg

SEQ ID NO: 82183 - DNA, 25 bp, Rattus norvegicus
accaccagcttccagaggactttgg

SEQ ID NO: 82184 - DNA, 25 bp, Rattus norvegicus
accaccagcttcgagaggactttgg

SEQ ID NO: 82185 - DNA, 25 bp, Rattus norvegicus
accaccaggcggctagaggacatca

SEQ ID NO: 82186 - DNA, 25 bp, Rattus norvegicus
accaccaggcgggtagaggacatca

SEQ ID NO: 82187 - DNA, 25 bp, Rattus norvegicus
accaccaggtcacaagagcccagtt

SEQ ID NO: 82188 - DNA, 25 bp, Rattus norvegicus
accaccaggtcagaagagcccagtt

SEQ ID NO: 82189 - DNA, 25 bp, Rattus norvegicus
accaccatcctgagtgcaggcgtgt

SEQ ID NO: 82190 - DNA, 25 bp, Rattus norvegicus
accaccatcctgtgtgcaggcgtgt

SEQ ID NO: 82191 - DNA, 25 bp, Rattus norvegicus
accaccatcggtagttagttgcctt

SEQ ID NO: 82192 - DNA, 25 bp, Rattus norvegicus
accaccatcggttgttagttgcctt

SEQ ID NO: 82193 - DNA, 25 bp, Rattus norvegicus
accaccatcgttagaacccagtata

SEQ ID NO: 82194 - DNA, 25 bp, Rattus norvegicus
accaccatcgtttgaacccagtata

SEQ ID NO: 82195 - DNA, 25 bp, Rattus norvegicus
accaccatgggcaggactcgctgaa

SEQ ID NO: 82196 - DNA, 25 bp, Rattus norvegicus
accaccatgggctggactcgctgaa

SEQ ID NO: 82197 - DNA, 25 bp, Rattus norvegicus
accacccaaggacttcaagtctagc

SEQ ID NO: 82198 - DNA, 25 bp, Rattus norvegicus
accacccaaggagttcaagtctagc

SEQ ID NO: 82199 - DNA, 25 bp, Rattus norvegicus
accacccagagtcccaaatctaaat

SEQ ID NO: 82200 - DNA, 25 bp, Rattus norvegicus
accacccagagtgccaaatctaaat

SEQ ID NO: 82201 - DNA, 25 bp, Rattus norvegicus
accacccagatacatccctttgtat

SEQ ID NO: 82202 - DNA, 25 bp, Rattus norvegicus
accacccagatagatccctttgtat

SEQ ID NO: 82203 - DNA, 25 bp, Rattus norvegicus
accacccagctaagatgtctacaaa

SEQ ID NO: 82204 - DNA, 25 bp, Rattus norvegicus
accacccagctatgatgtctacaaa

SEQ ID NO: 82205 - DNA, 25 bp, Rattus norvegicus
accacccaggtgaagatgtgtgctg

SEQ ID NO: 82206 - DNA, 25 bp, Rattus norvegicus
accacccaggtgtagatgtgtgctg

SEQ ID NO: 82207 - DNA, 25 bp, Rattus norvegicus
accacccatgtaagcgacgacagag

SEQ ID NO: 82208 - DNA, 25 bp, Rattus norvegicus
accacccatgtatgcgacgacagag

SEQ ID NO: 82209 - DNA, 25 bp, Rattus norvegicus
accaccccaggcaaagacattgagg

SEQ ID NO: 82210 - DNA, 25 bp, Rattus norvegicus
accaccccaggctaagacattgagg

SEQ ID NO: 82211 - DNA, 25 bp, Rattus norvegicus
accacccggagacgacgccttgaga

SEQ ID NO: 82212 - DNA, 25 bp, Rattus norvegicus
accacccggagaggacgccttgaga

SEQ ID NO: 82213 - DNA, 25 bp, Rattus norvegicus
accacccttggcatgactgttaaat

SEQ ID NO: 82214 - DNA, 25 bp, Rattus norvegicus
accacccttggcttgactgttaaat

SEQ ID NO: 82215 - DNA, 25 bp, Rattus norvegicus
accacccttgttagtctgctttgga

SEQ ID NO: 82216 - DNA, 25 bp, Rattus norvegicus
accacccttgtttgtctgctttgga

SEQ ID NO: 82217 - DNA, 25 bp, Rattus norvegicus
accaccgacgtgatacgctttattg

SEQ ID NO: 82218 - DNA, 25 bp, Rattus norvegicus
accaccgacgtgttacgctttattg

SEQ ID NO: 82219 - DNA, 25 bp, Rattus norvegicus
accaccgagatgattctattccgtt

SEQ ID NO: 82220 - DNA, 25 bp, Rattus norvegicus
accaccgagatgtttctattccgtt

SEQ ID NO: 82221 - DNA, 25 bp, Rattus norvegicus
accaccgagggcatgatgtccggct

SEQ ID NO: 82222 - DNA, 25 bp, Rattus norvegicus
accaccgagggcttgatgtccggct

SEQ ID NO: 82223 - DNA, 25 bp, Rattus norvegicus
accaccgatctaattttgaatttat

SEQ ID NO: 82224 - DNA, 25 bp, Rattus norvegicus
accaccgatctatttttgaatttat

SEQ ID NO: 82225 - DNA, 25 bp, Rattus norvegicus
accaccgatgggaagacgcagattt

SEQ ID NO: 82226 - DNA, 25 bp, Rattus norvegicus
accaccgatgggtagacgcagattt

SEQ ID NO: 82227 - DNA, 25 bp, Rattus norvegicus
accaccgcaaacactaacaacaata

SEQ ID NO: 82228 - DNA, 25 bp, Rattus norvegicus
accaccgcaaactctaacaacaata

SEQ ID NO: 82229 - DNA, 25 bp, Rattus norvegicus
accaccggttttccttgtgtgtgaa

SEQ ID NO: 82230 - DNA, 25 bp, Rattus norvegicus
accaccggttttgcttgtgtgtgaa

SEQ ID NO: 82231 - DNA, 25 bp, Rattus norvegicus
accaccgtggtgaggttctaagagc

SEQ ID NO: 82232 - DNA, 25 bp, Rattus norvegicus
accaccgtggtgtggttctaagagc

SEQ ID NO: 82233 - DNA, 25 bp, Rattus norvegicus
accacctaccagatcttcataagag

SEQ ID NO: 82234 - DNA, 25 bp, Rattus norvegicus
accacctaccagttcttcataagag

SEQ ID NO: 82235 - DNA, 25 bp, Rattus norvegicus
accacctactggcaactttggttgg

SEQ ID NO: 82236 - DNA, 25 bp, Rattus norvegicus
accacctactgggaactttggttgg

SEQ ID NO: 82237 - DNA, 25 bp, Rattus norvegicus
accacctcacaacctttttctgtgt

SEQ ID NO: 82238 - DNA, 25 bp, Rattus norvegicus
accacctcacaagctttttctgtgt

SEQ ID NO: 82239 - DNA, 25 bp, Rattus norvegicus
accacctcatgtctagctttctctt

SEQ ID NO: 82240 - DNA, 25 bp, Rattus norvegicus
accacctcatgtgtagctttctctt

SEQ ID NO: 82241 - DNA, 25 bp, Rattus norvegicus
accacctccattaggcaagttgttt

SEQ ID NO: 82242 - DNA, 25 bp, Rattus norvegicus
accacctccatttggcaagttgttt

SEQ ID NO: 82243 - DNA, 25 bp, Rattus norvegicus
accacctcctgcacatgggtttggg

SEQ ID NO: 82244 - DNA, 25 bp, Rattus norvegicus
accacctcctgctcatgggtttggg

SEQ ID NO: 82245 - DNA, 25 bp, Rattus norvegicus
accacctcctttcacttgtgtaatg

SEQ ID NO: 82246 - DNA, 25 bp, Rattus norvegicus
accacctcctttgacttgtgtaatg

SEQ ID NO: 82247 - DNA, 25 bp, Rattus norvegicus
accacctctcaactgatcctgttta

SEQ ID NO: 82248 - DNA, 25 bp, Rattus norvegicus
accacctctcaagtgatcctgttta

SEQ ID NO: 82249 - DNA, 25 bp, Rattus norvegicus
accacctctgcgctagtctttcagt

SEQ ID NO: 82250 - DNA, 25 bp, Rattus norvegicus
accacctctgcggtagtctttcagt

SEQ ID NO: 82251 - DNA, 25 bp, Rattus norvegicus
accacctgatgcacgccgagggcta

SEQ ID NO: 82252 - DNA, 25 bp, Rattus norvegicus
accacctgatgctcgccgagggcta

SEQ ID NO: 82253 - DNA, 25 bp, Rattus norvegicus
accacctgcagcacctgaggattga

SEQ ID NO: 82254 - DNA, 25 bp, Rattus norvegicus
accacctgcagctcctgaggattga

SEQ ID NO: 82255 - DNA, 25 bp, Rattus norvegicus
accacctgcctaaaatcagcaagca

SEQ ID NO: 82256 - DNA, 25 bp, Rattus norvegicus
accacctgcctataatcagcaagca

SEQ ID NO: 82257 - DNA, 25 bp, Rattus norvegicus
accacctgggcaacaagaacatctt

SEQ ID NO: 82258 - DNA, 25 bp, Rattus norvegicus
accacctgggcatcaagaacatctt

SEQ ID NO: 82259 - DNA, 25 bp, Rattus norvegicus
accacctggtctactaatttggaag

SEQ ID NO: 82260 - DNA, 25 bp, Rattus norvegicus
accacctggtcttctaatttggaag

SEQ ID NO: 82261 - DNA, 25 bp, Rattus norvegicus
accacctgtaatatattaagctgcc

SEQ ID NO: 82262 - DNA, 25 bp, Rattus norvegicus
accacctgtaatttattaagctgcc

SEQ ID NO: 82263 - DNA, 25 bp, Rattus norvegicus
accacctgtcacaagtgtcaagtga

SEQ ID NO: 82264 - DNA, 25 bp, Rattus norvegicus
accacctgtcactagtgtcaagtga

SEQ ID NO: 82265 - DNA, 25 bp, Rattus norvegicus
accacctgtcatattcctcaagtat

SEQ ID NO: 82266 - DNA, 25 bp, Rattus norvegicus
accacctgtcattttcctcaagtat

SEQ ID NO: 82267 - DNA, 25 bp, Rattus norvegicus
accacctgtctgattgcagttgact

SEQ ID NO: 82268 - DNA, 25 bp, Rattus norvegicus
accacctgtctgtttgcagttgact

SEQ ID NO: 82269 - DNA, 25 bp, Rattus norvegicus
accacctgtggaaattttccttctg

SEQ ID NO: 82270 - DNA, 25 bp, Rattus norvegicus
accacctgtggatattttccttctg

SEQ ID NO: 82271 - DNA, 25 bp, Rattus norvegicus
accacctgtttcagatagttcctgt

SEQ ID NO: 82272 - DNA, 25 bp, Rattus norvegicus
accacctgtttctgatagttcctgt

SEQ ID NO: 82273 - DNA, 25 bp, Rattus norvegicus
accaccttccatatcagtagcagaa

SEQ ID NO: 82274 - DNA, 25 bp, Rattus norvegicus
accaccttccatttcagtagcagaa

SEQ ID NO: 82275 - DNA, 25 bp, Rattus norvegicus
accaccttgaggactgtgtcgggca

SEQ ID NO: 82276 - DNA, 25 bp, Rattus norvegicus
accaccttgaggtctgtgtcgggca

SEQ ID NO: 82277 - DNA, 25 bp, Rattus norvegicus
accaccttgggcagagtatgaagct

SEQ ID NO: 82278 - DNA, 25 bp, Rattus norvegicus
accaccttgggctgagtatgaagct

SEQ ID NO: 82279 - DNA, 25 bp, Rattus norvegicus
accaccttgtctagacctactgaag

SEQ ID NO: 82280 - DNA, 25 bp, Rattus norvegicus
accaccttgtcttgacctactgaag

SEQ ID NO: 82281 - DNA, 25 bp, Rattus norvegicus
accacctttgaaacaaaggcttctg

SEQ ID NO: 82282 - DNA, 25 bp, Rattus norvegicus
accacctttgaatcaaaggcttctg

SEQ ID NO: 82283 - DNA, 25 bp, Rattus norvegicus
accacctttgttagaatggcctctg

SEQ ID NO: 82284 - DNA, 25 bp, Rattus norvegicus
accacctttgtttgaatggcctctg

SEQ ID NO: 82285 - DNA, 25 bp, Rattus norvegicus
accaccttttggcagtgctctaagt

SEQ ID NO: 82286 - DNA, 25 bp, Rattus norvegicus
accaccttttgggagtgctctaagt

SEQ ID NO: 82287 - DNA, 25 bp, Rattus norvegicus
accacgaaaagacaggcgctgtcct

SEQ ID NO: 82288 - DNA, 25 bp, Rattus norvegicus
accacgaaaagagaggcgctgtcct

SEQ ID NO: 82289 - DNA, 25 bp, Rattus norvegicus
accacgaaactacaacttccataca

SEQ ID NO: 82290 - DNA, 25 bp, Rattus norvegicus
accacgaaactagaacttccataca

SEQ ID NO: 82291 - DNA, 25 bp, Rattus norvegicus
accacgaacccaatagcttcggcat

SEQ ID NO: 82292 - DNA, 25 bp, Rattus norvegicus
accacgaacccattagcttcggcat

SEQ ID NO: 82293 - DNA, 25 bp, Rattus norvegicus
accacgacaagcacaataaaactga

SEQ ID NO: 82294 - DNA, 25 bp, Rattus norvegicus
accacgacaagctcaataaaactga

SEQ ID NO: 82295 - DNA, 25 bp, Rattus norvegicus
accacgagctggaatatgaggccat

SEQ ID NO: 82296 - DNA, 25 bp, Rattus norvegicus
accacgagctggtatatgaggccat

SEQ ID NO: 82297 - DNA, 25 bp, Rattus norvegicus
accacgatggttatctggctacctg

SEQ ID NO: 82298 - DNA, 25 bp, Rattus norvegicus
accacgatggttttctggctacctg

SEQ ID NO: 82299 - DNA, 25 bp, Rattus norvegicus
accacgattgcacttctctttgaga

SEQ ID NO: 82300 - DNA, 25 bp, Rattus norvegicus
accacgattgcagttctctttgaga

SEQ ID NO: 82301 - DNA, 25 bp, Rattus norvegicus
accacgcaacacactgactcggttt

SEQ ID NO: 82302 - DNA, 25 bp, Rattus norvegicus
accacgcaacactctgactcggttt

SEQ ID NO: 82303 - DNA, 25 bp, Rattus norvegicus
accacgcaagcacagaggttctcca

SEQ ID NO: 82304 - DNA, 25 bp, Rattus norvegicus
accacgcaagcagagaggttctcca

SEQ ID NO: 82305 - DNA, 25 bp, Rattus norvegicus
accacgcacttgatggcctgcatgg

SEQ ID NO: 82306 - DNA, 25 bp, Rattus norvegicus
accacgcacttgttggcctgcatgg

SEQ ID NO: 82307 - DNA, 25 bp, Rattus norvegicus
accacgcatgtcctacgtcgtaatt

SEQ ID NO: 82308 - DNA, 25 bp, Rattus norvegicus
accacgcatgtcgtacgtcgtaatt

SEQ ID NO: 82309 - DNA, 25 bp, Rattus norvegicus
accacgcggcagagtcaataattca

SEQ ID NO: 82310 - DNA, 25 bp, Rattus norvegicus
accacgcggcagtgtcaataattca

SEQ ID NO: 82311 - DNA, 25 bp, Rattus norvegicus
accacgctctcaacgatatgacttc

SEQ ID NO: 82312 - DNA, 25 bp, Rattus norvegicus
accacgctctcatcgatatgacttc

SEQ ID NO: 82313 - DNA, 25 bp, Rattus norvegicus
accacggacccacgcactagaggaa

SEQ ID NO: 82314 - DNA, 25 bp, Rattus norvegicus
accacggacccaggcactagaggaa

SEQ ID NO: 82315 - DNA, 25 bp, Rattus norvegicus
accacggacccgcaactggttgctg

SEQ ID NO: 82316 - DNA, 25 bp, Rattus norvegicus
accacggacccggaactggttgctg

SEQ ID NO: 82317 - DNA, 25 bp, Rattus norvegicus
accacggcagccagggcctcaggga

SEQ ID NO: 82318 - DNA, 25 bp, Rattus norvegicus
accacggcagcctgggcctcaggga

SEQ ID NO: 82319 - DNA, 25 bp, Rattus norvegicus
accacggctgatatgtgtactctat

SEQ ID NO: 82320 - DNA, 25 bp, Rattus norvegicus
accacggctgatttgtgtactctat

SEQ ID NO: 82321 - DNA, 25 bp, Rattus norvegicus
accacgggttctcactggcttggtg

SEQ ID NO: 82322 - DNA, 25 bp, Rattus norvegicus
accacgggttctgactggcttggtg

SEQ ID NO: 82323 - DNA, 25 bp, Rattus norvegicus
accacggtgctcctgggcccaggaa

SEQ ID NO: 82324 - DNA, 25 bp, Rattus norvegicus
accacggtgctcgtgggcccaggaa

SEQ ID NO: 82325 - DNA, 25 bp, Rattus norvegicus
accacgtaggtgattgtcgctgatc

SEQ ID NO: 82326 - DNA, 25 bp, Rattus norvegicus
accacgtaggtgtttgtcgctgatc

SEQ ID NO: 82327 - DNA, 25 bp, Rattus norvegicus
accacgtccaggactatctgctggg

SEQ ID NO: 82328 - DNA, 25 bp, Rattus norvegicus
accacgtccaggtctatctgctggg

SEQ ID NO: 82329 - DNA, 25 bp, Rattus norvegicus
accacgtcttcacgtcttcgttcag

SEQ ID NO: 82330 - DNA, 25 bp, Rattus norvegicus
accacgtcttcaggtcttcgttcag

SEQ ID NO: 82331 - DNA, 25 bp, Rattus norvegicus
accacgtcttggagtcgtccagcag

SEQ ID NO: 82332 - DNA, 25 bp, Rattus norvegicus
accacgtcttggtgtcgtccagcag

SEQ ID NO: 82333 - DNA, 25 bp, Rattus norvegicus
accacgtgagctccatcattaaagg

SEQ ID NO: 82334 - DNA, 25 bp, Rattus norvegicus
accacgtgagctgcatcattaaagg

SEQ ID NO: 82335 - DNA, 25 bp, Rattus norvegicus
accacgtggcagagcctgcggaaaa

SEQ ID NO: 82336 - DNA, 25 bp, Rattus norvegicus
accacgtggcagtgcctgcggaaaa

SEQ ID NO: 82337 - DNA, 25 bp, Rattus norvegicus
accacgtggcgtccaaggatcggat

SEQ ID NO: 82338 - DNA, 25 bp, Rattus norvegicus
accacgtggcgtgcaaggatcggat

SEQ ID NO: 82339 - DNA, 25 bp, Rattus norvegicus
accacgtgtgttagtcagtcatgct

SEQ ID NO: 82340 - DNA, 25 bp, Rattus norvegicus
accacgtgtgtttgtcagtcatgct

SEQ ID NO: 82341 - DNA, 25 bp, Rattus norvegicus
accacgttcactcaggacagacaga

SEQ ID NO: 82342 - DNA, 25 bp, Rattus norvegicus
accacgttcactgaggacagacaga

SEQ ID NO: 82343 - DNA, 25 bp, Rattus norvegicus
accacgttgcacaccagtttgtaac

SEQ ID NO: 82344 - DNA, 25 bp, Rattus norvegicus
accacgttgcactccagtttgtaac

SEQ ID NO: 82345 - DNA, 25 bp, Rattus norvegicus
accacgttgtgaacccagggatcta

SEQ ID NO: 82346 - DNA, 25 bp, Rattus norvegicus
accacgttgtgatcccagggatcta

SEQ ID NO: 82347 - DNA, 25 bp, Rattus norvegicus
accacgttgttcactgtaagcacct

SEQ ID NO: 82348 - DNA, 25 bp, Rattus norvegicus
accacgttgttctctgtaagcacct

SEQ ID NO: 82349 - DNA, 25 bp, Rattus norvegicus
accactacaatgctgtagccctgtt

SEQ ID NO: 82350 - DNA, 25 bp, Rattus norvegicus
accactacaatggtgtagccctgtt

SEQ ID NO: 82351 - DNA, 25 bp, Rattus norvegicus
accactacacacacacctggattag

SEQ ID NO: 82352 - DNA, 25 bp, Rattus norvegicus
accactacacactcacctggattag

SEQ ID NO: 82353 - DNA, 25 bp, Rattus norvegicus
accactacagtgctcattcctggaa

SEQ ID NO: 82354 - DNA, 25 bp, Rattus norvegicus
accactacagtggtcattcctggaa

SEQ ID NO: 82355 - DNA, 25 bp, Rattus norvegicus
accactaccataccgcattaacgat

SEQ ID NO: 82356 - DNA, 25 bp, Rattus norvegicus
accactaccatagcgcattaacgat

SEQ ID NO: 82357 - DNA, 25 bp, Rattus norvegicus
accactacggcgctgacaggctggc

SEQ ID NO: 82358 - DNA, 25 bp, Rattus norvegicus
accactacggcggtgacaggctggc

SEQ ID NO: 82359 - DNA, 25 bp, Rattus norvegicus
accactagacccagtcatggacaga

SEQ ID NO: 82360 - DNA, 25 bp, Rattus norvegicus
accactagaccctgtcatggacaga

SEQ ID NO: 82361 - DNA, 25 bp, Rattus norvegicus
accactagagatatttatgatgcga

SEQ ID NO: 82362 - DNA, 25 bp, Rattus norvegicus
accactagagatttttatgatgcga

SEQ ID NO: 82363 - DNA, 25 bp, Rattus norvegicus
accactagtggacttcttgatgcag

SEQ ID NO: 82364 - DNA, 25 bp, Rattus norvegicus
accactagtggagttcttgatgcag

SEQ ID NO: 82365 - DNA, 25 bp, Rattus norvegicus
accactatatccatctttgtctgat

SEQ ID NO: 82366 - DNA, 25 bp, Rattus norvegicus
accactatatccttctttgtctgat

SEQ ID NO: 82367 - DNA, 25 bp, Rattus norvegicus
accactatttatagctgctctcggg

SEQ ID NO: 82368 - DNA, 25 bp, Rattus norvegicus
accactatttattgctgctctcggg

SEQ ID NO: 82369 - DNA, 25 bp, Rattus norvegicus
accactcaaactccatatttacaca

SEQ ID NO: 82370 - DNA, 25 bp, Rattus norvegicus
accactcaaactgcatatttacaca

SEQ ID NO: 82371 - DNA, 25 bp, Rattus norvegicus
accactcagcgaataggcggctctt

SEQ ID NO: 82372 - DNA, 25 bp, Rattus norvegicus
accactcagcgattaggcggctctt

SEQ ID NO: 82373 - DNA, 25 bp, Rattus norvegicus
accactcagctaatggctctttaag

SEQ ID NO: 82374 - DNA, 25 bp, Rattus norvegicus
accactcagctattggctctttaag

SEQ ID NO: 82375 - DNA, 25 bp, Rattus norvegicus
accactccaaagctctgtcaggatg

SEQ ID NO: 82376 - DNA, 25 bp, Rattus norvegicus
accactccaaaggtctgtcaggatg

SEQ ID NO: 82377 - DNA, 25 bp, Rattus norvegicus
accactccagcgagatggcagcaat

SEQ ID NO: 82378 - DNA, 25 bp, Rattus norvegicus
accactccagcgtgatggcagcaat

SEQ ID NO: 82379 - DNA, 25 bp, Rattus norvegicus
accactccgtggagaagctgcacaa

SEQ ID NO: 82380 - DNA, 25 bp, Rattus norvegicus
accactccgtggtgaagctgcacaa

SEQ ID NO: 82381 - DNA, 25 bp, Rattus norvegicus
accactcctaagcatattgtcacag

SEQ ID NO: 82382 - DNA, 25 bp, Rattus norvegicus
accactcctaaggatattgtcacag

SEQ ID NO: 82383 - DNA, 25 bp, Rattus norvegicus
accactcctacaagttgtcctgtaa

SEQ ID NO: 82384 - DNA, 25 bp, Rattus norvegicus
accactcctacatgttgtcctgtaa

SEQ ID NO: 82385 - DNA, 25 bp, Rattus norvegicus
accactcgacgtctaagctaaacaa

SEQ ID NO: 82386 - DNA, 25 bp, Rattus norvegicus
accactcgacgtgtaagctaaacaa

SEQ ID NO: 82387 - DNA, 25 bp, Rattus norvegicus
accactcggcagatttgtctttaga

SEQ ID NO: 82388 - DNA, 25 bp, Rattus norvegicus
accactcggcagttttgtctttaga

SEQ ID NO: 82389 - DNA, 25 bp, Rattus norvegicus
accactctcaccagaaatgctctga

SEQ ID NO: 82390 - DNA, 25 bp, Rattus norvegicus
accactctcacctgaaatgctctga

SEQ ID NO: 82391 - DNA, 25 bp, Rattus norvegicus
accactcttcataaaaaaggtcttg

SEQ ID NO: 82392 - DNA, 25 bp, Rattus norvegicus
accactcttcattaaaaaggtcttg

SEQ ID NO: 82393 - DNA, 25 bp, Rattus norvegicus
accactcttccaagatcgtttacag

SEQ ID NO: 82394 - DNA, 25 bp, Rattus norvegicus
accactcttccatgatcgtttacag

SEQ ID NO: 82395 - DNA, 25 bp, Rattus norvegicus
accactcttcttcctatattgactt

SEQ ID NO: 82396 - DNA, 25 bp, Rattus norvegicus
accactcttcttgctatattgactt

SEQ ID NO: 82397 - DNA, 25 bp, Rattus norvegicus
accactgacaaccagctcagctgtt

SEQ ID NO: 82398 - DNA, 25 bp, Rattus norvegicus
accactgacaacgagctcagctgtt

SEQ ID NO: 82399 - DNA, 25 bp, Rattus norvegicus
accactgacaatagcctaggaaaac

SEQ ID NO: 82400 - DNA, 25 bp, Rattus norvegicus
accactgacaattgcctaggaaaac

SEQ ID NO: 82401 - DNA, 25 bp, Rattus norvegicus
accactgacacaactctgagggctt

SEQ ID NO: 82402 - DNA, 25 bp, Rattus norvegicus
accactgacacatctctgagggctt

SEQ ID NO: 82403 - DNA, 25 bp, Rattus norvegicus
accactgactctaattcctgattaa

SEQ ID NO: 82404 - DNA, 25 bp, Rattus norvegicus
accactgactcttattcctgattaa

SEQ ID NO: 82405 - DNA, 25 bp, Rattus norvegicus
accactgatggtctactactactca

SEQ ID NO: 82406 - DNA, 25 bp, Rattus norvegicus
accactgatggtgtactactactca

SEQ ID NO: 82407 - DNA, 25 bp, Rattus norvegicus
accactgattcaaattccattcatg

SEQ ID NO: 82408 - DNA, 25 bp, Rattus norvegicus
accactgattcatattccattcatg

SEQ ID NO: 82409 - DNA, 25 bp, Rattus norvegicus
accactgcacttaaaccagggtctt

SEQ ID NO: 82410 - DNA, 25 bp, Rattus norvegicus
accactgcactttaaccagggtctt

SEQ ID NO: 82411 - DNA, 25 bp, Rattus norvegicus
accactgcagctccagaagggttgt

SEQ ID NO: 82412 - DNA, 25 bp, Rattus norvegicus
accactgcagctgcagaagggttgt

SEQ ID NO: 82413 - DNA, 25 bp, Rattus norvegicus
accactgcccgacttgttgtgaaga

SEQ ID NO: 82414 - DNA, 25 bp, Rattus norvegicus
accactgcccgagttgttgtgaaga

SEQ ID NO: 82415 - DNA, 25 bp, Rattus norvegicus
accactgcctggatcaaggttctta

SEQ ID NO: 82416 - DNA, 25 bp, Rattus norvegicus
accactgcctggcaaagccttgaag

SEQ ID NO: 82417 - DNA, 25 bp, Rattus norvegicus
accactgcctgggaaagccttgaag

SEQ ID NO: 82418 - DNA, 25 bp, Rattus norvegicus
accactgcctggttcaaggttctta

SEQ ID NO: 82419 - DNA, 25 bp, Rattus norvegicus
accactgcgggcagatggctggcta

SEQ ID NO: 82420 - DNA, 25 bp, Rattus norvegicus
accactgcgggctgatggctggcta

SEQ ID NO: 82421 - DNA, 25 bp, Rattus norvegicus
accactgcgtgtcagcctggaaata

SEQ ID NO: 82422 - DNA, 25 bp, Rattus norvegicus
accactgcgtgtgagcctggaaata

SEQ ID NO: 82423 - DNA, 25 bp, Rattus norvegicus
accactgctcacagctttaattagc

SEQ ID NO: 82424 - DNA, 25 bp, Rattus norvegicus
accactgctcactgctttaattagc

SEQ ID NO: 82425 - DNA, 25 bp, Rattus norvegicus
accactgctgtgaactgaggacatt

SEQ ID NO: 82426 - DNA, 25 bp, Rattus norvegicus
accactgctgtgtactgaggacatt

SEQ ID NO: 82427 - DNA, 25 bp, Rattus norvegicus
accactggacttatctcttctgtaa

SEQ ID NO: 82428 - DNA, 25 bp, Rattus norvegicus
accactggacttttctcttctgtaa

SEQ ID NO: 82429 - DNA, 25 bp, Rattus norvegicus
accactggagagaccaagggtgcgg

SEQ ID NO: 82430 - DNA, 25 bp, Rattus norvegicus
accactggagagtccaagggtgcgg

SEQ ID NO: 82431 - DNA, 25 bp, Rattus norvegicus
accactggagcacctgcagaggaca

SEQ ID NO: 82432 - DNA, 25 bp, Rattus norvegicus
accactggagcagctgcagaggaca

SEQ ID NO: 82433 - DNA, 25 bp, Rattus norvegicus
accactggccagcacaaggcggaac

SEQ ID NO: 82434 - DNA, 25 bp, Rattus norvegicus
accactggccaggacaaggcggaac

SEQ ID NO: 82435 - DNA, 25 bp, Rattus norvegicus
accactggctatcagatgtccttca

SEQ ID NO: 82436 - DNA, 25 bp, Rattus norvegicus
accactggctatgagatgtccttca

SEQ ID NO: 82437 - DNA, 25 bp, Rattus norvegicus
accactggctggctgtctgtgtttt

SEQ ID NO: 82438 - DNA, 25 bp, Rattus norvegicus
accactggctgggtgtctgtgtttt

SEQ ID NO: 82439 - DNA, 25 bp, Rattus norvegicus
accactggctgtatgtacattgaga

SEQ ID NO: 82440 - DNA, 25 bp, Rattus norvegicus
accactggctgtttgtacattgaga

SEQ ID NO: 82441 - DNA, 25 bp, Rattus norvegicus
accactgggacacagctgggtctca

SEQ ID NO: 82442 - DNA, 25 bp, Rattus norvegicus
accactgggacagagctgggtctca

SEQ ID NO: 82443 - DNA, 25 bp, Rattus norvegicus
accactgggagtcttgttcatcaca

SEQ ID NO: 82444 - DNA, 25 bp, Rattus norvegicus
accactgggagtgttgttcatcaca

SEQ ID NO: 82445 - DNA, 25 bp, Rattus norvegicus
accactggtagtctcctgaagcaag

SEQ ID NO: 82446 - DNA, 25 bp, Rattus norvegicus
accactggtagtgtcctgaagcaag

SEQ ID NO: 82447 - DNA, 25 bp, Rattus norvegicus
accactggtgccctggagtgctcca

SEQ ID NO: 82448 - DNA, 25 bp, Rattus norvegicus
accactggtgccgtggagtgctcca

SEQ ID NO: 82449 - DNA, 25 bp, Rattus norvegicus
accactgtatttacaggccttatcc

SEQ ID NO: 82450 - DNA, 25 bp, Rattus norvegicus
accactgtattttcaggccttatcc

SEQ ID NO: 82451 - DNA, 25 bp, Rattus norvegicus
accactgtcacgaagccatagaaat

SEQ ID NO: 82452 - DNA, 25 bp, Rattus norvegicus
accactgtcacgtagccatagaaat

SEQ ID NO: 82453 - DNA, 25 bp, Rattus norvegicus
accactgtcagcagaccgaagcggt

SEQ ID NO: 82454 - DNA, 25 bp, Rattus norvegicus
accactgtcagctgaccgaagcggt

SEQ ID NO: 82455 - DNA, 25 bp, Rattus norvegicus
accactgtcatacccaggtgctaat

SEQ ID NO: 82456 - DNA, 25 bp, Rattus norvegicus
accactgtcatagccaggtgctaat

SEQ ID NO: 82457 - DNA, 25 bp, Rattus norvegicus
accactgtccagaacacttgatcta

SEQ ID NO: 82458 - DNA, 25 bp, Rattus norvegicus
accactgtccagtacacttgatcta

SEQ ID NO: 82459 - DNA, 25 bp, Rattus norvegicus
accactgtccttcaagccaatgata

SEQ ID NO: 82460 - DNA, 25 bp, Rattus norvegicus
accactgtccttgaagccaatgata

SEQ ID NO: 82461 - DNA, 25 bp, Rattus norvegicus
accactgtgcctctcgtattcgaag

SEQ ID NO: 82462 - DNA, 25 bp, Rattus norvegicus
accactgtgcctgtcgtattcgaag

SEQ ID NO: 82463 - DNA, 25 bp, Rattus norvegicus
accactgtggtgaaattacaagcac

SEQ ID NO: 82464 - DNA, 25 bp, Rattus norvegicus
accactgtggtgtaattacaagcac

SEQ ID NO: 82465 - DNA, 25 bp, Rattus norvegicus
accactgtggttcgcattagggaaa

SEQ ID NO: 82466 - DNA, 25 bp, Rattus norvegicus
accactgtggttggcattagggaaa

SEQ ID NO: 82467 - DNA, 25 bp, Rattus norvegicus
accactgtgtgtaacttctttaaag

SEQ ID NO: 82468 - DNA, 25 bp, Rattus norvegicus
accactgtgtgttacttctttaaag

SEQ ID NO: 82469 - DNA, 25 bp, Rattus norvegicus
accactgttcagagcagctctgctt

SEQ ID NO: 82470 - DNA, 25 bp, Rattus norvegicus
accactgttcagtgcagctctgctt

SEQ ID NO: 82471 - DNA, 25 bp, Rattus norvegicus
accactgttcgaaccacggagatta

SEQ ID NO: 82472 - DNA, 25 bp, Rattus norvegicus
accactgttcgatccacggagatta

SEQ ID NO: 82473 - DNA, 25 bp, Rattus norvegicus
accactgttgtgacaggtgcttcaa

SEQ ID NO: 82474 - DNA, 25 bp, Rattus norvegicus
accactgttgtgtcaggtgcttcaa

SEQ ID NO: 82475 - DNA, 25 bp, Rattus norvegicus
accacttacactatgggtagcagga

SEQ ID NO: 82476 - DNA, 25 bp, Rattus norvegicus
accacttacactttgggtagcagga

SEQ ID NO: 82477 - DNA, 25 bp, Rattus norvegicus
accacttagagccaacgacatttga

SEQ ID NO: 82478 - DNA, 25 bp, Rattus norvegicus
accacttagagcgaacgacatttga

SEQ ID NO: 82479 - DNA, 25 bp, Rattus norvegicus
accacttatgtcacgattactccag

SEQ ID NO: 82480 - DNA, 25 bp, Rattus norvegicus
accacttatgtctcgattactccag

SEQ ID NO: 82481 - DNA, 25 bp, Rattus norvegicus
accacttcaattatcatgagtctca

SEQ ID NO: 82482 - DNA, 25 bp, Rattus norvegicus
accacttcaattttcatgagtctca

SEQ ID NO: 82483 - DNA, 25 bp, Rattus norvegicus
accacttcacctcttatttctattg

SEQ ID NO: 82484 - DNA, 25 bp, Rattus norvegicus
accacttcacctgttatttctattg

SEQ ID NO: 82485 - DNA, 25 bp, Rattus norvegicus
accacttcagttacactcacaagct

SEQ ID NO: 82486 - DNA, 25 bp, Rattus norvegicus
accacttcagtttcactcacaagct

SEQ ID NO: 82487 - DNA, 25 bp, Rattus norvegicus
accacttccccgaaattgatctgaa

SEQ ID NO: 82488 - DNA, 25 bp, Rattus norvegicus
accacttccccgtaattgatctgaa

SEQ ID NO: 82489 - DNA, 25 bp, Rattus norvegicus
accacttcccttctcatagtacata

SEQ ID NO: 82490 - DNA, 25 bp, Rattus norvegicus
accacttcccttgtcatagtacata

SEQ ID NO: 82491 - DNA, 25 bp, Rattus norvegicus
accacttcctgtattgtcatttctt

SEQ ID NO: 82492 - DNA, 25 bp, Rattus norvegicus
accacttcctgtcagaggtccgaaa

SEQ ID NO: 82493 - DNA, 25 bp, Rattus norvegicus
accacttcctgtgagaggtccgaaa

SEQ ID NO: 82494 - DNA, 25 bp, Rattus norvegicus
accacttcctgttttgtcatttctt

SEQ ID NO: 82495 - DNA, 25 bp, Rattus norvegicus
accacttcttttcttgccagtctaa

SEQ ID NO: 82496 - DNA, 25 bp, Rattus norvegicus
accacttcttttgttgccagtctaa

SEQ ID NO: 82497 - DNA, 25 bp, Rattus norvegicus
accacttgagaaatcatgagcactt

SEQ ID NO: 82498 - DNA, 25 bp, Rattus norvegicus
accacttgagaattcatgagcactt

SEQ ID NO: 82499 - DNA, 25 bp, Rattus norvegicus
accacttgatttagtgattccaatt

SEQ ID NO: 82500 - DNA, 25 bp, Rattus norvegicus
accacttgattttgtgattccaatt

SEQ ID NO: 82501 - DNA, 25 bp, Rattus norvegicus
accacttgcagcctgtttgtaactt

SEQ ID NO: 82502 - DNA, 25 bp, Rattus norvegicus
accacttgcagcgtgtttgtaactt

SEQ ID NO: 82503 - DNA, 25 bp, Rattus norvegicus
accacttggacgaagctgtattgta

SEQ ID NO: 82504 - DNA, 25 bp, Rattus norvegicus
accacttggacgtagctgtattgta

SEQ ID NO: 82505 - DNA, 25 bp, Rattus norvegicus
accacttggtggacatttcatgtat

SEQ ID NO: 82506 - DNA, 25 bp, Rattus norvegicus
accacttggtggtcatttcatgtat

SEQ ID NO: 82507 - DNA, 25 bp, Rattus norvegicus
accactttattcattattctctgta

SEQ ID NO: 82508 - DNA, 25 bp, Rattus norvegicus
accactttattctttattctctgta

SEQ ID NO: 82509 - DNA, 25 bp, Rattus norvegicus
accactttattgacataccttccct

SEQ ID NO: 82510 - DNA, 25 bp, Rattus norvegicus
accactttattgatgagaggccatc

SEQ ID NO: 82511 - DNA, 25 bp, Rattus norvegicus
accactttattgtcataccttccct

SEQ ID NO: 82512 - DNA, 25 bp, Rattus norvegicus
accactttattgttgagaggccatc

SEQ ID NO: 82513 - DNA, 25 bp, Rattus norvegicus
accactttgttgacggcacggcggg

SEQ ID NO: 82514 - DNA, 25 bp, Rattus norvegicus
accactttgttgtcggcacggcggg

SEQ ID NO: 82515 - DNA, 25 bp, Rattus norvegicus
accacttttagtcttgggcagttgc

SEQ ID NO: 82516 - DNA, 25 bp, Rattus norvegicus
accacttttagtgttgggcagttgc

SEQ ID NO: 82517 - DNA, 25 bp, Rattus norvegicus
accagaaatatacagtgacacacag

SEQ ID NO: 82518 - DNA, 25 bp, Rattus norvegicus
accagaaatatagagtgacacacag

SEQ ID NO: 82519 - DNA, 25 bp, Rattus norvegicus
accagaaatcgactgagctgctcat

SEQ ID NO: 82520 - DNA, 25 bp, Rattus norvegicus
accagaaatcgagtgagctgctcat

SEQ ID NO: 82521 - DNA, 25 bp, Rattus norvegicus
accagaaatctgctggtttatttcc

SEQ ID NO: 82522 - DNA, 25 bp, Rattus norvegicus
accagaaatctggtggtttatttcc

SEQ ID NO: 82523 - DNA, 25 bp, Rattus norvegicus
accagaaatttccatttcagttgag

SEQ ID NO: 82524 - DNA, 25 bp, Rattus norvegicus
accagaaatttcgatttcagttgag

SEQ ID NO: 82525 - DNA, 25 bp, Rattus norvegicus
accagaacagcaagatctagatttt

SEQ ID NO: 82526 - DNA, 25 bp, Rattus norvegicus
accagaacagcatgatctagatttt

SEQ ID NO: 82527 - DNA, 25 bp, Rattus norvegicus
accagaacccaacaagattccaata

SEQ ID NO: 82528 - DNA, 25 bp, Rattus norvegicus
accagaacccaagaagattccaata

SEQ ID NO: 82529 - DNA, 25 bp, Rattus norvegicus
accagaactcggaggcaagcgctat

SEQ ID NO: 82530 - DNA, 25 bp, Rattus norvegicus
accagaactcggtggcaagcgctat

SEQ ID NO: 82531 - DNA, 25 bp, Rattus norvegicus
accagaagaaggagtcagatctcat

SEQ ID NO: 82532 - DNA, 25 bp, Rattus norvegicus
accagaagaaggtgtcagatctcat

SEQ ID NO: 82533 - DNA, 25 bp, Rattus norvegicus
accagaagtcgtattgctgccctga

SEQ ID NO: 82534 - DNA, 25 bp, Rattus norvegicus
accagaagtcgttttgctgccctga

SEQ ID NO: 82535 - DNA, 25 bp, Rattus norvegicus
accagaagtgtgacgttcgtctcaa

SEQ ID NO: 82536 - DNA, 25 bp, Rattus norvegicus
accagaagtgtgtcgttcgtctcaa

SEQ ID NO: 82537 - DNA, 25 bp, Rattus norvegicus
accagaagttctaggctgtgcctct

SEQ ID NO: 82538 - DNA, 25 bp, Rattus norvegicus
accagaagttcttggctgtgcctct

SEQ ID NO: 82539 - DNA, 25 bp, Rattus norvegicus
accagaatctgtcttcctgtatatt

SEQ ID NO: 82540 - DNA, 25 bp, Rattus norvegicus
accagaatctgtgttcctgtatatt

SEQ ID NO: 82541 - DNA, 25 bp, Rattus norvegicus
accagaatggttagtttagaagact

SEQ ID NO: 82542 - DNA, 25 bp, Rattus norvegicus
accagaatggtttgtttagaagact

SEQ ID NO: 82543 - DNA, 25 bp, Rattus norvegicus
accagaatgtggaatttatgtacaa

SEQ ID NO: 82544 - DNA, 25 bp, Rattus norvegicus
accagaatgtggtatttatgtacaa

SEQ ID NO: 82545 - DNA, 25 bp, Rattus norvegicus
accagaattggcagcactctacaaa

SEQ ID NO: 82546 - DNA, 25 bp, Rattus norvegicus
accagaattggctgcactctacaaa

SEQ ID NO: 82547 - DNA, 25 bp, Rattus norvegicus
accagacaaggtaacctaggccaag

SEQ ID NO: 82548 - DNA, 25 bp, Rattus norvegicus
accagacaaggttacctaggccaag

SEQ ID NO: 82549 - DNA, 25 bp, Rattus norvegicus
accagacactatcgtcggatcccat

SEQ ID NO: 82550 - DNA, 25 bp, Rattus norvegicus
accagacactatggtcggatcccat

SEQ ID NO: 82551 - DNA, 25 bp, Rattus norvegicus
accagacactctcaacatacaggga

SEQ ID NO: 82552 - DNA, 25 bp, Rattus norvegicus
accagacactctgaacatacaggga

SEQ ID NO: 82553 - DNA, 25 bp, Rattus norvegicus
accagacagaggctgctcatgccaa

SEQ ID NO: 82554 - DNA, 25 bp, Rattus norvegicus
accagacagagggtgctcatgccaa

SEQ ID NO: 82555 - DNA, 25 bp, Rattus norvegicus
accagacagcagaagtagctctgtt

SEQ ID NO: 82556 - DNA, 25 bp, Rattus norvegicus
accagacagcagtagtagctctgtt

SEQ ID NO: 82557 - DNA, 25 bp, Rattus norvegicus
accagacaggatcggcagcctgcac

SEQ ID NO: 82558 - DNA, 25 bp, Rattus norvegicus
accagacaggatgggcagcctgcac

SEQ ID NO: 82559 - DNA, 25 bp, Rattus norvegicus
accagacaggcgctcatattcagta

SEQ ID NO: 82560 - DNA, 25 bp, Rattus norvegicus
accagacaggcggtcatattcagta

SEQ ID NO: 82561 - DNA, 25 bp, Rattus norvegicus
accagacatccacaccttgaaaata

SEQ ID NO: 82562 - DNA, 25 bp, Rattus norvegicus
accagacatccagaccttgaaaata

SEQ ID NO: 82563 - DNA, 25 bp, Rattus norvegicus
accagacattcactcaaggcactta

SEQ ID NO: 82564 - DNA, 25 bp, Rattus norvegicus
accagacattcagtcaaggcactta

SEQ ID NO: 82565 - DNA, 25 bp, Rattus norvegicus
accagaccactgaggagagcctgct

SEQ ID NO: 82566 - DNA, 25 bp, Rattus norvegicus
accagaccactgtggagagcctgct

SEQ ID NO: 82567 - DNA, 25 bp, Rattus norvegicus
accagaccattccgcttcaaggcag

SEQ ID NO: 82568 - DNA, 25 bp, Rattus norvegicus
accagaccattcggcttcaaggcag

SEQ ID NO: 82569 - DNA, 25 bp, Rattus norvegicus
accagaccggcaaccaaggtaacgg

SEQ ID NO: 82570 - DNA, 25 bp, Rattus norvegicus
accagaccggcatccaaggtaacgg

SEQ ID NO: 82571 - DNA, 25 bp, Rattus norvegicus
accagacctgtcagacttctttggg

SEQ ID NO: 82572 - DNA, 25 bp, Rattus norvegicus
accagacctgtctgacttctttggg

SEQ ID NO: 82573 - DNA, 25 bp, Rattus norvegicus
accagaccttctccttgggataagt

SEQ ID NO: 82574 - DNA, 25 bp, Rattus norvegicus
accagaccttctgcttgggataagt

SEQ ID NO: 82575 - DNA, 25 bp, Rattus norvegicus
accagacctttcacttcctgaagtg

SEQ ID NO: 82576 - DNA, 25 bp, Rattus norvegicus
accagacctttctcttcctgaagtg

SEQ ID NO: 82577 - DNA, 25 bp, Rattus norvegicus
accagacgacctagggctgttgctg

SEQ ID NO: 82578 - DNA, 25 bp, Rattus norvegicus
accagacgaccttgggctgttgctg

SEQ ID NO: 82579 - DNA, 25 bp, Rattus norvegicus
accagactagggatcgcacggagct

SEQ ID NO: 82580 - DNA, 25 bp, Rattus norvegicus
accagactagggttcgcacggagct

SEQ ID NO: 82581 - DNA, 25 bp, Rattus norvegicus
accagactatcccactcaataaaat

SEQ ID NO: 82582 - DNA, 25 bp, Rattus norvegicus
accagactatccgactcaataaaat

SEQ ID NO: 82583 - DNA, 25 bp, Rattus norvegicus
accagactcattaatttaattctat

SEQ ID NO: 82584 - DNA, 25 bp, Rattus norvegicus
accagactcatttatttaattctat

SEQ ID NO: 82585 - DNA, 25 bp, Rattus norvegicus
accagactccgtaatcgacgtcagt

SEQ ID NO: 82586 - DNA, 25 bp, Rattus norvegicus
accagactccgttatcgacgtcagt

SEQ ID NO: 82587 - DNA, 25 bp, Rattus norvegicus
accagactcgctcggaacttacgtt

SEQ ID NO: 82588 - DNA, 25 bp, Rattus norvegicus
accagactcgctgggaacttacgtt

SEQ ID NO: 82589 - DNA, 25 bp, Rattus norvegicus
accagactgatgatccctggtattc

SEQ ID NO: 82590 - DNA, 25 bp, Rattus norvegicus
accagactgatgttccctggtattc

SEQ ID NO: 82591 - DNA, 25 bp, Rattus norvegicus
accagactggccaactgcgtattga

SEQ ID NO: 82592 - DNA, 25 bp, Rattus norvegicus
accagactggcctactgcgtattga

SEQ ID NO: 82593 - DNA, 25 bp, Rattus norvegicus
accagacttcccatgtgtactttgg

SEQ ID NO: 82594 - DNA, 25 bp, Rattus norvegicus
accagacttcccttgtgtactttgg

SEQ ID NO: 82595 - DNA, 25 bp, Rattus norvegicus
accagagagatcattgctcgccaac

SEQ ID NO: 82596 - DNA, 25 bp, Rattus norvegicus
accagagagatctttgctcgccaac

SEQ ID NO: 82597 - DNA, 25 bp, Rattus norvegicus
accagagagcaaacaagtaggcaat

SEQ ID NO: 82598 - DNA, 25 bp, Rattus norvegicus
accagagagcaatcaagtaggcaat

SEQ ID NO: 82599 - DNA, 25 bp, Rattus norvegicus
accagagcatgacttgtgggcagca

SEQ ID NO: 82600 - DNA, 25 bp, Rattus norvegicus
accagagcatgagttgtgggcagca

SEQ ID NO: 82601 - DNA, 25 bp, Rattus norvegicus
accagagccatcaaaagtatataga

SEQ ID NO: 82602 - DNA, 25 bp, Rattus norvegicus
accagagccatctaaagtatataga

SEQ ID NO: 82603 - DNA, 25 bp, Rattus norvegicus
accagagcgctaaggccatgtgctg

SEQ ID NO: 82604 - DNA, 25 bp, Rattus norvegicus
accagagcgctatggccatgtgctg

SEQ ID NO: 82605 - DNA, 25 bp, Rattus norvegicus
accagagcttgcaggctggaggcca

SEQ ID NO: 82606 - DNA, 25 bp, Rattus norvegicus
accagagcttgctggctggaggcca

SEQ ID NO: 82607 - DNA, 25 bp, Rattus norvegicus
accagaggacttagtgtttcccttg

SEQ ID NO: 82608 - DNA, 25 bp, Rattus norvegicus
accagaggactttgtgtttcccttg

SEQ ID NO: 82609 - DNA, 25 bp, Rattus norvegicus
accagaggcaatcgcactgtgtagc

SEQ ID NO: 82610 - DNA, 25 bp, Rattus norvegicus
accagaggcaatggcactgtgtagc

SEQ ID NO: 82611 - DNA, 25 bp, Rattus norvegicus
accagaggcggtcgctcataccttt

SEQ ID NO: 82612 - DNA, 25 bp, Rattus norvegicus
accagaggcggtggctcataccttt

SEQ ID NO: 82613 - DNA, 25 bp, Rattus norvegicus
accagagtacaaaattttcccgtga

SEQ ID NO: 82614 - DNA, 25 bp, Rattus norvegicus
accagagtacaatattttcccgtga

SEQ ID NO: 82615 - DNA, 25 bp, Rattus norvegicus
accagagtaggaatcgacccataca

SEQ ID NO: 82616 - DNA, 25 bp, Rattus norvegicus
accagagtaggattcgacccataca

SEQ ID NO: 82617 - DNA, 25 bp, Rattus norvegicus
accagagtagttaacatacaatcta

SEQ ID NO: 82618 - DNA, 25 bp, Rattus norvegicus
accagagtagttatcttgcttcact

SEQ ID NO: 82619 - DNA, 25 bp, Rattus norvegicus
accagagtagtttacatacaatcta

SEQ ID NO: 82620 - DNA, 25 bp, Rattus norvegicus
accagagtagttttcttgcttcact

SEQ ID NO: 82621 - DNA, 25 bp, Rattus norvegicus
accagagtcatgacttcaatcagta

SEQ ID NO: 82622 - DNA, 25 bp, Rattus norvegicus
accagagtcatgtcttcaatcagta

SEQ ID NO: 82623 - DNA, 25 bp, Rattus norvegicus
accagagtctggcaagcttctaggc

SEQ ID NO: 82624 - DNA, 25 bp, Rattus norvegicus
accagagtctgggaagcttctaggc

SEQ ID NO: 82625 - DNA, 25 bp, Rattus norvegicus
accagagtgtgaccccatgattcga

SEQ ID NO: 82626 - DNA, 25 bp, Rattus norvegicus
accagagtgtgagcccatgattcga

SEQ ID NO: 82627 - DNA, 25 bp, Rattus norvegicus
accagagtgtggaacctgtggtcat

SEQ ID NO: 82628 - DNA, 25 bp, Rattus norvegicus
accagagtgtggtacctgtggtcat

SEQ ID NO: 82629 - DNA, 25 bp, Rattus norvegicus
accagagttcaacccacaaggaaga

SEQ ID NO: 82630 - DNA, 25 bp, Rattus norvegicus
accagagttcaagccacaaggaaga

SEQ ID NO: 82631 - DNA, 25 bp, Rattus norvegicus
accagagtttggatgaagcgcaggc

SEQ ID NO: 82632 - DNA, 25 bp, Rattus norvegicus
accagagtttggttgaagcgcaggc

SEQ ID NO: 82633 - DNA, 25 bp, Rattus norvegicus
accagataatccacactagagagag

SEQ ID NO: 82634 - DNA, 25 bp, Rattus norvegicus
accagataatcctcactagagagag

SEQ ID NO: 82635 - DNA, 25 bp, Rattus norvegicus
accagataatggacagggtcctaaa

SEQ ID NO: 82636 - DNA, 25 bp, Rattus norvegicus
accagataatggtcagggtcctaaa

SEQ ID NO: 82637 - DNA, 25 bp, Rattus norvegicus
accagatatcggctatcttctctgt

SEQ ID NO: 82638 - DNA, 25 bp, Rattus norvegicus
accagatatcgggtatcttctctgt

SEQ ID NO: 82639 - DNA, 25 bp, Rattus norvegicus
accagatattctcccgttagacttt

SEQ ID NO: 82640 - DNA, 25 bp, Rattus norvegicus
accagatattctgccgttagacttt

SEQ ID NO: 82641 - DNA, 25 bp, Rattus norvegicus
accagatccctgcaagcgtgctcgg

SEQ ID NO: 82642 - DNA, 25 bp, Rattus norvegicus
accagatccctggaagcgtgctcgg

SEQ ID NO: 82643 - DNA, 25 bp, Rattus norvegicus
accagatcctgcagcattattggaa

SEQ ID NO: 82644 - DNA, 25 bp, Rattus norvegicus
accagatcctgctgcattattggaa

SEQ ID NO: 82645 - DNA, 25 bp, Rattus norvegicus
accagatctcaacctttatgtcaca

SEQ ID NO: 82646 - DNA, 25 bp, Rattus norvegicus
accagatctcaagctttatgtcaca

SEQ ID NO: 82647 - DNA, 25 bp, Rattus norvegicus
accagatgacgcaccgcggtgagcg

SEQ ID NO: 82648 - DNA, 25 bp, Rattus norvegicus
accagatgacgctccgcggtgagcg

SEQ ID NO: 82649 - DNA, 25 bp, Rattus norvegicus
accagatgatgtcccagctctggca

SEQ ID NO: 82650 - DNA, 25 bp, Rattus norvegicus
accagatgatgtgccagctctggca

SEQ ID NO: 82651 - DNA, 25 bp, Rattus norvegicus
accagatgcaagagatcgggaacct

SEQ ID NO: 82652 - DNA, 25 bp, Rattus norvegicus
accagatgcaagtgatcgggaacct

SEQ ID NO: 82653 - DNA, 25 bp, Rattus norvegicus
accagatgccagctctgtgtgtgta

SEQ ID NO: 82654 - DNA, 25 bp, Rattus norvegicus
accagatgccaggtctgtgtgtgta

SEQ ID NO: 82655 - DNA, 25 bp, Rattus norvegicus
accagatgccctcgactggaggtag

SEQ ID NO: 82656 - DNA, 25 bp, Rattus norvegicus
accagatgccctggactggaggtag

SEQ ID NO: 82657 - DNA, 25 bp, Rattus norvegicus
accagatgctgcctcatgtagtgcg

SEQ ID NO: 82658 - DNA, 25 bp, Rattus norvegicus
accagatgctgcgtcatgtagtgcg

SEQ ID NO: 82659 - DNA, 25 bp, Rattus norvegicus
accagatggtgtattcctacggctc

SEQ ID NO: 82660 - DNA, 25 bp, Rattus norvegicus
accagatggtgttttcctacggctc

SEQ ID NO: 82661 - DNA, 25 bp, Rattus norvegicus
accagatgttgcaaggactccggga

SEQ ID NO: 82662 - DNA, 25 bp, Rattus norvegicus
accagatgttgctaggactccggga

SEQ ID NO: 82663 - DNA, 25 bp, Rattus norvegicus
accagattcacaataattaccattg

SEQ ID NO: 82664 - DNA, 25 bp, Rattus norvegicus
accagattcacattaattaccattg

SEQ ID NO: 82665 - DNA, 25 bp, Rattus norvegicus
accagattcaggagtttgcgctgtg

SEQ ID NO: 82666 - DNA, 25 bp, Rattus norvegicus
accagattcaggtgtttgcgctgtg

SEQ ID NO: 82667 - DNA, 25 bp, Rattus norvegicus
accagattccgcaaggtgtttcctg

SEQ ID NO: 82668 - DNA, 25 bp, Rattus norvegicus
accagattccgctaggtgtttcctg

SEQ ID NO: 82669 - DNA, 25 bp, Rattus norvegicus
accagattctaactgtaccatgcac

SEQ ID NO: 82670 - DNA, 25 bp, Rattus norvegicus
accagattctaagtgtaccatgcac

SEQ ID NO: 82671 - DNA, 25 bp, Rattus norvegicus
accagattgtagcttagtccttcct

SEQ ID NO: 82672 - DNA, 25 bp, Rattus norvegicus
accagattgtaggttagtccttcct

SEQ ID NO: 82673 - DNA, 25 bp, Rattus norvegicus
accagatttctaaaacttgcatttc

SEQ ID NO: 82674 - DNA, 25 bp, Rattus norvegicus
accagatttctataacttgcatttc

SEQ ID NO: 82675 - DNA, 25 bp, Rattus norvegicus
accagcaacctacgcttgtgatcag

SEQ ID NO: 82676 - DNA, 25 bp, Rattus norvegicus
accagcaacctaggcttgtgatcag

SEQ ID NO: 82677 - DNA, 25 bp, Rattus norvegicus
accagcaacctccatcaggttggat

SEQ ID NO: 82678 - DNA, 25 bp, Rattus norvegicus
accagcaacctcgatcaggttggat

SEQ ID NO: 82679 - DNA, 25 bp, Rattus norvegicus
accagcaagcttccgggtggccaag

SEQ ID NO: 82680 - DNA, 25 bp, Rattus norvegicus
accagcaagcttgcgggtggccaag

SEQ ID NO: 82681 - DNA, 25 bp, Rattus norvegicus
accagcaatcaaacagagcccggaa

SEQ ID NO: 82682 - DNA, 25 bp, Rattus norvegicus
accagcaatcaatcagagcccggaa

SEQ ID NO: 82683 - DNA, 25 bp, Rattus norvegicus
accagcaatctacgcagaggtcaaa

SEQ ID NO: 82684 - DNA, 25 bp, Rattus norvegicus
accagcaatctaggcagaggtcaaa

SEQ ID NO: 82685 - DNA, 25 bp, Rattus norvegicus
accagcacacccagtgtgcaaagtt

SEQ ID NO: 82686 - DNA, 25 bp, Rattus norvegicus
accagcacaccctgtgtgcaaagtt

SEQ ID NO: 82687 - DNA, 25 bp, Rattus norvegicus
accagcacagttaagatttcatagt

SEQ ID NO: 82688 - DNA, 25 bp, Rattus norvegicus
accagcacagtttagatttcatagt

SEQ ID NO: 82689 - DNA, 25 bp, Rattus norvegicus
accagcaccctccttatgtaggata

SEQ ID NO: 82690 - DNA, 25 bp, Rattus norvegicus
accagcaccctcgttatgtaggata

SEQ ID NO: 82691 - DNA, 25 bp, Rattus norvegicus
accagcacgggcacgagcagtggct

SEQ ID NO: 82692 - DNA, 25 bp, Rattus norvegicus
accagcacgggctcgagcagtggct

SEQ ID NO: 82693 - DNA, 25 bp, Rattus norvegicus
accagcactggcattggtggtggac

SEQ ID NO: 82694 - DNA, 25 bp, Rattus norvegicus
accagcactggctttggtggtggac

SEQ ID NO: 82695 - DNA, 25 bp, Rattus norvegicus
accagcactgggaggcgtgagttct

SEQ ID NO: 82696 - DNA, 25 bp, Rattus norvegicus
accagcactgggtggcgtgagttct

SEQ ID NO: 82697 - DNA, 25 bp, Rattus norvegicus
accagcacttcaactgcacaaaggg

SEQ ID NO: 82698 - DNA, 25 bp, Rattus norvegicus
accagcacttcatctgcacaaaggg

SEQ ID NO: 82699 - DNA, 25 bp, Rattus norvegicus
accagcagaagaagcggcccagagt

SEQ ID NO: 82700 - DNA, 25 bp, Rattus norvegicus
accagcagaagatgcggcccagagt

SEQ ID NO: 82701 - DNA, 25 bp, Rattus norvegicus
accagcagatggcacgcccttgtaa

SEQ ID NO: 82702 - DNA, 25 bp, Rattus norvegicus
accagcagatgggacgcccttgtaa

SEQ ID NO: 82703 - DNA, 25 bp, Rattus norvegicus
accagcagcctcacctgtagagacg

SEQ ID NO: 82704 - DNA, 25 bp, Rattus norvegicus
accagcagcctctcctgtagagacg

SEQ ID NO: 82705 - DNA, 25 bp, Rattus norvegicus
accagcagctcccagagtcggaaaa

SEQ ID NO: 82706 - DNA, 25 bp, Rattus norvegicus
accagcagctccgagagtcggaaaa

SEQ ID NO: 82707 - DNA, 25 bp, Rattus norvegicus
accagcaggaccatgtacattttgt

SEQ ID NO: 82708 - DNA, 25 bp, Rattus norvegicus
accagcaggaccttgtacattttgt

SEQ ID NO: 82709 - DNA, 25 bp, Rattus norvegicus
accagcaggagtacgtcagagctct

SEQ ID NO: 82710 - DNA, 25 bp, Rattus norvegicus
accagcaggagttcgtcagagctct

SEQ ID NO: 82711 - DNA, 25 bp, Rattus norvegicus
accagcagggccatcgtggaggact

SEQ ID NO: 82712 - DNA, 25 bp, Rattus norvegicus
accagcagggccttcgtggaggact

SEQ ID NO: 82713 - DNA, 25 bp, Rattus norvegicus
accagcaggtcgacaaaggagccat

SEQ ID NO: 82714 - DNA, 25 bp, Rattus norvegicus
accagcaggtcgtcaaaggagccat

SEQ ID NO: 82715 - DNA, 25 bp, Rattus norvegicus
accagcagtctcatacctgtatata

SEQ ID NO: 82716 - DNA, 25 bp, Rattus norvegicus
accagcagtctcttacctgtatata

SEQ ID NO: 82717 - DNA, 25 bp, Rattus norvegicus
accagcagtcttatctaacctgaat

SEQ ID NO: 82718 - DNA, 25 bp, Rattus norvegicus
accagcagtcttttctaacctgaat

SEQ ID NO: 82719 - DNA, 25 bp, Rattus norvegicus
accagcagtgtacaggttaggcctt

SEQ ID NO: 82720 - DNA, 25 bp, Rattus norvegicus
accagcagtgtagaggttaggcctt

SEQ ID NO: 82721 - DNA, 25 bp, Rattus norvegicus
accagcagttaaatccacttgtgga

SEQ ID NO: 82722 - DNA, 25 bp, Rattus norvegicus
accagcagttaattccacttgtgga

SEQ ID NO: 82723 - DNA, 25 bp, Rattus norvegicus
accagcagttagcatgtggacgcaa

SEQ ID NO: 82724 - DNA, 25 bp, Rattus norvegicus
accagcagttaggatgtggacgcaa

SEQ ID NO: 82725 - DNA, 25 bp, Rattus norvegicus
accagcatccacaatacaccagaga

SEQ ID NO: 82726 - DNA, 25 bp, Rattus norvegicus
accagcatccactatacaccagaga

SEQ ID NO: 82727 - DNA, 25 bp, Rattus norvegicus
accagcatccccattattgctaatt

SEQ ID NO: 82728 - DNA, 25 bp, Rattus norvegicus
accagcatcccctttattgctaatt

SEQ ID NO: 82729 - DNA, 25 bp, Rattus norvegicus
accagcatccttagggtcagctcta

SEQ ID NO: 82730 - DNA, 25 bp, Rattus norvegicus
accagcatcctttgggtcagctcta

SEQ ID NO: 82731 - DNA, 25 bp, Rattus norvegicus
accagcatcggcatgtgtgacatcg

SEQ ID NO: 82732 - DNA, 25 bp, Rattus norvegicus
accagcatcggcttgtgtgacatcg

SEQ ID NO: 82733 - DNA, 25 bp, Rattus norvegicus
accagcatctaaagtgtcccagaca

SEQ ID NO: 82734 - DNA, 25 bp, Rattus norvegicus
accagcatctaatgtgtcccagaca

SEQ ID NO: 82735 - DNA, 25 bp, Rattus norvegicus
accagcatctggagtgggagccaca

SEQ ID NO: 82736 - DNA, 25 bp, Rattus norvegicus
accagcatctggtgtgggagccaca

SEQ ID NO: 82737 - DNA, 25 bp, Rattus norvegicus
accagcatgctgaggagtatttcct

SEQ ID NO: 82738 - DNA, 25 bp, Rattus norvegicus
accagcatgctgtggagtatttcct

SEQ ID NO: 82739 - DNA, 25 bp, Rattus norvegicus
accagcatggtcatgttatttgcat

SEQ ID NO: 82740 - DNA, 25 bp, Rattus norvegicus
accagcatggtcttgttatttgcat

SEQ ID NO: 82741 - DNA, 25 bp, Rattus norvegicus
accagcatggtgaggagagcatcaa

SEQ ID NO: 82742 - DNA, 25 bp, Rattus norvegicus
accagcatggtgtggagagcatcaa

SEQ ID NO: 82743 - DNA, 25 bp, Rattus norvegicus
accagcattctcaagggagtgccca

SEQ ID NO: 82744 - DNA, 25 bp, Rattus norvegicus
accagcattctctagggagtgccca

SEQ ID NO: 82745 - DNA, 25 bp, Rattus norvegicus
accagcattcttacagtgtcatttt

SEQ ID NO: 82746 - DNA, 25 bp, Rattus norvegicus
accagcattctttcagtgtcatttt

SEQ ID NO: 82747 - DNA, 25 bp, Rattus norvegicus
accagcattggactgacctcgtcaa

SEQ ID NO: 82748 - DNA, 25 bp, Rattus norvegicus
accagcattggagtgacctcgtcaa

SEQ ID NO: 82749 - DNA, 25 bp, Rattus norvegicus
accagcatttgcagcttttgttagt

SEQ ID NO: 82750 - DNA, 25 bp, Rattus norvegicus
accagcatttgctgcttttgttagt

SEQ ID NO: 82751 - DNA, 25 bp, Rattus norvegicus
accagccaactcaagtcacaggatt

SEQ ID NO: 82752 - DNA, 25 bp, Rattus norvegicus
accagccaactctagtcacaggatt

SEQ ID NO: 82753 - DNA, 25 bp, Rattus norvegicus
accagccaagccatattgctgccta

SEQ ID NO: 82754 - DNA, 25 bp, Rattus norvegicus
accagccaagccttattgctgccta

SEQ ID NO: 82755 - DNA, 25 bp, Rattus norvegicus
accagccaccagagatctcatttgt

SEQ ID NO: 82756 - DNA, 25 bp, Rattus norvegicus
accagccaccagtgatctcatttgt

SEQ ID NO: 82757 - DNA, 25 bp, Rattus norvegicus
accagccaccgaatttccaaggaag

SEQ ID NO: 82758 - DNA, 25 bp, Rattus norvegicus
accagccaccgattttccaaggaag

SEQ ID NO: 82759 - DNA, 25 bp, Rattus norvegicus
accagccagatgacttagcagatca

SEQ ID NO: 82760 - DNA, 25 bp, Rattus norvegicus
accagccagatgtcttagcagatca

SEQ ID NO: 82761 - DNA, 25 bp, Rattus norvegicus
accagccagctaacaactcgcgccc

SEQ ID NO: 82762 - DNA, 25 bp, Rattus norvegicus
accagccagctatcaactcgcgccc

SEQ ID NO: 82763 - DNA, 25 bp, Rattus norvegicus
accagccagtggcagtattacatgc

SEQ ID NO: 82764 - DNA, 25 bp, Rattus norvegicus
accagccagtgggagtattacatgc

SEQ ID NO: 82765 - DNA, 25 bp, Rattus norvegicus
accagcccacacagagcagatacga

SEQ ID NO: 82766 - DNA, 25 bp, Rattus norvegicus
accagcccacactgagcagatacga

SEQ ID NO: 82767 - DNA, 25 bp, Rattus norvegicus
accagcccaccacgattatttacat

SEQ ID NO: 82768 - DNA, 25 bp, Rattus norvegicus
accagcccaccaggattatttacat

SEQ ID NO: 82769 - DNA, 25 bp, Rattus norvegicus
accagcccagacatgtgcattaaat

SEQ ID NO: 82770 - DNA, 25 bp, Rattus norvegicus
accagcccagacttgtgcattaaat

SEQ ID NO: 82771 - DNA, 25 bp, Rattus norvegicus
accagcccagataatcggatccgga

SEQ ID NO: 82772 - DNA, 25 bp, Rattus norvegicus
accagcccagattatcggatccgga

SEQ ID NO: 82773 - DNA, 25 bp, Rattus norvegicus
accagcccagtgattagccatgatt

SEQ ID NO: 82774 - DNA, 25 bp, Rattus norvegicus
accagcccagtgtttagccatgatt

SEQ ID NO: 82775 - DNA, 25 bp, Rattus norvegicus
accagccccaggaagatctttatca

SEQ ID NO: 82776 - DNA, 25 bp, Rattus norvegicus
accagccccaggtagatctttatca

SEQ ID NO: 82777 - DNA, 25 bp, Rattus norvegicus
accagccccattaaagtgttgtcta

SEQ ID NO: 82778 - DNA, 25 bp, Rattus norvegicus
accagccccatttaagtgttgtcta

SEQ ID NO: 82779 - DNA, 25 bp, Rattus norvegicus
accagcccctcacagaacaggaagt

SEQ ID NO: 82780 - DNA, 25 bp, Rattus norvegicus
accagcccctcagagaacaggaagt

SEQ ID NO: 82781 - DNA, 25 bp, Rattus norvegicus
accagccctgggaaatatgcatgag

SEQ ID NO: 82782 - DNA, 25 bp, Rattus norvegicus
accagccctgggtaatatgcatgag

SEQ ID NO: 82783 - DNA, 25 bp, Rattus norvegicus
accagccctgtccttggagggataa

SEQ ID NO: 82784 - DNA, 25 bp, Rattus norvegicus
accagccctgtcgttggagggataa

SEQ ID NO: 82785 - DNA, 25 bp, Rattus norvegicus
accagcccttgtccatttattgttc

SEQ ID NO: 82786 - DNA, 25 bp, Rattus norvegicus
accagcccttgtgcatttattgttc

SEQ ID NO: 82787 - DNA, 25 bp, Rattus norvegicus
accagccctttgatttgactttgtg

SEQ ID NO: 82788 - DNA, 25 bp, Rattus norvegicus
accagccctttgttttgactttgtg

SEQ ID NO: 82789 - DNA, 25 bp, Rattus norvegicus
accagccgcaccattgtgaataatt

SEQ ID NO: 82790 - DNA, 25 bp, Rattus norvegicus
accagccgcacctttgtgaataatt

SEQ ID NO: 82791 - DNA, 25 bp, Rattus norvegicus
accagccggaaacagcctttgctag

SEQ ID NO: 82792 - DNA, 25 bp, Rattus norvegicus
accagccggaaagagcctttgctag

SEQ ID NO: 82793 - DNA, 25 bp, Rattus norvegicus
accagcctattcatttaagtctcaa

SEQ ID NO: 82794 - DNA, 25 bp, Rattus norvegicus
accagcctattcttttaagtctcaa

SEQ ID NO: 82795 - DNA, 25 bp, Rattus norvegicus
accagcctcaccatgtggtggcttt

SEQ ID NO: 82796 - DNA, 25 bp, Rattus norvegicus
accagcctcaccttgtggtggcttt

SEQ ID NO: 82797 - DNA, 25 bp, Rattus norvegicus
accagcctcagtcagtcatagtttg

SEQ ID NO: 82798 - DNA, 25 bp, Rattus norvegicus
accagcctcagtgagtcatagtttg

SEQ ID NO: 82799 - DNA, 25 bp, Rattus norvegicus
accagcctgagtcgtcgtggagtca

SEQ ID NO: 82800 - DNA, 25 bp, Rattus norvegicus
accagcctgagtggtcgtggagtca

SEQ ID NO: 82801 - DNA, 25 bp, Rattus norvegicus
accagcctgccgatggagacagata

SEQ ID NO: 82802 - DNA, 25 bp, Rattus norvegicus
accagcctgccgttggagacagata

SEQ ID NO: 82803 - DNA, 25 bp, Rattus norvegicus
accagcctgctgacaacgtagaaga

SEQ ID NO: 82804 - DNA, 25 bp, Rattus norvegicus
accagcctgctgtcaacgtagaaga

SEQ ID NO: 82805 - DNA, 25 bp, Rattus norvegicus
accagcctggcaccatagtgagagc

SEQ ID NO: 82806 - DNA, 25 bp, Rattus norvegicus
accagcctggcagcatagtgagagc

SEQ ID NO: 82807 - DNA, 25 bp, Rattus norvegicus
accagcctggctccgatttttagat

SEQ ID NO: 82808 - DNA, 25 bp, Rattus norvegicus
accagcctggctgcgatttttagat

SEQ ID NO: 82809 - DNA, 25 bp, Rattus norvegicus
accagcctgggcaaagagtctgaga

SEQ ID NO: 82810 - DNA, 25 bp, Rattus norvegicus
accagcctgggctaagagtctgaga

SEQ ID NO: 82811 - DNA, 25 bp, Rattus norvegicus
accagcctggttacttcagagagca

SEQ ID NO: 82812 - DNA, 25 bp, Rattus norvegicus
accagcctggtttcttcagagagca

SEQ ID NO: 82813 - DNA, 25 bp, Rattus norvegicus
accagcctgtttctccacgtgtggg

SEQ ID NO: 82814 - DNA, 25 bp, Rattus norvegicus
accagcctgtttgtccacgtgtggg

SEQ ID NO: 82815 - DNA, 25 bp, Rattus norvegicus
accagccttaagatccctgttgagt

SEQ ID NO: 82816 - DNA, 25 bp, Rattus norvegicus
accagccttaagttccctgttgagt

SEQ ID NO: 82817 - DNA, 25 bp, Rattus norvegicus
accagccttcccaaagagcaataaa

SEQ ID NO: 82818 - DNA, 25 bp, Rattus norvegicus
accagccttccctaagagcaataaa

SEQ ID NO: 82819 - DNA, 25 bp, Rattus norvegicus
accagccttggtaataattgcatca

SEQ ID NO: 82820 - DNA, 25 bp, Rattus norvegicus
accagccttggttataattgcatca

SEQ ID NO: 82821 - DNA, 25 bp, Rattus norvegicus
accagccttgtgcttgcggcgcaca

SEQ ID NO: 82822 - DNA, 25 bp, Rattus norvegicus
accagccttgtggttgcggcgcaca

SEQ ID NO: 82823 - DNA, 25 bp, Rattus norvegicus
accagcgattcacactcgggctaag

SEQ ID NO: 82824 - DNA, 25 bp, Rattus norvegicus
accagcgattcagactcgggctaag

SEQ ID NO: 82825 - DNA, 25 bp, Rattus norvegicus
accagcgcccggatagagtacttga

SEQ ID NO: 82826 - DNA, 25 bp, Rattus norvegicus
accagcgcccggcaggttcagaacg

SEQ ID NO: 82827 - DNA, 25 bp, Rattus norvegicus
accagcgcccgggaggttcagaacg

SEQ ID NO: 82828 - DNA, 25 bp, Rattus norvegicus
accagcgcccggttagagtacttga

SEQ ID NO: 82829 - DNA, 25 bp, Rattus norvegicus
accagcgcggatcacatacagcagt

SEQ ID NO: 82830 - DNA, 25 bp, Rattus norvegicus
accagcgcggatgacatacagcagt

SEQ ID NO: 82831 - DNA, 25 bp, Rattus norvegicus
accagcgctaagaaaacttttcagc

SEQ ID NO: 82832 - DNA, 25 bp, Rattus norvegicus
accagcgctaagtaaacttttcagc

SEQ ID NO: 82833 - DNA, 25 bp, Rattus norvegicus
accagcgctgggagccattggctac

SEQ ID NO: 82834 - DNA, 25 bp, Rattus norvegicus
accagcgctgggtgccattggctac

SEQ ID NO: 82835 - DNA, 25 bp, Rattus norvegicus
accagcggctgcacttgaccaagaa

SEQ ID NO: 82836 - DNA, 25 bp, Rattus norvegicus
accagcggctgctcttgaccaagaa

SEQ ID NO: 82837 - DNA, 25 bp, Rattus norvegicus
accagcggtcatcagcggttgcaac

SEQ ID NO: 82838 - DNA, 25 bp, Rattus norvegicus
accagcggtcatgagcggttgcaac

SEQ ID NO: 82839 - DNA, 25 bp, Rattus norvegicus
accagcggtcctcctcatttttctt

SEQ ID NO: 82840 - DNA, 25 bp, Rattus norvegicus
accagcggtcctgctcatttttctt

SEQ ID NO: 82841 - DNA, 25 bp, Rattus norvegicus
accagcgtgtggacttcagtggcct

SEQ ID NO: 82842 - DNA, 25 bp, Rattus norvegicus
accagcgtgtggtcttcagtggcct

SEQ ID NO: 82843 - DNA, 25 bp, Rattus norvegicus
accagcgttggtcacatagcagatt

SEQ ID NO: 82844 - DNA, 25 bp, Rattus norvegicus
accagcgttggtgacatagcagatt

SEQ ID NO: 82845 - DNA, 25 bp, Rattus norvegicus
accagctacagcaggaggacccaat

SEQ ID NO: 82846 - DNA, 25 bp, Rattus norvegicus
accagctacagctggaggacccaat

SEQ ID NO: 82847 - DNA, 25 bp, Rattus norvegicus
accagctacatcattctcgcaaaat

SEQ ID NO: 82848 - DNA, 25 bp, Rattus norvegicus
accagctacatctttctcgcaaaat

SEQ ID NO: 82849 - DNA, 25 bp, Rattus norvegicus
accagctactggagttttctgtatg

SEQ ID NO: 82850 - DNA, 25 bp, Rattus norvegicus
accagctactggtgttttctgtatg

SEQ ID NO: 82851 - DNA, 25 bp, Rattus norvegicus
accagctatgtgcattcgtgcccat

SEQ ID NO: 82852 - DNA, 25 bp, Rattus norvegicus
accagctatgtggattcgtgcccat

SEQ ID NO: 82853 - DNA, 25 bp, Rattus norvegicus
accagctatgttcggcggatacctt

SEQ ID NO: 82854 - DNA, 25 bp, Rattus norvegicus
accagctatgttcgtactcacaaaa

SEQ ID NO: 82855 - DNA, 25 bp, Rattus norvegicus
accagctatgttgggcggatacctt

SEQ ID NO: 82856 - DNA, 25 bp, Rattus norvegicus
accagctatgttggtactcacaaaa

SEQ ID NO: 82857 - DNA, 25 bp, Rattus norvegicus
accagctcaagaaggaagtgaccct

SEQ ID NO: 82858 - DNA, 25 bp, Rattus norvegicus
accagctcaagatggaagtgaccct

SEQ ID NO: 82859 - DNA, 25 bp, Rattus norvegicus
accagctcactgaaggacacatgcc

SEQ ID NO: 82860 - DNA, 25 bp, Rattus norvegicus
accagctcactgtaggacacatgcc

SEQ ID NO: 82861 - DNA, 25 bp, Rattus norvegicus
accagctcagcacacgctttaagaa

SEQ ID NO: 82862 - DNA, 25 bp, Rattus norvegicus
accagctcagcagacgctttaagaa

SEQ ID NO: 82863 - DNA, 25 bp, Rattus norvegicus
accagctccaagaaatcgtgccaag

SEQ ID NO: 82864 - DNA, 25 bp, Rattus norvegicus
accagctccaagtaatcgtgccaag

SEQ ID NO: 82865 - DNA, 25 bp, Rattus norvegicus
accagctccgggagaaggcccagga

SEQ ID NO: 82866 - DNA, 25 bp, Rattus norvegicus
accagctccgggtgaaggcccagga

SEQ ID NO: 82867 - DNA, 25 bp, Rattus norvegicus
accagctctacgagatcatccaaag

SEQ ID NO: 82868 - DNA, 25 bp, Rattus norvegicus
accagctctacgtgatcatccaaag

SEQ ID NO: 82869 - DNA, 25 bp, Rattus norvegicus
accagctctggtcgaaagcaagtac

SEQ ID NO: 82870 - DNA, 25 bp, Rattus norvegicus
accagctctggtggaaagcaagtac

SEQ ID NO: 82871 - DNA, 25 bp, Rattus norvegicus
accagctctgtgatggagtgaccca

SEQ ID NO: 82872 - DNA, 25 bp, Rattus norvegicus
accagctctgtgttggagtgaccca

SEQ ID NO: 82873 - DNA, 25 bp, Rattus norvegicus
accagctgagacctgtaagtccgta

SEQ ID NO: 82874 - DNA, 25 bp, Rattus norvegicus
accagctgagacgtgtaagtccgta

SEQ ID NO: 82875 - DNA, 25 bp, Rattus norvegicus
accagctgcagtctatgtttccaag

SEQ ID NO: 82876 - DNA, 25 bp, Rattus norvegicus
accagctgcagtgtatgtttccaag

SEQ ID NO: 82877 - DNA, 25 bp, Rattus norvegicus
accagctgcctcctttaagcttggt

SEQ ID NO: 82878 - DNA, 25 bp, Rattus norvegicus
accagctgcctcgtttaagcttggt

SEQ ID NO: 82879 - DNA, 25 bp, Rattus norvegicus
accagctgctgaaacaggccacagg

SEQ ID NO: 82880 - DNA, 25 bp, Rattus norvegicus
accagctgctgacgtgcccggtgca

SEQ ID NO: 82881 - DNA, 25 bp, Rattus norvegicus
accagctgctgaggtgcccggtgca

SEQ ID NO: 82882 - DNA, 25 bp, Rattus norvegicus
accagctgctgatacaggccacagg

SEQ ID NO: 82883 - DNA, 25 bp, Rattus norvegicus
accagctgctggcacacggagactt

SEQ ID NO: 82884 - DNA, 25 bp, Rattus norvegicus
accagctgctgggacacggagactt

SEQ ID NO: 82885 - DNA, 25 bp, Rattus norvegicus
accagctgggccatgaactcatagt

SEQ ID NO: 82886 - DNA, 25 bp, Rattus norvegicus
accagctgggccttgaactcatagt

SEQ ID NO: 82887 - DNA, 25 bp, Rattus norvegicus
accagctgtctcaggacatgttgaa

SEQ ID NO: 82888 - DNA, 25 bp, Rattus norvegicus
accagctgtctctggacatgttgaa

SEQ ID NO: 82889 - DNA, 25 bp, Rattus norvegicus
accagctgtgctagtgtatcaccac

SEQ ID NO: 82890 - DNA, 25 bp, Rattus norvegicus
accagctgtgcttgtgtatcaccac

SEQ ID NO: 82891 - DNA, 25 bp, Rattus norvegicus
accagctgtggaagggcactacaca

SEQ ID NO: 82892 - DNA, 25 bp, Rattus norvegicus
accagctgtggatgggcactacaca

SEQ ID NO: 82893 - DNA, 25 bp, Rattus norvegicus
accagctgtgttatttcttgagcca

SEQ ID NO: 82894 - DNA, 25 bp, Rattus norvegicus
accagctgtgttcattccttcttgt

SEQ ID NO: 82895 - DNA, 25 bp, Rattus norvegicus
accagctgtgttgattccttcttgt

SEQ ID NO: 82896 - DNA, 25 bp, Rattus norvegicus
accagctgtgttttttcttgagcca

SEQ ID NO: 82897 - DNA, 25 bp, Rattus norvegicus
accagcttcagcattacgcagaata

SEQ ID NO: 82898 - DNA, 25 bp, Rattus norvegicus
accagcttcagctttacgcagaata

SEQ ID NO: 82899 - DNA, 25 bp, Rattus norvegicus
accagcttcaggaagtcttctgcca

SEQ ID NO: 82900 - DNA, 25 bp, Rattus norvegicus
accagcttcaggtagtcttctgcca

SEQ ID NO: 82901 - DNA, 25 bp, Rattus norvegicus
accagcttcatcatttatagtcgta

SEQ ID NO: 82902 - DNA, 25 bp, Rattus norvegicus
accagcttcatcttttatagtcgta

SEQ ID NO: 82903 - DNA, 25 bp, Rattus norvegicus
accagcttcatgagcattcgtggga

SEQ ID NO: 82904 - DNA, 25 bp, Rattus norvegicus
accagcttcatgtgcattcgtggga

SEQ ID NO: 82905 - DNA, 25 bp, Rattus norvegicus
accagcttcggcaatacggtgagac

SEQ ID NO: 82906 - DNA, 25 bp, Rattus norvegicus
accagcttcggctatacggtgagac

SEQ ID NO: 82907 - DNA, 25 bp, Rattus norvegicus
accagcttggaccttgtgagaccct

SEQ ID NO: 82908 - DNA, 25 bp, Rattus norvegicus
accagcttggacgttgtgagaccct

SEQ ID NO: 82909 - DNA, 25 bp, Rattus norvegicus
accagcttgttccaaaattaggcag

SEQ ID NO: 82910 - DNA, 25 bp, Rattus norvegicus
accagcttgttcgaaaattaggcag

SEQ ID NO: 82911 - DNA, 25 bp, Rattus norvegicus
accagctttcccacatattctggga

SEQ ID NO: 82912 - DNA, 25 bp, Rattus norvegicus
accagctttccctcatattctggga

SEQ ID NO: 82913 - DNA, 25 bp, Rattus norvegicus
accagctttctgcagcatgttggag

SEQ ID NO: 82914 - DNA, 25 bp, Rattus norvegicus
accagctttctggagcatgttggag

SEQ ID NO: 82915 - DNA, 25 bp, Rattus norvegicus
accagctttgctcagcggcagaaac

SEQ ID NO: 82916 - DNA, 25 bp, Rattus norvegicus
accagctttgctgagcggcagaaac

SEQ ID NO: 82917 - DNA, 25 bp, Rattus norvegicus
accaggaaacccaccacgaagaatg

SEQ ID NO: 82918 - DNA, 25 bp, Rattus norvegicus
accaggaaaccctccacgaagaatg

SEQ ID NO: 82919 - DNA, 25 bp, Rattus norvegicus
accaggaaagttcgttgctccccat

SEQ ID NO: 82920 - DNA, 25 bp, Rattus norvegicus
accaggaaagttggttgctccccat

SEQ ID NO: 82921 - DNA, 25 bp, Rattus norvegicus
accaggaacagccaaaacacggagg

SEQ ID NO: 82922 - DNA, 25 bp, Rattus norvegicus
accaggaacagcgaaaacacggagg

SEQ ID NO: 82923 - DNA, 25 bp, Rattus norvegicus
accaggaacattacttgagggctca

SEQ ID NO: 82924 - DNA, 25 bp, Rattus norvegicus
accaggaacatttcttgagggctca

SEQ ID NO: 82925 - DNA, 25 bp, Rattus norvegicus
accaggaacctaagcagcagctgca

SEQ ID NO: 82926 - DNA, 25 bp, Rattus norvegicus
accaggaacctatgcagcagctgca

SEQ ID NO: 82927 - DNA, 25 bp, Rattus norvegicus
accaggaagagcacatgtctgcgct

SEQ ID NO: 82928 - DNA, 25 bp, Rattus norvegicus
accaggaagagctcatgtctgcgct

SEQ ID NO: 82929 - DNA, 25 bp, Rattus norvegicus
accaggaagtggacgggcatgtttt

SEQ ID NO: 82930 - DNA, 25 bp, Rattus norvegicus
accaggaagtggtcgggcatgtttt

SEQ ID NO: 82931 - DNA, 25 bp, Rattus norvegicus
accaggaatcctacgctaatgtgaa

SEQ ID NO: 82932 - DNA, 25 bp, Rattus norvegicus
accaggaatccttcgctaatgtgaa

SEQ ID NO: 82933 - DNA, 25 bp, Rattus norvegicus
accaggacatcgagctctatctcat

SEQ ID NO: 82934 - DNA, 25 bp, Rattus norvegicus
accaggacatcgtgctctatctcat

SEQ ID NO: 82935 - DNA, 25 bp, Rattus norvegicus
accaggacatggcacgcgcagatag

SEQ ID NO: 82936 - DNA, 25 bp, Rattus norvegicus
accaggacatgggacgcgcagatag

SEQ ID NO: 82937 - DNA, 25 bp, Rattus norvegicus
accaggaccccgagagatgaagctc

SEQ ID NO: 82938 - DNA, 25 bp, Rattus norvegicus
accaggaccccgtgagatgaagctc

SEQ ID NO: 82939 - DNA, 25 bp, Rattus norvegicus
accaggacggtcatttacgagatac

SEQ ID NO: 82940 - DNA, 25 bp, Rattus norvegicus
accaggacggtcttttacgagatac

SEQ ID NO: 82941 - DNA, 25 bp, Rattus norvegicus
accaggagccatacctggctgcatc

SEQ ID NO: 82942 - DNA, 25 bp, Rattus norvegicus
accaggagccattcctggctgcatc

SEQ ID NO: 82943 - DNA, 25 bp, Rattus norvegicus
accaggagcctccttggcagaagat

SEQ ID NO: 82944 - DNA, 25 bp, Rattus norvegicus
accaggagcctcgttggcagaagat

SEQ ID NO: 82945 - DNA, 25 bp, Rattus norvegicus
accaggagccttcaattatttttgt

SEQ ID NO: 82946 - DNA, 25 bp, Rattus norvegicus
accaggagccttgaattatttttgt

SEQ ID NO: 82947 - DNA, 25 bp, Rattus norvegicus
accaggaggctgctgtttcttgcac

SEQ ID NO: 82948 - DNA, 25 bp, Rattus norvegicus
accaggaggctggtgtttcttgcac

SEQ ID NO: 82949 - DNA, 25 bp, Rattus norvegicus
accaggagggacacgtgcattttct

SEQ ID NO: 82950 - DNA, 25 bp, Rattus norvegicus
accaggagggactcgtgcattttct

SEQ ID NO: 82951 - DNA, 25 bp, Rattus norvegicus
accaggagggcaagccaatgcctgt

SEQ ID NO: 82952 - DNA, 25 bp, Rattus norvegicus
accaggagggcatgccaatgcctgt

SEQ ID NO: 82953 - DNA, 25 bp, Rattus norvegicus
accaggagtccactgtttcttgttc

SEQ ID NO: 82954 - DNA, 25 bp, Rattus norvegicus
accaggagtccagtgtttcttgttc

SEQ ID NO: 82955 - DNA, 25 bp, Rattus norvegicus
accaggagtgccatctttgtgactg

SEQ ID NO: 82956 - DNA, 25 bp, Rattus norvegicus
accaggagtgccttctttgtgactg

SEQ ID NO: 82957 - DNA, 25 bp, Rattus norvegicus
accaggatcacacaacggagtttct

SEQ ID NO: 82958 - DNA, 25 bp, Rattus norvegicus
accaggatcacagaacggagtttct

SEQ ID NO: 82959 - DNA, 25 bp, Rattus norvegicus
accaggatgccacgaggctttccat

SEQ ID NO: 82960 - DNA, 25 bp, Rattus norvegicus
accaggatgccaggaggctttccat

SEQ ID NO: 82961 - DNA, 25 bp, Rattus norvegicus
accaggatggcactctcttaactat

SEQ ID NO: 82962 - DNA, 25 bp, Rattus norvegicus
accaggatggcagtctcttaactat

SEQ ID NO: 82963 - DNA, 25 bp, Rattus norvegicus
accaggatggctactatgttaataa

SEQ ID NO: 82964 - DNA, 25 bp, Rattus norvegicus
accaggatggcttctatgttaataa

SEQ ID NO: 82965 - DNA, 25 bp, Rattus norvegicus
accaggatgggcaggttcttcagtt

SEQ ID NO: 82966 - DNA, 25 bp, Rattus norvegicus
accaggatgggctggttcttcagtt

SEQ ID NO: 82967 - DNA, 25 bp, Rattus norvegicus
accaggatttccaggccttacagaa

SEQ ID NO: 82968 - DNA, 25 bp, Rattus norvegicus
accaggatttcctggccttacagaa

SEQ ID NO: 82969 - DNA, 25 bp, Rattus norvegicus
accaggcaacctcgagcgtttgcag

SEQ ID NO: 82970 - DNA, 25 bp, Rattus norvegicus
accaggcaacctggagcgtttgcag

SEQ ID NO: 82971 - DNA, 25 bp, Rattus norvegicus
accaggcaagggagtgcccctcagg

SEQ ID NO: 82972 - DNA, 25 bp, Rattus norvegicus
accaggcaagggtgtgcccctcagg

SEQ ID NO: 82973 - DNA, 25 bp, Rattus norvegicus
accaggcacccaactgtgctaaggg

SEQ ID NO: 82974 - DNA, 25 bp, Rattus norvegicus
accaggcacccatctgtgctaaggg

SEQ ID NO: 82975 - DNA, 25 bp, Rattus norvegicus
accaggcacctgaatatggacatga

SEQ ID NO: 82976 - DNA, 25 bp, Rattus norvegicus
accaggcacctgtatatggacatga

SEQ ID NO: 82977 - DNA, 25 bp, Rattus norvegicus
accaggcagagcatacgttgttgaa

SEQ ID NO: 82978 - DNA, 25 bp, Rattus norvegicus
accaggcagagcttacgttgttgaa

SEQ ID NO: 82979 - DNA, 25 bp, Rattus norvegicus
accaggcagcaacaagacatcagag

SEQ ID NO: 82980 - DNA, 25 bp, Rattus norvegicus
accaggcagcaagaagacatcagag

SEQ ID NO: 82981 - DNA, 25 bp, Rattus norvegicus
accaggcatcataacaaagtacaga

SEQ ID NO: 82982 - DNA, 25 bp, Rattus norvegicus
accaggcatcattacaaagtacaga

SEQ ID NO: 82983 - DNA, 25 bp, Rattus norvegicus
accaggcatctgcttcttacttcag

SEQ ID NO: 82984 - DNA, 25 bp, Rattus norvegicus
accaggcatctggttcttacttcag

SEQ ID NO: 82985 - DNA, 25 bp, Rattus norvegicus
accaggcattgtaggagcaccgcac

SEQ ID NO: 82986 - DNA, 25 bp, Rattus norvegicus
accaggcattgttggagcaccgcac

SEQ ID NO: 82987 - DNA, 25 bp, Rattus norvegicus
accaggcccgagaccgcctagagga

SEQ ID NO: 82988 - DNA, 25 bp, Rattus norvegicus
accaggcccgagtccgcctagagga

SEQ ID NO: 82989 - DNA, 25 bp, Rattus norvegicus
accaggcccggtagttacagaagct

SEQ ID NO: 82990 - DNA, 25 bp, Rattus norvegicus
accaggcccggttgttacagaagct

SEQ ID NO: 82991 - DNA, 25 bp, Rattus norvegicus
accaggccctgaattcaattccaat

SEQ ID NO: 82992 - DNA, 25 bp, Rattus norvegicus
accaggccctgatttcaattccaat

SEQ ID NO: 82993 - DNA, 25 bp, Rattus norvegicus
accaggccctttcctcagaggagaa

SEQ ID NO: 82994 - DNA, 25 bp, Rattus norvegicus
accaggccctttgctcagaggagaa

SEQ ID NO: 82995 - DNA, 25 bp, Rattus norvegicus
accaggccgtcaccctctgaagaga

SEQ ID NO: 82996 - DNA, 25 bp, Rattus norvegicus
accaggccgtcagcctctgaagaga

SEQ ID NO: 82997 - DNA, 25 bp, Rattus norvegicus
accaggcctccacgttgaagggtca

SEQ ID NO: 82998 - DNA, 25 bp, Rattus norvegicus
accaggcctccaggttgaagggtca

SEQ ID NO: 82999 - DNA, 25 bp, Rattus norvegicus
accaggcctgccaagtatgcactac

SEQ ID NO: 83000 - DNA, 25 bp, Rattus norvegicus
accaggcctgcctagtatgcactac

SEQ ID NO: 83001 - DNA, 25 bp, Rattus norvegicus
accaggcctggacttaggtagtgct

SEQ ID NO: 83002 - DNA, 25 bp, Rattus norvegicus
accaggcctggagttaggtagtgct

SEQ ID NO: 83003 - DNA, 25 bp, Rattus norvegicus
accaggccttccacttgagggtaat

SEQ ID NO: 83004 - DNA, 25 bp, Rattus norvegicus
accaggccttcctcttgagggtaat

SEQ ID NO: 83005 - DNA, 25 bp, Rattus norvegicus
accaggcgcacaagcaaatgtatct

SEQ ID NO: 83006 - DNA, 25 bp, Rattus norvegicus
accaggcgcacatgcaaatgtatct

SEQ ID NO: 83007 - DNA, 25 bp, Rattus norvegicus
accaggcgctggaagcacctcacgg

SEQ ID NO: 83008 - DNA, 25 bp, Rattus norvegicus
accaggcgctggtagcacctcacgg

SEQ ID NO: 83009 - DNA, 25 bp, Rattus norvegicus
accaggcggcagagacagagcagct

SEQ ID NO: 83010 - DNA, 25 bp, Rattus norvegicus
accaggcggcagtgacagagcagct

SEQ ID NO: 83011 - DNA, 25 bp, Rattus norvegicus
accaggcggtccagcaagcgctgcg

SEQ ID NO: 83012 - DNA, 25 bp, Rattus norvegicus
accaggcggtcctgcaagcgctgcg

SEQ ID NO: 83013 - DNA, 25 bp, Rattus norvegicus
accaggctatgcagatgcttagtct

SEQ ID NO: 83014 - DNA, 25 bp, Rattus norvegicus
accaggctatgctgatgcttagtct

SEQ ID NO: 83015 - DNA, 25 bp, Rattus norvegicus
accaggctcaagctgttctttggga

SEQ ID NO: 83016 - DNA, 25 bp, Rattus norvegicus
accaggctcaaggtgttctttggga

SEQ ID NO: 83017 - DNA, 25 bp, Rattus norvegicus
accaggctcagtatctttgtcttaa

SEQ ID NO: 83018 - DNA, 25 bp, Rattus norvegicus
accaggctcagtcagatcctgctgg

SEQ ID NO: 83019 - DNA, 25 bp, Rattus norvegicus
accaggctcagtgagatcctgctgg

SEQ ID NO: 83020 - DNA, 25 bp, Rattus norvegicus
accaggctcagtttctttgtcttaa

SEQ ID NO: 83021 - DNA, 25 bp, Rattus norvegicus
accaggctccagaccaaaatatgtg

SEQ ID NO: 83022 - DNA, 25 bp, Rattus norvegicus
accaggctccagtccaaaatatgtg

SEQ ID NO: 83023 - DNA, 25 bp, Rattus norvegicus
accaggctccatcacgctcgctggg

SEQ ID NO: 83024 - DNA, 25 bp, Rattus norvegicus
accaggctccatgacgctcgctggg

SEQ ID NO: 83025 - DNA, 25 bp, Rattus norvegicus
accaggctcccgcatcacaaatgaa

SEQ ID NO: 83026 - DNA, 25 bp, Rattus norvegicus
accaggctcccggatcacaaatgaa

SEQ ID NO: 83027 - DNA, 25 bp, Rattus norvegicus
accaggctcctgagacagcagagca

SEQ ID NO: 83028 - DNA, 25 bp, Rattus norvegicus
accaggctcctgtgacagcagagca

SEQ ID NO: 83029 - DNA, 25 bp, Rattus norvegicus
accaggctctggcataattacagca

SEQ ID NO: 83030 - DNA, 25 bp, Rattus norvegicus
accaggctctgggataattacagca

SEQ ID NO: 83031 - DNA, 25 bp, Rattus norvegicus
accaggctgcgaatgggttctattt

SEQ ID NO: 83032 - DNA, 25 bp, Rattus norvegicus
accaggctgcgattgggttctattt

SEQ ID NO: 83033 - DNA, 25 bp, Rattus norvegicus
accaggctgggactctaatgtaatt

SEQ ID NO: 83034 - DNA, 25 bp, Rattus norvegicus
accaggctgggagtctaatgtaatt

SEQ ID NO: 83035 - DNA, 25 bp, Rattus norvegicus
accaggctgggtccagacttcccaa

SEQ ID NO: 83036 - DNA, 25 bp, Rattus norvegicus
accaggctgggtgcagacttcccaa

SEQ ID NO: 83037 - DNA, 25 bp, Rattus norvegicus
accaggctgtcccagagaggtctgc

SEQ ID NO: 83038 - DNA, 25 bp, Rattus norvegicus
accaggctgtccgagagaggtctgc

SEQ ID NO: 83039 - DNA, 25 bp, Rattus norvegicus
accaggcttcagacatgaggatcca

SEQ ID NO: 83040 - DNA, 25 bp, Rattus norvegicus
accaggcttcagtcatgaggatcca

SEQ ID NO: 83041 - DNA, 25 bp, Rattus norvegicus
accaggcttcggactctgagaattt

SEQ ID NO: 83042 - DNA, 25 bp, Rattus norvegicus
accaggcttcggtctctgagaattt

SEQ ID NO: 83043 - DNA, 25 bp, Rattus norvegicus
accaggcttgcaaaccgggagggat

SEQ ID NO: 83044 - DNA, 25 bp, Rattus norvegicus
accaggcttgcataccgggagggat

SEQ ID NO: 83045 - DNA, 25 bp, Rattus norvegicus
accaggcttgttaggccgagcacag

SEQ ID NO: 83046 - DNA, 25 bp, Rattus norvegicus
accaggcttgtttggccgagcacag

SEQ ID NO: 83047 - DNA, 25 bp, Rattus norvegicus
accaggctttccaatgacggttctg

SEQ ID NO: 83048 - DNA, 25 bp, Rattus norvegicus
accaggctttcctatgacggttctg

SEQ ID NO: 83049 - DNA, 25 bp, Rattus norvegicus
accaggcttttccacatcatgtata

SEQ ID NO: 83050 - DNA, 25 bp, Rattus norvegicus
accaggcttttcgacatcatgtata

SEQ ID NO: 83051 - DNA, 25 bp, Rattus norvegicus
accagggacactctagtcagggcta

SEQ ID NO: 83052 - DNA, 25 bp, Rattus norvegicus
accagggacactgtagtcagggcta

SEQ ID NO: 83053 - DNA, 25 bp, Rattus norvegicus
accagggactccagatttcagacag

SEQ ID NO: 83054 - DNA, 25 bp, Rattus norvegicus
accagggactcctgatttcagacag

SEQ ID NO: 83055 - DNA, 25 bp, Rattus norvegicus
accagggagcctaagtgttgttgaa

SEQ ID NO: 83056 - DNA, 25 bp, Rattus norvegicus
accagggagccttagtgttgttgaa

SEQ ID NO: 83057 - DNA, 25 bp, Rattus norvegicus
accagggagtctctggttgactact

SEQ ID NO: 83058 - DNA, 25 bp, Rattus norvegicus
accagggagtctgtggttgactact

SEQ ID NO: 83059 - DNA, 25 bp, Rattus norvegicus
accagggatgcacaattctcagtct

SEQ ID NO: 83060 - DNA, 25 bp, Rattus norvegicus
accagggatgcagaattctcagtct

SEQ ID NO: 83061 - DNA, 25 bp, Rattus norvegicus
accagggcacttagcctaattggca

SEQ ID NO: 83062 - DNA, 25 bp, Rattus norvegicus
accagggcactttgcctaattggca

SEQ ID NO: 83063 - DNA, 25 bp, Rattus norvegicus
accagggcagtcatttttaggcaga

SEQ ID NO: 83064 - DNA, 25 bp, Rattus norvegicus
accagggcagtcttttttaggcaga

SEQ ID NO: 83065 - DNA, 25 bp, Rattus norvegicus
accagggcatccagatcgtgtgtga

SEQ ID NO: 83066 - DNA, 25 bp, Rattus norvegicus
accagggcatcctgatcgtgtgtga

SEQ ID NO: 83067 - DNA, 25 bp, Rattus norvegicus
accagggccctgagtgttgagagtc

SEQ ID NO: 83068 - DNA, 25 bp, Rattus norvegicus
accagggccctgtgtgttgagagtc

SEQ ID NO: 83069 - DNA, 25 bp, Rattus norvegicus
accagggccgcaattcagaagtata

SEQ ID NO: 83070 - DNA, 25 bp, Rattus norvegicus
accagggccgcatttcagaagtata

SEQ ID NO: 83071 - DNA, 25 bp, Rattus norvegicus
accagggctactactcaacggagga

SEQ ID NO: 83072 - DNA, 25 bp, Rattus norvegicus
accagggctacttctcaacggagga

SEQ ID NO: 83073 - DNA, 25 bp, Rattus norvegicus
accagggctccacgaccgtggaaga

SEQ ID NO: 83074 - DNA, 25 bp, Rattus norvegicus
accagggctccaggaccgtggaaga

SEQ ID NO: 83075 - DNA, 25 bp, Rattus norvegicus
accagggctggaacgcagagatcac

SEQ ID NO: 83076 - DNA, 25 bp, Rattus norvegicus
accagggctggatcgcagagatcac

SEQ ID NO: 83077 - DNA, 25 bp, Rattus norvegicus
accagggctgtgagccagagccaag

SEQ ID NO: 83078 - DNA, 25 bp, Rattus norvegicus
accagggctgtgtgccagagccaag

SEQ ID NO: 83079 - DNA, 25 bp, Rattus norvegicus
accagggctttgcttgtgctcagca

SEQ ID NO: 83080 - DNA, 25 bp, Rattus norvegicus
accagggctttggttgtgctcagca

SEQ ID NO: 83081 - DNA, 25 bp, Rattus norvegicus
accagggtaatgatagcacttgcta

SEQ ID NO: 83082 - DNA, 25 bp, Rattus norvegicus
accagggtaatgttagcacttgcta

SEQ ID NO: 83083 - DNA, 25 bp, Rattus norvegicus
accagggtagtcacctccaggtata

SEQ ID NO: 83084 - DNA, 25 bp, Rattus norvegicus
accagggtagtctcctccaggtata

SEQ ID NO: 83085 - DNA, 25 bp, Rattus norvegicus
accagggtctttactattacatgta

SEQ ID NO: 83086 - DNA, 25 bp, Rattus norvegicus
accagggtcttttctattacatgta

SEQ ID NO: 83087 - DNA, 25 bp, Rattus norvegicus
accagggtgggcctttctctttctg

SEQ ID NO: 83088 - DNA, 25 bp, Rattus norvegicus
accagggtgggcgtttctctttctg

SEQ ID NO: 83089 - DNA, 25 bp, Rattus norvegicus
accagggtgtttcagtgtgccaatc

SEQ ID NO: 83090 - DNA, 25 bp, Rattus norvegicus
accagggtgtttgagtgtgccaatc

SEQ ID NO: 83091 - DNA, 25 bp, Rattus norvegicus
accagggttgggaatgttgctcagc

SEQ ID NO: 83092 - DNA, 25 bp, Rattus norvegicus
accagggttgggtatgttgctcagc

SEQ ID NO: 83093 - DNA, 25 bp, Rattus norvegicus
accaggtactcgctgtgcattgtag

SEQ ID NO: 83094 - DNA, 25 bp, Rattus norvegicus
accaggtactcggtgtgcattgtag

SEQ ID NO: 83095 - DNA, 25 bp, Rattus norvegicus
accaggtagttcagatgccatctca

SEQ ID NO: 83096 - DNA, 25 bp, Rattus norvegicus
accaggtagttctgatgccatctca

SEQ ID NO: 83097 - DNA, 25 bp, Rattus norvegicus
accaggtcagctacggagtcaggag

SEQ ID NO: 83098 - DNA, 25 bp, Rattus norvegicus
accaggtcagcttcggagtcaggag

SEQ ID NO: 83099 - DNA, 25 bp, Rattus norvegicus
accaggtcccatcagatactctgaa

SEQ ID NO: 83100 - DNA, 25 bp, Rattus norvegicus
accaggtcccatgagatactctgaa

SEQ ID NO: 83101 - DNA, 25 bp, Rattus norvegicus
accaggtcctggaggagtcggacaa

SEQ ID NO: 83102 - DNA, 25 bp, Rattus norvegicus
accaggtcctggtggagtcggacaa

SEQ ID NO: 83103 - DNA, 25 bp, Rattus norvegicus
accaggtcctgtcgctgtacggcaa

SEQ ID NO: 83104 - DNA, 25 bp, Rattus norvegicus
accaggtcctgtggctgtacggcaa

SEQ ID NO: 83105 - DNA, 25 bp, Rattus norvegicus
accaggtctcctacagttaaagcta

SEQ ID NO: 83106 - DNA, 25 bp, Rattus norvegicus
accaggtctccttcagttaaagcta

SEQ ID NO: 83107 - DNA, 25 bp, Rattus norvegicus
accaggtcttcaactgctcttggaa

SEQ ID NO: 83108 - DNA, 25 bp, Rattus norvegicus
accaggtcttcatctgctcttggaa

SEQ ID NO: 83109 - DNA, 25 bp, Rattus norvegicus
accaggtgcgttatcttgccgaagt

SEQ ID NO: 83110 - DNA, 25 bp, Rattus norvegicus
accaggtgcgttttcttgccgaagt

SEQ ID NO: 83111 - DNA, 25 bp, Rattus norvegicus
accaggtgctttctttgtactgcct

SEQ ID NO: 83112 - DNA, 25 bp, Rattus norvegicus
accaggtgctttgtttgtactgcct

SEQ ID NO: 83113 - DNA, 25 bp, Rattus norvegicus
accaggtggacaaccccatggagaa

SEQ ID NO: 83114 - DNA, 25 bp, Rattus norvegicus
accaggtggacatccccatggagaa

SEQ ID NO: 83115 - DNA, 25 bp, Rattus norvegicus
accaggtggcagagtggctcttgat

SEQ ID NO: 83116 - DNA, 25 bp, Rattus norvegicus
accaggtggcagtgtggctcttgat

SEQ ID NO: 83117 - DNA, 25 bp, Rattus norvegicus
accaggtgtatgatctgaacacgca

SEQ ID NO: 83118 - DNA, 25 bp, Rattus norvegicus
accaggtgtatgttctgaacacgca

SEQ ID NO: 83119 - DNA, 25 bp, Rattus norvegicus
accaggtgtccgcagagtttgccat

SEQ ID NO: 83120 - DNA, 25 bp, Rattus norvegicus
accaggtgtccggagagtttgccat

SEQ ID NO: 83121 - DNA, 25 bp, Rattus norvegicus
accaggtgttttcagctgtgtccaa

SEQ ID NO: 83122 - DNA, 25 bp, Rattus norvegicus
accaggtgttttgagctgtgtccaa

SEQ ID NO: 83123 - DNA, 25 bp, Rattus norvegicus
accaggttaaggctgtgaccgcata

SEQ ID NO: 83124 - DNA, 25 bp, Rattus norvegicus
accaggttaagggtgtgaccgcata

SEQ ID NO: 83125 - DNA, 25 bp, Rattus norvegicus
accaggttagccctatatttgtggc

SEQ ID NO: 83126 - DNA, 25 bp, Rattus norvegicus
accaggttagccgtatatttgtggc

SEQ ID NO: 83127 - DNA, 25 bp, Rattus norvegicus
accaggttagttatagcagcacatc

SEQ ID NO: 83128 - DNA, 25 bp, Rattus norvegicus
accaggttagttttagcagcacatc

SEQ ID NO: 83129 - DNA, 25 bp, Rattus norvegicus
accaggttcctacctgggctgtgga

SEQ ID NO: 83130 - DNA, 25 bp, Rattus norvegicus
accaggttcctagctgggctgtgga

SEQ ID NO: 83131 - DNA, 25 bp, Rattus norvegicus
accaggttctggagcgaatgcgccc

SEQ ID NO: 83132 - DNA, 25 bp, Rattus norvegicus
accaggttctggtgcgaatgcgccc

SEQ ID NO: 83133 - DNA, 25 bp, Rattus norvegicus
accaggttgggtcattctctagaat

SEQ ID NO: 83134 - DNA, 25 bp, Rattus norvegicus
accaggttgggtgattctctagaat

SEQ ID NO: 83135 - DNA, 25 bp, Rattus norvegicus
accagtaaacttaaatcagctacat

SEQ ID NO: 83136 - DNA, 25 bp, Rattus norvegicus
accagtaaactttaatcagctacat

SEQ ID NO: 83137 - DNA, 25 bp, Rattus norvegicus
accagtacaagtccatcccggtaga

SEQ ID NO: 83138 - DNA, 25 bp, Rattus norvegicus
accagtacaagtgcatcccggtaga

SEQ ID NO: 83139 - DNA, 25 bp, Rattus norvegicus
accagtacctctatgctatgacgga

SEQ ID NO: 83140 - DNA, 25 bp, Rattus norvegicus
accagtacctctttgctatgacgga

SEQ ID NO: 83141 - DNA, 25 bp, Rattus norvegicus
accagtagctgaacttcaggcattt

SEQ ID NO: 83142 - DNA, 25 bp, Rattus norvegicus
accagtagctgatcttcaggcattt

SEQ ID NO: 83143 - DNA, 25 bp, Rattus norvegicus
accagtagtagtattcaggcctcga

SEQ ID NO: 83144 - DNA, 25 bp, Rattus norvegicus
accagtagtagttttcaggcctcga

SEQ ID NO: 83145 - DNA, 25 bp, Rattus norvegicus
accagtatattgaccccgtggtata

SEQ ID NO: 83146 - DNA, 25 bp, Rattus norvegicus
accagtatattgtccccgtggtata

SEQ ID NO: 83147 - DNA, 25 bp, Rattus norvegicus
accagtatgtggcaggcaacttccc

SEQ ID NO: 83148 - DNA, 25 bp, Rattus norvegicus
accagtatgtgggaggcaacttccc

SEQ ID NO: 83149 - DNA, 25 bp, Rattus norvegicus
accagtatttgcatgtacggcagca

SEQ ID NO: 83150 - DNA, 25 bp, Rattus norvegicus
accagtatttgcttgtacggcagca

SEQ ID NO: 83151 - DNA, 25 bp, Rattus norvegicus
accagtcaagacagccagggaaaca

SEQ ID NO: 83152 - DNA, 25 bp, Rattus norvegicus
accagtcaagactgccagggaaaca

SEQ ID NO: 83153 - DNA, 25 bp, Rattus norvegicus
accagtcagaggctgagtgtccatt

SEQ ID NO: 83154 - DNA, 25 bp, Rattus norvegicus
accagtcagagggtgagtgtccatt

SEQ ID NO: 83155 - DNA, 25 bp, Rattus norvegicus
accagtcagattattccaggattcc

SEQ ID NO: 83156 - DNA, 25 bp, Rattus norvegicus
accagtcagatttttccaggattcc

SEQ ID NO: 83157 - DNA, 25 bp, Rattus norvegicus
accagtcaggcccatctgggaataa

SEQ ID NO: 83158 - DNA, 25 bp, Rattus norvegicus
accagtcaggccgatctgggaataa

SEQ ID NO: 83159 - DNA, 25 bp, Rattus norvegicus
accagtcatgtccttcactattgtt

SEQ ID NO: 83160 - DNA, 25 bp, Rattus norvegicus
accagtcatgtcgttcactattgtt

SEQ ID NO: 83161 - DNA, 25 bp, Rattus norvegicus
accagtccccagagatttgaatgga

SEQ ID NO: 83162 - DNA, 25 bp, Rattus norvegicus
accagtccccagtgatttgaatgga

SEQ ID NO: 83163 - DNA, 25 bp, Rattus norvegicus
accagtccctggctgtgcttgtagg

SEQ ID NO: 83164 - DNA, 25 bp, Rattus norvegicus
accagtccctgggtgtgcttgtagg

SEQ ID NO: 83165 - DNA, 25 bp, Rattus norvegicus
accagtccgagtacgaaggcttcga

SEQ ID NO: 83166 - DNA, 25 bp, Rattus norvegicus
accagtccgagttcgaaggcttcga

SEQ ID NO: 83167 - DNA, 25 bp, Rattus norvegicus
accagtccggccatgagctcacaga

SEQ ID NO: 83168 - DNA, 25 bp, Rattus norvegicus
accagtccggccttgagctcacaga

SEQ ID NO: 83169 - DNA, 25 bp, Rattus norvegicus
accagtcctggaacccttgggatga

SEQ ID NO: 83170 - DNA, 25 bp, Rattus norvegicus
accagtcctggatcccttgggatga

SEQ ID NO: 83171 - DNA, 25 bp, Rattus norvegicus
accagtccttagattacagttagca

SEQ ID NO: 83172 - DNA, 25 bp, Rattus norvegicus
accagtccttagtttacagttagca

SEQ ID NO: 83173 - DNA, 25 bp, Rattus norvegicus
accagtccttcactcttttgttcag

SEQ ID NO: 83174 - DNA, 25 bp, Rattus norvegicus
accagtccttcagtcttttgttcag

SEQ ID NO: 83175 - DNA, 25 bp, Rattus norvegicus
accagtctcattcctcatccgagaa

SEQ ID NO: 83176 - DNA, 25 bp, Rattus norvegicus
accagtctcattgctcatccgagaa

SEQ ID NO: 83177 - DNA, 25 bp, Rattus norvegicus
accagtctccggcaactatggcaaa

SEQ ID NO: 83178 - DNA, 25 bp, Rattus norvegicus
accagtctccgggaactatggcaaa

SEQ ID NO: 83179 - DNA, 25 bp, Rattus norvegicus
accagtctccttactgtaagcattt

SEQ ID NO: 83180 - DNA, 25 bp, Rattus norvegicus
accagtctcctttctgtaagcattt

SEQ ID NO: 83181 - DNA, 25 bp, Rattus norvegicus
accagtctgcatagtctgtgctgta

SEQ ID NO: 83182 - DNA, 25 bp, Rattus norvegicus
accagtctgcattgtctgtgctgta

SEQ ID NO: 83183 - DNA, 25 bp, Rattus norvegicus
accagtctgtttaaatgtaggcgtt

SEQ ID NO: 83184 - DNA, 25 bp, Rattus norvegicus
accagtctgttttaatgtaggcgtt

SEQ ID NO: 83185 - DNA, 25 bp, Rattus norvegicus
accagtgaatgaagccctagtccta

SEQ ID NO: 83186 - DNA, 25 bp, Rattus norvegicus
accagtgaatgatgccctagtccta

SEQ ID NO: 83187 - DNA, 25 bp, Rattus norvegicus
accagtgaccagagctttaatcttg

SEQ ID NO: 83188 - DNA, 25 bp, Rattus norvegicus
accagtgaccagtgctttaatcttg

SEQ ID NO: 83189 - DNA, 25 bp, Rattus norvegicus
accagtgaccatcccacagttgtgt

SEQ ID NO: 83190 - DNA, 25 bp, Rattus norvegicus
accagtgaccatgccacagttgtgt

SEQ ID NO: 83191 - DNA, 25 bp, Rattus norvegicus
accagtgacttcaccgtcagtgtgt

SEQ ID NO: 83192 - DNA, 25 bp, Rattus norvegicus
accagtgacttctccgtcagtgtgt

SEQ ID NO: 83193 - DNA, 25 bp, Rattus norvegicus
accagtgacttgaatgactcttgtg

SEQ ID NO: 83194 - DNA, 25 bp, Rattus norvegicus
accagtgacttgtatgactcttgtg

SEQ ID NO: 83195 - DNA, 25 bp, Rattus norvegicus
accagtgagaagatgtgcagagccc

SEQ ID NO: 83196 - DNA, 25 bp, Rattus norvegicus
accagtgagaagttgtgcagagccc

SEQ ID NO: 83197 - DNA, 25 bp, Rattus norvegicus
accagtgagctgctccagtgggtaa

SEQ ID NO: 83198 - DNA, 25 bp, Rattus norvegicus
accagtgagctggtccagtgggtaa

SEQ ID NO: 83199 - DNA, 25 bp, Rattus norvegicus
accagtgaggttagcatgtgcctga

SEQ ID NO: 83200 - DNA, 25 bp, Rattus norvegicus
accagtgaggtttgcatgtgcctga

SEQ ID NO: 83201 - DNA, 25 bp, Rattus norvegicus
accagtgataacctcccggtgcgtg

SEQ ID NO: 83202 - DNA, 25 bp, Rattus norvegicus
accagtgataacgtcccggtgcgtg

SEQ ID NO: 83203 - DNA, 25 bp, Rattus norvegicus
accagtgatgtgatgattctgccaa

SEQ ID NO: 83204 - DNA, 25 bp, Rattus norvegicus
accagtgatgtgttgattctgccaa

SEQ ID NO: 83205 - DNA, 25 bp, Rattus norvegicus
accagtgcacgaacgcctgagagtt

SEQ ID NO: 83206 - DNA, 25 bp, Rattus norvegicus
accagtgcacgatcgcctgagagtt

SEQ ID NO: 83207 - DNA, 25 bp, Rattus norvegicus
accagtgcagaccagtatctctttg

SEQ ID NO: 83208 - DNA, 25 bp, Rattus norvegicus
accagtgcagacgagtatctctttg

SEQ ID NO: 83209 - DNA, 25 bp, Rattus norvegicus
accagtgccacccatgaagacgctt

SEQ ID NO: 83210 - DNA, 25 bp, Rattus norvegicus
accagtgccaccgatgaagacgctt

SEQ ID NO: 83211 - DNA, 25 bp, Rattus norvegicus
accagtgcctctatttacagatggc

SEQ ID NO: 83212 - DNA, 25 bp, Rattus norvegicus
accagtgcctctttttacagatggc

SEQ ID NO: 83213 - DNA, 25 bp, Rattus norvegicus
accagtgcctgaagatgtcctctca

SEQ ID NO: 83214 - DNA, 25 bp, Rattus norvegicus
accagtgcctgatgatgtcctctca

SEQ ID NO: 83215 - DNA, 25 bp, Rattus norvegicus
accagtgccttgacattcgattgaa

SEQ ID NO: 83216 - DNA, 25 bp, Rattus norvegicus
accagtgccttgtcattcgattgaa

SEQ ID NO: 83217 - DNA, 25 bp, Rattus norvegicus
accagtgctagcaagaaccctttag

SEQ ID NO: 83218 - DNA, 25 bp, Rattus norvegicus
accagtgctagctagaaccctttag

SEQ ID NO: 83219 - DNA, 25 bp, Rattus norvegicus
accagtgctctgcactttttaaagc

SEQ ID NO: 83220 - DNA, 25 bp, Rattus norvegicus
accagtgctctggactttttaaagc

SEQ ID NO: 83221 - DNA, 25 bp, Rattus norvegicus
accagtgctgcaatgatgacttcca

SEQ ID NO: 83222 - DNA, 25 bp, Rattus norvegicus
accagtgctgcattgatgacttcca

SEQ ID NO: 83223 - DNA, 25 bp, Rattus norvegicus
accagtgctgctccgggacatgcgc

SEQ ID NO: 83224 - DNA, 25 bp, Rattus norvegicus
accagtgctgctgcgggacatgcgc

SEQ ID NO: 83225 - DNA, 25 bp, Rattus norvegicus
accagtggattgagctgccattact

SEQ ID NO: 83226 - DNA, 25 bp, Rattus norvegicus
accagtggattgtgctgccattact

SEQ ID NO: 83227 - DNA, 25 bp, Rattus norvegicus
accagtggcaggaagcgcatatctc

SEQ ID NO: 83228 - DNA, 25 bp, Rattus norvegicus
accagtggcaggtagcgcatatctc

SEQ ID NO: 83229 - DNA, 25 bp, Rattus norvegicus
accagtggccagcttcaggctatca

SEQ ID NO: 83230 - DNA, 25 bp, Rattus norvegicus
accagtggccaggttcaggctatca

SEQ ID NO: 83231 - DNA, 25 bp, Rattus norvegicus
accagtggccttccacaatctgtaa

SEQ ID NO: 83232 - DNA, 25 bp, Rattus norvegicus
accagtggccttgcacaatctgtaa

SEQ ID NO: 83233 - DNA, 25 bp, Rattus norvegicus
accagtggctgtatctaaacctgaa

SEQ ID NO: 83234 - DNA, 25 bp, Rattus norvegicus
accagtggctgtttctaaacctgaa

SEQ ID NO: 83235 - DNA, 25 bp, Rattus norvegicus
accagtggtcatccggcatcttaga

SEQ ID NO: 83236 - DNA, 25 bp, Rattus norvegicus
accagtggtcatgcggcatcttaga

SEQ ID NO: 83237 - DNA, 25 bp, Rattus norvegicus
accagtggtgtgctttcctaatgaa

SEQ ID NO: 83238 - DNA, 25 bp, Rattus norvegicus
accagtggtgtggtttcctaatgaa

SEQ ID NO: 83239 - DNA, 25 bp, Rattus norvegicus
accagtgtagatctaaccagtagct

SEQ ID NO: 83240 - DNA, 25 bp, Rattus norvegicus
accagtgtagatgtaaccagtagct

SEQ ID NO: 83241 - DNA, 25 bp, Rattus norvegicus
accagtgtcccgaatgcgagaagaa

SEQ ID NO: 83242 - DNA, 25 bp, Rattus norvegicus
accagtgtcccgtatgcgagaagaa

SEQ ID NO: 83243 - DNA, 25 bp, Rattus norvegicus
accagtgtctatcgattctgtgcca

SEQ ID NO: 83244 - DNA, 25 bp, Rattus norvegicus
accagtgtctatggattctgtgcca

SEQ ID NO: 83245 - DNA, 25 bp, Rattus norvegicus
accagtgtctttctggccatcttta

SEQ ID NO: 83246 - DNA, 25 bp, Rattus norvegicus
accagtgtctttgtggccatcttta

SEQ ID NO: 83247 - DNA, 25 bp, Rattus norvegicus
accagtgtgatcatgtgggacccct

SEQ ID NO: 83248 - DNA, 25 bp, Rattus norvegicus
accagtgtgatccttgcccggaaag

SEQ ID NO: 83249 - DNA, 25 bp, Rattus norvegicus
accagtgtgatcgttgcccggaaag

SEQ ID NO: 83250 - DNA, 25 bp, Rattus norvegicus
accagtgtgatcttgtgggacccct

SEQ ID NO: 83251 - DNA, 25 bp, Rattus norvegicus
accagtgtgcgacatccttcaagga

SEQ ID NO: 83252 - DNA, 25 bp, Rattus norvegicus
accagtgtgcgagatccttcaagga

SEQ ID NO: 83253 - DNA, 25 bp, Rattus norvegicus
accagtgtggtcatcagggctcctg

SEQ ID NO: 83254 - DNA, 25 bp, Rattus norvegicus
accagtgtggtcttcagggctcctg

SEQ ID NO: 83255 - DNA, 25 bp, Rattus norvegicus
accagtgtggtgatgctgttctaca

SEQ ID NO: 83256 - DNA, 25 bp, Rattus norvegicus
accagtgtggtgttgctgttctaca

SEQ ID NO: 83257 - DNA, 25 bp, Rattus norvegicus
accagtgtggttcacaattgcagct

SEQ ID NO: 83258 - DNA, 25 bp, Rattus norvegicus
accagtgtggttgacaattgcagct

SEQ ID NO: 83259 - DNA, 25 bp, Rattus norvegicus
accagtgtgtatcaggtgtgtcctc

SEQ ID NO: 83260 - DNA, 25 bp, Rattus norvegicus
accagtgtgtatgaggtgtgtcctc

SEQ ID NO: 83261 - DNA, 25 bp, Rattus norvegicus
accagtgtgtcacttttgtagatca

SEQ ID NO: 83262 - DNA, 25 bp, Rattus norvegicus
accagtgtgtcagttttgtagatca

SEQ ID NO: 83263 - DNA, 25 bp, Rattus norvegicus
accagtgtgtccagcctgacggagc

SEQ ID NO: 83264 - DNA, 25 bp, Rattus norvegicus
accagtgtgtcctgcctgacggagc

SEQ ID NO: 83265 - DNA, 25 bp, Rattus norvegicus
accagtgtgtgcctactttgtataa

SEQ ID NO: 83266 - DNA, 25 bp, Rattus norvegicus
accagtgtgtgcgtactttgtataa

SEQ ID NO: 83267 - DNA, 25 bp, Rattus norvegicus
accagtgtttttcttaagtgcataa

SEQ ID NO: 83268 - DNA, 25 bp, Rattus norvegicus
accagtgtttttgttaagtgcataa

SEQ ID NO: 83269 - DNA, 25 bp, Rattus norvegicus
accagttaaacgatcctcagatgag

SEQ ID NO: 83270 - DNA, 25 bp, Rattus norvegicus
accagttaaacgttcctcagatgag

SEQ ID NO: 83271 - DNA, 25 bp, Rattus norvegicus
accagttaggcccagcaggaagtca

SEQ ID NO: 83272 - DNA, 25 bp, Rattus norvegicus
accagttaggccgagcaggaagtca

SEQ ID NO: 83273 - DNA, 25 bp, Rattus norvegicus
accagttcatgacactgagtgcaaa

SEQ ID NO: 83274 - DNA, 25 bp, Rattus norvegicus
accagttcatgagactgagtgcaaa

SEQ ID NO: 83275 - DNA, 25 bp, Rattus norvegicus
accagttcattgcatgctgacgcga

SEQ ID NO: 83276 - DNA, 25 bp, Rattus norvegicus
accagttcattggatgctgacgcga

SEQ ID NO: 83277 - DNA, 25 bp, Rattus norvegicus
accagttccaagagaggcgcggcga

SEQ ID NO: 83278 - DNA, 25 bp, Rattus norvegicus
accagttccaagtgaggcgcggcga

SEQ ID NO: 83279 - DNA, 25 bp, Rattus norvegicus
accagttccccgaagtgtgtgcgcc

SEQ ID NO: 83280 - DNA, 25 bp, Rattus norvegicus
accagttccccgtagtgtgtgcgcc

SEQ ID NO: 83281 - DNA, 25 bp, Rattus norvegicus
accagttctgtgaaacggtacctca

SEQ ID NO: 83282 - DNA, 25 bp, Rattus norvegicus
accagttctgtgtaacggtacctca

SEQ ID NO: 83283 - DNA, 25 bp, Rattus norvegicus
accagttgactaaagctatttatga

SEQ ID NO: 83284 - DNA, 25 bp, Rattus norvegicus
accagttgactaaagtgtgacagca

SEQ ID NO: 83285 - DNA, 25 bp, Rattus norvegicus
accagttgactatagctatttatga

SEQ ID NO: 83286 - DNA, 25 bp, Rattus norvegicus
accagttgactatagtgtgacagca

SEQ ID NO: 83287 - DNA, 25 bp, Rattus norvegicus
accagttgagttctgacttacattg

SEQ ID NO: 83288 - DNA, 25 bp, Rattus norvegicus
accagttgagttgtgacttacattg

SEQ ID NO: 83289 - DNA, 25 bp, Rattus norvegicus
accagttgctagcagacttctgtaa

SEQ ID NO: 83290 - DNA, 25 bp, Rattus norvegicus
accagttgctaggagacttctgtaa

SEQ ID NO: 83291 - DNA, 25 bp, Rattus norvegicus
accagttggcctactggctgaagtt

SEQ ID NO: 83292 - DNA, 25 bp, Rattus norvegicus
accagttggccttctggctgaagtt

SEQ ID NO: 83293 - DNA, 25 bp, Rattus norvegicus
accagttgtgacagacttgtcccat

SEQ ID NO: 83294 - DNA, 25 bp, Rattus norvegicus
accagttgtgactgacttgtcccat

SEQ ID NO: 83295 - DNA, 25 bp, Rattus norvegicus
accagtttaaccctcgatgaagtca

SEQ ID NO: 83296 - DNA, 25 bp, Rattus norvegicus
accagtttaaccgtcgatgaagtca

SEQ ID NO: 83297 - DNA, 25 bp, Rattus norvegicus
accagtttacaaatattcgtctcta

SEQ ID NO: 83298 - DNA, 25 bp, Rattus norvegicus
accagtttacaattattcgtctcta

SEQ ID NO: 83299 - DNA, 25 bp, Rattus norvegicus
accagtttcatcaagctggaaatag

SEQ ID NO: 83300 - DNA, 25 bp, Rattus norvegicus
accagtttcatcaagtgcctaacca

SEQ ID NO: 83301 - DNA, 25 bp, Rattus norvegicus
accagtttcatctagctggaaatag

SEQ ID NO: 83302 - DNA, 25 bp, Rattus norvegicus
accagtttcatctagtgcctaacca

SEQ ID NO: 83303 - DNA, 25 bp, Rattus norvegicus
accagtttcttcagaccatcttttt

SEQ ID NO: 83304 - DNA, 25 bp, Rattus norvegicus
accagtttcttctgaccatcttttt

SEQ ID NO: 83305 - DNA, 25 bp, Rattus norvegicus
accagtttgatgagatcagcccctc

SEQ ID NO: 83306 - DNA, 25 bp, Rattus norvegicus
accagtttgatgtgatcagcccctc

SEQ ID NO: 83307 - DNA, 25 bp, Rattus norvegicus
accagtttggtactctcaccttgga

SEQ ID NO: 83308 - DNA, 25 bp, Rattus norvegicus
accagtttggtagtctcaccttgga

SEQ ID NO: 83309 - DNA, 25 bp, Rattus norvegicus
accagtttggtcaccaaccacataa

SEQ ID NO: 83310 - DNA, 25 bp, Rattus norvegicus
accagtttggtctccaaccacataa

SEQ ID NO: 83311 - DNA, 25 bp, Rattus norvegicus
accagttttcaaccggagacaggat

SEQ ID NO: 83312 - DNA, 25 bp, Rattus norvegicus
accagttttcaagcggagacaggat

SEQ ID NO: 83313 - DNA, 25 bp, Rattus norvegicus
accagttttgtcctgctggctccac

SEQ ID NO: 83314 - DNA, 25 bp, Rattus norvegicus
accagttttgtcgtgctggctccac

SEQ ID NO: 83315 - DNA, 25 bp, Rattus norvegicus
accataacagtcatggcctagcaca

SEQ ID NO: 83316 - DNA, 25 bp, Rattus norvegicus
accataacagtcttggcctagcaca

SEQ ID NO: 83317 - DNA, 25 bp, Rattus norvegicus
accataaccacaatgaagcacagga

SEQ ID NO: 83318 - DNA, 25 bp, Rattus norvegicus
accataaccacattgaagcacagga

SEQ ID NO: 83319 - DNA, 25 bp, Rattus norvegicus
accataaccgtgctctgtactgaag

SEQ ID NO: 83320 - DNA, 25 bp, Rattus norvegicus
accataaccgtggtctgtactgaag

SEQ ID NO: 83321 - DNA, 25 bp, Rattus norvegicus
accataagcaccattttgcaacttt

SEQ ID NO: 83322 - DNA, 25 bp, Rattus norvegicus
accataagcacctttttgcaacttt

SEQ ID NO: 83323 - DNA, 25 bp, Rattus norvegicus
accataatgtatctcttctacctgt

SEQ ID NO: 83324 - DNA, 25 bp, Rattus norvegicus
accataatgtatgtcttctacctgt

SEQ ID NO: 83325 - DNA, 25 bp, Rattus norvegicus
accatactcagtctcttacgcttag

SEQ ID NO: 83326 - DNA, 25 bp, Rattus norvegicus
accatactcagtgtcttacgcttag

SEQ ID NO: 83327 - DNA, 25 bp, Rattus norvegicus
accatactggctattgtctctggca

SEQ ID NO: 83328 - DNA, 25 bp, Rattus norvegicus
accatactggcttttgtctctggca

SEQ ID NO: 83329 - DNA, 25 bp, Rattus norvegicus
accatagacatgagctagggccagc

SEQ ID NO: 83330 - DNA, 25 bp, Rattus norvegicus
accatagacatgtgctagggccagc

SEQ ID NO: 83331 - DNA, 25 bp, Rattus norvegicus
accatagagacgacgcctcgctaga

SEQ ID NO: 83332 - DNA, 25 bp, Rattus norvegicus
accatagagacgtcgcctcgctaga

SEQ ID NO: 83333 - DNA, 25 bp, Rattus norvegicus
accatagcatccatggctgtgtgtc

SEQ ID NO: 83334 - DNA, 25 bp, Rattus norvegicus
accatagcatccttggctgtgtgtc

SEQ ID NO: 83335 - DNA, 25 bp, Rattus norvegicus
accatagccctgagtgtttgatttc

SEQ ID NO: 83336 - DNA, 25 bp, Rattus norvegicus
accatagccctgtgtgtttgatttc

SEQ ID NO: 83337 - DNA, 25 bp, Rattus norvegicus
accatagcgcccactgtaaacaaat

SEQ ID NO: 83338 - DNA, 25 bp, Rattus norvegicus
accatagcgccctctgtaaacaaat

SEQ ID NO: 83339 - DNA, 25 bp, Rattus norvegicus
accatagctgcgatttcctctggtc

SEQ ID NO: 83340 - DNA, 25 bp, Rattus norvegicus
accatagctgcgttttcctctggtc

SEQ ID NO: 83341 - DNA, 25 bp, Rattus norvegicus
accataggactacgcggtattttca

SEQ ID NO: 83342 - DNA, 25 bp, Rattus norvegicus
accataggactaggcggtattttca

SEQ ID NO: 83343 - DNA, 25 bp, Rattus norvegicus
accatagtccctatatgcctttttc

SEQ ID NO: 83344 - DNA, 25 bp, Rattus norvegicus
accatagtccctttatgcctttttc

SEQ ID NO: 83345 - DNA, 25 bp, Rattus norvegicus
accatagtggtcagcttgcctgagg

SEQ ID NO: 83346 - DNA, 25 bp, Rattus norvegicus
accatagtggtctgcttgcctgagg

SEQ ID NO: 83347 - DNA, 25 bp, Rattus norvegicus
accatatagcccaccttgagcaaag

SEQ ID NO: 83348 - DNA, 25 bp, Rattus norvegicus
accatatagccctccttgagcaaag

SEQ ID NO: 83349 - DNA, 25 bp, Rattus norvegicus
accatatctgatacttcaccaatcc

SEQ ID NO: 83350 - DNA, 25 bp, Rattus norvegicus
accatatctgattcttcaccaatcc

SEQ ID NO: 83351 - DNA, 25 bp, Rattus norvegicus
accatatctggtcacatttttgttt

SEQ ID NO: 83352 - DNA, 25 bp, Rattus norvegicus
accatatctggtgacatttttgttt

SEQ ID NO: 83353 - DNA, 25 bp, Rattus norvegicus
accatatgcccgacgtcatgattcg

SEQ ID NO: 83354 - DNA, 25 bp, Rattus norvegicus
accatatgcccgtcgtcatgattcg

SEQ ID NO: 83355 - DNA, 25 bp, Rattus norvegicus
accatcaagcttacttgcgcaagca

SEQ ID NO: 83356 - DNA, 25 bp, Rattus norvegicus
accatcaagctttcttgcgcaagca

SEQ ID NO: 83357 - DNA, 25 bp, Rattus norvegicus
accatcaaggatctgcatttttgtt

SEQ ID NO: 83358 - DNA, 25 bp, Rattus norvegicus
accatcaaggatgtgcatttttgtt

SEQ ID NO: 83359 - DNA, 25 bp, Rattus norvegicus
accatcaataataccagtcctaggg

SEQ ID NO: 83360 - DNA, 25 bp, Rattus norvegicus
accatcaataattccagtcctaggg

SEQ ID NO: 83361 - DNA, 25 bp, Rattus norvegicus
accatcaccacgctgagatgctgat

SEQ ID NO: 83362 - DNA, 25 bp, Rattus norvegicus
accatcaccacggtgagatgctgat

SEQ ID NO: 83363 - DNA, 25 bp, Rattus norvegicus
accatcaccatccaggcttgagaac

SEQ ID NO: 83364 - DNA, 25 bp, Rattus norvegicus
accatcaccatcgaggcttgagaac

SEQ ID NO: 83365 - DNA, 25 bp, Rattus norvegicus
accatcaccatgcatgagtttccag

SEQ ID NO: 83366 - DNA, 25 bp, Rattus norvegicus
accatcaccatggatgagtttccag

SEQ ID NO: 83367 - DNA, 25 bp, Rattus norvegicus
accatcacctggacaatttccatat

SEQ ID NO: 83368 - DNA, 25 bp, Rattus norvegicus
accatcacctggtcaatttccatat

SEQ ID NO: 83369 - DNA, 25 bp, Rattus norvegicus
accatcacgtgtcgcacttttgtgg

SEQ ID NO: 83370 - DNA, 25 bp, Rattus norvegicus
accatcacgtgtggcacttttgtgg

SEQ ID NO: 83371 - DNA, 25 bp, Rattus norvegicus
accatcactaggctccgggaaagtt

SEQ ID NO: 83372 - DNA, 25 bp, Rattus norvegicus
accatcactagggtccgggaaagtt

SEQ ID NO: 83373 - DNA, 25 bp, Rattus norvegicus
accatcactgtccagttttagccag

SEQ ID NO: 83374 - DNA, 25 bp, Rattus norvegicus
accatcactgtcgagttttagccag

SEQ ID NO: 83375 - DNA, 25 bp, Rattus norvegicus
accatcagactgagccagcactgga

SEQ ID NO: 83376 - DNA, 25 bp, Rattus norvegicus
accatcagactgtgccagcactgga

SEQ ID NO: 83377 - DNA, 25 bp, Rattus norvegicus
accatcagccagattgcagctttga

SEQ ID NO: 83378 - DNA, 25 bp, Rattus norvegicus
accatcagccagtttgcagctttga

SEQ ID NO: 83379 - DNA, 25 bp, Rattus norvegicus
accatcagccctagagctttgagct

SEQ ID NO: 83380 - DNA, 25 bp, Rattus norvegicus
accatcagcccttgagctttgagct

SEQ ID NO: 83381 - DNA, 25 bp, Rattus norvegicus
accatcagttcaatgtgttgtaatt

SEQ ID NO: 83382 - DNA, 25 bp, Rattus norvegicus
accatcagttcattgtgttgtaatt

SEQ ID NO: 83383 - DNA, 25 bp, Rattus norvegicus
accatcatattgagcctttctgcaa

SEQ ID NO: 83384 - DNA, 25 bp, Rattus norvegicus
accatcatattgtgcctttctgcaa

SEQ ID NO: 83385 - DNA, 25 bp, Rattus norvegicus
accatcatcaaccaagtcttatcac

SEQ ID NO: 83386 - DNA, 25 bp, Rattus norvegicus
accatcatcaacgaagtcttatcac

SEQ ID NO: 83387 - DNA, 25 bp, Rattus norvegicus
accatcatcactcgccggtagctat

SEQ ID NO: 83388 - DNA, 25 bp, Rattus norvegicus
accatcatcactggccggtagctat

SEQ ID NO: 83389 - DNA, 25 bp, Rattus norvegicus
accatcatcatccttattgctgtaa

SEQ ID NO: 83390 - DNA, 25 bp, Rattus norvegicus
accatcatcatcgttattgctgtaa

SEQ ID NO: 83391 - DNA, 25 bp, Rattus norvegicus
accatcatcgcacgaatgagtgcat

SEQ ID NO: 83392 - DNA, 25 bp, Rattus norvegicus
accatcatcgcaggaatgagtgcat

SEQ ID NO: 83393 - DNA, 25 bp, Rattus norvegicus
accatcatgagtctccaccgtggag

SEQ ID NO: 83394 - DNA, 25 bp, Rattus norvegicus
accatcatgagtgtccaccgtggag

SEQ ID NO: 83395 - DNA, 25 bp, Rattus norvegicus
accatcatgcataagttctgtccca

SEQ ID NO: 83396 - DNA, 25 bp, Rattus norvegicus
accatcatgcattagttctgtccca

SEQ ID NO: 83397 - DNA, 25 bp, Rattus norvegicus
accatcattccacaagttcccataa

SEQ ID NO: 83398 - DNA, 25 bp, Rattus norvegicus
accatcattccagaagttcccataa

SEQ ID NO: 83399 - DNA, 25 bp, Rattus norvegicus
accatcattttgctcttggccgtga

SEQ ID NO: 83400 - DNA, 25 bp, Rattus norvegicus
accatcattttggtcttggccgtga

SEQ ID NO: 83401 - DNA, 25 bp, Rattus norvegicus
accatccaaggcattctgtcttgct

SEQ ID NO: 83402 - DNA, 25 bp, Rattus norvegicus
accatccaaggctttctgtcttgct

SEQ ID NO: 83403 - DNA, 25 bp, Rattus norvegicus
accatccaatgtcactcgggctttg

SEQ ID NO: 83404 - DNA, 25 bp, Rattus norvegicus
accatccaatgtgactcgggctttg

SEQ ID NO: 83405 - DNA, 25 bp, Rattus norvegicus
accatccaattaatactgtccaagt

SEQ ID NO: 83406 - DNA, 25 bp, Rattus norvegicus
accatccaattattactgtccaagt

SEQ ID NO: 83407 - DNA, 25 bp, Rattus norvegicus
accatccaccgaccacagagattga

SEQ ID NO: 83408 - DNA, 25 bp, Rattus norvegicus
accatccaccgagcacagagattga

SEQ ID NO: 83409 - DNA, 25 bp, Rattus norvegicus
accatccactgactccagcttggaa

SEQ ID NO: 83410 - DNA, 25 bp, Rattus norvegicus
accatccactgagtccagcttggaa

SEQ ID NO: 83411 - DNA, 25 bp, Rattus norvegicus
accatccatggtaaagctttcaaga

SEQ ID NO: 83412 - DNA, 25 bp, Rattus norvegicus
accatccatggttaagctttcaaga

SEQ ID NO: 83413 - DNA, 25 bp, Rattus norvegicus
accatcccaattccctcagaataag

SEQ ID NO: 83414 - DNA, 25 bp, Rattus norvegicus
accatcccaattgcctcagaataag

SEQ ID NO: 83415 - DNA, 25 bp, Rattus norvegicus
accatcccattcagagatacaccag

SEQ ID NO: 83416 - DNA, 25 bp, Rattus norvegicus
accatcccattctgagatacaccag

SEQ ID NO: 83417 - DNA, 25 bp, Rattus norvegicus
accatccccttcagtaagcctgtga

SEQ ID NO: 83418 - DNA, 25 bp, Rattus norvegicus
accatccccttctgtaagcctgtga

SEQ ID NO: 83419 - DNA, 25 bp, Rattus norvegicus
accatcccgatgaacatgaagtgca

SEQ ID NO: 83420 - DNA, 25 bp, Rattus norvegicus
accatcccgatgtacatgaagtgca

SEQ ID NO: 83421 - DNA, 25 bp, Rattus norvegicus
accatccctcccattattattatta

SEQ ID NO: 83422 - DNA, 25 bp, Rattus norvegicus
accatccctccctttattattatta

SEQ ID NO: 83423 - DNA, 25 bp, Rattus norvegicus
accatccctgtgctgtcaaagtaga

SEQ ID NO: 83424 - DNA, 25 bp, Rattus norvegicus
accatccctgtggtgtcaaagtaga

SEQ ID NO: 83425 - DNA, 25 bp, Rattus norvegicus
accatccgagatctttccttgaaaa

SEQ ID NO: 83426 - DNA, 25 bp, Rattus norvegicus
accatccgagatgtttccttgaaaa

SEQ ID NO: 83427 - DNA, 25 bp, Rattus norvegicus
accatccgtaatactacttccaggg

SEQ ID NO: 83428 - DNA, 25 bp, Rattus norvegicus
accatccgtaattctacttccaggg

SEQ ID NO: 83429 - DNA, 25 bp, Rattus norvegicus
accatcctagcgacggcaggacagc

SEQ ID NO: 83430 - DNA, 25 bp, Rattus norvegicus
accatcctagcgtcggcaggacagc

SEQ ID NO: 83431 - DNA, 25 bp, Rattus norvegicus
accatcctcaacaagatcgactcag

SEQ ID NO: 83432 - DNA, 25 bp, Rattus norvegicus
accatcctcaactagatcgactcag

SEQ ID NO: 83433 - DNA, 25 bp, Rattus norvegicus
accatcctctataagctgaagcttg

SEQ ID NO: 83434 - DNA, 25 bp, Rattus norvegicus
accatcctctatcagatcctactgg

SEQ ID NO: 83435 - DNA, 25 bp, Rattus norvegicus
accatcctctatgagatcctactgg

SEQ ID NO: 83436 - DNA, 25 bp, Rattus norvegicus
accatcctctattagctgaagcttg

SEQ ID NO: 83437 - DNA, 25 bp, Rattus norvegicus
accatcctgcctatcacatttgttt

SEQ ID NO: 83438 - DNA, 25 bp, Rattus norvegicus
accatcctgcctatgtaagagcggg

SEQ ID NO: 83439 - DNA, 25 bp, Rattus norvegicus
accatcctgcctttcacatttgttt

SEQ ID NO: 83440 - DNA, 25 bp, Rattus norvegicus
accatcctgcctttgtaagagcggg

SEQ ID NO: 83441 - DNA, 25 bp, Rattus norvegicus
accatcctgctcatgtagggaacct

SEQ ID NO: 83442 - DNA, 25 bp, Rattus norvegicus
accatcctgctcttgtagggaacct

SEQ ID NO: 83443 - DNA, 25 bp, Rattus norvegicus
accatcctgcttaatttccacgtaa

SEQ ID NO: 83444 - DNA, 25 bp, Rattus norvegicus
accatcctgctttatttccacgtaa

SEQ ID NO: 83445 - DNA, 25 bp, Rattus norvegicus
accatcctggctacaaagcttcttt

SEQ ID NO: 83446 - DNA, 25 bp, Rattus norvegicus
accatcctggcttcaaagcttcttt

SEQ ID NO: 83447 - DNA, 25 bp, Rattus norvegicus
accatcctgggcagccgagtacgga

SEQ ID NO: 83448 - DNA, 25 bp, Rattus norvegicus
accatcctgggctgccgagtacgga

SEQ ID NO: 83449 - DNA, 25 bp, Rattus norvegicus
accatcctggtcaagctttcaatca

SEQ ID NO: 83450 - DNA, 25 bp, Rattus norvegicus
accatcctggtctagctttcaatca

SEQ ID NO: 83451 - DNA, 25 bp, Rattus norvegicus
accatcctggttagtagagctttaa

SEQ ID NO: 83452 - DNA, 25 bp, Rattus norvegicus
accatcctggtttgtagagctttaa

SEQ ID NO: 83453 - DNA, 25 bp, Rattus norvegicus
accatcctgtgacccgggaccagag

SEQ ID NO: 83454 - DNA, 25 bp, Rattus norvegicus
accatcctgtgagccgggaccagag

SEQ ID NO: 83455 - DNA, 25 bp, Rattus norvegicus
accatccttatgacaccaaagacgt

SEQ ID NO: 83456 - DNA, 25 bp, Rattus norvegicus
accatccttatgtcaccaaagacgt

SEQ ID NO: 83457 - DNA, 25 bp, Rattus norvegicus
accatccttgatctttctccattag

SEQ ID NO: 83458 - DNA, 25 bp, Rattus norvegicus
accatccttgatgtttctccattag

SEQ ID NO: 83459 - DNA, 25 bp, Rattus norvegicus
accatcctttgaccttgtgcgtatg

SEQ ID NO: 83460 - DNA, 25 bp, Rattus norvegicus
accatcctttgagcttgtgcgtatg

SEQ ID NO: 83461 - DNA, 25 bp, Rattus norvegicus
accatcggttgtaagttgccttgag

SEQ ID NO: 83462 - DNA, 25 bp, Rattus norvegicus
accatcggttgttagttgccttgag

SEQ ID NO: 83463 - DNA, 25 bp, Rattus norvegicus
accatcgtccagagcctgagcaggt

SEQ ID NO: 83464 - DNA, 25 bp, Rattus norvegicus
accatcgtccagtgcctgagcaggt

SEQ ID NO: 83465 - DNA, 25 bp, Rattus norvegicus
accatcgtcttcaagttgcagcgca

SEQ ID NO: 83466 - DNA, 25 bp, Rattus norvegicus
accatcgtcttctagttgcagcgca

SEQ ID NO: 83467 - DNA, 25 bp, Rattus norvegicus
accatctataacaacaagtctgctt

SEQ ID NO: 83468 - DNA, 25 bp, Rattus norvegicus
accatctataactacaagtctgctt

SEQ ID NO: 83469 - DNA, 25 bp, Rattus norvegicus
accatctatgagcagatcttccgct

SEQ ID NO: 83470 - DNA, 25 bp, Rattus norvegicus
accatctatgaggagatcttccgct

SEQ ID NO: 83471 - DNA, 25 bp, Rattus norvegicus
accatctcaaggcaaggctccatac

SEQ ID NO: 83472 - DNA, 25 bp, Rattus norvegicus
accatctcaagggaaggctccatac

SEQ ID NO: 83473 - DNA, 25 bp, Rattus norvegicus
accatctcagagatgattattgcaa

SEQ ID NO: 83474 - DNA, 25 bp, Rattus norvegicus
accatctcagagttgattattgcaa

SEQ ID NO: 83475 - DNA, 25 bp, Rattus norvegicus
accatctcctatacagaactctgtg

SEQ ID NO: 83476 - DNA, 25 bp, Rattus norvegicus
accatctcctatatcccagagggag

SEQ ID NO: 83477 - DNA, 25 bp, Rattus norvegicus
accatctcctatcacagtcttgatt

SEQ ID NO: 83478 - DNA, 25 bp, Rattus norvegicus
accatctcctatgacagtcttgatt

SEQ ID NO: 83479 - DNA, 25 bp, Rattus norvegicus
accatctcctattcagaactctgtg

SEQ ID NO: 83480 - DNA, 25 bp, Rattus norvegicus
accatctcctatttcccagagggag

SEQ ID NO: 83481 - DNA, 25 bp, Rattus norvegicus
accatctcctgtagcttacagggag

SEQ ID NO: 83482 - DNA, 25 bp, Rattus norvegicus
accatctcctgttgcttacagggag

SEQ ID NO: 83483 - DNA, 25 bp, Rattus norvegicus
accatctcggctctcttaaaacaag

SEQ ID NO: 83484 - DNA, 25 bp, Rattus norvegicus
accatctcggctgtcttaaaacaag

SEQ ID NO: 83485 - DNA, 25 bp, Rattus norvegicus
accatctctcaacgcttcagctgag

SEQ ID NO: 83486 - DNA, 25 bp, Rattus norvegicus
accatctctcaaggcttcagctgag

SEQ ID NO: 83487 - DNA, 25 bp, Rattus norvegicus
accatctctcctaggtatgtttcta

SEQ ID NO: 83488 - DNA, 25 bp, Rattus norvegicus
accatctctccttggtatgtttcta

SEQ ID NO: 83489 - DNA, 25 bp, Rattus norvegicus
accatctctgtaacacatcgctaga

SEQ ID NO: 83490 - DNA, 25 bp, Rattus norvegicus
accatctctgtatcacatcgctaga

SEQ ID NO: 83491 - DNA, 25 bp, Rattus norvegicus
accatctctgtcacacttgagcttg

SEQ ID NO: 83492 - DNA, 25 bp, Rattus norvegicus
accatctctgtctcacttgagcttg

SEQ ID NO: 83493 - DNA, 25 bp, Rattus norvegicus
accatctgaaacaggttcccacgga

SEQ ID NO: 83494 - DNA, 25 bp, Rattus norvegicus
accatctgaaactggttcccacgga

SEQ ID NO: 83495 - DNA, 25 bp, Rattus norvegicus
accatctgagctcgccgtttagttt

SEQ ID NO: 83496 - DNA, 25 bp, Rattus norvegicus
accatctgagctggccgtttagttt

SEQ ID NO: 83497 - DNA, 25 bp, Rattus norvegicus
accatctgcacactcactttctgaa

SEQ ID NO: 83498 - DNA, 25 bp, Rattus norvegicus
accatctgcacagtcactttctgaa

SEQ ID NO: 83499 - DNA, 25 bp, Rattus norvegicus
accatctgcagaacgatctcttgtg

SEQ ID NO: 83500 - DNA, 25 bp, Rattus norvegicus
accatctgcagatcgatctcttgtg

SEQ ID NO: 83501 - DNA, 25 bp, Rattus norvegicus
accatctgcatactgtctgtcgagt

SEQ ID NO: 83502 - DNA, 25 bp, Rattus norvegicus
accatctgcatagtgtctgtcgagt

SEQ ID NO: 83503 - DNA, 25 bp, Rattus norvegicus
accatctgctctaaccgtgtagacg

SEQ ID NO: 83504 - DNA, 25 bp, Rattus norvegicus
accatctgctcttaccgtgtagacg

SEQ ID NO: 83505 - DNA, 25 bp, Rattus norvegicus
accatctgctgacgcggcaaagctg

SEQ ID NO: 83506 - DNA, 25 bp, Rattus norvegicus
accatctgctgaggcggcaaagctg

SEQ ID NO: 83507 - DNA, 25 bp, Rattus norvegicus
accatctgctgcattgcaagggcaa

SEQ ID NO: 83508 - DNA, 25 bp, Rattus norvegicus
accatctgctgctttgcaagggcaa

SEQ ID NO: 83509 - DNA, 25 bp, Rattus norvegicus
accatctggccgatgatgatagcat

SEQ ID NO: 83510 - DNA, 25 bp, Rattus norvegicus
accatctggccgttgatgatagcat

SEQ ID NO: 83511 - DNA, 25 bp, Rattus norvegicus
accatctgggaacaaaggcctgctt

SEQ ID NO: 83512 - DNA, 25 bp, Rattus norvegicus
accatctgggaagaaaggcctgctt

SEQ ID NO: 83513 - DNA, 25 bp, Rattus norvegicus
accatctgggcgctcaagagctgaa

SEQ ID NO: 83514 - DNA, 25 bp, Rattus norvegicus
accatctgggcggtcaagagctgaa

SEQ ID NO: 83515 - DNA, 25 bp, Rattus norvegicus
accatctggtgcagggtcctttgga

SEQ ID NO: 83516 - DNA, 25 bp, Rattus norvegicus
accatctggtgctgggtcctttgga

SEQ ID NO: 83517 - DNA, 25 bp, Rattus norvegicus
accatctgtatgaaacaggatccca

SEQ ID NO: 83518 - DNA, 25 bp, Rattus norvegicus
accatctgtatgtaacaggatccca

SEQ ID NO: 83519 - DNA, 25 bp, Rattus norvegicus
accatctgtgttatgaaagtgttca

SEQ ID NO: 83520 - DNA, 25 bp, Rattus norvegicus
accatctgtgttttgaaagtgttca

SEQ ID NO: 83521 - DNA, 25 bp, Rattus norvegicus
accatcttagggaacaatacattgc

SEQ ID NO: 83522 - DNA, 25 bp, Rattus norvegicus
accatcttagggtacaatacattgc

SEQ ID NO: 83523 - DNA, 25 bp, Rattus norvegicus
accatcttcaggcatgacatctcca

SEQ ID NO: 83524 - DNA, 25 bp, Rattus norvegicus
accatcttcagggatgacatctcca

SEQ ID NO: 83525 - DNA, 25 bp, Rattus norvegicus
accatcttccggaagataccaggct

SEQ ID NO: 83526 - DNA, 25 bp, Rattus norvegicus
accatcttccggtagataccaggct

SEQ ID NO: 83527 - DNA, 25 bp, Rattus norvegicus
accatcttcgtccactgttattagt

SEQ ID NO: 83528 - DNA, 25 bp, Rattus norvegicus
accatcttcgtcgactgttattagt

SEQ ID NO: 83529 - DNA, 25 bp, Rattus norvegicus
accatcttgctaagcctcgcagaaa

SEQ ID NO: 83530 - DNA, 25 bp, Rattus norvegicus
accatcttgctatgcctcgcagaaa

SEQ ID NO: 83531 - DNA, 25 bp, Rattus norvegicus
accatctttacgcacgccaaggagt

SEQ ID NO: 83532 - DNA, 25 bp, Rattus norvegicus
accatctttacggacgccaaggagt

SEQ ID NO: 83533 - DNA, 25 bp, Rattus norvegicus
accatctttcctcgctattgtgaga

SEQ ID NO: 83534 - DNA, 25 bp, Rattus norvegicus
accatctttcctggctattgtgaga

SEQ ID NO: 83535 - DNA, 25 bp, Rattus norvegicus
accatgaaaatgatgttgaagtctt

SEQ ID NO: 83536 - DNA, 25 bp, Rattus norvegicus
accatgaaaatgttgttgaagtctt

SEQ ID NO: 83537 - DNA, 25 bp, Rattus norvegicus
accatgaaccttccttctacaaagg

SEQ ID NO: 83538 - DNA, 25 bp, Rattus norvegicus
accatgaaccttgcttctacaaagg

SEQ ID NO: 83539 - DNA, 25 bp, Rattus norvegicus
accatgaactcacttggaccaacat

SEQ ID NO: 83540 - DNA, 25 bp, Rattus norvegicus
accatgaactcagttggaccaacat

SEQ ID NO: 83541 - DNA, 25 bp, Rattus norvegicus
accatgaaggtccagctgtgcagtt

SEQ ID NO: 83542 - DNA, 25 bp, Rattus norvegicus
accatgaaggtcgagctgtgcagtt

SEQ ID NO: 83543 - DNA, 25 bp, Rattus norvegicus
accatgaagttcatcttgtggcgac

SEQ ID NO: 83544 - DNA, 25 bp, Rattus norvegicus
accatgaagttcttcttgtggcgac

SEQ ID NO: 83545 - DNA, 25 bp, Rattus norvegicus
accatgacccaaagcaccatgggta

SEQ ID NO: 83546 - DNA, 25 bp, Rattus norvegicus
accatgacccaatgcaccatgggta

SEQ ID NO: 83547 - DNA, 25 bp, Rattus norvegicus
accatgagcttgactgtgacaatat

SEQ ID NO: 83548 - DNA, 25 bp, Rattus norvegicus
accatgagcttgtctgtgacaatat

SEQ ID NO: 83549 - DNA, 25 bp, Rattus norvegicus
accatgaggcgccatttctcaaata

SEQ ID NO: 83550 - DNA, 25 bp, Rattus norvegicus
accatgaggcgcgatttctcaaata

SEQ ID NO: 83551 - DNA, 25 bp, Rattus norvegicus
accatgaggctcagtttttaaacaa

SEQ ID NO: 83552 - DNA, 25 bp, Rattus norvegicus
accatgaggctctgtttttaaacaa

SEQ ID NO: 83553 - DNA, 25 bp, Rattus norvegicus
accatgagtcggagtggccaacact

SEQ ID NO: 83554 - DNA, 25 bp, Rattus norvegicus
accatgagtcggtgtggccaacact

SEQ ID NO: 83555 - DNA, 25 bp, Rattus norvegicus
accatgatatttagtaaagctcttg

SEQ ID NO: 83556 - DNA, 25 bp, Rattus norvegicus
accatgatattttgtaaagctcttg

SEQ ID NO: 83557 - DNA, 25 bp, Rattus norvegicus
accatgatcgtaagagtgtgtcaat

SEQ ID NO: 83558 - DNA, 25 bp, Rattus norvegicus
accatgatcgtatgagtgtgtcaat

SEQ ID NO: 83559 - DNA, 25 bp, Rattus norvegicus
accatgatcttgagctccttgccgg

SEQ ID NO: 83560 - DNA, 25 bp, Rattus norvegicus
accatgatcttgtgctccttgccgg

SEQ ID NO: 83561 - DNA, 25 bp, Rattus norvegicus
accatgatgaccagtgcgtatgaag

SEQ ID NO: 83562 - DNA, 25 bp, Rattus norvegicus
accatgatgacctgtgcgtatgaag

SEQ ID NO: 83563 - DNA, 25 bp, Rattus norvegicus
accatgattgatagtgttttgtgaa

SEQ ID NO: 83564 - DNA, 25 bp, Rattus norvegicus
accatgattgattgtgttttgtgaa

SEQ ID NO: 83565 - DNA, 25 bp, Rattus norvegicus
accatgcactttaactgcacttacg

SEQ ID NO: 83566 - DNA, 25 bp, Rattus norvegicus
accatgcacttttactgcacttacg

SEQ ID NO: 83567 - DNA, 25 bp, Rattus norvegicus
accatgcagaacattgagtctacaa

SEQ ID NO: 83568 - DNA, 25 bp, Rattus norvegicus
accatgcagaactttgagtctacaa

SEQ ID NO: 83569 - DNA, 25 bp, Rattus norvegicus
accatgcagcccatcaattatgtga

SEQ ID NO: 83570 - DNA, 25 bp, Rattus norvegicus
accatgcagcccttcaattatgtga

SEQ ID NO: 83571 - DNA, 25 bp, Rattus norvegicus
accatgcatgcccacatgtggatag

SEQ ID NO: 83572 - DNA, 25 bp, Rattus norvegicus
accatgcatgccgacatgtggatag

SEQ ID NO: 83573 - DNA, 25 bp, Rattus norvegicus
accatgccaatgagtatcttcttcc

SEQ ID NO: 83574 - DNA, 25 bp, Rattus norvegicus
accatgccaatgctcccttacttgt

SEQ ID NO: 83575 - DNA, 25 bp, Rattus norvegicus
accatgccaatggtcccttacttgt

SEQ ID NO: 83576 - DNA, 25 bp, Rattus norvegicus
accatgccaatgtgtatcttcttcc

SEQ ID NO: 83577 - DNA, 25 bp, Rattus norvegicus
accatgccacaccttttaacattag

SEQ ID NO: 83578 - DNA, 25 bp, Rattus norvegicus
accatgccacacgttttaacattag

SEQ ID NO: 83579 - DNA, 25 bp, Rattus norvegicus
accatgccagcacagtccacagaag

SEQ ID NO: 83580 - DNA, 25 bp, Rattus norvegicus
accatgccagcagagtccacagaag

SEQ ID NO: 83581 - DNA, 25 bp, Rattus norvegicus
accatgccccaacgaggactgttga

SEQ ID NO: 83582 - DNA, 25 bp, Rattus norvegicus
accatgccccaaggaggactgttga

SEQ ID NO: 83583 - DNA, 25 bp, Rattus norvegicus
accatgcccggcatgatggagaaag

SEQ ID NO: 83584 - DNA, 25 bp, Rattus norvegicus
accatgcccggcttgatggagaaag

SEQ ID NO: 83585 - DNA, 25 bp, Rattus norvegicus
accatgccctctacagggatgactt

SEQ ID NO: 83586 - DNA, 25 bp, Rattus norvegicus
accatgccctcttcagggatgactt

SEQ ID NO: 83587 - DNA, 25 bp, Rattus norvegicus
accatgccggctcactattttttat

SEQ ID NO: 83588 - DNA, 25 bp, Rattus norvegicus
accatgccggctgactattttttat

SEQ ID NO: 83589 - DNA, 25 bp, Rattus norvegicus
accatgcctatcagaatgctgccgt

SEQ ID NO: 83590 - DNA, 25 bp, Rattus norvegicus
accatgcctatctgaatgctgccgt

SEQ ID NO: 83591 - DNA, 25 bp, Rattus norvegicus
accatgcctggcagagcagtttttt

SEQ ID NO: 83592 - DNA, 25 bp, Rattus norvegicus
accatgcctggctgagcagtttttt

SEQ ID NO: 83593 - DNA, 25 bp, Rattus norvegicus
accatgcgctccacaagactaggga

SEQ ID NO: 83594 - DNA, 25 bp, Rattus norvegicus
accatgcgctcctcaagactaggga

SEQ ID NO: 83595 - DNA, 25 bp, Rattus norvegicus
accatgcgtgagagggtcgaaccaa

SEQ ID NO: 83596 - DNA, 25 bp, Rattus norvegicus
accatgcgtgagtgggtcgaaccaa

SEQ ID NO: 83597 - DNA, 25 bp, Rattus norvegicus
accatgctccatcgatactttgaag

SEQ ID NO: 83598 - DNA, 25 bp, Rattus norvegicus
accatgctccatggatactttgaag

SEQ ID NO: 83599 - DNA, 25 bp, Rattus norvegicus
accatgctcgagattcttcctgtag

SEQ ID NO: 83600 - DNA, 25 bp, Rattus norvegicus
accatgctcgagtttcttcctgtag

SEQ ID NO: 83601 - DNA, 25 bp, Rattus norvegicus
accatgctgactagggaggtgacag

SEQ ID NO: 83602 - DNA, 25 bp, Rattus norvegicus
accatgctgacttgggaggtgacag

SEQ ID NO: 83603 - DNA, 25 bp, Rattus norvegicus
accatgctgcttcaaagccactcga

SEQ ID NO: 83604 - DNA, 25 bp, Rattus norvegicus
accatgctgcttgaaagccactcga

SEQ ID NO: 83605 - DNA, 25 bp, Rattus norvegicus
accatgctggtgagctggctgtgca

SEQ ID NO: 83606 - DNA, 25 bp, Rattus norvegicus
accatgctggtgtgctggctgtgca

SEQ ID NO: 83607 - DNA, 25 bp, Rattus norvegicus
accatgctgtccatgtggagtcctg

SEQ ID NO: 83608 - DNA, 25 bp, Rattus norvegicus
accatgctgtccttgtggagtcctg

SEQ ID NO: 83609 - DNA, 25 bp, Rattus norvegicus
accatgctgtggaaggtatctgtcc

SEQ ID NO: 83610 - DNA, 25 bp, Rattus norvegicus
accatgctgtggtaggtatctgtcc

SEQ ID NO: 83611 - DNA, 25 bp, Rattus norvegicus
accatgcttcttcccattctgataa

SEQ ID NO: 83612 - DNA, 25 bp, Rattus norvegicus
accatgcttcttgccattctgataa

SEQ ID NO: 83613 - DNA, 25 bp, Rattus norvegicus
accatgctttgtccagccagcggta

SEQ ID NO: 83614 - DNA, 25 bp, Rattus norvegicus
accatgctttgtgcagccagcggta

SEQ ID NO: 83615 - DNA, 25 bp, Rattus norvegicus
accatggaccgtagcgtgtgctcgg

SEQ ID NO: 83616 - DNA, 25 bp, Rattus norvegicus
accatggaccgttgcgtgtgctcgg

SEQ ID NO: 83617 - DNA, 25 bp, Rattus norvegicus
accatggagtttatcgtttcctgcg

SEQ ID NO: 83618 - DNA, 25 bp, Rattus norvegicus
accatggagtttttcgtttcctgcg

SEQ ID NO: 83619 - DNA, 25 bp, Rattus norvegicus
accatggcaataagtatttcccttg

SEQ ID NO: 83620 - DNA, 25 bp, Rattus norvegicus
accatggcaatatgtatttcccttg

SEQ ID NO: 83621 - DNA, 25 bp, Rattus norvegicus
accatggcactgagacactgtgttt

SEQ ID NO: 83622 - DNA, 25 bp, Rattus norvegicus
accatggcactgtgacactgtgttt

SEQ ID NO: 83623 - DNA, 25 bp, Rattus norvegicus
accatggctatacagtgaccgtttc

SEQ ID NO: 83624 - DNA, 25 bp, Rattus norvegicus
accatggctatagagtgaccgtttc

SEQ ID NO: 83625 - DNA, 25 bp, Rattus norvegicus
accatggctggcactgtgtgtatgt

SEQ ID NO: 83626 - DNA, 25 bp, Rattus norvegicus
accatggctggctctgtgtgtatgt

SEQ ID NO: 83627 - DNA, 25 bp, Rattus norvegicus
accatggctggtatgtgtgcatcca

SEQ ID NO: 83628 - DNA, 25 bp, Rattus norvegicus
accatggctggtttgtgtgcatcca

SEQ ID NO: 83629 - DNA, 25 bp, Rattus norvegicus
accatggcttccagaggcttgcttt

SEQ ID NO: 83630 - DNA, 25 bp, Rattus norvegicus
accatggcttcccaagcttttgtga

SEQ ID NO: 83631 - DNA, 25 bp, Rattus norvegicus
accatggcttccgaagcttttgtga

SEQ ID NO: 83632 - DNA, 25 bp, Rattus norvegicus
accatggcttcctgaggcttgcttt

SEQ ID NO: 83633 - DNA, 25 bp, Rattus norvegicus
accatgggcatcatgctccactatg

SEQ ID NO: 83634 - DNA, 25 bp, Rattus norvegicus
accatgggcatcttgctccactatg

SEQ ID NO: 83635 - DNA, 25 bp, Rattus norvegicus
accatgggccaacattggtcaagta

SEQ ID NO: 83636 - DNA, 25 bp, Rattus norvegicus
accatgggccaagattggtcaagta

SEQ ID NO: 83637 - DNA, 25 bp, Rattus norvegicus
accatgggctggcatcaccagggtt

SEQ ID NO: 83638 - DNA, 25 bp, Rattus norvegicus
accatgggctgggatcaccagggtt

SEQ ID NO: 83639 - DNA, 25 bp, Rattus norvegicus
accatgggtctcagcagttgcgtgc

SEQ ID NO: 83640 - DNA, 25 bp, Rattus norvegicus
accatgggtctctgcagttgcgtgc

SEQ ID NO: 83641 - DNA, 25 bp, Rattus norvegicus
accatgggtggcctgtttcagattg

SEQ ID NO: 83642 - DNA, 25 bp, Rattus norvegicus
accatgggtggcgtgtttcagattg

SEQ ID NO: 83643 - DNA, 25 bp, Rattus norvegicus
accatgggtggtaattttaatctct

SEQ ID NO: 83644 - DNA, 25 bp, Rattus norvegicus
accatgggtggttattttaatctct

SEQ ID NO: 83645 - DNA, 25 bp, Rattus norvegicus
accatggtacagctatacctcccta

SEQ ID NO: 83646 - DNA, 25 bp, Rattus norvegicus
accatggtacaggtatacctcccta

SEQ ID NO: 83647 - DNA, 25 bp, Rattus norvegicus
accatggtcaccactttccataaat

SEQ ID NO: 83648 - DNA, 25 bp, Rattus norvegicus
accatggtcacctctttccataaat

SEQ ID NO: 83649 - DNA, 25 bp, Rattus norvegicus
accatggtccggctcatgaggtaca

SEQ ID NO: 83650 - DNA, 25 bp, Rattus norvegicus
accatggtccgggtcatgaggtaca

SEQ ID NO: 83651 - DNA, 25 bp, Rattus norvegicus
accatggtctggagaacctctggag

SEQ ID NO: 83652 - DNA, 25 bp, Rattus norvegicus
accatggtctggtgaacctctggag

SEQ ID NO: 83653 - DNA, 25 bp, Rattus norvegicus
accatggtgaatccgggcagcagct

SEQ ID NO: 83654 - DNA, 25 bp, Rattus norvegicus
accatggtgaatgcgggcagcagct

SEQ ID NO: 83655 - DNA, 25 bp, Rattus norvegicus
accatggtgagtatgtgcccctctt

SEQ ID NO: 83656 - DNA, 25 bp, Rattus norvegicus
accatggtgagtttgtgcccctctt

SEQ ID NO: 83657 - DNA, 25 bp, Rattus norvegicus
accatggtggctctggctaaactgt

SEQ ID NO: 83658 - DNA, 25 bp, Rattus norvegicus
accatggtggctgtggctaaactgt

SEQ ID NO: 83659 - DNA, 25 bp, Rattus norvegicus
accatggtgtagctgtcgatgctct

SEQ ID NO: 83660 - DNA, 25 bp, Rattus norvegicus
accatggtgtaggtgtcgatgctct

SEQ ID NO: 83661 - DNA, 25 bp, Rattus norvegicus
accatggttttcaagctcttgggct

SEQ ID NO: 83662 - DNA, 25 bp, Rattus norvegicus
accatggttttctagctcttgggct

SEQ ID NO: 83663 - DNA, 25 bp, Rattus norvegicus
accatgtacatgacagtgctctcag

SEQ ID NO: 83664 - DNA, 25 bp, Rattus norvegicus
accatgtacatgtcagtgctctcag

SEQ ID NO: 83665 - DNA, 25 bp, Rattus norvegicus
accatgtacccaagcacagtggcga

SEQ ID NO: 83666 - DNA, 25 bp, Rattus norvegicus
accatgtacccatgcacagtggcga

SEQ ID NO: 83667 - DNA, 25 bp, Rattus norvegicus
accatgtatcacaacctgcagtttg

SEQ ID NO: 83668 - DNA, 25 bp, Rattus norvegicus
accatgtatcactacctgcagtttg

SEQ ID NO: 83669 - DNA, 25 bp, Rattus norvegicus
accatgtcactgaagtgcctcggca

SEQ ID NO: 83670 - DNA, 25 bp, Rattus norvegicus
accatgtcactgtagtgcctcggca

SEQ ID NO: 83671 - DNA, 25 bp, Rattus norvegicus
accatgtcatcaaggctgtcacaca

SEQ ID NO: 83672 - DNA, 25 bp, Rattus norvegicus
accatgtcatcatggctgtcacaca

SEQ ID NO: 83673 - DNA, 25 bp, Rattus norvegicus
accatgtccagcaagttttcgtcag

SEQ ID NO: 83674 - DNA, 25 bp, Rattus norvegicus
accatgtccagctagttttcgtcag

SEQ ID NO: 83675 - DNA, 25 bp, Rattus norvegicus
accatgtccagtacatttcttctat

SEQ ID NO: 83676 - DNA, 25 bp, Rattus norvegicus
accatgtccagttcatttcttctat

SEQ ID NO: 83677 - DNA, 25 bp, Rattus norvegicus
accatgtcctgactctaaggtcctg

SEQ ID NO: 83678 - DNA, 25 bp, Rattus norvegicus
accatgtcctgagtctaaggtcctg

SEQ ID NO: 83679 - DNA, 25 bp, Rattus norvegicus
accatgtgccacactcttggataat

SEQ ID NO: 83680 - DNA, 25 bp, Rattus norvegicus
accatgtgccactctcttggataat

SEQ ID NO: 83681 - DNA, 25 bp, Rattus norvegicus
accatgtgcctacgtgcctgctggg

SEQ ID NO: 83682 - DNA, 25 bp, Rattus norvegicus
accatgtgcctaggtgcctgctggg

SEQ ID NO: 83683 - DNA, 25 bp, Rattus norvegicus
accatgtgctcaccctgtgtaatta

SEQ ID NO: 83684 - DNA, 25 bp, Rattus norvegicus
accatgtgctcagcctgtgtaatta

SEQ ID NO: 83685 - DNA, 25 bp, Rattus norvegicus
accatgtggagcctgccactgagga

SEQ ID NO: 83686 - DNA, 25 bp, Rattus norvegicus
accatgtggagcgtgccactgagga

SEQ ID NO: 83687 - DNA, 25 bp, Rattus norvegicus
accatgtggatcatgggcattgcat

SEQ ID NO: 83688 - DNA, 25 bp, Rattus norvegicus
accatgtggatcttgggcattgcat

SEQ ID NO: 83689 - DNA, 25 bp, Rattus norvegicus
accatgtggtgcagtgggaaccaac

SEQ ID NO: 83690 - DNA, 25 bp, Rattus norvegicus
accatgtggtgctgtgggaaccaac

SEQ ID NO: 83691 - DNA, 25 bp, Rattus norvegicus
accatgtgtaaaaaccagtctcaga

SEQ ID NO: 83692 - DNA, 25 bp, Rattus norvegicus
accatgtgtaaataccagtctcaga

SEQ ID NO: 83693 - DNA, 25 bp, Rattus norvegicus
accatgtgtatgcagtgaccgagga

SEQ ID NO: 83694 - DNA, 25 bp, Rattus norvegicus
accatgtgtatggagtgaccgagga

SEQ ID NO: 83695 - DNA, 25 bp, Rattus norvegicus
accatgtgttaacgtcagagtccat

SEQ ID NO: 83696 - DNA, 25 bp, Rattus norvegicus
accatgtgttaaggtcagagtccat

SEQ ID NO: 83697 - DNA, 25 bp, Rattus norvegicus
accatgtgtttgattcagatgcgct

SEQ ID NO: 83698 - DNA, 25 bp, Rattus norvegicus
accatgtgtttgtttcagatgcgct

SEQ ID NO: 83699 - DNA, 25 bp, Rattus norvegicus
accatgttactcatcattccagtct

SEQ ID NO: 83700 - DNA, 25 bp, Rattus norvegicus
accatgttactcttcattccagtct

SEQ ID NO: 83701 - DNA, 25 bp, Rattus norvegicus
accatgttagttactctccatttca

SEQ ID NO: 83702 - DNA, 25 bp, Rattus norvegicus
accatgttagtttctctccatttca

SEQ ID NO: 83703 - DNA, 25 bp, Rattus norvegicus
accatgttcatacctgcctaatttg

SEQ ID NO: 83704 - DNA, 25 bp, Rattus norvegicus
accatgttcatagctgcctaatttg

SEQ ID NO: 83705 - DNA, 25 bp, Rattus norvegicus
accatgttggatatatgcaccgctg

SEQ ID NO: 83706 - DNA, 25 bp, Rattus norvegicus
accatgttggatttatgcaccgctg

SEQ ID NO: 83707 - DNA, 25 bp, Rattus norvegicus
accatgttgtataccggatctctgc

SEQ ID NO: 83708 - DNA, 25 bp, Rattus norvegicus
accatgttgtattccggatctctgc

SEQ ID NO: 83709 - DNA, 25 bp, Rattus norvegicus
accattaaatggaagcagctgaccc

SEQ ID NO: 83710 - DNA, 25 bp, Rattus norvegicus
accattaaatggtagcagctgaccc

SEQ ID NO: 83711 - DNA, 25 bp, Rattus norvegicus
accattaactgaatacttggcttca

SEQ ID NO: 83712 - DNA, 25 bp, Rattus norvegicus
accattaactgattacttggcttca

SEQ ID NO: 83713 - DNA, 25 bp, Rattus norvegicus
accattaattccatgacccagcagg

SEQ ID NO: 83714 - DNA, 25 bp, Rattus norvegicus
accattaattccttgacccagcagg

SEQ ID NO: 83715 - DNA, 25 bp, Rattus norvegicus
accattacctggcacagatttctta

SEQ ID NO: 83716 - DNA, 25 bp, Rattus norvegicus
accattacctgggacagatttctta

SEQ ID NO: 83717 - DNA, 25 bp, Rattus norvegicus
accattactgttattgctgatttga

SEQ ID NO: 83718 - DNA, 25 bp, Rattus norvegicus
accattactgtttttgctgatttga

SEQ ID NO: 83719 - DNA, 25 bp, Rattus norvegicus
accattatgactaatgctcctcaca

SEQ ID NO: 83720 - DNA, 25 bp, Rattus norvegicus
accattatgacttatgctcctcaca

SEQ ID NO: 83721 - DNA, 25 bp, Rattus norvegicus
accattcagtgtatatgtggacagg

SEQ ID NO: 83722 - DNA, 25 bp, Rattus norvegicus
accattcagtgtttatgtggacagg

SEQ ID NO: 83723 - DNA, 25 bp, Rattus norvegicus
accattcattggagctgactacata

SEQ ID NO: 83724 - DNA, 25 bp, Rattus norvegicus
accattcattggtgctgactacata

SEQ ID NO: 83725 - DNA, 25 bp, Rattus norvegicus
accattcccaccatcgggtttaatg

SEQ ID NO: 83726 - DNA, 25 bp, Rattus norvegicus
accattcccaccttcgggtttaatg

SEQ ID NO: 83727 - DNA, 25 bp, Rattus norvegicus
accattcccatgcaccacttgagaa

SEQ ID NO: 83728 - DNA, 25 bp, Rattus norvegicus
accattcccatggaccacttgagaa

SEQ ID NO: 83729 - DNA, 25 bp, Rattus norvegicus
accattccccagcagcggagggctg

SEQ ID NO: 83730 - DNA, 25 bp, Rattus norvegicus
accattccccaggagcggagggctg

SEQ ID NO: 83731 - DNA, 25 bp, Rattus norvegicus
accattccctatccagaggatcctg

SEQ ID NO: 83732 - DNA, 25 bp, Rattus norvegicus
accattccctatgcagaggatcctg

SEQ ID NO: 83733 - DNA, 25 bp, Rattus norvegicus
accattccctgcctcttagaaagaa

SEQ ID NO: 83734 - DNA, 25 bp, Rattus norvegicus
accattccctgcgtcttagaaagaa

SEQ ID NO: 83735 - DNA, 25 bp, Rattus norvegicus
accattccctggctggaatcttgga

SEQ ID NO: 83736 - DNA, 25 bp, Rattus norvegicus
accattccctgggtggaatcttgga

SEQ ID NO: 83737 - DNA, 25 bp, Rattus norvegicus
accattccggataagatttgctagt

SEQ ID NO: 83738 - DNA, 25 bp, Rattus norvegicus
accattccggattagatttgctagt

SEQ ID NO: 83739 - DNA, 25 bp, Rattus norvegicus
accattccggcccagagaggaaagg

SEQ ID NO: 83740 - DNA, 25 bp, Rattus norvegicus
accattccggccgagagaggaaagg

SEQ ID NO: 83741 - DNA, 25 bp, Rattus norvegicus
accattcctggcatatgtagttctg

SEQ ID NO: 83742 - DNA, 25 bp, Rattus norvegicus
accattcctggcttatgtagttctg

SEQ ID NO: 83743 - DNA, 25 bp, Rattus norvegicus
accattcctggtatttcatagtcaa

SEQ ID NO: 83744 - DNA, 25 bp, Rattus norvegicus
accattcctggtttttcatagtcaa

SEQ ID NO: 83745 - DNA, 25 bp, Rattus norvegicus
accattctcccaagatgtcgttgta

SEQ ID NO: 83746 - DNA, 25 bp, Rattus norvegicus
accattctcccatgatgtcgttgta

SEQ ID NO: 83747 - DNA, 25 bp, Rattus norvegicus
accattctgcataaaggtcccacag

SEQ ID NO: 83748 - DNA, 25 bp, Rattus norvegicus
accattctgcattaaggtcccacag

SEQ ID NO: 83749 - DNA, 25 bp, Rattus norvegicus
accattctgggtaacatagggagac

SEQ ID NO: 83750 - DNA, 25 bp, Rattus norvegicus
accattctgggttacatagggagac

SEQ ID NO: 83751 - DNA, 25 bp, Rattus norvegicus
accattcttgtgactcagggatgca

SEQ ID NO: 83752 - DNA, 25 bp, Rattus norvegicus
accattcttgtgtctcagggatgca

SEQ ID NO: 83753 - DNA, 25 bp, Rattus norvegicus
accattgacgtaagacaaatcccga

SEQ ID NO: 83754 - DNA, 25 bp, Rattus norvegicus
accattgacgtatgacaaatcccga

SEQ ID NO: 83755 - DNA, 25 bp, Rattus norvegicus
accattgactggaggattcggaaag

SEQ ID NO: 83756 - DNA, 25 bp, Rattus norvegicus
accattgactggtggattcggaaag

SEQ ID NO: 83757 - DNA, 25 bp, Rattus norvegicus
accattgagatacagggcctgcgcg

SEQ ID NO: 83758 - DNA, 25 bp, Rattus norvegicus
accattgagatagagggcctgcgcg

SEQ ID NO: 83759 - DNA, 25 bp, Rattus norvegicus
accattgagtatatgctggatgacc

SEQ ID NO: 83760 - DNA, 25 bp, Rattus norvegicus
accattgagtatttgctggatgacc

SEQ ID NO: 83761 - DNA, 25 bp, Rattus norvegicus
accattgatgccaaagaacctgttt

SEQ ID NO: 83762 - DNA, 25 bp, Rattus norvegicus
accattgatgcctaagaacctgttt

SEQ ID NO: 83763 - DNA, 25 bp, Rattus norvegicus
accattgccaccatttttatgtcca

SEQ ID NO: 83764 - DNA, 25 bp, Rattus norvegicus
accattgccaccttttttatgtcca

SEQ ID NO: 83765 - DNA, 25 bp, Rattus norvegicus
accattgccagaagaatgtctacag

SEQ ID NO: 83766 - DNA, 25 bp, Rattus norvegicus
accattgccagatgaatgtctacag

SEQ ID NO: 83767 - DNA, 25 bp, Rattus norvegicus
accattgccgttattgtgcttttat

SEQ ID NO: 83768 - DNA, 25 bp, Rattus norvegicus
accattgccgtttttgtgcttttat

SEQ ID NO: 83769 - DNA, 25 bp, Rattus norvegicus
accattgcctatctgggatcgctga

SEQ ID NO: 83770 - DNA, 25 bp, Rattus norvegicus
accattgcctatgtgggatcgctga

SEQ ID NO: 83771 - DNA, 25 bp, Rattus norvegicus
accattgcctggagtattcggccat

SEQ ID NO: 83772 - DNA, 25 bp, Rattus norvegicus
accattgcctggtgtattcggccat

SEQ ID NO: 83773 - DNA, 25 bp, Rattus norvegicus
accattgctgtacgatgtgtggcct

SEQ ID NO: 83774 - DNA, 25 bp, Rattus norvegicus
accattgctgtaggatgtgtggcct

SEQ ID NO: 83775 - DNA, 25 bp, Rattus norvegicus
accattgcttggcacttgaactact

SEQ ID NO: 83776 - DNA, 25 bp, Rattus norvegicus
accattgcttgggacttgaactact

SEQ ID NO: 83777 - DNA, 25 bp, Rattus norvegicus
accattgggatgatgacctgagacc

SEQ ID NO: 83778 - DNA, 25 bp, Rattus norvegicus
accattgggatgttgacctgagacc

SEQ ID NO: 83779 - DNA, 25 bp, Rattus norvegicus
accattgggccaccttaatgttttc

SEQ ID NO: 83780 - DNA, 25 bp, Rattus norvegicus
accattgggccagcttaatgttttc

SEQ ID NO: 83781 - DNA, 25 bp, Rattus norvegicus
accattgtcatgctgagtcccagga

SEQ ID NO: 83782 - DNA, 25 bp, Rattus norvegicus
accattgtcatggtgagtcccagga

SEQ ID NO: 83783 - DNA, 25 bp, Rattus norvegicus
accattgtcattagctgttctcctt

SEQ ID NO: 83784 - DNA, 25 bp, Rattus norvegicus
accattgtcatttgctgttctcctt

SEQ ID NO: 83785 - DNA, 25 bp, Rattus norvegicus
accattgtccctcatgcatttgttt

SEQ ID NO: 83786 - DNA, 25 bp, Rattus norvegicus
accattgtccctgatgcatttgttt

SEQ ID NO: 83787 - DNA, 25 bp, Rattus norvegicus
accattgtcctgatgcctgttgtct

SEQ ID NO: 83788 - DNA, 25 bp, Rattus norvegicus
accattgtcctgttgcctgttgtct

SEQ ID NO: 83789 - DNA, 25 bp, Rattus norvegicus
accattgtgcctcggcccaaacttt

SEQ ID NO: 83790 - DNA, 25 bp, Rattus norvegicus
accattgtgcctgggcccaaacttt

SEQ ID NO: 83791 - DNA, 25 bp, Rattus norvegicus
accattgtgcttattgagacccttg

SEQ ID NO: 83792 - DNA, 25 bp, Rattus norvegicus
accattgtgctttttgagacccttg

SEQ ID NO: 83793 - DNA, 25 bp, Rattus norvegicus
accattgtgtccagcagctgctgaa

SEQ ID NO: 83794 - DNA, 25 bp, Rattus norvegicus
accattgtgtcctgcagctgctgaa

SEQ ID NO: 83795 - DNA, 25 bp, Rattus norvegicus
accattgtgtgaactgtcctgaccc

SEQ ID NO: 83796 - DNA, 25 bp, Rattus norvegicus
accattgtgtgatctgtcctgaccc

SEQ ID NO: 83797 - DNA, 25 bp, Rattus norvegicus
accattgttattagcatgtacatct

SEQ ID NO: 83798 - DNA, 25 bp, Rattus norvegicus
accattgttatttgcatgtacatct

SEQ ID NO: 83799 - DNA, 25 bp, Rattus norvegicus
accattgttgttcttaaagtcagga

SEQ ID NO: 83800 - DNA, 25 bp, Rattus norvegicus
accattgttgttgttaaagtcagga

SEQ ID NO: 83801 - DNA, 25 bp, Rattus norvegicus
accatttactttctgttctactgag

SEQ ID NO: 83802 - DNA, 25 bp, Rattus norvegicus
accatttactttgtgttctactgag

SEQ ID NO: 83803 - DNA, 25 bp, Rattus norvegicus
accatttagcacaagggtctgttaa

SEQ ID NO: 83804 - DNA, 25 bp, Rattus norvegicus
accatttagcactagggtctgttaa

SEQ ID NO: 83805 - DNA, 25 bp, Rattus norvegicus
accatttatatcctagctgtcctga

SEQ ID NO: 83806 - DNA, 25 bp, Rattus norvegicus
accatttatatcgtagctgtcctga

SEQ ID NO: 83807 - DNA, 25 bp, Rattus norvegicus
accatttattccctcttgattcaca

SEQ ID NO: 83808 - DNA, 25 bp, Rattus norvegicus
accatttattccgtcttgattcaca

SEQ ID NO: 83809 - DNA, 25 bp, Rattus norvegicus
accatttcagaactcctcacagaga

SEQ ID NO: 83810 - DNA, 25 bp, Rattus norvegicus
accatttcagaagtcctcacagaga

SEQ ID NO: 83811 - DNA, 25 bp, Rattus norvegicus
accatttccaagaatcctacggagc

SEQ ID NO: 83812 - DNA, 25 bp, Rattus norvegicus
accatttccaagtatcctacggagc

SEQ ID NO: 83813 - DNA, 25 bp, Rattus norvegicus
accatttccacaccttgattcatga

SEQ ID NO: 83814 - DNA, 25 bp, Rattus norvegicus
accatttccacagcttgattcatga

SEQ ID NO: 83815 - DNA, 25 bp, Rattus norvegicus
accatttccgagcacatagttttga

SEQ ID NO: 83816 - DNA, 25 bp, Rattus norvegicus
accatttccgaggacatagttttga

SEQ ID NO: 83817 - DNA, 25 bp, Rattus norvegicus
accatttcctgcacgaaggcgtgaa

SEQ ID NO: 83818 - DNA, 25 bp, Rattus norvegicus
accatttcctgctcgaaggcgtgaa

SEQ ID NO: 83819 - DNA, 25 bp, Rattus norvegicus
accatttctagtcaacgggctcagt

SEQ ID NO: 83820 - DNA, 25 bp, Rattus norvegicus
accatttctagtgaacgggctcagt

SEQ ID NO: 83821 - DNA, 25 bp, Rattus norvegicus
accatttctcagctgtgtgtcaagg

SEQ ID NO: 83822 - DNA, 25 bp, Rattus norvegicus
accatttctcaggtgtgtgtcaagg

SEQ ID NO: 83823 - DNA, 25 bp, Rattus norvegicus
accatttctgatatttgttcctcta

SEQ ID NO: 83824 - DNA, 25 bp, Rattus norvegicus
accatttctgatttttgttcctcta

SEQ ID NO: 83825 - DNA, 25 bp, Rattus norvegicus
accatttctggaagtgcctttcaaa

SEQ ID NO: 83826 - DNA, 25 bp, Rattus norvegicus
accatttctggatgtgcctttcaaa

SEQ ID NO: 83827 - DNA, 25 bp, Rattus norvegicus
accatttctgttacctcattttcaa

SEQ ID NO: 83828 - DNA, 25 bp, Rattus norvegicus
accatttctgtttcctcattttcaa

SEQ ID NO: 83829 - DNA, 25 bp, Rattus norvegicus
accatttgctgcagcgtctaagaaa

SEQ ID NO: 83830 - DNA, 25 bp, Rattus norvegicus
accatttgctgctgcgtctaagaaa

SEQ ID NO: 83831 - DNA, 25 bp, Rattus norvegicus
accatttgggctagtttctgtgtaa

SEQ ID NO: 83832 - DNA, 25 bp, Rattus norvegicus
accatttgggcttgtttctgtgtaa

SEQ ID NO: 83833 - DNA, 25 bp, Rattus norvegicus
accattttaagtactgacctcaggc

SEQ ID NO: 83834 - DNA, 25 bp, Rattus norvegicus
accattttaagttctgacctcaggc

SEQ ID NO: 83835 - DNA, 25 bp, Rattus norvegicus
accattttcagcacaatgttcatag

SEQ ID NO: 83836 - DNA, 25 bp, Rattus norvegicus
accattttcagctcaatgttcatag

SEQ ID NO: 83837 - DNA, 25 bp, Rattus norvegicus
accattttcttcagctacttttgtg

SEQ ID NO: 83838 - DNA, 25 bp, Rattus norvegicus
accattttcttctgctacttttgtg

SEQ ID NO: 83839 - DNA, 25 bp, Rattus norvegicus
accattttgttgagaacggtggaat

SEQ ID NO: 83840 - DNA, 25 bp, Rattus norvegicus
accattttgttgtgaacggtggaat

SEQ ID NO: 83841 - DNA, 25 bp, Rattus norvegicus
accatttttattacaagttcctctg

SEQ ID NO: 83842 - DNA, 25 bp, Rattus norvegicus
accatttttatttcaagttcctctg

SEQ ID NO: 83843 - DNA, 25 bp, Rattus norvegicus
acccaaaatcatcagttctagacta

SEQ ID NO: 83844 - DNA, 25 bp, Rattus norvegicus
acccaaaatcatgagttctagacta

SEQ ID NO: 83845 - DNA, 25 bp, Rattus norvegicus
acccaaacacctagcaaattgcgga

SEQ ID NO: 83846 - DNA, 25 bp, Rattus norvegicus
acccaaacaccttgcaaattgcgga

SEQ ID NO: 83847 - DNA, 25 bp, Rattus norvegicus
acccaaaccggcagtgattcatgaa

SEQ ID NO: 83848 - DNA, 25 bp, Rattus norvegicus
acccaaaccggctgtgattcatgaa

SEQ ID NO: 83849 - DNA, 25 bp, Rattus norvegicus
acccaaactgttcgctccacaggaa

SEQ ID NO: 83850 - DNA, 25 bp, Rattus norvegicus
acccaaactgttggctccacaggaa

SEQ ID NO: 83851 - DNA, 25 bp, Rattus norvegicus
acccaaagattcaatcccctgggat

SEQ ID NO: 83852 - DNA, 25 bp, Rattus norvegicus
acccaaagattctatcccctgggat

SEQ ID NO: 83853 - DNA, 25 bp, Rattus norvegicus
acccaaaggaccaagctctgtagaa

SEQ ID NO: 83854 - DNA, 25 bp, Rattus norvegicus
acccaaaggacctagctctgtagaa

SEQ ID NO: 83855 - DNA, 25 bp, Rattus norvegicus
acccaaatcaggatgtagcttcaat

SEQ ID NO: 83856 - DNA, 25 bp, Rattus norvegicus
acccaaatcaggttgtagcttcaat

SEQ ID NO: 83857 - DNA, 25 bp, Rattus norvegicus
acccaaatcagtccttctcagaata

SEQ ID NO: 83858 - DNA, 25 bp, Rattus norvegicus
acccaaatcagtgcttctcagaata

SEQ ID NO: 83859 - DNA, 25 bp, Rattus norvegicus
acccaaatctcgctatcagtgcaat

SEQ ID NO: 83860 - DNA, 25 bp, Rattus norvegicus
acccaaatctcggtatcagtgcaat

SEQ ID NO: 83861 - DNA, 25 bp, Rattus norvegicus
acccaaattccacccagagagagca

SEQ ID NO: 83862 - DNA, 25 bp, Rattus norvegicus
acccaaattccagccagagagagca

SEQ ID NO: 83863 - DNA, 25 bp, Rattus norvegicus
acccaacacaggaagttttgtcaat

SEQ ID NO: 83864 - DNA, 25 bp, Rattus norvegicus
acccaacacaggtagttttgtcaat

SEQ ID NO: 83865 - DNA, 25 bp, Rattus norvegicus
acccaaccaaaactatgccggcatg

SEQ ID NO: 83866 - DNA, 25 bp, Rattus norvegicus
acccaaccaaaagtatgccggcatg

SEQ ID NO: 83867 - DNA, 25 bp, Rattus norvegicus
acccaaccaaccctagatgatatca

SEQ ID NO: 83868 - DNA, 25 bp, Rattus norvegicus
acccaaccaaccgtagatgatatca

SEQ ID NO: 83869 - DNA, 25 bp, Rattus norvegicus
acccaaccatcaacagagagggctg

SEQ ID NO: 83870 - DNA, 25 bp, Rattus norvegicus
acccaaccatcatcagagagggctg

SEQ ID NO: 83871 - DNA, 25 bp, Rattus norvegicus
acccaaccccacattaatgacattt

SEQ ID NO: 83872 - DNA, 25 bp, Rattus norvegicus
acccaaccccactttaatgacattt

SEQ ID NO: 83873 - DNA, 25 bp, Rattus norvegicus
acccaaccctagaaccactgagaag

SEQ ID NO: 83874 - DNA, 25 bp, Rattus norvegicus
acccaaccctagtaccactgagaag

SEQ ID NO: 83875 - DNA, 25 bp, Rattus norvegicus
acccaacgcatcaaggtggcctgtg

SEQ ID NO: 83876 - DNA, 25 bp, Rattus norvegicus
acccaacgcatctaggtggcctgtg

SEQ ID NO: 83877 - DNA, 25 bp, Rattus norvegicus
acccaactccctcttatacatgtaa

SEQ ID NO: 83878 - DNA, 25 bp, Rattus norvegicus
acccaactccctgttatacatgtaa

SEQ ID NO: 83879 - DNA, 25 bp, Rattus norvegicus
acccaacttgttcttcctggtcaag

SEQ ID NO: 83880 - DNA, 25 bp, Rattus norvegicus
acccaacttgttgttcctggtcaag

SEQ ID NO: 83881 - DNA, 25 bp, Rattus norvegicus
acccaacttttgacctgttatggct

SEQ ID NO: 83882 - DNA, 25 bp, Rattus norvegicus
acccaacttttgtcctgttatggct

SEQ ID NO: 83883 - DNA, 25 bp, Rattus norvegicus
acccaagaacttctgtgacctgttt

SEQ ID NO: 83884 - DNA, 25 bp, Rattus norvegicus
acccaagaacttgtgtgacctgttt

SEQ ID NO: 83885 - DNA, 25 bp, Rattus norvegicus
acccaagacctcattgctcatgaag

SEQ ID NO: 83886 - DNA, 25 bp, Rattus norvegicus
acccaagacctctttgctcatgaag

SEQ ID NO: 83887 - DNA, 25 bp, Rattus norvegicus
acccaagcagccctcaaggcataaa

SEQ ID NO: 83888 - DNA, 25 bp, Rattus norvegicus
acccaagcagccgtcaaggcataaa

SEQ ID NO: 83889 - DNA, 25 bp, Rattus norvegicus
acccaagtacttcgtgtgaaccatt

SEQ ID NO: 83890 - DNA, 25 bp, Rattus norvegicus
acccaagtacttggtgtgaaccatt

SEQ ID NO: 83891 - DNA, 25 bp, Rattus norvegicus
acccaagtcccgacgtgaagtggag

SEQ ID NO: 83892 - DNA, 25 bp, Rattus norvegicus
acccaagtcccgtcgtgaagtggag

SEQ ID NO: 83893 - DNA, 25 bp, Rattus norvegicus
acccaagtcctgcatttcacaaagg

SEQ ID NO: 83894 - DNA, 25 bp, Rattus norvegicus
acccaagtcctggatttcacaaagg

SEQ ID NO: 83895 - DNA, 25 bp, Rattus norvegicus
acccaagtcttcattttccacagta

SEQ ID NO: 83896 - DNA, 25 bp, Rattus norvegicus
acccaagtcttctttttccacagta

SEQ ID NO: 83897 - DNA, 25 bp, Rattus norvegicus
acccaagttcagctttggaggtaga

SEQ ID NO: 83898 - DNA, 25 bp, Rattus norvegicus
acccaagttcaggtttggaggtaga

SEQ ID NO: 83899 - DNA, 25 bp, Rattus norvegicus
acccaagtttggattgcagcatctg

SEQ ID NO: 83900 - DNA, 25 bp, Rattus norvegicus
acccaagtttggtttgcagcatctg

SEQ ID NO: 83901 - DNA, 25 bp, Rattus norvegicus
acccaataccatcgtgttttgtcat

SEQ ID NO: 83902 - DNA, 25 bp, Rattus norvegicus
acccaataccatggtgttttgtcat

SEQ ID NO: 83903 - DNA, 25 bp, Rattus norvegicus
acccaatactctagactcagttatg

SEQ ID NO: 83904 - DNA, 25 bp, Rattus norvegicus
acccaatactcttgactcagttatg

SEQ ID NO: 83905 - DNA, 25 bp, Rattus norvegicus
acccaatatctcagctttgacttat

SEQ ID NO: 83906 - DNA, 25 bp, Rattus norvegicus
acccaatatctctgctttgacttat

SEQ ID NO: 83907 - DNA, 25 bp, Rattus norvegicus
acccaatgatggctcggtgagtgat

SEQ ID NO: 83908 - DNA, 25 bp, Rattus norvegicus
acccaatgatgggtcggtgagtgat

SEQ ID NO: 83909 - DNA, 25 bp, Rattus norvegicus
acccaatgtgtcattctagggaatt

SEQ ID NO: 83910 - DNA, 25 bp, Rattus norvegicus
acccaatgtgtctttctagggaatt

SEQ ID NO: 83911 - DNA, 25 bp, Rattus norvegicus
acccaattgccaagttcaggtggtt

SEQ ID NO: 83912 - DNA, 25 bp, Rattus norvegicus
acccaattgccatgttcaggtggtt

SEQ ID NO: 83913 - DNA, 25 bp, Rattus norvegicus
acccacaagggtccaggtaggctgt

SEQ ID NO: 83914 - DNA, 25 bp, Rattus norvegicus
acccacaagggtgcaggtaggctgt

SEQ ID NO: 83915 - DNA, 25 bp, Rattus norvegicus
acccacaagtctcgtagtataactg

SEQ ID NO: 83916 - DNA, 25 bp, Rattus norvegicus
acccacaagtctggtagtataactg

SEQ ID NO: 83917 - DNA, 25 bp, Rattus norvegicus
acccacacctatcgattgctatttt

SEQ ID NO: 83918 - DNA, 25 bp, Rattus norvegicus
acccacacctatggattgctatttt

SEQ ID NO: 83919 - DNA, 25 bp, Rattus norvegicus
acccacacctctataagtatgcagc

SEQ ID NO: 83920 - DNA, 25 bp, Rattus norvegicus
acccacacctctttaagtatgcagc

SEQ ID NO: 83921 - DNA, 25 bp, Rattus norvegicus
acccacacgggccagtgagcatgcg

SEQ ID NO: 83922 - DNA, 25 bp, Rattus norvegicus
acccacacgggcgagtgagcatgcg

SEQ ID NO: 83923 - DNA, 25 bp, Rattus norvegicus
acccacactgccatgtgagatggaa

SEQ ID NO: 83924 - DNA, 25 bp, Rattus norvegicus
acccacactgccttgtgagatggaa

SEQ ID NO: 83925 - DNA, 25 bp, Rattus norvegicus
acccacagccagaaggacctttgag

SEQ ID NO: 83926 - DNA, 25 bp, Rattus norvegicus
acccacagccagtaggacctttgag

SEQ ID NO: 83927 - DNA, 25 bp, Rattus norvegicus
acccacagctccactttgaagaatg

SEQ ID NO: 83928 - DNA, 25 bp, Rattus norvegicus
acccacagctcctctttgaagaatg

SEQ ID NO: 83929 - DNA, 25 bp, Rattus norvegicus
acccacaggaggactgggcctgtat

SEQ ID NO: 83930 - DNA, 25 bp, Rattus norvegicus
acccacaggaggtctgggcctgtat

SEQ ID NO: 83931 - DNA, 25 bp, Rattus norvegicus
acccacagtgggattggacagttgg

SEQ ID NO: 83932 - DNA, 25 bp, Rattus norvegicus
acccacagtgggtttggacagttgg

SEQ ID NO: 83933 - DNA, 25 bp, Rattus norvegicus
acccacatagacactttcttctcag

SEQ ID NO: 83934 - DNA, 25 bp, Rattus norvegicus
acccacatagactctttcttctcag

SEQ ID NO: 83935 - DNA, 25 bp, Rattus norvegicus
acccacatagccagtcagatgttca

SEQ ID NO: 83936 - DNA, 25 bp, Rattus norvegicus
acccacatagcctgtcagatgttca

SEQ ID NO: 83937 - DNA, 25 bp, Rattus norvegicus
acccacatagtgattgcttttcgat

SEQ ID NO: 83938 - DNA, 25 bp, Rattus norvegicus
acccacatagtgtttgcttttcgat

SEQ ID NO: 83939 - DNA, 25 bp, Rattus norvegicus
acccacatccttattcttctacagt

SEQ ID NO: 83940 - DNA, 25 bp, Rattus norvegicus
acccacatcctttttcttctacagt

SEQ ID NO: 83941 - DNA, 25 bp, Rattus norvegicus
acccacatcggcacaggacaagagt

SEQ ID NO: 83942 - DNA, 25 bp, Rattus norvegicus
acccacatcggctcaggacaagagt

SEQ ID NO: 83943 - DNA, 25 bp, Rattus norvegicus
acccacatgtatccctgagcagaag

SEQ ID NO: 83944 - DNA, 25 bp, Rattus norvegicus
acccacatgtatgcctgagcagaag

SEQ ID NO: 83945 - DNA, 25 bp, Rattus norvegicus
acccacatgtcacaggtatgtcaca

SEQ ID NO: 83946 - DNA, 25 bp, Rattus norvegicus
acccacatgtcagaggtatgtcaca

SEQ ID NO: 83947 - DNA, 25 bp, Rattus norvegicus
acccacattcagacacacatattca

SEQ ID NO: 83948 - DNA, 25 bp, Rattus norvegicus
acccacattcagtcacacatattca

SEQ ID NO: 83949 - DNA, 25 bp, Rattus norvegicus
acccaccaaaataatggcaattctg

SEQ ID NO: 83950 - DNA, 25 bp, Rattus norvegicus
acccaccaaaattatggcaattctg

SEQ ID NO: 83951 - DNA, 25 bp, Rattus norvegicus
acccaccaccagcaagagacagatt

SEQ ID NO: 83952 - DNA, 25 bp, Rattus norvegicus
acccaccaccaggaagagacagatt

SEQ ID NO: 83953 - DNA, 25 bp, Rattus norvegicus
acccaccaccggatatggttgtttg

SEQ ID NO: 83954 - DNA, 25 bp, Rattus norvegicus
acccaccaccggttatggttgtttg

SEQ ID NO: 83955 - DNA, 25 bp, Rattus norvegicus
acccaccagactattgcctaaatgg

SEQ ID NO: 83956 - DNA, 25 bp, Rattus norvegicus
acccaccagacttttgcctaaatgg

SEQ ID NO: 83957 - DNA, 25 bp, Rattus norvegicus
acccaccatttaaaaccttcaacag

SEQ ID NO: 83958 - DNA, 25 bp, Rattus norvegicus
acccaccatttataaccttcaacag

SEQ ID NO: 83959 - DNA, 25 bp, Rattus norvegicus
acccacccacagatagtgcatttta

SEQ ID NO: 83960 - DNA, 25 bp, Rattus norvegicus
acccacccacagttagtgcatttta

SEQ ID NO: 83961 - DNA, 25 bp, Rattus norvegicus
acccacccagatatgacagttcagg

SEQ ID NO: 83962 - DNA, 25 bp, Rattus norvegicus
acccacccagatttgacagttcagg

SEQ ID NO: 83963 - DNA, 25 bp, Rattus norvegicus
acccaccctcaaataaagtgcgcag

SEQ ID NO: 83964 - DNA, 25 bp, Rattus norvegicus
acccaccctcaattaaagtgcgcag

SEQ ID NO: 83965 - DNA, 25 bp, Rattus norvegicus
acccaccgccgcaacaagcagaacc

SEQ ID NO: 83966 - DNA, 25 bp, Rattus norvegicus
acccaccgccgctacaagcagaacc

SEQ ID NO: 83967 - DNA, 25 bp, Rattus norvegicus
acccaccgtggaagctgattttgta

SEQ ID NO: 83968 - DNA, 25 bp, Rattus norvegicus
acccaccgtggatgctgattttgta

SEQ ID NO: 83969 - DNA, 25 bp, Rattus norvegicus
acccacctacttcttgggagctgaa

SEQ ID NO: 83970 - DNA, 25 bp, Rattus norvegicus
acccacctacttgttgggagctgaa

SEQ ID NO: 83971 - DNA, 25 bp, Rattus norvegicus
acccacctagccagaggtttccagt

SEQ ID NO: 83972 - DNA, 25 bp, Rattus norvegicus
acccacctagcctgaggtttccagt

SEQ ID NO: 83973 - DNA, 25 bp, Rattus norvegicus
acccacctggccctgcaagtaaagt

SEQ ID NO: 83974 - DNA, 25 bp, Rattus norvegicus
acccacctggccgtgcaagtaaagt

SEQ ID NO: 83975 - DNA, 25 bp, Rattus norvegicus
acccacctgggcagtcgttgtctat

SEQ ID NO: 83976 - DNA, 25 bp, Rattus norvegicus
acccacctgggctgtcgttgtctat

SEQ ID NO: 83977 - DNA, 25 bp, Rattus norvegicus
acccacctgttgcttacctgtaaat

SEQ ID NO: 83978 - DNA, 25 bp, Rattus norvegicus
acccacctgttggttacctgtaaat

SEQ ID NO: 83979 - DNA, 25 bp, Rattus norvegicus
acccaccttcggacaatattttgct

SEQ ID NO: 83980 - DNA, 25 bp, Rattus norvegicus
acccaccttcggtcaatattttgct

SEQ ID NO: 83981 - DNA, 25 bp, Rattus norvegicus
acccacgaacacagttagctcttga

SEQ ID NO: 83982 - DNA, 25 bp, Rattus norvegicus
acccacgaacactgttagctcttga

SEQ ID NO: 83983 - DNA, 25 bp, Rattus norvegicus
acccacgaagccagcgggagcagaa

SEQ ID NO: 83984 - DNA, 25 bp, Rattus norvegicus
acccacgaagcctgcgggagcagaa

SEQ ID NO: 83985 - DNA, 25 bp, Rattus norvegicus
acccacgagttgaatggttgtgcca

SEQ ID NO: 83986 - DNA, 25 bp, Rattus norvegicus
acccacgagttgtatggttgtgcca

SEQ ID NO: 83987 - DNA, 25 bp, Rattus norvegicus
acccacggagcacgtctaggacagt

SEQ ID NO: 83988 - DNA, 25 bp, Rattus norvegicus
acccacggagcaggtctaggacagt

SEQ ID NO: 83989 - DNA, 25 bp, Rattus norvegicus
acccacggaggcaggagttactgga

SEQ ID NO: 83990 - DNA, 25 bp, Rattus norvegicus
acccacggaggctggagttactgga

SEQ ID NO: 83991 - DNA, 25 bp, Rattus norvegicus
acccacgtgtgtaagcgcagtccgc

SEQ ID NO: 83992 - DNA, 25 bp, Rattus norvegicus
acccacgtgtgttagcgcagtccgc

SEQ ID NO: 83993 - DNA, 25 bp, Rattus norvegicus
acccactcaaggagctgagacctga

SEQ ID NO: 83994 - DNA, 25 bp, Rattus norvegicus
acccactcaaggtgctgagacctga

SEQ ID NO: 83995 - DNA, 25 bp, Rattus norvegicus
acccactcacccaatgctgagttaa

SEQ ID NO: 83996 - DNA, 25 bp, Rattus norvegicus
acccactcaccctatgctgagttaa

SEQ ID NO: 83997 - DNA, 25 bp, Rattus norvegicus
acccactcctaacagaagtgttcag

SEQ ID NO: 83998 - DNA, 25 bp, Rattus norvegicus
acccactcctaagagaagtgttcag

SEQ ID NO: 83999 - DNA, 25 bp, Rattus norvegicus
acccactcggagctgaagacaaatt

SEQ ID NO: 84000 - DNA, 25 bp, Rattus norvegicus
acccactcggaggtgaagacaaatt

SEQ ID NO: 84001 - DNA, 25 bp, Rattus norvegicus
acccactcgtggagctgactcttgt

SEQ ID NO: 84002 - DNA, 25 bp, Rattus norvegicus
acccactcgtggtgctgactcttgt

SEQ ID NO: 84003 - DNA, 25 bp, Rattus norvegicus
acccactctatgattcttccagatt

SEQ ID NO: 84004 - DNA, 25 bp, Rattus norvegicus
acccactctatgtttcttccagatt

SEQ ID NO: 84005 - DNA, 25 bp, Rattus norvegicus
acccactctggtatctgttcagtta

SEQ ID NO: 84006 - DNA, 25 bp, Rattus norvegicus
acccactctggtttctgttcagtta

SEQ ID NO: 84007 - DNA, 25 bp, Rattus norvegicus
acccactgaggtctaactggcttta

SEQ ID NO: 84008 - DNA, 25 bp, Rattus norvegicus
acccactgaggtgtaactggcttta

SEQ ID NO: 84009 - DNA, 25 bp, Rattus norvegicus
acccactgctccaaaagaacgtatc

SEQ ID NO: 84010 - DNA, 25 bp, Rattus norvegicus
acccactgctcctaaagaacgtatc

SEQ ID NO: 84011 - DNA, 25 bp, Rattus norvegicus
acccactgctgtatcaatccaataa

SEQ ID NO: 84012 - DNA, 25 bp, Rattus norvegicus
acccactgctgtttcaatccaataa

SEQ ID NO: 84013 - DNA, 25 bp, Rattus norvegicus
acccactggcacagctgtgggattt

SEQ ID NO: 84014 - DNA, 25 bp, Rattus norvegicus
acccactggcactgctgtgggattt

SEQ ID NO: 84015 - DNA, 25 bp, Rattus norvegicus
acccactgggtgatgtgcctaagca

SEQ ID NO: 84016 - DNA, 25 bp, Rattus norvegicus
acccactgggtgttgtgcctaagca

SEQ ID NO: 84017 - DNA, 25 bp, Rattus norvegicus
acccactgtattaacctgttctact

SEQ ID NO: 84018 - DNA, 25 bp, Rattus norvegicus
acccactgtatttacctgttctact

SEQ ID NO: 84019 - DNA, 25 bp, Rattus norvegicus
acccacttaccaagacttgtaaagc

SEQ ID NO: 84020 - DNA, 25 bp, Rattus norvegicus
acccacttaccatgacttgtaaagc

SEQ ID NO: 84021 - DNA, 25 bp, Rattus norvegicus
acccacttgaccattgtatagattg

SEQ ID NO: 84022 - DNA, 25 bp, Rattus norvegicus
acccacttgacctttgtatagattg

SEQ ID NO: 84023 - DNA, 25 bp, Rattus norvegicus
acccagaaaacgaacctgcgatctt

SEQ ID NO: 84024 - DNA, 25 bp, Rattus norvegicus
acccagaaaacgtacctgcgatctt

SEQ ID NO: 84025 - DNA, 25 bp, Rattus norvegicus
acccagaaaactctcctgtgtcttt

SEQ ID NO: 84026 - DNA, 25 bp, Rattus norvegicus
acccagaaaactgtcctgtgtcttt

SEQ ID NO: 84027 - DNA, 25 bp, Rattus norvegicus
acccagaagagactcccctgttaga

SEQ ID NO: 84028 - DNA, 25 bp, Rattus norvegicus
acccagaagagagtcccctgttaga

SEQ ID NO: 84029 - DNA, 25 bp, Rattus norvegicus
acccagaagccacacacagtgtagt

SEQ ID NO: 84030 - DNA, 25 bp, Rattus norvegicus
acccagaagccagacacagtgtagt

SEQ ID NO: 84031 - DNA, 25 bp, Rattus norvegicus
acccagaaggaacacagcagtgagg

SEQ ID NO: 84032 - DNA, 25 bp, Rattus norvegicus
acccagaaggaagacagcagtgagg

SEQ ID NO: 84033 - DNA, 25 bp, Rattus norvegicus
acccagaatgccacaccgtttactt

SEQ ID NO: 84034 - DNA, 25 bp, Rattus norvegicus
acccagaatgcctcaccgtttactt

SEQ ID NO: 84035 - DNA, 25 bp, Rattus norvegicus
acccagacgtcccacagtggatgaa

SEQ ID NO: 84036 - DNA, 25 bp, Rattus norvegicus
acccagacgtccgacagtggatgaa

SEQ ID NO: 84037 - DNA, 25 bp, Rattus norvegicus
acccagactgctacctggtttaaga

SEQ ID NO: 84038 - DNA, 25 bp, Rattus norvegicus
acccagactgcttcctggtttaaga

SEQ ID NO: 84039 - DNA, 25 bp, Rattus norvegicus
acccagagaggacggccatgcagct

SEQ ID NO: 84040 - DNA, 25 bp, Rattus norvegicus
acccagagaggagggccatgcagct

SEQ ID NO: 84041 - DNA, 25 bp, Rattus norvegicus
acccagagatagacaaccccaaata

SEQ ID NO: 84042 - DNA, 25 bp, Rattus norvegicus
acccagagatagtcaaccccaaata

SEQ ID NO: 84043 - DNA, 25 bp, Rattus norvegicus
acccagagctctctgtaacggcagt

SEQ ID NO: 84044 - DNA, 25 bp, Rattus norvegicus
acccagagctctgtgtaacggcagt

SEQ ID NO: 84045 - DNA, 25 bp, Rattus norvegicus
acccagaggccgcagtactgtatga

SEQ ID NO: 84046 - DNA, 25 bp, Rattus norvegicus
acccagaggccggagtactgtatga

SEQ ID NO: 84047 - DNA, 25 bp, Rattus norvegicus
acccagagggaccaacagcaacttt

SEQ ID NO: 84048 - DNA, 25 bp, Rattus norvegicus
acccagagggacgaacagcaacttt

SEQ ID NO: 84049 - DNA, 25 bp, Rattus norvegicus
acccagagggctagctaagacacta

SEQ ID NO: 84050 - DNA, 25 bp, Rattus norvegicus
acccagagggcttgctaagacacta

SEQ ID NO: 84051 - DNA, 25 bp, Rattus norvegicus
acccagaggtatctgagagaagtct

SEQ ID NO: 84052 - DNA, 25 bp, Rattus norvegicus
acccagaggtatgtgagagaagtct

SEQ ID NO: 84053 - DNA, 25 bp, Rattus norvegicus
acccagatcctcctggctttaaaga

SEQ ID NO: 84054 - DNA, 25 bp, Rattus norvegicus
acccagatcctcgtggctttaaaga

SEQ ID NO: 84055 - DNA, 25 bp, Rattus norvegicus
acccagatctagatgtttgagccca

SEQ ID NO: 84056 - DNA, 25 bp, Rattus norvegicus
acccagatctagttgtttgagccca

SEQ ID NO: 84057 - DNA, 25 bp, Rattus norvegicus
acccagatgagacattccttttaaa

SEQ ID NO: 84058 - DNA, 25 bp, Rattus norvegicus
acccagatgagagattccttttaaa

SEQ ID NO: 84059 - DNA, 25 bp, Rattus norvegicus
acccagatttgccaccgcataaaaa

SEQ ID NO: 84060 - DNA, 25 bp, Rattus norvegicus
acccagatttgcgaccgcataaaaa

SEQ ID NO: 84061 - DNA, 25 bp, Rattus norvegicus
acccagcaatggatacaggaccttg

SEQ ID NO: 84062 - DNA, 25 bp, Rattus norvegicus
acccagcaatggttacaggaccttg

SEQ ID NO: 84063 - DNA, 25 bp, Rattus norvegicus
acccagcacattactttgtcatcta

SEQ ID NO: 84064 - DNA, 25 bp, Rattus norvegicus
acccagcacatttctttgtcatcta

SEQ ID NO: 84065 - DNA, 25 bp, Rattus norvegicus
acccagcacctcatgtatatagtta

SEQ ID NO: 84066 - DNA, 25 bp, Rattus norvegicus
acccagcacctcttgtatatagtta

SEQ ID NO: 84067 - DNA, 25 bp, Rattus norvegicus
acccagcagtggctctttgaacata

SEQ ID NO: 84068 - DNA, 25 bp, Rattus norvegicus
acccagcagtgggtctttgaacata

SEQ ID NO: 84069 - DNA, 25 bp, Rattus norvegicus
acccagcatgtgattcgtattttgt

SEQ ID NO: 84070 - DNA, 25 bp, Rattus norvegicus
acccagcatgtgtttcgtattttgt

SEQ ID NO: 84071 - DNA, 25 bp, Rattus norvegicus
acccagccaggaagtttcttgtttt

SEQ ID NO: 84072 - DNA, 25 bp, Rattus norvegicus
acccagccaggatgtttcttgtttt

SEQ ID NO: 84073 - DNA, 25 bp, Rattus norvegicus
acccagccaggtcctgttggtggcc

SEQ ID NO: 84074 - DNA, 25 bp, Rattus norvegicus
acccagccaggtgctgttggtggcc

SEQ ID NO: 84075 - DNA, 25 bp, Rattus norvegicus
acccagccataaactgagtcagttg

SEQ ID NO: 84076 - DNA, 25 bp, Rattus norvegicus
acccagccataatctgagtcagttg

SEQ ID NO: 84077 - DNA, 25 bp, Rattus norvegicus
acccagcctctacaagcaacaggtg

SEQ ID NO: 84078 - DNA, 25 bp, Rattus norvegicus
acccagcctctagaagcaacaggtg

SEQ ID NO: 84079 - DNA, 25 bp, Rattus norvegicus
acccagccttcaacaaagtcctaga

SEQ ID NO: 84080 - DNA, 25 bp, Rattus norvegicus
acccagccttcatcaaagtcctaga

SEQ ID NO: 84081 - DNA, 25 bp, Rattus norvegicus
acccagcctttgctttaccatgaaa

SEQ ID NO: 84082 - DNA, 25 bp, Rattus norvegicus
acccagcctttggtttaccatgaaa

SEQ ID NO: 84083 - DNA, 25 bp, Rattus norvegicus
acccagcgacacagttctgatgttt

SEQ ID NO: 84084 - DNA, 25 bp, Rattus norvegicus
acccagcgacactgttctgatgttt

SEQ ID NO: 84085 - DNA, 25 bp, Rattus norvegicus
acccagctaacaacaggccggatga

SEQ ID NO: 84086 - DNA, 25 bp, Rattus norvegicus
acccagctaacatcaggccggatga

SEQ ID NO: 84087 - DNA, 25 bp, Rattus norvegicus
acccagctaagcctgactaagatca

SEQ ID NO: 84088 - DNA, 25 bp, Rattus norvegicus
acccagctaagcgtgactaagatca

SEQ ID NO: 84089 - DNA, 25 bp, Rattus norvegicus
acccagctccagattcagatttaat

SEQ ID NO: 84090 - DNA, 25 bp, Rattus norvegicus
acccagctccagtttcagatttaat

SEQ ID NO: 84091 - DNA, 25 bp, Rattus norvegicus
acccagctgaccaggcaatgacttt

SEQ ID NO: 84092 - DNA, 25 bp, Rattus norvegicus
acccagctgacctggcaatgacttt

SEQ ID NO: 84093 - DNA, 25 bp, Rattus norvegicus
acccagctgctcatggacaagtggc

SEQ ID NO: 84094 - DNA, 25 bp, Rattus norvegicus
acccagctgctcttggacaagtggc

SEQ ID NO: 84095 - DNA, 25 bp, Rattus norvegicus
acccagcttgctattttcatttctt

SEQ ID NO: 84096 - DNA, 25 bp, Rattus norvegicus
acccagcttgcttttttcatttctt

SEQ ID NO: 84097 - DNA, 25 bp, Rattus norvegicus
acccaggaacctatttatcatgcaa

SEQ ID NO: 84098 - DNA, 25 bp, Rattus norvegicus
acccaggaacctttttatcatgcaa

SEQ ID NO: 84099 - DNA, 25 bp, Rattus norvegicus
acccaggaatatatgagcggcttaa

SEQ ID NO: 84100 - DNA, 25 bp, Rattus norvegicus
acccaggaatatttgagcggcttaa

SEQ ID NO: 84101 - DNA, 25 bp, Rattus norvegicus
acccaggaattcatgcctctgagga

SEQ ID NO: 84102 - DNA, 25 bp, Rattus norvegicus
acccaggaattcttgcctctgagga

SEQ ID NO: 84103 - DNA, 25 bp, Rattus norvegicus
acccaggagttaccacaaccatgtg

SEQ ID NO: 84104 - DNA, 25 bp, Rattus norvegicus
acccaggagttagcacaaccatgtg

SEQ ID NO: 84105 - DNA, 25 bp, Rattus norvegicus
acccaggatagcaactaggcccatt

SEQ ID NO: 84106 - DNA, 25 bp, Rattus norvegicus
acccaggatagctactaggcccatt

SEQ ID NO: 84107 - DNA, 25 bp, Rattus norvegicus
acccaggcagggacttgtaacacaa

SEQ ID NO: 84108 - DNA, 25 bp, Rattus norvegicus
acccaggcagggtcttgtaacacaa

SEQ ID NO: 84109 - DNA, 25 bp, Rattus norvegicus
acccaggcaggtcttgagcttgcaa

SEQ ID NO: 84110 - DNA, 25 bp, Rattus norvegicus
acccaggcaggtgttgagcttgcaa

SEQ ID NO: 84111 - DNA, 25 bp, Rattus norvegicus
acccaggcatggacactcactgttt

SEQ ID NO: 84112 - DNA, 25 bp, Rattus norvegicus
acccaggcatggtcactcactgttt

SEQ ID NO: 84113 - DNA, 25 bp, Rattus norvegicus
acccaggcgctcctcttgaagtgga

SEQ ID NO: 84114 - DNA, 25 bp, Rattus norvegicus
acccaggcgctcgtcttgaagtgga

SEQ ID NO: 84115 - DNA, 25 bp, Rattus norvegicus
acccaggctgagacatgtatttcat

SEQ ID NO: 84116 - DNA, 25 bp, Rattus norvegicus
acccaggctgagtcatgtatttcat

SEQ ID NO: 84117 - DNA, 25 bp, Rattus norvegicus
acccaggctgtaattgtgatttttt

SEQ ID NO: 84118 - DNA, 25 bp, Rattus norvegicus
acccaggctgtatttgtgatttttt

SEQ ID NO: 84119 - DNA, 25 bp, Rattus norvegicus
acccaggctgttacacattctaata

SEQ ID NO: 84120 - DNA, 25 bp, Rattus norvegicus
acccaggctgtttcacattctaata

SEQ ID NO: 84121 - DNA, 25 bp, Rattus norvegicus
acccagggcaagcagttcaatgtat

SEQ ID NO: 84122 - DNA, 25 bp, Rattus norvegicus
acccagggcaaggagttcaatgtat

SEQ ID NO: 84123 - DNA, 25 bp, Rattus norvegicus
acccagggcgtcacaggatggagct

SEQ ID NO: 84124 - DNA, 25 bp, Rattus norvegicus
acccagggcgtctcaggatggagct

SEQ ID NO: 84125 - DNA, 25 bp, Rattus norvegicus
acccagggtattcccgctgttctaa

SEQ ID NO: 84126 - DNA, 25 bp, Rattus norvegicus
acccagggtattgccgctgttctaa

SEQ ID NO: 84127 - DNA, 25 bp, Rattus norvegicus
acccagggtcatacagagcgctgta

SEQ ID NO: 84128 - DNA, 25 bp, Rattus norvegicus
acccagggtcattcagagcgctgta

SEQ ID NO: 84129 - DNA, 25 bp, Rattus norvegicus
acccaggtcctgaggataacaataa

SEQ ID NO: 84130 - DNA, 25 bp, Rattus norvegicus
acccaggtcctgtggataacaataa

SEQ ID NO: 84131 - DNA, 25 bp, Rattus norvegicus
acccaggtctcaaggatggtgcctt

SEQ ID NO: 84132 - DNA, 25 bp, Rattus norvegicus
acccaggtctcatggatggtgcctt

SEQ ID NO: 84133 - DNA, 25 bp, Rattus norvegicus
acccaggtgaagatgtgtgctgcca

SEQ ID NO: 84134 - DNA, 25 bp, Rattus norvegicus
acccaggtgaagttgtgtgctgcca

SEQ ID NO: 84135 - DNA, 25 bp, Rattus norvegicus
acccaggtgcttagctgacaaaaaa

SEQ ID NO: 84136 - DNA, 25 bp, Rattus norvegicus
acccaggtgctttgctgacaaaaaa

SEQ ID NO: 84137 - DNA, 25 bp, Rattus norvegicus
acccaggttctaatctcagcagaca

SEQ ID NO: 84138 - DNA, 25 bp, Rattus norvegicus
acccaggttctattctcagcagaca

SEQ ID NO: 84139 - DNA, 25 bp, Rattus norvegicus
acccagtaaggacttgtttgacatc

SEQ ID NO: 84140 - DNA, 25 bp, Rattus norvegicus
acccagtaaggagttgtttgacatc

SEQ ID NO: 84141 - DNA, 25 bp, Rattus norvegicus
acccagtacctgattcgaattagaa

SEQ ID NO: 84142 - DNA, 25 bp, Rattus norvegicus
acccagtacctgtttcgaattagaa

SEQ ID NO: 84143 - DNA, 25 bp, Rattus norvegicus
acccagtagctcatgctgagtctct

SEQ ID NO: 84144 - DNA, 25 bp, Rattus norvegicus
acccagtagctcttgctgagtctct

SEQ ID NO: 84145 - DNA, 25 bp, Rattus norvegicus
acccagtagtacaggactcctacta

SEQ ID NO: 84146 - DNA, 25 bp, Rattus norvegicus
acccagtagtactggactcctacta

SEQ ID NO: 84147 - DNA, 25 bp, Rattus norvegicus
acccagtatataaagtctgttcata

SEQ ID NO: 84148 - DNA, 25 bp, Rattus norvegicus
acccagtatatatagtctgttcata

SEQ ID NO: 84149 - DNA, 25 bp, Rattus norvegicus
acccagtatggcacctgactccatg

SEQ ID NO: 84150 - DNA, 25 bp, Rattus norvegicus
acccagtatggctcctgactccatg

SEQ ID NO: 84151 - DNA, 25 bp, Rattus norvegicus
acccagtattccatgcggtccagca

SEQ ID NO: 84152 - DNA, 25 bp, Rattus norvegicus
acccagtattccttgcggtccagca

SEQ ID NO: 84153 - DNA, 25 bp, Rattus norvegicus
acccagtcacgaaattttctctagc

SEQ ID NO: 84154 - DNA, 25 bp, Rattus norvegicus
acccagtcacgatattttctctagc

SEQ ID NO: 84155 - DNA, 25 bp, Rattus norvegicus
acccagtcaggtcgtgttcgtccat

SEQ ID NO: 84156 - DNA, 25 bp, Rattus norvegicus
acccagtcaggtggtgttcgtccat

SEQ ID NO: 84157 - DNA, 25 bp, Rattus norvegicus
acccagtcagtaagcccttcagtat

SEQ ID NO: 84158 - DNA, 25 bp, Rattus norvegicus
acccagtcagtatgcccttcagtat

SEQ ID NO: 84159 - DNA, 25 bp, Rattus norvegicus
acccagtcctgaaggtgctgagttt

SEQ ID NO: 84160 - DNA, 25 bp, Rattus norvegicus
acccagtcctgatggtgctgagttt

SEQ ID NO: 84161 - DNA, 25 bp, Rattus norvegicus
acccagtcgctgaacgaggcatttg

SEQ ID NO: 84162 - DNA, 25 bp, Rattus norvegicus
acccagtcgctgtacgaggcatttg

SEQ ID NO: 84163 - DNA, 25 bp, Rattus norvegicus
acccagtcttatagtttgctcttgc

SEQ ID NO: 84164 - DNA, 25 bp, Rattus norvegicus
acccagtcttattgtttgctcttgc

SEQ ID NO: 84165 - DNA, 25 bp, Rattus norvegicus
acccagtgactgaccttttggtaag

SEQ ID NO: 84166 - DNA, 25 bp, Rattus norvegicus
acccagtgactgtccttttggtaag

SEQ ID NO: 84167 - DNA, 25 bp, Rattus norvegicus
acccagtgcactaggtgttcacaga

SEQ ID NO: 84168 - DNA, 25 bp, Rattus norvegicus
acccagtgcacttggtgttcacaga

SEQ ID NO: 84169 - DNA, 25 bp, Rattus norvegicus
acccagtgccccaaggaagaaggat

SEQ ID NO: 84170 - DNA, 25 bp, Rattus norvegicus
acccagtgcccctaggaagaaggat

SEQ ID NO: 84171 - DNA, 25 bp, Rattus norvegicus
acccagtggactctatgttagcttg

SEQ ID NO: 84172 - DNA, 25 bp, Rattus norvegicus
acccagtggactgtatgttagcttg

SEQ ID NO: 84173 - DNA, 25 bp, Rattus norvegicus
acccagtgggcaaactctggagttt

SEQ ID NO: 84174 - DNA, 25 bp, Rattus norvegicus
acccagtgggcatactctggagttt

SEQ ID NO: 84175 - DNA, 25 bp, Rattus norvegicus
acccagtgtgcaaagttccccacag

SEQ ID NO: 84176 - DNA, 25 bp, Rattus norvegicus
acccagtgtgcatagttccccacag

SEQ ID NO: 84177 - DNA, 25 bp, Rattus norvegicus
acccagtgtgcgatgtgtttgtcct

SEQ ID NO: 84178 - DNA, 25 bp, Rattus norvegicus
acccagtgtgcgttgtgtttgtcct

SEQ ID NO: 84179 - DNA, 25 bp, Rattus norvegicus
acccagtgtggcaccggagagcatc

SEQ ID NO: 84180 - DNA, 25 bp, Rattus norvegicus
acccagtgtggctccggagagcatc

SEQ ID NO: 84181 - DNA, 25 bp, Rattus norvegicus
acccagtgttggctgtgcagattaa

SEQ ID NO: 84182 - DNA, 25 bp, Rattus norvegicus
acccagtgttgggtgtgcagattaa

SEQ ID NO: 84183 - DNA, 25 bp, Rattus norvegicus
acccagtgtttcagaggttctgtct

SEQ ID NO: 84184 - DNA, 25 bp, Rattus norvegicus
acccagtgtttctgaggttctgtct

SEQ ID NO: 84185 - DNA, 25 bp, Rattus norvegicus
acccagttccagctttaagacctat

SEQ ID NO: 84186 - DNA, 25 bp, Rattus norvegicus
acccagttccaggtttaagacctat

SEQ ID NO: 84187 - DNA, 25 bp, Rattus norvegicus
acccagttcgtgagcatgtgctgtt

SEQ ID NO: 84188 - DNA, 25 bp, Rattus norvegicus
acccagttcgtgtgcatgtgctgtt

SEQ ID NO: 84189 - DNA, 25 bp, Rattus norvegicus
acccagttctggaattgcgtgcttt

SEQ ID NO: 84190 - DNA, 25 bp, Rattus norvegicus
acccagttctggtattgcgtgcttt

SEQ ID NO: 84191 - DNA, 25 bp, Rattus norvegicus
acccagttgacccatttgaagtctc

SEQ ID NO: 84192 - DNA, 25 bp, Rattus norvegicus
acccagttgaccgatttgaagtctc

SEQ ID NO: 84193 - DNA, 25 bp, Rattus norvegicus
acccagttgtgtccagggtgacgaa

SEQ ID NO: 84194 - DNA, 25 bp, Rattus norvegicus
acccagttgtgtgcagggtgacgaa

SEQ ID NO: 84195 - DNA, 25 bp, Rattus norvegicus
acccagtttactattctgatggaat

SEQ ID NO: 84196 - DNA, 25 bp, Rattus norvegicus
acccagtttacttttctgatggaat

SEQ ID NO: 84197 - DNA, 25 bp, Rattus norvegicus
acccagtttctaccactgtctgaaa

SEQ ID NO: 84198 - DNA, 25 bp, Rattus norvegicus
acccagtttctagcactgtctgaaa

SEQ ID NO: 84199 - DNA, 25 bp, Rattus norvegicus
acccataaatttcctctttgtggct

SEQ ID NO: 84200 - DNA, 25 bp, Rattus norvegicus
acccataaatttgctctttgtggct

SEQ ID NO: 84201 - DNA, 25 bp, Rattus norvegicus
acccatacttggcagtgttcacatg

SEQ ID NO: 84202 - DNA, 25 bp, Rattus norvegicus
acccatacttgggagtgttcacatg

SEQ ID NO: 84203 - DNA, 25 bp, Rattus norvegicus
acccatagcctgcataagtggtttt

SEQ ID NO: 84204 - DNA, 25 bp, Rattus norvegicus
acccatagcctggataagtggtttt

SEQ ID NO: 84205 - DNA, 25 bp, Rattus norvegicus
acccatatccccaataaagtcacgt

SEQ ID NO: 84206 - DNA, 25 bp, Rattus norvegicus
acccatatcccctataaagtcacgt

SEQ ID NO: 84207 - DNA, 25 bp, Rattus norvegicus
acccatatggtgaccaagaggacgg

SEQ ID NO: 84208 - DNA, 25 bp, Rattus norvegicus
acccatatggtgtccaagaggacgg

SEQ ID NO: 84209 - DNA, 25 bp, Rattus norvegicus
acccatatgtcactgttcttcttgt

SEQ ID NO: 84210 - DNA, 25 bp, Rattus norvegicus
acccatatgtcagtgttcttcttgt

SEQ ID NO: 84211 - DNA, 25 bp, Rattus norvegicus
acccatatttaaagttgccccatca

SEQ ID NO: 84212 - DNA, 25 bp, Rattus norvegicus
acccatatttaatgttgccccatca

SEQ ID NO: 84213 - DNA, 25 bp, Rattus norvegicus
acccatatttctctttcacatcttt

SEQ ID NO: 84214 - DNA, 25 bp, Rattus norvegicus
acccatatttctgtttcacatcttt

SEQ ID NO: 84215 - DNA, 25 bp, Rattus norvegicus
acccatatttggaggcttgcaactg

SEQ ID NO: 84216 - DNA, 25 bp, Rattus norvegicus
acccatatttggtggcttgcaactg

SEQ ID NO: 84217 - DNA, 25 bp, Rattus norvegicus
acccatcaaagcagtccattctgtg

SEQ ID NO: 84218 - DNA, 25 bp, Rattus norvegicus
acccatcaaagctgtccattctgtg

SEQ ID NO: 84219 - DNA, 25 bp, Rattus norvegicus
acccatcatcctaaagcttgtgtca

SEQ ID NO: 84220 - DNA, 25 bp, Rattus norvegicus
acccatcatccttaagcttgtgtca

SEQ ID NO: 84221 - DNA, 25 bp, Rattus norvegicus
acccatccaggcctgtttttgttga

SEQ ID NO: 84222 - DNA, 25 bp, Rattus norvegicus
acccatccaggcgtgtttttgttga

SEQ ID NO: 84223 - DNA, 25 bp, Rattus norvegicus
acccatcccagcagtatcattaaaa

SEQ ID NO: 84224 - DNA, 25 bp, Rattus norvegicus
acccatcccagctgtatcattaaaa

SEQ ID NO: 84225 - DNA, 25 bp, Rattus norvegicus
acccatccggacagcagctagatga

SEQ ID NO: 84226 - DNA, 25 bp, Rattus norvegicus
acccatccggactgcagctagatga

SEQ ID NO: 84227 - DNA, 25 bp, Rattus norvegicus
acccatcctcgcaggaatgtaagca

SEQ ID NO: 84228 - DNA, 25 bp, Rattus norvegicus
acccatcctcgctggaatgtaagca

SEQ ID NO: 84229 - DNA, 25 bp, Rattus norvegicus
acccatcctggcaggtagtgcagaa

SEQ ID NO: 84230 - DNA, 25 bp, Rattus norvegicus
acccatcctggctggtagtgcagaa

SEQ ID NO: 84231 - DNA, 25 bp, Rattus norvegicus
acccatcctggtagttcggaatgca

SEQ ID NO: 84232 - DNA, 25 bp, Rattus norvegicus
acccatcctggttgttcggaatgca

SEQ ID NO: 84233 - DNA, 25 bp, Rattus norvegicus
acccatcgggtcaggtgtggagcct

SEQ ID NO: 84234 - DNA, 25 bp, Rattus norvegicus
acccatcgggtctggtgtggagcct

SEQ ID NO: 84235 - DNA, 25 bp, Rattus norvegicus
acccatcgtcatatagatttccaat

SEQ ID NO: 84236 - DNA, 25 bp, Rattus norvegicus
acccatcgtcatttagatttccaat

SEQ ID NO: 84237 - DNA, 25 bp, Rattus norvegicus
acccatcgtcttagtacagcgtatg

SEQ ID NO: 84238 - DNA, 25 bp, Rattus norvegicus
acccatcgtctttgtacagcgtatg

SEQ ID NO: 84239 - DNA, 25 bp, Rattus norvegicus
acccatctgggtatttacacactga

SEQ ID NO: 84240 - DNA, 25 bp, Rattus norvegicus
acccatctgggtttttacacactga

SEQ ID NO: 84241 - DNA, 25 bp, Rattus norvegicus
acccatctgtgtcatacagcccgag

SEQ ID NO: 84242 - DNA, 25 bp, Rattus norvegicus
acccatctgtgtgatacagcccgag

SEQ ID NO: 84243 - DNA, 25 bp, Rattus norvegicus
acccatcttcacaggcatactgttg

SEQ ID NO: 84244 - DNA, 25 bp, Rattus norvegicus
acccatcttcactggcatactgttg

SEQ ID NO: 84245 - DNA, 25 bp, Rattus norvegicus
acccatcttccgagggaatgcttga

SEQ ID NO: 84246 - DNA, 25 bp, Rattus norvegicus
acccatcttccgtgggaatgcttga

SEQ ID NO: 84247 - DNA, 25 bp, Rattus norvegicus
acccatcttgtgaggaacccagcat

SEQ ID NO: 84248 - DNA, 25 bp, Rattus norvegicus
acccatcttgtgctatttcctggaa

SEQ ID NO: 84249 - DNA, 25 bp, Rattus norvegicus
acccatcttgtggtatttcctggaa

SEQ ID NO: 84250 - DNA, 25 bp, Rattus norvegicus
acccatcttgtgtggaacccagcat

SEQ ID NO: 84251 - DNA, 25 bp, Rattus norvegicus
acccatgaaagcctttgattcccgg

SEQ ID NO: 84252 - DNA, 25 bp, Rattus norvegicus
acccatgaaagcgtttgattcccgg

SEQ ID NO: 84253 - DNA, 25 bp, Rattus norvegicus
acccatgaatggaaaagctgcaaaa

SEQ ID NO: 84254 - DNA, 25 bp, Rattus norvegicus
acccatgaatggtaaagctgcaaaa

SEQ ID NO: 84255 - DNA, 25 bp, Rattus norvegicus
acccatgagtttcaggaaggagaat

SEQ ID NO: 84256 - DNA, 25 bp, Rattus norvegicus
acccatgagtttgaggaaggagaat

SEQ ID NO: 84257 - DNA, 25 bp, Rattus norvegicus
acccatgattgcagatagcttagct

SEQ ID NO: 84258 - DNA, 25 bp, Rattus norvegicus
acccatgattgctgatagcttagct

SEQ ID NO: 84259 - DNA, 25 bp, Rattus norvegicus
acccatgcaagcactcttgagattt

SEQ ID NO: 84260 - DNA, 25 bp, Rattus norvegicus
acccatgcaagctctcttgagattt

SEQ ID NO: 84261 - DNA, 25 bp, Rattus norvegicus
acccatgcatatcttcaccatttgg

SEQ ID NO: 84262 - DNA, 25 bp, Rattus norvegicus
acccatgcatatgttcaccatttgg

SEQ ID NO: 84263 - DNA, 25 bp, Rattus norvegicus
acccatgccctgacatttcaatgta

SEQ ID NO: 84264 - DNA, 25 bp, Rattus norvegicus
acccatgccctgtcatttcaatgta

SEQ ID NO: 84265 - DNA, 25 bp, Rattus norvegicus
acccatgccggcaagtgctgtgctc

SEQ ID NO: 84266 - DNA, 25 bp, Rattus norvegicus
acccatgccggctagtgctgtgctc

SEQ ID NO: 84267 - DNA, 25 bp, Rattus norvegicus
acccatgcctctaaggagtctgtta

SEQ ID NO: 84268 - DNA, 25 bp, Rattus norvegicus
acccatgcctctcgaacgggtgcag

SEQ ID NO: 84269 - DNA, 25 bp, Rattus norvegicus
acccatgcctctggaacgggtgcag

SEQ ID NO: 84270 - DNA, 25 bp, Rattus norvegicus
acccatgcctcttaggagtctgtta

SEQ ID NO: 84271 - DNA, 25 bp, Rattus norvegicus
acccatgcgtggatcccaataaact

SEQ ID NO: 84272 - DNA, 25 bp, Rattus norvegicus
acccatgcgtggttcccaataaact

SEQ ID NO: 84273 - DNA, 25 bp, Rattus norvegicus
acccatgcgttaactgaactcatca

SEQ ID NO: 84274 - DNA, 25 bp, Rattus norvegicus
acccatgcgttatctgaactcatca

SEQ ID NO: 84275 - DNA, 25 bp, Rattus norvegicus
acccatgctggtagtgtgtgacact

SEQ ID NO: 84276 - DNA, 25 bp, Rattus norvegicus
acccatgctggttgtgtgtgacact

SEQ ID NO: 84277 - DNA, 25 bp, Rattus norvegicus
acccatggaacgcaggtcacctttg

SEQ ID NO: 84278 - DNA, 25 bp, Rattus norvegicus
acccatggaacggaggtcacctttg

SEQ ID NO: 84279 - DNA, 25 bp, Rattus norvegicus
acccatggactgcagccgttatgcc

SEQ ID NO: 84280 - DNA, 25 bp, Rattus norvegicus
acccatggactggagccgttatgcc

SEQ ID NO: 84281 - DNA, 25 bp, Rattus norvegicus
acccatggcccactttttgtgggag

SEQ ID NO: 84282 - DNA, 25 bp, Rattus norvegicus
acccatggcccagtttttgtgggag

SEQ ID NO: 84283 - DNA, 25 bp, Rattus norvegicus
acccatgggatgaatactgtttacg

SEQ ID NO: 84284 - DNA, 25 bp, Rattus norvegicus
acccatgggatgtatactgtttacg

SEQ ID NO: 84285 - DNA, 25 bp, Rattus norvegicus
acccatgggcctatgtggagggact

SEQ ID NO: 84286 - DNA, 25 bp, Rattus norvegicus
acccatgggcctttgtggagggact

SEQ ID NO: 84287 - DNA, 25 bp, Rattus norvegicus
acccatgggtctctgtaagtgtctt

SEQ ID NO: 84288 - DNA, 25 bp, Rattus norvegicus
acccatgggtctgtgtaagtgtctt

SEQ ID NO: 84289 - DNA, 25 bp, Rattus norvegicus
acccatggtcaacttccgagaatac

SEQ ID NO: 84290 - DNA, 25 bp, Rattus norvegicus
acccatggtcaagttccgagaatac

SEQ ID NO: 84291 - DNA, 25 bp, Rattus norvegicus
acccatggtgttattattagacgca

SEQ ID NO: 84292 - DNA, 25 bp, Rattus norvegicus
acccatggtgtttttattagacgca

SEQ ID NO: 84293 - DNA, 25 bp, Rattus norvegicus
acccatgtacttaccgcaagaggat

SEQ ID NO: 84294 - DNA, 25 bp, Rattus norvegicus
acccatgtactttccgcaagaggat

SEQ ID NO: 84295 - DNA, 25 bp, Rattus norvegicus
acccatgtatgtctgtgcagaggca

SEQ ID NO: 84296 - DNA, 25 bp, Rattus norvegicus
acccatgtatgtgtgtgcagaggca

SEQ ID NO: 84297 - DNA, 25 bp, Rattus norvegicus
acccatgtcgcgcactaagtagttt

SEQ ID NO: 84298 - DNA, 25 bp, Rattus norvegicus
acccatgtcgcggactaagtagttt

SEQ ID NO: 84299 - DNA, 25 bp, Rattus norvegicus
acccatgtctctcttagtgcatcag

SEQ ID NO: 84300 - DNA, 25 bp, Rattus norvegicus
acccatgtctctgttagtgcatcag

SEQ ID NO: 84301 - DNA, 25 bp, Rattus norvegicus
acccatgtgaggaagttcgtgactt

SEQ ID NO: 84302 - DNA, 25 bp, Rattus norvegicus
acccatgtgaggtagttcgtgactt

SEQ ID NO: 84303 - DNA, 25 bp, Rattus norvegicus
acccatgtgggtctataacttgatc

SEQ ID NO: 84304 - DNA, 25 bp, Rattus norvegicus
acccatgtgggtgtataacttgatc

SEQ ID NO: 84305 - DNA, 25 bp, Rattus norvegicus
acccatgtggtgaactcttaaggat

SEQ ID NO: 84306 - DNA, 25 bp, Rattus norvegicus
acccatgtggtgtactcttaaggat

SEQ ID NO: 84307 - DNA, 25 bp, Rattus norvegicus
acccatgtgtagagaaattcttctg

SEQ ID NO: 84308 - DNA, 25 bp, Rattus norvegicus
acccatgtgtagtgaaattcttctg

SEQ ID NO: 84309 - DNA, 25 bp, Rattus norvegicus
acccatgtgtttctagagattttag

SEQ ID NO: 84310 - DNA, 25 bp, Rattus norvegicus
acccatgtgtttgtagagattttag

SEQ ID NO: 84311 - DNA, 25 bp, Rattus norvegicus
acccatgttctgctgttggacacta

SEQ ID NO: 84312 - DNA, 25 bp, Rattus norvegicus
acccatgttctggtgttggacacta

SEQ ID NO: 84313 - DNA, 25 bp, Rattus norvegicus
acccatgttcttcttaaagcctcaa

SEQ ID NO: 84314 - DNA, 25 bp, Rattus norvegicus
acccatgttcttgttaaagcctcaa

SEQ ID NO: 84315 - DNA, 25 bp, Rattus norvegicus
acccatgttgttattgctcttgtgc

SEQ ID NO: 84316 - DNA, 25 bp, Rattus norvegicus
acccatgttgtttttgctcttgtgc

SEQ ID NO: 84317 - DNA, 25 bp, Rattus norvegicus
acccattaagccacctgatgacatt

SEQ ID NO: 84318 - DNA, 25 bp, Rattus norvegicus
acccattaagcctcctgatgacatt

SEQ ID NO: 84319 - DNA, 25 bp, Rattus norvegicus
acccattagtttagttcttctgcag

SEQ ID NO: 84320 - DNA, 25 bp, Rattus norvegicus
acccattagttttgttcttctgcag

SEQ ID NO: 84321 - DNA, 25 bp, Rattus norvegicus
acccattccaggcagcagtgtggtg

SEQ ID NO: 84322 - DNA, 25 bp, Rattus norvegicus
acccattccagggagcagtgtggtg

SEQ ID NO: 84323 - DNA, 25 bp, Rattus norvegicus
acccattccctactcattttcaaat

SEQ ID NO: 84324 - DNA, 25 bp, Rattus norvegicus
acccattccctagtcattttcaaat

SEQ ID NO: 84325 - DNA, 25 bp, Rattus norvegicus
acccattcgctcatcttgatgagtt

SEQ ID NO: 84326 - DNA, 25 bp, Rattus norvegicus
acccattcgctcttcttgatgagtt

SEQ ID NO: 84327 - DNA, 25 bp, Rattus norvegicus
acccattctgggactgctgctgctg

SEQ ID NO: 84328 - DNA, 25 bp, Rattus norvegicus
acccattctgggtctgctgctgctg

SEQ ID NO: 84329 - DNA, 25 bp, Rattus norvegicus
acccattgctccagccaaatatgtt

SEQ ID NO: 84330 - DNA, 25 bp, Rattus norvegicus
acccattgctcctgccaaatatgtt

SEQ ID NO: 84331 - DNA, 25 bp, Rattus norvegicus
acccattgtgggaagagccagccct

SEQ ID NO: 84332 - DNA, 25 bp, Rattus norvegicus
acccattgtgggtagagccagccct

SEQ ID NO: 84333 - DNA, 25 bp, Rattus norvegicus
acccatttatctattcttgtgctta

SEQ ID NO: 84334 - DNA, 25 bp, Rattus norvegicus
acccatttatcttttcttgtgctta

SEQ ID NO: 84335 - DNA, 25 bp, Rattus norvegicus
acccatttcaccagtacattgtact

SEQ ID NO: 84336 - DNA, 25 bp, Rattus norvegicus
acccatttcacctgtacattgtact

SEQ ID NO: 84337 - DNA, 25 bp, Rattus norvegicus
acccatttcaggattgctctctgag

SEQ ID NO: 84338 - DNA, 25 bp, Rattus norvegicus
acccatttcaggtttgctctctgag

SEQ ID NO: 84339 - DNA, 25 bp, Rattus norvegicus
acccatttcccgatggatgattctg

SEQ ID NO: 84340 - DNA, 25 bp, Rattus norvegicus
acccatttcccgttggatgattctg

SEQ ID NO: 84341 - DNA, 25 bp, Rattus norvegicus
acccatttccttaagagagcttgcc

SEQ ID NO: 84342 - DNA, 25 bp, Rattus norvegicus
acccatttcctttagagagcttgcc

SEQ ID NO: 84343 - DNA, 25 bp, Rattus norvegicus
acccatttctttaacctcttgtcat

SEQ ID NO: 84344 - DNA, 25 bp, Rattus norvegicus
acccatttcttttacctcttgtcat

SEQ ID NO: 84345 - DNA, 25 bp, Rattus norvegicus
accccaaacccgaggctggagagat

SEQ ID NO: 84346 - DNA, 25 bp, Rattus norvegicus
accccaaacccgtggctggagagat

SEQ ID NO: 84347 - DNA, 25 bp, Rattus norvegicus
accccaaagcacacttttcttatga

SEQ ID NO: 84348 - DNA, 25 bp, Rattus norvegicus
accccaaagcactcttttcttatga

SEQ ID NO: 84349 - DNA, 25 bp, Rattus norvegicus
accccaaatgtcaatgctctgttaa

SEQ ID NO: 84350 - DNA, 25 bp, Rattus norvegicus
accccaaatgtctatgctctgttaa

SEQ ID NO: 84351 - DNA, 25 bp, Rattus norvegicus
accccaaccaccatgtagatatatc

SEQ ID NO: 84352 - DNA, 25 bp, Rattus norvegicus
accccaaccaccttgtagatatatc

SEQ ID NO: 84353 - DNA, 25 bp, Rattus norvegicus
accccaagccttatggagtcccaag

SEQ ID NO: 84354 - DNA, 25 bp, Rattus norvegicus
accccaagccttttggagtcccaag

SEQ ID NO: 84355 - DNA, 25 bp, Rattus norvegicus
accccaaggagcaccgagagactga

SEQ ID NO: 84356 - DNA, 25 bp, Rattus norvegicus
accccaaggagctccgagagactga

SEQ ID NO: 84357 - DNA, 25 bp, Rattus norvegicus
accccaaggcagaggcgctgctcta

SEQ ID NO: 84358 - DNA, 25 bp, Rattus norvegicus
accccaaggcagtggcgctgctcta

SEQ ID NO: 84359 - DNA, 25 bp, Rattus norvegicus
accccaagtcttctcttaggtgaag

SEQ ID NO: 84360 - DNA, 25 bp, Rattus norvegicus
accccaagtcttgtcttaggtgaag

SEQ ID NO: 84361 - DNA, 25 bp, Rattus norvegicus
accccaatgcccagggatgggagtt

SEQ ID NO: 84362 - DNA, 25 bp, Rattus norvegicus
accccaatgccctgggatgggagtt

SEQ ID NO: 84363 - DNA, 25 bp, Rattus norvegicus
accccaatggaccatacgggagcgg

SEQ ID NO: 84364 - DNA, 25 bp, Rattus norvegicus
accccaatggacgatacgggagcgg

SEQ ID NO: 84365 - DNA, 25 bp, Rattus norvegicus
accccaatgtccaaagtgtgccagg

SEQ ID NO: 84366 - DNA, 25 bp, Rattus norvegicus
accccaatgtcctaagtgtgccagg

SEQ ID NO: 84367 - DNA, 25 bp, Rattus norvegicus
accccaattcaactagtgctcctaa

SEQ ID NO: 84368 - DNA, 25 bp, Rattus norvegicus
accccaattcaagtagtgctcctaa

SEQ ID NO: 84369 - DNA, 25 bp, Rattus norvegicus
accccaattcacaataatccttctt

SEQ ID NO: 84370 - DNA, 25 bp, Rattus norvegicus
accccaattcactataatccttctt

SEQ ID NO: 84371 - DNA, 25 bp, Rattus norvegicus
accccacaatgcaattatactctct

SEQ ID NO: 84372 - DNA, 25 bp, Rattus norvegicus
accccacaatgctattatactctct

SEQ ID NO: 84373 - DNA, 25 bp, Rattus norvegicus
accccacaccctaaggcattattat

SEQ ID NO: 84374 - DNA, 25 bp, Rattus norvegicus
accccacacccttaggcattattat

SEQ ID NO: 84375 - DNA, 25 bp, Rattus norvegicus
accccacacgctcttcgagaagaaa

SEQ ID NO: 84376 - DNA, 25 bp, Rattus norvegicus
accccacacgctgttcgagaagaaa

SEQ ID NO: 84377 - DNA, 25 bp, Rattus norvegicus
accccacagtgccacatgtattgag

SEQ ID NO: 84378 - DNA, 25 bp, Rattus norvegicus
accccacagtgcgacatgtattgag

SEQ ID NO: 84379 - DNA, 25 bp, Rattus norvegicus
accccacattctcgatggttttgaa

SEQ ID NO: 84380 - DNA, 25 bp, Rattus norvegicus
accccacattctggatggttttgaa

SEQ ID NO: 84381 - DNA, 25 bp, Rattus norvegicus
accccaccgacaacagtagaaacaa

SEQ ID NO: 84382 - DNA, 25 bp, Rattus norvegicus
accccaccgacatcagtagaaacaa

SEQ ID NO: 84383 - DNA, 25 bp, Rattus norvegicus
accccacctatcaagcagagaacag

SEQ ID NO: 84384 - DNA, 25 bp, Rattus norvegicus
accccacctatctagcagagaacag

SEQ ID NO: 84385 - DNA, 25 bp, Rattus norvegicus
accccacctgcaagacgatttattt

SEQ ID NO: 84386 - DNA, 25 bp, Rattus norvegicus
accccacctgcatgacgatttattt

SEQ ID NO: 84387 - DNA, 25 bp, Rattus norvegicus
accccacgcggcaacgaataagtgt

SEQ ID NO: 84388 - DNA, 25 bp, Rattus norvegicus
accccacgcggctacgaataagtgt

SEQ ID NO: 84389 - DNA, 25 bp, Rattus norvegicus
accccactatgcagcagatcacagt

SEQ ID NO: 84390 - DNA, 25 bp, Rattus norvegicus
accccactatgctgcagatcacagt

SEQ ID NO: 84391 - DNA, 25 bp, Rattus norvegicus
accccactgtgcacaggaatgcatg

SEQ ID NO: 84392 - DNA, 25 bp, Rattus norvegicus
accccactgtgctcaggaatgcatg

SEQ ID NO: 84393 - DNA, 25 bp, Rattus norvegicus
accccactttggcagtcatgtcagt

SEQ ID NO: 84394 - DNA, 25 bp, Rattus norvegicus
accccactttgggagtcatgtcagt

SEQ ID NO: 84395 - DNA, 25 bp, Rattus norvegicus
accccagaaagtatgcgtgatgccc

SEQ ID NO: 84396 - DNA, 25 bp, Rattus norvegicus
accccagaaagtttgcgtgatgccc

SEQ ID NO: 84397 - DNA, 25 bp, Rattus norvegicus
accccagaactcatgtagatctcta

SEQ ID NO: 84398 - DNA, 25 bp, Rattus norvegicus
accccagaactcttgtagatctcta

SEQ ID NO: 84399 - DNA, 25 bp, Rattus norvegicus
accccagagaagatgtgcgtgtgac

SEQ ID NO: 84400 - DNA, 25 bp, Rattus norvegicus
accccagagaagttgtgcgtgtgac

SEQ ID NO: 84401 - DNA, 25 bp, Rattus norvegicus
accccagaggatcgtggttgtttct

SEQ ID NO: 84402 - DNA, 25 bp, Rattus norvegicus
accccagaggatggtggttgtttct

SEQ ID NO: 84403 - DNA, 25 bp, Rattus norvegicus
accccagagtggcatagtacccaag

SEQ ID NO: 84404 - DNA, 25 bp, Rattus norvegicus
accccagagtgggatagtacccaag

SEQ ID NO: 84405 - DNA, 25 bp, Rattus norvegicus
accccagatgctagttttcctgaga

SEQ ID NO: 84406 - DNA, 25 bp, Rattus norvegicus
accccagatgcttgttttcctgaga

SEQ ID NO: 84407 - DNA, 25 bp, Rattus norvegicus
accccagatgtccagatgttttgca

SEQ ID NO: 84408 - DNA, 25 bp, Rattus norvegicus
accccagatgtcgagatgttttgca

SEQ ID NO: 84409 - DNA, 25 bp, Rattus norvegicus
accccagcaccaagacattatttaa

SEQ ID NO: 84410 - DNA, 25 bp, Rattus norvegicus
accccagcaccatgacattatttaa

SEQ ID NO: 84411 - DNA, 25 bp, Rattus norvegicus
accccagcaggacgtcccaaaggat

SEQ ID NO: 84412 - DNA, 25 bp, Rattus norvegicus
accccagcaggaggtcccaaaggat

SEQ ID NO: 84413 - DNA, 25 bp, Rattus norvegicus
accccagcaggcagttttcactatt

SEQ ID NO: 84414 - DNA, 25 bp, Rattus norvegicus
accccagcaggctgttttcactatt

SEQ ID NO: 84415 - DNA, 25 bp, Rattus norvegicus
accccagcagggaggccagcaacag

SEQ ID NO: 84416 - DNA, 25 bp, Rattus norvegicus
accccagcagggtggccagcaacag

SEQ ID NO: 84417 - DNA, 25 bp, Rattus norvegicus
accccagcagttatctgacggattg

SEQ ID NO: 84418 - DNA, 25 bp, Rattus norvegicus
accccagcagttttctgacggattg

SEQ ID NO: 84419 - DNA, 25 bp, Rattus norvegicus
accccagcataaatcgccagagatt

SEQ ID NO: 84420 - DNA, 25 bp, Rattus norvegicus
accccagcataattcgccagagatt

SEQ ID NO: 84421 - DNA, 25 bp, Rattus norvegicus
accccagcatggatgttgacaaaca

SEQ ID NO: 84422 - DNA, 25 bp, Rattus norvegicus
accccagcatggttgttgacaaaca

SEQ ID NO: 84423 - DNA, 25 bp, Rattus norvegicus
accccagccaagaaaaattgcacag

SEQ ID NO: 84424 - DNA, 25 bp, Rattus norvegicus
accccagccaagtaaaattgcacag

SEQ ID NO: 84425 - DNA, 25 bp, Rattus norvegicus
accccagccactctgtgtgggcagg

SEQ ID NO: 84426 - DNA, 25 bp, Rattus norvegicus
accccagccactgtgtgtgggcagg

SEQ ID NO: 84427 - DNA, 25 bp, Rattus norvegicus
accccagctcagcataggcttggaa

SEQ ID NO: 84428 - DNA, 25 bp, Rattus norvegicus
accccagctcaggataggcttggaa

SEQ ID NO: 84429 - DNA, 25 bp, Rattus norvegicus
accccagctcatcctgaaggagtga

SEQ ID NO: 84430 - DNA, 25 bp, Rattus norvegicus
accccagctcatgctgaaggagtga

SEQ ID NO: 84431 - DNA, 25 bp, Rattus norvegicus
accccagctgcgatgttcagagggt

SEQ ID NO: 84432 - DNA, 25 bp, Rattus norvegicus
accccagctgcgttgttcagagggt

SEQ ID NO: 84433 - DNA, 25 bp, Rattus norvegicus
accccagcttcaactctgttttaat

SEQ ID NO: 84434 - DNA, 25 bp, Rattus norvegicus
accccagcttcacttcagtgttgaa

SEQ ID NO: 84435 - DNA, 25 bp, Rattus norvegicus
accccagcttcagttcagtgttgaa

SEQ ID NO: 84436 - DNA, 25 bp, Rattus norvegicus
accccagcttcatctctgttttaat

SEQ ID NO: 84437 - DNA, 25 bp, Rattus norvegicus
accccagcttggctgagtcatgcgt

SEQ ID NO: 84438 - DNA, 25 bp, Rattus norvegicus
accccagcttggctggctctacaat

SEQ ID NO: 84439 - DNA, 25 bp, Rattus norvegicus
accccagcttgggtgagtcatgcgt

SEQ ID NO: 84440 - DNA, 25 bp, Rattus norvegicus
accccagcttgggtggctctacaat

SEQ ID NO: 84441 - DNA, 25 bp, Rattus norvegicus
accccaggcccacgaaggattctat

SEQ ID NO: 84442 - DNA, 25 bp, Rattus norvegicus
accccaggcccaggaaggattctat

SEQ ID NO: 84443 - DNA, 25 bp, Rattus norvegicus
accccaggctcacttttggatagaa

SEQ ID NO: 84444 - DNA, 25 bp, Rattus norvegicus
accccaggctcagttttggatagaa

SEQ ID NO: 84445 - DNA, 25 bp, Rattus norvegicus
accccagggactcccgaggagagtt

SEQ ID NO: 84446 - DNA, 25 bp, Rattus norvegicus
accccagggactgccgaggagagtt

SEQ ID NO: 84447 - DNA, 25 bp, Rattus norvegicus
accccagggctaaggttctacaaga

SEQ ID NO: 84448 - DNA, 25 bp, Rattus norvegicus
accccagggctatggttctacaaga

SEQ ID NO: 84449 - DNA, 25 bp, Rattus norvegicus
accccagggcttagtctggagatgt

SEQ ID NO: 84450 - DNA, 25 bp, Rattus norvegicus
accccagggctttgtctggagatgt

SEQ ID NO: 84451 - DNA, 25 bp, Rattus norvegicus
accccaggtagacacgtattccttg

SEQ ID NO: 84452 - DNA, 25 bp, Rattus norvegicus
accccaggtagagacgtattccttg

SEQ ID NO: 84453 - DNA, 25 bp, Rattus norvegicus
accccaggtcagcaagtgtatgcgt

SEQ ID NO: 84454 - DNA, 25 bp, Rattus norvegicus
accccaggtcaggaagtgtatgcgt

SEQ ID NO: 84455 - DNA, 25 bp, Rattus norvegicus
accccagtaagcctcttttcagaag

SEQ ID NO: 84456 - DNA, 25 bp, Rattus norvegicus
accccagtaagcgtcttttcagaag

SEQ ID NO: 84457 - DNA, 25 bp, Rattus norvegicus
accccagtacccaatgcagatgcag

SEQ ID NO: 84458 - DNA, 25 bp, Rattus norvegicus
accccagtaccctatgcagatgcag

SEQ ID NO: 84459 - DNA, 25 bp, Rattus norvegicus
accccagtcagcagtgcacagtttg

SEQ ID NO: 84460 - DNA, 25 bp, Rattus norvegicus
accccagtcagctgtgcacagtttg

SEQ ID NO: 84461 - DNA, 25 bp, Rattus norvegicus
accccagtctgacggcactctaaag

SEQ ID NO: 84462 - DNA, 25 bp, Rattus norvegicus
accccagtctgagggcactctaaag

SEQ ID NO: 84463 - DNA, 25 bp, Rattus norvegicus
accccagtgaatccagtctgtgctt

SEQ ID NO: 84464 - DNA, 25 bp, Rattus norvegicus
accccagtgaatgcagtctgtgctt

SEQ ID NO: 84465 - DNA, 25 bp, Rattus norvegicus
accccagtgagccagttcataagaa

SEQ ID NO: 84466 - DNA, 25 bp, Rattus norvegicus
accccagtgagcgagttcataagaa

SEQ ID NO: 84467 - DNA, 25 bp, Rattus norvegicus
accccagtgctgctgtaaagctgca

SEQ ID NO: 84468 - DNA, 25 bp, Rattus norvegicus
accccagtgctggtgtaaagctgca

SEQ ID NO: 84469 - DNA, 25 bp, Rattus norvegicus
accccagtggcactttcgtggcgct

SEQ ID NO: 84470 - DNA, 25 bp, Rattus norvegicus
accccagtggcagtttcgtggcgct

SEQ ID NO: 84471 - DNA, 25 bp, Rattus norvegicus
accccagtgtttcgacagttaccat

SEQ ID NO: 84472 - DNA, 25 bp, Rattus norvegicus
accccagtgtttggacagttaccat

SEQ ID NO: 84473 - DNA, 25 bp, Rattus norvegicus
accccagttcttccaggtgtcaact

SEQ ID NO: 84474 - DNA, 25 bp, Rattus norvegicus
accccagttcttgcaggtgtcaact

SEQ ID NO: 84475 - DNA, 25 bp, Rattus norvegicus
accccataatctacaggacagtctg

SEQ ID NO: 84476 - DNA, 25 bp, Rattus norvegicus
accccataatcttcaggacagtctg

SEQ ID NO: 84477 - DNA, 25 bp, Rattus norvegicus
accccatactcacttcaggtggtaa

SEQ ID NO: 84478 - DNA, 25 bp, Rattus norvegicus
accccatactcagttcaggtggtaa

SEQ ID NO: 84479 - DNA, 25 bp, Rattus norvegicus
accccatagtggattccatttctca

SEQ ID NO: 84480 - DNA, 25 bp, Rattus norvegicus
accccatagtggtttccatttctca

SEQ ID NO: 84481 - DNA, 25 bp, Rattus norvegicus
accccatattccaacacttttaatg

SEQ ID NO: 84482 - DNA, 25 bp, Rattus norvegicus
accccatattcctacacttttaatg

SEQ ID NO: 84483 - DNA, 25 bp, Rattus norvegicus
accccatcacagaggtgttaccaga

SEQ ID NO: 84484 - DNA, 25 bp, Rattus norvegicus
accccatcacagtggtgttaccaga

SEQ ID NO: 84485 - DNA, 25 bp, Rattus norvegicus
accccatcactcacctgaatggaag

SEQ ID NO: 84486 - DNA, 25 bp, Rattus norvegicus
accccatcactctcctgaatggaag

SEQ ID NO: 84487 - DNA, 25 bp, Rattus norvegicus
accccatcaggcaccagaaatacat

SEQ ID NO: 84488 - DNA, 25 bp, Rattus norvegicus
accccatcaggctccagaaatacat

SEQ ID NO: 84489 - DNA, 25 bp, Rattus norvegicus
accccatcatggctgtttttgcaag

SEQ ID NO: 84490 - DNA, 25 bp, Rattus norvegicus
accccatcatgggtgtttttgcaag

SEQ ID NO: 84491 - DNA, 25 bp, Rattus norvegicus
accccatccaagattgaacccatga

SEQ ID NO: 84492 - DNA, 25 bp, Rattus norvegicus
accccatccaagtttgaacccatga

SEQ ID NO: 84493 - DNA, 25 bp, Rattus norvegicus
accccatccacaccgttgtagggaa

SEQ ID NO: 84494 - DNA, 25 bp, Rattus norvegicus
accccatccacagcgttgtagggaa

SEQ ID NO: 84495 - DNA, 25 bp, Rattus norvegicus
accccatccagtatgcttacatctt

SEQ ID NO: 84496 - DNA, 25 bp, Rattus norvegicus
accccatccagtttgcttacatctt

SEQ ID NO: 84497 - DNA, 25 bp, Rattus norvegicus
accccatccatgaggctaagagtca

SEQ ID NO: 84498 - DNA, 25 bp, Rattus norvegicus
accccatccatgtggctaagagtca

SEQ ID NO: 84499 - DNA, 25 bp, Rattus norvegicus
accccatcccaccattggagtaaga

SEQ ID NO: 84500 - DNA, 25 bp, Rattus norvegicus
accccatcccacgattggagtaaga

SEQ ID NO: 84501 - DNA, 25 bp, Rattus norvegicus
accccatccctcaggagtctggagg

SEQ ID NO: 84502 - DNA, 25 bp, Rattus norvegicus
accccatccctctggagtctggagg

SEQ ID NO: 84503 - DNA, 25 bp, Rattus norvegicus
accccatcgaccagtatcttattaa

SEQ ID NO: 84504 - DNA, 25 bp, Rattus norvegicus
accccatcgacctgtatcttattaa

SEQ ID NO: 84505 - DNA, 25 bp, Rattus norvegicus
accccatgactcaatgtgtggagaa

SEQ ID NO: 84506 - DNA, 25 bp, Rattus norvegicus
accccatgactctatgtgtggagaa

SEQ ID NO: 84507 - DNA, 25 bp, Rattus norvegicus
accccatgagccaggtcacgctaga

SEQ ID NO: 84508 - DNA, 25 bp, Rattus norvegicus
accccatgagcctggtcacgctaga

SEQ ID NO: 84509 - DNA, 25 bp, Rattus norvegicus
accccatgaggtctctttcttgtat

SEQ ID NO: 84510 - DNA, 25 bp, Rattus norvegicus
accccatgaggtgtctttcttgtat

SEQ ID NO: 84511 - DNA, 25 bp, Rattus norvegicus
accccatgccggcagaggtgttcag

SEQ ID NO: 84512 - DNA, 25 bp, Rattus norvegicus
accccatgccgggagaggtgttcag

SEQ ID NO: 84513 - DNA, 25 bp, Rattus norvegicus
accccatggcaactgtgtacttagg

SEQ ID NO: 84514 - DNA, 25 bp, Rattus norvegicus
accccatggcaagtgtgtacttagg

SEQ ID NO: 84515 - DNA, 25 bp, Rattus norvegicus
accccatgggctctattctgtgttc

SEQ ID NO: 84516 - DNA, 25 bp, Rattus norvegicus
accccatgggctgtattctgtgttc

SEQ ID NO: 84517 - DNA, 25 bp, Rattus norvegicus
accccatgttgtaggtcaatgaaat

SEQ ID NO: 84518 - DNA, 25 bp, Rattus norvegicus
accccatgttgttggtcaatgaaat

SEQ ID NO: 84519 - DNA, 25 bp, Rattus norvegicus
accccattccgtcagagcaagctga

SEQ ID NO: 84520 - DNA, 25 bp, Rattus norvegicus
accccattccgtgagagcaagctga

SEQ ID NO: 84521 - DNA, 25 bp, Rattus norvegicus
accccattctgactttgtccaagat

SEQ ID NO: 84522 - DNA, 25 bp, Rattus norvegicus
accccattctgagtttgtccaagat

SEQ ID NO: 84523 - DNA, 25 bp, Rattus norvegicus
accccattctgcagtacttctaaga

SEQ ID NO: 84524 - DNA, 25 bp, Rattus norvegicus
accccattctgctgtacttctaaga

SEQ ID NO: 84525 - DNA, 25 bp, Rattus norvegicus
accccattctttctcaaactttatg

SEQ ID NO: 84526 - DNA, 25 bp, Rattus norvegicus
accccattctttgtcaaactttatg

SEQ ID NO: 84527 - DNA, 25 bp, Rattus norvegicus
accccattgtgaacatcctctataa

SEQ ID NO: 84528 - DNA, 25 bp, Rattus norvegicus
accccattgtgatcatcctctataa

SEQ ID NO: 84529 - DNA, 25 bp, Rattus norvegicus
accccatttcacaggtgagactaat

SEQ ID NO: 84530 - DNA, 25 bp, Rattus norvegicus
accccatttcactggtgagactaat

SEQ ID NO: 84531 - DNA, 25 bp, Rattus norvegicus
accccatttcttcatgttcctaatg

SEQ ID NO: 84532 - DNA, 25 bp, Rattus norvegicus
accccatttcttgatgttcctaatg

SEQ ID NO: 84533 - DNA, 25 bp, Rattus norvegicus
accccatttggtcggttgagcctga

SEQ ID NO: 84534 - DNA, 25 bp, Rattus norvegicus
accccatttggtgggttgagcctga

SEQ ID NO: 84535 - DNA, 25 bp, Rattus norvegicus
accccattttccctatgacaatgtt

SEQ ID NO: 84536 - DNA, 25 bp, Rattus norvegicus
accccattttccgtatgacaatgtt

SEQ ID NO: 84537 - DNA, 25 bp, Rattus norvegicus
accccattttctagttggcagcaat

SEQ ID NO: 84538 - DNA, 25 bp, Rattus norvegicus
accccattttcttgttggcagcaat

SEQ ID NO: 84539 - DNA, 25 bp, Rattus norvegicus
accccgaaagtgagcagatttgata

SEQ ID NO: 84540 - DNA, 25 bp, Rattus norvegicus
accccgaaagtgtgcagatttgata

SEQ ID NO: 84541 - DNA, 25 bp, Rattus norvegicus
accccgagctataccttacatatgt

SEQ ID NO: 84542 - DNA, 25 bp, Rattus norvegicus
accccgagctattccttacatatgt

SEQ ID NO: 84543 - DNA, 25 bp, Rattus norvegicus
accccgagggatctcactggacttg

SEQ ID NO: 84544 - DNA, 25 bp, Rattus norvegicus
accccgagggatgtcactggacttg

SEQ ID NO: 84545 - DNA, 25 bp, Rattus norvegicus
accccgagtgaccaagcagtggaga

SEQ ID NO: 84546 - DNA, 25 bp, Rattus norvegicus
accccgagtgacgaagcagtggaga

SEQ ID NO: 84547 - DNA, 25 bp, Rattus norvegicus
accccgatgggactgttaagactgt

SEQ ID NO: 84548 - DNA, 25 bp, Rattus norvegicus
accccgatgggagtgttaagactgt

SEQ ID NO: 84549 - DNA, 25 bp, Rattus norvegicus
accccgcagagaaatccgtcaatgg

SEQ ID NO: 84550 - DNA, 25 bp, Rattus norvegicus
accccgcagagatatccgtcaatgg

SEQ ID NO: 84551 - DNA, 25 bp, Rattus norvegicus
accccgctggagacggaagatcttt

SEQ ID NO: 84552 - DNA, 25 bp, Rattus norvegicus
accccgctggagtcggaagatcttt

SEQ ID NO: 84553 - DNA, 25 bp, Rattus norvegicus
accccgcttcaaaaatgttcaactg

SEQ ID NO: 84554 - DNA, 25 bp, Rattus norvegicus
accccgcttcaataatgttcaactg

SEQ ID NO: 84555 - DNA, 25 bp, Rattus norvegicus
accccggaaggcacgaagactgtga

SEQ ID NO: 84556 - DNA, 25 bp, Rattus norvegicus
accccggaaggctcgaagactgtga

SEQ ID NO: 84557 - DNA, 25 bp, Rattus norvegicus
accccggagagcagccggagcttca

SEQ ID NO: 84558 - DNA, 25 bp, Rattus norvegicus
accccggagagctgccggagcttca

SEQ ID NO: 84559 - DNA, 25 bp, Rattus norvegicus
accccggagcagagacaccaggagc

SEQ ID NO: 84560 - DNA, 25 bp, Rattus norvegicus
accccggagcagtgacaccaggagc

SEQ ID NO: 84561 - DNA, 25 bp, Rattus norvegicus
accccgggagctcttacacgagctg

SEQ ID NO: 84562 - DNA, 25 bp, Rattus norvegicus
accccgggagctgttacacgagctg

SEQ ID NO: 84563 - DNA, 25 bp, Rattus norvegicus
accccggtacatacttctattgagg

SEQ ID NO: 84564 - DNA, 25 bp, Rattus norvegicus
accccggtacattcttctattgagg

SEQ ID NO: 84565 - DNA, 25 bp, Rattus norvegicus
accccggtatgcatatgttttacag

SEQ ID NO: 84566 - DNA, 25 bp, Rattus norvegicus
accccggtatgcttatgttttacag

SEQ ID NO: 84567 - DNA, 25 bp, Rattus norvegicus
accccggtggttcttatgcacagga

SEQ ID NO: 84568 - DNA, 25 bp, Rattus norvegicus
accccggtggttgttatgcacagga

SEQ ID NO: 84569 - DNA, 25 bp, Rattus norvegicus
accccggtgtgtatggccagagtta

SEQ ID NO: 84570 - DNA, 25 bp, Rattus norvegicus
accccggtgtgtttggccagagtta

SEQ ID NO: 84571 - DNA, 25 bp, Rattus norvegicus
accccggttgacatctggagcatag

SEQ ID NO: 84572 - DNA, 25 bp, Rattus norvegicus
accccggttgacttctggagcatag

SEQ ID NO: 84573 - DNA, 25 bp, Rattus norvegicus
accccgtagccgattggcacaggag

SEQ ID NO: 84574 - DNA, 25 bp, Rattus norvegicus
accccgtagccgtttggcacaggag

SEQ ID NO: 84575 - DNA, 25 bp, Rattus norvegicus
accccgtcatcacgtgaaatccagg

SEQ ID NO: 84576 - DNA, 25 bp, Rattus norvegicus
accccgtcatcaggtgaaatccagg

SEQ ID NO: 84577 - DNA, 25 bp, Rattus norvegicus
accccgtgaacgcagatacgctgac

SEQ ID NO: 84578 - DNA, 25 bp, Rattus norvegicus
accccgtgaacggagatacgctgac

SEQ ID NO: 84579 - DNA, 25 bp, Rattus norvegicus
accccgtgacgcagggccagatgaa

SEQ ID NO: 84580 - DNA, 25 bp, Rattus norvegicus
accccgtgacgctgggccagatgaa

SEQ ID NO: 84581 - DNA, 25 bp, Rattus norvegicus
accccgtgcttgctcaatttaaagg

SEQ ID NO: 84582 - DNA, 25 bp, Rattus norvegicus
accccgtgcttggtcaatttaaagg

SEQ ID NO: 84583 - DNA, 25 bp, Rattus norvegicus
accccgttcacacctcagaagtata

SEQ ID NO: 84584 - DNA, 25 bp, Rattus norvegicus
accccgttcacagctcagaagtata

SEQ ID NO: 84585 - DNA, 25 bp, Rattus norvegicus
acccctaattgtatgcctctggcaa

SEQ ID NO: 84586 - DNA, 25 bp, Rattus norvegicus
acccctaattgtttgcctctggcaa

SEQ ID NO: 84587 - DNA, 25 bp, Rattus norvegicus
acccctacactgctggtcataagac

SEQ ID NO: 84588 - DNA, 25 bp, Rattus norvegicus
acccctacactggtggtcataagac

SEQ ID NO: 84589 - DNA, 25 bp, Rattus norvegicus
acccctagccagagattggcagcat

SEQ ID NO: 84590 - DNA, 25 bp, Rattus norvegicus
acccctagccagtgattggcagcat

SEQ ID NO: 84591 - DNA, 25 bp, Rattus norvegicus
acccctagcttgaaaaccagcttgc

SEQ ID NO: 84592 - DNA, 25 bp, Rattus norvegicus
acccctagcttgtaaaccagcttgc

SEQ ID NO: 84593 - DNA, 25 bp, Rattus norvegicus
acccctatccgtactgactgtaagt

SEQ ID NO: 84594 - DNA, 25 bp, Rattus norvegicus
acccctatccgttctgactgtaagt

SEQ ID NO: 84595 - DNA, 25 bp, Rattus norvegicus
acccctatgtgtacaagttgtgtgt

SEQ ID NO: 84596 - DNA, 25 bp, Rattus norvegicus
acccctatgtgttcaagttgtgtgt

SEQ ID NO: 84597 - DNA, 25 bp, Rattus norvegicus
acccctattaggcatcggcagaata

SEQ ID NO: 84598 - DNA, 25 bp, Rattus norvegicus
acccctattagggatcggcagaata

SEQ ID NO: 84599 - DNA, 25 bp, Rattus norvegicus
acccctattgttagcatgcctttat

SEQ ID NO: 84600 - DNA, 25 bp, Rattus norvegicus
acccctattgtttgcatgcctttat

SEQ ID NO: 84601 - DNA, 25 bp, Rattus norvegicus
acccctatttctaagtcacatcttg

SEQ ID NO: 84602 - DNA, 25 bp, Rattus norvegicus
acccctatttcttagtcacatcttg

SEQ ID NO: 84603 - DNA, 25 bp, Rattus norvegicus
acccctcaagtcaacttttgtgctc

SEQ ID NO: 84604 - DNA, 25 bp, Rattus norvegicus
acccctcaagtctacttttgtgctc

SEQ ID NO: 84605 - DNA, 25 bp, Rattus norvegicus
acccctcacaatagtcagtcacgag

SEQ ID NO: 84606 - DNA, 25 bp, Rattus norvegicus
acccctcacaattgtcagtcacgag

SEQ ID NO: 84607 - DNA, 25 bp, Rattus norvegicus
acccctcacatcatattggctatta

SEQ ID NO: 84608 - DNA, 25 bp, Rattus norvegicus
acccctcacatcttattggctatta

SEQ ID NO: 84609 - DNA, 25 bp, Rattus norvegicus
acccctcacttcaagatgttcaaaa

SEQ ID NO: 84610 - DNA, 25 bp, Rattus norvegicus
acccctcacttctagatgttcaaaa

SEQ ID NO: 84611 - DNA, 25 bp, Rattus norvegicus
acccctcagctaaccaggattcaaa

SEQ ID NO: 84612 - DNA, 25 bp, Rattus norvegicus
acccctcagctatccaggattcaaa

SEQ ID NO: 84613 - DNA, 25 bp, Rattus norvegicus
acccctcagcttaacacaacaaagt

SEQ ID NO: 84614 - DNA, 25 bp, Rattus norvegicus
acccctcagctttacacaacaaagt

SEQ ID NO: 84615 - DNA, 25 bp, Rattus norvegicus
acccctcaggttacttatctgggat

SEQ ID NO: 84616 - DNA, 25 bp, Rattus norvegicus
acccctcaggttctggtattaaatg

SEQ ID NO: 84617 - DNA, 25 bp, Rattus norvegicus
acccctcaggttgtggtattaaatg

SEQ ID NO: 84618 - DNA, 25 bp, Rattus norvegicus
acccctcaggtttcttatctgggat

SEQ ID NO: 84619 - DNA, 25 bp, Rattus norvegicus
acccctccagccatgaataggactg

SEQ ID NO: 84620 - DNA, 25 bp, Rattus norvegicus
acccctccagccttgaataggactg

SEQ ID NO: 84621 - DNA, 25 bp, Rattus norvegicus
acccctcccagaaatttatgtgaaa

SEQ ID NO: 84622 - DNA, 25 bp, Rattus norvegicus
acccctcccagatatttatgtgaaa

SEQ ID NO: 84623 - DNA, 25 bp, Rattus norvegicus
acccctcccttacgtgagataggca

SEQ ID NO: 84624 - DNA, 25 bp, Rattus norvegicus
acccctcccttaggtgagataggca

SEQ ID NO: 84625 - DNA, 25 bp, Rattus norvegicus
acccctcccttgctgtacaatggtt

SEQ ID NO: 84626 - DNA, 25 bp, Rattus norvegicus
acccctcccttggtgtacaatggtt

SEQ ID NO: 84627 - DNA, 25 bp, Rattus norvegicus
acccctcctgaaacttcgaagtgaa

SEQ ID NO: 84628 - DNA, 25 bp, Rattus norvegicus
acccctcctgaatcttcgaagtgaa

SEQ ID NO: 84629 - DNA, 25 bp, Rattus norvegicus
acccctcctttgacattgttagtgg

SEQ ID NO: 84630 - DNA, 25 bp, Rattus norvegicus
acccctcctttgtcattgttagtgg

SEQ ID NO: 84631 - DNA, 25 bp, Rattus norvegicus
acccctcgagctcatgtgattggat

SEQ ID NO: 84632 - DNA, 25 bp, Rattus norvegicus
acccctcgagctgatgtgattggat

SEQ ID NO: 84633 - DNA, 25 bp, Rattus norvegicus
acccctcgccctacattttgtagag

SEQ ID NO: 84634 - DNA, 25 bp, Rattus norvegicus
acccctcgcccttcattttgtagag

SEQ ID NO: 84635 - DNA, 25 bp, Rattus norvegicus
acccctcgtctgcagcagtgagcag

SEQ ID NO: 84636 - DNA, 25 bp, Rattus norvegicus
acccctcgtctggagcagtgagcag

SEQ ID NO: 84637 - DNA, 25 bp, Rattus norvegicus
acccctcgtgtgagacaacagagcc

SEQ ID NO: 84638 - DNA, 25 bp, Rattus norvegicus
acccctcgtgtgtgacaacagagcc

SEQ ID NO: 84639 - DNA, 25 bp, Rattus norvegicus
acccctctcccaattagaaagcaat

SEQ ID NO: 84640 - DNA, 25 bp, Rattus norvegicus
acccctctcccatttagaaagcaat

SEQ ID NO: 84641 - DNA, 25 bp, Rattus norvegicus
acccctctctgtagacatggtggta

SEQ ID NO: 84642 - DNA, 25 bp, Rattus norvegicus
acccctctctgttgacatggtggta

SEQ ID NO: 84643 - DNA, 25 bp, Rattus norvegicus
acccctctgaaaaagcctggctaag

SEQ ID NO: 84644 - DNA, 25 bp, Rattus norvegicus
acccctctgaaatagcctggctaag

SEQ ID NO: 84645 - DNA, 25 bp, Rattus norvegicus
acccctctgagaagaaattaagtca

SEQ ID NO: 84646 - DNA, 25 bp, Rattus norvegicus
acccctctgagatgaaattaagtca

SEQ ID NO: 84647 - DNA, 25 bp, Rattus norvegicus
acccctctgagtcggaattccctga

SEQ ID NO: 84648 - DNA, 25 bp, Rattus norvegicus
acccctctgagtgggaattccctga

SEQ ID NO: 84649 - DNA, 25 bp, Rattus norvegicus
acccctctgcttacatgttgtatgt

SEQ ID NO: 84650 - DNA, 25 bp, Rattus norvegicus
acccctctgcttaggctagatgtat

SEQ ID NO: 84651 - DNA, 25 bp, Rattus norvegicus
acccctctgctttcatgttgtatgt

SEQ ID NO: 84652 - DNA, 25 bp, Rattus norvegicus
acccctctgctttggctagatgtat

SEQ ID NO: 84653 - DNA, 25 bp, Rattus norvegicus
acccctctgtgcatcttgtaaagaa

SEQ ID NO: 84654 - DNA, 25 bp, Rattus norvegicus
acccctctgtgcttcttgtaaagaa

SEQ ID NO: 84655 - DNA, 25 bp, Rattus norvegicus
acccctctttgcacagtggtttgaa

SEQ ID NO: 84656 - DNA, 25 bp, Rattus norvegicus
acccctctttgctcagtggtttgaa

SEQ ID NO: 84657 - DNA, 25 bp, Rattus norvegicus
acccctgaatgtcatgtacactcac

SEQ ID NO: 84658 - DNA, 25 bp, Rattus norvegicus
acccctgaatgtgatgtacactcac

SEQ ID NO: 84659 - DNA, 25 bp, Rattus norvegicus
acccctgactctctggtggcttcat

SEQ ID NO: 84660 - DNA, 25 bp, Rattus norvegicus
acccctgactctgtggtggcttcat

SEQ ID NO: 84661 - DNA, 25 bp, Rattus norvegicus
acccctgactgtcaaggaatcattt

SEQ ID NO: 84662 - DNA, 25 bp, Rattus norvegicus
acccctgactgtgaaggaatcattt

SEQ ID NO: 84663 - DNA, 25 bp, Rattus norvegicus
acccctgaggatagctaggtgtcac

SEQ ID NO: 84664 - DNA, 25 bp, Rattus norvegicus
acccctgaggattgctaggtgtcac

SEQ ID NO: 84665 - DNA, 25 bp, Rattus norvegicus
acccctgaggtactgcttgggcttt

SEQ ID NO: 84666 - DNA, 25 bp, Rattus norvegicus
acccctgaggtagtgcttgggcttt

SEQ ID NO: 84667 - DNA, 25 bp, Rattus norvegicus
acccctgatgtgctgtgaaactact

SEQ ID NO: 84668 - DNA, 25 bp, Rattus norvegicus
acccctgatgtggtgtgaaactact

SEQ ID NO: 84669 - DNA, 25 bp, Rattus norvegicus
acccctgcaaaacggccattcaatg

SEQ ID NO: 84670 - DNA, 25 bp, Rattus norvegicus
acccctgcaaaagggccattcaatg

SEQ ID NO: 84671 - DNA, 25 bp, Rattus norvegicus
acccctgcaggcatgctgaagtgat

SEQ ID NO: 84672 - DNA, 25 bp, Rattus norvegicus
acccctgcaggcttgctgaagtgat

SEQ ID NO: 84673 - DNA, 25 bp, Rattus norvegicus
acccctgcccagcaggatggaaaag

SEQ ID NO: 84674 - DNA, 25 bp, Rattus norvegicus
acccctgcccaggaggatggaaaag

SEQ ID NO: 84675 - DNA, 25 bp, Rattus norvegicus
acccctgccctgaaaggcatgtttg

SEQ ID NO: 84676 - DNA, 25 bp, Rattus norvegicus
acccctgccctgtaaggcatgtttg

SEQ ID NO: 84677 - DNA, 25 bp, Rattus norvegicus
acccctgccttcaacaatcatgaaa

SEQ ID NO: 84678 - DNA, 25 bp, Rattus norvegicus
acccctgccttctacaatcatgaaa

SEQ ID NO: 84679 - DNA, 25 bp, Rattus norvegicus
acccctgctccaccatgaagacagc

SEQ ID NO: 84680 - DNA, 25 bp, Rattus norvegicus
acccctgctccagcatgaagacagc

SEQ ID NO: 84681 - DNA, 25 bp, Rattus norvegicus
acccctgctggaaacagttgcggca

SEQ ID NO: 84682 - DNA, 25 bp, Rattus norvegicus
acccctgctggatacagttgcggca

SEQ ID NO: 84683 - DNA, 25 bp, Rattus norvegicus
acccctggagccctagtacagagaa

SEQ ID NO: 84684 - DNA, 25 bp, Rattus norvegicus
acccctggagccgtagtacagagaa

SEQ ID NO: 84685 - DNA, 25 bp, Rattus norvegicus
acccctggaggccacttcgtgaaga

SEQ ID NO: 84686 - DNA, 25 bp, Rattus norvegicus
acccctggaggcgacttcgtgaaga

SEQ ID NO: 84687 - DNA, 25 bp, Rattus norvegicus
acccctggatgcacgtgtgtgtata

SEQ ID NO: 84688 - DNA, 25 bp, Rattus norvegicus
acccctggatgctcgtgtgtgtata

SEQ ID NO: 84689 - DNA, 25 bp, Rattus norvegicus
acccctggcatgcttcatgaggata

SEQ ID NO: 84690 - DNA, 25 bp, Rattus norvegicus
acccctggcatggttcatgaggata

SEQ ID NO: 84691 - DNA, 25 bp, Rattus norvegicus
acccctgggatgctggacctaagca

SEQ ID NO: 84692 - DNA, 25 bp, Rattus norvegicus
acccctgggatggtggacctaagca

SEQ ID NO: 84693 - DNA, 25 bp, Rattus norvegicus
acccctgggcctataccataaagtg

SEQ ID NO: 84694 - DNA, 25 bp, Rattus norvegicus
acccctgggcctttaccataaagtg

SEQ ID NO: 84695 - DNA, 25 bp, Rattus norvegicus
acccctgggtgacacagcctgtgaa

SEQ ID NO: 84696 - DNA, 25 bp, Rattus norvegicus
acccctgggtgagacagcctgtgaa

SEQ ID NO: 84697 - DNA, 25 bp, Rattus norvegicus
acccctggtcatcactgtgtaattt

SEQ ID NO: 84698 - DNA, 25 bp, Rattus norvegicus
acccctggtcatgactgtgtaattt

SEQ ID NO: 84699 - DNA, 25 bp, Rattus norvegicus
acccctggtgttaggagtctgtgac

SEQ ID NO: 84700 - DNA, 25 bp, Rattus norvegicus
acccctggtgtttggagtctgtgac

SEQ ID NO: 84701 - DNA, 25 bp, Rattus norvegicus
acccctgtatgtaagtagtcaagtg

SEQ ID NO: 84702 - DNA, 25 bp, Rattus norvegicus
acccctgtatgttagtagtcaagtg

SEQ ID NO: 84703 - DNA, 25 bp, Rattus norvegicus
acccctgtctgtcaactttgctgac

SEQ ID NO: 84704 - DNA, 25 bp, Rattus norvegicus
acccctgtctgtcaagccttgaggc

SEQ ID NO: 84705 - DNA, 25 bp, Rattus norvegicus
acccctgtctgtgaactttgctgac

SEQ ID NO: 84706 - DNA, 25 bp, Rattus norvegicus
acccctgtctgtgaagccttgaggc

SEQ ID NO: 84707 - DNA, 25 bp, Rattus norvegicus
acccctgtcttaatttctgctgaat

SEQ ID NO: 84708 - DNA, 25 bp, Rattus norvegicus
acccctgtcttattttctgctgaat

SEQ ID NO: 84709 - DNA, 25 bp, Rattus norvegicus
acccctgtggcacgtttcaacagct

SEQ ID NO: 84710 - DNA, 25 bp, Rattus norvegicus
acccctgtggcaggtttcaacagct

SEQ ID NO: 84711 - DNA, 25 bp, Rattus norvegicus
acccctgtggctcagaactggactg

SEQ ID NO: 84712 - DNA, 25 bp, Rattus norvegicus
acccctgtggctgagaactggactg

SEQ ID NO: 84713 - DNA, 25 bp, Rattus norvegicus
acccctgtgtgaaggagcagccaca

SEQ ID NO: 84714 - DNA, 25 bp, Rattus norvegicus
acccctgtgtgatggagcagccaca

SEQ ID NO: 84715 - DNA, 25 bp, Rattus norvegicus
acccctgtgttcctgagtaaactca

SEQ ID NO: 84716 - DNA, 25 bp, Rattus norvegicus
acccctgtgttcgtgagtaaactca

SEQ ID NO: 84717 - DNA, 25 bp, Rattus norvegicus
acccctgtgtttaccaaagctagat

SEQ ID NO: 84718 - DNA, 25 bp, Rattus norvegicus
acccctgtgttttccaaagctagat

SEQ ID NO: 84719 - DNA, 25 bp, Rattus norvegicus
acccctgttaccaatagttgtcttg

SEQ ID NO: 84720 - DNA, 25 bp, Rattus norvegicus
acccctgttacctatagttgtcttg

SEQ ID NO: 84721 - DNA, 25 bp, Rattus norvegicus
acccctgttgcaaggtggcagagac

SEQ ID NO: 84722 - DNA, 25 bp, Rattus norvegicus
acccctgttgcatggtggcagagac

SEQ ID NO: 84723 - DNA, 25 bp, Rattus norvegicus
accccttaagcacactcagtgagaa

SEQ ID NO: 84724 - DNA, 25 bp, Rattus norvegicus
accccttaagcagactcagtgagaa

SEQ ID NO: 84725 - DNA, 25 bp, Rattus norvegicus
accccttaatggctgcagggagcta

SEQ ID NO: 84726 - DNA, 25 bp, Rattus norvegicus
accccttaatgggtgcagggagcta

SEQ ID NO: 84727 - DNA, 25 bp, Rattus norvegicus
accccttatatgcgaattccctgat

SEQ ID NO: 84728 - DNA, 25 bp, Rattus norvegicus
accccttatatgggaattccctgat

SEQ ID NO: 84729 - DNA, 25 bp, Rattus norvegicus
accccttatgacactttgttgttgc

SEQ ID NO: 84730 - DNA, 25 bp, Rattus norvegicus
accccttatgactctttgttgttgc

SEQ ID NO: 84731 - DNA, 25 bp, Rattus norvegicus
accccttcaagacgccagtagtatg

SEQ ID NO: 84732 - DNA, 25 bp, Rattus norvegicus
accccttcaagaggccagtagtatg

SEQ ID NO: 84733 - DNA, 25 bp, Rattus norvegicus
accccttcagacctatgcttggatg

SEQ ID NO: 84734 - DNA, 25 bp, Rattus norvegicus
accccttcagacgtatgcttggatg

SEQ ID NO: 84735 - DNA, 25 bp, Rattus norvegicus
accccttcagggatccatttcatat

SEQ ID NO: 84736 - DNA, 25 bp, Rattus norvegicus
accccttcagggttccatttcatat

SEQ ID NO: 84737 - DNA, 25 bp, Rattus norvegicus
accccttcatggatgtgtgagactc

SEQ ID NO: 84738 - DNA, 25 bp, Rattus norvegicus
accccttcatggttgtgtgagactc

SEQ ID NO: 84739 - DNA, 25 bp, Rattus norvegicus
accccttccatgaggctggatagat

SEQ ID NO: 84740 - DNA, 25 bp, Rattus norvegicus
accccttccatgtggctggatagat

SEQ ID NO: 84741 - DNA, 25 bp, Rattus norvegicus
accccttccgcaatgaagacgagat

SEQ ID NO: 84742 - DNA, 25 bp, Rattus norvegicus
accccttccgcattgaagacgagat

SEQ ID NO: 84743 - DNA, 25 bp, Rattus norvegicus
accccttcgacaagccaaatgatga

SEQ ID NO: 84744 - DNA, 25 bp, Rattus norvegicus
accccttcgacatgccaaatgatga

SEQ ID NO: 84745 - DNA, 25 bp, Rattus norvegicus
accccttcgactaacagagtgtcat

SEQ ID NO: 84746 - DNA, 25 bp, Rattus norvegicus
accccttcgacttacagagtgtcat

SEQ ID NO: 84747 - DNA, 25 bp, Rattus norvegicus
accccttcgcaaagctcattgtgga

SEQ ID NO: 84748 - DNA, 25 bp, Rattus norvegicus
accccttcgcaatgctcattgtgga

SEQ ID NO: 84749 - DNA, 25 bp, Rattus norvegicus
accccttgacacaatttttaagcag

SEQ ID NO: 84750 - DNA, 25 bp, Rattus norvegicus
accccttgacactatttttaagcag

SEQ ID NO: 84751 - DNA, 25 bp, Rattus norvegicus
accccttgatctaaactgtggagtc

SEQ ID NO: 84752 - DNA, 25 bp, Rattus norvegicus
accccttgatcttaactgtggagtc

SEQ ID NO: 84753 - DNA, 25 bp, Rattus norvegicus
accccttgggcactttggcagtagc

SEQ ID NO: 84754 - DNA, 25 bp, Rattus norvegicus
accccttgggcagtttggcagtagc

SEQ ID NO: 84755 - DNA, 25 bp, Rattus norvegicus
accccttgtagaaactgccttaaca

SEQ ID NO: 84756 - DNA, 25 bp, Rattus norvegicus
accccttgtagatactgccttaaca

SEQ ID NO: 84757 - DNA, 25 bp, Rattus norvegicus
accccttgtcatcgactatggtcaa

SEQ ID NO: 84758 - DNA, 25 bp, Rattus norvegicus
accccttgtcatggactatggtcaa

SEQ ID NO: 84759 - DNA, 25 bp, Rattus norvegicus
acccctttctctacaatagtttcag

SEQ ID NO: 84760 - DNA, 25 bp, Rattus norvegicus
acccctttctcttcaatagtttcag

SEQ ID NO: 84761 - DNA, 25 bp, Rattus norvegicus
acccgaaaagccacactgtagcagg

SEQ ID NO: 84762 - DNA, 25 bp, Rattus norvegicus
acccgaaaagcctcactgtagcagg

SEQ ID NO: 84763 - DNA, 25 bp, Rattus norvegicus
acccgaaaccgtaagatgtctagca

SEQ ID NO: 84764 - DNA, 25 bp, Rattus norvegicus
acccgaaaccgttagatgtctagca

SEQ ID NO: 84765 - DNA, 25 bp, Rattus norvegicus
acccgaaagcttctgaccaactaag

SEQ ID NO: 84766 - DNA, 25 bp, Rattus norvegicus
acccgaaagcttgtgaccaactaag

SEQ ID NO: 84767 - DNA, 25 bp, Rattus norvegicus
acccgaactactagcttgaagattg

SEQ ID NO: 84768 - DNA, 25 bp, Rattus norvegicus
acccgaactacttgcttgaagattg

SEQ ID NO: 84769 - DNA, 25 bp, Rattus norvegicus
acccgaagccagaagccatcagtgg

SEQ ID NO: 84770 - DNA, 25 bp, Rattus norvegicus
acccgaagccagtagccatcagtgg

SEQ ID NO: 84771 - DNA, 25 bp, Rattus norvegicus
acccgaatgaacctctaaagccact

SEQ ID NO: 84772 - DNA, 25 bp, Rattus norvegicus
acccgaatgaacgtctaaagccact

SEQ ID NO: 84773 - DNA, 25 bp, Rattus norvegicus
acccgacattaacttctctggcgaa

SEQ ID NO: 84774 - DNA, 25 bp, Rattus norvegicus
acccgacattaagttctctggcgaa

SEQ ID NO: 84775 - DNA, 25 bp, Rattus norvegicus
acccgaccccagagcagattgatga

SEQ ID NO: 84776 - DNA, 25 bp, Rattus norvegicus
acccgaccccagtgcagattgatga

SEQ ID NO: 84777 - DNA, 25 bp, Rattus norvegicus
acccgacccttaactgcaggagact

SEQ ID NO: 84778 - DNA, 25 bp, Rattus norvegicus
acccgacccttatctgcaggagact

SEQ ID NO: 84779 - DNA, 25 bp, Rattus norvegicus
acccgacggtttagccgttcacatg

SEQ ID NO: 84780 - DNA, 25 bp, Rattus norvegicus
acccgacggttttgccgttcacatg

SEQ ID NO: 84781 - DNA, 25 bp, Rattus norvegicus
acccgacttggcagttcagtgtctt

SEQ ID NO: 84782 - DNA, 25 bp, Rattus norvegicus
acccgacttggctgttcagtgtctt

SEQ ID NO: 84783 - DNA, 25 bp, Rattus norvegicus
acccgagaaaggaacgctggcacat

SEQ ID NO: 84784 - DNA, 25 bp, Rattus norvegicus
acccgagaaaggtacgctggcacat

SEQ ID NO: 84785 - DNA, 25 bp, Rattus norvegicus
acccgagactccagctgtatatgaa

SEQ ID NO: 84786 - DNA, 25 bp, Rattus norvegicus
acccgagactcctgctgtatatgaa

SEQ ID NO: 84787 - DNA, 25 bp, Rattus norvegicus
acccgagccctgaaggacgaacgat

SEQ ID NO: 84788 - DNA, 25 bp, Rattus norvegicus
acccgagccctgtaggacgaacgat

SEQ ID NO: 84789 - DNA, 25 bp, Rattus norvegicus
acccgagctaggaggctcagggcac

SEQ ID NO: 84790 - DNA, 25 bp, Rattus norvegicus
acccgagctaggtggctcagggcac

SEQ ID NO: 84791 - DNA, 25 bp, Rattus norvegicus
acccgaggcgatcacattctgctga

SEQ ID NO: 84792 - DNA, 25 bp, Rattus norvegicus
acccgaggcgatgacattctgctga

SEQ ID NO: 84793 - DNA, 25 bp, Rattus norvegicus
acccgagggagcaggaatcctgata

SEQ ID NO: 84794 - DNA, 25 bp, Rattus norvegicus
acccgagggagctggaatcctgata

SEQ ID NO: 84795 - DNA, 25 bp, Rattus norvegicus
acccgagtgacccagaaagtgcttg

SEQ ID NO: 84796 - DNA, 25 bp, Rattus norvegicus
acccgagtgaccgagaaagtgcttg

SEQ ID NO: 84797 - DNA, 25 bp, Rattus norvegicus
acccgagtgtagagtgcaagtgtga

SEQ ID NO: 84798 - DNA, 25 bp, Rattus norvegicus
acccgagtgtagtgtgcaagtgtga

SEQ ID NO: 84799 - DNA, 25 bp, Rattus norvegicus
acccgataaactatgtcactgcaca

SEQ ID NO: 84800 - DNA, 25 bp, Rattus norvegicus
acccgataaactttgtcactgcaca

SEQ ID NO: 84801 - DNA, 25 bp, Rattus norvegicus
acccgatcgggaagaacgtctcaaa

SEQ ID NO: 84802 - DNA, 25 bp, Rattus norvegicus
acccgatcgggatgaacgtctcaaa

SEQ ID NO: 84803 - DNA, 25 bp, Rattus norvegicus
acccgatctcgacactgaggcagta

SEQ ID NO: 84804 - DNA, 25 bp, Rattus norvegicus
acccgatctcgagactgaggcagta

SEQ ID NO: 84805 - DNA, 25 bp, Rattus norvegicus
acccgatctgggagtgcatgttgcc

SEQ ID NO: 84806 - DNA, 25 bp, Rattus norvegicus
acccgatctgggtgtgcatgttgcc

SEQ ID NO: 84807 - DNA, 25 bp, Rattus norvegicus
acccgatgctcaagaaccttcttaa

SEQ ID NO: 84808 - DNA, 25 bp, Rattus norvegicus
acccgatgctcatgaaccttcttaa

SEQ ID NO: 84809 - DNA, 25 bp, Rattus norvegicus
acccgatggcttaccagttactgaa

SEQ ID NO: 84810 - DNA, 25 bp, Rattus norvegicus
acccgatggctttccagttactgaa

SEQ ID NO: 84811 - DNA, 25 bp, Rattus norvegicus
acccgatgtttcaaagtgagctgct

SEQ ID NO: 84812 - DNA, 25 bp, Rattus norvegicus
acccgatgtttctaagtgagctgct

SEQ ID NO: 84813 - DNA, 25 bp, Rattus norvegicus
acccgatttcatcttatcctttttg

SEQ ID NO: 84814 - DNA, 25 bp, Rattus norvegicus
acccgatttcatgttatcctttttg

SEQ ID NO: 84815 - DNA, 25 bp, Rattus norvegicus
acccgcacataccatacacagaatt

SEQ ID NO: 84816 - DNA, 25 bp, Rattus norvegicus
acccgcacatacgatacacagaatt

SEQ ID NO: 84817 - DNA, 25 bp, Rattus norvegicus
acccgcatagcacctcataactgtt

SEQ ID NO: 84818 - DNA, 25 bp, Rattus norvegicus
acccgcatagcagctcataactgtt

SEQ ID NO: 84819 - DNA, 25 bp, Rattus norvegicus
acccgcatcgacaaatataccggat

SEQ ID NO: 84820 - DNA, 25 bp, Rattus norvegicus
acccgcatcgactaatataccggat

SEQ ID NO: 84821 - DNA, 25 bp, Rattus norvegicus
acccgcatggttaatgagcttcttc

SEQ ID NO: 84822 - DNA, 25 bp, Rattus norvegicus
acccgcatggtttatgagcttcttc

SEQ ID NO: 84823 - DNA, 25 bp, Rattus norvegicus
acccgccaatccactgttgcataaa

SEQ ID NO: 84824 - DNA, 25 bp, Rattus norvegicus
acccgccaatcctctgttgcataaa

SEQ ID NO: 84825 - DNA, 25 bp, Rattus norvegicus
acccgccatagacttcaagtcgttg

SEQ ID NO: 84826 - DNA, 25 bp, Rattus norvegicus
acccgccatagagttcaagtcgttg

SEQ ID NO: 84827 - DNA, 25 bp, Rattus norvegicus
acccgccatgtgcagatgctcagag

SEQ ID NO: 84828 - DNA, 25 bp, Rattus norvegicus
acccgccatgtggagatgctcagag

SEQ ID NO: 84829 - DNA, 25 bp, Rattus norvegicus
acccgcctgcggcatacgaataaag

SEQ ID NO: 84830 - DNA, 25 bp, Rattus norvegicus
acccgcctgcgggatacgaataaag

SEQ ID NO: 84831 - DNA, 25 bp, Rattus norvegicus
acccgcctgggcatcataatgagac

SEQ ID NO: 84832 - DNA, 25 bp, Rattus norvegicus
acccgcctgggcttcataatgagac

SEQ ID NO: 84833 - DNA, 25 bp, Rattus norvegicus
acccgcctgtaaactccaaggcagg

SEQ ID NO: 84834 - DNA, 25 bp, Rattus norvegicus
acccgcctgtaatctccaaggcagg

SEQ ID NO: 84835 - DNA, 25 bp, Rattus norvegicus
acccgccttttcctgacagtgggag

SEQ ID NO: 84836 - DNA, 25 bp, Rattus norvegicus
acccgccttttcgtgacagtgggag

SEQ ID NO: 84837 - DNA, 25 bp, Rattus norvegicus
acccgcggcggtcattcacacggga

SEQ ID NO: 84838 - DNA, 25 bp, Rattus norvegicus
acccgcggcggtgattcacacggga

SEQ ID NO: 84839 - DNA, 25 bp, Rattus norvegicus
acccgcgggaggactcgcagtttga

SEQ ID NO: 84840 - DNA, 25 bp, Rattus norvegicus
acccgcgggaggtctcgcagtttga

SEQ ID NO: 84841 - DNA, 25 bp, Rattus norvegicus
acccgcgtacggagctcagaagtat

SEQ ID NO: 84842 - DNA, 25 bp, Rattus norvegicus
acccgcgtacggtgctcagaagtat

SEQ ID NO: 84843 - DNA, 25 bp, Rattus norvegicus
acccgcgttgccatgaacagcaaga

SEQ ID NO: 84844 - DNA, 25 bp, Rattus norvegicus
acccgcgttgccttgaacagcaaga

SEQ ID NO: 84845 - DNA, 25 bp, Rattus norvegicus
acccgctatcctcatggtataatgg

SEQ ID NO: 84846 - DNA, 25 bp, Rattus norvegicus
acccgctatcctgatggtataatgg

SEQ ID NO: 84847 - DNA, 25 bp, Rattus norvegicus
acccgctccaagcagtgagatcgtg

SEQ ID NO: 84848 - DNA, 25 bp, Rattus norvegicus
acccgctccaaggagtgagatcgtg

SEQ ID NO: 84849 - DNA, 25 bp, Rattus norvegicus
acccgctgcctgcagtgtcttggaa

SEQ ID NO: 84850 - DNA, 25 bp, Rattus norvegicus
acccgctgcctggagtgtcttggaa

SEQ ID NO: 84851 - DNA, 25 bp, Rattus norvegicus
acccgcttcttccaaatgttcaaga

SEQ ID NO: 84852 - DNA, 25 bp, Rattus norvegicus
acccgcttcttcgaaatgttcaaga

SEQ ID NO: 84853 - DNA, 25 bp, Rattus norvegicus
acccggaagccactcaggtttggtg

SEQ ID NO: 84854 - DNA, 25 bp, Rattus norvegicus
acccggaagccagtcaggtttggtg

SEQ ID NO: 84855 - DNA, 25 bp, Rattus norvegicus
acccggacattaactgccgcaaagc

SEQ ID NO: 84856 - DNA, 25 bp, Rattus norvegicus
acccggacattatctgccgcaaagc

SEQ ID NO: 84857 - DNA, 25 bp, Rattus norvegicus
acccggagggtcacaaggaacagca

SEQ ID NO: 84858 - DNA, 25 bp, Rattus norvegicus
acccggagggtctcaaggaacagca

SEQ ID NO: 84859 - DNA, 25 bp, Rattus norvegicus
acccggatgcagattcgttgtatgt

SEQ ID NO: 84860 - DNA, 25 bp, Rattus norvegicus
acccggatgcagtttcgttgtatgt

SEQ ID NO: 84861 - DNA, 25 bp, Rattus norvegicus
acccggcaaggcctgaggtctacag

SEQ ID NO: 84862 - DNA, 25 bp, Rattus norvegicus
acccggcaaggcgtgaggtctacag

SEQ ID NO: 84863 - DNA, 25 bp, Rattus norvegicus
acccggcacgctcaacagggcgccc

SEQ ID NO: 84864 - DNA, 25 bp, Rattus norvegicus
acccggcacgctgaacagggcgccc

SEQ ID NO: 84865 - DNA, 25 bp, Rattus norvegicus
acccggccaagacagtagtgacttt

SEQ ID NO: 84866 - DNA, 25 bp, Rattus norvegicus
acccggccaagagagtagtgacttt

SEQ ID NO: 84867 - DNA, 25 bp, Rattus norvegicus
acccggccacgacaactttgtgcag

SEQ ID NO: 84868 - DNA, 25 bp, Rattus norvegicus
acccggccacgagaactttgtgcag

SEQ ID NO: 84869 - DNA, 25 bp, Rattus norvegicus
acccggccctttccagcatgagaaa

SEQ ID NO: 84870 - DNA, 25 bp, Rattus norvegicus
acccggccctttgcagcatgagaaa

SEQ ID NO: 84871 - DNA, 25 bp, Rattus norvegicus
acccggcctataatcgtgaggacca

SEQ ID NO: 84872 - DNA, 25 bp, Rattus norvegicus
acccggcctatattcgtgaggacca

SEQ ID NO: 84873 - DNA, 25 bp, Rattus norvegicus
acccggcggcatactaaacgcgatg

SEQ ID NO: 84874 - DNA, 25 bp, Rattus norvegicus
acccggcggcattctaaacgcgatg

SEQ ID NO: 84875 - DNA, 25 bp, Rattus norvegicus
acccggcttagcagagcaaggctga

SEQ ID NO: 84876 - DNA, 25 bp, Rattus norvegicus
acccggcttagctgagcaaggctga

SEQ ID NO: 84877 - DNA, 25 bp, Rattus norvegicus
acccggcttatgatacagcgctaag

SEQ ID NO: 84878 - DNA, 25 bp, Rattus norvegicus
acccggcttatgttacagcgctaag

SEQ ID NO: 84879 - DNA, 25 bp, Rattus norvegicus
acccgggagcacatggaccgaatga

SEQ ID NO: 84880 - DNA, 25 bp, Rattus norvegicus
acccgggagcacttggaccgaatga

SEQ ID NO: 84881 - DNA, 25 bp, Rattus norvegicus
acccgggatgccatttgctgtatgt

SEQ ID NO: 84882 - DNA, 25 bp, Rattus norvegicus
acccgggatgccttttgctgtatgt

SEQ ID NO: 84883 - DNA, 25 bp, Rattus norvegicus
acccgggtctgccagcagaacctgg

SEQ ID NO: 84884 - DNA, 25 bp, Rattus norvegicus
acccgggtctgcgagcagaacctgg

SEQ ID NO: 84885 - DNA, 25 bp, Rattus norvegicus
acccgggtcttcaacaatgatgctg

SEQ ID NO: 84886 - DNA, 25 bp, Rattus norvegicus
acccgggtcttctacaatgatgctg

SEQ ID NO: 84887 - DNA, 25 bp, Rattus norvegicus
acccggtaggtgcagaccatgcctc

SEQ ID NO: 84888 - DNA, 25 bp, Rattus norvegicus
acccggtaggtggagaccatgcctc

SEQ ID NO: 84889 - DNA, 25 bp, Rattus norvegicus
acccggtatggtagcacatggctta

SEQ ID NO: 84890 - DNA, 25 bp, Rattus norvegicus
acccggtatggttgcacatggctta

SEQ ID NO: 84891 - DNA, 25 bp, Rattus norvegicus
acccggtctagaaggtgaggtccca

SEQ ID NO: 84892 - DNA, 25 bp, Rattus norvegicus
acccggtctagatggtgaggtccca

SEQ ID NO: 84893 - DNA, 25 bp, Rattus norvegicus
acccggtgagggatgacagactctg

SEQ ID NO: 84894 - DNA, 25 bp, Rattus norvegicus
acccggtgagggttgacagactctg

SEQ ID NO: 84895 - DNA, 25 bp, Rattus norvegicus
acccggtggagcagtccgtgaatga

SEQ ID NO: 84896 - DNA, 25 bp, Rattus norvegicus
acccggtggagctgtccgtgaatga

SEQ ID NO: 84897 - DNA, 25 bp, Rattus norvegicus
acccggtggctgcactctatgaaga

SEQ ID NO: 84898 - DNA, 25 bp, Rattus norvegicus
acccggtggctggactctatgaaga

SEQ ID NO: 84899 - DNA, 25 bp, Rattus norvegicus
acccggtttcagaagctgctggcca

SEQ ID NO: 84900 - DNA, 25 bp, Rattus norvegicus
acccggtttcagtagctgctggcca

SEQ ID NO: 84901 - DNA, 25 bp, Rattus norvegicus
acccgtagacttaggttactgctat

SEQ ID NO: 84902 - DNA, 25 bp, Rattus norvegicus
acccgtagacttcagcgtttgtata

SEQ ID NO: 84903 - DNA, 25 bp, Rattus norvegicus
acccgtagacttgagcgtttgtata

SEQ ID NO: 84904 - DNA, 25 bp, Rattus norvegicus
acccgtagactttggttactgctat

SEQ ID NO: 84905 - DNA, 25 bp, Rattus norvegicus
acccgtcagatgagcaacactcatt

SEQ ID NO: 84906 - DNA, 25 bp, Rattus norvegicus
acccgtcagatgtgcaacactcatt

SEQ ID NO: 84907 - DNA, 25 bp, Rattus norvegicus
acccgtccacttcttctcatgtagg

SEQ ID NO: 84908 - DNA, 25 bp, Rattus norvegicus
acccgtccacttgttctcatgtagg

SEQ ID NO: 84909 - DNA, 25 bp, Rattus norvegicus
acccgtcctgatcgtgttgagcaca

SEQ ID NO: 84910 - DNA, 25 bp, Rattus norvegicus
acccgtcctgatggtgttgagcaca

SEQ ID NO: 84911 - DNA, 25 bp, Rattus norvegicus
acccgtcgtcaacagcttcaacagg

SEQ ID NO: 84912 - DNA, 25 bp, Rattus norvegicus
acccgtcgtcaagagcttcaacagg

SEQ ID NO: 84913 - DNA, 25 bp, Rattus norvegicus
acccgtcttgttcatcgtctaaatc

SEQ ID NO: 84914 - DNA, 25 bp, Rattus norvegicus
acccgtcttgttgatcgtctaaatc

SEQ ID NO: 84915 - DNA, 25 bp, Rattus norvegicus
acccgtgaagacagcacatcatcta

SEQ ID NO: 84916 - DNA, 25 bp, Rattus norvegicus
acccgtgaagactgcacatcatcta

SEQ ID NO: 84917 - DNA, 25 bp, Rattus norvegicus
acccgtgactgccagttcggacgct

SEQ ID NO: 84918 - DNA, 25 bp, Rattus norvegicus
acccgtgactgcgagttcggacgct

SEQ ID NO: 84919 - DNA, 25 bp, Rattus norvegicus
acccgtgcacctcccaaagagggaa

SEQ ID NO: 84920 - DNA, 25 bp, Rattus norvegicus
acccgtgcacctgccaaagagggaa

SEQ ID NO: 84921 - DNA, 25 bp, Rattus norvegicus
acccgtgcactgcaggtgttgacaa

SEQ ID NO: 84922 - DNA, 25 bp, Rattus norvegicus
acccgtgcactggaggtgttgacaa

SEQ ID NO: 84923 - DNA, 25 bp, Rattus norvegicus
acccgtgcgggtctgaagtgccttc

SEQ ID NO: 84924 - DNA, 25 bp, Rattus norvegicus
acccgtgcgggtgtgaagtgccttc

SEQ ID NO: 84925 - DNA, 25 bp, Rattus norvegicus
acccgtgctgtcagtgacgtttaca

SEQ ID NO: 84926 - DNA, 25 bp, Rattus norvegicus
acccgtgctgtctgtgacgtttaca

SEQ ID NO: 84927 - DNA, 25 bp, Rattus norvegicus
acccgtgcttcactgtgtgtaaact

SEQ ID NO: 84928 - DNA, 25 bp, Rattus norvegicus
acccgtgcttcagtgtgtgtaaact

SEQ ID NO: 84929 - DNA, 25 bp, Rattus norvegicus
acccgtggagatatccagaccttaa

SEQ ID NO: 84930 - DNA, 25 bp, Rattus norvegicus
acccgtggagatttccagaccttaa

SEQ ID NO: 84931 - DNA, 25 bp, Rattus norvegicus
acccgtgggctcactgaagacaatc

SEQ ID NO: 84932 - DNA, 25 bp, Rattus norvegicus
acccgtgggctctctgaagacaatc

SEQ ID NO: 84933 - DNA, 25 bp, Rattus norvegicus
acccgtgtaagaccagtttcagatt

SEQ ID NO: 84934 - DNA, 25 bp, Rattus norvegicus
acccgtgtaagagcagtttcagatt

SEQ ID NO: 84935 - DNA, 25 bp, Rattus norvegicus
acccgtgtgcagacacatgctgtag

SEQ ID NO: 84936 - DNA, 25 bp, Rattus norvegicus
acccgtgtgcagtcacatgctgtag

SEQ ID NO: 84937 - DNA, 25 bp, Rattus norvegicus
acccgtgtgcttctgagccaggcca

SEQ ID NO: 84938 - DNA, 25 bp, Rattus norvegicus
acccgtgtgcttgtgagccaggcca

SEQ ID NO: 84939 - DNA, 25 bp, Rattus norvegicus
acccgtgtggatccgtcgatgttct

SEQ ID NO: 84940 - DNA, 25 bp, Rattus norvegicus
acccgtgtggatgcgtcgatgttct

SEQ ID NO: 84941 - DNA, 25 bp, Rattus norvegicus
acccgtgtggttcacctcgctagga

SEQ ID NO: 84942 - DNA, 25 bp, Rattus norvegicus
acccgtgtggttgacctcgctagga

SEQ ID NO: 84943 - DNA, 25 bp, Rattus norvegicus
acccgtgtgtcacccttcaatgaat

SEQ ID NO: 84944 - DNA, 25 bp, Rattus norvegicus
acccgtgtgtcagccttcaatgaat

SEQ ID NO: 84945 - DNA, 25 bp, Rattus norvegicus
acccgttacctgcatgtgttgtcca

SEQ ID NO: 84946 - DNA, 25 bp, Rattus norvegicus
acccgttacctggatgtgttgtcca

SEQ ID NO: 84947 - DNA, 25 bp, Rattus norvegicus
acccgttatcaactcagggctgatg

SEQ ID NO: 84948 - DNA, 25 bp, Rattus norvegicus
acccgttatcaagtcagggctgatg

SEQ ID NO: 84949 - DNA, 25 bp, Rattus norvegicus
acccgttgattactccttgtctgga

SEQ ID NO: 84950 - DNA, 25 bp, Rattus norvegicus
acccgttgattagtccttgtctgga

SEQ ID NO: 84951 - DNA, 25 bp, Rattus norvegicus
acccgtttcaaactgcctgttaatg

SEQ ID NO: 84952 - DNA, 25 bp, Rattus norvegicus
acccgtttcaaagtgcctgttaatg

SEQ ID NO: 84953 - DNA, 25 bp, Rattus norvegicus
accctaaacccacctcggaagagat

SEQ ID NO: 84954 - DNA, 25 bp, Rattus norvegicus
accctaaacccagctcggaagagat

SEQ ID NO: 84955 - DNA, 25 bp, Rattus norvegicus
accctaaactttctaacatcacaca

SEQ ID NO: 84956 - DNA, 25 bp, Rattus norvegicus
accctaaactttgtaacatcacaca

SEQ ID NO: 84957 - DNA, 25 bp, Rattus norvegicus
accctaaattgaaatatgtctgtat

SEQ ID NO: 84958 - DNA, 25 bp, Rattus norvegicus
accctaaattgatatatgtctgtat

SEQ ID NO: 84959 - DNA, 25 bp, Rattus norvegicus
accctaaggtagatcatggctggca

SEQ ID NO: 84960 - DNA, 25 bp, Rattus norvegicus
accctaaggtagttcatggctggca

SEQ ID NO: 84961 - DNA, 25 bp, Rattus norvegicus
accctaagtcctctatttgaatcgt

SEQ ID NO: 84962 - DNA, 25 bp, Rattus norvegicus
accctaagtcctgtatttgaatcgt

SEQ ID NO: 84963 - DNA, 25 bp, Rattus norvegicus
accctaataataaacagcctagtat

SEQ ID NO: 84964 - DNA, 25 bp, Rattus norvegicus
accctaataatatacagcctagtat

SEQ ID NO: 84965 - DNA, 25 bp, Rattus norvegicus
accctaatttatctggcctgtcaat

SEQ ID NO: 84966 - DNA, 25 bp, Rattus norvegicus
accctaatttatgtggcctgtcaat

SEQ ID NO: 84967 - DNA, 25 bp, Rattus norvegicus
accctacacagaagctaccaagttt

SEQ ID NO: 84968 - DNA, 25 bp, Rattus norvegicus
accctacacagatgctaccaagttt

SEQ ID NO: 84969 - DNA, 25 bp, Rattus norvegicus
accctacactttatccagctctttg

SEQ ID NO: 84970 - DNA, 25 bp, Rattus norvegicus
accctacactttttccagctctttg

SEQ ID NO: 84971 - DNA, 25 bp, Rattus norvegicus
accctacgagccatatctgtggatt

SEQ ID NO: 84972 - DNA, 25 bp, Rattus norvegicus
accctacgagccttatctgtggatt

SEQ ID NO: 84973 - DNA, 25 bp, Rattus norvegicus
accctactcaccagcacttaattaa

SEQ ID NO: 84974 - DNA, 25 bp, Rattus norvegicus
accctactcacctgcacttaattaa

SEQ ID NO: 84975 - DNA, 25 bp, Rattus norvegicus
accctactcttgacttttcttaatg

SEQ ID NO: 84976 - DNA, 25 bp, Rattus norvegicus
accctactcttgtcttttcttaatg

SEQ ID NO: 84977 - DNA, 25 bp, Rattus norvegicus
accctagaagacaccaaatcatccg

SEQ ID NO: 84978 - DNA, 25 bp, Rattus norvegicus
accctagaagactccaaatcatccg

SEQ ID NO: 84979 - DNA, 25 bp, Rattus norvegicus
accctagagttgagccacgacgaga

SEQ ID NO: 84980 - DNA, 25 bp, Rattus norvegicus
accctagagttgtgccacgacgaga

SEQ ID NO: 84981 - DNA, 25 bp, Rattus norvegicus
accctagcaaggacaccatcattga

SEQ ID NO: 84982 - DNA, 25 bp, Rattus norvegicus
accctagcaaggtcaccatcattga

SEQ ID NO: 84983 - DNA, 25 bp, Rattus norvegicus
accctagcacttatgtaccctctga

SEQ ID NO: 84984 - DNA, 25 bp, Rattus norvegicus
accctagcacttttgtaccctctga

SEQ ID NO: 84985 - DNA, 25 bp, Rattus norvegicus
accctagcaggtctcatttctcggc

SEQ ID NO: 84986 - DNA, 25 bp, Rattus norvegicus
accctagcaggtgtcatttctcggc

SEQ ID NO: 84987 - DNA, 25 bp, Rattus norvegicus
accctagccatgcacctcaggaaag

SEQ ID NO: 84988 - DNA, 25 bp, Rattus norvegicus
accctagccatggacctcaggaaag

SEQ ID NO: 84989 - DNA, 25 bp, Rattus norvegicus
accctagctcttacctcattgtggg

SEQ ID NO: 84990 - DNA, 25 bp, Rattus norvegicus
accctagctctttcctcattgtggg

SEQ ID NO: 84991 - DNA, 25 bp, Rattus norvegicus
accctagctggtagtgaagctgcca

SEQ ID NO: 84992 - DNA, 25 bp, Rattus norvegicus
accctagctggttgtgaagctgcca

SEQ ID NO: 84993 - DNA, 25 bp, Rattus norvegicus
accctagctttgatggtcaccatgg

SEQ ID NO: 84994 - DNA, 25 bp, Rattus norvegicus
accctagctttgttggtcaccatgg

SEQ ID NO: 84995 - DNA, 25 bp, Rattus norvegicus
accctagtgtgcctcttgaatttaa

SEQ ID NO: 84996 - DNA, 25 bp, Rattus norvegicus
accctagtgtgcgtcttgaatttaa

SEQ ID NO: 84997 - DNA, 25 bp, Rattus norvegicus
accctataagttcttgtcatccata

SEQ ID NO: 84998 - DNA, 25 bp, Rattus norvegicus
accctataagttgttgtcatccata

SEQ ID NO: 84999 - DNA, 25 bp, Rattus norvegicus
accctatcttcacctctagtctata

SEQ ID NO: 85000 - DNA, 25 bp, Rattus norvegicus
accctatcttcagctctagtctata

SEQ ID NO: 85001 - DNA, 25 bp, Rattus norvegicus
accctatgcatccttgaactcatga

SEQ ID NO: 85002 - DNA, 25 bp, Rattus norvegicus
accctatgcatcgttgaactcatga

SEQ ID NO: 85003 - DNA, 25 bp, Rattus norvegicus
accctatgctgtagtatgatggacg

SEQ ID NO: 85004 - DNA, 25 bp, Rattus norvegicus
accctatgctgttgtatgatggacg

SEQ ID NO: 85005 - DNA, 25 bp, Rattus norvegicus
accctatgtcctatcatgattccat

SEQ ID NO: 85006 - DNA, 25 bp, Rattus norvegicus
accctatgtcctttcatgattccat

SEQ ID NO: 85007 - DNA, 25 bp, Rattus norvegicus
accctattaatcacactcatgcctg

SEQ ID NO: 85008 - DNA, 25 bp, Rattus norvegicus
accctattaatctcactcatgcctg

SEQ ID NO: 85009 - DNA, 25 bp, Rattus norvegicus
accctattccacaaggtcctgaata

SEQ ID NO: 85010 - DNA, 25 bp, Rattus norvegicus
accctattccactaggtcctgaata

SEQ ID NO: 85011 - DNA, 25 bp, Rattus norvegicus
accctatttatcactgccatttgga

SEQ ID NO: 85012 - DNA, 25 bp, Rattus norvegicus
accctatttatctctgccatttgga

SEQ ID NO: 85013 - DNA, 25 bp, Rattus norvegicus
accctatttattctcatgctttctg

SEQ ID NO: 85014 - DNA, 25 bp, Rattus norvegicus
accctatttattgtcatgctttctg

SEQ ID NO: 85015 - DNA, 25 bp, Rattus norvegicus
accctcaagacgagggatgggccca

SEQ ID NO: 85016 - DNA, 25 bp, Rattus norvegicus
accctcaagacgtgggatgggccca

SEQ ID NO: 85017 - DNA, 25 bp, Rattus norvegicus
accctcaaggctagagtcctgtgtt

SEQ ID NO: 85018 - DNA, 25 bp, Rattus norvegicus
accctcaaggcttgagtcctgtgtt

SEQ ID NO: 85019 - DNA, 25 bp, Rattus norvegicus
accctcaatttgacattgccacaag

SEQ ID NO: 85020 - DNA, 25 bp, Rattus norvegicus
accctcaatttgtcattgccacaag

SEQ ID NO: 85021 - DNA, 25 bp, Rattus norvegicus
accctcacaaggctgtggactctat

SEQ ID NO: 85022 - DNA, 25 bp, Rattus norvegicus
accctcacaagggtgtggactctat

SEQ ID NO: 85023 - DNA, 25 bp, Rattus norvegicus
accctcaccgatatactttgtctat

SEQ ID NO: 85024 - DNA, 25 bp, Rattus norvegicus
accctcaccgatttactttgtctat

SEQ ID NO: 85025 - DNA, 25 bp, Rattus norvegicus
accctcacggtaccttgcgacagtt

SEQ ID NO: 85026 - DNA, 25 bp, Rattus norvegicus
accctcacggtagcttgcgacagtt

SEQ ID NO: 85027 - DNA, 25 bp, Rattus norvegicus
accctcactcctagtagtggaagcg

SEQ ID NO: 85028 - DNA, 25 bp, Rattus norvegicus
accctcactccttgtagtggaagcg

SEQ ID NO: 85029 - DNA, 25 bp, Rattus norvegicus
accctcaggactacttggaacatgg

SEQ ID NO: 85030 - DNA, 25 bp, Rattus norvegicus
accctcaggacttcttggaacatgg

SEQ ID NO: 85031 - DNA, 25 bp, Rattus norvegicus
accctcaggatgctacagagcccag

SEQ ID NO: 85032 - DNA, 25 bp, Rattus norvegicus
accctcaggatggtacagagcccag

SEQ ID NO: 85033 - DNA, 25 bp, Rattus norvegicus
accctcagtgcgaatcctcaataaa

SEQ ID NO: 85034 - DNA, 25 bp, Rattus norvegicus
accctcagtgcgtatcctcaataaa

SEQ ID NO: 85035 - DNA, 25 bp, Rattus norvegicus
accctcagtgctactcatggtttga

SEQ ID NO: 85036 - DNA, 25 bp, Rattus norvegicus
accctcagtgcttctcatggtttga

SEQ ID NO: 85037 - DNA, 25 bp, Rattus norvegicus
accctcagtggactctaggttccta

SEQ ID NO: 85038 - DNA, 25 bp, Rattus norvegicus
accctcagtggagtctaggttccta

SEQ ID NO: 85039 - DNA, 25 bp, Rattus norvegicus
accctcagttttctttctagcagtg

SEQ ID NO: 85040 - DNA, 25 bp, Rattus norvegicus
accctcagttttgtttctagcagtg

SEQ ID NO: 85041 - DNA, 25 bp, Rattus norvegicus
accctcatagctaggtgtgtgtcca

SEQ ID NO: 85042 - DNA, 25 bp, Rattus norvegicus
accctcatagcttggtgtgtgtcca

SEQ ID NO: 85043 - DNA, 25 bp, Rattus norvegicus
accctcatctcaattatctttttca

SEQ ID NO: 85044 - DNA, 25 bp, Rattus norvegicus
accctcatctcatttatctttttca

SEQ ID NO: 85045 - DNA, 25 bp, Rattus norvegicus
accctcatcttgagtttatggtggc

SEQ ID NO: 85046 - DNA, 25 bp, Rattus norvegicus
accctcatcttgtgtttatggtggc

SEQ ID NO: 85047 - DNA, 25 bp, Rattus norvegicus
accctcatctttcacgtggagctgc

SEQ ID NO: 85048 - DNA, 25 bp, Rattus norvegicus
accctcatctttgacgtggagctgc

SEQ ID NO: 85049 - DNA, 25 bp, Rattus norvegicus
accctccactatctataggctggga

SEQ ID NO: 85050 - DNA, 25 bp, Rattus norvegicus
accctccactatgtataggctggga

SEQ ID NO: 85051 - DNA, 25 bp, Rattus norvegicus
accctccagcatctttgtcggaaga

SEQ ID NO: 85052 - DNA, 25 bp, Rattus norvegicus
accctccagcatgtttgtcggaaga

SEQ ID NO: 85053 - DNA, 25 bp, Rattus norvegicus
accctccatgtactgtgaagccaag

SEQ ID NO: 85054 - DNA, 25 bp, Rattus norvegicus
accctccatgtagtgtgaagccaag

SEQ ID NO: 85055 - DNA, 25 bp, Rattus norvegicus
accctccccattctatgcaaatgta

SEQ ID NO: 85056 - DNA, 25 bp, Rattus norvegicus
accctccccattgtatgcaaatgta

SEQ ID NO: 85057 - DNA, 25 bp, Rattus norvegicus
accctcccgcaacttgagtcaagtt

SEQ ID NO: 85058 - DNA, 25 bp, Rattus norvegicus
accctcccgcaagttgagtcaagtt

SEQ ID NO: 85059 - DNA, 25 bp, Rattus norvegicus
accctcccgcatacaagagaacatt

SEQ ID NO: 85060 - DNA, 25 bp, Rattus norvegicus
accctcccgcattcaagagaacatt

SEQ ID NO: 85061 - DNA, 25 bp, Rattus norvegicus
accctcccgcgcataggagcaggtg

SEQ ID NO: 85062 - DNA, 25 bp, Rattus norvegicus
accctcccgcgcttaggagcaggtg

SEQ ID NO: 85063 - DNA, 25 bp, Rattus norvegicus
accctccgaagtcgacctgtagtgg

SEQ ID NO: 85064 - DNA, 25 bp, Rattus norvegicus
accctccgaagtggacctgtagtgg

SEQ ID NO: 85065 - DNA, 25 bp, Rattus norvegicus
accctccggtatatctcagaactgt

SEQ ID NO: 85066 - DNA, 25 bp, Rattus norvegicus
accctccggtatttctcagaactgt

SEQ ID NO: 85067 - DNA, 25 bp, Rattus norvegicus
accctcctatcaaggtactgattct

SEQ ID NO: 85068 - DNA, 25 bp, Rattus norvegicus
accctcctatcatggtactgattct

SEQ ID NO: 85069 - DNA, 25 bp, Rattus norvegicus
accctcctggctatagcgaacagag

SEQ ID NO: 85070 - DNA, 25 bp, Rattus norvegicus
accctcctggctttagcgaacagag

SEQ ID NO: 85071 - DNA, 25 bp, Rattus norvegicus
accctcctgggaagaccattcatgg

SEQ ID NO: 85072 - DNA, 25 bp, Rattus norvegicus
accctcctgggatgaccattcatgg

SEQ ID NO: 85073 - DNA, 25 bp, Rattus norvegicus
accctcctgtctcatttactgaaag

SEQ ID NO: 85074 - DNA, 25 bp, Rattus norvegicus
accctcctgtctgatttactgaaag

SEQ ID NO: 85075 - DNA, 25 bp, Rattus norvegicus
accctcctgtgtacatgttgtgaaa

SEQ ID NO: 85076 - DNA, 25 bp, Rattus norvegicus
accctcctgtgttcatgttgtgaaa

SEQ ID NO: 85077 - DNA, 25 bp, Rattus norvegicus
accctcctttacatcagactgagat

SEQ ID NO: 85078 - DNA, 25 bp, Rattus norvegicus
accctcctttacttcagactgagat

SEQ ID NO: 85079 - DNA, 25 bp, Rattus norvegicus
accctcgaaacaagcctttggatat

SEQ ID NO: 85080 - DNA, 25 bp, Rattus norvegicus
accctcgaaacatgcctttggatat

SEQ ID NO: 85081 - DNA, 25 bp, Rattus norvegicus
accctcgaccatcttatgtcttaag

SEQ ID NO: 85082 - DNA, 25 bp, Rattus norvegicus
accctcgaccatgttatgtcttaag

SEQ ID NO: 85083 - DNA, 25 bp, Rattus norvegicus
accctcgacttcatcagcataaatt

SEQ ID NO: 85084 - DNA, 25 bp, Rattus norvegicus
accctcgacttcttcagcataaatt

SEQ ID NO: 85085 - DNA, 25 bp, Rattus norvegicus
accctcgcttagatctggtcatgga

SEQ ID NO: 85086 - DNA, 25 bp, Rattus norvegicus
accctcgcttagttctggtcatgga

SEQ ID NO: 85087 - DNA, 25 bp, Rattus norvegicus
accctcgtccgtaactagaaggcag

SEQ ID NO: 85088 - DNA, 25 bp, Rattus norvegicus
accctcgtccgttactagaaggcag

SEQ ID NO: 85089 - DNA, 25 bp, Rattus norvegicus
accctctaaactcatctactgcaga

SEQ ID NO: 85090 - DNA, 25 bp, Rattus norvegicus
accctctaaactgatctactgcaga

SEQ ID NO: 85091 - DNA, 25 bp, Rattus norvegicus
accctctaattaatctctcctggat

SEQ ID NO: 85092 - DNA, 25 bp, Rattus norvegicus
accctctaattattctctcctggat

SEQ ID NO: 85093 - DNA, 25 bp, Rattus norvegicus
accctctaccttctttgcatttatt

SEQ ID NO: 85094 - DNA, 25 bp, Rattus norvegicus
accctctaccttgtttgcatttatt

SEQ ID NO: 85095 - DNA, 25 bp, Rattus norvegicus
accctctatgtgatactctgatttt

SEQ ID NO: 85096 - DNA, 25 bp, Rattus norvegicus
accctctatgtgttactctgatttt

SEQ ID NO: 85097 - DNA, 25 bp, Rattus norvegicus
accctctcagttagcctgtttatta

SEQ ID NO: 85098 - DNA, 25 bp, Rattus norvegicus
accctctcagtttgcctgtttatta

SEQ ID NO: 85099 - DNA, 25 bp, Rattus norvegicus
accctctccagcaactgggatgatg

SEQ ID NO: 85100 - DNA, 25 bp, Rattus norvegicus
accctctccagctactgggatgatg

SEQ ID NO: 85101 - DNA, 25 bp, Rattus norvegicus
accctctccatgactgtggccgtgg

SEQ ID NO: 85102 - DNA, 25 bp, Rattus norvegicus
accctctccatgtctgtggccgtgg

SEQ ID NO: 85103 - DNA, 25 bp, Rattus norvegicus
accctctcctctctcttaatattaa

SEQ ID NO: 85104 - DNA, 25 bp, Rattus norvegicus
accctctcctctgtcttaatattaa

SEQ ID NO: 85105 - DNA, 25 bp, Rattus norvegicus
accctctcgctaatgttcaagtctt

SEQ ID NO: 85106 - DNA, 25 bp, Rattus norvegicus
accctctcgctattgttcaagtctt

SEQ ID NO: 85107 - DNA, 25 bp, Rattus norvegicus
accctctcggtgagtcagtcagaag

SEQ ID NO: 85108 - DNA, 25 bp, Rattus norvegicus
accctctcggtgtgtcagtcagaag

SEQ ID NO: 85109 - DNA, 25 bp, Rattus norvegicus
accctctctatacatacgctatgga

SEQ ID NO: 85110 - DNA, 25 bp, Rattus norvegicus
accctctctatagatacgctatgga

SEQ ID NO: 85111 - DNA, 25 bp, Rattus norvegicus
accctctctgataacaacatccaga

SEQ ID NO: 85112 - DNA, 25 bp, Rattus norvegicus
accctctctgattacaacatccaga

SEQ ID NO: 85113 - DNA, 25 bp, Rattus norvegicus
accctctgacttaaagggagtccat

SEQ ID NO: 85114 - DNA, 25 bp, Rattus norvegicus
accctctgacttcgatgtagcggct

SEQ ID NO: 85115 - DNA, 25 bp, Rattus norvegicus
accctctgacttggatgtagcggct

SEQ ID NO: 85116 - DNA, 25 bp, Rattus norvegicus
accctctgactttaagggagtccat

SEQ ID NO: 85117 - DNA, 25 bp, Rattus norvegicus
accctctgagccaaaattgtatctg

SEQ ID NO: 85118 - DNA, 25 bp, Rattus norvegicus
accctctgagcctaaattgtatctg

SEQ ID NO: 85119 - DNA, 25 bp, Rattus norvegicus
accctctgagtcctgggattgtaga

SEQ ID NO: 85120 - DNA, 25 bp, Rattus norvegicus
accctctgagtcgtgggattgtaga

SEQ ID NO: 85121 - DNA, 25 bp, Rattus norvegicus
accctctgagtgagctttgcatgtt

SEQ ID NO: 85122 - DNA, 25 bp, Rattus norvegicus
accctctgagtgtgctttgcatgtt

SEQ ID NO: 85123 - DNA, 25 bp, Rattus norvegicus
accctctggaacatcttgtacatgc

SEQ ID NO: 85124 - DNA, 25 bp, Rattus norvegicus
accctctggaacttcttgtacatgc

SEQ ID NO: 85125 - DNA, 25 bp, Rattus norvegicus
accctctggtccaagatagagttca

SEQ ID NO: 85126 - DNA, 25 bp, Rattus norvegicus
accctctggtcctagatagagttca

SEQ ID NO: 85127 - DNA, 25 bp, Rattus norvegicus
accctctggtgtactgttggtaaca

SEQ ID NO: 85128 - DNA, 25 bp, Rattus norvegicus
accctctggtgttctgttggtaaca

SEQ ID NO: 85129 - DNA, 25 bp, Rattus norvegicus
accctctgtcccaaagctcatatgg

SEQ ID NO: 85130 - DNA, 25 bp, Rattus norvegicus
accctctgtccctaagctcatatgg

SEQ ID NO: 85131 - DNA, 25 bp, Rattus norvegicus
accctctgtctgctgagccttggtt

SEQ ID NO: 85132 - DNA, 25 bp, Rattus norvegicus
accctctgtctggtgagccttggtt

SEQ ID NO: 85133 - DNA, 25 bp, Rattus norvegicus
accctctgtgccagtaagttgtact

SEQ ID NO: 85134 - DNA, 25 bp, Rattus norvegicus
accctctgtgcctgtaagttgtact

SEQ ID NO: 85135 - DNA, 25 bp, Rattus norvegicus
accctcttacctattgtgaactgca

SEQ ID NO: 85136 - DNA, 25 bp, Rattus norvegicus
accctcttaccttttgtgaactgca

SEQ ID NO: 85137 - DNA, 25 bp, Rattus norvegicus
accctcttcagaccttgggaaatgg

SEQ ID NO: 85138 - DNA, 25 bp, Rattus norvegicus
accctcttcagagcttgggaaatgg

SEQ ID NO: 85139 - DNA, 25 bp, Rattus norvegicus
accctcttcaggagccggtgggaag

SEQ ID NO: 85140 - DNA, 25 bp, Rattus norvegicus
accctcttcaggtgccggtgggaag

SEQ ID NO: 85141 - DNA, 25 bp, Rattus norvegicus
accctcttcatactgtgtggctaaa

SEQ ID NO: 85142 - DNA, 25 bp, Rattus norvegicus
accctcttcatagtgtgtggctaaa

SEQ ID NO: 85143 - DNA, 25 bp, Rattus norvegicus
accctcttccttactcacaataaag

SEQ ID NO: 85144 - DNA, 25 bp, Rattus norvegicus
accctcttcctttctcacaataaag

SEQ ID NO: 85145 - DNA, 25 bp, Rattus norvegicus
accctcttcttcatctgttgccatt

SEQ ID NO: 85146 - DNA, 25 bp, Rattus norvegicus
accctcttcttcttctgttgccatt

SEQ ID NO: 85147 - DNA, 25 bp, Rattus norvegicus
accctcttgagtcttggttgagaac

SEQ ID NO: 85148 - DNA, 25 bp, Rattus norvegicus
accctcttgagtgttggttgagaac

SEQ ID NO: 85149 - DNA, 25 bp, Rattus norvegicus
accctcttgcaaagtatagttttta

SEQ ID NO: 85150 - DNA, 25 bp, Rattus norvegicus
accctcttgcaatgtatagttttta

SEQ ID NO: 85151 - DNA, 25 bp, Rattus norvegicus
accctcttggagattaatcacatag

SEQ ID NO: 85152 - DNA, 25 bp, Rattus norvegicus
accctcttggagtttaatcacatag

SEQ ID NO: 85153 - DNA, 25 bp, Rattus norvegicus
accctcttttgtcacttcttgtagt

SEQ ID NO: 85154 - DNA, 25 bp, Rattus norvegicus
accctcttttgtgacttcttgtagt

SEQ ID NO: 85155 - DNA, 25 bp, Rattus norvegicus
accctgaaaagtagcaccagctgaa

SEQ ID NO: 85156 - DNA, 25 bp, Rattus norvegicus
accctgaaaagttgcaccagctgaa

SEQ ID NO: 85157 - DNA, 25 bp, Rattus norvegicus
accctgaaatggctcaagtgcataa

SEQ ID NO: 85158 - DNA, 25 bp, Rattus norvegicus
accctgaaatgggtcaagtgcataa

SEQ ID NO: 85159 - DNA, 25 bp, Rattus norvegicus
accctgaacaccagatctgtgtcag

SEQ ID NO: 85160 - DNA, 25 bp, Rattus norvegicus
accctgaacacctgatctgtgtcag

SEQ ID NO: 85161 - DNA, 25 bp, Rattus norvegicus
accctgaactgcctcggcggaatac

SEQ ID NO: 85162 - DNA, 25 bp, Rattus norvegicus
accctgaactgcgtcggcggaatac

SEQ ID NO: 85163 - DNA, 25 bp, Rattus norvegicus
accctgaaggcgcacggctgtaagt

SEQ ID NO: 85164 - DNA, 25 bp, Rattus norvegicus
accctgaaggcggacggctgtaagt

SEQ ID NO: 85165 - DNA, 25 bp, Rattus norvegicus
accctgaagtcacttcactgggttt

SEQ ID NO: 85166 - DNA, 25 bp, Rattus norvegicus
accctgaagtcagttcactgggttt

SEQ ID NO: 85167 - DNA, 25 bp, Rattus norvegicus
accctgaagttaagtgccacgcaag

SEQ ID NO: 85168 - DNA, 25 bp, Rattus norvegicus
accctgaagttatgtgccacgcaag

SEQ ID NO: 85169 - DNA, 25 bp, Rattus norvegicus
accctgaatgctctcaacactgttt

SEQ ID NO: 85170 - DNA, 25 bp, Rattus norvegicus
accctgaatgctgtcaacactgttt

SEQ ID NO: 85171 - DNA, 25 bp, Rattus norvegicus
accctgaatgttatgtgtgcaccga

SEQ ID NO: 85172 - DNA, 25 bp, Rattus norvegicus
accctgaatgttttgtgtgcaccga

SEQ ID NO: 85173 - DNA, 25 bp, Rattus norvegicus
accctgacagctcccactgaaaatt

SEQ ID NO: 85174 - DNA, 25 bp, Rattus norvegicus
accctgacagctgccactgaaaatt

SEQ ID NO: 85175 - DNA, 25 bp, Rattus norvegicus
accctgacagggatgctaatgtact

SEQ ID NO: 85176 - DNA, 25 bp, Rattus norvegicus
accctgacagggttgctaatgtact

SEQ ID NO: 85177 - DNA, 25 bp, Rattus norvegicus
accctgacagttactcttgacactt

SEQ ID NO: 85178 - DNA, 25 bp, Rattus norvegicus
accctgacagtttctcttgacactt

SEQ ID NO: 85179 - DNA, 25 bp, Rattus norvegicus
accctgaccacgataggttccatgt

SEQ ID NO: 85180 - DNA, 25 bp, Rattus norvegicus
accctgaccacgttaggttccatgt

SEQ ID NO: 85181 - DNA, 25 bp, Rattus norvegicus
accctgaccatgaatgcacttgcta

SEQ ID NO: 85182 - DNA, 25 bp, Rattus norvegicus
accctgaccatgtatgcacttgcta

SEQ ID NO: 85183 - DNA, 25 bp, Rattus norvegicus
accctgacccaaccatcatgtgatg

SEQ ID NO: 85184 - DNA, 25 bp, Rattus norvegicus
accctgacccaagcatcatgtgatg

SEQ ID NO: 85185 - DNA, 25 bp, Rattus norvegicus
accctgaccctaagtggatgatgct

SEQ ID NO: 85186 - DNA, 25 bp, Rattus norvegicus
accctgaccctatgtggatgatgct

SEQ ID NO: 85187 - DNA, 25 bp, Rattus norvegicus
accctgacctccctaagtgtctatt

SEQ ID NO: 85188 - DNA, 25 bp, Rattus norvegicus
accctgacctccgtaagtgtctatt

SEQ ID NO: 85189 - DNA, 25 bp, Rattus norvegicus
accctgacgcatctgagaaccgaat

SEQ ID NO: 85190 - DNA, 25 bp, Rattus norvegicus
accctgacgcatgtgagaaccgaat

SEQ ID NO: 85191 - DNA, 25 bp, Rattus norvegicus
accctgacgccaacatttttggtga

SEQ ID NO: 85192 - DNA, 25 bp, Rattus norvegicus
accctgacgccatcatttttggtga

SEQ ID NO: 85193 - DNA, 25 bp, Rattus norvegicus
accctgactcagaatctatgcaaag

SEQ ID NO: 85194 - DNA, 25 bp, Rattus norvegicus
accctgactcagtatctatgcaaag

SEQ ID NO: 85195 - DNA, 25 bp, Rattus norvegicus
accctgagaaccagagcttgatcct

SEQ ID NO: 85196 - DNA, 25 bp, Rattus norvegicus
accctgagaacctgagcttgatcct

SEQ ID NO: 85197 - DNA, 25 bp, Rattus norvegicus
accctgaggacacatttaccgtcac

SEQ ID NO: 85198 - DNA, 25 bp, Rattus norvegicus
accctgaggacagatttaccgtcac

SEQ ID NO: 85199 - DNA, 25 bp, Rattus norvegicus
accctgaggactctgacgtgttcga

SEQ ID NO: 85200 - DNA, 25 bp, Rattus norvegicus
accctgaggactgtgacgtgttcga

SEQ ID NO: 85201 - DNA, 25 bp, Rattus norvegicus
accctgaggccgatatctcaagtaa

SEQ ID NO: 85202 - DNA, 25 bp, Rattus norvegicus
accctgaggccgttatctcaagtaa

SEQ ID NO: 85203 - DNA, 25 bp, Rattus norvegicus
accctgaggcttctctgattggcta

SEQ ID NO: 85204 - DNA, 25 bp, Rattus norvegicus
accctgaggcttgtctgattggcta

SEQ ID NO: 85205 - DNA, 25 bp, Rattus norvegicus
accctgagtgttacctaggtgcatg

SEQ ID NO: 85206 - DNA, 25 bp, Rattus norvegicus
accctgagtgtttcctaggtgcatg

SEQ ID NO: 85207 - DNA, 25 bp, Rattus norvegicus
accctgatctacagtgtacactctg

SEQ ID NO: 85208 - DNA, 25 bp, Rattus norvegicus
accctgatctactgtgtacactctg

SEQ ID NO: 85209 - DNA, 25 bp, Rattus norvegicus
accctgatgagaaaccatgtccatt

SEQ ID NO: 85210 - DNA, 25 bp, Rattus norvegicus
accctgatgagataccatgtccatt

SEQ ID NO: 85211 - DNA, 25 bp, Rattus norvegicus
accctgatgctgattcagtggctgt

SEQ ID NO: 85212 - DNA, 25 bp, Rattus norvegicus
accctgatgctgtttcagtggctgt

SEQ ID NO: 85213 - DNA, 25 bp, Rattus norvegicus
accctgatggctactccatgtatgg

SEQ ID NO: 85214 - DNA, 25 bp, Rattus norvegicus
accctgatggcttctccatgtatgg

SEQ ID NO: 85215 - DNA, 25 bp, Rattus norvegicus
accctgatgttgatctccgagcgac

SEQ ID NO: 85216 - DNA, 25 bp, Rattus norvegicus
accctgatgttgttctccgagcgac

SEQ ID NO: 85217 - DNA, 25 bp, Rattus norvegicus
accctgattaggaatgctgtagaca

SEQ ID NO: 85218 - DNA, 25 bp, Rattus norvegicus
accctgattaggtatgctgtagaca

SEQ ID NO: 85219 - DNA, 25 bp, Rattus norvegicus
accctgcaatgaagtggccaccctg

SEQ ID NO: 85220 - DNA, 25 bp, Rattus norvegicus
accctgcaatgatgtggccaccctg

SEQ ID NO: 85221 - DNA, 25 bp, Rattus norvegicus
accctgcactgtaactgacttgaga

SEQ ID NO: 85222 - DNA, 25 bp, Rattus norvegicus
accctgcactgttactgacttgaga

SEQ ID NO: 85223 - DNA, 25 bp, Rattus norvegicus
accctgcacttccttcttagaaatt

SEQ ID NO: 85224 - DNA, 25 bp, Rattus norvegicus
accctgcacttcgttcttagaaatt

SEQ ID NO: 85225 - DNA, 25 bp, Rattus norvegicus
accctgcagaacaggcgaggttgtg

SEQ ID NO: 85226 - DNA, 25 bp, Rattus norvegicus
accctgcagaactggcgaggttgtg

SEQ ID NO: 85227 - DNA, 25 bp, Rattus norvegicus
accctgcagagaacaatgtggagag

SEQ ID NO: 85228 - DNA, 25 bp, Rattus norvegicus
accctgcagagatcaatgtggagag

SEQ ID NO: 85229 - DNA, 25 bp, Rattus norvegicus
accctgcagggcacggtcagtgatg

SEQ ID NO: 85230 - DNA, 25 bp, Rattus norvegicus
accctgcagggctcggtcagtgatg

SEQ ID NO: 85231 - DNA, 25 bp, Rattus norvegicus
accctgcaggtaccatatttaatga

SEQ ID NO: 85232 - DNA, 25 bp, Rattus norvegicus
accctgcaggtagcatatttaatga

SEQ ID NO: 85233 - DNA, 25 bp, Rattus norvegicus
accctgcagtccaagtcggagtcag

SEQ ID NO: 85234 - DNA, 25 bp, Rattus norvegicus
accctgcagtcctagtcggagtcag

SEQ ID NO: 85235 - DNA, 25 bp, Rattus norvegicus
accctgcatgcactgtgtggtccca

SEQ ID NO: 85236 - DNA, 25 bp, Rattus norvegicus
accctgcatgcagtgtgtggtccca

SEQ ID NO: 85237 - DNA, 25 bp, Rattus norvegicus
accctgcatgtcagtactggatatt

SEQ ID NO: 85238 - DNA, 25 bp, Rattus norvegicus
accctgcatgtctgtactggatatt

SEQ ID NO: 85239 - DNA, 25 bp, Rattus norvegicus
accctgccaagcacactattgaatc

SEQ ID NO: 85240 - DNA, 25 bp, Rattus norvegicus
accctgccaagctcactattgaatc

SEQ ID NO: 85241 - DNA, 25 bp, Rattus norvegicus
accctgccatccaggtggtgaggaa

SEQ ID NO: 85242 - DNA, 25 bp, Rattus norvegicus
accctgccatcctggtggtgaggaa

SEQ ID NO: 85243 - DNA, 25 bp, Rattus norvegicus
accctgcccaagacagacagacaga

SEQ ID NO: 85244 - DNA, 25 bp, Rattus norvegicus
accctgcccaagtcagacagacaga

SEQ ID NO: 85245 - DNA, 25 bp, Rattus norvegicus
accctgccccatatagggagtagct

SEQ ID NO: 85246 - DNA, 25 bp, Rattus norvegicus
accctgccccatttagggagtagct

SEQ ID NO: 85247 - DNA, 25 bp, Rattus norvegicus
accctgccgtttaatgtgttgtctc

SEQ ID NO: 85248 - DNA, 25 bp, Rattus norvegicus
accctgccgttttatgtgttgtctc

SEQ ID NO: 85249 - DNA, 25 bp, Rattus norvegicus
accctgcctcacaccaagatggaaa

SEQ ID NO: 85250 - DNA, 25 bp, Rattus norvegicus
accctgcctcactccaagatggaaa

SEQ ID NO: 85251 - DNA, 25 bp, Rattus norvegicus
accctgcctcagcatctaagcagaa

SEQ ID NO: 85252 - DNA, 25 bp, Rattus norvegicus
accctgcctcaggatctaagcagaa

SEQ ID NO: 85253 - DNA, 25 bp, Rattus norvegicus
accctgcctccaattggtttaatgt

SEQ ID NO: 85254 - DNA, 25 bp, Rattus norvegicus
accctgcctccatttggtttaatgt

SEQ ID NO: 85255 - DNA, 25 bp, Rattus norvegicus
accctgcctttgatgctgtggaaga

SEQ ID NO: 85256 - DNA, 25 bp, Rattus norvegicus
accctgcctttgttgctgtggaaga

SEQ ID NO: 85257 - DNA, 25 bp, Rattus norvegicus
accctgcgcataacttactgtatag

SEQ ID NO: 85258 - DNA, 25 bp, Rattus norvegicus
accctgcgcatatcttactgtatag

SEQ ID NO: 85259 - DNA, 25 bp, Rattus norvegicus
accctgcggtaccttgaagagatta

SEQ ID NO: 85260 - DNA, 25 bp, Rattus norvegicus
accctgcggtacgttgaagagatta

SEQ ID NO: 85261 - DNA, 25 bp, Rattus norvegicus
accctgctacataatctaccgagaa

SEQ ID NO: 85262 - DNA, 25 bp, Rattus norvegicus
accctgctacattatctaccgagaa

SEQ ID NO: 85263 - DNA, 25 bp, Rattus norvegicus
accctgctgacgacacttgtgaagg

SEQ ID NO: 85264 - DNA, 25 bp, Rattus norvegicus
accctgctgacgtcacttgtgaagg

SEQ ID NO: 85265 - DNA, 25 bp, Rattus norvegicus
accctgctggacctgaacgagatgt

SEQ ID NO: 85266 - DNA, 25 bp, Rattus norvegicus
accctgctggacgtgaacgagatgt

SEQ ID NO: 85267 - DNA, 25 bp, Rattus norvegicus
accctgctggtcattgcttttgtct

SEQ ID NO: 85268 - DNA, 25 bp, Rattus norvegicus
accctgctggtctttgcttttgtct

SEQ ID NO: 85269 - DNA, 25 bp, Rattus norvegicus
accctgcttacaagaggtaccaaga

SEQ ID NO: 85270 - DNA, 25 bp, Rattus norvegicus
accctgcttacatgaggtaccaaga

SEQ ID NO: 85271 - DNA, 25 bp, Rattus norvegicus
accctgcttttaaatctgtcctttg

SEQ ID NO: 85272 - DNA, 25 bp, Rattus norvegicus
accctgcttttacgatatagacctt

SEQ ID NO: 85273 - DNA, 25 bp, Rattus norvegicus
accctgcttttaggatatagacctt

SEQ ID NO: 85274 - DNA, 25 bp, Rattus norvegicus
accctgcttttatatctgtcctttg

SEQ ID NO: 85275 - DNA, 25 bp, Rattus norvegicus
accctgcttttgctggtgtcctgca

SEQ ID NO: 85276 - DNA, 25 bp, Rattus norvegicus
accctgcttttggtggtgtcctgca

SEQ ID NO: 85277 - DNA, 25 bp, Rattus norvegicus
accctggaaagtatgcagtcgtgga

SEQ ID NO: 85278 - DNA, 25 bp, Rattus norvegicus
accctggaaagtttgcagtcgtgga

SEQ ID NO: 85279 - DNA, 25 bp, Rattus norvegicus
accctggaacccacatgttggaagg

SEQ ID NO: 85280 - DNA, 25 bp, Rattus norvegicus
accctggaaccctcatgttggaagg

SEQ ID NO: 85281 - DNA, 25 bp, Rattus norvegicus
accctggactcgctttctcaggttt

SEQ ID NO: 85282 - DNA, 25 bp, Rattus norvegicus
accctggactcggtttctcaggttt

SEQ ID NO: 85283 - DNA, 25 bp, Rattus norvegicus
accctggagacgattttgcctaatg

SEQ ID NO: 85284 - DNA, 25 bp, Rattus norvegicus
accctggagacgtttttgcctaatg

SEQ ID NO: 85285 - DNA, 25 bp, Rattus norvegicus
accctggagctgacttggctgaaac

SEQ ID NO: 85286 - DNA, 25 bp, Rattus norvegicus
accctggagctgtcttggctgaaac

SEQ ID NO: 85287 - DNA, 25 bp, Rattus norvegicus
accctggagcttcttacttctggag

SEQ ID NO: 85288 - DNA, 25 bp, Rattus norvegicus
accctggagcttgttacttctggag

SEQ ID NO: 85289 - DNA, 25 bp, Rattus norvegicus
accctggatcttcctgtattgttac

SEQ ID NO: 85290 - DNA, 25 bp, Rattus norvegicus
accctggatcttgctgtattgttac

SEQ ID NO: 85291 - DNA, 25 bp, Rattus norvegicus
accctggcactgcactaacatgcag

SEQ ID NO: 85292 - DNA, 25 bp, Rattus norvegicus
accctggcactggactaacatgcag

SEQ ID NO: 85293 - DNA, 25 bp, Rattus norvegicus
accctggcatacagtcgcatgtaca

SEQ ID NO: 85294 - DNA, 25 bp, Rattus norvegicus
accctggcatactgtcgcatgtaca

SEQ ID NO: 85295 - DNA, 25 bp, Rattus norvegicus
accctggcccaacactgaaaacagt

SEQ ID NO: 85296 - DNA, 25 bp, Rattus norvegicus
accctggcccaacttggagtctgaa

SEQ ID NO: 85297 - DNA, 25 bp, Rattus norvegicus
accctggcccaagactgaaaacagt

SEQ ID NO: 85298 - DNA, 25 bp, Rattus norvegicus
accctggcccaagttggagtctgaa

SEQ ID NO: 85299 - DNA, 25 bp, Rattus norvegicus
accctggctatcaggccctgggtga

SEQ ID NO: 85300 - DNA, 25 bp, Rattus norvegicus
accctggctatctggccctgggtga

SEQ ID NO: 85301 - DNA, 25 bp, Rattus norvegicus
accctggctctgcaagctgtgggat

SEQ ID NO: 85302 - DNA, 25 bp, Rattus norvegicus
accctggctctggaagctgtgggat

SEQ ID NO: 85303 - DNA, 25 bp, Rattus norvegicus
accctggctgctctcataaagtctg

SEQ ID NO: 85304 - DNA, 25 bp, Rattus norvegicus
accctggctgctgtcataaagtctg

SEQ ID NO: 85305 - DNA, 25 bp, Rattus norvegicus
accctggctgtaacagagcagagta

SEQ ID NO: 85306 - DNA, 25 bp, Rattus norvegicus
accctggctgtatcagagcagagta

SEQ ID NO: 85307 - DNA, 25 bp, Rattus norvegicus
accctgggaatcagcactggcggca

SEQ ID NO: 85308 - DNA, 25 bp, Rattus norvegicus
accctgggaatctgcactggcggca

SEQ ID NO: 85309 - DNA, 25 bp, Rattus norvegicus
accctgggaccaacctatttagatg

SEQ ID NO: 85310 - DNA, 25 bp, Rattus norvegicus
accctgggaccatcctatttagatg

SEQ ID NO: 85311 - DNA, 25 bp, Rattus norvegicus
accctgggagtcagctaagtgattt

SEQ ID NO: 85312 - DNA, 25 bp, Rattus norvegicus
accctgggagtctgctaagtgattt

SEQ ID NO: 85313 - DNA, 25 bp, Rattus norvegicus
accctgggcaccacatatgaacagt

SEQ ID NO: 85314 - DNA, 25 bp, Rattus norvegicus
accctgggcacctcatatgaacagt

SEQ ID NO: 85315 - DNA, 25 bp, Rattus norvegicus
accctgggcatcaactcttggaaat

SEQ ID NO: 85316 - DNA, 25 bp, Rattus norvegicus
accctgggcatctactcttggaaat

SEQ ID NO: 85317 - DNA, 25 bp, Rattus norvegicus
accctgggccctaagattattcttg

SEQ ID NO: 85318 - DNA, 25 bp, Rattus norvegicus
accctgggcccttagattattcttg

SEQ ID NO: 85319 - DNA, 25 bp, Rattus norvegicus
accctgggcggacgaattctgagtt

SEQ ID NO: 85320 - DNA, 25 bp, Rattus norvegicus
accctgggcggaggaattctgagtt

SEQ ID NO: 85321 - DNA, 25 bp, Rattus norvegicus
accctgggctggaggagcagtactt

SEQ ID NO: 85322 - DNA, 25 bp, Rattus norvegicus
accctgggctggagtaggcaaagtc

SEQ ID NO: 85323 - DNA, 25 bp, Rattus norvegicus
accctgggctggtggagcagtactt

SEQ ID NO: 85324 - DNA, 25 bp, Rattus norvegicus
accctgggctggtgtaggcaaagtc

SEQ ID NO: 85325 - DNA, 25 bp, Rattus norvegicus
accctgggtggcctttgagcaatct

SEQ ID NO: 85326 - DNA, 25 bp, Rattus norvegicus
accctgggtggcgtttgagcaatct

SEQ ID NO: 85327 - DNA, 25 bp, Rattus norvegicus
accctgggtgtacaagtcctgagca

SEQ ID NO: 85328 - DNA, 25 bp, Rattus norvegicus
accctgggtgtagaagtcctgagca

SEQ ID NO: 85329 - DNA, 25 bp, Rattus norvegicus
accctgggtgtccagatcctcgaaa

SEQ ID NO: 85330 - DNA, 25 bp, Rattus norvegicus
accctgggtgtcgagatcctcgaaa

SEQ ID NO: 85331 - DNA, 25 bp, Rattus norvegicus
accctggtaaccaatgtgaaagacg

SEQ ID NO: 85332 - DNA, 25 bp, Rattus norvegicus
accctggtaacctatgtgaaagacg

SEQ ID NO: 85333 - DNA, 25 bp, Rattus norvegicus
accctggtagaacacttacagctga

SEQ ID NO: 85334 - DNA, 25 bp, Rattus norvegicus
accctggtagaagacttacagctga

SEQ ID NO: 85335 - DNA, 25 bp, Rattus norvegicus
accctggtcacccatgagaatggag

SEQ ID NO: 85336 - DNA, 25 bp, Rattus norvegicus
accctggtcaccgatgagaatggag

SEQ ID NO: 85337 - DNA, 25 bp, Rattus norvegicus
accctggtcaggattgtggtcactc

SEQ ID NO: 85338 - DNA, 25 bp, Rattus norvegicus
accctggtcaggtttgtggtcactc

SEQ ID NO: 85339 - DNA, 25 bp, Rattus norvegicus
accctggtccacatcactgagaaat

SEQ ID NO: 85340 - DNA, 25 bp, Rattus norvegicus
accctggtccacttcactgagaaat

SEQ ID NO: 85341 - DNA, 25 bp, Rattus norvegicus
accctggtgtttcaggtggaactgc

SEQ ID NO: 85342 - DNA, 25 bp, Rattus norvegicus
accctggtgtttgaggtggaactgc

SEQ ID NO: 85343 - DNA, 25 bp, Rattus norvegicus
accctgtagcccagataggtcttga

SEQ ID NO: 85344 - DNA, 25 bp, Rattus norvegicus
accctgtagccctgataggtcttga

SEQ ID NO: 85345 - DNA, 25 bp, Rattus norvegicus
accctgtaggccaagatggcctcct

SEQ ID NO: 85346 - DNA, 25 bp, Rattus norvegicus
accctgtaggcctagatggcctcct

SEQ ID NO: 85347 - DNA, 25 bp, Rattus norvegicus
accctgtatgacaactcctcagtat

SEQ ID NO: 85348 - DNA, 25 bp, Rattus norvegicus
accctgtatgactactcctcagtat

SEQ ID NO: 85349 - DNA, 25 bp, Rattus norvegicus
accctgtcagtacttcgaggcttga

SEQ ID NO: 85350 - DNA, 25 bp, Rattus norvegicus
accctgtcagtagttcgaggcttga

SEQ ID NO: 85351 - DNA, 25 bp, Rattus norvegicus
accctgtccagccagcaaggtggta

SEQ ID NO: 85352 - DNA, 25 bp, Rattus norvegicus
accctgtccagcgagcaaggtggta

SEQ ID NO: 85353 - DNA, 25 bp, Rattus norvegicus
accctgtccggtattggcaaattca

SEQ ID NO: 85354 - DNA, 25 bp, Rattus norvegicus
accctgtccggttttggcaaattca

SEQ ID NO: 85355 - DNA, 25 bp, Rattus norvegicus
accctgtctccaaccaagtgagttg

SEQ ID NO: 85356 - DNA, 25 bp, Rattus norvegicus
accctgtctccatccaagtgagttg

SEQ ID NO: 85357 - DNA, 25 bp, Rattus norvegicus
accctgtctcgtcaaagagagaagg

SEQ ID NO: 85358 - DNA, 25 bp, Rattus norvegicus
accctgtctcgtgaaagagagaagg

SEQ ID NO: 85359 - DNA, 25 bp, Rattus norvegicus
accctgtctctcagagggaagcgag

SEQ ID NO: 85360 - DNA, 25 bp, Rattus norvegicus
accctgtctctctgagggaagcgag

SEQ ID NO: 85361 - DNA, 25 bp, Rattus norvegicus
accctgtcttccactcttataagaa

SEQ ID NO: 85362 - DNA, 25 bp, Rattus norvegicus
accctgtcttcctctcttataagaa

SEQ ID NO: 85363 - DNA, 25 bp, Rattus norvegicus
accctgtcttcgaggtagtcacatg

SEQ ID NO: 85364 - DNA, 25 bp, Rattus norvegicus
accctgtcttcgtggtagtcacatg

SEQ ID NO: 85365 - DNA, 25 bp, Rattus norvegicus
accctgtgcaggaaagcagctccct

SEQ ID NO: 85366 - DNA, 25 bp, Rattus norvegicus
accctgtgcaggtaagcagctccct

SEQ ID NO: 85367 - DNA, 25 bp, Rattus norvegicus
accctgtgcatactcttgggaggca

SEQ ID NO: 85368 - DNA, 25 bp, Rattus norvegicus
accctgtgcatagtcttgggaggca

SEQ ID NO: 85369 - DNA, 25 bp, Rattus norvegicus
accctgtgcatcagcgtttgtaatt

SEQ ID NO: 85370 - DNA, 25 bp, Rattus norvegicus
accctgtgcatctgcgtttgtaatt

SEQ ID NO: 85371 - DNA, 25 bp, Rattus norvegicus
accctgtgcttgcttgtggtgctaa

SEQ ID NO: 85372 - DNA, 25 bp, Rattus norvegicus
accctgtgcttggttgtggtgctaa

SEQ ID NO: 85373 - DNA, 25 bp, Rattus norvegicus
accctgtggccaatgcttctggcta

SEQ ID NO: 85374 - DNA, 25 bp, Rattus norvegicus
accctgtggccattgcttctggcta

SEQ ID NO: 85375 - DNA, 25 bp, Rattus norvegicus
accctgtggtgtacggtgggcaatt

SEQ ID NO: 85376 - DNA, 25 bp, Rattus norvegicus
accctgtggtgttcggtgggcaatt

SEQ ID NO: 85377 - DNA, 25 bp, Rattus norvegicus
accctgtgtctgagccgccggacag

SEQ ID NO: 85378 - DNA, 25 bp, Rattus norvegicus
accctgtgtctgtgccgccggacag

SEQ ID NO: 85379 - DNA, 25 bp, Rattus norvegicus
accctgtgtgccagtcggcatgaaa

SEQ ID NO: 85380 - DNA, 25 bp, Rattus norvegicus
accctgtgtgcctgtcggcatgaaa

SEQ ID NO: 85381 - DNA, 25 bp, Rattus norvegicus
accctgtgtgggaacatgtcattta

SEQ ID NO: 85382 - DNA, 25 bp, Rattus norvegicus
accctgtgtgggtacatgtcattta

SEQ ID NO: 85383 - DNA, 25 bp, Rattus norvegicus
accctgtgtggtagtgcacttgtaa

SEQ ID NO: 85384 - DNA, 25 bp, Rattus norvegicus
accctgtgtggttgtgcacttgtaa

SEQ ID NO: 85385 - DNA, 25 bp, Rattus norvegicus
accctgtgttgaacctgatgcatat

SEQ ID NO: 85386 - DNA, 25 bp, Rattus norvegicus
accctgtgttgaccggccattgctt

SEQ ID NO: 85387 - DNA, 25 bp, Rattus norvegicus
accctgtgttgagcggccattgctt

SEQ ID NO: 85388 - DNA, 25 bp, Rattus norvegicus
accctgtgttgatcctgatgcatat

SEQ ID NO: 85389 - DNA, 25 bp, Rattus norvegicus
accctgtgtttcctagtatgtgtga

SEQ ID NO: 85390 - DNA, 25 bp, Rattus norvegicus
accctgtgtttcgtagtatgtgtga

SEQ ID NO: 85391 - DNA, 25 bp, Rattus norvegicus
accctgttagcaatcattgttggac

SEQ ID NO: 85392 - DNA, 25 bp, Rattus norvegicus
accctgttagcattcattgttggac

SEQ ID NO: 85393 - DNA, 25 bp, Rattus norvegicus
accctgttcactcgagactttgttc

SEQ ID NO: 85394 - DNA, 25 bp, Rattus norvegicus
accctgttcactggagactttgttc

SEQ ID NO: 85395 - DNA, 25 bp, Rattus norvegicus
accctgttcatgatatctgtaccta

SEQ ID NO: 85396 - DNA, 25 bp, Rattus norvegicus
accctgttcatgttatctgtaccta

SEQ ID NO: 85397 - DNA, 25 bp, Rattus norvegicus
accctgttctccagagctggaatga

SEQ ID NO: 85398 - DNA, 25 bp, Rattus norvegicus
accctgttctcctgagctggaatga

SEQ ID NO: 85399 - DNA, 25 bp, Rattus norvegicus
accctgttgcgcagtagtcggattc

SEQ ID NO: 85400 - DNA, 25 bp, Rattus norvegicus
accctgttgcgctgtagtcggattc

SEQ ID NO: 85401 - DNA, 25 bp, Rattus norvegicus
accctgtttcttatgtctcctggag

SEQ ID NO: 85402 - DNA, 25 bp, Rattus norvegicus
accctgtttcttttgtctcctggag

SEQ ID NO: 85403 - DNA, 25 bp, Rattus norvegicus
accctgttttgcagctttaagctgc

SEQ ID NO: 85404 - DNA, 25 bp, Rattus norvegicus
accctgttttgctgctttaagctgc

SEQ ID NO: 85405 - DNA, 25 bp, Rattus norvegicus
accctgttttgtaaagatggcttct

SEQ ID NO: 85406 - DNA, 25 bp, Rattus norvegicus
accctgttttgttaagatggcttct

SEQ ID NO: 85407 - DNA, 25 bp, Rattus norvegicus
acccttaccgccactggtgatagga

SEQ ID NO: 85408 - DNA, 25 bp, Rattus norvegicus
acccttaccgcctctggtgatagga

SEQ ID NO: 85409 - DNA, 25 bp, Rattus norvegicus
acccttactatcacagagagtaatt

SEQ ID NO: 85410 - DNA, 25 bp, Rattus norvegicus
acccttactatctcagagagtaatt

SEQ ID NO: 85411 - DNA, 25 bp, Rattus norvegicus
acccttactctccaaaaattgatgg

SEQ ID NO: 85412 - DNA, 25 bp, Rattus norvegicus
acccttactctcgaaaaattgatgg

SEQ ID NO: 85413 - DNA, 25 bp, Rattus norvegicus
acccttacttctacactgtcgtgaa

SEQ ID NO: 85414 - DNA, 25 bp, Rattus norvegicus
acccttacttcttcactgtcgtgaa

SEQ ID NO: 85415 - DNA, 25 bp, Rattus norvegicus
acccttagatcaaacgtggacttat

SEQ ID NO: 85416 - DNA, 25 bp, Rattus norvegicus
acccttagatcatacgtggacttat

SEQ ID NO: 85417 - DNA, 25 bp, Rattus norvegicus
acccttagccttactctgaagataa

SEQ ID NO: 85418 - DNA, 25 bp, Rattus norvegicus
acccttagcctttctctgaagataa

SEQ ID NO: 85419 - DNA, 25 bp, Rattus norvegicus
acccttagcttgagagtgtgatcca

SEQ ID NO: 85420 - DNA, 25 bp, Rattus norvegicus
acccttagcttgtgagtgtgatcca

SEQ ID NO: 85421 - DNA, 25 bp, Rattus norvegicus
acccttattcaactggctgtcttag

SEQ ID NO: 85422 - DNA, 25 bp, Rattus norvegicus
acccttattcaagtggctgtcttag

SEQ ID NO: 85423 - DNA, 25 bp, Rattus norvegicus
acccttattttgatatccaatatga

SEQ ID NO: 85424 - DNA, 25 bp, Rattus norvegicus
acccttattttgttatccaatatga

SEQ ID NO: 85425 - DNA, 25 bp, Rattus norvegicus
acccttcctgaaccaacgagcatat

SEQ ID NO: 85426 - DNA, 25 bp, Rattus norvegicus
acccttcctgaagcaacgagcatat

SEQ ID NO: 85427 - DNA, 25 bp, Rattus norvegicus
acccttccttgacctgttgctgtac

SEQ ID NO: 85428 - DNA, 25 bp, Rattus norvegicus
acccttccttgagctgttgctgtac

SEQ ID NO: 85429 - DNA, 25 bp, Rattus norvegicus
acccttcggcatcatgacagacatt

SEQ ID NO: 85430 - DNA, 25 bp, Rattus norvegicus
acccttcggcatgatgacagacatt

SEQ ID NO: 85431 - DNA, 25 bp, Rattus norvegicus
acccttcgtactactttgatctttg

SEQ ID NO: 85432 - DNA, 25 bp, Rattus norvegicus
acccttcgtacttctttgatctttg

SEQ ID NO: 85433 - DNA, 25 bp, Rattus norvegicus
acccttctagctatttgaccttgtg

SEQ ID NO: 85434 - DNA, 25 bp, Rattus norvegicus
acccttctagctttttgaccttgtg

SEQ ID NO: 85435 - DNA, 25 bp, Rattus norvegicus
acccttctctgcacattaaaactgt

SEQ ID NO: 85436 - DNA, 25 bp, Rattus norvegicus
acccttctctgctcattaaaactgt

SEQ ID NO: 85437 - DNA, 25 bp, Rattus norvegicus
acccttctctgtcctttgggataat

SEQ ID NO: 85438 - DNA, 25 bp, Rattus norvegicus
acccttctctgtgctttgggataat

SEQ ID NO: 85439 - DNA, 25 bp, Rattus norvegicus
acccttctgagtcttgtaattgttg

SEQ ID NO: 85440 - DNA, 25 bp, Rattus norvegicus
acccttctgagtgttgtaattgttg

SEQ ID NO: 85441 - DNA, 25 bp, Rattus norvegicus
acccttctggagcttatcccgatga

SEQ ID NO: 85442 - DNA, 25 bp, Rattus norvegicus
acccttctggaggttatcccgatga

SEQ ID NO: 85443 - DNA, 25 bp, Rattus norvegicus
acccttcttaaacattttggagcag

SEQ ID NO: 85444 - DNA, 25 bp, Rattus norvegicus
acccttcttaaagattttggagcag

SEQ ID NO: 85445 - DNA, 25 bp, Rattus norvegicus
acccttcttaagatgtggttagatg

SEQ ID NO: 85446 - DNA, 25 bp, Rattus norvegicus
acccttcttaagttgtggttagatg

SEQ ID NO: 85447 - DNA, 25 bp, Rattus norvegicus
acccttcttcctaatatgcgagtgg

SEQ ID NO: 85448 - DNA, 25 bp, Rattus norvegicus
acccttcttccttatatgcgagtgg

SEQ ID NO: 85449 - DNA, 25 bp, Rattus norvegicus
acccttcttggtcctgatttcattc

SEQ ID NO: 85450 - DNA, 25 bp, Rattus norvegicus
acccttcttggtgctgatttcattc

SEQ ID NO: 85451 - DNA, 25 bp, Rattus norvegicus
acccttctttgtatccagtcaggaa

SEQ ID NO: 85452 - DNA, 25 bp, Rattus norvegicus
acccttctttgtttccagtcaggaa

SEQ ID NO: 85453 - DNA, 25 bp, Rattus norvegicus
acccttgaacctcaatcccatgtgg

SEQ ID NO: 85454 - DNA, 25 bp, Rattus norvegicus
acccttgaacctgaatcccatgtgg

SEQ ID NO: 85455 - DNA, 25 bp, Rattus norvegicus
acccttgaagctccttatgctggga

SEQ ID NO: 85456 - DNA, 25 bp, Rattus norvegicus
acccttgaagctgcttatgctggga

SEQ ID NO: 85457 - DNA, 25 bp, Rattus norvegicus
acccttgagctacgtgtagttacac

SEQ ID NO: 85458 - DNA, 25 bp, Rattus norvegicus
acccttgagctaggtgtagttacac

SEQ ID NO: 85459 - DNA, 25 bp, Rattus norvegicus
acccttgagggcagctgtgtccatg

SEQ ID NO: 85460 - DNA, 25 bp, Rattus norvegicus
acccttgagggctgctgtgtccatg

SEQ ID NO: 85461 - DNA, 25 bp, Rattus norvegicus
acccttgaggtcatcactggagctg

SEQ ID NO: 85462 - DNA, 25 bp, Rattus norvegicus
acccttgaggtcttcactggagctg

SEQ ID NO: 85463 - DNA, 25 bp, Rattus norvegicus
acccttgcatccctagttgtgtttg

SEQ ID NO: 85464 - DNA, 25 bp, Rattus norvegicus
acccttgcatccgtagttgtgtttg

SEQ ID NO: 85465 - DNA, 25 bp, Rattus norvegicus
acccttgccataatagaatccacca

SEQ ID NO: 85466 - DNA, 25 bp, Rattus norvegicus
acccttgccatattagaatccacca

SEQ ID NO: 85467 - DNA, 25 bp, Rattus norvegicus
acccttgccgcaacagtttggagag

SEQ ID NO: 85468 - DNA, 25 bp, Rattus norvegicus
acccttgccgcatcagtttggagag

SEQ ID NO: 85469 - DNA, 25 bp, Rattus norvegicus
acccttgctgtcaggattatttcca

SEQ ID NO: 85470 - DNA, 25 bp, Rattus norvegicus
acccttgctgtctggattatttcca

SEQ ID NO: 85471 - DNA, 25 bp, Rattus norvegicus
acccttggaggtctctgcagctggc

SEQ ID NO: 85472 - DNA, 25 bp, Rattus norvegicus
acccttggaggtgtctgcagctggc

SEQ ID NO: 85473 - DNA, 25 bp, Rattus norvegicus
acccttggcccaactgtataatttt

SEQ ID NO: 85474 - DNA, 25 bp, Rattus norvegicus
acccttggcccatctgtataatttt

SEQ ID NO: 85475 - DNA, 25 bp, Rattus norvegicus
acccttggctgtctggtgagttcca

SEQ ID NO: 85476 - DNA, 25 bp, Rattus norvegicus
acccttggctgtgtggtgagttcca

SEQ ID NO: 85477 - DNA, 25 bp, Rattus norvegicus
acccttggtctcaccagtggtccac

SEQ ID NO: 85478 - DNA, 25 bp, Rattus norvegicus
acccttggtctctccagtggtccac

SEQ ID NO: 85479 - DNA, 25 bp, Rattus norvegicus
acccttgtatccagggtcttagaga

SEQ ID NO: 85480 - DNA, 25 bp, Rattus norvegicus
acccttgtatcctgggtcttagaga

SEQ ID NO: 85481 - DNA, 25 bp, Rattus norvegicus
acccttgtccagcaaaatgagcctc

SEQ ID NO: 85482 - DNA, 25 bp, Rattus norvegicus
acccttgtccaggaaaatgagcctc

SEQ ID NO: 85483 - DNA, 25 bp, Rattus norvegicus
acccttgtgttaattccatgtccca

SEQ ID NO: 85484 - DNA, 25 bp, Rattus norvegicus
acccttgtgttatttccatgtccca

SEQ ID NO: 85485 - DNA, 25 bp, Rattus norvegicus
acccttgttctacatggttctccat

SEQ ID NO: 85486 - DNA, 25 bp, Rattus norvegicus
acccttgttctagatggttctccat

SEQ ID NO: 85487 - DNA, 25 bp, Rattus norvegicus
accctttaggtaacacctctacaga

SEQ ID NO: 85488 - DNA, 25 bp, Rattus norvegicus
accctttaggtatcacctctacaga

SEQ ID NO: 85489 - DNA, 25 bp, Rattus norvegicus
accctttatcctaatgtgaccagag

SEQ ID NO: 85490 - DNA, 25 bp, Rattus norvegicus
accctttatccttatgtgaccagag

SEQ ID NO: 85491 - DNA, 25 bp, Rattus norvegicus
accctttatggaagcagccctttag

SEQ ID NO: 85492 - DNA, 25 bp, Rattus norvegicus
accctttatggatgcagccctttag

SEQ ID NO: 85493 - DNA, 25 bp, Rattus norvegicus
accctttcacttacctgacatgtag

SEQ ID NO: 85494 - DNA, 25 bp, Rattus norvegicus
accctttcactttcctgacatgtag

SEQ ID NO: 85495 - DNA, 25 bp, Rattus norvegicus
accctttcaggtctgacctctttgg

SEQ ID NO: 85496 - DNA, 25 bp, Rattus norvegicus
accctttcaggtgtgacctctttgg

SEQ ID NO: 85497 - DNA, 25 bp, Rattus norvegicus
accctttcagtaaagtctcctcaga

SEQ ID NO: 85498 - DNA, 25 bp, Rattus norvegicus
accctttcagtatagtctcctcaga

SEQ ID NO: 85499 - DNA, 25 bp, Rattus norvegicus
accctttcattcactgttcgttcaa

SEQ ID NO: 85500 - DNA, 25 bp, Rattus norvegicus
accctttcattctctgttcgttcaa

SEQ ID NO: 85501 - DNA, 25 bp, Rattus norvegicus
accctttcctatcatgggctccaaa

SEQ ID NO: 85502 - DNA, 25 bp, Rattus norvegicus
accctttcctatgatgggctccaaa

SEQ ID NO: 85503 - DNA, 25 bp, Rattus norvegicus
accctttccttactaattgtgatca

SEQ ID NO: 85504 - DNA, 25 bp, Rattus norvegicus
accctttccttagtaattgtgatca

SEQ ID NO: 85505 - DNA, 25 bp, Rattus norvegicus
accctttcttgtctacagttctgtg

SEQ ID NO: 85506 - DNA, 25 bp, Rattus norvegicus
accctttcttgtgtacagttctgtg

SEQ ID NO: 85507 - DNA, 25 bp, Rattus norvegicus
accctttgacttctgtctgatggac

SEQ ID NO: 85508 - DNA, 25 bp, Rattus norvegicus
accctttgacttgtgtctgatggac

SEQ ID NO: 85509 - DNA, 25 bp, Rattus norvegicus
accctttgcctcaggttgaccatga

SEQ ID NO: 85510 - DNA, 25 bp, Rattus norvegicus
accctttgcctctggttgaccatga

SEQ ID NO: 85511 - DNA, 25 bp, Rattus norvegicus
accctttgctccagcgatatcttaa

SEQ ID NO: 85512 - DNA, 25 bp, Rattus norvegicus
accctttgctcctgcgatatcttaa

SEQ ID NO: 85513 - DNA, 25 bp, Rattus norvegicus
accctttggctgcttctaagacttg

SEQ ID NO: 85514 - DNA, 25 bp, Rattus norvegicus
accctttggctggttctaagacttg

SEQ ID NO: 85515 - DNA, 25 bp, Rattus norvegicus
accctttgggtaactcatagcgttt

SEQ ID NO: 85516 - DNA, 25 bp, Rattus norvegicus
accctttgggtatctcatagcgttt

SEQ ID NO: 85517 - DNA, 25 bp, Rattus norvegicus
accctttgtggtaactgatctccgc

SEQ ID NO: 85518 - DNA, 25 bp, Rattus norvegicus
accctttgtggtccccataaactca

SEQ ID NO: 85519 - DNA, 25 bp, Rattus norvegicus
accctttgtggtgcccataaactca

SEQ ID NO: 85520 - DNA, 25 bp, Rattus norvegicus
accctttgtggttactgatctccgc

SEQ ID NO: 85521 - DNA, 25 bp, Rattus norvegicus
accctttgtgtaaacgtgggagaca

SEQ ID NO: 85522 - DNA, 25 bp, Rattus norvegicus
accctttgtgtatacgtgggagaca

SEQ ID NO: 85523 - DNA, 25 bp, Rattus norvegicus
acccttttaatcacactgtgtgtgg

SEQ ID NO: 85524 - DNA, 25 bp, Rattus norvegicus
acccttttaatctcactgtgtgtgg

SEQ ID NO: 85525 - DNA, 25 bp, Rattus norvegicus
acccttttatgcatcaatgtgcctt

SEQ ID NO: 85526 - DNA, 25 bp, Rattus norvegicus
acccttttatgcttcaatgtgcctt

SEQ ID NO: 85527 - DNA, 25 bp, Rattus norvegicus
acccttttgctaaatgttctccaga

SEQ ID NO: 85528 - DNA, 25 bp, Rattus norvegicus
acccttttgctatatgttctccaga

SEQ ID NO: 85529 - DNA, 25 bp, Rattus norvegicus
acccttttgtatctgaacacgtctc

SEQ ID NO: 85530 - DNA, 25 bp, Rattus norvegicus
acccttttgtatgtgaacacgtctc

SEQ ID NO: 85531 - DNA, 25 bp, Rattus norvegicus
acccttttttatcctgcgatgtcat

SEQ ID NO: 85532 - DNA, 25 bp, Rattus norvegicus
acccttttttatgctgcgatgtcat

SEQ ID NO: 85533 - DNA, 25 bp, Rattus norvegicus
accgaaaccgcacgctcatgatgga

SEQ ID NO: 85534 - DNA, 25 bp, Rattus norvegicus
accgaaaccgcaggctcatgatgga

SEQ ID NO: 85535 - DNA, 25 bp, Rattus norvegicus
accgaaagctataggtcggcttctt

SEQ ID NO: 85536 - DNA, 25 bp, Rattus norvegicus
accgaaagctattggtcggcttctt

SEQ ID NO: 85537 - DNA, 25 bp, Rattus norvegicus
accgaacccaacaagcttctatgtg

SEQ ID NO: 85538 - DNA, 25 bp, Rattus norvegicus
accgaacccaactagcttctatgtg

SEQ ID NO: 85539 - DNA, 25 bp, Rattus norvegicus
accgaacccatgacctctacaagaa

SEQ ID NO: 85540 - DNA, 25 bp, Rattus norvegicus
accgaacccatgtcctctacaagaa

SEQ ID NO: 85541 - DNA, 25 bp, Rattus norvegicus
accgaacgttatatttgctctatga

SEQ ID NO: 85542 - DNA, 25 bp, Rattus norvegicus
accgaacgttatttttgctctatga

SEQ ID NO: 85543 - DNA, 25 bp, Rattus norvegicus
accgaactgagtcttggagtgtcca

SEQ ID NO: 85544 - DNA, 25 bp, Rattus norvegicus
accgaactgagtgttggagtgtcca

SEQ ID NO: 85545 - DNA, 25 bp, Rattus norvegicus
accgaactggtgaagagcaagctca

SEQ ID NO: 85546 - DNA, 25 bp, Rattus norvegicus
accgaactggtgtagagcaagctca

SEQ ID NO: 85547 - DNA, 25 bp, Rattus norvegicus
accgaacttctcaatgtctgcatgg

SEQ ID NO: 85548 - DNA, 25 bp, Rattus norvegicus
accgaacttctctatgtctgcatgg

SEQ ID NO: 85549 - DNA, 25 bp, Rattus norvegicus
accgaagaattcaccttttggcctg

SEQ ID NO: 85550 - DNA, 25 bp, Rattus norvegicus
accgaagaattctccttttggcctg

SEQ ID NO: 85551 - DNA, 25 bp, Rattus norvegicus
accgaagacacgaaggcagcctgat

SEQ ID NO: 85552 - DNA, 25 bp, Rattus norvegicus
accgaagacacgtaggcagcctgat

SEQ ID NO: 85553 - DNA, 25 bp, Rattus norvegicus
accgaagataatcgtttcccagctt

SEQ ID NO: 85554 - DNA, 25 bp, Rattus norvegicus
accgaagataatggtttcccagctt

SEQ ID NO: 85555 - DNA, 25 bp, Rattus norvegicus
accgaagataccatctctccggatt

SEQ ID NO: 85556 - DNA, 25 bp, Rattus norvegicus
accgaagataccttctctccggatt

SEQ ID NO: 85557 - DNA, 25 bp, Rattus norvegicus
accgaagattcacacatggattccg

SEQ ID NO: 85558 - DNA, 25 bp, Rattus norvegicus
accgaagattcagacatggattccg

SEQ ID NO: 85559 - DNA, 25 bp, Rattus norvegicus
accgaagccttgaacagccaagcaa

SEQ ID NO: 85560 - DNA, 25 bp, Rattus norvegicus
accgaagccttgtacagccaagcaa

SEQ ID NO: 85561 - DNA, 25 bp, Rattus norvegicus
accgaagctgcacctgacgtcagtg

SEQ ID NO: 85562 - DNA, 25 bp, Rattus norvegicus
accgaagctgcagctgacgtcagtg

SEQ ID NO: 85563 - DNA, 25 bp, Rattus norvegicus
accgaagctgtcattgagctgcaca

SEQ ID NO: 85564 - DNA, 25 bp, Rattus norvegicus
accgaagctgtctttgagctgcaca

SEQ ID NO: 85565 - DNA, 25 bp, Rattus norvegicus
accgaaggatttctggaggcgtcca

SEQ ID NO: 85566 - DNA, 25 bp, Rattus norvegicus
accgaaggatttgtggaggcgtcca

SEQ ID NO: 85567 - DNA, 25 bp, Rattus norvegicus
accgaagggagtacttacatgaaga

SEQ ID NO: 85568 - DNA, 25 bp, Rattus norvegicus
accgaagggagttcttacatgaaga

SEQ ID NO: 85569 - DNA, 25 bp, Rattus norvegicus
accgaagttctgctgtgctttctct

SEQ ID NO: 85570 - DNA, 25 bp, Rattus norvegicus
accgaagttctggtgtgctttctct

SEQ ID NO: 85571 - DNA, 25 bp, Rattus norvegicus
accgaatccagtctagggcctttga

SEQ ID NO: 85572 - DNA, 25 bp, Rattus norvegicus
accgaatccagtgtagggcctttga

SEQ ID NO: 85573 - DNA, 25 bp, Rattus norvegicus
accgaatgcgaaactttgcacccaa

SEQ ID NO: 85574 - DNA, 25 bp, Rattus norvegicus
accgaatgcgaatctttgcacccaa

SEQ ID NO: 85575 - DNA, 25 bp, Rattus norvegicus
accgaatgcggcagccggtgatgtc

SEQ ID NO: 85576 - DNA, 25 bp, Rattus norvegicus
accgaatgcggctgccggtgatgtc

SEQ ID NO: 85577 - DNA, 25 bp, Rattus norvegicus
accgaatgtgtcattagctagccct

SEQ ID NO: 85578 - DNA, 25 bp, Rattus norvegicus
accgaatgtgtctttagctagccct

SEQ ID NO: 85579 - DNA, 25 bp, Rattus norvegicus
accgaatgttcgatgtttgtagcgt

SEQ ID NO: 85580 - DNA, 25 bp, Rattus norvegicus
accgaatgttcgttgtttgtagcgt

SEQ ID NO: 85581 - DNA, 25 bp, Rattus norvegicus
accgaattcatgacagtctcagcac

SEQ ID NO: 85582 - DNA, 25 bp, Rattus norvegicus
accgaattcatgtcagtctcagcac

SEQ ID NO: 85583 - DNA, 25 bp, Rattus norvegicus
accgaatttcttcgcctgcaagata

SEQ ID NO: 85584 - DNA, 25 bp, Rattus norvegicus
accgaatttcttggcctgcaagata

SEQ ID NO: 85585 - DNA, 25 bp, Rattus norvegicus
accgaatttgatctccatgacctga

SEQ ID NO: 85586 - DNA, 25 bp, Rattus norvegicus
accgaatttgatgtccatgacctga

SEQ ID NO: 85587 - DNA, 25 bp, Rattus norvegicus
accgacaccagtaacatccagtttg

SEQ ID NO: 85588 - DNA, 25 bp, Rattus norvegicus
accgacaccagttacatccagtttg

SEQ ID NO: 85589 - DNA, 25 bp, Rattus norvegicus
accgacactgccagggcgcctagaa

SEQ ID NO: 85590 - DNA, 25 bp, Rattus norvegicus
accgacactgcctgggcgcctagaa

SEQ ID NO: 85591 - DNA, 25 bp, Rattus norvegicus
accgacagggttatgtgtcttcact

SEQ ID NO: 85592 - DNA, 25 bp, Rattus norvegicus
accgacagggttttgtgtcttcact

SEQ ID NO: 85593 - DNA, 25 bp, Rattus norvegicus
accgacatccctctagtgtgtttag

SEQ ID NO: 85594 - DNA, 25 bp, Rattus norvegicus
accgacatccctgtagtgtgtttag

SEQ ID NO: 85595 - DNA, 25 bp, Rattus norvegicus
accgacatgtgtcaccgtactgtga

SEQ ID NO: 85596 - DNA, 25 bp, Rattus norvegicus
accgacatgtgtgaccgtactgtga

SEQ ID NO: 85597 - DNA, 25 bp, Rattus norvegicus
accgacattttacttctgtgtgtga

SEQ ID NO: 85598 - DNA, 25 bp, Rattus norvegicus
accgacattttagttctgtgtgtga

SEQ ID NO: 85599 - DNA, 25 bp, Rattus norvegicus
accgaccaaattaagctcttccttg

SEQ ID NO: 85600 - DNA, 25 bp, Rattus norvegicus
accgaccaaatttagctcttccttg

SEQ ID NO: 85601 - DNA, 25 bp, Rattus norvegicus
accgaccggcggacagctgtggact

SEQ ID NO: 85602 - DNA, 25 bp, Rattus norvegicus
accgaccggcggtcagctgtggact

SEQ ID NO: 85603 - DNA, 25 bp, Rattus norvegicus
accgaccttgcccttggatgaaatg

SEQ ID NO: 85604 - DNA, 25 bp, Rattus norvegicus
accgaccttgccgttggatgaaatg

SEQ ID NO: 85605 - DNA, 25 bp, Rattus norvegicus
accgacgactaccaagatactgtgt

SEQ ID NO: 85606 - DNA, 25 bp, Rattus norvegicus
accgacgactacgaagatactgtgt

SEQ ID NO: 85607 - DNA, 25 bp, Rattus norvegicus
accgacgatctcactcgggtgtgaa

SEQ ID NO: 85608 - DNA, 25 bp, Rattus norvegicus
accgacgatctctctcgggtgtgaa

SEQ ID NO: 85609 - DNA, 25 bp, Rattus norvegicus
accgacgcatggactatgttgctac

SEQ ID NO: 85610 - DNA, 25 bp, Rattus norvegicus
accgacgcatggtctatgttgctac

SEQ ID NO: 85611 - DNA, 25 bp, Rattus norvegicus
accgactacatccaaacatcactag

SEQ ID NO: 85612 - DNA, 25 bp, Rattus norvegicus
accgactacatcgaaacatcactag

SEQ ID NO: 85613 - DNA, 25 bp, Rattus norvegicus
accgactaccggatgcgctgaggag

SEQ ID NO: 85614 - DNA, 25 bp, Rattus norvegicus
accgactaccggttgcgctgaggag

SEQ ID NO: 85615 - DNA, 25 bp, Rattus norvegicus
accgactgtggcatcaacctgaaac

SEQ ID NO: 85616 - DNA, 25 bp, Rattus norvegicus
accgactgtggcttcaacctgaaac

SEQ ID NO: 85617 - DNA, 25 bp, Rattus norvegicus
accgacttccagctgatgtgcgtgg

SEQ ID NO: 85618 - DNA, 25 bp, Rattus norvegicus
accgacttccaggtgatgtgcgtgg

SEQ ID NO: 85619 - DNA, 25 bp, Rattus norvegicus
accgactttggtcaagcctcacaga

SEQ ID NO: 85620 - DNA, 25 bp, Rattus norvegicus
accgactttggtgaagcctcacaga

SEQ ID NO: 85621 - DNA, 25 bp, Rattus norvegicus
accgagaagttcatgcgcgcctggg

SEQ ID NO: 85622 - DNA, 25 bp, Rattus norvegicus
accgagaagttcttgcgcgcctggg

SEQ ID NO: 85623 - DNA, 25 bp, Rattus norvegicus
accgagaattcacgagaccccagtg

SEQ ID NO: 85624 - DNA, 25 bp, Rattus norvegicus
accgagaattcaggagaccccagtg

SEQ ID NO: 85625 - DNA, 25 bp, Rattus norvegicus
accgagaccgatctatatgcttgca

SEQ ID NO: 85626 - DNA, 25 bp, Rattus norvegicus
accgagaccgatgtatatgcttgca

SEQ ID NO: 85627 - DNA, 25 bp, Rattus norvegicus
accgagaccgctatgggagcagcag

SEQ ID NO: 85628 - DNA, 25 bp, Rattus norvegicus
accgagaccgctttgggagcagcag

SEQ ID NO: 85629 - DNA, 25 bp, Rattus norvegicus
accgagacttcccagcctgagtgtg

SEQ ID NO: 85630 - DNA, 25 bp, Rattus norvegicus
accgagacttccgagcctgagtgtg

SEQ ID NO: 85631 - DNA, 25 bp, Rattus norvegicus
accgagagagagcattagttccact

SEQ ID NO: 85632 - DNA, 25 bp, Rattus norvegicus
accgagagagaggattagttccact

SEQ ID NO: 85633 - DNA, 25 bp, Rattus norvegicus
accgagagggttatccaagccacca

SEQ ID NO: 85634 - DNA, 25 bp, Rattus norvegicus
accgagagggttttccaagccacca

SEQ ID NO: 85635 - DNA, 25 bp, Rattus norvegicus
accgagagtgtgcacccgtttctag

SEQ ID NO: 85636 - DNA, 25 bp, Rattus norvegicus
accgagagtgtggacccgtttctag

SEQ ID NO: 85637 - DNA, 25 bp, Rattus norvegicus
accgagatgcctcgcagagtgagat

SEQ ID NO: 85638 - DNA, 25 bp, Rattus norvegicus
accgagatgcctggcagagtgagat

SEQ ID NO: 85639 - DNA, 25 bp, Rattus norvegicus
accgagatggcgacgttggagacta

SEQ ID NO: 85640 - DNA, 25 bp, Rattus norvegicus
accgagatggcgtcgttggagacta

SEQ ID NO: 85641 - DNA, 25 bp, Rattus norvegicus
accgagcagtccagggttcccaggg

SEQ ID NO: 85642 - DNA, 25 bp, Rattus norvegicus
accgagcagtcctgggttcccaggg

SEQ ID NO: 85643 - DNA, 25 bp, Rattus norvegicus
accgagccactgcactgtgaggtca

SEQ ID NO: 85644 - DNA, 25 bp, Rattus norvegicus
accgagccactggactgtgaggtca

SEQ ID NO: 85645 - DNA, 25 bp, Rattus norvegicus
accgagcccatgctgtgacagttga

SEQ ID NO: 85646 - DNA, 25 bp, Rattus norvegicus
accgagcccatggtgtgacagttga

SEQ ID NO: 85647 - DNA, 25 bp, Rattus norvegicus
accgagccctgtctgagacgtggaa

SEQ ID NO: 85648 - DNA, 25 bp, Rattus norvegicus
accgagccctgtgtgagacgtggaa

SEQ ID NO: 85649 - DNA, 25 bp, Rattus norvegicus
accgagcccttccttatagatggac

SEQ ID NO: 85650 - DNA, 25 bp, Rattus norvegicus
accgagcccttcgttatagatggac

SEQ ID NO: 85651 - DNA, 25 bp, Rattus norvegicus
accgagcctggcagttagaaccaag

SEQ ID NO: 85652 - DNA, 25 bp, Rattus norvegicus
accgagcctggctgttagaaccaag

SEQ ID NO: 85653 - DNA, 25 bp, Rattus norvegicus
accgagcgatatccatctctgatga

SEQ ID NO: 85654 - DNA, 25 bp, Rattus norvegicus
accgagcgatatgcatctctgatga

SEQ ID NO: 85655 - DNA, 25 bp, Rattus norvegicus
accgagcgtcgcacctggacagagc

SEQ ID NO: 85656 - DNA, 25 bp, Rattus norvegicus
accgagcgtcgctcctggacagagc

SEQ ID NO: 85657 - DNA, 25 bp, Rattus norvegicus
accgagctccagagccaaccgggag

SEQ ID NO: 85658 - DNA, 25 bp, Rattus norvegicus
accgagctccagtgccaaccgggag

SEQ ID NO: 85659 - DNA, 25 bp, Rattus norvegicus
accgagctgaggagtccgtctccat

SEQ ID NO: 85660 - DNA, 25 bp, Rattus norvegicus
accgagctgaggtgtccgtctccat

SEQ ID NO: 85661 - DNA, 25 bp, Rattus norvegicus
accgagctggccaaatgtcacaata

SEQ ID NO: 85662 - DNA, 25 bp, Rattus norvegicus
accgagctggcctaatgtcacaata

SEQ ID NO: 85663 - DNA, 25 bp, Rattus norvegicus
accgagctgttcagggccagggcat

SEQ ID NO: 85664 - DNA, 25 bp, Rattus norvegicus
accgagctgttctgggccagggcat

SEQ ID NO: 85665 - DNA, 25 bp, Rattus norvegicus
accgagcttagccagtgagatccag

SEQ ID NO: 85666 - DNA, 25 bp, Rattus norvegicus
accgagcttagcgagtgagatccag

SEQ ID NO: 85667 - DNA, 25 bp, Rattus norvegicus
accgaggaaaggctgcactgctgtt

SEQ ID NO: 85668 - DNA, 25 bp, Rattus norvegicus
accgaggaaagggtgcactgctgtt

SEQ ID NO: 85669 - DNA, 25 bp, Rattus norvegicus
accgaggaggagagcctttcagcaa

SEQ ID NO: 85670 - DNA, 25 bp, Rattus norvegicus
accgaggaggagtgcctttcagcaa

SEQ ID NO: 85671 - DNA, 25 bp, Rattus norvegicus
accgaggcagttaccatgagagccc

SEQ ID NO: 85672 - DNA, 25 bp, Rattus norvegicus
accgaggcagtttccatgagagccc

SEQ ID NO: 85673 - DNA, 25 bp, Rattus norvegicus
accgaggcatagcacttgttgtgac

SEQ ID NO: 85674 - DNA, 25 bp, Rattus norvegicus
accgaggcataggacttgttgtgac

SEQ ID NO: 85675 - DNA, 25 bp, Rattus norvegicus
accgaggctctcaaaggcatggaca

SEQ ID NO: 85676 - DNA, 25 bp, Rattus norvegicus
accgaggctctctaaggcatggaca

SEQ ID NO: 85677 - DNA, 25 bp, Rattus norvegicus
accgaggctgacaaagttgttccga

SEQ ID NO: 85678 - DNA, 25 bp, Rattus norvegicus
accgaggctgactaagttgttccga

SEQ ID NO: 85679 - DNA, 25 bp, Rattus norvegicus
accgaggctgttctcctttaaatag

SEQ ID NO: 85680 - DNA, 25 bp, Rattus norvegicus
accgaggctgttgtcctttaaatag

SEQ ID NO: 85681 - DNA, 25 bp, Rattus norvegicus
accgaggctttgctctggacttggc

SEQ ID NO: 85682 - DNA, 25 bp, Rattus norvegicus
accgaggctttggtctggacttggc

SEQ ID NO: 85683 - DNA, 25 bp, Rattus norvegicus
accgaggcttttagaacagatggct

SEQ ID NO: 85684 - DNA, 25 bp, Rattus norvegicus
accgaggctttttgaacagatggct

SEQ ID NO: 85685 - DNA, 25 bp, Rattus norvegicus
accgagggtgagacacgtttgcccg

SEQ ID NO: 85686 - DNA, 25 bp, Rattus norvegicus
accgagggtgagtcacgtttgcccg

SEQ ID NO: 85687 - DNA, 25 bp, Rattus norvegicus
accgaggtaagcacccagctaatgt

SEQ ID NO: 85688 - DNA, 25 bp, Rattus norvegicus
accgaggtaagctcccagctaatgt

SEQ ID NO: 85689 - DNA, 25 bp, Rattus norvegicus
accgaggtcatgatgtgccagtcat

SEQ ID NO: 85690 - DNA, 25 bp, Rattus norvegicus
accgaggtcatgttgtgccagtcat

SEQ ID NO: 85691 - DNA, 25 bp, Rattus norvegicus
accgaggtggctacagccgatttgc

SEQ ID NO: 85692 - DNA, 25 bp, Rattus norvegicus
accgaggtggcttcagccgatttgc

SEQ ID NO: 85693 - DNA, 25 bp, Rattus norvegicus
accgaggttcaaagtgggctcccat

SEQ ID NO: 85694 - DNA, 25 bp, Rattus norvegicus
accgaggttcaatgtgggctcccat

SEQ ID NO: 85695 - DNA, 25 bp, Rattus norvegicus
accgagtacgggagtctgctgacac

SEQ ID NO: 85696 - DNA, 25 bp, Rattus norvegicus
accgagtacgggtgtctgctgacac

SEQ ID NO: 85697 - DNA, 25 bp, Rattus norvegicus
accgagtagcttacaccctgagaat

SEQ ID NO: 85698 - DNA, 25 bp, Rattus norvegicus
accgagtagctttcaccctgagaat

SEQ ID NO: 85699 - DNA, 25 bp, Rattus norvegicus
accgagtcgagtctaagcctgtgtt

SEQ ID NO: 85700 - DNA, 25 bp, Rattus norvegicus
accgagtcgagtgtaagcctgtgtt

SEQ ID NO: 85701 - DNA, 25 bp, Rattus norvegicus
accgagtggaagatctgctgctggc

SEQ ID NO: 85702 - DNA, 25 bp, Rattus norvegicus
accgagtggaagttctgctgctggc

SEQ ID NO: 85703 - DNA, 25 bp, Rattus norvegicus
accgagtggcttagggtcctccatt

SEQ ID NO: 85704 - DNA, 25 bp, Rattus norvegicus
accgagtggctttgggtcctccatt

SEQ ID NO: 85705 - DNA, 25 bp, Rattus norvegicus
accgagtgtaagagccatgggcttt

SEQ ID NO: 85706 - DNA, 25 bp, Rattus norvegicus
accgagtgtaagtgccatgggcttt

SEQ ID NO: 85707 - DNA, 25 bp, Rattus norvegicus
accgatatgagtctgtttcctatgc

SEQ ID NO: 85708 - DNA, 25 bp, Rattus norvegicus
accgatatgagtgtgtttcctatgc

SEQ ID NO: 85709 - DNA, 25 bp, Rattus norvegicus
accgatcatggtctaatcacactta

SEQ ID NO: 85710 - DNA, 25 bp, Rattus norvegicus
accgatcatggtgtaatcacactta

SEQ ID NO: 85711 - DNA, 25 bp, Rattus norvegicus
accgatcccaacaaatgatgcgcac

SEQ ID NO: 85712 - DNA, 25 bp, Rattus norvegicus
accgatcccaactaatgatgcgcac

SEQ ID NO: 85713 - DNA, 25 bp, Rattus norvegicus
accgatctgatcacaagcttatgca

SEQ ID NO: 85714 - DNA, 25 bp, Rattus norvegicus
accgatctgatctcaagcttatgca

SEQ ID NO: 85715 - DNA, 25 bp, Rattus norvegicus
accgatgacgatccgcaggtgcttg

SEQ ID NO: 85716 - DNA, 25 bp, Rattus norvegicus
accgatgacgatgcgcaggtgcttg

SEQ ID NO: 85717 - DNA, 25 bp, Rattus norvegicus
accgatgatgacatgctgggcagac

SEQ ID NO: 85718 - DNA, 25 bp, Rattus norvegicus
accgatgatgacttgctgggcagac

SEQ ID NO: 85719 - DNA, 25 bp, Rattus norvegicus
accgatgccttgagccagctgtgga

SEQ ID NO: 85720 - DNA, 25 bp, Rattus norvegicus
accgatgccttgtgccagctgtgga

SEQ ID NO: 85721 - DNA, 25 bp, Rattus norvegicus
accgatggacatccctaagccagag

SEQ ID NO: 85722 - DNA, 25 bp, Rattus norvegicus
accgatggacatgcctaagccagag

SEQ ID NO: 85723 - DNA, 25 bp, Rattus norvegicus
accgatggatgcagtgcctcaattt

SEQ ID NO: 85724 - DNA, 25 bp, Rattus norvegicus
accgatggatgctgtgcctcaattt

SEQ ID NO: 85725 - DNA, 25 bp, Rattus norvegicus
accgatgggaccagcgaagacctga

SEQ ID NO: 85726 - DNA, 25 bp, Rattus norvegicus
accgatgggacctgcgaagacctga

SEQ ID NO: 85727 - DNA, 25 bp, Rattus norvegicus
accgatgtctgtatggctaatgtaa

SEQ ID NO: 85728 - DNA, 25 bp, Rattus norvegicus
accgatgtctgtttggctaatgtaa

SEQ ID NO: 85729 - DNA, 25 bp, Rattus norvegicus
accgatgtgaatctagttccccacc

SEQ ID NO: 85730 - DNA, 25 bp, Rattus norvegicus
accgatgtgaatgtagttccccacc

SEQ ID NO: 85731 - DNA, 25 bp, Rattus norvegicus
accgattacaaaagccagccgatgg

SEQ ID NO: 85732 - DNA, 25 bp, Rattus norvegicus
accgattacaaatgccagccgatgg

SEQ ID NO: 85733 - DNA, 25 bp, Rattus norvegicus
accgattccgcaatgagctatctga

SEQ ID NO: 85734 - DNA, 25 bp, Rattus norvegicus
accgattccgcattgagctatctga

SEQ ID NO: 85735 - DNA, 25 bp, Rattus norvegicus
accgatttcagcagcgcggtcacca

SEQ ID NO: 85736 - DNA, 25 bp, Rattus norvegicus
accgatttcagctgcgcggtcacca

SEQ ID NO: 85737 - DNA, 25 bp, Rattus norvegicus
accgatttcgcaactacctgggaga

SEQ ID NO: 85738 - DNA, 25 bp, Rattus norvegicus
accgatttcgcatctacctgggaga

SEQ ID NO: 85739 - DNA, 25 bp, Rattus norvegicus
accgcaagatccattgctgcttgag

SEQ ID NO: 85740 - DNA, 25 bp, Rattus norvegicus
accgcaagatcctttgctgcttgag

SEQ ID NO: 85741 - DNA, 25 bp, Rattus norvegicus
accgcacaagatcgacagactattt

SEQ ID NO: 85742 - DNA, 25 bp, Rattus norvegicus
accgcacaagatggacagactattt

SEQ ID NO: 85743 - DNA, 25 bp, Rattus norvegicus
accgcacacacaaacaacgaacaga

SEQ ID NO: 85744 - DNA, 25 bp, Rattus norvegicus
accgcacacacatacaacgaacaga

SEQ ID NO: 85745 - DNA, 25 bp, Rattus norvegicus
accgcacacctgcttcacgagttaa

SEQ ID NO: 85746 - DNA, 25 bp, Rattus norvegicus
accgcacacctggttcacgagttaa

SEQ ID NO: 85747 - DNA, 25 bp, Rattus norvegicus
accgcacactggatctaaggctgta

SEQ ID NO: 85748 - DNA, 25 bp, Rattus norvegicus
accgcacactggttctaaggctgta

SEQ ID NO: 85749 - DNA, 25 bp, Rattus norvegicus
accgcacagagtcctcagtgtggcg

SEQ ID NO: 85750 - DNA, 25 bp, Rattus norvegicus
accgcacagagtgctcagtgtggcg

SEQ ID NO: 85751 - DNA, 25 bp, Rattus norvegicus
accgcagacgctcgagtcaggaact

SEQ ID NO: 85752 - DNA, 25 bp, Rattus norvegicus
accgcagacgctggagtcaggaact

SEQ ID NO: 85753 - DNA, 25 bp, Rattus norvegicus
accgcagcagacacaggtttgtcca

SEQ ID NO: 85754 - DNA, 25 bp, Rattus norvegicus
accgcagcagactcaggtttgtcca

SEQ ID NO: 85755 - DNA, 25 bp, Rattus norvegicus
accgcagccacccatgtacgagtgg

SEQ ID NO: 85756 - DNA, 25 bp, Rattus norvegicus
accgcagccaccgatgtacgagtgg

SEQ ID NO: 85757 - DNA, 25 bp, Rattus norvegicus
accgcagcctaaatccagcagtgta

SEQ ID NO: 85758 - DNA, 25 bp, Rattus norvegicus
accgcagcctaattccagcagtgta

SEQ ID NO: 85759 - DNA, 25 bp, Rattus norvegicus
accgcagcttcaaatgtttcaatca

SEQ ID NO: 85760 - DNA, 25 bp, Rattus norvegicus
accgcagcttcatatgtttcaatca

SEQ ID NO: 85761 - DNA, 25 bp, Rattus norvegicus
accgcaggcggtacaacgtggttga

SEQ ID NO: 85762 - DNA, 25 bp, Rattus norvegicus
accgcaggcggttcaacgtggttga

SEQ ID NO: 85763 - DNA, 25 bp, Rattus norvegicus
accgcaggtcgacattcgaagcgtt

SEQ ID NO: 85764 - DNA, 25 bp, Rattus norvegicus
accgcaggtcgagattcgaagcgtt

SEQ ID NO: 85765 - DNA, 25 bp, Rattus norvegicus
accgcagtactgcacgagctaggaa

SEQ ID NO: 85766 - DNA, 25 bp, Rattus norvegicus
accgcagtactggacgagctaggaa

SEQ ID NO: 85767 - DNA, 25 bp, Rattus norvegicus
accgcagtgtttactttcatctcat

SEQ ID NO: 85768 - DNA, 25 bp, Rattus norvegicus
accgcagtgttttctttcatctcat

SEQ ID NO: 85769 - DNA, 25 bp, Rattus norvegicus
accgcataggtcactgttactcagg

SEQ ID NO: 85770 - DNA, 25 bp, Rattus norvegicus
accgcataggtctctgttactcagg

SEQ ID NO: 85771 - DNA, 25 bp, Rattus norvegicus
accgcatcatgtattctgtctggaa

SEQ ID NO: 85772 - DNA, 25 bp, Rattus norvegicus
accgcatcatgttttctgtctggaa

SEQ ID NO: 85773 - DNA, 25 bp, Rattus norvegicus
accgcatcctggagaaagtctctag

SEQ ID NO: 85774 - DNA, 25 bp, Rattus norvegicus
accgcatcctggtgaaagtctctag

SEQ ID NO: 85775 - DNA, 25 bp, Rattus norvegicus
accgcatgatctctcgctggaagtg

SEQ ID NO: 85776 - DNA, 25 bp, Rattus norvegicus
accgcatgatctgtcgctggaagtg

SEQ ID NO: 85777 - DNA, 25 bp, Rattus norvegicus
accgcatgcgctagtggtcatcaca

SEQ ID NO: 85778 - DNA, 25 bp, Rattus norvegicus
accgcatgcgcttgtggtcatcaca

SEQ ID NO: 85779 - DNA, 25 bp, Rattus norvegicus
accgcattagcgagaagctcccaga

SEQ ID NO: 85780 - DNA, 25 bp, Rattus norvegicus
accgcattagcgtgaagctcccaga

SEQ ID NO: 85781 - DNA, 25 bp, Rattus norvegicus
accgcattcatacccctgttacaag

SEQ ID NO: 85782 - DNA, 25 bp, Rattus norvegicus
accgcattcatagccctgttacaag

SEQ ID NO: 85783 - DNA, 25 bp, Rattus norvegicus
accgcattgcttatccatcgagaag

SEQ ID NO: 85784 - DNA, 25 bp, Rattus norvegicus
accgcattgcttttccatcgagaag

SEQ ID NO: 85785 - DNA, 25 bp, Rattus norvegicus
accgccaccgcacaagtagactatg

SEQ ID NO: 85786 - DNA, 25 bp, Rattus norvegicus
accgccaccgcagaagtagactatg

SEQ ID NO: 85787 - DNA, 25 bp, Rattus norvegicus
accgccagatgaaatcgaacagtcg

SEQ ID NO: 85788 - DNA, 25 bp, Rattus norvegicus
accgccagatgatatcgaacagtcg

SEQ ID NO: 85789 - DNA, 25 bp, Rattus norvegicus
accgccagcaagcaggtggtctact

SEQ ID NO: 85790 - DNA, 25 bp, Rattus norvegicus
accgccagcaaggaggtggtctact

SEQ ID NO: 85791 - DNA, 25 bp, Rattus norvegicus
accgccagcgctaggcagccaaaga

SEQ ID NO: 85792 - DNA, 25 bp, Rattus norvegicus
accgccagcgcttggcagccaaaga

SEQ ID NO: 85793 - DNA, 25 bp, Rattus norvegicus
accgccaggagtacagagcccttca

SEQ ID NO: 85794 - DNA, 25 bp, Rattus norvegicus
accgccaggagttcagagcccttca

SEQ ID NO: 85795 - DNA, 25 bp, Rattus norvegicus
accgccatatgcaagaggcctctga

SEQ ID NO: 85796 - DNA, 25 bp, Rattus norvegicus
accgccatatgctagaggcctctga

SEQ ID NO: 85797 - DNA, 25 bp, Rattus norvegicus
accgccatcttcattggagctgtgg

SEQ ID NO: 85798 - DNA, 25 bp, Rattus norvegicus
accgccatcttctttggagctgtgg

SEQ ID NO: 85799 - DNA, 25 bp, Rattus norvegicus
accgccatgcatcatgggtgaagca

SEQ ID NO: 85800 - DNA, 25 bp, Rattus norvegicus
accgccatgcatgatgggtgaagca

SEQ ID NO: 85801 - DNA, 25 bp, Rattus norvegicus
accgccattcctcacttatatgtgt

SEQ ID NO: 85802 - DNA, 25 bp, Rattus norvegicus
accgccattcctgacttatatgtgt

SEQ ID NO: 85803 - DNA, 25 bp, Rattus norvegicus
accgccattgttcaagggcttgcct

SEQ ID NO: 85804 - DNA, 25 bp, Rattus norvegicus
accgccattgttgaagggcttgcct

SEQ ID NO: 85805 - DNA, 25 bp, Rattus norvegicus
accgcccagataacgatttgttcag

SEQ ID NO: 85806 - DNA, 25 bp, Rattus norvegicus
accgcccagatatcgatttgttcag

SEQ ID NO: 85807 - DNA, 25 bp, Rattus norvegicus
accgccctacagctatagattccga

SEQ ID NO: 85808 - DNA, 25 bp, Rattus norvegicus
accgccctacaggtatagattccga

SEQ ID NO: 85809 - DNA, 25 bp, Rattus norvegicus
accgccctatgtcgcataaccaatt

SEQ ID NO: 85810 - DNA, 25 bp, Rattus norvegicus
accgccctatgtggcataaccaatt

SEQ ID NO: 85811 - DNA, 25 bp, Rattus norvegicus
accgccctcgggaagatacagttgg

SEQ ID NO: 85812 - DNA, 25 bp, Rattus norvegicus
accgccctcgggtagatacagttgg

SEQ ID NO: 85813 - DNA, 25 bp, Rattus norvegicus
accgccgagttcctctatgatgagg

SEQ ID NO: 85814 - DNA, 25 bp, Rattus norvegicus
accgccgagttcgtctatgatgagg

SEQ ID NO: 85815 - DNA, 25 bp, Rattus norvegicus
accgccgcgacaacgtgctcaagag

SEQ ID NO: 85816 - DNA, 25 bp, Rattus norvegicus
accgccgcgacatcgtgctcaagag

SEQ ID NO: 85817 - DNA, 25 bp, Rattus norvegicus
accgccgggaacatttctgatcgaa

SEQ ID NO: 85818 - DNA, 25 bp, Rattus norvegicus
accgccgggaacttttctgatcgaa

SEQ ID NO: 85819 - DNA, 25 bp, Rattus norvegicus
accgcctcctgcagagtcatgtgtg

SEQ ID NO: 85820 - DNA, 25 bp, Rattus norvegicus
accgcctcctgctgagtcatgtgtg

SEQ ID NO: 85821 - DNA, 25 bp, Rattus norvegicus
accgcctgcgcaagcgggtggaaca

SEQ ID NO: 85822 - DNA, 25 bp, Rattus norvegicus
accgcctgcgcatgcgggtggaaca

SEQ ID NO: 85823 - DNA, 25 bp, Rattus norvegicus
accgcctgctgactagtacctgtgg

SEQ ID NO: 85824 - DNA, 25 bp, Rattus norvegicus
accgcctgctgagtagtacctgtgg

SEQ ID NO: 85825 - DNA, 25 bp, Rattus norvegicus
accgcctggctgagcagcacattcg

SEQ ID NO: 85826 - DNA, 25 bp, Rattus norvegicus
accgcctggctgtgcagcacattcg

SEQ ID NO: 85827 - DNA, 25 bp, Rattus norvegicus
accgcctgtgctccatctgaaataa

SEQ ID NO: 85828 - DNA, 25 bp, Rattus norvegicus
accgcctgtgctgcatctgaaataa

SEQ ID NO: 85829 - DNA, 25 bp, Rattus norvegicus
accgccttaagaaccactcatgata

SEQ ID NO: 85830 - DNA, 25 bp, Rattus norvegicus
accgccttaagatccactcatgata

SEQ ID NO: 85831 - DNA, 25 bp, Rattus norvegicus
accgccttaggtatcttttgagagc

SEQ ID NO: 85832 - DNA, 25 bp, Rattus norvegicus
accgccttaggtttcttttgagagc

SEQ ID NO: 85833 - DNA, 25 bp, Rattus norvegicus
accgccttcgtaacaggtaaccagt

SEQ ID NO: 85834 - DNA, 25 bp, Rattus norvegicus
accgccttcgtatcaggtaaccagt

SEQ ID NO: 85835 - DNA, 25 bp, Rattus norvegicus
accgccttgccgagaacactgagaa

SEQ ID NO: 85836 - DNA, 25 bp, Rattus norvegicus
accgccttgccgtgaacactgagaa

SEQ ID NO: 85837 - DNA, 25 bp, Rattus norvegicus
accgccttgctcatcaggagttggt

SEQ ID NO: 85838 - DNA, 25 bp, Rattus norvegicus
accgccttgctcttcaggagttggt

SEQ ID NO: 85839 - DNA, 25 bp, Rattus norvegicus
accgccttgtccaggagcagcataa

SEQ ID NO: 85840 - DNA, 25 bp, Rattus norvegicus
accgccttgtcctggagcagcataa

SEQ ID NO: 85841 - DNA, 25 bp, Rattus norvegicus
accgcgagccgcatgtgtggaacca

SEQ ID NO: 85842 - DNA, 25 bp, Rattus norvegicus
accgcgagccgcttgtgtggaacca

SEQ ID NO: 85843 - DNA, 25 bp, Rattus norvegicus
accgcgatccaccaagtgagaactg

SEQ ID NO: 85844 - DNA, 25 bp, Rattus norvegicus
accgcgatccacgaagtgagaactg

SEQ ID NO: 85845 - DNA, 25 bp, Rattus norvegicus
accgcgccaggaagaatgccttgga

SEQ ID NO: 85846 - DNA, 25 bp, Rattus norvegicus
accgcgccaggatgaatgccttgga

SEQ ID NO: 85847 - DNA, 25 bp, Rattus norvegicus
accgcgctatcaagggacttagtca

SEQ ID NO: 85848 - DNA, 25 bp, Rattus norvegicus
accgcgctatcatgggacttagtca

SEQ ID NO: 85849 - DNA, 25 bp, Rattus norvegicus
accgcgctctatcaggccttggcag

SEQ ID NO: 85850 - DNA, 25 bp, Rattus norvegicus
accgcgctctatgaggccttggcag

SEQ ID NO: 85851 - DNA, 25 bp, Rattus norvegicus
accgcgctgttgatggcagctatga

SEQ ID NO: 85852 - DNA, 25 bp, Rattus norvegicus
accgcgctgttgttggcagctatga

SEQ ID NO: 85853 - DNA, 25 bp, Rattus norvegicus
accgcggtcgaactaaaatcctgca

SEQ ID NO: 85854 - DNA, 25 bp, Rattus norvegicus
accgcggtcgaagtaaaatcctgca

SEQ ID NO: 85855 - DNA, 25 bp, Rattus norvegicus
accgcggtgagccgccctacaaatg

SEQ ID NO: 85856 - DNA, 25 bp, Rattus norvegicus
accgcggtgagcggccctacaaatg

SEQ ID NO: 85857 - DNA, 25 bp, Rattus norvegicus
accgcggtgtaccaccatgagtgag

SEQ ID NO: 85858 - DNA, 25 bp, Rattus norvegicus
accgcggtgtacgaccatgagtgag

SEQ ID NO: 85859 - DNA, 25 bp, Rattus norvegicus
accgcgtctggtcaagcattgtatc

SEQ ID NO: 85860 - DNA, 25 bp, Rattus norvegicus
accgcgtctggtgaagcattgtatc

SEQ ID NO: 85861 - DNA, 25 bp, Rattus norvegicus
accgctaaaacgagggcctgcagta

SEQ ID NO: 85862 - DNA, 25 bp, Rattus norvegicus
accgctaaaacgtgggcctgcagta

SEQ ID NO: 85863 - DNA, 25 bp, Rattus norvegicus
accgctaaaatgatgctcgtgccat

SEQ ID NO: 85864 - DNA, 25 bp, Rattus norvegicus
accgctaaaatgttgctcgtgccat

SEQ ID NO: 85865 - DNA, 25 bp, Rattus norvegicus
accgctaacatcagctgagttgtca

SEQ ID NO: 85866 - DNA, 25 bp, Rattus norvegicus
accgctaacatctgctgagttgtca

SEQ ID NO: 85867 - DNA, 25 bp, Rattus norvegicus
accgctacctgacccgaaggagaag

SEQ ID NO: 85868 - DNA, 25 bp, Rattus norvegicus
accgctacctgagccgaaggagaag

SEQ ID NO: 85869 - DNA, 25 bp, Rattus norvegicus
accgctactactatctggagactgc

SEQ ID NO: 85870 - DNA, 25 bp, Rattus norvegicus
accgctactactttctggagactgc

SEQ ID NO: 85871 - DNA, 25 bp, Rattus norvegicus
accgctactcctacaaggttgctga

SEQ ID NO: 85872 - DNA, 25 bp, Rattus norvegicus
accgctactccttcaaggttgctga

SEQ ID NO: 85873 - DNA, 25 bp, Rattus norvegicus
accgctcgggttaactagctgggcg

SEQ ID NO: 85874 - DNA, 25 bp, Rattus norvegicus
accgctcgggtttactagctgggcg

SEQ ID NO: 85875 - DNA, 25 bp, Rattus norvegicus
accgctctacccaggctagggcgga

SEQ ID NO: 85876 - DNA, 25 bp, Rattus norvegicus
accgctctaccctggctagggcgga

SEQ ID NO: 85877 - DNA, 25 bp, Rattus norvegicus
accgctctttctcaaactggatggg

SEQ ID NO: 85878 - DNA, 25 bp, Rattus norvegicus
accgctctttctgaaactggatggg

SEQ ID NO: 85879 - DNA, 25 bp, Rattus norvegicus
accgctctttttaggagaaggcaca

SEQ ID NO: 85880 - DNA, 25 bp, Rattus norvegicus
accgctcttttttggagaaggcaca

SEQ ID NO: 85881 - DNA, 25 bp, Rattus norvegicus
accgctgactgactttgggtgccag

SEQ ID NO: 85882 - DNA, 25 bp, Rattus norvegicus
accgctgactgagtttgggtgccag

SEQ ID NO: 85883 - DNA, 25 bp, Rattus norvegicus
accgctgcggcaactgggactcacg

SEQ ID NO: 85884 - DNA, 25 bp, Rattus norvegicus
accgctgcggcatctgggactcacg

SEQ ID NO: 85885 - DNA, 25 bp, Rattus norvegicus
accgctgcgggtctgtattcagatg

SEQ ID NO: 85886 - DNA, 25 bp, Rattus norvegicus
accgctgcgggtgtgtattcagatg

SEQ ID NO: 85887 - DNA, 25 bp, Rattus norvegicus
accgctgctctccttgagaaaatga

SEQ ID NO: 85888 - DNA, 25 bp, Rattus norvegicus
accgctgctctcgttgagaaaatga

SEQ ID NO: 85889 - DNA, 25 bp, Rattus norvegicus
accgctgctgcgctttctgggagaa

SEQ ID NO: 85890 - DNA, 25 bp, Rattus norvegicus
accgctgctgcggtttctgggagaa

SEQ ID NO: 85891 - DNA, 25 bp, Rattus norvegicus
accgctgggttgatgcaggtgacta

SEQ ID NO: 85892 - DNA, 25 bp, Rattus norvegicus
accgctgggttgttgcaggtgacta

SEQ ID NO: 85893 - DNA, 25 bp, Rattus norvegicus
accgctggtgtgagtgagccactca

SEQ ID NO: 85894 - DNA, 25 bp, Rattus norvegicus
accgctggtgtgtgtgagccactca

SEQ ID NO: 85895 - DNA, 25 bp, Rattus norvegicus
accgctgtccatccatacttgaaag

SEQ ID NO: 85896 - DNA, 25 bp, Rattus norvegicus
accgctgtccatgcatacttgaaag

SEQ ID NO: 85897 - DNA, 25 bp, Rattus norvegicus
accgctgtgttaacctaagagtggc

SEQ ID NO: 85898 - DNA, 25 bp, Rattus norvegicus
accgctgtgttatcctaagagtggc

SEQ ID NO: 85899 - DNA, 25 bp, Rattus norvegicus
accgcttcatgccactgaatacgtt

SEQ ID NO: 85900 - DNA, 25 bp, Rattus norvegicus
accgcttcatgcgactgaatacgtt

SEQ ID NO: 85901 - DNA, 25 bp, Rattus norvegicus
accgcttcgtgtcgattgtgactga

SEQ ID NO: 85902 - DNA, 25 bp, Rattus norvegicus
accgcttcgtgtggattgtgactga

SEQ ID NO: 85903 - DNA, 25 bp, Rattus norvegicus
accgcttcttccacaagtggagtgt

SEQ ID NO: 85904 - DNA, 25 bp, Rattus norvegicus
accgcttcttcctcaagtggagtgt

SEQ ID NO: 85905 - DNA, 25 bp, Rattus norvegicus
accggaaacacactcatcttcgcga

SEQ ID NO: 85906 - DNA, 25 bp, Rattus norvegicus
accggaaacacagtcatcttcgcga

SEQ ID NO: 85907 - DNA, 25 bp, Rattus norvegicus
accggaaattctcgtgagcctgttt

SEQ ID NO: 85908 - DNA, 25 bp, Rattus norvegicus
accggaaattctggtgagcctgttt

SEQ ID NO: 85909 - DNA, 25 bp, Rattus norvegicus
accggaacaatccttaatgtcagtg

SEQ ID NO: 85910 - DNA, 25 bp, Rattus norvegicus
accggaacaatcgttaatgtcagtg

SEQ ID NO: 85911 - DNA, 25 bp, Rattus norvegicus
accggaaccccaccatgtagagaga

SEQ ID NO: 85912 - DNA, 25 bp, Rattus norvegicus
accggaaccccagcatgtagagaga

SEQ ID NO: 85913 - DNA, 25 bp, Rattus norvegicus
accggaaccggaaacgcaatcagag

SEQ ID NO: 85914 - DNA, 25 bp, Rattus norvegicus
accggaaccggatacgcaatcagag

SEQ ID NO: 85915 - DNA, 25 bp, Rattus norvegicus
accggaacgtagacaatgtgcatat

SEQ ID NO: 85916 - DNA, 25 bp, Rattus norvegicus
accggaacgtagtcaatgtgcatat

SEQ ID NO: 85917 - DNA, 25 bp, Rattus norvegicus
accggaactgccattctgtcttagg

SEQ ID NO: 85918 - DNA, 25 bp, Rattus norvegicus
accggaactgcctttctgtcttagg

SEQ ID NO: 85919 - DNA, 25 bp, Rattus norvegicus
accggaagtgcaaggccatccctgg

SEQ ID NO: 85920 - DNA, 25 bp, Rattus norvegicus
accggaagtgcatggccatccctgg

SEQ ID NO: 85921 - DNA, 25 bp, Rattus norvegicus
accggaattcccatattctgagtgg

SEQ ID NO: 85922 - DNA, 25 bp, Rattus norvegicus
accggaattcccttattctgagtgg

SEQ ID NO: 85923 - DNA, 25 bp, Rattus norvegicus
accggacaccaccagagattaggat

SEQ ID NO: 85924 - DNA, 25 bp, Rattus norvegicus
accggacaccacgagagattaggat

SEQ ID NO: 85925 - DNA, 25 bp, Rattus norvegicus
accggacacctgatgtcatgtttca

SEQ ID NO: 85926 - DNA, 25 bp, Rattus norvegicus
accggacacctgttgtcatgtttca

SEQ ID NO: 85927 - DNA, 25 bp, Rattus norvegicus
accggacagtacagtcctctgccta

SEQ ID NO: 85928 - DNA, 25 bp, Rattus norvegicus
accggacagtactgtcctctgccta

SEQ ID NO: 85929 - DNA, 25 bp, Rattus norvegicus
accggaccaggtctcctttgttcat

SEQ ID NO: 85930 - DNA, 25 bp, Rattus norvegicus
accggaccaggtgtcctttgttcat

SEQ ID NO: 85931 - DNA, 25 bp, Rattus norvegicus
accggacctcacagtcgggaatgaa

SEQ ID NO: 85932 - DNA, 25 bp, Rattus norvegicus
accggacctcactgtcgggaatgaa

SEQ ID NO: 85933 - DNA, 25 bp, Rattus norvegicus
accggagaaaagcagggcactggca

SEQ ID NO: 85934 - DNA, 25 bp, Rattus norvegicus
accggagaaaaggagggcactggca

SEQ ID NO: 85935 - DNA, 25 bp, Rattus norvegicus
accggagccctgaaactgtacttca

SEQ ID NO: 85936 - DNA, 25 bp, Rattus norvegicus
accggagccctgtaactgtacttca

SEQ ID NO: 85937 - DNA, 25 bp, Rattus norvegicus
accggaggccccaagcaagcaggac

SEQ ID NO: 85938 - DNA, 25 bp, Rattus norvegicus
accggaggcccctagcaagcaggac

SEQ ID NO: 85939 - DNA, 25 bp, Rattus norvegicus
accggagggccaaacctgaggcata

SEQ ID NO: 85940 - DNA, 25 bp, Rattus norvegicus
accggagggccatacctgaggcata

SEQ ID NO: 85941 - DNA, 25 bp, Rattus norvegicus
accggagtctccagtcttgaggatg

SEQ ID NO: 85942 - DNA, 25 bp, Rattus norvegicus
accggagtctcctgtcttgaggatg

SEQ ID NO: 85943 - DNA, 25 bp, Rattus norvegicus
accggagtgctgattgccctatgtc

SEQ ID NO: 85944 - DNA, 25 bp, Rattus norvegicus
accggagtgctgtttgccctatgtc

SEQ ID NO: 85945 - DNA, 25 bp, Rattus norvegicus
accggagtgtcaacgcttcaacctg

SEQ ID NO: 85946 - DNA, 25 bp, Rattus norvegicus
accggagtgtcaacgggctccctgg

SEQ ID NO: 85947 - DNA, 25 bp, Rattus norvegicus
accggagtgtcatcgcttcaacctg

SEQ ID NO: 85948 - DNA, 25 bp, Rattus norvegicus
accggagtgtcatcgggctccctgg

SEQ ID NO: 85949 - DNA, 25 bp, Rattus norvegicus
accggataaatgatagagtccccat

SEQ ID NO: 85950 - DNA, 25 bp, Rattus norvegicus
accggataaatgttagagtccccat

SEQ ID NO: 85951 - DNA, 25 bp, Rattus norvegicus
accggatctggacgttgccgctgac

SEQ ID NO: 85952 - DNA, 25 bp, Rattus norvegicus
accggatctggaggttgccgctgac

SEQ ID NO: 85953 - DNA, 25 bp, Rattus norvegicus
accggatgatgtcaccagcacaatc

SEQ ID NO: 85954 - DNA, 25 bp, Rattus norvegicus
accggatgatgtgaccagcacaatc

SEQ ID NO: 85955 - DNA, 25 bp, Rattus norvegicus
accggatgtaacatgcatgctttct

SEQ ID NO: 85956 - DNA, 25 bp, Rattus norvegicus
accggatgtaacttgcatgctttct

SEQ ID NO: 85957 - DNA, 25 bp, Rattus norvegicus
accggattgtagagagtggcgccca

SEQ ID NO: 85958 - DNA, 25 bp, Rattus norvegicus
accggattgtagtgagtggcgccca

SEQ ID NO: 85959 - DNA, 25 bp, Rattus norvegicus
accggcaacgttaacacagagacaa

SEQ ID NO: 85960 - DNA, 25 bp, Rattus norvegicus
accggcaacgtttacacagagacaa

SEQ ID NO: 85961 - DNA, 25 bp, Rattus norvegicus
accggcaccagtaccacgaagagat

SEQ ID NO: 85962 - DNA, 25 bp, Rattus norvegicus
accggcaccagttccacgaagagat

SEQ ID NO: 85963 - DNA, 25 bp, Rattus norvegicus
accggcacccatcaaggttactgga

SEQ ID NO: 85964 - DNA, 25 bp, Rattus norvegicus
accggcacccatgaaggttactgga

SEQ ID NO: 85965 - DNA, 25 bp, Rattus norvegicus
accggcagagccagaatgtcaacag

SEQ ID NO: 85966 - DNA, 25 bp, Rattus norvegicus
accggcagagcctgaatgtcaacag

SEQ ID NO: 85967 - DNA, 25 bp, Rattus norvegicus
accggcagcctcagattattgcagt

SEQ ID NO: 85968 - DNA, 25 bp, Rattus norvegicus
accggcagcctctgattattgcagt

SEQ ID NO: 85969 - DNA, 25 bp, Rattus norvegicus
accggcaggatgacagagaagtgct

SEQ ID NO: 85970 - DNA, 25 bp, Rattus norvegicus
accggcaggatgtcagagaagtgct

SEQ ID NO: 85971 - DNA, 25 bp, Rattus norvegicus
accggcaggcacataggtacctatt

SEQ ID NO: 85972 - DNA, 25 bp, Rattus norvegicus
accggcaggcacttaggtacctatt

SEQ ID NO: 85973 - DNA, 25 bp, Rattus norvegicus
accggcaggcggcagtcaccaagta

SEQ ID NO: 85974 - DNA, 25 bp, Rattus norvegicus
accggcaggcgggagtcaccaagta

SEQ ID NO: 85975 - DNA, 25 bp, Rattus norvegicus
accggcagggtcaggacagagcttt

SEQ ID NO: 85976 - DNA, 25 bp, Rattus norvegicus
accggcagggtctggacagagcttt

SEQ ID NO: 85977 - DNA, 25 bp, Rattus norvegicus
accggcagtatgcaagtctcaactt

SEQ ID NO: 85978 - DNA, 25 bp, Rattus norvegicus
accggcagtatggaagtctcaactt

SEQ ID NO: 85979 - DNA, 25 bp, Rattus norvegicus
accggcatcggacacaaaacactga

SEQ ID NO: 85980 - DNA, 25 bp, Rattus norvegicus
accggcatcggagacaaaacactga

SEQ ID NO: 85981 - DNA, 25 bp, Rattus norvegicus
accggcatgaacaactgtaccacag

SEQ ID NO: 85982 - DNA, 25 bp, Rattus norvegicus
accggcatgaactactgtaccacag

SEQ ID NO: 85983 - DNA, 25 bp, Rattus norvegicus
accggccagctcctgtgagataaac

SEQ ID NO: 85984 - DNA, 25 bp, Rattus norvegicus
accggccagctcgtgtgagataaac

SEQ ID NO: 85985 - DNA, 25 bp, Rattus norvegicus
accggccccatgctggacagacatg

SEQ ID NO: 85986 - DNA, 25 bp, Rattus norvegicus
accggccccatggtggacagacatg

SEQ ID NO: 85987 - DNA, 25 bp, Rattus norvegicus
accggccgcgatcgctgacgagatt

SEQ ID NO: 85988 - DNA, 25 bp, Rattus norvegicus
accggccgcgatggctgacgagatt

SEQ ID NO: 85989 - DNA, 25 bp, Rattus norvegicus
accggccgctggaaacttgtacata

SEQ ID NO: 85990 - DNA, 25 bp, Rattus norvegicus
accggccgctggtaacttgtacata

SEQ ID NO: 85991 - DNA, 25 bp, Rattus norvegicus
accggccgtggacacagtgtctcca

SEQ ID NO: 85992 - DNA, 25 bp, Rattus norvegicus
accggccgtggagacagtgtctcca

SEQ ID NO: 85993 - DNA, 25 bp, Rattus norvegicus
accggccttcggataacatgagctc

SEQ ID NO: 85994 - DNA, 25 bp, Rattus norvegicus
accggccttcggttaacatgagctc

SEQ ID NO: 85995 - DNA, 25 bp, Rattus norvegicus
accggcgaggagatttttggcacta

SEQ ID NO: 85996 - DNA, 25 bp, Rattus norvegicus
accggcgaggagttttttggcacta

SEQ ID NO: 85997 - DNA, 25 bp, Rattus norvegicus
accggcgcctacacacaggtgagag

SEQ ID NO: 85998 - DNA, 25 bp, Rattus norvegicus
accggcgcctactcacaggtgagag

SEQ ID NO: 85999 - DNA, 25 bp, Rattus norvegicus
accggcgcgcagctcagcaatggaa

SEQ ID NO: 86000 - DNA, 25 bp, Rattus norvegicus
accggcgcgcaggtcagcaatggaa

SEQ ID NO: 86001 - DNA, 25 bp, Rattus norvegicus
accggcgctcttcagtgttaggtga

SEQ ID NO: 86002 - DNA, 25 bp, Rattus norvegicus
accggcgctcttgagtgttaggtga

SEQ ID NO: 86003 - DNA, 25 bp, Rattus norvegicus
accggcgggaccagccaccgagagt

SEQ ID NO: 86004 - DNA, 25 bp, Rattus norvegicus
accggcgggacctgccaccgagagt

SEQ ID NO: 86005 - DNA, 25 bp, Rattus norvegicus
accggcgtaccgattgtgtctggaa

SEQ ID NO: 86006 - DNA, 25 bp, Rattus norvegicus
accggcgtaccgtttgtgtctggaa

SEQ ID NO: 86007 - DNA, 25 bp, Rattus norvegicus
accggcgtgacacatggcttctttt

SEQ ID NO: 86008 - DNA, 25 bp, Rattus norvegicus
accggcgtgacagatggcttctttt

SEQ ID NO: 86009 - DNA, 25 bp, Rattus norvegicus
accggcgtgggccacagccactaaa

SEQ ID NO: 86010 - DNA, 25 bp, Rattus norvegicus
accggcgtgggcgacagccactaaa

SEQ ID NO: 86011 - DNA, 25 bp, Rattus norvegicus
accggcgtgtgtacaccctctgggt

SEQ ID NO: 86012 - DNA, 25 bp, Rattus norvegicus
accggcgtgtgttcaccctctgggt

SEQ ID NO: 86013 - DNA, 25 bp, Rattus norvegicus
accggcgttttcataagctctgtga

SEQ ID NO: 86014 - DNA, 25 bp, Rattus norvegicus
accggcgttttcttaagctctgtga

SEQ ID NO: 86015 - DNA, 25 bp, Rattus norvegicus
accggctacatgaccctgagaggag

SEQ ID NO: 86016 - DNA, 25 bp, Rattus norvegicus
accggctacatgtccctgagaggag

SEQ ID NO: 86017 - DNA, 25 bp, Rattus norvegicus
accggctcagaactgaggctcgctt

SEQ ID NO: 86018 - DNA, 25 bp, Rattus norvegicus
accggctcagaagtgaggctcgctt

SEQ ID NO: 86019 - DNA, 25 bp, Rattus norvegicus
accggctgcgtcatgaagcgggact

SEQ ID NO: 86020 - DNA, 25 bp, Rattus norvegicus
accggctgcgtcttgaagcgggact

SEQ ID NO: 86021 - DNA, 25 bp, Rattus norvegicus
accggctgctggaagcacctgagaa

SEQ ID NO: 86022 - DNA, 25 bp, Rattus norvegicus
accggctgctggtagcacctgagaa

SEQ ID NO: 86023 - DNA, 25 bp, Rattus norvegicus
accggctggctccatactataagac

SEQ ID NO: 86024 - DNA, 25 bp, Rattus norvegicus
accggctggctcgatactataagac

SEQ ID NO: 86025 - DNA, 25 bp, Rattus norvegicus
accggctggtctaccaaaggacatg

SEQ ID NO: 86026 - DNA, 25 bp, Rattus norvegicus
accggctggtcttccaaaggacatg

SEQ ID NO: 86027 - DNA, 25 bp, Rattus norvegicus
accggcttctctcagtgcgtgcatt

SEQ ID NO: 86028 - DNA, 25 bp, Rattus norvegicus
accggcttctctgagtgcgtgcatt

SEQ ID NO: 86029 - DNA, 25 bp, Rattus norvegicus
accggcttctttatcagcacatgta

SEQ ID NO: 86030 - DNA, 25 bp, Rattus norvegicus
accggcttctttttcagcacatgta

SEQ ID NO: 86031 - DNA, 25 bp, Rattus norvegicus
accggcttggtgaggacaggcaaaa

SEQ ID NO: 86032 - DNA, 25 bp, Rattus norvegicus
accggcttggtgtggacaggcaaaa

SEQ ID NO: 86033 - DNA, 25 bp, Rattus norvegicus
accgggaaccttcactctgtaaatg

SEQ ID NO: 86034 - DNA, 25 bp, Rattus norvegicus
accgggaaccttgactctgtaaatg

SEQ ID NO: 86035 - DNA, 25 bp, Rattus norvegicus
accgggaactggaacgccactacag

SEQ ID NO: 86036 - DNA, 25 bp, Rattus norvegicus
accgggaactggtacgccactacag

SEQ ID NO: 86037 - DNA, 25 bp, Rattus norvegicus
accgggaagactagcccagctttgg

SEQ ID NO: 86038 - DNA, 25 bp, Rattus norvegicus
accgggaagacttgcccagctttgg

SEQ ID NO: 86039 - DNA, 25 bp, Rattus norvegicus
accgggaagattccgtctcgtactg

SEQ ID NO: 86040 - DNA, 25 bp, Rattus norvegicus
accgggaagattgcgtctcgtactg

SEQ ID NO: 86041 - DNA, 25 bp, Rattus norvegicus
accgggaagttcactgatgccttga

SEQ ID NO: 86042 - DNA, 25 bp, Rattus norvegicus
accgggaagttctctgatgccttga

SEQ ID NO: 86043 - DNA, 25 bp, Rattus norvegicus
accgggacaggtaactctcagacga

SEQ ID NO: 86044 - DNA, 25 bp, Rattus norvegicus
accgggacaggttactctcagacga

SEQ ID NO: 86045 - DNA, 25 bp, Rattus norvegicus
accgggactgcacgtaagtaccaat

SEQ ID NO: 86046 - DNA, 25 bp, Rattus norvegicus
accgggactgcaggtaagtaccaat

SEQ ID NO: 86047 - DNA, 25 bp, Rattus norvegicus
accgggagtctcagattgtgttcat

SEQ ID NO: 86048 - DNA, 25 bp, Rattus norvegicus
accgggagtctctgattgtgttcat

SEQ ID NO: 86049 - DNA, 25 bp, Rattus norvegicus
accgggatccgcatgccagagcggt

SEQ ID NO: 86050 - DNA, 25 bp, Rattus norvegicus
accgggatccgcttgccagagcggt

SEQ ID NO: 86051 - DNA, 25 bp, Rattus norvegicus
accgggatgagaacggcgaggcgaa

SEQ ID NO: 86052 - DNA, 25 bp, Rattus norvegicus
accgggatgagatcggcgaggcgaa

SEQ ID NO: 86053 - DNA, 25 bp, Rattus norvegicus
accgggattcagagtgaccagccta

SEQ ID NO: 86054 - DNA, 25 bp, Rattus norvegicus
accgggattcagtgtgaccagccta

SEQ ID NO: 86055 - DNA, 25 bp, Rattus norvegicus
accgggcagtacctcattcagtgtt

SEQ ID NO: 86056 - DNA, 25 bp, Rattus norvegicus
accgggcagtacgtcattcagtgtt

SEQ ID NO: 86057 - DNA, 25 bp, Rattus norvegicus
accgggcatgggagatcgtcagcga

SEQ ID NO: 86058 - DNA, 25 bp, Rattus norvegicus
accgggcatgggtgatcgtcagcga

SEQ ID NO: 86059 - DNA, 25 bp, Rattus norvegicus
accgggccagacaagcaatcgacaa

SEQ ID NO: 86060 - DNA, 25 bp, Rattus norvegicus
accgggccagactagcaatcgacaa

SEQ ID NO: 86061 - DNA, 25 bp, Rattus norvegicus
accgggcccacacactgatgagagt

SEQ ID NO: 86062 - DNA, 25 bp, Rattus norvegicus
accgggcccacagactgatgagagt

SEQ ID NO: 86063 - DNA, 25 bp, Rattus norvegicus
accgggcgcttccaggaggacttca

SEQ ID NO: 86064 - DNA, 25 bp, Rattus norvegicus
accgggcgcttcgaggaggacttca

SEQ ID NO: 86065 - DNA, 25 bp, Rattus norvegicus
accgggctatgtctaggtacagcat

SEQ ID NO: 86066 - DNA, 25 bp, Rattus norvegicus
accgggctatgtgtaggtacagcat

SEQ ID NO: 86067 - DNA, 25 bp, Rattus norvegicus
accgggctcgggatagcaggcacca

SEQ ID NO: 86068 - DNA, 25 bp, Rattus norvegicus
accgggctcgggttagcaggcacca

SEQ ID NO: 86069 - DNA, 25 bp, Rattus norvegicus
accgggctgcttaactggaggccaa

SEQ ID NO: 86070 - DNA, 25 bp, Rattus norvegicus
accgggctgctttactggaggccaa

SEQ ID NO: 86071 - DNA, 25 bp, Rattus norvegicus
accgggctgtgaagctgcacgacaa

SEQ ID NO: 86072 - DNA, 25 bp, Rattus norvegicus
accgggctgtgatgctgcacgacaa

SEQ ID NO: 86073 - DNA, 25 bp, Rattus norvegicus
accgggtataacatcatgcctacaa

SEQ ID NO: 86074 - DNA, 25 bp, Rattus norvegicus
accgggtataacttcatgcctacaa

SEQ ID NO: 86075 - DNA, 25 bp, Rattus norvegicus
accgggtcatgacactccgcagaaa

SEQ ID NO: 86076 - DNA, 25 bp, Rattus norvegicus
accgggtcatgagactccgcagaaa

SEQ ID NO: 86077 - DNA, 25 bp, Rattus norvegicus
accgggtccaagaataccatcactg

SEQ ID NO: 86078 - DNA, 25 bp, Rattus norvegicus
accgggtccaagtataccatcactg

SEQ ID NO: 86079 - DNA, 25 bp, Rattus norvegicus
accgggtgccttagatgcttttggg

SEQ ID NO: 86080 - DNA, 25 bp, Rattus norvegicus
accgggtgcctttgatgcttttggg

SEQ ID NO: 86081 - DNA, 25 bp, Rattus norvegicus
accgggtgctcacccatgggcagaa

SEQ ID NO: 86082 - DNA, 25 bp, Rattus norvegicus
accgggtgctcagccatgggcagaa

SEQ ID NO: 86083 - DNA, 25 bp, Rattus norvegicus
accgggtggtgtatgccggcaatat

SEQ ID NO: 86084 - DNA, 25 bp, Rattus norvegicus
accgggtggtgtttgccggcaatat

SEQ ID NO: 86085 - DNA, 25 bp, Rattus norvegicus
accgggtgtagcattggtgattcat

SEQ ID NO: 86086 - DNA, 25 bp, Rattus norvegicus
accgggtgtagctttggtgattcat

SEQ ID NO: 86087 - DNA, 25 bp, Rattus norvegicus
accgggtttcggcacttgatgcaat

SEQ ID NO: 86088 - DNA, 25 bp, Rattus norvegicus
accgggtttcgggacttgatgcaat

SEQ ID NO: 86089 - DNA, 25 bp, Rattus norvegicus
accggtaagtgcaatcgccgcgaga

SEQ ID NO: 86090 - DNA, 25 bp, Rattus norvegicus
accggtaagtgctatcgccgcgaga

SEQ ID NO: 86091 - DNA, 25 bp, Rattus norvegicus
accggtacaagtctgcgatgccttt

SEQ ID NO: 86092 - DNA, 25 bp, Rattus norvegicus
accggtacaagtgtgcgatgccttt

SEQ ID NO: 86093 - DNA, 25 bp, Rattus norvegicus
accggtacggagctgccactatgaa

SEQ ID NO: 86094 - DNA, 25 bp, Rattus norvegicus
accggtacggaggtgccactatgaa

SEQ ID NO: 86095 - DNA, 25 bp, Rattus norvegicus
accggtactcggagcttcagcagca

SEQ ID NO: 86096 - DNA, 25 bp, Rattus norvegicus
accggtactcggtgcttcagcagca

SEQ ID NO: 86097 - DNA, 25 bp, Rattus norvegicus
accggtagccatcgttgggtcagct

SEQ ID NO: 86098 - DNA, 25 bp, Rattus norvegicus
accggtagccatggttgggtcagct

SEQ ID NO: 86099 - DNA, 25 bp, Rattus norvegicus
accggtagccgtcagacagcagtta

SEQ ID NO: 86100 - DNA, 25 bp, Rattus norvegicus
accggtagccgtgagacagcagtta

SEQ ID NO: 86101 - DNA, 25 bp, Rattus norvegicus
accggtatattccattaatcgttga

SEQ ID NO: 86102 - DNA, 25 bp, Rattus norvegicus
accggtatattcgattaatcgttga

SEQ ID NO: 86103 - DNA, 25 bp, Rattus norvegicus
accggtcagtggaacctgggctcag

SEQ ID NO: 86104 - DNA, 25 bp, Rattus norvegicus
accggtcagtggtacctgggctcag

SEQ ID NO: 86105 - DNA, 25 bp, Rattus norvegicus
accggtccacagcaaggtcagtctt

SEQ ID NO: 86106 - DNA, 25 bp, Rattus norvegicus
accggtccacaggaaggtcagtctt

SEQ ID NO: 86107 - DNA, 25 bp, Rattus norvegicus
accggtccattcaatctgtgacgaa

SEQ ID NO: 86108 - DNA, 25 bp, Rattus norvegicus
accggtccattctatctgtgacgaa

SEQ ID NO: 86109 - DNA, 25 bp, Rattus norvegicus
accggtcctcatcatggtacagcaa

SEQ ID NO: 86110 - DNA, 25 bp, Rattus norvegicus
accggtcctcatgatggtacagcaa

SEQ ID NO: 86111 - DNA, 25 bp, Rattus norvegicus
accggtctgtgtctgctggtccata

SEQ ID NO: 86112 - DNA, 25 bp, Rattus norvegicus
accggtctgtgtgtgctggtccata

SEQ ID NO: 86113 - DNA, 25 bp, Rattus norvegicus
accggtgactaccagcctgtcatta

SEQ ID NO: 86114 - DNA, 25 bp, Rattus norvegicus
accggtgactacgagcctgtcatta

SEQ ID NO: 86115 - DNA, 25 bp, Rattus norvegicus
accggtgcacagagcgtttctagaa

SEQ ID NO: 86116 - DNA, 25 bp, Rattus norvegicus
accggtgcacagtgcgtttctagaa

SEQ ID NO: 86117 - DNA, 25 bp, Rattus norvegicus
accggtgtagtgagcccatgtttac

SEQ ID NO: 86118 - DNA, 25 bp, Rattus norvegicus
accggtgtagtgtgcccatgtttac

SEQ ID NO: 86119 - DNA, 25 bp, Rattus norvegicus
accggtgtcctacaactgctggaga

SEQ ID NO: 86120 - DNA, 25 bp, Rattus norvegicus
accggtgtcctagaactgctggaga

SEQ ID NO: 86121 - DNA, 25 bp, Rattus norvegicus
accggttaagtcaatgtatggcaca

SEQ ID NO: 86122 - DNA, 25 bp, Rattus norvegicus
accggttaagtctatgtatggcaca

SEQ ID NO: 86123 - DNA, 25 bp, Rattus norvegicus
accggttcaggaagctggtggtcaa

SEQ ID NO: 86124 - DNA, 25 bp, Rattus norvegicus
accggttcaggatgctggtggtcaa

SEQ ID NO: 86125 - DNA, 25 bp, Rattus norvegicus
accgtaatttacaacgctccgtgag

SEQ ID NO: 86126 - DNA, 25 bp, Rattus norvegicus
accgtaatttactacgctccgtgag

SEQ ID NO: 86127 - DNA, 25 bp, Rattus norvegicus
accgtaccatgtagacttgtttttg

SEQ ID NO: 86128 - DNA, 25 bp, Rattus norvegicus
accgtaccatgttgacttgtttttg

SEQ ID NO: 86129 - DNA, 25 bp, Rattus norvegicus
accgtaccggtgacttggtgagcac

SEQ ID NO: 86130 - DNA, 25 bp, Rattus norvegicus
accgtaccggtgtcttggtgagcac

SEQ ID NO: 86131 - DNA, 25 bp, Rattus norvegicus
accgtactcaacatacccagagctt

SEQ ID NO: 86132 - DNA, 25 bp, Rattus norvegicus
accgtactcaacttacccagagctt

SEQ ID NO: 86133 - DNA, 25 bp, Rattus norvegicus
accgtactcacgcaacgtatgactg

SEQ ID NO: 86134 - DNA, 25 bp, Rattus norvegicus
accgtactcacggaacgtatgactg

SEQ ID NO: 86135 - DNA, 25 bp, Rattus norvegicus
accgtactcgacatactgtttgttg

SEQ ID NO: 86136 - DNA, 25 bp, Rattus norvegicus
accgtactcgacttactgtttgttg

SEQ ID NO: 86137 - DNA, 25 bp, Rattus norvegicus
accgtagaagtgacccgtgtgcaga

SEQ ID NO: 86138 - DNA, 25 bp, Rattus norvegicus
accgtagaagtgtcccgtgtgcaga

SEQ ID NO: 86139 - DNA, 25 bp, Rattus norvegicus
accgtagtccctccatatcatgatt

SEQ ID NO: 86140 - DNA, 25 bp, Rattus norvegicus
accgtagtccctgcatatcatgatt

SEQ ID NO: 86141 - DNA, 25 bp, Rattus norvegicus
accgtagtgaatactgtgtccccag

SEQ ID NO: 86142 - DNA, 25 bp, Rattus norvegicus
accgtagtgaattctgtgtccccag

SEQ ID NO: 86143 - DNA, 25 bp, Rattus norvegicus
accgtatatactccaaagttcccaa

SEQ ID NO: 86144 - DNA, 25 bp, Rattus norvegicus
accgtatatactgcaaagttcccaa

SEQ ID NO: 86145 - DNA, 25 bp, Rattus norvegicus
accgtatatttcaagtgtccccaat

SEQ ID NO: 86146 - DNA, 25 bp, Rattus norvegicus
accgtatatttctagtgtccccaat

SEQ ID NO: 86147 - DNA, 25 bp, Rattus norvegicus
accgtattccgtcataaccttgagg

SEQ ID NO: 86148 - DNA, 25 bp, Rattus norvegicus
accgtattccgtgataaccttgagg

SEQ ID NO: 86149 - DNA, 25 bp, Rattus norvegicus
accgtattgagacgcgtcgcgcaga

SEQ ID NO: 86150 - DNA, 25 bp, Rattus norvegicus
accgtattgagaggcgtcgcgcaga

SEQ ID NO: 86151 - DNA, 25 bp, Rattus norvegicus
accgtatttcatcttgctaggcaca

SEQ ID NO: 86152 - DNA, 25 bp, Rattus norvegicus
accgtatttcatgttgctaggcaca

SEQ ID NO: 86153 - DNA, 25 bp, Rattus norvegicus
accgtcaccctcagattgatttaaa

SEQ ID NO: 86154 - DNA, 25 bp, Rattus norvegicus
accgtcaccctctgattgatttaaa

SEQ ID NO: 86155 - DNA, 25 bp, Rattus norvegicus
accgtcacctacctcttgattttga

SEQ ID NO: 86156 - DNA, 25 bp, Rattus norvegicus
accgtcacctacgtcttgattttga

SEQ ID NO: 86157 - DNA, 25 bp, Rattus norvegicus
accgtcacgagcacacttcgtggaa

SEQ ID NO: 86158 - DNA, 25 bp, Rattus norvegicus
accgtcacgagctcacttcgtggaa

SEQ ID NO: 86159 - DNA, 25 bp, Rattus norvegicus
accgtcacgtcaacagagggcacaa

SEQ ID NO: 86160 - DNA, 25 bp, Rattus norvegicus
accgtcacgtcatcagagggcacaa

SEQ ID NO: 86161 - DNA, 25 bp, Rattus norvegicus
accgtcagctagagccattggccac

SEQ ID NO: 86162 - DNA, 25 bp, Rattus norvegicus
accgtcagctagtgccattggccac

SEQ ID NO: 86163 - DNA, 25 bp, Rattus norvegicus
accgtcatcatgcaagtgtcgtcat

SEQ ID NO: 86164 - DNA, 25 bp, Rattus norvegicus
accgtcatcatggaagtgtcgtcat

SEQ ID NO: 86165 - DNA, 25 bp, Rattus norvegicus
accgtccgtctgaagggcatctgat

SEQ ID NO: 86166 - DNA, 25 bp, Rattus norvegicus
accgtccgtctgtagggcatctgat

SEQ ID NO: 86167 - DNA, 25 bp, Rattus norvegicus
accgtcctcacgcaaacaacagagt

SEQ ID NO: 86168 - DNA, 25 bp, Rattus norvegicus
accgtcctcacggaaacaacagagt

SEQ ID NO: 86169 - DNA, 25 bp, Rattus norvegicus
accgtcctgggaatcgtgtatgact

SEQ ID NO: 86170 - DNA, 25 bp, Rattus norvegicus
accgtcctgggattcgtgtatgact

SEQ ID NO: 86171 - DNA, 25 bp, Rattus norvegicus
accgtccttcatcataccaagttac

SEQ ID NO: 86172 - DNA, 25 bp, Rattus norvegicus
accgtccttcatgataccaagttac

SEQ ID NO: 86173 - DNA, 25 bp, Rattus norvegicus
accgtcgcaaatctcctcagtgtat

SEQ ID NO: 86174 - DNA, 25 bp, Rattus norvegicus
accgtcgcaaatgtcctcagtgtat

SEQ ID NO: 86175 - DNA, 25 bp, Rattus norvegicus
accgtcgctattaccgctgctctat

SEQ ID NO: 86176 - DNA, 25 bp, Rattus norvegicus
accgtcgctatttccgctgctctat

SEQ ID NO: 86177 - DNA, 25 bp, Rattus norvegicus
accgtcgtgggtcacatcattgcca

SEQ ID NO: 86178 - DNA, 25 bp, Rattus norvegicus
accgtcgtgggtgacatcattgcca

SEQ ID NO: 86179 - DNA, 25 bp, Rattus norvegicus
accgtcgttgtgagatagagtgttt

SEQ ID NO: 86180 - DNA, 25 bp, Rattus norvegicus
accgtcgttgtgtgatagagtgttt

SEQ ID NO: 86181 - DNA, 25 bp, Rattus norvegicus
accgtctccagcagaccagagtcag

SEQ ID NO: 86182 - DNA, 25 bp, Rattus norvegicus
accgtctccagctgaccagagtcag

SEQ ID NO: 86183 - DNA, 25 bp, Rattus norvegicus
accgtctccgttctagtctataaag

SEQ ID NO: 86184 - DNA, 25 bp, Rattus norvegicus
accgtctccgttgtagtctataaag

SEQ ID NO: 86185 - DNA, 25 bp, Rattus norvegicus
accgtctcctatcccaggatttaat

SEQ ID NO: 86186 - DNA, 25 bp, Rattus norvegicus
accgtctcctatgccaggatttaat

SEQ ID NO: 86187 - DNA, 25 bp, Rattus norvegicus
accgtctcctgcataagttcattag

SEQ ID NO: 86188 - DNA, 25 bp, Rattus norvegicus
accgtctcctgcttaagttcattag

SEQ ID NO: 86189 - DNA, 25 bp, Rattus norvegicus
accgtctccttcacggatcatgaag

SEQ ID NO: 86190 - DNA, 25 bp, Rattus norvegicus
accgtctccttctcggatcatgaag

SEQ ID NO: 86191 - DNA, 25 bp, Rattus norvegicus
accgtctgctcccaaagggcagcta

SEQ ID NO: 86192 - DNA, 25 bp, Rattus norvegicus
accgtctgctccgaaagggcagcta

SEQ ID NO: 86193 - DNA, 25 bp, Rattus norvegicus
accgtctgctttacaagggcaacta

SEQ ID NO: 86194 - DNA, 25 bp, Rattus norvegicus
accgtctgcttttcaagggcaacta

SEQ ID NO: 86195 - DNA, 25 bp, Rattus norvegicus
accgtctggcatcgtgtatccacat

SEQ ID NO: 86196 - DNA, 25 bp, Rattus norvegicus
accgtctggcatggtgtatccacat

SEQ ID NO: 86197 - DNA, 25 bp, Rattus norvegicus
accgtctgtctgctgattcgttaaa

SEQ ID NO: 86198 - DNA, 25 bp, Rattus norvegicus
accgtctgtctggtgattcgttaaa

SEQ ID NO: 86199 - DNA, 25 bp, Rattus norvegicus
accgtctgtgctcgagtctacgtaa

SEQ ID NO: 86200 - DNA, 25 bp, Rattus norvegicus
accgtctgtgctggagtctacgtaa

SEQ ID NO: 86201 - DNA, 25 bp, Rattus norvegicus
accgtctgtggactttctgctgcaa

SEQ ID NO: 86202 - DNA, 25 bp, Rattus norvegicus
accgtctgtggagtttctgctgcaa

SEQ ID NO: 86203 - DNA, 25 bp, Rattus norvegicus
accgtcttaatgatacttcgctatg

SEQ ID NO: 86204 - DNA, 25 bp, Rattus norvegicus
accgtcttaatgttacttcgctatg

SEQ ID NO: 86205 - DNA, 25 bp, Rattus norvegicus
accgtcttacgtactgtgtgtgaga

SEQ ID NO: 86206 - DNA, 25 bp, Rattus norvegicus
accgtcttacgttctgtgtgtgaga

SEQ ID NO: 86207 - DNA, 25 bp, Rattus norvegicus
accgtcttcgtgctgtttatcgcta

SEQ ID NO: 86208 - DNA, 25 bp, Rattus norvegicus
accgtcttcgtggtgtttatcgcta

SEQ ID NO: 86209 - DNA, 25 bp, Rattus norvegicus
accgtgaacaagaccatcgcctatg

SEQ ID NO: 86210 - DNA, 25 bp, Rattus norvegicus
accgtgaacaagtccatcgcctatg

SEQ ID NO: 86211 - DNA, 25 bp, Rattus norvegicus
accgtgaagtggctgttgatctaca

SEQ ID NO: 86212 - DNA, 25 bp, Rattus norvegicus
accgtgaagtgggtgttgatctaca

SEQ ID NO: 86213 - DNA, 25 bp, Rattus norvegicus
accgtgaagttcaggctgtctggcg

SEQ ID NO: 86214 - DNA, 25 bp, Rattus norvegicus
accgtgaagttctggctgtctggcg

SEQ ID NO: 86215 - DNA, 25 bp, Rattus norvegicus
accgtgaatggtaatgtgctcccga

SEQ ID NO: 86216 - DNA, 25 bp, Rattus norvegicus
accgtgaatggttatgtgctcccga

SEQ ID NO: 86217 - DNA, 25 bp, Rattus norvegicus
accgtgacctgaccaagccattgct

SEQ ID NO: 86218 - DNA, 25 bp, Rattus norvegicus
accgtgacctgagcaagccattgct

SEQ ID NO: 86219 - DNA, 25 bp, Rattus norvegicus
accgtgacctgcctgaagaactatg

SEQ ID NO: 86220 - DNA, 25 bp, Rattus norvegicus
accgtgacctgcgtgaagaactatg

SEQ ID NO: 86221 - DNA, 25 bp, Rattus norvegicus
accgtgactccgagattttgtgggc

SEQ ID NO: 86222 - DNA, 25 bp, Rattus norvegicus
accgtgactccgtgattttgtgggc

SEQ ID NO: 86223 - DNA, 25 bp, Rattus norvegicus
accgtgactgcacctgtgcttggtg

SEQ ID NO: 86224 - DNA, 25 bp, Rattus norvegicus
accgtgactgcagctgtgcttggtg

SEQ ID NO: 86225 - DNA, 25 bp, Rattus norvegicus
accgtgacttccagtgtgacaacac

SEQ ID NO: 86226 - DNA, 25 bp, Rattus norvegicus
accgtgacttcctgtgtgacaacac

SEQ ID NO: 86227 - DNA, 25 bp, Rattus norvegicus
accgtgagccctctgtatggcatat

SEQ ID NO: 86228 - DNA, 25 bp, Rattus norvegicus
accgtgagccctgtgtatggcatat

SEQ ID NO: 86229 - DNA, 25 bp, Rattus norvegicus
accgtgatagagctcatatgtatga

SEQ ID NO: 86230 - DNA, 25 bp, Rattus norvegicus
accgtgatagaggtcatatgtatga

SEQ ID NO: 86231 - DNA, 25 bp, Rattus norvegicus
accgtgcacaggacagggctcagag

SEQ ID NO: 86232 - DNA, 25 bp, Rattus norvegicus
accgtgcacaggtcagggctcagag

SEQ ID NO: 86233 - DNA, 25 bp, Rattus norvegicus
accgtgcctgatcttgggtcagaaa

SEQ ID NO: 86234 - DNA, 25 bp, Rattus norvegicus
accgtgcctgatgttgggtcagaaa

SEQ ID NO: 86235 - DNA, 25 bp, Rattus norvegicus
accgtgcctgctaatcaacattgtc

SEQ ID NO: 86236 - DNA, 25 bp, Rattus norvegicus
accgtgcctgcttatcaacattgtc

SEQ ID NO: 86237 - DNA, 25 bp, Rattus norvegicus
accgtgcggtacacactagagctga

SEQ ID NO: 86238 - DNA, 25 bp, Rattus norvegicus
accgtgcggtactcactagagctga

SEQ ID NO: 86239 - DNA, 25 bp, Rattus norvegicus
accgtgctactgatgtgtctcaaag

SEQ ID NO: 86240 - DNA, 25 bp, Rattus norvegicus
accgtgctactgttgtgtctcaaag

SEQ ID NO: 86241 - DNA, 25 bp, Rattus norvegicus
accgtgctctatcactgcattgcag

SEQ ID NO: 86242 - DNA, 25 bp, Rattus norvegicus
accgtgctctatgactgcattgcag

SEQ ID NO: 86243 - DNA, 25 bp, Rattus norvegicus
accgtgctggtaagggaatgtgccc

SEQ ID NO: 86244 - DNA, 25 bp, Rattus norvegicus
accgtgctggtatgggaatgtgccc

SEQ ID NO: 86245 - DNA, 25 bp, Rattus norvegicus
accgtgctgtacatgtgcagacgca

SEQ ID NO: 86246 - DNA, 25 bp, Rattus norvegicus
accgtgctgtacttgtgcagacgca

SEQ ID NO: 86247 - DNA, 25 bp, Rattus norvegicus
accgtgctgtgcctaatctgtgttc

SEQ ID NO: 86248 - DNA, 25 bp, Rattus norvegicus
accgtgctgtgcgtaatctgtgttc

SEQ ID NO: 86249 - DNA, 25 bp, Rattus norvegicus
accgtgcttgttactttcctggatg

SEQ ID NO: 86250 - DNA, 25 bp, Rattus norvegicus
accgtgcttgtttctttcctggatg

SEQ ID NO: 86251 - DNA, 25 bp, Rattus norvegicus
accgtgctttaacaaatactagaca

SEQ ID NO: 86252 - DNA, 25 bp, Rattus norvegicus
accgtgctttaagaaatactagaca

SEQ ID NO: 86253 - DNA, 25 bp, Rattus norvegicus
accgtggacagaacgcggcagcagc

SEQ ID NO: 86254 - DNA, 25 bp, Rattus norvegicus
accgtggacagatcgcggcagcagc

SEQ ID NO: 86255 - DNA, 25 bp, Rattus norvegicus
accgtggacggtctgtgaactgtac

SEQ ID NO: 86256 - DNA, 25 bp, Rattus norvegicus
accgtggacggtgtgtgaactgtac

SEQ ID NO: 86257 - DNA, 25 bp, Rattus norvegicus
accgtggcctacctgggcaaaatga

SEQ ID NO: 86258 - DNA, 25 bp, Rattus norvegicus
accgtggcctacgtgggcaaaatga

SEQ ID NO: 86259 - DNA, 25 bp, Rattus norvegicus
accgtggcctggcattccatctgga

SEQ ID NO: 86260 - DNA, 25 bp, Rattus norvegicus
accgtggcctgggattccatctgga

SEQ ID NO: 86261 - DNA, 25 bp, Rattus norvegicus
accgtggcgttaagtcacattcctg

SEQ ID NO: 86262 - DNA, 25 bp, Rattus norvegicus
accgtggcgttatgtcacattcctg

SEQ ID NO: 86263 - DNA, 25 bp, Rattus norvegicus
accgtgggaagcacagtcccatcag

SEQ ID NO: 86264 - DNA, 25 bp, Rattus norvegicus
accgtgggaagctcagtcccatcag

SEQ ID NO: 86265 - DNA, 25 bp, Rattus norvegicus
accgtgggcaccatgatgacctgtg

SEQ ID NO: 86266 - DNA, 25 bp, Rattus norvegicus
accgtgggcaccttgatgacctgtg

SEQ ID NO: 86267 - DNA, 25 bp, Rattus norvegicus
accgtgggctctcgttatttgtata

SEQ ID NO: 86268 - DNA, 25 bp, Rattus norvegicus
accgtgggctctggttatttgtata

SEQ ID NO: 86269 - DNA, 25 bp, Rattus norvegicus
accgtgggtggaatggactctgctc

SEQ ID NO: 86270 - DNA, 25 bp, Rattus norvegicus
accgtgggtggacatcttaccgtct

SEQ ID NO: 86271 - DNA, 25 bp, Rattus norvegicus
accgtgggtggagatcttaccgtct

SEQ ID NO: 86272 - DNA, 25 bp, Rattus norvegicus
accgtgggtggattggactctgctc

SEQ ID NO: 86273 - DNA, 25 bp, Rattus norvegicus
accgtgggtggcagtgttctctaga

SEQ ID NO: 86274 - DNA, 25 bp, Rattus norvegicus
accgtgggtggctgtgttctctaga

SEQ ID NO: 86275 - DNA, 25 bp, Rattus norvegicus
accgtggtgggtatatatgccttca

SEQ ID NO: 86276 - DNA, 25 bp, Rattus norvegicus
accgtggtgggtttatatgccttca

SEQ ID NO: 86277 - DNA, 25 bp, Rattus norvegicus
accgtgtaaatgcttctctcgtggc

SEQ ID NO: 86278 - DNA, 25 bp, Rattus norvegicus
accgtgtaaatggttctctcgtggc

SEQ ID NO: 86279 - DNA, 25 bp, Rattus norvegicus
accgtgtagctgagttgctcttcag

SEQ ID NO: 86280 - DNA, 25 bp, Rattus norvegicus
accgtgtagctgtgttgctcttcag

SEQ ID NO: 86281 - DNA, 25 bp, Rattus norvegicus
accgtgtattaaatgccagtgttta

SEQ ID NO: 86282 - DNA, 25 bp, Rattus norvegicus
accgtgtattaattgccagtgttta

SEQ ID NO: 86283 - DNA, 25 bp, Rattus norvegicus
accgtgtcacgaaagagcccagaat

SEQ ID NO: 86284 - DNA, 25 bp, Rattus norvegicus
accgtgtcacgatagagcccagaat

SEQ ID NO: 86285 - DNA, 25 bp, Rattus norvegicus
accgtgtccagcattctttgcaata

SEQ ID NO: 86286 - DNA, 25 bp, Rattus norvegicus
accgtgtccagcctgagaccaattg

SEQ ID NO: 86287 - DNA, 25 bp, Rattus norvegicus
accgtgtccagcgtgagaccaattg

SEQ ID NO: 86288 - DNA, 25 bp, Rattus norvegicus
accgtgtccagctttctttgcaata

SEQ ID NO: 86289 - DNA, 25 bp, Rattus norvegicus
accgtgtcccagcagaagctataga

SEQ ID NO: 86290 - DNA, 25 bp, Rattus norvegicus
accgtgtcccaggagaagctataga

SEQ ID NO: 86291 - DNA, 25 bp, Rattus norvegicus
accgtgtgataacgtcgtgtgctgt

SEQ ID NO: 86292 - DNA, 25 bp, Rattus norvegicus
accgtgtgataaggtcgtgtgctgt

SEQ ID NO: 86293 - DNA, 25 bp, Rattus norvegicus
accgtgtgcgcaactttggtggcaa

SEQ ID NO: 86294 - DNA, 25 bp, Rattus norvegicus
accgtgtgcgcatctttggtggcaa

SEQ ID NO: 86295 - DNA, 25 bp, Rattus norvegicus
accgtgtgctggagggcttcatcaa

SEQ ID NO: 86296 - DNA, 25 bp, Rattus norvegicus
accgtgtgctggtgggcttcatcaa

SEQ ID NO: 86297 - DNA, 25 bp, Rattus norvegicus
accgtgtgtctaattgtgtgttgca

SEQ ID NO: 86298 - DNA, 25 bp, Rattus norvegicus
accgtgtgtctatttgtgtgttgca

SEQ ID NO: 86299 - DNA, 25 bp, Rattus norvegicus
accgtgttcagtacctatgttttca

SEQ ID NO: 86300 - DNA, 25 bp, Rattus norvegicus
accgtgttcagttcctatgttttca

SEQ ID NO: 86301 - DNA, 25 bp, Rattus norvegicus
accgtgtttgccctgatgctgatca

SEQ ID NO: 86302 - DNA, 25 bp, Rattus norvegicus
accgtgtttgccgtgatgctgatca

SEQ ID NO: 86303 - DNA, 25 bp, Rattus norvegicus
accgtgttttgtcttctctatgtca

SEQ ID NO: 86304 - DNA, 25 bp, Rattus norvegicus
accgtgttttgtgttctctatgtca

SEQ ID NO: 86305 - DNA, 25 bp, Rattus norvegicus
accgttacctggacgtggtcaatcg

SEQ ID NO: 86306 - DNA, 25 bp, Rattus norvegicus
accgttacctggtcgtggtcaatcg

SEQ ID NO: 86307 - DNA, 25 bp, Rattus norvegicus
accgttatctacagctgtcctatat

SEQ ID NO: 86308 - DNA, 25 bp, Rattus norvegicus
accgttatctactgctgtcctatat

SEQ ID NO: 86309 - DNA, 25 bp, Rattus norvegicus
accgttcacgctaaggagacgcatg

SEQ ID NO: 86310 - DNA, 25 bp, Rattus norvegicus
accgttcacgcttaggagacgcatg

SEQ ID NO: 86311 - DNA, 25 bp, Rattus norvegicus
accgttcagagcctattttgcattt

SEQ ID NO: 86312 - DNA, 25 bp, Rattus norvegicus
accgttcagagcgtattttgcattt

SEQ ID NO: 86313 - DNA, 25 bp, Rattus norvegicus
accgttcatcatccgtcagatggac

SEQ ID NO: 86314 - DNA, 25 bp, Rattus norvegicus
accgttcatcatgcgtcagatggac

SEQ ID NO: 86315 - DNA, 25 bp, Rattus norvegicus
accgttcctgtactcatatggcgtt

SEQ ID NO: 86316 - DNA, 25 bp, Rattus norvegicus
accgttcctgtagtcatatggcgtt

SEQ ID NO: 86317 - DNA, 25 bp, Rattus norvegicus
accgttctatgaccgcttctctgaa

SEQ ID NO: 86318 - DNA, 25 bp, Rattus norvegicus
accgttctatgagcgcttctctgaa

SEQ ID NO: 86319 - DNA, 25 bp, Rattus norvegicus
accgttctccaacctctagaagaag

SEQ ID NO: 86320 - DNA, 25 bp, Rattus norvegicus
accgttctccaagctctagaagaag

SEQ ID NO: 86321 - DNA, 25 bp, Rattus norvegicus
accgttctccatagatctatgtgtg

SEQ ID NO: 86322 - DNA, 25 bp, Rattus norvegicus
accgttctccattgatctatgtgtg

SEQ ID NO: 86323 - DNA, 25 bp, Rattus norvegicus
accgttctggccagactgaacagtg

SEQ ID NO: 86324 - DNA, 25 bp, Rattus norvegicus
accgttctggcctgactgaacagtg

SEQ ID NO: 86325 - DNA, 25 bp, Rattus norvegicus
accgttctgtttcatgcttattcca

SEQ ID NO: 86326 - DNA, 25 bp, Rattus norvegicus
accgttctgtttgatgcttattcca

SEQ ID NO: 86327 - DNA, 25 bp, Rattus norvegicus
accgttcttcgtctgtttcatggac

SEQ ID NO: 86328 - DNA, 25 bp, Rattus norvegicus
accgttcttcgtgtgtttcatggac

SEQ ID NO: 86329 - DNA, 25 bp, Rattus norvegicus
accgttcttctcacttctggaagtt

SEQ ID NO: 86330 - DNA, 25 bp, Rattus norvegicus
accgttcttctctcttctggaagtt

SEQ ID NO: 86331 - DNA, 25 bp, Rattus norvegicus
accgttcttttcactctggtggata

SEQ ID NO: 86332 - DNA, 25 bp, Rattus norvegicus
accgttcttttctctctggtggata

SEQ ID NO: 86333 - DNA, 25 bp, Rattus norvegicus
accgttgctgcaatcctgggaggag

SEQ ID NO: 86334 - DNA, 25 bp, Rattus norvegicus
accgttgctgcattcctgggaggag

SEQ ID NO: 86335 - DNA, 25 bp, Rattus norvegicus
accgttgctggtatggaattcacac

SEQ ID NO: 86336 - DNA, 25 bp, Rattus norvegicus
accgttgctggtttggaattcacac

SEQ ID NO: 86337 - DNA, 25 bp, Rattus norvegicus
accgttggctttatcagggaacact

SEQ ID NO: 86338 - DNA, 25 bp, Rattus norvegicus
accgttggctttttcagggaacact

SEQ ID NO: 86339 - DNA, 25 bp, Rattus norvegicus
accgttgggcaacgattgctaaaat

SEQ ID NO: 86340 - DNA, 25 bp, Rattus norvegicus
accgttgggcaaggattgctaaaat

SEQ ID NO: 86341 - DNA, 25 bp, Rattus norvegicus
accgttggtgtgagactgccagtca

SEQ ID NO: 86342 - DNA, 25 bp, Rattus norvegicus
accgttggtgtgtgactgccagtca

SEQ ID NO: 86343 - DNA, 25 bp, Rattus norvegicus
accgttgtagctaccttcagcaaaa

SEQ ID NO: 86344 - DNA, 25 bp, Rattus norvegicus
accgttgtagcttccttcagcaaaa

SEQ ID NO: 86345 - DNA, 25 bp, Rattus norvegicus
accgttgtcacaccagcagtttgaa

SEQ ID NO: 86346 - DNA, 25 bp, Rattus norvegicus
accgttgtcacagcagcagtttgaa

SEQ ID NO: 86347 - DNA, 25 bp, Rattus norvegicus
accgttgtccatctgaatactgact

SEQ ID NO: 86348 - DNA, 25 bp, Rattus norvegicus
accgttgtccatgtgaatactgact

SEQ ID NO: 86349 - DNA, 25 bp, Rattus norvegicus
accgttgtcgccacagcaacttgga

SEQ ID NO: 86350 - DNA, 25 bp, Rattus norvegicus
accgttgtcgcctcagcaacttgga

SEQ ID NO: 86351 - DNA, 25 bp, Rattus norvegicus
accgttgtctttactcctgggctct

SEQ ID NO: 86352 - DNA, 25 bp, Rattus norvegicus
accgttgtcttttctcctgggctct

SEQ ID NO: 86353 - DNA, 25 bp, Rattus norvegicus
accgttgttgtcatggcactcatct

SEQ ID NO: 86354 - DNA, 25 bp, Rattus norvegicus
accgttgttgtcttggcactcatct

SEQ ID NO: 86355 - DNA, 25 bp, Rattus norvegicus
accgtttggcggcacaagctggact

SEQ ID NO: 86356 - DNA, 25 bp, Rattus norvegicus
accgtttggcgggacaagctggact

SEQ ID NO: 86357 - DNA, 25 bp, Rattus norvegicus
accgttttcaccctcaatatcaata

SEQ ID NO: 86358 - DNA, 25 bp, Rattus norvegicus
accgttttcaccgtcaatatcaata

SEQ ID NO: 86359 - DNA, 25 bp, Rattus norvegicus
acctaaaattctagtagtctgtaga

SEQ ID NO: 86360 - DNA, 25 bp, Rattus norvegicus
acctaaaattcttgtagtctgtaga

SEQ ID NO: 86361 - DNA, 25 bp, Rattus norvegicus
acctaaacactacgtggtggtgcac

SEQ ID NO: 86362 - DNA, 25 bp, Rattus norvegicus
acctaaacactaggtggtggtgcac

SEQ ID NO: 86363 - DNA, 25 bp, Rattus norvegicus
acctaaagacttctaacagtaatat

SEQ ID NO: 86364 - DNA, 25 bp, Rattus norvegicus
acctaaagacttgtaacagtaatat

SEQ ID NO: 86365 - DNA, 25 bp, Rattus norvegicus
acctaaaggcgcatctgaggacgca

SEQ ID NO: 86366 - DNA, 25 bp, Rattus norvegicus
acctaaaggcgcttctgaggacgca

SEQ ID NO: 86367 - DNA, 25 bp, Rattus norvegicus
acctaaagttcccttcaagccagat

SEQ ID NO: 86368 - DNA, 25 bp, Rattus norvegicus
acctaaagttccgttcaagccagat

SEQ ID NO: 86369 - DNA, 25 bp, Rattus norvegicus
acctaaatccatactggcctgaaag

SEQ ID NO: 86370 - DNA, 25 bp, Rattus norvegicus
acctaaatccattctggcctgaaag

SEQ ID NO: 86371 - DNA, 25 bp, Rattus norvegicus
acctaaatctgtattcatggctaat

SEQ ID NO: 86372 - DNA, 25 bp, Rattus norvegicus
acctaaatctgttttcatggctaat

SEQ ID NO: 86373 - DNA, 25 bp, Rattus norvegicus
acctaacaaaccagtgatggctttt

SEQ ID NO: 86374 - DNA, 25 bp, Rattus norvegicus
acctaacaaacctgtgatggctttt

SEQ ID NO: 86375 - DNA, 25 bp, Rattus norvegicus
acctaacccatacggctttgctggt

SEQ ID NO: 86376 - DNA, 25 bp, Rattus norvegicus
acctaacccatagggctttgctggt

SEQ ID NO: 86377 - DNA, 25 bp, Rattus norvegicus
acctaacgttcccacactgtcttga

SEQ ID NO: 86378 - DNA, 25 bp, Rattus norvegicus
acctaacgttccgacactgtcttga

SEQ ID NO: 86379 - DNA, 25 bp, Rattus norvegicus
acctaactggtgagtgtgtcccggt

SEQ ID NO: 86380 - DNA, 25 bp, Rattus norvegicus
acctaactggtgtgtgtgtcccggt

SEQ ID NO: 86381 - DNA, 25 bp, Rattus norvegicus
acctaactttaactcccatctgttg

SEQ ID NO: 86382 - DNA, 25 bp, Rattus norvegicus
acctaactttaagtcccatctgttg

SEQ ID NO: 86383 - DNA, 25 bp, Rattus norvegicus
acctaagataggagctccccaattc

SEQ ID NO: 86384 - DNA, 25 bp, Rattus norvegicus
acctaagataggtgctccccaattc

SEQ ID NO: 86385 - DNA, 25 bp, Rattus norvegicus
acctaagcagggaccatgcctttaa

SEQ ID NO: 86386 - DNA, 25 bp, Rattus norvegicus
acctaagcagggtccatgcctttaa

SEQ ID NO: 86387 - DNA, 25 bp, Rattus norvegicus
acctaagtatatctattttcggcaa

SEQ ID NO: 86388 - DNA, 25 bp, Rattus norvegicus
acctaagtatatgtattttcggcaa

SEQ ID NO: 86389 - DNA, 25 bp, Rattus norvegicus
acctaagtcaggagctgccaggcaa

SEQ ID NO: 86390 - DNA, 25 bp, Rattus norvegicus
acctaagtcaggtgctgccaggcaa

SEQ ID NO: 86391 - DNA, 25 bp, Rattus norvegicus
acctaatcattcagcacctgcttgg

SEQ ID NO: 86392 - DNA, 25 bp, Rattus norvegicus
acctaatcattctgcacctgcttgg

SEQ ID NO: 86393 - DNA, 25 bp, Rattus norvegicus
acctaatgcctgatgtgaatattcc

SEQ ID NO: 86394 - DNA, 25 bp, Rattus norvegicus
acctaatgcctgttgtgaatattcc

SEQ ID NO: 86395 - DNA, 25 bp, Rattus norvegicus
acctaatggtgtacgcactctgcga

SEQ ID NO: 86396 - DNA, 25 bp, Rattus norvegicus
acctaatggtgttcgcactctgcga

SEQ ID NO: 86397 - DNA, 25 bp, Rattus norvegicus
acctaattacttcttgtctgggata

SEQ ID NO: 86398 - DNA, 25 bp, Rattus norvegicus
acctaattacttgttgtctgggata

SEQ ID NO: 86399 - DNA, 25 bp, Rattus norvegicus
acctaattggtgatcttgctccctt

SEQ ID NO: 86400 - DNA, 25 bp, Rattus norvegicus
acctaattggtgttcttgctccctt

SEQ ID NO: 86401 - DNA, 25 bp, Rattus norvegicus
acctaatttgttcgtgggcgcacac

SEQ ID NO: 86402 - DNA, 25 bp, Rattus norvegicus
acctaatttgttggtgggcgcacac

SEQ ID NO: 86403 - DNA, 25 bp, Rattus norvegicus
acctacaaccatcagatttttgaca

SEQ ID NO: 86404 - DNA, 25 bp, Rattus norvegicus
acctacaaccatgagatttttgaca

SEQ ID NO: 86405 - DNA, 25 bp, Rattus norvegicus
acctacaatcgcctacgttcaaatt

SEQ ID NO: 86406 - DNA, 25 bp, Rattus norvegicus
acctacaatcgcgtacgttcaaatt

SEQ ID NO: 86407 - DNA, 25 bp, Rattus norvegicus
acctacacaaccctgtcagttacag

SEQ ID NO: 86408 - DNA, 25 bp, Rattus norvegicus
acctacacaaccgtgtcagttacag

SEQ ID NO: 86409 - DNA, 25 bp, Rattus norvegicus
acctacactgttataccaaatcaag

SEQ ID NO: 86410 - DNA, 25 bp, Rattus norvegicus
acctacactgttttaccaaatcaag

SEQ ID NO: 86411 - DNA, 25 bp, Rattus norvegicus
acctacagagctcacggccggatta

SEQ ID NO: 86412 - DNA, 25 bp, Rattus norvegicus
acctacagagctgacggccggatta

SEQ ID NO: 86413 - DNA, 25 bp, Rattus norvegicus
acctacagccgccaccagtgtgagg

SEQ ID NO: 86414 - DNA, 25 bp, Rattus norvegicus
acctacagccgcgaccagtgtgagg

SEQ ID NO: 86415 - DNA, 25 bp, Rattus norvegicus
acctacatacatacctacctttgtt

SEQ ID NO: 86416 - DNA, 25 bp, Rattus norvegicus
acctacatacattcctacctttgtt

SEQ ID NO: 86417 - DNA, 25 bp, Rattus norvegicus
acctacatatcaaatgtctctgcaa

SEQ ID NO: 86418 - DNA, 25 bp, Rattus norvegicus
acctacatatcatatgtctctgcaa

SEQ ID NO: 86419 - DNA, 25 bp, Rattus norvegicus
acctacatcatgacttctctatgga

SEQ ID NO: 86420 - DNA, 25 bp, Rattus norvegicus
acctacatcatgtcttctctatgga

SEQ ID NO: 86421 - DNA, 25 bp, Rattus norvegicus
acctacattatgacagggctaccat

SEQ ID NO: 86422 - DNA, 25 bp, Rattus norvegicus
acctacattatgtcagggctaccat

SEQ ID NO: 86423 - DNA, 25 bp, Rattus norvegicus
acctacattcataaaggaatccttc

SEQ ID NO: 86424 - DNA, 25 bp, Rattus norvegicus
acctacattcattaaggaatccttc

SEQ ID NO: 86425 - DNA, 25 bp, Rattus norvegicus
acctacatttcaccatctgtcctgt

SEQ ID NO: 86426 - DNA, 25 bp, Rattus norvegicus
acctacatttcagcatctgtcctgt

SEQ ID NO: 86427 - DNA, 25 bp, Rattus norvegicus
acctaccaatatctgtgtttctttt

SEQ ID NO: 86428 - DNA, 25 bp, Rattus norvegicus
acctaccaatatgtgtgtttctttt

SEQ ID NO: 86429 - DNA, 25 bp, Rattus norvegicus
acctaccaccgactcatggataaag

SEQ ID NO: 86430 - DNA, 25 bp, Rattus norvegicus
acctaccaccgagtcatggataaag

SEQ ID NO: 86431 - DNA, 25 bp, Rattus norvegicus
acctaccagggtcatgtctactact

SEQ ID NO: 86432 - DNA, 25 bp, Rattus norvegicus
acctaccagggtgatgtctactact

SEQ ID NO: 86433 - DNA, 25 bp, Rattus norvegicus
acctaccataacagcaggatcctct

SEQ ID NO: 86434 - DNA, 25 bp, Rattus norvegicus
acctaccataactgcaggatcctct

SEQ ID NO: 86435 - DNA, 25 bp, Rattus norvegicus
acctaccatgctctggctagacttg

SEQ ID NO: 86436 - DNA, 25 bp, Rattus norvegicus
acctaccatgctgtggctagacttg

SEQ ID NO: 86437 - DNA, 25 bp, Rattus norvegicus
acctaccatttcaacttcacagttt

SEQ ID NO: 86438 - DNA, 25 bp, Rattus norvegicus
acctaccatttctacttcacagttt

SEQ ID NO: 86439 - DNA, 25 bp, Rattus norvegicus
acctaccccgatcagggtgctggag

SEQ ID NO: 86440 - DNA, 25 bp, Rattus norvegicus
acctaccccgatgagggtgctggag

SEQ ID NO: 86441 - DNA, 25 bp, Rattus norvegicus
acctaccctttcacttattacagat

SEQ ID NO: 86442 - DNA, 25 bp, Rattus norvegicus
acctaccctttctcttattacagat

SEQ ID NO: 86443 - DNA, 25 bp, Rattus norvegicus
acctacctgagtcttctgtttgtct

SEQ ID NO: 86444 - DNA, 25 bp, Rattus norvegicus
acctacctgagtgttctgtttgtct

SEQ ID NO: 86445 - DNA, 25 bp, Rattus norvegicus
acctacctgcttcgctgagaaacgt

SEQ ID NO: 86446 - DNA, 25 bp, Rattus norvegicus
acctacctgcttggctgagaaacgt

SEQ ID NO: 86447 - DNA, 25 bp, Rattus norvegicus
acctacctggtgacaagcgtgctgc

SEQ ID NO: 86448 - DNA, 25 bp, Rattus norvegicus
acctacctggtgtcaagcgtgctgc

SEQ ID NO: 86449 - DNA, 25 bp, Rattus norvegicus
acctacctgtcaaccttgttggaaa

SEQ ID NO: 86450 - DNA, 25 bp, Rattus norvegicus
acctacctgtcatccttgttggaaa

SEQ ID NO: 86451 - DNA, 25 bp, Rattus norvegicus
acctaccttcataggcactgggtaa

SEQ ID NO: 86452 - DNA, 25 bp, Rattus norvegicus
acctaccttcattggcactgggtaa

SEQ ID NO: 86453 - DNA, 25 bp, Rattus norvegicus
acctaccttggtcttttgccaggct

SEQ ID NO: 86454 - DNA, 25 bp, Rattus norvegicus
acctaccttggtgttttgccaggct

SEQ ID NO: 86455 - DNA, 25 bp, Rattus norvegicus
acctacctttgtctttgccacatgt

SEQ ID NO: 86456 - DNA, 25 bp, Rattus norvegicus
acctacctttgtgtttgccacatgt

SEQ ID NO: 86457 - DNA, 25 bp, Rattus norvegicus
acctacgaatacctagtgacactcc

SEQ ID NO: 86458 - DNA, 25 bp, Rattus norvegicus
acctacgaatacgtagtgacactcc

SEQ ID NO: 86459 - DNA, 25 bp, Rattus norvegicus
acctacgtgtatctgccacatgcat

SEQ ID NO: 86460 - DNA, 25 bp, Rattus norvegicus
acctacgtgtatgtgccacatgcat

SEQ ID NO: 86461 - DNA, 25 bp, Rattus norvegicus
acctactaggagactgctctactat

SEQ ID NO: 86462 - DNA, 25 bp, Rattus norvegicus
acctactaggagtctgctctactat

SEQ ID NO: 86463 - DNA, 25 bp, Rattus norvegicus
acctactgcaccaaagttctcgatt

SEQ ID NO: 86464 - DNA, 25 bp, Rattus norvegicus
acctactgcacctaagttctcgatt

SEQ ID NO: 86465 - DNA, 25 bp, Rattus norvegicus
acctactgcctcctcataggaggag

SEQ ID NO: 86466 - DNA, 25 bp, Rattus norvegicus
acctactgcctcgtcataggaggag

SEQ ID NO: 86467 - DNA, 25 bp, Rattus norvegicus
acctactggagaaactgtccctcaa

SEQ ID NO: 86468 - DNA, 25 bp, Rattus norvegicus
acctactggagatactgtccctcaa

SEQ ID NO: 86469 - DNA, 25 bp, Rattus norvegicus
acctactgggtaactctggctaata

SEQ ID NO: 86470 - DNA, 25 bp, Rattus norvegicus
acctactgggtatctctggctaata

SEQ ID NO: 86471 - DNA, 25 bp, Rattus norvegicus
acctactgtctcaagtgtattcgca

SEQ ID NO: 86472 - DNA, 25 bp, Rattus norvegicus
acctactgtctctagtgtattcgca

SEQ ID NO: 86473 - DNA, 25 bp, Rattus norvegicus
acctactgtgagctggtgacatgtg

SEQ ID NO: 86474 - DNA, 25 bp, Rattus norvegicus
acctactgtgaggtggtgacatgtg

SEQ ID NO: 86475 - DNA, 25 bp, Rattus norvegicus
acctactgtgggattgttagtgctc

SEQ ID NO: 86476 - DNA, 25 bp, Rattus norvegicus
acctactgtgggtttgttagtgctc

SEQ ID NO: 86477 - DNA, 25 bp, Rattus norvegicus
acctactgtgtgcttcttctagggc

SEQ ID NO: 86478 - DNA, 25 bp, Rattus norvegicus
acctactgtgtggttcttctagggc

SEQ ID NO: 86479 - DNA, 25 bp, Rattus norvegicus
acctacttcagacttcagaccgagt

SEQ ID NO: 86480 - DNA, 25 bp, Rattus norvegicus
acctacttcagagttcagaccgagt

SEQ ID NO: 86481 - DNA, 25 bp, Rattus norvegicus
acctacttgtcgcatggcgctgaaa

SEQ ID NO: 86482 - DNA, 25 bp, Rattus norvegicus
acctacttgtcggatggcgctgaaa

SEQ ID NO: 86483 - DNA, 25 bp, Rattus norvegicus
acctactttaggcagcgagtccttg

SEQ ID NO: 86484 - DNA, 25 bp, Rattus norvegicus
acctactttagggagcgagtccttg

SEQ ID NO: 86485 - DNA, 25 bp, Rattus norvegicus
acctactttcaacagccctgtggca

SEQ ID NO: 86486 - DNA, 25 bp, Rattus norvegicus
acctactttcaagagccctgtggca

SEQ ID NO: 86487 - DNA, 25 bp, Rattus norvegicus
acctagaatgacagcatggatgccc

SEQ ID NO: 86488 - DNA, 25 bp, Rattus norvegicus
acctagaatgactgcatggatgccc

SEQ ID NO: 86489 - DNA, 25 bp, Rattus norvegicus
acctagactcttcggctggctgaac

SEQ ID NO: 86490 - DNA, 25 bp, Rattus norvegicus
acctagactcttgggctggctgaac

SEQ ID NO: 86491 - DNA, 25 bp, Rattus norvegicus
acctagactggcaatgagtttgtca

SEQ ID NO: 86492 - DNA, 25 bp, Rattus norvegicus
acctagactggctatgagtttgtca

SEQ ID NO: 86493 - DNA, 25 bp, Rattus norvegicus
acctagagccctctgaccgttagtt

SEQ ID NO: 86494 - DNA, 25 bp, Rattus norvegicus
acctagagccctgtgaccgttagtt

SEQ ID NO: 86495 - DNA, 25 bp, Rattus norvegicus
acctagccatgtccagacacagcag

SEQ ID NO: 86496 - DNA, 25 bp, Rattus norvegicus
acctagccatgtgcagacacagcag

SEQ ID NO: 86497 - DNA, 25 bp, Rattus norvegicus
acctagcccagtctgtgcctagaga

SEQ ID NO: 86498 - DNA, 25 bp, Rattus norvegicus
acctagcccagtgtgtgcctagaga

SEQ ID NO: 86499 - DNA, 25 bp, Rattus norvegicus
acctagctccctaggccaggcatga

SEQ ID NO: 86500 - DNA, 25 bp, Rattus norvegicus
acctagctcccttggccaggcatga

SEQ ID NO: 86501 - DNA, 25 bp, Rattus norvegicus
acctagctgagcagctggagtgaac

SEQ ID NO: 86502 - DNA, 25 bp, Rattus norvegicus
acctagctgagctgctggagtgaac

SEQ ID NO: 86503 - DNA, 25 bp, Rattus norvegicus
acctagctgtggctgtatggaccag

SEQ ID NO: 86504 - DNA, 25 bp, Rattus norvegicus
acctagctgtgggtgtatggaccag

SEQ ID NO: 86505 - DNA, 25 bp, Rattus norvegicus
acctagctttctaacacaacccagg

SEQ ID NO: 86506 - DNA, 25 bp, Rattus norvegicus
acctagctttcttacacaacccagg

SEQ ID NO: 86507 - DNA, 25 bp, Rattus norvegicus
acctagcttttacgcccagggtcag

SEQ ID NO: 86508 - DNA, 25 bp, Rattus norvegicus
acctagcttttaggcccagggtcag

SEQ ID NO: 86509 - DNA, 25 bp, Rattus norvegicus
acctaggaagcactcctggtcaggc

SEQ ID NO: 86510 - DNA, 25 bp, Rattus norvegicus
acctaggaagcagtcctggtcaggc

SEQ ID NO: 86511 - DNA, 25 bp, Rattus norvegicus
acctaggaaggaacatcaaccatct

SEQ ID NO: 86512 - DNA, 25 bp, Rattus norvegicus
acctaggaaggatcatcaaccatct

SEQ ID NO: 86513 - DNA, 25 bp, Rattus norvegicus
acctaggagcatcgtgatcccgtgc

SEQ ID NO: 86514 - DNA, 25 bp, Rattus norvegicus
acctaggagcatggtgatcccgtgc

SEQ ID NO: 86515 - DNA, 25 bp, Rattus norvegicus
acctaggatggaccttagcctggtc

SEQ ID NO: 86516 - DNA, 25 bp, Rattus norvegicus
acctaggatggagcttagcctggtc

SEQ ID NO: 86517 - DNA, 25 bp, Rattus norvegicus
acctaggcctggatgtacctgtatg

SEQ ID NO: 86518 - DNA, 25 bp, Rattus norvegicus
acctaggcctggttgtacctgtatg

SEQ ID NO: 86519 - DNA, 25 bp, Rattus norvegicus
acctaggctactccaagatcacttg

SEQ ID NO: 86520 - DNA, 25 bp, Rattus norvegicus
acctaggctactgcaagatcacttg

SEQ ID NO: 86521 - DNA, 25 bp, Rattus norvegicus
acctaggctgttatggatcctgcca

SEQ ID NO: 86522 - DNA, 25 bp, Rattus norvegicus
acctaggctgttttggatcctgcca

SEQ ID NO: 86523 - DNA, 25 bp, Rattus norvegicus
acctagggcatcatgctgagaacac

SEQ ID NO: 86524 - DNA, 25 bp, Rattus norvegicus
acctagggcatcttgctgagaacac

SEQ ID NO: 86525 - DNA, 25 bp, Rattus norvegicus
acctagggcgtcagctgagtggcaa

SEQ ID NO: 86526 - DNA, 25 bp, Rattus norvegicus
acctagggcgtctgctgagtggcaa

SEQ ID NO: 86527 - DNA, 25 bp, Rattus norvegicus
acctagggctggagacctttgcaaa

SEQ ID NO: 86528 - DNA, 25 bp, Rattus norvegicus
acctagggctggtgacctttgcaaa

SEQ ID NO: 86529 - DNA, 25 bp, Rattus norvegicus
acctagtacgcactttctgttccta

SEQ ID NO: 86530 - DNA, 25 bp, Rattus norvegicus
acctagtacgcagtttctgttccta

SEQ ID NO: 86531 - DNA, 25 bp, Rattus norvegicus
acctagtagaatattagtgctttga

SEQ ID NO: 86532 - DNA, 25 bp, Rattus norvegicus
acctagtagaattttagtgctttga

SEQ ID NO: 86533 - DNA, 25 bp, Rattus norvegicus
acctagtatagcctcctggatcatg

SEQ ID NO: 86534 - DNA, 25 bp, Rattus norvegicus
acctagtatagcgtcctggatcatg

SEQ ID NO: 86535 - DNA, 25 bp, Rattus norvegicus
acctagtatgtaatggccccacaag

SEQ ID NO: 86536 - DNA, 25 bp, Rattus norvegicus
acctagtatgtattggccccacaag

SEQ ID NO: 86537 - DNA, 25 bp, Rattus norvegicus
acctagtctaccacgtgtctgaagt

SEQ ID NO: 86538 - DNA, 25 bp, Rattus norvegicus
acctagtctacctcgtgtctgaagt

SEQ ID NO: 86539 - DNA, 25 bp, Rattus norvegicus
acctagtctcccattgtcaatgtgt

SEQ ID NO: 86540 - DNA, 25 bp, Rattus norvegicus
acctagtctccctttgtcaatgtgt

SEQ ID NO: 86541 - DNA, 25 bp, Rattus norvegicus
acctagttcctcaggatgctgaagc

SEQ ID NO: 86542 - DNA, 25 bp, Rattus norvegicus
acctagttcctctggatgctgaagc

SEQ ID NO: 86543 - DNA, 25 bp, Rattus norvegicus
acctataaacccatacaaagcaggg

SEQ ID NO: 86544 - DNA, 25 bp, Rattus norvegicus
acctataaacccttacaaagcaggg

SEQ ID NO: 86545 - DNA, 25 bp, Rattus norvegicus
acctataagatgagctctatcccgc

SEQ ID NO: 86546 - DNA, 25 bp, Rattus norvegicus
acctataagatgtgctctatcccgc

SEQ ID NO: 86547 - DNA, 25 bp, Rattus norvegicus
acctatacaaccacaagtcgctgga

SEQ ID NO: 86548 - DNA, 25 bp, Rattus norvegicus
acctatacaacctcaagtcgctgga

SEQ ID NO: 86549 - DNA, 25 bp, Rattus norvegicus
acctataccttgctctcaaacactg

SEQ ID NO: 86550 - DNA, 25 bp, Rattus norvegicus
acctataccttggtctcaaacactg

SEQ ID NO: 86551 - DNA, 25 bp, Rattus norvegicus
acctatactcctaggcactttgaag

SEQ ID NO: 86552 - DNA, 25 bp, Rattus norvegicus
acctatactccttggcactttgaag

SEQ ID NO: 86553 - DNA, 25 bp, Rattus norvegicus
acctataggtctagtccatacgtgc

SEQ ID NO: 86554 - DNA, 25 bp, Rattus norvegicus
acctataggtcttgtccatacgtgc

SEQ ID NO: 86555 - DNA, 25 bp, Rattus norvegicus
acctatatccccatgttttgtgact

SEQ ID NO: 86556 - DNA, 25 bp, Rattus norvegicus
acctatatccccttgttttgtgact

SEQ ID NO: 86557 - DNA, 25 bp, Rattus norvegicus
acctatatcccgacaagggcttggg

SEQ ID NO: 86558 - DNA, 25 bp, Rattus norvegicus
acctatatcccgtcaagggcttggg

SEQ ID NO: 86559 - DNA, 25 bp, Rattus norvegicus
acctatatgtctcaccgtcttagag

SEQ ID NO: 86560 - DNA, 25 bp, Rattus norvegicus
acctatatgtctgaccgtcttagag

SEQ ID NO: 86561 - DNA, 25 bp, Rattus norvegicus
acctatcctgtgaataacatttcgt

SEQ ID NO: 86562 - DNA, 25 bp, Rattus norvegicus
acctatcctgtgtataacatttcgt

SEQ ID NO: 86563 - DNA, 25 bp, Rattus norvegicus
acctatcggtatcacaccagacttt

SEQ ID NO: 86564 - DNA, 25 bp, Rattus norvegicus
acctatcggtatgacaccagacttt

SEQ ID NO: 86565 - DNA, 25 bp, Rattus norvegicus
acctatcgtgccacagagaggcctt

SEQ ID NO: 86566 - DNA, 25 bp, Rattus norvegicus
acctatcgtgcctcagagaggcctt

SEQ ID NO: 86567 - DNA, 25 bp, Rattus norvegicus
acctatctctccagttattttcata

SEQ ID NO: 86568 - DNA, 25 bp, Rattus norvegicus
acctatctctcctgttattttcata

SEQ ID NO: 86569 - DNA, 25 bp, Rattus norvegicus
acctatctgaagatgttcagcaccg

SEQ ID NO: 86570 - DNA, 25 bp, Rattus norvegicus
acctatctgaagttgttcagcaccg

SEQ ID NO: 86571 - DNA, 25 bp, Rattus norvegicus
acctatctgaccagcctcatgatgc

SEQ ID NO: 86572 - DNA, 25 bp, Rattus norvegicus
acctatctgacctgcctcatgatgc

SEQ ID NO: 86573 - DNA, 25 bp, Rattus norvegicus
acctatctgagaagacttgttttat

SEQ ID NO: 86574 - DNA, 25 bp, Rattus norvegicus
acctatctgagatgacttgttttat

SEQ ID NO: 86575 - DNA, 25 bp, Rattus norvegicus
acctatcttagactttgtggagcag

SEQ ID NO: 86576 - DNA, 25 bp, Rattus norvegicus
acctatcttagagtttgtggagcag

SEQ ID NO: 86577 - DNA, 25 bp, Rattus norvegicus
acctatcttgacaccctgaagtaac

SEQ ID NO: 86578 - DNA, 25 bp, Rattus norvegicus
acctatcttgactccctgaagtaac

SEQ ID NO: 86579 - DNA, 25 bp, Rattus norvegicus
acctatctttaacctgttcagtgga

SEQ ID NO: 86580 - DNA, 25 bp, Rattus norvegicus
acctatctttaagctgttcagtgga

SEQ ID NO: 86581 - DNA, 25 bp, Rattus norvegicus
acctatgacctgaacatcacttacg

SEQ ID NO: 86582 - DNA, 25 bp, Rattus norvegicus
acctatgacctgtacatcacttacg

SEQ ID NO: 86583 - DNA, 25 bp, Rattus norvegicus
acctatgatgaacacgccactccgg

SEQ ID NO: 86584 - DNA, 25 bp, Rattus norvegicus
acctatgatgaagacgccactccgg

SEQ ID NO: 86585 - DNA, 25 bp, Rattus norvegicus
acctatgcacttcctattcttgaaa

SEQ ID NO: 86586 - DNA, 25 bp, Rattus norvegicus
acctatgcacttgctattcttgaaa

SEQ ID NO: 86587 - DNA, 25 bp, Rattus norvegicus
acctatgccgtgcttaaacgatctt

SEQ ID NO: 86588 - DNA, 25 bp, Rattus norvegicus
acctatgccgtggttaaacgatctt

SEQ ID NO: 86589 - DNA, 25 bp, Rattus norvegicus
acctatgcgaggagtaagtcttgca

SEQ ID NO: 86590 - DNA, 25 bp, Rattus norvegicus
acctatgcgaggtgtaagtcttgca

SEQ ID NO: 86591 - DNA, 25 bp, Rattus norvegicus
acctatgctcaaagataccaaccca

SEQ ID NO: 86592 - DNA, 25 bp, Rattus norvegicus
acctatgctcaatgataccaaccca

SEQ ID NO: 86593 - DNA, 25 bp, Rattus norvegicus
acctatggatctcaacctctgggct

SEQ ID NO: 86594 - DNA, 25 bp, Rattus norvegicus
acctatggatctgaacctctgggct

SEQ ID NO: 86595 - DNA, 25 bp, Rattus norvegicus
acctatggatggagtctgtcgctac

SEQ ID NO: 86596 - DNA, 25 bp, Rattus norvegicus
acctatggatggtgtctgtcgctac

SEQ ID NO: 86597 - DNA, 25 bp, Rattus norvegicus
acctatggtgctagctgtcagacaa

SEQ ID NO: 86598 - DNA, 25 bp, Rattus norvegicus
acctatggtgcttgctgtcagacaa

SEQ ID NO: 86599 - DNA, 25 bp, Rattus norvegicus
acctatggttacagatgactcggaa

SEQ ID NO: 86600 - DNA, 25 bp, Rattus norvegicus
acctatggttactgatgactcggaa

SEQ ID NO: 86601 - DNA, 25 bp, Rattus norvegicus
acctatgtacaaatgctacttctta

SEQ ID NO: 86602 - DNA, 25 bp, Rattus norvegicus
acctatgtacaattgctacttctta

SEQ ID NO: 86603 - DNA, 25 bp, Rattus norvegicus
acctatgtcattaatgtcgtccttg

SEQ ID NO: 86604 - DNA, 25 bp, Rattus norvegicus
acctatgtcatttatgtcgtccttg

SEQ ID NO: 86605 - DNA, 25 bp, Rattus norvegicus
acctatgtcggtagagctttactgt

SEQ ID NO: 86606 - DNA, 25 bp, Rattus norvegicus
acctatgtcggttgagctttactgt

SEQ ID NO: 86607 - DNA, 25 bp, Rattus norvegicus
acctattcacagcacgtagatttcg

SEQ ID NO: 86608 - DNA, 25 bp, Rattus norvegicus
acctattcacaggacgtagatttcg

SEQ ID NO: 86609 - DNA, 25 bp, Rattus norvegicus
acctattgccaaatgctgggattgc

SEQ ID NO: 86610 - DNA, 25 bp, Rattus norvegicus
acctattgccaattgctgggattgc

SEQ ID NO: 86611 - DNA, 25 bp, Rattus norvegicus
acctattggttgaggctgcgctctc

SEQ ID NO: 86612 - DNA, 25 bp, Rattus norvegicus
acctattggttgtggctgcgctctc

SEQ ID NO: 86613 - DNA, 25 bp, Rattus norvegicus
acctattgttccaccatctgattgt

SEQ ID NO: 86614 - DNA, 25 bp, Rattus norvegicus
acctattgttcctccatctgattgt

SEQ ID NO: 86615 - DNA, 25 bp, Rattus norvegicus
acctatttctgacatctaactccta

SEQ ID NO: 86616 - DNA, 25 bp, Rattus norvegicus
acctatttctgagatctaactccta

SEQ ID NO: 86617 - DNA, 25 bp, Rattus norvegicus
acctatttctggcagccttagaatt

SEQ ID NO: 86618 - DNA, 25 bp, Rattus norvegicus
acctatttctgggagccttagaatt

SEQ ID NO: 86619 - DNA, 25 bp, Rattus norvegicus
acctattttatccatacccaatctg

SEQ ID NO: 86620 - DNA, 25 bp, Rattus norvegicus
acctattttatcgatacccaatctg

SEQ ID NO: 86621 - DNA, 25 bp, Rattus norvegicus
acctcaaaagtaagacttgggccaa

SEQ ID NO: 86622 - DNA, 25 bp, Rattus norvegicus
acctcaaaagtatgacttgggccaa

SEQ ID NO: 86623 - DNA, 25 bp, Rattus norvegicus
acctcaaacactccaaaaggccttg

SEQ ID NO: 86624 - DNA, 25 bp, Rattus norvegicus
acctcaaacactgcaaaaggccttg

SEQ ID NO: 86625 - DNA, 25 bp, Rattus norvegicus
acctcaaacagtacactgctcttac

SEQ ID NO: 86626 - DNA, 25 bp, Rattus norvegicus
acctcaaacagttcactgctcttac

SEQ ID NO: 86627 - DNA, 25 bp, Rattus norvegicus
acctcaaagactaggttccaggctc

SEQ ID NO: 86628 - DNA, 25 bp, Rattus norvegicus
acctcaaagacttggttccaggctc

SEQ ID NO: 86629 - DNA, 25 bp, Rattus norvegicus
acctcaaattccctatgtatctcta

SEQ ID NO: 86630 - DNA, 25 bp, Rattus norvegicus
acctcaaattccgtatgtatctcta

SEQ ID NO: 86631 - DNA, 25 bp, Rattus norvegicus
acctcaaccgctcctgggaaggcgg

SEQ ID NO: 86632 - DNA, 25 bp, Rattus norvegicus
acctcaaccgctgctgggaaggcgg

SEQ ID NO: 86633 - DNA, 25 bp, Rattus norvegicus
acctcaacggttacatttatgctgc

SEQ ID NO: 86634 - DNA, 25 bp, Rattus norvegicus
acctcaacggtttcatttatgctgc

SEQ ID NO: 86635 - DNA, 25 bp, Rattus norvegicus
acctcaagagggactgttaaataca

SEQ ID NO: 86636 - DNA, 25 bp, Rattus norvegicus
acctcaagagggtctgttaaataca

SEQ ID NO: 86637 - DNA, 25 bp, Rattus norvegicus
acctcaagcagaaggcgcgcgccga

SEQ ID NO: 86638 - DNA, 25 bp, Rattus norvegicus
acctcaagcagatggcgcgcgccga

SEQ ID NO: 86639 - DNA, 25 bp, Rattus norvegicus
acctcaagcattaggtcaaaggcct

SEQ ID NO: 86640 - DNA, 25 bp, Rattus norvegicus
acctcaagcatttggtcaaaggcct

SEQ ID NO: 86641 - DNA, 25 bp, Rattus norvegicus
acctcaaggccgatttgcactttgc

SEQ ID NO: 86642 - DNA, 25 bp, Rattus norvegicus
acctcaaggccgttttgcactttgc

SEQ ID NO: 86643 - DNA, 25 bp, Rattus norvegicus
acctcaaggcttcttacgtagacat

SEQ ID NO: 86644 - DNA, 25 bp, Rattus norvegicus
acctcaaggcttgttacgtagacat

SEQ ID NO: 86645 - DNA, 25 bp, Rattus norvegicus
acctcaagtgaaaatccttcggctt

SEQ ID NO: 86646 - DNA, 25 bp, Rattus norvegicus
acctcaagtgaatatccttcggctt

SEQ ID NO: 86647 - DNA, 25 bp, Rattus norvegicus
acctcaagttctcagacacctctgt

SEQ ID NO: 86648 - DNA, 25 bp, Rattus norvegicus
acctcaagttctgagacacctctgt

SEQ ID NO: 86649 - DNA, 25 bp, Rattus norvegicus
acctcaatagacatgcctggcattt

SEQ ID NO: 86650 - DNA, 25 bp, Rattus norvegicus
acctcaatagacatggtgtttgttt

SEQ ID NO: 86651 - DNA, 25 bp, Rattus norvegicus
acctcaatagacttgcctggcattt

SEQ ID NO: 86652 - DNA, 25 bp, Rattus norvegicus
acctcaatagacttggtgtttgttt

SEQ ID NO: 86653 - DNA, 25 bp, Rattus norvegicus
acctcaatatgacagttccccaatg

SEQ ID NO: 86654 - DNA, 25 bp, Rattus norvegicus
acctcaatatgagagttccccaatg

SEQ ID NO: 86655 - DNA, 25 bp, Rattus norvegicus
acctcaatctgactatgtactcctg

SEQ ID NO: 86656 - DNA, 25 bp, Rattus norvegicus
acctcaatctgagtatgtactcctg

SEQ ID NO: 86657 - DNA, 25 bp, Rattus norvegicus
acctcaatctgcactacaaattttg

SEQ ID NO: 86658 - DNA, 25 bp, Rattus norvegicus
acctcaatctgctctacaaattttg

SEQ ID NO: 86659 - DNA, 25 bp, Rattus norvegicus
acctcaatgcttaggacctgttttt

SEQ ID NO: 86660 - DNA, 25 bp, Rattus norvegicus
acctcaatgctttggacctgttttt

SEQ ID NO: 86661 - DNA, 25 bp, Rattus norvegicus
acctcacacattctgtatactctgt

SEQ ID NO: 86662 - DNA, 25 bp, Rattus norvegicus
acctcacacattgtgtatactctgt

SEQ ID NO: 86663 - DNA, 25 bp, Rattus norvegicus
acctcaccaaccagcttttggagag

SEQ ID NO: 86664 - DNA, 25 bp, Rattus norvegicus
acctcaccaacctgcttttggagag

SEQ ID NO: 86665 - DNA, 25 bp, Rattus norvegicus
acctcaccacaaaagctccatagtt

SEQ ID NO: 86666 - DNA, 25 bp, Rattus norvegicus
acctcaccacaatagctccatagtt

SEQ ID NO: 86667 - DNA, 25 bp, Rattus norvegicus
acctcacccactagcatttgcagtt

SEQ ID NO: 86668 - DNA, 25 bp, Rattus norvegicus
acctcacccacttgcatttgcagtt

SEQ ID NO: 86669 - DNA, 25 bp, Rattus norvegicus
acctcacccagcagaagacgtgtgc

SEQ ID NO: 86670 - DNA, 25 bp, Rattus norvegicus
acctcacccagctgaagacgtgtgc

SEQ ID NO: 86671 - DNA, 25 bp, Rattus norvegicus
acctcacccttcactcggagataaa

SEQ ID NO: 86672 - DNA, 25 bp, Rattus norvegicus
acctcacccttctctcggagataaa

SEQ ID NO: 86673 - DNA, 25 bp, Rattus norvegicus
acctcaccgagacctggcttaagga

SEQ ID NO: 86674 - DNA, 25 bp, Rattus norvegicus
acctcaccgagagctggcttaagga

SEQ ID NO: 86675 - DNA, 25 bp, Rattus norvegicus
acctcacctaatccttggtgggcat

SEQ ID NO: 86676 - DNA, 25 bp, Rattus norvegicus
acctcacctaatgcttggtgggcat

SEQ ID NO: 86677 - DNA, 25 bp, Rattus norvegicus
acctcacctgctcttttttgagata

SEQ ID NO: 86678 - DNA, 25 bp, Rattus norvegicus
acctcacctgctgttttttgagata

SEQ ID NO: 86679 - DNA, 25 bp, Rattus norvegicus
acctcacgctggagtgtctcgattg

SEQ ID NO: 86680 - DNA, 25 bp, Rattus norvegicus
acctcacgctggtgtgtctcgattg

SEQ ID NO: 86681 - DNA, 25 bp, Rattus norvegicus
acctcacggaggattatattttcta

SEQ ID NO: 86682 - DNA, 25 bp, Rattus norvegicus
acctcacggaggtttatattttcta

SEQ ID NO: 86683 - DNA, 25 bp, Rattus norvegicus
acctcactaatccatttgttcttca

SEQ ID NO: 86684 - DNA, 25 bp, Rattus norvegicus
acctcactaatcgatttgttcttca

SEQ ID NO: 86685 - DNA, 25 bp, Rattus norvegicus
acctcactagccatttcttgttatt

SEQ ID NO: 86686 - DNA, 25 bp, Rattus norvegicus
acctcactagccttttcttgttatt

SEQ ID NO: 86687 - DNA, 25 bp, Rattus norvegicus
acctcactatgcaccaggtgctgaa

SEQ ID NO: 86688 - DNA, 25 bp, Rattus norvegicus
acctcactatgctccaggtgctgaa

SEQ ID NO: 86689 - DNA, 25 bp, Rattus norvegicus
acctcactcatgaggaactgtcagt

SEQ ID NO: 86690 - DNA, 25 bp, Rattus norvegicus
acctcactcatgtggaactgtcagt

SEQ ID NO: 86691 - DNA, 25 bp, Rattus norvegicus
acctcactccttagacatcatggag

SEQ ID NO: 86692 - DNA, 25 bp, Rattus norvegicus
acctcactcctttgacatcatggag

SEQ ID NO: 86693 - DNA, 25 bp, Rattus norvegicus
acctcactgaaacgcacactgtatg

SEQ ID NO: 86694 - DNA, 25 bp, Rattus norvegicus
acctcactgaaaggcacactgtatg

SEQ ID NO: 86695 - DNA, 25 bp, Rattus norvegicus
acctcactgtcgcagagctggtaca

SEQ ID NO: 86696 - DNA, 25 bp, Rattus norvegicus
acctcactgtcggagagctggtaca

SEQ ID NO: 86697 - DNA, 25 bp, Rattus norvegicus
acctcactgtggctgctggagctcc

SEQ ID NO: 86698 - DNA, 25 bp, Rattus norvegicus
acctcactgtgggtgctggagctcc

SEQ ID NO: 86699 - DNA, 25 bp, Rattus norvegicus
acctcactgtgtagtaacggattca

SEQ ID NO: 86700 - DNA, 25 bp, Rattus norvegicus
acctcactgtgttgtaacggattca

SEQ ID NO: 86701 - DNA, 25 bp, Rattus norvegicus
acctcagacaatagcaccgccgtga

SEQ ID NO: 86702 - DNA, 25 bp, Rattus norvegicus
acctcagacaattgcaccgccgtga

SEQ ID NO: 86703 - DNA, 25 bp, Rattus norvegicus
acctcagagctgattgttgccactg

SEQ ID NO: 86704 - DNA, 25 bp, Rattus norvegicus
acctcagagctgtttgttgccactg

SEQ ID NO: 86705 - DNA, 25 bp, Rattus norvegicus
acctcagaggtcctggcaagtcaca

SEQ ID NO: 86706 - DNA, 25 bp, Rattus norvegicus
acctcagaggtcgtggcaagtcaca

SEQ ID NO: 86707 - DNA, 25 bp, Rattus norvegicus
acctcagatcaaccactcatatatg

SEQ ID NO: 86708 - DNA, 25 bp, Rattus norvegicus
acctcagatcaagcactcatatatg

SEQ ID NO: 86709 - DNA, 25 bp, Rattus norvegicus
acctcagatttaattttgcccttca

SEQ ID NO: 86710 - DNA, 25 bp, Rattus norvegicus
acctcagatttatttttgcccttca

SEQ ID NO: 86711 - DNA, 25 bp, Rattus norvegicus
acctcagcagccagaaccgatattt

SEQ ID NO: 86712 - DNA, 25 bp, Rattus norvegicus
acctcagcagcctgaaccgatattt

SEQ ID NO: 86713 - DNA, 25 bp, Rattus norvegicus
acctcagcagtgatggcttgaacca

SEQ ID NO: 86714 - DNA, 25 bp, Rattus norvegicus
acctcagcagtgttggcttgaacca

SEQ ID NO: 86715 - DNA, 25 bp, Rattus norvegicus
acctcagcctatattgcatccacag

SEQ ID NO: 86716 - DNA, 25 bp, Rattus norvegicus
acctcagcctattttgcatccacag

SEQ ID NO: 86717 - DNA, 25 bp, Rattus norvegicus
acctcagcgtggaggcccgcggctg

SEQ ID NO: 86718 - DNA, 25 bp, Rattus norvegicus
acctcagcgtggtggcccgcggctg

SEQ ID NO: 86719 - DNA, 25 bp, Rattus norvegicus
acctcagctctcacagttgtaaaag

SEQ ID NO: 86720 - DNA, 25 bp, Rattus norvegicus
acctcagctctctcagttgtaaaag

SEQ ID NO: 86721 - DNA, 25 bp, Rattus norvegicus
acctcagctgtcagccaagagatgg

SEQ ID NO: 86722 - DNA, 25 bp, Rattus norvegicus
acctcagctgtctgccaagagatgg

SEQ ID NO: 86723 - DNA, 25 bp, Rattus norvegicus
acctcagctttgatttatgcctgtt

SEQ ID NO: 86724 - DNA, 25 bp, Rattus norvegicus
acctcagctttgttttatgcctgtt

SEQ ID NO: 86725 - DNA, 25 bp, Rattus norvegicus
acctcaggactgctttgactaatga

SEQ ID NO: 86726 - DNA, 25 bp, Rattus norvegicus
acctcaggactggtttgactaatga

SEQ ID NO: 86727 - DNA, 25 bp, Rattus norvegicus
acctcaggaggcattgggcatatga

SEQ ID NO: 86728 - DNA, 25 bp, Rattus norvegicus
acctcaggaggctttgggcatatga

SEQ ID NO: 86729 - DNA, 25 bp, Rattus norvegicus
acctcaggcagcaaaactggccggg

SEQ ID NO: 86730 - DNA, 25 bp, Rattus norvegicus
acctcaggcagctaaactggccggg

SEQ ID NO: 86731 - DNA, 25 bp, Rattus norvegicus
acctcaggcctgagaagagcctctt

SEQ ID NO: 86732 - DNA, 25 bp, Rattus norvegicus
acctcaggcctgcatactagtcaca

SEQ ID NO: 86733 - DNA, 25 bp, Rattus norvegicus
acctcaggcctggatactagtcaca

SEQ ID NO: 86734 - DNA, 25 bp, Rattus norvegicus
acctcaggcctgtgaagagcctctt

SEQ ID NO: 86735 - DNA, 25 bp, Rattus norvegicus
acctcaggccttagcaaatcgatgt

SEQ ID NO: 86736 - DNA, 25 bp, Rattus norvegicus
acctcaggcctttgcaaatcgatgt

SEQ ID NO: 86737 - DNA, 25 bp, Rattus norvegicus
acctcaggtgtcatggttgatacct

SEQ ID NO: 86738 - DNA, 25 bp, Rattus norvegicus
acctcaggtgtcttggttgatacct

SEQ ID NO: 86739 - DNA, 25 bp, Rattus norvegicus
acctcagtagagaggccgtgtttct

SEQ ID NO: 86740 - DNA, 25 bp, Rattus norvegicus
acctcagtagagtggccgtgtttct

SEQ ID NO: 86741 - DNA, 25 bp, Rattus norvegicus
acctcagtattgctcccagaatttt

SEQ ID NO: 86742 - DNA, 25 bp, Rattus norvegicus
acctcagtattggtcccagaatttt

SEQ ID NO: 86743 - DNA, 25 bp, Rattus norvegicus
acctcagtcaaacctctgtgtacag

SEQ ID NO: 86744 - DNA, 25 bp, Rattus norvegicus
acctcagtcaaagctctgtgtacag

SEQ ID NO: 86745 - DNA, 25 bp, Rattus norvegicus
acctcagtctccatcaacattatag

SEQ ID NO: 86746 - DNA, 25 bp, Rattus norvegicus
acctcagtctccttcaacattatag

SEQ ID NO: 86747 - DNA, 25 bp, Rattus norvegicus
acctcagtgaggacagtgagaccac

SEQ ID NO: 86748 - DNA, 25 bp, Rattus norvegicus
acctcagtgaggagcgctcgctgca

SEQ ID NO: 86749 - DNA, 25 bp, Rattus norvegicus
acctcagtgaggtcagtgagaccac

SEQ ID NO: 86750 - DNA, 25 bp, Rattus norvegicus
acctcagtgaggtgcgctcgctgca

SEQ ID NO: 86751 - DNA, 25 bp, Rattus norvegicus
acctcagtgattctgggaagttcta

SEQ ID NO: 86752 - DNA, 25 bp, Rattus norvegicus
acctcagtgattgtgggaagttcta

SEQ ID NO: 86753 - DNA, 25 bp, Rattus norvegicus
acctcagtgcacagtggtctcagca

SEQ ID NO: 86754 - DNA, 25 bp, Rattus norvegicus
acctcagtgcactgtggtctcagca

SEQ ID NO: 86755 - DNA, 25 bp, Rattus norvegicus
acctcagtgccaacttgataccaaa

SEQ ID NO: 86756 - DNA, 25 bp, Rattus norvegicus
acctcagtgccatcttgataccaaa

SEQ ID NO: 86757 - DNA, 25 bp, Rattus norvegicus
acctcagtgggccagcttatgctta

SEQ ID NO: 86758 - DNA, 25 bp, Rattus norvegicus
acctcagtgggcgagcttatgctta

SEQ ID NO: 86759 - DNA, 25 bp, Rattus norvegicus
acctcagtgggtctgctgtgctgct

SEQ ID NO: 86760 - DNA, 25 bp, Rattus norvegicus
acctcagtgggtgtgctgtgctgct

SEQ ID NO: 86761 - DNA, 25 bp, Rattus norvegicus
acctcagtttttctaccgctggcta

SEQ ID NO: 86762 - DNA, 25 bp, Rattus norvegicus
acctcagtttttgtaccgctggcta

SEQ ID NO: 86763 - DNA, 25 bp, Rattus norvegicus
acctcatatattataatcctcctgc

SEQ ID NO: 86764 - DNA, 25 bp, Rattus norvegicus
acctcatatattttaatcctcctgc

SEQ ID NO: 86765 - DNA, 25 bp, Rattus norvegicus
acctcatatccgagtttgtgtgcag

SEQ ID NO: 86766 - DNA, 25 bp, Rattus norvegicus
acctcatatccgtgtttgtgtgcag

SEQ ID NO: 86767 - DNA, 25 bp, Rattus norvegicus
acctcatcaacaacctgtgtggctg

SEQ ID NO: 86768 - DNA, 25 bp, Rattus norvegicus
acctcatcaacatcctgtgtggctg

SEQ ID NO: 86769 - DNA, 25 bp, Rattus norvegicus
acctcatcacagctcataatgcaga

SEQ ID NO: 86770 - DNA, 25 bp, Rattus norvegicus
acctcatcacaggtcataatgcaga

SEQ ID NO: 86771 - DNA, 25 bp, Rattus norvegicus
acctcatcctggcagccctggttat

SEQ ID NO: 86772 - DNA, 25 bp, Rattus norvegicus
acctcatcctgggagccctggttat

SEQ ID NO: 86773 - DNA, 25 bp, Rattus norvegicus
acctcatcgacaacctgacagaaat

SEQ ID NO: 86774 - DNA, 25 bp, Rattus norvegicus
acctcatcgacatcctgacagaaat

SEQ ID NO: 86775 - DNA, 25 bp, Rattus norvegicus
acctcatctaggcagtgtggagatt

SEQ ID NO: 86776 - DNA, 25 bp, Rattus norvegicus
acctcatctagggagtgtggagatt

SEQ ID NO: 86777 - DNA, 25 bp, Rattus norvegicus
acctcatcttccatctggtgtttga

SEQ ID NO: 86778 - DNA, 25 bp, Rattus norvegicus
acctcatcttccttctggtgtttga

SEQ ID NO: 86779 - DNA, 25 bp, Rattus norvegicus
acctcatgtgccagtgctggcggaa

SEQ ID NO: 86780 - DNA, 25 bp, Rattus norvegicus
acctcatgtgcctgtgctggcggaa

SEQ ID NO: 86781 - DNA, 25 bp, Rattus norvegicus
acctcatgtggtaagtcaccctaga

SEQ ID NO: 86782 - DNA, 25 bp, Rattus norvegicus
acctcatgtggttagtcaccctaga

SEQ ID NO: 86783 - DNA, 25 bp, Rattus norvegicus
acctcattcagtaattcagttttta

SEQ ID NO: 86784 - DNA, 25 bp, Rattus norvegicus
acctcattcagttattcagttttta

SEQ ID NO: 86785 - DNA, 25 bp, Rattus norvegicus
acctcattcctcatgtaggtttggt

SEQ ID NO: 86786 - DNA, 25 bp, Rattus norvegicus
acctcattcctcttgtaggtttggt

SEQ ID NO: 86787 - DNA, 25 bp, Rattus norvegicus
acctcattcttccactgtcagatga

SEQ ID NO: 86788 - DNA, 25 bp, Rattus norvegicus
acctcattcttcgactgtcagatga

SEQ ID NO: 86789 - DNA, 25 bp, Rattus norvegicus
acctcattggtcaactaggctgcta

SEQ ID NO: 86790 - DNA, 25 bp, Rattus norvegicus
acctcattggtctactaggctgcta

SEQ ID NO: 86791 - DNA, 25 bp, Rattus norvegicus
acctcatttgccatattttgttctt

SEQ ID NO: 86792 - DNA, 25 bp, Rattus norvegicus
acctcatttgccttattttgttctt

SEQ ID NO: 86793 - DNA, 25 bp, Rattus norvegicus
acctcatttgtgagaaattccttct

SEQ ID NO: 86794 - DNA, 25 bp, Rattus norvegicus
acctcatttgtgtgaaattccttct

SEQ ID NO: 86795 - DNA, 25 bp, Rattus norvegicus
acctccaaatttcgccatggtcgct

SEQ ID NO: 86796 - DNA, 25 bp, Rattus norvegicus
acctccaaatttggccatggtcgct

SEQ ID NO: 86797 - DNA, 25 bp, Rattus norvegicus
acctccaacgcaatgtggcttttac

SEQ ID NO: 86798 - DNA, 25 bp, Rattus norvegicus
acctccaacgcattgtggcttttac

SEQ ID NO: 86799 - DNA, 25 bp, Rattus norvegicus
acctccaacgtgagggatctgtgtt

SEQ ID NO: 86800 - DNA, 25 bp, Rattus norvegicus
acctccaacgtgtgggatctgtgtt

SEQ ID NO: 86801 - DNA, 25 bp, Rattus norvegicus
acctccaaggcccagataatggctt

SEQ ID NO: 86802 - DNA, 25 bp, Rattus norvegicus
acctccaaggccgagataatggctt

SEQ ID NO: 86803 - DNA, 25 bp, Rattus norvegicus
acctccacagaaatacacccaaata

SEQ ID NO: 86804 - DNA, 25 bp, Rattus norvegicus
acctccacagaattacacccaaata

SEQ ID NO: 86805 - DNA, 25 bp, Rattus norvegicus
acctccacagttcgtcctaggattt

SEQ ID NO: 86806 - DNA, 25 bp, Rattus norvegicus
acctccacagttggtcctaggattt

SEQ ID NO: 86807 - DNA, 25 bp, Rattus norvegicus
acctccacattcacattgtagcatc

SEQ ID NO: 86808 - DNA, 25 bp, Rattus norvegicus
acctccacattctcattgtagcatc

SEQ ID NO: 86809 - DNA, 25 bp, Rattus norvegicus
acctccacatttcatcgcacttgtg

SEQ ID NO: 86810 - DNA, 25 bp, Rattus norvegicus
acctccacatttgatcgcacttgtg

SEQ ID NO: 86811 - DNA, 25 bp, Rattus norvegicus
acctccacctctcagttactaaatg

SEQ ID NO: 86812 - DNA, 25 bp, Rattus norvegicus
acctccacctctgagttactaaatg

SEQ ID NO: 86813 - DNA, 25 bp, Rattus norvegicus
acctccactccaaatggcattttgt

SEQ ID NO: 86814 - DNA, 25 bp, Rattus norvegicus
acctccactccatatggcattttgt

SEQ ID NO: 86815 - DNA, 25 bp, Rattus norvegicus
acctccagcaacattgactccagta

SEQ ID NO: 86816 - DNA, 25 bp, Rattus norvegicus
acctccagcaactttgactccagta

SEQ ID NO: 86817 - DNA, 25 bp, Rattus norvegicus
acctccagcatcactaagctgctaa

SEQ ID NO: 86818 - DNA, 25 bp, Rattus norvegicus
acctccagcatcctgacaggatggg

SEQ ID NO: 86819 - DNA, 25 bp, Rattus norvegicus
acctccagcatcgtgacaggatggg

SEQ ID NO: 86820 - DNA, 25 bp, Rattus norvegicus
acctccagcatctctaagctgctaa

SEQ ID NO: 86821 - DNA, 25 bp, Rattus norvegicus
acctccagccttcttagaacagtat

SEQ ID NO: 86822 - DNA, 25 bp, Rattus norvegicus
acctccagccttgttagaacagtat

SEQ ID NO: 86823 - DNA, 25 bp, Rattus norvegicus
acctccaggacactgtgctgtttta

SEQ ID NO: 86824 - DNA, 25 bp, Rattus norvegicus
acctccaggacagtgtgctgtttta

SEQ ID NO: 86825 - DNA, 25 bp, Rattus norvegicus
acctccaggcgcctgatttttcaga

SEQ ID NO: 86826 - DNA, 25 bp, Rattus norvegicus
acctccaggcgcgtgatttttcaga

SEQ ID NO: 86827 - DNA, 25 bp, Rattus norvegicus
acctccagggagattgtgcagcagc

SEQ ID NO: 86828 - DNA, 25 bp, Rattus norvegicus
acctccagggagtttgtgcagcagc

SEQ ID NO: 86829 - DNA, 25 bp, Rattus norvegicus
acctccagggctagtattgaactgc

SEQ ID NO: 86830 - DNA, 25 bp, Rattus norvegicus
acctccagggcttgtattgaactgc

SEQ ID NO: 86831 - DNA, 25 bp, Rattus norvegicus
acctccatacttaagtgcctttctt

SEQ ID NO: 86832 - DNA, 25 bp, Rattus norvegicus
acctccatactttagtgcctttctt

SEQ ID NO: 86833 - DNA, 25 bp, Rattus norvegicus
acctccatcatcactgtatagatcc

SEQ ID NO: 86834 - DNA, 25 bp, Rattus norvegicus
acctccatcatctctgtatagatcc

SEQ ID NO: 86835 - DNA, 25 bp, Rattus norvegicus
acctccatccgaaaagctgtcttag

SEQ ID NO: 86836 - DNA, 25 bp, Rattus norvegicus
acctccatccgataagctgtcttag

SEQ ID NO: 86837 - DNA, 25 bp, Rattus norvegicus
acctccatctgactttttgctttca

SEQ ID NO: 86838 - DNA, 25 bp, Rattus norvegicus
acctccatctgagtttttgctttca

SEQ ID NO: 86839 - DNA, 25 bp, Rattus norvegicus
acctccatctggaacatagccgttt

SEQ ID NO: 86840 - DNA, 25 bp, Rattus norvegicus
acctccatctggtacatagccgttt

SEQ ID NO: 86841 - DNA, 25 bp, Rattus norvegicus
acctccatgggcatcaagcatgcat

SEQ ID NO: 86842 - DNA, 25 bp, Rattus norvegicus
acctccatgggcttcaagcatgcat

SEQ ID NO: 86843 - DNA, 25 bp, Rattus norvegicus
acctccatggtcagtttgggcggaa

SEQ ID NO: 86844 - DNA, 25 bp, Rattus norvegicus
acctccatggtctgtttgggcggaa

SEQ ID NO: 86845 - DNA, 25 bp, Rattus norvegicus
acctccatggtgaaggatgcttttc

SEQ ID NO: 86846 - DNA, 25 bp, Rattus norvegicus
acctccatggtgtaggatgcttttc

SEQ ID NO: 86847 - DNA, 25 bp, Rattus norvegicus
acctccatttgcatcagaccgagtg

SEQ ID NO: 86848 - DNA, 25 bp, Rattus norvegicus
acctccatttgcttcagaccgagtg

SEQ ID NO: 86849 - DNA, 25 bp, Rattus norvegicus
acctcccaagttcacatttcagttt

SEQ ID NO: 86850 - DNA, 25 bp, Rattus norvegicus
acctcccaagttgacatttcagttt

SEQ ID NO: 86851 - DNA, 25 bp, Rattus norvegicus
acctcccactagaagctgtgtgttt

SEQ ID NO: 86852 - DNA, 25 bp, Rattus norvegicus
acctcccactagtagctgtgtgttt

SEQ ID NO: 86853 - DNA, 25 bp, Rattus norvegicus
acctcccagcacagctttggaatga

SEQ ID NO: 86854 - DNA, 25 bp, Rattus norvegicus
acctcccagcactgctttggaatga

SEQ ID NO: 86855 - DNA, 25 bp, Rattus norvegicus
acctcccagggcacttataatggtt

SEQ ID NO: 86856 - DNA, 25 bp, Rattus norvegicus
acctcccagggctcttataatggtt

SEQ ID NO: 86857 - DNA, 25 bp, Rattus norvegicus
acctcccatcaactacatgtgcatt

SEQ ID NO: 86858 - DNA, 25 bp, Rattus norvegicus
acctcccatcaagtacatgtgcatt

SEQ ID NO: 86859 - DNA, 25 bp, Rattus norvegicus
acctcccatctgaatgtatgtactg

SEQ ID NO: 86860 - DNA, 25 bp, Rattus norvegicus
acctcccatctgtatgtatgtactg

SEQ ID NO: 86861 - DNA, 25 bp, Rattus norvegicus
acctcccatcttaaccaggtcaggg

SEQ ID NO: 86862 - DNA, 25 bp, Rattus norvegicus
acctcccatctttaccaggtcaggg

SEQ ID NO: 86863 - DNA, 25 bp, Rattus norvegicus
acctccccagacctgtgtgcatgtg

SEQ ID NO: 86864 - DNA, 25 bp, Rattus norvegicus
acctccccagacgtgtgtgcatgtg

SEQ ID NO: 86865 - DNA, 25 bp, Rattus norvegicus
acctccccggtcactctgagggtga

SEQ ID NO: 86866 - DNA, 25 bp, Rattus norvegicus
acctccccggtctctctgagggtga

SEQ ID NO: 86867 - DNA, 25 bp, Rattus norvegicus
acctcccctcatatcaaggctagat

SEQ ID NO: 86868 - DNA, 25 bp, Rattus norvegicus
acctcccctcatttcaaggctagat

SEQ ID NO: 86869 - DNA, 25 bp, Rattus norvegicus
acctcccctgatatgagttgctcag

SEQ ID NO: 86870 - DNA, 25 bp, Rattus norvegicus
acctcccctgatttgagttgctcag

SEQ ID NO: 86871 - DNA, 25 bp, Rattus norvegicus
acctccccttacatttgacattatt

SEQ ID NO: 86872 - DNA, 25 bp, Rattus norvegicus
acctccccttacttttgacattatt

SEQ ID NO: 86873 - DNA, 25 bp, Rattus norvegicus
acctccctacagacagaatcgcaag

SEQ ID NO: 86874 - DNA, 25 bp, Rattus norvegicus
acctccctacagtcagaatcgcaag

SEQ ID NO: 86875 - DNA, 25 bp, Rattus norvegicus
acctccctagagcatgtgtggtaga

SEQ ID NO: 86876 - DNA, 25 bp, Rattus norvegicus
acctccctagaggatgtgtggtaga

SEQ ID NO: 86877 - DNA, 25 bp, Rattus norvegicus
acctccctcagaattagtttcattg

SEQ ID NO: 86878 - DNA, 25 bp, Rattus norvegicus
acctccctcagatttagtttcattg

SEQ ID NO: 86879 - DNA, 25 bp, Rattus norvegicus
acctccctcagcagggcatgaggaa

SEQ ID NO: 86880 - DNA, 25 bp, Rattus norvegicus
acctccctcagctgggcatgaggaa

SEQ ID NO: 86881 - DNA, 25 bp, Rattus norvegicus
acctccctccgactaggaacagaat

SEQ ID NO: 86882 - DNA, 25 bp, Rattus norvegicus
acctccctccgagtaggaacagaat

SEQ ID NO: 86883 - DNA, 25 bp, Rattus norvegicus
acctccctctgaaactctgagagaa

SEQ ID NO: 86884 - DNA, 25 bp, Rattus norvegicus
acctccctctgatactctgagagaa

SEQ ID NO: 86885 - DNA, 25 bp, Rattus norvegicus
acctccctctgcagtgtgaagacaa

SEQ ID NO: 86886 - DNA, 25 bp, Rattus norvegicus
acctccctctgctgtgtgaagacaa

SEQ ID NO: 86887 - DNA, 25 bp, Rattus norvegicus
acctccctctgtattttagatcagg

SEQ ID NO: 86888 - DNA, 25 bp, Rattus norvegicus
acctccctctgttttttagatcagg

SEQ ID NO: 86889 - DNA, 25 bp, Rattus norvegicus
acctccctgaataggtgatttttca

SEQ ID NO: 86890 - DNA, 25 bp, Rattus norvegicus
acctccctgaattggtgatttttca

SEQ ID NO: 86891 - DNA, 25 bp, Rattus norvegicus
acctccctgcagctttgaggctggc

SEQ ID NO: 86892 - DNA, 25 bp, Rattus norvegicus
acctccctgcaggtttgaggctggc

SEQ ID NO: 86893 - DNA, 25 bp, Rattus norvegicus
acctccctggaccttgaatttgtat

SEQ ID NO: 86894 - DNA, 25 bp, Rattus norvegicus
acctccctggacgttgaatttgtat

SEQ ID NO: 86895 - DNA, 25 bp, Rattus norvegicus
acctccctgtcccagatgtaatgtt

SEQ ID NO: 86896 - DNA, 25 bp, Rattus norvegicus
acctccctgtccgagatgtaatgtt

SEQ ID NO: 86897 - DNA, 25 bp, Rattus norvegicus
acctccctgtgacctgttggtcaga

SEQ ID NO: 86898 - DNA, 25 bp, Rattus norvegicus
acctccctgtgagctgttggtcaga

SEQ ID NO: 86899 - DNA, 25 bp, Rattus norvegicus
acctccctgttgactagaattctct

SEQ ID NO: 86900 - DNA, 25 bp, Rattus norvegicus
acctccctgttgtctagaattctct

SEQ ID NO: 86901 - DNA, 25 bp, Rattus norvegicus
acctccgaggcaagagctccacttt

SEQ ID NO: 86902 - DNA, 25 bp, Rattus norvegicus
acctccgaggcatgagctccacttt

SEQ ID NO: 86903 - DNA, 25 bp, Rattus norvegicus
acctccgcaggacagcaccgagtgg

SEQ ID NO: 86904 - DNA, 25 bp, Rattus norvegicus
acctccgcaggagagcaccgagtgg

SEQ ID NO: 86905 - DNA, 25 bp, Rattus norvegicus
acctccggactgagtgtgtgataag

SEQ ID NO: 86906 - DNA, 25 bp, Rattus norvegicus
acctccggactgtgtgtgtgataag

SEQ ID NO: 86907 - DNA, 25 bp, Rattus norvegicus
acctccggtcagcatcaaatccgaa

SEQ ID NO: 86908 - DNA, 25 bp, Rattus norvegicus
acctccggtcaggatcaaatccgaa

SEQ ID NO: 86909 - DNA, 25 bp, Rattus norvegicus
acctccgtaagtcatagttcagtcc

SEQ ID NO: 86910 - DNA, 25 bp, Rattus norvegicus
acctccgtaagtgatagttcagtcc

SEQ ID NO: 86911 - DNA, 25 bp, Rattus norvegicus
acctccgtatggagcttccagagca

SEQ ID NO: 86912 - DNA, 25 bp, Rattus norvegicus
acctccgtatggtgcttccagagca

SEQ ID NO: 86913 - DNA, 25 bp, Rattus norvegicus
acctccgtcccaaggtgggcatttg

SEQ ID NO: 86914 - DNA, 25 bp, Rattus norvegicus
acctccgtcccatggtgggcatttg

SEQ ID NO: 86915 - DNA, 25 bp, Rattus norvegicus
acctccgtgatgaggctgtttggaa

SEQ ID NO: 86916 - DNA, 25 bp, Rattus norvegicus
acctccgtgatgtggctgtttggaa

SEQ ID NO: 86917 - DNA, 25 bp, Rattus norvegicus
acctccgtgcttctggaactagctg

SEQ ID NO: 86918 - DNA, 25 bp, Rattus norvegicus
acctccgtgcttgtggaactagctg

SEQ ID NO: 86919 - DNA, 25 bp, Rattus norvegicus
acctccgtgtgtcccttgacatgtg

SEQ ID NO: 86920 - DNA, 25 bp, Rattus norvegicus
acctccgtgtgtgccttgacatgtg

SEQ ID NO: 86921 - DNA, 25 bp, Rattus norvegicus
acctcctaactactgggattatggg

SEQ ID NO: 86922 - DNA, 25 bp, Rattus norvegicus
acctcctaactagtgggattatggg

SEQ ID NO: 86923 - DNA, 25 bp, Rattus norvegicus
acctcctaacttcgctcatgtgagc

SEQ ID NO: 86924 - DNA, 25 bp, Rattus norvegicus
acctcctaacttggctcatgtgagc

SEQ ID NO: 86925 - DNA, 25 bp, Rattus norvegicus
acctcctacaccagtgatagtctga

SEQ ID NO: 86926 - DNA, 25 bp, Rattus norvegicus
acctcctacaccatcttcagggatg

SEQ ID NO: 86927 - DNA, 25 bp, Rattus norvegicus
acctcctacacctgtgatagtctga

SEQ ID NO: 86928 - DNA, 25 bp, Rattus norvegicus
acctcctacaccttcttcagggatg

SEQ ID NO: 86929 - DNA, 25 bp, Rattus norvegicus
acctcctagaggatatctggcttta

SEQ ID NO: 86930 - DNA, 25 bp, Rattus norvegicus
acctcctagaggttatctggcttta

SEQ ID NO: 86931 - DNA, 25 bp, Rattus norvegicus
acctcctcacgtataaactgctgga

SEQ ID NO: 86932 - DNA, 25 bp, Rattus norvegicus
acctcctcacgtttaaactgctgga

SEQ ID NO: 86933 - DNA, 25 bp, Rattus norvegicus
acctcctcacttcttgttttcagaa

SEQ ID NO: 86934 - DNA, 25 bp, Rattus norvegicus
acctcctcacttgttgttttcagaa

SEQ ID NO: 86935 - DNA, 25 bp, Rattus norvegicus
acctcctcaggtcgtgaagcacaga

SEQ ID NO: 86936 - DNA, 25 bp, Rattus norvegicus
acctcctcaggtggtgaagcacaga

SEQ ID NO: 86937 - DNA, 25 bp, Rattus norvegicus
acctcctcagtaatttataacggct

SEQ ID NO: 86938 - DNA, 25 bp, Rattus norvegicus
acctcctcagtattttataacggct

SEQ ID NO: 86939 - DNA, 25 bp, Rattus norvegicus
acctcctcagtcatgttgtagctga

SEQ ID NO: 86940 - DNA, 25 bp, Rattus norvegicus
acctcctcagtcttgttgtagctga

SEQ ID NO: 86941 - DNA, 25 bp, Rattus norvegicus
acctcctcagttctgtatctctgaa

SEQ ID NO: 86942 - DNA, 25 bp, Rattus norvegicus
acctcctcagttgtgtatctctgaa

SEQ ID NO: 86943 - DNA, 25 bp, Rattus norvegicus
acctcctccacgctctttgtgtgag

SEQ ID NO: 86944 - DNA, 25 bp, Rattus norvegicus
acctcctccacggtctttgtgtgag

SEQ ID NO: 86945 - DNA, 25 bp, Rattus norvegicus
acctcctcccaactgaagagcaata

SEQ ID NO: 86946 - DNA, 25 bp, Rattus norvegicus
acctcctcccaagtgaagagcaata

SEQ ID NO: 86947 - DNA, 25 bp, Rattus norvegicus
acctcctcctccaggtatgagttgc

SEQ ID NO: 86948 - DNA, 25 bp, Rattus norvegicus
acctcctcctccattatagatgatg

SEQ ID NO: 86949 - DNA, 25 bp, Rattus norvegicus
acctcctcctcctggtatgagttgc

SEQ ID NO: 86950 - DNA, 25 bp, Rattus norvegicus
acctcctcctcctttatagatgatg

SEQ ID NO: 86951 - DNA, 25 bp, Rattus norvegicus
acctcctctggtatatatgatgctt

SEQ ID NO: 86952 - DNA, 25 bp, Rattus norvegicus
acctcctctggtttatatgatgctt

SEQ ID NO: 86953 - DNA, 25 bp, Rattus norvegicus
acctcctcttctctcattggagatg

SEQ ID NO: 86954 - DNA, 25 bp, Rattus norvegicus
acctcctcttctgtcattggagatg

SEQ ID NO: 86955 - DNA, 25 bp, Rattus norvegicus
acctcctgaactatgtgagcttggg

SEQ ID NO: 86956 - DNA, 25 bp, Rattus norvegicus
acctcctgaactttgtgagcttggg

SEQ ID NO: 86957 - DNA, 25 bp, Rattus norvegicus
acctcctgagccagggcggtaggaa

SEQ ID NO: 86958 - DNA, 25 bp, Rattus norvegicus
acctcctgagcctgggcggtaggaa

SEQ ID NO: 86959 - DNA, 25 bp, Rattus norvegicus
acctcctgaggaaatcgtagctatt

SEQ ID NO: 86960 - DNA, 25 bp, Rattus norvegicus
acctcctgaggatatcgtagctatt

SEQ ID NO: 86961 - DNA, 25 bp, Rattus norvegicus
acctcctgcatacaatagtgcctga

SEQ ID NO: 86962 - DNA, 25 bp, Rattus norvegicus
acctcctgcatagaatagtgcctga

SEQ ID NO: 86963 - DNA, 25 bp, Rattus norvegicus
acctcctgcattatccagatcagaa

SEQ ID NO: 86964 - DNA, 25 bp, Rattus norvegicus
acctcctgcattttccagatcagaa

SEQ ID NO: 86965 - DNA, 25 bp, Rattus norvegicus
acctcctggcaaatccaaggctgga

SEQ ID NO: 86966 - DNA, 25 bp, Rattus norvegicus
acctcctggcaattccaaggctgga

SEQ ID NO: 86967 - DNA, 25 bp, Rattus norvegicus
acctcctggctgattcctgtgggaa

SEQ ID NO: 86968 - DNA, 25 bp, Rattus norvegicus
acctcctggctgtttcctgtgggaa

SEQ ID NO: 86969 - DNA, 25 bp, Rattus norvegicus
acctcctgggcaccctacgaggtga

SEQ ID NO: 86970 - DNA, 25 bp, Rattus norvegicus
acctcctgggcagcctacgaggtga

SEQ ID NO: 86971 - DNA, 25 bp, Rattus norvegicus
acctcctgggtaagggctgctctgc

SEQ ID NO: 86972 - DNA, 25 bp, Rattus norvegicus
acctcctgggtatgggctgctctgc

SEQ ID NO: 86973 - DNA, 25 bp, Rattus norvegicus
acctcctgtggaaatctgcattggc

SEQ ID NO: 86974 - DNA, 25 bp, Rattus norvegicus
acctcctgtggatatctgcattggc

SEQ ID NO: 86975 - DNA, 25 bp, Rattus norvegicus
acctcctgtggcagtatcaatcagt

SEQ ID NO: 86976 - DNA, 25 bp, Rattus norvegicus
acctcctgtggctgtatcaatcagt

SEQ ID NO: 86977 - DNA, 25 bp, Rattus norvegicus
acctccttacttaggctacatagct

SEQ ID NO: 86978 - DNA, 25 bp, Rattus norvegicus
acctccttactttggctacatagct

SEQ ID NO: 86979 - DNA, 25 bp, Rattus norvegicus
acctccttcataaagccagcattag

SEQ ID NO: 86980 - DNA, 25 bp, Rattus norvegicus
acctccttcatatagccagcattag

SEQ ID NO: 86981 - DNA, 25 bp, Rattus norvegicus
acctccttctggctgtctaagatga

SEQ ID NO: 86982 - DNA, 25 bp, Rattus norvegicus
acctccttctgggtgtctaagatga

SEQ ID NO: 86983 - DNA, 25 bp, Rattus norvegicus
acctccttgaccatgacattctaat

SEQ ID NO: 86984 - DNA, 25 bp, Rattus norvegicus
acctccttgaccttgacattctaat

SEQ ID NO: 86985 - DNA, 25 bp, Rattus norvegicus
acctcgaagcacagggcagctggtg

SEQ ID NO: 86986 - DNA, 25 bp, Rattus norvegicus
acctcgaagcactgggcagctggtg

SEQ ID NO: 86987 - DNA, 25 bp, Rattus norvegicus
acctcgaccagaacccaaagaagca

SEQ ID NO: 86988 - DNA, 25 bp, Rattus norvegicus
acctcgaccagatcccaaagaagca

SEQ ID NO: 86989 - DNA, 25 bp, Rattus norvegicus
acctcgacgtctcagagtggcaggc

SEQ ID NO: 86990 - DNA, 25 bp, Rattus norvegicus
acctcgacgtctgagagtggcaggc

SEQ ID NO: 86991 - DNA, 25 bp, Rattus norvegicus
acctcgagcttcagccaggaacagc

SEQ ID NO: 86992 - DNA, 25 bp, Rattus norvegicus
acctcgagcttctgccaggaacagc

SEQ ID NO: 86993 - DNA, 25 bp, Rattus norvegicus
acctcgagtcatcgtgtgtccacag

SEQ ID NO: 86994 - DNA, 25 bp, Rattus norvegicus
acctcgagtcatggtgtgtccacag

SEQ ID NO: 86995 - DNA, 25 bp, Rattus norvegicus
acctcgccgtggagcatgtgcaagg

SEQ ID NO: 86996 - DNA, 25 bp, Rattus norvegicus
acctcgccgtggtgcatgtgcaagg

SEQ ID NO: 86997 - DNA, 25 bp, Rattus norvegicus
acctcgcggacaaggcaccgtcgat

SEQ ID NO: 86998 - DNA, 25 bp, Rattus norvegicus
acctcgcggacatggcaccgtcgat

SEQ ID NO: 86999 - DNA, 25 bp, Rattus norvegicus
acctcgctttctcagctctgtatca

SEQ ID NO: 87000 - DNA, 25 bp, Rattus norvegicus
acctcgctttctgagctctgtatca

SEQ ID NO: 87001 - DNA, 25 bp, Rattus norvegicus
acctcggacctcaggatgccttgga

SEQ ID NO: 87002 - DNA, 25 bp, Rattus norvegicus
acctcggacctctggatgccttgga

SEQ ID NO: 87003 - DNA, 25 bp, Rattus norvegicus
acctcggagctcatcagtgtcttga

SEQ ID NO: 87004 - DNA, 25 bp, Rattus norvegicus
acctcggagctcttcagtgtcttga

SEQ ID NO: 87005 - DNA, 25 bp, Rattus norvegicus
acctcggcactcactgacatagtca

SEQ ID NO: 87006 - DNA, 25 bp, Rattus norvegicus
acctcggcactctctgacatagtca

SEQ ID NO: 87007 - DNA, 25 bp, Rattus norvegicus
acctcggcagccaatatttatttgt

SEQ ID NO: 87008 - DNA, 25 bp, Rattus norvegicus
acctcggcagcctatatttatttgt

SEQ ID NO: 87009 - DNA, 25 bp, Rattus norvegicus
acctcggcatgtactgtagtcactt

SEQ ID NO: 87010 - DNA, 25 bp, Rattus norvegicus
acctcggcatgttctgtagtcactt

SEQ ID NO: 87011 - DNA, 25 bp, Rattus norvegicus
acctcggccagcaattgcttgaaga

SEQ ID NO: 87012 - DNA, 25 bp, Rattus norvegicus
acctcggccagctattgcttgaaga

SEQ ID NO: 87013 - DNA, 25 bp, Rattus norvegicus
acctcggcctcacaggaaggtagca

SEQ ID NO: 87014 - DNA, 25 bp, Rattus norvegicus
acctcggcctcagaggaaggtagca

SEQ ID NO: 87015 - DNA, 25 bp, Rattus norvegicus
acctcgggaaacctctaagatgcct

SEQ ID NO: 87016 - DNA, 25 bp, Rattus norvegicus
acctcgggaaacgtctaagatgcct

SEQ ID NO: 87017 - DNA, 25 bp, Rattus norvegicus
acctcgggagaaacaaatgtgttaa

SEQ ID NO: 87018 - DNA, 25 bp, Rattus norvegicus
acctcgggagaatcaaatgtgttaa

SEQ ID NO: 87019 - DNA, 25 bp, Rattus norvegicus
acctcgggagagacgcagcttggcc

SEQ ID NO: 87020 - DNA, 25 bp, Rattus norvegicus
acctcgggagagtcgcagcttggcc

SEQ ID NO: 87021 - DNA, 25 bp, Rattus norvegicus
acctcgggatttatgtggccttctg

SEQ ID NO: 87022 - DNA, 25 bp, Rattus norvegicus
acctcgggatttttgtggccttctg

SEQ ID NO: 87023 - DNA, 25 bp, Rattus norvegicus
acctcggtaactccaattcattcag

SEQ ID NO: 87024 - DNA, 25 bp, Rattus norvegicus
acctcggtaactgcaattcattcag

SEQ ID NO: 87025 - DNA, 25 bp, Rattus norvegicus
acctcggtcggcagttgtcagtaat

SEQ ID NO: 87026 - DNA, 25 bp, Rattus norvegicus
acctcggtcggctgttgtcagtaat

SEQ ID NO: 87027 - DNA, 25 bp, Rattus norvegicus
acctcggtggagaagaatgactttg

SEQ ID NO: 87028 - DNA, 25 bp, Rattus norvegicus
acctcggtggagtagaatgactttg

SEQ ID NO: 87029 - DNA, 25 bp, Rattus norvegicus
acctcggtgggtcctaacgcagtgt

SEQ ID NO: 87030 - DNA, 25 bp, Rattus norvegicus
acctcggtgggtgctaacgcagtgt

SEQ ID NO: 87031 - DNA, 25 bp, Rattus norvegicus
acctcgtcgtcgctgttgggctccg

SEQ ID NO: 87032 - DNA, 25 bp, Rattus norvegicus
acctcgtcgtcggtgttgggctccg

SEQ ID NO: 87033 - DNA, 25 bp, Rattus norvegicus
acctcgtctctcctgttttgtaaat

SEQ ID NO: 87034 - DNA, 25 bp, Rattus norvegicus
acctcgtctctcgtgttttgtaaat

SEQ ID NO: 87035 - DNA, 25 bp, Rattus norvegicus
acctcgtctcttctatatttttctt

SEQ ID NO: 87036 - DNA, 25 bp, Rattus norvegicus
acctcgtctcttgtatatttttctt

SEQ ID NO: 87037 - DNA, 25 bp, Rattus norvegicus
acctcgtctgcccagagaagtttct

SEQ ID NO: 87038 - DNA, 25 bp, Rattus norvegicus
acctcgtctgccgagagaagtttct

SEQ ID NO: 87039 - DNA, 25 bp, Rattus norvegicus
acctcgtgcgtgctctgaagatgat

SEQ ID NO: 87040 - DNA, 25 bp, Rattus norvegicus
acctcgtgcgtggtctgaagatgat

SEQ ID NO: 87041 - DNA, 25 bp, Rattus norvegicus
acctcgtgcttaatcggaccgtggg

SEQ ID NO: 87042 - DNA, 25 bp, Rattus norvegicus
acctcgtgcttattcggaccgtggg

SEQ ID NO: 87043 - DNA, 25 bp, Rattus norvegicus
acctcgtgtcagatcacatgatgct

SEQ ID NO: 87044 - DNA, 25 bp, Rattus norvegicus
acctcgtgtcagttcacatgatgct

SEQ ID NO: 87045 - DNA, 25 bp, Rattus norvegicus
acctcgtgtggcctctcatctgcat

SEQ ID NO: 87046 - DNA, 25 bp, Rattus norvegicus
acctcgtgtggcgtctcatctgcat

SEQ ID NO: 87047 - DNA, 25 bp, Rattus norvegicus
acctcgttctcccaagtaggtcaga

SEQ ID NO: 87048 - DNA, 25 bp, Rattus norvegicus
acctcgttctccgaagtaggtcaga

SEQ ID NO: 87049 - DNA, 25 bp, Rattus norvegicus
acctcgttcttgactttgtgtgtca

SEQ ID NO: 87050 - DNA, 25 bp, Rattus norvegicus
acctcgttcttgtctttgtgtgtca

SEQ ID NO: 87051 - DNA, 25 bp, Rattus norvegicus
acctcgttttatcatacagacatct

SEQ ID NO: 87052 - DNA, 25 bp, Rattus norvegicus
acctcgttttatgatacagacatct

SEQ ID NO: 87053 - DNA, 25 bp, Rattus norvegicus
acctctaaagttctaaatcaattca

SEQ ID NO: 87054 - DNA, 25 bp, Rattus norvegicus
acctctaaagttgtaaatcaattca

SEQ ID NO: 87055 - DNA, 25 bp, Rattus norvegicus
acctctaagagtacacagtttcatt

SEQ ID NO: 87056 - DNA, 25 bp, Rattus norvegicus
acctctaagagttcacagtttcatt

SEQ ID NO: 87057 - DNA, 25 bp, Rattus norvegicus
acctctaccatgagaccgtaaactg

SEQ ID NO: 87058 - DNA, 25 bp, Rattus norvegicus
acctctaccatgtgaccgtaaactg

SEQ ID NO: 87059 - DNA, 25 bp, Rattus norvegicus
acctctacgagcacgatgggcgaat

SEQ ID NO: 87060 - DNA, 25 bp, Rattus norvegicus
acctctacgagctcgatgggcgaat

SEQ ID NO: 87061 - DNA, 25 bp, Rattus norvegicus
acctctacttttatgactagctatg

SEQ ID NO: 87062 - DNA, 25 bp, Rattus norvegicus
acctctacttttttgactagctatg

SEQ ID NO: 87063 - DNA, 25 bp, Rattus norvegicus
acctctagaggtcagcttgctgctt

SEQ ID NO: 87064 - DNA, 25 bp, Rattus norvegicus
acctctagaggtgagcttgctgctt

SEQ ID NO: 87065 - DNA, 25 bp, Rattus norvegicus
acctctagccctcgctcgagatgga

SEQ ID NO: 87066 - DNA, 25 bp, Rattus norvegicus
acctctagccctggctcgagatgga

SEQ ID NO: 87067 - DNA, 25 bp, Rattus norvegicus
acctctagcctgaactgtacttgta

SEQ ID NO: 87068 - DNA, 25 bp, Rattus norvegicus
acctctagcctgtactgtacttgta

SEQ ID NO: 87069 - DNA, 25 bp, Rattus norvegicus
acctctagtaatcggctttatgtgc

SEQ ID NO: 87070 - DNA, 25 bp, Rattus norvegicus
acctctagtaatgggctttatgtgc

SEQ ID NO: 87071 - DNA, 25 bp, Rattus norvegicus
acctctatgcctctgggagcgcaga

SEQ ID NO: 87072 - DNA, 25 bp, Rattus norvegicus
acctctatgcctgtgggagcgcaga

SEQ ID NO: 87073 - DNA, 25 bp, Rattus norvegicus
acctctatggcaacactgcagtcta

SEQ ID NO: 87074 - DNA, 25 bp, Rattus norvegicus
acctctatggcatcactgcagtcta

SEQ ID NO: 87075 - DNA, 25 bp, Rattus norvegicus
acctctatgggaccagcgtccagtc

SEQ ID NO: 87076 - DNA, 25 bp, Rattus norvegicus
acctctatgggagcagcgtccagtc

SEQ ID NO: 87077 - DNA, 25 bp, Rattus norvegicus
acctctatgtttctggcgatgtgcg

SEQ ID NO: 87078 - DNA, 25 bp, Rattus norvegicus
acctctatgtttgtggcgatgtgcg

SEQ ID NO: 87079 - DNA, 25 bp, Rattus norvegicus
acctctcaagacctgtttctatttg

SEQ ID NO: 87080 - DNA, 25 bp, Rattus norvegicus
acctctcaagacgtgtttctatttg

SEQ ID NO: 87081 - DNA, 25 bp, Rattus norvegicus
acctctcaagctattatgtctgcca

SEQ ID NO: 87082 - DNA, 25 bp, Rattus norvegicus
acctctcaagcttttatgtctgcca

SEQ ID NO: 87083 - DNA, 25 bp, Rattus norvegicus
acctctcacatcctgaaggatcttc

SEQ ID NO: 87084 - DNA, 25 bp, Rattus norvegicus
acctctcacatcgtgaaggatcttc

SEQ ID NO: 87085 - DNA, 25 bp, Rattus norvegicus
acctctcatcgactgctgttttgaa

SEQ ID NO: 87086 - DNA, 25 bp, Rattus norvegicus
acctctcatcgagtgctgttttgaa

SEQ ID NO: 87087 - DNA, 25 bp, Rattus norvegicus
acctctcatctacttgttcaacatt

SEQ ID NO: 87088 - DNA, 25 bp, Rattus norvegicus
acctctcatctagttgttcaacatt

SEQ ID NO: 87089 - DNA, 25 bp, Rattus norvegicus
acctctcattgtcctgtacggacta

SEQ ID NO: 87090 - DNA, 25 bp, Rattus norvegicus
acctctcattgtgctgtacggacta

SEQ ID NO: 87091 - DNA, 25 bp, Rattus norvegicus
acctctccaatgagcaggttgctat

SEQ ID NO: 87092 - DNA, 25 bp, Rattus norvegicus
acctctccaatgtgcaggttgctat

SEQ ID NO: 87093 - DNA, 25 bp, Rattus norvegicus
acctctccaattagtgttaaagtga

SEQ ID NO: 87094 - DNA, 25 bp, Rattus norvegicus
acctctccaatttgtgttaaagtga

SEQ ID NO: 87095 - DNA, 25 bp, Rattus norvegicus
acctctccacacactgaagcaagtg

SEQ ID NO: 87096 - DNA, 25 bp, Rattus norvegicus
acctctccacactctgaagcaagtg

SEQ ID NO: 87097 - DNA, 25 bp, Rattus norvegicus
acctctccaggtcacaaaatccatt

SEQ ID NO: 87098 - DNA, 25 bp, Rattus norvegicus
acctctccaggtgacaaaatccatt

SEQ ID NO: 87099 - DNA, 25 bp, Rattus norvegicus
acctctccagtgaagcgatcagttg

SEQ ID NO: 87100 - DNA, 25 bp, Rattus norvegicus
acctctccagtgtagcgatcagttg

SEQ ID NO: 87101 - DNA, 25 bp, Rattus norvegicus
acctctcccatcaatgctagaattt

SEQ ID NO: 87102 - DNA, 25 bp, Rattus norvegicus
acctctcccatctatgctagaattt

SEQ ID NO: 87103 - DNA, 25 bp, Rattus norvegicus
acctctccccagaaagagtgcacat

SEQ ID NO: 87104 - DNA, 25 bp, Rattus norvegicus
acctctccccagtaagagtgcacat

SEQ ID NO: 87105 - DNA, 25 bp, Rattus norvegicus
acctctccccatattttgcaaagaa

SEQ ID NO: 87106 - DNA, 25 bp, Rattus norvegicus
acctctccccattttttgcaaagaa

SEQ ID NO: 87107 - DNA, 25 bp, Rattus norvegicus
acctctcccctaatgtctgagattt

SEQ ID NO: 87108 - DNA, 25 bp, Rattus norvegicus
acctctcccctattgtctgagattt

SEQ ID NO: 87109 - DNA, 25 bp, Rattus norvegicus
acctctctaaggagtcaggctctga

SEQ ID NO: 87110 - DNA, 25 bp, Rattus norvegicus
acctctctaaggtgtcaggctctga

SEQ ID NO: 87111 - DNA, 25 bp, Rattus norvegicus
acctctctatacctgctttgcaaaa

SEQ ID NO: 87112 - DNA, 25 bp, Rattus norvegicus
acctctctatacgtgctttgcaaaa

SEQ ID NO: 87113 - DNA, 25 bp, Rattus norvegicus
acctctctcttcatacacgagtgtt

SEQ ID NO: 87114 - DNA, 25 bp, Rattus norvegicus
acctctctcttcttacacgagtgtt

SEQ ID NO: 87115 - DNA, 25 bp, Rattus norvegicus
acctctctctttcttgctatctttt

SEQ ID NO: 87116 - DNA, 25 bp, Rattus norvegicus
acctctctctttgttgctatctttt

SEQ ID NO: 87117 - DNA, 25 bp, Rattus norvegicus
acctctctgaggcttaagctttcca

SEQ ID NO: 87118 - DNA, 25 bp, Rattus norvegicus
acctctctgagggttaagctttcca

SEQ ID NO: 87119 - DNA, 25 bp, Rattus norvegicus
acctctctgccaacattttgtggaa

SEQ ID NO: 87120 - DNA, 25 bp, Rattus norvegicus
acctctctgccatcattttgtggaa

SEQ ID NO: 87121 - DNA, 25 bp, Rattus norvegicus
acctctctggtcatgtaaaatgaag

SEQ ID NO: 87122 - DNA, 25 bp, Rattus norvegicus
acctctctggtcttgtaaaatgaag

SEQ ID NO: 87123 - DNA, 25 bp, Rattus norvegicus
acctctcttggaagtcagtgttgtt

SEQ ID NO: 87124 - DNA, 25 bp, Rattus norvegicus
acctctcttggatgtcagtgttgtt

SEQ ID NO: 87125 - DNA, 25 bp, Rattus norvegicus
acctctgacacactcagacatttct

SEQ ID NO: 87126 - DNA, 25 bp, Rattus norvegicus
acctctgacacagtcagacatttct

SEQ ID NO: 87127 - DNA, 25 bp, Rattus norvegicus
acctctgacagaatctctttgcatc

SEQ ID NO: 87128 - DNA, 25 bp, Rattus norvegicus
acctctgacagattctctttgcatc

SEQ ID NO: 87129 - DNA, 25 bp, Rattus norvegicus
acctctgagatgacactgttgtgct

SEQ ID NO: 87130 - DNA, 25 bp, Rattus norvegicus
acctctgagatgtcactgttgtgct

SEQ ID NO: 87131 - DNA, 25 bp, Rattus norvegicus
acctctgaggagacttacccgacaa

SEQ ID NO: 87132 - DNA, 25 bp, Rattus norvegicus
acctctgaggagtcttacccgacaa

SEQ ID NO: 87133 - DNA, 25 bp, Rattus norvegicus
acctctgaggtgagcattagccact

SEQ ID NO: 87134 - DNA, 25 bp, Rattus norvegicus
acctctgaggtgtgcattagccact

SEQ ID NO: 87135 - DNA, 25 bp, Rattus norvegicus
acctctgagttcaagactagtctga

SEQ ID NO: 87136 - DNA, 25 bp, Rattus norvegicus
acctctgagttctagactagtctga

SEQ ID NO: 87137 - DNA, 25 bp, Rattus norvegicus
acctctgatcacatactgggcgatg

SEQ ID NO: 87138 - DNA, 25 bp, Rattus norvegicus
acctctgatcacttactgggcgatg

SEQ ID NO: 87139 - DNA, 25 bp, Rattus norvegicus
acctctgcaaagaagctgctctgtt

SEQ ID NO: 87140 - DNA, 25 bp, Rattus norvegicus
acctctgcaaagtagctgctctgtt

SEQ ID NO: 87141 - DNA, 25 bp, Rattus norvegicus
acctctgcagacactacaagcggaa

SEQ ID NO: 87142 - DNA, 25 bp, Rattus norvegicus
acctctgcagactctacaagcggaa

SEQ ID NO: 87143 - DNA, 25 bp, Rattus norvegicus
acctctgcagctcgtacaaggacca

SEQ ID NO: 87144 - DNA, 25 bp, Rattus norvegicus
acctctgcagctggtacaaggacca

SEQ ID NO: 87145 - DNA, 25 bp, Rattus norvegicus
acctctgcatgcacttaactttggc

SEQ ID NO: 87146 - DNA, 25 bp, Rattus norvegicus
acctctgcatgctcttaactttggc

SEQ ID NO: 87147 - DNA, 25 bp, Rattus norvegicus
acctctgcatttaggcttgctacat

SEQ ID NO: 87148 - DNA, 25 bp, Rattus norvegicus
acctctgcattttggcttgctacat

SEQ ID NO: 87149 - DNA, 25 bp, Rattus norvegicus
acctctgccagactgtaggaagcct

SEQ ID NO: 87150 - DNA, 25 bp, Rattus norvegicus
acctctgccagagtgtaggaagcct

SEQ ID NO: 87151 - DNA, 25 bp, Rattus norvegicus
acctctgcccgtctggtgtgagata

SEQ ID NO: 87152 - DNA, 25 bp, Rattus norvegicus
acctctgcccgtgtggtgtgagata

SEQ ID NO: 87153 - DNA, 25 bp, Rattus norvegicus
acctctgccctcagattctgtaaaa

SEQ ID NO: 87154 - DNA, 25 bp, Rattus norvegicus
acctctgccctcatggagtctttgt

SEQ ID NO: 87155 - DNA, 25 bp, Rattus norvegicus
acctctgccctctgattctgtaaaa

SEQ ID NO: 87156 - DNA, 25 bp, Rattus norvegicus
acctctgccctcttggagtctttgt

SEQ ID NO: 87157 - DNA, 25 bp, Rattus norvegicus
acctctgcctacagagcggaaagac

SEQ ID NO: 87158 - DNA, 25 bp, Rattus norvegicus
acctctgcctactgagcggaaagac

SEQ ID NO: 87159 - DNA, 25 bp, Rattus norvegicus
acctctgcctatctttctgtaggag

SEQ ID NO: 87160 - DNA, 25 bp, Rattus norvegicus
acctctgcctatgtttctgtaggag

SEQ ID NO: 87161 - DNA, 25 bp, Rattus norvegicus
acctctgcctggagtgagtgggcca

SEQ ID NO: 87162 - DNA, 25 bp, Rattus norvegicus
acctctgcctggtgtgagtgggcca

SEQ ID NO: 87163 - DNA, 25 bp, Rattus norvegicus
acctctgcgtgacccggatgaaaac

SEQ ID NO: 87164 - DNA, 25 bp, Rattus norvegicus
acctctgcgtgagccggatgaaaac

SEQ ID NO: 87165 - DNA, 25 bp, Rattus norvegicus
acctctgctactagtcggagcatga

SEQ ID NO: 87166 - DNA, 25 bp, Rattus norvegicus
acctctgctacttgtcggagcatga

SEQ ID NO: 87167 - DNA, 25 bp, Rattus norvegicus
acctctgctcccctatattgtagga

SEQ ID NO: 87168 - DNA, 25 bp, Rattus norvegicus
acctctgctcccgtatattgtagga

SEQ ID NO: 87169 - DNA, 25 bp, Rattus norvegicus
acctctgctcttcaatgctgagatt

SEQ ID NO: 87170 - DNA, 25 bp, Rattus norvegicus
acctctgctcttgaatgctgagatt

SEQ ID NO: 87171 - DNA, 25 bp, Rattus norvegicus
acctctgctggaattctgtttacat

SEQ ID NO: 87172 - DNA, 25 bp, Rattus norvegicus
acctctgctggatttctgtttacat

SEQ ID NO: 87173 - DNA, 25 bp, Rattus norvegicus
acctctgctttgatctgtctggaga

SEQ ID NO: 87174 - DNA, 25 bp, Rattus norvegicus
acctctgctttgttctgtctggaga

SEQ ID NO: 87175 - DNA, 25 bp, Rattus norvegicus
acctctggaggaagtctttgtggga

SEQ ID NO: 87176 - DNA, 25 bp, Rattus norvegicus
acctctggaggatgtctttgtggga

SEQ ID NO: 87177 - DNA, 25 bp, Rattus norvegicus
acctctggagtaaagcgctggctat

SEQ ID NO: 87178 - DNA, 25 bp, Rattus norvegicus
acctctggagtatagcgctggctat

SEQ ID NO: 87179 - DNA, 25 bp, Rattus norvegicus
acctctggagttccagatcccatac

SEQ ID NO: 87180 - DNA, 25 bp, Rattus norvegicus
acctctggagttgcagatcccatac

SEQ ID NO: 87181 - DNA, 25 bp, Rattus norvegicus
acctctggattcagatgccatctag

SEQ ID NO: 87182 - DNA, 25 bp, Rattus norvegicus
acctctggattctgatgccatctag

SEQ ID NO: 87183 - DNA, 25 bp, Rattus norvegicus
acctctggcagaatctcggattcaa

SEQ ID NO: 87184 - DNA, 25 bp, Rattus norvegicus
acctctggcagattctcggattcaa

SEQ ID NO: 87185 - DNA, 25 bp, Rattus norvegicus
acctctggcctgcttgctttaggag

SEQ ID NO: 87186 - DNA, 25 bp, Rattus norvegicus
acctctggcctggttgctttaggag

SEQ ID NO: 87187 - DNA, 25 bp, Rattus norvegicus
acctctggctctaacttgtctttgt

SEQ ID NO: 87188 - DNA, 25 bp, Rattus norvegicus
acctctggctcttacttgtctttgt

SEQ ID NO: 87189 - DNA, 25 bp, Rattus norvegicus
acctctggctgtattttattggctc

SEQ ID NO: 87190 - DNA, 25 bp, Rattus norvegicus
acctctggctgttttttattggctc

SEQ ID NO: 87191 - DNA, 25 bp, Rattus norvegicus
acctctggctttcgttagggcctga

SEQ ID NO: 87192 - DNA, 25 bp, Rattus norvegicus
acctctggctttggttagggcctga

SEQ ID NO: 87193 - DNA, 25 bp, Rattus norvegicus
acctctgggctcctatccttatggg

SEQ ID NO: 87194 - DNA, 25 bp, Rattus norvegicus
acctctgggctcgtatccttatggg

SEQ ID NO: 87195 - DNA, 25 bp, Rattus norvegicus
acctctgggtatctgagtggctctg

SEQ ID NO: 87196 - DNA, 25 bp, Rattus norvegicus
acctctgggtatgtgagtggctctg

SEQ ID NO: 87197 - DNA, 25 bp, Rattus norvegicus
acctctgtaattatgaagctctctg

SEQ ID NO: 87198 - DNA, 25 bp, Rattus norvegicus
acctctgtaattttgaagctctctg

SEQ ID NO: 87199 - DNA, 25 bp, Rattus norvegicus
acctctgtatcgatcacttttgttt

SEQ ID NO: 87200 - DNA, 25 bp, Rattus norvegicus
acctctgtatcgttcacttttgttt

SEQ ID NO: 87201 - DNA, 25 bp, Rattus norvegicus
acctctgtcctcagcaaactggaaa

SEQ ID NO: 87202 - DNA, 25 bp, Rattus norvegicus
acctctgtcctctgcaaactggaaa

SEQ ID NO: 87203 - DNA, 25 bp, Rattus norvegicus
acctctgtctacctgagttagtcaa

SEQ ID NO: 87204 - DNA, 25 bp, Rattus norvegicus
acctctgtctacgtgagttagtcaa

SEQ ID NO: 87205 - DNA, 25 bp, Rattus norvegicus
acctctgtctccctgttgaatatag

SEQ ID NO: 87206 - DNA, 25 bp, Rattus norvegicus
acctctgtctccgtgttgaatatag

SEQ ID NO: 87207 - DNA, 25 bp, Rattus norvegicus
acctctgtctgtaagtgccatgcaa

SEQ ID NO: 87208 - DNA, 25 bp, Rattus norvegicus
acctctgtctgtcggaagtgttctc

SEQ ID NO: 87209 - DNA, 25 bp, Rattus norvegicus
acctctgtctgtgggaagtgttctc

SEQ ID NO: 87210 - DNA, 25 bp, Rattus norvegicus
acctctgtctgttagtgccatgcaa

SEQ ID NO: 87211 - DNA, 25 bp, Rattus norvegicus
acctctgtgagaagccatatccgat

SEQ ID NO: 87212 - DNA, 25 bp, Rattus norvegicus
acctctgtgagatgccatatccgat

SEQ ID NO: 87213 - DNA, 25 bp, Rattus norvegicus
acctctgtgagtcttgccggaattg

SEQ ID NO: 87214 - DNA, 25 bp, Rattus norvegicus
acctctgtgagtgttgccggaattg

SEQ ID NO: 87215 - DNA, 25 bp, Rattus norvegicus
acctctgtgcccatttttctttgta

SEQ ID NO: 87216 - DNA, 25 bp, Rattus norvegicus
acctctgtgcccttttttctttgta

SEQ ID NO: 87217 - DNA, 25 bp, Rattus norvegicus
acctctgtgcgtccactgtaacatg

SEQ ID NO: 87218 - DNA, 25 bp, Rattus norvegicus
acctctgtgcgtgcactgtaacatg

SEQ ID NO: 87219 - DNA, 25 bp, Rattus norvegicus
acctctgtgctacgtctgatgctgg

SEQ ID NO: 87220 - DNA, 25 bp, Rattus norvegicus
acctctgtgctaggtctgatgctgg

SEQ ID NO: 87221 - DNA, 25 bp, Rattus norvegicus
acctctgtgctcctagaaactaact

SEQ ID NO: 87222 - DNA, 25 bp, Rattus norvegicus
acctctgtgctcgtagaaactaact

SEQ ID NO: 87223 - DNA, 25 bp, Rattus norvegicus
acctctgtgcttacttgtcatgtta

SEQ ID NO: 87224 - DNA, 25 bp, Rattus norvegicus
acctctgtgctttcttgtcatgtta

SEQ ID NO: 87225 - DNA, 25 bp, Rattus norvegicus
acctctgtggaaagtccttgcttaa

SEQ ID NO: 87226 - DNA, 25 bp, Rattus norvegicus
acctctgtggaatgtccttgcttaa

SEQ ID NO: 87227 - DNA, 25 bp, Rattus norvegicus
acctctgtggctaggatttatctca

SEQ ID NO: 87228 - DNA, 25 bp, Rattus norvegicus
acctctgtggcttggatttatctca

SEQ ID NO: 87229 - DNA, 25 bp, Rattus norvegicus
acctctgtgggcatttaagaataga

SEQ ID NO: 87230 - DNA, 25 bp, Rattus norvegicus
acctctgtgggcttttaagaataga

SEQ ID NO: 87231 - DNA, 25 bp, Rattus norvegicus
acctctgtgggtattgtatgcatgc

SEQ ID NO: 87232 - DNA, 25 bp, Rattus norvegicus
acctctgtgggttttgtatgcatgc

SEQ ID NO: 87233 - DNA, 25 bp, Rattus norvegicus
acctctgtgtgcaaactgaaaagta

SEQ ID NO: 87234 - DNA, 25 bp, Rattus norvegicus
acctctgtgtgctaactgaaaagta

SEQ ID NO: 87235 - DNA, 25 bp, Rattus norvegicus
acctctgttaggctcatcaggctgt

SEQ ID NO: 87236 - DNA, 25 bp, Rattus norvegicus
acctctgttagggtcatcaggctgt

SEQ ID NO: 87237 - DNA, 25 bp, Rattus norvegicus
acctctgttgtgatgatttcttctg

SEQ ID NO: 87238 - DNA, 25 bp, Rattus norvegicus
acctctgttgtgttgatttcttctg

SEQ ID NO: 87239 - DNA, 25 bp, Rattus norvegicus
acctcttagcaacggtgtgacctta

SEQ ID NO: 87240 - DNA, 25 bp, Rattus norvegicus
acctcttagcaagggtgtgacctta

SEQ ID NO: 87241 - DNA, 25 bp, Rattus norvegicus
acctcttagccaatgaattctgcag

SEQ ID NO: 87242 - DNA, 25 bp, Rattus norvegicus
acctcttagccattgaattctgcag

SEQ ID NO: 87243 - DNA, 25 bp, Rattus norvegicus
acctcttagttcctccatcagagaa

SEQ ID NO: 87244 - DNA, 25 bp, Rattus norvegicus
acctcttagttcgtccatcagagaa

SEQ ID NO: 87245 - DNA, 25 bp, Rattus norvegicus
acctcttatttgactgaactccttt

SEQ ID NO: 87246 - DNA, 25 bp, Rattus norvegicus
acctcttatttgtctgaactccttt

SEQ ID NO: 87247 - DNA, 25 bp, Rattus norvegicus
acctcttcaagaccatctggaacaa

SEQ ID NO: 87248 - DNA, 25 bp, Rattus norvegicus
acctcttcaagagcatctggaacaa

SEQ ID NO: 87249 - DNA, 25 bp, Rattus norvegicus
acctcttcactcagcatttgtacag

SEQ ID NO: 87250 - DNA, 25 bp, Rattus norvegicus
acctcttcactctgcatttgtacag

SEQ ID NO: 87251 - DNA, 25 bp, Rattus norvegicus
acctcttcactgctggagtctggga

SEQ ID NO: 87252 - DNA, 25 bp, Rattus norvegicus
acctcttcactggtggagtctggga

SEQ ID NO: 87253 - DNA, 25 bp, Rattus norvegicus
acctcttccatgctatggtgcctta

SEQ ID NO: 87254 - DNA, 25 bp, Rattus norvegicus
acctcttccatggtatggtgcctta

SEQ ID NO: 87255 - DNA, 25 bp, Rattus norvegicus
acctcttcccatcaactctttaatg

SEQ ID NO: 87256 - DNA, 25 bp, Rattus norvegicus
acctcttcccatgaactctttaatg

SEQ ID NO: 87257 - DNA, 25 bp, Rattus norvegicus
acctcttccctgaagagacaggcac

SEQ ID NO: 87258 - DNA, 25 bp, Rattus norvegicus
acctcttccctgtagagacaggcac

SEQ ID NO: 87259 - DNA, 25 bp, Rattus norvegicus
acctcttcctcaagcagcgtgaggg

SEQ ID NO: 87260 - DNA, 25 bp, Rattus norvegicus
acctcttcctcatgcagcgtgaggg

SEQ ID NO: 87261 - DNA, 25 bp, Rattus norvegicus
acctcttcctggcttgcagttacaa

SEQ ID NO: 87262 - DNA, 25 bp, Rattus norvegicus
acctcttcctgggttgcagttacaa

SEQ ID NO: 87263 - DNA, 25 bp, Rattus norvegicus
acctcttcgccacttctatgcataa

SEQ ID NO: 87264 - DNA, 25 bp, Rattus norvegicus
acctcttcgccagttctatgcataa

SEQ ID NO: 87265 - DNA, 25 bp, Rattus norvegicus
acctcttcgcttcggtgtattctcc

SEQ ID NO: 87266 - DNA, 25 bp, Rattus norvegicus
acctcttcgcttgggtgtattctcc

SEQ ID NO: 87267 - DNA, 25 bp, Rattus norvegicus
acctcttctaagcacgtgtggtcaa

SEQ ID NO: 87268 - DNA, 25 bp, Rattus norvegicus
acctcttctaaggacgtgtggtcaa

SEQ ID NO: 87269 - DNA, 25 bp, Rattus norvegicus
acctcttcttggatttgctgcagtc

SEQ ID NO: 87270 - DNA, 25 bp, Rattus norvegicus
acctcttcttggctgaatctgatat

SEQ ID NO: 87271 - DNA, 25 bp, Rattus norvegicus
acctcttcttgggtgaatctgatat

SEQ ID NO: 87272 - DNA, 25 bp, Rattus norvegicus
acctcttcttggttttgctgcagtc

SEQ ID NO: 87273 - DNA, 25 bp, Rattus norvegicus
acctcttgccaactgttaccttttg

SEQ ID NO: 87274 - DNA, 25 bp, Rattus norvegicus
acctcttgccaagtgttaccttttg

SEQ ID NO: 87275 - DNA, 25 bp, Rattus norvegicus
acctcttgccttccagttgtatgga

SEQ ID NO: 87276 - DNA, 25 bp, Rattus norvegicus
acctcttgccttgcagttgtatgga

SEQ ID NO: 87277 - DNA, 25 bp, Rattus norvegicus
acctcttgctctagctgtcatgcat

SEQ ID NO: 87278 - DNA, 25 bp, Rattus norvegicus
acctcttgctcttgctgtcatgcat

SEQ ID NO: 87279 - DNA, 25 bp, Rattus norvegicus
acctcttgctgtctcagtattgcca

SEQ ID NO: 87280 - DNA, 25 bp, Rattus norvegicus
acctcttgctgtgtcagtattgcca

SEQ ID NO: 87281 - DNA, 25 bp, Rattus norvegicus
acctcttggaggctacattgttaat

SEQ ID NO: 87282 - DNA, 25 bp, Rattus norvegicus
acctcttggagggtacattgttaat

SEQ ID NO: 87283 - DNA, 25 bp, Rattus norvegicus
acctcttggctcatgggtggagcgc

SEQ ID NO: 87284 - DNA, 25 bp, Rattus norvegicus
acctcttggctcttgggtggagcgc

SEQ ID NO: 87285 - DNA, 25 bp, Rattus norvegicus
acctcttggcttacatgtccaggaa

SEQ ID NO: 87286 - DNA, 25 bp, Rattus norvegicus
acctcttggctttcatgtccaggaa

SEQ ID NO: 87287 - DNA, 25 bp, Rattus norvegicus
acctcttgtcccacagtattttgaa

SEQ ID NO: 87288 - DNA, 25 bp, Rattus norvegicus
acctcttgtccctcagtattttgaa

SEQ ID NO: 87289 - DNA, 25 bp, Rattus norvegicus
acctcttgttctccgttgatgttat

SEQ ID NO: 87290 - DNA, 25 bp, Rattus norvegicus
acctcttgttctgcgttgatgttat

SEQ ID NO: 87291 - DNA, 25 bp, Rattus norvegicus
acctctttagccagcacatctgtgt

SEQ ID NO: 87292 - DNA, 25 bp, Rattus norvegicus
acctctttagcctgcacatctgtgt

SEQ ID NO: 87293 - DNA, 25 bp, Rattus norvegicus
acctctttcaccattgccatattga

SEQ ID NO: 87294 - DNA, 25 bp, Rattus norvegicus
acctctttcacccaggcatggcatg

SEQ ID NO: 87295 - DNA, 25 bp, Rattus norvegicus
acctctttcaccgaggcatggcatg

SEQ ID NO: 87296 - DNA, 25 bp, Rattus norvegicus
acctctttcacctttgccatattga

SEQ ID NO: 87297 - DNA, 25 bp, Rattus norvegicus
acctctttcccaagtggaagctgga

SEQ ID NO: 87298 - DNA, 25 bp, Rattus norvegicus
acctctttcccatgtggaagctgga

SEQ ID NO: 87299 - DNA, 25 bp, Rattus norvegicus
acctctttgctgaacgcctaatgat

SEQ ID NO: 87300 - DNA, 25 bp, Rattus norvegicus
acctctttgctgacttctccagata

SEQ ID NO: 87301 - DNA, 25 bp, Rattus norvegicus
acctctttgctgtacgcctaatgat

SEQ ID NO: 87302 - DNA, 25 bp, Rattus norvegicus
acctctttgctgtcttctccagata

SEQ ID NO: 87303 - DNA, 25 bp, Rattus norvegicus
acctctttgtttcagtgcctatgga

SEQ ID NO: 87304 - DNA, 25 bp, Rattus norvegicus
acctctttgtttgagtgcctatgga

SEQ ID NO: 87305 - DNA, 25 bp, Rattus norvegicus
acctcttttctcaggcacaggagtt

SEQ ID NO: 87306 - DNA, 25 bp, Rattus norvegicus
acctcttttctctggcacaggagtt

SEQ ID NO: 87307 - DNA, 25 bp, Rattus norvegicus
acctcttttgttccttgcttgcatt

SEQ ID NO: 87308 - DNA, 25 bp, Rattus norvegicus
acctcttttgttgcttgcttgcatt

SEQ ID NO: 87309 - DNA, 25 bp, Rattus norvegicus
acctgaaagggcatcactcgactgg

SEQ ID NO: 87310 - DNA, 25 bp, Rattus norvegicus
acctgaaagggcttcactcgactgg

SEQ ID NO: 87311 - DNA, 25 bp, Rattus norvegicus
acctgaaattggagcagccctttgt

SEQ ID NO: 87312 - DNA, 25 bp, Rattus norvegicus
acctgaaattggtgcagccctttgt

SEQ ID NO: 87313 - DNA, 25 bp, Rattus norvegicus
acctgaacacagacatcccttatga

SEQ ID NO: 87314 - DNA, 25 bp, Rattus norvegicus
acctgaacacagtcatcccttatga

SEQ ID NO: 87315 - DNA, 25 bp, Rattus norvegicus
acctgaacctgaagctggccattca

SEQ ID NO: 87316 - DNA, 25 bp, Rattus norvegicus
acctgaacctgatgctggccattca

SEQ ID NO: 87317 - DNA, 25 bp, Rattus norvegicus
acctgaacctggcagcagctgtaca

SEQ ID NO: 87318 - DNA, 25 bp, Rattus norvegicus
acctgaacctgggagcagctgtaca

SEQ ID NO: 87319 - DNA, 25 bp, Rattus norvegicus
acctgaactccaagagactctatct

SEQ ID NO: 87320 - DNA, 25 bp, Rattus norvegicus
acctgaactccatgagactctatct

SEQ ID NO: 87321 - DNA, 25 bp, Rattus norvegicus
acctgaagaatcacccctgtcccca

SEQ ID NO: 87322 - DNA, 25 bp, Rattus norvegicus
acctgaagaatctcccctgtcccca

SEQ ID NO: 87323 - DNA, 25 bp, Rattus norvegicus
acctgaagacaaactgagagtggct

SEQ ID NO: 87324 - DNA, 25 bp, Rattus norvegicus
acctgaagacaatctgagagtggct

SEQ ID NO: 87325 - DNA, 25 bp, Rattus norvegicus
acctgaagccaaagctgagctgcct

SEQ ID NO: 87326 - DNA, 25 bp, Rattus norvegicus
acctgaagccaatgctgagctgcct

SEQ ID NO: 87327 - DNA, 25 bp, Rattus norvegicus
acctgaagggctcggttccctcctg

SEQ ID NO: 87328 - DNA, 25 bp, Rattus norvegicus
acctgaagggctgggttccctcctg

SEQ ID NO: 87329 - DNA, 25 bp, Rattus norvegicus
acctgaaggtttaccagctgtggta

SEQ ID NO: 87330 - DNA, 25 bp, Rattus norvegicus
acctgaaggttttccagctgtggta

SEQ ID NO: 87331 - DNA, 25 bp, Rattus norvegicus
acctgaagtgtcagagtgctgctga

SEQ ID NO: 87332 - DNA, 25 bp, Rattus norvegicus
acctgaagtgtctgagtgctgctga

SEQ ID NO: 87333 - DNA, 25 bp, Rattus norvegicus
acctgaatccagatctaccggtgta

SEQ ID NO: 87334 - DNA, 25 bp, Rattus norvegicus
acctgaatccagttctaccggtgta

SEQ ID NO: 87335 - DNA, 25 bp, Rattus norvegicus
acctgaatgccgaggagtccgagaa

SEQ ID NO: 87336 - DNA, 25 bp, Rattus norvegicus
acctgaatgccgtggagtccgagaa

SEQ ID NO: 87337 - DNA, 25 bp, Rattus norvegicus
acctgaatggtcagcttactgtgac

SEQ ID NO: 87338 - DNA, 25 bp, Rattus norvegicus
acctgaatggtctgcttactgtgac

SEQ ID NO: 87339 - DNA, 25 bp, Rattus norvegicus
acctgaattaatctgcactgcttgc

SEQ ID NO: 87340 - DNA, 25 bp, Rattus norvegicus
acctgaattaatgtgcactgcttgc

SEQ ID NO: 87341 - DNA, 25 bp, Rattus norvegicus
acctgaattcccaaccagagaggat

SEQ ID NO: 87342 - DNA, 25 bp, Rattus norvegicus
acctgaattccctaccagagaggat

SEQ ID NO: 87343 - DNA, 25 bp, Rattus norvegicus
acctgaattttgagccatctttggg

SEQ ID NO: 87344 - DNA, 25 bp, Rattus norvegicus
acctgaattttgtgccatctttggg

SEQ ID NO: 87345 - DNA, 25 bp, Rattus norvegicus
acctgacaccagctagaatcgtctg

SEQ ID NO: 87346 - DNA, 25 bp, Rattus norvegicus
acctgacaccaggtagaatcgtctg

SEQ ID NO: 87347 - DNA, 25 bp, Rattus norvegicus
acctgacactgaacagcggcttggt

SEQ ID NO: 87348 - DNA, 25 bp, Rattus norvegicus
acctgacactgatcagcggcttggt

SEQ ID NO: 87349 - DNA, 25 bp, Rattus norvegicus
acctgacagaccactatcatgcata

SEQ ID NO: 87350 - DNA, 25 bp, Rattus norvegicus
acctgacagacctctatcatgcata

SEQ ID NO: 87351 - DNA, 25 bp, Rattus norvegicus
acctgacagcgcatggcatcctttg

SEQ ID NO: 87352 - DNA, 25 bp, Rattus norvegicus
acctgacagcgcttggcatcctttg

SEQ ID NO: 87353 - DNA, 25 bp, Rattus norvegicus
acctgaccactgagacacactggct

SEQ ID NO: 87354 - DNA, 25 bp, Rattus norvegicus
acctgaccactgtgacacactggct

SEQ ID NO: 87355 - DNA, 25 bp, Rattus norvegicus
acctgacccattattcatctgtgat

SEQ ID NO: 87356 - DNA, 25 bp, Rattus norvegicus
acctgacccatttttcatctgtgat

SEQ ID NO: 87357 - DNA, 25 bp, Rattus norvegicus
acctgacctctgactgatggtttgg

SEQ ID NO: 87358 - DNA, 25 bp, Rattus norvegicus
acctgacctctgtctgatggtttgg

SEQ ID NO: 87359 - DNA, 25 bp, Rattus norvegicus
acctgacctgtgaggactctgatca

SEQ ID NO: 87360 - DNA, 25 bp, Rattus norvegicus
acctgacctgtgtggactctgatca

SEQ ID NO: 87361 - DNA, 25 bp, Rattus norvegicus
acctgaccttctctgctgtacagaa

SEQ ID NO: 87362 - DNA, 25 bp, Rattus norvegicus
acctgaccttctgtgctgtacagaa

SEQ ID NO: 87363 - DNA, 25 bp, Rattus norvegicus
acctgacctttgatttctttgcatt

SEQ ID NO: 87364 - DNA, 25 bp, Rattus norvegicus
acctgacctttgttttctttgcatt

SEQ ID NO: 87365 - DNA, 25 bp, Rattus norvegicus
acctgacgacaacgactcaccatgt

SEQ ID NO: 87366 - DNA, 25 bp, Rattus norvegicus
acctgacgacaaggactcaccatgt

SEQ ID NO: 87367 - DNA, 25 bp, Rattus norvegicus
acctgacgtggtacacatggttcac

SEQ ID NO: 87368 - DNA, 25 bp, Rattus norvegicus
acctgacgtggttcacatggttcac

SEQ ID NO: 87369 - DNA, 25 bp, Rattus norvegicus
acctgactaaatctgactggctgag

SEQ ID NO: 87370 - DNA, 25 bp, Rattus norvegicus
acctgactaaatgtgactggctgag

SEQ ID NO: 87371 - DNA, 25 bp, Rattus norvegicus
acctgactaattacattacccgcca

SEQ ID NO: 87372 - DNA, 25 bp, Rattus norvegicus
acctgactaatttcattacccgcca

SEQ ID NO: 87373 - DNA, 25 bp, Rattus norvegicus
acctgactatctcctgagttctgag

SEQ ID NO: 87374 - DNA, 25 bp, Rattus norvegicus
acctgactatctgctgagttctgag

SEQ ID NO: 87375 - DNA, 25 bp, Rattus norvegicus
acctgactattcctcacacaagttt

SEQ ID NO: 87376 - DNA, 25 bp, Rattus norvegicus
acctgactattcgtcacacaagttt

SEQ ID NO: 87377 - DNA, 25 bp, Rattus norvegicus
acctgactcagtacaagccaaaaga

SEQ ID NO: 87378 - DNA, 25 bp, Rattus norvegicus
acctgactcagttcaagccaaaaga

SEQ ID NO: 87379 - DNA, 25 bp, Rattus norvegicus
acctgactcccaaaaacgattacgg

SEQ ID NO: 87380 - DNA, 25 bp, Rattus norvegicus
acctgactcccataaacgattacgg

SEQ ID NO: 87381 - DNA, 25 bp, Rattus norvegicus
acctgactctttctctgtgatgttg

SEQ ID NO: 87382 - DNA, 25 bp, Rattus norvegicus
acctgactctttgtctgtgatgttg

SEQ ID NO: 87383 - DNA, 25 bp, Rattus norvegicus
acctgactgccaattgccaaaagtt

SEQ ID NO: 87384 - DNA, 25 bp, Rattus norvegicus
acctgactgccatttgccaaaagtt

SEQ ID NO: 87385 - DNA, 25 bp, Rattus norvegicus
acctgactgctaccttttcattcat

SEQ ID NO: 87386 - DNA, 25 bp, Rattus norvegicus
acctgactgctagcttttcattcat

SEQ ID NO: 87387 - DNA, 25 bp, Rattus norvegicus
acctgactggccaggcactcgggct

SEQ ID NO: 87388 - DNA, 25 bp, Rattus norvegicus
acctgactggcctggcactcgggct

SEQ ID NO: 87389 - DNA, 25 bp, Rattus norvegicus
acctgactgtgaattgatttgtaac

SEQ ID NO: 87390 - DNA, 25 bp, Rattus norvegicus
acctgactgtgatttgatttgtaac

SEQ ID NO: 87391 - DNA, 25 bp, Rattus norvegicus
acctgactttcacctttgtactgtg

SEQ ID NO: 87392 - DNA, 25 bp, Rattus norvegicus
acctgactttcagctttgtactgtg

SEQ ID NO: 87393 - DNA, 25 bp, Rattus norvegicus
acctgactttccagcagggactgag

SEQ ID NO: 87394 - DNA, 25 bp, Rattus norvegicus
acctgactttcctgcagggactgag

SEQ ID NO: 87395 - DNA, 25 bp, Rattus norvegicus
acctgactttgcactgattctgtaa

SEQ ID NO: 87396 - DNA, 25 bp, Rattus norvegicus
acctgactttgctctgattctgtaa

SEQ ID NO: 87397 - DNA, 25 bp, Rattus norvegicus
acctgactttgtatcctctcctttt

SEQ ID NO: 87398 - DNA, 25 bp, Rattus norvegicus
acctgactttgtttcctctcctttt

SEQ ID NO: 87399 - DNA, 25 bp, Rattus norvegicus
acctgagaactcacccatcaatata

SEQ ID NO: 87400 - DNA, 25 bp, Rattus norvegicus
acctgagaactctcccatcaatata

SEQ ID NO: 87401 - DNA, 25 bp, Rattus norvegicus
acctgagagaccacgccgagtcatc

SEQ ID NO: 87402 - DNA, 25 bp, Rattus norvegicus
acctgagagacctcgccgagtcatc

SEQ ID NO: 87403 - DNA, 25 bp, Rattus norvegicus
acctgagatggtatgcagctctgct

SEQ ID NO: 87404 - DNA, 25 bp, Rattus norvegicus
acctgagatggtttgcagctctgct

SEQ ID NO: 87405 - DNA, 25 bp, Rattus norvegicus
acctgagatgtgcagggttttctga

SEQ ID NO: 87406 - DNA, 25 bp, Rattus norvegicus
acctgagatgtggagggttttctga

SEQ ID NO: 87407 - DNA, 25 bp, Rattus norvegicus
acctgagccaggatcagcatttcgg

SEQ ID NO: 87408 - DNA, 25 bp, Rattus norvegicus
acctgagccaggttcagcatttcgg

SEQ ID NO: 87409 - DNA, 25 bp, Rattus norvegicus
acctgagcctgcaagaagagagcga

SEQ ID NO: 87410 - DNA, 25 bp, Rattus norvegicus
acctgagcctgctagaagagagcga

SEQ ID NO: 87411 - DNA, 25 bp, Rattus norvegicus
acctgagcgaagaccctctctgacg

SEQ ID NO: 87412 - DNA, 25 bp, Rattus norvegicus
acctgagcgaagtccctctctgacg

SEQ ID NO: 87413 - DNA, 25 bp, Rattus norvegicus
acctgagcgaccagtgtggcctgtg

SEQ ID NO: 87414 - DNA, 25 bp, Rattus norvegicus
acctgagcgacctgtgtggcctgtg

SEQ ID NO: 87415 - DNA, 25 bp, Rattus norvegicus
acctgagctcagagttagtggcgtt

SEQ ID NO: 87416 - DNA, 25 bp, Rattus norvegicus
acctgagctcagtgttagtggcgtt

SEQ ID NO: 87417 - DNA, 25 bp, Rattus norvegicus
acctgagctcataatactggctaag

SEQ ID NO: 87418 - DNA, 25 bp, Rattus norvegicus
acctgagctcattatactggctaag

SEQ ID NO: 87419 - DNA, 25 bp, Rattus norvegicus
acctgagctgagctctgtggctcaa

SEQ ID NO: 87420 - DNA, 25 bp, Rattus norvegicus
acctgagctgaggtctgtggctcaa

SEQ ID NO: 87421 - DNA, 25 bp, Rattus norvegicus
acctgaggaccaacggtgctgggat

SEQ ID NO: 87422 - DNA, 25 bp, Rattus norvegicus
acctgaggaccatcggtgctgggat

SEQ ID NO: 87423 - DNA, 25 bp, Rattus norvegicus
acctgaggcatcagctggtgggcaa

SEQ ID NO: 87424 - DNA, 25 bp, Rattus norvegicus
acctgaggcatctgctggtgggcaa

SEQ ID NO: 87425 - DNA, 25 bp, Rattus norvegicus
acctgaggcggcactaggtgactcg

SEQ ID NO: 87426 - DNA, 25 bp, Rattus norvegicus
acctgaggcggctctaggtgactcg

SEQ ID NO: 87427 - DNA, 25 bp, Rattus norvegicus
acctgaggctgcaacaccagagact

SEQ ID NO: 87428 - DNA, 25 bp, Rattus norvegicus
acctgaggctgctacaccagagact

SEQ ID NO: 87429 - DNA, 25 bp, Rattus norvegicus
acctgagggaaaaggtcagctcctt

SEQ ID NO: 87430 - DNA, 25 bp, Rattus norvegicus
acctgagggaaatggtcagctcctt

SEQ ID NO: 87431 - DNA, 25 bp, Rattus norvegicus
acctgagggagccactgagagcaca

SEQ ID NO: 87432 - DNA, 25 bp, Rattus norvegicus
acctgagggagcgactgagagcaca

SEQ ID NO: 87433 - DNA, 25 bp, Rattus norvegicus
acctgagggtgtatggtcttgttca

SEQ ID NO: 87434 - DNA, 25 bp, Rattus norvegicus
acctgagggtgtttggtcttgttca

SEQ ID NO: 87435 - DNA, 25 bp, Rattus norvegicus
acctgaggtagcacgcttctcgcct

SEQ ID NO: 87436 - DNA, 25 bp, Rattus norvegicus
acctgaggtagctcgcttctcgcct

SEQ ID NO: 87437 - DNA, 25 bp, Rattus norvegicus
acctgaggttgcacatttgcagttt

SEQ ID NO: 87438 - DNA, 25 bp, Rattus norvegicus
acctgaggttgctcatttgcagttt

SEQ ID NO: 87439 - DNA, 25 bp, Rattus norvegicus
acctgagtcctaatcgcctgtaagt

SEQ ID NO: 87440 - DNA, 25 bp, Rattus norvegicus
acctgagtcctattcgcctgtaagt

SEQ ID NO: 87441 - DNA, 25 bp, Rattus norvegicus
acctgagtctccaaacaagcggaca

SEQ ID NO: 87442 - DNA, 25 bp, Rattus norvegicus
acctgagtctcctaacaagcggaca

SEQ ID NO: 87443 - DNA, 25 bp, Rattus norvegicus
acctgagtcttgaggtgccagttaa

SEQ ID NO: 87444 - DNA, 25 bp, Rattus norvegicus
acctgagtcttgtggtgccagttaa

SEQ ID NO: 87445 - DNA, 25 bp, Rattus norvegicus
acctgagtgtgactaagcttccttt

SEQ ID NO: 87446 - DNA, 25 bp, Rattus norvegicus
acctgagtgtgagtaagcttccttt

SEQ ID NO: 87447 - DNA, 25 bp, Rattus norvegicus
acctgagtgtttactacttcctgat

SEQ ID NO: 87448 - DNA, 25 bp, Rattus norvegicus
acctgagtgttttctacttcctgat

SEQ ID NO: 87449 - DNA, 25 bp, Rattus norvegicus
acctgagttcagactttggagtcca

SEQ ID NO: 87450 - DNA, 25 bp, Rattus norvegicus
acctgagttcagtctttggagtcca

SEQ ID NO: 87451 - DNA, 25 bp, Rattus norvegicus
acctgagttctgcacttggatgtca

SEQ ID NO: 87452 - DNA, 25 bp, Rattus norvegicus
acctgagttctgctaccttggaaga

SEQ ID NO: 87453 - DNA, 25 bp, Rattus norvegicus
acctgagttctggacttggatgtca

SEQ ID NO: 87454 - DNA, 25 bp, Rattus norvegicus
acctgagttctggtaccttggaaga

SEQ ID NO: 87455 - DNA, 25 bp, Rattus norvegicus
acctgagttgtgagtcctgcctgct

SEQ ID NO: 87456 - DNA, 25 bp, Rattus norvegicus
acctgagttgtgtgtcctgcctgct

SEQ ID NO: 87457 - DNA, 25 bp, Rattus norvegicus
acctgagttttcatggctgttcgga

SEQ ID NO: 87458 - DNA, 25 bp, Rattus norvegicus
acctgagttttcttggctgttcgga

SEQ ID NO: 87459 - DNA, 25 bp, Rattus norvegicus
acctgataacagcttccatgggtat

SEQ ID NO: 87460 - DNA, 25 bp, Rattus norvegicus
acctgataacaggttccatgggtat

SEQ ID NO: 87461 - DNA, 25 bp, Rattus norvegicus
acctgataatacctaacctgcttag

SEQ ID NO: 87462 - DNA, 25 bp, Rattus norvegicus
acctgataatacgtaacctgcttag

SEQ ID NO: 87463 - DNA, 25 bp, Rattus norvegicus
acctgatactataacttctggctaa

SEQ ID NO: 87464 - DNA, 25 bp, Rattus norvegicus
acctgatactattacttctggctaa

SEQ ID NO: 87465 - DNA, 25 bp, Rattus norvegicus
acctgatcaaagacattccccatga

SEQ ID NO: 87466 - DNA, 25 bp, Rattus norvegicus
acctgatcaaagtcattccccatga

SEQ ID NO: 87467 - DNA, 25 bp, Rattus norvegicus
acctgatcaggtcaaagtgcgcgtt

SEQ ID NO: 87468 - DNA, 25 bp, Rattus norvegicus
acctgatcaggtgaaagtgcgcgtt

SEQ ID NO: 87469 - DNA, 25 bp, Rattus norvegicus
acctgatcccttcggctctttggaa

SEQ ID NO: 87470 - DNA, 25 bp, Rattus norvegicus
acctgatcccttgggctctttggaa

SEQ ID NO: 87471 - DNA, 25 bp, Rattus norvegicus
acctgatccggtactgctggctgcg

SEQ ID NO: 87472 - DNA, 25 bp, Rattus norvegicus
acctgatccggttctgctggctgcg

SEQ ID NO: 87473 - DNA, 25 bp, Rattus norvegicus
acctgatcctggctagatgacatca

SEQ ID NO: 87474 - DNA, 25 bp, Rattus norvegicus
acctgatcctgggtagatgacatca

SEQ ID NO: 87475 - DNA, 25 bp, Rattus norvegicus
acctgatggcatcaatgactcctgg

SEQ ID NO: 87476 - DNA, 25 bp, Rattus norvegicus
acctgatggcatgaatgactcctgg

SEQ ID NO: 87477 - DNA, 25 bp, Rattus norvegicus
acctgatgtcagatgttttgtcttt

SEQ ID NO: 87478 - DNA, 25 bp, Rattus norvegicus
acctgatgtcagttgttttgtcttt

SEQ ID NO: 87479 - DNA, 25 bp, Rattus norvegicus
acctgatgtcccatactcttaggaa

SEQ ID NO: 87480 - DNA, 25 bp, Rattus norvegicus
acctgatgtcccttactcttaggaa

SEQ ID NO: 87481 - DNA, 25 bp, Rattus norvegicus
acctgatgtccgcttgtttcttggg

SEQ ID NO: 87482 - DNA, 25 bp, Rattus norvegicus
acctgatgtccggttgtttcttggg

SEQ ID NO: 87483 - DNA, 25 bp, Rattus norvegicus
acctgattatggatatcgctttaca

SEQ ID NO: 87484 - DNA, 25 bp, Rattus norvegicus
acctgattatggttatcgctttaca

SEQ ID NO: 87485 - DNA, 25 bp, Rattus norvegicus
acctgattcaacactgctgtgtctt

SEQ ID NO: 87486 - DNA, 25 bp, Rattus norvegicus
acctgattcaactctgctgtgtctt

SEQ ID NO: 87487 - DNA, 25 bp, Rattus norvegicus
acctgattgagaaactgctgaacta

SEQ ID NO: 87488 - DNA, 25 bp, Rattus norvegicus
acctgattgagatactgctgaacta

SEQ ID NO: 87489 - DNA, 25 bp, Rattus norvegicus
acctgattggtcatgagtctctcca

SEQ ID NO: 87490 - DNA, 25 bp, Rattus norvegicus
acctgattggtcttgagtctctcca

SEQ ID NO: 87491 - DNA, 25 bp, Rattus norvegicus
acctgattgttgaattgatgatgtc

SEQ ID NO: 87492 - DNA, 25 bp, Rattus norvegicus
acctgattgttgtattgatgatgtc

SEQ ID NO: 87493 - DNA, 25 bp, Rattus norvegicus
acctgatttcacctttctactctag

SEQ ID NO: 87494 - DNA, 25 bp, Rattus norvegicus
acctgatttcacgtttctactctag

SEQ ID NO: 87495 - DNA, 25 bp, Rattus norvegicus
acctgattttgtagttcttggactg

SEQ ID NO: 87496 - DNA, 25 bp, Rattus norvegicus
acctgattttgttgttcttggactg

SEQ ID NO: 87497 - DNA, 25 bp, Rattus norvegicus
acctgatttttcaaccatgacctgc

SEQ ID NO: 87498 - DNA, 25 bp, Rattus norvegicus
acctgatttttctaccatgacctgc

SEQ ID NO: 87499 - DNA, 25 bp, Rattus norvegicus
acctgcaaggacagcgcttatttat

SEQ ID NO: 87500 - DNA, 25 bp, Rattus norvegicus
acctgcaaggactgcgcttatttat

SEQ ID NO: 87501 - DNA, 25 bp, Rattus norvegicus
acctgcaataacatgattagccttt

SEQ ID NO: 87502 - DNA, 25 bp, Rattus norvegicus
acctgcaataacttgattagccttt

SEQ ID NO: 87503 - DNA, 25 bp, Rattus norvegicus
acctgcacagcaccttgtcagagtt

SEQ ID NO: 87504 - DNA, 25 bp, Rattus norvegicus
acctgcacagcagcttgtcagagtt

SEQ ID NO: 87505 - DNA, 25 bp, Rattus norvegicus
acctgcacattgaccagcggttggt

SEQ ID NO: 87506 - DNA, 25 bp, Rattus norvegicus
acctgcacattgtccagcggttggt

SEQ ID NO: 87507 - DNA, 25 bp, Rattus norvegicus
acctgcacctggctgaaaaccactt

SEQ ID NO: 87508 - DNA, 25 bp, Rattus norvegicus
acctgcacctgggtgaaaaccactt

SEQ ID NO: 87509 - DNA, 25 bp, Rattus norvegicus
acctgcacgggcagcagttctttgg

SEQ ID NO: 87510 - DNA, 25 bp, Rattus norvegicus
acctgcacgggctgcagttctttgg

SEQ ID NO: 87511 - DNA, 25 bp, Rattus norvegicus
acctgcactgcaatgagatgacttt

SEQ ID NO: 87512 - DNA, 25 bp, Rattus norvegicus
acctgcactgcattgagatgacttt

SEQ ID NO: 87513 - DNA, 25 bp, Rattus norvegicus
acctgcagaagccatgtttgtgaat

SEQ ID NO: 87514 - DNA, 25 bp, Rattus norvegicus
acctgcagaagcgatgtttgtgaat

SEQ ID NO: 87515 - DNA, 25 bp, Rattus norvegicus
acctgcagagggactcagtggccaa

SEQ ID NO: 87516 - DNA, 25 bp, Rattus norvegicus
acctgcagagggtctcagtggccaa

SEQ ID NO: 87517 - DNA, 25 bp, Rattus norvegicus
acctgcagagtgatcacacctgtga

SEQ ID NO: 87518 - DNA, 25 bp, Rattus norvegicus
acctgcagagtgttcacacctgtga

SEQ ID NO: 87519 - DNA, 25 bp, Rattus norvegicus
acctgcagcattacatgtgagttgt

SEQ ID NO: 87520 - DNA, 25 bp, Rattus norvegicus
acctgcagcatttcatgtgagttgt

SEQ ID NO: 87521 - DNA, 25 bp, Rattus norvegicus
acctgcagcctgatactcaataaac

SEQ ID NO: 87522 - DNA, 25 bp, Rattus norvegicus
acctgcagcctgttactcaataaac

SEQ ID NO: 87523 - DNA, 25 bp, Rattus norvegicus
acctgcagcggcctgtgtggattaa

SEQ ID NO: 87524 - DNA, 25 bp, Rattus norvegicus
acctgcagcggcgtgtgtggattaa

SEQ ID NO: 87525 - DNA, 25 bp, Rattus norvegicus
acctgcaggcagaggttgagcactt

SEQ ID NO: 87526 - DNA, 25 bp, Rattus norvegicus
acctgcaggcagtggttgagcactt

SEQ ID NO: 87527 - DNA, 25 bp, Rattus norvegicus
acctgcaggccgagttggccttcga

SEQ ID NO: 87528 - DNA, 25 bp, Rattus norvegicus
acctgcaggccgtgttggccttcga

SEQ ID NO: 87529 - DNA, 25 bp, Rattus norvegicus
acctgcaggtggctgcgtgacacaa

SEQ ID NO: 87530 - DNA, 25 bp, Rattus norvegicus
acctgcaggtgggtgcgtgacacaa

SEQ ID NO: 87531 - DNA, 25 bp, Rattus norvegicus
acctgcagtgcactgcttttcagtg

SEQ ID NO: 87532 - DNA, 25 bp, Rattus norvegicus
acctgcagtgcactgtgcctttgga

SEQ ID NO: 87533 - DNA, 25 bp, Rattus norvegicus
acctgcagtgcagtgcttttcagtg

SEQ ID NO: 87534 - DNA, 25 bp, Rattus norvegicus
acctgcagtgcagtgtgcctttgga

SEQ ID NO: 87535 - DNA, 25 bp, Rattus norvegicus
acctgcagttcgcatcctgcgtggg

SEQ ID NO: 87536 - DNA, 25 bp, Rattus norvegicus
acctgcagttcggatcctgcgtggg

SEQ ID NO: 87537 - DNA, 25 bp, Rattus norvegicus
acctgcatcaggcatgtctgtctgc

SEQ ID NO: 87538 - DNA, 25 bp, Rattus norvegicus
acctgcatcagggatgtctgtctgc

SEQ ID NO: 87539 - DNA, 25 bp, Rattus norvegicus
acctgcatccggctagacaaactgg

SEQ ID NO: 87540 - DNA, 25 bp, Rattus norvegicus
acctgcatccgggtagacaaactgg

SEQ ID NO: 87541 - DNA, 25 bp, Rattus norvegicus
acctgcatcctaacacatctgtaga

SEQ ID NO: 87542 - DNA, 25 bp, Rattus norvegicus
acctgcatcctatcacatctgtaga

SEQ ID NO: 87543 - DNA, 25 bp, Rattus norvegicus
acctgcatccttatctgcacaagag

SEQ ID NO: 87544 - DNA, 25 bp, Rattus norvegicus
acctgcatccttttctgcacaagag

SEQ ID NO: 87545 - DNA, 25 bp, Rattus norvegicus
acctgcatgctaatgatgtgtatta

SEQ ID NO: 87546 - DNA, 25 bp, Rattus norvegicus
acctgcatgctattgatgtgtatta

SEQ ID NO: 87547 - DNA, 25 bp, Rattus norvegicus
acctgcatgctgatcacagagccag

SEQ ID NO: 87548 - DNA, 25 bp, Rattus norvegicus
acctgcatgctgttcacagagccag

SEQ ID NO: 87549 - DNA, 25 bp, Rattus norvegicus
acctgcatgtgcctgttctgtttta

SEQ ID NO: 87550 - DNA, 25 bp, Rattus norvegicus
acctgcatgtgcgtgttctgtttta

SEQ ID NO: 87551 - DNA, 25 bp, Rattus norvegicus
acctgcatgttcaatagttttatat

SEQ ID NO: 87552 - DNA, 25 bp, Rattus norvegicus
acctgcatgttctatagttttatat

SEQ ID NO: 87553 - DNA, 25 bp, Rattus norvegicus
acctgcattaggaggtgttcctttt

SEQ ID NO: 87554 - DNA, 25 bp, Rattus norvegicus
acctgcattaggtggtgttcctttt

SEQ ID NO: 87555 - DNA, 25 bp, Rattus norvegicus
acctgccaagcgaggccgcagcgag

SEQ ID NO: 87556 - DNA, 25 bp, Rattus norvegicus
acctgccaagcgtggccgcagcgag

SEQ ID NO: 87557 - DNA, 25 bp, Rattus norvegicus
acctgccaatggcaacgctcaaaat

SEQ ID NO: 87558 - DNA, 25 bp, Rattus norvegicus
acctgccaatgggaacgctcaaaat

SEQ ID NO: 87559 - DNA, 25 bp, Rattus norvegicus
acctgccacatgaagctcttttttg

SEQ ID NO: 87560 - DNA, 25 bp, Rattus norvegicus
acctgccacatgtagctcttttttg

SEQ ID NO: 87561 - DNA, 25 bp, Rattus norvegicus
acctgccagaagacacagtgattgg

SEQ ID NO: 87562 - DNA, 25 bp, Rattus norvegicus
acctgccagaagtcacagtgattgg

SEQ ID NO: 87563 - DNA, 25 bp, Rattus norvegicus
acctgccatctgagcacttgggaga

SEQ ID NO: 87564 - DNA, 25 bp, Rattus norvegicus
acctgccatctgctgactagtggaa

SEQ ID NO: 87565 - DNA, 25 bp, Rattus norvegicus
acctgccatctggtgactagtggaa

SEQ ID NO: 87566 - DNA, 25 bp, Rattus norvegicus
acctgccatctgtgcacttgggaga

SEQ ID NO: 87567 - DNA, 25 bp, Rattus norvegicus
acctgcccaagactacctttgtgtt

SEQ ID NO: 87568 - DNA, 25 bp, Rattus norvegicus
acctgcccaagagtacctttgtgtt

SEQ ID NO: 87569 - DNA, 25 bp, Rattus norvegicus
acctgcccaggtcacaagagtgcgt

SEQ ID NO: 87570 - DNA, 25 bp, Rattus norvegicus
acctgcccaggtgacaagagtgcgt

SEQ ID NO: 87571 - DNA, 25 bp, Rattus norvegicus
acctgcccattgcattctcctggat

SEQ ID NO: 87572 - DNA, 25 bp, Rattus norvegicus
acctgcccattggattctcctggat

SEQ ID NO: 87573 - DNA, 25 bp, Rattus norvegicus
acctgcccctgaaagaaccagtaga

SEQ ID NO: 87574 - DNA, 25 bp, Rattus norvegicus
acctgcccctgatagaaccagtaga

SEQ ID NO: 87575 - DNA, 25 bp, Rattus norvegicus
acctgcccgctacacttgggaggat

SEQ ID NO: 87576 - DNA, 25 bp, Rattus norvegicus
acctgcccgctagacttgggaggat

SEQ ID NO: 87577 - DNA, 25 bp, Rattus norvegicus
acctgccctctgcaagtgtggagac

SEQ ID NO: 87578 - DNA, 25 bp, Rattus norvegicus
acctgccctctggaagtgtggagac

SEQ ID NO: 87579 - DNA, 25 bp, Rattus norvegicus
acctgccgcccgaagtggacgacgt

SEQ ID NO: 87580 - DNA, 25 bp, Rattus norvegicus
acctgccgcccgtagtggacgacgt

SEQ ID NO: 87581 - DNA, 25 bp, Rattus norvegicus
acctgccgcgtcaccggtgaggaag

SEQ ID NO: 87582 - DNA, 25 bp, Rattus norvegicus
acctgccgcgtctccggtgaggaag

SEQ ID NO: 87583 - DNA, 25 bp, Rattus norvegicus
acctgccgtctgcatcagtatgatg

SEQ ID NO: 87584 - DNA, 25 bp, Rattus norvegicus
acctgccgtctggatcagtatgatg

SEQ ID NO: 87585 - DNA, 25 bp, Rattus norvegicus
acctgcctaaggcatgctgctaatc

SEQ ID NO: 87586 - DNA, 25 bp, Rattus norvegicus
acctgcctaagggatgctgctaatc

SEQ ID NO: 87587 - DNA, 25 bp, Rattus norvegicus
acctgcctatgaaacaatgtccctg

SEQ ID NO: 87588 - DNA, 25 bp, Rattus norvegicus
acctgcctatgatacaatgtccctg

SEQ ID NO: 87589 - DNA, 25 bp, Rattus norvegicus
acctgcctcacgcaacacaaagata

SEQ ID NO: 87590 - DNA, 25 bp, Rattus norvegicus
acctgcctcacggaacacaaagata

SEQ ID NO: 87591 - DNA, 25 bp, Rattus norvegicus
acctgcctcatcagtcatagcaaag

SEQ ID NO: 87592 - DNA, 25 bp, Rattus norvegicus
acctgcctcatctgtcatagcaaag

SEQ ID NO: 87593 - DNA, 25 bp, Rattus norvegicus
acctgcctccaaatcaaaatagctc

SEQ ID NO: 87594 - DNA, 25 bp, Rattus norvegicus
acctgcctccaattcaaaatagctc

SEQ ID NO: 87595 - DNA, 25 bp, Rattus norvegicus
acctgcctgactcctggtcttagga

SEQ ID NO: 87596 - DNA, 25 bp, Rattus norvegicus
acctgcctgactgctggtcttagga

SEQ ID NO: 87597 - DNA, 25 bp, Rattus norvegicus
acctgcctgaggctcactttcagaa

SEQ ID NO: 87598 - DNA, 25 bp, Rattus norvegicus
acctgcctgagggtcactttcagaa

SEQ ID NO: 87599 - DNA, 25 bp, Rattus norvegicus
acctgcctgcttcgtggacagtcag

SEQ ID NO: 87600 - DNA, 25 bp, Rattus norvegicus
acctgcctgcttggtggacagtcag

SEQ ID NO: 87601 - DNA, 25 bp, Rattus norvegicus
acctgcctggcaattcatctgggag

SEQ ID NO: 87602 - DNA, 25 bp, Rattus norvegicus
acctgcctggcatttcatctgggag

SEQ ID NO: 87603 - DNA, 25 bp, Rattus norvegicus
acctgcctggtccttggatcaaaat

SEQ ID NO: 87604 - DNA, 25 bp, Rattus norvegicus
acctgcctggtcgttggatcaaaat

SEQ ID NO: 87605 - DNA, 25 bp, Rattus norvegicus
acctgcctgtgtccttacaactgaa

SEQ ID NO: 87606 - DNA, 25 bp, Rattus norvegicus
acctgcctgtgtgcttacaactgaa

SEQ ID NO: 87607 - DNA, 25 bp, Rattus norvegicus
acctgccttatgagtgattgagaaa

SEQ ID NO: 87608 - DNA, 25 bp, Rattus norvegicus
acctgccttatgtgtgattgagaaa

SEQ ID NO: 87609 - DNA, 25 bp, Rattus norvegicus
acctgccttctcatagatttctgaa

SEQ ID NO: 87610 - DNA, 25 bp, Rattus norvegicus
acctgccttctcttagatttctgaa

SEQ ID NO: 87611 - DNA, 25 bp, Rattus norvegicus
acctgccttgagattcagacctgaa

SEQ ID NO: 87612 - DNA, 25 bp, Rattus norvegicus
acctgccttgagtttcagacctgaa

SEQ ID NO: 87613 - DNA, 25 bp, Rattus norvegicus
acctgcgaagtacctctgtcttaaa

SEQ ID NO: 87614 - DNA, 25 bp, Rattus norvegicus
acctgcgaagtagctctgtcttaaa

SEQ ID NO: 87615 - DNA, 25 bp, Rattus norvegicus
acctgcgagcgaatcatctatttaa

SEQ ID NO: 87616 - DNA, 25 bp, Rattus norvegicus
acctgcgagcgattcatctatttaa

SEQ ID NO: 87617 - DNA, 25 bp, Rattus norvegicus
acctgcgagcgtatggcgcgcgcga

SEQ ID NO: 87618 - DNA, 25 bp, Rattus norvegicus
acctgcgagcgtttggcgcgcgcga

SEQ ID NO: 87619 - DNA, 25 bp, Rattus norvegicus
acctgcgcagtccaaatccaagtga

SEQ ID NO: 87620 - DNA, 25 bp, Rattus norvegicus
acctgcgcagtcgaaatccaagtga

SEQ ID NO: 87621 - DNA, 25 bp, Rattus norvegicus
acctgcgcctgaaatttctgatgga

SEQ ID NO: 87622 - DNA, 25 bp, Rattus norvegicus
acctgcgcctgatatttctgatgga

SEQ ID NO: 87623 - DNA, 25 bp, Rattus norvegicus
acctgcggcccaccatggtggaaaa

SEQ ID NO: 87624 - DNA, 25 bp, Rattus norvegicus
acctgcggcccagcatggtggaaaa

SEQ ID NO: 87625 - DNA, 25 bp, Rattus norvegicus
acctgcggtctcacctaaggaaact

SEQ ID NO: 87626 - DNA, 25 bp, Rattus norvegicus
acctgcggtctctcctaaggaaact

SEQ ID NO: 87627 - DNA, 25 bp, Rattus norvegicus
acctgcggtggtagagcctaactct

SEQ ID NO: 87628 - DNA, 25 bp, Rattus norvegicus
acctgcggtggttgagcctaactct

SEQ ID NO: 87629 - DNA, 25 bp, Rattus norvegicus
acctgcgtcccgaggcccaaggtgg

SEQ ID NO: 87630 - DNA, 25 bp, Rattus norvegicus
acctgcgtcccgtggcccaaggtgg

SEQ ID NO: 87631 - DNA, 25 bp, Rattus norvegicus
acctgcgttaagagagctggagaaa

SEQ ID NO: 87632 - DNA, 25 bp, Rattus norvegicus
acctgcgttaagtgagctggagaaa

SEQ ID NO: 87633 - DNA, 25 bp, Rattus norvegicus
acctgcgttccactatccgagagaa

SEQ ID NO: 87634 - DNA, 25 bp, Rattus norvegicus
acctgcgttccagtatccgagagaa

SEQ ID NO: 87635 - DNA, 25 bp, Rattus norvegicus
acctgcgttgctattgtaactcgat

SEQ ID NO: 87636 - DNA, 25 bp, Rattus norvegicus
acctgcgttgcttttgtaactcgat

SEQ ID NO: 87637 - DNA, 25 bp, Rattus norvegicus
acctgctaagtgcttgtgtgtcttc

SEQ ID NO: 87638 - DNA, 25 bp, Rattus norvegicus
acctgctaagtggttgtgtgtcttc

SEQ ID NO: 87639 - DNA, 25 bp, Rattus norvegicus
acctgctactggcaattacttttca

SEQ ID NO: 87640 - DNA, 25 bp, Rattus norvegicus
acctgctactgggaattacttttca

SEQ ID NO: 87641 - DNA, 25 bp, Rattus norvegicus
acctgctagcacagttgcttctaat

SEQ ID NO: 87642 - DNA, 25 bp, Rattus norvegicus
acctgctagcactgttgcttctaat

SEQ ID NO: 87643 - DNA, 25 bp, Rattus norvegicus
acctgctatttcactctgtcattgt

SEQ ID NO: 87644 - DNA, 25 bp, Rattus norvegicus
acctgctatttctctctgtcattgt

SEQ ID NO: 87645 - DNA, 25 bp, Rattus norvegicus
acctgctcaaacactttgcacaaag

SEQ ID NO: 87646 - DNA, 25 bp, Rattus norvegicus
acctgctcaaactctttgcacaaag

SEQ ID NO: 87647 - DNA, 25 bp, Rattus norvegicus
acctgctcaattcctggtgtggacc

SEQ ID NO: 87648 - DNA, 25 bp, Rattus norvegicus
acctgctcaattgctggtgtggacc

SEQ ID NO: 87649 - DNA, 25 bp, Rattus norvegicus
acctgctcacgtattaagttctcca

SEQ ID NO: 87650 - DNA, 25 bp, Rattus norvegicus
acctgctcacgttttaagttctcca

SEQ ID NO: 87651 - DNA, 25 bp, Rattus norvegicus
acctgctcattcacgtagctttaaa

SEQ ID NO: 87652 - DNA, 25 bp, Rattus norvegicus
acctgctcattctcgtagctttaaa

SEQ ID NO: 87653 - DNA, 25 bp, Rattus norvegicus
acctgctcattgaactgctactggg

SEQ ID NO: 87654 - DNA, 25 bp, Rattus norvegicus
acctgctcattgtactgctactggg

SEQ ID NO: 87655 - DNA, 25 bp, Rattus norvegicus
acctgctccagtacctgaacaaaag

SEQ ID NO: 87656 - DNA, 25 bp, Rattus norvegicus
acctgctccagttcctgaacaaaag

SEQ ID NO: 87657 - DNA, 25 bp, Rattus norvegicus
acctgctcctctcattggacatgag

SEQ ID NO: 87658 - DNA, 25 bp, Rattus norvegicus
acctgctcctctgattggacatgag

SEQ ID NO: 87659 - DNA, 25 bp, Rattus norvegicus
acctgctcctggacttttcatattc

SEQ ID NO: 87660 - DNA, 25 bp, Rattus norvegicus
acctgctcctggtcttttcatattc

SEQ ID NO: 87661 - DNA, 25 bp, Rattus norvegicus
acctgctcctttatagtagatgtta

SEQ ID NO: 87662 - DNA, 25 bp, Rattus norvegicus
acctgctcctttttagtagatgtta

SEQ ID NO: 87663 - DNA, 25 bp, Rattus norvegicus
acctgctcgcagagtctgtgtcatt

SEQ ID NO: 87664 - DNA, 25 bp, Rattus norvegicus
acctgctcgcagtgtctgtgtcatt

SEQ ID NO: 87665 - DNA, 25 bp, Rattus norvegicus
acctgctctcacagaactctgtgta

SEQ ID NO: 87666 - DNA, 25 bp, Rattus norvegicus
acctgctctcactgaactctgtgta

SEQ ID NO: 87667 - DNA, 25 bp, Rattus norvegicus
acctgctctgggagaacatgacctt

SEQ ID NO: 87668 - DNA, 25 bp, Rattus norvegicus
acctgctctgggtgaacatgacctt

SEQ ID NO: 87669 - DNA, 25 bp, Rattus norvegicus
acctgctcttccatgttggtagttt

SEQ ID NO: 87670 - DNA, 25 bp, Rattus norvegicus
acctgctcttccttgttggtagttt

SEQ ID NO: 87671 - DNA, 25 bp, Rattus norvegicus
acctgctcttgtcaccagtgtatga

SEQ ID NO: 87672 - DNA, 25 bp, Rattus norvegicus
acctgctcttgtgaccagtgtatga

SEQ ID NO: 87673 - DNA, 25 bp, Rattus norvegicus
acctgctgagggactctgagaagtt

SEQ ID NO: 87674 - DNA, 25 bp, Rattus norvegicus
acctgctgagggtctctgagaagtt

SEQ ID NO: 87675 - DNA, 25 bp, Rattus norvegicus
acctgctgcaccaaaactcttatac

SEQ ID NO: 87676 - DNA, 25 bp, Rattus norvegicus
acctgctgcacctaaactcttatac

SEQ ID NO: 87677 - DNA, 25 bp, Rattus norvegicus
acctgctgcaggcatccagtgtgga

SEQ ID NO: 87678 - DNA, 25 bp, Rattus norvegicus
acctgctgcagggatccagtgtgga

SEQ ID NO: 87679 - DNA, 25 bp, Rattus norvegicus
acctgctggctgaagtgatcgagaa

SEQ ID NO: 87680 - DNA, 25 bp, Rattus norvegicus
acctgctggctgtagtgatcgagaa

SEQ ID NO: 87681 - DNA, 25 bp, Rattus norvegicus
acctgctggcttaggggagtcccta

SEQ ID NO: 87682 - DNA, 25 bp, Rattus norvegicus
acctgctggctttggggagtcccta

SEQ ID NO: 87683 - DNA, 25 bp, Rattus norvegicus
acctgctgtgcacactgtgggaaat

SEQ ID NO: 87684 - DNA, 25 bp, Rattus norvegicus
acctgctgtgcagactgtgggaaat

SEQ ID NO: 87685 - DNA, 25 bp, Rattus norvegicus
acctgctgtggtacttcaatgacac

SEQ ID NO: 87686 - DNA, 25 bp, Rattus norvegicus
acctgctgtggttcttcaatgacac

SEQ ID NO: 87687 - DNA, 25 bp, Rattus norvegicus
acctgctgttttatgaagaggctga

SEQ ID NO: 87688 - DNA, 25 bp, Rattus norvegicus
acctgctgttttttgaagaggctga

SEQ ID NO: 87689 - DNA, 25 bp, Rattus norvegicus
acctgcttagccattcttgagttta

SEQ ID NO: 87690 - DNA, 25 bp, Rattus norvegicus
acctgcttagcctttcttgagttta

SEQ ID NO: 87691 - DNA, 25 bp, Rattus norvegicus
acctgcttaggcatgcttgtggtaa

SEQ ID NO: 87692 - DNA, 25 bp, Rattus norvegicus
acctgcttaggcttgcttgtggtaa

SEQ ID NO: 87693 - DNA, 25 bp, Rattus norvegicus
acctgcttagttagactgaatcctt

SEQ ID NO: 87694 - DNA, 25 bp, Rattus norvegicus
acctgcttagtttgactgaatcctt

SEQ ID NO: 87695 - DNA, 25 bp, Rattus norvegicus
acctgcttatgcagatattcaaggc

SEQ ID NO: 87696 - DNA, 25 bp, Rattus norvegicus
acctgcttatgctgatattcaaggc

SEQ ID NO: 87697 - DNA, 25 bp, Rattus norvegicus
acctgcttcaggacatctgagtgtt

SEQ ID NO: 87698 - DNA, 25 bp, Rattus norvegicus
acctgcttcaggtcatctgagtgtt

SEQ ID NO: 87699 - DNA, 25 bp, Rattus norvegicus
acctgcttgagcagacttgtgcgta

SEQ ID NO: 87700 - DNA, 25 bp, Rattus norvegicus
acctgcttgagctgacttgtgcgta

SEQ ID NO: 87701 - DNA, 25 bp, Rattus norvegicus
acctgcttgggcacaagggtggttt

SEQ ID NO: 87702 - DNA, 25 bp, Rattus norvegicus
acctgcttgggctcaagggtggttt

SEQ ID NO: 87703 - DNA, 25 bp, Rattus norvegicus
acctgcttgtttctccagatctgaa

SEQ ID NO: 87704 - DNA, 25 bp, Rattus norvegicus
acctgcttgtttgtccagatctgaa

SEQ ID NO: 87705 - DNA, 25 bp, Rattus norvegicus
acctgctttaagctctggagacctg

SEQ ID NO: 87706 - DNA, 25 bp, Rattus norvegicus
acctgctttaaggtctggagacctg

SEQ ID NO: 87707 - DNA, 25 bp, Rattus norvegicus
acctgctttgccactggaatgatgg

SEQ ID NO: 87708 - DNA, 25 bp, Rattus norvegicus
acctgctttgcctctggaatgatgg

SEQ ID NO: 87709 - DNA, 25 bp, Rattus norvegicus
acctgctttggaccttctggtgacc

SEQ ID NO: 87710 - DNA, 25 bp, Rattus norvegicus
acctgctttggagcttctggtgacc

SEQ ID NO: 87711 - DNA, 25 bp, Rattus norvegicus
acctgctttgttacagatctcatga

SEQ ID NO: 87712 - DNA, 25 bp, Rattus norvegicus
acctgctttgtttcagatctcatga

SEQ ID NO: 87713 - DNA, 25 bp, Rattus norvegicus
acctggaaaaacatgtgcttctttg

SEQ ID NO: 87714 - DNA, 25 bp, Rattus norvegicus
acctggaaaaacttgtgcttctttg

SEQ ID NO: 87715 - DNA, 25 bp, Rattus norvegicus
acctggaacgacaggactgggacaa

SEQ ID NO: 87716 - DNA, 25 bp, Rattus norvegicus
acctggaacgactggactgggacaa

SEQ ID NO: 87717 - DNA, 25 bp, Rattus norvegicus
acctggaagaagatgccgcgctcaa

SEQ ID NO: 87718 - DNA, 25 bp, Rattus norvegicus
acctggaagaagttgccgcgctcaa

SEQ ID NO: 87719 - DNA, 25 bp, Rattus norvegicus
acctggaagtcacaggaagccacct

SEQ ID NO: 87720 - DNA, 25 bp, Rattus norvegicus
acctggaagtcagaggaagccacct

SEQ ID NO: 87721 - DNA, 25 bp, Rattus norvegicus
acctggaatcttcatggtcagtatt

SEQ ID NO: 87722 - DNA, 25 bp, Rattus norvegicus
acctggaatcttgatggtcagtatt

SEQ ID NO: 87723 - DNA, 25 bp, Rattus norvegicus
acctggacaagcagatgccttcaca

SEQ ID NO: 87724 - DNA, 25 bp, Rattus norvegicus
acctggacaagctgatgccttcaca

SEQ ID NO: 87725 - DNA, 25 bp, Rattus norvegicus
acctggacagtgagactcgcagcat

SEQ ID NO: 87726 - DNA, 25 bp, Rattus norvegicus
acctggacagtgtgactcgcagcat

SEQ ID NO: 87727 - DNA, 25 bp, Rattus norvegicus
acctggaccataatagccctgtgag

SEQ ID NO: 87728 - DNA, 25 bp, Rattus norvegicus
acctggaccatattagccctgtgag

SEQ ID NO: 87729 - DNA, 25 bp, Rattus norvegicus
acctggacgcggagcattacatcga

SEQ ID NO: 87730 - DNA, 25 bp, Rattus norvegicus
acctggacgcggtgcattacatcga

SEQ ID NO: 87731 - DNA, 25 bp, Rattus norvegicus
acctggacggctactcaggctggag

SEQ ID NO: 87732 - DNA, 25 bp, Rattus norvegicus
acctggacggcttctcaggctggag

SEQ ID NO: 87733 - DNA, 25 bp, Rattus norvegicus
acctggacttgaccagtctgtggta

SEQ ID NO: 87734 - DNA, 25 bp, Rattus norvegicus
acctggacttgagcagtctgtggta

SEQ ID NO: 87735 - DNA, 25 bp, Rattus norvegicus
acctggagaactcggcttcctggta

SEQ ID NO: 87736 - DNA, 25 bp, Rattus norvegicus
acctggagaactgggcttcctggta

SEQ ID NO: 87737 - DNA, 25 bp, Rattus norvegicus
acctggagaagaagtgccggaccct

SEQ ID NO: 87738 - DNA, 25 bp, Rattus norvegicus
acctggagaagatgtgccggaccct

SEQ ID NO: 87739 - DNA, 25 bp, Rattus norvegicus
acctggagcatgattgctgactgac

SEQ ID NO: 87740 - DNA, 25 bp, Rattus norvegicus
acctggagcatgtttgctgactgac

SEQ ID NO: 87741 - DNA, 25 bp, Rattus norvegicus
acctggaggaccatcgggacaccgg

SEQ ID NO: 87742 - DNA, 25 bp, Rattus norvegicus
acctggaggaccttcgggacaccgg

SEQ ID NO: 87743 - DNA, 25 bp, Rattus norvegicus
acctggaggagcacaacttccggaa

SEQ ID NO: 87744 - DNA, 25 bp, Rattus norvegicus
acctggaggagctcaacttccggaa

SEQ ID NO: 87745 - DNA, 25 bp, Rattus norvegicus
acctggaggcatatccccaagttgc

SEQ ID NO: 87746 - DNA, 25 bp, Rattus norvegicus
acctggaggcatttccccaagttgc

SEQ ID NO: 87747 - DNA, 25 bp, Rattus norvegicus
acctggagggcacaacagttgtact

SEQ ID NO: 87748 - DNA, 25 bp, Rattus norvegicus
acctggagggcagaacagttgtact

SEQ ID NO: 87749 - DNA, 25 bp, Rattus norvegicus
acctggaggtttctgctattcggct

SEQ ID NO: 87750 - DNA, 25 bp, Rattus norvegicus
acctggaggtttgtgctattcggct

SEQ ID NO: 87751 - DNA, 25 bp, Rattus norvegicus
acctggagtcctctgcttaaaaaca

SEQ ID NO: 87752 - DNA, 25 bp, Rattus norvegicus
acctggagtcctctggtcagtctga

SEQ ID NO: 87753 - DNA, 25 bp, Rattus norvegicus
acctggagtcctgtgcttaaaaaca

SEQ ID NO: 87754 - DNA, 25 bp, Rattus norvegicus
acctggagtcctgtggtcagtctga

SEQ ID NO: 87755 - DNA, 25 bp, Rattus norvegicus
acctggagtctcattctgtgtgaat

SEQ ID NO: 87756 - DNA, 25 bp, Rattus norvegicus
acctggagtctctttctgtgtgaat

SEQ ID NO: 87757 - DNA, 25 bp, Rattus norvegicus
acctggatccccacaaaatgagaga

SEQ ID NO: 87758 - DNA, 25 bp, Rattus norvegicus
acctggatcccctcaaaatgagaga

SEQ ID NO: 87759 - DNA, 25 bp, Rattus norvegicus
acctggatcctgattagctcttttt

SEQ ID NO: 87760 - DNA, 25 bp, Rattus norvegicus
acctggatcctgtttagctcttttt

SEQ ID NO: 87761 - DNA, 25 bp, Rattus norvegicus
acctggatgaatccttttggccctt

SEQ ID NO: 87762 - DNA, 25 bp, Rattus norvegicus
acctggatgaatgcttttggccctt

SEQ ID NO: 87763 - DNA, 25 bp, Rattus norvegicus
acctggatgagccttttgcctgcat

SEQ ID NO: 87764 - DNA, 25 bp, Rattus norvegicus
acctggatgagcgttttgcctgcat

SEQ ID NO: 87765 - DNA, 25 bp, Rattus norvegicus
acctggattgtacagaggcagaatt

SEQ ID NO: 87766 - DNA, 25 bp, Rattus norvegicus
acctggattgtagagaggcagaatt

SEQ ID NO: 87767 - DNA, 25 bp, Rattus norvegicus
acctggatttccctcagggacctgc

SEQ ID NO: 87768 - DNA, 25 bp, Rattus norvegicus
acctggatttccgtcagggacctgc

SEQ ID NO: 87769 - DNA, 25 bp, Rattus norvegicus
acctggcacaagatttattgcagag

SEQ ID NO: 87770 - DNA, 25 bp, Rattus norvegicus
acctggcacaagttttattgcagag

SEQ ID NO: 87771 - DNA, 25 bp, Rattus norvegicus
acctggcaccagatactcttttata

SEQ ID NO: 87772 - DNA, 25 bp, Rattus norvegicus
acctggcaccagcatcacattaaaa

SEQ ID NO: 87773 - DNA, 25 bp, Rattus norvegicus
acctggcaccaggatcacattaaaa

SEQ ID NO: 87774 - DNA, 25 bp, Rattus norvegicus
acctggcaccagttactcttttata

SEQ ID NO: 87775 - DNA, 25 bp, Rattus norvegicus
acctggcagcctaccacaagagaga

SEQ ID NO: 87776 - DNA, 25 bp, Rattus norvegicus
acctggcagccttccacaagagaga

SEQ ID NO: 87777 - DNA, 25 bp, Rattus norvegicus
acctggcagctgcttacgggtctga

SEQ ID NO: 87778 - DNA, 25 bp, Rattus norvegicus
acctggcagctggttacgggtctga

SEQ ID NO: 87779 - DNA, 25 bp, Rattus norvegicus
acctggcagtcaatatataccttca

SEQ ID NO: 87780 - DNA, 25 bp, Rattus norvegicus
acctggcagtcattatataccttca

SEQ ID NO: 87781 - DNA, 25 bp, Rattus norvegicus
acctggcagtcgctgaattcaactt

SEQ ID NO: 87782 - DNA, 25 bp, Rattus norvegicus
acctggcagtcggtgaattcaactt

SEQ ID NO: 87783 - DNA, 25 bp, Rattus norvegicus
acctggcatgaaacccattcttaaa

SEQ ID NO: 87784 - DNA, 25 bp, Rattus norvegicus
acctggcatgaatcccattcttaaa

SEQ ID NO: 87785 - DNA, 25 bp, Rattus norvegicus
acctggccaacgaatgcaagtcctg

SEQ ID NO: 87786 - DNA, 25 bp, Rattus norvegicus
acctggccaacgtatgcaagtcctg

SEQ ID NO: 87787 - DNA, 25 bp, Rattus norvegicus
acctggccacgtcgaggctggttaa

SEQ ID NO: 87788 - DNA, 25 bp, Rattus norvegicus
acctggccacgtggaggctggttaa

SEQ ID NO: 87789 - DNA, 25 bp, Rattus norvegicus
acctggccagataatgactcaactt

SEQ ID NO: 87790 - DNA, 25 bp, Rattus norvegicus
acctggccagattatgactcaactt

SEQ ID NO: 87791 - DNA, 25 bp, Rattus norvegicus
acctggccagtgacgtcttttagga

SEQ ID NO: 87792 - DNA, 25 bp, Rattus norvegicus
acctggccagtgagaagtcttctag

SEQ ID NO: 87793 - DNA, 25 bp, Rattus norvegicus
acctggccagtgtcgtcttttagga

SEQ ID NO: 87794 - DNA, 25 bp, Rattus norvegicus
acctggccagtgtgaagtcttctag

SEQ ID NO: 87795 - DNA, 25 bp, Rattus norvegicus
acctggccattcatgcaataggaaa

SEQ ID NO: 87796 - DNA, 25 bp, Rattus norvegicus
acctggccattcttgcaataggaaa

SEQ ID NO: 87797 - DNA, 25 bp, Rattus norvegicus
acctggcccaggagaatcggacaaa

SEQ ID NO: 87798 - DNA, 25 bp, Rattus norvegicus
acctggcccaggtgaatcggacaaa

SEQ ID NO: 87799 - DNA, 25 bp, Rattus norvegicus
acctggccgctgatcacttgtaaga

SEQ ID NO: 87800 - DNA, 25 bp, Rattus norvegicus
acctggccgctgttcacttgtaaga

SEQ ID NO: 87801 - DNA, 25 bp, Rattus norvegicus
acctggccttagcttgtacaatgat

SEQ ID NO: 87802 - DNA, 25 bp, Rattus norvegicus
acctggccttaggttgtacaatgat

SEQ ID NO: 87803 - DNA, 25 bp, Rattus norvegicus
acctggcctttacactcatcttatt

SEQ ID NO: 87804 - DNA, 25 bp, Rattus norvegicus
acctggcctttagactcatcttatt

SEQ ID NO: 87805 - DNA, 25 bp, Rattus norvegicus
acctggcgagatatcatgtttatat

SEQ ID NO: 87806 - DNA, 25 bp, Rattus norvegicus
acctggcgagatttcatgtttatat

SEQ ID NO: 87807 - DNA, 25 bp, Rattus norvegicus
acctggcgagcaagctcgcttttta

SEQ ID NO: 87808 - DNA, 25 bp, Rattus norvegicus
acctggcgagcatgctcgcttttta

SEQ ID NO: 87809 - DNA, 25 bp, Rattus norvegicus
acctggctaatcactgctttgtgaa

SEQ ID NO: 87810 - DNA, 25 bp, Rattus norvegicus
acctggctaatctctgctttgtgaa

SEQ ID NO: 87811 - DNA, 25 bp, Rattus norvegicus
acctggctactgagcacagttctga

SEQ ID NO: 87812 - DNA, 25 bp, Rattus norvegicus
acctggctactgtgcacagttctga

SEQ ID NO: 87813 - DNA, 25 bp, Rattus norvegicus
acctggctacttagctatttgtgca

SEQ ID NO: 87814 - DNA, 25 bp, Rattus norvegicus
acctggctactttgctatttgtgca

SEQ ID NO: 87815 - DNA, 25 bp, Rattus norvegicus
acctggctatccataggtgtccgga

SEQ ID NO: 87816 - DNA, 25 bp, Rattus norvegicus
acctggctatccttaggtgtccgga

SEQ ID NO: 87817 - DNA, 25 bp, Rattus norvegicus
acctggctatgactgacccgctcag

SEQ ID NO: 87818 - DNA, 25 bp, Rattus norvegicus
acctggctatgagtgacccgctcag

SEQ ID NO: 87819 - DNA, 25 bp, Rattus norvegicus
acctggctcacaaggatctcacagt

SEQ ID NO: 87820 - DNA, 25 bp, Rattus norvegicus
acctggctcacatggatctcacagt

SEQ ID NO: 87821 - DNA, 25 bp, Rattus norvegicus
acctggctcagcagcgcaactgtga

SEQ ID NO: 87822 - DNA, 25 bp, Rattus norvegicus
acctggctcagctgcgcaactgtga

SEQ ID NO: 87823 - DNA, 25 bp, Rattus norvegicus
acctggctcctaagctgtgatatat

SEQ ID NO: 87824 - DNA, 25 bp, Rattus norvegicus
acctggctcctatgctgtgatatat

SEQ ID NO: 87825 - DNA, 25 bp, Rattus norvegicus
acctggctcgggagttcatgatcaa

SEQ ID NO: 87826 - DNA, 25 bp, Rattus norvegicus
acctggctcgggtgttcatgatcaa

SEQ ID NO: 87827 - DNA, 25 bp, Rattus norvegicus
acctggctctagcaccaattcttta

SEQ ID NO: 87828 - DNA, 25 bp, Rattus norvegicus
acctggctctaggaccaattcttta

SEQ ID NO: 87829 - DNA, 25 bp, Rattus norvegicus
acctggctctgccatagggcgttgc

SEQ ID NO: 87830 - DNA, 25 bp, Rattus norvegicus
acctggctctgcgatagggcgttgc

SEQ ID NO: 87831 - DNA, 25 bp, Rattus norvegicus
acctggctgcagaacactcacgtgt

SEQ ID NO: 87832 - DNA, 25 bp, Rattus norvegicus
acctggctgcagtacactcacgtgt

SEQ ID NO: 87833 - DNA, 25 bp, Rattus norvegicus
acctggctgccaaagaaatcatgaa

SEQ ID NO: 87834 - DNA, 25 bp, Rattus norvegicus
acctggctgccatagaaatcatgaa

SEQ ID NO: 87835 - DNA, 25 bp, Rattus norvegicus
acctggctgctgagaagaagcgcat

SEQ ID NO: 87836 - DNA, 25 bp, Rattus norvegicus
acctggctgctgagtctgtctggga

SEQ ID NO: 87837 - DNA, 25 bp, Rattus norvegicus
acctggctgctgtgaagaagcgcat

SEQ ID NO: 87838 - DNA, 25 bp, Rattus norvegicus
acctggctgctgtgtctgtctggga

SEQ ID NO: 87839 - DNA, 25 bp, Rattus norvegicus
acctggctggtaacatgtccttagt

SEQ ID NO: 87840 - DNA, 25 bp, Rattus norvegicus
acctggctggtatcatgtccttagt

SEQ ID NO: 87841 - DNA, 25 bp, Rattus norvegicus
acctggcttccaatggaggtgaact

SEQ ID NO: 87842 - DNA, 25 bp, Rattus norvegicus
acctggcttccattggaggtgaact

SEQ ID NO: 87843 - DNA, 25 bp, Rattus norvegicus
acctggcttgtacggtcttagcttc

SEQ ID NO: 87844 - DNA, 25 bp, Rattus norvegicus
acctggcttgtagggtcttagcttc

SEQ ID NO: 87845 - DNA, 25 bp, Rattus norvegicus
acctggctttacctgatgaattcct

SEQ ID NO: 87846 - DNA, 25 bp, Rattus norvegicus
acctggctttacgtgatgaattcct

SEQ ID NO: 87847 - DNA, 25 bp, Rattus norvegicus
acctgggaaatgcaccatactctaa

SEQ ID NO: 87848 - DNA, 25 bp, Rattus norvegicus
acctgggaaatggaccatactctaa

SEQ ID NO: 87849 - DNA, 25 bp, Rattus norvegicus
acctgggaacttcggaacttgctgg

SEQ ID NO: 87850 - DNA, 25 bp, Rattus norvegicus
acctgggaacttgggaacttgctgg

SEQ ID NO: 87851 - DNA, 25 bp, Rattus norvegicus
acctgggaagcaacggtggccgtca

SEQ ID NO: 87852 - DNA, 25 bp, Rattus norvegicus
acctgggaagcatcggtggccgtca

SEQ ID NO: 87853 - DNA, 25 bp, Rattus norvegicus
acctgggacagtcagtctggcttgt

SEQ ID NO: 87854 - DNA, 25 bp, Rattus norvegicus
acctgggacagtgagtctggcttgt

SEQ ID NO: 87855 - DNA, 25 bp, Rattus norvegicus
acctgggaccaaaccatgtggcttt

SEQ ID NO: 87856 - DNA, 25 bp, Rattus norvegicus
acctgggaccaatccatgtggcttt

SEQ ID NO: 87857 - DNA, 25 bp, Rattus norvegicus
acctgggacttcctccaaagagata

SEQ ID NO: 87858 - DNA, 25 bp, Rattus norvegicus
acctgggacttcgtccaaagagata

SEQ ID NO: 87859 - DNA, 25 bp, Rattus norvegicus
acctgggagaacacccagctgtgtt

SEQ ID NO: 87860 - DNA, 25 bp, Rattus norvegicus
acctgggagaactcccagctgtgtt

SEQ ID NO: 87861 - DNA, 25 bp, Rattus norvegicus
acctgggagaccctggtgtgctaaa

SEQ ID NO: 87862 - DNA, 25 bp, Rattus norvegicus
acctgggagaccgtggtgtgctaaa

SEQ ID NO: 87863 - DNA, 25 bp, Rattus norvegicus
acctgggatcagcaagggcttctag

SEQ ID NO: 87864 - DNA, 25 bp, Rattus norvegicus
acctgggatcaggaagggcttctag

SEQ ID NO: 87865 - DNA, 25 bp, Rattus norvegicus
acctgggatcatcataaaccgttga

SEQ ID NO: 87866 - DNA, 25 bp, Rattus norvegicus
acctgggatcatgataaaccgttga

SEQ ID NO: 87867 - DNA, 25 bp, Rattus norvegicus
acctgggatcttattgggccactgg

SEQ ID NO: 87868 - DNA, 25 bp, Rattus norvegicus
acctgggatctttttgggccactgg

SEQ ID NO: 87869 - DNA, 25 bp, Rattus norvegicus
acctgggatggcacatctggcagaa

SEQ ID NO: 87870 - DNA, 25 bp, Rattus norvegicus
acctgggatggctcatctggcagaa

SEQ ID NO: 87871 - DNA, 25 bp, Rattus norvegicus
acctgggcaactcctgctgcataag

SEQ ID NO: 87872 - DNA, 25 bp, Rattus norvegicus
acctgggcaactgctgctgcataag

SEQ ID NO: 87873 - DNA, 25 bp, Rattus norvegicus
acctgggcaatgaggctgctggaaa

SEQ ID NO: 87874 - DNA, 25 bp, Rattus norvegicus
acctgggcaatgtggctgctggaaa

SEQ ID NO: 87875 - DNA, 25 bp, Rattus norvegicus
acctgggcaccaaccatgacatgaa

SEQ ID NO: 87876 - DNA, 25 bp, Rattus norvegicus
acctgggcaccatccatgacatgaa

SEQ ID NO: 87877 - DNA, 25 bp, Rattus norvegicus
acctgggcaggaaaagggtgcactc

SEQ ID NO: 87878 - DNA, 25 bp, Rattus norvegicus
acctgggcaggataagggtgcactc

SEQ ID NO: 87879 - DNA, 25 bp, Rattus norvegicus
acctgggcatagctcctaacatata

SEQ ID NO: 87880 - DNA, 25 bp, Rattus norvegicus
acctgggcataggtcctaacatata

SEQ ID NO: 87881 - DNA, 25 bp, Rattus norvegicus
acctgggcatggatgtggacctgat

SEQ ID NO: 87882 - DNA, 25 bp, Rattus norvegicus
acctgggcatggttgtggacctgat

SEQ ID NO: 87883 - DNA, 25 bp, Rattus norvegicus
acctgggcccagacagttgtaggaa

SEQ ID NO: 87884 - DNA, 25 bp, Rattus norvegicus
acctgggcccagtcagttgtaggaa

SEQ ID NO: 87885 - DNA, 25 bp, Rattus norvegicus
acctgggccctgataacggatgtga

SEQ ID NO: 87886 - DNA, 25 bp, Rattus norvegicus
acctgggccctgttaacggatgtga

SEQ ID NO: 87887 - DNA, 25 bp, Rattus norvegicus
acctgggctccgagttcctgcctgg

SEQ ID NO: 87888 - DNA, 25 bp, Rattus norvegicus
acctgggctccgtgttcctgcctgg

SEQ ID NO: 87889 - DNA, 25 bp, Rattus norvegicus
acctgggctcttctcttagcaaagt

SEQ ID NO: 87890 - DNA, 25 bp, Rattus norvegicus
acctgggctcttgtcttagcaaagt

SEQ ID NO: 87891 - DNA, 25 bp, Rattus norvegicus
acctgggcttatctccagcagctga

SEQ ID NO: 87892 - DNA, 25 bp, Rattus norvegicus
acctgggcttatgtccagcagctga

SEQ ID NO: 87893 - DNA, 25 bp, Rattus norvegicus
acctgggcttcaatagattgtccta

SEQ ID NO: 87894 - DNA, 25 bp, Rattus norvegicus
acctgggcttcattagattgtccta

SEQ ID NO: 87895 - DNA, 25 bp, Rattus norvegicus
acctgggtacacaaactgttctttg

SEQ ID NO: 87896 - DNA, 25 bp, Rattus norvegicus
acctgggtacactaactgttctttg

SEQ ID NO: 87897 - DNA, 25 bp, Rattus norvegicus
acctgggtctacatactcttgtatt

SEQ ID NO: 87898 - DNA, 25 bp, Rattus norvegicus
acctgggtctacttactcttgtatt

SEQ ID NO: 87899 - DNA, 25 bp, Rattus norvegicus
acctgggtctgaattgtagatcact

SEQ ID NO: 87900 - DNA, 25 bp, Rattus norvegicus
acctgggtctgatttgtagatcact

SEQ ID NO: 87901 - DNA, 25 bp, Rattus norvegicus
acctgggtgggcctaatataatcac

SEQ ID NO: 87902 - DNA, 25 bp, Rattus norvegicus
acctgggtgggcgtaatataatcac

SEQ ID NO: 87903 - DNA, 25 bp, Rattus norvegicus
acctgggttagtcttttgtcctcag

SEQ ID NO: 87904 - DNA, 25 bp, Rattus norvegicus
acctgggttagtgttttgtcctcag

SEQ ID NO: 87905 - DNA, 25 bp, Rattus norvegicus
acctgggtttgaacctgagggccta

SEQ ID NO: 87906 - DNA, 25 bp, Rattus norvegicus
acctgggtttgatcctgagggccta

SEQ ID NO: 87907 - DNA, 25 bp, Rattus norvegicus
acctggtaaccaagcagaaatttta

SEQ ID NO: 87908 - DNA, 25 bp, Rattus norvegicus
acctggtaaccatgcagaaatttta

SEQ ID NO: 87909 - DNA, 25 bp, Rattus norvegicus
acctggtaacctattctatctgtag

SEQ ID NO: 87910 - DNA, 25 bp, Rattus norvegicus
acctggtaaccttttctatctgtag

SEQ ID NO: 87911 - DNA, 25 bp, Rattus norvegicus
acctggtaccctaaaagctctagag

SEQ ID NO: 87912 - DNA, 25 bp, Rattus norvegicus
acctggtaccctcgtgttgatctaa

SEQ ID NO: 87913 - DNA, 25 bp, Rattus norvegicus
acctggtaccctggtgttgatctaa

SEQ ID NO: 87914 - DNA, 25 bp, Rattus norvegicus
acctggtacccttaaagctctagag

SEQ ID NO: 87915 - DNA, 25 bp, Rattus norvegicus
acctggtacgttcatctaaatctcc

SEQ ID NO: 87916 - DNA, 25 bp, Rattus norvegicus
acctggtacgttgatctaaatctcc

SEQ ID NO: 87917 - DNA, 25 bp, Rattus norvegicus
acctggtactaactgtcctgcaaag

SEQ ID NO: 87918 - DNA, 25 bp, Rattus norvegicus
acctggtactaagtgtcctgcaaag

SEQ ID NO: 87919 - DNA, 25 bp, Rattus norvegicus
acctggtacttgaatactgatcctt

SEQ ID NO: 87920 - DNA, 25 bp, Rattus norvegicus
acctggtacttgtatactgatcctt

SEQ ID NO: 87921 - DNA, 25 bp, Rattus norvegicus
acctggtagcaccattctctgtcta

SEQ ID NO: 87922 - DNA, 25 bp, Rattus norvegicus
acctggtagcacgattctctgtcta

SEQ ID NO: 87923 - DNA, 25 bp, Rattus norvegicus
acctggtagttgagggctgcactga

SEQ ID NO: 87924 - DNA, 25 bp, Rattus norvegicus
acctggtagttgtgggctgcactga

SEQ ID NO: 87925 - DNA, 25 bp, Rattus norvegicus
acctggtatcgtcgtgacgaacgtg

SEQ ID NO: 87926 - DNA, 25 bp, Rattus norvegicus
acctggtatcgtggtgacgaacgtg

SEQ ID NO: 87927 - DNA, 25 bp, Rattus norvegicus
acctggtccagactgcatgggtagc

SEQ ID NO: 87928 - DNA, 25 bp, Rattus norvegicus
acctggtccagagtgcatgggtagc

SEQ ID NO: 87929 - DNA, 25 bp, Rattus norvegicus
acctggtccagcagtggcaagcaga

SEQ ID NO: 87930 - DNA, 25 bp, Rattus norvegicus
acctggtccagctgtggcaagcaga

SEQ ID NO: 87931 - DNA, 25 bp, Rattus norvegicus
acctggtcgggcagtctgcatggac

SEQ ID NO: 87932 - DNA, 25 bp, Rattus norvegicus
acctggtcgggctgtctgcatggac

SEQ ID NO: 87933 - DNA, 25 bp, Rattus norvegicus
acctggtcgtgtatggtttgggcat

SEQ ID NO: 87934 - DNA, 25 bp, Rattus norvegicus
acctggtcgtgtttggtttgggcat

SEQ ID NO: 87935 - DNA, 25 bp, Rattus norvegicus
acctggtctgtacgagcccggagtc

SEQ ID NO: 87936 - DNA, 25 bp, Rattus norvegicus
acctggtctgtaggagcccggagtc

SEQ ID NO: 87937 - DNA, 25 bp, Rattus norvegicus
acctggtctttgacttgtagcattt

SEQ ID NO: 87938 - DNA, 25 bp, Rattus norvegicus
acctggtctttgtcttgtagcattt

SEQ ID NO: 87939 - DNA, 25 bp, Rattus norvegicus
acctggtgaaggactggcacccaga

SEQ ID NO: 87940 - DNA, 25 bp, Rattus norvegicus
acctggtgaaggtctggcacccaga

SEQ ID NO: 87941 - DNA, 25 bp, Rattus norvegicus
acctggtgcaatctctcttttatat

SEQ ID NO: 87942 - DNA, 25 bp, Rattus norvegicus
acctggtgcaatgtctcttttatat

SEQ ID NO: 87943 - DNA, 25 bp, Rattus norvegicus
acctggtgccagatctgtctaagga

SEQ ID NO: 87944 - DNA, 25 bp, Rattus norvegicus
acctggtgccagttctgtctaagga

SEQ ID NO: 87945 - DNA, 25 bp, Rattus norvegicus
acctggtgccttaatctgccctgtc

SEQ ID NO: 87946 - DNA, 25 bp, Rattus norvegicus
acctggtgccttcagccttgaaatt

SEQ ID NO: 87947 - DNA, 25 bp, Rattus norvegicus
acctggtgccttgagccttgaaatt

SEQ ID NO: 87948 - DNA, 25 bp, Rattus norvegicus
acctggtgcctttatctgccctgtc

SEQ ID NO: 87949 - DNA, 25 bp, Rattus norvegicus
acctggtgcggtatttgtgtgccaa

SEQ ID NO: 87950 - DNA, 25 bp, Rattus norvegicus
acctggtgcggtttttgtgtgccaa

SEQ ID NO: 87951 - DNA, 25 bp, Rattus norvegicus
acctggtgcttcacatgtcagaggt

SEQ ID NO: 87952 - DNA, 25 bp, Rattus norvegicus
acctggtgcttctcatgtcagaggt

SEQ ID NO: 87953 - DNA, 25 bp, Rattus norvegicus
acctggtggcccactttggagagct

SEQ ID NO: 87954 - DNA, 25 bp, Rattus norvegicus
acctggtggccctctttggagagct

SEQ ID NO: 87955 - DNA, 25 bp, Rattus norvegicus
acctggtggcgaaaacttgctggac

SEQ ID NO: 87956 - DNA, 25 bp, Rattus norvegicus
acctggtggcgataacttgctggac

SEQ ID NO: 87957 - DNA, 25 bp, Rattus norvegicus
acctggtggtgcagctgtttgagac

SEQ ID NO: 87958 - DNA, 25 bp, Rattus norvegicus
acctggtggtgctgctgtttgagac

SEQ ID NO: 87959 - DNA, 25 bp, Rattus norvegicus
acctggtggttgagtaatgtctttc

SEQ ID NO: 87960 - DNA, 25 bp, Rattus norvegicus
acctggtggttgtgtaatgtctttc

SEQ ID NO: 87961 - DNA, 25 bp, Rattus norvegicus
acctggtgtaccagctgaaggctga

SEQ ID NO: 87962 - DNA, 25 bp, Rattus norvegicus
acctggtgtacctgctgaaggctga

SEQ ID NO: 87963 - DNA, 25 bp, Rattus norvegicus
acctggtgtcgcaggaggctgttta

SEQ ID NO: 87964 - DNA, 25 bp, Rattus norvegicus
acctggtgtcgctggaggctgttta

SEQ ID NO: 87965 - DNA, 25 bp, Rattus norvegicus
acctggtgtcttagtattttccata

SEQ ID NO: 87966 - DNA, 25 bp, Rattus norvegicus
acctggtgtctttgtattttccata

SEQ ID NO: 87967 - DNA, 25 bp, Rattus norvegicus
acctggtgtggtcggatatgccttt

SEQ ID NO: 87968 - DNA, 25 bp, Rattus norvegicus
acctggtgtggtgggatatgccttt

SEQ ID NO: 87969 - DNA, 25 bp, Rattus norvegicus
acctggtgttttcattacagtgaga

SEQ ID NO: 87970 - DNA, 25 bp, Rattus norvegicus
acctggtgttttgattacagtgaga

SEQ ID NO: 87971 - DNA, 25 bp, Rattus norvegicus
acctggttaagcctctccagtggac

SEQ ID NO: 87972 - DNA, 25 bp, Rattus norvegicus
acctggttaagcgtctccagtggac

SEQ ID NO: 87973 - DNA, 25 bp, Rattus norvegicus
acctggttagccaaactgcagcaca

SEQ ID NO: 87974 - DNA, 25 bp, Rattus norvegicus
acctggttagcctaactgcagcaca

SEQ ID NO: 87975 - DNA, 25 bp, Rattus norvegicus
acctggttcccaaattcagtctgtg

SEQ ID NO: 87976 - DNA, 25 bp, Rattus norvegicus
acctggttcccatattcagtctgtg

SEQ ID NO: 87977 - DNA, 25 bp, Rattus norvegicus
acctggttccttacttaagcagaca

SEQ ID NO: 87978 - DNA, 25 bp, Rattus norvegicus
acctggttcctttcttaagcagaca

SEQ ID NO: 87979 - DNA, 25 bp, Rattus norvegicus
acctggttcggcagctgtcagatga

SEQ ID NO: 87980 - DNA, 25 bp, Rattus norvegicus
acctggttcggctgctgtcagatga

SEQ ID NO: 87981 - DNA, 25 bp, Rattus norvegicus
acctggttctgcagaatgtgtacac

SEQ ID NO: 87982 - DNA, 25 bp, Rattus norvegicus
acctggttctgctgaatgtgtacac

SEQ ID NO: 87983 - DNA, 25 bp, Rattus norvegicus
acctggttgccaatttcatattact

SEQ ID NO: 87984 - DNA, 25 bp, Rattus norvegicus
acctggttgccattttcatattact

SEQ ID NO: 87985 - DNA, 25 bp, Rattus norvegicus
acctggttggcgcatctgctgaaac

SEQ ID NO: 87986 - DNA, 25 bp, Rattus norvegicus
acctggttggcggatctgctgaaac

SEQ ID NO: 87987 - DNA, 25 bp, Rattus norvegicus
acctggtttaatacttctctttctg

SEQ ID NO: 87988 - DNA, 25 bp, Rattus norvegicus
acctggtttaattcttctctttctg

SEQ ID NO: 87989 - DNA, 25 bp, Rattus norvegicus
acctgtaaactgaagcctggagcca

SEQ ID NO: 87990 - DNA, 25 bp, Rattus norvegicus
acctgtaaactgtagcctggagcca

SEQ ID NO: 87991 - DNA, 25 bp, Rattus norvegicus
acctgtaacagtccctggtgcataa

SEQ ID NO: 87992 - DNA, 25 bp, Rattus norvegicus
acctgtaacagtgcctggtgcataa

SEQ ID NO: 87993 - DNA, 25 bp, Rattus norvegicus
acctgtaatcctagtcgcagggagg

SEQ ID NO: 87994 - DNA, 25 bp, Rattus norvegicus
acctgtaatccttgtcgcagggagg

SEQ ID NO: 87995 - DNA, 25 bp, Rattus norvegicus
acctgtaatcttagccatttgtcag

SEQ ID NO: 87996 - DNA, 25 bp, Rattus norvegicus
acctgtaatctttgccatttgtcag

SEQ ID NO: 87997 - DNA, 25 bp, Rattus norvegicus
acctgtaatgaactctgtggacctg

SEQ ID NO: 87998 - DNA, 25 bp, Rattus norvegicus
acctgtaatgaagtctgtggacctg

SEQ ID NO: 87999 - DNA, 25 bp, Rattus norvegicus
acctgtaattgcctccttagtattg

SEQ ID NO: 88000 - DNA, 25 bp, Rattus norvegicus
acctgtaattgcgtccttagtattg

SEQ ID NO: 88001 - DNA, 25 bp, Rattus norvegicus
acctgtaatttgctgcacatacaca

SEQ ID NO: 88002 - DNA, 25 bp, Rattus norvegicus
acctgtaatttggtgcacatacaca

SEQ ID NO: 88003 - DNA, 25 bp, Rattus norvegicus
acctgtacaacaagtgcctggccgt

SEQ ID NO: 88004 - DNA, 25 bp, Rattus norvegicus
acctgtacaacatgtgcctggccgt

SEQ ID NO: 88005 - DNA, 25 bp, Rattus norvegicus
acctgtacagcaaagtgaagttcca

SEQ ID NO: 88006 - DNA, 25 bp, Rattus norvegicus
acctgtacagcatagtgaagttcca

SEQ ID NO: 88007 - DNA, 25 bp, Rattus norvegicus
acctgtacctttcttgttctgtgga

SEQ ID NO: 88008 - DNA, 25 bp, Rattus norvegicus
acctgtacctttgttgttctgtgga

SEQ ID NO: 88009 - DNA, 25 bp, Rattus norvegicus
acctgtactcctcattatgccaaaa

SEQ ID NO: 88010 - DNA, 25 bp, Rattus norvegicus
acctgtactcctgattatgccaaaa

SEQ ID NO: 88011 - DNA, 25 bp, Rattus norvegicus
acctgtactttgatcccgtgaagtg

SEQ ID NO: 88012 - DNA, 25 bp, Rattus norvegicus
acctgtactttgttcccgtgaagtg

SEQ ID NO: 88013 - DNA, 25 bp, Rattus norvegicus
acctgtagcctgcacggtgttgtac

SEQ ID NO: 88014 - DNA, 25 bp, Rattus norvegicus
acctgtagcctggacggtgttgtac

SEQ ID NO: 88015 - DNA, 25 bp, Rattus norvegicus
acctgtaggctcatgagggcctgcc

SEQ ID NO: 88016 - DNA, 25 bp, Rattus norvegicus
acctgtaggctcttgagggcctgcc

SEQ ID NO: 88017 - DNA, 25 bp, Rattus norvegicus
acctgtagtgttactgccctgtaaa

SEQ ID NO: 88018 - DNA, 25 bp, Rattus norvegicus
acctgtagtgtttctgccctgtaaa

SEQ ID NO: 88019 - DNA, 25 bp, Rattus norvegicus
acctgtagttgtcggagtatgtgac

SEQ ID NO: 88020 - DNA, 25 bp, Rattus norvegicus
acctgtagttgtgggagtatgtgac

SEQ ID NO: 88021 - DNA, 25 bp, Rattus norvegicus
acctgtagtttgcatttctctgtta

SEQ ID NO: 88022 - DNA, 25 bp, Rattus norvegicus
acctgtagtttggatttctctgtta

SEQ ID NO: 88023 - DNA, 25 bp, Rattus norvegicus
acctgtatacttccttgcttagaca

SEQ ID NO: 88024 - DNA, 25 bp, Rattus norvegicus
acctgtatacttgcttgcttagaca

SEQ ID NO: 88025 - DNA, 25 bp, Rattus norvegicus
acctgtatagctattgatgtcctgt

SEQ ID NO: 88026 - DNA, 25 bp, Rattus norvegicus
acctgtatagcttttgatgtcctgt

SEQ ID NO: 88027 - DNA, 25 bp, Rattus norvegicus
acctgtatcatcagactcttcccag

SEQ ID NO: 88028 - DNA, 25 bp, Rattus norvegicus
acctgtatcatcagtcaagaccttc

SEQ ID NO: 88029 - DNA, 25 bp, Rattus norvegicus
acctgtatcatctgactcttcccag

SEQ ID NO: 88030 - DNA, 25 bp, Rattus norvegicus
acctgtatcatctgtcaagaccttc

SEQ ID NO: 88031 - DNA, 25 bp, Rattus norvegicus
acctgtatctgtcttcttgagccac

SEQ ID NO: 88032 - DNA, 25 bp, Rattus norvegicus
acctgtatctgtgttcttgagccac

SEQ ID NO: 88033 - DNA, 25 bp, Rattus norvegicus
acctgtatggttctccagggctcca

SEQ ID NO: 88034 - DNA, 25 bp, Rattus norvegicus
acctgtatggttgtccagggctcca

SEQ ID NO: 88035 - DNA, 25 bp, Rattus norvegicus
acctgtatgtgtcgaacttgctaat

SEQ ID NO: 88036 - DNA, 25 bp, Rattus norvegicus
acctgtatgtgtggaacttgctaat

SEQ ID NO: 88037 - DNA, 25 bp, Rattus norvegicus
acctgtattattatttgaacgatct

SEQ ID NO: 88038 - DNA, 25 bp, Rattus norvegicus
acctgtattattcacttgtgccgat

SEQ ID NO: 88039 - DNA, 25 bp, Rattus norvegicus
acctgtattattgacttgtgccgat

SEQ ID NO: 88040 - DNA, 25 bp, Rattus norvegicus
acctgtattattttttgaacgatct

SEQ ID NO: 88041 - DNA, 25 bp, Rattus norvegicus
acctgtatttttcatgtttgcaact

SEQ ID NO: 88042 - DNA, 25 bp, Rattus norvegicus
acctgtatttttgatgtttgcaact

SEQ ID NO: 88043 - DNA, 25 bp, Rattus norvegicus
acctgtcacaccaacatgcttaaga

SEQ ID NO: 88044 - DNA, 25 bp, Rattus norvegicus
acctgtcacacctacatgcttaaga

SEQ ID NO: 88045 - DNA, 25 bp, Rattus norvegicus
acctgtcaccaacgatcacacttat

SEQ ID NO: 88046 - DNA, 25 bp, Rattus norvegicus
acctgtcaccaaggatcacacttat

SEQ ID NO: 88047 - DNA, 25 bp, Rattus norvegicus
acctgtcaccttaattacattgtaa

SEQ ID NO: 88048 - DNA, 25 bp, Rattus norvegicus
acctgtcacctttattacattgtaa

SEQ ID NO: 88049 - DNA, 25 bp, Rattus norvegicus
acctgtcacgtgaatagccaagctt

SEQ ID NO: 88050 - DNA, 25 bp, Rattus norvegicus
acctgtcacgtgtatagccaagctt

SEQ ID NO: 88051 - DNA, 25 bp, Rattus norvegicus
acctgtcagctcacttgcaatggag

SEQ ID NO: 88052 - DNA, 25 bp, Rattus norvegicus
acctgtcagctctcttgcaatggag

SEQ ID NO: 88053 - DNA, 25 bp, Rattus norvegicus
acctgtcatcttatctttgaggacc

SEQ ID NO: 88054 - DNA, 25 bp, Rattus norvegicus
acctgtcatcttcgctcctaaggaa

SEQ ID NO: 88055 - DNA, 25 bp, Rattus norvegicus
acctgtcatcttggctcctaaggaa

SEQ ID NO: 88056 - DNA, 25 bp, Rattus norvegicus
acctgtcatcttttctttgaggacc

SEQ ID NO: 88057 - DNA, 25 bp, Rattus norvegicus
acctgtccaaggacggtcaccagaa

SEQ ID NO: 88058 - DNA, 25 bp, Rattus norvegicus
acctgtccaaggtcggtcaccagaa

SEQ ID NO: 88059 - DNA, 25 bp, Rattus norvegicus
acctgtccagctatacttgtgtgat

SEQ ID NO: 88060 - DNA, 25 bp, Rattus norvegicus
acctgtccagctttacttgtgtgat

SEQ ID NO: 88061 - DNA, 25 bp, Rattus norvegicus
acctgtccaggaaagtgagtgattc

SEQ ID NO: 88062 - DNA, 25 bp, Rattus norvegicus
acctgtccaggatagtgagtgattc

SEQ ID NO: 88063 - DNA, 25 bp, Rattus norvegicus
acctgtccctcacagaagatttcta

SEQ ID NO: 88064 - DNA, 25 bp, Rattus norvegicus
acctgtccctcagagaagatttcta

SEQ ID NO: 88065 - DNA, 25 bp, Rattus norvegicus
acctgtccctgtaataactgctatg

SEQ ID NO: 88066 - DNA, 25 bp, Rattus norvegicus
acctgtccctgttataactgctatg

SEQ ID NO: 88067 - DNA, 25 bp, Rattus norvegicus
acctgtcctatcagaagtactgggc

SEQ ID NO: 88068 - DNA, 25 bp, Rattus norvegicus
acctgtcctatctgaagtactgggc

SEQ ID NO: 88069 - DNA, 25 bp, Rattus norvegicus
acctgtcctcccaacatttgagaag

SEQ ID NO: 88070 - DNA, 25 bp, Rattus norvegicus
acctgtcctccctacatttgagaag

SEQ ID NO: 88071 - DNA, 25 bp, Rattus norvegicus
acctgtcctctgagggcttgttaat

SEQ ID NO: 88072 - DNA, 25 bp, Rattus norvegicus
acctgtcctctgtgggcttgttaat

SEQ ID NO: 88073 - DNA, 25 bp, Rattus norvegicus
acctgtcctgacctggtctctagtt

SEQ ID NO: 88074 - DNA, 25 bp, Rattus norvegicus
acctgtcctgacgtggtctctagtt

SEQ ID NO: 88075 - DNA, 25 bp, Rattus norvegicus
acctgtcctgtcagctgaggtctga

SEQ ID NO: 88076 - DNA, 25 bp, Rattus norvegicus
acctgtcctgtctgctgaggtctga

SEQ ID NO: 88077 - DNA, 25 bp, Rattus norvegicus
acctgtccttgcacatgagtcttag

SEQ ID NO: 88078 - DNA, 25 bp, Rattus norvegicus
acctgtccttgctcatgagtcttag

SEQ ID NO: 88079 - DNA, 25 bp, Rattus norvegicus
acctgtcgcctaagaatagatttgg

SEQ ID NO: 88080 - DNA, 25 bp, Rattus norvegicus
acctgtcgcctatgaatagatttgg

SEQ ID NO: 88081 - DNA, 25 bp, Rattus norvegicus
acctgtcggatcagtttagggcaac

SEQ ID NO: 88082 - DNA, 25 bp, Rattus norvegicus
acctgtcggatctgtttagggcaac

SEQ ID NO: 88083 - DNA, 25 bp, Rattus norvegicus
acctgtctaacaaactttccatcaa

SEQ ID NO: 88084 - DNA, 25 bp, Rattus norvegicus
acctgtctaacatactttccatcaa

SEQ ID NO: 88085 - DNA, 25 bp, Rattus norvegicus
acctgtctacaaagaatcgtcttta

SEQ ID NO: 88086 - DNA, 25 bp, Rattus norvegicus
acctgtctacaatgaatcgtcttta

SEQ ID NO: 88087 - DNA, 25 bp, Rattus norvegicus
acctgtctatctctgtgatctcaaa

SEQ ID NO: 88088 - DNA, 25 bp, Rattus norvegicus
acctgtctatctgtgtgatctcaaa

SEQ ID NO: 88089 - DNA, 25 bp, Rattus norvegicus
acctgtctatgaagccctttaggat

SEQ ID NO: 88090 - DNA, 25 bp, Rattus norvegicus
acctgtctatgatgccctttaggat

SEQ ID NO: 88091 - DNA, 25 bp, Rattus norvegicus
acctgtctccagatgaagttgctca

SEQ ID NO: 88092 - DNA, 25 bp, Rattus norvegicus
acctgtctccagttgaagttgctca

SEQ ID NO: 88093 - DNA, 25 bp, Rattus norvegicus
acctgtctctaacgctcagtctgaa

SEQ ID NO: 88094 - DNA, 25 bp, Rattus norvegicus
acctgtctctaaggctcagtctgaa

SEQ ID NO: 88095 - DNA, 25 bp, Rattus norvegicus
acctgtctctttccctaaaaccaag

SEQ ID NO: 88096 - DNA, 25 bp, Rattus norvegicus
acctgtctctttgcctaaaaccaag

SEQ ID NO: 88097 - DNA, 25 bp, Rattus norvegicus
acctgtctgcagagcgtaactctta

SEQ ID NO: 88098 - DNA, 25 bp, Rattus norvegicus
acctgtctgcagtgcgtaactctta

SEQ ID NO: 88099 - DNA, 25 bp, Rattus norvegicus
acctgtctgcggctaaagctgatca

SEQ ID NO: 88100 - DNA, 25 bp, Rattus norvegicus
acctgtctgcgggtaaagctgatca

SEQ ID NO: 88101 - DNA, 25 bp, Rattus norvegicus
acctgtctgctaaacctgtctgtga

SEQ ID NO: 88102 - DNA, 25 bp, Rattus norvegicus
acctgtctgctatacctgtctgtga

SEQ ID NO: 88103 - DNA, 25 bp, Rattus norvegicus
acctgtctggaaaatctggctctag

SEQ ID NO: 88104 - DNA, 25 bp, Rattus norvegicus
acctgtctggaacaagtaggcccat

SEQ ID NO: 88105 - DNA, 25 bp, Rattus norvegicus
acctgtctggaagaagtaggcccat

SEQ ID NO: 88106 - DNA, 25 bp, Rattus norvegicus
acctgtctggaatatctggctctag

SEQ ID NO: 88107 - DNA, 25 bp, Rattus norvegicus
acctgtctgtgtccctaaatagctg

SEQ ID NO: 88108 - DNA, 25 bp, Rattus norvegicus
acctgtctgtgtctggcgaaagcct

SEQ ID NO: 88109 - DNA, 25 bp, Rattus norvegicus
acctgtctgtgtgcctaaatagctg

SEQ ID NO: 88110 - DNA, 25 bp, Rattus norvegicus
acctgtctgtgtgtggcgaaagcct

SEQ ID NO: 88111 - DNA, 25 bp, Rattus norvegicus
acctgtcttgctcatgctgaagctg

SEQ ID NO: 88112 - DNA, 25 bp, Rattus norvegicus
acctgtcttgctgatgctgaagctg

SEQ ID NO: 88113 - DNA, 25 bp, Rattus norvegicus
acctgtcttgtaaccgtaaactcca

SEQ ID NO: 88114 - DNA, 25 bp, Rattus norvegicus
acctgtcttgtatccgtaaactcca

SEQ ID NO: 88115 - DNA, 25 bp, Rattus norvegicus
acctgtcttttaatatctgttagtc

SEQ ID NO: 88116 - DNA, 25 bp, Rattus norvegicus
acctgtcttttattatctgttagtc

SEQ ID NO: 88117 - DNA, 25 bp, Rattus norvegicus
acctgtgaacagatttcctccaaag

SEQ ID NO: 88118 - DNA, 25 bp, Rattus norvegicus
acctgtgaacagttttcctccaaag

SEQ ID NO: 88119 - DNA, 25 bp, Rattus norvegicus
acctgtgaagccaggctttcagagt

SEQ ID NO: 88120 - DNA, 25 bp, Rattus norvegicus
acctgtgaagcctggctttcagagt

SEQ ID NO: 88121 - DNA, 25 bp, Rattus norvegicus
acctgtgacctcagcttagctgaaa

SEQ ID NO: 88122 - DNA, 25 bp, Rattus norvegicus
acctgtgacctctgcttagctgaaa

SEQ ID NO: 88123 - DNA, 25 bp, Rattus norvegicus
acctgtgactcactttgtgactctg

SEQ ID NO: 88124 - DNA, 25 bp, Rattus norvegicus
acctgtgactcagtttgtgactctg

SEQ ID NO: 88125 - DNA, 25 bp, Rattus norvegicus
acctgtgactggacctactgctgga

SEQ ID NO: 88126 - DNA, 25 bp, Rattus norvegicus
acctgtgactggtcctactgctgga

SEQ ID NO: 88127 - DNA, 25 bp, Rattus norvegicus
acctgtgacttgaatttgttattta

SEQ ID NO: 88128 - DNA, 25 bp, Rattus norvegicus
acctgtgacttgtatttgttattta

SEQ ID NO: 88129 - DNA, 25 bp, Rattus norvegicus
acctgtgagaggagttcatcctgcc

SEQ ID NO: 88130 - DNA, 25 bp, Rattus norvegicus
acctgtgagaggtgttcatcctgcc

SEQ ID NO: 88131 - DNA, 25 bp, Rattus norvegicus
acctgtgagccccaaactttcagat

SEQ ID NO: 88132 - DNA, 25 bp, Rattus norvegicus
acctgtgagcccgaaactttcagat

SEQ ID NO: 88133 - DNA, 25 bp, Rattus norvegicus
acctgtgataatcctttgccttaaa

SEQ ID NO: 88134 - DNA, 25 bp, Rattus norvegicus
acctgtgataatgctttgccttaaa

SEQ ID NO: 88135 - DNA, 25 bp, Rattus norvegicus
acctgtgatgttaccagcctttagg

SEQ ID NO: 88136 - DNA, 25 bp, Rattus norvegicus
acctgtgatgtttccagcctttagg

SEQ ID NO: 88137 - DNA, 25 bp, Rattus norvegicus
acctgtgcatacagtgagctacctg

SEQ ID NO: 88138 - DNA, 25 bp, Rattus norvegicus
acctgtgcatactgtgagctacctg

SEQ ID NO: 88139 - DNA, 25 bp, Rattus norvegicus
acctgtgcatgacctgtattcttca

SEQ ID NO: 88140 - DNA, 25 bp, Rattus norvegicus
acctgtgcatgagctgtattcttca

SEQ ID NO: 88141 - DNA, 25 bp, Rattus norvegicus
acctgtgccaggatctgaaaagcta

SEQ ID NO: 88142 - DNA, 25 bp, Rattus norvegicus
acctgtgccaggttctgaaaagcta

SEQ ID NO: 88143 - DNA, 25 bp, Rattus norvegicus
acctgtgccatcacaactattgtta

SEQ ID NO: 88144 - DNA, 25 bp, Rattus norvegicus
acctgtgccatctcaactattgtta

SEQ ID NO: 88145 - DNA, 25 bp, Rattus norvegicus
acctgtgcccacaatggactgtgat

SEQ ID NO: 88146 - DNA, 25 bp, Rattus norvegicus
acctgtgcccactatggactgtgat

SEQ ID NO: 88147 - DNA, 25 bp, Rattus norvegicus
acctgtgctcatctaagtgacctca

SEQ ID NO: 88148 - DNA, 25 bp, Rattus norvegicus
acctgtgctcatgtaagtgacctca

SEQ ID NO: 88149 - DNA, 25 bp, Rattus norvegicus
acctgtgctctcatgggcatggctg

SEQ ID NO: 88150 - DNA, 25 bp, Rattus norvegicus
acctgtgctctcttgggcatggctg

SEQ ID NO: 88151 - DNA, 25 bp, Rattus norvegicus
acctgtggaacaagtacgctgcttc

SEQ ID NO: 88152 - DNA, 25 bp, Rattus norvegicus
acctgtggaacatgtacgctgcttc

SEQ ID NO: 88153 - DNA, 25 bp, Rattus norvegicus
acctgtggacaacctgcccatggtg

SEQ ID NO: 88154 - DNA, 25 bp, Rattus norvegicus
acctgtggacaagctgcccatggtg

SEQ ID NO: 88155 - DNA, 25 bp, Rattus norvegicus
acctgtggactgaggcttgccgagc

SEQ ID NO: 88156 - DNA, 25 bp, Rattus norvegicus
acctgtggactgtggcttgccgagc

SEQ ID NO: 88157 - DNA, 25 bp, Rattus norvegicus
acctgtggagacctttgttctgcac

SEQ ID NO: 88158 - DNA, 25 bp, Rattus norvegicus
acctgtggagacgtttgttctgcac

SEQ ID NO: 88159 - DNA, 25 bp, Rattus norvegicus
acctgtggatctcgcttctgaatgc

SEQ ID NO: 88160 - DNA, 25 bp, Rattus norvegicus
acctgtggatctggcttctgaatgc

SEQ ID NO: 88161 - DNA, 25 bp, Rattus norvegicus
acctgtggatgtaatcttggcttct

SEQ ID NO: 88162 - DNA, 25 bp, Rattus norvegicus
acctgtggatgttatcttggcttct

SEQ ID NO: 88163 - DNA, 25 bp, Rattus norvegicus
acctgtggcactagcaaactgtcaa

SEQ ID NO: 88164 - DNA, 25 bp, Rattus norvegicus
acctgtggcacttgcaaactgtcaa

SEQ ID NO: 88165 - DNA, 25 bp, Rattus norvegicus
acctgtggcgtgatgcttctgttaa

SEQ ID NO: 88166 - DNA, 25 bp, Rattus norvegicus
acctgtggcgtgttgcttctgttaa

SEQ ID NO: 88167 - DNA, 25 bp, Rattus norvegicus
acctgtggctgactttcttctatga

SEQ ID NO: 88168 - DNA, 25 bp, Rattus norvegicus
acctgtggctgagtttcttctatga

SEQ ID NO: 88169 - DNA, 25 bp, Rattus norvegicus
acctgtggctgtcaggtctcatata

SEQ ID NO: 88170 - DNA, 25 bp, Rattus norvegicus
acctgtggctgtgaggtctcatata

SEQ ID NO: 88171 - DNA, 25 bp, Rattus norvegicus
acctgtggctttcccgtggagtgaa

SEQ ID NO: 88172 - DNA, 25 bp, Rattus norvegicus
acctgtggctttgccgtggagtgaa

SEQ ID NO: 88173 - DNA, 25 bp, Rattus norvegicus
acctgtgggcatccatgaagttctc

SEQ ID NO: 88174 - DNA, 25 bp, Rattus norvegicus
acctgtgggcatgcatgaagttctc

SEQ ID NO: 88175 - DNA, 25 bp, Rattus norvegicus
acctgtggtccacgcagtttggaga

SEQ ID NO: 88176 - DNA, 25 bp, Rattus norvegicus
acctgtggtccaggcagtttggaga

SEQ ID NO: 88177 - DNA, 25 bp, Rattus norvegicus
acctgtggttaactgcttggcttct

SEQ ID NO: 88178 - DNA, 25 bp, Rattus norvegicus
acctgtggttaagtgcttggcttct

SEQ ID NO: 88179 - DNA, 25 bp, Rattus norvegicus
acctgtggttttatcctgagtaaag

SEQ ID NO: 88180 - DNA, 25 bp, Rattus norvegicus
acctgtggttttttcctgagtaaag

SEQ ID NO: 88181 - DNA, 25 bp, Rattus norvegicus
acctgtgtacccctctatatatatg

SEQ ID NO: 88182 - DNA, 25 bp, Rattus norvegicus
acctgtgtacccgtctatatatatg

SEQ ID NO: 88183 - DNA, 25 bp, Rattus norvegicus
acctgtgtcattctgatgctccgaa

SEQ ID NO: 88184 - DNA, 25 bp, Rattus norvegicus
acctgtgtcattgtgatgctccgaa

SEQ ID NO: 88185 - DNA, 25 bp, Rattus norvegicus
acctgtgtcctcagctataatttaa

SEQ ID NO: 88186 - DNA, 25 bp, Rattus norvegicus
acctgtgtcctctgctataatttaa

SEQ ID NO: 88187 - DNA, 25 bp, Rattus norvegicus
acctgtgtcctgagtaaggagcact

SEQ ID NO: 88188 - DNA, 25 bp, Rattus norvegicus
acctgtgtcctgtgtaaggagcact

SEQ ID NO: 88189 - DNA, 25 bp, Rattus norvegicus
acctgtgtgaccacactgtagcctt

SEQ ID NO: 88190 - DNA, 25 bp, Rattus norvegicus
acctgtgtgacctcactgtagcctt

SEQ ID NO: 88191 - DNA, 25 bp, Rattus norvegicus
acctgtgtgccaatgtgagttactt

SEQ ID NO: 88192 - DNA, 25 bp, Rattus norvegicus
acctgtgtgccattgtgagttactt

SEQ ID NO: 88193 - DNA, 25 bp, Rattus norvegicus
acctgtgtgggtccatttgagcaaa

SEQ ID NO: 88194 - DNA, 25 bp, Rattus norvegicus
acctgtgtgggtgcatttgagcaaa

SEQ ID NO: 88195 - DNA, 25 bp, Rattus norvegicus
acctgtgtggtacaggaacaaactg

SEQ ID NO: 88196 - DNA, 25 bp, Rattus norvegicus
acctgtgtggtagaggaacaaactg

SEQ ID NO: 88197 - DNA, 25 bp, Rattus norvegicus
acctgtgtgtgcctgctactccagg

SEQ ID NO: 88198 - DNA, 25 bp, Rattus norvegicus
acctgtgtgtgcgtgctactccagg

SEQ ID NO: 88199 - DNA, 25 bp, Rattus norvegicus
acctgtgtgttcaaggactgggaca

SEQ ID NO: 88200 - DNA, 25 bp, Rattus norvegicus
acctgtgtgttctaggactgggaca

SEQ ID NO: 88201 - DNA, 25 bp, Rattus norvegicus
acctgtgttcagactctagagtgca

SEQ ID NO: 88202 - DNA, 25 bp, Rattus norvegicus
acctgtgttcagtctctagagtgca

SEQ ID NO: 88203 - DNA, 25 bp, Rattus norvegicus
acctgtgttctgagagcatgggccc

SEQ ID NO: 88204 - DNA, 25 bp, Rattus norvegicus
acctgtgttctgtgagcatgggccc

SEQ ID NO: 88205 - DNA, 25 bp, Rattus norvegicus
acctgtgttgagacgcgtgcttcca

SEQ ID NO: 88206 - DNA, 25 bp, Rattus norvegicus
acctgtgttgagtcgcgtgcttcca

SEQ ID NO: 88207 - DNA, 25 bp, Rattus norvegicus
acctgtgttggtaaggatctgctgt

SEQ ID NO: 88208 - DNA, 25 bp, Rattus norvegicus
acctgtgttggttaggatctgctgt

SEQ ID NO: 88209 - DNA, 25 bp, Rattus norvegicus
acctgtgtttagatcatgtagcata

SEQ ID NO: 88210 - DNA, 25 bp, Rattus norvegicus
acctgtgtttagttcatgtagcata

SEQ ID NO: 88211 - DNA, 25 bp, Rattus norvegicus
acctgtgtttctctctttaacccag

SEQ ID NO: 88212 - DNA, 25 bp, Rattus norvegicus
acctgtgtttctgtctttaacccag

SEQ ID NO: 88213 - DNA, 25 bp, Rattus norvegicus
acctgtgtttggaggagctttctca

SEQ ID NO: 88214 - DNA, 25 bp, Rattus norvegicus
acctgtgtttggtggagctttctca

SEQ ID NO: 88215 - DNA, 25 bp, Rattus norvegicus
acctgtgtttgtcatgatatttcca

SEQ ID NO: 88216 - DNA, 25 bp, Rattus norvegicus
acctgtgtttgtgatgatatttcca

SEQ ID NO: 88217 - DNA, 25 bp, Rattus norvegicus
acctgttagaggaccttcatgtttc

SEQ ID NO: 88218 - DNA, 25 bp, Rattus norvegicus
acctgttagaggtccttcatgtttc

SEQ ID NO: 88219 - DNA, 25 bp, Rattus norvegicus
acctgttagtcccagtagttctgtt

SEQ ID NO: 88220 - DNA, 25 bp, Rattus norvegicus
acctgttagtccgagtagttctgtt

SEQ ID NO: 88221 - DNA, 25 bp, Rattus norvegicus
acctgttagtctcctagtgggaacg

SEQ ID NO: 88222 - DNA, 25 bp, Rattus norvegicus
acctgttagtctgctagtgggaacg

SEQ ID NO: 88223 - DNA, 25 bp, Rattus norvegicus
acctgttatgtgatggttttggcag

SEQ ID NO: 88224 - DNA, 25 bp, Rattus norvegicus
acctgttatgtgttggttttggcag

SEQ ID NO: 88225 - DNA, 25 bp, Rattus norvegicus
acctgttcactacaccttaggagct

SEQ ID NO: 88226 - DNA, 25 bp, Rattus norvegicus
acctgttcactagaccttaggagct

SEQ ID NO: 88227 - DNA, 25 bp, Rattus norvegicus
acctgttcagaacactcatcctggg

SEQ ID NO: 88228 - DNA, 25 bp, Rattus norvegicus
acctgttcagaagactcatcctggg

SEQ ID NO: 88229 - DNA, 25 bp, Rattus norvegicus
acctgttcagccacaatgaggccag

SEQ ID NO: 88230 - DNA, 25 bp, Rattus norvegicus
acctgttcagcctcaatgaggccag

SEQ ID NO: 88231 - DNA, 25 bp, Rattus norvegicus
acctgttccagtagtgtgggctcca

SEQ ID NO: 88232 - DNA, 25 bp, Rattus norvegicus
acctgttccagttgtgtgggctcca

SEQ ID NO: 88233 - DNA, 25 bp, Rattus norvegicus
acctgttcccacatattgttgctgt

SEQ ID NO: 88234 - DNA, 25 bp, Rattus norvegicus
acctgttcccacttattgttgctgt

SEQ ID NO: 88235 - DNA, 25 bp, Rattus norvegicus
acctgttctagcagtgatcttacca

SEQ ID NO: 88236 - DNA, 25 bp, Rattus norvegicus
acctgttctagctgtgatcttacca

SEQ ID NO: 88237 - DNA, 25 bp, Rattus norvegicus
acctgttgaaacctcgaagccactt

SEQ ID NO: 88238 - DNA, 25 bp, Rattus norvegicus
acctgttgaaacgtcgaagccactt

SEQ ID NO: 88239 - DNA, 25 bp, Rattus norvegicus
acctgttgaagtagatctctgcgct

SEQ ID NO: 88240 - DNA, 25 bp, Rattus norvegicus
acctgttgaagttgatctctgcgct

SEQ ID NO: 88241 - DNA, 25 bp, Rattus norvegicus
acctgttgagccaagaagtggtcat

SEQ ID NO: 88242 - DNA, 25 bp, Rattus norvegicus
acctgttgagcctagaagtggtcat

SEQ ID NO: 88243 - DNA, 25 bp, Rattus norvegicus
acctgttgagctactgactgtataa

SEQ ID NO: 88244 - DNA, 25 bp, Rattus norvegicus
acctgttgagcttctgactgtataa

SEQ ID NO: 88245 - DNA, 25 bp, Rattus norvegicus
acctgttgatacagcggtgggcatc

SEQ ID NO: 88246 - DNA, 25 bp, Rattus norvegicus
acctgttgatactgcggtgggcatc

SEQ ID NO: 88247 - DNA, 25 bp, Rattus norvegicus
acctgttgcaggagagaagcattca

SEQ ID NO: 88248 - DNA, 25 bp, Rattus norvegicus
acctgttgcaggtgagaagcattca

SEQ ID NO: 88249 - DNA, 25 bp, Rattus norvegicus
acctgttgctcacccttgaggtaca

SEQ ID NO: 88250 - DNA, 25 bp, Rattus norvegicus
acctgttgctcagccttgaggtaca

SEQ ID NO: 88251 - DNA, 25 bp, Rattus norvegicus
acctgttgcttcaggatcctaggag

SEQ ID NO: 88252 - DNA, 25 bp, Rattus norvegicus
acctgttgcttctggatcctaggag

SEQ ID NO: 88253 - DNA, 25 bp, Rattus norvegicus
acctgttgcttgatttgtacctggg

SEQ ID NO: 88254 - DNA, 25 bp, Rattus norvegicus
acctgttgcttgttttgtacctggg

SEQ ID NO: 88255 - DNA, 25 bp, Rattus norvegicus
acctgttggcctacctggcagatga

SEQ ID NO: 88256 - DNA, 25 bp, Rattus norvegicus
acctgttggccttcctggcagatga

SEQ ID NO: 88257 - DNA, 25 bp, Rattus norvegicus
acctgttgggctcctggtcaagaaa

SEQ ID NO: 88258 - DNA, 25 bp, Rattus norvegicus
acctgttgggctgctggtcaagaaa

SEQ ID NO: 88259 - DNA, 25 bp, Rattus norvegicus
acctgttgttccatgtgactatcat

SEQ ID NO: 88260 - DNA, 25 bp, Rattus norvegicus
acctgttgttccttgtgactatcat

SEQ ID NO: 88261 - DNA, 25 bp, Rattus norvegicus
acctgtttctagagtgagtcccaat

SEQ ID NO: 88262 - DNA, 25 bp, Rattus norvegicus
acctgtttctagtgtgagtcccaat

SEQ ID NO: 88263 - DNA, 25 bp, Rattus norvegicus
acctgtttctctctcactggaggag

SEQ ID NO: 88264 - DNA, 25 bp, Rattus norvegicus
acctgtttctctgtcactggaggag

SEQ ID NO: 88265 - DNA, 25 bp, Rattus norvegicus
acctgtttctgaagctcacaacgaa

SEQ ID NO: 88266 - DNA, 25 bp, Rattus norvegicus
acctgtttctgatgctcacaacgaa

SEQ ID NO: 88267 - DNA, 25 bp, Rattus norvegicus
acctgtttgaggagctttagatact

SEQ ID NO: 88268 - DNA, 25 bp, Rattus norvegicus
acctgtttgaggtgctttagatact

SEQ ID NO: 88269 - DNA, 25 bp, Rattus norvegicus
acctgtttgggtagcacactggctg

SEQ ID NO: 88270 - DNA, 25 bp, Rattus norvegicus
acctgtttgggttgcacactggctg

SEQ ID NO: 88271 - DNA, 25 bp, Rattus norvegicus
acctgtttgtgtcttctcctcttca

SEQ ID NO: 88272 - DNA, 25 bp, Rattus norvegicus
acctgtttgtgtgttctcctcttca

SEQ ID NO: 88273 - DNA, 25 bp, Rattus norvegicus
acctgttttcatacggtctacgaga

SEQ ID NO: 88274 - DNA, 25 bp, Rattus norvegicus
acctgttttcattcggtctacgaga

SEQ ID NO: 88275 - DNA, 25 bp, Rattus norvegicus
acctgttttcttctcacctgaataa

SEQ ID NO: 88276 - DNA, 25 bp, Rattus norvegicus
acctgttttcttgtcacctgaataa

SEQ ID NO: 88277 - DNA, 25 bp, Rattus norvegicus
acctgttttgatacttgccttctct

SEQ ID NO: 88278 - DNA, 25 bp, Rattus norvegicus
acctgttttgattcttgccttctct

SEQ ID NO: 88279 - DNA, 25 bp, Rattus norvegicus
accttaaaacgcctgctgacatcac

SEQ ID NO: 88280 - DNA, 25 bp, Rattus norvegicus
accttaaaacgcgtgctgacatcac

SEQ ID NO: 88281 - DNA, 25 bp, Rattus norvegicus
accttaaaagtcatctgtggcccag

SEQ ID NO: 88282 - DNA, 25 bp, Rattus norvegicus
accttaaaagtcttctgtggcccag

SEQ ID NO: 88283 - DNA, 25 bp, Rattus norvegicus
accttaaaggtgaactctgccattt

SEQ ID NO: 88284 - DNA, 25 bp, Rattus norvegicus
accttaaaggtgtactctgccattt

SEQ ID NO: 88285 - DNA, 25 bp, Rattus norvegicus
accttaactctgacctggttctgac

SEQ ID NO: 88286 - DNA, 25 bp, Rattus norvegicus
accttaactctgtcctggttctgac

SEQ ID NO: 88287 - DNA, 25 bp, Rattus norvegicus
accttaagcagtatgtttggattgt

SEQ ID NO: 88288 - DNA, 25 bp, Rattus norvegicus
accttaagcagtttgtttggattgt

SEQ ID NO: 88289 - DNA, 25 bp, Rattus norvegicus
accttaatggccacagctcaagctg

SEQ ID NO: 88290 - DNA, 25 bp, Rattus norvegicus
accttaatggcctcagctcaagctg

SEQ ID NO: 88291 - DNA, 25 bp, Rattus norvegicus
accttacctgtaagctactgtgtta

SEQ ID NO: 88292 - DNA, 25 bp, Rattus norvegicus
accttacctgtatgctactgtgtta

SEQ ID NO: 88293 - DNA, 25 bp, Rattus norvegicus
accttactccagcttgtgcgtgagc

SEQ ID NO: 88294 - DNA, 25 bp, Rattus norvegicus
accttactccaggttgtgcgtgagc

SEQ ID NO: 88295 - DNA, 25 bp, Rattus norvegicus
accttagacaagatccacgtgacag

SEQ ID NO: 88296 - DNA, 25 bp, Rattus norvegicus
accttagacaagttccacgtgacag

SEQ ID NO: 88297 - DNA, 25 bp, Rattus norvegicus
accttagactccatcaagtgcgagc

SEQ ID NO: 88298 - DNA, 25 bp, Rattus norvegicus
accttagactccttcaagtgcgagc

SEQ ID NO: 88299 - DNA, 25 bp, Rattus norvegicus
accttagcctgtatcactctgtgga

SEQ ID NO: 88300 - DNA, 25 bp, Rattus norvegicus
accttagcctgtttcactctgtgga

SEQ ID NO: 88301 - DNA, 25 bp, Rattus norvegicus
accttagcggccatggttactgtgt

SEQ ID NO: 88302 - DNA, 25 bp, Rattus norvegicus
accttagcggccttggttactgtgt

SEQ ID NO: 88303 - DNA, 25 bp, Rattus norvegicus
accttagctctaagggaattcttca

SEQ ID NO: 88304 - DNA, 25 bp, Rattus norvegicus
accttagctctatgggaattcttca

SEQ ID NO: 88305 - DNA, 25 bp, Rattus norvegicus
accttaggaagaacgttaatgccag

SEQ ID NO: 88306 - DNA, 25 bp, Rattus norvegicus
accttaggaagatcgttaatgccag

SEQ ID NO: 88307 - DNA, 25 bp, Rattus norvegicus
accttagtccttcggtgtgcgctta

SEQ ID NO: 88308 - DNA, 25 bp, Rattus norvegicus
accttagtccttgggtgtgcgctta

SEQ ID NO: 88309 - DNA, 25 bp, Rattus norvegicus
accttagtcttactgtttggcctca

SEQ ID NO: 88310 - DNA, 25 bp, Rattus norvegicus
accttagtcttagtgtttggcctca

SEQ ID NO: 88311 - DNA, 25 bp, Rattus norvegicus
accttagtgctccagatggtccaag

SEQ ID NO: 88312 - DNA, 25 bp, Rattus norvegicus
accttagtgctcgagatggtccaag

SEQ ID NO: 88313 - DNA, 25 bp, Rattus norvegicus
accttagtgttgaagcttcgcccaa

SEQ ID NO: 88314 - DNA, 25 bp, Rattus norvegicus
accttagtgttgtagcttcgcccaa

SEQ ID NO: 88315 - DNA, 25 bp, Rattus norvegicus
accttagttagactcacacccagct

SEQ ID NO: 88316 - DNA, 25 bp, Rattus norvegicus
accttagttagagtcacacccagct

SEQ ID NO: 88317 - DNA, 25 bp, Rattus norvegicus
accttagtttgaaccttagtacaca

SEQ ID NO: 88318 - DNA, 25 bp, Rattus norvegicus
accttagtttgatccttagtacaca

SEQ ID NO: 88319 - DNA, 25 bp, Rattus norvegicus
accttataccggaccatgaacatgg

SEQ ID NO: 88320 - DNA, 25 bp, Rattus norvegicus
accttataccggtccatgaacatgg

SEQ ID NO: 88321 - DNA, 25 bp, Rattus norvegicus
accttatagatgaacaaagtgtgac

SEQ ID NO: 88322 - DNA, 25 bp, Rattus norvegicus
accttatagatgtacaaagtgtgac

SEQ ID NO: 88323 - DNA, 25 bp, Rattus norvegicus
accttataggttctgactgctgcac

SEQ ID NO: 88324 - DNA, 25 bp, Rattus norvegicus
accttataggttgtgactgctgcac

SEQ ID NO: 88325 - DNA, 25 bp, Rattus norvegicus
accttatcccttacaatacttcatg

SEQ ID NO: 88326 - DNA, 25 bp, Rattus norvegicus
accttatccctttcaatacttcatg

SEQ ID NO: 88327 - DNA, 25 bp, Rattus norvegicus
accttatccttgaccacatggagac

SEQ ID NO: 88328 - DNA, 25 bp, Rattus norvegicus
accttatccttgtccacatggagac

SEQ ID NO: 88329 - DNA, 25 bp, Rattus norvegicus
accttatgggttagagattgcgaat

SEQ ID NO: 88330 - DNA, 25 bp, Rattus norvegicus
accttatgggtttgagattgcgaat

SEQ ID NO: 88331 - DNA, 25 bp, Rattus norvegicus
accttatgtatcatggtcacttccc

SEQ ID NO: 88332 - DNA, 25 bp, Rattus norvegicus
accttatgtatcttggtcacttccc

SEQ ID NO: 88333 - DNA, 25 bp, Rattus norvegicus
accttatgttagagtgctccttaga

SEQ ID NO: 88334 - DNA, 25 bp, Rattus norvegicus
accttatgttagtgtgctccttaga

SEQ ID NO: 88335 - DNA, 25 bp, Rattus norvegicus
accttattccacagcttagagacca

SEQ ID NO: 88336 - DNA, 25 bp, Rattus norvegicus
accttattccactgcttagagacca

SEQ ID NO: 88337 - DNA, 25 bp, Rattus norvegicus
accttcaactcaccggatgtacagt

SEQ ID NO: 88338 - DNA, 25 bp, Rattus norvegicus
accttcaactcagcggatgtacagt

SEQ ID NO: 88339 - DNA, 25 bp, Rattus norvegicus
accttcaacttcctggtgaggacag

SEQ ID NO: 88340 - DNA, 25 bp, Rattus norvegicus
accttcaacttcgtggtgaggacag

SEQ ID NO: 88341 - DNA, 25 bp, Rattus norvegicus
accttcaagctgaggaatccccagc

SEQ ID NO: 88342 - DNA, 25 bp, Rattus norvegicus
accttcaagctgtggaatccccagc

SEQ ID NO: 88343 - DNA, 25 bp, Rattus norvegicus
accttcaatgaacaaacgtcactga

SEQ ID NO: 88344 - DNA, 25 bp, Rattus norvegicus
accttcaatgaagaaacgtcactga

SEQ ID NO: 88345 - DNA, 25 bp, Rattus norvegicus
accttcacagttcgcatcggtaaac

SEQ ID NO: 88346 - DNA, 25 bp, Rattus norvegicus
accttcacagttggcatcggtaaac

SEQ ID NO: 88347 - DNA, 25 bp, Rattus norvegicus
accttcaccagtcggccctgagaaa

SEQ ID NO: 88348 - DNA, 25 bp, Rattus norvegicus
accttcaccagtgggccctgagaaa

SEQ ID NO: 88349 - DNA, 25 bp, Rattus norvegicus
accttcactctaagtacccaatgga

SEQ ID NO: 88350 - DNA, 25 bp, Rattus norvegicus
accttcactctatgtacccaatgga

SEQ ID NO: 88351 - DNA, 25 bp, Rattus norvegicus
accttcagaaaacatgggctccgag

SEQ ID NO: 88352 - DNA, 25 bp, Rattus norvegicus
accttcagaaaagatgggctccgag

SEQ ID NO: 88353 - DNA, 25 bp, Rattus norvegicus
accttcagagccagaaaggtggctt

SEQ ID NO: 88354 - DNA, 25 bp, Rattus norvegicus
accttcagagcctgaaaggtggctt

SEQ ID NO: 88355 - DNA, 25 bp, Rattus norvegicus
accttcagagtcaagtttgtacgta

SEQ ID NO: 88356 - DNA, 25 bp, Rattus norvegicus
accttcagagtctagtttgtacgta

SEQ ID NO: 88357 - DNA, 25 bp, Rattus norvegicus
accttcagcacgctggtcagacagg

SEQ ID NO: 88358 - DNA, 25 bp, Rattus norvegicus
accttcagcacggtggtcagacagg

SEQ ID NO: 88359 - DNA, 25 bp, Rattus norvegicus
accttcatcacaagcgcaacctatt

SEQ ID NO: 88360 - DNA, 25 bp, Rattus norvegicus
accttcatcacatgcgcaacctatt

SEQ ID NO: 88361 - DNA, 25 bp, Rattus norvegicus
accttcatcaggcttattgtgtttg

SEQ ID NO: 88362 - DNA, 25 bp, Rattus norvegicus
accttcatcagggttattgtgtttg

SEQ ID NO: 88363 - DNA, 25 bp, Rattus norvegicus
accttcatccgcaagttctatacag

SEQ ID NO: 88364 - DNA, 25 bp, Rattus norvegicus
accttcatccgctagttctatacag

SEQ ID NO: 88365 - DNA, 25 bp, Rattus norvegicus
accttcatcgttaatcgtttggcca

SEQ ID NO: 88366 - DNA, 25 bp, Rattus norvegicus
accttcatcgtttatcgtttggcca

SEQ ID NO: 88367 - DNA, 25 bp, Rattus norvegicus
accttcatggttctcatctttcttg

SEQ ID NO: 88368 - DNA, 25 bp, Rattus norvegicus
accttcatggttgtcatctttcttg

SEQ ID NO: 88369 - DNA, 25 bp, Rattus norvegicus
accttcattgttcaagctcgcctgg

SEQ ID NO: 88370 - DNA, 25 bp, Rattus norvegicus
accttcattgttgaagctcgcctgg

SEQ ID NO: 88371 - DNA, 25 bp, Rattus norvegicus
accttccaagtgatctccaagtggg

SEQ ID NO: 88372 - DNA, 25 bp, Rattus norvegicus
accttccaagtgttctccaagtggg

SEQ ID NO: 88373 - DNA, 25 bp, Rattus norvegicus
accttccactataaccactatggga

SEQ ID NO: 88374 - DNA, 25 bp, Rattus norvegicus
accttccactattaccactatggga

SEQ ID NO: 88375 - DNA, 25 bp, Rattus norvegicus
accttccactctagaacaaagcagc

SEQ ID NO: 88376 - DNA, 25 bp, Rattus norvegicus
accttccactcttgaacaaagcagc

SEQ ID NO: 88377 - DNA, 25 bp, Rattus norvegicus
accttccactttagtgccagtgagc

SEQ ID NO: 88378 - DNA, 25 bp, Rattus norvegicus
accttccacttttgtgccagtgagc

SEQ ID NO: 88379 - DNA, 25 bp, Rattus norvegicus
accttccatcttcatgtgggttcta

SEQ ID NO: 88380 - DNA, 25 bp, Rattus norvegicus
accttccatcttgatgtgggttcta

SEQ ID NO: 88381 - DNA, 25 bp, Rattus norvegicus
accttccattataggtctgtctcag

SEQ ID NO: 88382 - DNA, 25 bp, Rattus norvegicus
accttccattattggtctgtctcag

SEQ ID NO: 88383 - DNA, 25 bp, Rattus norvegicus
accttccatttgactgcatcatgtg

SEQ ID NO: 88384 - DNA, 25 bp, Rattus norvegicus
accttccatttgtctgcatcatgtg

SEQ ID NO: 88385 - DNA, 25 bp, Rattus norvegicus
accttccccatgcacagtcataaga

SEQ ID NO: 88386 - DNA, 25 bp, Rattus norvegicus
accttccccatggacagtcataaga

SEQ ID NO: 88387 - DNA, 25 bp, Rattus norvegicus
accttcccgggccaaccacagatgg

SEQ ID NO: 88388 - DNA, 25 bp, Rattus norvegicus
accttcccgggcgaaccacagatgg

SEQ ID NO: 88389 - DNA, 25 bp, Rattus norvegicus
accttcccgggtctatataatgtgt

SEQ ID NO: 88390 - DNA, 25 bp, Rattus norvegicus
accttcccgggtgtatataatgtgt

SEQ ID NO: 88391 - DNA, 25 bp, Rattus norvegicus
accttccctccaaagatagactgtg

SEQ ID NO: 88392 - DNA, 25 bp, Rattus norvegicus
accttccctccatagatagactgtg

SEQ ID NO: 88393 - DNA, 25 bp, Rattus norvegicus
accttccgggctatactagatgacg

SEQ ID NO: 88394 - DNA, 25 bp, Rattus norvegicus
accttccgggctttactagatgacg

SEQ ID NO: 88395 - DNA, 25 bp, Rattus norvegicus
accttcctaatgatgagtttgcttt

SEQ ID NO: 88396 - DNA, 25 bp, Rattus norvegicus
accttcctaatgttgagtttgcttt

SEQ ID NO: 88397 - DNA, 25 bp, Rattus norvegicus
accttcctagccagtggtggtgggt

SEQ ID NO: 88398 - DNA, 25 bp, Rattus norvegicus
accttcctagcctgtggtggtgggt

SEQ ID NO: 88399 - DNA, 25 bp, Rattus norvegicus
accttcctcaacaccaagcgtgaga

SEQ ID NO: 88400 - DNA, 25 bp, Rattus norvegicus
accttcctcaactccaagcgtgaga

SEQ ID NO: 88401 - DNA, 25 bp, Rattus norvegicus
accttcctcatcacaaaatgtgtag

SEQ ID NO: 88402 - DNA, 25 bp, Rattus norvegicus
accttcctcatctcaaaatgtgtag

SEQ ID NO: 88403 - DNA, 25 bp, Rattus norvegicus
accttcctcgcgatctggattagaa

SEQ ID NO: 88404 - DNA, 25 bp, Rattus norvegicus
accttcctcgcgttctggattagaa

SEQ ID NO: 88405 - DNA, 25 bp, Rattus norvegicus
accttcctcggcaagtgcttggaaa

SEQ ID NO: 88406 - DNA, 25 bp, Rattus norvegicus
accttcctcggctagtgcttggaaa

SEQ ID NO: 88407 - DNA, 25 bp, Rattus norvegicus
accttcctgaagaagtccctgcagg

SEQ ID NO: 88408 - DNA, 25 bp, Rattus norvegicus
accttcctgaagaatggcaccttgg

SEQ ID NO: 88409 - DNA, 25 bp, Rattus norvegicus
accttcctgaagtagtccctgcagg

SEQ ID NO: 88410 - DNA, 25 bp, Rattus norvegicus
accttcctgaagtatggcaccttgg

SEQ ID NO: 88411 - DNA, 25 bp, Rattus norvegicus
accttcctgactagccttatttatt

SEQ ID NO: 88412 - DNA, 25 bp, Rattus norvegicus
accttcctgacttgccttatttatt

SEQ ID NO: 88413 - DNA, 25 bp, Rattus norvegicus
accttcctgagacgcatgtcgacat

SEQ ID NO: 88414 - DNA, 25 bp, Rattus norvegicus
accttcctgagaggcatgtcgacat

SEQ ID NO: 88415 - DNA, 25 bp, Rattus norvegicus
accttcctgaggagctattgacaaa

SEQ ID NO: 88416 - DNA, 25 bp, Rattus norvegicus
accttcctgaggtgctattgacaaa

SEQ ID NO: 88417 - DNA, 25 bp, Rattus norvegicus
accttcctgggtagaggagcttctt

SEQ ID NO: 88418 - DNA, 25 bp, Rattus norvegicus
accttcctgggttgaggagcttctt

SEQ ID NO: 88419 - DNA, 25 bp, Rattus norvegicus
accttcctggtgcacaggcagagac

SEQ ID NO: 88420 - DNA, 25 bp, Rattus norvegicus
accttcctggtggacaggcagagac

SEQ ID NO: 88421 - DNA, 25 bp, Rattus norvegicus
accttcctgtacatccagtatcagg

SEQ ID NO: 88422 - DNA, 25 bp, Rattus norvegicus
accttcctgtacttccagtatcagg

SEQ ID NO: 88423 - DNA, 25 bp, Rattus norvegicus
accttccttctgctgaggagctgga

SEQ ID NO: 88424 - DNA, 25 bp, Rattus norvegicus
accttccttctggtgaggagctgga

SEQ ID NO: 88425 - DNA, 25 bp, Rattus norvegicus
accttcctttgaccatggtcatgcg

SEQ ID NO: 88426 - DNA, 25 bp, Rattus norvegicus
accttcctttgagcatggtcatgcg

SEQ ID NO: 88427 - DNA, 25 bp, Rattus norvegicus
accttcgactctccagtgatgcaca

SEQ ID NO: 88428 - DNA, 25 bp, Rattus norvegicus
accttcgactctgcagtgatgcaca

SEQ ID NO: 88429 - DNA, 25 bp, Rattus norvegicus
accttcgagtagagaagcaggcccc

SEQ ID NO: 88430 - DNA, 25 bp, Rattus norvegicus
accttcgagtagtgaagcaggcccc

SEQ ID NO: 88431 - DNA, 25 bp, Rattus norvegicus
accttcgcactgaacatggagctgt

SEQ ID NO: 88432 - DNA, 25 bp, Rattus norvegicus
accttcgcactgtacatggagctgt

SEQ ID NO: 88433 - DNA, 25 bp, Rattus norvegicus
accttcggtggtatttgacatatgc

SEQ ID NO: 88434 - DNA, 25 bp, Rattus norvegicus
accttcggtggtttttgacatatgc

SEQ ID NO: 88435 - DNA, 25 bp, Rattus norvegicus
accttcgttggtctctgtgtctgag

SEQ ID NO: 88436 - DNA, 25 bp, Rattus norvegicus
accttcgttggtgtctgtgtctgag

SEQ ID NO: 88437 - DNA, 25 bp, Rattus norvegicus
accttctaattgaacctgtgatgag

SEQ ID NO: 88438 - DNA, 25 bp, Rattus norvegicus
accttctaattgtacctgtgatgag

SEQ ID NO: 88439 - DNA, 25 bp, Rattus norvegicus
accttctacctgcaacgaccatatt

SEQ ID NO: 88440 - DNA, 25 bp, Rattus norvegicus
accttctacctggaacgaccatatt

SEQ ID NO: 88441 - DNA, 25 bp, Rattus norvegicus
accttctcactcaagatggtagaga

SEQ ID NO: 88442 - DNA, 25 bp, Rattus norvegicus
accttctcactctagatggtagaga

SEQ ID NO: 88443 - DNA, 25 bp, Rattus norvegicus
accttctcaggcaagagcctaggca

SEQ ID NO: 88444 - DNA, 25 bp, Rattus norvegicus
accttctcaggctagagcctaggca

SEQ ID NO: 88445 - DNA, 25 bp, Rattus norvegicus
accttctcagtcctagatgcatatg

SEQ ID NO: 88446 - DNA, 25 bp, Rattus norvegicus
accttctcagtcgtagatgcatatg

SEQ ID NO: 88447 - DNA, 25 bp, Rattus norvegicus
accttctccagaagtgctagaccaa

SEQ ID NO: 88448 - DNA, 25 bp, Rattus norvegicus
accttctccagatgtgctagaccaa

SEQ ID NO: 88449 - DNA, 25 bp, Rattus norvegicus
accttctccagcacagtaaacgttt

SEQ ID NO: 88450 - DNA, 25 bp, Rattus norvegicus
accttctccagctcagtaaacgttt

SEQ ID NO: 88451 - DNA, 25 bp, Rattus norvegicus
accttctcctaacatgtcacagatt

SEQ ID NO: 88452 - DNA, 25 bp, Rattus norvegicus
accttctcctaagatgtcacagatt

SEQ ID NO: 88453 - DNA, 25 bp, Rattus norvegicus
accttctccttactacagtcgtgga

SEQ ID NO: 88454 - DNA, 25 bp, Rattus norvegicus
accttctccttagtacagtcgtgga

SEQ ID NO: 88455 - DNA, 25 bp, Rattus norvegicus
accttctcgacgctacacagttggg

SEQ ID NO: 88456 - DNA, 25 bp, Rattus norvegicus
accttctcgacggtacacagttggg

SEQ ID NO: 88457 - DNA, 25 bp, Rattus norvegicus
accttctctgtgctgactgatgtgg

SEQ ID NO: 88458 - DNA, 25 bp, Rattus norvegicus
accttctctgtggtgactgatgtgg

SEQ ID NO: 88459 - DNA, 25 bp, Rattus norvegicus
accttctgaaccactgctgaattag

SEQ ID NO: 88460 - DNA, 25 bp, Rattus norvegicus
accttctgaacctctgctgaattag

SEQ ID NO: 88461 - DNA, 25 bp, Rattus norvegicus
accttctgacttaacacgtgctgca

SEQ ID NO: 88462 - DNA, 25 bp, Rattus norvegicus
accttctgactttacacgtgctgca

SEQ ID NO: 88463 - DNA, 25 bp, Rattus norvegicus
accttctgcaacaaccatggactta

SEQ ID NO: 88464 - DNA, 25 bp, Rattus norvegicus
accttctgcaactaccatggactta

SEQ ID NO: 88465 - DNA, 25 bp, Rattus norvegicus
accttctgctttctgcttttaggca

SEQ ID NO: 88466 - DNA, 25 bp, Rattus norvegicus
accttctgctttgtgcttttaggca

SEQ ID NO: 88467 - DNA, 25 bp, Rattus norvegicus
accttctggagacggtcttggctct

SEQ ID NO: 88468 - DNA, 25 bp, Rattus norvegicus
accttctggagagggtcttggctct

SEQ ID NO: 88469 - DNA, 25 bp, Rattus norvegicus
accttctggaggagagtggcccttg

SEQ ID NO: 88470 - DNA, 25 bp, Rattus norvegicus
accttctggaggtgagtggcccttg

SEQ ID NO: 88471 - DNA, 25 bp, Rattus norvegicus
accttctgggctatcataaaccaag

SEQ ID NO: 88472 - DNA, 25 bp, Rattus norvegicus
accttctgggctttcataaaccaag

SEQ ID NO: 88473 - DNA, 25 bp, Rattus norvegicus
accttctgtattagtgctactcttg

SEQ ID NO: 88474 - DNA, 25 bp, Rattus norvegicus
accttctgtatttgtgctactcttg

SEQ ID NO: 88475 - DNA, 25 bp, Rattus norvegicus
accttctgtctactcattgttgcat

SEQ ID NO: 88476 - DNA, 25 bp, Rattus norvegicus
accttctgtctagtcattgttgcat

SEQ ID NO: 88477 - DNA, 25 bp, Rattus norvegicus
accttctgttgactagacacggcta

SEQ ID NO: 88478 - DNA, 25 bp, Rattus norvegicus
accttctgttgagtagacacggcta

SEQ ID NO: 88479 - DNA, 25 bp, Rattus norvegicus
accttctgttgtcctgaactctgat

SEQ ID NO: 88480 - DNA, 25 bp, Rattus norvegicus
accttctgttgtcgctactgttggt

SEQ ID NO: 88481 - DNA, 25 bp, Rattus norvegicus
accttctgttgtgctgaactctgat

SEQ ID NO: 88482 - DNA, 25 bp, Rattus norvegicus
accttctgttgtggctactgttggt

SEQ ID NO: 88483 - DNA, 25 bp, Rattus norvegicus
accttcttatccaagatggctgcag

SEQ ID NO: 88484 - DNA, 25 bp, Rattus norvegicus
accttcttatcctagatggctgcag

SEQ ID NO: 88485 - DNA, 25 bp, Rattus norvegicus
accttcttcaaaagccccgtgagag

SEQ ID NO: 88486 - DNA, 25 bp, Rattus norvegicus
accttcttcaaatgccccgtgagag

SEQ ID NO: 88487 - DNA, 25 bp, Rattus norvegicus
accttcttcataagttggtttcaag

SEQ ID NO: 88488 - DNA, 25 bp, Rattus norvegicus
accttcttcatatgttggtttcaag

SEQ ID NO: 88489 - DNA, 25 bp, Rattus norvegicus
accttcttccctatgggtggcccag

SEQ ID NO: 88490 - DNA, 25 bp, Rattus norvegicus
accttcttccctttgggtggcccag

SEQ ID NO: 88491 - DNA, 25 bp, Rattus norvegicus
accttcttggttcctcatgccatgg

SEQ ID NO: 88492 - DNA, 25 bp, Rattus norvegicus
accttcttggttgctcatgccatgg

SEQ ID NO: 88493 - DNA, 25 bp, Rattus norvegicus
accttcttgtcacacctgagctctt

SEQ ID NO: 88494 - DNA, 25 bp, Rattus norvegicus
accttcttgtcagacctgagctctt

SEQ ID NO: 88495 - DNA, 25 bp, Rattus norvegicus
accttctttaggctgtctagcacat

SEQ ID NO: 88496 - DNA, 25 bp, Rattus norvegicus
accttctttagggtgtctagcacat

SEQ ID NO: 88497 - DNA, 25 bp, Rattus norvegicus
accttctttagtcttgattgccctt

SEQ ID NO: 88498 - DNA, 25 bp, Rattus norvegicus
accttctttagtgttgattgccctt

SEQ ID NO: 88499 - DNA, 25 bp, Rattus norvegicus
accttctttctcacttgtctttaga

SEQ ID NO: 88500 - DNA, 25 bp, Rattus norvegicus
accttctttctctcttgtctttaga

SEQ ID NO: 88501 - DNA, 25 bp, Rattus norvegicus
accttgaaaagcattggagttgtct

SEQ ID NO: 88502 - DNA, 25 bp, Rattus norvegicus
accttgaaaagctttggagttgtct

SEQ ID NO: 88503 - DNA, 25 bp, Rattus norvegicus
accttgaaagagagcttcttcccct

SEQ ID NO: 88504 - DNA, 25 bp, Rattus norvegicus
accttgaaagagtgcttcttcccct

SEQ ID NO: 88505 - DNA, 25 bp, Rattus norvegicus
accttgaacatcagacactgctcct

SEQ ID NO: 88506 - DNA, 25 bp, Rattus norvegicus
accttgaacatctgacactgctcct

SEQ ID NO: 88507 - DNA, 25 bp, Rattus norvegicus
accttgaaccagcacacagggctat

SEQ ID NO: 88508 - DNA, 25 bp, Rattus norvegicus
accttgaaccaggacacagggctat

SEQ ID NO: 88509 - DNA, 25 bp, Rattus norvegicus
accttgaaccccatggtgaatgtgg

SEQ ID NO: 88510 - DNA, 25 bp, Rattus norvegicus
accttgaaccccttggtgaatgtgg

SEQ ID NO: 88511 - DNA, 25 bp, Rattus norvegicus
accttgaacttcacattctccagct

SEQ ID NO: 88512 - DNA, 25 bp, Rattus norvegicus
accttgaacttctcattctccagct

SEQ ID NO: 88513 - DNA, 25 bp, Rattus norvegicus
accttgaagctgctattggctatgc

SEQ ID NO: 88514 - DNA, 25 bp, Rattus norvegicus
accttgaagctggtattggctatgc

SEQ ID NO: 88515 - DNA, 25 bp, Rattus norvegicus
accttgaatgtgattgcttagtgaa

SEQ ID NO: 88516 - DNA, 25 bp, Rattus norvegicus
accttgaatgtgtttgcttagtgaa

SEQ ID NO: 88517 - DNA, 25 bp, Rattus norvegicus
accttgaatttgaccaccattgctg

SEQ ID NO: 88518 - DNA, 25 bp, Rattus norvegicus
accttgaatttgtccaccattgctg

SEQ ID NO: 88519 - DNA, 25 bp, Rattus norvegicus
accttgacaacacaaccttgcttgg

SEQ ID NO: 88520 - DNA, 25 bp, Rattus norvegicus
accttgacaacagaaccttgcttgg

SEQ ID NO: 88521 - DNA, 25 bp, Rattus norvegicus
accttgacactgcaggcgttgtttc

SEQ ID NO: 88522 - DNA, 25 bp, Rattus norvegicus
accttgacactggaggcgttgtttc

SEQ ID NO: 88523 - DNA, 25 bp, Rattus norvegicus
accttgactgtgatatgcttgagca

SEQ ID NO: 88524 - DNA, 25 bp, Rattus norvegicus
accttgactgtgttatgcttgagca

SEQ ID NO: 88525 - DNA, 25 bp, Rattus norvegicus
accttgacttgtaatctgggctgaa

SEQ ID NO: 88526 - DNA, 25 bp, Rattus norvegicus
accttgacttgtaatttgcactttc

SEQ ID NO: 88527 - DNA, 25 bp, Rattus norvegicus
accttgacttgttatctgggctgaa

SEQ ID NO: 88528 - DNA, 25 bp, Rattus norvegicus
accttgacttgttatttgcactttc

SEQ ID NO: 88529 - DNA, 25 bp, Rattus norvegicus
accttgagacttccttttgtgcttt

SEQ ID NO: 88530 - DNA, 25 bp, Rattus norvegicus
accttgagacttgcttttgtgcttt

SEQ ID NO: 88531 - DNA, 25 bp, Rattus norvegicus
accttgagtgccataccgtgggaag

SEQ ID NO: 88532 - DNA, 25 bp, Rattus norvegicus
accttgagtgccttaccgtgggaag

SEQ ID NO: 88533 - DNA, 25 bp, Rattus norvegicus
accttgatcttaagcacatcctatg

SEQ ID NO: 88534 - DNA, 25 bp, Rattus norvegicus
accttgatcttatgcacatcctatg

SEQ ID NO: 88535 - DNA, 25 bp, Rattus norvegicus
accttgattttcattcagcctggga

SEQ ID NO: 88536 - DNA, 25 bp, Rattus norvegicus
accttgattttctttcagcctggga

SEQ ID NO: 88537 - DNA, 25 bp, Rattus norvegicus
accttgcaaaggacccagtggcact

SEQ ID NO: 88538 - DNA, 25 bp, Rattus norvegicus
accttgcaaaggtcccagtggcact

SEQ ID NO: 88539 - DNA, 25 bp, Rattus norvegicus
accttgcaaggcattgtggtgctca

SEQ ID NO: 88540 - DNA, 25 bp, Rattus norvegicus
accttgcaaggctttgtggtgctca

SEQ ID NO: 88541 - DNA, 25 bp, Rattus norvegicus
accttgcacgcaattggataccttg

SEQ ID NO: 88542 - DNA, 25 bp, Rattus norvegicus
accttgcacgcatttggataccttg

SEQ ID NO: 88543 - DNA, 25 bp, Rattus norvegicus
accttgcagcccctgaactaaaata

SEQ ID NO: 88544 - DNA, 25 bp, Rattus norvegicus
accttgcagcccgtgaactaaaata

SEQ ID NO: 88545 - DNA, 25 bp, Rattus norvegicus
accttgcattgtaatattcagtttt

SEQ ID NO: 88546 - DNA, 25 bp, Rattus norvegicus
accttgcattgttatattcagtttt

SEQ ID NO: 88547 - DNA, 25 bp, Rattus norvegicus
accttgcccaatcgctggtggctgg

SEQ ID NO: 88548 - DNA, 25 bp, Rattus norvegicus
accttgcccaatggctggtggctgg

SEQ ID NO: 88549 - DNA, 25 bp, Rattus norvegicus
accttgcccagcaacaaacttggga

SEQ ID NO: 88550 - DNA, 25 bp, Rattus norvegicus
accttgcccagctacaaacttggga

SEQ ID NO: 88551 - DNA, 25 bp, Rattus norvegicus
accttgccctgtcaagcacacagat

SEQ ID NO: 88552 - DNA, 25 bp, Rattus norvegicus
accttgccctgtgaagcacacagat

SEQ ID NO: 88553 - DNA, 25 bp, Rattus norvegicus
accttgctaccgacatgtgacagga

SEQ ID NO: 88554 - DNA, 25 bp, Rattus norvegicus
accttgctaccgtcatgtgacagga

SEQ ID NO: 88555 - DNA, 25 bp, Rattus norvegicus
accttgctagagatcagtcatcagt

SEQ ID NO: 88556 - DNA, 25 bp, Rattus norvegicus
accttgctagagttcagtcatcagt

SEQ ID NO: 88557 - DNA, 25 bp, Rattus norvegicus
accttgctcttgagtttcccttaga

SEQ ID NO: 88558 - DNA, 25 bp, Rattus norvegicus
accttgctcttgtgtttcccttaga

SEQ ID NO: 88559 - DNA, 25 bp, Rattus norvegicus
accttgctgcggatggttgggtaca

SEQ ID NO: 88560 - DNA, 25 bp, Rattus norvegicus
accttgctgcggttggttgggtaca

SEQ ID NO: 88561 - DNA, 25 bp, Rattus norvegicus
accttgctgggtcagatggcactgt

SEQ ID NO: 88562 - DNA, 25 bp, Rattus norvegicus
accttgctgggtgagatggcactgt

SEQ ID NO: 88563 - DNA, 25 bp, Rattus norvegicus
accttgctgtccacggcatgtcaga

SEQ ID NO: 88564 - DNA, 25 bp, Rattus norvegicus
accttgctgtcctcggcatgtcaga

SEQ ID NO: 88565 - DNA, 25 bp, Rattus norvegicus
accttgctgtgcctccctatatcag

SEQ ID NO: 88566 - DNA, 25 bp, Rattus norvegicus
accttgctgtgcgtccctatatcag

SEQ ID NO: 88567 - DNA, 25 bp, Rattus norvegicus
accttgcttctgctgtcttcttgta

SEQ ID NO: 88568 - DNA, 25 bp, Rattus norvegicus
accttgcttctggtgtcttcttgta

SEQ ID NO: 88569 - DNA, 25 bp, Rattus norvegicus
accttgcttgagagtgtgcacgcac

SEQ ID NO: 88570 - DNA, 25 bp, Rattus norvegicus
accttgcttgagtgtgtgcacgcac

SEQ ID NO: 88571 - DNA, 25 bp, Rattus norvegicus
accttgcttgtgatggcatgatgga

SEQ ID NO: 88572 - DNA, 25 bp, Rattus norvegicus
accttgcttgtgttggcatgatgga

SEQ ID NO: 88573 - DNA, 25 bp, Rattus norvegicus
accttgcttgttactggcccatgat

SEQ ID NO: 88574 - DNA, 25 bp, Rattus norvegicus
accttgcttgtttctggcccatgat

SEQ ID NO: 88575 - DNA, 25 bp, Rattus norvegicus
accttggacactcattgaattgcat

SEQ ID NO: 88576 - DNA, 25 bp, Rattus norvegicus
accttggacactgattgaattgcat

SEQ ID NO: 88577 - DNA, 25 bp, Rattus norvegicus
accttggaccgcccaggttgaatgg

SEQ ID NO: 88578 - DNA, 25 bp, Rattus norvegicus
accttggaccgcgcaggttgaatgg

SEQ ID NO: 88579 - DNA, 25 bp, Rattus norvegicus
accttggagaccagctgcggatatg

SEQ ID NO: 88580 - DNA, 25 bp, Rattus norvegicus
accttggagacctgctgcggatatg

SEQ ID NO: 88581 - DNA, 25 bp, Rattus norvegicus
accttggatgagactgttgcctggc

SEQ ID NO: 88582 - DNA, 25 bp, Rattus norvegicus
accttggatgagtctgttgcctggc

SEQ ID NO: 88583 - DNA, 25 bp, Rattus norvegicus
accttggatgctcacttctaagcaa

SEQ ID NO: 88584 - DNA, 25 bp, Rattus norvegicus
accttggatgctgacttctaagcaa

SEQ ID NO: 88585 - DNA, 25 bp, Rattus norvegicus
accttggattcactgatcattttca

SEQ ID NO: 88586 - DNA, 25 bp, Rattus norvegicus
accttggattcagtgatcattttca

SEQ ID NO: 88587 - DNA, 25 bp, Rattus norvegicus
accttggatttgagggagttggcct

SEQ ID NO: 88588 - DNA, 25 bp, Rattus norvegicus
accttggatttgtgggagttggcct

SEQ ID NO: 88589 - DNA, 25 bp, Rattus norvegicus
accttggcaagtccctgcgcagggc

SEQ ID NO: 88590 - DNA, 25 bp, Rattus norvegicus
accttggcaagtgcctgcgcagggc

SEQ ID NO: 88591 - DNA, 25 bp, Rattus norvegicus
accttggcactgctgggctgccatg

SEQ ID NO: 88592 - DNA, 25 bp, Rattus norvegicus
accttggcactggtgggctgccatg

SEQ ID NO: 88593 - DNA, 25 bp, Rattus norvegicus
accttggccggcatgtacctacaca

SEQ ID NO: 88594 - DNA, 25 bp, Rattus norvegicus
accttggccggcttgtacctacaca

SEQ ID NO: 88595 - DNA, 25 bp, Rattus norvegicus
accttggcggtaacaggtccagctt

SEQ ID NO: 88596 - DNA, 25 bp, Rattus norvegicus
accttggcggtatcaggtccagctt

SEQ ID NO: 88597 - DNA, 25 bp, Rattus norvegicus
accttggctctgaacatgggtctca

SEQ ID NO: 88598 - DNA, 25 bp, Rattus norvegicus
accttggctctgtacatgggtctca

SEQ ID NO: 88599 - DNA, 25 bp, Rattus norvegicus
accttggctgtactctggcagctga

SEQ ID NO: 88600 - DNA, 25 bp, Rattus norvegicus
accttggctgtagtctggcagctga

SEQ ID NO: 88601 - DNA, 25 bp, Rattus norvegicus
accttggcttgtagtcatgtttgac

SEQ ID NO: 88602 - DNA, 25 bp, Rattus norvegicus
accttggcttgttgtcatgtttgac

SEQ ID NO: 88603 - DNA, 25 bp, Rattus norvegicus
accttggcttttactcccaggagat

SEQ ID NO: 88604 - DNA, 25 bp, Rattus norvegicus
accttggctttttctcccaggagat

SEQ ID NO: 88605 - DNA, 25 bp, Rattus norvegicus
accttgggctgtagagtagttgaat

SEQ ID NO: 88606 - DNA, 25 bp, Rattus norvegicus
accttgggctgttgagtagttgaat

SEQ ID NO: 88607 - DNA, 25 bp, Rattus norvegicus
accttgggtcttagtgccttcactt

SEQ ID NO: 88608 - DNA, 25 bp, Rattus norvegicus
accttgggtctttgtgccttcactt

SEQ ID NO: 88609 - DNA, 25 bp, Rattus norvegicus
accttggtaggtataatcccagcac

SEQ ID NO: 88610 - DNA, 25 bp, Rattus norvegicus
accttggtaggtttaatcccagcac

SEQ ID NO: 88611 - DNA, 25 bp, Rattus norvegicus
accttggtcagcatataacgtcctt

SEQ ID NO: 88612 - DNA, 25 bp, Rattus norvegicus
accttggtcagcttataacgtcctt

SEQ ID NO: 88613 - DNA, 25 bp, Rattus norvegicus
accttggtcatgatcatcttcattt

SEQ ID NO: 88614 - DNA, 25 bp, Rattus norvegicus
accttggtcatgttcatcttcattt

SEQ ID NO: 88615 - DNA, 25 bp, Rattus norvegicus
accttggtctcactggattacgaaa

SEQ ID NO: 88616 - DNA, 25 bp, Rattus norvegicus
accttggtctcagtggattacgaaa

SEQ ID NO: 88617 - DNA, 25 bp, Rattus norvegicus
accttggtgcctcaccagtggaaag

SEQ ID NO: 88618 - DNA, 25 bp, Rattus norvegicus
accttggtgcctgaccagtggaaag

SEQ ID NO: 88619 - DNA, 25 bp, Rattus norvegicus
accttggtgctcagagagccctgaa

SEQ ID NO: 88620 - DNA, 25 bp, Rattus norvegicus
accttggtgctctgagagccctgaa

SEQ ID NO: 88621 - DNA, 25 bp, Rattus norvegicus
accttggtgcttccgggtcactcac

SEQ ID NO: 88622 - DNA, 25 bp, Rattus norvegicus
accttggtgcttgcgggtcactcac

SEQ ID NO: 88623 - DNA, 25 bp, Rattus norvegicus
accttggtggagagggtctagactc

SEQ ID NO: 88624 - DNA, 25 bp, Rattus norvegicus
accttggtggagtgggtctagactc

SEQ ID NO: 88625 - DNA, 25 bp, Rattus norvegicus
accttggtgtgtacctgccccgagg

SEQ ID NO: 88626 - DNA, 25 bp, Rattus norvegicus
accttggtgtgttcctgccccgagg

SEQ ID NO: 88627 - DNA, 25 bp, Rattus norvegicus
accttggttattaatctattgatac

SEQ ID NO: 88628 - DNA, 25 bp, Rattus norvegicus
accttggttatttatctattgatac

SEQ ID NO: 88629 - DNA, 25 bp, Rattus norvegicus
accttggttctgacatggatagcaa

SEQ ID NO: 88630 - DNA, 25 bp, Rattus norvegicus
accttggttctgtcatggatagcaa

SEQ ID NO: 88631 - DNA, 25 bp, Rattus norvegicus
accttggttggtagagtctagtata

SEQ ID NO: 88632 - DNA, 25 bp, Rattus norvegicus
accttggttggttgagtctagtata

SEQ ID NO: 88633 - DNA, 25 bp, Rattus norvegicus
accttggttttcctcatctgtatat

SEQ ID NO: 88634 - DNA, 25 bp, Rattus norvegicus
accttggttttcgtcatctgtatat

SEQ ID NO: 88635 - DNA, 25 bp, Rattus norvegicus
accttgtaagatagttgctcgccgc

SEQ ID NO: 88636 - DNA, 25 bp, Rattus norvegicus
accttgtaagattgttgctcgccgc

SEQ ID NO: 88637 - DNA, 25 bp, Rattus norvegicus
accttgtacagtcagaccagatcta

SEQ ID NO: 88638 - DNA, 25 bp, Rattus norvegicus
accttgtacagtgagaccagatcta

SEQ ID NO: 88639 - DNA, 25 bp, Rattus norvegicus
accttgtatacactgtgtacacaca

SEQ ID NO: 88640 - DNA, 25 bp, Rattus norvegicus
accttgtatacagtgtgtacacaca

SEQ ID NO: 88641 - DNA, 25 bp, Rattus norvegicus
accttgtatagccagatgcctactt

SEQ ID NO: 88642 - DNA, 25 bp, Rattus norvegicus
accttgtatagcgagatgcctactt

SEQ ID NO: 88643 - DNA, 25 bp, Rattus norvegicus
accttgtcctatctccagatctgag

SEQ ID NO: 88644 - DNA, 25 bp, Rattus norvegicus
accttgtcctatgtccagatctgag

SEQ ID NO: 88645 - DNA, 25 bp, Rattus norvegicus
accttgtgaattctgtgccgtcctc

SEQ ID NO: 88646 - DNA, 25 bp, Rattus norvegicus
accttgtgaattgtgtgccgtcctc

SEQ ID NO: 88647 - DNA, 25 bp, Rattus norvegicus
accttgtgagatccttatcccttga

SEQ ID NO: 88648 - DNA, 25 bp, Rattus norvegicus
accttgtgagatgcttatcccttga

SEQ ID NO: 88649 - DNA, 25 bp, Rattus norvegicus
accttgtgcatgaattatttgggaa

SEQ ID NO: 88650 - DNA, 25 bp, Rattus norvegicus
accttgtgcatgtattatttgggaa

SEQ ID NO: 88651 - DNA, 25 bp, Rattus norvegicus
accttgtgccttcttgctcctgaag

SEQ ID NO: 88652 - DNA, 25 bp, Rattus norvegicus
accttgtgccttgttgctcctgaag

SEQ ID NO: 88653 - DNA, 25 bp, Rattus norvegicus
accttgtggacaccgacgactgggt

SEQ ID NO: 88654 - DNA, 25 bp, Rattus norvegicus
accttgtggacagcgacgactgggt

SEQ ID NO: 88655 - DNA, 25 bp, Rattus norvegicus
accttgtggatcatgctgggtcaga

SEQ ID NO: 88656 - DNA, 25 bp, Rattus norvegicus
accttgtggatcttgctgggtcaga

SEQ ID NO: 88657 - DNA, 25 bp, Rattus norvegicus
accttgtggctcactgcaggttgaa

SEQ ID NO: 88658 - DNA, 25 bp, Rattus norvegicus
accttgtggctctctgcaggttgaa

SEQ ID NO: 88659 - DNA, 25 bp, Rattus norvegicus
accttgtgttgacctttgatgctga

SEQ ID NO: 88660 - DNA, 25 bp, Rattus norvegicus
accttgtgttgagctttgatgctga

SEQ ID NO: 88661 - DNA, 25 bp, Rattus norvegicus
accttgttacacactcacacagtta

SEQ ID NO: 88662 - DNA, 25 bp, Rattus norvegicus
accttgttacactctcacacagtta

SEQ ID NO: 88663 - DNA, 25 bp, Rattus norvegicus
accttgttaggtacccaatgtcatt

SEQ ID NO: 88664 - DNA, 25 bp, Rattus norvegicus
accttgttaggttcccaatgtcatt

SEQ ID NO: 88665 - DNA, 25 bp, Rattus norvegicus
accttgttcactatgagtcagggaa

SEQ ID NO: 88666 - DNA, 25 bp, Rattus norvegicus
accttgttcactttgagtcagggaa

SEQ ID NO: 88667 - DNA, 25 bp, Rattus norvegicus
accttgttgacccagatctcaaatt

SEQ ID NO: 88668 - DNA, 25 bp, Rattus norvegicus
accttgttgaccgagatctcaaatt

SEQ ID NO: 88669 - DNA, 25 bp, Rattus norvegicus
acctttaaccatcttgccacagatg

SEQ ID NO: 88670 - DNA, 25 bp, Rattus norvegicus
acctttaaccatgttgccacagatg

SEQ ID NO: 88671 - DNA, 25 bp, Rattus norvegicus
acctttaactatcctcccgggatgg

SEQ ID NO: 88672 - DNA, 25 bp, Rattus norvegicus
acctttaactatgctcccgggatgg

SEQ ID NO: 88673 - DNA, 25 bp, Rattus norvegicus
acctttaacttcaaatgtccagcca

SEQ ID NO: 88674 - DNA, 25 bp, Rattus norvegicus
acctttaacttctaatgtccagcca

SEQ ID NO: 88675 - DNA, 25 bp, Rattus norvegicus
acctttactcatctttctgcatctg

SEQ ID NO: 88676 - DNA, 25 bp, Rattus norvegicus
acctttactcatgtttctgcatctg

SEQ ID NO: 88677 - DNA, 25 bp, Rattus norvegicus
acctttagacatatgtttaccattg

SEQ ID NO: 88678 - DNA, 25 bp, Rattus norvegicus
acctttagacatttgtttaccattg

SEQ ID NO: 88679 - DNA, 25 bp, Rattus norvegicus
acctttagtgtcatttcttcttgat

SEQ ID NO: 88680 - DNA, 25 bp, Rattus norvegicus
acctttagtgtcttttcttcttgat

SEQ ID NO: 88681 - DNA, 25 bp, Rattus norvegicus
acctttatacctcgcctttctgtga

SEQ ID NO: 88682 - DNA, 25 bp, Rattus norvegicus
acctttatacctggcctttctgtga

SEQ ID NO: 88683 - DNA, 25 bp, Rattus norvegicus
acctttataggtactgtttgtctga

SEQ ID NO: 88684 - DNA, 25 bp, Rattus norvegicus
acctttataggttctgtttgtctga

SEQ ID NO: 88685 - DNA, 25 bp, Rattus norvegicus
acctttatcctgattggttgactct

SEQ ID NO: 88686 - DNA, 25 bp, Rattus norvegicus
acctttatcctgtttggttgactct

SEQ ID NO: 88687 - DNA, 25 bp, Rattus norvegicus
acctttatcttgagtagtctcccat

SEQ ID NO: 88688 - DNA, 25 bp, Rattus norvegicus
acctttatcttgtgtagtctcccat

SEQ ID NO: 88689 - DNA, 25 bp, Rattus norvegicus
acctttcaaacccataactctcaga

SEQ ID NO: 88690 - DNA, 25 bp, Rattus norvegicus
acctttcaaaccgataactctcaga

SEQ ID NO: 88691 - DNA, 25 bp, Rattus norvegicus
acctttcacctcatgtctgttggaa

SEQ ID NO: 88692 - DNA, 25 bp, Rattus norvegicus
acctttcacctcttgtctgttggaa

SEQ ID NO: 88693 - DNA, 25 bp, Rattus norvegicus
acctttcactgaattcatgacctct

SEQ ID NO: 88694 - DNA, 25 bp, Rattus norvegicus
acctttcactgatttcatgacctct

SEQ ID NO: 88695 - DNA, 25 bp, Rattus norvegicus
acctttcagcacagtggatagggac

SEQ ID NO: 88696 - DNA, 25 bp, Rattus norvegicus
acctttcagcactgtggatagggac

SEQ ID NO: 88697 - DNA, 25 bp, Rattus norvegicus
acctttcagccgcactttagcagaa

SEQ ID NO: 88698 - DNA, 25 bp, Rattus norvegicus
acctttcagccggactttagcagaa

SEQ ID NO: 88699 - DNA, 25 bp, Rattus norvegicus
acctttcagcctccagagactttga

SEQ ID NO: 88700 - DNA, 25 bp, Rattus norvegicus
acctttcagcctgcagagactttga

SEQ ID NO: 88701 - DNA, 25 bp, Rattus norvegicus
acctttccatcgacgttgtgtataa

SEQ ID NO: 88702 - DNA, 25 bp, Rattus norvegicus
acctttccatcgtcgttgtgtataa

SEQ ID NO: 88703 - DNA, 25 bp, Rattus norvegicus
acctttccatgaaatgctgtatgct

SEQ ID NO: 88704 - DNA, 25 bp, Rattus norvegicus
acctttccatgatatgctgtatgct

SEQ ID NO: 88705 - DNA, 25 bp, Rattus norvegicus
acctttccctcgaatcagattctgt

SEQ ID NO: 88706 - DNA, 25 bp, Rattus norvegicus
acctttccctcgtatcagattctgt

SEQ ID NO: 88707 - DNA, 25 bp, Rattus norvegicus
acctttcctcgacacttgcagaagt

SEQ ID NO: 88708 - DNA, 25 bp, Rattus norvegicus
acctttcctcgagacttgcagaagt

SEQ ID NO: 88709 - DNA, 25 bp, Rattus norvegicus
acctttccttacaaacctggcatat

SEQ ID NO: 88710 - DNA, 25 bp, Rattus norvegicus
acctttccttactaacctggcatat

SEQ ID NO: 88711 - DNA, 25 bp, Rattus norvegicus
acctttccttgcctttgcagaaaat

SEQ ID NO: 88712 - DNA, 25 bp, Rattus norvegicus
acctttccttgcgtttgcagaaaat

SEQ ID NO: 88713 - DNA, 25 bp, Rattus norvegicus
acctttcgcttcattcttattctat

SEQ ID NO: 88714 - DNA, 25 bp, Rattus norvegicus
acctttcgcttctttcttattctat

SEQ ID NO: 88715 - DNA, 25 bp, Rattus norvegicus
acctttctaacaatctgtcaacatt

SEQ ID NO: 88716 - DNA, 25 bp, Rattus norvegicus
acctttctaacattctgtcaacatt

SEQ ID NO: 88717 - DNA, 25 bp, Rattus norvegicus
acctttctcattcctcggatgtaaa

SEQ ID NO: 88718 - DNA, 25 bp, Rattus norvegicus
acctttctcattgctcggatgtaaa

SEQ ID NO: 88719 - DNA, 25 bp, Rattus norvegicus
acctttctgagtcggaggtggccct

SEQ ID NO: 88720 - DNA, 25 bp, Rattus norvegicus
acctttctgagtgggaggtggccct

SEQ ID NO: 88721 - DNA, 25 bp, Rattus norvegicus
acctttctgtgtctgcttagcttat

SEQ ID NO: 88722 - DNA, 25 bp, Rattus norvegicus
acctttctgtgtgtgcttagcttat

SEQ ID NO: 88723 - DNA, 25 bp, Rattus norvegicus
acctttcttcctctctatcatagca

SEQ ID NO: 88724 - DNA, 25 bp, Rattus norvegicus
acctttcttcctgtctatcatagca

SEQ ID NO: 88725 - DNA, 25 bp, Rattus norvegicus
acctttcttggtcctccagacatga

SEQ ID NO: 88726 - DNA, 25 bp, Rattus norvegicus
acctttcttggtgctccagacatga

SEQ ID NO: 88727 - DNA, 25 bp, Rattus norvegicus
acctttgaagtcagaagtgtggaga

SEQ ID NO: 88728 - DNA, 25 bp, Rattus norvegicus
acctttgaagtctgaagtgtggaga

SEQ ID NO: 88729 - DNA, 25 bp, Rattus norvegicus
acctttgaccctcgcagtgggcagg

SEQ ID NO: 88730 - DNA, 25 bp, Rattus norvegicus
acctttgaccctggcagtgggcagg

SEQ ID NO: 88731 - DNA, 25 bp, Rattus norvegicus
acctttgagactctggcggagagct

SEQ ID NO: 88732 - DNA, 25 bp, Rattus norvegicus
acctttgagactgtggcggagagct

SEQ ID NO: 88733 - DNA, 25 bp, Rattus norvegicus
acctttgagctcacgctggtgttca

SEQ ID NO: 88734 - DNA, 25 bp, Rattus norvegicus
acctttgagctctcgctggtgttca

SEQ ID NO: 88735 - DNA, 25 bp, Rattus norvegicus
acctttgaggaactcggagctctgt

SEQ ID NO: 88736 - DNA, 25 bp, Rattus norvegicus
acctttgaggaagtcggagctctgt

SEQ ID NO: 88737 - DNA, 25 bp, Rattus norvegicus
acctttgatctcaggccatccaggc

SEQ ID NO: 88738 - DNA, 25 bp, Rattus norvegicus
acctttgatctctggccatccaggc

SEQ ID NO: 88739 - DNA, 25 bp, Rattus norvegicus
acctttgcagccaaccatgagtagt

SEQ ID NO: 88740 - DNA, 25 bp, Rattus norvegicus
acctttgcagcctaccatgagtagt

SEQ ID NO: 88741 - DNA, 25 bp, Rattus norvegicus
acctttgccagcagacaggcgagga

SEQ ID NO: 88742 - DNA, 25 bp, Rattus norvegicus
acctttgccagctgacaggcgagga

SEQ ID NO: 88743 - DNA, 25 bp, Rattus norvegicus
acctttgccgagatgactctgtgga

SEQ ID NO: 88744 - DNA, 25 bp, Rattus norvegicus
acctttgccgagttgactctgtgga

SEQ ID NO: 88745 - DNA, 25 bp, Rattus norvegicus
acctttgctcccacctgtgaatgga

SEQ ID NO: 88746 - DNA, 25 bp, Rattus norvegicus
acctttgctccctcctgtgaatgga

SEQ ID NO: 88747 - DNA, 25 bp, Rattus norvegicus
acctttgcttagacgctccagaaaa

SEQ ID NO: 88748 - DNA, 25 bp, Rattus norvegicus
acctttgcttagtcgctccagaaaa

SEQ ID NO: 88749 - DNA, 25 bp, Rattus norvegicus
acctttgcttggcatgcctgtgaga

SEQ ID NO: 88750 - DNA, 25 bp, Rattus norvegicus
acctttgcttgggatgcctgtgaga

SEQ ID NO: 88751 - DNA, 25 bp, Rattus norvegicus
acctttggactgctgttactgatct

SEQ ID NO: 88752 - DNA, 25 bp, Rattus norvegicus
acctttggactggtgttactgatct

SEQ ID NO: 88753 - DNA, 25 bp, Rattus norvegicus
acctttgggccaaacatctttcaat

SEQ ID NO: 88754 - DNA, 25 bp, Rattus norvegicus
acctttgggccatacatctttcaat

SEQ ID NO: 88755 - DNA, 25 bp, Rattus norvegicus
acctttgggcgcatcgggctgcagc

SEQ ID NO: 88756 - DNA, 25 bp, Rattus norvegicus
acctttgggcgcttcgggctgcagc

SEQ ID NO: 88757 - DNA, 25 bp, Rattus norvegicus
acctttggtctgaggtgttgctctg

SEQ ID NO: 88758 - DNA, 25 bp, Rattus norvegicus
acctttggtctgtggtgttgctctg

SEQ ID NO: 88759 - DNA, 25 bp, Rattus norvegicus
acctttgtagtcacagcacttaaga

SEQ ID NO: 88760 - DNA, 25 bp, Rattus norvegicus
acctttgtagtctcagcacttaaga

SEQ ID NO: 88761 - DNA, 25 bp, Rattus norvegicus
acctttgtctgtccactgtacagga

SEQ ID NO: 88762 - DNA, 25 bp, Rattus norvegicus
acctttgtctgtgcactgtacagga

SEQ ID NO: 88763 - DNA, 25 bp, Rattus norvegicus
acctttgtcttaagcaatgaatgtg

SEQ ID NO: 88764 - DNA, 25 bp, Rattus norvegicus
acctttgtcttatgcaatgaatgtg

SEQ ID NO: 88765 - DNA, 25 bp, Rattus norvegicus
acctttgtcttcaccattatcttgt

SEQ ID NO: 88766 - DNA, 25 bp, Rattus norvegicus
acctttgtcttctccattatcttgt

SEQ ID NO: 88767 - DNA, 25 bp, Rattus norvegicus
acctttgtgaacatgcccatgtgtg

SEQ ID NO: 88768 - DNA, 25 bp, Rattus norvegicus
acctttgtgaacttgcccatgtgtg

SEQ ID NO: 88769 - DNA, 25 bp, Rattus norvegicus
acctttgtggatccttcttggtttg

SEQ ID NO: 88770 - DNA, 25 bp, Rattus norvegicus
acctttgtggatgcttcttggtttg

SEQ ID NO: 88771 - DNA, 25 bp, Rattus norvegicus
acctttgttaccaggtgctctggac

SEQ ID NO: 88772 - DNA, 25 bp, Rattus norvegicus
acctttgttacctggtgctctggac

SEQ ID NO: 88773 - DNA, 25 bp, Rattus norvegicus
acctttgttctccttcattgttcag

SEQ ID NO: 88774 - DNA, 25 bp, Rattus norvegicus
acctttgttctcgttcattgttcag

SEQ ID NO: 88775 - DNA, 25 bp, Rattus norvegicus
accttttaagcccagcatgtttctt

SEQ ID NO: 88776 - DNA, 25 bp, Rattus norvegicus
accttttaagccgagcatgtttctt

SEQ ID NO: 88777 - DNA, 25 bp, Rattus norvegicus
accttttaagtcatgcctgtgcgtg

SEQ ID NO: 88778 - DNA, 25 bp, Rattus norvegicus
accttttaagtcttgcctgtgcgtg

SEQ ID NO: 88779 - DNA, 25 bp, Rattus norvegicus
accttttacctgagatctctccatc

SEQ ID NO: 88780 - DNA, 25 bp, Rattus norvegicus
accttttacctgtgatctctccatc

SEQ ID NO: 88781 - DNA, 25 bp, Rattus norvegicus
accttttagaagagtcagtgctgga

SEQ ID NO: 88782 - DNA, 25 bp, Rattus norvegicus
accttttagaagtgtcagtgctgga

SEQ ID NO: 88783 - DNA, 25 bp, Rattus norvegicus
accttttaggccatttgctcatagc

SEQ ID NO: 88784 - DNA, 25 bp, Rattus norvegicus
accttttaggccttttgctcatagc

SEQ ID NO: 88785 - DNA, 25 bp, Rattus norvegicus
accttttattccagttctcgtgcta

SEQ ID NO: 88786 - DNA, 25 bp, Rattus norvegicus
accttttattcctgttctcgtgcta

SEQ ID NO: 88787 - DNA, 25 bp, Rattus norvegicus
accttttcagtgaccgctttatcaa

SEQ ID NO: 88788 - DNA, 25 bp, Rattus norvegicus
accttttcagtgtccgctttatcaa

SEQ ID NO: 88789 - DNA, 25 bp, Rattus norvegicus
accttttcagttaccattagcacaa

SEQ ID NO: 88790 - DNA, 25 bp, Rattus norvegicus
accttttcagtttccattagcacaa

SEQ ID NO: 88791 - DNA, 25 bp, Rattus norvegicus
accttttcatccctgtgtgtcctgc

SEQ ID NO: 88792 - DNA, 25 bp, Rattus norvegicus
accttttcatccgtgtgtgtcctgc

SEQ ID NO: 88793 - DNA, 25 bp, Rattus norvegicus
accttttcattcactaaatgtgtat

SEQ ID NO: 88794 - DNA, 25 bp, Rattus norvegicus
accttttcattctctaaatgtgtat

SEQ ID NO: 88795 - DNA, 25 bp, Rattus norvegicus
accttttcctgtactctggatcaga

SEQ ID NO: 88796 - DNA, 25 bp, Rattus norvegicus
accttttcctgttctctggatcaga

SEQ ID NO: 88797 - DNA, 25 bp, Rattus norvegicus
accttttccttcaaactgcattgag

SEQ ID NO: 88798 - DNA, 25 bp, Rattus norvegicus
accttttccttcaatgtacaccaag

SEQ ID NO: 88799 - DNA, 25 bp, Rattus norvegicus
accttttccttctaactgcattgag

SEQ ID NO: 88800 - DNA, 25 bp, Rattus norvegicus
accttttccttctatgtacaccaag

SEQ ID NO: 88801 - DNA, 25 bp, Rattus norvegicus
accttttctcacaatcaaacttcta

SEQ ID NO: 88802 - DNA, 25 bp, Rattus norvegicus
accttttctcactatcaaacttcta

SEQ ID NO: 88803 - DNA, 25 bp, Rattus norvegicus
accttttctctgcagtcgcgaatag

SEQ ID NO: 88804 - DNA, 25 bp, Rattus norvegicus
accttttctctggagtcgcgaatag

SEQ ID NO: 88805 - DNA, 25 bp, Rattus norvegicus
accttttgacgtctggatctttctc

SEQ ID NO: 88806 - DNA, 25 bp, Rattus norvegicus
accttttgacgtgtggatctttctc

SEQ ID NO: 88807 - DNA, 25 bp, Rattus norvegicus
accttttgagttagtgtcctgagaa

SEQ ID NO: 88808 - DNA, 25 bp, Rattus norvegicus
accttttgagtttgtgtcctgagaa

SEQ ID NO: 88809 - DNA, 25 bp, Rattus norvegicus
accttttgggtcaggcagctgaaga

SEQ ID NO: 88810 - DNA, 25 bp, Rattus norvegicus
accttttgggtctggcagctgaaga

SEQ ID NO: 88811 - DNA, 25 bp, Rattus norvegicus
acctttttaagcagcaacacccagc

SEQ ID NO: 88812 - DNA, 25 bp, Rattus norvegicus
acctttttaagctgcaacacccagc

SEQ ID NO: 88813 - DNA, 25 bp, Rattus norvegicus
acctttttacacattagagctactg

SEQ ID NO: 88814 - DNA, 25 bp, Rattus norvegicus
acctttttacactttagagctactg

SEQ ID NO: 88815 - DNA, 25 bp, Rattus norvegicus
acctttttacagattgctacgatcg

SEQ ID NO: 88816 - DNA, 25 bp, Rattus norvegicus
acctttttacagtttgctacgatcg

SEQ ID NO: 88817 - DNA, 25 bp, Rattus norvegicus
acctttttccatctcttcatagtta

SEQ ID NO: 88818 - DNA, 25 bp, Rattus norvegicus
acctttttccatgtcttcatagtta

SEQ ID NO: 88819 - DNA, 25 bp, Rattus norvegicus
accttttttggtaactgcactgcat

SEQ ID NO: 88820 - DNA, 25 bp, Rattus norvegicus
accttttttggttactgcactgcat

SEQ ID NO: 88821 - DNA, 25 bp, Rattus norvegicus
acgaaaacccggcaggagcattcta

SEQ ID NO: 88822 - DNA, 25 bp, Rattus norvegicus
acgaaaacccgggaggagcattcta

SEQ ID NO: 88823 - DNA, 25 bp, Rattus norvegicus
acgaaaactcggatcctgctgcaga

SEQ ID NO: 88824 - DNA, 25 bp, Rattus norvegicus
acgaaaactcggttcctgctgcaga

SEQ ID NO: 88825 - DNA, 25 bp, Rattus norvegicus
acgaaaatgctgaccaggctgtgca

SEQ ID NO: 88826 - DNA, 25 bp, Rattus norvegicus
acgaaaatgctgtccaggctgtgca

SEQ ID NO: 88827 - DNA, 25 bp, Rattus norvegicus
acgaaacccgtgctatttaatactg

SEQ ID NO: 88828 - DNA, 25 bp, Rattus norvegicus
acgaaacccgtggtatttaatactg

SEQ ID NO: 88829 - DNA, 25 bp, Rattus norvegicus
acgaaaccttgtcggctgagacctc

SEQ ID NO: 88830 - DNA, 25 bp, Rattus norvegicus
acgaaaccttgtgggctgagacctc

SEQ ID NO: 88831 - DNA, 25 bp, Rattus norvegicus
acgaaactcagcaccgaagatacat

SEQ ID NO: 88832 - DNA, 25 bp, Rattus norvegicus
acgaaactcagctccgaagatacat

SEQ ID NO: 88833 - DNA, 25 bp, Rattus norvegicus
acgaaactcctgagggccttgtgag

SEQ ID NO: 88834 - DNA, 25 bp, Rattus norvegicus
acgaaactcctgtgggccttgtgag

SEQ ID NO: 88835 - DNA, 25 bp, Rattus norvegicus
acgaaacttcttacttctgatgcta

SEQ ID NO: 88836 - DNA, 25 bp, Rattus norvegicus
acgaaacttctttcttctgatgcta

SEQ ID NO: 88837 - DNA, 25 bp, Rattus norvegicus
acgaaaggtctcattttaggccgct

SEQ ID NO: 88838 - DNA, 25 bp, Rattus norvegicus
acgaaaggtctctttttaggccgct

SEQ ID NO: 88839 - DNA, 25 bp, Rattus norvegicus
acgaaatcatagaagcctctgggca

SEQ ID NO: 88840 - DNA, 25 bp, Rattus norvegicus
acgaaatcatagtagcctctgggca

SEQ ID NO: 88841 - DNA, 25 bp, Rattus norvegicus
acgaaatggtttatgccggtgcaca

SEQ ID NO: 88842 - DNA, 25 bp, Rattus norvegicus
acgaaatggtttttgccggtgcaca

SEQ ID NO: 88843 - DNA, 25 bp, Rattus norvegicus
acgaacaaatacactctctccctgg

SEQ ID NO: 88844 - DNA, 25 bp, Rattus norvegicus
acgaacaaatactctctctccctgg

SEQ ID NO: 88845 - DNA, 25 bp, Rattus norvegicus
acgaacacaaggagctgctgggcat

SEQ ID NO: 88846 - DNA, 25 bp, Rattus norvegicus
acgaacacaaggtgctgctgggcat

SEQ ID NO: 88847 - DNA, 25 bp, Rattus norvegicus
acgaacacacacaactgagggcctt

SEQ ID NO: 88848 - DNA, 25 bp, Rattus norvegicus
acgaacacacactactgagggcctt

SEQ ID NO: 88849 - DNA, 25 bp, Rattus norvegicus
acgaacagtgcaccgtgccctagga

SEQ ID NO: 88850 - DNA, 25 bp, Rattus norvegicus
acgaacagtgcagcgtgccctagga

SEQ ID NO: 88851 - DNA, 25 bp, Rattus norvegicus
acgaacatatatagccaacccggaa

SEQ ID NO: 88852 - DNA, 25 bp, Rattus norvegicus
acgaacatatattgccaacccggaa

SEQ ID NO: 88853 - DNA, 25 bp, Rattus norvegicus
acgaaccaatagaaggcaagctctc

SEQ ID NO: 88854 - DNA, 25 bp, Rattus norvegicus
acgaaccaatagtaggcaagctctc

SEQ ID NO: 88855 - DNA, 25 bp, Rattus norvegicus
acgaaccatccgaaatgccatgaag

SEQ ID NO: 88856 - DNA, 25 bp, Rattus norvegicus
acgaaccatccgtaatgccatgaag

SEQ ID NO: 88857 - DNA, 25 bp, Rattus norvegicus
acgaaccgcctcaaactgggcttga

SEQ ID NO: 88858 - DNA, 25 bp, Rattus norvegicus
acgaaccgcctctaactgggcttga

SEQ ID NO: 88859 - DNA, 25 bp, Rattus norvegicus
acgaacctctgccaacttcaataaa

SEQ ID NO: 88860 - DNA, 25 bp, Rattus norvegicus
acgaacctctgcgaacttcaataaa

SEQ ID NO: 88861 - DNA, 25 bp, Rattus norvegicus
acgaacctcttcattgtgcatatgg

SEQ ID NO: 88862 - DNA, 25 bp, Rattus norvegicus
acgaacctcttctttgtgcatatgg

SEQ ID NO: 88863 - DNA, 25 bp, Rattus norvegicus
acgaacgagatcacggtcacccgaa

SEQ ID NO: 88864 - DNA, 25 bp, Rattus norvegicus
acgaacgagatctcggtcacccgaa

SEQ ID NO: 88865 - DNA, 25 bp, Rattus norvegicus
acgaacgcagtgagctgagccacgt

SEQ ID NO: 88866 - DNA, 25 bp, Rattus norvegicus
acgaacgcagtgtgctgagccacgt

SEQ ID NO: 88867 - DNA, 25 bp, Rattus norvegicus
acgaacgggtggactcaactgagag

SEQ ID NO: 88868 - DNA, 25 bp, Rattus norvegicus
acgaacgggtggtctcaactgagag

SEQ ID NO: 88869 - DNA, 25 bp, Rattus norvegicus
acgaacgtgagccttatgcaccggg

SEQ ID NO: 88870 - DNA, 25 bp, Rattus norvegicus
acgaacgtgagcgttatgcaccggg

SEQ ID NO: 88871 - DNA, 25 bp, Rattus norvegicus
acgaactatactcccggagccgctt

SEQ ID NO: 88872 - DNA, 25 bp, Rattus norvegicus
acgaactatactgccggagccgctt

SEQ ID NO: 88873 - DNA, 25 bp, Rattus norvegicus
acgaactgggtcatcaggtaggcaa

SEQ ID NO: 88874 - DNA, 25 bp, Rattus norvegicus
acgaactgggtcttcaggtaggcaa

SEQ ID NO: 88875 - DNA, 25 bp, Rattus norvegicus
acgaagagatgaacggctactacct

SEQ ID NO: 88876 - DNA, 25 bp, Rattus norvegicus
acgaagagatgatcggctactacct

SEQ ID NO: 88877 - DNA, 25 bp, Rattus norvegicus
acgaagagtcatcagcggcacagct

SEQ ID NO: 88878 - DNA, 25 bp, Rattus norvegicus
acgaagagtcatgagcggcacagct

SEQ ID NO: 88879 - DNA, 25 bp, Rattus norvegicus
acgaagatttgtcacccaggcctca

SEQ ID NO: 88880 - DNA, 25 bp, Rattus norvegicus
acgaagatttgtgacccaggcctca

SEQ ID NO: 88881 - DNA, 25 bp, Rattus norvegicus
acgaagcaacaaccgaagttctcac

SEQ ID NO: 88882 - DNA, 25 bp, Rattus norvegicus
acgaagcaacaagcgaagttctcac

SEQ ID NO: 88883 - DNA, 25 bp, Rattus norvegicus
acgaagcactgtctcatctaccgca

SEQ ID NO: 88884 - DNA, 25 bp, Rattus norvegicus
acgaagcactgtgtcatctaccgca

SEQ ID NO: 88885 - DNA, 25 bp, Rattus norvegicus
acgaagcatcctattctttgttgaa

SEQ ID NO: 88886 - DNA, 25 bp, Rattus norvegicus
acgaagcatccttttctttgttgaa

SEQ ID NO: 88887 - DNA, 25 bp, Rattus norvegicus
acgaagcatctgagactggacattt

SEQ ID NO: 88888 - DNA, 25 bp, Rattus norvegicus
acgaagcatctgtgactggacattt

SEQ ID NO: 88889 - DNA, 25 bp, Rattus norvegicus
acgaagccaaatacgcagacatgca

SEQ ID NO: 88890 - DNA, 25 bp, Rattus norvegicus
acgaagccaaattcgcagacatgca

SEQ ID NO: 88891 - DNA, 25 bp, Rattus norvegicus
acgaagccaatgaaacagaggagtt

SEQ ID NO: 88892 - DNA, 25 bp, Rattus norvegicus
acgaagccaatgagcaggtgcacca

SEQ ID NO: 88893 - DNA, 25 bp, Rattus norvegicus
acgaagccaatgtaacagaggagtt

SEQ ID NO: 88894 - DNA, 25 bp, Rattus norvegicus
acgaagccaatgtgcaggtgcacca

SEQ ID NO: 88895 - DNA, 25 bp, Rattus norvegicus
acgaagccactaaccttgctgaagg

SEQ ID NO: 88896 - DNA, 25 bp, Rattus norvegicus
acgaagccactatccttgctgaagg

SEQ ID NO: 88897 - DNA, 25 bp, Rattus norvegicus
acgaagccgacaagctgttctctgt

SEQ ID NO: 88898 - DNA, 25 bp, Rattus norvegicus
acgaagccgacatgctgttctctgt

SEQ ID NO: 88899 - DNA, 25 bp, Rattus norvegicus
acgaagctgatgacgctggtcagac

SEQ ID NO: 88900 - DNA, 25 bp, Rattus norvegicus
acgaagctgatgtcgctggtcagac

SEQ ID NO: 88901 - DNA, 25 bp, Rattus norvegicus
acgaagcttcacagacgaggtccta

SEQ ID NO: 88902 - DNA, 25 bp, Rattus norvegicus
acgaagcttcactgacgaggtccta

SEQ ID NO: 88903 - DNA, 25 bp, Rattus norvegicus
acgaagcttccacccctgggtttct

SEQ ID NO: 88904 - DNA, 25 bp, Rattus norvegicus
acgaagcttccagccctgggtttct

SEQ ID NO: 88905 - DNA, 25 bp, Rattus norvegicus
acgaagctttacagcgcgtagcctc

SEQ ID NO: 88906 - DNA, 25 bp, Rattus norvegicus
acgaagctttactgcgcgtagcctc

SEQ ID NO: 88907 - DNA, 25 bp, Rattus norvegicus
acgaaggaatccaggacaagatgct

SEQ ID NO: 88908 - DNA, 25 bp, Rattus norvegicus
acgaaggaatcctggacaagatgct

SEQ ID NO: 88909 - DNA, 25 bp, Rattus norvegicus
acgaaggcacctacacatgtgtggt

SEQ ID NO: 88910 - DNA, 25 bp, Rattus norvegicus
acgaaggcaccttcacatgtgtggt

SEQ ID NO: 88911 - DNA, 25 bp, Rattus norvegicus
acgaaggtagcaaacatttagccat

SEQ ID NO: 88912 - DNA, 25 bp, Rattus norvegicus
acgaaggtagcatacatttagccat

SEQ ID NO: 88913 - DNA, 25 bp, Rattus norvegicus
acgaaggtggtgatcttcttgtaga

SEQ ID NO: 88914 - DNA, 25 bp, Rattus norvegicus
acgaaggtggtgttcttcttgtaga

SEQ ID NO: 88915 - DNA, 25 bp, Rattus norvegicus
acgaaggtgtgcctctgcataggca

SEQ ID NO: 88916 - DNA, 25 bp, Rattus norvegicus
acgaaggtgtgcgtctgcataggca

SEQ ID NO: 88917 - DNA, 25 bp, Rattus norvegicus
acgaaggtttgaaccaggtgtgcct

SEQ ID NO: 88918 - DNA, 25 bp, Rattus norvegicus
acgaaggtttgatccaggtgtgcct

SEQ ID NO: 88919 - DNA, 25 bp, Rattus norvegicus
acgaagtctgagaccatttcagtct

SEQ ID NO: 88920 - DNA, 25 bp, Rattus norvegicus
acgaagtctgagtccatttcagtct

SEQ ID NO: 88921 - DNA, 25 bp, Rattus norvegicus
acgaagtcttcccatttgcttcagc

SEQ ID NO: 88922 - DNA, 25 bp, Rattus norvegicus
acgaagtcttccgatttgcttcagc

SEQ ID NO: 88923 - DNA, 25 bp, Rattus norvegicus
acgaagtgcatcacgccacagggtg

SEQ ID NO: 88924 - DNA, 25 bp, Rattus norvegicus
acgaagtgcatctcgccacagggtg

SEQ ID NO: 88925 - DNA, 25 bp, Rattus norvegicus
acgaagtgcgtgagagatccagaca

SEQ ID NO: 88926 - DNA, 25 bp, Rattus norvegicus
acgaagtgcgtgtgagatccagaca

SEQ ID NO: 88927 - DNA, 25 bp, Rattus norvegicus
acgaagtggatgaccctccttggga

SEQ ID NO: 88928 - DNA, 25 bp, Rattus norvegicus
acgaagtggatgtccctccttggga

SEQ ID NO: 88929 - DNA, 25 bp, Rattus norvegicus
acgaagttcacaccggagttcacac

SEQ ID NO: 88930 - DNA, 25 bp, Rattus norvegicus
acgaagttcacagcggagttcacac

SEQ ID NO: 88931 - DNA, 25 bp, Rattus norvegicus
acgaagttcccactcaagaggacat

SEQ ID NO: 88932 - DNA, 25 bp, Rattus norvegicus
acgaagttcccagtcaagaggacat

SEQ ID NO: 88933 - DNA, 25 bp, Rattus norvegicus
acgaagttggccctccagaccaggc

SEQ ID NO: 88934 - DNA, 25 bp, Rattus norvegicus
acgaagttggccgtccagaccaggc

SEQ ID NO: 88935 - DNA, 25 bp, Rattus norvegicus
acgaatcttattattcctgtcctgc

SEQ ID NO: 88936 - DNA, 25 bp, Rattus norvegicus
acgaatcttatttttcctgtcctgc

SEQ ID NO: 88937 - DNA, 25 bp, Rattus norvegicus
acgaatgccccaaaaatgttaccat

SEQ ID NO: 88938 - DNA, 25 bp, Rattus norvegicus
acgaatgccccataaatgttaccat

SEQ ID NO: 88939 - DNA, 25 bp, Rattus norvegicus
acgaatgctgacactatcctggaag

SEQ ID NO: 88940 - DNA, 25 bp, Rattus norvegicus
acgaatgctgactctatcctggaag

SEQ ID NO: 88941 - DNA, 25 bp, Rattus norvegicus
acgaatgctttaatgtgtgccagag

SEQ ID NO: 88942 - DNA, 25 bp, Rattus norvegicus
acgaatgctttattgtgtgccagag

SEQ ID NO: 88943 - DNA, 25 bp, Rattus norvegicus
acgaatggagtcaagtgcctaggtt

SEQ ID NO: 88944 - DNA, 25 bp, Rattus norvegicus
acgaatggagtctagtgcctaggtt

SEQ ID NO: 88945 - DNA, 25 bp, Rattus norvegicus
acgaatgtatgtcggttcttaggaa

SEQ ID NO: 88946 - DNA, 25 bp, Rattus norvegicus
acgaatgtatgtgggttcttaggaa

SEQ ID NO: 88947 - DNA, 25 bp, Rattus norvegicus
acgaatgttaatcctaacgcctcat

SEQ ID NO: 88948 - DNA, 25 bp, Rattus norvegicus
acgaatgttaatgctaacgcctcat

SEQ ID NO: 88949 - DNA, 25 bp, Rattus norvegicus
acgaatgttccaactagtactgcag

SEQ ID NO: 88950 - DNA, 25 bp, Rattus norvegicus
acgaatgttccatctagtactgcag

SEQ ID NO: 88951 - DNA, 25 bp, Rattus norvegicus
acgaatgtttttaccaatcctgccg

SEQ ID NO: 88952 - DNA, 25 bp, Rattus norvegicus
acgaatgttttttccaatcctgccg

SEQ ID NO: 88953 - DNA, 25 bp, Rattus norvegicus
acgaattgctgcatctggtctttga

SEQ ID NO: 88954 - DNA, 25 bp, Rattus norvegicus
acgaattgctgcttctggtctttga

SEQ ID NO: 88955 - DNA, 25 bp, Rattus norvegicus
acgaatttcctcatgatgacttctg

SEQ ID NO: 88956 - DNA, 25 bp, Rattus norvegicus
acgaatttcctcttgatgacttctg

SEQ ID NO: 88957 - DNA, 25 bp, Rattus norvegicus
acgaatttctcgagtcctgtcagga

SEQ ID NO: 88958 - DNA, 25 bp, Rattus norvegicus
acgaatttctcgtgtcctgtcagga

SEQ ID NO: 88959 - DNA, 25 bp, Rattus norvegicus
acgaatttctggaatcacccgagtc

SEQ ID NO: 88960 - DNA, 25 bp, Rattus norvegicus
acgaatttctggtatcacccgagtc

SEQ ID NO: 88961 - DNA, 25 bp, Rattus norvegicus
acgacaacaatcaggcctatcttga

SEQ ID NO: 88962 - DNA, 25 bp, Rattus norvegicus
acgacaacaatctggcctatcttga

SEQ ID NO: 88963 - DNA, 25 bp, Rattus norvegicus
acgacaagcaccagagtgtgcccaa

SEQ ID NO: 88964 - DNA, 25 bp, Rattus norvegicus
acgacaagcacctgagtgtgcccaa

SEQ ID NO: 88965 - DNA, 25 bp, Rattus norvegicus
acgacaccgcaaaaggatatcctgt

SEQ ID NO: 88966 - DNA, 25 bp, Rattus norvegicus
acgacaccgcaataggatatcctgt

SEQ ID NO: 88967 - DNA, 25 bp, Rattus norvegicus
acgacacctcggcagcagaccttgg

SEQ ID NO: 88968 - DNA, 25 bp, Rattus norvegicus
acgacacctcgggagcagaccttgg

SEQ ID NO: 88969 - DNA, 25 bp, Rattus norvegicus
acgacaccttcgaggacctgcagaa

SEQ ID NO: 88970 - DNA, 25 bp, Rattus norvegicus
acgacaccttcgtggacctgcagaa

SEQ ID NO: 88971 - DNA, 25 bp, Rattus norvegicus
acgacacggagtacagtgcctgggt

SEQ ID NO: 88972 - DNA, 25 bp, Rattus norvegicus
acgacacggagttcagtgcctgggt

SEQ ID NO: 88973 - DNA, 25 bp, Rattus norvegicus
acgacactctccagtcacagtaata

SEQ ID NO: 88974 - DNA, 25 bp, Rattus norvegicus
acgacactctcctgtcacagtaata

SEQ ID NO: 88975 - DNA, 25 bp, Rattus norvegicus
acgacagcagtaactgaggttctta

SEQ ID NO: 88976 - DNA, 25 bp, Rattus norvegicus
acgacagcagtatctgaggttctta

SEQ ID NO: 88977 - DNA, 25 bp, Rattus norvegicus
acgacagcatcaatggcgaaggccc

SEQ ID NO: 88978 - DNA, 25 bp, Rattus norvegicus
acgacagcatcattggcgaaggccc

SEQ ID NO: 88979 - DNA, 25 bp, Rattus norvegicus
acgacagcctgtccatcaaaacttg

SEQ ID NO: 88980 - DNA, 25 bp, Rattus norvegicus
acgacagcctgtgcatcaaaacttg

SEQ ID NO: 88981 - DNA, 25 bp, Rattus norvegicus
acgacagcgactccgaggagcccgt

SEQ ID NO: 88982 - DNA, 25 bp, Rattus norvegicus
acgacagcgactgcgaggagcccgt

SEQ ID NO: 88983 - DNA, 25 bp, Rattus norvegicus
acgacagctctgagtttgtgttggt

SEQ ID NO: 88984 - DNA, 25 bp, Rattus norvegicus
acgacagctctgtgtttgtgttggt

SEQ ID NO: 88985 - DNA, 25 bp, Rattus norvegicus
acgacaggcatgaagacgcagacat

SEQ ID NO: 88986 - DNA, 25 bp, Rattus norvegicus
acgacaggcatgtagacgcagacat

SEQ ID NO: 88987 - DNA, 25 bp, Rattus norvegicus
acgacagtacaacagacgagatgac

SEQ ID NO: 88988 - DNA, 25 bp, Rattus norvegicus
acgacagtacaagagacgagatgac

SEQ ID NO: 88989 - DNA, 25 bp, Rattus norvegicus
acgacagtgctgaggactctctcat

SEQ ID NO: 88990 - DNA, 25 bp, Rattus norvegicus
acgacagtgctgtggactctctcat

SEQ ID NO: 88991 - DNA, 25 bp, Rattus norvegicus
acgacatgagatactaccatcccag

SEQ ID NO: 88992 - DNA, 25 bp, Rattus norvegicus
acgacatgagattctaccatcccag

SEQ ID NO: 88993 - DNA, 25 bp, Rattus norvegicus
acgacatgatccctgcgcagaagta

SEQ ID NO: 88994 - DNA, 25 bp, Rattus norvegicus
acgacatgatccgtgcgcagaagta

SEQ ID NO: 88995 - DNA, 25 bp, Rattus norvegicus
acgacatttacaacttcttctctcc

SEQ ID NO: 88996 - DNA, 25 bp, Rattus norvegicus
acgacatttacatcttcttctctcc

SEQ ID NO: 88997 - DNA, 25 bp, Rattus norvegicus
acgaccacacctagacctacggaat

SEQ ID NO: 88998 - DNA, 25 bp, Rattus norvegicus
acgaccacaccttgacctacggaat

SEQ ID NO: 88999 - DNA, 25 bp, Rattus norvegicus
acgaccacgatacagttggcaggat

SEQ ID NO: 89000 - DNA, 25 bp, Rattus norvegicus
acgaccacgatagagttggcaggat

SEQ ID NO: 89001 - DNA, 25 bp, Rattus norvegicus
acgaccactgccctcagaatgttgg

SEQ ID NO: 89002 - DNA, 25 bp, Rattus norvegicus
acgaccactgccgtcagaatgttgg

SEQ ID NO: 89003 - DNA, 25 bp, Rattus norvegicus
acgaccactgtgcacagcgattcga

SEQ ID NO: 89004 - DNA, 25 bp, Rattus norvegicus
acgaccactgtggacagcgattcga

SEQ ID NO: 89005 - DNA, 25 bp, Rattus norvegicus
acgaccagagtgcttcagcttgttt

SEQ ID NO: 89006 - DNA, 25 bp, Rattus norvegicus
acgaccagagtggttcagcttgttt

SEQ ID NO: 89007 - DNA, 25 bp, Rattus norvegicus
acgaccagtttactatccatttgat

SEQ ID NO: 89008 - DNA, 25 bp, Rattus norvegicus
acgaccagtttagtatccatttgat

SEQ ID NO: 89009 - DNA, 25 bp, Rattus norvegicus
acgaccattccccatgattgatgag

SEQ ID NO: 89010 - DNA, 25 bp, Rattus norvegicus
acgaccattcccgatgattgatgag

SEQ ID NO: 89011 - DNA, 25 bp, Rattus norvegicus
acgaccattgccaaggacatcatga

SEQ ID NO: 89012 - DNA, 25 bp, Rattus norvegicus
acgaccattgcctaggacatcatga

SEQ ID NO: 89013 - DNA, 25 bp, Rattus norvegicus
acgacccaccggacagctgtgtagg

SEQ ID NO: 89014 - DNA, 25 bp, Rattus norvegicus
acgacccaccggtcagctgtgtagg

SEQ ID NO: 89015 - DNA, 25 bp, Rattus norvegicus
acgacccttcctagtctgaggatgt

SEQ ID NO: 89016 - DNA, 25 bp, Rattus norvegicus
acgacccttccttgtctgaggatgt

SEQ ID NO: 89017 - DNA, 25 bp, Rattus norvegicus
acgaccgctacaaccttgctgaggg

SEQ ID NO: 89018 - DNA, 25 bp, Rattus norvegicus
acgaccgctacatccttgctgaggg

SEQ ID NO: 89019 - DNA, 25 bp, Rattus norvegicus
acgaccgtacatctgactctatggg

SEQ ID NO: 89020 - DNA, 25 bp, Rattus norvegicus
acgaccgtacatgtgactctatggg

SEQ ID NO: 89021 - DNA, 25 bp, Rattus norvegicus
acgaccgtcgagagtttgccaagtt

SEQ ID NO: 89022 - DNA, 25 bp, Rattus norvegicus
acgaccgtcgagtgtttgccaagtt

SEQ ID NO: 89023 - DNA, 25 bp, Rattus norvegicus
acgacctaacgcaacgcattgggag

SEQ ID NO: 89024 - DNA, 25 bp, Rattus norvegicus
acgacctaacgctacgcattgggag

SEQ ID NO: 89025 - DNA, 25 bp, Rattus norvegicus
acgacctacaggaagctttactata

SEQ ID NO: 89026 - DNA, 25 bp, Rattus norvegicus
acgacctacaggtagctttactata

SEQ ID NO: 89027 - DNA, 25 bp, Rattus norvegicus
acgacctcctgcagttgaacgagat

SEQ ID NO: 89028 - DNA, 25 bp, Rattus norvegicus
acgacctcctgctgttgaacgagat

SEQ ID NO: 89029 - DNA, 25 bp, Rattus norvegicus
acgacctctgtcagaatgtacttga

SEQ ID NO: 89030 - DNA, 25 bp, Rattus norvegicus
acgacctctgtctgaatgtacttga

SEQ ID NO: 89031 - DNA, 25 bp, Rattus norvegicus
acgacctgggtgagcgtatctcctg

SEQ ID NO: 89032 - DNA, 25 bp, Rattus norvegicus
acgacctgggtgtgcgtatctcctg

SEQ ID NO: 89033 - DNA, 25 bp, Rattus norvegicus
acgaccttagaccatttgaatctgt

SEQ ID NO: 89034 - DNA, 25 bp, Rattus norvegicus
acgaccttagacgatttgaatctgt

SEQ ID NO: 89035 - DNA, 25 bp, Rattus norvegicus
acgaccttgtagagatgctaccagg

SEQ ID NO: 89036 - DNA, 25 bp, Rattus norvegicus
acgaccttgtagtgatgctaccagg

SEQ ID NO: 89037 - DNA, 25 bp, Rattus norvegicus
acgaccttgttcaggctgaggacga

SEQ ID NO: 89038 - DNA, 25 bp, Rattus norvegicus
acgaccttgttctggctgaggacga

SEQ ID NO: 89039 - DNA, 25 bp, Rattus norvegicus
acgacctttgaaatgtgcctactaa

SEQ ID NO: 89040 - DNA, 25 bp, Rattus norvegicus
acgacctttgaattgtgcctactaa

SEQ ID NO: 89041 - DNA, 25 bp, Rattus norvegicus
acgacgacacggaggaggcagcagc

SEQ ID NO: 89042 - DNA, 25 bp, Rattus norvegicus
acgacgacacggtggaggcagcagc

SEQ ID NO: 89043 - DNA, 25 bp, Rattus norvegicus
acgacgacactaaccttcagatgtt

SEQ ID NO: 89044 - DNA, 25 bp, Rattus norvegicus
acgacgacactatccttcagatgtt

SEQ ID NO: 89045 - DNA, 25 bp, Rattus norvegicus
acgacgactccaaggtgggctttga

SEQ ID NO: 89046 - DNA, 25 bp, Rattus norvegicus
acgacgactccatggtgggctttga

SEQ ID NO: 89047 - DNA, 25 bp, Rattus norvegicus
acgacgccggcgagtttgtggacct

SEQ ID NO: 89048 - DNA, 25 bp, Rattus norvegicus
acgacgccggcgtgtttgtggacct

SEQ ID NO: 89049 - DNA, 25 bp, Rattus norvegicus
acgacgcctcttattgcccctatct

SEQ ID NO: 89050 - DNA, 25 bp, Rattus norvegicus
acgacgcctctttttgcccctatct

SEQ ID NO: 89051 - DNA, 25 bp, Rattus norvegicus
acgacgctgcgtagtgtacctggta

SEQ ID NO: 89052 - DNA, 25 bp, Rattus norvegicus
acgacgctgcgttgtgtacctggta

SEQ ID NO: 89053 - DNA, 25 bp, Rattus norvegicus
acgacgctgttcatagttcactaat

SEQ ID NO: 89054 - DNA, 25 bp, Rattus norvegicus
acgacgctgttcttagttcactaat

SEQ ID NO: 89055 - DNA, 25 bp, Rattus norvegicus
acgacggacatgagatcaccctgta

SEQ ID NO: 89056 - DNA, 25 bp, Rattus norvegicus
acgacggacatgtgatcaccctgta

SEQ ID NO: 89057 - DNA, 25 bp, Rattus norvegicus
acgacggctttcagatgtacctaga

SEQ ID NO: 89058 - DNA, 25 bp, Rattus norvegicus
acgacggctttctgatgtacctaga

SEQ ID NO: 89059 - DNA, 25 bp, Rattus norvegicus
acgacgggcccacagcaagagacct

SEQ ID NO: 89060 - DNA, 25 bp, Rattus norvegicus
acgacgggcccagagcaagagacct

SEQ ID NO: 89061 - DNA, 25 bp, Rattus norvegicus
acgacgtaccacctactgaggcggc

SEQ ID NO: 89062 - DNA, 25 bp, Rattus norvegicus
acgacgtaccacgtactgaggcggc

SEQ ID NO: 89063 - DNA, 25 bp, Rattus norvegicus
acgactaaagctcagctgtcaccca

SEQ ID NO: 89064 - DNA, 25 bp, Rattus norvegicus
acgactaaagctgagctgtcaccca

SEQ ID NO: 89065 - DNA, 25 bp, Rattus norvegicus
acgactacattgcattacctgaaat

SEQ ID NO: 89066 - DNA, 25 bp, Rattus norvegicus
acgactacattggattacctgaaat

SEQ ID NO: 89067 - DNA, 25 bp, Rattus norvegicus
acgactactacaaagtttgcctctt

SEQ ID NO: 89068 - DNA, 25 bp, Rattus norvegicus
acgactactacatagtttgcctctt

SEQ ID NO: 89069 - DNA, 25 bp, Rattus norvegicus
acgactatattccatgtctattaag

SEQ ID NO: 89070 - DNA, 25 bp, Rattus norvegicus
acgactatattcgatgtctattaag

SEQ ID NO: 89071 - DNA, 25 bp, Rattus norvegicus
acgactcaagccctttgtacgtgca

SEQ ID NO: 89072 - DNA, 25 bp, Rattus norvegicus
acgactcaagccgtttgtacgtgca

SEQ ID NO: 89073 - DNA, 25 bp, Rattus norvegicus
acgactcagactccaacatcatatt

SEQ ID NO: 89074 - DNA, 25 bp, Rattus norvegicus
acgactcagactgcaacatcatatt

SEQ ID NO: 89075 - DNA, 25 bp, Rattus norvegicus
acgactccagaacacagcggtgctc

SEQ ID NO: 89076 - DNA, 25 bp, Rattus norvegicus
acgactccagaagacagcggtgctc

SEQ ID NO: 89077 - DNA, 25 bp, Rattus norvegicus
acgactcgagtcctgtaatagcact

SEQ ID NO: 89078 - DNA, 25 bp, Rattus norvegicus
acgactcgagtcgtgtaatagcact

SEQ ID NO: 89079 - DNA, 25 bp, Rattus norvegicus
acgactcggccactagcagggcgta

SEQ ID NO: 89080 - DNA, 25 bp, Rattus norvegicus
acgactcggccagtagcagggcgta

SEQ ID NO: 89081 - DNA, 25 bp, Rattus norvegicus
acgactcgtgacaatgtaccaaaat

SEQ ID NO: 89082 - DNA, 25 bp, Rattus norvegicus
acgactcgtgactatgtaccaaaat

SEQ ID NO: 89083 - DNA, 25 bp, Rattus norvegicus
acgactctgctacggttcatggaaa

SEQ ID NO: 89084 - DNA, 25 bp, Rattus norvegicus
acgactctgctagggttcatggaaa

SEQ ID NO: 89085 - DNA, 25 bp, Rattus norvegicus
acgactgaccacacacttggtaaaa

SEQ ID NO: 89086 - DNA, 25 bp, Rattus norvegicus
acgactgaccactcacttggtaaaa

SEQ ID NO: 89087 - DNA, 25 bp, Rattus norvegicus
acgactgagcgcagcttggagaata

SEQ ID NO: 89088 - DNA, 25 bp, Rattus norvegicus
acgactgagcgctgcttggagaata

SEQ ID NO: 89089 - DNA, 25 bp, Rattus norvegicus
acgactgcacagatgtctctggcct

SEQ ID NO: 89090 - DNA, 25 bp, Rattus norvegicus
acgactgcacagttgtctctggcct

SEQ ID NO: 89091 - DNA, 25 bp, Rattus norvegicus
acgactgctatgctggccccagagg

SEQ ID NO: 89092 - DNA, 25 bp, Rattus norvegicus
acgactgctatggtggccccagagg

SEQ ID NO: 89093 - DNA, 25 bp, Rattus norvegicus
acgactgctcgtctagaactcaaag

SEQ ID NO: 89094 - DNA, 25 bp, Rattus norvegicus
acgactgctcgtgtagaactcaaag

SEQ ID NO: 89095 - DNA, 25 bp, Rattus norvegicus
acgactgctgcaccaaaggctggaa

SEQ ID NO: 89096 - DNA, 25 bp, Rattus norvegicus
acgactgctgcagcaaaggctggaa

SEQ ID NO: 89097 - DNA, 25 bp, Rattus norvegicus
acgactgctgccattcatttataat

SEQ ID NO: 89098 - DNA, 25 bp, Rattus norvegicus
acgactgctgcctttcatttataat

SEQ ID NO: 89099 - DNA, 25 bp, Rattus norvegicus
acgactggcttgaactgcttgtggc

SEQ ID NO: 89100 - DNA, 25 bp, Rattus norvegicus
acgactggcttgtactgcttgtggc

SEQ ID NO: 89101 - DNA, 25 bp, Rattus norvegicus
acgactggtaatcttctgcagctca

SEQ ID NO: 89102 - DNA, 25 bp, Rattus norvegicus
acgactggtaatgttctgcagctca

SEQ ID NO: 89103 - DNA, 25 bp, Rattus norvegicus
acgactgtacagattggtgactcat

SEQ ID NO: 89104 - DNA, 25 bp, Rattus norvegicus
acgactgtacagtttggtgactcat

SEQ ID NO: 89105 - DNA, 25 bp, Rattus norvegicus
acgactgtaggtcctaaggcttcac

SEQ ID NO: 89106 - DNA, 25 bp, Rattus norvegicus
acgactgtaggtgctaaggcttcac

SEQ ID NO: 89107 - DNA, 25 bp, Rattus norvegicus
acgactgtgacaccctgacgtggga

SEQ ID NO: 89108 - DNA, 25 bp, Rattus norvegicus
acgactgtgacagcctgacgtggga

SEQ ID NO: 89109 - DNA, 25 bp, Rattus norvegicus
acgactgttacaagttcgccgtctc

SEQ ID NO: 89110 - DNA, 25 bp, Rattus norvegicus
acgactgttacatgttcgccgtctc

SEQ ID NO: 89111 - DNA, 25 bp, Rattus norvegicus
acgactgttcttcagccaatgtaca

SEQ ID NO: 89112 - DNA, 25 bp, Rattus norvegicus
acgactgttcttgagccaatgtaca

SEQ ID NO: 89113 - DNA, 25 bp, Rattus norvegicus
acgactgtttccatacgttctgtgg

SEQ ID NO: 89114 - DNA, 25 bp, Rattus norvegicus
acgactgtttccttacgttctgtgg

SEQ ID NO: 89115 - DNA, 25 bp, Rattus norvegicus
acgacttatgtcaccttgaatcctg

SEQ ID NO: 89116 - DNA, 25 bp, Rattus norvegicus
acgacttatgtctccttgaatcctg

SEQ ID NO: 89117 - DNA, 25 bp, Rattus norvegicus
acgacttattagatgagttctcttg

SEQ ID NO: 89118 - DNA, 25 bp, Rattus norvegicus
acgacttattagttgagttctcttg

SEQ ID NO: 89119 - DNA, 25 bp, Rattus norvegicus
acgacttccataattacgtctacga

SEQ ID NO: 89120 - DNA, 25 bp, Rattus norvegicus
acgacttccatatttacgtctacga

SEQ ID NO: 89121 - DNA, 25 bp, Rattus norvegicus
acgacttccggacgaacttgatcct

SEQ ID NO: 89122 - DNA, 25 bp, Rattus norvegicus
acgacttccggaggaacttgatcct

SEQ ID NO: 89123 - DNA, 25 bp, Rattus norvegicus
acgacttcctgcatgtttatcttga

SEQ ID NO: 89124 - DNA, 25 bp, Rattus norvegicus
acgacttcctgcttgtttatcttga

SEQ ID NO: 89125 - DNA, 25 bp, Rattus norvegicus
acgacttcgtggcacaatgccacca

SEQ ID NO: 89126 - DNA, 25 bp, Rattus norvegicus
acgacttcgtgggacaatgccacca

SEQ ID NO: 89127 - DNA, 25 bp, Rattus norvegicus
acgacttctctcaaacttgtgtgct

SEQ ID NO: 89128 - DNA, 25 bp, Rattus norvegicus
acgacttctctctaacttgtgtgct

SEQ ID NO: 89129 - DNA, 25 bp, Rattus norvegicus
acgacttgggtcaggtggaactgtc

SEQ ID NO: 89130 - DNA, 25 bp, Rattus norvegicus
acgacttgggtctggtggaactgtc

SEQ ID NO: 89131 - DNA, 25 bp, Rattus norvegicus
acgacttttcagaatcctaccgaga

SEQ ID NO: 89132 - DNA, 25 bp, Rattus norvegicus
acgacttttcagtatcctaccgaga

SEQ ID NO: 89133 - DNA, 25 bp, Rattus norvegicus
acgacttttgacaggagctttgtac

SEQ ID NO: 89134 - DNA, 25 bp, Rattus norvegicus
acgacttttgactggagctttgtac

SEQ ID NO: 89135 - DNA, 25 bp, Rattus norvegicus
acgagaaagcctagaagacccgcct

SEQ ID NO: 89136 - DNA, 25 bp, Rattus norvegicus
acgagaaagccttgaagacccgcct

SEQ ID NO: 89137 - DNA, 25 bp, Rattus norvegicus
acgagaacaaggaacatgcattatg

SEQ ID NO: 89138 - DNA, 25 bp, Rattus norvegicus
acgagaacaaggtacatgcattatg

SEQ ID NO: 89139 - DNA, 25 bp, Rattus norvegicus
acgagaacaatgacgcggccatcct

SEQ ID NO: 89140 - DNA, 25 bp, Rattus norvegicus
acgagaacaatgtcgcggccatcct

SEQ ID NO: 89141 - DNA, 25 bp, Rattus norvegicus
acgagaaccacgagtcgagcgacta

SEQ ID NO: 89142 - DNA, 25 bp, Rattus norvegicus
acgagaaccacgtgtcgagcgacta

SEQ ID NO: 89143 - DNA, 25 bp, Rattus norvegicus
acgagaaccagaccgcgactgtgtt

SEQ ID NO: 89144 - DNA, 25 bp, Rattus norvegicus
acgagaaccagagcgcgactgtgtt

SEQ ID NO: 89145 - DNA, 25 bp, Rattus norvegicus
acgagaacttctatacctatgccca

SEQ ID NO: 89146 - DNA, 25 bp, Rattus norvegicus
acgagaacttctttacctatgccca

SEQ ID NO: 89147 - DNA, 25 bp, Rattus norvegicus
acgagaagccaaatgtttttacaca

SEQ ID NO: 89148 - DNA, 25 bp, Rattus norvegicus
acgagaagccaattgtttttacaca

SEQ ID NO: 89149 - DNA, 25 bp, Rattus norvegicus
acgagaagtgatatctgtccctctt

SEQ ID NO: 89150 - DNA, 25 bp, Rattus norvegicus
acgagaagtgatttctgtccctctt

SEQ ID NO: 89151 - DNA, 25 bp, Rattus norvegicus
acgagaatcctcatcccgtgttttg

SEQ ID NO: 89152 - DNA, 25 bp, Rattus norvegicus
acgagaatcctcttcccgtgttttg

SEQ ID NO: 89153 - DNA, 25 bp, Rattus norvegicus
acgagaatggtactacatccctcca

SEQ ID NO: 89154 - DNA, 25 bp, Rattus norvegicus
acgagaatggtagtacatccctcca

SEQ ID NO: 89155 - DNA, 25 bp, Rattus norvegicus
acgagaatggtcatcagcgctgtaa

SEQ ID NO: 89156 - DNA, 25 bp, Rattus norvegicus
acgagaatggtcttcagcgctgtaa

SEQ ID NO: 89157 - DNA, 25 bp, Rattus norvegicus
acgagacaacccctcagggagacag

SEQ ID NO: 89158 - DNA, 25 bp, Rattus norvegicus
acgagacaacccgtcagggagacag

SEQ ID NO: 89159 - DNA, 25 bp, Rattus norvegicus
acgagacagttcattccttgctaga

SEQ ID NO: 89160 - DNA, 25 bp, Rattus norvegicus
acgagacagttctttccttgctaga

SEQ ID NO: 89161 - DNA, 25 bp, Rattus norvegicus
acgagaccacagaggttcctggcca

SEQ ID NO: 89162 - DNA, 25 bp, Rattus norvegicus
acgagaccacagtggttcctggcca

SEQ ID NO: 89163 - DNA, 25 bp, Rattus norvegicus
acgagaccctttattcatatcatga

SEQ ID NO: 89164 - DNA, 25 bp, Rattus norvegicus
acgagacccttttttcatatcatga

SEQ ID NO: 89165 - DNA, 25 bp, Rattus norvegicus
acgagacggcacaatgggataactt

SEQ ID NO: 89166 - DNA, 25 bp, Rattus norvegicus
acgagacggcactatgggataactt

SEQ ID NO: 89167 - DNA, 25 bp, Rattus norvegicus
acgagactctgcagtggtatcactg

SEQ ID NO: 89168 - DNA, 25 bp, Rattus norvegicus
acgagactctgctgtggtatcactg

SEQ ID NO: 89169 - DNA, 25 bp, Rattus norvegicus
acgagagacccgagttcgtcgccta

SEQ ID NO: 89170 - DNA, 25 bp, Rattus norvegicus
acgagagacccgtgttcgtcgccta

SEQ ID NO: 89171 - DNA, 25 bp, Rattus norvegicus
acgagagagagaccgattcccacca

SEQ ID NO: 89172 - DNA, 25 bp, Rattus norvegicus
acgagagagagagcgattcccacca

SEQ ID NO: 89173 - DNA, 25 bp, Rattus norvegicus
acgagagagcaaagcggccactggc

SEQ ID NO: 89174 - DNA, 25 bp, Rattus norvegicus
acgagagagcaatgcggccactggc

SEQ ID NO: 89175 - DNA, 25 bp, Rattus norvegicus
acgagagagcccctctgaatgggca

SEQ ID NO: 89176 - DNA, 25 bp, Rattus norvegicus
acgagagagcccgtctgaatgggca

SEQ ID NO: 89177 - DNA, 25 bp, Rattus norvegicus
acgagagcactaactcaagcagaag

SEQ ID NO: 89178 - DNA, 25 bp, Rattus norvegicus
acgagagcactatctcaagcagaag

SEQ ID NO: 89179 - DNA, 25 bp, Rattus norvegicus
acgagagcagccaagcaccccagag

SEQ ID NO: 89180 - DNA, 25 bp, Rattus norvegicus
acgagagcagcctagcaccccagag

SEQ ID NO: 89181 - DNA, 25 bp, Rattus norvegicus
acgagagcagctagacagcctggaa

SEQ ID NO: 89182 - DNA, 25 bp, Rattus norvegicus
acgagagcagcttgacagcctggaa

SEQ ID NO: 89183 - DNA, 25 bp, Rattus norvegicus
acgagagcatcaaccttgctcacgg

SEQ ID NO: 89184 - DNA, 25 bp, Rattus norvegicus
acgagagcatcatccttgctcacgg

SEQ ID NO: 89185 - DNA, 25 bp, Rattus norvegicus
acgagagctgcacccgcctgggatc

SEQ ID NO: 89186 - DNA, 25 bp, Rattus norvegicus
acgagagctgcagccgcctgggatc

SEQ ID NO: 89187 - DNA, 25 bp, Rattus norvegicus
acgagagctgtgaatatgccctggg

SEQ ID NO: 89188 - DNA, 25 bp, Rattus norvegicus
acgagagctgtgtatatgccctggg

SEQ ID NO: 89189 - DNA, 25 bp, Rattus norvegicus
acgagaggaacgagtccacgcgcca

SEQ ID NO: 89190 - DNA, 25 bp, Rattus norvegicus
acgagaggaacgtgtccacgcgcca

SEQ ID NO: 89191 - DNA, 25 bp, Rattus norvegicus
acgagaggcagcaaaacaggagctt

SEQ ID NO: 89192 - DNA, 25 bp, Rattus norvegicus
acgagaggcagctaaacaggagctt

SEQ ID NO: 89193 - DNA, 25 bp, Rattus norvegicus
acgagaggcatcatcttgtgctgct

SEQ ID NO: 89194 - DNA, 25 bp, Rattus norvegicus
acgagaggcatcttcttgtgctgct

SEQ ID NO: 89195 - DNA, 25 bp, Rattus norvegicus
acgagagggaagattacagaggcca

SEQ ID NO: 89196 - DNA, 25 bp, Rattus norvegicus
acgagagggaagtttacagaggcca

SEQ ID NO: 89197 - DNA, 25 bp, Rattus norvegicus
acgagagtcaccagccccgtcgttt

SEQ ID NO: 89198 - DNA, 25 bp, Rattus norvegicus
acgagagtcacctgccccgtcgttt

SEQ ID NO: 89199 - DNA, 25 bp, Rattus norvegicus
acgagagtcccacctgaccaagttc

SEQ ID NO: 89200 - DNA, 25 bp, Rattus norvegicus
acgagagtcccagctgaccaagttc

SEQ ID NO: 89201 - DNA, 25 bp, Rattus norvegicus
acgagagtctgaactgggaatccct

SEQ ID NO: 89202 - DNA, 25 bp, Rattus norvegicus
acgagagtctgatctgggaatccct

SEQ ID NO: 89203 - DNA, 25 bp, Rattus norvegicus
acgagatgttcgatcttttgtattc

SEQ ID NO: 89204 - DNA, 25 bp, Rattus norvegicus
acgagatgttcgttcttttgtattc

SEQ ID NO: 89205 - DNA, 25 bp, Rattus norvegicus
acgagattacatcggagcctctaaa

SEQ ID NO: 89206 - DNA, 25 bp, Rattus norvegicus
acgagattacatgggagcctctaaa

SEQ ID NO: 89207 - DNA, 25 bp, Rattus norvegicus
acgagattctttatcttttgtcagg

SEQ ID NO: 89208 - DNA, 25 bp, Rattus norvegicus
acgagattctttttcttttgtcagg

SEQ ID NO: 89209 - DNA, 25 bp, Rattus norvegicus
acgagattgcccctgtcaaagctaa

SEQ ID NO: 89210 - DNA, 25 bp, Rattus norvegicus
acgagattgcccgtgtcaaagctaa

SEQ ID NO: 89211 - DNA, 25 bp, Rattus norvegicus
acgagatttcctcgagccatgccga

SEQ ID NO: 89212 - DNA, 25 bp, Rattus norvegicus
acgagatttcctggagccatgccga

SEQ ID NO: 89213 - DNA, 25 bp, Rattus norvegicus
acgagatttggtatgccaggcagcc

SEQ ID NO: 89214 - DNA, 25 bp, Rattus norvegicus
acgagatttggtttgccaggcagcc

SEQ ID NO: 89215 - DNA, 25 bp, Rattus norvegicus
acgagcaaagatcagcatcccgtcc

SEQ ID NO: 89216 - DNA, 25 bp, Rattus norvegicus
acgagcaaagatgagcatcccgtcc

SEQ ID NO: 89217 - DNA, 25 bp, Rattus norvegicus
acgagcaatggtccgactgcttcct

SEQ ID NO: 89218 - DNA, 25 bp, Rattus norvegicus
acgagcaatggtgcgactgcttcct

SEQ ID NO: 89219 - DNA, 25 bp, Rattus norvegicus
acgagcagctgaaacgggccttgat

SEQ ID NO: 89220 - DNA, 25 bp, Rattus norvegicus
acgagcagctgatacgggccttgat

SEQ ID NO: 89221 - DNA, 25 bp, Rattus norvegicus
acgagcaggatgcacgattttccct

SEQ ID NO: 89222 - DNA, 25 bp, Rattus norvegicus
acgagcaggatggacgattttccct

SEQ ID NO: 89223 - DNA, 25 bp, Rattus norvegicus
acgagcagtgtgcaggcggcgagct

SEQ ID NO: 89224 - DNA, 25 bp, Rattus norvegicus
acgagcagtgtgctccacatcgtga

SEQ ID NO: 89225 - DNA, 25 bp, Rattus norvegicus
acgagcagtgtggaggcggcgagct

SEQ ID NO: 89226 - DNA, 25 bp, Rattus norvegicus
acgagcagtgtggtccacatcgtga

SEQ ID NO: 89227 - DNA, 25 bp, Rattus norvegicus
acgagcatgcccaacctaagagact

SEQ ID NO: 89228 - DNA, 25 bp, Rattus norvegicus
acgagcatgccctacctaagagact

SEQ ID NO: 89229 - DNA, 25 bp, Rattus norvegicus
acgagcatgctactgctgctgcaaa

SEQ ID NO: 89230 - DNA, 25 bp, Rattus norvegicus
acgagcatgctagtgctgctgcaaa

SEQ ID NO: 89231 - DNA, 25 bp, Rattus norvegicus
acgagcatgtctccttcacctttaa

SEQ ID NO: 89232 - DNA, 25 bp, Rattus norvegicus
acgagcatgtctgcttcacctttaa

SEQ ID NO: 89233 - DNA, 25 bp, Rattus norvegicus
acgagcattcgtctgcacttccagg

SEQ ID NO: 89234 - DNA, 25 bp, Rattus norvegicus
acgagcattcgtgtgcacttccagg

SEQ ID NO: 89235 - DNA, 25 bp, Rattus norvegicus
acgagccaaagccttgtacacctgg

SEQ ID NO: 89236 - DNA, 25 bp, Rattus norvegicus
acgagccaaagcgttgtacacctgg

SEQ ID NO: 89237 - DNA, 25 bp, Rattus norvegicus
acgagcccacctactgcttatgtaa

SEQ ID NO: 89238 - DNA, 25 bp, Rattus norvegicus
acgagcccaccttctgcttatgtaa

SEQ ID NO: 89239 - DNA, 25 bp, Rattus norvegicus
acgagcccagccctatagaaagcaa

SEQ ID NO: 89240 - DNA, 25 bp, Rattus norvegicus
acgagcccagccgtatagaaagcaa

SEQ ID NO: 89241 - DNA, 25 bp, Rattus norvegicus
acgagccccaagagcaaccaggagt

SEQ ID NO: 89242 - DNA, 25 bp, Rattus norvegicus
acgagccccaagtgcaaccaggagt

SEQ ID NO: 89243 - DNA, 25 bp, Rattus norvegicus
acgagccggtacatctcctggccgg

SEQ ID NO: 89244 - DNA, 25 bp, Rattus norvegicus
acgagccggtacttctcctggccgg

SEQ ID NO: 89245 - DNA, 25 bp, Rattus norvegicus
acgagcctcggtcaggttttgcttt

SEQ ID NO: 89246 - DNA, 25 bp, Rattus norvegicus
acgagcctcggtgaggttttgcttt

SEQ ID NO: 89247 - DNA, 25 bp, Rattus norvegicus
acgagcctctggctatgcctttggg

SEQ ID NO: 89248 - DNA, 25 bp, Rattus norvegicus
acgagcctctgggtatgcctttggg

SEQ ID NO: 89249 - DNA, 25 bp, Rattus norvegicus
acgagcctttgcaagtactagcaga

SEQ ID NO: 89250 - DNA, 25 bp, Rattus norvegicus
acgagcctttgctagtactagcaga

SEQ ID NO: 89251 - DNA, 25 bp, Rattus norvegicus
acgagcgactttcaccccgcgaggg

SEQ ID NO: 89252 - DNA, 25 bp, Rattus norvegicus
acgagcgactttgaccccgcgaggg

SEQ ID NO: 89253 - DNA, 25 bp, Rattus norvegicus
acgagcgagaggactacagaggcca

SEQ ID NO: 89254 - DNA, 25 bp, Rattus norvegicus
acgagcgagaggtctacagaggcca

SEQ ID NO: 89255 - DNA, 25 bp, Rattus norvegicus
acgagcgatacaagctgctgtgcgt

SEQ ID NO: 89256 - DNA, 25 bp, Rattus norvegicus
acgagcgatacatgctgctgtgcgt

SEQ ID NO: 89257 - DNA, 25 bp, Rattus norvegicus
acgagcgcacgtacttggcagtgaa

SEQ ID NO: 89258 - DNA, 25 bp, Rattus norvegicus
acgagcgcacgttcttggcagtgaa

SEQ ID NO: 89259 - DNA, 25 bp, Rattus norvegicus
acgagcgctgttatgctgtggctgt

SEQ ID NO: 89260 - DNA, 25 bp, Rattus norvegicus
acgagcgctgttttgctgtggctgt

SEQ ID NO: 89261 - DNA, 25 bp, Rattus norvegicus
acgagcgtgccgaggatattgtcac

SEQ ID NO: 89262 - DNA, 25 bp, Rattus norvegicus
acgagcgtgccgtggatattgtcac

SEQ ID NO: 89263 - DNA, 25 bp, Rattus norvegicus
acgagcgtggtgagtgcctcatcac

SEQ ID NO: 89264 - DNA, 25 bp, Rattus norvegicus
acgagcgtggtgtgtgcctcatcac

SEQ ID NO: 89265 - DNA, 25 bp, Rattus norvegicus
acgagcgttctaacagctgtgagct

SEQ ID NO: 89266 - DNA, 25 bp, Rattus norvegicus
acgagcgttctatcagctgtgagct

SEQ ID NO: 89267 - DNA, 25 bp, Rattus norvegicus
acgagctaagctccgtgaaattgag

SEQ ID NO: 89268 - DNA, 25 bp, Rattus norvegicus
acgagctaagctgcgtgaaattgag

SEQ ID NO: 89269 - DNA, 25 bp, Rattus norvegicus
acgagctaatagatgctttaagtaa

SEQ ID NO: 89270 - DNA, 25 bp, Rattus norvegicus
acgagctaatagttgctttaagtaa

SEQ ID NO: 89271 - DNA, 25 bp, Rattus norvegicus
acgagctagcggaccacattggctt

SEQ ID NO: 89272 - DNA, 25 bp, Rattus norvegicus
acgagctagcggtccacattggctt

SEQ ID NO: 89273 - DNA, 25 bp, Rattus norvegicus
acgagctcagtgacatcatgtagtg

SEQ ID NO: 89274 - DNA, 25 bp, Rattus norvegicus
acgagctcagtgtcatcatgtagtg

SEQ ID NO: 89275 - DNA, 25 bp, Rattus norvegicus
acgagctcatgaaccactgctggaa

SEQ ID NO: 89276 - DNA, 25 bp, Rattus norvegicus
acgagctcatgatccactgctggaa

SEQ ID NO: 89277 - DNA, 25 bp, Rattus norvegicus
acgagctcgacaccagtggcttaga

SEQ ID NO: 89278 - DNA, 25 bp, Rattus norvegicus
acgagctcgacagcagtggcttaga

SEQ ID NO: 89279 - DNA, 25 bp, Rattus norvegicus
acgagctcggtgacctagtaggtaa

SEQ ID NO: 89280 - DNA, 25 bp, Rattus norvegicus
acgagctcggtgtcctagtaggtaa

SEQ ID NO: 89281 - DNA, 25 bp, Rattus norvegicus
acgagctctatgagagtttccgcca

SEQ ID NO: 89282 - DNA, 25 bp, Rattus norvegicus
acgagctctatgtgagtttccgcca

SEQ ID NO: 89283 - DNA, 25 bp, Rattus norvegicus
acgagctctcaacgacaagcagatg

SEQ ID NO: 89284 - DNA, 25 bp, Rattus norvegicus
acgagctctcaaggacaagcagatg

SEQ ID NO: 89285 - DNA, 25 bp, Rattus norvegicus
acgagctgatggacccggcctgctt

SEQ ID NO: 89286 - DNA, 25 bp, Rattus norvegicus
acgagctgatggtcccggcctgctt

SEQ ID NO: 89287 - DNA, 25 bp, Rattus norvegicus
acgagctgctttacaaagaaatcga

SEQ ID NO: 89288 - DNA, 25 bp, Rattus norvegicus
acgagctgcttttcaaagaaatcga

SEQ ID NO: 89289 - DNA, 25 bp, Rattus norvegicus
acgagcttctgtctacaccggcgtg

SEQ ID NO: 89290 - DNA, 25 bp, Rattus norvegicus
acgagcttctgtgtacaccggcgtg

SEQ ID NO: 89291 - DNA, 25 bp, Rattus norvegicus
acgagcttgtgactcagtaccggat

SEQ ID NO: 89292 - DNA, 25 bp, Rattus norvegicus
acgagcttgtgagtcagtaccggat

SEQ ID NO: 89293 - DNA, 25 bp, Rattus norvegicus
acgagcttttacagcagcgcgggca

SEQ ID NO: 89294 - DNA, 25 bp, Rattus norvegicus
acgagcttttactgcagcgcgggca

SEQ ID NO: 89295 - DNA, 25 bp, Rattus norvegicus
acgaggacaaagcacactggctgct

SEQ ID NO: 89296 - DNA, 25 bp, Rattus norvegicus
acgaggacaaaggacactggctgct

SEQ ID NO: 89297 - DNA, 25 bp, Rattus norvegicus
acgaggacatttacagctgcccaga

SEQ ID NO: 89298 - DNA, 25 bp, Rattus norvegicus
acgaggacattttcagctgcccaga

SEQ ID NO: 89299 - DNA, 25 bp, Rattus norvegicus
acgaggaccgatcttgaccgatctt

SEQ ID NO: 89300 - DNA, 25 bp, Rattus norvegicus
acgaggaccgatgttgaccgatctt

SEQ ID NO: 89301 - DNA, 25 bp, Rattus norvegicus
acgaggactcagaagcactggagga

SEQ ID NO: 89302 - DNA, 25 bp, Rattus norvegicus
acgaggactcagtagcactggagga

SEQ ID NO: 89303 - DNA, 25 bp, Rattus norvegicus
acgaggactctgaagccaactggca

SEQ ID NO: 89304 - DNA, 25 bp, Rattus norvegicus
acgaggactctgtagccaactggca

SEQ ID NO: 89305 - DNA, 25 bp, Rattus norvegicus
acgaggactgtgaggtcatagcaga

SEQ ID NO: 89306 - DNA, 25 bp, Rattus norvegicus
acgaggactgtgtggtcatagcaga

SEQ ID NO: 89307 - DNA, 25 bp, Rattus norvegicus
acgaggagaataaatgccactcttg

SEQ ID NO: 89308 - DNA, 25 bp, Rattus norvegicus
acgaggagaatatatgccactcttg

SEQ ID NO: 89309 - DNA, 25 bp, Rattus norvegicus
acgaggatatttatcattgtacaag

SEQ ID NO: 89310 - DNA, 25 bp, Rattus norvegicus
acgaggatatttttcattgtacaag

SEQ ID NO: 89311 - DNA, 25 bp, Rattus norvegicus
acgaggatctagagctggacagttt

SEQ ID NO: 89312 - DNA, 25 bp, Rattus norvegicus
acgaggatctagtgctggacagttt

SEQ ID NO: 89313 - DNA, 25 bp, Rattus norvegicus
acgaggatgctcaccggactcttat

SEQ ID NO: 89314 - DNA, 25 bp, Rattus norvegicus
acgaggatgctctccggactcttat

SEQ ID NO: 89315 - DNA, 25 bp, Rattus norvegicus
acgaggcagcttatgttgccatgat

SEQ ID NO: 89316 - DNA, 25 bp, Rattus norvegicus
acgaggcagcttttgttgccatgat

SEQ ID NO: 89317 - DNA, 25 bp, Rattus norvegicus
acgaggcagtggcaattcctgagta

SEQ ID NO: 89318 - DNA, 25 bp, Rattus norvegicus
acgaggcagtgggaattcctgagta

SEQ ID NO: 89319 - DNA, 25 bp, Rattus norvegicus
acgaggccaagacactgcgcgcgct

SEQ ID NO: 89320 - DNA, 25 bp, Rattus norvegicus
acgaggccaagagactgcgcgcgct

SEQ ID NO: 89321 - DNA, 25 bp, Rattus norvegicus
acgaggccagctcagttatagcgca

SEQ ID NO: 89322 - DNA, 25 bp, Rattus norvegicus
acgaggccagctgagttatagcgca

SEQ ID NO: 89323 - DNA, 25 bp, Rattus norvegicus
acgaggcctggaaactaagtgagca

SEQ ID NO: 89324 - DNA, 25 bp, Rattus norvegicus
acgaggcctggatactaagtgagca

SEQ ID NO: 89325 - DNA, 25 bp, Rattus norvegicus
acgagggaatttctacatcactggg

SEQ ID NO: 89326 - DNA, 25 bp, Rattus norvegicus
acgagggaatttgtacatcactggg

SEQ ID NO: 89327 - DNA, 25 bp, Rattus norvegicus
acgagggactgcctgccgctacatt

SEQ ID NO: 89328 - DNA, 25 bp, Rattus norvegicus
acgagggactgcgtgccgctacatt

SEQ ID NO: 89329 - DNA, 25 bp, Rattus norvegicus
acgagggcatttaccaggagcgcct

SEQ ID NO: 89330 - DNA, 25 bp, Rattus norvegicus
acgagggcattttccaggagcgcct

SEQ ID NO: 89331 - DNA, 25 bp, Rattus norvegicus
acgagggctcaacatctatgcgatg

SEQ ID NO: 89332 - DNA, 25 bp, Rattus norvegicus
acgagggctcaagatctatgcgatg

SEQ ID NO: 89333 - DNA, 25 bp, Rattus norvegicus
acgagggctctgagaatgcagtcaa

SEQ ID NO: 89334 - DNA, 25 bp, Rattus norvegicus
acgagggctctgtgaatgcagtcaa

SEQ ID NO: 89335 - DNA, 25 bp, Rattus norvegicus
acgagggtagcgacctaagcgcaca

SEQ ID NO: 89336 - DNA, 25 bp, Rattus norvegicus
acgagggtagcgtcctaagcgcaca

SEQ ID NO: 89337 - DNA, 25 bp, Rattus norvegicus
acgagggtcgcccactgtgtgaaaa

SEQ ID NO: 89338 - DNA, 25 bp, Rattus norvegicus
acgagggtcgccgactgtgtgaaaa

SEQ ID NO: 89339 - DNA, 25 bp, Rattus norvegicus
acgagggtgaccagcagacccagga

SEQ ID NO: 89340 - DNA, 25 bp, Rattus norvegicus
acgagggtgacctgcagacccagga

SEQ ID NO: 89341 - DNA, 25 bp, Rattus norvegicus
acgagggtgagaacgccgtcttccc

SEQ ID NO: 89342 - DNA, 25 bp, Rattus norvegicus
acgagggtgagatcgccgtcttccc

SEQ ID NO: 89343 - DNA, 25 bp, Rattus norvegicus
acgagggttcccagaaggctcttct

SEQ ID NO: 89344 - DNA, 25 bp, Rattus norvegicus
acgagggttccctgaaggctcttct

SEQ ID NO: 89345 - DNA, 25 bp, Rattus norvegicus
acgaggtatcttacttattcttaca

SEQ ID NO: 89346 - DNA, 25 bp, Rattus norvegicus
acgaggtatctttcttattcttaca

SEQ ID NO: 89347 - DNA, 25 bp, Rattus norvegicus
acgaggtgacagcttggcgtccatt

SEQ ID NO: 89348 - DNA, 25 bp, Rattus norvegicus
acgaggtgacaggttggcgtccatt

SEQ ID NO: 89349 - DNA, 25 bp, Rattus norvegicus
acgaggtgaggtactgccagtcttt

SEQ ID NO: 89350 - DNA, 25 bp, Rattus norvegicus
acgaggtgaggttctgccagtcttt

SEQ ID NO: 89351 - DNA, 25 bp, Rattus norvegicus
acgaggtggtcaacgtctggaccca

SEQ ID NO: 89352 - DNA, 25 bp, Rattus norvegicus
acgaggtggtcatcgtctggaccca

SEQ ID NO: 89353 - DNA, 25 bp, Rattus norvegicus
acgaggtgtcctaggtgagtgcaaa

SEQ ID NO: 89354 - DNA, 25 bp, Rattus norvegicus
acgaggtgtccttggtgagtgcaaa

SEQ ID NO: 89355 - DNA, 25 bp, Rattus norvegicus
acgaggtgtctcctcctatctgatc

SEQ ID NO: 89356 - DNA, 25 bp, Rattus norvegicus
acgaggtgtctcgtcctatctgatc

SEQ ID NO: 89357 - DNA, 25 bp, Rattus norvegicus
acgagtacatcgaggacctcatgtt

SEQ ID NO: 89358 - DNA, 25 bp, Rattus norvegicus
acgagtacatcgtggacctcatgtt

SEQ ID NO: 89359 - DNA, 25 bp, Rattus norvegicus
acgagtatcgcaatttattttctaa

SEQ ID NO: 89360 - DNA, 25 bp, Rattus norvegicus
acgagtatcgcattttattttctaa

SEQ ID NO: 89361 - DNA, 25 bp, Rattus norvegicus
acgagtccgttaagtgtatgtcaca

SEQ ID NO: 89362 - DNA, 25 bp, Rattus norvegicus
acgagtccgttatgtgtatgtcaca

SEQ ID NO: 89363 - DNA, 25 bp, Rattus norvegicus
acgagtcctcagacacgcagagtga

SEQ ID NO: 89364 - DNA, 25 bp, Rattus norvegicus
acgagtcctcagtcacgcagagtga

SEQ ID NO: 89365 - DNA, 25 bp, Rattus norvegicus
acgagtcctgataggagctaggtgt

SEQ ID NO: 89366 - DNA, 25 bp, Rattus norvegicus
acgagtcctgattggagctaggtgt

SEQ ID NO: 89367 - DNA, 25 bp, Rattus norvegicus
acgagtccttctcgctaatttttag

SEQ ID NO: 89368 - DNA, 25 bp, Rattus norvegicus
acgagtccttctggctaatttttag

SEQ ID NO: 89369 - DNA, 25 bp, Rattus norvegicus
acgagtctcaatcaaagtctgttct

SEQ ID NO: 89370 - DNA, 25 bp, Rattus norvegicus
acgagtctcaatgaaagtctgttct

SEQ ID NO: 89371 - DNA, 25 bp, Rattus norvegicus
acgagtctccgtattctgaacagaa

SEQ ID NO: 89372 - DNA, 25 bp, Rattus norvegicus
acgagtctccgttttctgaacagaa

SEQ ID NO: 89373 - DNA, 25 bp, Rattus norvegicus
acgagtgaagtcatgacctctctgc

SEQ ID NO: 89374 - DNA, 25 bp, Rattus norvegicus
acgagtgaagtcttgacctctctgc

SEQ ID NO: 89375 - DNA, 25 bp, Rattus norvegicus
acgagtgcaatgaggtcttcctgtt

SEQ ID NO: 89376 - DNA, 25 bp, Rattus norvegicus
acgagtgcaatgtggtcttcctgtt

SEQ ID NO: 89377 - DNA, 25 bp, Rattus norvegicus
acgagtgcccaaaccagctgtgttg

SEQ ID NO: 89378 - DNA, 25 bp, Rattus norvegicus
acgagtgcccaatccagctgtgttg

SEQ ID NO: 89379 - DNA, 25 bp, Rattus norvegicus
acgagtggcgttactacttcttcag

SEQ ID NO: 89380 - DNA, 25 bp, Rattus norvegicus
acgagtggcgtttctacttcttcag

SEQ ID NO: 89381 - DNA, 25 bp, Rattus norvegicus
acgagtgggcggcttgttgatttca

SEQ ID NO: 89382 - DNA, 25 bp, Rattus norvegicus
acgagtgggcgggttgttgatttca

SEQ ID NO: 89383 - DNA, 25 bp, Rattus norvegicus
acgagtgtgaatatgccgggttatt

SEQ ID NO: 89384 - DNA, 25 bp, Rattus norvegicus
acgagtgtgaatttgccgggttatt

SEQ ID NO: 89385 - DNA, 25 bp, Rattus norvegicus
acgagtgtgccgatactgctgcgta

SEQ ID NO: 89386 - DNA, 25 bp, Rattus norvegicus
acgagtgtgccgttactgctgcgta

SEQ ID NO: 89387 - DNA, 25 bp, Rattus norvegicus
acgagttcagatagagtcctctccc

SEQ ID NO: 89388 - DNA, 25 bp, Rattus norvegicus
acgagttcagattgagtcctctccc

SEQ ID NO: 89389 - DNA, 25 bp, Rattus norvegicus
acgagttcatgtcgctgcctgagct

SEQ ID NO: 89390 - DNA, 25 bp, Rattus norvegicus
acgagttcatgtggctgcctgagct

SEQ ID NO: 89391 - DNA, 25 bp, Rattus norvegicus
acgagttcgagtctggcatctctca

SEQ ID NO: 89392 - DNA, 25 bp, Rattus norvegicus
acgagttcgagtgtggcatctctca

SEQ ID NO: 89393 - DNA, 25 bp, Rattus norvegicus
acgagttcgtgcatccgttttcatg

SEQ ID NO: 89394 - DNA, 25 bp, Rattus norvegicus
acgagttcgtgcttccgttttcatg

SEQ ID NO: 89395 - DNA, 25 bp, Rattus norvegicus
acgagttctctgaggacatgacctg

SEQ ID NO: 89396 - DNA, 25 bp, Rattus norvegicus
acgagttctctgtggacatgacctg

SEQ ID NO: 89397 - DNA, 25 bp, Rattus norvegicus
acgagttctgccctttgcttaagaa

SEQ ID NO: 89398 - DNA, 25 bp, Rattus norvegicus
acgagttctgccgtttgcttaagaa

SEQ ID NO: 89399 - DNA, 25 bp, Rattus norvegicus
acgagtttctgtagccttgttctat

SEQ ID NO: 89400 - DNA, 25 bp, Rattus norvegicus
acgagtttctgttgccttgttctat

SEQ ID NO: 89401 - DNA, 25 bp, Rattus norvegicus
acgagtttgcatcatccacgtggct

SEQ ID NO: 89402 - DNA, 25 bp, Rattus norvegicus
acgagtttgcatgatccacgtggct

SEQ ID NO: 89403 - DNA, 25 bp, Rattus norvegicus
acgagtttttcactgtttgccattg

SEQ ID NO: 89404 - DNA, 25 bp, Rattus norvegicus
acgagtttttcagtgtttgccattg

SEQ ID NO: 89405 - DNA, 25 bp, Rattus norvegicus
acgataacttttctgccattgctag

SEQ ID NO: 89406 - DNA, 25 bp, Rattus norvegicus
acgataacttttgtgccattgctag

SEQ ID NO: 89407 - DNA, 25 bp, Rattus norvegicus
acgatacagagacttgggcggcttc

SEQ ID NO: 89408 - DNA, 25 bp, Rattus norvegicus
acgatacagagagttgggcggcttc

SEQ ID NO: 89409 - DNA, 25 bp, Rattus norvegicus
acgatagcaaacattctggtcctct

SEQ ID NO: 89410 - DNA, 25 bp, Rattus norvegicus
acgatagcaaactttctggtcctct

SEQ ID NO: 89411 - DNA, 25 bp, Rattus norvegicus
acgatagggttccaaagtctctggg

SEQ ID NO: 89412 - DNA, 25 bp, Rattus norvegicus
acgatagggttcgaaagtctctggg

SEQ ID NO: 89413 - DNA, 25 bp, Rattus norvegicus
acgatatatttcatggctgacctgt

SEQ ID NO: 89414 - DNA, 25 bp, Rattus norvegicus
acgatatatttcttggctgacctgt

SEQ ID NO: 89415 - DNA, 25 bp, Rattus norvegicus
acgatattaataacgccgccagcca

SEQ ID NO: 89416 - DNA, 25 bp, Rattus norvegicus
acgatattaatatcgccgccagcca

SEQ ID NO: 89417 - DNA, 25 bp, Rattus norvegicus
acgatcacgattccaactcagctag

SEQ ID NO: 89418 - DNA, 25 bp, Rattus norvegicus
acgatcacgattgcaactcagctag

SEQ ID NO: 89419 - DNA, 25 bp, Rattus norvegicus
acgatcagaaatacagccacttccc

SEQ ID NO: 89420 - DNA, 25 bp, Rattus norvegicus
acgatcagaaattcagccacttccc

SEQ ID NO: 89421 - DNA, 25 bp, Rattus norvegicus
acgatcagccataggcggtggagcc

SEQ ID NO: 89422 - DNA, 25 bp, Rattus norvegicus
acgatcagccattggcggtggagcc

SEQ ID NO: 89423 - DNA, 25 bp, Rattus norvegicus
acgatcagccttatgtatagagaaa

SEQ ID NO: 89424 - DNA, 25 bp, Rattus norvegicus
acgatcagccttttgtatagagaaa

SEQ ID NO: 89425 - DNA, 25 bp, Rattus norvegicus
acgatcagtttgcagtgggattcac

SEQ ID NO: 89426 - DNA, 25 bp, Rattus norvegicus
acgatcagtttggagtgggattcac

SEQ ID NO: 89427 - DNA, 25 bp, Rattus norvegicus
acgatcattcttaacgccactaaaa

SEQ ID NO: 89428 - DNA, 25 bp, Rattus norvegicus
acgatcattctttacgccactaaaa

SEQ ID NO: 89429 - DNA, 25 bp, Rattus norvegicus
acgatccagacaacgcacttaggca

SEQ ID NO: 89430 - DNA, 25 bp, Rattus norvegicus
acgatccagacatcgcacttaggca

SEQ ID NO: 89431 - DNA, 25 bp, Rattus norvegicus
acgatcccactgcagatgtgtttgt

SEQ ID NO: 89432 - DNA, 25 bp, Rattus norvegicus
acgatcccactggagatgtgtttgt

SEQ ID NO: 89433 - DNA, 25 bp, Rattus norvegicus
acgatcccggatccagtgactggtt

SEQ ID NO: 89434 - DNA, 25 bp, Rattus norvegicus
acgatcccggatgcagtgactggtt

SEQ ID NO: 89435 - DNA, 25 bp, Rattus norvegicus
acgatcctgtacatttcctgcagtg

SEQ ID NO: 89436 - DNA, 25 bp, Rattus norvegicus
acgatcctgtacttttcctgcagtg

SEQ ID NO: 89437 - DNA, 25 bp, Rattus norvegicus
acgatcggacccagcttgtagctga

SEQ ID NO: 89438 - DNA, 25 bp, Rattus norvegicus
acgatcggaccctgcttgtagctga

SEQ ID NO: 89439 - DNA, 25 bp, Rattus norvegicus
acgatctattagcaagtgctcccgc

SEQ ID NO: 89440 - DNA, 25 bp, Rattus norvegicus
acgatctattaggaagtgctcccgc

SEQ ID NO: 89441 - DNA, 25 bp, Rattus norvegicus
acgatctgggctctaacatccacct

SEQ ID NO: 89442 - DNA, 25 bp, Rattus norvegicus
acgatctgggctgtaacatccacct

SEQ ID NO: 89443 - DNA, 25 bp, Rattus norvegicus
acgatctgttctatgggttctatca

SEQ ID NO: 89444 - DNA, 25 bp, Rattus norvegicus
acgatctgttctttgggttctatca

SEQ ID NO: 89445 - DNA, 25 bp, Rattus norvegicus
acgatcttgccgacgggctggatca

SEQ ID NO: 89446 - DNA, 25 bp, Rattus norvegicus
acgatcttgccgtcgggctggatca

SEQ ID NO: 89447 - DNA, 25 bp, Rattus norvegicus
acgatcttggctctcagggcctggc

SEQ ID NO: 89448 - DNA, 25 bp, Rattus norvegicus
acgatcttggctgtcagggcctggc

SEQ ID NO: 89449 - DNA, 25 bp, Rattus norvegicus
acgatgacactgcaggaagacctca

SEQ ID NO: 89450 - DNA, 25 bp, Rattus norvegicus
acgatgacactggaggaagacctca

SEQ ID NO: 89451 - DNA, 25 bp, Rattus norvegicus
acgatgacatgtacctgtgaaggcc

SEQ ID NO: 89452 - DNA, 25 bp, Rattus norvegicus
acgatgacatgttcctgtgaaggcc

SEQ ID NO: 89453 - DNA, 25 bp, Rattus norvegicus
acgatgacgatgcttccgacagcga

SEQ ID NO: 89454 - DNA, 25 bp, Rattus norvegicus
acgatgacgatggttccgacagcga

SEQ ID NO: 89455 - DNA, 25 bp, Rattus norvegicus
acgatgactactctcatttttgtga

SEQ ID NO: 89456 - DNA, 25 bp, Rattus norvegicus
acgatgactactgtcatttttgtga

SEQ ID NO: 89457 - DNA, 25 bp, Rattus norvegicus
acgatgagagatccgatccagcctt

SEQ ID NO: 89458 - DNA, 25 bp, Rattus norvegicus
acgatgagagatgcgatccagcctt

SEQ ID NO: 89459 - DNA, 25 bp, Rattus norvegicus
acgatgagcggcaggttctcccgtt

SEQ ID NO: 89460 - DNA, 25 bp, Rattus norvegicus
acgatgagcggctggttctcccgtt

SEQ ID NO: 89461 - DNA, 25 bp, Rattus norvegicus
acgatgaggtcgctcagctcaggaa

SEQ ID NO: 89462 - DNA, 25 bp, Rattus norvegicus
acgatgaggtcggtcagctcaggaa

SEQ ID NO: 89463 - DNA, 25 bp, Rattus norvegicus
acgatgatcttgctgctccaggcag

SEQ ID NO: 89464 - DNA, 25 bp, Rattus norvegicus
acgatgatcttggtgctccaggcag

SEQ ID NO: 89465 - DNA, 25 bp, Rattus norvegicus
acgatgatgaggacctgaccccgga

SEQ ID NO: 89466 - DNA, 25 bp, Rattus norvegicus
acgatgatgaggtcctgaccccgga

SEQ ID NO: 89467 - DNA, 25 bp, Rattus norvegicus
acgatgatgccgatgatattactga

SEQ ID NO: 89468 - DNA, 25 bp, Rattus norvegicus
acgatgatgccgttgatattactga

SEQ ID NO: 89469 - DNA, 25 bp, Rattus norvegicus
acgatgatgtcgatgcctttgattt

SEQ ID NO: 89470 - DNA, 25 bp, Rattus norvegicus
acgatgatgtcgttgcctttgattt

SEQ ID NO: 89471 - DNA, 25 bp, Rattus norvegicus
acgatgattcagacgaggacctcct

SEQ ID NO: 89472 - DNA, 25 bp, Rattus norvegicus
acgatgattcagtcgaggacctcct

SEQ ID NO: 89473 - DNA, 25 bp, Rattus norvegicus
acgatgccaggcctgcctcaacaag

SEQ ID NO: 89474 - DNA, 25 bp, Rattus norvegicus
acgatgccaggcgtgcctcaacaag

SEQ ID NO: 89475 - DNA, 25 bp, Rattus norvegicus
acgatgcctattagaacagcccgag

SEQ ID NO: 89476 - DNA, 25 bp, Rattus norvegicus
acgatgcctatttgaacagcccgag

SEQ ID NO: 89477 - DNA, 25 bp, Rattus norvegicus
acgatgctaaatcccaccaggccag

SEQ ID NO: 89478 - DNA, 25 bp, Rattus norvegicus
acgatgctaaatgccaccaggccag

SEQ ID NO: 89479 - DNA, 25 bp, Rattus norvegicus
acgatgctgggacctctgagtgctc

SEQ ID NO: 89480 - DNA, 25 bp, Rattus norvegicus
acgatgctgggagctctgagtgctc

SEQ ID NO: 89481 - DNA, 25 bp, Rattus norvegicus
acgatggccacgatttgcgtgttcg

SEQ ID NO: 89482 - DNA, 25 bp, Rattus norvegicus
acgatggccacgttttgcgtgttcg

SEQ ID NO: 89483 - DNA, 25 bp, Rattus norvegicus
acgatggccatgagctccaagtcag

SEQ ID NO: 89484 - DNA, 25 bp, Rattus norvegicus
acgatggccatgtgctccaagtcag

SEQ ID NO: 89485 - DNA, 25 bp, Rattus norvegicus
acgatggctacgcagaggaccttat

SEQ ID NO: 89486 - DNA, 25 bp, Rattus norvegicus
acgatggctacggagaggaccttat

SEQ ID NO: 89487 - DNA, 25 bp, Rattus norvegicus
acgatggctcagagtgggcctgacc

SEQ ID NO: 89488 - DNA, 25 bp, Rattus norvegicus
acgatggctcagtgtgggcctgacc

SEQ ID NO: 89489 - DNA, 25 bp, Rattus norvegicus
acgatggtcatccttgtttgagtga

SEQ ID NO: 89490 - DNA, 25 bp, Rattus norvegicus
acgatggtcatcgttgtttgagtga

SEQ ID NO: 89491 - DNA, 25 bp, Rattus norvegicus
acgatggttgggagctgccatgtat

SEQ ID NO: 89492 - DNA, 25 bp, Rattus norvegicus
acgatggttgggtgctgccatgtat

SEQ ID NO: 89493 - DNA, 25 bp, Rattus norvegicus
acgatgtaatttccagtgtgactgc

SEQ ID NO: 89494 - DNA, 25 bp, Rattus norvegicus
acgatgtaatttgcagtgtgactgc

SEQ ID NO: 89495 - DNA, 25 bp, Rattus norvegicus
acgatgtcacgtattgccaagagct

SEQ ID NO: 89496 - DNA, 25 bp, Rattus norvegicus
acgatgtcacgttttgccaagagct

SEQ ID NO: 89497 - DNA, 25 bp, Rattus norvegicus
acgatgtcaggtagccgccaggccg

SEQ ID NO: 89498 - DNA, 25 bp, Rattus norvegicus
acgatgtcaggttgccgccaggccg

SEQ ID NO: 89499 - DNA, 25 bp, Rattus norvegicus
acgatgtcagttattgtccttccac

SEQ ID NO: 89500 - DNA, 25 bp, Rattus norvegicus
acgatgtcagtttttgtccttccac

SEQ ID NO: 89501 - DNA, 25 bp, Rattus norvegicus
acgatgtcatccattacactgcaag

SEQ ID NO: 89502 - DNA, 25 bp, Rattus norvegicus
acgatgtcatcctttacactgcaag

SEQ ID NO: 89503 - DNA, 25 bp, Rattus norvegicus
acgatgtccccaaggtgatagcgtg

SEQ ID NO: 89504 - DNA, 25 bp, Rattus norvegicus
acgatgtccccatggtgatagcgtg

SEQ ID NO: 89505 - DNA, 25 bp, Rattus norvegicus
acgatgtcgattagcggttccaaca

SEQ ID NO: 89506 - DNA, 25 bp, Rattus norvegicus
acgatgtcgatttgcggttccaaca

SEQ ID NO: 89507 - DNA, 25 bp, Rattus norvegicus
acgatgtgcctaccagaagggcttt

SEQ ID NO: 89508 - DNA, 25 bp, Rattus norvegicus
acgatgtgcctagcagaagggcttt

SEQ ID NO: 89509 - DNA, 25 bp, Rattus norvegicus
acgatgttctggagtcaatgtggaa

SEQ ID NO: 89510 - DNA, 25 bp, Rattus norvegicus
acgatgttctggtgtcaatgtggaa

SEQ ID NO: 89511 - DNA, 25 bp, Rattus norvegicus
acgatgttgccaagatgacctttcc

SEQ ID NO: 89512 - DNA, 25 bp, Rattus norvegicus
acgatgttgccatgatgacctttcc

SEQ ID NO: 89513 - DNA, 25 bp, Rattus norvegicus
acgatgtttatactccctgctggga

SEQ ID NO: 89514 - DNA, 25 bp, Rattus norvegicus
acgatgtttatagtccctgctggga

SEQ ID NO: 89515 - DNA, 25 bp, Rattus norvegicus
acgatgtttggtattatgcactttg

SEQ ID NO: 89516 - DNA, 25 bp, Rattus norvegicus
acgatgtttggttttatgcactttg

SEQ ID NO: 89517 - DNA, 25 bp, Rattus norvegicus
acgattagaggcctttgagccccat

SEQ ID NO: 89518 - DNA, 25 bp, Rattus norvegicus
acgattagaggcgtttgagccccat

SEQ ID NO: 89519 - DNA, 25 bp, Rattus norvegicus
acgattataactcgtcttcccatcc

SEQ ID NO: 89520 - DNA, 25 bp, Rattus norvegicus
acgattataactggtcttcccatcc

SEQ ID NO: 89521 - DNA, 25 bp, Rattus norvegicus
acgattcagaccagctggcgctgca

SEQ ID NO: 89522 - DNA, 25 bp, Rattus norvegicus
acgattcagacctgctggcgctgca

SEQ ID NO: 89523 - DNA, 25 bp, Rattus norvegicus
acgattcgacttcctgcatgtgaaa

SEQ ID NO: 89524 - DNA, 25 bp, Rattus norvegicus
acgattcgacttgctgcatgtgaaa

SEQ ID NO: 89525 - DNA, 25 bp, Rattus norvegicus
acgattctcactacccagttaaaga

SEQ ID NO: 89526 - DNA, 25 bp, Rattus norvegicus
acgattctcacttcccagttaaaga

SEQ ID NO: 89527 - DNA, 25 bp, Rattus norvegicus
acgattctcctgaagatgcctggaa

SEQ ID NO: 89528 - DNA, 25 bp, Rattus norvegicus
acgattctcctgtagatgcctggaa

SEQ ID NO: 89529 - DNA, 25 bp, Rattus norvegicus
acgattgctttcactactgctgtag

SEQ ID NO: 89530 - DNA, 25 bp, Rattus norvegicus
acgattgctttctctactgctgtag

SEQ ID NO: 89531 - DNA, 25 bp, Rattus norvegicus
acgattgggactcatgtttacatct

SEQ ID NO: 89532 - DNA, 25 bp, Rattus norvegicus
acgattgggactgatgtttacatct

SEQ ID NO: 89533 - DNA, 25 bp, Rattus norvegicus
acgattgtcattcctgtgtcttcca

SEQ ID NO: 89534 - DNA, 25 bp, Rattus norvegicus
acgattgtcattgctgtgtcttcca

SEQ ID NO: 89535 - DNA, 25 bp, Rattus norvegicus
acgattgtgtgtcttgttctttctc

SEQ ID NO: 89536 - DNA, 25 bp, Rattus norvegicus
acgattgtgtgtgttgttctttctc

SEQ ID NO: 89537 - DNA, 25 bp, Rattus norvegicus
acgatttagtgcatcggtctttaaa

SEQ ID NO: 89538 - DNA, 25 bp, Rattus norvegicus
acgatttagtgcttcggtctttaaa

SEQ ID NO: 89539 - DNA, 25 bp, Rattus norvegicus
acgatttggctaattttgttctcat

SEQ ID NO: 89540 - DNA, 25 bp, Rattus norvegicus
acgatttggctatttttgttctcat

SEQ ID NO: 89541 - DNA, 25 bp, Rattus norvegicus
acgattttcctccatgttgtaataa

SEQ ID NO: 89542 - DNA, 25 bp, Rattus norvegicus
acgattttcctcgatgttgtaataa

SEQ ID NO: 89543 - DNA, 25 bp, Rattus norvegicus
acgcaaaccagtacaccacatagat

SEQ ID NO: 89544 - DNA, 25 bp, Rattus norvegicus
acgcaaaccagttcaccacatagat

SEQ ID NO: 89545 - DNA, 25 bp, Rattus norvegicus
acgcaacagtaaatccttacacctt

SEQ ID NO: 89546 - DNA, 25 bp, Rattus norvegicus
acgcaacagtaattccttacacctt

SEQ ID NO: 89547 - DNA, 25 bp, Rattus norvegicus
acgcaaccaaccactaaaccaatga

SEQ ID NO: 89548 - DNA, 25 bp, Rattus norvegicus
acgcaaccaacctctaaaccaatga

SEQ ID NO: 89549 - DNA, 25 bp, Rattus norvegicus
acgcaaccctggctgcagagaatga

SEQ ID NO: 89550 - DNA, 25 bp, Rattus norvegicus
acgcaaccctgggtgcagagaatga

SEQ ID NO: 89551 - DNA, 25 bp, Rattus norvegicus
acgcaagcccttaggatcgtgagct

SEQ ID NO: 89552 - DNA, 25 bp, Rattus norvegicus
acgcaagccctttggatcgtgagct

SEQ ID NO: 89553 - DNA, 25 bp, Rattus norvegicus
acgcaaggagttccaggtcctgtac

SEQ ID NO: 89554 - DNA, 25 bp, Rattus norvegicus
acgcaaggagttgcaggtcctgtac

SEQ ID NO: 89555 - DNA, 25 bp, Rattus norvegicus
acgcaagggtgacatctccatctgt

SEQ ID NO: 89556 - DNA, 25 bp, Rattus norvegicus
acgcaagggtgagatctccatctgt

SEQ ID NO: 89557 - DNA, 25 bp, Rattus norvegicus
acgcaagtccgaaggcttcaaggta

SEQ ID NO: 89558 - DNA, 25 bp, Rattus norvegicus
acgcaagtccgatggcttcaaggta

SEQ ID NO: 89559 - DNA, 25 bp, Rattus norvegicus
acgcaagtcctcatcgtgtgcaaga

SEQ ID NO: 89560 - DNA, 25 bp, Rattus norvegicus
acgcaagtcctcttcgtgtgcaaga

SEQ ID NO: 89561 - DNA, 25 bp, Rattus norvegicus
acgcaagtgctcattaactgtcgaa

SEQ ID NO: 89562 - DNA, 25 bp, Rattus norvegicus
acgcaagtgctctttaactgtcgaa

SEQ ID NO: 89563 - DNA, 25 bp, Rattus norvegicus
acgcaatctctgaagtgctggtcta

SEQ ID NO: 89564 - DNA, 25 bp, Rattus norvegicus
acgcaatctctgtagtgctggtcta

SEQ ID NO: 89565 - DNA, 25 bp, Rattus norvegicus
acgcaatgcccgcacgtaacaggaa

SEQ ID NO: 89566 - DNA, 25 bp, Rattus norvegicus
acgcaatgcccggacgtaacaggaa

SEQ ID NO: 89567 - DNA, 25 bp, Rattus norvegicus
acgcaattttaccttcctcttgtag

SEQ ID NO: 89568 - DNA, 25 bp, Rattus norvegicus
acgcaattttacgttcctcttgtag

SEQ ID NO: 89569 - DNA, 25 bp, Rattus norvegicus
acgcacaagtacacatcgctctcag

SEQ ID NO: 89570 - DNA, 25 bp, Rattus norvegicus
acgcacaagtactcatcgctctcag

SEQ ID NO: 89571 - DNA, 25 bp, Rattus norvegicus
acgcacagagctcgtctgcagaata

SEQ ID NO: 89572 - DNA, 25 bp, Rattus norvegicus
acgcacagagctggtctgcagaata

SEQ ID NO: 89573 - DNA, 25 bp, Rattus norvegicus
acgcacagcgtaatgatggtcttta

SEQ ID NO: 89574 - DNA, 25 bp, Rattus norvegicus
acgcacagcgtattgatggtcttta

SEQ ID NO: 89575 - DNA, 25 bp, Rattus norvegicus
acgcacagggtgactctgaagcaca

SEQ ID NO: 89576 - DNA, 25 bp, Rattus norvegicus
acgcacagggtgtctctgaagcaca

SEQ ID NO: 89577 - DNA, 25 bp, Rattus norvegicus
acgcacagtgctcacacatatctca

SEQ ID NO: 89578 - DNA, 25 bp, Rattus norvegicus
acgcacagtgctgacacatatctca

SEQ ID NO: 89579 - DNA, 25 bp, Rattus norvegicus
acgcacattcttccacctaaagttt

SEQ ID NO: 89580 - DNA, 25 bp, Rattus norvegicus
acgcacattcttgcacctaaagttt

SEQ ID NO: 89581 - DNA, 25 bp, Rattus norvegicus
acgcaccatgtgcttgtgttgtcaa

SEQ ID NO: 89582 - DNA, 25 bp, Rattus norvegicus
acgcaccatgtggttgtgttgtcaa

SEQ ID NO: 89583 - DNA, 25 bp, Rattus norvegicus
acgcaccggcgcacatacagttgaa

SEQ ID NO: 89584 - DNA, 25 bp, Rattus norvegicus
acgcaccggcgctcatacagttgaa

SEQ ID NO: 89585 - DNA, 25 bp, Rattus norvegicus
acgcacctgggtatatattcttctg

SEQ ID NO: 89586 - DNA, 25 bp, Rattus norvegicus
acgcacctgggtttatattcttctg

SEQ ID NO: 89587 - DNA, 25 bp, Rattus norvegicus
acgcaccttcttacagtcatgtgat

SEQ ID NO: 89588 - DNA, 25 bp, Rattus norvegicus
acgcaccttctttcagtcatgtgat

SEQ ID NO: 89589 - DNA, 25 bp, Rattus norvegicus
acgcacgcacacacagggcttcgtt

SEQ ID NO: 89590 - DNA, 25 bp, Rattus norvegicus
acgcacgcacactcagggcttcgtt

SEQ ID NO: 89591 - DNA, 25 bp, Rattus norvegicus
acgcacgcattccacatacgaagat

SEQ ID NO: 89592 - DNA, 25 bp, Rattus norvegicus
acgcacgcattcgacatacgaagat

SEQ ID NO: 89593 - DNA, 25 bp, Rattus norvegicus
acgcacgcggcccagctgtggtggg

SEQ ID NO: 89594 - DNA, 25 bp, Rattus norvegicus
acgcacgcggccgagctgtggtggg

SEQ ID NO: 89595 - DNA, 25 bp, Rattus norvegicus
acgcacggctgtatgttgttgggtt

SEQ ID NO: 89596 - DNA, 25 bp, Rattus norvegicus
acgcacggctgtttgttgttgggtt

SEQ ID NO: 89597 - DNA, 25 bp, Rattus norvegicus
acgcacgtttatatgtgttaatgct

SEQ ID NO: 89598 - DNA, 25 bp, Rattus norvegicus
acgcacgtttatttgtgttaatgct

SEQ ID NO: 89599 - DNA, 25 bp, Rattus norvegicus
acgcactcaaggacacactggattc

SEQ ID NO: 89600 - DNA, 25 bp, Rattus norvegicus
acgcactcaaggtcacactggattc

SEQ ID NO: 89601 - DNA, 25 bp, Rattus norvegicus
acgcacttatcacgaacgcctcgat

SEQ ID NO: 89602 - DNA, 25 bp, Rattus norvegicus
acgcacttatcaggaacgcctcgat

SEQ ID NO: 89603 - DNA, 25 bp, Rattus norvegicus
acgcacttctctcctttcttaagag

SEQ ID NO: 89604 - DNA, 25 bp, Rattus norvegicus
acgcacttctctgctttcttaagag

SEQ ID NO: 89605 - DNA, 25 bp, Rattus norvegicus
acgcacttgttaatccatgggttta

SEQ ID NO: 89606 - DNA, 25 bp, Rattus norvegicus
acgcacttgttattccatgggttta

SEQ ID NO: 89607 - DNA, 25 bp, Rattus norvegicus
acgcactttggcatgtaattctttc

SEQ ID NO: 89608 - DNA, 25 bp, Rattus norvegicus
acgcactttggcttgtaattctttc

SEQ ID NO: 89609 - DNA, 25 bp, Rattus norvegicus
acgcagaaaagccatgccccagcaa

SEQ ID NO: 89610 - DNA, 25 bp, Rattus norvegicus
acgcagaaaagcgatgccccagcaa

SEQ ID NO: 89611 - DNA, 25 bp, Rattus norvegicus
acgcagaagtcacactctgcctggg

SEQ ID NO: 89612 - DNA, 25 bp, Rattus norvegicus
acgcagaagtcagactctgcctggg

SEQ ID NO: 89613 - DNA, 25 bp, Rattus norvegicus
acgcagaagtcgaccgggttgtgta

SEQ ID NO: 89614 - DNA, 25 bp, Rattus norvegicus
acgcagaagtcgtccgggttgtgta

SEQ ID NO: 89615 - DNA, 25 bp, Rattus norvegicus
acgcagaatgtgctcctttgtgtta

SEQ ID NO: 89616 - DNA, 25 bp, Rattus norvegicus
acgcagaatgtggtcctttgtgtta

SEQ ID NO: 89617 - DNA, 25 bp, Rattus norvegicus
acgcagacgtgtctgcactcaaact

SEQ ID NO: 89618 - DNA, 25 bp, Rattus norvegicus
acgcagacgtgtgtgcactcaaact

SEQ ID NO: 89619 - DNA, 25 bp, Rattus norvegicus
acgcagaggcggaccaggttcctag

SEQ ID NO: 89620 - DNA, 25 bp, Rattus norvegicus
acgcagaggcggtccaggttcctag

SEQ ID NO: 89621 - DNA, 25 bp, Rattus norvegicus
acgcagattcctcatcaaagcatca

SEQ ID NO: 89622 - DNA, 25 bp, Rattus norvegicus
acgcagattcctgatcaaagcatca

SEQ ID NO: 89623 - DNA, 25 bp, Rattus norvegicus
acgcagattcgtcaagcattccata

SEQ ID NO: 89624 - DNA, 25 bp, Rattus norvegicus
acgcagattcgtgaagcattccata

SEQ ID NO: 89625 - DNA, 25 bp, Rattus norvegicus
acgcagattgccagacttttagaac

SEQ ID NO: 89626 - DNA, 25 bp, Rattus norvegicus
acgcagattgcctgacttttagaac

SEQ ID NO: 89627 - DNA, 25 bp, Rattus norvegicus
acgcagatttttccagctcttttat

SEQ ID NO: 89628 - DNA, 25 bp, Rattus norvegicus
acgcagatttttgcagctcttttat

SEQ ID NO: 89629 - DNA, 25 bp, Rattus norvegicus
acgcagcagatgaagtccggagtgt

SEQ ID NO: 89630 - DNA, 25 bp, Rattus norvegicus
acgcagcagatgtagtccggagtgt

SEQ ID NO: 89631 - DNA, 25 bp, Rattus norvegicus
acgcagcccagtaaccagggacgac

SEQ ID NO: 89632 - DNA, 25 bp, Rattus norvegicus
acgcagcccagttaccagggacgac

SEQ ID NO: 89633 - DNA, 25 bp, Rattus norvegicus
acgcagccggcgcatggtcaactcg

SEQ ID NO: 89634 - DNA, 25 bp, Rattus norvegicus
acgcagccggcggatggtcaactcg

SEQ ID NO: 89635 - DNA, 25 bp, Rattus norvegicus
acgcagccttttcgcggaattttgc

SEQ ID NO: 89636 - DNA, 25 bp, Rattus norvegicus
acgcagccttttggcggaattttgc

SEQ ID NO: 89637 - DNA, 25 bp, Rattus norvegicus
acgcagcgaacgctgagcggcgcgc

SEQ ID NO: 89638 - DNA, 25 bp, Rattus norvegicus
acgcagcgaacggtgagcggcgcgc

SEQ ID NO: 89639 - DNA, 25 bp, Rattus norvegicus
acgcagcgctcacggaggcaacgat

SEQ ID NO: 89640 - DNA, 25 bp, Rattus norvegicus
acgcagcgctcagggaggcaacgat

SEQ ID NO: 89641 - DNA, 25 bp, Rattus norvegicus
acgcagctccctcaaacgttttgga

SEQ ID NO: 89642 - DNA, 25 bp, Rattus norvegicus
acgcagctccctgaaacgttttgga

SEQ ID NO: 89643 - DNA, 25 bp, Rattus norvegicus
acgcagctggcaacctgaccatggg

SEQ ID NO: 89644 - DNA, 25 bp, Rattus norvegicus
acgcagctggcatcctgaccatggg

SEQ ID NO: 89645 - DNA, 25 bp, Rattus norvegicus
acgcaggcacctattgttgatttct

SEQ ID NO: 89646 - DNA, 25 bp, Rattus norvegicus
acgcaggcaccttttgttgatttct

SEQ ID NO: 89647 - DNA, 25 bp, Rattus norvegicus
acgcaggcctacacaggaattcagc

SEQ ID NO: 89648 - DNA, 25 bp, Rattus norvegicus
acgcaggcctactcaggaattcagc

SEQ ID NO: 89649 - DNA, 25 bp, Rattus norvegicus
acgcagggaggaatgagagtctttt

SEQ ID NO: 89650 - DNA, 25 bp, Rattus norvegicus
acgcagggaggattgagagtctttt

SEQ ID NO: 89651 - DNA, 25 bp, Rattus norvegicus
acgcagggctgtagttcttccatta

SEQ ID NO: 89652 - DNA, 25 bp, Rattus norvegicus
acgcagggctgttgttcttccatta

SEQ ID NO: 89653 - DNA, 25 bp, Rattus norvegicus
acgcaggtctaaaggagtttcttaa

SEQ ID NO: 89654 - DNA, 25 bp, Rattus norvegicus
acgcaggtctaatggagtttcttaa

SEQ ID NO: 89655 - DNA, 25 bp, Rattus norvegicus
acgcaggttcgtccgcgtgcttcct

SEQ ID NO: 89656 - DNA, 25 bp, Rattus norvegicus
acgcaggttcgtgcgcgtgcttcct

SEQ ID NO: 89657 - DNA, 25 bp, Rattus norvegicus
acgcagtccgagacctatttatgag

SEQ ID NO: 89658 - DNA, 25 bp, Rattus norvegicus
acgcagtccgagtcctatttatgag

SEQ ID NO: 89659 - DNA, 25 bp, Rattus norvegicus
acgcagtccttaccagttttgtaga

SEQ ID NO: 89660 - DNA, 25 bp, Rattus norvegicus
acgcagtccttagcagttttgtaga

SEQ ID NO: 89661 - DNA, 25 bp, Rattus norvegicus
acgcagtctaagacccagtaacggg

SEQ ID NO: 89662 - DNA, 25 bp, Rattus norvegicus
acgcagtctaagtcccagtaacggg

SEQ ID NO: 89663 - DNA, 25 bp, Rattus norvegicus
acgcagtctgctagctaggctggaa

SEQ ID NO: 89664 - DNA, 25 bp, Rattus norvegicus
acgcagtctgcttgctaggctggaa

SEQ ID NO: 89665 - DNA, 25 bp, Rattus norvegicus
acgcagtgcctgagatgtcttgaga

SEQ ID NO: 89666 - DNA, 25 bp, Rattus norvegicus
acgcagtgcctgtgatgtcttgaga

SEQ ID NO: 89667 - DNA, 25 bp, Rattus norvegicus
acgcagtgcgtgatatgtccacaga

SEQ ID NO: 89668 - DNA, 25 bp, Rattus norvegicus
acgcagtgcgtgttatgtccacaga

SEQ ID NO: 89669 - DNA, 25 bp, Rattus norvegicus
acgcagttagatcagttgttccgaa

SEQ ID NO: 89670 - DNA, 25 bp, Rattus norvegicus
acgcagttagatgagttgttccgaa

SEQ ID NO: 89671 - DNA, 25 bp, Rattus norvegicus
acgcagtttgaaaacgcctggtgcc

SEQ ID NO: 89672 - DNA, 25 bp, Rattus norvegicus
acgcagtttgaatacgcctggtgcc

SEQ ID NO: 89673 - DNA, 25 bp, Rattus norvegicus
acgcatacatgtccgcacgtacaca

SEQ ID NO: 89674 - DNA, 25 bp, Rattus norvegicus
acgcatacatgtgcgcacgtacaca

SEQ ID NO: 89675 - DNA, 25 bp, Rattus norvegicus
acgcatatgagtacactcttgctgt

SEQ ID NO: 89676 - DNA, 25 bp, Rattus norvegicus
acgcatatgagttcactcttgctgt

SEQ ID NO: 89677 - DNA, 25 bp, Rattus norvegicus
acgcatatggctactacacgggaga

SEQ ID NO: 89678 - DNA, 25 bp, Rattus norvegicus
acgcatatggcttctacacgggaga

SEQ ID NO: 89679 - DNA, 25 bp, Rattus norvegicus
acgcatcattgcattttcactgttt

SEQ ID NO: 89680 - DNA, 25 bp, Rattus norvegicus
acgcatcattgctttttcactgttt

SEQ ID NO: 89681 - DNA, 25 bp, Rattus norvegicus
acgcatccaacaagttgtcctgtga

SEQ ID NO: 89682 - DNA, 25 bp, Rattus norvegicus
acgcatccaacatgttgtcctgtga

SEQ ID NO: 89683 - DNA, 25 bp, Rattus norvegicus
acgcatccaacgctttctgtgtaaa

SEQ ID NO: 89684 - DNA, 25 bp, Rattus norvegicus
acgcatccaacggtttctgtgtaaa

SEQ ID NO: 89685 - DNA, 25 bp, Rattus norvegicus
acgcatctatgtcgccctgggatac

SEQ ID NO: 89686 - DNA, 25 bp, Rattus norvegicus
acgcatctatgtggccctgggatac

SEQ ID NO: 89687 - DNA, 25 bp, Rattus norvegicus
acgcatgagcgtcttggccgatgcc

SEQ ID NO: 89688 - DNA, 25 bp, Rattus norvegicus
acgcatgagcgtgttggccgatgcc

SEQ ID NO: 89689 - DNA, 25 bp, Rattus norvegicus
acgcatgctattaccactagtcagc

SEQ ID NO: 89690 - DNA, 25 bp, Rattus norvegicus
acgcatgctatttccactagtcagc

SEQ ID NO: 89691 - DNA, 25 bp, Rattus norvegicus
acgcatgctcacacatgtactggga

SEQ ID NO: 89692 - DNA, 25 bp, Rattus norvegicus
acgcatgctcactcatgtactggga

SEQ ID NO: 89693 - DNA, 25 bp, Rattus norvegicus
acgcatgtcagcagagatttacctc

SEQ ID NO: 89694 - DNA, 25 bp, Rattus norvegicus
acgcatgtcagctgagatttacctc

SEQ ID NO: 89695 - DNA, 25 bp, Rattus norvegicus
acgcatgtcatcaggtttccactaa

SEQ ID NO: 89696 - DNA, 25 bp, Rattus norvegicus
acgcatgtcatctggtttccactaa

SEQ ID NO: 89697 - DNA, 25 bp, Rattus norvegicus
acgcatgtcgtgaccttggcttgag

SEQ ID NO: 89698 - DNA, 25 bp, Rattus norvegicus
acgcatgtcgtgtccttggcttgag

SEQ ID NO: 89699 - DNA, 25 bp, Rattus norvegicus
acgcatgtgcatcctggctggagat

SEQ ID NO: 89700 - DNA, 25 bp, Rattus norvegicus
acgcatgtgcatgctggctggagat

SEQ ID NO: 89701 - DNA, 25 bp, Rattus norvegicus
acgcatgtggttccagttgactcgg

SEQ ID NO: 89702 - DNA, 25 bp, Rattus norvegicus
acgcatgtggttgcagttgactcgg

SEQ ID NO: 89703 - DNA, 25 bp, Rattus norvegicus
acgcattagttgatctgtcagtcct

SEQ ID NO: 89704 - DNA, 25 bp, Rattus norvegicus
acgcattagttgttctgtcagtcct

SEQ ID NO: 89705 - DNA, 25 bp, Rattus norvegicus
acgcatttagctcttttagtccaag

SEQ ID NO: 89706 - DNA, 25 bp, Rattus norvegicus
acgcatttagctgttttagtccaag

SEQ ID NO: 89707 - DNA, 25 bp, Rattus norvegicus
acgcatttcctgagcgggtgtaaat

SEQ ID NO: 89708 - DNA, 25 bp, Rattus norvegicus
acgcatttcctgtgcgggtgtaaat

SEQ ID NO: 89709 - DNA, 25 bp, Rattus norvegicus
acgcattttccgcgtgaatcatggg

SEQ ID NO: 89710 - DNA, 25 bp, Rattus norvegicus
acgcattttccgggtgaatcatggg

SEQ ID NO: 89711 - DNA, 25 bp, Rattus norvegicus
acgccaaacagaagagtcccgaggt

SEQ ID NO: 89712 - DNA, 25 bp, Rattus norvegicus
acgccaaacagatgagtcccgaggt

SEQ ID NO: 89713 - DNA, 25 bp, Rattus norvegicus
acgccaaactgcaggcttggtttta

SEQ ID NO: 89714 - DNA, 25 bp, Rattus norvegicus
acgccaaactgctggcttggtttta

SEQ ID NO: 89715 - DNA, 25 bp, Rattus norvegicus
acgccaaagttgcctcttttagaag

SEQ ID NO: 89716 - DNA, 25 bp, Rattus norvegicus
acgccaaagttggctcttttagaag

SEQ ID NO: 89717 - DNA, 25 bp, Rattus norvegicus
acgccaacctgcagctctaaagata

SEQ ID NO: 89718 - DNA, 25 bp, Rattus norvegicus
acgccaacctgctgctctaaagata

SEQ ID NO: 89719 - DNA, 25 bp, Rattus norvegicus
acgccaaggacaagacgtgcttcta

SEQ ID NO: 89720 - DNA, 25 bp, Rattus norvegicus
acgccaaggacatgacgtgcttcta

SEQ ID NO: 89721 - DNA, 25 bp, Rattus norvegicus
acgccaaggccaagactgtagtgat

SEQ ID NO: 89722 - DNA, 25 bp, Rattus norvegicus
acgccaaggccatgactgtagtgat

SEQ ID NO: 89723 - DNA, 25 bp, Rattus norvegicus
acgccaattatccatctcagctgaa

SEQ ID NO: 89724 - DNA, 25 bp, Rattus norvegicus
acgccaattatcgatctcagctgaa

SEQ ID NO: 89725 - DNA, 25 bp, Rattus norvegicus
acgccacaaggaccaccagaaatat

SEQ ID NO: 89726 - DNA, 25 bp, Rattus norvegicus
acgccacaaggagcaccagaaatat

SEQ ID NO: 89727 - DNA, 25 bp, Rattus norvegicus
acgccacagggacagttggttcgaa

SEQ ID NO: 89728 - DNA, 25 bp, Rattus norvegicus
acgccacagggagagttggttcgaa

SEQ ID NO: 89729 - DNA, 25 bp, Rattus norvegicus
acgccaccgggaagcaaaaccacag

SEQ ID NO: 89730 - DNA, 25 bp, Rattus norvegicus
acgccaccgggatgcaaaaccacag

SEQ ID NO: 89731 - DNA, 25 bp, Rattus norvegicus
acgccacttgctcctttctataaaa

SEQ ID NO: 89732 - DNA, 25 bp, Rattus norvegicus
acgccacttgctgctttctataaaa

SEQ ID NO: 89733 - DNA, 25 bp, Rattus norvegicus
acgccactttctagagattcattat

SEQ ID NO: 89734 - DNA, 25 bp, Rattus norvegicus
acgccactttcttgagattcattat

SEQ ID NO: 89735 - DNA, 25 bp, Rattus norvegicus
acgccagaccgaccttctaatatgt

SEQ ID NO: 89736 - DNA, 25 bp, Rattus norvegicus
acgccagaccgagcttctaatatgt

SEQ ID NO: 89737 - DNA, 25 bp, Rattus norvegicus
acgccagacgccaacagaggagcag

SEQ ID NO: 89738 - DNA, 25 bp, Rattus norvegicus
acgccagacgcctacagaggagcag

SEQ ID NO: 89739 - DNA, 25 bp, Rattus norvegicus
acgccagctatcatgcttctgaaat

SEQ ID NO: 89740 - DNA, 25 bp, Rattus norvegicus
acgccagctatcttgcttctgaaat

SEQ ID NO: 89741 - DNA, 25 bp, Rattus norvegicus
acgccagctccgctagcaagtcagg

SEQ ID NO: 89742 - DNA, 25 bp, Rattus norvegicus
acgccagctccggtagcaagtcagg

SEQ ID NO: 89743 - DNA, 25 bp, Rattus norvegicus
acgccaggaatgaggctgaggtcct

SEQ ID NO: 89744 - DNA, 25 bp, Rattus norvegicus
acgccaggaatgtggctgaggtcct

SEQ ID NO: 89745 - DNA, 25 bp, Rattus norvegicus
acgccaggcctcctggttggagtat

SEQ ID NO: 89746 - DNA, 25 bp, Rattus norvegicus
acgccaggcctcgtggttggagtat

SEQ ID NO: 89747 - DNA, 25 bp, Rattus norvegicus
acgccaggtcgtcgtacgttcagaa

SEQ ID NO: 89748 - DNA, 25 bp, Rattus norvegicus
acgccaggtcgtggtacgttcagaa

SEQ ID NO: 89749 - DNA, 25 bp, Rattus norvegicus
acgccagtgactacaggtccagaga

SEQ ID NO: 89750 - DNA, 25 bp, Rattus norvegicus
acgccagtgacttcaggtccagaga

SEQ ID NO: 89751 - DNA, 25 bp, Rattus norvegicus
acgccagtggtcatcacccgggtgt

SEQ ID NO: 89752 - DNA, 25 bp, Rattus norvegicus
acgccagtggtcttcacccgggtgt

SEQ ID NO: 89753 - DNA, 25 bp, Rattus norvegicus
acgccagtgtcgagcatgtcatcag

SEQ ID NO: 89754 - DNA, 25 bp, Rattus norvegicus
acgccagtgtcgtgcatgtcatcag

SEQ ID NO: 89755 - DNA, 25 bp, Rattus norvegicus
acgccataaggcaggtccgggagaa

SEQ ID NO: 89756 - DNA, 25 bp, Rattus norvegicus
acgccataaggctggtccgggagaa

SEQ ID NO: 89757 - DNA, 25 bp, Rattus norvegicus
acgccatagcagaggaagccttact

SEQ ID NO: 89758 - DNA, 25 bp, Rattus norvegicus
acgccatagcagtggaagccttact

SEQ ID NO: 89759 - DNA, 25 bp, Rattus norvegicus
acgccatagccaagcttctgggata

SEQ ID NO: 89760 - DNA, 25 bp, Rattus norvegicus
acgccatagccatgcttctgggata

SEQ ID NO: 89761 - DNA, 25 bp, Rattus norvegicus
acgccatctcggaggtcacagtgtg

SEQ ID NO: 89762 - DNA, 25 bp, Rattus norvegicus
acgccatctcggtggtcacagtgtg

SEQ ID NO: 89763 - DNA, 25 bp, Rattus norvegicus
acgccatctgggagatacttgatct

SEQ ID NO: 89764 - DNA, 25 bp, Rattus norvegicus
acgccatctgggtgatacttgatct

SEQ ID NO: 89765 - DNA, 25 bp, Rattus norvegicus
acgccatgaggtcactgctgtcttt

SEQ ID NO: 89766 - DNA, 25 bp, Rattus norvegicus
acgccatgaggtgactgctgtcttt

SEQ ID NO: 89767 - DNA, 25 bp, Rattus norvegicus
acgccatgcgtactgtcagcactgt

SEQ ID NO: 89768 - DNA, 25 bp, Rattus norvegicus
acgccatgcgtagtgtcagcactgt

SEQ ID NO: 89769 - DNA, 25 bp, Rattus norvegicus
acgccatggcccaggttgatgcttg

SEQ ID NO: 89770 - DNA, 25 bp, Rattus norvegicus
acgccatggccctggttgatgcttg

SEQ ID NO: 89771 - DNA, 25 bp, Rattus norvegicus
acgccatgtgccagcagtgtgggta

SEQ ID NO: 89772 - DNA, 25 bp, Rattus norvegicus
acgccatgtgcctgcagtgtgggta

SEQ ID NO: 89773 - DNA, 25 bp, Rattus norvegicus
acgccattgcccagttggctaagtg

SEQ ID NO: 89774 - DNA, 25 bp, Rattus norvegicus
acgccattgccctgttggctaagtg

SEQ ID NO: 89775 - DNA, 25 bp, Rattus norvegicus
acgccattgtctcatcaaaagccca

SEQ ID NO: 89776 - DNA, 25 bp, Rattus norvegicus
acgccattgtctgatcaaaagccca

SEQ ID NO: 89777 - DNA, 25 bp, Rattus norvegicus
acgccatttcacatttgtcaccagt

SEQ ID NO: 89778 - DNA, 25 bp, Rattus norvegicus
acgccatttcacttttgtcaccagt

SEQ ID NO: 89779 - DNA, 25 bp, Rattus norvegicus
acgcccaaatcccagtatgtttatg

SEQ ID NO: 89780 - DNA, 25 bp, Rattus norvegicus
acgcccaaatccgagtatgtttatg

SEQ ID NO: 89781 - DNA, 25 bp, Rattus norvegicus
acgcccaagttgacggacacaccag

SEQ ID NO: 89782 - DNA, 25 bp, Rattus norvegicus
acgcccaagttgtcggacacaccag

SEQ ID NO: 89783 - DNA, 25 bp, Rattus norvegicus
acgcccacagcgattggtgttgatt

SEQ ID NO: 89784 - DNA, 25 bp, Rattus norvegicus
acgcccacagcgtttggtgttgatt

SEQ ID NO: 89785 - DNA, 25 bp, Rattus norvegicus
acgcccacgtgtatgcttggaataa

SEQ ID NO: 89786 - DNA, 25 bp, Rattus norvegicus
acgcccacgtgtttgcttggaataa

SEQ ID NO: 89787 - DNA, 25 bp, Rattus norvegicus
acgcccactgggatctagtgagcag

SEQ ID NO: 89788 - DNA, 25 bp, Rattus norvegicus
acgcccactgggttctagtgagcag

SEQ ID NO: 89789 - DNA, 25 bp, Rattus norvegicus
acgcccagcccaatcgaattagatg

SEQ ID NO: 89790 - DNA, 25 bp, Rattus norvegicus
acgcccagcccattcgaattagatg

SEQ ID NO: 89791 - DNA, 25 bp, Rattus norvegicus
acgcccagccctaccaggttatggt

SEQ ID NO: 89792 - DNA, 25 bp, Rattus norvegicus
acgcccagcccttccaggttatggt

SEQ ID NO: 89793 - DNA, 25 bp, Rattus norvegicus
acgcccagccgacagtcataaagaa

SEQ ID NO: 89794 - DNA, 25 bp, Rattus norvegicus
acgcccagccgagagtcataaagaa

SEQ ID NO: 89795 - DNA, 25 bp, Rattus norvegicus
acgcccagctaaaatcctaacactt

SEQ ID NO: 89796 - DNA, 25 bp, Rattus norvegicus
acgcccagctaatatcctaacactt

SEQ ID NO: 89797 - DNA, 25 bp, Rattus norvegicus
acgcccaggcagattactatctatg

SEQ ID NO: 89798 - DNA, 25 bp, Rattus norvegicus
acgcccaggcagtttactatctatg

SEQ ID NO: 89799 - DNA, 25 bp, Rattus norvegicus
acgcccaggttacaggtcgtcagtc

SEQ ID NO: 89800 - DNA, 25 bp, Rattus norvegicus
acgcccaggttagaggtcgtcagtc

SEQ ID NO: 89801 - DNA, 25 bp, Rattus norvegicus
acgcccagtgtgacagacattttga

SEQ ID NO: 89802 - DNA, 25 bp, Rattus norvegicus
acgcccagtgtgtcagacattttga

SEQ ID NO: 89803 - DNA, 25 bp, Rattus norvegicus
acgcccatactcattgacttacagt

SEQ ID NO: 89804 - DNA, 25 bp, Rattus norvegicus
acgcccatactctttgacttacagt

SEQ ID NO: 89805 - DNA, 25 bp, Rattus norvegicus
acgccccacttcaggatcgtgcagt

SEQ ID NO: 89806 - DNA, 25 bp, Rattus norvegicus
acgccccacttctggatcgtgcagt

SEQ ID NO: 89807 - DNA, 25 bp, Rattus norvegicus
acgccccaggtaagctgtgcagatg

SEQ ID NO: 89808 - DNA, 25 bp, Rattus norvegicus
acgccccaggtatgctgtgcagatg

SEQ ID NO: 89809 - DNA, 25 bp, Rattus norvegicus
acgccccagtcgagcgaagatggtg

SEQ ID NO: 89810 - DNA, 25 bp, Rattus norvegicus
acgccccagtcgtgcgaagatggtg

SEQ ID NO: 89811 - DNA, 25 bp, Rattus norvegicus
acgcccctgaccaattaagttctag

SEQ ID NO: 89812 - DNA, 25 bp, Rattus norvegicus
acgcccctgacctattaagttctag

SEQ ID NO: 89813 - DNA, 25 bp, Rattus norvegicus
acgccccttctgagtatttcaagtc

SEQ ID NO: 89814 - DNA, 25 bp, Rattus norvegicus
acgccccttctgtgtatttcaagtc

SEQ ID NO: 89815 - DNA, 25 bp, Rattus norvegicus
acgcccggcagccaggtgctgggag

SEQ ID NO: 89816 - DNA, 25 bp, Rattus norvegicus
acgcccggcagcgaggtgctgggag

SEQ ID NO: 89817 - DNA, 25 bp, Rattus norvegicus
acgccctcaatgacatgacctctat

SEQ ID NO: 89818 - DNA, 25 bp, Rattus norvegicus
acgccctcaatgtcatgacctctat

SEQ ID NO: 89819 - DNA, 25 bp, Rattus norvegicus
acgccctcatgaacaaagcctcgaa

SEQ ID NO: 89820 - DNA, 25 bp, Rattus norvegicus
acgccctcatgatcaaagcctcgaa

SEQ ID NO: 89821 - DNA, 25 bp, Rattus norvegicus
acgccctctactctggcaagatgga

SEQ ID NO: 89822 - DNA, 25 bp, Rattus norvegicus
acgccctctactgtggcaagatgga

SEQ ID NO: 89823 - DNA, 25 bp, Rattus norvegicus
acgccctgaatacctagtcctttgt

SEQ ID NO: 89824 - DNA, 25 bp, Rattus norvegicus
acgccctgaatagctagtcctttgt

SEQ ID NO: 89825 - DNA, 25 bp, Rattus norvegicus
acgccctgctgcatattcaatggta

SEQ ID NO: 89826 - DNA, 25 bp, Rattus norvegicus
acgccctgctgcttattcaatggta

SEQ ID NO: 89827 - DNA, 25 bp, Rattus norvegicus
acgccctgtgctctgggtcgttcac

SEQ ID NO: 89828 - DNA, 25 bp, Rattus norvegicus
acgccctgtgctgtgggtcgttcac

SEQ ID NO: 89829 - DNA, 25 bp, Rattus norvegicus
acgcccttagcaaaactgaactgag

SEQ ID NO: 89830 - DNA, 25 bp, Rattus norvegicus
acgcccttagcataactgaactgag

SEQ ID NO: 89831 - DNA, 25 bp, Rattus norvegicus
acgccgaaatcgacatgctttcata

SEQ ID NO: 89832 - DNA, 25 bp, Rattus norvegicus
acgccgaaatcgtcatgctttcata

SEQ ID NO: 89833 - DNA, 25 bp, Rattus norvegicus
acgccgaatcttcggtgaccagcag

SEQ ID NO: 89834 - DNA, 25 bp, Rattus norvegicus
acgccgaatcttgggtgaccagcag

SEQ ID NO: 89835 - DNA, 25 bp, Rattus norvegicus
acgccgactgtgactgggagagcca

SEQ ID NO: 89836 - DNA, 25 bp, Rattus norvegicus
acgccgactgtgtctgggagagcca

SEQ ID NO: 89837 - DNA, 25 bp, Rattus norvegicus
acgccgacttctaccttggagagat

SEQ ID NO: 89838 - DNA, 25 bp, Rattus norvegicus
acgccgacttcttccttggagagat

SEQ ID NO: 89839 - DNA, 25 bp, Rattus norvegicus
acgccgagcagtcaggccagacaca

SEQ ID NO: 89840 - DNA, 25 bp, Rattus norvegicus
acgccgagcagtgaggccagacaca

SEQ ID NO: 89841 - DNA, 25 bp, Rattus norvegicus
acgccgatacggactgggagcaaac

SEQ ID NO: 89842 - DNA, 25 bp, Rattus norvegicus
acgccgatacggtctgggagcaaac

SEQ ID NO: 89843 - DNA, 25 bp, Rattus norvegicus
acgccgattctgcatcaactactga

SEQ ID NO: 89844 - DNA, 25 bp, Rattus norvegicus
acgccgattctggatcaactactga

SEQ ID NO: 89845 - DNA, 25 bp, Rattus norvegicus
acgccgccgataatagatacagttg

SEQ ID NO: 89846 - DNA, 25 bp, Rattus norvegicus
acgccgccgatattagatacagttg

SEQ ID NO: 89847 - DNA, 25 bp, Rattus norvegicus
acgccgctggctccaagaagcatga

SEQ ID NO: 89848 - DNA, 25 bp, Rattus norvegicus
acgccgctggctgcaagaagcatga

SEQ ID NO: 89849 - DNA, 25 bp, Rattus norvegicus
acgccgcttctgacatacacaatgt

SEQ ID NO: 89850 - DNA, 25 bp, Rattus norvegicus
acgccgcttctgtcatacacaatgt

SEQ ID NO: 89851 - DNA, 25 bp, Rattus norvegicus
acgccgcttgcccataacgatgatg

SEQ ID NO: 89852 - DNA, 25 bp, Rattus norvegicus
acgccgcttgccgataacgatgatg

SEQ ID NO: 89853 - DNA, 25 bp, Rattus norvegicus
acgccggccaaactcactggcaaga

SEQ ID NO: 89854 - DNA, 25 bp, Rattus norvegicus
acgccggccaaagtcactggcaaga

SEQ ID NO: 89855 - DNA, 25 bp, Rattus norvegicus
acgccggtggacaaaggcggatcta

SEQ ID NO: 89856 - DNA, 25 bp, Rattus norvegicus
acgccggtggactaaggcggatcta

SEQ ID NO: 89857 - DNA, 25 bp, Rattus norvegicus
acgccggtgggaaatggcatgtacc

SEQ ID NO: 89858 - DNA, 25 bp, Rattus norvegicus
acgccggtgggatatggcatgtacc

SEQ ID NO: 89859 - DNA, 25 bp, Rattus norvegicus
acgccgtagtgcagcttagtagggt

SEQ ID NO: 89860 - DNA, 25 bp, Rattus norvegicus
acgccgtagtgctgcttagtagggt

SEQ ID NO: 89861 - DNA, 25 bp, Rattus norvegicus
acgccgtcatcactcggcatataca

SEQ ID NO: 89862 - DNA, 25 bp, Rattus norvegicus
acgccgtcatcagtcggcatataca

SEQ ID NO: 89863 - DNA, 25 bp, Rattus norvegicus
acgccgtcattaccaggatcatcaa

SEQ ID NO: 89864 - DNA, 25 bp, Rattus norvegicus
acgccgtcattagcaggatcatcaa

SEQ ID NO: 89865 - DNA, 25 bp, Rattus norvegicus
acgccgtctcggcactgcagagtca

SEQ ID NO: 89866 - DNA, 25 bp, Rattus norvegicus
acgccgtctcgggactgcagagtca

SEQ ID NO: 89867 - DNA, 25 bp, Rattus norvegicus
acgccgtcttcgagcagagttacta

SEQ ID NO: 89868 - DNA, 25 bp, Rattus norvegicus
acgccgtcttcgtgcagagttacta

SEQ ID NO: 89869 - DNA, 25 bp, Rattus norvegicus
acgccgtctttgacagacaggtgca

SEQ ID NO: 89870 - DNA, 25 bp, Rattus norvegicus
acgccgtctttgtcagacaggtgca

SEQ ID NO: 89871 - DNA, 25 bp, Rattus norvegicus
acgccgtgtacgatcagttttatgt

SEQ ID NO: 89872 - DNA, 25 bp, Rattus norvegicus
acgccgtgtacgttcagttttatgt

SEQ ID NO: 89873 - DNA, 25 bp, Rattus norvegicus
acgcctacaagcctgtgcagtttga

SEQ ID NO: 89874 - DNA, 25 bp, Rattus norvegicus
acgcctacaagcgtgtgcagtttga

SEQ ID NO: 89875 - DNA, 25 bp, Rattus norvegicus
acgcctacatgtactgcatcattga

SEQ ID NO: 89876 - DNA, 25 bp, Rattus norvegicus
acgcctacatgttctgcatcattga

SEQ ID NO: 89877 - DNA, 25 bp, Rattus norvegicus
acgcctatgggcataactttctcat

SEQ ID NO: 89878 - DNA, 25 bp, Rattus norvegicus
acgcctatgggcttaactttctcat

SEQ ID NO: 89879 - DNA, 25 bp, Rattus norvegicus
acgcctattctgctttgatctggac

SEQ ID NO: 89880 - DNA, 25 bp, Rattus norvegicus
acgcctattctggtttgatctggac

SEQ ID NO: 89881 - DNA, 25 bp, Rattus norvegicus
acgcctcaagccactagtgtgcaga

SEQ ID NO: 89882 - DNA, 25 bp, Rattus norvegicus
acgcctcaagcctctagtgtgcaga

SEQ ID NO: 89883 - DNA, 25 bp, Rattus norvegicus
acgcctcaccttacatcagatgaca

SEQ ID NO: 89884 - DNA, 25 bp, Rattus norvegicus
acgcctcacctttcatcagatgaca

SEQ ID NO: 89885 - DNA, 25 bp, Rattus norvegicus
acgcctcactgacagaactggagag

SEQ ID NO: 89886 - DNA, 25 bp, Rattus norvegicus
acgcctcactgagagaactggagag

SEQ ID NO: 89887 - DNA, 25 bp, Rattus norvegicus
acgcctcagactcggatgcttttga

SEQ ID NO: 89888 - DNA, 25 bp, Rattus norvegicus
acgcctcagactgggatgcttttga

SEQ ID NO: 89889 - DNA, 25 bp, Rattus norvegicus
acgcctcagagcatgctattgcgaa

SEQ ID NO: 89890 - DNA, 25 bp, Rattus norvegicus
acgcctcagagcttgctattgcgaa

SEQ ID NO: 89891 - DNA, 25 bp, Rattus norvegicus
acgcctcagtctctctggttgaaag

SEQ ID NO: 89892 - DNA, 25 bp, Rattus norvegicus
acgcctcagtctgtctggttgaaag

SEQ ID NO: 89893 - DNA, 25 bp, Rattus norvegicus
acgcctcatattcactcgagtgtga

SEQ ID NO: 89894 - DNA, 25 bp, Rattus norvegicus
acgcctcatattgactcgagtgtga

SEQ ID NO: 89895 - DNA, 25 bp, Rattus norvegicus
acgcctcatcttagatgcacggtga

SEQ ID NO: 89896 - DNA, 25 bp, Rattus norvegicus
acgcctcatctttgatgcacggtga

SEQ ID NO: 89897 - DNA, 25 bp, Rattus norvegicus
acgcctcctggtaaaagtctggcca

SEQ ID NO: 89898 - DNA, 25 bp, Rattus norvegicus
acgcctcctggttaaagtctggcca

SEQ ID NO: 89899 - DNA, 25 bp, Rattus norvegicus
acgcctcgcatgaacgggaacctga

SEQ ID NO: 89900 - DNA, 25 bp, Rattus norvegicus
acgcctcgcatgtacgggaacctga

SEQ ID NO: 89901 - DNA, 25 bp, Rattus norvegicus
acgcctctaactactgcgaatagca

SEQ ID NO: 89902 - DNA, 25 bp, Rattus norvegicus
acgcctctaacttctgcgaatagca

SEQ ID NO: 89903 - DNA, 25 bp, Rattus norvegicus
acgcctctatcaaccatgaagctac

SEQ ID NO: 89904 - DNA, 25 bp, Rattus norvegicus
acgcctctatcatccatgaagctac

SEQ ID NO: 89905 - DNA, 25 bp, Rattus norvegicus
acgcctctgtgacctttttaagata

SEQ ID NO: 89906 - DNA, 25 bp, Rattus norvegicus
acgcctctgtgagctttttaagata

SEQ ID NO: 89907 - DNA, 25 bp, Rattus norvegicus
acgcctctgttgattcctctttgga

SEQ ID NO: 89908 - DNA, 25 bp, Rattus norvegicus
acgcctctgttgtttcctctttgga

SEQ ID NO: 89909 - DNA, 25 bp, Rattus norvegicus
acgcctcttgtcactgaacatggaa

SEQ ID NO: 89910 - DNA, 25 bp, Rattus norvegicus
acgcctcttgtctctgaacatggaa

SEQ ID NO: 89911 - DNA, 25 bp, Rattus norvegicus
acgcctgagaggcacacagtcctga

SEQ ID NO: 89912 - DNA, 25 bp, Rattus norvegicus
acgcctgagagggacacagtcctga

SEQ ID NO: 89913 - DNA, 25 bp, Rattus norvegicus
acgcctgcacttcggttgataggac

SEQ ID NO: 89914 - DNA, 25 bp, Rattus norvegicus
acgcctgcacttgggttgataggac

SEQ ID NO: 89915 - DNA, 25 bp, Rattus norvegicus
acgcctgcattcacagcgaatatgg

SEQ ID NO: 89916 - DNA, 25 bp, Rattus norvegicus
acgcctgcattctcagcgaatatgg

SEQ ID NO: 89917 - DNA, 25 bp, Rattus norvegicus
acgcctgcccgtcattaatgggatt

SEQ ID NO: 89918 - DNA, 25 bp, Rattus norvegicus
acgcctgcccgtgattaatgggatt

SEQ ID NO: 89919 - DNA, 25 bp, Rattus norvegicus
acgcctgcctggatagactttaaat

SEQ ID NO: 89920 - DNA, 25 bp, Rattus norvegicus
acgcctgcctggttagactttaaat

SEQ ID NO: 89921 - DNA, 25 bp, Rattus norvegicus
acgcctggaaccaggttactccact

SEQ ID NO: 89922 - DNA, 25 bp, Rattus norvegicus
acgcctggaacctggttactccact

SEQ ID NO: 89923 - DNA, 25 bp, Rattus norvegicus
acgcctggaacgactgtctgcagaa

SEQ ID NO: 89924 - DNA, 25 bp, Rattus norvegicus
acgcctggaacgtctgtctgcagaa

SEQ ID NO: 89925 - DNA, 25 bp, Rattus norvegicus
acgcctggcctaagagtattcctgg

SEQ ID NO: 89926 - DNA, 25 bp, Rattus norvegicus
acgcctggcctatgagtattcctgg

SEQ ID NO: 89927 - DNA, 25 bp, Rattus norvegicus
acgcctggcttcagtgcacacttat

SEQ ID NO: 89928 - DNA, 25 bp, Rattus norvegicus
acgcctggcttctgtgcacacttat

SEQ ID NO: 89929 - DNA, 25 bp, Rattus norvegicus
acgcctggtcagagctgtcacctgg

SEQ ID NO: 89930 - DNA, 25 bp, Rattus norvegicus
acgcctggtcagtgctgtcacctgg

SEQ ID NO: 89931 - DNA, 25 bp, Rattus norvegicus
acgcctggttctaccgatggatgat

SEQ ID NO: 89932 - DNA, 25 bp, Rattus norvegicus
acgcctggttcttccgatggatgat

SEQ ID NO: 89933 - DNA, 25 bp, Rattus norvegicus
acgcctggtttacagtcctgatttt

SEQ ID NO: 89934 - DNA, 25 bp, Rattus norvegicus
acgcctggtttagagtcctgatttt

SEQ ID NO: 89935 - DNA, 25 bp, Rattus norvegicus
acgcctgtcagcattcctggagaaa

SEQ ID NO: 89936 - DNA, 25 bp, Rattus norvegicus
acgcctgtcagctttcctggagaaa

SEQ ID NO: 89937 - DNA, 25 bp, Rattus norvegicus
acgcctgtctacagaatcacctttt

SEQ ID NO: 89938 - DNA, 25 bp, Rattus norvegicus
acgcctgtctactgaatcacctttt

SEQ ID NO: 89939 - DNA, 25 bp, Rattus norvegicus
acgcctgtctgtagtttgtttgact

SEQ ID NO: 89940 - DNA, 25 bp, Rattus norvegicus
acgcctgtctgttgtttgtttgact

SEQ ID NO: 89941 - DNA, 25 bp, Rattus norvegicus
acgcctgtggccagtaatcatttgg

SEQ ID NO: 89942 - DNA, 25 bp, Rattus norvegicus
acgcctgtggcctgtaatcatttgg

SEQ ID NO: 89943 - DNA, 25 bp, Rattus norvegicus
acgcctgtttacatttgggcacatt

SEQ ID NO: 89944 - DNA, 25 bp, Rattus norvegicus
acgcctgtttacttttgggcacatt

SEQ ID NO: 89945 - DNA, 25 bp, Rattus norvegicus
acgccttacgtgcttgctcgtgttc

SEQ ID NO: 89946 - DNA, 25 bp, Rattus norvegicus
acgccttacgtggttgctcgtgttc

SEQ ID NO: 89947 - DNA, 25 bp, Rattus norvegicus
acgccttattctactttgtcaacaa

SEQ ID NO: 89948 - DNA, 25 bp, Rattus norvegicus
acgccttattcttctttgtcaacaa

SEQ ID NO: 89949 - DNA, 25 bp, Rattus norvegicus
acgccttcgacaccagtaacgttga

SEQ ID NO: 89950 - DNA, 25 bp, Rattus norvegicus
acgccttcgacagcagtaacgttga

SEQ ID NO: 89951 - DNA, 25 bp, Rattus norvegicus
acgccttctccgactggaggatgga

SEQ ID NO: 89952 - DNA, 25 bp, Rattus norvegicus
acgccttctccgtctggaggatgga

SEQ ID NO: 89953 - DNA, 25 bp, Rattus norvegicus
acgccttgaggcagtctaacactaa

SEQ ID NO: 89954 - DNA, 25 bp, Rattus norvegicus
acgccttgaggctgtctaacactaa

SEQ ID NO: 89955 - DNA, 25 bp, Rattus norvegicus
acgccttgcgtacttagaattttct

SEQ ID NO: 89956 - DNA, 25 bp, Rattus norvegicus
acgccttgcgtagttagaattttct

SEQ ID NO: 89957 - DNA, 25 bp, Rattus norvegicus
acgccttggccaccgcagggtcaga

SEQ ID NO: 89958 - DNA, 25 bp, Rattus norvegicus
acgccttggccagcgcagggtcaga

SEQ ID NO: 89959 - DNA, 25 bp, Rattus norvegicus
acgccttgggctacagtactattgt

SEQ ID NO: 89960 - DNA, 25 bp, Rattus norvegicus
acgccttgggcttcagtactattgt

SEQ ID NO: 89961 - DNA, 25 bp, Rattus norvegicus
acgccttgttctatcactgtggttc

SEQ ID NO: 89962 - DNA, 25 bp, Rattus norvegicus
acgccttgttctttcactgtggttc

SEQ ID NO: 89963 - DNA, 25 bp, Rattus norvegicus
acgcctttatctctctgctgagtga

SEQ ID NO: 89964 - DNA, 25 bp, Rattus norvegicus
acgcctttatctgtctgctgagtga

SEQ ID NO: 89965 - DNA, 25 bp, Rattus norvegicus
acgcctttcattccagaactctgag

SEQ ID NO: 89966 - DNA, 25 bp, Rattus norvegicus
acgcctttcattgcagaactctgag

SEQ ID NO: 89967 - DNA, 25 bp, Rattus norvegicus
acgccttttgagctatgtaacttaa

SEQ ID NO: 89968 - DNA, 25 bp, Rattus norvegicus
acgccttttgaggtatgtaacttaa

SEQ ID NO: 89969 - DNA, 25 bp, Rattus norvegicus
acgcgaactgtgaatgtcactttga

SEQ ID NO: 89970 - DNA, 25 bp, Rattus norvegicus
acgcgaactgtgtatgtcactttga

SEQ ID NO: 89971 - DNA, 25 bp, Rattus norvegicus
acgcgacagcccactgaggaggcag

SEQ ID NO: 89972 - DNA, 25 bp, Rattus norvegicus
acgcgacagccctctgaggaggcag

SEQ ID NO: 89973 - DNA, 25 bp, Rattus norvegicus
acgcgactctaccactgccaggagg

SEQ ID NO: 89974 - DNA, 25 bp, Rattus norvegicus
acgcgactctacgactgccaggagg

SEQ ID NO: 89975 - DNA, 25 bp, Rattus norvegicus
acgcgagaagtaaatgctgttgatc

SEQ ID NO: 89976 - DNA, 25 bp, Rattus norvegicus
acgcgagaagtatatgctgttgatc

SEQ ID NO: 89977 - DNA, 25 bp, Rattus norvegicus
acgcgagagacgagcttccgaagga

SEQ ID NO: 89978 - DNA, 25 bp, Rattus norvegicus
acgcgagagacgtgcttccgaagga

SEQ ID NO: 89979 - DNA, 25 bp, Rattus norvegicus
acgcgagctataccctgctggaaga

SEQ ID NO: 89980 - DNA, 25 bp, Rattus norvegicus
acgcgagctatagcctgctggaaga

SEQ ID NO: 89981 - DNA, 25 bp, Rattus norvegicus
acgcgatcagatcttatgaatcaga

SEQ ID NO: 89982 - DNA, 25 bp, Rattus norvegicus
acgcgatcagatgttatgaatcaga

SEQ ID NO: 89983 - DNA, 25 bp, Rattus norvegicus
acgcgattggaaatttgggccctga

SEQ ID NO: 89984 - DNA, 25 bp, Rattus norvegicus
acgcgattggaattttgggccctga

SEQ ID NO: 89985 - DNA, 25 bp, Rattus norvegicus
acgcgcactgtgcagatcatcaacg

SEQ ID NO: 89986 - DNA, 25 bp, Rattus norvegicus
acgcgcactgtggagatcatcaacg

SEQ ID NO: 89987 - DNA, 25 bp, Rattus norvegicus
acgcgcagcgaacacacaggaggaa

SEQ ID NO: 89988 - DNA, 25 bp, Rattus norvegicus
acgcgcagcgaagacacaggaggaa

SEQ ID NO: 89989 - DNA, 25 bp, Rattus norvegicus
acgcgcaggcctctgtactggtgta

SEQ ID NO: 89990 - DNA, 25 bp, Rattus norvegicus
acgcgcaggcctgtgtactggtgta

SEQ ID NO: 89991 - DNA, 25 bp, Rattus norvegicus
acgcgcatgccaacaacgtgtagga

SEQ ID NO: 89992 - DNA, 25 bp, Rattus norvegicus
acgcgcatgccatcaacgtgtagga

SEQ ID NO: 89993 - DNA, 25 bp, Rattus norvegicus
acgcgcatgtcaacggctgggctaa

SEQ ID NO: 89994 - DNA, 25 bp, Rattus norvegicus
acgcgcatgtcatcggctgggctaa

SEQ ID NO: 89995 - DNA, 25 bp, Rattus norvegicus
acgcgccaaaaaccttctcaagaca

SEQ ID NO: 89996 - DNA, 25 bp, Rattus norvegicus
acgcgccaaaaagcttctcaagaca

SEQ ID NO: 89997 - DNA, 25 bp, Rattus norvegicus
acgcgcccactgaagaggatcctta

SEQ ID NO: 89998 - DNA, 25 bp, Rattus norvegicus
acgcgcccactgacatgggtggaat

SEQ ID NO: 89999 - DNA, 25 bp, Rattus norvegicus
acgcgcccactgtagaggatcctta

SEQ ID NO: 90000 - DNA, 25 bp, Rattus norvegicus
acgcgcccactgtcatgggtggaat

SEQ ID NO: 90001 - DNA, 25 bp, Rattus norvegicus
acgcgcccgatcacgtctgatctcg

SEQ ID NO: 90002 - DNA, 25 bp, Rattus norvegicus
acgcgcccgatctcgtctgatctcg

SEQ ID NO: 90003 - DNA, 25 bp, Rattus norvegicus
acgcgcctgggtaatgactttcaca

SEQ ID NO: 90004 - DNA, 25 bp, Rattus norvegicus
acgcgcctgggttatgactttcaca

SEQ ID NO: 90005 - DNA, 25 bp, Rattus norvegicus
acgcgcgaagctcttgccgcagcga

SEQ ID NO: 90006 - DNA, 25 bp, Rattus norvegicus
acgcgcgaagctgttgccgcagcga

SEQ ID NO: 90007 - DNA, 25 bp, Rattus norvegicus
acgcgcgagaatcctgctcatctga

SEQ ID NO: 90008 - DNA, 25 bp, Rattus norvegicus
acgcgcgagaatgctgctcatctga

SEQ ID NO: 90009 - DNA, 25 bp, Rattus norvegicus
acgcgcgagtcaccgtcaaatacga

SEQ ID NO: 90010 - DNA, 25 bp, Rattus norvegicus
acgcgcgagtcagcgtcaaatacga

SEQ ID NO: 90011 - DNA, 25 bp, Rattus norvegicus
acgcgcggtgaacccagattaggat

SEQ ID NO: 90012 - DNA, 25 bp, Rattus norvegicus
acgcgcggtgaagccagattaggat

SEQ ID NO: 90013 - DNA, 25 bp, Rattus norvegicus
acgcgcgtctggacttaggtggacc

SEQ ID NO: 90014 - DNA, 25 bp, Rattus norvegicus
acgcgcgtctggtcttaggtggacc

SEQ ID NO: 90015 - DNA, 25 bp, Rattus norvegicus
acgcgctgctgcaggatttaatttc

SEQ ID NO: 90016 - DNA, 25 bp, Rattus norvegicus
acgcgctgctgctggatttaatttc

SEQ ID NO: 90017 - DNA, 25 bp, Rattus norvegicus
acgcgctgctggatcagatcagagc

SEQ ID NO: 90018 - DNA, 25 bp, Rattus norvegicus
acgcgctgctggttcagatcagagc

SEQ ID NO: 90019 - DNA, 25 bp, Rattus norvegicus
acgcgctgggagatctttttctgct

SEQ ID NO: 90020 - DNA, 25 bp, Rattus norvegicus
acgcgctgggagttctttttctgct

SEQ ID NO: 90021 - DNA, 25 bp, Rattus norvegicus
acgcggaagcctatgttgtgacatc

SEQ ID NO: 90022 - DNA, 25 bp, Rattus norvegicus
acgcggaagcctttgttgtgacatc

SEQ ID NO: 90023 - DNA, 25 bp, Rattus norvegicus
acgcggacttgactgcacctgagaa

SEQ ID NO: 90024 - DNA, 25 bp, Rattus norvegicus
acgcggacttgagtgcacctgagaa

SEQ ID NO: 90025 - DNA, 25 bp, Rattus norvegicus
acgcggagctccctgaagagagtta

SEQ ID NO: 90026 - DNA, 25 bp, Rattus norvegicus
acgcggagctccgtgaagagagtta

SEQ ID NO: 90027 - DNA, 25 bp, Rattus norvegicus
acgcggcccgcgacaacaagaagac

SEQ ID NO: 90028 - DNA, 25 bp, Rattus norvegicus
acgcggcccgcgtcaacaagaagac

SEQ ID NO: 90029 - DNA, 25 bp, Rattus norvegicus
acgcggccttagattccattttcat

SEQ ID NO: 90030 - DNA, 25 bp, Rattus norvegicus
acgcggccttagtttccattttcat

SEQ ID NO: 90031 - DNA, 25 bp, Rattus norvegicus
acgcggcggcggctctgggtcttgc

SEQ ID NO: 90032 - DNA, 25 bp, Rattus norvegicus
acgcggcggcgggtctgggtcttgc

SEQ ID NO: 90033 - DNA, 25 bp, Rattus norvegicus
acgcggcttcggacgagctccggtc

SEQ ID NO: 90034 - DNA, 25 bp, Rattus norvegicus
acgcggcttcggtcgagctccggtc

SEQ ID NO: 90035 - DNA, 25 bp, Rattus norvegicus
acgcgggtggctcgtgttcggtgac

SEQ ID NO: 90036 - DNA, 25 bp, Rattus norvegicus
acgcgggtggctggtgttcggtgac

SEQ ID NO: 90037 - DNA, 25 bp, Rattus norvegicus
acgcgggttgtgcacctggctggat

SEQ ID NO: 90038 - DNA, 25 bp, Rattus norvegicus
acgcgggttgtggacctggctggat

SEQ ID NO: 90039 - DNA, 25 bp, Rattus norvegicus
acgcggtctctgagcagccagggca

SEQ ID NO: 90040 - DNA, 25 bp, Rattus norvegicus
acgcggtctctgtgcagccagggca

SEQ ID NO: 90041 - DNA, 25 bp, Rattus norvegicus
acgcggtgagccaggagcaacacaa

SEQ ID NO: 90042 - DNA, 25 bp, Rattus norvegicus
acgcggtgagcctggagcaacacaa

SEQ ID NO: 90043 - DNA, 25 bp, Rattus norvegicus
acgcggttgagtcctatacctacaa

SEQ ID NO: 90044 - DNA, 25 bp, Rattus norvegicus
acgcggttgagtgctatacctacaa

SEQ ID NO: 90045 - DNA, 25 bp, Rattus norvegicus
acgcgtacactcagcactgattggg

SEQ ID NO: 90046 - DNA, 25 bp, Rattus norvegicus
acgcgtacactctgcactgattggg

SEQ ID NO: 90047 - DNA, 25 bp, Rattus norvegicus
acgcgtactgcactgtgacagccat

SEQ ID NO: 90048 - DNA, 25 bp, Rattus norvegicus
acgcgtactgcagtgtgacagccat

SEQ ID NO: 90049 - DNA, 25 bp, Rattus norvegicus
acgcgtccaacaactcaaacttgat

SEQ ID NO: 90050 - DNA, 25 bp, Rattus norvegicus
acgcgtccaacatctcaaacttgat

SEQ ID NO: 90051 - DNA, 25 bp, Rattus norvegicus
acgcgtcctggtaacggccagctgg

SEQ ID NO: 90052 - DNA, 25 bp, Rattus norvegicus
acgcgtcctggttacggccagctgg

SEQ ID NO: 90053 - DNA, 25 bp, Rattus norvegicus
acgcgtctagatagtagattccctt

SEQ ID NO: 90054 - DNA, 25 bp, Rattus norvegicus
acgcgtctagattgtagattccctt

SEQ ID NO: 90055 - DNA, 25 bp, Rattus norvegicus
acgcgtgcgtccacaataggtttag

SEQ ID NO: 90056 - DNA, 25 bp, Rattus norvegicus
acgcgtgcgtcctcaataggtttag

SEQ ID NO: 90057 - DNA, 25 bp, Rattus norvegicus
acgcgtgctttgacttacagggact

SEQ ID NO: 90058 - DNA, 25 bp, Rattus norvegicus
acgcgtgctttgtcttacagggact

SEQ ID NO: 90059 - DNA, 25 bp, Rattus norvegicus
acgcgtggcagaccttagtgcaatt

SEQ ID NO: 90060 - DNA, 25 bp, Rattus norvegicus
acgcgtggcagagcttagtgcaatt

SEQ ID NO: 90061 - DNA, 25 bp, Rattus norvegicus
acgcgtgtccatcttgaagggcatc

SEQ ID NO: 90062 - DNA, 25 bp, Rattus norvegicus
acgcgtgtccatgttgaagggcatc

SEQ ID NO: 90063 - DNA, 25 bp, Rattus norvegicus
acgcgtgtgttgaatctgtctgtcc

SEQ ID NO: 90064 - DNA, 25 bp, Rattus norvegicus
acgcgtgtgttgtatctgtctgtcc

SEQ ID NO: 90065 - DNA, 25 bp, Rattus norvegicus
acgctaagctgtagttcattcccaa

SEQ ID NO: 90066 - DNA, 25 bp, Rattus norvegicus
acgctaagctgttgttcattcccaa

SEQ ID NO: 90067 - DNA, 25 bp, Rattus norvegicus
acgctaatagtgagatgttctgatc

SEQ ID NO: 90068 - DNA, 25 bp, Rattus norvegicus
acgctaatagtgtgatgttctgatc

SEQ ID NO: 90069 - DNA, 25 bp, Rattus norvegicus
acgctacagataatgaatgcacctt

SEQ ID NO: 90070 - DNA, 25 bp, Rattus norvegicus
acgctacagatattgaatgcacctt

SEQ ID NO: 90071 - DNA, 25 bp, Rattus norvegicus
acgctaccaaagaggtggataccct

SEQ ID NO: 90072 - DNA, 25 bp, Rattus norvegicus
acgctaccaaagtggtggataccct

SEQ ID NO: 90073 - DNA, 25 bp, Rattus norvegicus
acgctaccatgaacagacccagtct

SEQ ID NO: 90074 - DNA, 25 bp, Rattus norvegicus
acgctaccatgatcagacccagtct

SEQ ID NO: 90075 - DNA, 25 bp, Rattus norvegicus
acgctaccttatactctatctgaaa

SEQ ID NO: 90076 - DNA, 25 bp, Rattus norvegicus
acgctaccttattctctatctgaaa

SEQ ID NO: 90077 - DNA, 25 bp, Rattus norvegicus
acgctactgagtcacctggaggaac

SEQ ID NO: 90078 - DNA, 25 bp, Rattus norvegicus
acgctactgagtgacctggaggaac

SEQ ID NO: 90079 - DNA, 25 bp, Rattus norvegicus
acgctagctaggcacgcaccaagat

SEQ ID NO: 90080 - DNA, 25 bp, Rattus norvegicus
acgctagctagggacgcaccaagat

SEQ ID NO: 90081 - DNA, 25 bp, Rattus norvegicus
acgctagctattctctttacctggg

SEQ ID NO: 90082 - DNA, 25 bp, Rattus norvegicus
acgctagctattgtctttacctggg

SEQ ID NO: 90083 - DNA, 25 bp, Rattus norvegicus
acgctagctgtgacggtcctggccc

SEQ ID NO: 90084 - DNA, 25 bp, Rattus norvegicus
acgctagctgtgtcggtcctggccc

SEQ ID NO: 90085 - DNA, 25 bp, Rattus norvegicus
acgctagctttcactactgcagaga

SEQ ID NO: 90086 - DNA, 25 bp, Rattus norvegicus
acgctagctttctctactgcagaga

SEQ ID NO: 90087 - DNA, 25 bp, Rattus norvegicus
acgctaggcggaatagttggtattt

SEQ ID NO: 90088 - DNA, 25 bp, Rattus norvegicus
acgctaggcggattagttggtattt

SEQ ID NO: 90089 - DNA, 25 bp, Rattus norvegicus
acgctatgtatcagcttcatgtgtt

SEQ ID NO: 90090 - DNA, 25 bp, Rattus norvegicus
acgctatgtatctgcttcatgtgtt

SEQ ID NO: 90091 - DNA, 25 bp, Rattus norvegicus
acgctcaaaagcactccaacgggaa

SEQ ID NO: 90092 - DNA, 25 bp, Rattus norvegicus
acgctcaaaagctctccaacgggaa

SEQ ID NO: 90093 - DNA, 25 bp, Rattus norvegicus
acgctcaattgtctttattttggag

SEQ ID NO: 90094 - DNA, 25 bp, Rattus norvegicus
acgctcaattgtgtttattttggag

SEQ ID NO: 90095 - DNA, 25 bp, Rattus norvegicus
acgctcactcggaaggctcaagtgg

SEQ ID NO: 90096 - DNA, 25 bp, Rattus norvegicus
acgctcactcggtaggctcaagtgg

SEQ ID NO: 90097 - DNA, 25 bp, Rattus norvegicus
acgctcagcccacgtcggatggaga

SEQ ID NO: 90098 - DNA, 25 bp, Rattus norvegicus
acgctcagcccaggtcggatggaga

SEQ ID NO: 90099 - DNA, 25 bp, Rattus norvegicus
acgctcagcctgctatggatgccat

SEQ ID NO: 90100 - DNA, 25 bp, Rattus norvegicus
acgctcagcctggtatggatgccat

SEQ ID NO: 90101 - DNA, 25 bp, Rattus norvegicus
acgctcagtgttcagaagccagtga

SEQ ID NO: 90102 - DNA, 25 bp, Rattus norvegicus
acgctcagtgttgagaagccagtga

SEQ ID NO: 90103 - DNA, 25 bp, Rattus norvegicus
acgctcatcagtctttttactcatg

SEQ ID NO: 90104 - DNA, 25 bp, Rattus norvegicus
acgctcatcagtgtttttactcatg

SEQ ID NO: 90105 - DNA, 25 bp, Rattus norvegicus
acgctcatccagatataccaacact

SEQ ID NO: 90106 - DNA, 25 bp, Rattus norvegicus
acgctcatccagttataccaacact

SEQ ID NO: 90107 - DNA, 25 bp, Rattus norvegicus
acgctcatctccatttgaacatgta

SEQ ID NO: 90108 - DNA, 25 bp, Rattus norvegicus
acgctcatctccttttgaacatgta

SEQ ID NO: 90109 - DNA, 25 bp, Rattus norvegicus
acgctccaaactcccgtctaattta

SEQ ID NO: 90110 - DNA, 25 bp, Rattus norvegicus
acgctccaaactgccgtctaattta

SEQ ID NO: 90111 - DNA, 25 bp, Rattus norvegicus
acgctccagtaaaccttcagtgtct

SEQ ID NO: 90112 - DNA, 25 bp, Rattus norvegicus
acgctccagtaatccttcagtgtct

SEQ ID NO: 90113 - DNA, 25 bp, Rattus norvegicus
acgctccattgcacagtattggctg

SEQ ID NO: 90114 - DNA, 25 bp, Rattus norvegicus
acgctccattgctcagtattggctg

SEQ ID NO: 90115 - DNA, 25 bp, Rattus norvegicus
acgctccctatcagtggtcataaat

SEQ ID NO: 90116 - DNA, 25 bp, Rattus norvegicus
acgctccctatctgtggtcataaat

SEQ ID NO: 90117 - DNA, 25 bp, Rattus norvegicus
acgctccctgaaatgtaatttgcta

SEQ ID NO: 90118 - DNA, 25 bp, Rattus norvegicus
acgctccctgaattgtaatttgcta

SEQ ID NO: 90119 - DNA, 25 bp, Rattus norvegicus
acgctcgcacacacagggtctgctg

SEQ ID NO: 90120 - DNA, 25 bp, Rattus norvegicus
acgctcgcacactcagggtctgctg

SEQ ID NO: 90121 - DNA, 25 bp, Rattus norvegicus
acgctcgttttcatcagctgatgtt

SEQ ID NO: 90122 - DNA, 25 bp, Rattus norvegicus
acgctcgttttcttcagctgatgtt

SEQ ID NO: 90123 - DNA, 25 bp, Rattus norvegicus
acgctctatctcctctgaatgtgga

SEQ ID NO: 90124 - DNA, 25 bp, Rattus norvegicus
acgctctatctcgtctgaatgtgga

SEQ ID NO: 90125 - DNA, 25 bp, Rattus norvegicus
acgctctcaacgatatgacttccat

SEQ ID NO: 90126 - DNA, 25 bp, Rattus norvegicus
acgctctcaacgttatgacttccat

SEQ ID NO: 90127 - DNA, 25 bp, Rattus norvegicus
acgctctcatctaaatattctcctg

SEQ ID NO: 90128 - DNA, 25 bp, Rattus norvegicus
acgctctcatcttaatattctcctg

SEQ ID NO: 90129 - DNA, 25 bp, Rattus norvegicus
acgctctcattaagtggtccaggct

SEQ ID NO: 90130 - DNA, 25 bp, Rattus norvegicus
acgctctcattatgtggtccaggct

SEQ ID NO: 90131 - DNA, 25 bp, Rattus norvegicus
acgctcttaagactagctactacat

SEQ ID NO: 90132 - DNA, 25 bp, Rattus norvegicus
acgctcttaagagtagctactacat

SEQ ID NO: 90133 - DNA, 25 bp, Rattus norvegicus
acgctcttacaaagcaaagtgcctg

SEQ ID NO: 90134 - DNA, 25 bp, Rattus norvegicus
acgctcttacaatgcaaagtgcctg

SEQ ID NO: 90135 - DNA, 25 bp, Rattus norvegicus
acgctcttgcagaacttgccaacaa

SEQ ID NO: 90136 - DNA, 25 bp, Rattus norvegicus
acgctcttgcagtacttgccaacaa

SEQ ID NO: 90137 - DNA, 25 bp, Rattus norvegicus
acgctgaactgtcgttggatcccta

SEQ ID NO: 90138 - DNA, 25 bp, Rattus norvegicus
acgctgaactgtggttggatcccta

SEQ ID NO: 90139 - DNA, 25 bp, Rattus norvegicus
acgctgaatataagaccacgctcac

SEQ ID NO: 90140 - DNA, 25 bp, Rattus norvegicus
acgctgaatatatgaccacgctcac

SEQ ID NO: 90141 - DNA, 25 bp, Rattus norvegicus
acgctgaattgtaggtggtacacga

SEQ ID NO: 90142 - DNA, 25 bp, Rattus norvegicus
acgctgaattgttggtggtacacga

SEQ ID NO: 90143 - DNA, 25 bp, Rattus norvegicus
acgctgacctggaggctctgaggca

SEQ ID NO: 90144 - DNA, 25 bp, Rattus norvegicus
acgctgacctggtggctctgaggca

SEQ ID NO: 90145 - DNA, 25 bp, Rattus norvegicus
acgctgagacgccatgacgaccggc

SEQ ID NO: 90146 - DNA, 25 bp, Rattus norvegicus
acgctgagacgcgatgacgaccggc

SEQ ID NO: 90147 - DNA, 25 bp, Rattus norvegicus
acgctgaggcaccagtgctccctgt

SEQ ID NO: 90148 - DNA, 25 bp, Rattus norvegicus
acgctgaggcacgagtgctccctgt

SEQ ID NO: 90149 - DNA, 25 bp, Rattus norvegicus
acgctgagtccgaggccgagtctcc

SEQ ID NO: 90150 - DNA, 25 bp, Rattus norvegicus
acgctgagtccgtggccgagtctcc

SEQ ID NO: 90151 - DNA, 25 bp, Rattus norvegicus
acgctgcacaggctgcgtctttgac

SEQ ID NO: 90152 - DNA, 25 bp, Rattus norvegicus
acgctgcacagggtgcgtctttgac

SEQ ID NO: 90153 - DNA, 25 bp, Rattus norvegicus
acgctgcagatgcacagcatcacag

SEQ ID NO: 90154 - DNA, 25 bp, Rattus norvegicus
acgctgcagatggacagcatcacag

SEQ ID NO: 90155 - DNA, 25 bp, Rattus norvegicus
acgctgcagcctacatagtcgagga

SEQ ID NO: 90156 - DNA, 25 bp, Rattus norvegicus
acgctgcagccttcatagtcgagga

SEQ ID NO: 90157 - DNA, 25 bp, Rattus norvegicus
acgctgccaaatctctcatgttgtc

SEQ ID NO: 90158 - DNA, 25 bp, Rattus norvegicus
acgctgccaaatgtctcatgttgtc

SEQ ID NO: 90159 - DNA, 25 bp, Rattus norvegicus
acgctgccgctcagacggagagaac

SEQ ID NO: 90160 - DNA, 25 bp, Rattus norvegicus
acgctgccgctctgacggagagaac

SEQ ID NO: 90161 - DNA, 25 bp, Rattus norvegicus
acgctgccttgccttacgtaaagaa

SEQ ID NO: 90162 - DNA, 25 bp, Rattus norvegicus
acgctgccttgcgttacgtaaagaa

SEQ ID NO: 90163 - DNA, 25 bp, Rattus norvegicus
acgctgcgtctgatgggccgctgcc

SEQ ID NO: 90164 - DNA, 25 bp, Rattus norvegicus
acgctgcgtctgttgggccgctgcc

SEQ ID NO: 90165 - DNA, 25 bp, Rattus norvegicus
acgctgcgtgtaatagctcctatag

SEQ ID NO: 90166 - DNA, 25 bp, Rattus norvegicus
acgctgcgtgtattagctcctatag

SEQ ID NO: 90167 - DNA, 25 bp, Rattus norvegicus
acgctgctcagcaccttgttgaaag

SEQ ID NO: 90168 - DNA, 25 bp, Rattus norvegicus
acgctgctcagctccttgttgaaag

SEQ ID NO: 90169 - DNA, 25 bp, Rattus norvegicus
acgctgctgacccatgcctgtggtt

SEQ ID NO: 90170 - DNA, 25 bp, Rattus norvegicus
acgctgctgaccgatgcctgtggtt

SEQ ID NO: 90171 - DNA, 25 bp, Rattus norvegicus
acgctgctgacgatcagtgtcacaa

SEQ ID NO: 90172 - DNA, 25 bp, Rattus norvegicus
acgctgctgacgttcagtgtcacaa

SEQ ID NO: 90173 - DNA, 25 bp, Rattus norvegicus
acgctgctgcttacccttgggaggg

SEQ ID NO: 90174 - DNA, 25 bp, Rattus norvegicus
acgctgctgctttcccttgggaggg

SEQ ID NO: 90175 - DNA, 25 bp, Rattus norvegicus
acgctgctttaacatctctgggtct

SEQ ID NO: 90176 - DNA, 25 bp, Rattus norvegicus
acgctgctttaagatctctgggtct

SEQ ID NO: 90177 - DNA, 25 bp, Rattus norvegicus
acgctggaccagagtggacgttcct

SEQ ID NO: 90178 - DNA, 25 bp, Rattus norvegicus
acgctggaccagtgtggacgttcct

SEQ ID NO: 90179 - DNA, 25 bp, Rattus norvegicus
acgctggacggcagccaagcacagt

SEQ ID NO: 90180 - DNA, 25 bp, Rattus norvegicus
acgctggacggctgccaagcacagt

SEQ ID NO: 90181 - DNA, 25 bp, Rattus norvegicus
acgctggcatctaccagcacatagg

SEQ ID NO: 90182 - DNA, 25 bp, Rattus norvegicus
acgctggcatcttccagcacatagg

SEQ ID NO: 90183 - DNA, 25 bp, Rattus norvegicus
acgctggccggcagggacaagaaca

SEQ ID NO: 90184 - DNA, 25 bp, Rattus norvegicus
acgctggccggctgggacaagaaca

SEQ ID NO: 90185 - DNA, 25 bp, Rattus norvegicus
acgctggctcagagtctagatcaaa

SEQ ID NO: 90186 - DNA, 25 bp, Rattus norvegicus
acgctggctcagtgtctagatcaaa

SEQ ID NO: 90187 - DNA, 25 bp, Rattus norvegicus
acgctggctcctatatgttcagaaa

SEQ ID NO: 90188 - DNA, 25 bp, Rattus norvegicus
acgctggctcctttatgttcagaaa

SEQ ID NO: 90189 - DNA, 25 bp, Rattus norvegicus
acgctgggaagacgcctgtgcccaa

SEQ ID NO: 90190 - DNA, 25 bp, Rattus norvegicus
acgctgggaagaggcctgtgcccaa

SEQ ID NO: 90191 - DNA, 25 bp, Rattus norvegicus
acgctgggcagcacttcaagggtat

SEQ ID NO: 90192 - DNA, 25 bp, Rattus norvegicus
acgctgggcagctcttcaagggtat

SEQ ID NO: 90193 - DNA, 25 bp, Rattus norvegicus
acgctgggtttccacagtttggaca

SEQ ID NO: 90194 - DNA, 25 bp, Rattus norvegicus
acgctgggtttcgacagtttggaca

SEQ ID NO: 90195 - DNA, 25 bp, Rattus norvegicus
acgctgggtttgatggtacgtgcct

SEQ ID NO: 90196 - DNA, 25 bp, Rattus norvegicus
acgctgggtttgttggtacgtgcct

SEQ ID NO: 90197 - DNA, 25 bp, Rattus norvegicus
acgctggtacagaatgtggaacctt

SEQ ID NO: 90198 - DNA, 25 bp, Rattus norvegicus
acgctggtacagtatgtggaacctt

SEQ ID NO: 90199 - DNA, 25 bp, Rattus norvegicus
acgctggtcaccagtgtgactttta

SEQ ID NO: 90200 - DNA, 25 bp, Rattus norvegicus
acgctggtcacctgtgtgactttta

SEQ ID NO: 90201 - DNA, 25 bp, Rattus norvegicus
acgctggtcttcagggatcaccatg

SEQ ID NO: 90202 - DNA, 25 bp, Rattus norvegicus
acgctggtcttctgggatcaccatg

SEQ ID NO: 90203 - DNA, 25 bp, Rattus norvegicus
acgctggtgcccagtgaactctggt

SEQ ID NO: 90204 - DNA, 25 bp, Rattus norvegicus
acgctggtgccctgtgaactctggt

SEQ ID NO: 90205 - DNA, 25 bp, Rattus norvegicus
acgctggttgaaatttgttttgaca

SEQ ID NO: 90206 - DNA, 25 bp, Rattus norvegicus
acgctggttgaattttgttttgaca

SEQ ID NO: 90207 - DNA, 25 bp, Rattus norvegicus
acgctgtagtggagtttgtggtcta

SEQ ID NO: 90208 - DNA, 25 bp, Rattus norvegicus
acgctgtagtggtgtttgtggtcta

SEQ ID NO: 90209 - DNA, 25 bp, Rattus norvegicus
acgctgtataaaattgttctcttca

SEQ ID NO: 90210 - DNA, 25 bp, Rattus norvegicus
acgctgtataaatttgttctcttca

SEQ ID NO: 90211 - DNA, 25 bp, Rattus norvegicus
acgctgtatcagatatcctggccaa

SEQ ID NO: 90212 - DNA, 25 bp, Rattus norvegicus
acgctgtatcagttatcctggccaa

SEQ ID NO: 90213 - DNA, 25 bp, Rattus norvegicus
acgctgtcgacaagatctactgcaa

SEQ ID NO: 90214 - DNA, 25 bp, Rattus norvegicus
acgctgtcgacatgatctactgcaa

SEQ ID NO: 90215 - DNA, 25 bp, Rattus norvegicus
acgctgtgacttagtgactggtaaa

SEQ ID NO: 90216 - DNA, 25 bp, Rattus norvegicus
acgctgtgactttgtgactggtaaa

SEQ ID NO: 90217 - DNA, 25 bp, Rattus norvegicus
acgctgtgatgtctaggctgtgacc

SEQ ID NO: 90218 - DNA, 25 bp, Rattus norvegicus
acgctgtgatgtgtaggctgtgacc

SEQ ID NO: 90219 - DNA, 25 bp, Rattus norvegicus
acgctgtgcagaagcagatcatggt

SEQ ID NO: 90220 - DNA, 25 bp, Rattus norvegicus
acgctgtgcagatgcagatcatggt

SEQ ID NO: 90221 - DNA, 25 bp, Rattus norvegicus
acgctgtgcagtcagcatggctcga

SEQ ID NO: 90222 - DNA, 25 bp, Rattus norvegicus
acgctgtgcagtgagcatggctcga

SEQ ID NO: 90223 - DNA, 25 bp, Rattus norvegicus
acgctgtgtgcacttaccgtacaat

SEQ ID NO: 90224 - DNA, 25 bp, Rattus norvegicus
acgctgtgtgcagttaccgtacaat

SEQ ID NO: 90225 - DNA, 25 bp, Rattus norvegicus
acgctgtgtttgattgtaccttgtt

SEQ ID NO: 90226 - DNA, 25 bp, Rattus norvegicus
acgctgtgtttgtttgtaccttgtt

SEQ ID NO: 90227 - DNA, 25 bp, Rattus norvegicus
acgctgttaacgagcatacttaata

SEQ ID NO: 90228 - DNA, 25 bp, Rattus norvegicus
acgctgttaacgtgcatacttaata

SEQ ID NO: 90229 - DNA, 25 bp, Rattus norvegicus
acgcttacaatcaccatgaacctaa

SEQ ID NO: 90230 - DNA, 25 bp, Rattus norvegicus
acgcttacaatctccatgaacctaa

SEQ ID NO: 90231 - DNA, 25 bp, Rattus norvegicus
acgcttacatagcaagcactgggtc

SEQ ID NO: 90232 - DNA, 25 bp, Rattus norvegicus
acgcttacataggaagcactgggtc

SEQ ID NO: 90233 - DNA, 25 bp, Rattus norvegicus
acgcttagctcaactgcagatatgt

SEQ ID NO: 90234 - DNA, 25 bp, Rattus norvegicus
acgcttagctcatctgcagatatgt

SEQ ID NO: 90235 - DNA, 25 bp, Rattus norvegicus
acgcttaggaatccttggcctctgg

SEQ ID NO: 90236 - DNA, 25 bp, Rattus norvegicus
acgcttaggaatgcttggcctctgg

SEQ ID NO: 90237 - DNA, 25 bp, Rattus norvegicus
acgcttatgagtactgtgccaggtc

SEQ ID NO: 90238 - DNA, 25 bp, Rattus norvegicus
acgcttatgagttctgtgccaggtc

SEQ ID NO: 90239 - DNA, 25 bp, Rattus norvegicus
acgcttcctttgaactgtggcagct

SEQ ID NO: 90240 - DNA, 25 bp, Rattus norvegicus
acgcttcctttgtactgtggcagct

SEQ ID NO: 90241 - DNA, 25 bp, Rattus norvegicus
acgcttctctaccatcttcaacaga

SEQ ID NO: 90242 - DNA, 25 bp, Rattus norvegicus
acgcttctctacgatcttcaacaga

SEQ ID NO: 90243 - DNA, 25 bp, Rattus norvegicus
acgcttctttccagtactactgtag

SEQ ID NO: 90244 - DNA, 25 bp, Rattus norvegicus
acgcttctttcctgtactactgtag

SEQ ID NO: 90245 - DNA, 25 bp, Rattus norvegicus
acgcttgccttgcttgtgagcattc

SEQ ID NO: 90246 - DNA, 25 bp, Rattus norvegicus
acgcttgccttggttgtgagcattc

SEQ ID NO: 90247 - DNA, 25 bp, Rattus norvegicus
acgcttggattgcaggtcccagcag

SEQ ID NO: 90248 - DNA, 25 bp, Rattus norvegicus
acgcttggattggaggtcccagcag

SEQ ID NO: 90249 - DNA, 25 bp, Rattus norvegicus
acgcttggcttcctgatttggtaat

SEQ ID NO: 90250 - DNA, 25 bp, Rattus norvegicus
acgcttggcttcgtgatttggtaat

SEQ ID NO: 90251 - DNA, 25 bp, Rattus norvegicus
acgcttgtctgtcaggctgcaattc

SEQ ID NO: 90252 - DNA, 25 bp, Rattus norvegicus
acgcttgtctgtcttttgatgtaga

SEQ ID NO: 90253 - DNA, 25 bp, Rattus norvegicus
acgcttgtctgtgaggctgcaattc

SEQ ID NO: 90254 - DNA, 25 bp, Rattus norvegicus
acgcttgtctgtgttttgatgtaga

SEQ ID NO: 90255 - DNA, 25 bp, Rattus norvegicus
acgcttgtggatcgctgcacgagtc

SEQ ID NO: 90256 - DNA, 25 bp, Rattus norvegicus
acgcttgtggatggctgcacgagtc

SEQ ID NO: 90257 - DNA, 25 bp, Rattus norvegicus
acgctttacgtgatcatacttgctt

SEQ ID NO: 90258 - DNA, 25 bp, Rattus norvegicus
acgctttacgtgttcatacttgctt

SEQ ID NO: 90259 - DNA, 25 bp, Rattus norvegicus
acgctttagagcacttatggtctta

SEQ ID NO: 90260 - DNA, 25 bp, Rattus norvegicus
acgctttagagctcttatggtctta

SEQ ID NO: 90261 - DNA, 25 bp, Rattus norvegicus
acgctttgaccgaatttacctgtga

SEQ ID NO: 90262 - DNA, 25 bp, Rattus norvegicus
acgctttgaccgtatttacctgtga

SEQ ID NO: 90263 - DNA, 25 bp, Rattus norvegicus
acggaaagacctcaatgcgcctgac

SEQ ID NO: 90264 - DNA, 25 bp, Rattus norvegicus
acggaaagacctgaatgcgcctgac

SEQ ID NO: 90265 - DNA, 25 bp, Rattus norvegicus
acggaaagtactctctgtatttagg

SEQ ID NO: 90266 - DNA, 25 bp, Rattus norvegicus
acggaaagtactgtctgtatttagg

SEQ ID NO: 90267 - DNA, 25 bp, Rattus norvegicus
acggaaattcctcagcccatatgac

SEQ ID NO: 90268 - DNA, 25 bp, Rattus norvegicus
acggaaattcctgagcccatatgac

SEQ ID NO: 90269 - DNA, 25 bp, Rattus norvegicus
acggaacctatcaactttgggcaga

SEQ ID NO: 90270 - DNA, 25 bp, Rattus norvegicus
acggaacctatctactttgggcaga

SEQ ID NO: 90271 - DNA, 25 bp, Rattus norvegicus
acggaactacgcatttgcctcaggc

SEQ ID NO: 90272 - DNA, 25 bp, Rattus norvegicus
acggaactacgcttttgcctcaggc

SEQ ID NO: 90273 - DNA, 25 bp, Rattus norvegicus
acggaactgctcaaacttctggttg

SEQ ID NO: 90274 - DNA, 25 bp, Rattus norvegicus
acggaactgctctaacttctggttg

SEQ ID NO: 90275 - DNA, 25 bp, Rattus norvegicus
acggaagacctgctggccaagctga

SEQ ID NO: 90276 - DNA, 25 bp, Rattus norvegicus
acggaagacctggtggccaagctga

SEQ ID NO: 90277 - DNA, 25 bp, Rattus norvegicus
acggaagaggcaatcctcagccatg

SEQ ID NO: 90278 - DNA, 25 bp, Rattus norvegicus
acggaagaggcattcctcagccatg

SEQ ID NO: 90279 - DNA, 25 bp, Rattus norvegicus
acggaagatctacaactcaggagtt

SEQ ID NO: 90280 - DNA, 25 bp, Rattus norvegicus
acggaagatctagaactcaggagtt

SEQ ID NO: 90281 - DNA, 25 bp, Rattus norvegicus
acggaagcaagacccaggacctgtt

SEQ ID NO: 90282 - DNA, 25 bp, Rattus norvegicus
acggaagcaagagccaggacctgtt

SEQ ID NO: 90283 - DNA, 25 bp, Rattus norvegicus
acggaagcctggatgatgttctgca

SEQ ID NO: 90284 - DNA, 25 bp, Rattus norvegicus
acggaagcctggttgatgttctgca

SEQ ID NO: 90285 - DNA, 25 bp, Rattus norvegicus
acggaaggaatgctcggatctcaca

SEQ ID NO: 90286 - DNA, 25 bp, Rattus norvegicus
acggaaggaatggtcggatctcaca

SEQ ID NO: 90287 - DNA, 25 bp, Rattus norvegicus
acggaaggacacaagtcggctgctt

SEQ ID NO: 90288 - DNA, 25 bp, Rattus norvegicus
acggaaggacactagtcggctgctt

SEQ ID NO: 90289 - DNA, 25 bp, Rattus norvegicus
acggaaggacctatcatggcagcat

SEQ ID NO: 90290 - DNA, 25 bp, Rattus norvegicus
acggaaggacctttcatggcagcat

SEQ ID NO: 90291 - DNA, 25 bp, Rattus norvegicus
acggaaggacgcacacagagaatat

SEQ ID NO: 90292 - DNA, 25 bp, Rattus norvegicus
acggaaggacgctcacagagaatat

SEQ ID NO: 90293 - DNA, 25 bp, Rattus norvegicus
acggaagttcaacttctgtctgtat

SEQ ID NO: 90294 - DNA, 25 bp, Rattus norvegicus
acggaagttcaagttctgtctgtat

SEQ ID NO: 90295 - DNA, 25 bp, Rattus norvegicus
acggaatatgttctcctatgtagca

SEQ ID NO: 90296 - DNA, 25 bp, Rattus norvegicus
acggaatatgttgtcctatgtagca

SEQ ID NO: 90297 - DNA, 25 bp, Rattus norvegicus
acggaatcacgtaatgcttgctttg

SEQ ID NO: 90298 - DNA, 25 bp, Rattus norvegicus
acggaatcacgttatgcttgctttg

SEQ ID NO: 90299 - DNA, 25 bp, Rattus norvegicus
acggaatccgatcttctcaagaatg

SEQ ID NO: 90300 - DNA, 25 bp, Rattus norvegicus
acggaatccgatgttctcaagaatg

SEQ ID NO: 90301 - DNA, 25 bp, Rattus norvegicus
acggaatccgcgctgcccttggtgc

SEQ ID NO: 90302 - DNA, 25 bp, Rattus norvegicus
acggaatccgcggtgcccttggtgc

SEQ ID NO: 90303 - DNA, 25 bp, Rattus norvegicus
acggaatgccagatggttccttgct

SEQ ID NO: 90304 - DNA, 25 bp, Rattus norvegicus
acggaatgccagttggttccttgct

SEQ ID NO: 90305 - DNA, 25 bp, Rattus norvegicus
acggaatggagaagcttgtctgcta

SEQ ID NO: 90306 - DNA, 25 bp, Rattus norvegicus
acggaatggagatgcttgtctgcta

SEQ ID NO: 90307 - DNA, 25 bp, Rattus norvegicus
acggaattacttaccccagtgaatg

SEQ ID NO: 90308 - DNA, 25 bp, Rattus norvegicus
acggaattactttccccagtgaatg

SEQ ID NO: 90309 - DNA, 25 bp, Rattus norvegicus
acggacaaatgcaacccttaagaag

SEQ ID NO: 90310 - DNA, 25 bp, Rattus norvegicus
acggacaaatgctacccttaagaag

SEQ ID NO: 90311 - DNA, 25 bp, Rattus norvegicus
acggacaagcctcgagctgctttta

SEQ ID NO: 90312 - DNA, 25 bp, Rattus norvegicus
acggacaagcctggagctgctttta

SEQ ID NO: 90313 - DNA, 25 bp, Rattus norvegicus
acggacacacttcgcgcacatggag

SEQ ID NO: 90314 - DNA, 25 bp, Rattus norvegicus
acggacacacttggcgcacatggag

SEQ ID NO: 90315 - DNA, 25 bp, Rattus norvegicus
acggacacagttccccatgaagatt

SEQ ID NO: 90316 - DNA, 25 bp, Rattus norvegicus
acggacacagttgcccatgaagatt

SEQ ID NO: 90317 - DNA, 25 bp, Rattus norvegicus
acggacacctcaacagacttagcag

SEQ ID NO: 90318 - DNA, 25 bp, Rattus norvegicus
acggacacctcatcagacttagcag

SEQ ID NO: 90319 - DNA, 25 bp, Rattus norvegicus
acggacacctgaagaggcaacccag

SEQ ID NO: 90320 - DNA, 25 bp, Rattus norvegicus
acggacacctgatgaggcaacccag

SEQ ID NO: 90321 - DNA, 25 bp, Rattus norvegicus
acggacactaccaccagtgtgtgga

SEQ ID NO: 90322 - DNA, 25 bp, Rattus norvegicus
acggacactacctccagtgtgtgga

SEQ ID NO: 90323 - DNA, 25 bp, Rattus norvegicus
acggacactgtgactggtgctttgg

SEQ ID NO: 90324 - DNA, 25 bp, Rattus norvegicus
acggacactgtgtctggtgctttgg

SEQ ID NO: 90325 - DNA, 25 bp, Rattus norvegicus
acggacagcgccaatgagtgccagt

SEQ ID NO: 90326 - DNA, 25 bp, Rattus norvegicus
acggacagcgcctatgagtgccagt

SEQ ID NO: 90327 - DNA, 25 bp, Rattus norvegicus
acggacatctgtctgatagccatct

SEQ ID NO: 90328 - DNA, 25 bp, Rattus norvegicus
acggacatctgtgtgatagccatct

SEQ ID NO: 90329 - DNA, 25 bp, Rattus norvegicus
acggaccaaaatcggccctggcgat

SEQ ID NO: 90330 - DNA, 25 bp, Rattus norvegicus
acggaccaaaatgggccctggcgat

SEQ ID NO: 90331 - DNA, 25 bp, Rattus norvegicus
acggaccccatgagtttttaggcat

SEQ ID NO: 90332 - DNA, 25 bp, Rattus norvegicus
acggaccccatgtgtttttaggcat

SEQ ID NO: 90333 - DNA, 25 bp, Rattus norvegicus
acggacctctccaagggatctatga

SEQ ID NO: 90334 - DNA, 25 bp, Rattus norvegicus
acggacctctcctagggatctatga

SEQ ID NO: 90335 - DNA, 25 bp, Rattus norvegicus
acggacctgcagaacactctatgga

SEQ ID NO: 90336 - DNA, 25 bp, Rattus norvegicus
acggacctgcagtacactctatgga

SEQ ID NO: 90337 - DNA, 25 bp, Rattus norvegicus
acggacgacggcaggtctataagtt

SEQ ID NO: 90338 - DNA, 25 bp, Rattus norvegicus
acggacgacggctggtctataagtt

SEQ ID NO: 90339 - DNA, 25 bp, Rattus norvegicus
acggacgagttcaactctccccagg

SEQ ID NO: 90340 - DNA, 25 bp, Rattus norvegicus
acggacgagttctactctccccagg

SEQ ID NO: 90341 - DNA, 25 bp, Rattus norvegicus
acggacgcccagagtttagtagaag

SEQ ID NO: 90342 - DNA, 25 bp, Rattus norvegicus
acggacgcccagtgtttagtagaag

SEQ ID NO: 90343 - DNA, 25 bp, Rattus norvegicus
acggacgcttgcataatagtttcaa

SEQ ID NO: 90344 - DNA, 25 bp, Rattus norvegicus
acggacgcttgcttaatagtttcaa

SEQ ID NO: 90345 - DNA, 25 bp, Rattus norvegicus
acggacgtcctcaagtgtgtggtca

SEQ ID NO: 90346 - DNA, 25 bp, Rattus norvegicus
acggacgtcctctagtgtgtggtca

SEQ ID NO: 90347 - DNA, 25 bp, Rattus norvegicus
acggactcaatcacagactctgggt

SEQ ID NO: 90348 - DNA, 25 bp, Rattus norvegicus
acggactcaatctcagactctgggt

SEQ ID NO: 90349 - DNA, 25 bp, Rattus norvegicus
acggactccataaaaggcttagggt

SEQ ID NO: 90350 - DNA, 25 bp, Rattus norvegicus
acggactccatataaggcttagggt

SEQ ID NO: 90351 - DNA, 25 bp, Rattus norvegicus
acggactcgtcaccgcagctttggc

SEQ ID NO: 90352 - DNA, 25 bp, Rattus norvegicus
acggactcgtcagcgcagctttggc

SEQ ID NO: 90353 - DNA, 25 bp, Rattus norvegicus
acggactcgtgcactgcttacagtt

SEQ ID NO: 90354 - DNA, 25 bp, Rattus norvegicus
acggactcgtgctctgcttacagtt

SEQ ID NO: 90355 - DNA, 25 bp, Rattus norvegicus
acggactctcctcgatgcaaacgaa

SEQ ID NO: 90356 - DNA, 25 bp, Rattus norvegicus
acggactctcctggatgcaaacgaa

SEQ ID NO: 90357 - DNA, 25 bp, Rattus norvegicus
acggactgttttcttgtcaggctca

SEQ ID NO: 90358 - DNA, 25 bp, Rattus norvegicus
acggactgttttgttgtcaggctca

SEQ ID NO: 90359 - DNA, 25 bp, Rattus norvegicus
acggacttatttctcttggcattat

SEQ ID NO: 90360 - DNA, 25 bp, Rattus norvegicus
acggacttatttgtcttggcattat

SEQ ID NO: 90361 - DNA, 25 bp, Rattus norvegicus
acggactttctgagttcagttcaat

SEQ ID NO: 90362 - DNA, 25 bp, Rattus norvegicus
acggactttctgtgttcagttcaat

SEQ ID NO: 90363 - DNA, 25 bp, Rattus norvegicus
acggacttttcactaatctgctttg

SEQ ID NO: 90364 - DNA, 25 bp, Rattus norvegicus
acggacttttcagtaatctgctttg

SEQ ID NO: 90365 - DNA, 25 bp, Rattus norvegicus
acggagaccctcctgctgcaggctg

SEQ ID NO: 90366 - DNA, 25 bp, Rattus norvegicus
acggagaccctcgtgctgcaggctg

SEQ ID NO: 90367 - DNA, 25 bp, Rattus norvegicus
acggagacctctcctgctatggctt

SEQ ID NO: 90368 - DNA, 25 bp, Rattus norvegicus
acggagacctctgctgctatggctt

SEQ ID NO: 90369 - DNA, 25 bp, Rattus norvegicus
acggagacgccaacctgcctgggat

SEQ ID NO: 90370 - DNA, 25 bp, Rattus norvegicus
acggagacgccatcctgcctgggat

SEQ ID NO: 90371 - DNA, 25 bp, Rattus norvegicus
acggagacggctatccagcttatgg

SEQ ID NO: 90372 - DNA, 25 bp, Rattus norvegicus
acggagacggctttccagcttatgg

SEQ ID NO: 90373 - DNA, 25 bp, Rattus norvegicus
acggagactagacgacaggcagcac

SEQ ID NO: 90374 - DNA, 25 bp, Rattus norvegicus
acggagactagaggacaggcagcac

SEQ ID NO: 90375 - DNA, 25 bp, Rattus norvegicus
acggagactgttccaggctcatcac

SEQ ID NO: 90376 - DNA, 25 bp, Rattus norvegicus
acggagactgttgcaggctcatcac

SEQ ID NO: 90377 - DNA, 25 bp, Rattus norvegicus
acggagagagcgaagttcagcagct

SEQ ID NO: 90378 - DNA, 25 bp, Rattus norvegicus
acggagagagcgtagttcagcagct

SEQ ID NO: 90379 - DNA, 25 bp, Rattus norvegicus
acggagagcccacttctgacttaag

SEQ ID NO: 90380 - DNA, 25 bp, Rattus norvegicus
acggagagcccagttctgacttaag

SEQ ID NO: 90381 - DNA, 25 bp, Rattus norvegicus
acggagagcgatcgtctgcaacatc

SEQ ID NO: 90382 - DNA, 25 bp, Rattus norvegicus
acggagagcgatggtctgcaacatc

SEQ ID NO: 90383 - DNA, 25 bp, Rattus norvegicus
acggagaggccgcagatcgcgggaa

SEQ ID NO: 90384 - DNA, 25 bp, Rattus norvegicus
acggagaggccggagatcgcgggaa

SEQ ID NO: 90385 - DNA, 25 bp, Rattus norvegicus
acggagatgccaacaccattgtgtg

SEQ ID NO: 90386 - DNA, 25 bp, Rattus norvegicus
acggagatgccatcaccattgtgtg

SEQ ID NO: 90387 - DNA, 25 bp, Rattus norvegicus
acggagcaactgacccacgaggctg

SEQ ID NO: 90388 - DNA, 25 bp, Rattus norvegicus
acggagcaactgtcccacgaggctg

SEQ ID NO: 90389 - DNA, 25 bp, Rattus norvegicus
acggagcactccaggcggcgttcac

SEQ ID NO: 90390 - DNA, 25 bp, Rattus norvegicus
acggagcactcctggcggcgttcac

SEQ ID NO: 90391 - DNA, 25 bp, Rattus norvegicus
acggagcagtttccccatgacatag

SEQ ID NO: 90392 - DNA, 25 bp, Rattus norvegicus
acggagcagtttgcccatgacatag

SEQ ID NO: 90393 - DNA, 25 bp, Rattus norvegicus
acggagcccagaccatacagcagga

SEQ ID NO: 90394 - DNA, 25 bp, Rattus norvegicus
acggagcccagagcatacagcagga

SEQ ID NO: 90395 - DNA, 25 bp, Rattus norvegicus
acggagcccctgactgcagaggcca

SEQ ID NO: 90396 - DNA, 25 bp, Rattus norvegicus
acggagcccctgtctgcagaggcca

SEQ ID NO: 90397 - DNA, 25 bp, Rattus norvegicus
acggagcctggcatgatttttgagg

SEQ ID NO: 90398 - DNA, 25 bp, Rattus norvegicus
acggagcctggcttgatttttgagg

SEQ ID NO: 90399 - DNA, 25 bp, Rattus norvegicus
acggagcctgggagcagctgttctc

SEQ ID NO: 90400 - DNA, 25 bp, Rattus norvegicus
acggagcctgggtgcagctgttctc

SEQ ID NO: 90401 - DNA, 25 bp, Rattus norvegicus
acggagcctgttattaacatcttta

SEQ ID NO: 90402 - DNA, 25 bp, Rattus norvegicus
acggagcctgtttttaacatcttta

SEQ ID NO: 90403 - DNA, 25 bp, Rattus norvegicus
acggagctacgcagtgtttgcttaa

SEQ ID NO: 90404 - DNA, 25 bp, Rattus norvegicus
acggagctacgctgtgtttgcttaa

SEQ ID NO: 90405 - DNA, 25 bp, Rattus norvegicus
acggagctctgaattgcgctttgaa

SEQ ID NO: 90406 - DNA, 25 bp, Rattus norvegicus
acggagctctgatttgcgctttgaa

SEQ ID NO: 90407 - DNA, 25 bp, Rattus norvegicus
acggagctgggaacgaagacccaga

SEQ ID NO: 90408 - DNA, 25 bp, Rattus norvegicus
acggagctgggatcgaagacccaga

SEQ ID NO: 90409 - DNA, 25 bp, Rattus norvegicus
acggaggacttgctacaccatgtta

SEQ ID NO: 90410 - DNA, 25 bp, Rattus norvegicus
acggaggacttggtacaccatgtta

SEQ ID NO: 90411 - DNA, 25 bp, Rattus norvegicus
acggaggatcctacttcaaagacag

SEQ ID NO: 90412 - DNA, 25 bp, Rattus norvegicus
acggaggatccttcttcaaagacag

SEQ ID NO: 90413 - DNA, 25 bp, Rattus norvegicus
acggaggcacagcaattcttctgga

SEQ ID NO: 90414 - DNA, 25 bp, Rattus norvegicus
acggaggcacaggaattcttctgga

SEQ ID NO: 90415 - DNA, 25 bp, Rattus norvegicus
acggaggcagtgacttctttctctg

SEQ ID NO: 90416 - DNA, 25 bp, Rattus norvegicus
acggaggcagtgtcttctttctctg

SEQ ID NO: 90417 - DNA, 25 bp, Rattus norvegicus
acggaggcgcagcagccaacacttg

SEQ ID NO: 90418 - DNA, 25 bp, Rattus norvegicus
acggaggcgcaggagccaacacttg

SEQ ID NO: 90419 - DNA, 25 bp, Rattus norvegicus
acggaggcttgtaccccgacttgcg

SEQ ID NO: 90420 - DNA, 25 bp, Rattus norvegicus
acggaggcttgttccccgacttgcg

SEQ ID NO: 90421 - DNA, 25 bp, Rattus norvegicus
acggagggacagagcgtacctgctt

SEQ ID NO: 90422 - DNA, 25 bp, Rattus norvegicus
acggagggacagtgcgtacctgctt

SEQ ID NO: 90423 - DNA, 25 bp, Rattus norvegicus
acggaggtccgcagttccctgggct

SEQ ID NO: 90424 - DNA, 25 bp, Rattus norvegicus
acggaggtccgctgttccctgggct

SEQ ID NO: 90425 - DNA, 25 bp, Rattus norvegicus
acggaggtgcccactatagacagtt

SEQ ID NO: 90426 - DNA, 25 bp, Rattus norvegicus
acggaggtgccctctatagacagtt

SEQ ID NO: 90427 - DNA, 25 bp, Rattus norvegicus
acggagtcactgcaggccaacgtgc

SEQ ID NO: 90428 - DNA, 25 bp, Rattus norvegicus
acggagtcactggaggccaacgtgc

SEQ ID NO: 90429 - DNA, 25 bp, Rattus norvegicus
acggagtgaaaacccttccagtcag

SEQ ID NO: 90430 - DNA, 25 bp, Rattus norvegicus
acggagtgaaaagccttccagtcag

SEQ ID NO: 90431 - DNA, 25 bp, Rattus norvegicus
acggagtgaactcaaagctggcctt

SEQ ID NO: 90432 - DNA, 25 bp, Rattus norvegicus
acggagtgaactgaaagctggcctt

SEQ ID NO: 90433 - DNA, 25 bp, Rattus norvegicus
acggagtgccgtatctgtcaggatg

SEQ ID NO: 90434 - DNA, 25 bp, Rattus norvegicus
acggagtgccgtttctgtcaggatg

SEQ ID NO: 90435 - DNA, 25 bp, Rattus norvegicus
acggagttctcaatgcctctggagt

SEQ ID NO: 90436 - DNA, 25 bp, Rattus norvegicus
acggagttctcattgcctctggagt

SEQ ID NO: 90437 - DNA, 25 bp, Rattus norvegicus
acggagttgagtcttcctgagaaac

SEQ ID NO: 90438 - DNA, 25 bp, Rattus norvegicus
acggagttgagtgttcctgagaaac

SEQ ID NO: 90439 - DNA, 25 bp, Rattus norvegicus
acggagtttattatatctgaagcgc

SEQ ID NO: 90440 - DNA, 25 bp, Rattus norvegicus
acggagtttattttatctgaagcgc

SEQ ID NO: 90441 - DNA, 25 bp, Rattus norvegicus
acggatgaatgaaacctttgacctc

SEQ ID NO: 90442 - DNA, 25 bp, Rattus norvegicus
acggatgaatgatacctttgacctc

SEQ ID NO: 90443 - DNA, 25 bp, Rattus norvegicus
acggatgacctgctggactgcttag

SEQ ID NO: 90444 - DNA, 25 bp, Rattus norvegicus
acggatgacctggtggactgcttag

SEQ ID NO: 90445 - DNA, 25 bp, Rattus norvegicus
acggatgactcaacctattttcttt

SEQ ID NO: 90446 - DNA, 25 bp, Rattus norvegicus
acggatgactcatcctattttcttt

SEQ ID NO: 90447 - DNA, 25 bp, Rattus norvegicus
acggatgagcttcgtgtccagctgc

SEQ ID NO: 90448 - DNA, 25 bp, Rattus norvegicus
acggatgagcttggtgtccagctgc

SEQ ID NO: 90449 - DNA, 25 bp, Rattus norvegicus
acggatgcccctcattctggacaag

SEQ ID NO: 90450 - DNA, 25 bp, Rattus norvegicus
acggatgcccctgattctggacaag

SEQ ID NO: 90451 - DNA, 25 bp, Rattus norvegicus
acggatgcctgcaagtgtcttggta

SEQ ID NO: 90452 - DNA, 25 bp, Rattus norvegicus
acggatgcctgctagtgtcttggta

SEQ ID NO: 90453 - DNA, 25 bp, Rattus norvegicus
acggatgcttggcagatgtgctaac

SEQ ID NO: 90454 - DNA, 25 bp, Rattus norvegicus
acggatgcttgggagatgtgctaac

SEQ ID NO: 90455 - DNA, 25 bp, Rattus norvegicus
acggatgtggttctactggctgacc

SEQ ID NO: 90456 - DNA, 25 bp, Rattus norvegicus
acggatgtggttgtactggctgacc

SEQ ID NO: 90457 - DNA, 25 bp, Rattus norvegicus
acggatgttcgtctcctgatgactc

SEQ ID NO: 90458 - DNA, 25 bp, Rattus norvegicus
acggatgttcgtgtcctgatgactc

SEQ ID NO: 90459 - DNA, 25 bp, Rattus norvegicus
acggatgttgatattccctctttct

SEQ ID NO: 90460 - DNA, 25 bp, Rattus norvegicus
acggatgttgattttccctctttct

SEQ ID NO: 90461 - DNA, 25 bp, Rattus norvegicus
acggattggcctaatgaagaagttc

SEQ ID NO: 90462 - DNA, 25 bp, Rattus norvegicus
acggattggccttatgaagaagttc

SEQ ID NO: 90463 - DNA, 25 bp, Rattus norvegicus
acggatttctggaggccttgcagta

SEQ ID NO: 90464 - DNA, 25 bp, Rattus norvegicus
acggatttctggtggccttgcagta

SEQ ID NO: 90465 - DNA, 25 bp, Rattus norvegicus
acggattttcccagtctgtccttct

SEQ ID NO: 90466 - DNA, 25 bp, Rattus norvegicus
acggattttccctgtctgtccttct

SEQ ID NO: 90467 - DNA, 25 bp, Rattus norvegicus
acggattttgttacttgttgcccag

SEQ ID NO: 90468 - DNA, 25 bp, Rattus norvegicus
acggattttgtttcttgttgcccag

SEQ ID NO: 90469 - DNA, 25 bp, Rattus norvegicus
acggcaaaaacaacacaggattggt

SEQ ID NO: 90470 - DNA, 25 bp, Rattus norvegicus
acggcaaaaacatcacaggattggt

SEQ ID NO: 90471 - DNA, 25 bp, Rattus norvegicus
acggcaacccttctggacagcatat

SEQ ID NO: 90472 - DNA, 25 bp, Rattus norvegicus
acggcaacccttgtggacagcatat

SEQ ID NO: 90473 - DNA, 25 bp, Rattus norvegicus
acggcaaccggcaggctaatgctaa

SEQ ID NO: 90474 - DNA, 25 bp, Rattus norvegicus
acggcaaccggctggctaatgctaa

SEQ ID NO: 90475 - DNA, 25 bp, Rattus norvegicus
acggcaacctgcagcttttctttct

SEQ ID NO: 90476 - DNA, 25 bp, Rattus norvegicus
acggcaacctgctgcttttctttct

SEQ ID NO: 90477 - DNA, 25 bp, Rattus norvegicus
acggcaactgcccagctaaaatatt

SEQ ID NO: 90478 - DNA, 25 bp, Rattus norvegicus
acggcaactgccgagctaaaatatt

SEQ ID NO: 90479 - DNA, 25 bp, Rattus norvegicus
acggcaagatggatgcctgtcctct

SEQ ID NO: 90480 - DNA, 25 bp, Rattus norvegicus
acggcaagatggttgcctgtcctct

SEQ ID NO: 90481 - DNA, 25 bp, Rattus norvegicus
acggcaaggagcagtccatggtcaa

SEQ ID NO: 90482 - DNA, 25 bp, Rattus norvegicus
acggcaaggagctgtccatggtcaa

SEQ ID NO: 90483 - DNA, 25 bp, Rattus norvegicus
acggcaaggcatccgcttaacatgg

SEQ ID NO: 90484 - DNA, 25 bp, Rattus norvegicus
acggcaaggcatgcgcttaacatgg

SEQ ID NO: 90485 - DNA, 25 bp, Rattus norvegicus
acggcaagtctgagtcatggtctga

SEQ ID NO: 90486 - DNA, 25 bp, Rattus norvegicus
acggcaagtctgtgtcatggtctga

SEQ ID NO: 90487 - DNA, 25 bp, Rattus norvegicus
acggcaataactcttagctactcac

SEQ ID NO: 90488 - DNA, 25 bp, Rattus norvegicus
acggcaataactgttagctactcac

SEQ ID NO: 90489 - DNA, 25 bp, Rattus norvegicus
acggcacaaaatctcctcattggtg

SEQ ID NO: 90490 - DNA, 25 bp, Rattus norvegicus
acggcacaaaatgtcctcattggtg

SEQ ID NO: 90491 - DNA, 25 bp, Rattus norvegicus
acggcacacagaccaccttgtagag

SEQ ID NO: 90492 - DNA, 25 bp, Rattus norvegicus
acggcacacagagcaccttgtagag

SEQ ID NO: 90493 - DNA, 25 bp, Rattus norvegicus
acggcacaggttcgactcagctcac

SEQ ID NO: 90494 - DNA, 25 bp, Rattus norvegicus
acggcacaggttggactcagctcac

SEQ ID NO: 90495 - DNA, 25 bp, Rattus norvegicus
acggcaccacttagatctcatttat

SEQ ID NO: 90496 - DNA, 25 bp, Rattus norvegicus
acggcaccactttgatctcatttat

SEQ ID NO: 90497 - DNA, 25 bp, Rattus norvegicus
acggcaccagggactgcaagctcca

SEQ ID NO: 90498 - DNA, 25 bp, Rattus norvegicus
acggcaccagggtctgcaagctcca

SEQ ID NO: 90499 - DNA, 25 bp, Rattus norvegicus
acggcaccattcacatcaaccgggt

SEQ ID NO: 90500 - DNA, 25 bp, Rattus norvegicus
acggcaccattctcatcaaccgggt

SEQ ID NO: 90501 - DNA, 25 bp, Rattus norvegicus
acggcaccggctatgaagtcattat

SEQ ID NO: 90502 - DNA, 25 bp, Rattus norvegicus
acggcaccggctttgaagtcattat

SEQ ID NO: 90503 - DNA, 25 bp, Rattus norvegicus
acggcaccggttcgtccacgaggca

SEQ ID NO: 90504 - DNA, 25 bp, Rattus norvegicus
acggcaccggttggtccacgaggca

SEQ ID NO: 90505 - DNA, 25 bp, Rattus norvegicus
acggcacctcatacgtggacgagaa

SEQ ID NO: 90506 - DNA, 25 bp, Rattus norvegicus
acggcacctcattcgtggacgagaa

SEQ ID NO: 90507 - DNA, 25 bp, Rattus norvegicus
acggcactgtgtaactctactgtgt

SEQ ID NO: 90508 - DNA, 25 bp, Rattus norvegicus
acggcactgtgttactctactgtgt

SEQ ID NO: 90509 - DNA, 25 bp, Rattus norvegicus
acggcacttcgcaggcaagcaggcc

SEQ ID NO: 90510 - DNA, 25 bp, Rattus norvegicus
acggcacttcgctggcaagcaggcc

SEQ ID NO: 90511 - DNA, 25 bp, Rattus norvegicus
acggcagacgcccaatcttgggtga

SEQ ID NO: 90512 - DNA, 25 bp, Rattus norvegicus
acggcagacgccgaatcttgggtga

SEQ ID NO: 90513 - DNA, 25 bp, Rattus norvegicus
acggcagacgcgctcctggatatac

SEQ ID NO: 90514 - DNA, 25 bp, Rattus norvegicus
acggcagacgcggtcctggatatac

SEQ ID NO: 90515 - DNA, 25 bp, Rattus norvegicus
acggcagatgaccagcagcctgagt

SEQ ID NO: 90516 - DNA, 25 bp, Rattus norvegicus
acggcagatgacgagcagcctgagt

SEQ ID NO: 90517 - DNA, 25 bp, Rattus norvegicus
acggcagcaccaccatgagtctcgg

SEQ ID NO: 90518 - DNA, 25 bp, Rattus norvegicus
acggcagcaccagcatgagtctcgg

SEQ ID NO: 90519 - DNA, 25 bp, Rattus norvegicus
acggcagccaagcatctctgagtga

SEQ ID NO: 90520 - DNA, 25 bp, Rattus norvegicus
acggcagccaaggatctctgagtga

SEQ ID NO: 90521 - DNA, 25 bp, Rattus norvegicus
acggcagccctgatggcgagactga

SEQ ID NO: 90522 - DNA, 25 bp, Rattus norvegicus
acggcagccctgttggcgagactga

SEQ ID NO: 90523 - DNA, 25 bp, Rattus norvegicus
acggcagccgcgagaccttcgactg

SEQ ID NO: 90524 - DNA, 25 bp, Rattus norvegicus
acggcagccgcgtgaccttcgactg

SEQ ID NO: 90525 - DNA, 25 bp, Rattus norvegicus
acggcagctgtacattgactttagg

SEQ ID NO: 90526 - DNA, 25 bp, Rattus norvegicus
acggcagctgtagattgactttagg

SEQ ID NO: 90527 - DNA, 25 bp, Rattus norvegicus
acggcaggagcaaacatcccagttt

SEQ ID NO: 90528 - DNA, 25 bp, Rattus norvegicus
acggcaggagcatacatcccagttt

SEQ ID NO: 90529 - DNA, 25 bp, Rattus norvegicus
acggcaggatgcagtaccgcgcttc

SEQ ID NO: 90530 - DNA, 25 bp, Rattus norvegicus
acggcaggatgctgtaccgcgcttc

SEQ ID NO: 90531 - DNA, 25 bp, Rattus norvegicus
acggcagtcggcaaaaccattattt

SEQ ID NO: 90532 - DNA, 25 bp, Rattus norvegicus
acggcagtcggctaaaccattattt

SEQ ID NO: 90533 - DNA, 25 bp, Rattus norvegicus
acggcagtgctaatagcagtccttt

SEQ ID NO: 90534 - DNA, 25 bp, Rattus norvegicus
acggcagtgctattagcagtccttt

SEQ ID NO: 90535 - DNA, 25 bp, Rattus norvegicus
acggcagttctgatattgaccaccc

SEQ ID NO: 90536 - DNA, 25 bp, Rattus norvegicus
acggcagttctgttattgaccaccc

SEQ ID NO: 90537 - DNA, 25 bp, Rattus norvegicus
acggcagtttgccatcaccgacgtg

SEQ ID NO: 90538 - DNA, 25 bp, Rattus norvegicus
acggcagtttgcgatcaccgacgtg

SEQ ID NO: 90539 - DNA, 25 bp, Rattus norvegicus
acggcatatctgaggactcttttag

SEQ ID NO: 90540 - DNA, 25 bp, Rattus norvegicus
acggcatatctgtggactcttttag

SEQ ID NO: 90541 - DNA, 25 bp, Rattus norvegicus
acggcatcacccaggacgtgctggt

SEQ ID NO: 90542 - DNA, 25 bp, Rattus norvegicus
acggcatcaccctggacgtgctggt

SEQ ID NO: 90543 - DNA, 25 bp, Rattus norvegicus
acggcatcagctccttcacagaaga

SEQ ID NO: 90544 - DNA, 25 bp, Rattus norvegicus
acggcatcagctgcttcacagaaga

SEQ ID NO: 90545 - DNA, 25 bp, Rattus norvegicus
acggcatcagtgagcactcttctgt

SEQ ID NO: 90546 - DNA, 25 bp, Rattus norvegicus
acggcatcagtgtgcactcttctgt

SEQ ID NO: 90547 - DNA, 25 bp, Rattus norvegicus
acggcatcttcaatctggtcagaga

SEQ ID NO: 90548 - DNA, 25 bp, Rattus norvegicus
acggcatcttcattctggtcagaga

SEQ ID NO: 90549 - DNA, 25 bp, Rattus norvegicus
acggcatgcactacagtacctggga

SEQ ID NO: 90550 - DNA, 25 bp, Rattus norvegicus
acggcatgcacttcagtacctggga

SEQ ID NO: 90551 - DNA, 25 bp, Rattus norvegicus
acggcatgggccaggaattaggaat

SEQ ID NO: 90552 - DNA, 25 bp, Rattus norvegicus
acggcatgggcctggaattaggaat

SEQ ID NO: 90553 - DNA, 25 bp, Rattus norvegicus
acggcatgggtaccccttgaaccaa

SEQ ID NO: 90554 - DNA, 25 bp, Rattus norvegicus
acggcatgggtagcccttgaaccaa

SEQ ID NO: 90555 - DNA, 25 bp, Rattus norvegicus
acggcatgggtgctggagacagtat

SEQ ID NO: 90556 - DNA, 25 bp, Rattus norvegicus
acggcatgggtggtggagacagtat

SEQ ID NO: 90557 - DNA, 25 bp, Rattus norvegicus
acggcattcaatacagtgtcattag

SEQ ID NO: 90558 - DNA, 25 bp, Rattus norvegicus
acggcattcaattcagtgtcattag

SEQ ID NO: 90559 - DNA, 25 bp, Rattus norvegicus
acggcattcacccaatacttctatc

SEQ ID NO: 90560 - DNA, 25 bp, Rattus norvegicus
acggcattcaccgaatacttctatc

SEQ ID NO: 90561 - DNA, 25 bp, Rattus norvegicus
acggcattctccattactcaaatct

SEQ ID NO: 90562 - DNA, 25 bp, Rattus norvegicus
acggcattctcctttactcaaatct

SEQ ID NO: 90563 - DNA, 25 bp, Rattus norvegicus
acggccaagtggacgtgtaccctgc

SEQ ID NO: 90564 - DNA, 25 bp, Rattus norvegicus
acggccaagtggtcgtgtaccctgc

SEQ ID NO: 90565 - DNA, 25 bp, Rattus norvegicus
acggccaagttcagcatggtgcact

SEQ ID NO: 90566 - DNA, 25 bp, Rattus norvegicus
acggccaagttctgcatggtgcact

SEQ ID NO: 90567 - DNA, 25 bp, Rattus norvegicus
acggccacacatatgtactgcttaa

SEQ ID NO: 90568 - DNA, 25 bp, Rattus norvegicus
acggccacacatttgtactgcttaa

SEQ ID NO: 90569 - DNA, 25 bp, Rattus norvegicus
acggccacccatacctttgtattat

SEQ ID NO: 90570 - DNA, 25 bp, Rattus norvegicus
acggccacccattcctttgtattat

SEQ ID NO: 90571 - DNA, 25 bp, Rattus norvegicus
acggccacggacacgctaagcagga

SEQ ID NO: 90572 - DNA, 25 bp, Rattus norvegicus
acggccacggactcgctaagcagga

SEQ ID NO: 90573 - DNA, 25 bp, Rattus norvegicus
acggccactatcagcatcatattta

SEQ ID NO: 90574 - DNA, 25 bp, Rattus norvegicus
acggccactatctgcatcatattta

SEQ ID NO: 90575 - DNA, 25 bp, Rattus norvegicus
acggccagactgaggatttctactg

SEQ ID NO: 90576 - DNA, 25 bp, Rattus norvegicus
acggccagactgtggatttctactg

SEQ ID NO: 90577 - DNA, 25 bp, Rattus norvegicus
acggccagcctcatggatgtgatcc

SEQ ID NO: 90578 - DNA, 25 bp, Rattus norvegicus
acggccagcctcttggatgtgatcc

SEQ ID NO: 90579 - DNA, 25 bp, Rattus norvegicus
acggccagtggaatttctgacctgt

SEQ ID NO: 90580 - DNA, 25 bp, Rattus norvegicus
acggccagtggattttctgacctgt

SEQ ID NO: 90581 - DNA, 25 bp, Rattus norvegicus
acggccatcctactaatgctctgag

SEQ ID NO: 90582 - DNA, 25 bp, Rattus norvegicus
acggccatcctagtaatgctctgag

SEQ ID NO: 90583 - DNA, 25 bp, Rattus norvegicus
acggccatgcaacccaagaacatta

SEQ ID NO: 90584 - DNA, 25 bp, Rattus norvegicus
acggccatgcaagccaagaacatta

SEQ ID NO: 90585 - DNA, 25 bp, Rattus norvegicus
acggccattggccattgtaggctac

SEQ ID NO: 90586 - DNA, 25 bp, Rattus norvegicus
acggccattggcgattgtaggctac

SEQ ID NO: 90587 - DNA, 25 bp, Rattus norvegicus
acggccatttggattcagcatgtca

SEQ ID NO: 90588 - DNA, 25 bp, Rattus norvegicus
acggccatttggtttcagcatgtca

SEQ ID NO: 90589 - DNA, 25 bp, Rattus norvegicus
acggcccacataccatgcaagtttg

SEQ ID NO: 90590 - DNA, 25 bp, Rattus norvegicus
acggcccacatagcatgcaagtttg

SEQ ID NO: 90591 - DNA, 25 bp, Rattus norvegicus
acggccccatcgactacaagcggaa

SEQ ID NO: 90592 - DNA, 25 bp, Rattus norvegicus
acggccccatcgtctacaagcggaa

SEQ ID NO: 90593 - DNA, 25 bp, Rattus norvegicus
acggcccgcactaactgggtcttgc

SEQ ID NO: 90594 - DNA, 25 bp, Rattus norvegicus
acggcccgcacttactgggtcttgc

SEQ ID NO: 90595 - DNA, 25 bp, Rattus norvegicus
acggcccggccgactggataaatgt

SEQ ID NO: 90596 - DNA, 25 bp, Rattus norvegicus
acggcccggccgtctggataaatgt

SEQ ID NO: 90597 - DNA, 25 bp, Rattus norvegicus
acggcccttgtactctcagaattca

SEQ ID NO: 90598 - DNA, 25 bp, Rattus norvegicus
acggcccttgtagtctcagaattca

SEQ ID NO: 90599 - DNA, 25 bp, Rattus norvegicus
acggccgcacagcagtaagatttga

SEQ ID NO: 90600 - DNA, 25 bp, Rattus norvegicus
acggccgcacaggagtaagatttga

SEQ ID NO: 90601 - DNA, 25 bp, Rattus norvegicus
acggccgcgcagaactcatcgtagc

SEQ ID NO: 90602 - DNA, 25 bp, Rattus norvegicus
acggccgcgcagtactcatcgtagc

SEQ ID NO: 90603 - DNA, 25 bp, Rattus norvegicus
acggccgggtgcatttggccagcaa

SEQ ID NO: 90604 - DNA, 25 bp, Rattus norvegicus
acggccgggtgcttttggccagcaa

SEQ ID NO: 90605 - DNA, 25 bp, Rattus norvegicus
acggcctagataccagcaaccaaga

SEQ ID NO: 90606 - DNA, 25 bp, Rattus norvegicus
acggcctagatagcagcaaccaaga

SEQ ID NO: 90607 - DNA, 25 bp, Rattus norvegicus
acggcctcagctagttgtgtgaaca

SEQ ID NO: 90608 - DNA, 25 bp, Rattus norvegicus
acggcctcagcttgttgtgtgaaca

SEQ ID NO: 90609 - DNA, 25 bp, Rattus norvegicus
acggcctcctcacctggcggaagta

SEQ ID NO: 90610 - DNA, 25 bp, Rattus norvegicus
acggcctcctcagctggcggaagta

SEQ ID NO: 90611 - DNA, 25 bp, Rattus norvegicus
acggcctcctgcatcttgaaggagt

SEQ ID NO: 90612 - DNA, 25 bp, Rattus norvegicus
acggcctcctgcttcttgaaggagt

SEQ ID NO: 90613 - DNA, 25 bp, Rattus norvegicus
acggcctcggtcacttctgggcagc

SEQ ID NO: 90614 - DNA, 25 bp, Rattus norvegicus
acggcctcggtctcttctgggcagc

SEQ ID NO: 90615 - DNA, 25 bp, Rattus norvegicus
acggcctgaacaacaactacaactg

SEQ ID NO: 90616 - DNA, 25 bp, Rattus norvegicus
acggcctgaacatcaactacaactg

SEQ ID NO: 90617 - DNA, 25 bp, Rattus norvegicus
acggcctggatgacttgcggcagat

SEQ ID NO: 90618 - DNA, 25 bp, Rattus norvegicus
acggcctggatgtcttgcggcagat

SEQ ID NO: 90619 - DNA, 25 bp, Rattus norvegicus
acggcctggctaatctgggaccaga

SEQ ID NO: 90620 - DNA, 25 bp, Rattus norvegicus
acggcctggctattctgggaccaga

SEQ ID NO: 90621 - DNA, 25 bp, Rattus norvegicus
acggccttcacaatatggcgatcat

SEQ ID NO: 90622 - DNA, 25 bp, Rattus norvegicus
acggccttcacattatggcgatcat

SEQ ID NO: 90623 - DNA, 25 bp, Rattus norvegicus
acggccttcgttcacacatggaggt

SEQ ID NO: 90624 - DNA, 25 bp, Rattus norvegicus
acggccttcgttgacacatggaggt

SEQ ID NO: 90625 - DNA, 25 bp, Rattus norvegicus
acggccttggtcacattaaacactg

SEQ ID NO: 90626 - DNA, 25 bp, Rattus norvegicus
acggccttggtctcattaaacactg

SEQ ID NO: 90627 - DNA, 25 bp, Rattus norvegicus
acggcctttctgagtgatttctgct

SEQ ID NO: 90628 - DNA, 25 bp, Rattus norvegicus
acggcctttctgtgtgatttctgct

SEQ ID NO: 90629 - DNA, 25 bp, Rattus norvegicus
acggcctttgaccatctgtagttgt

SEQ ID NO: 90630 - DNA, 25 bp, Rattus norvegicus
acggcctttgacgatctgtagttgt

SEQ ID NO: 90631 - DNA, 25 bp, Rattus norvegicus
acggcgaactaaccgagtcactcac

SEQ ID NO: 90632 - DNA, 25 bp, Rattus norvegicus
acggcgaactaagcgagtcactcac

SEQ ID NO: 90633 - DNA, 25 bp, Rattus norvegicus
acggcgaccggtactgggatatcaa

SEQ ID NO: 90634 - DNA, 25 bp, Rattus norvegicus
acggcgaccggttctgggatatcaa

SEQ ID NO: 90635 - DNA, 25 bp, Rattus norvegicus
acggcgacctggacttggagcagat

SEQ ID NO: 90636 - DNA, 25 bp, Rattus norvegicus
acggcgacctggtcttggagcagat

SEQ ID NO: 90637 - DNA, 25 bp, Rattus norvegicus
acggcgagggcccagcgcggcggag

SEQ ID NO: 90638 - DNA, 25 bp, Rattus norvegicus
acggcgagggccgagcgcggcggag

SEQ ID NO: 90639 - DNA, 25 bp, Rattus norvegicus
acggcgagtatcagcagcaacagca

SEQ ID NO: 90640 - DNA, 25 bp, Rattus norvegicus
acggcgagtatctgcagcaacagca

SEQ ID NO: 90641 - DNA, 25 bp, Rattus norvegicus
acggcgcaagtgaccaacaggttga

SEQ ID NO: 90642 - DNA, 25 bp, Rattus norvegicus
acggcgcaagtgtccaacaggttga

SEQ ID NO: 90643 - DNA, 25 bp, Rattus norvegicus
acggcgcagaacatggaccacggga

SEQ ID NO: 90644 - DNA, 25 bp, Rattus norvegicus
acggcgcagaacttggaccacggga

SEQ ID NO: 90645 - DNA, 25 bp, Rattus norvegicus
acggcgccttaactgttagctttga

SEQ ID NO: 90646 - DNA, 25 bp, Rattus norvegicus
acggcgccttaagtgttagctttga

SEQ ID NO: 90647 - DNA, 25 bp, Rattus norvegicus
acggcgctttgtctgtgttttagca

SEQ ID NO: 90648 - DNA, 25 bp, Rattus norvegicus
acggcgctttgtgtgtgttttagca

SEQ ID NO: 90649 - DNA, 25 bp, Rattus norvegicus
acggcggaagtgcaagtcttatcat

SEQ ID NO: 90650 - DNA, 25 bp, Rattus norvegicus
acggcggaagtggaagtcttatcat

SEQ ID NO: 90651 - DNA, 25 bp, Rattus norvegicus
acggcggcgcctatgtaagcttcag

SEQ ID NO: 90652 - DNA, 25 bp, Rattus norvegicus
acggcggcgcctttgtaagcttcag

SEQ ID NO: 90653 - DNA, 25 bp, Rattus norvegicus
acggcgggaaggatgctcactgaca

SEQ ID NO: 90654 - DNA, 25 bp, Rattus norvegicus
acggcgggaaggttgctcactgaca

SEQ ID NO: 90655 - DNA, 25 bp, Rattus norvegicus
acggcggtccagatctccaagaaga

SEQ ID NO: 90656 - DNA, 25 bp, Rattus norvegicus
acggcggtccagttctccaagaaga

SEQ ID NO: 90657 - DNA, 25 bp, Rattus norvegicus
acggcgtacacgagtgctcagctgg

SEQ ID NO: 90658 - DNA, 25 bp, Rattus norvegicus
acggcgtacacgtgtgctcagctgg

SEQ ID NO: 90659 - DNA, 25 bp, Rattus norvegicus
acggcgtacgctatgtcttcacgtt

SEQ ID NO: 90660 - DNA, 25 bp, Rattus norvegicus
acggcgtacgctttgtcttcacgtt

SEQ ID NO: 90661 - DNA, 25 bp, Rattus norvegicus
acggcgtaggcgagcagattgacac

SEQ ID NO: 90662 - DNA, 25 bp, Rattus norvegicus
acggcgtaggcgtgcagattgacac

SEQ ID NO: 90663 - DNA, 25 bp, Rattus norvegicus
acggcgtctcagactttaattacca

SEQ ID NO: 90664 - DNA, 25 bp, Rattus norvegicus
acggcgtctcagtctttaattacca

SEQ ID NO: 90665 - DNA, 25 bp, Rattus norvegicus
acggcgttctcaccaacagcaaatt

SEQ ID NO: 90666 - DNA, 25 bp, Rattus norvegicus
acggcgttctcagcaacagcaaatt

SEQ ID NO: 90667 - DNA, 25 bp, Rattus norvegicus
acggcgtttcttccattatcaagta

SEQ ID NO: 90668 - DNA, 25 bp, Rattus norvegicus
acggcgtttcttgcattatcaagta

SEQ ID NO: 90669 - DNA, 25 bp, Rattus norvegicus
acggctaaaactacctactgtgatg

SEQ ID NO: 90670 - DNA, 25 bp, Rattus norvegicus
acggctaaaacttcctactgtgatg

SEQ ID NO: 90671 - DNA, 25 bp, Rattus norvegicus
acggctaactacagcaaatctaact

SEQ ID NO: 90672 - DNA, 25 bp, Rattus norvegicus
acggctaactactgcaaatctaact

SEQ ID NO: 90673 - DNA, 25 bp, Rattus norvegicus
acggctaatcgtatgtacagcaaca

SEQ ID NO: 90674 - DNA, 25 bp, Rattus norvegicus
acggctaatcgtttgtacagcaaca

SEQ ID NO: 90675 - DNA, 25 bp, Rattus norvegicus
acggctaatgcacctgaattctcag

SEQ ID NO: 90676 - DNA, 25 bp, Rattus norvegicus
acggctaatgcagctgaattctcag

SEQ ID NO: 90677 - DNA, 25 bp, Rattus norvegicus
acggctactcgcacttcatttatat

SEQ ID NO: 90678 - DNA, 25 bp, Rattus norvegicus
acggctactcgctcttcatttatat

SEQ ID NO: 90679 - DNA, 25 bp, Rattus norvegicus
acggctatctggaaacttgtcatgt

SEQ ID NO: 90680 - DNA, 25 bp, Rattus norvegicus
acggctatctggtaacttgtcatgt

SEQ ID NO: 90681 - DNA, 25 bp, Rattus norvegicus
acggctattcccatcttgcagatga

SEQ ID NO: 90682 - DNA, 25 bp, Rattus norvegicus
acggctattcccttcttgcagatga

SEQ ID NO: 90683 - DNA, 25 bp, Rattus norvegicus
acggctatttcgatggaatccctca

SEQ ID NO: 90684 - DNA, 25 bp, Rattus norvegicus
acggctatttcgttggaatccctca

SEQ ID NO: 90685 - DNA, 25 bp, Rattus norvegicus
acggctcatgttatggtgcagtgtt

SEQ ID NO: 90686 - DNA, 25 bp, Rattus norvegicus
acggctcatgttttggtgcagtgtt

SEQ ID NO: 90687 - DNA, 25 bp, Rattus norvegicus
acggctctggctctttggctatgat

SEQ ID NO: 90688 - DNA, 25 bp, Rattus norvegicus
acggctctggctgtttggctatgat

SEQ ID NO: 90689 - DNA, 25 bp, Rattus norvegicus
acggctcttaacattttcagaggga

SEQ ID NO: 90690 - DNA, 25 bp, Rattus norvegicus
acggctcttaactttttcagaggga

SEQ ID NO: 90691 - DNA, 25 bp, Rattus norvegicus
acggctgacagacctctcgttgtaa

SEQ ID NO: 90692 - DNA, 25 bp, Rattus norvegicus
acggctgacagagctctcgttgtaa

SEQ ID NO: 90693 - DNA, 25 bp, Rattus norvegicus
acggctgcaatcaagacggttcaca

SEQ ID NO: 90694 - DNA, 25 bp, Rattus norvegicus
acggctgcaatctagacggttcaca

SEQ ID NO: 90695 - DNA, 25 bp, Rattus norvegicus
acggctgcacatatccaagttacta

SEQ ID NO: 90696 - DNA, 25 bp, Rattus norvegicus
acggctgcacatttccaagttacta

SEQ ID NO: 90697 - DNA, 25 bp, Rattus norvegicus
acggctgctacaccaagagactttt

SEQ ID NO: 90698 - DNA, 25 bp, Rattus norvegicus
acggctgctacagcaagagactttt

SEQ ID NO: 90699 - DNA, 25 bp, Rattus norvegicus
acggctgctattcttcctagtcttc

SEQ ID NO: 90700 - DNA, 25 bp, Rattus norvegicus
acggctgctattgttcctagtcttc

SEQ ID NO: 90701 - DNA, 25 bp, Rattus norvegicus
acggctgctgtgaaatcatctgaag

SEQ ID NO: 90702 - DNA, 25 bp, Rattus norvegicus
acggctgctgtgtaatcatctgaag

SEQ ID NO: 90703 - DNA, 25 bp, Rattus norvegicus
acggctgcttacagttctatttcat

SEQ ID NO: 90704 - DNA, 25 bp, Rattus norvegicus
acggctgcttactgttctatttcat

SEQ ID NO: 90705 - DNA, 25 bp, Rattus norvegicus
acggctgtacatagtttgcatcgat

SEQ ID NO: 90706 - DNA, 25 bp, Rattus norvegicus
acggctgtacattgtttgcatcgat

SEQ ID NO: 90707 - DNA, 25 bp, Rattus norvegicus
acggctgtatccagttcatctggaa

SEQ ID NO: 90708 - DNA, 25 bp, Rattus norvegicus
acggctgtatcctgttcatctggaa

SEQ ID NO: 90709 - DNA, 25 bp, Rattus norvegicus
acggctgtatttaggctttctccct

SEQ ID NO: 90710 - DNA, 25 bp, Rattus norvegicus
acggctgtattttggctttctccct

SEQ ID NO: 90711 - DNA, 25 bp, Rattus norvegicus
acggctgtccagctgaatgcaggca

SEQ ID NO: 90712 - DNA, 25 bp, Rattus norvegicus
acggctgtccaggtgaatgcaggca

SEQ ID NO: 90713 - DNA, 25 bp, Rattus norvegicus
acggctgtccctaaactgttgaatt

SEQ ID NO: 90714 - DNA, 25 bp, Rattus norvegicus
acggctgtcccttaactgttgaatt

SEQ ID NO: 90715 - DNA, 25 bp, Rattus norvegicus
acggctgtcgctcaataggtttact

SEQ ID NO: 90716 - DNA, 25 bp, Rattus norvegicus
acggctgtcgctgaataggtttact

SEQ ID NO: 90717 - DNA, 25 bp, Rattus norvegicus
acggctgtctccaagtccagaagaa

SEQ ID NO: 90718 - DNA, 25 bp, Rattus norvegicus
acggctgtctcctagtccagaagaa

SEQ ID NO: 90719 - DNA, 25 bp, Rattus norvegicus
acggctgtgaatctgaaactctagg

SEQ ID NO: 90720 - DNA, 25 bp, Rattus norvegicus
acggctgtgaatctgctatgtaagt

SEQ ID NO: 90721 - DNA, 25 bp, Rattus norvegicus
acggctgtgaatgtgaaactctagg

SEQ ID NO: 90722 - DNA, 25 bp, Rattus norvegicus
acggctgtgaatgtgctatgtaagt

SEQ ID NO: 90723 - DNA, 25 bp, Rattus norvegicus
acggctgtgactattggcacccgga

SEQ ID NO: 90724 - DNA, 25 bp, Rattus norvegicus
acggctgtgacttttggcacccgga

SEQ ID NO: 90725 - DNA, 25 bp, Rattus norvegicus
acggctgtggccagaagttgctgtc

SEQ ID NO: 90726 - DNA, 25 bp, Rattus norvegicus
acggctgtggcctgaagttgctgtc

SEQ ID NO: 90727 - DNA, 25 bp, Rattus norvegicus
acggcttacaatcgcggtacatctg

SEQ ID NO: 90728 - DNA, 25 bp, Rattus norvegicus
acggcttacaatggcggtacatctg

SEQ ID NO: 90729 - DNA, 25 bp, Rattus norvegicus
acggcttacgcaacattctgtatct

SEQ ID NO: 90730 - DNA, 25 bp, Rattus norvegicus
acggcttacgcatcattctgtatct

SEQ ID NO: 90731 - DNA, 25 bp, Rattus norvegicus
acggcttagtgcaaaattaagcgta

SEQ ID NO: 90732 - DNA, 25 bp, Rattus norvegicus
acggcttagtgctaaattaagcgta

SEQ ID NO: 90733 - DNA, 25 bp, Rattus norvegicus
acggcttcatttctcccaaggaata

SEQ ID NO: 90734 - DNA, 25 bp, Rattus norvegicus
acggcttcatttgtcccaaggaata

SEQ ID NO: 90735 - DNA, 25 bp, Rattus norvegicus
acggcttctgaaaatcctctttgtt

SEQ ID NO: 90736 - DNA, 25 bp, Rattus norvegicus
acggcttctgaatatcctctttgtt

SEQ ID NO: 90737 - DNA, 25 bp, Rattus norvegicus
acggcttcttgcagggcccagtgaa

SEQ ID NO: 90738 - DNA, 25 bp, Rattus norvegicus
acggcttcttgctgggcccagtgaa

SEQ ID NO: 90739 - DNA, 25 bp, Rattus norvegicus
acggcttgcctccatggacctgaga

SEQ ID NO: 90740 - DNA, 25 bp, Rattus norvegicus
acggcttgcctcgatggacctgaga

SEQ ID NO: 90741 - DNA, 25 bp, Rattus norvegicus
acggcttgtcctcagccagagtcac

SEQ ID NO: 90742 - DNA, 25 bp, Rattus norvegicus
acggcttgtcctgagccagagtcac

SEQ ID NO: 90743 - DNA, 25 bp, Rattus norvegicus
acggcttgttctcgattttacgctt

SEQ ID NO: 90744 - DNA, 25 bp, Rattus norvegicus
acggcttgttctggattttacgctt

SEQ ID NO: 90745 - DNA, 25 bp, Rattus norvegicus
acggctttgctgaatggactcattc

SEQ ID NO: 90746 - DNA, 25 bp, Rattus norvegicus
acggctttgctgtatggactcattc

SEQ ID NO: 90747 - DNA, 25 bp, Rattus norvegicus
acggcttttgagattctctcctccg

SEQ ID NO: 90748 - DNA, 25 bp, Rattus norvegicus
acggcttttgagtttctctcctccg

SEQ ID NO: 90749 - DNA, 25 bp, Rattus norvegicus
acgggaaagtcactctcagttctct

SEQ ID NO: 90750 - DNA, 25 bp, Rattus norvegicus
acgggaaagtcagtctcagttctct

SEQ ID NO: 90751 - DNA, 25 bp, Rattus norvegicus
acgggaaccatgctgctttgccttc

SEQ ID NO: 90752 - DNA, 25 bp, Rattus norvegicus
acgggaaccatggtgctttgccttc

SEQ ID NO: 90753 - DNA, 25 bp, Rattus norvegicus
acgggaaccgcgcaattctgaaaga

SEQ ID NO: 90754 - DNA, 25 bp, Rattus norvegicus
acgggaaccgcggaattctgaaaga

SEQ ID NO: 90755 - DNA, 25 bp, Rattus norvegicus
acgggaagctcactggcatggcctt

SEQ ID NO: 90756 - DNA, 25 bp, Rattus norvegicus
acgggaagctcagtggcatggcctt

SEQ ID NO: 90757 - DNA, 25 bp, Rattus norvegicus
acgggaagctgtactgtgtccagtt

SEQ ID NO: 90758 - DNA, 25 bp, Rattus norvegicus
acgggaagctgttctgtgtccagtt

SEQ ID NO: 90759 - DNA, 25 bp, Rattus norvegicus
acgggaaggagacactgatgcgctc

SEQ ID NO: 90760 - DNA, 25 bp, Rattus norvegicus
acgggaaggagagactgatgcgctc

SEQ ID NO: 90761 - DNA, 25 bp, Rattus norvegicus
acgggaagtcggagtcttatgtact

SEQ ID NO: 90762 - DNA, 25 bp, Rattus norvegicus
acgggaagtcggtgtcttatgtact

SEQ ID NO: 90763 - DNA, 25 bp, Rattus norvegicus
acgggaattattcggctgccagttt

SEQ ID NO: 90764 - DNA, 25 bp, Rattus norvegicus
acgggaattattgggctgccagttt

SEQ ID NO: 90765 - DNA, 25 bp, Rattus norvegicus
acgggacaggaaactacccaactgc

SEQ ID NO: 90766 - DNA, 25 bp, Rattus norvegicus
acgggacaggaatctacccaactgc

SEQ ID NO: 90767 - DNA, 25 bp, Rattus norvegicus
acgggaccacgaaagcagtgttctt

SEQ ID NO: 90768 - DNA, 25 bp, Rattus norvegicus
acgggaccacgatagcagtgttctt

SEQ ID NO: 90769 - DNA, 25 bp, Rattus norvegicus
acgggactcgctattcatcagacac

SEQ ID NO: 90770 - DNA, 25 bp, Rattus norvegicus
acgggactcgcttttcatcagacac

SEQ ID NO: 90771 - DNA, 25 bp, Rattus norvegicus
acgggagacggaactggcagcctct

SEQ ID NO: 90772 - DNA, 25 bp, Rattus norvegicus
acgggagacggatctggcagcctct

SEQ ID NO: 90773 - DNA, 25 bp, Rattus norvegicus
acgggagcggagacctctgtccaag

SEQ ID NO: 90774 - DNA, 25 bp, Rattus norvegicus
acgggagcggagtcctctgtccaag

SEQ ID NO: 90775 - DNA, 25 bp, Rattus norvegicus
acgggagctcagagattgtgtcagt

SEQ ID NO: 90776 - DNA, 25 bp, Rattus norvegicus
acgggagctcagtgattgtgtcagt

SEQ ID NO: 90777 - DNA, 25 bp, Rattus norvegicus
acgggagctgctcttctattagaag

SEQ ID NO: 90778 - DNA, 25 bp, Rattus norvegicus
acgggagctgctgttctattagaag

SEQ ID NO: 90779 - DNA, 25 bp, Rattus norvegicus
acgggagctttgaatccagccgaca

SEQ ID NO: 90780 - DNA, 25 bp, Rattus norvegicus
acgggagctttgtatccagccgaca

SEQ ID NO: 90781 - DNA, 25 bp, Rattus norvegicus
acgggaggccagaaagctgcagact

SEQ ID NO: 90782 - DNA, 25 bp, Rattus norvegicus
acgggaggccagtaagctgcagact

SEQ ID NO: 90783 - DNA, 25 bp, Rattus norvegicus
acgggatagctgacctgttagaatc

SEQ ID NO: 90784 - DNA, 25 bp, Rattus norvegicus
acgggatagctgtcctgttagaatc

SEQ ID NO: 90785 - DNA, 25 bp, Rattus norvegicus
acgggatcactgagtggcccacaaa

SEQ ID NO: 90786 - DNA, 25 bp, Rattus norvegicus
acgggatcactgtgtggcccacaaa

SEQ ID NO: 90787 - DNA, 25 bp, Rattus norvegicus
acgggatcgtggcaaccatcgtcaa

SEQ ID NO: 90788 - DNA, 25 bp, Rattus norvegicus
acgggatcgtgggaaccatcgtcaa

SEQ ID NO: 90789 - DNA, 25 bp, Rattus norvegicus
acgggatggaacaggctctgagcct

SEQ ID NO: 90790 - DNA, 25 bp, Rattus norvegicus
acgggatggaactggctctgagcct

SEQ ID NO: 90791 - DNA, 25 bp, Rattus norvegicus
acgggatggatgagtggtcctctcc

SEQ ID NO: 90792 - DNA, 25 bp, Rattus norvegicus
acgggatggatgtgtggtcctctcc

SEQ ID NO: 90793 - DNA, 25 bp, Rattus norvegicus
acgggatggcatccctaggacctga

SEQ ID NO: 90794 - DNA, 25 bp, Rattus norvegicus
acgggatggcatgcctaggacctga

SEQ ID NO: 90795 - DNA, 25 bp, Rattus norvegicus
acgggatttctacctgtggacagat

SEQ ID NO: 90796 - DNA, 25 bp, Rattus norvegicus
acgggatttctagctgtggacagat

SEQ ID NO: 90797 - DNA, 25 bp, Rattus norvegicus
acgggattttctcgctggagacgac

SEQ ID NO: 90798 - DNA, 25 bp, Rattus norvegicus
acgggattttctggctggagacgac

SEQ ID NO: 90799 - DNA, 25 bp, Rattus norvegicus
acgggcaatcttctgcaatcttgga

SEQ ID NO: 90800 - DNA, 25 bp, Rattus norvegicus
acgggcaatcttgtgcaatcttgga

SEQ ID NO: 90801 - DNA, 25 bp, Rattus norvegicus
acgggcaatgcacatggtcaaactt

SEQ ID NO: 90802 - DNA, 25 bp, Rattus norvegicus
acgggcaatgcagatggtcaaactt

SEQ ID NO: 90803 - DNA, 25 bp, Rattus norvegicus
acgggcacctctcgcagatgtggta

SEQ ID NO: 90804 - DNA, 25 bp, Rattus norvegicus
acgggcacctctggcagatgtggta

SEQ ID NO: 90805 - DNA, 25 bp, Rattus norvegicus
acgggcacctgtcatgaacacatgg

SEQ ID NO: 90806 - DNA, 25 bp, Rattus norvegicus
acgggcacctgtgatgaacacatgg

SEQ ID NO: 90807 - DNA, 25 bp, Rattus norvegicus
acgggcactctaagactacgacggt

SEQ ID NO: 90808 - DNA, 25 bp, Rattus norvegicus
acgggcactctatgactacgacggt

SEQ ID NO: 90809 - DNA, 25 bp, Rattus norvegicus
acgggcactgccagtcctgagaagg

SEQ ID NO: 90810 - DNA, 25 bp, Rattus norvegicus
acgggcactgcctgtcctgagaagg

SEQ ID NO: 90811 - DNA, 25 bp, Rattus norvegicus
acgggcactgtcaggaacttgtctc

SEQ ID NO: 90812 - DNA, 25 bp, Rattus norvegicus
acgggcactgtctggaacttgtctc

SEQ ID NO: 90813 - DNA, 25 bp, Rattus norvegicus
acgggcagcctcatcaggatacaaa

SEQ ID NO: 90814 - DNA, 25 bp, Rattus norvegicus
acgggcagcctcttcaggatacaaa

SEQ ID NO: 90815 - DNA, 25 bp, Rattus norvegicus
acgggcaggaggaccttttgcattc

SEQ ID NO: 90816 - DNA, 25 bp, Rattus norvegicus
acgggcaggaggtccttttgcattc

SEQ ID NO: 90817 - DNA, 25 bp, Rattus norvegicus
acgggcaggcccaggcttttgctta

SEQ ID NO: 90818 - DNA, 25 bp, Rattus norvegicus
acgggcaggccctggcttttgctta

SEQ ID NO: 90819 - DNA, 25 bp, Rattus norvegicus
acgggcattcaccaaagtctcgact

SEQ ID NO: 90820 - DNA, 25 bp, Rattus norvegicus
acgggcattcacgaaagtctcgact

SEQ ID NO: 90821 - DNA, 25 bp, Rattus norvegicus
acgggcattgggatctcaaggtcta

SEQ ID NO: 90822 - DNA, 25 bp, Rattus norvegicus
acgggcattgggttctcaaggtcta

SEQ ID NO: 90823 - DNA, 25 bp, Rattus norvegicus
acgggccagcggaccacacgggaat

SEQ ID NO: 90824 - DNA, 25 bp, Rattus norvegicus
acgggccagcggtccacacgggaat

SEQ ID NO: 90825 - DNA, 25 bp, Rattus norvegicus
acgggccattcactctatgaagaca

SEQ ID NO: 90826 - DNA, 25 bp, Rattus norvegicus
acgggccattcagtctatgaagaca

SEQ ID NO: 90827 - DNA, 25 bp, Rattus norvegicus
acgggcccagtgacagatgatgcat

SEQ ID NO: 90828 - DNA, 25 bp, Rattus norvegicus
acgggcccagtgtcagatgatgcat

SEQ ID NO: 90829 - DNA, 25 bp, Rattus norvegicus
acgggccccagacagtcacacaaag

SEQ ID NO: 90830 - DNA, 25 bp, Rattus norvegicus
acgggccccagagagtcacacaaag

SEQ ID NO: 90831 - DNA, 25 bp, Rattus norvegicus
acgggccccagcaaagactgaaggg

SEQ ID NO: 90832 - DNA, 25 bp, Rattus norvegicus
acgggccccagctaagactgaaggg

SEQ ID NO: 90833 - DNA, 25 bp, Rattus norvegicus
acgggccctgcgatcggcagccaga

SEQ ID NO: 90834 - DNA, 25 bp, Rattus norvegicus
acgggccctgcgttcggcagccaga

SEQ ID NO: 90835 - DNA, 25 bp, Rattus norvegicus
acgggccgcaggaaacgcactgaag

SEQ ID NO: 90836 - DNA, 25 bp, Rattus norvegicus
acgggccgcaggtaacgcactgaag

SEQ ID NO: 90837 - DNA, 25 bp, Rattus norvegicus
acgggcctcatcaagggtcctttgt

SEQ ID NO: 90838 - DNA, 25 bp, Rattus norvegicus
acgggcctcatctagggtcctttgt

SEQ ID NO: 90839 - DNA, 25 bp, Rattus norvegicus
acgggcctctccagagtggcattta

SEQ ID NO: 90840 - DNA, 25 bp, Rattus norvegicus
acgggcctctcctgagtggcattta

SEQ ID NO: 90841 - DNA, 25 bp, Rattus norvegicus
acgggcctgttacgatgcccaggaa

SEQ ID NO: 90842 - DNA, 25 bp, Rattus norvegicus
acgggcctgttaggatgcccaggaa

SEQ ID NO: 90843 - DNA, 25 bp, Rattus norvegicus
acgggctaatttctcactctgcatg

SEQ ID NO: 90844 - DNA, 25 bp, Rattus norvegicus
acgggctaatttgtcactctgcatg

SEQ ID NO: 90845 - DNA, 25 bp, Rattus norvegicus
acgggctactatactgcttcaggaa

SEQ ID NO: 90846 - DNA, 25 bp, Rattus norvegicus
acgggctactattctgcttcaggaa

SEQ ID NO: 90847 - DNA, 25 bp, Rattus norvegicus
acgggctatttgaccaacaaccgat

SEQ ID NO: 90848 - DNA, 25 bp, Rattus norvegicus
acgggctatttgtccaacaaccgat

SEQ ID NO: 90849 - DNA, 25 bp, Rattus norvegicus
acgggctcaggactgggtcatctca

SEQ ID NO: 90850 - DNA, 25 bp, Rattus norvegicus
acgggctcaggagtgggtcatctca

SEQ ID NO: 90851 - DNA, 25 bp, Rattus norvegicus
acgggctcatccagggtagcagcag

SEQ ID NO: 90852 - DNA, 25 bp, Rattus norvegicus
acgggctcatcctgggtagcagcag

SEQ ID NO: 90853 - DNA, 25 bp, Rattus norvegicus
acgggctccatacattggctttgaa

SEQ ID NO: 90854 - DNA, 25 bp, Rattus norvegicus
acgggctccatagattggctttgaa

SEQ ID NO: 90855 - DNA, 25 bp, Rattus norvegicus
acgggctcttgcctatttgtagatt

SEQ ID NO: 90856 - DNA, 25 bp, Rattus norvegicus
acgggctcttgcgtatttgtagatt

SEQ ID NO: 90857 - DNA, 25 bp, Rattus norvegicus
acgggctgagggacggacttcatcc

SEQ ID NO: 90858 - DNA, 25 bp, Rattus norvegicus
acgggctgagggtcggacttcatcc

SEQ ID NO: 90859 - DNA, 25 bp, Rattus norvegicus
acgggctgatagctctgcaggcatt

SEQ ID NO: 90860 - DNA, 25 bp, Rattus norvegicus
acgggctgataggtctgcaggcatt

SEQ ID NO: 90861 - DNA, 25 bp, Rattus norvegicus
acgggctgcctccaggtgatagcaa

SEQ ID NO: 90862 - DNA, 25 bp, Rattus norvegicus
acgggctgcctcgaggtgatagcaa

SEQ ID NO: 90863 - DNA, 25 bp, Rattus norvegicus
acgggctgcctgctattcagtcaca

SEQ ID NO: 90864 - DNA, 25 bp, Rattus norvegicus
acgggctgcctggtattcagtcaca

SEQ ID NO: 90865 - DNA, 25 bp, Rattus norvegicus
acgggctgtttgaatctctgtctca

SEQ ID NO: 90866 - DNA, 25 bp, Rattus norvegicus
acgggctgtttgtatctctgtctca

SEQ ID NO: 90867 - DNA, 25 bp, Rattus norvegicus
acgggcttaggcactcgtggatgtc

SEQ ID NO: 90868 - DNA, 25 bp, Rattus norvegicus
acgggcttaggctctcgtggatgtc

SEQ ID NO: 90869 - DNA, 25 bp, Rattus norvegicus
acgggcttcgagctttcagacaact

SEQ ID NO: 90870 - DNA, 25 bp, Rattus norvegicus
acgggcttcgaggtttcagacaact

SEQ ID NO: 90871 - DNA, 25 bp, Rattus norvegicus
acgggctttacaaggaaggtcagtc

SEQ ID NO: 90872 - DNA, 25 bp, Rattus norvegicus
acgggctttacatggaaggtcagtc

SEQ ID NO: 90873 - DNA, 25 bp, Rattus norvegicus
acgggctttgcaccttggcacatag

SEQ ID NO: 90874 - DNA, 25 bp, Rattus norvegicus
acgggctttgcagcttggcacatag

SEQ ID NO: 90875 - DNA, 25 bp, Rattus norvegicus
acgggtaatttcatcgactgcctat

SEQ ID NO: 90876 - DNA, 25 bp, Rattus norvegicus
acgggtaatttcttcgactgcctat

SEQ ID NO: 90877 - DNA, 25 bp, Rattus norvegicus
acgggtacacggagcaaggacatga

SEQ ID NO: 90878 - DNA, 25 bp, Rattus norvegicus
acgggtacacggtgcaaggacatga

SEQ ID NO: 90879 - DNA, 25 bp, Rattus norvegicus
acgggtacagcaaggctccaacagg

SEQ ID NO: 90880 - DNA, 25 bp, Rattus norvegicus
acgggtacagcatggctccaacagg

SEQ ID NO: 90881 - DNA, 25 bp, Rattus norvegicus
acgggtacctctcacaccaggaaag

SEQ ID NO: 90882 - DNA, 25 bp, Rattus norvegicus
acgggtacctctgacaccaggaaag

SEQ ID NO: 90883 - DNA, 25 bp, Rattus norvegicus
acgggtacctgtattacactgtgat

SEQ ID NO: 90884 - DNA, 25 bp, Rattus norvegicus
acgggtacctgttttacactgtgat

SEQ ID NO: 90885 - DNA, 25 bp, Rattus norvegicus
acgggtacgagtcgtcagagcccat

SEQ ID NO: 90886 - DNA, 25 bp, Rattus norvegicus
acgggtacgagtggtcagagcccat

SEQ ID NO: 90887 - DNA, 25 bp, Rattus norvegicus
acgggtatgcccagtggtgtttaca

SEQ ID NO: 90888 - DNA, 25 bp, Rattus norvegicus
acgggtatgccctgtggtgtttaca

SEQ ID NO: 90889 - DNA, 25 bp, Rattus norvegicus
acgggtatttgcagctaggccctat

SEQ ID NO: 90890 - DNA, 25 bp, Rattus norvegicus
acgggtatttgctgctaggccctat

SEQ ID NO: 90891 - DNA, 25 bp, Rattus norvegicus
acgggtctataaatccagctgtcaa

SEQ ID NO: 90892 - DNA, 25 bp, Rattus norvegicus
acgggtctataattccagctgtcaa

SEQ ID NO: 90893 - DNA, 25 bp, Rattus norvegicus
acgggtctatttatatgtcaactct

SEQ ID NO: 90894 - DNA, 25 bp, Rattus norvegicus
acgggtctatttttatgtcaactct

SEQ ID NO: 90895 - DNA, 25 bp, Rattus norvegicus
acgggtctggccaaggcttatagtt

SEQ ID NO: 90896 - DNA, 25 bp, Rattus norvegicus
acgggtctggcctaggcttatagtt

SEQ ID NO: 90897 - DNA, 25 bp, Rattus norvegicus
acgggtctgtggcaaatgtgcattc

SEQ ID NO: 90898 - DNA, 25 bp, Rattus norvegicus
acgggtctgtgggaaatgtgcattc

SEQ ID NO: 90899 - DNA, 25 bp, Rattus norvegicus
acgggtctttgtcgtacacgagcgt

SEQ ID NO: 90900 - DNA, 25 bp, Rattus norvegicus
acgggtctttgtggtacacgagcgt

SEQ ID NO: 90901 - DNA, 25 bp, Rattus norvegicus
acgggtgattccagacccggcaggt

SEQ ID NO: 90902 - DNA, 25 bp, Rattus norvegicus
acgggtgattcctgacccggcaggt

SEQ ID NO: 90903 - DNA, 25 bp, Rattus norvegicus
acgggtgcactgagatacacatcac

SEQ ID NO: 90904 - DNA, 25 bp, Rattus norvegicus
acgggtgcactgtgatacacatcac

SEQ ID NO: 90905 - DNA, 25 bp, Rattus norvegicus
acgggtgcagttcggagccaacaaa

SEQ ID NO: 90906 - DNA, 25 bp, Rattus norvegicus
acgggtgcagttgggagccaacaaa

SEQ ID NO: 90907 - DNA, 25 bp, Rattus norvegicus
acgggtgccttgagtgttgtcttca

SEQ ID NO: 90908 - DNA, 25 bp, Rattus norvegicus
acgggtgccttgtgtgttgtcttca

SEQ ID NO: 90909 - DNA, 25 bp, Rattus norvegicus
acgggtggacggaactgtgattcta

SEQ ID NO: 90910 - DNA, 25 bp, Rattus norvegicus
acgggtggacggtactgtgattcta

SEQ ID NO: 90911 - DNA, 25 bp, Rattus norvegicus
acgggtgggccaaatggcaccagca

SEQ ID NO: 90912 - DNA, 25 bp, Rattus norvegicus
acgggtgggccatatggcaccagca

SEQ ID NO: 90913 - DNA, 25 bp, Rattus norvegicus
acgggtgtcttgactaggtgtgtcc

SEQ ID NO: 90914 - DNA, 25 bp, Rattus norvegicus
acgggtgtcttgtctaggtgtgtcc

SEQ ID NO: 90915 - DNA, 25 bp, Rattus norvegicus
acgggttcagcaagtatgttctcag

SEQ ID NO: 90916 - DNA, 25 bp, Rattus norvegicus
acgggttcagcatgtatgttctcag

SEQ ID NO: 90917 - DNA, 25 bp, Rattus norvegicus
acgggttcgactcaacgcccaggcg

SEQ ID NO: 90918 - DNA, 25 bp, Rattus norvegicus
acgggttcgactgaacgcccaggcg

SEQ ID NO: 90919 - DNA, 25 bp, Rattus norvegicus
acgggttgcctcatatcaatggaca

SEQ ID NO: 90920 - DNA, 25 bp, Rattus norvegicus
acgggttgcctcttatcaatggaca

SEQ ID NO: 90921 - DNA, 25 bp, Rattus norvegicus
acgggttgctgtatgccacatttta

SEQ ID NO: 90922 - DNA, 25 bp, Rattus norvegicus
acgggttgctgtttgccacatttta

SEQ ID NO: 90923 - DNA, 25 bp, Rattus norvegicus
acgggttgttgtatatcagcacgga

SEQ ID NO: 90924 - DNA, 25 bp, Rattus norvegicus
acgggttgttgtttatcagcacgga

SEQ ID NO: 90925 - DNA, 25 bp, Rattus norvegicus
acgggtttatgtcttgctccatggc

SEQ ID NO: 90926 - DNA, 25 bp, Rattus norvegicus
acgggtttatgtgttgctccatggc

SEQ ID NO: 90927 - DNA, 25 bp, Rattus norvegicus
acgggtttcattattgccttctcaa

SEQ ID NO: 90928 - DNA, 25 bp, Rattus norvegicus
acgggtttcatttttgccttctcaa

SEQ ID NO: 90929 - DNA, 25 bp, Rattus norvegicus
acgggttttctcaacatcgagtcta

SEQ ID NO: 90930 - DNA, 25 bp, Rattus norvegicus
acgggttttctctacatcgagtcta

SEQ ID NO: 90931 - DNA, 25 bp, Rattus norvegicus
acggtaaggattactgtccagccct

SEQ ID NO: 90932 - DNA, 25 bp, Rattus norvegicus
acggtaaggatttctgtccagccct

SEQ ID NO: 90933 - DNA, 25 bp, Rattus norvegicus
acggtaagtgtgatcttgtgctatt

SEQ ID NO: 90934 - DNA, 25 bp, Rattus norvegicus
acggtaagtgtgttcttgtgctatt

SEQ ID NO: 90935 - DNA, 25 bp, Rattus norvegicus
acggtacacggcatgcttacggaag

SEQ ID NO: 90936 - DNA, 25 bp, Rattus norvegicus
acggtacacggcttgcttacggaag

SEQ ID NO: 90937 - DNA, 25 bp, Rattus norvegicus
acggtacagccaagcttgctaattc

SEQ ID NO: 90938 - DNA, 25 bp, Rattus norvegicus
acggtacagccatgcttgctaattc

SEQ ID NO: 90939 - DNA, 25 bp, Rattus norvegicus
acggtacttattaatgtagtcactg

SEQ ID NO: 90940 - DNA, 25 bp, Rattus norvegicus
acggtacttatttatgtagtcactg

SEQ ID NO: 90941 - DNA, 25 bp, Rattus norvegicus
acggtactttttctgaatggttgca

SEQ ID NO: 90942 - DNA, 25 bp, Rattus norvegicus
acggtactttttgtgaatggttgca

SEQ ID NO: 90943 - DNA, 25 bp, Rattus norvegicus
acggtaggttgccaggctcccttgt

SEQ ID NO: 90944 - DNA, 25 bp, Rattus norvegicus
acggtaggttgcgaggctcccttgt

SEQ ID NO: 90945 - DNA, 25 bp, Rattus norvegicus
acggtatccacaaagaccaggctga

SEQ ID NO: 90946 - DNA, 25 bp, Rattus norvegicus
acggtatccacatagaccaggctga

SEQ ID NO: 90947 - DNA, 25 bp, Rattus norvegicus
acggtatccgtgagtgaatgaagcc

SEQ ID NO: 90948 - DNA, 25 bp, Rattus norvegicus
acggtatccgtgtgtgaatgaagcc

SEQ ID NO: 90949 - DNA, 25 bp, Rattus norvegicus
acggtatctcagacgctgtcttatt

SEQ ID NO: 90950 - DNA, 25 bp, Rattus norvegicus
acggtatctcagtcgctgtcttatt

SEQ ID NO: 90951 - DNA, 25 bp, Rattus norvegicus
acggtcaagctgctcttgggccgaa

SEQ ID NO: 90952 - DNA, 25 bp, Rattus norvegicus
acggtcaagctggtcttgggccgaa

SEQ ID NO: 90953 - DNA, 25 bp, Rattus norvegicus
acggtcaatgtgaccaggcaggtag

SEQ ID NO: 90954 - DNA, 25 bp, Rattus norvegicus
acggtcaatgtgtccaggcaggtag

SEQ ID NO: 90955 - DNA, 25 bp, Rattus norvegicus
acggtcacctggactcctatgagaa

SEQ ID NO: 90956 - DNA, 25 bp, Rattus norvegicus
acggtcacctggtctcctatgagaa

SEQ ID NO: 90957 - DNA, 25 bp, Rattus norvegicus
acggtcacgactatgtaattcctgt

SEQ ID NO: 90958 - DNA, 25 bp, Rattus norvegicus
acggtcacgactttgtaattcctgt

SEQ ID NO: 90959 - DNA, 25 bp, Rattus norvegicus
acggtcagtactctgtgtgttttcc

SEQ ID NO: 90960 - DNA, 25 bp, Rattus norvegicus
acggtcagtactgtgtgtgttttcc

SEQ ID NO: 90961 - DNA, 25 bp, Rattus norvegicus
acggtcccattaaacagtctgcttt

SEQ ID NO: 90962 - DNA, 25 bp, Rattus norvegicus
acggtcccattatacagtctgcttt

SEQ ID NO: 90963 - DNA, 25 bp, Rattus norvegicus
acggtccctgcaaaggacttctgaa

SEQ ID NO: 90964 - DNA, 25 bp, Rattus norvegicus
acggtccctgcataggacttctgaa

SEQ ID NO: 90965 - DNA, 25 bp, Rattus norvegicus
acggtccctttaacagttgaatgtt

SEQ ID NO: 90966 - DNA, 25 bp, Rattus norvegicus
acggtccctttatcagttgaatgtt

SEQ ID NO: 90967 - DNA, 25 bp, Rattus norvegicus
acggtccggtgcctgggcgcgataa

SEQ ID NO: 90968 - DNA, 25 bp, Rattus norvegicus
acggtccggtgcgtgggcgcgataa

SEQ ID NO: 90969 - DNA, 25 bp, Rattus norvegicus
acggtcctatgtagcaagtgcctac

SEQ ID NO: 90970 - DNA, 25 bp, Rattus norvegicus
acggtcctatgttgcaagtgcctac

SEQ ID NO: 90971 - DNA, 25 bp, Rattus norvegicus
acggtcctcgttctgccggttcgct

SEQ ID NO: 90972 - DNA, 25 bp, Rattus norvegicus
acggtcctcgttgtgccggttcgct

SEQ ID NO: 90973 - DNA, 25 bp, Rattus norvegicus
acggtcctgctcacagctagggaac

SEQ ID NO: 90974 - DNA, 25 bp, Rattus norvegicus
acggtcctgctctcagctagggaac

SEQ ID NO: 90975 - DNA, 25 bp, Rattus norvegicus
acggtcgcatcgctaagcaccgcaa

SEQ ID NO: 90976 - DNA, 25 bp, Rattus norvegicus
acggtcgcatcggtaagcaccgcaa

SEQ ID NO: 90977 - DNA, 25 bp, Rattus norvegicus
acggtcgcgaagaaggtcctataca

SEQ ID NO: 90978 - DNA, 25 bp, Rattus norvegicus
acggtcgcgaagtaggtcctataca

SEQ ID NO: 90979 - DNA, 25 bp, Rattus norvegicus
acggtcgggaatcagcttgttgcaa

SEQ ID NO: 90980 - DNA, 25 bp, Rattus norvegicus
acggtcgggaatgagcttgttgcaa

SEQ ID NO: 90981 - DNA, 25 bp, Rattus norvegicus
acggtctactttcttgctgtttggc

SEQ ID NO: 90982 - DNA, 25 bp, Rattus norvegicus
acggtctactttgttgctgtttggc

SEQ ID NO: 90983 - DNA, 25 bp, Rattus norvegicus
acggtctataatattgatgggtcta

SEQ ID NO: 90984 - DNA, 25 bp, Rattus norvegicus
acggtctataattttgatgggtcta

SEQ ID NO: 90985 - DNA, 25 bp, Rattus norvegicus
acggtctatggccagattccacttc

SEQ ID NO: 90986 - DNA, 25 bp, Rattus norvegicus
acggtctatggcgagattccacttc

SEQ ID NO: 90987 - DNA, 25 bp, Rattus norvegicus
acggtctccaccactttatttatgg

SEQ ID NO: 90988 - DNA, 25 bp, Rattus norvegicus
acggtctccacctctttatttatgg

SEQ ID NO: 90989 - DNA, 25 bp, Rattus norvegicus
acggtctctgacattgtggcatatg

SEQ ID NO: 90990 - DNA, 25 bp, Rattus norvegicus
acggtctctgactttgtggcatatg

SEQ ID NO: 90991 - DNA, 25 bp, Rattus norvegicus
acggtctctgctaacacggaggaca

SEQ ID NO: 90992 - DNA, 25 bp, Rattus norvegicus
acggtctctgcttacacggaggaca

SEQ ID NO: 90993 - DNA, 25 bp, Rattus norvegicus
acggtctcttcaaaagtccaggtct

SEQ ID NO: 90994 - DNA, 25 bp, Rattus norvegicus
acggtctcttcataagtccaggtct

SEQ ID NO: 90995 - DNA, 25 bp, Rattus norvegicus
acggtctgatggattccaaggactt

SEQ ID NO: 90996 - DNA, 25 bp, Rattus norvegicus
acggtctgatggtttccaaggactt

SEQ ID NO: 90997 - DNA, 25 bp, Rattus norvegicus
acggtctgcattatgtctggagccc

SEQ ID NO: 90998 - DNA, 25 bp, Rattus norvegicus
acggtctgcattttgtctggagccc

SEQ ID NO: 90999 - DNA, 25 bp, Rattus norvegicus
acggtctgtctcagcaaggccttgg

SEQ ID NO: 91000 - DNA, 25 bp, Rattus norvegicus
acggtctgtctctgcaaggccttgg

SEQ ID NO: 91001 - DNA, 25 bp, Rattus norvegicus
acggtctgtggcctttgatgtcttc

SEQ ID NO: 91002 - DNA, 25 bp, Rattus norvegicus
acggtctgtggcgtttgatgtcttc

SEQ ID NO: 91003 - DNA, 25 bp, Rattus norvegicus
acggtctgtgggaaatcctggtcct

SEQ ID NO: 91004 - DNA, 25 bp, Rattus norvegicus
acggtctgtgggtaatcctggtcct

SEQ ID NO: 91005 - DNA, 25 bp, Rattus norvegicus
acggtcttgcagagacgagcatcca

SEQ ID NO: 91006 - DNA, 25 bp, Rattus norvegicus
acggtcttgcagtgacgagcatcca

SEQ ID NO: 91007 - DNA, 25 bp, Rattus norvegicus
acggtcttgctaaatgttctgatct

SEQ ID NO: 91008 - DNA, 25 bp, Rattus norvegicus
acggtcttgctatatgttctgatct

SEQ ID NO: 91009 - DNA, 25 bp, Rattus norvegicus
acggtctttgctagactagacgcta

SEQ ID NO: 91010 - DNA, 25 bp, Rattus norvegicus
acggtctttgcttgactagacgcta

SEQ ID NO: 91011 - DNA, 25 bp, Rattus norvegicus
acggtctttgtgagagcgttctcca

SEQ ID NO: 91012 - DNA, 25 bp, Rattus norvegicus
acggtctttgtgtgagcgttctcca

SEQ ID NO: 91013 - DNA, 25 bp, Rattus norvegicus
acggtgaattgtacagagcccctct

SEQ ID NO: 91014 - DNA, 25 bp, Rattus norvegicus
acggtgaattgttcagagcccctct

SEQ ID NO: 91015 - DNA, 25 bp, Rattus norvegicus
acggtgaatttgacttcctcctgaa

SEQ ID NO: 91016 - DNA, 25 bp, Rattus norvegicus
acggtgaatttgtcttcctcctgaa

SEQ ID NO: 91017 - DNA, 25 bp, Rattus norvegicus
acggtgacaagcctcactcctgctg

SEQ ID NO: 91018 - DNA, 25 bp, Rattus norvegicus
acggtgacaagcgtcactcctgctg

SEQ ID NO: 91019 - DNA, 25 bp, Rattus norvegicus
acggtgacatgtaccctgtgacaat

SEQ ID NO: 91020 - DNA, 25 bp, Rattus norvegicus
acggtgacatgttccctgtgacaat

SEQ ID NO: 91021 - DNA, 25 bp, Rattus norvegicus
acggtgacttctatatcccagtgtt

SEQ ID NO: 91022 - DNA, 25 bp, Rattus norvegicus
acggtgacttctttatcccagtgtt

SEQ ID NO: 91023 - DNA, 25 bp, Rattus norvegicus
acggtgagaagtcccagcatcatct

SEQ ID NO: 91024 - DNA, 25 bp, Rattus norvegicus
acggtgagaagtgccagcatcatct

SEQ ID NO: 91025 - DNA, 25 bp, Rattus norvegicus
acggtgagccagatgtctgtcatcc

SEQ ID NO: 91026 - DNA, 25 bp, Rattus norvegicus
acggtgagccagttgtctgtcatcc

SEQ ID NO: 91027 - DNA, 25 bp, Rattus norvegicus
acggtgatacacatcttatgccagt

SEQ ID NO: 91028 - DNA, 25 bp, Rattus norvegicus
acggtgatacacttcttatgccagt

SEQ ID NO: 91029 - DNA, 25 bp, Rattus norvegicus
acggtgatagtgacccttggttggc

SEQ ID NO: 91030 - DNA, 25 bp, Rattus norvegicus
acggtgatagtgtcccttggttggc

SEQ ID NO: 91031 - DNA, 25 bp, Rattus norvegicus
acggtgatcgtgcacgcttgaccgg

SEQ ID NO: 91032 - DNA, 25 bp, Rattus norvegicus
acggtgatcgtggacgcttgaccgg

SEQ ID NO: 91033 - DNA, 25 bp, Rattus norvegicus
acggtgatgacccacctggaggaca

SEQ ID NO: 91034 - DNA, 25 bp, Rattus norvegicus
acggtgatgaccgacctggaggaca

SEQ ID NO: 91035 - DNA, 25 bp, Rattus norvegicus
acggtgatgcatatctttgtggaga

SEQ ID NO: 91036 - DNA, 25 bp, Rattus norvegicus
acggtgatgcatttctttgtggaga

SEQ ID NO: 91037 - DNA, 25 bp, Rattus norvegicus
acggtgcagagaccacactgtctga

SEQ ID NO: 91038 - DNA, 25 bp, Rattus norvegicus
acggtgcagagagcacactgtctga

SEQ ID NO: 91039 - DNA, 25 bp, Rattus norvegicus
acggtgccgctgacataagtgtgtt

SEQ ID NO: 91040 - DNA, 25 bp, Rattus norvegicus
acggtgccgctgtcataagtgtgtt

SEQ ID NO: 91041 - DNA, 25 bp, Rattus norvegicus
acggtgctacttcatctgtgtacaa

SEQ ID NO: 91042 - DNA, 25 bp, Rattus norvegicus
acggtgctacttgatctgtgtacaa

SEQ ID NO: 91043 - DNA, 25 bp, Rattus norvegicus
acggtgctagacatgtacatctgga

SEQ ID NO: 91044 - DNA, 25 bp, Rattus norvegicus
acggtgctagacttgtacatctgga

SEQ ID NO: 91045 - DNA, 25 bp, Rattus norvegicus
acggtgctatccctggtgctactgg

SEQ ID NO: 91046 - DNA, 25 bp, Rattus norvegicus
acggtgctatccgtggtgctactgg

SEQ ID NO: 91047 - DNA, 25 bp, Rattus norvegicus
acggtgctcagtcagtttgtctctt

SEQ ID NO: 91048 - DNA, 25 bp, Rattus norvegicus
acggtgctcagtgagtttgtctctt

SEQ ID NO: 91049 - DNA, 25 bp, Rattus norvegicus
acggtgctggagattgacacgccca

SEQ ID NO: 91050 - DNA, 25 bp, Rattus norvegicus
acggtgctggagtttgacacgccca

SEQ ID NO: 91051 - DNA, 25 bp, Rattus norvegicus
acggtggacttcaaatctgccttgg

SEQ ID NO: 91052 - DNA, 25 bp, Rattus norvegicus
acggtggacttctaatctgccttgg

SEQ ID NO: 91053 - DNA, 25 bp, Rattus norvegicus
acggtggcaagcaggctgtgttcac

SEQ ID NO: 91054 - DNA, 25 bp, Rattus norvegicus
acggtggcaagctggctgtgttcac

SEQ ID NO: 91055 - DNA, 25 bp, Rattus norvegicus
acggtggcaatgacatcctggctga

SEQ ID NO: 91056 - DNA, 25 bp, Rattus norvegicus
acggtggcaatgtcatcctggctga

SEQ ID NO: 91057 - DNA, 25 bp, Rattus norvegicus
acggtggcatggacccaggcaagcc

SEQ ID NO: 91058 - DNA, 25 bp, Rattus norvegicus
acggtggcatggtcccaggcaagcc

SEQ ID NO: 91059 - DNA, 25 bp, Rattus norvegicus
acggtggctttgctggaagacaaat

SEQ ID NO: 91060 - DNA, 25 bp, Rattus norvegicus
acggtggctttggtggaagacaaat

SEQ ID NO: 91061 - DNA, 25 bp, Rattus norvegicus
acggtgggacctatgcagcatgtgt

SEQ ID NO: 91062 - DNA, 25 bp, Rattus norvegicus
acggtgggacctttgcagcatgtgt

SEQ ID NO: 91063 - DNA, 25 bp, Rattus norvegicus
acggtgggccaaacctgtgttcctg

SEQ ID NO: 91064 - DNA, 25 bp, Rattus norvegicus
acggtgggccaatcctgtgttcctg

SEQ ID NO: 91065 - DNA, 25 bp, Rattus norvegicus
acggtgggtacaccgacgcatcaga

SEQ ID NO: 91066 - DNA, 25 bp, Rattus norvegicus
acggtgggtacagcgacgcatcaga

SEQ ID NO: 91067 - DNA, 25 bp, Rattus norvegicus
acggtggtcactacctgggtgctgc

SEQ ID NO: 91068 - DNA, 25 bp, Rattus norvegicus
acggtggtcacttcctgggtgctgc

SEQ ID NO: 91069 - DNA, 25 bp, Rattus norvegicus
acggtggtcttcattgtctataaaa

SEQ ID NO: 91070 - DNA, 25 bp, Rattus norvegicus
acggtggtcttctttgtctataaaa

SEQ ID NO: 91071 - DNA, 25 bp, Rattus norvegicus
acggtgtacattaccagagccttgt

SEQ ID NO: 91072 - DNA, 25 bp, Rattus norvegicus
acggtgtacatttccagagccttgt

SEQ ID NO: 91073 - DNA, 25 bp, Rattus norvegicus
acggtgtcaacaactccaaggaggc

SEQ ID NO: 91074 - DNA, 25 bp, Rattus norvegicus
acggtgtcaacatctccaaggaggc

SEQ ID NO: 91075 - DNA, 25 bp, Rattus norvegicus
acggtgtcaaccaaactcagtgtag

SEQ ID NO: 91076 - DNA, 25 bp, Rattus norvegicus
acggtgtcaacctaactcagtgtag

SEQ ID NO: 91077 - DNA, 25 bp, Rattus norvegicus
acggtgtcggatcaaatgtgccaca

SEQ ID NO: 91078 - DNA, 25 bp, Rattus norvegicus
acggtgtcggatgaaatgtgccaca

SEQ ID NO: 91079 - DNA, 25 bp, Rattus norvegicus
acggtgtgggtgctaacagcatctt

SEQ ID NO: 91080 - DNA, 25 bp, Rattus norvegicus
acggtgtgggtggtaacagcatctt

SEQ ID NO: 91081 - DNA, 25 bp, Rattus norvegicus
acggtgtgttaaccaacgtcgacaa

SEQ ID NO: 91082 - DNA, 25 bp, Rattus norvegicus
acggtgtgttaagcaacgtcgacaa

SEQ ID NO: 91083 - DNA, 25 bp, Rattus norvegicus
acggtgtttggccttcacctgaaca

SEQ ID NO: 91084 - DNA, 25 bp, Rattus norvegicus
acggtgtttggcgttcacctgaaca

SEQ ID NO: 91085 - DNA, 25 bp, Rattus norvegicus
acggttacgctcaaagcagctttta

SEQ ID NO: 91086 - DNA, 25 bp, Rattus norvegicus
acggttacgctctaagcagctttta

SEQ ID NO: 91087 - DNA, 25 bp, Rattus norvegicus
acggttagatttccaggactggcct

SEQ ID NO: 91088 - DNA, 25 bp, Rattus norvegicus
acggttagatttgcaggactggcct

SEQ ID NO: 91089 - DNA, 25 bp, Rattus norvegicus
acggttatcccgagcagttctgtgt

SEQ ID NO: 91090 - DNA, 25 bp, Rattus norvegicus
acggttatcccgtgcagttctgtgt

SEQ ID NO: 91091 - DNA, 25 bp, Rattus norvegicus
acggttatctacaagaattctaact

SEQ ID NO: 91092 - DNA, 25 bp, Rattus norvegicus
acggttatctactagaattctaact

SEQ ID NO: 91093 - DNA, 25 bp, Rattus norvegicus
acggttcagtgacaaagtgctctac

SEQ ID NO: 91094 - DNA, 25 bp, Rattus norvegicus
acggttcagtgagaaagtgctctac

SEQ ID NO: 91095 - DNA, 25 bp, Rattus norvegicus
acggttcatccaagcgactgtcttt

SEQ ID NO: 91096 - DNA, 25 bp, Rattus norvegicus
acggttcatccatgcgactgtcttt

SEQ ID NO: 91097 - DNA, 25 bp, Rattus norvegicus
acggttccacaacacctacgaggtg

SEQ ID NO: 91098 - DNA, 25 bp, Rattus norvegicus
acggttccacaagacctacgaggtg

SEQ ID NO: 91099 - DNA, 25 bp, Rattus norvegicus
acggttccgatcctggattcacaag

SEQ ID NO: 91100 - DNA, 25 bp, Rattus norvegicus
acggttccgatcgtggattcacaag

SEQ ID NO: 91101 - DNA, 25 bp, Rattus norvegicus
acggttcctcatcacccagcaggag

SEQ ID NO: 91102 - DNA, 25 bp, Rattus norvegicus
acggttcctcatgacccagcaggag

SEQ ID NO: 91103 - DNA, 25 bp, Rattus norvegicus
acggttctcatcagttggttttcat

SEQ ID NO: 91104 - DNA, 25 bp, Rattus norvegicus
acggttctcatctgttggttttcat

SEQ ID NO: 91105 - DNA, 25 bp, Rattus norvegicus
acggttctcattaccaaaggacaag

SEQ ID NO: 91106 - DNA, 25 bp, Rattus norvegicus
acggttctcatttccaaaggacaag

SEQ ID NO: 91107 - DNA, 25 bp, Rattus norvegicus
acggttctgaggctgtcgctgctac

SEQ ID NO: 91108 - DNA, 25 bp, Rattus norvegicus
acggttctgagggtgtcgctgctac

SEQ ID NO: 91109 - DNA, 25 bp, Rattus norvegicus
acggttctggtgcatttggcagtca

SEQ ID NO: 91110 - DNA, 25 bp, Rattus norvegicus
acggttctggtggatttggcagtca

SEQ ID NO: 91111 - DNA, 25 bp, Rattus norvegicus
acggttgcgtctccttatcctaaga

SEQ ID NO: 91112 - DNA, 25 bp, Rattus norvegicus
acggttgcgtctgcttatcctaaga

SEQ ID NO: 91113 - DNA, 25 bp, Rattus norvegicus
acggttggtgcgaatgtagcctcta

SEQ ID NO: 91114 - DNA, 25 bp, Rattus norvegicus
acggttggtgcgtatgtagcctcta

SEQ ID NO: 91115 - DNA, 25 bp, Rattus norvegicus
acggttgttttaagttgctgacttg

SEQ ID NO: 91116 - DNA, 25 bp, Rattus norvegicus
acggttgttttatgttgctgacttg

SEQ ID NO: 91117 - DNA, 25 bp, Rattus norvegicus
acggtttaagcaatgcggcctttgt

SEQ ID NO: 91118 - DNA, 25 bp, Rattus norvegicus
acggtttaagcattgcggcctttgt

SEQ ID NO: 91119 - DNA, 25 bp, Rattus norvegicus
acggtttagacaccttcctctgcct

SEQ ID NO: 91120 - DNA, 25 bp, Rattus norvegicus
acggtttagacagcttcctctgcct

SEQ ID NO: 91121 - DNA, 25 bp, Rattus norvegicus
acggtttcagtgaggctatgtgcta

SEQ ID NO: 91122 - DNA, 25 bp, Rattus norvegicus
acggtttcagtgtggctatgtgcta

SEQ ID NO: 91123 - DNA, 25 bp, Rattus norvegicus
acggtttctacaatgtggcctcctg

SEQ ID NO: 91124 - DNA, 25 bp, Rattus norvegicus
acggtttctacattgtggcctcctg

SEQ ID NO: 91125 - DNA, 25 bp, Rattus norvegicus
acggtttctttcagtcagtctggta

SEQ ID NO: 91126 - DNA, 25 bp, Rattus norvegicus
acggtttctttctgtcagtctggta

SEQ ID NO: 91127 - DNA, 25 bp, Rattus norvegicus
acggtttgcatgatacagtgacagc

SEQ ID NO: 91128 - DNA, 25 bp, Rattus norvegicus
acggtttgcatgttacagtgacagc

SEQ ID NO: 91129 - DNA, 25 bp, Rattus norvegicus
acggtttgctttcagttcattctag

SEQ ID NO: 91130 - DNA, 25 bp, Rattus norvegicus
acggtttgctttgagttcattctag

SEQ ID NO: 91131 - DNA, 25 bp, Rattus norvegicus
acggtttgtgtgagggactgaccca

SEQ ID NO: 91132 - DNA, 25 bp, Rattus norvegicus
acggtttgtgtgtgggactgaccca

SEQ ID NO: 91133 - DNA, 25 bp, Rattus norvegicus
acggttttgtgcctcaaggcttagc

SEQ ID NO: 91134 - DNA, 25 bp, Rattus norvegicus
acggttttgtgcgtcaaggcttagc

SEQ ID NO: 91135 - DNA, 25 bp, Rattus norvegicus
acggtttttcagcaggcggtcacac

SEQ ID NO: 91136 - DNA, 25 bp, Rattus norvegicus
acggtttttcaggaggcggtcacac

SEQ ID NO: 91137 - DNA, 25 bp, Rattus norvegicus
acgtaaaaacgtcacgcaccgcctg

SEQ ID NO: 91138 - DNA, 25 bp, Rattus norvegicus
acgtaaaaacgtgacgcaccgcctg

SEQ ID NO: 91139 - DNA, 25 bp, Rattus norvegicus
acgtaaacatccagcaccgagtggg

SEQ ID NO: 91140 - DNA, 25 bp, Rattus norvegicus
acgtaaacatcctgcaccgagtggg

SEQ ID NO: 91141 - DNA, 25 bp, Rattus norvegicus
acgtaacacgacaagctaatcccct

SEQ ID NO: 91142 - DNA, 25 bp, Rattus norvegicus
acgtaacacgactagctaatcccct

SEQ ID NO: 91143 - DNA, 25 bp, Rattus norvegicus
acgtaacacttgctctagcctctag

SEQ ID NO: 91144 - DNA, 25 bp, Rattus norvegicus
acgtaacacttggtctagcctctag

SEQ ID NO: 91145 - DNA, 25 bp, Rattus norvegicus
acgtaaccaatcagtgcatcggtgt

SEQ ID NO: 91146 - DNA, 25 bp, Rattus norvegicus
acgtaaccaatctgtgcatcggtgt

SEQ ID NO: 91147 - DNA, 25 bp, Rattus norvegicus
acgtaaccacgtaggcgcactcgag

SEQ ID NO: 91148 - DNA, 25 bp, Rattus norvegicus
acgtaaccacgttggcgcactcgag

SEQ ID NO: 91149 - DNA, 25 bp, Rattus norvegicus
acgtaacgcagtattctgattcccc

SEQ ID NO: 91150 - DNA, 25 bp, Rattus norvegicus
acgtaacgcagttttctgattcccc

SEQ ID NO: 91151 - DNA, 25 bp, Rattus norvegicus
acgtaactgttaccactgcacttgt

SEQ ID NO: 91152 - DNA, 25 bp, Rattus norvegicus
acgtaactgttagcactgcacttgt

SEQ ID NO: 91153 - DNA, 25 bp, Rattus norvegicus
acgtaacttctcatccaaagtcagc

SEQ ID NO: 91154 - DNA, 25 bp, Rattus norvegicus
acgtaacttctcttccaaagtcagc

SEQ ID NO: 91155 - DNA, 25 bp, Rattus norvegicus
acgtaagcctgtattttgagataag

SEQ ID NO: 91156 - DNA, 25 bp, Rattus norvegicus
acgtaagcctgttttttgagataag

SEQ ID NO: 91157 - DNA, 25 bp, Rattus norvegicus
acgtaattttcccactgccacagac

SEQ ID NO: 91158 - DNA, 25 bp, Rattus norvegicus
acgtaattttccgactgccacagac

SEQ ID NO: 91159 - DNA, 25 bp, Rattus norvegicus
acgtacaaagggagccagacatggc

SEQ ID NO: 91160 - DNA, 25 bp, Rattus norvegicus
acgtacaaagggtgccagacatggc

SEQ ID NO: 91161 - DNA, 25 bp, Rattus norvegicus
acgtacaagggcacacaaggtggct

SEQ ID NO: 91162 - DNA, 25 bp, Rattus norvegicus
acgtacaagggctcacaaggtggct

SEQ ID NO: 91163 - DNA, 25 bp, Rattus norvegicus
acgtacaccctgatgtaatgctggt

SEQ ID NO: 91164 - DNA, 25 bp, Rattus norvegicus
acgtacaccctgttgtaatgctggt

SEQ ID NO: 91165 - DNA, 25 bp, Rattus norvegicus
acgtacactgtacttctctgtgcaa

SEQ ID NO: 91166 - DNA, 25 bp, Rattus norvegicus
acgtacactgtagttctctgtgcaa

SEQ ID NO: 91167 - DNA, 25 bp, Rattus norvegicus
acgtacatatctcaatgatgctttg

SEQ ID NO: 91168 - DNA, 25 bp, Rattus norvegicus
acgtacatatctgaatgatgctttg

SEQ ID NO: 91169 - DNA, 25 bp, Rattus norvegicus
acgtacatctccaagttcctgggaa

SEQ ID NO: 91170 - DNA, 25 bp, Rattus norvegicus
acgtacatctcctagttcctgggaa

SEQ ID NO: 91171 - DNA, 25 bp, Rattus norvegicus
acgtacatggagcagggcttccctg

SEQ ID NO: 91172 - DNA, 25 bp, Rattus norvegicus
acgtacatggaggagggcttccctg

SEQ ID NO: 91173 - DNA, 25 bp, Rattus norvegicus
acgtaccacacaatcttcctgttga

SEQ ID NO: 91174 - DNA, 25 bp, Rattus norvegicus
acgtaccacacattcttcctgttga

SEQ ID NO: 91175 - DNA, 25 bp, Rattus norvegicus
acgtaccaggagaggtatggaaatt

SEQ ID NO: 91176 - DNA, 25 bp, Rattus norvegicus
acgtaccaggagtggtatggaaatt

SEQ ID NO: 91177 - DNA, 25 bp, Rattus norvegicus
acgtacccacggctgctgaaggaga

SEQ ID NO: 91178 - DNA, 25 bp, Rattus norvegicus
acgtacccacgggtgctgaaggaga

SEQ ID NO: 91179 - DNA, 25 bp, Rattus norvegicus
acgtaccccatgacaggttcaggga

SEQ ID NO: 91180 - DNA, 25 bp, Rattus norvegicus
acgtaccccatgtcaggttcaggga

SEQ ID NO: 91181 - DNA, 25 bp, Rattus norvegicus
acgtaccctgcactccgcgaggagg

SEQ ID NO: 91182 - DNA, 25 bp, Rattus norvegicus
acgtaccctgcagtccgcgaggagg

SEQ ID NO: 91183 - DNA, 25 bp, Rattus norvegicus
acgtacctgtgaatgttgtcctgaa

SEQ ID NO: 91184 - DNA, 25 bp, Rattus norvegicus
acgtacctgtgattgttgtcctgaa

SEQ ID NO: 91185 - DNA, 25 bp, Rattus norvegicus
acgtactacgccatgtacagagaca

SEQ ID NO: 91186 - DNA, 25 bp, Rattus norvegicus
acgtactacgccttgtacagagaca

SEQ ID NO: 91187 - DNA, 25 bp, Rattus norvegicus
acgtactcatacaagtgctccggga

SEQ ID NO: 91188 - DNA, 25 bp, Rattus norvegicus
acgtactcatactagtgctccggga

SEQ ID NO: 91189 - DNA, 25 bp, Rattus norvegicus
acgtactgaagacgccgcttgggct

SEQ ID NO: 91190 - DNA, 25 bp, Rattus norvegicus
acgtactgaagaggccgcttgggct

SEQ ID NO: 91191 - DNA, 25 bp, Rattus norvegicus
acgtactgggccacagctcgggtag

SEQ ID NO: 91192 - DNA, 25 bp, Rattus norvegicus
acgtactgggcctcagctcgggtag

SEQ ID NO: 91193 - DNA, 25 bp, Rattus norvegicus
acgtactgtcaccttgtaacacttg

SEQ ID NO: 91194 - DNA, 25 bp, Rattus norvegicus
acgtactgtcacgttgtaacacttg

SEQ ID NO: 91195 - DNA, 25 bp, Rattus norvegicus
acgtagacatcgaactttgtagtat

SEQ ID NO: 91196 - DNA, 25 bp, Rattus norvegicus
acgtagacatcgtactttgtagtat

SEQ ID NO: 91197 - DNA, 25 bp, Rattus norvegicus
acgtagaccggacagctggctgccg

SEQ ID NO: 91198 - DNA, 25 bp, Rattus norvegicus
acgtagaccggagagctggctgccg

SEQ ID NO: 91199 - DNA, 25 bp, Rattus norvegicus
acgtagagagtccacggtagctcgt

SEQ ID NO: 91200 - DNA, 25 bp, Rattus norvegicus
acgtagagagtcgacggtagctcgt

SEQ ID NO: 91201 - DNA, 25 bp, Rattus norvegicus
acgtagatgcttactgtccaattca

SEQ ID NO: 91202 - DNA, 25 bp, Rattus norvegicus
acgtagatgctttctgtccaattca

SEQ ID NO: 91203 - DNA, 25 bp, Rattus norvegicus
acgtagcagagtagcggcggcgagt

SEQ ID NO: 91204 - DNA, 25 bp, Rattus norvegicus
acgtagcagagttgcggcggcgagt

SEQ ID NO: 91205 - DNA, 25 bp, Rattus norvegicus
acgtagccacagatgcagggagttt

SEQ ID NO: 91206 - DNA, 25 bp, Rattus norvegicus
acgtagccacagttgcagggagttt

SEQ ID NO: 91207 - DNA, 25 bp, Rattus norvegicus
acgtagccagagctctcggcagaga

SEQ ID NO: 91208 - DNA, 25 bp, Rattus norvegicus
acgtagccagaggtctcggcagaga

SEQ ID NO: 91209 - DNA, 25 bp, Rattus norvegicus
acgtagccagtgcaaggccagcagt

SEQ ID NO: 91210 - DNA, 25 bp, Rattus norvegicus
acgtagccagtggaaggccagcagt

SEQ ID NO: 91211 - DNA, 25 bp, Rattus norvegicus
acgtagctagagactgccatgcaca

SEQ ID NO: 91212 - DNA, 25 bp, Rattus norvegicus
acgtagctagagtctgccatgcaca

SEQ ID NO: 91213 - DNA, 25 bp, Rattus norvegicus
acgtagctgcttcctgttgtgaggc

SEQ ID NO: 91214 - DNA, 25 bp, Rattus norvegicus
acgtagctgcttgctgttgtgaggc

SEQ ID NO: 91215 - DNA, 25 bp, Rattus norvegicus
acgtaggtgttacttctgagtcctt

SEQ ID NO: 91216 - DNA, 25 bp, Rattus norvegicus
acgtaggtgttagttctgagtcctt

SEQ ID NO: 91217 - DNA, 25 bp, Rattus norvegicus
acgtagtccaaactgtctgtaaagc

SEQ ID NO: 91218 - DNA, 25 bp, Rattus norvegicus
acgtagtccaaagtgtctgtaaagc

SEQ ID NO: 91219 - DNA, 25 bp, Rattus norvegicus
acgtagtcttctagttgtgtccaac

SEQ ID NO: 91220 - DNA, 25 bp, Rattus norvegicus
acgtagtcttcttgttgtgtccaac

SEQ ID NO: 91221 - DNA, 25 bp, Rattus norvegicus
acgtagtgtgcgaacgtgtgtgtcc

SEQ ID NO: 91222 - DNA, 25 bp, Rattus norvegicus
acgtagtgtgcgtacgtgtgtgtcc

SEQ ID NO: 91223 - DNA, 25 bp, Rattus norvegicus
acgtagttaataatcatgccgcatg

SEQ ID NO: 91224 - DNA, 25 bp, Rattus norvegicus
acgtagttaatattcatgccgcatg

SEQ ID NO: 91225 - DNA, 25 bp, Rattus norvegicus
acgtagttgcctctgaagcctttgc

SEQ ID NO: 91226 - DNA, 25 bp, Rattus norvegicus
acgtagttgcctgtgaagcctttgc

SEQ ID NO: 91227 - DNA, 25 bp, Rattus norvegicus
acgtatactcctacctgcaaatgaa

SEQ ID NO: 91228 - DNA, 25 bp, Rattus norvegicus
acgtatactccttcctgcaaatgaa

SEQ ID NO: 91229 - DNA, 25 bp, Rattus norvegicus
acgtatatgcagaacttcaatagtt

SEQ ID NO: 91230 - DNA, 25 bp, Rattus norvegicus
acgtatatgcagtacttcaatagtt

SEQ ID NO: 91231 - DNA, 25 bp, Rattus norvegicus
acgtatcagtttcgtcccgtgtata

SEQ ID NO: 91232 - DNA, 25 bp, Rattus norvegicus
acgtatcagtttggtcccgtgtata

SEQ ID NO: 91233 - DNA, 25 bp, Rattus norvegicus
acgtatccgtctatggcagtgtcta

SEQ ID NO: 91234 - DNA, 25 bp, Rattus norvegicus
acgtatccgtctttggcagtgtcta

SEQ ID NO: 91235 - DNA, 25 bp, Rattus norvegicus
acgtatcgtcatatgcatagcattc

SEQ ID NO: 91236 - DNA, 25 bp, Rattus norvegicus
acgtatcgtcatttgcatagcattc

SEQ ID NO: 91237 - DNA, 25 bp, Rattus norvegicus
acgtatcttactctctgcaactggg

SEQ ID NO: 91238 - DNA, 25 bp, Rattus norvegicus
acgtatcttactgtctgcaactggg

SEQ ID NO: 91239 - DNA, 25 bp, Rattus norvegicus
acgtatgaagaaacctgttaacaca

SEQ ID NO: 91240 - DNA, 25 bp, Rattus norvegicus
acgtatgaagaatcctgttaacaca

SEQ ID NO: 91241 - DNA, 25 bp, Rattus norvegicus
acgtatgcacaccacccataacata

SEQ ID NO: 91242 - DNA, 25 bp, Rattus norvegicus
acgtatgcacacgacccataacata

SEQ ID NO: 91243 - DNA, 25 bp, Rattus norvegicus
acgtatgtgcagcaactagtctggg

SEQ ID NO: 91244 - DNA, 25 bp, Rattus norvegicus
acgtatgtgcaggaactagtctggg

SEQ ID NO: 91245 - DNA, 25 bp, Rattus norvegicus
acgtattccggaatagcaacccagg

SEQ ID NO: 91246 - DNA, 25 bp, Rattus norvegicus
acgtattccggattagcaacccagg

SEQ ID NO: 91247 - DNA, 25 bp, Rattus norvegicus
acgtattcgaacatagctgtgcagt

SEQ ID NO: 91248 - DNA, 25 bp, Rattus norvegicus
acgtattcgaacttagctgtgcagt

SEQ ID NO: 91249 - DNA, 25 bp, Rattus norvegicus
acgtattctgtaccttggttgtggc

SEQ ID NO: 91250 - DNA, 25 bp, Rattus norvegicus
acgtattctgtagcttggttgtggc

SEQ ID NO: 91251 - DNA, 25 bp, Rattus norvegicus
acgtatttccttcttgtctctgtaa

SEQ ID NO: 91252 - DNA, 25 bp, Rattus norvegicus
acgtatttccttgttgtctctgtaa

SEQ ID NO: 91253 - DNA, 25 bp, Rattus norvegicus
acgtatttgtttactgcaccagagg

SEQ ID NO: 91254 - DNA, 25 bp, Rattus norvegicus
acgtatttgttttctgcaccagagg

SEQ ID NO: 91255 - DNA, 25 bp, Rattus norvegicus
acgtcaaacttaccttcacagtgta

SEQ ID NO: 91256 - DNA, 25 bp, Rattus norvegicus
acgtcaaacttagcttcacagtgta

SEQ ID NO: 91257 - DNA, 25 bp, Rattus norvegicus
acgtcaaatcttatagctgaagaaa

SEQ ID NO: 91258 - DNA, 25 bp, Rattus norvegicus
acgtcaaatcttttagctgaagaaa

SEQ ID NO: 91259 - DNA, 25 bp, Rattus norvegicus
acgtcaaccctgatgatgctgctgt

SEQ ID NO: 91260 - DNA, 25 bp, Rattus norvegicus
acgtcaaccctgttgatgctgctgt

SEQ ID NO: 91261 - DNA, 25 bp, Rattus norvegicus
acgtcaaccgttcactggcggatgt

SEQ ID NO: 91262 - DNA, 25 bp, Rattus norvegicus
acgtcaaccgttgactggcggatgt

SEQ ID NO: 91263 - DNA, 25 bp, Rattus norvegicus
acgtcaacctcactggcttaggaag

SEQ ID NO: 91264 - DNA, 25 bp, Rattus norvegicus
acgtcaacctcagtggcttaggaag

SEQ ID NO: 91265 - DNA, 25 bp, Rattus norvegicus
acgtcaaggtcaaccgtgacttcaa

SEQ ID NO: 91266 - DNA, 25 bp, Rattus norvegicus
acgtcaaggtcatccgtgacttcaa

SEQ ID NO: 91267 - DNA, 25 bp, Rattus norvegicus
acgtcaatcatcagcatagttccca

SEQ ID NO: 91268 - DNA, 25 bp, Rattus norvegicus
acgtcaatcatctgcatagttccca

SEQ ID NO: 91269 - DNA, 25 bp, Rattus norvegicus
acgtcaattaaactaaagctccctg

SEQ ID NO: 91270 - DNA, 25 bp, Rattus norvegicus
acgtcaattaaagtaaagctccctg

SEQ ID NO: 91271 - DNA, 25 bp, Rattus norvegicus
acgtcaattctgaaatcgccatctg

SEQ ID NO: 91272 - DNA, 25 bp, Rattus norvegicus
acgtcaattctgtaatcgccatctg

SEQ ID NO: 91273 - DNA, 25 bp, Rattus norvegicus
acgtcacaagcaattccttccagac

SEQ ID NO: 91274 - DNA, 25 bp, Rattus norvegicus
acgtcacaagcatttccttccagac

SEQ ID NO: 91275 - DNA, 25 bp, Rattus norvegicus
acgtcacaggcacctgttgttgtaa

SEQ ID NO: 91276 - DNA, 25 bp, Rattus norvegicus
acgtcacaggcagctgttgttgtaa

SEQ ID NO: 91277 - DNA, 25 bp, Rattus norvegicus
acgtcacaggctacccagtaaaggc

SEQ ID NO: 91278 - DNA, 25 bp, Rattus norvegicus
acgtcacaggcttcccagtaaaggc

SEQ ID NO: 91279 - DNA, 25 bp, Rattus norvegicus
acgtcacagtgtctggccacgggaa

SEQ ID NO: 91280 - DNA, 25 bp, Rattus norvegicus
acgtcacagtgtgtggccacgggaa

SEQ ID NO: 91281 - DNA, 25 bp, Rattus norvegicus
acgtcacatcgaagaggccattcca

SEQ ID NO: 91282 - DNA, 25 bp, Rattus norvegicus
acgtcacatcgatgaggccattcca

SEQ ID NO: 91283 - DNA, 25 bp, Rattus norvegicus
acgtcacatgtcacgatgccagatt

SEQ ID NO: 91284 - DNA, 25 bp, Rattus norvegicus
acgtcacatgtctcgatgccagatt

SEQ ID NO: 91285 - DNA, 25 bp, Rattus norvegicus
acgtcacattatatccgtggctata

SEQ ID NO: 91286 - DNA, 25 bp, Rattus norvegicus
acgtcacattatttccgtggctata

SEQ ID NO: 91287 - DNA, 25 bp, Rattus norvegicus
acgtcacctacaatattatggcttt

SEQ ID NO: 91288 - DNA, 25 bp, Rattus norvegicus
acgtcacctacattattatggcttt

SEQ ID NO: 91289 - DNA, 25 bp, Rattus norvegicus
acgtcactacatctctatgcaaggg

SEQ ID NO: 91290 - DNA, 25 bp, Rattus norvegicus
acgtcactacatgtctatgcaaggg

SEQ ID NO: 91291 - DNA, 25 bp, Rattus norvegicus
acgtcactcgccatacgagttagca

SEQ ID NO: 91292 - DNA, 25 bp, Rattus norvegicus
acgtcactcgccttacgagttagca

SEQ ID NO: 91293 - DNA, 25 bp, Rattus norvegicus
acgtcactctctattgatagacaga

SEQ ID NO: 91294 - DNA, 25 bp, Rattus norvegicus
acgtcactctcttttgatagacaga

SEQ ID NO: 91295 - DNA, 25 bp, Rattus norvegicus
acgtcactctgcagattatccaaaa

SEQ ID NO: 91296 - DNA, 25 bp, Rattus norvegicus
acgtcactctgctgattatccaaaa

SEQ ID NO: 91297 - DNA, 25 bp, Rattus norvegicus
acgtcactctgtaggtctgtggaaa

SEQ ID NO: 91298 - DNA, 25 bp, Rattus norvegicus
acgtcactctgttggtctgtggaaa

SEQ ID NO: 91299 - DNA, 25 bp, Rattus norvegicus
acgtcactgaacctcaattagcctg

SEQ ID NO: 91300 - DNA, 25 bp, Rattus norvegicus
acgtcactgaacgtcaattagcctg

SEQ ID NO: 91301 - DNA, 25 bp, Rattus norvegicus
acgtcactgccgcacattagaaatg

SEQ ID NO: 91302 - DNA, 25 bp, Rattus norvegicus
acgtcactgccggacattagaaatg

SEQ ID NO: 91303 - DNA, 25 bp, Rattus norvegicus
acgtcactggagaggtgaggattcc

SEQ ID NO: 91304 - DNA, 25 bp, Rattus norvegicus
acgtcactggagtggtgaggattcc

SEQ ID NO: 91305 - DNA, 25 bp, Rattus norvegicus
acgtcagactggatagcggaaggtc

SEQ ID NO: 91306 - DNA, 25 bp, Rattus norvegicus
acgtcagactggttagcggaaggtc

SEQ ID NO: 91307 - DNA, 25 bp, Rattus norvegicus
acgtcagagcttctcagtgcacggt

SEQ ID NO: 91308 - DNA, 25 bp, Rattus norvegicus
acgtcagagcttgtcagtgcacggt

SEQ ID NO: 91309 - DNA, 25 bp, Rattus norvegicus
acgtcagcagccctgggactgtgac

SEQ ID NO: 91310 - DNA, 25 bp, Rattus norvegicus
acgtcagcagccgtgggactgtgac

SEQ ID NO: 91311 - DNA, 25 bp, Rattus norvegicus
acgtcagcctgtcaacatgccttac

SEQ ID NO: 91312 - DNA, 25 bp, Rattus norvegicus
acgtcagcctgtgaacatgccttac

SEQ ID NO: 91313 - DNA, 25 bp, Rattus norvegicus
acgtcagcgagcagtaaggccaatt

SEQ ID NO: 91314 - DNA, 25 bp, Rattus norvegicus
acgtcagcgagctgtaaggccaatt

SEQ ID NO: 91315 - DNA, 25 bp, Rattus norvegicus
acgtcagcgcccatttaatgtgttt

SEQ ID NO: 91316 - DNA, 25 bp, Rattus norvegicus
acgtcagcgcccttttaatgtgttt

SEQ ID NO: 91317 - DNA, 25 bp, Rattus norvegicus
acgtcagcgcctcctcgtcgatgag

SEQ ID NO: 91318 - DNA, 25 bp, Rattus norvegicus
acgtcagcgcctgctcgtcgatgag

SEQ ID NO: 91319 - DNA, 25 bp, Rattus norvegicus
acgtcaggcatgaacgccgggctat

SEQ ID NO: 91320 - DNA, 25 bp, Rattus norvegicus
acgtcaggcatgtacgccgggctat

SEQ ID NO: 91321 - DNA, 25 bp, Rattus norvegicus
acgtcaggtgacaacaatgcctctt

SEQ ID NO: 91322 - DNA, 25 bp, Rattus norvegicus
acgtcaggtgactacaatgcctctt

SEQ ID NO: 91323 - DNA, 25 bp, Rattus norvegicus
acgtcaggtgctacacaaccatctg

SEQ ID NO: 91324 - DNA, 25 bp, Rattus norvegicus
acgtcaggtgcttcacaaccatctg

SEQ ID NO: 91325 - DNA, 25 bp, Rattus norvegicus
acgtcagtcctgatgtgaactatga

SEQ ID NO: 91326 - DNA, 25 bp, Rattus norvegicus
acgtcagtcctgttgtgaactatga

SEQ ID NO: 91327 - DNA, 25 bp, Rattus norvegicus
acgtcagtcttcagccagcatggag

SEQ ID NO: 91328 - DNA, 25 bp, Rattus norvegicus
acgtcagtcttctgccagcatggag

SEQ ID NO: 91329 - DNA, 25 bp, Rattus norvegicus
acgtcagtgactatcttcatgttgg

SEQ ID NO: 91330 - DNA, 25 bp, Rattus norvegicus
acgtcagtgactttcttcatgttgg

SEQ ID NO: 91331 - DNA, 25 bp, Rattus norvegicus
acgtcagtgcccatgggatggagta

SEQ ID NO: 91332 - DNA, 25 bp, Rattus norvegicus
acgtcagtgcccttgggatggagta

SEQ ID NO: 91333 - DNA, 25 bp, Rattus norvegicus
acgtcagtgcgtccgtggaaattgt

SEQ ID NO: 91334 - DNA, 25 bp, Rattus norvegicus
acgtcagtgcgtgcgtggaaattgt

SEQ ID NO: 91335 - DNA, 25 bp, Rattus norvegicus
acgtcagtgtggaccggcggctcca

SEQ ID NO: 91336 - DNA, 25 bp, Rattus norvegicus
acgtcagtgtggtccggcggctcca

SEQ ID NO: 91337 - DNA, 25 bp, Rattus norvegicus
acgtcatcagtaacagcatcagcat

SEQ ID NO: 91338 - DNA, 25 bp, Rattus norvegicus
acgtcatcagtatcagcatcagcat

SEQ ID NO: 91339 - DNA, 25 bp, Rattus norvegicus
acgtcatccggcctatccgctggga

SEQ ID NO: 91340 - DNA, 25 bp, Rattus norvegicus
acgtcatccggcgtatccgctggga

SEQ ID NO: 91341 - DNA, 25 bp, Rattus norvegicus
acgtcatcctgtacctcatggtgat

SEQ ID NO: 91342 - DNA, 25 bp, Rattus norvegicus
acgtcatcctgttcctcatggtgat

SEQ ID NO: 91343 - DNA, 25 bp, Rattus norvegicus
acgtcatctatgctcaggctcatta

SEQ ID NO: 91344 - DNA, 25 bp, Rattus norvegicus
acgtcatctatggtcaggctcatta

SEQ ID NO: 91345 - DNA, 25 bp, Rattus norvegicus
acgtcatcttgtactctttcttgag

SEQ ID NO: 91346 - DNA, 25 bp, Rattus norvegicus
acgtcatcttgttctctttcttgag

SEQ ID NO: 91347 - DNA, 25 bp, Rattus norvegicus
acgtcatgatacattctgccagcag

SEQ ID NO: 91348 - DNA, 25 bp, Rattus norvegicus
acgtcatgatactttctgccagcag

SEQ ID NO: 91349 - DNA, 25 bp, Rattus norvegicus
acgtcatggcatctccaaggaatta

SEQ ID NO: 91350 - DNA, 25 bp, Rattus norvegicus
acgtcatggcatgtccaaggaatta

SEQ ID NO: 91351 - DNA, 25 bp, Rattus norvegicus
acgtcatgggagaacctgtgtccta

SEQ ID NO: 91352 - DNA, 25 bp, Rattus norvegicus
acgtcatgggagtacctgtgtccta

SEQ ID NO: 91353 - DNA, 25 bp, Rattus norvegicus
acgtcattgcctcgtatatacccaa

SEQ ID NO: 91354 - DNA, 25 bp, Rattus norvegicus
acgtcattgcctggtatatacccaa

SEQ ID NO: 91355 - DNA, 25 bp, Rattus norvegicus
acgtccaaaggcatgcttgatgaca

SEQ ID NO: 91356 - DNA, 25 bp, Rattus norvegicus
acgtccaaaggcttgcttgatgaca

SEQ ID NO: 91357 - DNA, 25 bp, Rattus norvegicus
acgtccacgtctacagttggtagca

SEQ ID NO: 91358 - DNA, 25 bp, Rattus norvegicus
acgtccacgtcttcagttggtagca

SEQ ID NO: 91359 - DNA, 25 bp, Rattus norvegicus
acgtccactcctctgtaaacgcgaa

SEQ ID NO: 91360 - DNA, 25 bp, Rattus norvegicus
acgtccactcctgtgtaaacgcgaa

SEQ ID NO: 91361 - DNA, 25 bp, Rattus norvegicus
acgtccactgaaatgtaatgcttga

SEQ ID NO: 91362 - DNA, 25 bp, Rattus norvegicus
acgtccactgaattgtaatgcttga

SEQ ID NO: 91363 - DNA, 25 bp, Rattus norvegicus
acgtccactgcacatctagttgcaa

SEQ ID NO: 91364 - DNA, 25 bp, Rattus norvegicus
acgtccactgcagatctagttgcaa

SEQ ID NO: 91365 - DNA, 25 bp, Rattus norvegicus
acgtccactggcattctaagagaat

SEQ ID NO: 91366 - DNA, 25 bp, Rattus norvegicus
acgtccactggctttctaagagaat

SEQ ID NO: 91367 - DNA, 25 bp, Rattus norvegicus
acgtccagacgacatcagccaaatt

SEQ ID NO: 91368 - DNA, 25 bp, Rattus norvegicus
acgtccagacgagatcagccaaatt

SEQ ID NO: 91369 - DNA, 25 bp, Rattus norvegicus
acgtccaggcacactttgactttga

SEQ ID NO: 91370 - DNA, 25 bp, Rattus norvegicus
acgtccaggcactctttgactttga

SEQ ID NO: 91371 - DNA, 25 bp, Rattus norvegicus
acgtccataaaactccttcccagag

SEQ ID NO: 91372 - DNA, 25 bp, Rattus norvegicus
acgtccataaaagtccttcccagag

SEQ ID NO: 91373 - DNA, 25 bp, Rattus norvegicus
acgtcccaaacacccgaggcagaga

SEQ ID NO: 91374 - DNA, 25 bp, Rattus norvegicus
acgtcccaaacagccgaggcagaga

SEQ ID NO: 91375 - DNA, 25 bp, Rattus norvegicus
acgtcccaagatcgcttcgaggtcc

SEQ ID NO: 91376 - DNA, 25 bp, Rattus norvegicus
acgtcccaagatggcttcgaggtcc

SEQ ID NO: 91377 - DNA, 25 bp, Rattus norvegicus
acgtcccacgccagatttaaaacag

SEQ ID NO: 91378 - DNA, 25 bp, Rattus norvegicus
acgtcccacgcctgatttaaaacag

SEQ ID NO: 91379 - DNA, 25 bp, Rattus norvegicus
acgtcccagtacagtatcctctgac

SEQ ID NO: 91380 - DNA, 25 bp, Rattus norvegicus
acgtcccagtactgtatcctctgac

SEQ ID NO: 91381 - DNA, 25 bp, Rattus norvegicus
acgtcccatctcagactttgtttgt

SEQ ID NO: 91382 - DNA, 25 bp, Rattus norvegicus
acgtcccatctctgactttgtttgt

SEQ ID NO: 91383 - DNA, 25 bp, Rattus norvegicus
acgtcccatctgactgctgtagcag

SEQ ID NO: 91384 - DNA, 25 bp, Rattus norvegicus
acgtcccatctgtctgctgtagcag

SEQ ID NO: 91385 - DNA, 25 bp, Rattus norvegicus
acgtcccgagttccactggtctaga

SEQ ID NO: 91386 - DNA, 25 bp, Rattus norvegicus
acgtcccgagttgcactggtctaga

SEQ ID NO: 91387 - DNA, 25 bp, Rattus norvegicus
acgtccctctgaatcctgttaggat

SEQ ID NO: 91388 - DNA, 25 bp, Rattus norvegicus
acgtccctctgattcctgttaggat

SEQ ID NO: 91389 - DNA, 25 bp, Rattus norvegicus
acgtccctggagaaccattttgttg

SEQ ID NO: 91390 - DNA, 25 bp, Rattus norvegicus
acgtccctggagtaccattttgttg

SEQ ID NO: 91391 - DNA, 25 bp, Rattus norvegicus
acgtcccttgttctatttattgatt

SEQ ID NO: 91392 - DNA, 25 bp, Rattus norvegicus
acgtcccttgttgtatttattgatt

SEQ ID NO: 91393 - DNA, 25 bp, Rattus norvegicus
acgtccgcacacatcggtggactgg

SEQ ID NO: 91394 - DNA, 25 bp, Rattus norvegicus
acgtccgcacacttcggtggactgg

SEQ ID NO: 91395 - DNA, 25 bp, Rattus norvegicus
acgtccggtctgaagtttctccgag

SEQ ID NO: 91396 - DNA, 25 bp, Rattus norvegicus
acgtccggtctgtagtttctccgag

SEQ ID NO: 91397 - DNA, 25 bp, Rattus norvegicus
acgtcctaatgtcttcctcaaatat

SEQ ID NO: 91398 - DNA, 25 bp, Rattus norvegicus
acgtcctaatgtgttcctcaaatat

SEQ ID NO: 91399 - DNA, 25 bp, Rattus norvegicus
acgtcctaggttattactgtcagta

SEQ ID NO: 91400 - DNA, 25 bp, Rattus norvegicus
acgtcctaggtttttactgtcagta

SEQ ID NO: 91401 - DNA, 25 bp, Rattus norvegicus
acgtcctcagatccagaatgtcctc

SEQ ID NO: 91402 - DNA, 25 bp, Rattus norvegicus
acgtcctcagatgcagaatgtcctc

SEQ ID NO: 91403 - DNA, 25 bp, Rattus norvegicus
acgtcctcatgtactcgtactatgg

SEQ ID NO: 91404 - DNA, 25 bp, Rattus norvegicus
acgtcctcatgttctcgtactatgg

SEQ ID NO: 91405 - DNA, 25 bp, Rattus norvegicus
acgtcctccattagtgagagcagcc

SEQ ID NO: 91406 - DNA, 25 bp, Rattus norvegicus
acgtcctccatttgtgagagcagcc

SEQ ID NO: 91407 - DNA, 25 bp, Rattus norvegicus
acgtcctgacctatggtgcaggtaa

SEQ ID NO: 91408 - DNA, 25 bp, Rattus norvegicus
acgtcctgacctttggtgcaggtaa

SEQ ID NO: 91409 - DNA, 25 bp, Rattus norvegicus
acgtcctgtgtgcaccgagatcact

SEQ ID NO: 91410 - DNA, 25 bp, Rattus norvegicus
acgtcctgtgtggaccgagatcact

SEQ ID NO: 91411 - DNA, 25 bp, Rattus norvegicus
acgtccttaacacttactggcagaa

SEQ ID NO: 91412 - DNA, 25 bp, Rattus norvegicus
acgtccttaacagttactggcagaa

SEQ ID NO: 91413 - DNA, 25 bp, Rattus norvegicus
acgtcgaacttgatgctgagggcaa

SEQ ID NO: 91414 - DNA, 25 bp, Rattus norvegicus
acgtcgaacttgttgctgagggcaa

SEQ ID NO: 91415 - DNA, 25 bp, Rattus norvegicus
acgtcgagtgacagagcagccggtt

SEQ ID NO: 91416 - DNA, 25 bp, Rattus norvegicus
acgtcgagtgactgagcagccggtt

SEQ ID NO: 91417 - DNA, 25 bp, Rattus norvegicus
acgtcgatgggcacgtgcagcagcg

SEQ ID NO: 91418 - DNA, 25 bp, Rattus norvegicus
acgtcgatgggctcgtgcagcagcg

SEQ ID NO: 91419 - DNA, 25 bp, Rattus norvegicus
acgtcgcggccgaggtggttcctat

SEQ ID NO: 91420 - DNA, 25 bp, Rattus norvegicus
acgtcgcggccgtggtggttcctat

SEQ ID NO: 91421 - DNA, 25 bp, Rattus norvegicus
acgtcgcggtgaaggagccggccac

SEQ ID NO: 91422 - DNA, 25 bp, Rattus norvegicus
acgtcgcggtgatggagccggccac

SEQ ID NO: 91423 - DNA, 25 bp, Rattus norvegicus
acgtcgctccacaagggatgatgtc

SEQ ID NO: 91424 - DNA, 25 bp, Rattus norvegicus
acgtcgctccactagggatgatgtc

SEQ ID NO: 91425 - DNA, 25 bp, Rattus norvegicus
acgtcggcagaaaatggctcgcttg

SEQ ID NO: 91426 - DNA, 25 bp, Rattus norvegicus
acgtcggcagaatatggctcgcttg

SEQ ID NO: 91427 - DNA, 25 bp, Rattus norvegicus
acgtcggcatatctgtgcccgtctg

SEQ ID NO: 91428 - DNA, 25 bp, Rattus norvegicus
acgtcggcatatgtgtgcccgtctg

SEQ ID NO: 91429 - DNA, 25 bp, Rattus norvegicus
acgtcggtgtccagcattattgcga

SEQ ID NO: 91430 - DNA, 25 bp, Rattus norvegicus
acgtcggtgtcctgcattattgcga

SEQ ID NO: 91431 - DNA, 25 bp, Rattus norvegicus
acgtcgtcccgactttacagagtat

SEQ ID NO: 91432 - DNA, 25 bp, Rattus norvegicus
acgtcgtcccgagtttacagagtat

SEQ ID NO: 91433 - DNA, 25 bp, Rattus norvegicus
acgtcgtcctggctgaaggcagtac

SEQ ID NO: 91434 - DNA, 25 bp, Rattus norvegicus
acgtcgtcctgggtgaaggcagtac

SEQ ID NO: 91435 - DNA, 25 bp, Rattus norvegicus
acgtcgtcttttcgagtccgagtca

SEQ ID NO: 91436 - DNA, 25 bp, Rattus norvegicus
acgtcgtcttttggagtccgagtca

SEQ ID NO: 91437 - DNA, 25 bp, Rattus norvegicus
acgtcgtgagcgatctggaggccct

SEQ ID NO: 91438 - DNA, 25 bp, Rattus norvegicus
acgtcgtgagcgttctggaggccct

SEQ ID NO: 91439 - DNA, 25 bp, Rattus norvegicus
acgtcgtgagtgactttggcaatgt

SEQ ID NO: 91440 - DNA, 25 bp, Rattus norvegicus
acgtcgtgagtgtctttggcaatgt

SEQ ID NO: 91441 - DNA, 25 bp, Rattus norvegicus
acgtctactgtaaactctgggccga

SEQ ID NO: 91442 - DNA, 25 bp, Rattus norvegicus
acgtctactgtatactctgggccga

SEQ ID NO: 91443 - DNA, 25 bp, Rattus norvegicus
acgtctagcctcaagcttctttatt

SEQ ID NO: 91444 - DNA, 25 bp, Rattus norvegicus
acgtctagcctctagcttctttatt

SEQ ID NO: 91445 - DNA, 25 bp, Rattus norvegicus
acgtctatctatctgagtgcttctg

SEQ ID NO: 91446 - DNA, 25 bp, Rattus norvegicus
acgtctatctatgtgagtgcttctg

SEQ ID NO: 91447 - DNA, 25 bp, Rattus norvegicus
acgtctatgcatcaaccgttagcta

SEQ ID NO: 91448 - DNA, 25 bp, Rattus norvegicus
acgtctatgcatgaaccgttagcta

SEQ ID NO: 91449 - DNA, 25 bp, Rattus norvegicus
acgtctatgtgtcgcctttttgaag

SEQ ID NO: 91450 - DNA, 25 bp, Rattus norvegicus
acgtctatgtgtggcctttttgaag

SEQ ID NO: 91451 - DNA, 25 bp, Rattus norvegicus
acgtctcagccacttaccataaagg

SEQ ID NO: 91452 - DNA, 25 bp, Rattus norvegicus
acgtctcagccagttaccataaagg

SEQ ID NO: 91453 - DNA, 25 bp, Rattus norvegicus
acgtctcagggacactggcttctaa

SEQ ID NO: 91454 - DNA, 25 bp, Rattus norvegicus
acgtctcagggagactggcttctaa

SEQ ID NO: 91455 - DNA, 25 bp, Rattus norvegicus
acgtctccctgacgatgtttaggcc

SEQ ID NO: 91456 - DNA, 25 bp, Rattus norvegicus
acgtctccctgaggatgtttaggcc

SEQ ID NO: 91457 - DNA, 25 bp, Rattus norvegicus
acgtctcgaagtagccatctcatga

SEQ ID NO: 91458 - DNA, 25 bp, Rattus norvegicus
acgtctcgaagttgccatctcatga

SEQ ID NO: 91459 - DNA, 25 bp, Rattus norvegicus
acgtctcgggagagctagccagtga

SEQ ID NO: 91460 - DNA, 25 bp, Rattus norvegicus
acgtctcgggagtgctagccagtga

SEQ ID NO: 91461 - DNA, 25 bp, Rattus norvegicus
acgtctctaagtctgggctaaagca

SEQ ID NO: 91462 - DNA, 25 bp, Rattus norvegicus
acgtctctaagtgtgggctaaagca

SEQ ID NO: 91463 - DNA, 25 bp, Rattus norvegicus
acgtctctcagtatccatatgtgga

SEQ ID NO: 91464 - DNA, 25 bp, Rattus norvegicus
acgtctctcagtctagtatctctaa

SEQ ID NO: 91465 - DNA, 25 bp, Rattus norvegicus
acgtctctcagtgtagtatctctaa

SEQ ID NO: 91466 - DNA, 25 bp, Rattus norvegicus
acgtctctcagtttccatatgtgga

SEQ ID NO: 91467 - DNA, 25 bp, Rattus norvegicus
acgtctctggtgacagggagtcttg

SEQ ID NO: 91468 - DNA, 25 bp, Rattus norvegicus
acgtctctggtgtcagggagtcttg

SEQ ID NO: 91469 - DNA, 25 bp, Rattus norvegicus
acgtctgaagcacttcttggagaaa

SEQ ID NO: 91470 - DNA, 25 bp, Rattus norvegicus
acgtctgaagcagttcttggagaaa

SEQ ID NO: 91471 - DNA, 25 bp, Rattus norvegicus
acgtctgacgtaactctggatcctt

SEQ ID NO: 91472 - DNA, 25 bp, Rattus norvegicus
acgtctgacgtatctctggatcctt

SEQ ID NO: 91473 - DNA, 25 bp, Rattus norvegicus
acgtctgatgctacatccccaagat

SEQ ID NO: 91474 - DNA, 25 bp, Rattus norvegicus
acgtctgatgcttcatccccaagat

SEQ ID NO: 91475 - DNA, 25 bp, Rattus norvegicus
acgtctgcagcaagtagttctaccc

SEQ ID NO: 91476 - DNA, 25 bp, Rattus norvegicus
acgtctgcagcatgtagttctaccc

SEQ ID NO: 91477 - DNA, 25 bp, Rattus norvegicus
acgtctgccagtccgctgaagggaa

SEQ ID NO: 91478 - DNA, 25 bp, Rattus norvegicus
acgtctgccagtgcgctgaagggaa

SEQ ID NO: 91479 - DNA, 25 bp, Rattus norvegicus
acgtctgcccagcattagaggatca

SEQ ID NO: 91480 - DNA, 25 bp, Rattus norvegicus
acgtctgcccaggattagaggatca

SEQ ID NO: 91481 - DNA, 25 bp, Rattus norvegicus
acgtctgccttaagtttaaactggg

SEQ ID NO: 91482 - DNA, 25 bp, Rattus norvegicus
acgtctgccttatgtttaaactggg

SEQ ID NO: 91483 - DNA, 25 bp, Rattus norvegicus
acgtctgctcagacattatacttta

SEQ ID NO: 91484 - DNA, 25 bp, Rattus norvegicus
acgtctgctcagtcattatacttta

SEQ ID NO: 91485 - DNA, 25 bp, Rattus norvegicus
acgtctgctctactggctaggtgtt

SEQ ID NO: 91486 - DNA, 25 bp, Rattus norvegicus
acgtctgctctagtggctaggtgtt

SEQ ID NO: 91487 - DNA, 25 bp, Rattus norvegicus
acgtctgcttctacatctcaggaat

SEQ ID NO: 91488 - DNA, 25 bp, Rattus norvegicus
acgtctgcttcttcatctcaggaat

SEQ ID NO: 91489 - DNA, 25 bp, Rattus norvegicus
acgtctggagtgatggctgcgccat

SEQ ID NO: 91490 - DNA, 25 bp, Rattus norvegicus
acgtctggagtgttggctgcgccat

SEQ ID NO: 91491 - DNA, 25 bp, Rattus norvegicus
acgtctggcaagatccgtcgtggaa

SEQ ID NO: 91492 - DNA, 25 bp, Rattus norvegicus
acgtctggcaagttccgtcgtggaa

SEQ ID NO: 91493 - DNA, 25 bp, Rattus norvegicus
acgtctgggactatggctggcatta

SEQ ID NO: 91494 - DNA, 25 bp, Rattus norvegicus
acgtctgggactttggctggcatta

SEQ ID NO: 91495 - DNA, 25 bp, Rattus norvegicus
acgtctggttttactgaagggctct

SEQ ID NO: 91496 - DNA, 25 bp, Rattus norvegicus
acgtctggtttttctgaagggctct

SEQ ID NO: 91497 - DNA, 25 bp, Rattus norvegicus
acgtctgtaacactgcgttgttcca

SEQ ID NO: 91498 - DNA, 25 bp, Rattus norvegicus
acgtctgtaacagtgcgttgttcca

SEQ ID NO: 91499 - DNA, 25 bp, Rattus norvegicus
acgtctgtaccgagtgactaaccca

SEQ ID NO: 91500 - DNA, 25 bp, Rattus norvegicus
acgtctgtaccgtgtgactaaccca

SEQ ID NO: 91501 - DNA, 25 bp, Rattus norvegicus
acgtctgtagctataggacactcag

SEQ ID NO: 91502 - DNA, 25 bp, Rattus norvegicus
acgtctgtagctttaggacactcag

SEQ ID NO: 91503 - DNA, 25 bp, Rattus norvegicus
acgtctgtgaacatgatgttccttg

SEQ ID NO: 91504 - DNA, 25 bp, Rattus norvegicus
acgtctgtgaacttgatgttccttg

SEQ ID NO: 91505 - DNA, 25 bp, Rattus norvegicus
acgtcttatcgtattttggcctcat

SEQ ID NO: 91506 - DNA, 25 bp, Rattus norvegicus
acgtcttatcgttttttggcctcat

SEQ ID NO: 91507 - DNA, 25 bp, Rattus norvegicus
acgtcttatgtgatgtgttcttcca

SEQ ID NO: 91508 - DNA, 25 bp, Rattus norvegicus
acgtcttatgtgttgtgttcttcca

SEQ ID NO: 91509 - DNA, 25 bp, Rattus norvegicus
acgtcttatgttatctctgatgatg

SEQ ID NO: 91510 - DNA, 25 bp, Rattus norvegicus
acgtcttatgttttctctgatgatg

SEQ ID NO: 91511 - DNA, 25 bp, Rattus norvegicus
acgtcttcatttcgactgttctata

SEQ ID NO: 91512 - DNA, 25 bp, Rattus norvegicus
acgtcttcatttggactgttctata

SEQ ID NO: 91513 - DNA, 25 bp, Rattus norvegicus
acgtcttccacaaatcattgtcttc

SEQ ID NO: 91514 - DNA, 25 bp, Rattus norvegicus
acgtcttccacatatcattgtcttc

SEQ ID NO: 91515 - DNA, 25 bp, Rattus norvegicus
acgtcttctgtacgtactctgggaa

SEQ ID NO: 91516 - DNA, 25 bp, Rattus norvegicus
acgtcttctgtaggtactctgggaa

SEQ ID NO: 91517 - DNA, 25 bp, Rattus norvegicus
acgtcttcttggcagtctatggcag

SEQ ID NO: 91518 - DNA, 25 bp, Rattus norvegicus
acgtcttcttgggagtctatggcag

SEQ ID NO: 91519 - DNA, 25 bp, Rattus norvegicus
acgtcttgtccaataaatcttgctg

SEQ ID NO: 91520 - DNA, 25 bp, Rattus norvegicus
acgtcttgtccattaaatcttgctg

SEQ ID NO: 91521 - DNA, 25 bp, Rattus norvegicus
acgtctttaattaggctgaactggc

SEQ ID NO: 91522 - DNA, 25 bp, Rattus norvegicus
acgtctttaatttggctgaactggc

SEQ ID NO: 91523 - DNA, 25 bp, Rattus norvegicus
acgtcttttcatattcccgcctgct

SEQ ID NO: 91524 - DNA, 25 bp, Rattus norvegicus
acgtcttttcattttcccgcctgct

SEQ ID NO: 91525 - DNA, 25 bp, Rattus norvegicus
acgtgaaagggcattttggctccgg

SEQ ID NO: 91526 - DNA, 25 bp, Rattus norvegicus
acgtgaaagggctttttggctccgg

SEQ ID NO: 91527 - DNA, 25 bp, Rattus norvegicus
acgtgaacagcaatatgtagcctag

SEQ ID NO: 91528 - DNA, 25 bp, Rattus norvegicus
acgtgaacagcattatgtagcctag

SEQ ID NO: 91529 - DNA, 25 bp, Rattus norvegicus
acgtgaacgcgtcttctcagaagcc

SEQ ID NO: 91530 - DNA, 25 bp, Rattus norvegicus
acgtgaacgcgtgttctcagaagcc

SEQ ID NO: 91531 - DNA, 25 bp, Rattus norvegicus
acgtgaagaataacctctctcccaa

SEQ ID NO: 91532 - DNA, 25 bp, Rattus norvegicus
acgtgaagaatatcctctctcccaa

SEQ ID NO: 91533 - DNA, 25 bp, Rattus norvegicus
acgtgaagacgcacttggaccggcc

SEQ ID NO: 91534 - DNA, 25 bp, Rattus norvegicus
acgtgaagacgctcttggaccggcc

SEQ ID NO: 91535 - DNA, 25 bp, Rattus norvegicus
acgtgaaggattagccgatccgccc

SEQ ID NO: 91536 - DNA, 25 bp, Rattus norvegicus
acgtgaaggatttgccgatccgccc

SEQ ID NO: 91537 - DNA, 25 bp, Rattus norvegicus
acgtgaagtctcagtcctgatgatc

SEQ ID NO: 91538 - DNA, 25 bp, Rattus norvegicus
acgtgaagtctctgtcctgatgatc

SEQ ID NO: 91539 - DNA, 25 bp, Rattus norvegicus
acgtgacaatctaggtgaagctccc

SEQ ID NO: 91540 - DNA, 25 bp, Rattus norvegicus
acgtgacaatcttggtgaagctccc

SEQ ID NO: 91541 - DNA, 25 bp, Rattus norvegicus
acgtgacacacgagcatacgtttgt

SEQ ID NO: 91542 - DNA, 25 bp, Rattus norvegicus
acgtgacacacgtgcatacgtttgt

SEQ ID NO: 91543 - DNA, 25 bp, Rattus norvegicus
acgtgacagccgcagaccttcaacg

SEQ ID NO: 91544 - DNA, 25 bp, Rattus norvegicus
acgtgacagccggagaccttcaacg

SEQ ID NO: 91545 - DNA, 25 bp, Rattus norvegicus
acgtgacagcctctgacgggccaag

SEQ ID NO: 91546 - DNA, 25 bp, Rattus norvegicus
acgtgacagcctgtgacgggccaag

SEQ ID NO: 91547 - DNA, 25 bp, Rattus norvegicus
acgtgacaggttacctctcagtgtg

SEQ ID NO: 91548 - DNA, 25 bp, Rattus norvegicus
acgtgacaggtttcctctcagtgtg

SEQ ID NO: 91549 - DNA, 25 bp, Rattus norvegicus
acgtgacatccacactgggctaaag

SEQ ID NO: 91550 - DNA, 25 bp, Rattus norvegicus
acgtgacatccagactgggctaaag

SEQ ID NO: 91551 - DNA, 25 bp, Rattus norvegicus
acgtgaccagctacctgagagcaaa

SEQ ID NO: 91552 - DNA, 25 bp, Rattus norvegicus
acgtgaccagcttcctgagagcaaa

SEQ ID NO: 91553 - DNA, 25 bp, Rattus norvegicus
acgtgacccgggaggtggcgcgctc

SEQ ID NO: 91554 - DNA, 25 bp, Rattus norvegicus
acgtgacccgggtggtggcgcgctc

SEQ ID NO: 91555 - DNA, 25 bp, Rattus norvegicus
acgtgacccttaatcaactggctgt

SEQ ID NO: 91556 - DNA, 25 bp, Rattus norvegicus
acgtgacccttattcaactggctgt

SEQ ID NO: 91557 - DNA, 25 bp, Rattus norvegicus
acgtgaccgtctccatggtgttttt

SEQ ID NO: 91558 - DNA, 25 bp, Rattus norvegicus
acgtgaccgtctgcatggtgttttt

SEQ ID NO: 91559 - DNA, 25 bp, Rattus norvegicus
acgtgacctatgagcagatgttata

SEQ ID NO: 91560 - DNA, 25 bp, Rattus norvegicus
acgtgacctatgtgcagatgttata

SEQ ID NO: 91561 - DNA, 25 bp, Rattus norvegicus
acgtgacgccgaacggcacgtgaca

SEQ ID NO: 91562 - DNA, 25 bp, Rattus norvegicus
acgtgacgccgatcggcacgtgaca

SEQ ID NO: 91563 - DNA, 25 bp, Rattus norvegicus
acgtgactaatgatgttgctgtaac

SEQ ID NO: 91564 - DNA, 25 bp, Rattus norvegicus
acgtgactaatgttgttgctgtaac

SEQ ID NO: 91565 - DNA, 25 bp, Rattus norvegicus
acgtgactactgagcctttgtggtg

SEQ ID NO: 91566 - DNA, 25 bp, Rattus norvegicus
acgtgactactgtgcctttgtggtg

SEQ ID NO: 91567 - DNA, 25 bp, Rattus norvegicus
acgtgactccctcgtcacgaggctt

SEQ ID NO: 91568 - DNA, 25 bp, Rattus norvegicus
acgtgactccctggtcacgaggctt

SEQ ID NO: 91569 - DNA, 25 bp, Rattus norvegicus
acgtgactgtctagagctcctgctc

SEQ ID NO: 91570 - DNA, 25 bp, Rattus norvegicus
acgtgactgtcttgagctcctgctc

SEQ ID NO: 91571 - DNA, 25 bp, Rattus norvegicus
acgtgactgtgcctttctcaccctg

SEQ ID NO: 91572 - DNA, 25 bp, Rattus norvegicus
acgtgactgtgcgtttctcaccctg

SEQ ID NO: 91573 - DNA, 25 bp, Rattus norvegicus
acgtgacttatcattcaacagctga

SEQ ID NO: 91574 - DNA, 25 bp, Rattus norvegicus
acgtgacttatctttcaacagctga

SEQ ID NO: 91575 - DNA, 25 bp, Rattus norvegicus
acgtgagaggctacgactggtccac

SEQ ID NO: 91576 - DNA, 25 bp, Rattus norvegicus
acgtgagaggcttcgactggtccac

SEQ ID NO: 91577 - DNA, 25 bp, Rattus norvegicus
acgtgagcaaggagcagctgacccg

SEQ ID NO: 91578 - DNA, 25 bp, Rattus norvegicus
acgtgagcaaggtgcagctgacccg

SEQ ID NO: 91579 - DNA, 25 bp, Rattus norvegicus
acgtgagccctgacactgaaacaaa

SEQ ID NO: 91580 - DNA, 25 bp, Rattus norvegicus
acgtgagccctgtcactgaaacaaa

SEQ ID NO: 91581 - DNA, 25 bp, Rattus norvegicus
acgtgagctgatagtggctgcgcct

SEQ ID NO: 91582 - DNA, 25 bp, Rattus norvegicus
acgtgagctgattgtggctgcgcct

SEQ ID NO: 91583 - DNA, 25 bp, Rattus norvegicus
acgtgagctggtccatcacagcaaa

SEQ ID NO: 91584 - DNA, 25 bp, Rattus norvegicus
acgtgagctggtgcatcacagcaaa

SEQ ID NO: 91585 - DNA, 25 bp, Rattus norvegicus
acgtgaggccacagcatgttgtgaa

SEQ ID NO: 91586 - DNA, 25 bp, Rattus norvegicus
acgtgaggccactgcatgttgtgaa

SEQ ID NO: 91587 - DNA, 25 bp, Rattus norvegicus
acgtgagttctgatgtttgcattga

SEQ ID NO: 91588 - DNA, 25 bp, Rattus norvegicus
acgtgagttctgttgtttgcattga

SEQ ID NO: 91589 - DNA, 25 bp, Rattus norvegicus
acgtgataccgtcttctagaagtaa

SEQ ID NO: 91590 - DNA, 25 bp, Rattus norvegicus
acgtgataccgtgttctagaagtaa

SEQ ID NO: 91591 - DNA, 25 bp, Rattus norvegicus
acgtgataggcgcacatatgttcaa

SEQ ID NO: 91592 - DNA, 25 bp, Rattus norvegicus
acgtgataggcggacatatgttcaa

SEQ ID NO: 91593 - DNA, 25 bp, Rattus norvegicus
acgtgatatattagctgtccttact

SEQ ID NO: 91594 - DNA, 25 bp, Rattus norvegicus
acgtgatatatttgctgtccttact

SEQ ID NO: 91595 - DNA, 25 bp, Rattus norvegicus
acgtgatcaagaagccgtgctagct

SEQ ID NO: 91596 - DNA, 25 bp, Rattus norvegicus
acgtgatcaagatgccgtgctagct

SEQ ID NO: 91597 - DNA, 25 bp, Rattus norvegicus
acgtgatcacggagccaaggttggc

SEQ ID NO: 91598 - DNA, 25 bp, Rattus norvegicus
acgtgatcacggtgccaaggttggc

SEQ ID NO: 91599 - DNA, 25 bp, Rattus norvegicus
acgtgatcagtgagcctgcttggtt

SEQ ID NO: 91600 - DNA, 25 bp, Rattus norvegicus
acgtgatcagtgtgcctgcttggtt

SEQ ID NO: 91601 - DNA, 25 bp, Rattus norvegicus
acgtgatctggcagtacgggctact

SEQ ID NO: 91602 - DNA, 25 bp, Rattus norvegicus
acgtgatctggctgtacgggctact

SEQ ID NO: 91603 - DNA, 25 bp, Rattus norvegicus
acgtgatctgttaggactgcttcca

SEQ ID NO: 91604 - DNA, 25 bp, Rattus norvegicus
acgtgatctgtttggactgcttcca

SEQ ID NO: 91605 - DNA, 25 bp, Rattus norvegicus
acgtgattaaggacaccacttccct

SEQ ID NO: 91606 - DNA, 25 bp, Rattus norvegicus
acgtgattaaggtcaccacttccct

SEQ ID NO: 91607 - DNA, 25 bp, Rattus norvegicus
acgtgattagaaacctgccacctga

SEQ ID NO: 91608 - DNA, 25 bp, Rattus norvegicus
acgtgattagaatcctgccacctga

SEQ ID NO: 91609 - DNA, 25 bp, Rattus norvegicus
acgtgattatggacggtgctgcctc

SEQ ID NO: 91610 - DNA, 25 bp, Rattus norvegicus
acgtgattatggtcggtgctgcctc

SEQ ID NO: 91611 - DNA, 25 bp, Rattus norvegicus
acgtgattctacacagctctcagac

SEQ ID NO: 91612 - DNA, 25 bp, Rattus norvegicus
acgtgattctactcagctctcagac

SEQ ID NO: 91613 - DNA, 25 bp, Rattus norvegicus
acgtgattggctatctcctggccat

SEQ ID NO: 91614 - DNA, 25 bp, Rattus norvegicus
acgtgattggctttctcctggccat

SEQ ID NO: 91615 - DNA, 25 bp, Rattus norvegicus
acgtgcaaaacacgctctagcgttc

SEQ ID NO: 91616 - DNA, 25 bp, Rattus norvegicus
acgtgcaaaacaggctctagcgttc

SEQ ID NO: 91617 - DNA, 25 bp, Rattus norvegicus
acgtgcaactgactggcagccgctt

SEQ ID NO: 91618 - DNA, 25 bp, Rattus norvegicus
acgtgcaactgagtggcagccgctt

SEQ ID NO: 91619 - DNA, 25 bp, Rattus norvegicus
acgtgcacacacaactgggaatcag

SEQ ID NO: 91620 - DNA, 25 bp, Rattus norvegicus
acgtgcacacactactgggaatcag

SEQ ID NO: 91621 - DNA, 25 bp, Rattus norvegicus
acgtgcaccatgcaaacctagctgt

SEQ ID NO: 91622 - DNA, 25 bp, Rattus norvegicus
acgtgcaccatggaaacctagctgt

SEQ ID NO: 91623 - DNA, 25 bp, Rattus norvegicus
acgtgcacgctcacaacgagaattg

SEQ ID NO: 91624 - DNA, 25 bp, Rattus norvegicus
acgtgcacgctctcaacgagaattg

SEQ ID NO: 91625 - DNA, 25 bp, Rattus norvegicus
acgtgcactacaatagacctactat

SEQ ID NO: 91626 - DNA, 25 bp, Rattus norvegicus
acgtgcactacattagacctactat

SEQ ID NO: 91627 - DNA, 25 bp, Rattus norvegicus
acgtgcactgaaagtggcaagtcat

SEQ ID NO: 91628 - DNA, 25 bp, Rattus norvegicus
acgtgcactgaatgtggcaagtcat

SEQ ID NO: 91629 - DNA, 25 bp, Rattus norvegicus
acgtgcactgttcttcttttcaagc

SEQ ID NO: 91630 - DNA, 25 bp, Rattus norvegicus
acgtgcactgttgttcttttcaagc

SEQ ID NO: 91631 - DNA, 25 bp, Rattus norvegicus
acgtgcagcctgaagtgatgtccat

SEQ ID NO: 91632 - DNA, 25 bp, Rattus norvegicus
acgtgcagcctgtagtgatgtccat

SEQ ID NO: 91633 - DNA, 25 bp, Rattus norvegicus
acgtgcagctctacatggccgatga

SEQ ID NO: 91634 - DNA, 25 bp, Rattus norvegicus
acgtgcagctcttcatggccgatga

SEQ ID NO: 91635 - DNA, 25 bp, Rattus norvegicus
acgtgcagtgttctgtcttggagca

SEQ ID NO: 91636 - DNA, 25 bp, Rattus norvegicus
acgtgcagtgttgtgtcttggagca

SEQ ID NO: 91637 - DNA, 25 bp, Rattus norvegicus
acgtgcatgcccctaagatcggttg

SEQ ID NO: 91638 - DNA, 25 bp, Rattus norvegicus
acgtgcatgcccgtaagatcggttg

SEQ ID NO: 91639 - DNA, 25 bp, Rattus norvegicus
acgtgcattccaagtcctgggacat

SEQ ID NO: 91640 - DNA, 25 bp, Rattus norvegicus
acgtgcattccatgtcctgggacat

SEQ ID NO: 91641 - DNA, 25 bp, Rattus norvegicus
acgtgcattgtgcttctttgagaat

SEQ ID NO: 91642 - DNA, 25 bp, Rattus norvegicus
acgtgcattgtggttctttgagaat

SEQ ID NO: 91643 - DNA, 25 bp, Rattus norvegicus
acgtgccatcatcccaagccagaat

SEQ ID NO: 91644 - DNA, 25 bp, Rattus norvegicus
acgtgccatcatgccaagccagaat

SEQ ID NO: 91645 - DNA, 25 bp, Rattus norvegicus
acgtgccattggctcagccttttgg

SEQ ID NO: 91646 - DNA, 25 bp, Rattus norvegicus
acgtgccattgggtcagccttttgg

SEQ ID NO: 91647 - DNA, 25 bp, Rattus norvegicus
acgtgcccaacaaggtggctaccga

SEQ ID NO: 91648 - DNA, 25 bp, Rattus norvegicus
acgtgcccaacatggtggctaccga

SEQ ID NO: 91649 - DNA, 25 bp, Rattus norvegicus
acgtgcccacagcagttggttgtgt

SEQ ID NO: 91650 - DNA, 25 bp, Rattus norvegicus
acgtgcccacaggagttggttgtgt

SEQ ID NO: 91651 - DNA, 25 bp, Rattus norvegicus
acgtgcccatagagtgctgcagcga

SEQ ID NO: 91652 - DNA, 25 bp, Rattus norvegicus
acgtgcccatagtgtgctgcagcga

SEQ ID NO: 91653 - DNA, 25 bp, Rattus norvegicus
acgtgccccaagcaaatctttctga

SEQ ID NO: 91654 - DNA, 25 bp, Rattus norvegicus
acgtgccccaagcaactggatacca

SEQ ID NO: 91655 - DNA, 25 bp, Rattus norvegicus
acgtgccccaaggaaatctttctga

SEQ ID NO: 91656 - DNA, 25 bp, Rattus norvegicus
acgtgccccaaggaactggatacca

SEQ ID NO: 91657 - DNA, 25 bp, Rattus norvegicus
acgtgccccggcaaaagacattaga

SEQ ID NO: 91658 - DNA, 25 bp, Rattus norvegicus
acgtgccccggctaaagacattaga

SEQ ID NO: 91659 - DNA, 25 bp, Rattus norvegicus
acgtgcccctgtacttttaaagatg

SEQ ID NO: 91660 - DNA, 25 bp, Rattus norvegicus
acgtgcccctgttcttttaaagatg

SEQ ID NO: 91661 - DNA, 25 bp, Rattus norvegicus
acgtgcctatgaagcttagagccac

SEQ ID NO: 91662 - DNA, 25 bp, Rattus norvegicus
acgtgcctatgatgcttagagccac

SEQ ID NO: 91663 - DNA, 25 bp, Rattus norvegicus
acgtgcctcaagaccttcataagtt

SEQ ID NO: 91664 - DNA, 25 bp, Rattus norvegicus
acgtgcctcaagtccttcataagtt

SEQ ID NO: 91665 - DNA, 25 bp, Rattus norvegicus
acgtgcctcctcctactgtgtagga

SEQ ID NO: 91666 - DNA, 25 bp, Rattus norvegicus
acgtgcctcctcgtactgtgtagga

SEQ ID NO: 91667 - DNA, 25 bp, Rattus norvegicus
acgtgcctctcacctcaaagtgaag

SEQ ID NO: 91668 - DNA, 25 bp, Rattus norvegicus
acgtgcctctcagctcaaagtgaag

SEQ ID NO: 91669 - DNA, 25 bp, Rattus norvegicus
acgtgcctgacgcttccaggaagct

SEQ ID NO: 91670 - DNA, 25 bp, Rattus norvegicus
acgtgcctgacggttccaggaagct

SEQ ID NO: 91671 - DNA, 25 bp, Rattus norvegicus
acgtgcctgtcacagcagccagtaa

SEQ ID NO: 91672 - DNA, 25 bp, Rattus norvegicus
acgtgcctgtcagagcagccagtaa

SEQ ID NO: 91673 - DNA, 25 bp, Rattus norvegicus
acgtgccttcacacttaggcagcta

SEQ ID NO: 91674 - DNA, 25 bp, Rattus norvegicus
acgtgccttcactcttaggcagcta

SEQ ID NO: 91675 - DNA, 25 bp, Rattus norvegicus
acgtgcgcaaccatcaagagctaga

SEQ ID NO: 91676 - DNA, 25 bp, Rattus norvegicus
acgtgcgcaaccttcaagagctaga

SEQ ID NO: 91677 - DNA, 25 bp, Rattus norvegicus
acgtgcgcccggaaggccgcaggct

SEQ ID NO: 91678 - DNA, 25 bp, Rattus norvegicus
acgtgcgcccggtaggccgcaggct

SEQ ID NO: 91679 - DNA, 25 bp, Rattus norvegicus
acgtgcgcggctattctgcatcaat

SEQ ID NO: 91680 - DNA, 25 bp, Rattus norvegicus
acgtgcgcggcttttctgcatcaat

SEQ ID NO: 91681 - DNA, 25 bp, Rattus norvegicus
acgtgcgcttggagctgtggctaaa

SEQ ID NO: 91682 - DNA, 25 bp, Rattus norvegicus
acgtgcgcttggtgctgtggctaaa

SEQ ID NO: 91683 - DNA, 25 bp, Rattus norvegicus
acgtgcggccatccatgatctgtgg

SEQ ID NO: 91684 - DNA, 25 bp, Rattus norvegicus
acgtgcggccatgcatgatctgtgg

SEQ ID NO: 91685 - DNA, 25 bp, Rattus norvegicus
acgtgcgggtgaagctcacacacag

SEQ ID NO: 91686 - DNA, 25 bp, Rattus norvegicus
acgtgcgggtgatgctcacacacag

SEQ ID NO: 91687 - DNA, 25 bp, Rattus norvegicus
acgtgcgtacagcagagcggttacc

SEQ ID NO: 91688 - DNA, 25 bp, Rattus norvegicus
acgtgcgtacaggagagcggttacc

SEQ ID NO: 91689 - DNA, 25 bp, Rattus norvegicus
acgtgcgtcctaaatatttgatgta

SEQ ID NO: 91690 - DNA, 25 bp, Rattus norvegicus
acgtgcgtcctatatatttgatgta

SEQ ID NO: 91691 - DNA, 25 bp, Rattus norvegicus
acgtgcgtgcctcatactgacggag

SEQ ID NO: 91692 - DNA, 25 bp, Rattus norvegicus
acgtgcgtgcctgatactgacggag

SEQ ID NO: 91693 - DNA, 25 bp, Rattus norvegicus
acgtgcgtggtcatgtctggcattc

SEQ ID NO: 91694 - DNA, 25 bp, Rattus norvegicus
acgtgcgtggtcttgtctggcattc

SEQ ID NO: 91695 - DNA, 25 bp, Rattus norvegicus
acgtgcgtgtagattcctgtgtatt

SEQ ID NO: 91696 - DNA, 25 bp, Rattus norvegicus
acgtgcgtgtagtttcctgtgtatt

SEQ ID NO: 91697 - DNA, 25 bp, Rattus norvegicus
acgtgctaagaaaaatatccttgtt

SEQ ID NO: 91698 - DNA, 25 bp, Rattus norvegicus
acgtgctaagaataatatccttgtt

SEQ ID NO: 91699 - DNA, 25 bp, Rattus norvegicus
acgtgctatgttcttctatgtgact

SEQ ID NO: 91700 - DNA, 25 bp, Rattus norvegicus
acgtgctatgttgttctatgtgact

SEQ ID NO: 91701 - DNA, 25 bp, Rattus norvegicus
acgtgctcagctctgtaccatttag

SEQ ID NO: 91702 - DNA, 25 bp, Rattus norvegicus
acgtgctcagctgtgtaccatttag

SEQ ID NO: 91703 - DNA, 25 bp, Rattus norvegicus
acgtgctccacaaagtcagaggctt

SEQ ID NO: 91704 - DNA, 25 bp, Rattus norvegicus
acgtgctccacatagtcagaggctt

SEQ ID NO: 91705 - DNA, 25 bp, Rattus norvegicus
acgtgctcccatatctgttagcaga

SEQ ID NO: 91706 - DNA, 25 bp, Rattus norvegicus
acgtgctcccatttctgttagcaga

SEQ ID NO: 91707 - DNA, 25 bp, Rattus norvegicus
acgtgctcctcaactatttcggcgg

SEQ ID NO: 91708 - DNA, 25 bp, Rattus norvegicus
acgtgctcctcatctatttcggcgg

SEQ ID NO: 91709 - DNA, 25 bp, Rattus norvegicus
acgtgctctgcgaaggctgctttct

SEQ ID NO: 91710 - DNA, 25 bp, Rattus norvegicus
acgtgctctgcgtaggctgctttct

SEQ ID NO: 91711 - DNA, 25 bp, Rattus norvegicus
acgtgctgaccaatgcactgcctgg

SEQ ID NO: 91712 - DNA, 25 bp, Rattus norvegicus
acgtgctgaccattgcactgcctgg

SEQ ID NO: 91713 - DNA, 25 bp, Rattus norvegicus
acgtgctgacgtcaacgtgcagttt

SEQ ID NO: 91714 - DNA, 25 bp, Rattus norvegicus
acgtgctgacgtgaacgtgcagttt

SEQ ID NO: 91715 - DNA, 25 bp, Rattus norvegicus
acgtgctgccgtacatgttttgaca

SEQ ID NO: 91716 - DNA, 25 bp, Rattus norvegicus
acgtgctgccgttcatgttttgaca

SEQ ID NO: 91717 - DNA, 25 bp, Rattus norvegicus
acgtgcttccgtcaataccgagtgt

SEQ ID NO: 91718 - DNA, 25 bp, Rattus norvegicus
acgtgcttccgtgaataccgagtgt

SEQ ID NO: 91719 - DNA, 25 bp, Rattus norvegicus
acgtgcttgagtccctggacatgga

SEQ ID NO: 91720 - DNA, 25 bp, Rattus norvegicus
acgtgcttgagtgcctggacatgga

SEQ ID NO: 91721 - DNA, 25 bp, Rattus norvegicus
acgtgctttcccctgtgagtgacac

SEQ ID NO: 91722 - DNA, 25 bp, Rattus norvegicus
acgtgctttcccgtgtgagtgacac

SEQ ID NO: 91723 - DNA, 25 bp, Rattus norvegicus
acgtggaagaccagcttggtgccct

SEQ ID NO: 91724 - DNA, 25 bp, Rattus norvegicus
acgtggaagacctgcttggtgccct

SEQ ID NO: 91725 - DNA, 25 bp, Rattus norvegicus
acgtggaatctgcagctttgctgaa

SEQ ID NO: 91726 - DNA, 25 bp, Rattus norvegicus
acgtggaatctggagctttgctgaa

SEQ ID NO: 91727 - DNA, 25 bp, Rattus norvegicus
acgtggacaacgcaggctgaacatt

SEQ ID NO: 91728 - DNA, 25 bp, Rattus norvegicus
acgtggacaacggaggctgaacatt

SEQ ID NO: 91729 - DNA, 25 bp, Rattus norvegicus
acgtggacatgacctctgtgcccag

SEQ ID NO: 91730 - DNA, 25 bp, Rattus norvegicus
acgtggacatgagctctgtgcccag

SEQ ID NO: 91731 - DNA, 25 bp, Rattus norvegicus
acgtggaccacactgaactgcaggg

SEQ ID NO: 91732 - DNA, 25 bp, Rattus norvegicus
acgtggaccacagtgaactgcaggg

SEQ ID NO: 91733 - DNA, 25 bp, Rattus norvegicus
acgtggaccacccttatggtacaga

SEQ ID NO: 91734 - DNA, 25 bp, Rattus norvegicus
acgtggaccaccgttatggtacaga

SEQ ID NO: 91735 - DNA, 25 bp, Rattus norvegicus
acgtggactttcaactctcatgaag

SEQ ID NO: 91736 - DNA, 25 bp, Rattus norvegicus
acgtggactttctactctcatgaag

SEQ ID NO: 91737 - DNA, 25 bp, Rattus norvegicus
acgtggagccagcttcaccgacgag

SEQ ID NO: 91738 - DNA, 25 bp, Rattus norvegicus
acgtggagccaggttcaccgacgag

SEQ ID NO: 91739 - DNA, 25 bp, Rattus norvegicus
acgtggatcccgagaactttaagct

SEQ ID NO: 91740 - DNA, 25 bp, Rattus norvegicus
acgtggatcccgtgaactttaagct

SEQ ID NO: 91741 - DNA, 25 bp, Rattus norvegicus
acgtggatggacacacattccaggg

SEQ ID NO: 91742 - DNA, 25 bp, Rattus norvegicus
acgtggatggactcacattccaggg

SEQ ID NO: 91743 - DNA, 25 bp, Rattus norvegicus
acgtggatggtgaggctaaccttcc

SEQ ID NO: 91744 - DNA, 25 bp, Rattus norvegicus
acgtggatggtgtggctaaccttcc

SEQ ID NO: 91745 - DNA, 25 bp, Rattus norvegicus
acgtggcacatcagcgattccgctg

SEQ ID NO: 91746 - DNA, 25 bp, Rattus norvegicus
acgtggcacatctgcgattccgctg

SEQ ID NO: 91747 - DNA, 25 bp, Rattus norvegicus
acgtggcacttaccatttcagttgt

SEQ ID NO: 91748 - DNA, 25 bp, Rattus norvegicus
acgtggcacttagcatttcagttgt

SEQ ID NO: 91749 - DNA, 25 bp, Rattus norvegicus
acgtggcagaccaccagcagcagtg

SEQ ID NO: 91750 - DNA, 25 bp, Rattus norvegicus
acgtggcagacctccagcagcagtg

SEQ ID NO: 91751 - DNA, 25 bp, Rattus norvegicus
acgtggcagcctactgaaacagtgt

SEQ ID NO: 91752 - DNA, 25 bp, Rattus norvegicus
acgtggcagccttctgaaacagtgt

SEQ ID NO: 91753 - DNA, 25 bp, Rattus norvegicus
acgtggcccagaaagtggtagcctt

SEQ ID NO: 91754 - DNA, 25 bp, Rattus norvegicus
acgtggcccagatagtggtagcctt

SEQ ID NO: 91755 - DNA, 25 bp, Rattus norvegicus
acgtggccgacaagcttgttaaggt

SEQ ID NO: 91756 - DNA, 25 bp, Rattus norvegicus
acgtggccgacatgcttgttaaggt

SEQ ID NO: 91757 - DNA, 25 bp, Rattus norvegicus
acgtggcgctggacatttcagtaaa

SEQ ID NO: 91758 - DNA, 25 bp, Rattus norvegicus
acgtggcgctggtcatttcagtaaa

SEQ ID NO: 91759 - DNA, 25 bp, Rattus norvegicus
acgtggcgtactcagcatcgtaggc

SEQ ID NO: 91760 - DNA, 25 bp, Rattus norvegicus
acgtggcgtactgagcatcgtaggc

SEQ ID NO: 91761 - DNA, 25 bp, Rattus norvegicus
acgtggcgtctgctagaccggccta

SEQ ID NO: 91762 - DNA, 25 bp, Rattus norvegicus
acgtggcgtctggtagaccggccta

SEQ ID NO: 91763 - DNA, 25 bp, Rattus norvegicus
acgtggcgtggtaatctggtgtttt

SEQ ID NO: 91764 - DNA, 25 bp, Rattus norvegicus
acgtggcgtggttatctggtgtttt

SEQ ID NO: 91765 - DNA, 25 bp, Rattus norvegicus
acgtggctcaagcttgcctggctag

SEQ ID NO: 91766 - DNA, 25 bp, Rattus norvegicus
acgtggctcaaggttgcctggctag

SEQ ID NO: 91767 - DNA, 25 bp, Rattus norvegicus
acgtggctcacgagcgtctcagcta

SEQ ID NO: 91768 - DNA, 25 bp, Rattus norvegicus
acgtggctcacgtgcgtctcagcta

SEQ ID NO: 91769 - DNA, 25 bp, Rattus norvegicus
acgtggctgtccacgggatcagaac

SEQ ID NO: 91770 - DNA, 25 bp, Rattus norvegicus
acgtggctgtcccactactgtagag

SEQ ID NO: 91771 - DNA, 25 bp, Rattus norvegicus
acgtggctgtccgactactgtagag

SEQ ID NO: 91772 - DNA, 25 bp, Rattus norvegicus
acgtggctgtcctcgggatcagaac

SEQ ID NO: 91773 - DNA, 25 bp, Rattus norvegicus
acgtggctgtggagtccttggctac

SEQ ID NO: 91774 - DNA, 25 bp, Rattus norvegicus
acgtggctgtggtgtccttggctac

SEQ ID NO: 91775 - DNA, 25 bp, Rattus norvegicus
acgtgggacagcataagacagtgta

SEQ ID NO: 91776 - DNA, 25 bp, Rattus norvegicus
acgtgggacagcttaagacagtgta

SEQ ID NO: 91777 - DNA, 25 bp, Rattus norvegicus
acgtgggagttcattcgtagagcac

SEQ ID NO: 91778 - DNA, 25 bp, Rattus norvegicus
acgtgggagttctttcgtagagcac

SEQ ID NO: 91779 - DNA, 25 bp, Rattus norvegicus
acgtgggattacctatgcatgacta

SEQ ID NO: 91780 - DNA, 25 bp, Rattus norvegicus
acgtgggattacgtatgcatgacta

SEQ ID NO: 91781 - DNA, 25 bp, Rattus norvegicus
acgtgggccgccagtgacagataac

SEQ ID NO: 91782 - DNA, 25 bp, Rattus norvegicus
acgtgggccgcctgtgacagataac

SEQ ID NO: 91783 - DNA, 25 bp, Rattus norvegicus
acgtgggcctggatgccttagattt

SEQ ID NO: 91784 - DNA, 25 bp, Rattus norvegicus
acgtgggcctggttgccttagattt

SEQ ID NO: 91785 - DNA, 25 bp, Rattus norvegicus
acgtgggcgttaccttggctcgctc

SEQ ID NO: 91786 - DNA, 25 bp, Rattus norvegicus
acgtgggcgttagcttggctcgctc

SEQ ID NO: 91787 - DNA, 25 bp, Rattus norvegicus
acgtgggctgctaccattgtggccg

SEQ ID NO: 91788 - DNA, 25 bp, Rattus norvegicus
acgtgggctgcttccattgtggccg

SEQ ID NO: 91789 - DNA, 25 bp, Rattus norvegicus
acgtggtagaccctggctctccagg

SEQ ID NO: 91790 - DNA, 25 bp, Rattus norvegicus
acgtggtagaccgtggctctccagg

SEQ ID NO: 91791 - DNA, 25 bp, Rattus norvegicus
acgtggtatacaaccagacactcca

SEQ ID NO: 91792 - DNA, 25 bp, Rattus norvegicus
acgtggtatacatccagacactcca

SEQ ID NO: 91793 - DNA, 25 bp, Rattus norvegicus
acgtggtctcctcgaatttgtggac

SEQ ID NO: 91794 - DNA, 25 bp, Rattus norvegicus
acgtggtctcctggaatttgtggac

SEQ ID NO: 91795 - DNA, 25 bp, Rattus norvegicus
acgtggtgaaagctttccaccgcga

SEQ ID NO: 91796 - DNA, 25 bp, Rattus norvegicus
acgtggtgaaaggtttccaccgcga

SEQ ID NO: 91797 - DNA, 25 bp, Rattus norvegicus
acgtggtgcgtgacacagtgtgcca

SEQ ID NO: 91798 - DNA, 25 bp, Rattus norvegicus
acgtggtgcgtgtcacagtgtgcca

SEQ ID NO: 91799 - DNA, 25 bp, Rattus norvegicus
acgtggtggtgcaagtcccaggact

SEQ ID NO: 91800 - DNA, 25 bp, Rattus norvegicus
acgtggtggtgctagtcccaggact

SEQ ID NO: 91801 - DNA, 25 bp, Rattus norvegicus
acgtggtgttcgacagtccgctgca

SEQ ID NO: 91802 - DNA, 25 bp, Rattus norvegicus
acgtggtgttcgtcagtccgctgca

SEQ ID NO: 91803 - DNA, 25 bp, Rattus norvegicus
acgtggttagcgactcatgggactc

SEQ ID NO: 91804 - DNA, 25 bp, Rattus norvegicus
acgtggttagcgtctcatgggactc

SEQ ID NO: 91805 - DNA, 25 bp, Rattus norvegicus
acgtggttcatgcttcttctgtgac

SEQ ID NO: 91806 - DNA, 25 bp, Rattus norvegicus
acgtggttcatggttcttctgtgac

SEQ ID NO: 91807 - DNA, 25 bp, Rattus norvegicus
acgtggttcttaattaactgtctag

SEQ ID NO: 91808 - DNA, 25 bp, Rattus norvegicus
acgtggttcttatttaactgtctag

SEQ ID NO: 91809 - DNA, 25 bp, Rattus norvegicus
acgtggttctttatatgcagttgca

SEQ ID NO: 91810 - DNA, 25 bp, Rattus norvegicus
acgtggttctttttatgcagttgca

SEQ ID NO: 91811 - DNA, 25 bp, Rattus norvegicus
acgtggttgctcacctgtttgaaga

SEQ ID NO: 91812 - DNA, 25 bp, Rattus norvegicus
acgtggttgctctcctgtttgaaga

SEQ ID NO: 91813 - DNA, 25 bp, Rattus norvegicus
acgtggttttgacttctgatggctt

SEQ ID NO: 91814 - DNA, 25 bp, Rattus norvegicus
acgtggttttgagttctgatggctt

SEQ ID NO: 91815 - DNA, 25 bp, Rattus norvegicus
acgtggtttttcaaatgcttaacat

SEQ ID NO: 91816 - DNA, 25 bp, Rattus norvegicus
acgtggtttttctaatgcttaacat

SEQ ID NO: 91817 - DNA, 25 bp, Rattus norvegicus
acgtgtaaatcacccggcttggaca

SEQ ID NO: 91818 - DNA, 25 bp, Rattus norvegicus
acgtgtaaatcagccggcttggaca

SEQ ID NO: 91819 - DNA, 25 bp, Rattus norvegicus
acgtgtaatgttacagattgcaagg

SEQ ID NO: 91820 - DNA, 25 bp, Rattus norvegicus
acgtgtaatgtttcagattgcaagg

SEQ ID NO: 91821 - DNA, 25 bp, Rattus norvegicus
acgtgtacaatacacctgtgataaa

SEQ ID NO: 91822 - DNA, 25 bp, Rattus norvegicus
acgtgtacaatagacctgtgataaa

SEQ ID NO: 91823 - DNA, 25 bp, Rattus norvegicus
acgtgtacagctattatgtccctac

SEQ ID NO: 91824 - DNA, 25 bp, Rattus norvegicus
acgtgtacagcttttatgtccctac

SEQ ID NO: 91825 - DNA, 25 bp, Rattus norvegicus
acgtgtacatgacaccttgggagaa

SEQ ID NO: 91826 - DNA, 25 bp, Rattus norvegicus
acgtgtacatgagaccttgggagaa

SEQ ID NO: 91827 - DNA, 25 bp, Rattus norvegicus
acgtgtactgtaacttagtgtgttc

SEQ ID NO: 91828 - DNA, 25 bp, Rattus norvegicus
acgtgtactgtatcttagtgtgttc

SEQ ID NO: 91829 - DNA, 25 bp, Rattus norvegicus
acgtgtaggactattcttcagctct

SEQ ID NO: 91830 - DNA, 25 bp, Rattus norvegicus
acgtgtaggacttttcttcagctct

SEQ ID NO: 91831 - DNA, 25 bp, Rattus norvegicus
acgtgtaggcgaattcactaggctc

SEQ ID NO: 91832 - DNA, 25 bp, Rattus norvegicus
acgtgtaggcgatttcactaggctc

SEQ ID NO: 91833 - DNA, 25 bp, Rattus norvegicus
acgtgtagttatatctgcttgtcat

SEQ ID NO: 91834 - DNA, 25 bp, Rattus norvegicus
acgtgtagttatttctgcttgtcat

SEQ ID NO: 91835 - DNA, 25 bp, Rattus norvegicus
acgtgtatatgtattgctgagcagc

SEQ ID NO: 91836 - DNA, 25 bp, Rattus norvegicus
acgtgtatatgttttgctgagcagc

SEQ ID NO: 91837 - DNA, 25 bp, Rattus norvegicus
acgtgtatcgtaaggcttgccttca

SEQ ID NO: 91838 - DNA, 25 bp, Rattus norvegicus
acgtgtatcgtatggcttgccttca

SEQ ID NO: 91839 - DNA, 25 bp, Rattus norvegicus
acgtgtatgggcaccacatcagtca

SEQ ID NO: 91840 - DNA, 25 bp, Rattus norvegicus
acgtgtatgggctccacatcagtca

SEQ ID NO: 91841 - DNA, 25 bp, Rattus norvegicus
acgtgtattactatgatatgacttt

SEQ ID NO: 91842 - DNA, 25 bp, Rattus norvegicus
acgtgtattactttgatatgacttt

SEQ ID NO: 91843 - DNA, 25 bp, Rattus norvegicus
acgtgtcaccacagaaggcagcttc

SEQ ID NO: 91844 - DNA, 25 bp, Rattus norvegicus
acgtgtcaccactgaaggcagcttc

SEQ ID NO: 91845 - DNA, 25 bp, Rattus norvegicus
acgtgtcacggcactaggctttagt

SEQ ID NO: 91846 - DNA, 25 bp, Rattus norvegicus
acgtgtcacggctctaggctttagt

SEQ ID NO: 91847 - DNA, 25 bp, Rattus norvegicus
acgtgtcacttcaacctggacaagt

SEQ ID NO: 91848 - DNA, 25 bp, Rattus norvegicus
acgtgtcacttctacctggacaagt

SEQ ID NO: 91849 - DNA, 25 bp, Rattus norvegicus
acgtgtccaagactgcggtgagccc

SEQ ID NO: 91850 - DNA, 25 bp, Rattus norvegicus
acgtgtccaagagtgcggtgagccc

SEQ ID NO: 91851 - DNA, 25 bp, Rattus norvegicus
acgtgtccatatacacagtgcgcag

SEQ ID NO: 91852 - DNA, 25 bp, Rattus norvegicus
acgtgtccatattcacagtgcgcag

SEQ ID NO: 91853 - DNA, 25 bp, Rattus norvegicus
acgtgtcctggtatttgataatcat

SEQ ID NO: 91854 - DNA, 25 bp, Rattus norvegicus
acgtgtcctggtttttgataatcat

SEQ ID NO: 91855 - DNA, 25 bp, Rattus norvegicus
acgtgtccttgacttctagtgttgc

SEQ ID NO: 91856 - DNA, 25 bp, Rattus norvegicus
acgtgtccttgagttctagtgttgc

SEQ ID NO: 91857 - DNA, 25 bp, Rattus norvegicus
acgtgtcgcttacttactctgtaga

SEQ ID NO: 91858 - DNA, 25 bp, Rattus norvegicus
acgtgtcgcttagttactctgtaga

SEQ ID NO: 91859 - DNA, 25 bp, Rattus norvegicus
acgtgtctgattacttacttccatg

SEQ ID NO: 91860 - DNA, 25 bp, Rattus norvegicus
acgtgtctgatttcttacttccatg

SEQ ID NO: 91861 - DNA, 25 bp, Rattus norvegicus
acgtgtctgtgtcctaagcgcactc

SEQ ID NO: 91862 - DNA, 25 bp, Rattus norvegicus
acgtgtctgtgtgctaagcgcactc

SEQ ID NO: 91863 - DNA, 25 bp, Rattus norvegicus
acgtgtcttctactgtttgttccca

SEQ ID NO: 91864 - DNA, 25 bp, Rattus norvegicus
acgtgtcttctagtgtttgttccca

SEQ ID NO: 91865 - DNA, 25 bp, Rattus norvegicus
acgtgtcttggcctgtggttagacc

SEQ ID NO: 91866 - DNA, 25 bp, Rattus norvegicus
acgtgtcttggcgtgtggttagacc

SEQ ID NO: 91867 - DNA, 25 bp, Rattus norvegicus
acgtgtgaaaacaccatactctctt

SEQ ID NO: 91868 - DNA, 25 bp, Rattus norvegicus
acgtgtgaaaactccatactctctt

SEQ ID NO: 91869 - DNA, 25 bp, Rattus norvegicus
acgtgtgaccacaggcattcatttg

SEQ ID NO: 91870 - DNA, 25 bp, Rattus norvegicus
acgtgtgaccactggcattcatttg

SEQ ID NO: 91871 - DNA, 25 bp, Rattus norvegicus
acgtgtgacttcagtcccggagaga

SEQ ID NO: 91872 - DNA, 25 bp, Rattus norvegicus
acgtgtgacttctgtcccggagaga

SEQ ID NO: 91873 - DNA, 25 bp, Rattus norvegicus
acgtgtgagcatctgagagatttct

SEQ ID NO: 91874 - DNA, 25 bp, Rattus norvegicus
acgtgtgagcatgtgagagatttct

SEQ ID NO: 91875 - DNA, 25 bp, Rattus norvegicus
acgtgtgaggtccagcttcaatgtt

SEQ ID NO: 91876 - DNA, 25 bp, Rattus norvegicus
acgtgtgaggtcgagcttcaatgtt

SEQ ID NO: 91877 - DNA, 25 bp, Rattus norvegicus
acgtgtgcaaggatctagtggcctc

SEQ ID NO: 91878 - DNA, 25 bp, Rattus norvegicus
acgtgtgcaaggttctagtggcctc

SEQ ID NO: 91879 - DNA, 25 bp, Rattus norvegicus
acgtgtgcactgaggaagtccctaa

SEQ ID NO: 91880 - DNA, 25 bp, Rattus norvegicus
acgtgtgcactgtggaagtccctaa

SEQ ID NO: 91881 - DNA, 25 bp, Rattus norvegicus
acgtgtgcaggaagggctcctctta

SEQ ID NO: 91882 - DNA, 25 bp, Rattus norvegicus
acgtgtgcaggatgggctcctctta

SEQ ID NO: 91883 - DNA, 25 bp, Rattus norvegicus
acgtgtgcgaacagcatgactgagt

SEQ ID NO: 91884 - DNA, 25 bp, Rattus norvegicus
acgtgtgcgaactgcatgactgagt

SEQ ID NO: 91885 - DNA, 25 bp, Rattus norvegicus
acgtgtgcggagctagcgtcttccc

SEQ ID NO: 91886 - DNA, 25 bp, Rattus norvegicus
acgtgtgcggaggtagcgtcttccc

SEQ ID NO: 91887 - DNA, 25 bp, Rattus norvegicus
acgtgtgcgtctacagaaccttaca

SEQ ID NO: 91888 - DNA, 25 bp, Rattus norvegicus
acgtgtgcgtcttcagaaccttaca

SEQ ID NO: 91889 - DNA, 25 bp, Rattus norvegicus
acgtgtgctaggcaaataccaccaa

SEQ ID NO: 91890 - DNA, 25 bp, Rattus norvegicus
acgtgtgctagggaaataccaccaa

SEQ ID NO: 91891 - DNA, 25 bp, Rattus norvegicus
acgtgtgctcccagaagcttaatgt

SEQ ID NO: 91892 - DNA, 25 bp, Rattus norvegicus
acgtgtgctccctgaagcttaatgt

SEQ ID NO: 91893 - DNA, 25 bp, Rattus norvegicus
acgtgtgctcttcacttgcaggttc

SEQ ID NO: 91894 - DNA, 25 bp, Rattus norvegicus
acgtgtgctcttgacttgcaggttc

SEQ ID NO: 91895 - DNA, 25 bp, Rattus norvegicus
acgtgtgctgcaacgtcagacggca

SEQ ID NO: 91896 - DNA, 25 bp, Rattus norvegicus
acgtgtgctgcatcgtcagacggca

SEQ ID NO: 91897 - DNA, 25 bp, Rattus norvegicus
acgtgtgctttgactctgggtggaa

SEQ ID NO: 91898 - DNA, 25 bp, Rattus norvegicus
acgtgtgctttgtctctgggtggaa

SEQ ID NO: 91899 - DNA, 25 bp, Rattus norvegicus
acgtgtggatacacctcattcagtc

SEQ ID NO: 91900 - DNA, 25 bp, Rattus norvegicus
acgtgtggatactcctcattcagtc

SEQ ID NO: 91901 - DNA, 25 bp, Rattus norvegicus
acgtgtggcctccaggtgctttctt

SEQ ID NO: 91902 - DNA, 25 bp, Rattus norvegicus
acgtgtggcctcgaggtgctttctt

SEQ ID NO: 91903 - DNA, 25 bp, Rattus norvegicus
acgtgtggcctgaaggtgcctagct

SEQ ID NO: 91904 - DNA, 25 bp, Rattus norvegicus
acgtgtggcctgtaggtgcctagct

SEQ ID NO: 91905 - DNA, 25 bp, Rattus norvegicus
acgtgtggcgcccagacggtcaaat

SEQ ID NO: 91906 - DNA, 25 bp, Rattus norvegicus
acgtgtggcgccgagacggtcaaat

SEQ ID NO: 91907 - DNA, 25 bp, Rattus norvegicus
acgtgtgtaaatactgccttgctgt

SEQ ID NO: 91908 - DNA, 25 bp, Rattus norvegicus
acgtgtgtaaattctgccttgctgt

SEQ ID NO: 91909 - DNA, 25 bp, Rattus norvegicus
acgtgtgtatgcaggagccccaaag

SEQ ID NO: 91910 - DNA, 25 bp, Rattus norvegicus
acgtgtgtatgctggagccccaaag

SEQ ID NO: 91911 - DNA, 25 bp, Rattus norvegicus
acgtgtgtattaatgcctctatgaa

SEQ ID NO: 91912 - DNA, 25 bp, Rattus norvegicus
acgtgtgtattattgcctctatgaa

SEQ ID NO: 91913 - DNA, 25 bp, Rattus norvegicus
acgtgtgtctagaagccatcggcga

SEQ ID NO: 91914 - DNA, 25 bp, Rattus norvegicus
acgtgtgtctagtagccatcggcga

SEQ ID NO: 91915 - DNA, 25 bp, Rattus norvegicus
acgtgtgtgtatatcctctgtcagg

SEQ ID NO: 91916 - DNA, 25 bp, Rattus norvegicus
acgtgtgtgtatttcctctgtcagg

SEQ ID NO: 91917 - DNA, 25 bp, Rattus norvegicus
acgtgtgtgtcccagatgcctgtgg

SEQ ID NO: 91918 - DNA, 25 bp, Rattus norvegicus
acgtgtgtgtcccagcttgagctct

SEQ ID NO: 91919 - DNA, 25 bp, Rattus norvegicus
acgtgtgtgtccgagatgcctgtgg

SEQ ID NO: 91920 - DNA, 25 bp, Rattus norvegicus
acgtgtgtgtccgagcttgagctct

SEQ ID NO: 91921 - DNA, 25 bp, Rattus norvegicus
acgtgtgttcttattatggtgttca

SEQ ID NO: 91922 - DNA, 25 bp, Rattus norvegicus
acgtgtgttctttttatggtgttca

SEQ ID NO: 91923 - DNA, 25 bp, Rattus norvegicus
acgtgttcacctagccagagcctag

SEQ ID NO: 91924 - DNA, 25 bp, Rattus norvegicus
acgtgttcaccttgccagagcctag

SEQ ID NO: 91925 - DNA, 25 bp, Rattus norvegicus
acgtgttcatgaagggcctgtccat

SEQ ID NO: 91926 - DNA, 25 bp, Rattus norvegicus
acgtgttcatgatgggcctgtccat

SEQ ID NO: 91927 - DNA, 25 bp, Rattus norvegicus
acgtgttcccaacactgagcgtggt

SEQ ID NO: 91928 - DNA, 25 bp, Rattus norvegicus
acgtgttcccaagactgagcgtggt

SEQ ID NO: 91929 - DNA, 25 bp, Rattus norvegicus
acgtgttgaaggctctagggtcata

SEQ ID NO: 91930 - DNA, 25 bp, Rattus norvegicus
acgtgttgaagggtctagggtcata

SEQ ID NO: 91931 - DNA, 25 bp, Rattus norvegicus
acgtgttgacagaagacctccgcat

SEQ ID NO: 91932 - DNA, 25 bp, Rattus norvegicus
acgtgttgacagtagacctccgcat

SEQ ID NO: 91933 - DNA, 25 bp, Rattus norvegicus
acgtgttgactgacgctgtgacaca

SEQ ID NO: 91934 - DNA, 25 bp, Rattus norvegicus
acgtgttgactgtcgctgtgacaca

SEQ ID NO: 91935 - DNA, 25 bp, Rattus norvegicus
acgtgttgctgcacagtcagttcat

SEQ ID NO: 91936 - DNA, 25 bp, Rattus norvegicus
acgtgttgctgctcagtcagttcat

SEQ ID NO: 91937 - DNA, 25 bp, Rattus norvegicus
acgtgttggcccagcaaattggtgg

SEQ ID NO: 91938 - DNA, 25 bp, Rattus norvegicus
acgtgttggccctgcaaattggtgg

SEQ ID NO: 91939 - DNA, 25 bp, Rattus norvegicus
acgtgttgtacaagtggcccttaac

SEQ ID NO: 91940 - DNA, 25 bp, Rattus norvegicus
acgtgttgtacatgtggcccttaac

SEQ ID NO: 91941 - DNA, 25 bp, Rattus norvegicus
acgtgtttagatccagtgtgcatat

SEQ ID NO: 91942 - DNA, 25 bp, Rattus norvegicus
acgtgtttagatgcagtgtgcatat

SEQ ID NO: 91943 - DNA, 25 bp, Rattus norvegicus
acgtgtttcaaacaatgctatactg

SEQ ID NO: 91944 - DNA, 25 bp, Rattus norvegicus
acgtgtttcaaagaatgctatactg

SEQ ID NO: 91945 - DNA, 25 bp, Rattus norvegicus
acgtgtttcacccaagagtgtttca

SEQ ID NO: 91946 - DNA, 25 bp, Rattus norvegicus
acgtgtttcaccgaagagtgtttca

SEQ ID NO: 91947 - DNA, 25 bp, Rattus norvegicus
acgtgtttgtttcctgggtgttaat

SEQ ID NO: 91948 - DNA, 25 bp, Rattus norvegicus
acgtgtttgtttgctgggtgttaat

SEQ ID NO: 91949 - DNA, 25 bp, Rattus norvegicus
acgttaaactaccacgcactgcttt

SEQ ID NO: 91950 - DNA, 25 bp, Rattus norvegicus
acgttaaactacgacgcactgcttt

SEQ ID NO: 91951 - DNA, 25 bp, Rattus norvegicus
acgttaccccttagagatgccaact

SEQ ID NO: 91952 - DNA, 25 bp, Rattus norvegicus
acgttacccctttgagatgccaact

SEQ ID NO: 91953 - DNA, 25 bp, Rattus norvegicus
acgttacctctgagctgattgtgtg

SEQ ID NO: 91954 - DNA, 25 bp, Rattus norvegicus
acgttacctctgtgctgattgtgtg

SEQ ID NO: 91955 - DNA, 25 bp, Rattus norvegicus
acgttactagataagcctcctctgc

SEQ ID NO: 91956 - DNA, 25 bp, Rattus norvegicus
acgttactagattagcctcctctgc

SEQ ID NO: 91957 - DNA, 25 bp, Rattus norvegicus
acgttactgcgtctgctattggatg

SEQ ID NO: 91958 - DNA, 25 bp, Rattus norvegicus
acgttactgcgtgtgctattggatg

SEQ ID NO: 91959 - DNA, 25 bp, Rattus norvegicus
acgttactgtgcctcaaaggtcaca

SEQ ID NO: 91960 - DNA, 25 bp, Rattus norvegicus
acgttactgtgcgtcaaaggtcaca

SEQ ID NO: 91961 - DNA, 25 bp, Rattus norvegicus
acgttactgttgatgacttggtggc

SEQ ID NO: 91962 - DNA, 25 bp, Rattus norvegicus
acgttactgttgttgacttggtggc

SEQ ID NO: 91963 - DNA, 25 bp, Rattus norvegicus
acgttagcagacactggctgttgct

SEQ ID NO: 91964 - DNA, 25 bp, Rattus norvegicus
acgttagcagactctggctgttgct

SEQ ID NO: 91965 - DNA, 25 bp, Rattus norvegicus
acgttatgaagcaccttatgcctaa

SEQ ID NO: 91966 - DNA, 25 bp, Rattus norvegicus
acgttatgaagctccttatgcctaa

SEQ ID NO: 91967 - DNA, 25 bp, Rattus norvegicus
acgttattcacgcattcgcatggtt

SEQ ID NO: 91968 - DNA, 25 bp, Rattus norvegicus
acgttattcacggattcgcatggtt

SEQ ID NO: 91969 - DNA, 25 bp, Rattus norvegicus
acgttcaaattacttcaccatccat

SEQ ID NO: 91970 - DNA, 25 bp, Rattus norvegicus
acgttcaaattagttcaccatccat

SEQ ID NO: 91971 - DNA, 25 bp, Rattus norvegicus
acgttcaaggccagcttggacttca

SEQ ID NO: 91972 - DNA, 25 bp, Rattus norvegicus
acgttcaaggcctgcttggacttca

SEQ ID NO: 91973 - DNA, 25 bp, Rattus norvegicus
acgttcacgcgccacgaggacctgg

SEQ ID NO: 91974 - DNA, 25 bp, Rattus norvegicus
acgttcacgcgcgacgaggacctgg

SEQ ID NO: 91975 - DNA, 25 bp, Rattus norvegicus
acgttcactttgactgttacaggta

SEQ ID NO: 91976 - DNA, 25 bp, Rattus norvegicus
acgttcactttgtctgttacaggta

SEQ ID NO: 91977 - DNA, 25 bp, Rattus norvegicus
acgttcagcttcctgggcaagcgca

SEQ ID NO: 91978 - DNA, 25 bp, Rattus norvegicus
acgttcagcttcgtgggcaagcgca

SEQ ID NO: 91979 - DNA, 25 bp, Rattus norvegicus
acgttcagtgtcatcattgaaatac

SEQ ID NO: 91980 - DNA, 25 bp, Rattus norvegicus
acgttcagtgtcttcattgaaatac

SEQ ID NO: 91981 - DNA, 25 bp, Rattus norvegicus
acgttcagttccagcttttacagga

SEQ ID NO: 91982 - DNA, 25 bp, Rattus norvegicus
acgttcagttcctgcttttacagga

SEQ ID NO: 91983 - DNA, 25 bp, Rattus norvegicus
acgttcagttctcttcctgctatat

SEQ ID NO: 91984 - DNA, 25 bp, Rattus norvegicus
acgttcagttctgttcctgctatat

SEQ ID NO: 91985 - DNA, 25 bp, Rattus norvegicus
acgttcatgcttctgctgcatcact

SEQ ID NO: 91986 - DNA, 25 bp, Rattus norvegicus
acgttcatgcttgtgctgcatcact

SEQ ID NO: 91987 - DNA, 25 bp, Rattus norvegicus
acgttcattccaaaattcagttgca

SEQ ID NO: 91988 - DNA, 25 bp, Rattus norvegicus
acgttcattccataattcagttgca

SEQ ID NO: 91989 - DNA, 25 bp, Rattus norvegicus
acgttccacactattggactctgga

SEQ ID NO: 91990 - DNA, 25 bp, Rattus norvegicus
acgttccacacttttggactctgga

SEQ ID NO: 91991 - DNA, 25 bp, Rattus norvegicus
acgttccacgctatttaattgcagt

SEQ ID NO: 91992 - DNA, 25 bp, Rattus norvegicus
acgttccacgctttttaattgcagt

SEQ ID NO: 91993 - DNA, 25 bp, Rattus norvegicus
acgttccagactcagcctgaggtga

SEQ ID NO: 91994 - DNA, 25 bp, Rattus norvegicus
acgttccagactgagcctgaggtga

SEQ ID NO: 91995 - DNA, 25 bp, Rattus norvegicus
acgttccagctcctttgtgacattt

SEQ ID NO: 91996 - DNA, 25 bp, Rattus norvegicus
acgttccagctcgtttgtgacattt

SEQ ID NO: 91997 - DNA, 25 bp, Rattus norvegicus
acgttcccacgcattgaagttgatt

SEQ ID NO: 91998 - DNA, 25 bp, Rattus norvegicus
acgttcccacgctttgaagttgatt

SEQ ID NO: 91999 - DNA, 25 bp, Rattus norvegicus
acgttccccactaggtgagatgtct

SEQ ID NO: 92000 - DNA, 25 bp, Rattus norvegicus
acgttccccacttggtgagatgtct

SEQ ID NO: 92001 - DNA, 25 bp, Rattus norvegicus
acgttcccgctgagggccatgcaat

SEQ ID NO: 92002 - DNA, 25 bp, Rattus norvegicus
acgttcccgctgtgggccatgcaat

SEQ ID NO: 92003 - DNA, 25 bp, Rattus norvegicus
acgttccctatcatactgtctaaat

SEQ ID NO: 92004 - DNA, 25 bp, Rattus norvegicus
acgttccctatcttactgtctaaat

SEQ ID NO: 92005 - DNA, 25 bp, Rattus norvegicus
acgttcctatggcaacatgcacagt

SEQ ID NO: 92006 - DNA, 25 bp, Rattus norvegicus
acgttcctatgggaacatgcacagt

SEQ ID NO: 92007 - DNA, 25 bp, Rattus norvegicus
acgttcctctatacggtgatggcac

SEQ ID NO: 92008 - DNA, 25 bp, Rattus norvegicus
acgttcctctattcggtgatggcac

SEQ ID NO: 92009 - DNA, 25 bp, Rattus norvegicus
acgttccttctgagggcgatgtcct

SEQ ID NO: 92010 - DNA, 25 bp, Rattus norvegicus
acgttccttctgtgggcgatgtcct

SEQ ID NO: 92011 - DNA, 25 bp, Rattus norvegicus
acgttcgatcttccatggagcaatc

SEQ ID NO: 92012 - DNA, 25 bp, Rattus norvegicus
acgttcgatcttgcatggagcaatc

SEQ ID NO: 92013 - DNA, 25 bp, Rattus norvegicus
acgttcgccgcaaagggattctgca

SEQ ID NO: 92014 - DNA, 25 bp, Rattus norvegicus
acgttcgccgcatagggattctgca

SEQ ID NO: 92015 - DNA, 25 bp, Rattus norvegicus
acgttcgcttccagtgaatcttttc

SEQ ID NO: 92016 - DNA, 25 bp, Rattus norvegicus
acgttcgcttcctgtgaatcttttc

SEQ ID NO: 92017 - DNA, 25 bp, Rattus norvegicus
acgttcgtcctgctacagtgagggt

SEQ ID NO: 92018 - DNA, 25 bp, Rattus norvegicus
acgttcgtcctggtacagtgagggt

SEQ ID NO: 92019 - DNA, 25 bp, Rattus norvegicus
acgttctacacgcagctggtgctga

SEQ ID NO: 92020 - DNA, 25 bp, Rattus norvegicus
acgttctacacggagctggtgctga

SEQ ID NO: 92021 - DNA, 25 bp, Rattus norvegicus
acgttctcaagtaatgcggctgcag

SEQ ID NO: 92022 - DNA, 25 bp, Rattus norvegicus
acgttctcaagttatgcggctgcag

SEQ ID NO: 92023 - DNA, 25 bp, Rattus norvegicus
acgttctcagagatatcagccctgc

SEQ ID NO: 92024 - DNA, 25 bp, Rattus norvegicus
acgttctcagagcttatgctatact

SEQ ID NO: 92025 - DNA, 25 bp, Rattus norvegicus
acgttctcagaggttatgctatact

SEQ ID NO: 92026 - DNA, 25 bp, Rattus norvegicus
acgttctcagagttatcagccctgc

SEQ ID NO: 92027 - DNA, 25 bp, Rattus norvegicus
acgttctcagctcggactctggtca

SEQ ID NO: 92028 - DNA, 25 bp, Rattus norvegicus
acgttctcagctgggactctggtca

SEQ ID NO: 92029 - DNA, 25 bp, Rattus norvegicus
acgttctcaggtcctagtctaaggg

SEQ ID NO: 92030 - DNA, 25 bp, Rattus norvegicus
acgttctcaggtgctagtctaaggg

SEQ ID NO: 92031 - DNA, 25 bp, Rattus norvegicus
acgttctcccttcaagaaggtgctt

SEQ ID NO: 92032 - DNA, 25 bp, Rattus norvegicus
acgttctcccttgaagaaggtgctt

SEQ ID NO: 92033 - DNA, 25 bp, Rattus norvegicus
acgttctccgccagatcttgaaatg

SEQ ID NO: 92034 - DNA, 25 bp, Rattus norvegicus
acgttctccgcctgatcttgaaatg

SEQ ID NO: 92035 - DNA, 25 bp, Rattus norvegicus
acgttctgactactggtggcaaatc

SEQ ID NO: 92036 - DNA, 25 bp, Rattus norvegicus
acgttctgactagtggtggcaaatc

SEQ ID NO: 92037 - DNA, 25 bp, Rattus norvegicus
acgttctgaggaagctgggcagccc

SEQ ID NO: 92038 - DNA, 25 bp, Rattus norvegicus
acgttctgaggatgctgggcagccc

SEQ ID NO: 92039 - DNA, 25 bp, Rattus norvegicus
acgttctgatctctttgtgttccac

SEQ ID NO: 92040 - DNA, 25 bp, Rattus norvegicus
acgttctgatctgtttgtgttccac

SEQ ID NO: 92041 - DNA, 25 bp, Rattus norvegicus
acgttctggcttagcatgaagtgct

SEQ ID NO: 92042 - DNA, 25 bp, Rattus norvegicus
acgttctggctttgcatgaagtgct

SEQ ID NO: 92043 - DNA, 25 bp, Rattus norvegicus
acgttcttaatacccactgtcaagc

SEQ ID NO: 92044 - DNA, 25 bp, Rattus norvegicus
acgttcttaatagccactgtcaagc

SEQ ID NO: 92045 - DNA, 25 bp, Rattus norvegicus
acgttcttaccactctcggagagaa

SEQ ID NO: 92046 - DNA, 25 bp, Rattus norvegicus
acgttcttaccagtctcggagagaa

SEQ ID NO: 92047 - DNA, 25 bp, Rattus norvegicus
acgttcttcttactaccatccatga

SEQ ID NO: 92048 - DNA, 25 bp, Rattus norvegicus
acgttcttcttagtaccatccatga

SEQ ID NO: 92049 - DNA, 25 bp, Rattus norvegicus
acgttctttctaagttgtggtcaag

SEQ ID NO: 92050 - DNA, 25 bp, Rattus norvegicus
acgttctttctatgttgtggtcaag

SEQ ID NO: 92051 - DNA, 25 bp, Rattus norvegicus
acgttctttgtcactgtcctgtata

SEQ ID NO: 92052 - DNA, 25 bp, Rattus norvegicus
acgttctttgtctctgtcctgtata

SEQ ID NO: 92053 - DNA, 25 bp, Rattus norvegicus
acgttgaaagtgacctgcagcagcg

SEQ ID NO: 92054 - DNA, 25 bp, Rattus norvegicus
acgttgaaagtgtcctgcagcagcg

SEQ ID NO: 92055 - DNA, 25 bp, Rattus norvegicus
acgttgaatgtgaacctggcctctg

SEQ ID NO: 92056 - DNA, 25 bp, Rattus norvegicus
acgttgaatgtgtacctggcctctg

SEQ ID NO: 92057 - DNA, 25 bp, Rattus norvegicus
acgttgactgtacagcaggctggac

SEQ ID NO: 92058 - DNA, 25 bp, Rattus norvegicus
acgttgactgtagagcaggctggac

SEQ ID NO: 92059 - DNA, 25 bp, Rattus norvegicus
acgttgatagtcagctggcctcata

SEQ ID NO: 92060 - DNA, 25 bp, Rattus norvegicus
acgttgatagtctgctggcctcata

SEQ ID NO: 92061 - DNA, 25 bp, Rattus norvegicus
acgttgattctacttctggacctct

SEQ ID NO: 92062 - DNA, 25 bp, Rattus norvegicus
acgttgattctagttctggacctct

SEQ ID NO: 92063 - DNA, 25 bp, Rattus norvegicus
acgttgcaacatattccttcagata

SEQ ID NO: 92064 - DNA, 25 bp, Rattus norvegicus
acgttgcaacattttccttcagata

SEQ ID NO: 92065 - DNA, 25 bp, Rattus norvegicus
acgttgcccgtcaagtggccattca

SEQ ID NO: 92066 - DNA, 25 bp, Rattus norvegicus
acgttgcccgtctagtggccattca

SEQ ID NO: 92067 - DNA, 25 bp, Rattus norvegicus
acgttgcctggtatgttagtgagct

SEQ ID NO: 92068 - DNA, 25 bp, Rattus norvegicus
acgttgcctggtttgttagtgagct

SEQ ID NO: 92069 - DNA, 25 bp, Rattus norvegicus
acgttgctggttctcattttgcagt

SEQ ID NO: 92070 - DNA, 25 bp, Rattus norvegicus
acgttgctggttgtcattttgcagt

SEQ ID NO: 92071 - DNA, 25 bp, Rattus norvegicus
acgttgctttaaaatacaggcccaa

SEQ ID NO: 92072 - DNA, 25 bp, Rattus norvegicus
acgttgctttaatatacaggcccaa

SEQ ID NO: 92073 - DNA, 25 bp, Rattus norvegicus
acgttgctttggatcatacagggat

SEQ ID NO: 92074 - DNA, 25 bp, Rattus norvegicus
acgttgctttggttcatacagggat

SEQ ID NO: 92075 - DNA, 25 bp, Rattus norvegicus
acgttggaatcacaggtcagcgccc

SEQ ID NO: 92076 - DNA, 25 bp, Rattus norvegicus
acgttggaatcagaggtcagcgccc

SEQ ID NO: 92077 - DNA, 25 bp, Rattus norvegicus
acgttggccaagagcttctgtagat

SEQ ID NO: 92078 - DNA, 25 bp, Rattus norvegicus
acgttggccaagtgcttctgtagat

SEQ ID NO: 92079 - DNA, 25 bp, Rattus norvegicus
acgttgggccttcttcatctttgaa

SEQ ID NO: 92080 - DNA, 25 bp, Rattus norvegicus
acgttgggccttgttcatctttgaa

SEQ ID NO: 92081 - DNA, 25 bp, Rattus norvegicus
acgttggtattgctactgggccaca

SEQ ID NO: 92082 - DNA, 25 bp, Rattus norvegicus
acgttggtattggtactgggccaca

SEQ ID NO: 92083 - DNA, 25 bp, Rattus norvegicus
acgttggtcacgagatggcacagat

SEQ ID NO: 92084 - DNA, 25 bp, Rattus norvegicus
acgttggtcacgtgatggcacagat

SEQ ID NO: 92085 - DNA, 25 bp, Rattus norvegicus
acgttgtaaaccactcctatttcag

SEQ ID NO: 92086 - DNA, 25 bp, Rattus norvegicus
acgttgtaaacctctcctatttcag

SEQ ID NO: 92087 - DNA, 25 bp, Rattus norvegicus
acgttgtcccgaagcaggatgcctt

SEQ ID NO: 92088 - DNA, 25 bp, Rattus norvegicus
acgttgtcccgatgcaggatgcctt

SEQ ID NO: 92089 - DNA, 25 bp, Rattus norvegicus
acgttgtccttgagaaacttttgtg

SEQ ID NO: 92090 - DNA, 25 bp, Rattus norvegicus
acgttgtccttgtgaaacttttgtg

SEQ ID NO: 92091 - DNA, 25 bp, Rattus norvegicus
acgttgtcgcaccttgggtccaaca

SEQ ID NO: 92092 - DNA, 25 bp, Rattus norvegicus
acgttgtcgcacgttgggtccaaca

SEQ ID NO: 92093 - DNA, 25 bp, Rattus norvegicus
acgttgtgcagtcctaggtctgatg

SEQ ID NO: 92094 - DNA, 25 bp, Rattus norvegicus
acgttgtgcagtgctaggtctgatg

SEQ ID NO: 92095 - DNA, 25 bp, Rattus norvegicus
acgtttaaccagctagtgagaccat

SEQ ID NO: 92096 - DNA, 25 bp, Rattus norvegicus
acgtttaaccaggtagtgagaccat

SEQ ID NO: 92097 - DNA, 25 bp, Rattus norvegicus
acgtttaaggtcaaggtagctgcca

SEQ ID NO: 92098 - DNA, 25 bp, Rattus norvegicus
acgtttaaggtctaggtagctgcca

SEQ ID NO: 92099 - DNA, 25 bp, Rattus norvegicus
acgtttaattgccacactgcagctg

SEQ ID NO: 92100 - DNA, 25 bp, Rattus norvegicus
acgtttaattgcgacactgcagctg

SEQ ID NO: 92101 - DNA, 25 bp, Rattus norvegicus
acgtttacacctatgccagtgtcgc

SEQ ID NO: 92102 - DNA, 25 bp, Rattus norvegicus
acgtttacacctttgccagtgtcgc

SEQ ID NO: 92103 - DNA, 25 bp, Rattus norvegicus
acgtttacattcaatccaagccttt

SEQ ID NO: 92104 - DNA, 25 bp, Rattus norvegicus
acgtttacattctatccaagccttt

SEQ ID NO: 92105 - DNA, 25 bp, Rattus norvegicus
acgtttagcgtcacttgtcttaatg

SEQ ID NO: 92106 - DNA, 25 bp, Rattus norvegicus
acgtttagcgtctcttgtcttaatg

SEQ ID NO: 92107 - DNA, 25 bp, Rattus norvegicus
acgtttccagtcacgggccaggaga

SEQ ID NO: 92108 - DNA, 25 bp, Rattus norvegicus
acgtttccagtctcgggccaggaga

SEQ ID NO: 92109 - DNA, 25 bp, Rattus norvegicus
acgtttccggccaatggacaatttg

SEQ ID NO: 92110 - DNA, 25 bp, Rattus norvegicus
acgtttccggcctatggacaatttg

SEQ ID NO: 92111 - DNA, 25 bp, Rattus norvegicus
acgtttcgaagacgctcggaaggca

SEQ ID NO: 92112 - DNA, 25 bp, Rattus norvegicus
acgtttcgaagaggctcggaaggca

SEQ ID NO: 92113 - DNA, 25 bp, Rattus norvegicus
acgtttcgctgccttgttggcagaa

SEQ ID NO: 92114 - DNA, 25 bp, Rattus norvegicus
acgtttcgctgcgttgttggcagaa

SEQ ID NO: 92115 - DNA, 25 bp, Rattus norvegicus
acgtttcgttctcactgtgatctga

SEQ ID NO: 92116 - DNA, 25 bp, Rattus norvegicus
acgtttcgttctctgaggacaccat

SEQ ID NO: 92117 - DNA, 25 bp, Rattus norvegicus
acgtttcgttctgactgtgatctga

SEQ ID NO: 92118 - DNA, 25 bp, Rattus norvegicus
acgtttcgttctgtgaggacaccat

SEQ ID NO: 92119 - DNA, 25 bp, Rattus norvegicus
acgtttctacagagctcagcacgat

SEQ ID NO: 92120 - DNA, 25 bp, Rattus norvegicus
acgtttctacagtgctcagcacgat

SEQ ID NO: 92121 - DNA, 25 bp, Rattus norvegicus
acgtttctggtgcacttactctggc

SEQ ID NO: 92122 - DNA, 25 bp, Rattus norvegicus
acgtttctggtggacttactctggc

SEQ ID NO: 92123 - DNA, 25 bp, Rattus norvegicus
acgtttcttcacaaacatcccaata

SEQ ID NO: 92124 - DNA, 25 bp, Rattus norvegicus
acgtttcttcactaacatcccaata

SEQ ID NO: 92125 - DNA, 25 bp, Rattus norvegicus
acgtttgaggccagtgaggcgctac

SEQ ID NO: 92126 - DNA, 25 bp, Rattus norvegicus
acgtttgaggcctgtgaggcgctac

SEQ ID NO: 92127 - DNA, 25 bp, Rattus norvegicus
acgtttgctgatagtgggccataaa

SEQ ID NO: 92128 - DNA, 25 bp, Rattus norvegicus
acgtttgctgattgtgggccataaa

SEQ ID NO: 92129 - DNA, 25 bp, Rattus norvegicus
acgtttgtccgacatgcctagatgc

SEQ ID NO: 92130 - DNA, 25 bp, Rattus norvegicus
acgtttgtccgagatgcctagatgc

SEQ ID NO: 92131 - DNA, 25 bp, Rattus norvegicus
acgtttgtctcgattcgcaatacag

SEQ ID NO: 92132 - DNA, 25 bp, Rattus norvegicus
acgtttgtctcgtttcgcaatacag

SEQ ID NO: 92133 - DNA, 25 bp, Rattus norvegicus
acgtttgtctgaagtcagcagtccc

SEQ ID NO: 92134 - DNA, 25 bp, Rattus norvegicus
acgtttgtctgatgtcagcagtccc

SEQ ID NO: 92135 - DNA, 25 bp, Rattus norvegicus
acgtttgtctttcccatgtttattg

SEQ ID NO: 92136 - DNA, 25 bp, Rattus norvegicus
acgtttgtctttgccatgtttattg

SEQ ID NO: 92137 - DNA, 25 bp, Rattus norvegicus
acgtttgttgtcagtcagtgtctcc

SEQ ID NO: 92138 - DNA, 25 bp, Rattus norvegicus
acgtttgttgtctgtcagtgtctcc

SEQ ID NO: 92139 - DNA, 25 bp, Rattus norvegicus
acgttttacctactaactcagcaag

SEQ ID NO: 92140 - DNA, 25 bp, Rattus norvegicus
acgttttacctagtaactcagcaag

SEQ ID NO: 92141 - DNA, 25 bp, Rattus norvegicus
acgttttagtatccagtgttcaaga

SEQ ID NO: 92142 - DNA, 25 bp, Rattus norvegicus
acgttttagtatgcagtgttcaaga

SEQ ID NO: 92143 - DNA, 25 bp, Rattus norvegicus
acgttttcattacccactctcaaga

SEQ ID NO: 92144 - DNA, 25 bp, Rattus norvegicus
acgttttcattagccactctcaaga

SEQ ID NO: 92145 - DNA, 25 bp, Rattus norvegicus
acgttttcccacaaacatgacagca

SEQ ID NO: 92146 - DNA, 25 bp, Rattus norvegicus
acgttttcccactaacatgacagca

SEQ ID NO: 92147 - DNA, 25 bp, Rattus norvegicus
acgttttccttactgatggtcacca

SEQ ID NO: 92148 - DNA, 25 bp, Rattus norvegicus
acgttttccttagtgatggtcacca

SEQ ID NO: 92149 - DNA, 25 bp, Rattus norvegicus
acgttttctgatctggagggtcctc

SEQ ID NO: 92150 - DNA, 25 bp, Rattus norvegicus
acgttttctgatgtggagggtcctc

SEQ ID NO: 92151 - DNA, 25 bp, Rattus norvegicus
acgttttctgttactcctgatggtg

SEQ ID NO: 92152 - DNA, 25 bp, Rattus norvegicus
acgttttctgtttctcctgatggtg

SEQ ID NO: 92153 - DNA, 25 bp, Rattus norvegicus
acgttttgcacaccctggacacagg

SEQ ID NO: 92154 - DNA, 25 bp, Rattus norvegicus
acgttttgcacagcctggacacagg

SEQ ID NO: 92155 - DNA, 25 bp, Rattus norvegicus
acgttttgtcacaatctcatgatgt

SEQ ID NO: 92156 - DNA, 25 bp, Rattus norvegicus
acgttttgtcactatctcatgatgt

SEQ ID NO: 92157 - DNA, 25 bp, Rattus norvegicus
acgttttgttggcatactcccttca

SEQ ID NO: 92158 - DNA, 25 bp, Rattus norvegicus
acgttttgttgggatactcccttca

SEQ ID NO: 92159 - DNA, 25 bp, Rattus norvegicus
acgtttttacggacatgtcctgcta

SEQ ID NO: 92160 - DNA, 25 bp, Rattus norvegicus
acgtttttacggtcatgtcctgcta

SEQ ID NO: 92161 - DNA, 25 bp, Rattus norvegicus
acgtttttacgtcgcagatatctgt

SEQ ID NO: 92162 - DNA, 25 bp, Rattus norvegicus
acgtttttacgtggcagatatctgt

SEQ ID NO: 92163 - DNA, 25 bp, Rattus norvegicus
acgtttttcacgattgctcttcaaa

SEQ ID NO: 92164 - DNA, 25 bp, Rattus norvegicus
acgtttttcacgtttgctcttcaaa

SEQ ID NO: 92165 - DNA, 25 bp, Rattus norvegicus
actaaaaccagtacactagagacct

SEQ ID NO: 92166 - DNA, 25 bp, Rattus norvegicus
actaaaaccagttcactagagacct

SEQ ID NO: 92167 - DNA, 25 bp, Rattus norvegicus
actaaaagatctcgcccgagagcta

SEQ ID NO: 92168 - DNA, 25 bp, Rattus norvegicus
actaaaagatctggcccgagagcta

SEQ ID NO: 92169 - DNA, 25 bp, Rattus norvegicus
actaaaatgtggagacacgtggtcc

SEQ ID NO: 92170 - DNA, 25 bp, Rattus norvegicus
actaaaatgtggtgacacgtggtcc

SEQ ID NO: 92171 - DNA, 25 bp, Rattus norvegicus
actaaacagcctaaaccgttcatgc

SEQ ID NO: 92172 - DNA, 25 bp, Rattus norvegicus
actaaacagccttaaccgttcatgc

SEQ ID NO: 92173 - DNA, 25 bp, Rattus norvegicus
actaaaccgagaccccggcttagca

SEQ ID NO: 92174 - DNA, 25 bp, Rattus norvegicus
actaaaccgagagcccggcttagca

SEQ ID NO: 92175 - DNA, 25 bp, Rattus norvegicus
actaaacctacaagagcgctggaaa

SEQ ID NO: 92176 - DNA, 25 bp, Rattus norvegicus
actaaacctacatgagcgctggaaa

SEQ ID NO: 92177 - DNA, 25 bp, Rattus norvegicus
actaaacctgtgaaccagacagtct

SEQ ID NO: 92178 - DNA, 25 bp, Rattus norvegicus
actaaacctgtgtaccagacagtct

SEQ ID NO: 92179 - DNA, 25 bp, Rattus norvegicus
actaaacgcatgatcttggatccat

SEQ ID NO: 92180 - DNA, 25 bp, Rattus norvegicus
actaaacgcatgttcttggatccat

SEQ ID NO: 92181 - DNA, 25 bp, Rattus norvegicus
actaaactacagacctggacctggg

SEQ ID NO: 92182 - DNA, 25 bp, Rattus norvegicus
actaaactacagtcctggacctggg

SEQ ID NO: 92183 - DNA, 25 bp, Rattus norvegicus
actaaactgaagaccctacatctgc

SEQ ID NO: 92184 - DNA, 25 bp, Rattus norvegicus
actaaactgaagtccctacatctgc

SEQ ID NO: 92185 - DNA, 25 bp, Rattus norvegicus
actaaactgtctcttcaccacatgt

SEQ ID NO: 92186 - DNA, 25 bp, Rattus norvegicus
actaaactgtctgttcaccacatgt

SEQ ID NO: 92187 - DNA, 25 bp, Rattus norvegicus
actaaactgttaaccaggctggtct

SEQ ID NO: 92188 - DNA, 25 bp, Rattus norvegicus
actaaactgttatccaggctggtct

SEQ ID NO: 92189 - DNA, 25 bp, Rattus norvegicus
actaaacttgctagcttgcctaaca

SEQ ID NO: 92190 - DNA, 25 bp, Rattus norvegicus
actaaacttgcttgcttgcctaaca

SEQ ID NO: 92191 - DNA, 25 bp, Rattus norvegicus
actaaagcagtccttccagcattaa

SEQ ID NO: 92192 - DNA, 25 bp, Rattus norvegicus
actaaagcagtcgttccagcattaa

SEQ ID NO: 92193 - DNA, 25 bp, Rattus norvegicus
actaaagcagttcacattgtttctc

SEQ ID NO: 92194 - DNA, 25 bp, Rattus norvegicus
actaaagcagttgacattgtttctc

SEQ ID NO: 92195 - DNA, 25 bp, Rattus norvegicus
actaaagcctctcgttttcgtatga

SEQ ID NO: 92196 - DNA, 25 bp, Rattus norvegicus
actaaagcctctggttttcgtatga

SEQ ID NO: 92197 - DNA, 25 bp, Rattus norvegicus
actaaagcttccctaactgatgaaa

SEQ ID NO: 92198 - DNA, 25 bp, Rattus norvegicus
actaaagcttccgtaactgatgaaa

SEQ ID NO: 92199 - DNA, 25 bp, Rattus norvegicus
actaaaggacctcttgctgctggaa

SEQ ID NO: 92200 - DNA, 25 bp, Rattus norvegicus
actaaaggacctgttgctgctggaa

SEQ ID NO: 92201 - DNA, 25 bp, Rattus norvegicus
actaaagtgactcttcatgggcctc

SEQ ID NO: 92202 - DNA, 25 bp, Rattus norvegicus
actaaagtgactgttcatgggcctc

SEQ ID NO: 92203 - DNA, 25 bp, Rattus norvegicus
actaaagtgtatctgttatcccaac

SEQ ID NO: 92204 - DNA, 25 bp, Rattus norvegicus
actaaagtgtatgtgttatcccaac

SEQ ID NO: 92205 - DNA, 25 bp, Rattus norvegicus
actaaatgctttacttggataccag

SEQ ID NO: 92206 - DNA, 25 bp, Rattus norvegicus
actaaatgcttttcttggataccag

SEQ ID NO: 92207 - DNA, 25 bp, Rattus norvegicus
actaaatggtaaccctgggtgctgc

SEQ ID NO: 92208 - DNA, 25 bp, Rattus norvegicus
actaaatggtaagcctgggtgctgc

SEQ ID NO: 92209 - DNA, 25 bp, Rattus norvegicus
actaaattgaaccagccagctagag

SEQ ID NO: 92210 - DNA, 25 bp, Rattus norvegicus
actaaattgaacgagccagctagag

SEQ ID NO: 92211 - DNA, 25 bp, Rattus norvegicus
actaaattgctaaccgcaggtcctt

SEQ ID NO: 92212 - DNA, 25 bp, Rattus norvegicus
actaaattgctatccgcaggtcctt

SEQ ID NO: 92213 - DNA, 25 bp, Rattus norvegicus
actaaatttgagaaggtcaggccag

SEQ ID NO: 92214 - DNA, 25 bp, Rattus norvegicus
actaaatttgagtaggtcaggccag

SEQ ID NO: 92215 - DNA, 25 bp, Rattus norvegicus
actaacaaggagctggcctgcctga

SEQ ID NO: 92216 - DNA, 25 bp, Rattus norvegicus
actaacaaggaggtggcctgcctga

SEQ ID NO: 92217 - DNA, 25 bp, Rattus norvegicus
actaacagcataactctcagcttcc

SEQ ID NO: 92218 - DNA, 25 bp, Rattus norvegicus
actaacagcatatctctcagcttcc

SEQ ID NO: 92219 - DNA, 25 bp, Rattus norvegicus
actaacagcctcagcacgtcagata

SEQ ID NO: 92220 - DNA, 25 bp, Rattus norvegicus
actaacagcctctgcacgtcagata

SEQ ID NO: 92221 - DNA, 25 bp, Rattus norvegicus
actaacagcgtcctcgtggaggaac

SEQ ID NO: 92222 - DNA, 25 bp, Rattus norvegicus
actaacagcgtcgtcgtggaggaac

SEQ ID NO: 92223 - DNA, 25 bp, Rattus norvegicus
actaacaggcttacgtggtgtcttc

SEQ ID NO: 92224 - DNA, 25 bp, Rattus norvegicus
actaacaggctttcgtggtgtcttc

SEQ ID NO: 92225 - DNA, 25 bp, Rattus norvegicus
actaacagtaatactctcttcagag

SEQ ID NO: 92226 - DNA, 25 bp, Rattus norvegicus
actaacagtaattctctcttcagag

SEQ ID NO: 92227 - DNA, 25 bp, Rattus norvegicus
actaacatttccagtgctagtggta

SEQ ID NO: 92228 - DNA, 25 bp, Rattus norvegicus
actaacatttcctgtgctagtggta

SEQ ID NO: 92229 - DNA, 25 bp, Rattus norvegicus
actaaccatccgctcaaatgaggat

SEQ ID NO: 92230 - DNA, 25 bp, Rattus norvegicus
actaaccatccggtcaaatgaggat

SEQ ID NO: 92231 - DNA, 25 bp, Rattus norvegicus
actaacctcaggagaagagaagcct

SEQ ID NO: 92232 - DNA, 25 bp, Rattus norvegicus
actaacctcaggtgaagagaagcct

SEQ ID NO: 92233 - DNA, 25 bp, Rattus norvegicus
actaacctgagcaacaggagccctg

SEQ ID NO: 92234 - DNA, 25 bp, Rattus norvegicus
actaacctgagctacaggagccctg

SEQ ID NO: 92235 - DNA, 25 bp, Rattus norvegicus
actaacctggacaactggagttctc

SEQ ID NO: 92236 - DNA, 25 bp, Rattus norvegicus
actaacctggactactggagttctc

SEQ ID NO: 92237 - DNA, 25 bp, Rattus norvegicus
actaacctgggcagtatctaataaa

SEQ ID NO: 92238 - DNA, 25 bp, Rattus norvegicus
actaacctgggctgtatctaataaa

SEQ ID NO: 92239 - DNA, 25 bp, Rattus norvegicus
actaacggacaaccttctcatcttc

SEQ ID NO: 92240 - DNA, 25 bp, Rattus norvegicus
actaacggacaagcttctcatcttc

SEQ ID NO: 92241 - DNA, 25 bp, Rattus norvegicus
actaacggctgtcctgtgcgtttgc

SEQ ID NO: 92242 - DNA, 25 bp, Rattus norvegicus
actaacggctgtgctgtgcgtttgc

SEQ ID NO: 92243 - DNA, 25 bp, Rattus norvegicus
actaacgtcaggctttcctggtgtt

SEQ ID NO: 92244 - DNA, 25 bp, Rattus norvegicus
actaacgtcagggtttcctggtgtt

SEQ ID NO: 92245 - DNA, 25 bp, Rattus norvegicus
actaactagctcactgtgacagtgg

SEQ ID NO: 92246 - DNA, 25 bp, Rattus norvegicus
actaactagctctctgtgacagtgg

SEQ ID NO: 92247 - DNA, 25 bp, Rattus norvegicus
actaactattctcctaacgtctttg

SEQ ID NO: 92248 - DNA, 25 bp, Rattus norvegicus
actaactattctgctaacgtctttg

SEQ ID NO: 92249 - DNA, 25 bp, Rattus norvegicus
actaactcccatcctgaggtaacag

SEQ ID NO: 92250 - DNA, 25 bp, Rattus norvegicus
actaactcccatgctgaggtaacag

SEQ ID NO: 92251 - DNA, 25 bp, Rattus norvegicus
actaactgaagtactggctactgat

SEQ ID NO: 92252 - DNA, 25 bp, Rattus norvegicus
actaactgaagttctggctactgat

SEQ ID NO: 92253 - DNA, 25 bp, Rattus norvegicus
actaactgacctattttctgtgaac

SEQ ID NO: 92254 - DNA, 25 bp, Rattus norvegicus
actaactgaccttttttctgtgaac

SEQ ID NO: 92255 - DNA, 25 bp, Rattus norvegicus
actaactgtgttctgtacgctgctg

SEQ ID NO: 92256 - DNA, 25 bp, Rattus norvegicus
actaactgtgttgtgtacgctgctg

SEQ ID NO: 92257 - DNA, 25 bp, Rattus norvegicus
actaacttagttagccttcattcct

SEQ ID NO: 92258 - DNA, 25 bp, Rattus norvegicus
actaacttagtttgccttcattcct

SEQ ID NO: 92259 - DNA, 25 bp, Rattus norvegicus
actaacttctaaagcacttcttgaa

SEQ ID NO: 92260 - DNA, 25 bp, Rattus norvegicus
actaacttctaatgcacttcttgaa

SEQ ID NO: 92261 - DNA, 25 bp, Rattus norvegicus
actaacttctacatagagtctgaga

SEQ ID NO: 92262 - DNA, 25 bp, Rattus norvegicus
actaacttctacttagagtctgaga

SEQ ID NO: 92263 - DNA, 25 bp, Rattus norvegicus
actaactttctaacattgtcttcaa

SEQ ID NO: 92264 - DNA, 25 bp, Rattus norvegicus
actaactttctatcattgtcttcaa

SEQ ID NO: 92265 - DNA, 25 bp, Rattus norvegicus
actaactttttaatcatgcacttca

SEQ ID NO: 92266 - DNA, 25 bp, Rattus norvegicus
actaactttttattcatgcacttca

SEQ ID NO: 92267 - DNA, 25 bp, Rattus norvegicus
actaagaaaagtcctccctgggagg

SEQ ID NO: 92268 - DNA, 25 bp, Rattus norvegicus
actaagaaaagtgctccctgggagg

SEQ ID NO: 92269 - DNA, 25 bp, Rattus norvegicus
actaagaattaccagctccagtttg

SEQ ID NO: 92270 - DNA, 25 bp, Rattus norvegicus
actaagaattacgagctccagtttg

SEQ ID NO: 92271 - DNA, 25 bp, Rattus norvegicus
actaagagacatcgctgggaccgac

SEQ ID NO: 92272 - DNA, 25 bp, Rattus norvegicus
actaagagacatggctgggaccgac

SEQ ID NO: 92273 - DNA, 25 bp, Rattus norvegicus
actaagagaccacaatgcctacgtg

SEQ ID NO: 92274 - DNA, 25 bp, Rattus norvegicus
actaagagaccagaatgcctacgtg

SEQ ID NO: 92275 - DNA, 25 bp, Rattus norvegicus
actaagagccttatgtccctgattt

SEQ ID NO: 92276 - DNA, 25 bp, Rattus norvegicus
actaagagccttatgtctgttccct

SEQ ID NO: 92277 - DNA, 25 bp, Rattus norvegicus
actaagagccttttgtccctgattt

SEQ ID NO: 92278 - DNA, 25 bp, Rattus norvegicus
actaagagccttttgtctgttccct

SEQ ID NO: 92279 - DNA, 25 bp, Rattus norvegicus
actaagagcgccacccaggtagttt

SEQ ID NO: 92280 - DNA, 25 bp, Rattus norvegicus
actaagagcgcctcccaggtagttt

SEQ ID NO: 92281 - DNA, 25 bp, Rattus norvegicus
actaagagtgacaggcttctcggaa

SEQ ID NO: 92282 - DNA, 25 bp, Rattus norvegicus
actaagagtgactggcttctcggaa

SEQ ID NO: 92283 - DNA, 25 bp, Rattus norvegicus
actaagatcagccagccctcaactg

SEQ ID NO: 92284 - DNA, 25 bp, Rattus norvegicus
actaagatcagcgagccctcaactg

SEQ ID NO: 92285 - DNA, 25 bp, Rattus norvegicus
actaagatgcttagttctgctcacc

SEQ ID NO: 92286 - DNA, 25 bp, Rattus norvegicus
actaagatgctttgttctgctcacc

SEQ ID NO: 92287 - DNA, 25 bp, Rattus norvegicus
actaagatgtatcctattccctatg

SEQ ID NO: 92288 - DNA, 25 bp, Rattus norvegicus
actaagatgtatgctattccctatg

SEQ ID NO: 92289 - DNA, 25 bp, Rattus norvegicus
actaagcacatgaccccactttgta

SEQ ID NO: 92290 - DNA, 25 bp, Rattus norvegicus
actaagcacatgtccccactttgta

SEQ ID NO: 92291 - DNA, 25 bp, Rattus norvegicus
actaagcatttgaatctggattccc

SEQ ID NO: 92292 - DNA, 25 bp, Rattus norvegicus
actaagcatttgtatctggattccc

SEQ ID NO: 92293 - DNA, 25 bp, Rattus norvegicus
actaagccatccactgtgcttccaa

SEQ ID NO: 92294 - DNA, 25 bp, Rattus norvegicus
actaagccatcctctgtgcttccaa

SEQ ID NO: 92295 - DNA, 25 bp, Rattus norvegicus
actaagcgtgtaactgctttcgcct

SEQ ID NO: 92296 - DNA, 25 bp, Rattus norvegicus
actaagcgtgtatctgctttcgcct

SEQ ID NO: 92297 - DNA, 25 bp, Rattus norvegicus
actaagctggatctgtgtccttttc

SEQ ID NO: 92298 - DNA, 25 bp, Rattus norvegicus
actaagctggatgtgtgtccttttc

SEQ ID NO: 92299 - DNA, 25 bp, Rattus norvegicus
actaagctgtgcactttgcatatgg

SEQ ID NO: 92300 - DNA, 25 bp, Rattus norvegicus
actaagctgtgctctttgcatatgg

SEQ ID NO: 92301 - DNA, 25 bp, Rattus norvegicus
actaagcttcacatgtcttggaaag

SEQ ID NO: 92302 - DNA, 25 bp, Rattus norvegicus
actaagcttcacttgtcttggaaag

SEQ ID NO: 92303 - DNA, 25 bp, Rattus norvegicus
actaagcttggtctctggcactgtt

SEQ ID NO: 92304 - DNA, 25 bp, Rattus norvegicus
actaagcttggtgtctggcactgtt

SEQ ID NO: 92305 - DNA, 25 bp, Rattus norvegicus
actaaggatgtgctgctccaatggg

SEQ ID NO: 92306 - DNA, 25 bp, Rattus norvegicus
actaaggatgtggtgctccaatggg

SEQ ID NO: 92307 - DNA, 25 bp, Rattus norvegicus
actaaggcacaacaggctcctggca

SEQ ID NO: 92308 - DNA, 25 bp, Rattus norvegicus
actaaggcacaagaggctcctggca

SEQ ID NO: 92309 - DNA, 25 bp, Rattus norvegicus
actaaggcacctacctagttgtgga

SEQ ID NO: 92310 - DNA, 25 bp, Rattus norvegicus
actaaggcaccttcctagttgtgga

SEQ ID NO: 92311 - DNA, 25 bp, Rattus norvegicus
actaaggcagccactcagaggtcag

SEQ ID NO: 92312 - DNA, 25 bp, Rattus norvegicus
actaaggcagccagtgtaacccagg

SEQ ID NO: 92313 - DNA, 25 bp, Rattus norvegicus
actaaggcagcctctcagaggtcag

SEQ ID NO: 92314 - DNA, 25 bp, Rattus norvegicus
actaaggcagcctgtgtaacccagg

SEQ ID NO: 92315 - DNA, 25 bp, Rattus norvegicus
actaaggcctttatactgatcagac

SEQ ID NO: 92316 - DNA, 25 bp, Rattus norvegicus
actaaggcctttttactgatcagac

SEQ ID NO: 92317 - DNA, 25 bp, Rattus norvegicus
actaaggcttccaagagaccgtcac

SEQ ID NO: 92318 - DNA, 25 bp, Rattus norvegicus
actaaggcttcctagagaccgtcac

SEQ ID NO: 92319 - DNA, 25 bp, Rattus norvegicus
actaagggtgtgcaggacagggcaa

SEQ ID NO: 92320 - DNA, 25 bp, Rattus norvegicus
actaagggtgtggaggacagggcaa

SEQ ID NO: 92321 - DNA, 25 bp, Rattus norvegicus
actaaggtcacaaggccggtctcga

SEQ ID NO: 92322 - DNA, 25 bp, Rattus norvegicus
actaaggtcacatggccggtctcga

SEQ ID NO: 92323 - DNA, 25 bp, Rattus norvegicus
actaaggtcatgatcccagatccag

SEQ ID NO: 92324 - DNA, 25 bp, Rattus norvegicus
actaaggtcatgttcccagatccag

SEQ ID NO: 92325 - DNA, 25 bp, Rattus norvegicus
actaaggtctctaatgtcatgctat

SEQ ID NO: 92326 - DNA, 25 bp, Rattus norvegicus
actaaggtctcttatgtcatgctat

SEQ ID NO: 92327 - DNA, 25 bp, Rattus norvegicus
actaagtacatccttcagtgcacat

SEQ ID NO: 92328 - DNA, 25 bp, Rattus norvegicus
actaagtacatcgttcagtgcacat

SEQ ID NO: 92329 - DNA, 25 bp, Rattus norvegicus
actaagtatcctatcgaagcatcga

SEQ ID NO: 92330 - DNA, 25 bp, Rattus norvegicus
actaagtatcctttcgaagcatcga

SEQ ID NO: 92331 - DNA, 25 bp, Rattus norvegicus
actaagtcagccatctttaactcca

SEQ ID NO: 92332 - DNA, 25 bp, Rattus norvegicus
actaagtcagccttctttaactcca

SEQ ID NO: 92333 - DNA, 25 bp, Rattus norvegicus
actaagtcatgtcacctgggtcagg

SEQ ID NO: 92334 - DNA, 25 bp, Rattus norvegicus
actaagtcatgtgacctgggtcagg

SEQ ID NO: 92335 - DNA, 25 bp, Rattus norvegicus
actaagtcgattccactggtttgga

SEQ ID NO: 92336 - DNA, 25 bp, Rattus norvegicus
actaagtcgattgcactggtttgga

SEQ ID NO: 92337 - DNA, 25 bp, Rattus norvegicus
actaagtctcagagaggtggcgctg

SEQ ID NO: 92338 - DNA, 25 bp, Rattus norvegicus
actaagtctcagtgaggtggcgctg

SEQ ID NO: 92339 - DNA, 25 bp, Rattus norvegicus
actaagtctgatctccaaatgggca

SEQ ID NO: 92340 - DNA, 25 bp, Rattus norvegicus
actaagtctgatgtccaaatgggca

SEQ ID NO: 92341 - DNA, 25 bp, Rattus norvegicus
actaagtgccaaacgcatttctcac

SEQ ID NO: 92342 - DNA, 25 bp, Rattus norvegicus
actaagtgccaatcgcatttctcac

SEQ ID NO: 92343 - DNA, 25 bp, Rattus norvegicus
actaagtgtgtcagctaagtgcagt

SEQ ID NO: 92344 - DNA, 25 bp, Rattus norvegicus
actaagtgtgtctgctaagtgcagt

SEQ ID NO: 92345 - DNA, 25 bp, Rattus norvegicus
actaataaactgacggcgctcgggc

SEQ ID NO: 92346 - DNA, 25 bp, Rattus norvegicus
actaataaactgtcggcgctcgggc

SEQ ID NO: 92347 - DNA, 25 bp, Rattus norvegicus
actaatatgctgaacattcggaaga

SEQ ID NO: 92348 - DNA, 25 bp, Rattus norvegicus
actaatatgctgtacattcggaaga

SEQ ID NO: 92349 - DNA, 25 bp, Rattus norvegicus
actaatatttgaacatccagcagga

SEQ ID NO: 92350 - DNA, 25 bp, Rattus norvegicus
actaatatttgatcatccagcagga

SEQ ID NO: 92351 - DNA, 25 bp, Rattus norvegicus
actaatcactaaacactgtcggctc

SEQ ID NO: 92352 - DNA, 25 bp, Rattus norvegicus
actaatcactaatcactgtcggctc

SEQ ID NO: 92353 - DNA, 25 bp, Rattus norvegicus
actaatcagtgtatcagtaaggact

SEQ ID NO: 92354 - DNA, 25 bp, Rattus norvegicus
actaatcagtgtttcagtaaggact

SEQ ID NO: 92355 - DNA, 25 bp, Rattus norvegicus
actaatctaatcatgcacgtcactc

SEQ ID NO: 92356 - DNA, 25 bp, Rattus norvegicus
actaatctaatcttgcacgtcactc

SEQ ID NO: 92357 - DNA, 25 bp, Rattus norvegicus
actaatctctagatccagctgtcac

SEQ ID NO: 92358 - DNA, 25 bp, Rattus norvegicus
actaatctctagttccagctgtcac

SEQ ID NO: 92359 - DNA, 25 bp, Rattus norvegicus
actaatctcttcagcatgtgccatg

SEQ ID NO: 92360 - DNA, 25 bp, Rattus norvegicus
actaatctcttctgcatgtgccatg

SEQ ID NO: 92361 - DNA, 25 bp, Rattus norvegicus
actaatctgcaaactttcacgtgga

SEQ ID NO: 92362 - DNA, 25 bp, Rattus norvegicus
actaatctgcaatctttcacgtgga

SEQ ID NO: 92363 - DNA, 25 bp, Rattus norvegicus
actaatcttcagcaggtcttccaag

SEQ ID NO: 92364 - DNA, 25 bp, Rattus norvegicus
actaatcttcaggaggtcttccaag

SEQ ID NO: 92365 - DNA, 25 bp, Rattus norvegicus
actaatgaactaaagctggccctga

SEQ ID NO: 92366 - DNA, 25 bp, Rattus norvegicus
actaatgaactatagctggccctga

SEQ ID NO: 92367 - DNA, 25 bp, Rattus norvegicus
actaatgaagttaacacctccctct

SEQ ID NO: 92368 - DNA, 25 bp, Rattus norvegicus
actaatgaagtttacacctccctct

SEQ ID NO: 92369 - DNA, 25 bp, Rattus norvegicus
actaatgaatgacgtggccgtgccg

SEQ ID NO: 92370 - DNA, 25 bp, Rattus norvegicus
actaatgaatgaggtggccgtgccg

SEQ ID NO: 92371 - DNA, 25 bp, Rattus norvegicus
actaatgagtgcatttgtcaaactt

SEQ ID NO: 92372 - DNA, 25 bp, Rattus norvegicus
actaatgagtgcttttgtcaaactt

SEQ ID NO: 92373 - DNA, 25 bp, Rattus norvegicus
actaatgcaagtccaaggccagggt

SEQ ID NO: 92374 - DNA, 25 bp, Rattus norvegicus
actaatgcaagtgcaaggccagggt

SEQ ID NO: 92375 - DNA, 25 bp, Rattus norvegicus
actaatgcgccacctccggctaggt

SEQ ID NO: 92376 - DNA, 25 bp, Rattus norvegicus
actaatgcgccagctccggctaggt

SEQ ID NO: 92377 - DNA, 25 bp, Rattus norvegicus
actaatggaataaaggctgcgtctc

SEQ ID NO: 92378 - DNA, 25 bp, Rattus norvegicus
actaatggaatataggctgcgtctc

SEQ ID NO: 92379 - DNA, 25 bp, Rattus norvegicus
actaatgggcgcatttctgtctctc

SEQ ID NO: 92380 - DNA, 25 bp, Rattus norvegicus
actaatgggcgcttttctgtctctc

SEQ ID NO: 92381 - DNA, 25 bp, Rattus norvegicus
actaatgtaaatactccctcctgct

SEQ ID NO: 92382 - DNA, 25 bp, Rattus norvegicus
actaatgtaaattctccctcctgct

SEQ ID NO: 92383 - DNA, 25 bp, Rattus norvegicus
actaatgtgagccagcaggacccta

SEQ ID NO: 92384 - DNA, 25 bp, Rattus norvegicus
actaatgtgagcgagcaggacccta

SEQ ID NO: 92385 - DNA, 25 bp, Rattus norvegicus
actaattcagtcaattggctatgga

SEQ ID NO: 92386 - DNA, 25 bp, Rattus norvegicus
actaattcagtctattggctatgga

SEQ ID NO: 92387 - DNA, 25 bp, Rattus norvegicus
actaattcgtgaaggctctgctgta

SEQ ID NO: 92388 - DNA, 25 bp, Rattus norvegicus
actaattcgtgatggctctgctgta

SEQ ID NO: 92389 - DNA, 25 bp, Rattus norvegicus
actaattgaggaattccctcctctc

SEQ ID NO: 92390 - DNA, 25 bp, Rattus norvegicus
actaattgaggatttccctcctctc

SEQ ID NO: 92391 - DNA, 25 bp, Rattus norvegicus
actaattgatttcgtgcaaggccac

SEQ ID NO: 92392 - DNA, 25 bp, Rattus norvegicus
actaattgatttggtgcaaggccac

SEQ ID NO: 92393 - DNA, 25 bp, Rattus norvegicus
actaattgccatcgccactctgtgg

SEQ ID NO: 92394 - DNA, 25 bp, Rattus norvegicus
actaattgccatggccactctgtgg

SEQ ID NO: 92395 - DNA, 25 bp, Rattus norvegicus
actaattggcatctcccttgggctg

SEQ ID NO: 92396 - DNA, 25 bp, Rattus norvegicus
actaattggcatgtcccttgggctg

SEQ ID NO: 92397 - DNA, 25 bp, Rattus norvegicus
actaatttaaatccacagctcccca

SEQ ID NO: 92398 - DNA, 25 bp, Rattus norvegicus
actaatttaaatgcacagctcccca

SEQ ID NO: 92399 - DNA, 25 bp, Rattus norvegicus
actaatttctctaaggatcactgga

SEQ ID NO: 92400 - DNA, 25 bp, Rattus norvegicus
actaatttctcttaggatcactgga

SEQ ID NO: 92401 - DNA, 25 bp, Rattus norvegicus
actaatttctttctcatcgtgtcaa

SEQ ID NO: 92402 - DNA, 25 bp, Rattus norvegicus
actaatttctttgtcatcgtgtcaa

SEQ ID NO: 92403 - DNA, 25 bp, Rattus norvegicus
actaatttgtttaatctcagttatg

SEQ ID NO: 92404 - DNA, 25 bp, Rattus norvegicus
actaatttgttttatctcagttatg

SEQ ID NO: 92405 - DNA, 25 bp, Rattus norvegicus
actaattttaatcctatccttgagg

SEQ ID NO: 92406 - DNA, 25 bp, Rattus norvegicus
actaattttaatgctatccttgagg

SEQ ID NO: 92407 - DNA, 25 bp, Rattus norvegicus
actacaaacttcacccaagggactg

SEQ ID NO: 92408 - DNA, 25 bp, Rattus norvegicus
actacaaacttctcccaagggactg

SEQ ID NO: 92409 - DNA, 25 bp, Rattus norvegicus
actacaaagtgactcctagatagcc

SEQ ID NO: 92410 - DNA, 25 bp, Rattus norvegicus
actacaaagtgagtcctagatagcc

SEQ ID NO: 92411 - DNA, 25 bp, Rattus norvegicus
actacaaagtttccctcttcagtgt

SEQ ID NO: 92412 - DNA, 25 bp, Rattus norvegicus
actacaaagtttgcctcttcagtgt

SEQ ID NO: 92413 - DNA, 25 bp, Rattus norvegicus
actacaaatcctaatgagcgccctc

SEQ ID NO: 92414 - DNA, 25 bp, Rattus norvegicus
actacaaatccttatgagcgccctc

SEQ ID NO: 92415 - DNA, 25 bp, Rattus norvegicus
actacaaattgaacgatgtgcacca

SEQ ID NO: 92416 - DNA, 25 bp, Rattus norvegicus
actacaaattgatcgatgtgcacca

SEQ ID NO: 92417 - DNA, 25 bp, Rattus norvegicus
actacaacagctaccatgagaccta

SEQ ID NO: 92418 - DNA, 25 bp, Rattus norvegicus
actacaacagcttccatgagaccta

SEQ ID NO: 92419 - DNA, 25 bp, Rattus norvegicus
actacaacatccattatgcagctga

SEQ ID NO: 92420 - DNA, 25 bp, Rattus norvegicus
actacaacatcctttatgcagctga

SEQ ID NO: 92421 - DNA, 25 bp, Rattus norvegicus
actacaacatgtacatcttccctgt

SEQ ID NO: 92422 - DNA, 25 bp, Rattus norvegicus
actacaacatgttcatcttccctgt

SEQ ID NO: 92423 - DNA, 25 bp, Rattus norvegicus
actacaaccaggcttccgtattgaa

SEQ ID NO: 92424 - DNA, 25 bp, Rattus norvegicus
actacaaccagggttccgtattgaa

SEQ ID NO: 92425 - DNA, 25 bp, Rattus norvegicus
actacaacgtgaaggagctgttcca

SEQ ID NO: 92426 - DNA, 25 bp, Rattus norvegicus
actacaacgtgatggagctgttcca

SEQ ID NO: 92427 - DNA, 25 bp, Rattus norvegicus
actacaactactagggaacctctca

SEQ ID NO: 92428 - DNA, 25 bp, Rattus norvegicus
actacaactacttgggaacctctca

SEQ ID NO: 92429 - DNA, 25 bp, Rattus norvegicus
actacaagactaagtgccactcctc

SEQ ID NO: 92430 - DNA, 25 bp, Rattus norvegicus
actacaagactatgtgccactcctc

SEQ ID NO: 92431 - DNA, 25 bp, Rattus norvegicus
actacaagtctcactgctacatcat

SEQ ID NO: 92432 - DNA, 25 bp, Rattus norvegicus
actacaagtctctctgctacatcat

SEQ ID NO: 92433 - DNA, 25 bp, Rattus norvegicus
actacaatcgctacctgactcggcg

SEQ ID NO: 92434 - DNA, 25 bp, Rattus norvegicus
actacaatcgcttcctgactcggcg

SEQ ID NO: 92435 - DNA, 25 bp, Rattus norvegicus
actacacccaacaatgctctgctaa

SEQ ID NO: 92436 - DNA, 25 bp, Rattus norvegicus
actacacccaactatgctctgctaa

SEQ ID NO: 92437 - DNA, 25 bp, Rattus norvegicus
actacacccatcatgtattctgtgg

SEQ ID NO: 92438 - DNA, 25 bp, Rattus norvegicus
actacacccatcttgtattctgtgg

SEQ ID NO: 92439 - DNA, 25 bp, Rattus norvegicus
actacaccggtacaaacaccatctg

SEQ ID NO: 92440 - DNA, 25 bp, Rattus norvegicus
actacaccggtagaaacaccatctg

SEQ ID NO: 92441 - DNA, 25 bp, Rattus norvegicus
actacacgaaagcaaggtctccata

SEQ ID NO: 92442 - DNA, 25 bp, Rattus norvegicus
actacacgaaaggaaggtctccata

SEQ ID NO: 92443 - DNA, 25 bp, Rattus norvegicus
actacactatgtacggaaagcctgt

SEQ ID NO: 92444 - DNA, 25 bp, Rattus norvegicus
actacactatgttcggaaagcctgt

SEQ ID NO: 92445 - DNA, 25 bp, Rattus norvegicus
actacactctgacaccatgtttttg

SEQ ID NO: 92446 - DNA, 25 bp, Rattus norvegicus
actacactctgagaccatgtttttg

SEQ ID NO: 92447 - DNA, 25 bp, Rattus norvegicus
actacactgttacaaagactcccca

SEQ ID NO: 92448 - DNA, 25 bp, Rattus norvegicus
actacactgttagaaagactcccca

SEQ ID NO: 92449 - DNA, 25 bp, Rattus norvegicus
actacagaccttaaaccatgttgtt

SEQ ID NO: 92450 - DNA, 25 bp, Rattus norvegicus
actacagacctttaaccatgttgtt

SEQ ID NO: 92451 - DNA, 25 bp, Rattus norvegicus
actacagaggagcaatgggcatcat

SEQ ID NO: 92452 - DNA, 25 bp, Rattus norvegicus
actacagaggaggaatgggcatcat

SEQ ID NO: 92453 - DNA, 25 bp, Rattus norvegicus
actacagccgctcggatgccagcag

SEQ ID NO: 92454 - DNA, 25 bp, Rattus norvegicus
actacagccgctgggatgccagcag

SEQ ID NO: 92455 - DNA, 25 bp, Rattus norvegicus
actacagcctttctttcttcttagt

SEQ ID NO: 92456 - DNA, 25 bp, Rattus norvegicus
actacagcctttgtttcttcttagt

SEQ ID NO: 92457 - DNA, 25 bp, Rattus norvegicus
actacagcgctacggctcagtggtt

SEQ ID NO: 92458 - DNA, 25 bp, Rattus norvegicus
actacagcgctagggctcagtggtt

SEQ ID NO: 92459 - DNA, 25 bp, Rattus norvegicus
actacagcggtcagcagagcactta

SEQ ID NO: 92460 - DNA, 25 bp, Rattus norvegicus
actacagcggtctgcagagcactta

SEQ ID NO: 92461 - DNA, 25 bp, Rattus norvegicus
actacagctaagctgattgggaaaa

SEQ ID NO: 92462 - DNA, 25 bp, Rattus norvegicus
actacagctaaggtgattgggaaaa

SEQ ID NO: 92463 - DNA, 25 bp, Rattus norvegicus
actacagctcccattcgaacaatga

SEQ ID NO: 92464 - DNA, 25 bp, Rattus norvegicus
actacagctccctttcgaacaatga

SEQ ID NO: 92465 - DNA, 25 bp, Rattus norvegicus
actacagggcagatgccactacgga

SEQ ID NO: 92466 - DNA, 25 bp, Rattus norvegicus
actacagggcagttgccactacgga

SEQ ID NO: 92467 - DNA, 25 bp, Rattus norvegicus
actacaggtgtgagttcaccgctgt

SEQ ID NO: 92468 - DNA, 25 bp, Rattus norvegicus
actacaggtgtgtgttcaccgctgt

SEQ ID NO: 92469 - DNA, 25 bp, Rattus norvegicus
actacagtgactccacgggacctgg

SEQ ID NO: 92470 - DNA, 25 bp, Rattus norvegicus
actacagtgactccagcaagaaagc

SEQ ID NO: 92471 - DNA, 25 bp, Rattus norvegicus
actacagtgactgcacgggacctgg

SEQ ID NO: 92472 - DNA, 25 bp, Rattus norvegicus
actacagtgactgcagcaagaaagc

SEQ ID NO: 92473 - DNA, 25 bp, Rattus norvegicus
actacagtgtacacactctacagtg

SEQ ID NO: 92474 - DNA, 25 bp, Rattus norvegicus
actacagtgtactcactctacagtg

SEQ ID NO: 92475 - DNA, 25 bp, Rattus norvegicus
actacagttgctacttaaggtctct

SEQ ID NO: 92476 - DNA, 25 bp, Rattus norvegicus
actacagttgcttcttaaggtctct

SEQ ID NO: 92477 - DNA, 25 bp, Rattus norvegicus
actacataggtgagccctctcatta

SEQ ID NO: 92478 - DNA, 25 bp, Rattus norvegicus
actacataggtgtgccctctcatta

SEQ ID NO: 92479 - DNA, 25 bp, Rattus norvegicus
actacatagtgacagaaactgtctt

SEQ ID NO: 92480 - DNA, 25 bp, Rattus norvegicus
actacatagtgagagaaactgtctt

SEQ ID NO: 92481 - DNA, 25 bp, Rattus norvegicus
actacatatggcaagctacttgcta

SEQ ID NO: 92482 - DNA, 25 bp, Rattus norvegicus
actacatatggctagctacttgcta

SEQ ID NO: 92483 - DNA, 25 bp, Rattus norvegicus
actacatggaccagcaggacctggc

SEQ ID NO: 92484 - DNA, 25 bp, Rattus norvegicus
actacatggacctgcaggacctggc

SEQ ID NO: 92485 - DNA, 25 bp, Rattus norvegicus
actacatggctcagactgttgtgga

SEQ ID NO: 92486 - DNA, 25 bp, Rattus norvegicus
actacatggctctgactgttgtgga

SEQ ID NO: 92487 - DNA, 25 bp, Rattus norvegicus
actacatgtaccaagtcccagacaa

SEQ ID NO: 92488 - DNA, 25 bp, Rattus norvegicus
actacatgtacctagtcccagacaa

SEQ ID NO: 92489 - DNA, 25 bp, Rattus norvegicus
actacatgtatactgtgcccttggc

SEQ ID NO: 92490 - DNA, 25 bp, Rattus norvegicus
actacatgtatagtgtgcccttggc

SEQ ID NO: 92491 - DNA, 25 bp, Rattus norvegicus
actacattactgaccactggcatgg

SEQ ID NO: 92492 - DNA, 25 bp, Rattus norvegicus
actacattactgtccactggcatgg

SEQ ID NO: 92493 - DNA, 25 bp, Rattus norvegicus
actacattggcaacatggcggcagc

SEQ ID NO: 92494 - DNA, 25 bp, Rattus norvegicus
actacattggcatcatggcggcagc

SEQ ID NO: 92495 - DNA, 25 bp, Rattus norvegicus
actacattggctcgcctcagtggga

SEQ ID NO: 92496 - DNA, 25 bp, Rattus norvegicus
actacattggctggcctcagtggga

SEQ ID NO: 92497 - DNA, 25 bp, Rattus norvegicus
actacattgtggattctgcctatgg

SEQ ID NO: 92498 - DNA, 25 bp, Rattus norvegicus
actacattgtggtttctgcctatgg

SEQ ID NO: 92499 - DNA, 25 bp, Rattus norvegicus
actacatttcttattggctccaaca

SEQ ID NO: 92500 - DNA, 25 bp, Rattus norvegicus
actacatttctttttggctccaaca

SEQ ID NO: 92501 - DNA, 25 bp, Rattus norvegicus
actaccaagatacagaggcccagct

SEQ ID NO: 92502 - DNA, 25 bp, Rattus norvegicus
actaccaagatagagaggcccagct

SEQ ID NO: 92503 - DNA, 25 bp, Rattus norvegicus
actaccaccggtctgtgaagaccat

SEQ ID NO: 92504 - DNA, 25 bp, Rattus norvegicus
actaccaccggtgtgtgaagaccat

SEQ ID NO: 92505 - DNA, 25 bp, Rattus norvegicus
actaccacgtgcactgggatgacaa

SEQ ID NO: 92506 - DNA, 25 bp, Rattus norvegicus
actaccacgtgctctgggatgacaa

SEQ ID NO: 92507 - DNA, 25 bp, Rattus norvegicus
actaccactgcacgcgggagaactg

SEQ ID NO: 92508 - DNA, 25 bp, Rattus norvegicus
actaccactgcaggcgggagaactg

SEQ ID NO: 92509 - DNA, 25 bp, Rattus norvegicus
actaccagacttccaagttcagaat

SEQ ID NO: 92510 - DNA, 25 bp, Rattus norvegicus
actaccagacttgcaagttcagaat

SEQ ID NO: 92511 - DNA, 25 bp, Rattus norvegicus
actaccagcttgacatcgattacag

SEQ ID NO: 92512 - DNA, 25 bp, Rattus norvegicus
actaccagcttgtcatcgattacag

SEQ ID NO: 92513 - DNA, 25 bp, Rattus norvegicus
actaccagggtaacacaattaaaga

SEQ ID NO: 92514 - DNA, 25 bp, Rattus norvegicus
actaccagggtatcacaattaaaga

SEQ ID NO: 92515 - DNA, 25 bp, Rattus norvegicus
actaccagtaccagtcaggagggat

SEQ ID NO: 92516 - DNA, 25 bp, Rattus norvegicus
actaccagtacctgtcaggagggat

SEQ ID NO: 92517 - DNA, 25 bp, Rattus norvegicus
actaccagtgaccaggtggcctctt

SEQ ID NO: 92518 - DNA, 25 bp, Rattus norvegicus
actaccagtgacgaggtggcctctt

SEQ ID NO: 92519 - DNA, 25 bp, Rattus norvegicus
actaccataggcctatcctacaggc

SEQ ID NO: 92520 - DNA, 25 bp, Rattus norvegicus
actaccataggcgtatcctacaggc

SEQ ID NO: 92521 - DNA, 25 bp, Rattus norvegicus
actaccatcccacttcttgtgtttt

SEQ ID NO: 92522 - DNA, 25 bp, Rattus norvegicus
actaccatcccagttcttgtgtttt

SEQ ID NO: 92523 - DNA, 25 bp, Rattus norvegicus
actaccatgagacaccttgctgctg

SEQ ID NO: 92524 - DNA, 25 bp, Rattus norvegicus
actaccatgagagaccttgctgctg

SEQ ID NO: 92525 - DNA, 25 bp, Rattus norvegicus
actaccatgcttagctgcgatgtga

SEQ ID NO: 92526 - DNA, 25 bp, Rattus norvegicus
actaccatgctttgctgcgatgtga

SEQ ID NO: 92527 - DNA, 25 bp, Rattus norvegicus
actaccattcacctttcatattttc

SEQ ID NO: 92528 - DNA, 25 bp, Rattus norvegicus
actaccattcacgtttcatattttc

SEQ ID NO: 92529 - DNA, 25 bp, Rattus norvegicus
actacccaagtcagtccttggaaga

SEQ ID NO: 92530 - DNA, 25 bp, Rattus norvegicus
actacccaagtctgtccttggaaga

SEQ ID NO: 92531 - DNA, 25 bp, Rattus norvegicus
actacccacgttccttgtactgtat

SEQ ID NO: 92532 - DNA, 25 bp, Rattus norvegicus
actacccacgttgcttgtactgtat

SEQ ID NO: 92533 - DNA, 25 bp, Rattus norvegicus
actacccagcacagggtccttgtgt

SEQ ID NO: 92534 - DNA, 25 bp, Rattus norvegicus
actacccagcactgggtccttgtgt

SEQ ID NO: 92535 - DNA, 25 bp, Rattus norvegicus
actaccctggctaggcaccgagtga

SEQ ID NO: 92536 - DNA, 25 bp, Rattus norvegicus
actaccctggcttggcaccgagtga

SEQ ID NO: 92537 - DNA, 25 bp, Rattus norvegicus
actaccctggttcgatgagcgaagc

SEQ ID NO: 92538 - DNA, 25 bp, Rattus norvegicus
actaccctggttggatgagcgaagc

SEQ ID NO: 92539 - DNA, 25 bp, Rattus norvegicus
actacccttcgcacactaaaatgat

SEQ ID NO: 92540 - DNA, 25 bp, Rattus norvegicus
actacccttcgctcactaaaatgat

SEQ ID NO: 92541 - DNA, 25 bp, Rattus norvegicus
actaccctttagctgctgggaactg

SEQ ID NO: 92542 - DNA, 25 bp, Rattus norvegicus
actaccctttaggtgctgggaactg

SEQ ID NO: 92543 - DNA, 25 bp, Rattus norvegicus
actaccctttgcctctgggagaagc

SEQ ID NO: 92544 - DNA, 25 bp, Rattus norvegicus
actaccctttgcgtctgggagaagc

SEQ ID NO: 92545 - DNA, 25 bp, Rattus norvegicus
actaccgacctgaaagatttcttca

SEQ ID NO: 92546 - DNA, 25 bp, Rattus norvegicus
actaccgacctgtaagatttcttca

SEQ ID NO: 92547 - DNA, 25 bp, Rattus norvegicus
actaccggtccaaagctgagagtcc

SEQ ID NO: 92548 - DNA, 25 bp, Rattus norvegicus
actaccggtccatagctgagagtcc

SEQ ID NO: 92549 - DNA, 25 bp, Rattus norvegicus
actacctacaacacatcgggctata

SEQ ID NO: 92550 - DNA, 25 bp, Rattus norvegicus
actacctacaactcatcgggctata

SEQ ID NO: 92551 - DNA, 25 bp, Rattus norvegicus
actacctattccagcctgttttaga

SEQ ID NO: 92552 - DNA, 25 bp, Rattus norvegicus
actacctattcctgcctgttttaga

SEQ ID NO: 92553 - DNA, 25 bp, Rattus norvegicus
actacctcagctacagtcctgggag

SEQ ID NO: 92554 - DNA, 25 bp, Rattus norvegicus
actacctcagctcggcttctattta

SEQ ID NO: 92555 - DNA, 25 bp, Rattus norvegicus
actacctcagctgggcttctattta

SEQ ID NO: 92556 - DNA, 25 bp, Rattus norvegicus
actacctcagcttcagtcctgggag

SEQ ID NO: 92557 - DNA, 25 bp, Rattus norvegicus
actacctcatatcccattcagaatt

SEQ ID NO: 92558 - DNA, 25 bp, Rattus norvegicus
actacctcatatgccattcagaatt

SEQ ID NO: 92559 - DNA, 25 bp, Rattus norvegicus
actacctccaccaaatgggttcatt

SEQ ID NO: 92560 - DNA, 25 bp, Rattus norvegicus
actacctccacctaatgggttcatt

SEQ ID NO: 92561 - DNA, 25 bp, Rattus norvegicus
actacctctgagctcgttttatttt

SEQ ID NO: 92562 - DNA, 25 bp, Rattus norvegicus
actacctctgaggtcgttttatttt

SEQ ID NO: 92563 - DNA, 25 bp, Rattus norvegicus
actacctctgctcttggttaccaag

SEQ ID NO: 92564 - DNA, 25 bp, Rattus norvegicus
actacctctgctgttggttaccaag

SEQ ID NO: 92565 - DNA, 25 bp, Rattus norvegicus
actacctctgttcaattgctctagg

SEQ ID NO: 92566 - DNA, 25 bp, Rattus norvegicus
actacctctgttgaattgctctagg

SEQ ID NO: 92567 - DNA, 25 bp, Rattus norvegicus
actacctgcatcaggatactattga

SEQ ID NO: 92568 - DNA, 25 bp, Rattus norvegicus
actacctgcatctggatactattga

SEQ ID NO: 92569 - DNA, 25 bp, Rattus norvegicus
actacctgggacaccgagatgtaca

SEQ ID NO: 92570 - DNA, 25 bp, Rattus norvegicus
actacctgggactccgagatgtaca

SEQ ID NO: 92571 - DNA, 25 bp, Rattus norvegicus
actacctggtgaccttctgggagga

SEQ ID NO: 92572 - DNA, 25 bp, Rattus norvegicus
actacctggtgagcttctgggagga

SEQ ID NO: 92573 - DNA, 25 bp, Rattus norvegicus
actacctgtatcacaccggcgtgtg

SEQ ID NO: 92574 - DNA, 25 bp, Rattus norvegicus
actacctgtatctcaccggcgtgtg

SEQ ID NO: 92575 - DNA, 25 bp, Rattus norvegicus
actaccttcctgctcagtgtgtgaa

SEQ ID NO: 92576 - DNA, 25 bp, Rattus norvegicus
actaccttcctggtcagtgtgtgaa

SEQ ID NO: 92577 - DNA, 25 bp, Rattus norvegicus
actaccttgggaatatgttggctaa

SEQ ID NO: 92578 - DNA, 25 bp, Rattus norvegicus
actaccttgggattatgttggctaa

SEQ ID NO: 92579 - DNA, 25 bp, Rattus norvegicus
actaccttggtgagctgggtttcca

SEQ ID NO: 92580 - DNA, 25 bp, Rattus norvegicus
actaccttggtgtgctgggtttcca

SEQ ID NO: 92581 - DNA, 25 bp, Rattus norvegicus
actaccttgttgcaagaccttgggt

SEQ ID NO: 92582 - DNA, 25 bp, Rattus norvegicus
actaccttgttggaagaccttgggt

SEQ ID NO: 92583 - DNA, 25 bp, Rattus norvegicus
actacgaatgtcacgtctaccgtct

SEQ ID NO: 92584 - DNA, 25 bp, Rattus norvegicus
actacgaatgtctcgtctaccgtct

SEQ ID NO: 92585 - DNA, 25 bp, Rattus norvegicus
actacgacctgtccagcgtctgcga

SEQ ID NO: 92586 - DNA, 25 bp, Rattus norvegicus
actacgacctgtgcagcgtctgcga

SEQ ID NO: 92587 - DNA, 25 bp, Rattus norvegicus
actacgactactcacttcaaagcaa

SEQ ID NO: 92588 - DNA, 25 bp, Rattus norvegicus
actacgactactgacttcaaagcaa

SEQ ID NO: 92589 - DNA, 25 bp, Rattus norvegicus
actacgactgggagagcctgcaact

SEQ ID NO: 92590 - DNA, 25 bp, Rattus norvegicus
actacgactgggtgagcctgcaact

SEQ ID NO: 92591 - DNA, 25 bp, Rattus norvegicus
actacgacttggaaggctcacgctc

SEQ ID NO: 92592 - DNA, 25 bp, Rattus norvegicus
actacgacttggtaggctcacgctc

SEQ ID NO: 92593 - DNA, 25 bp, Rattus norvegicus
actacgaggagtatgctgcccgggc

SEQ ID NO: 92594 - DNA, 25 bp, Rattus norvegicus
actacgaggagtttgctgcccgggc

SEQ ID NO: 92595 - DNA, 25 bp, Rattus norvegicus
actacgatcactatggtcttcggag

SEQ ID NO: 92596 - DNA, 25 bp, Rattus norvegicus
actacgatcactttggtcttcggag

SEQ ID NO: 92597 - DNA, 25 bp, Rattus norvegicus
actacgatcgtgaccttgattttag

SEQ ID NO: 92598 - DNA, 25 bp, Rattus norvegicus
actacgatcgtgtccttgattttag

SEQ ID NO: 92599 - DNA, 25 bp, Rattus norvegicus
actacgcaggcccatctttccagat

SEQ ID NO: 92600 - DNA, 25 bp, Rattus norvegicus
actacgcaggccgatctttccagat

SEQ ID NO: 92601 - DNA, 25 bp, Rattus norvegicus
actacgcatgctacaccatatgtgc

SEQ ID NO: 92602 - DNA, 25 bp, Rattus norvegicus
actacgcatgcttcaccatatgtgc

SEQ ID NO: 92603 - DNA, 25 bp, Rattus norvegicus
actacgcgtgctataattctgaatg

SEQ ID NO: 92604 - DNA, 25 bp, Rattus norvegicus
actacgcgtgctttaattctgaatg

SEQ ID NO: 92605 - DNA, 25 bp, Rattus norvegicus
actacgctgtcaattttatctttct

SEQ ID NO: 92606 - DNA, 25 bp, Rattus norvegicus
actacgctgtcatttttatctttct

SEQ ID NO: 92607 - DNA, 25 bp, Rattus norvegicus
actacgctgttgaggatacttacta

SEQ ID NO: 92608 - DNA, 25 bp, Rattus norvegicus
actacgctgttgtggatacttacta

SEQ ID NO: 92609 - DNA, 25 bp, Rattus norvegicus
actacgctgtttccttctggaagtc

SEQ ID NO: 92610 - DNA, 25 bp, Rattus norvegicus
actacgctgtttgcttctggaagtc

SEQ ID NO: 92611 - DNA, 25 bp, Rattus norvegicus
actacggaccatagtgcacgatttg

SEQ ID NO: 92612 - DNA, 25 bp, Rattus norvegicus
actacggaccattgtgcacgatttg

SEQ ID NO: 92613 - DNA, 25 bp, Rattus norvegicus
actacggacttgaaagcagggctta

SEQ ID NO: 92614 - DNA, 25 bp, Rattus norvegicus
actacggacttgtaagcagggctta

SEQ ID NO: 92615 - DNA, 25 bp, Rattus norvegicus
actacggagttacccacagctcatt

SEQ ID NO: 92616 - DNA, 25 bp, Rattus norvegicus
actacggagttagccacagctcatt

SEQ ID NO: 92617 - DNA, 25 bp, Rattus norvegicus
actacggcatttagcacagtgcatt

SEQ ID NO: 92618 - DNA, 25 bp, Rattus norvegicus
actacggcattttgcacagtgcatt

SEQ ID NO: 92619 - DNA, 25 bp, Rattus norvegicus
actacggcccttcagggatctcctt

SEQ ID NO: 92620 - DNA, 25 bp, Rattus norvegicus
actacggcccttgagggatctcctt

SEQ ID NO: 92621 - DNA, 25 bp, Rattus norvegicus
actacggcggtaactgacctcagag

SEQ ID NO: 92622 - DNA, 25 bp, Rattus norvegicus
actacggcggtatctgacctcagag

SEQ ID NO: 92623 - DNA, 25 bp, Rattus norvegicus
actacggctacaactatgtgggcac

SEQ ID NO: 92624 - DNA, 25 bp, Rattus norvegicus
actacggctacatctatgtgggcac

SEQ ID NO: 92625 - DNA, 25 bp, Rattus norvegicus
actacggctggtctctgtgccaagc

SEQ ID NO: 92626 - DNA, 25 bp, Rattus norvegicus
actacggctggtgtctgtgccaagc

SEQ ID NO: 92627 - DNA, 25 bp, Rattus norvegicus
actacggttggtcgttcctgactga

SEQ ID NO: 92628 - DNA, 25 bp, Rattus norvegicus
actacggttggtggttcctgactga

SEQ ID NO: 92629 - DNA, 25 bp, Rattus norvegicus
actacgtacaagagggactcctgtg

SEQ ID NO: 92630 - DNA, 25 bp, Rattus norvegicus
actacgtacaagtgggactcctgtg

SEQ ID NO: 92631 - DNA, 25 bp, Rattus norvegicus
actacgtacatcaggacgggtccca

SEQ ID NO: 92632 - DNA, 25 bp, Rattus norvegicus
actacgtacatctggacgggtccca

SEQ ID NO: 92633 - DNA, 25 bp, Rattus norvegicus
actacgtataagacctagaggcttc

SEQ ID NO: 92634 - DNA, 25 bp, Rattus norvegicus
actacgtataagtcctagaggcttc

SEQ ID NO: 92635 - DNA, 25 bp, Rattus norvegicus
actacgtcagtcacttgaagccagc

SEQ ID NO: 92636 - DNA, 25 bp, Rattus norvegicus
actacgtcagtctcttgaagccagc

SEQ ID NO: 92637 - DNA, 25 bp, Rattus norvegicus
actacgtccagccaggatttctgaa

SEQ ID NO: 92638 - DNA, 25 bp, Rattus norvegicus
actacgtccagcgaggatttctgaa

SEQ ID NO: 92639 - DNA, 25 bp, Rattus norvegicus
actacgtcgcctacaggaagctgga

SEQ ID NO: 92640 - DNA, 25 bp, Rattus norvegicus
actacgtcgccttcaggaagctgga

SEQ ID NO: 92641 - DNA, 25 bp, Rattus norvegicus
actacgtgaagtaccatacattcat

SEQ ID NO: 92642 - DNA, 25 bp, Rattus norvegicus
actacgtgaagttccatacattcat

SEQ ID NO: 92643 - DNA, 25 bp, Rattus norvegicus
actacgtgcctaaaggaagtcgcaa

SEQ ID NO: 92644 - DNA, 25 bp, Rattus norvegicus
actacgtgcctataggaagtcgcaa

SEQ ID NO: 92645 - DNA, 25 bp, Rattus norvegicus
actacgttttatacctgccagagct

SEQ ID NO: 92646 - DNA, 25 bp, Rattus norvegicus
actacgttttattcctgccagagct

SEQ ID NO: 92647 - DNA, 25 bp, Rattus norvegicus
actacgtttttaacttgcatctgca

SEQ ID NO: 92648 - DNA, 25 bp, Rattus norvegicus
actacgtttttatcttgcatctgca

SEQ ID NO: 92649 - DNA, 25 bp, Rattus norvegicus
actactaaaagaatggtgagctact

SEQ ID NO: 92650 - DNA, 25 bp, Rattus norvegicus
actactaaaagattggtgagctact

SEQ ID NO: 92651 - DNA, 25 bp, Rattus norvegicus
actactaaggaaactgcaggctcaa

SEQ ID NO: 92652 - DNA, 25 bp, Rattus norvegicus
actactaaggaatctgcaggctcaa

SEQ ID NO: 92653 - DNA, 25 bp, Rattus norvegicus
actactacaaaacggctggctctgg

SEQ ID NO: 92654 - DNA, 25 bp, Rattus norvegicus
actactacaaaagggctggctctgg

SEQ ID NO: 92655 - DNA, 25 bp, Rattus norvegicus
actactacagctatgggtctcgata

SEQ ID NO: 92656 - DNA, 25 bp, Rattus norvegicus
actactacagctttgggtctcgata

SEQ ID NO: 92657 - DNA, 25 bp, Rattus norvegicus
actactaccagcctcactatgatga

SEQ ID NO: 92658 - DNA, 25 bp, Rattus norvegicus
actactaccagcgtcactatgatga

SEQ ID NO: 92659 - DNA, 25 bp, Rattus norvegicus
actactactgcactgtctccttagt

SEQ ID NO: 92660 - DNA, 25 bp, Rattus norvegicus
actactactgcagtgtctccttagt

SEQ ID NO: 92661 - DNA, 25 bp, Rattus norvegicus
actactacttttactgttgtctctt

SEQ ID NO: 92662 - DNA, 25 bp, Rattus norvegicus
actactactttttctgttgtctctt

SEQ ID NO: 92663 - DNA, 25 bp, Rattus norvegicus
actactagagatcggcttgcggcga

SEQ ID NO: 92664 - DNA, 25 bp, Rattus norvegicus
actactagagatgggcttgcggcga

SEQ ID NO: 92665 - DNA, 25 bp, Rattus norvegicus
actactaggcttcctcagagacttg

SEQ ID NO: 92666 - DNA, 25 bp, Rattus norvegicus
actactaggcttgctcagagacttg

SEQ ID NO: 92667 - DNA, 25 bp, Rattus norvegicus
actactatcatcatcatctcatgaa

SEQ ID NO: 92668 - DNA, 25 bp, Rattus norvegicus
actactatcatcttcatctcatgaa

SEQ ID NO: 92669 - DNA, 25 bp, Rattus norvegicus
actactatgtgtcaaatcttgtgag

SEQ ID NO: 92670 - DNA, 25 bp, Rattus norvegicus
actactatgtgtgaaatcttgtgag

SEQ ID NO: 92671 - DNA, 25 bp, Rattus norvegicus
actactattggcagatgtgcctctc

SEQ ID NO: 92672 - DNA, 25 bp, Rattus norvegicus
actactattggctgatgtgcctctc

SEQ ID NO: 92673 - DNA, 25 bp, Rattus norvegicus
actactattgtaactgtgtccagcc

SEQ ID NO: 92674 - DNA, 25 bp, Rattus norvegicus
actactattgtatctgtgtccagcc

SEQ ID NO: 92675 - DNA, 25 bp, Rattus norvegicus
actactcaattcatggtcagcacca

SEQ ID NO: 92676 - DNA, 25 bp, Rattus norvegicus
actactcaattcttggtcagcacca

SEQ ID NO: 92677 - DNA, 25 bp, Rattus norvegicus
actactcactgtatgcactatggct

SEQ ID NO: 92678 - DNA, 25 bp, Rattus norvegicus
actactcactgtttgcactatggct

SEQ ID NO: 92679 - DNA, 25 bp, Rattus norvegicus
actactcagcttctaccaccaaaaa

SEQ ID NO: 92680 - DNA, 25 bp, Rattus norvegicus
actactcagcttgtaccaccaaaaa

SEQ ID NO: 92681 - DNA, 25 bp, Rattus norvegicus
actactccagaacacagtgtttgaa

SEQ ID NO: 92682 - DNA, 25 bp, Rattus norvegicus
actactccagaagacagtgtttgaa

SEQ ID NO: 92683 - DNA, 25 bp, Rattus norvegicus
actactcgtcctattcagagctctg

SEQ ID NO: 92684 - DNA, 25 bp, Rattus norvegicus
actactcgtccttttcagagctctg

SEQ ID NO: 92685 - DNA, 25 bp, Rattus norvegicus
actactcgttggctggcgtttgtgc

SEQ ID NO: 92686 - DNA, 25 bp, Rattus norvegicus
actactcgttgggtggcgtttgtgc

SEQ ID NO: 92687 - DNA, 25 bp, Rattus norvegicus
actactcgttttacttgtgaattca

SEQ ID NO: 92688 - DNA, 25 bp, Rattus norvegicus
actactcgtttttcttgtgaattca

SEQ ID NO: 92689 - DNA, 25 bp, Rattus norvegicus
actactctcaccagtgactgaagga

SEQ ID NO: 92690 - DNA, 25 bp, Rattus norvegicus
actactctcacctgtgactgaagga

SEQ ID NO: 92691 - DNA, 25 bp, Rattus norvegicus
actactctccgcctatggaacatct

SEQ ID NO: 92692 - DNA, 25 bp, Rattus norvegicus
actactctccgcgtatggaacatct

SEQ ID NO: 92693 - DNA, 25 bp, Rattus norvegicus
actactctgagtagctggagctgca

SEQ ID NO: 92694 - DNA, 25 bp, Rattus norvegicus
actactctgagttgctggagctgca

SEQ ID NO: 92695 - DNA, 25 bp, Rattus norvegicus
actactctgggtaatgtgctctgga

SEQ ID NO: 92696 - DNA, 25 bp, Rattus norvegicus
actactctgggttatgtgctctgga

SEQ ID NO: 92697 - DNA, 25 bp, Rattus norvegicus
actactcttcttagtattctgggtg

SEQ ID NO: 92698 - DNA, 25 bp, Rattus norvegicus
actactcttctttgtattctgggtg

SEQ ID NO: 92699 - DNA, 25 bp, Rattus norvegicus
actactcttttgaatccagaggaca

SEQ ID NO: 92700 - DNA, 25 bp, Rattus norvegicus
actactcttttgtatccagaggaca

SEQ ID NO: 92701 - DNA, 25 bp, Rattus norvegicus
actactgaccttccctgagttccag

SEQ ID NO: 92702 - DNA, 25 bp, Rattus norvegicus
actactgaccttgcctgagttccag

SEQ ID NO: 92703 - DNA, 25 bp, Rattus norvegicus
actactgacgtactggtctactgta

SEQ ID NO: 92704 - DNA, 25 bp, Rattus norvegicus
actactgacgtagtggtctactgta

SEQ ID NO: 92705 - DNA, 25 bp, Rattus norvegicus
actactgacttgaagacaacctctt

SEQ ID NO: 92706 - DNA, 25 bp, Rattus norvegicus
actactgacttgtagacaacctctt

SEQ ID NO: 92707 - DNA, 25 bp, Rattus norvegicus
actactgagggtcactggccacggt

SEQ ID NO: 92708 - DNA, 25 bp, Rattus norvegicus
actactgagggtgactggccacggt

SEQ ID NO: 92709 - DNA, 25 bp, Rattus norvegicus
actactgcaatcacttcaactacat

SEQ ID NO: 92710 - DNA, 25 bp, Rattus norvegicus
actactgcaatctcttcaactacat

SEQ ID NO: 92711 - DNA, 25 bp, Rattus norvegicus
actactgcattaactttgagcccat

SEQ ID NO: 92712 - DNA, 25 bp, Rattus norvegicus
actactgcattatctttgagcccat

SEQ ID NO: 92713 - DNA, 25 bp, Rattus norvegicus
actactgccacaatcactgtgatga

SEQ ID NO: 92714 - DNA, 25 bp, Rattus norvegicus
actactgccacattcactgtgatga

SEQ ID NO: 92715 - DNA, 25 bp, Rattus norvegicus
actactgccggaagtcataccatta

SEQ ID NO: 92716 - DNA, 25 bp, Rattus norvegicus
actactgccggatgtcataccatta

SEQ ID NO: 92717 - DNA, 25 bp, Rattus norvegicus
actactgctagtctgagcatgcctt

SEQ ID NO: 92718 - DNA, 25 bp, Rattus norvegicus
actactgctagtgtgagcatgcctt

SEQ ID NO: 92719 - DNA, 25 bp, Rattus norvegicus
actactgctcctctgacgagtgctg

SEQ ID NO: 92720 - DNA, 25 bp, Rattus norvegicus
actactgctcctgtgacgagtgctg

SEQ ID NO: 92721 - DNA, 25 bp, Rattus norvegicus
actactggagtgagtgcgcttgcgc

SEQ ID NO: 92722 - DNA, 25 bp, Rattus norvegicus
actactggagtgtgtgcgcttgcgc

SEQ ID NO: 92723 - DNA, 25 bp, Rattus norvegicus
actactggcctgcattgtgggactg

SEQ ID NO: 92724 - DNA, 25 bp, Rattus norvegicus
actactggcctggattgtgggactg

SEQ ID NO: 92725 - DNA, 25 bp, Rattus norvegicus
actactgggcccaggtttctgatga

SEQ ID NO: 92726 - DNA, 25 bp, Rattus norvegicus
actactgggccctggtttctgatga

SEQ ID NO: 92727 - DNA, 25 bp, Rattus norvegicus
actactggtagtagacggctctgtc

SEQ ID NO: 92728 - DNA, 25 bp, Rattus norvegicus
actactggtagttgacggctctgtc

SEQ ID NO: 92729 - DNA, 25 bp, Rattus norvegicus
actactgtaaggatctggcatcaat

SEQ ID NO: 92730 - DNA, 25 bp, Rattus norvegicus
actactgtaaggttctggcatcaat

SEQ ID NO: 92731 - DNA, 25 bp, Rattus norvegicus
actactgtaatgaggtgcaaaactt

SEQ ID NO: 92732 - DNA, 25 bp, Rattus norvegicus
actactgtaatgtggtgcaaaactt

SEQ ID NO: 92733 - DNA, 25 bp, Rattus norvegicus
actactgtagctacttacctggtct

SEQ ID NO: 92734 - DNA, 25 bp, Rattus norvegicus
actactgtagcttcttacctggtct

SEQ ID NO: 92735 - DNA, 25 bp, Rattus norvegicus
actactgtaggcctctgtggtctaa

SEQ ID NO: 92736 - DNA, 25 bp, Rattus norvegicus
actactgtaggcgtctgtggtctaa

SEQ ID NO: 92737 - DNA, 25 bp, Rattus norvegicus
actactgtagggaggtgtctcttgc

SEQ ID NO: 92738 - DNA, 25 bp, Rattus norvegicus
actactgtagggtggtgtctcttgc

SEQ ID NO: 92739 - DNA, 25 bp, Rattus norvegicus
actactgtcagtcgatggaggtgta

SEQ ID NO: 92740 - DNA, 25 bp, Rattus norvegicus
actactgtcagtggatggaggtgta

SEQ ID NO: 92741 - DNA, 25 bp, Rattus norvegicus
actactgtcataatgtacttgctat

SEQ ID NO: 92742 - DNA, 25 bp, Rattus norvegicus
actactgtcatattgtacttgctat

SEQ ID NO: 92743 - DNA, 25 bp, Rattus norvegicus
actactgtcgtgagttaacgtttct

SEQ ID NO: 92744 - DNA, 25 bp, Rattus norvegicus
actactgtcgtgtgttaacgtttct

SEQ ID NO: 92745 - DNA, 25 bp, Rattus norvegicus
actactgtctctctgttactgttgg

SEQ ID NO: 92746 - DNA, 25 bp, Rattus norvegicus
actactgtctctgtgttactgttgg

SEQ ID NO: 92747 - DNA, 25 bp, Rattus norvegicus
actactgtcttaactctggtgtgtg

SEQ ID NO: 92748 - DNA, 25 bp, Rattus norvegicus
actactgtcttatctctggtgtgtg

SEQ ID NO: 92749 - DNA, 25 bp, Rattus norvegicus
actactgtcttgagctttaccatgt

SEQ ID NO: 92750 - DNA, 25 bp, Rattus norvegicus
actactgtcttgtgctttaccatgt

SEQ ID NO: 92751 - DNA, 25 bp, Rattus norvegicus
actactgtggatcaaggcatgtctc

SEQ ID NO: 92752 - DNA, 25 bp, Rattus norvegicus
actactgtggatgaaggcatgtctc

SEQ ID NO: 92753 - DNA, 25 bp, Rattus norvegicus
actactgtggctcgttttatgtaaa

SEQ ID NO: 92754 - DNA, 25 bp, Rattus norvegicus
actactgtggctggttttatgtaaa

SEQ ID NO: 92755 - DNA, 25 bp, Rattus norvegicus
actactgtgtccactttctaaataa

SEQ ID NO: 92756 - DNA, 25 bp, Rattus norvegicus
actactgtgtcctctttctaaataa

SEQ ID NO: 92757 - DNA, 25 bp, Rattus norvegicus
actactgtgtgtctgtttattttga

SEQ ID NO: 92758 - DNA, 25 bp, Rattus norvegicus
actactgtgtgtgtgtttattttga

SEQ ID NO: 92759 - DNA, 25 bp, Rattus norvegicus
actactgttctgagcattggtttgg

SEQ ID NO: 92760 - DNA, 25 bp, Rattus norvegicus
actactgttctgtgcattggtttgg

SEQ ID NO: 92761 - DNA, 25 bp, Rattus norvegicus
actactgtttgtaagttccatggta

SEQ ID NO: 92762 - DNA, 25 bp, Rattus norvegicus
actactgtttgttagttccatggta

SEQ ID NO: 92763 - DNA, 25 bp, Rattus norvegicus
actactgttttgagcaagtgctgta

SEQ ID NO: 92764 - DNA, 25 bp, Rattus norvegicus
actactgttttgtgcaagtgctgta

SEQ ID NO: 92765 - DNA, 25 bp, Rattus norvegicus
actacttattgcaaggtggtttcca

SEQ ID NO: 92766 - DNA, 25 bp, Rattus norvegicus
actacttattgctaggtggtttcca

SEQ ID NO: 92767 - DNA, 25 bp, Rattus norvegicus
actacttgctataggtcagtttcaa

SEQ ID NO: 92768 - DNA, 25 bp, Rattus norvegicus
actacttgctattggtcagtttcaa

SEQ ID NO: 92769 - DNA, 25 bp, Rattus norvegicus
actacttggaagcacatgactaatt

SEQ ID NO: 92770 - DNA, 25 bp, Rattus norvegicus
actacttggaaggacatgactaatt

SEQ ID NO: 92771 - DNA, 25 bp, Rattus norvegicus
actacttgtgttctcttaatggcct

SEQ ID NO: 92772 - DNA, 25 bp, Rattus norvegicus
actacttgtgttgtcttaatggcct

SEQ ID NO: 92773 - DNA, 25 bp, Rattus norvegicus
actactttacagatggtctcactaa

SEQ ID NO: 92774 - DNA, 25 bp, Rattus norvegicus
actactttacagttggtctcactaa

SEQ ID NO: 92775 - DNA, 25 bp, Rattus norvegicus
actactttcattatatttatgcctt

SEQ ID NO: 92776 - DNA, 25 bp, Rattus norvegicus
actactttcattttatttatgcctt

SEQ ID NO: 92777 - DNA, 25 bp, Rattus norvegicus
actactttccataaactgtgttatc

SEQ ID NO: 92778 - DNA, 25 bp, Rattus norvegicus
actactttccattaactgtgttatc

SEQ ID NO: 92779 - DNA, 25 bp, Rattus norvegicus
actactttgcatctctacggaatga

SEQ ID NO: 92780 - DNA, 25 bp, Rattus norvegicus
actactttgcatgtctacggaatga

SEQ ID NO: 92781 - DNA, 25 bp, Rattus norvegicus
actactttgtacacagtaccctaat

SEQ ID NO: 92782 - DNA, 25 bp, Rattus norvegicus
actactttgtactcagtaccctaat

SEQ ID NO: 92783 - DNA, 25 bp, Rattus norvegicus
actactttgttcattgattttctgg

SEQ ID NO: 92784 - DNA, 25 bp, Rattus norvegicus
actactttgttctttgattttctgg

SEQ ID NO: 92785 - DNA, 25 bp, Rattus norvegicus
actactttgtttcatttcctttgtg

SEQ ID NO: 92786 - DNA, 25 bp, Rattus norvegicus
actactttgtttgatttcctttgtg

SEQ ID NO: 92787 - DNA, 25 bp, Rattus norvegicus
actacttttggtctgggtgaagtct

SEQ ID NO: 92788 - DNA, 25 bp, Rattus norvegicus
actacttttggtgtgggtgaagtct

SEQ ID NO: 92789 - DNA, 25 bp, Rattus norvegicus
actacttttgtgatgtctccatggt

SEQ ID NO: 92790 - DNA, 25 bp, Rattus norvegicus
actacttttgtgttgtctccatggt

SEQ ID NO: 92791 - DNA, 25 bp, Rattus norvegicus
actagaaacatcctaggcccacttt

SEQ ID NO: 92792 - DNA, 25 bp, Rattus norvegicus
actagaaacatcgtaggcccacttt

SEQ ID NO: 92793 - DNA, 25 bp, Rattus norvegicus
actagaaacttcattgaggcataac

SEQ ID NO: 92794 - DNA, 25 bp, Rattus norvegicus
actagaaacttctttgaggcataac

SEQ ID NO: 92795 - DNA, 25 bp, Rattus norvegicus
actagaaccgtacggctggaccaca

SEQ ID NO: 92796 - DNA, 25 bp, Rattus norvegicus
actagaaccgtagggctggaccaca

SEQ ID NO: 92797 - DNA, 25 bp, Rattus norvegicus
actagaacttctatcaacttgatgt

SEQ ID NO: 92798 - DNA, 25 bp, Rattus norvegicus
actagaacttctttcaacttgatgt

SEQ ID NO: 92799 - DNA, 25 bp, Rattus norvegicus
actagaagatgtccctcatgacccc

SEQ ID NO: 92800 - DNA, 25 bp, Rattus norvegicus
actagaagatgtgcctcatgacccc

SEQ ID NO: 92801 - DNA, 25 bp, Rattus norvegicus
actagaatacacataaccccacagc

SEQ ID NO: 92802 - DNA, 25 bp, Rattus norvegicus
actagaatacacttaaccccacagc

SEQ ID NO: 92803 - DNA, 25 bp, Rattus norvegicus
actagaatctttacgttcatcatta

SEQ ID NO: 92804 - DNA, 25 bp, Rattus norvegicus
actagaatcttttcgttcatcatta

SEQ ID NO: 92805 - DNA, 25 bp, Rattus norvegicus
actagaatgactacccacataccta

SEQ ID NO: 92806 - DNA, 25 bp, Rattus norvegicus
actagaatgacttcccacataccta

SEQ ID NO: 92807 - DNA, 25 bp, Rattus norvegicus
actagaattcggctccagccattga

SEQ ID NO: 92808 - DNA, 25 bp, Rattus norvegicus
actagaattcgggtccagccattga

SEQ ID NO: 92809 - DNA, 25 bp, Rattus norvegicus
actagacaagcgatctgcacactga

SEQ ID NO: 92810 - DNA, 25 bp, Rattus norvegicus
actagacaagcgttctgcacactga

SEQ ID NO: 92811 - DNA, 25 bp, Rattus norvegicus
actagacacgccatctaatgctact

SEQ ID NO: 92812 - DNA, 25 bp, Rattus norvegicus
actagacacgccttctaatgctact

SEQ ID NO: 92813 - DNA, 25 bp, Rattus norvegicus
actagacagggcataggcgtgtact

SEQ ID NO: 92814 - DNA, 25 bp, Rattus norvegicus
actagacagggcttaggcgtgtact

SEQ ID NO: 92815 - DNA, 25 bp, Rattus norvegicus
actagacatcaaagccgctttccag

SEQ ID NO: 92816 - DNA, 25 bp, Rattus norvegicus
actagacatcaatgccgctttccag

SEQ ID NO: 92817 - DNA, 25 bp, Rattus norvegicus
actagaccgttaacttcctgtgata

SEQ ID NO: 92818 - DNA, 25 bp, Rattus norvegicus
actagaccgttatcttcctgtgata

SEQ ID NO: 92819 - DNA, 25 bp, Rattus norvegicus
actagacctagccggagctggcgca

SEQ ID NO: 92820 - DNA, 25 bp, Rattus norvegicus
actagacctagcgggagctggcgca

SEQ ID NO: 92821 - DNA, 25 bp, Rattus norvegicus
actagacctcagcagtgacgctcac

SEQ ID NO: 92822 - DNA, 25 bp, Rattus norvegicus
actagacctcaggagtgacgctcac

SEQ ID NO: 92823 - DNA, 25 bp, Rattus norvegicus
actagacctttccattgtatcagag

SEQ ID NO: 92824 - DNA, 25 bp, Rattus norvegicus
actagacctttcgattgtatcagag

SEQ ID NO: 92825 - DNA, 25 bp, Rattus norvegicus
actagactgcaacgccctggactta

SEQ ID NO: 92826 - DNA, 25 bp, Rattus norvegicus
actagactgcaaggccctggactta

SEQ ID NO: 92827 - DNA, 25 bp, Rattus norvegicus
actagactgccaaacctgtgtgaag

SEQ ID NO: 92828 - DNA, 25 bp, Rattus norvegicus
actagactgccatacctgtgtgaag

SEQ ID NO: 92829 - DNA, 25 bp, Rattus norvegicus
actagactggaacctcctcgagggc

SEQ ID NO: 92830 - DNA, 25 bp, Rattus norvegicus
actagactggaagctcctcgagggc

SEQ ID NO: 92831 - DNA, 25 bp, Rattus norvegicus
actagactgtgaactcctctggagc

SEQ ID NO: 92832 - DNA, 25 bp, Rattus norvegicus
actagactgtgatctcctctggagc

SEQ ID NO: 92833 - DNA, 25 bp, Rattus norvegicus
actagacttccaaattagcttcttt

SEQ ID NO: 92834 - DNA, 25 bp, Rattus norvegicus
actagacttccatattagcttcttt

SEQ ID NO: 92835 - DNA, 25 bp, Rattus norvegicus
actagagactctctttgccaaactt

SEQ ID NO: 92836 - DNA, 25 bp, Rattus norvegicus
actagagactctgtttgccaaactt

SEQ ID NO: 92837 - DNA, 25 bp, Rattus norvegicus
actagagagattcttctgtggttca

SEQ ID NO: 92838 - DNA, 25 bp, Rattus norvegicus
actagagagattgttctgtggttca

SEQ ID NO: 92839 - DNA, 25 bp, Rattus norvegicus
actagagagcctctgggcctcctga

SEQ ID NO: 92840 - DNA, 25 bp, Rattus norvegicus
actagagagcctgtgggcctcctga

SEQ ID NO: 92841 - DNA, 25 bp, Rattus norvegicus
actagagagttcaccgacaacctgg

SEQ ID NO: 92842 - DNA, 25 bp, Rattus norvegicus
actagagagttctccgacaacctgg

SEQ ID NO: 92843 - DNA, 25 bp, Rattus norvegicus
actagagatgttctgtggcatgaca

SEQ ID NO: 92844 - DNA, 25 bp, Rattus norvegicus
actagagatgttgtgtggcatgaca

SEQ ID NO: 92845 - DNA, 25 bp, Rattus norvegicus
actagagcctgcctggtttgaagca

SEQ ID NO: 92846 - DNA, 25 bp, Rattus norvegicus
actagagcctgcgtggtttgaagca

SEQ ID NO: 92847 - DNA, 25 bp, Rattus norvegicus
actagagctcccctgacttgagtct

SEQ ID NO: 92848 - DNA, 25 bp, Rattus norvegicus
actagagctcccgtgacttgagtct

SEQ ID NO: 92849 - DNA, 25 bp, Rattus norvegicus
actagaggaccaactctctgagggc

SEQ ID NO: 92850 - DNA, 25 bp, Rattus norvegicus
actagaggaccatctctctgagggc

SEQ ID NO: 92851 - DNA, 25 bp, Rattus norvegicus
actagaggctgaacatcccgtgagc

SEQ ID NO: 92852 - DNA, 25 bp, Rattus norvegicus
actagaggctgatcatcccgtgagc

SEQ ID NO: 92853 - DNA, 25 bp, Rattus norvegicus
actagaggtgctccccatggcggcc

SEQ ID NO: 92854 - DNA, 25 bp, Rattus norvegicus
actagaggtgctgcccatggcggcc

SEQ ID NO: 92855 - DNA, 25 bp, Rattus norvegicus
actagagttctccagcaggtgggct

SEQ ID NO: 92856 - DNA, 25 bp, Rattus norvegicus
actagagttctcgagcaggtgggct

SEQ ID NO: 92857 - DNA, 25 bp, Rattus norvegicus
actagatagccaagctgggctcggc

SEQ ID NO: 92858 - DNA, 25 bp, Rattus norvegicus
actagatagccatgctgggctcggc

SEQ ID NO: 92859 - DNA, 25 bp, Rattus norvegicus
actagatcgcagagtgctttttccc

SEQ ID NO: 92860 - DNA, 25 bp, Rattus norvegicus
actagatcgcagtgtgctttttccc

SEQ ID NO: 92861 - DNA, 25 bp, Rattus norvegicus
actagatgactacagggcccggtgt

SEQ ID NO: 92862 - DNA, 25 bp, Rattus norvegicus
actagatgactagagggcccggtgt

SEQ ID NO: 92863 - DNA, 25 bp, Rattus norvegicus
actagatgatggctacagtcctcca

SEQ ID NO: 92864 - DNA, 25 bp, Rattus norvegicus
actagatgatgggtacagtcctcca

SEQ ID NO: 92865 - DNA, 25 bp, Rattus norvegicus
actagatgattcattggtgtctctc

SEQ ID NO: 92866 - DNA, 25 bp, Rattus norvegicus
actagatgattctttggtgtctctc

SEQ ID NO: 92867 - DNA, 25 bp, Rattus norvegicus
actagatgtgctctcgtgctgggca

SEQ ID NO: 92868 - DNA, 25 bp, Rattus norvegicus
actagatgtgctgtcgtgctgggca

SEQ ID NO: 92869 - DNA, 25 bp, Rattus norvegicus
actagattatcaactgggcagtctg

SEQ ID NO: 92870 - DNA, 25 bp, Rattus norvegicus
actagattatcatctgggcagtctg

SEQ ID NO: 92871 - DNA, 25 bp, Rattus norvegicus
actagatttggaccttctgtgctgc

SEQ ID NO: 92872 - DNA, 25 bp, Rattus norvegicus
actagatttggagcttctgtgctgc

SEQ ID NO: 92873 - DNA, 25 bp, Rattus norvegicus
actagatttgtcagtgggtccacct

SEQ ID NO: 92874 - DNA, 25 bp, Rattus norvegicus
actagatttgtctgtgggtccacct

SEQ ID NO: 92875 - DNA, 25 bp, Rattus norvegicus
actagatttgttcatgccatgttac

SEQ ID NO: 92876 - DNA, 25 bp, Rattus norvegicus
actagatttgttgatgccatgttac

SEQ ID NO: 92877 - DNA, 25 bp, Rattus norvegicus
actagcaaattcagtcctggttaaa

SEQ ID NO: 92878 - DNA, 25 bp, Rattus norvegicus
actagcaaattctgtcctggttaaa

SEQ ID NO: 92879 - DNA, 25 bp, Rattus norvegicus
actagcacatggctgtcgggttttc

SEQ ID NO: 92880 - DNA, 25 bp, Rattus norvegicus
actagcacatgggtgtcgggttttc

SEQ ID NO: 92881 - DNA, 25 bp, Rattus norvegicus
actagcaccgtgcttgctggaggct

SEQ ID NO: 92882 - DNA, 25 bp, Rattus norvegicus
actagcaccgtggttgctggaggct

SEQ ID NO: 92883 - DNA, 25 bp, Rattus norvegicus
actagcacctttctgtttgttggaa

SEQ ID NO: 92884 - DNA, 25 bp, Rattus norvegicus
actagcacctttgtgtttgttggaa

SEQ ID NO: 92885 - DNA, 25 bp, Rattus norvegicus
actagcacgaacactgttgccgtag

SEQ ID NO: 92886 - DNA, 25 bp, Rattus norvegicus
actagcacgaactctgttgccgtag

SEQ ID NO: 92887 - DNA, 25 bp, Rattus norvegicus
actagcactgtcacctaaacttgta

SEQ ID NO: 92888 - DNA, 25 bp, Rattus norvegicus
actagcactgtctcctaaacttgta

SEQ ID NO: 92889 - DNA, 25 bp, Rattus norvegicus
actagcactgtgatagccctgagga

SEQ ID NO: 92890 - DNA, 25 bp, Rattus norvegicus
actagcactgtgttagccctgagga

SEQ ID NO: 92891 - DNA, 25 bp, Rattus norvegicus
actagcagagtcatagtccctgaag

SEQ ID NO: 92892 - DNA, 25 bp, Rattus norvegicus
actagcagagtcttagtccctgaag

SEQ ID NO: 92893 - DNA, 25 bp, Rattus norvegicus
actagcagggcgaagctgtcgtgca

SEQ ID NO: 92894 - DNA, 25 bp, Rattus norvegicus
actagcagggcgtagctgtcgtgca

SEQ ID NO: 92895 - DNA, 25 bp, Rattus norvegicus
actagcagtctcaactactctggac

SEQ ID NO: 92896 - DNA, 25 bp, Rattus norvegicus
actagcagtctctactactctggac

SEQ ID NO: 92897 - DNA, 25 bp, Rattus norvegicus
actagcagtgccagtcgggaactgg

SEQ ID NO: 92898 - DNA, 25 bp, Rattus norvegicus
actagcagtgcctgtcgggaactgg

SEQ ID NO: 92899 - DNA, 25 bp, Rattus norvegicus
actagcagttttcctacttagcgca

SEQ ID NO: 92900 - DNA, 25 bp, Rattus norvegicus
actagcagttttgctacttagcgca

SEQ ID NO: 92901 - DNA, 25 bp, Rattus norvegicus
actagcataataaaccttgatctgg

SEQ ID NO: 92902 - DNA, 25 bp, Rattus norvegicus
actagcataatataccttgatctgg

SEQ ID NO: 92903 - DNA, 25 bp, Rattus norvegicus
actagcatggctcccgtgtcttctg

SEQ ID NO: 92904 - DNA, 25 bp, Rattus norvegicus
actagcatggctgccgtgtcttctg

SEQ ID NO: 92905 - DNA, 25 bp, Rattus norvegicus
actagccaaagccatactgttcaaa

SEQ ID NO: 92906 - DNA, 25 bp, Rattus norvegicus
actagccaaagcgatactgttcaaa

SEQ ID NO: 92907 - DNA, 25 bp, Rattus norvegicus
actagccacgggaactgctgattat

SEQ ID NO: 92908 - DNA, 25 bp, Rattus norvegicus
actagccacgggtactgctgattat

SEQ ID NO: 92909 - DNA, 25 bp, Rattus norvegicus
actagccagcagaccagcattggag

SEQ ID NO: 92910 - DNA, 25 bp, Rattus norvegicus
actagccagcagtccagcattggag

SEQ ID NO: 92911 - DNA, 25 bp, Rattus norvegicus
actagccatgtcagtgggttccttt

SEQ ID NO: 92912 - DNA, 25 bp, Rattus norvegicus
actagccatgtctgtgggttccttt

SEQ ID NO: 92913 - DNA, 25 bp, Rattus norvegicus
actagccccggcatcagctatggaa

SEQ ID NO: 92914 - DNA, 25 bp, Rattus norvegicus
actagccccggcttcagctatggaa

SEQ ID NO: 92915 - DNA, 25 bp, Rattus norvegicus
actagccgctctcactgtgccggga

SEQ ID NO: 92916 - DNA, 25 bp, Rattus norvegicus
actagccgctctgactgtgccggga

SEQ ID NO: 92917 - DNA, 25 bp, Rattus norvegicus
actagccgtaccctcatagatttgt

SEQ ID NO: 92918 - DNA, 25 bp, Rattus norvegicus
actagccgtaccgtcatagatttgt

SEQ ID NO: 92919 - DNA, 25 bp, Rattus norvegicus
actagccgtgacagagagcctggaa

SEQ ID NO: 92920 - DNA, 25 bp, Rattus norvegicus
actagccgtgactgagagcctggaa

SEQ ID NO: 92921 - DNA, 25 bp, Rattus norvegicus
actagcctcaaaatctgtctgtctc

SEQ ID NO: 92922 - DNA, 25 bp, Rattus norvegicus
actagcctcaaattctgtctgtctc

SEQ ID NO: 92923 - DNA, 25 bp, Rattus norvegicus
actagcctcctgatgctcaaattgt

SEQ ID NO: 92924 - DNA, 25 bp, Rattus norvegicus
actagcctcctgttgctcaaattgt

SEQ ID NO: 92925 - DNA, 25 bp, Rattus norvegicus
actagcctgtctctaaggcccagac

SEQ ID NO: 92926 - DNA, 25 bp, Rattus norvegicus
actagcctgtctgtaaggcccagac

SEQ ID NO: 92927 - DNA, 25 bp, Rattus norvegicus
actagccttaggcttgcggtctgtc

SEQ ID NO: 92928 - DNA, 25 bp, Rattus norvegicus
actagccttagggttgcggtctgtc

SEQ ID NO: 92929 - DNA, 25 bp, Rattus norvegicus
actagcgaacaacttccttccctgg

SEQ ID NO: 92930 - DNA, 25 bp, Rattus norvegicus
actagcgaacaagttccttccctgg

SEQ ID NO: 92931 - DNA, 25 bp, Rattus norvegicus
actagcgctgtcaccgagtggcttt

SEQ ID NO: 92932 - DNA, 25 bp, Rattus norvegicus
actagcgctgtctccgagtggcttt

SEQ ID NO: 92933 - DNA, 25 bp, Rattus norvegicus
actagcggacctcagtcacgtggag

SEQ ID NO: 92934 - DNA, 25 bp, Rattus norvegicus
actagcggacctgagtcacgtggag

SEQ ID NO: 92935 - DNA, 25 bp, Rattus norvegicus
actagctagacacaggaggcattcc

SEQ ID NO: 92936 - DNA, 25 bp, Rattus norvegicus
actagctagacagaggaggcattcc

SEQ ID NO: 92937 - DNA, 25 bp, Rattus norvegicus
actagctagggcacttcggtggttc

SEQ ID NO: 92938 - DNA, 25 bp, Rattus norvegicus
actagctagggctcttcggtggttc

SEQ ID NO: 92939 - DNA, 25 bp, Rattus norvegicus
actagctcaacacatccattctaaa

SEQ ID NO: 92940 - DNA, 25 bp, Rattus norvegicus
actagctcaacagatccattctaaa

SEQ ID NO: 92941 - DNA, 25 bp, Rattus norvegicus
actagctccactataaggacctgca

SEQ ID NO: 92942 - DNA, 25 bp, Rattus norvegicus
actagctccactttaaggacctgca

SEQ ID NO: 92943 - DNA, 25 bp, Rattus norvegicus
actagctctggacagtaacctccaa

SEQ ID NO: 92944 - DNA, 25 bp, Rattus norvegicus
actagctctggagagtaacctccaa

SEQ ID NO: 92945 - DNA, 25 bp, Rattus norvegicus
actagctctggtatcggatgcggta

SEQ ID NO: 92946 - DNA, 25 bp, Rattus norvegicus
actagctctggtttcggatgcggta

SEQ ID NO: 92947 - DNA, 25 bp, Rattus norvegicus
actagctgaagaaccttttgccggt

SEQ ID NO: 92948 - DNA, 25 bp, Rattus norvegicus
actagctgaagatccttttgccggt

SEQ ID NO: 92949 - DNA, 25 bp, Rattus norvegicus
actagctgaggtcagccgccaactt

SEQ ID NO: 92950 - DNA, 25 bp, Rattus norvegicus
actagctgaggtgagccgccaactt

SEQ ID NO: 92951 - DNA, 25 bp, Rattus norvegicus
actagctgattgatttccaccgtgg

SEQ ID NO: 92952 - DNA, 25 bp, Rattus norvegicus
actagctgattgttttccaccgtgg

SEQ ID NO: 92953 - DNA, 25 bp, Rattus norvegicus
actagctgcttaaagaatttcctga

SEQ ID NO: 92954 - DNA, 25 bp, Rattus norvegicus
actagctgcttatagaatttcctga

SEQ ID NO: 92955 - DNA, 25 bp, Rattus norvegicus
actagctgggcccttaatggcggac

SEQ ID NO: 92956 - DNA, 25 bp, Rattus norvegicus
actagctgggccgttaatggcggac

SEQ ID NO: 92957 - DNA, 25 bp, Rattus norvegicus
actagctggtggcatggagctctct

SEQ ID NO: 92958 - DNA, 25 bp, Rattus norvegicus
actagctggtgggatggagctctct

SEQ ID NO: 92959 - DNA, 25 bp, Rattus norvegicus
actagcttagctcatatgtccatat

SEQ ID NO: 92960 - DNA, 25 bp, Rattus norvegicus
actagcttagctgatatgtccatat

SEQ ID NO: 92961 - DNA, 25 bp, Rattus norvegicus
actagctttcacacttactgttctc

SEQ ID NO: 92962 - DNA, 25 bp, Rattus norvegicus
actagctttcactcttactgttctc

SEQ ID NO: 92963 - DNA, 25 bp, Rattus norvegicus
actagctttctaaatgtgtccttac

SEQ ID NO: 92964 - DNA, 25 bp, Rattus norvegicus
actagctttctatatgtgtccttac

SEQ ID NO: 92965 - DNA, 25 bp, Rattus norvegicus
actagcttttccaacatgagtctac

SEQ ID NO: 92966 - DNA, 25 bp, Rattus norvegicus
actagcttttcctacatgagtctac

SEQ ID NO: 92967 - DNA, 25 bp, Rattus norvegicus
actaggaaatgcactgggtgggact

SEQ ID NO: 92968 - DNA, 25 bp, Rattus norvegicus
actaggaaatgctctgggtgggact

SEQ ID NO: 92969 - DNA, 25 bp, Rattus norvegicus
actaggaagcgcaccaaagggagag

SEQ ID NO: 92970 - DNA, 25 bp, Rattus norvegicus
actaggaagcgctccaaagggagag

SEQ ID NO: 92971 - DNA, 25 bp, Rattus norvegicus
actaggaatggccttcggcagcgca

SEQ ID NO: 92972 - DNA, 25 bp, Rattus norvegicus
actaggaatggcgttcggcagcgca

SEQ ID NO: 92973 - DNA, 25 bp, Rattus norvegicus
actaggaattgaccccaggttctct

SEQ ID NO: 92974 - DNA, 25 bp, Rattus norvegicus
actaggaattgagcccaggttctct

SEQ ID NO: 92975 - DNA, 25 bp, Rattus norvegicus
actaggactcacattccactttaag

SEQ ID NO: 92976 - DNA, 25 bp, Rattus norvegicus
actaggactcactttccactttaag

SEQ ID NO: 92977 - DNA, 25 bp, Rattus norvegicus
actaggactccaaggcacacggtgg

SEQ ID NO: 92978 - DNA, 25 bp, Rattus norvegicus
actaggactccatggcacacggtgg

SEQ ID NO: 92979 - DNA, 25 bp, Rattus norvegicus
actaggagagccatccagggctcta

SEQ ID NO: 92980 - DNA, 25 bp, Rattus norvegicus
actaggagagccttccagggctcta

SEQ ID NO: 92981 - DNA, 25 bp, Rattus norvegicus
actaggagagctccaggtacctgcc

SEQ ID NO: 92982 - DNA, 25 bp, Rattus norvegicus
actaggagagctgcaggtacctgcc

SEQ ID NO: 92983 - DNA, 25 bp, Rattus norvegicus
actaggagaggtcgcaagaatgttt

SEQ ID NO: 92984 - DNA, 25 bp, Rattus norvegicus
actaggagaggtggcaagaatgttt

SEQ ID NO: 92985 - DNA, 25 bp, Rattus norvegicus
actaggagccccattcctgtagtct

SEQ ID NO: 92986 - DNA, 25 bp, Rattus norvegicus
actaggagcccctttcctgtagtct

SEQ ID NO: 92987 - DNA, 25 bp, Rattus norvegicus
actaggaggactactgtgtgagagc

SEQ ID NO: 92988 - DNA, 25 bp, Rattus norvegicus
actaggaggacttctgtgtgagagc

SEQ ID NO: 92989 - DNA, 25 bp, Rattus norvegicus
actaggaggctaatactacgactac

SEQ ID NO: 92990 - DNA, 25 bp, Rattus norvegicus
actaggaggctattactacgactac

SEQ ID NO: 92991 - DNA, 25 bp, Rattus norvegicus
actaggatacgacgaggccaagctc

SEQ ID NO: 92992 - DNA, 25 bp, Rattus norvegicus
actaggatacgaggaggccaagctc

SEQ ID NO: 92993 - DNA, 25 bp, Rattus norvegicus
actaggatctttactgtcagcacaa

SEQ ID NO: 92994 - DNA, 25 bp, Rattus norvegicus
actaggatcttttctgtcagcacaa

SEQ ID NO: 92995 - DNA, 25 bp, Rattus norvegicus
actaggcacagtcagggcctgcttc

SEQ ID NO: 92996 - DNA, 25 bp, Rattus norvegicus
actaggcacagtgagggcctgcttc

SEQ ID NO: 92997 - DNA, 25 bp, Rattus norvegicus
actaggcaccatatgattttccaca

SEQ ID NO: 92998 - DNA, 25 bp, Rattus norvegicus
actaggcaccatttgattttccaca

SEQ ID NO: 92999 - DNA, 25 bp, Rattus norvegicus
actaggcagtgtacaccgactggcc

SEQ ID NO: 93000 - DNA, 25 bp, Rattus norvegicus
actaggcagtgttcaccgactggcc

SEQ ID NO: 93001 - DNA, 25 bp, Rattus norvegicus
actaggcatagcacattaatgagac

SEQ ID NO: 93002 - DNA, 25 bp, Rattus norvegicus
actaggcatagctcattaatgagac

SEQ ID NO: 93003 - DNA, 25 bp, Rattus norvegicus
actaggccacagcagacaggacaag

SEQ ID NO: 93004 - DNA, 25 bp, Rattus norvegicus
actaggccacaggagacaggacaag

SEQ ID NO: 93005 - DNA, 25 bp, Rattus norvegicus
actaggcgagttctctgcttgatca

SEQ ID NO: 93006 - DNA, 25 bp, Rattus norvegicus
actaggcgagttgtctgcttgatca

SEQ ID NO: 93007 - DNA, 25 bp, Rattus norvegicus
actaggcgttgcaggacgttgccat

SEQ ID NO: 93008 - DNA, 25 bp, Rattus norvegicus
actaggcgttgctggacgttgccat

SEQ ID NO: 93009 - DNA, 25 bp, Rattus norvegicus
actaggctagcacttctaatgcaac

SEQ ID NO: 93010 - DNA, 25 bp, Rattus norvegicus
actaggctagcagttctaatgcaac

SEQ ID NO: 93011 - DNA, 25 bp, Rattus norvegicus
actaggctgcgcagttacgtatgct

SEQ ID NO: 93012 - DNA, 25 bp, Rattus norvegicus
actaggctgcgctgttacgtatgct

SEQ ID NO: 93013 - DNA, 25 bp, Rattus norvegicus
actaggcttaatcgccaagtcgttt

SEQ ID NO: 93014 - DNA, 25 bp, Rattus norvegicus
actaggcttaatggccaagtcgttt

SEQ ID NO: 93015 - DNA, 25 bp, Rattus norvegicus
actagggaccctatgctctgtggct

SEQ ID NO: 93016 - DNA, 25 bp, Rattus norvegicus
actagggaccctttgctctgtggct

SEQ ID NO: 93017 - DNA, 25 bp, Rattus norvegicus
actagggacttgcagggctctctct

SEQ ID NO: 93018 - DNA, 25 bp, Rattus norvegicus
actagggacttggagggctctctct

SEQ ID NO: 93019 - DNA, 25 bp, Rattus norvegicus
actagggatggtcctagtctggacc

SEQ ID NO: 93020 - DNA, 25 bp, Rattus norvegicus
actagggatggtgctagtctggacc

SEQ ID NO: 93021 - DNA, 25 bp, Rattus norvegicus
actagggcactacggcaggttccgt

SEQ ID NO: 93022 - DNA, 25 bp, Rattus norvegicus
actagggcactagggcaggttccgt

SEQ ID NO: 93023 - DNA, 25 bp, Rattus norvegicus
actagggctacaattccagagaagg

SEQ ID NO: 93024 - DNA, 25 bp, Rattus norvegicus
actagggctacatttccagagaagg

SEQ ID NO: 93025 - DNA, 25 bp, Rattus norvegicus
actagggctgaaaacctcctccata

SEQ ID NO: 93026 - DNA, 25 bp, Rattus norvegicus
actagggctgaatacctcctccata

SEQ ID NO: 93027 - DNA, 25 bp, Rattus norvegicus
actagggctgttacatctctgtttt

SEQ ID NO: 93028 - DNA, 25 bp, Rattus norvegicus
actagggctgtttcatctctgtttt

SEQ ID NO: 93029 - DNA, 25 bp, Rattus norvegicus
actagggtcatcacagggcggtact

SEQ ID NO: 93030 - DNA, 25 bp, Rattus norvegicus
actagggtcatctcagggcggtact

SEQ ID NO: 93031 - DNA, 25 bp, Rattus norvegicus
actagggttatgagctccaggccag

SEQ ID NO: 93032 - DNA, 25 bp, Rattus norvegicus
actagggttatgtgctccaggccag

SEQ ID NO: 93033 - DNA, 25 bp, Rattus norvegicus
actaggtacataatccaattcagga

SEQ ID NO: 93034 - DNA, 25 bp, Rattus norvegicus
actaggtacatattccaattcagga

SEQ ID NO: 93035 - DNA, 25 bp, Rattus norvegicus
actaggtagcaaaccaggtattgtc

SEQ ID NO: 93036 - DNA, 25 bp, Rattus norvegicus
actaggtagcaatccaggtattgtc

SEQ ID NO: 93037 - DNA, 25 bp, Rattus norvegicus
actaggtagcctctgtcaactctca

SEQ ID NO: 93038 - DNA, 25 bp, Rattus norvegicus
actaggtagcctgtgtcaactctca

SEQ ID NO: 93039 - DNA, 25 bp, Rattus norvegicus
actaggtcagtgctgtgttcataaa

SEQ ID NO: 93040 - DNA, 25 bp, Rattus norvegicus
actaggtcagtggtgtgttcataaa

SEQ ID NO: 93041 - DNA, 25 bp, Rattus norvegicus
actaggtcatgtcgtaatgggcaac

SEQ ID NO: 93042 - DNA, 25 bp, Rattus norvegicus
actaggtcatgtggtaatgggcaac

SEQ ID NO: 93043 - DNA, 25 bp, Rattus norvegicus
actaggtcctggagtgttccttcca

SEQ ID NO: 93044 - DNA, 25 bp, Rattus norvegicus
actaggtcctggtgtgttccttcca

SEQ ID NO: 93045 - DNA, 25 bp, Rattus norvegicus
actaggtgacacatggcttcagatc

SEQ ID NO: 93046 - DNA, 25 bp, Rattus norvegicus
actaggtgacacttggcttcagatc

SEQ ID NO: 93047 - DNA, 25 bp, Rattus norvegicus
actaggtggacaaggactggcctcc

SEQ ID NO: 93048 - DNA, 25 bp, Rattus norvegicus
actaggtggacatggactggcctcc

SEQ ID NO: 93049 - DNA, 25 bp, Rattus norvegicus
actaggtgggtcaggtcttcttcca

SEQ ID NO: 93050 - DNA, 25 bp, Rattus norvegicus
actaggtgggtctggtcttcttcca

SEQ ID NO: 93051 - DNA, 25 bp, Rattus norvegicus
actaggtttccactgtatctgataa

SEQ ID NO: 93052 - DNA, 25 bp, Rattus norvegicus
actaggtttccagtgtatctgataa

SEQ ID NO: 93053 - DNA, 25 bp, Rattus norvegicus
actaggtttttcaggacgcatcgcg

SEQ ID NO: 93054 - DNA, 25 bp, Rattus norvegicus
actaggtttttctggacgcatcgcg

SEQ ID NO: 93055 - DNA, 25 bp, Rattus norvegicus
actagtaaaacgcatgctctctggg

SEQ ID NO: 93056 - DNA, 25 bp, Rattus norvegicus
actagtaaaacggatgctctctggg

SEQ ID NO: 93057 - DNA, 25 bp, Rattus norvegicus
actagtaaggtcacccgtgcaggct

SEQ ID NO: 93058 - DNA, 25 bp, Rattus norvegicus
actagtaaggtctcccgtgcaggct

SEQ ID NO: 93059 - DNA, 25 bp, Rattus norvegicus
actagtaatttacatgcccagccct

SEQ ID NO: 93060 - DNA, 25 bp, Rattus norvegicus
actagtaatttagatgcccagccct

SEQ ID NO: 93061 - DNA, 25 bp, Rattus norvegicus
actagtacttagactcacctcggga

SEQ ID NO: 93062 - DNA, 25 bp, Rattus norvegicus
actagtacttagtctcacctcggga

SEQ ID NO: 93063 - DNA, 25 bp, Rattus norvegicus
actagtacttctatgatttctcgta

SEQ ID NO: 93064 - DNA, 25 bp, Rattus norvegicus
actagtacttctttgatttctcgta

SEQ ID NO: 93065 - DNA, 25 bp, Rattus norvegicus
actagtagtcacatgctctgtggcc

SEQ ID NO: 93066 - DNA, 25 bp, Rattus norvegicus
actagtagtcacttgctctgtggcc

SEQ ID NO: 93067 - DNA, 25 bp, Rattus norvegicus
actagtcaagtacacggcagcctgc

SEQ ID NO: 93068 - DNA, 25 bp, Rattus norvegicus
actagtcaagtagacggcagcctgc

SEQ ID NO: 93069 - DNA, 25 bp, Rattus norvegicus
actagtcacaggagtagcttactac

SEQ ID NO: 93070 - DNA, 25 bp, Rattus norvegicus
actagtcacaggtgtagcttactac

SEQ ID NO: 93071 - DNA, 25 bp, Rattus norvegicus
actagtcctgcacccttcagattaa

SEQ ID NO: 93072 - DNA, 25 bp, Rattus norvegicus
actagtcctgcagccttcagattaa

SEQ ID NO: 93073 - DNA, 25 bp, Rattus norvegicus
actagtcgatggctgattccggatc

SEQ ID NO: 93074 - DNA, 25 bp, Rattus norvegicus
actagtcgatgggtgattccggatc

SEQ ID NO: 93075 - DNA, 25 bp, Rattus norvegicus
actagtcttctcaagttcagctcta

SEQ ID NO: 93076 - DNA, 25 bp, Rattus norvegicus
actagtcttctctagttcagctcta

SEQ ID NO: 93077 - DNA, 25 bp, Rattus norvegicus
actagtcttgtcagtgcagggtgag

SEQ ID NO: 93078 - DNA, 25 bp, Rattus norvegicus
actagtcttgtctgtgcagggtgag

SEQ ID NO: 93079 - DNA, 25 bp, Rattus norvegicus
actagtctttatattgcatttttcg

SEQ ID NO: 93080 - DNA, 25 bp, Rattus norvegicus
actagtctttattttgcatttttcg

SEQ ID NO: 93081 - DNA, 25 bp, Rattus norvegicus
actagtcttttgagtatgcctgtgc

SEQ ID NO: 93082 - DNA, 25 bp, Rattus norvegicus
actagtcttttgtgtatgcctgtgc

SEQ ID NO: 93083 - DNA, 25 bp, Rattus norvegicus
actagtgacgtgaccgccattgaaa

SEQ ID NO: 93084 - DNA, 25 bp, Rattus norvegicus
actagtgacgtgtccgccattgaaa

SEQ ID NO: 93085 - DNA, 25 bp, Rattus norvegicus
actagtgacgttcttttctgtatct

SEQ ID NO: 93086 - DNA, 25 bp, Rattus norvegicus
actagtgacgttgttttctgtatct

SEQ ID NO: 93087 - DNA, 25 bp, Rattus norvegicus
actagtgagaatctggcctcctacc

SEQ ID NO: 93088 - DNA, 25 bp, Rattus norvegicus
actagtgagaatgtggcctcctacc

SEQ ID NO: 93089 - DNA, 25 bp, Rattus norvegicus
actagtgaggttacagactcttgta

SEQ ID NO: 93090 - DNA, 25 bp, Rattus norvegicus
actagtgaggtttcagactcttgta

SEQ ID NO: 93091 - DNA, 25 bp, Rattus norvegicus
actagtgcagacaacagccagggtg

SEQ ID NO: 93092 - DNA, 25 bp, Rattus norvegicus
actagtgcagactacagccagggtg

SEQ ID NO: 93093 - DNA, 25 bp, Rattus norvegicus
actagtgcaggtcaccctcagtgga

SEQ ID NO: 93094 - DNA, 25 bp, Rattus norvegicus
actagtgcaggtgaccctcagtgga

SEQ ID NO: 93095 - DNA, 25 bp, Rattus norvegicus
actagtgccaccacaagtggttgaa

SEQ ID NO: 93096 - DNA, 25 bp, Rattus norvegicus
actagtgccacctcaagtggttgaa

SEQ ID NO: 93097 - DNA, 25 bp, Rattus norvegicus
actagtgcgcagcagaagctctgat

SEQ ID NO: 93098 - DNA, 25 bp, Rattus norvegicus
actagtgcgcaggagaagctctgat

SEQ ID NO: 93099 - DNA, 25 bp, Rattus norvegicus
actagtgctgctcccgaagtggaaa

SEQ ID NO: 93100 - DNA, 25 bp, Rattus norvegicus
actagtgctgctgccgaagtggaaa

SEQ ID NO: 93101 - DNA, 25 bp, Rattus norvegicus
actagtggaccacagcaaatccttc

SEQ ID NO: 93102 - DNA, 25 bp, Rattus norvegicus
actagtggaccagagcaaatccttc

SEQ ID NO: 93103 - DNA, 25 bp, Rattus norvegicus
actagtggctgtaaatgcggacgca

SEQ ID NO: 93104 - DNA, 25 bp, Rattus norvegicus
actagtggctgttaatgcggacgca

SEQ ID NO: 93105 - DNA, 25 bp, Rattus norvegicus
actagtgtgagcatgtctgccatgc

SEQ ID NO: 93106 - DNA, 25 bp, Rattus norvegicus
actagtgtgagcttgtctgccatgc

SEQ ID NO: 93107 - DNA, 25 bp, Rattus norvegicus
actagtgtggttctcttgaaggccc

SEQ ID NO: 93108 - DNA, 25 bp, Rattus norvegicus
actagtgtggttgtcttgaaggccc

SEQ ID NO: 93109 - DNA, 25 bp, Rattus norvegicus
actagtgtgtccctttggctgtgac

SEQ ID NO: 93110 - DNA, 25 bp, Rattus norvegicus
actagtgtgtccgtttggctgtgac

SEQ ID NO: 93111 - DNA, 25 bp, Rattus norvegicus
actagtgtgtgtcgatcctcagatc

SEQ ID NO: 93112 - DNA, 25 bp, Rattus norvegicus
actagtgtgtgtggatcctcagatc

SEQ ID NO: 93113 - DNA, 25 bp, Rattus norvegicus
actagtgttctgaattttgttaaga

SEQ ID NO: 93114 - DNA, 25 bp, Rattus norvegicus
actagtgttctgtattttgttaaga

SEQ ID NO: 93115 - DNA, 25 bp, Rattus norvegicus
actagtgtttggactgtagccaggc

SEQ ID NO: 93116 - DNA, 25 bp, Rattus norvegicus
actagtgtttggtctgtagccaggc

SEQ ID NO: 93117 - DNA, 25 bp, Rattus norvegicus
actagtgtttgtatgtatccttgca

SEQ ID NO: 93118 - DNA, 25 bp, Rattus norvegicus
actagtgtttgtttgtatccttgca

SEQ ID NO: 93119 - DNA, 25 bp, Rattus norvegicus
actagttactcaacctggaggtcag

SEQ ID NO: 93120 - DNA, 25 bp, Rattus norvegicus
actagttactcatcctggaggtcag

SEQ ID NO: 93121 - DNA, 25 bp, Rattus norvegicus
actagttatacgatgctgtggcaga

SEQ ID NO: 93122 - DNA, 25 bp, Rattus norvegicus
actagttatacgttgctgtggcaga

SEQ ID NO: 93123 - DNA, 25 bp, Rattus norvegicus
actagttatctaacttgggacctca

SEQ ID NO: 93124 - DNA, 25 bp, Rattus norvegicus
actagttatctatcttgggacctca

SEQ ID NO: 93125 - DNA, 25 bp, Rattus norvegicus
actagttccaccatgtgttcactat

SEQ ID NO: 93126 - DNA, 25 bp, Rattus norvegicus
actagttccaccttgtgttcactat

SEQ ID NO: 93127 - DNA, 25 bp, Rattus norvegicus
actagttccttgagctggtccaaaa

SEQ ID NO: 93128 - DNA, 25 bp, Rattus norvegicus
actagttccttgtgctggtccaaaa

SEQ ID NO: 93129 - DNA, 25 bp, Rattus norvegicus
actagttctgttctcttgtggccaa

SEQ ID NO: 93130 - DNA, 25 bp, Rattus norvegicus
actagttctgttgtcttgtggccaa

SEQ ID NO: 93131 - DNA, 25 bp, Rattus norvegicus
actagttgcttaacgtagaggacct

SEQ ID NO: 93132 - DNA, 25 bp, Rattus norvegicus
actagttgcttatcgtagaggacct

SEQ ID NO: 93133 - DNA, 25 bp, Rattus norvegicus
actagttggaagctaatgtccctca

SEQ ID NO: 93134 - DNA, 25 bp, Rattus norvegicus
actagttggaaggtaatgtccctca

SEQ ID NO: 93135 - DNA, 25 bp, Rattus norvegicus
actagtttcacacatgccccattat

SEQ ID NO: 93136 - DNA, 25 bp, Rattus norvegicus
actagtttcacagatgccccattat

SEQ ID NO: 93137 - DNA, 25 bp, Rattus norvegicus
actagtttctatcctgtgtctgcta

SEQ ID NO: 93138 - DNA, 25 bp, Rattus norvegicus
actagtttctatgctgtgtctgcta

SEQ ID NO: 93139 - DNA, 25 bp, Rattus norvegicus
actagtttcttaaatcctggtggat

SEQ ID NO: 93140 - DNA, 25 bp, Rattus norvegicus
actagtttcttatatcctggtggat

SEQ ID NO: 93141 - DNA, 25 bp, Rattus norvegicus
actagtttgagtcactcgccgtgca

SEQ ID NO: 93142 - DNA, 25 bp, Rattus norvegicus
actagtttgagtgactcgccgtgca

SEQ ID NO: 93143 - DNA, 25 bp, Rattus norvegicus
actagtttttatactcagctgtcag

SEQ ID NO: 93144 - DNA, 25 bp, Rattus norvegicus
actagtttttattctcagctgtcag

SEQ ID NO: 93145 - DNA, 25 bp, Rattus norvegicus
actataaaaacgcaacacccctgtg

SEQ ID NO: 93146 - DNA, 25 bp, Rattus norvegicus
actataaaaacggaacacccctgtg

SEQ ID NO: 93147 - DNA, 25 bp, Rattus norvegicus
actataaactctatgggtcttgcca

SEQ ID NO: 93148 - DNA, 25 bp, Rattus norvegicus
actataaactctttgggtcttgcca

SEQ ID NO: 93149 - DNA, 25 bp, Rattus norvegicus
actataagtgtaagccctggacctc

SEQ ID NO: 93150 - DNA, 25 bp, Rattus norvegicus
actataagtgtatgccctggacctc

SEQ ID NO: 93151 - DNA, 25 bp, Rattus norvegicus
actataatagttcagctccaggcca

SEQ ID NO: 93152 - DNA, 25 bp, Rattus norvegicus
actataatagttgagctccaggcca

SEQ ID NO: 93153 - DNA, 25 bp, Rattus norvegicus
actatacagaaaatccctctctcaa

SEQ ID NO: 93154 - DNA, 25 bp, Rattus norvegicus
actatacagaaattccctctctcaa

SEQ ID NO: 93155 - DNA, 25 bp, Rattus norvegicus
actataccgtcactggcccattgtt

SEQ ID NO: 93156 - DNA, 25 bp, Rattus norvegicus
actataccgtcagtggcccattgtt

SEQ ID NO: 93157 - DNA, 25 bp, Rattus norvegicus
actataccttggctcgtctgtgaac

SEQ ID NO: 93158 - DNA, 25 bp, Rattus norvegicus
actataccttgggtcgtctgtgaac

SEQ ID NO: 93159 - DNA, 25 bp, Rattus norvegicus
actatactgtacctaaatttgttga

SEQ ID NO: 93160 - DNA, 25 bp, Rattus norvegicus
actatactgtacgtaaatttgttga

SEQ ID NO: 93161 - DNA, 25 bp, Rattus norvegicus
actatacttttcattgccctttgag

SEQ ID NO: 93162 - DNA, 25 bp, Rattus norvegicus
actatacttttctttgccctttgag

SEQ ID NO: 93163 - DNA, 25 bp, Rattus norvegicus
actatagaggttacgttcgccgcaa

SEQ ID NO: 93164 - DNA, 25 bp, Rattus norvegicus
actatagaggtttcgttcgccgcaa

SEQ ID NO: 93165 - DNA, 25 bp, Rattus norvegicus
actatagcactacatacacacacac

SEQ ID NO: 93166 - DNA, 25 bp, Rattus norvegicus
actatagcactagatacacacacac

SEQ ID NO: 93167 - DNA, 25 bp, Rattus norvegicus
actatagcccctactcagtaaagag

SEQ ID NO: 93168 - DNA, 25 bp, Rattus norvegicus
actatagccccttctcagtaaagag

SEQ ID NO: 93169 - DNA, 25 bp, Rattus norvegicus
actatagcggttcttggtgttcatc

SEQ ID NO: 93170 - DNA, 25 bp, Rattus norvegicus
actatagcggttgttggtgttcatc

SEQ ID NO: 93171 - DNA, 25 bp, Rattus norvegicus
actatagggccacctaggcagacaa

SEQ ID NO: 93172 - DNA, 25 bp, Rattus norvegicus
actatagggccagctaggcagacaa

SEQ ID NO: 93173 - DNA, 25 bp, Rattus norvegicus
actatagggtgtatgctctggtcat

SEQ ID NO: 93174 - DNA, 25 bp, Rattus norvegicus
actatagggtgtttgctctggtcat

SEQ ID NO: 93175 - DNA, 25 bp, Rattus norvegicus
actatagtcgtcacctttattggca

SEQ ID NO: 93176 - DNA, 25 bp, Rattus norvegicus
actatagtcgtctcctttattggca

SEQ ID NO: 93177 - DNA, 25 bp, Rattus norvegicus
actatatcaatgctgctctcacttc

SEQ ID NO: 93178 - DNA, 25 bp, Rattus norvegicus
actatatcaatggtgctctcacttc

SEQ ID NO: 93179 - DNA, 25 bp, Rattus norvegicus
actatatcgtgactgagggcttgca

SEQ ID NO: 93180 - DNA, 25 bp, Rattus norvegicus
actatatcgtgagtgagggcttgca

SEQ ID NO: 93181 - DNA, 25 bp, Rattus norvegicus
actatattccatacagtctgccttg

SEQ ID NO: 93182 - DNA, 25 bp, Rattus norvegicus
actatattccattcagtctgccttg

SEQ ID NO: 93183 - DNA, 25 bp, Rattus norvegicus
actatattgcctaactctacaccag

SEQ ID NO: 93184 - DNA, 25 bp, Rattus norvegicus
actatattgccttactctacaccag

SEQ ID NO: 93185 - DNA, 25 bp, Rattus norvegicus
actatatttctcaacactgtccagc

SEQ ID NO: 93186 - DNA, 25 bp, Rattus norvegicus
actatatttctctacactgtccagc

SEQ ID NO: 93187 - DNA, 25 bp, Rattus norvegicus
actatattttccatgaggtctccac

SEQ ID NO: 93188 - DNA, 25 bp, Rattus norvegicus
actatattttccttgaggtctccac

SEQ ID NO: 93189 - DNA, 25 bp, Rattus norvegicus
actatcaattgacctgcttagctag

SEQ ID NO: 93190 - DNA, 25 bp, Rattus norvegicus
actatcaattgagctgcttagctag

SEQ ID NO: 93191 - DNA, 25 bp, Rattus norvegicus
actatcacacaaaggctattctcta

SEQ ID NO: 93192 - DNA, 25 bp, Rattus norvegicus
actatcacacaatggctattctcta

SEQ ID NO: 93193 - DNA, 25 bp, Rattus norvegicus
actatcacaggcagtccaccgagat

SEQ ID NO: 93194 - DNA, 25 bp, Rattus norvegicus
actatcacaggctgtccaccgagat

SEQ ID NO: 93195 - DNA, 25 bp, Rattus norvegicus
actatcacagttagcaaggcgtcct

SEQ ID NO: 93196 - DNA, 25 bp, Rattus norvegicus
actatcacagtttgcaaggcgtcct

SEQ ID NO: 93197 - DNA, 25 bp, Rattus norvegicus
actatcaccctgcaaactgttttca

SEQ ID NO: 93198 - DNA, 25 bp, Rattus norvegicus
actatcaccctggaaactgttttca

SEQ ID NO: 93199 - DNA, 25 bp, Rattus norvegicus
actatcactggccagtggtctggga

SEQ ID NO: 93200 - DNA, 25 bp, Rattus norvegicus
actatcactggcgagtggtctggga

SEQ ID NO: 93201 - DNA, 25 bp, Rattus norvegicus
actatcagaaaaagcctgtagcccc

SEQ ID NO: 93202 - DNA, 25 bp, Rattus norvegicus
actatcagaaaatgcctgtagcccc

SEQ ID NO: 93203 - DNA, 25 bp, Rattus norvegicus
actatcagcccaattgtgtttgttt

SEQ ID NO: 93204 - DNA, 25 bp, Rattus norvegicus
actatcagcccatttgtgtttgttt

SEQ ID NO: 93205 - DNA, 25 bp, Rattus norvegicus
actatcatgtcccatttccaagtgg

SEQ ID NO: 93206 - DNA, 25 bp, Rattus norvegicus
actatcatgtccgatttccaagtgg

SEQ ID NO: 93207 - DNA, 25 bp, Rattus norvegicus
actatcattcttcagcatggagccc

SEQ ID NO: 93208 - DNA, 25 bp, Rattus norvegicus
actatcattcttgagcatggagccc

SEQ ID NO: 93209 - DNA, 25 bp, Rattus norvegicus
actatccagttgatgggctgcctga

SEQ ID NO: 93210 - DNA, 25 bp, Rattus norvegicus
actatccagttgttgggctgcctga

SEQ ID NO: 93211 - DNA, 25 bp, Rattus norvegicus
actatccataacacccgttcactaa

SEQ ID NO: 93212 - DNA, 25 bp, Rattus norvegicus
actatccataactcccgttcactaa

SEQ ID NO: 93213 - DNA, 25 bp, Rattus norvegicus
actatccatgtcacaagtaaccttg

SEQ ID NO: 93214 - DNA, 25 bp, Rattus norvegicus
actatccatgtcacagaatcaccgt

SEQ ID NO: 93215 - DNA, 25 bp, Rattus norvegicus
actatccatgtctcaagtaaccttg

SEQ ID NO: 93216 - DNA, 25 bp, Rattus norvegicus
actatccatgtctcagaatcaccgt

SEQ ID NO: 93217 - DNA, 25 bp, Rattus norvegicus
actatccattagagacctttgtgac

SEQ ID NO: 93218 - DNA, 25 bp, Rattus norvegicus
actatccattagtgacctttgtgac

SEQ ID NO: 93219 - DNA, 25 bp, Rattus norvegicus
actatccattggactcacttgcgtg

SEQ ID NO: 93220 - DNA, 25 bp, Rattus norvegicus
actatccattggtctcacttgcgtg

SEQ ID NO: 93221 - DNA, 25 bp, Rattus norvegicus
actatccccgtactggaggccacag

SEQ ID NO: 93222 - DNA, 25 bp, Rattus norvegicus
actatccccgtagtggaggccacag

SEQ ID NO: 93223 - DNA, 25 bp, Rattus norvegicus
actatccctactcttatggttcata

SEQ ID NO: 93224 - DNA, 25 bp, Rattus norvegicus
actatccctactgttatggttcata

SEQ ID NO: 93225 - DNA, 25 bp, Rattus norvegicus
actatccctgtcagagattattgtg

SEQ ID NO: 93226 - DNA, 25 bp, Rattus norvegicus
actatccctgtctgagattattgtg

SEQ ID NO: 93227 - DNA, 25 bp, Rattus norvegicus
actatccggtgcctaggaaatggga

SEQ ID NO: 93228 - DNA, 25 bp, Rattus norvegicus
actatccggtgcgtaggaaatggga

SEQ ID NO: 93229 - DNA, 25 bp, Rattus norvegicus
actatcctctgtaaagtcaaggatc

SEQ ID NO: 93230 - DNA, 25 bp, Rattus norvegicus
actatcctctgttaagtcaaggatc

SEQ ID NO: 93231 - DNA, 25 bp, Rattus norvegicus
actatcctgtctcgtcaagcttaaa

SEQ ID NO: 93232 - DNA, 25 bp, Rattus norvegicus
actatcctgtctggtcaagcttaaa

SEQ ID NO: 93233 - DNA, 25 bp, Rattus norvegicus
actatccttactcgctgatctggta

SEQ ID NO: 93234 - DNA, 25 bp, Rattus norvegicus
actatccttactggctgatctggta

SEQ ID NO: 93235 - DNA, 25 bp, Rattus norvegicus
actatcctttgcactgtttggcaag

SEQ ID NO: 93236 - DNA, 25 bp, Rattus norvegicus
actatcctttgctctgtttggcaag

SEQ ID NO: 93237 - DNA, 25 bp, Rattus norvegicus
actatccttttaatgcttggagaca

SEQ ID NO: 93238 - DNA, 25 bp, Rattus norvegicus
actatccttttattgcttggagaca

SEQ ID NO: 93239 - DNA, 25 bp, Rattus norvegicus
actatcgagagtacctacgtggccg

SEQ ID NO: 93240 - DNA, 25 bp, Rattus norvegicus
actatcgagagttcctacgtggccg

SEQ ID NO: 93241 - DNA, 25 bp, Rattus norvegicus
actatcgagggaccctgtcggtgta

SEQ ID NO: 93242 - DNA, 25 bp, Rattus norvegicus
actatcgagggagcctgtcggtgta

SEQ ID NO: 93243 - DNA, 25 bp, Rattus norvegicus
actatcgctccaaattactcctttt

SEQ ID NO: 93244 - DNA, 25 bp, Rattus norvegicus
actatcgctccatattactcctttt

SEQ ID NO: 93245 - DNA, 25 bp, Rattus norvegicus
actatctatattccttttccctttg

SEQ ID NO: 93246 - DNA, 25 bp, Rattus norvegicus
actatctatattctctctttcattg

SEQ ID NO: 93247 - DNA, 25 bp, Rattus norvegicus
actatctatattgcttttccctttg

SEQ ID NO: 93248 - DNA, 25 bp, Rattus norvegicus
actatctatattgtctctttcattg

SEQ ID NO: 93249 - DNA, 25 bp, Rattus norvegicus
actatctattagacaccctggtgca

SEQ ID NO: 93250 - DNA, 25 bp, Rattus norvegicus
actatctattagtcaccctggtgca

SEQ ID NO: 93251 - DNA, 25 bp, Rattus norvegicus
actatctattcaactccatctgtgt

SEQ ID NO: 93252 - DNA, 25 bp, Rattus norvegicus
actatctattcatctccatctgtgt

SEQ ID NO: 93253 - DNA, 25 bp, Rattus norvegicus
actatctctcatctattcttttcaa

SEQ ID NO: 93254 - DNA, 25 bp, Rattus norvegicus
actatctctcatgtattcttttcaa

SEQ ID NO: 93255 - DNA, 25 bp, Rattus norvegicus
actatctcttttattgggatggctg

SEQ ID NO: 93256 - DNA, 25 bp, Rattus norvegicus
actatctctttttttgggatggctg

SEQ ID NO: 93257 - DNA, 25 bp, Rattus norvegicus
actatctgcagtatgctactcctca

SEQ ID NO: 93258 - DNA, 25 bp, Rattus norvegicus
actatctgcagtttgctactcctca

SEQ ID NO: 93259 - DNA, 25 bp, Rattus norvegicus
actatctggtgtcagtcagacgccc

SEQ ID NO: 93260 - DNA, 25 bp, Rattus norvegicus
actatctggtgtgagtcagacgccc

SEQ ID NO: 93261 - DNA, 25 bp, Rattus norvegicus
actatctgtacgactgcattctatg

SEQ ID NO: 93262 - DNA, 25 bp, Rattus norvegicus
actatctgtacgtctgcattctatg

SEQ ID NO: 93263 - DNA, 25 bp, Rattus norvegicus
actatcttatgtatacgtactggtt

SEQ ID NO: 93264 - DNA, 25 bp, Rattus norvegicus
actatcttatgtttacgtactggtt

SEQ ID NO: 93265 - DNA, 25 bp, Rattus norvegicus
actatcttcaaaatgcacctcctgg

SEQ ID NO: 93266 - DNA, 25 bp, Rattus norvegicus
actatcttcaaattgcacctcctgg

SEQ ID NO: 93267 - DNA, 25 bp, Rattus norvegicus
actatcttttggatcaggctgtttc

SEQ ID NO: 93268 - DNA, 25 bp, Rattus norvegicus
actatcttttggttcaggctgtttc

SEQ ID NO: 93269 - DNA, 25 bp, Rattus norvegicus
actatgaacagcagtccacctagac

SEQ ID NO: 93270 - DNA, 25 bp, Rattus norvegicus
actatgaacagctgtccacctagac

SEQ ID NO: 93271 - DNA, 25 bp, Rattus norvegicus
actatgaagattcaccgagctgtga

SEQ ID NO: 93272 - DNA, 25 bp, Rattus norvegicus
actatgaagattgaccgagctgtga

SEQ ID NO: 93273 - DNA, 25 bp, Rattus norvegicus
actatgacatctacacagcaggcct

SEQ ID NO: 93274 - DNA, 25 bp, Rattus norvegicus
actatgacatcttcacagcaggcct

SEQ ID NO: 93275 - DNA, 25 bp, Rattus norvegicus
actatgacctagatttcacagtggg

SEQ ID NO: 93276 - DNA, 25 bp, Rattus norvegicus
actatgacctagttttcacagtggg

SEQ ID NO: 93277 - DNA, 25 bp, Rattus norvegicus
actatgactgtaagtgtcttgagtg

SEQ ID NO: 93278 - DNA, 25 bp, Rattus norvegicus
actatgactgtatgtgtcttgagtg

SEQ ID NO: 93279 - DNA, 25 bp, Rattus norvegicus
actatgagcctgaggagctgccagt

SEQ ID NO: 93280 - DNA, 25 bp, Rattus norvegicus
actatgagcctgtggagctgccagt

SEQ ID NO: 93281 - DNA, 25 bp, Rattus norvegicus
actatgagctggagcacctgtctac

SEQ ID NO: 93282 - DNA, 25 bp, Rattus norvegicus
actatgagctggtgcacctgtctac

SEQ ID NO: 93283 - DNA, 25 bp, Rattus norvegicus
actatgaggctgcgaaggcagatgc

SEQ ID NO: 93284 - DNA, 25 bp, Rattus norvegicus
actatgaggctgggaaggcagatgc

SEQ ID NO: 93285 - DNA, 25 bp, Rattus norvegicus
actatgaggtgtacttcgtctgtga

SEQ ID NO: 93286 - DNA, 25 bp, Rattus norvegicus
actatgaggtgttcttcgtctgtga

SEQ ID NO: 93287 - DNA, 25 bp, Rattus norvegicus
actatgatcggcctactggcagagg

SEQ ID NO: 93288 - DNA, 25 bp, Rattus norvegicus
actatgatcggcgtactggcagagg

SEQ ID NO: 93289 - DNA, 25 bp, Rattus norvegicus
actatgatgtggagcgtctgcgcct

SEQ ID NO: 93290 - DNA, 25 bp, Rattus norvegicus
actatgatgtggtgcgtctgcgcct

SEQ ID NO: 93291 - DNA, 25 bp, Rattus norvegicus
actatgcaaaccagtccagacttga

SEQ ID NO: 93292 - DNA, 25 bp, Rattus norvegicus
actatgcaaacctgtccagacttga

SEQ ID NO: 93293 - DNA, 25 bp, Rattus norvegicus
actatgcacacgcatttcttaaaca

SEQ ID NO: 93294 - DNA, 25 bp, Rattus norvegicus
actatgcacacggatttcttaaaca

SEQ ID NO: 93295 - DNA, 25 bp, Rattus norvegicus
actatgccaagcactgaaggaccca

SEQ ID NO: 93296 - DNA, 25 bp, Rattus norvegicus
actatgccaagctctgaaggaccca

SEQ ID NO: 93297 - DNA, 25 bp, Rattus norvegicus
actatgccacacatggtggtccatg

SEQ ID NO: 93298 - DNA, 25 bp, Rattus norvegicus
actatgccacacttggtggtccatg

SEQ ID NO: 93299 - DNA, 25 bp, Rattus norvegicus
actatgccccggaatctgaggagga

SEQ ID NO: 93300 - DNA, 25 bp, Rattus norvegicus
actatgccccggtatctgaggagga

SEQ ID NO: 93301 - DNA, 25 bp, Rattus norvegicus
actatgcctcctcagatgcagctta

SEQ ID NO: 93302 - DNA, 25 bp, Rattus norvegicus
actatgcctcctgagatgcagctta

SEQ ID NO: 93303 - DNA, 25 bp, Rattus norvegicus
actatgcctgcaacgtcttaaacaa

SEQ ID NO: 93304 - DNA, 25 bp, Rattus norvegicus
actatgcctgcatcgtcttaaacaa

SEQ ID NO: 93305 - DNA, 25 bp, Rattus norvegicus
actatgcgcaggctcatcaaagaca

SEQ ID NO: 93306 - DNA, 25 bp, Rattus norvegicus
actatgcgcagggtcatcaaagaca

SEQ ID NO: 93307 - DNA, 25 bp, Rattus norvegicus
actatgctaacaaccatccctgtat

SEQ ID NO: 93308 - DNA, 25 bp, Rattus norvegicus
actatgctaacatccatccctgtat

SEQ ID NO: 93309 - DNA, 25 bp, Rattus norvegicus
actatgctacagacatctcccacaa

SEQ ID NO: 93310 - DNA, 25 bp, Rattus norvegicus
actatgctacagtcatctcccacaa

SEQ ID NO: 93311 - DNA, 25 bp, Rattus norvegicus
actatgctagggatgagctggttcc

SEQ ID NO: 93312 - DNA, 25 bp, Rattus norvegicus
actatgctagggttgagctggttcc

SEQ ID NO: 93313 - DNA, 25 bp, Rattus norvegicus
actatgctagttacgtgttggttca

SEQ ID NO: 93314 - DNA, 25 bp, Rattus norvegicus
actatgctagtttcgtgttggttca

SEQ ID NO: 93315 - DNA, 25 bp, Rattus norvegicus
actatgctccagaacacagctgtga

SEQ ID NO: 93316 - DNA, 25 bp, Rattus norvegicus
actatgctccagtacacagctgtga

SEQ ID NO: 93317 - DNA, 25 bp, Rattus norvegicus
actatgctccttagaagccaacgtg

SEQ ID NO: 93318 - DNA, 25 bp, Rattus norvegicus
actatgctcctttgaagccaacgtg

SEQ ID NO: 93319 - DNA, 25 bp, Rattus norvegicus
actatgctgacaaataccctgggaa

SEQ ID NO: 93320 - DNA, 25 bp, Rattus norvegicus
actatgctgacatataccctgggaa

SEQ ID NO: 93321 - DNA, 25 bp, Rattus norvegicus
actatggaatgtaggctggtctgaa

SEQ ID NO: 93322 - DNA, 25 bp, Rattus norvegicus
actatggaatgttggctggtctgaa

SEQ ID NO: 93323 - DNA, 25 bp, Rattus norvegicus
actatggacaggcaccggatactat

SEQ ID NO: 93324 - DNA, 25 bp, Rattus norvegicus
actatggacagggaccggatactat

SEQ ID NO: 93325 - DNA, 25 bp, Rattus norvegicus
actatggaccttaacttgattttga

SEQ ID NO: 93326 - DNA, 25 bp, Rattus norvegicus
actatggacctttacttgattttga

SEQ ID NO: 93327 - DNA, 25 bp, Rattus norvegicus
actatggagttcagcatccccgcca

SEQ ID NO: 93328 - DNA, 25 bp, Rattus norvegicus
actatggagttctgcatccccgcca

SEQ ID NO: 93329 - DNA, 25 bp, Rattus norvegicus
actatggatccaaagatggtgtgtt

SEQ ID NO: 93330 - DNA, 25 bp, Rattus norvegicus
actatggatccatagatggtgtgtt

SEQ ID NO: 93331 - DNA, 25 bp, Rattus norvegicus
actatggatgaccaagagcctctta

SEQ ID NO: 93332 - DNA, 25 bp, Rattus norvegicus
actatggatgacgaagagcctctta

SEQ ID NO: 93333 - DNA, 25 bp, Rattus norvegicus
actatggatgctaaatttctctgtg

SEQ ID NO: 93334 - DNA, 25 bp, Rattus norvegicus
actatggatgcttaatttctctgtg

SEQ ID NO: 93335 - DNA, 25 bp, Rattus norvegicus
actatggcactgagaccggcgcgga

SEQ ID NO: 93336 - DNA, 25 bp, Rattus norvegicus
actatggcactgtgaccggcgcgga

SEQ ID NO: 93337 - DNA, 25 bp, Rattus norvegicus
actatggcagctccgactgcaaata

SEQ ID NO: 93338 - DNA, 25 bp, Rattus norvegicus
actatggcagctgcgactgcaaata

SEQ ID NO: 93339 - DNA, 25 bp, Rattus norvegicus
actatggctgtgagtcgccgtaatt

SEQ ID NO: 93340 - DNA, 25 bp, Rattus norvegicus
actatggctgtgtgtcgccgtaatt

SEQ ID NO: 93341 - DNA, 25 bp, Rattus norvegicus
actatgggccctagacttgttttgg

SEQ ID NO: 93342 - DNA, 25 bp, Rattus norvegicus
actatgggcccttgacttgttttgg

SEQ ID NO: 93343 - DNA, 25 bp, Rattus norvegicus
actatgggctgtatctcttggattt

SEQ ID NO: 93344 - DNA, 25 bp, Rattus norvegicus
actatgggctgtttctcttggattt

SEQ ID NO: 93345 - DNA, 25 bp, Rattus norvegicus
actatgggttgtccatggagttaca

SEQ ID NO: 93346 - DNA, 25 bp, Rattus norvegicus
actatgggttgtgcatggagttaca

SEQ ID NO: 93347 - DNA, 25 bp, Rattus norvegicus
actatgggtttgcatgtggtgattt

SEQ ID NO: 93348 - DNA, 25 bp, Rattus norvegicus
actatgggtttggatgtggtgattt

SEQ ID NO: 93349 - DNA, 25 bp, Rattus norvegicus
actatggtcttcaagcctacttgaa

SEQ ID NO: 93350 - DNA, 25 bp, Rattus norvegicus
actatggtcttctagcctacttgaa

SEQ ID NO: 93351 - DNA, 25 bp, Rattus norvegicus
actatggttagcatcttccagggca

SEQ ID NO: 93352 - DNA, 25 bp, Rattus norvegicus
actatggttagcttcttccagggca

SEQ ID NO: 93353 - DNA, 25 bp, Rattus norvegicus
actatgtagcccaagcttccctgga

SEQ ID NO: 93354 - DNA, 25 bp, Rattus norvegicus
actatgtagccctagcttccctgga

SEQ ID NO: 93355 - DNA, 25 bp, Rattus norvegicus
actatgtccatgagaacgctactta

SEQ ID NO: 93356 - DNA, 25 bp, Rattus norvegicus
actatgtccatgtgaacgctactta

SEQ ID NO: 93357 - DNA, 25 bp, Rattus norvegicus
actatgtgcagcacttccaggccct

SEQ ID NO: 93358 - DNA, 25 bp, Rattus norvegicus
actatgtgcagctcttccaggccct

SEQ ID NO: 93359 - DNA, 25 bp, Rattus norvegicus
actatgtgccatctaatgacccgga

SEQ ID NO: 93360 - DNA, 25 bp, Rattus norvegicus
actatgtgccatgtaatgacccgga

SEQ ID NO: 93361 - DNA, 25 bp, Rattus norvegicus
actatgtgccctcttttggaggctg

SEQ ID NO: 93362 - DNA, 25 bp, Rattus norvegicus
actatgtgccctgttttggaggctg

SEQ ID NO: 93363 - DNA, 25 bp, Rattus norvegicus
actatgtgtacgactgagggccgtt

SEQ ID NO: 93364 - DNA, 25 bp, Rattus norvegicus
actatgtgtacgtctgagggccgtt

SEQ ID NO: 93365 - DNA, 25 bp, Rattus norvegicus
actatgtgtcccagagctccttgca

SEQ ID NO: 93366 - DNA, 25 bp, Rattus norvegicus
actatgtgtccctgagctccttgca

SEQ ID NO: 93367 - DNA, 25 bp, Rattus norvegicus
actatgtgtggcaccatggcctggg

SEQ ID NO: 93368 - DNA, 25 bp, Rattus norvegicus
actatgtgtggctccatggcctggg

SEQ ID NO: 93369 - DNA, 25 bp, Rattus norvegicus
actatgtgttaccttattggattaa

SEQ ID NO: 93370 - DNA, 25 bp, Rattus norvegicus
actatgtgttacgttattggattaa

SEQ ID NO: 93371 - DNA, 25 bp, Rattus norvegicus
actatgttgtacactgcactattga

SEQ ID NO: 93372 - DNA, 25 bp, Rattus norvegicus
actatgttgtactctgcactattga

SEQ ID NO: 93373 - DNA, 25 bp, Rattus norvegicus
actatgttgtccagcgcaagaggga

SEQ ID NO: 93374 - DNA, 25 bp, Rattus norvegicus
actatgttgtcctgcgcaagaggga

SEQ ID NO: 93375 - DNA, 25 bp, Rattus norvegicus
actattaagcctcaacccctactgt

SEQ ID NO: 93376 - DNA, 25 bp, Rattus norvegicus
actattaagcctgaacccctactgt

SEQ ID NO: 93377 - DNA, 25 bp, Rattus norvegicus
actattacccctcaatgggtgcggc

SEQ ID NO: 93378 - DNA, 25 bp, Rattus norvegicus
actattacccctgaatgggtgcggc

SEQ ID NO: 93379 - DNA, 25 bp, Rattus norvegicus
actattagcgacaagatgccctgcc

SEQ ID NO: 93380 - DNA, 25 bp, Rattus norvegicus
actattagcgactagatgccctgcc

SEQ ID NO: 93381 - DNA, 25 bp, Rattus norvegicus
actattagcgtccgtgctatatcct

SEQ ID NO: 93382 - DNA, 25 bp, Rattus norvegicus
actattagcgtcggtgctatatcct

SEQ ID NO: 93383 - DNA, 25 bp, Rattus norvegicus
actattagtttgctctgtgtgtgtg

SEQ ID NO: 93384 - DNA, 25 bp, Rattus norvegicus
actattagtttggtctgtgtgtgtg

SEQ ID NO: 93385 - DNA, 25 bp, Rattus norvegicus
actattatgtagaggctgctcttga

SEQ ID NO: 93386 - DNA, 25 bp, Rattus norvegicus
actattatgtagtggctgctcttga

SEQ ID NO: 93387 - DNA, 25 bp, Rattus norvegicus
actattcagccgaacccaattatta

SEQ ID NO: 93388 - DNA, 25 bp, Rattus norvegicus
actattcagccgtacccaattatta

SEQ ID NO: 93389 - DNA, 25 bp, Rattus norvegicus
actattcaggatatcttcacttgga

SEQ ID NO: 93390 - DNA, 25 bp, Rattus norvegicus
actattcaggatttcttcacttgga

SEQ ID NO: 93391 - DNA, 25 bp, Rattus norvegicus
actattcagtggatcatgtctgtac

SEQ ID NO: 93392 - DNA, 25 bp, Rattus norvegicus
actattcagtggttcatgtctgtac

SEQ ID NO: 93393 - DNA, 25 bp, Rattus norvegicus
actattcattgcatttatttggaca

SEQ ID NO: 93394 - DNA, 25 bp, Rattus norvegicus
actattcattgcttttatttggaca

SEQ ID NO: 93395 - DNA, 25 bp, Rattus norvegicus
actattcattttacgtttggtcaca

SEQ ID NO: 93396 - DNA, 25 bp, Rattus norvegicus
actattcatttttcgtttggtcaca

SEQ ID NO: 93397 - DNA, 25 bp, Rattus norvegicus
actattccacatactttcattgagg

SEQ ID NO: 93398 - DNA, 25 bp, Rattus norvegicus
actattccacattctttcattgagg

SEQ ID NO: 93399 - DNA, 25 bp, Rattus norvegicus
actattccatgccactcaagagcaa

SEQ ID NO: 93400 - DNA, 25 bp, Rattus norvegicus
actattccatgcgactcaagagcaa

SEQ ID NO: 93401 - DNA, 25 bp, Rattus norvegicus
actattccattcagccaccaaggca

SEQ ID NO: 93402 - DNA, 25 bp, Rattus norvegicus
actattccattctgccaccaaggca

SEQ ID NO: 93403 - DNA, 25 bp, Rattus norvegicus
actattccctttcccattgacaaag

SEQ ID NO: 93404 - DNA, 25 bp, Rattus norvegicus
actattccctttgccattgacaaag

SEQ ID NO: 93405 - DNA, 25 bp, Rattus norvegicus
actattcctgaactttgtgcccact

SEQ ID NO: 93406 - DNA, 25 bp, Rattus norvegicus
actattcctgaagtttgtgcccact

SEQ ID NO: 93407 - DNA, 25 bp, Rattus norvegicus
actattcctgttagtcccacagtga

SEQ ID NO: 93408 - DNA, 25 bp, Rattus norvegicus
actattcctgtttgtcccacagtga

SEQ ID NO: 93409 - DNA, 25 bp, Rattus norvegicus
actattcgctgtcggttcattgtca

SEQ ID NO: 93410 - DNA, 25 bp, Rattus norvegicus
actattcgctgtgggttcattgtca

SEQ ID NO: 93411 - DNA, 25 bp, Rattus norvegicus
actattcggaggagtctgacacgga

SEQ ID NO: 93412 - DNA, 25 bp, Rattus norvegicus
actattcggaggtgtctgacacgga

SEQ ID NO: 93413 - DNA, 25 bp, Rattus norvegicus
actattcgtgacatcctaggaggca

SEQ ID NO: 93414 - DNA, 25 bp, Rattus norvegicus
actattcgtgacttcctaggaggca

SEQ ID NO: 93415 - DNA, 25 bp, Rattus norvegicus
actattctagcaataacaacctttg

SEQ ID NO: 93416 - DNA, 25 bp, Rattus norvegicus
actattctagcattaacaacctttg

SEQ ID NO: 93417 - DNA, 25 bp, Rattus norvegicus
actattctagtcacttgccaggacg

SEQ ID NO: 93418 - DNA, 25 bp, Rattus norvegicus
actattctagtctcttgccaggacg

SEQ ID NO: 93419 - DNA, 25 bp, Rattus norvegicus
actattctctataccaatggtgttg

SEQ ID NO: 93420 - DNA, 25 bp, Rattus norvegicus
actattctctattccaatggtgttg

SEQ ID NO: 93421 - DNA, 25 bp, Rattus norvegicus
actattctgtgtaccttaaatttct

SEQ ID NO: 93422 - DNA, 25 bp, Rattus norvegicus
actattctgtgttccttaaatttct

SEQ ID NO: 93423 - DNA, 25 bp, Rattus norvegicus
actattctttatcatgctacaggtt

SEQ ID NO: 93424 - DNA, 25 bp, Rattus norvegicus
actattctttatgatgctacaggtt

SEQ ID NO: 93425 - DNA, 25 bp, Rattus norvegicus
actattgaaagccagtgtccgattt

SEQ ID NO: 93426 - DNA, 25 bp, Rattus norvegicus
actattgaaagcgagtgtccgattt

SEQ ID NO: 93427 - DNA, 25 bp, Rattus norvegicus
actattgatactatcgatggtcgca

SEQ ID NO: 93428 - DNA, 25 bp, Rattus norvegicus
actattgatactttcgatggtcgca

SEQ ID NO: 93429 - DNA, 25 bp, Rattus norvegicus
actattgcaataaaatggcctccat

SEQ ID NO: 93430 - DNA, 25 bp, Rattus norvegicus
actattgcaatataatggcctccat

SEQ ID NO: 93431 - DNA, 25 bp, Rattus norvegicus
actattgcaggtcccttattggtag

SEQ ID NO: 93432 - DNA, 25 bp, Rattus norvegicus
actattgcaggtgccttattggtag

SEQ ID NO: 93433 - DNA, 25 bp, Rattus norvegicus
actattgcatgtatcttccctggaa

SEQ ID NO: 93434 - DNA, 25 bp, Rattus norvegicus
actattgcatgtttcttccctggaa

SEQ ID NO: 93435 - DNA, 25 bp, Rattus norvegicus
actattgcattcatggtctgattta

SEQ ID NO: 93436 - DNA, 25 bp, Rattus norvegicus
actattgcattcttggtctgattta

SEQ ID NO: 93437 - DNA, 25 bp, Rattus norvegicus
actattgcgcagacatattctttta

SEQ ID NO: 93438 - DNA, 25 bp, Rattus norvegicus
actattgcgcagtcatattctttta

SEQ ID NO: 93439 - DNA, 25 bp, Rattus norvegicus
actattgcgggcaccagtgtcttgt

SEQ ID NO: 93440 - DNA, 25 bp, Rattus norvegicus
actattgcgggctccagtgtcttgt

SEQ ID NO: 93441 - DNA, 25 bp, Rattus norvegicus
actattgctgacacaagagtttgta

SEQ ID NO: 93442 - DNA, 25 bp, Rattus norvegicus
actattgctgactcaagagtttgta

SEQ ID NO: 93443 - DNA, 25 bp, Rattus norvegicus
actattgcttgacttcttcagtgat

SEQ ID NO: 93444 - DNA, 25 bp, Rattus norvegicus
actattgcttgagttcttcagtgat

SEQ ID NO: 93445 - DNA, 25 bp, Rattus norvegicus
actattggatgacgctttctccagc

SEQ ID NO: 93446 - DNA, 25 bp, Rattus norvegicus
actattggatgaggctttctccagc

SEQ ID NO: 93447 - DNA, 25 bp, Rattus norvegicus
actattggcactcttaaggatactt

SEQ ID NO: 93448 - DNA, 25 bp, Rattus norvegicus
actattggcactgttaaggatactt

SEQ ID NO: 93449 - DNA, 25 bp, Rattus norvegicus
actattgtaaccctctgtctgctga

SEQ ID NO: 93450 - DNA, 25 bp, Rattus norvegicus
actattgtaaccgtctgtctgctga

SEQ ID NO: 93451 - DNA, 25 bp, Rattus norvegicus
actattgtcagcattgactccaaga

SEQ ID NO: 93452 - DNA, 25 bp, Rattus norvegicus
actattgtcagctttgactccaaga

SEQ ID NO: 93453 - DNA, 25 bp, Rattus norvegicus
actattgtcatacgtgctcttccgc

SEQ ID NO: 93454 - DNA, 25 bp, Rattus norvegicus
actattgtcataggtgctcttccgc

SEQ ID NO: 93455 - DNA, 25 bp, Rattus norvegicus
actattgtccaacagtgcccactat

SEQ ID NO: 93456 - DNA, 25 bp, Rattus norvegicus
actattgtccaagagtgcccactat

SEQ ID NO: 93457 - DNA, 25 bp, Rattus norvegicus
actattgtccacagtactgacaggt

SEQ ID NO: 93458 - DNA, 25 bp, Rattus norvegicus
actattgtccactgtactgacaggt

SEQ ID NO: 93459 - DNA, 25 bp, Rattus norvegicus
actattgtggtgatgcaggctgtca

SEQ ID NO: 93460 - DNA, 25 bp, Rattus norvegicus
actattgtggtgttgcaggctgtca

SEQ ID NO: 93461 - DNA, 25 bp, Rattus norvegicus
actattgttcatccaacttcccgag

SEQ ID NO: 93462 - DNA, 25 bp, Rattus norvegicus
actattgttcatgcaacttcccgag

SEQ ID NO: 93463 - DNA, 25 bp, Rattus norvegicus
actatttacaccctttgttgcctat

SEQ ID NO: 93464 - DNA, 25 bp, Rattus norvegicus
actatttacaccgtttgttgcctat

SEQ ID NO: 93465 - DNA, 25 bp, Rattus norvegicus
actatttactccaaaagaccctctg

SEQ ID NO: 93466 - DNA, 25 bp, Rattus norvegicus
actatttactcctaaagaccctctg

SEQ ID NO: 93467 - DNA, 25 bp, Rattus norvegicus
actatttattgcactcctcaggaaa

SEQ ID NO: 93468 - DNA, 25 bp, Rattus norvegicus
actatttattgctctcctcaggaaa

SEQ ID NO: 93469 - DNA, 25 bp, Rattus norvegicus
actatttcattgagccatctatttg

SEQ ID NO: 93470 - DNA, 25 bp, Rattus norvegicus
actatttcattgtgccatctatttg

SEQ ID NO: 93471 - DNA, 25 bp, Rattus norvegicus
actatttccacacttgcagccaaca

SEQ ID NO: 93472 - DNA, 25 bp, Rattus norvegicus
actatttccacagttgcagccaaca

SEQ ID NO: 93473 - DNA, 25 bp, Rattus norvegicus
actatttccccaaaacatgtgatgt

SEQ ID NO: 93474 - DNA, 25 bp, Rattus norvegicus
actatttccccataacatgtgatgt

SEQ ID NO: 93475 - DNA, 25 bp, Rattus norvegicus
actatttcctagcacttcctcgaag

SEQ ID NO: 93476 - DNA, 25 bp, Rattus norvegicus
actatttcctaggacttcctcgaag

SEQ ID NO: 93477 - DNA, 25 bp, Rattus norvegicus
actatttcctcccatgtgtttgatt

SEQ ID NO: 93478 - DNA, 25 bp, Rattus norvegicus
actatttcctccgatgtgtttgatt

SEQ ID NO: 93479 - DNA, 25 bp, Rattus norvegicus
actatttctagtattgtctctttgt

SEQ ID NO: 93480 - DNA, 25 bp, Rattus norvegicus
actatttctagttttgtctctttgt

SEQ ID NO: 93481 - DNA, 25 bp, Rattus norvegicus
actatttgatgactgtcgcctccag

SEQ ID NO: 93482 - DNA, 25 bp, Rattus norvegicus
actatttgatgagtgtcgcctccag

SEQ ID NO: 93483 - DNA, 25 bp, Rattus norvegicus
actatttgcatacgaggtggcggca

SEQ ID NO: 93484 - DNA, 25 bp, Rattus norvegicus
actatttgcataggaggtggcggca

SEQ ID NO: 93485 - DNA, 25 bp, Rattus norvegicus
actatttggagtaatcccccagcac

SEQ ID NO: 93486 - DNA, 25 bp, Rattus norvegicus
actatttggagttatcccccagcac

SEQ ID NO: 93487 - DNA, 25 bp, Rattus norvegicus
actattttcctcagtacaccttgga

SEQ ID NO: 93488 - DNA, 25 bp, Rattus norvegicus
actattttcctctgtacaccttgga

SEQ ID NO: 93489 - DNA, 25 bp, Rattus norvegicus
actatttttctgatgcattcagcaa

SEQ ID NO: 93490 - DNA, 25 bp, Rattus norvegicus
actatttttctgttgcattcagcaa

SEQ ID NO: 93491 - DNA, 25 bp, Rattus norvegicus
actatttttgttaagcgtgtctgta

SEQ ID NO: 93492 - DNA, 25 bp, Rattus norvegicus
actatttttgtttagcgtgtctgta

SEQ ID NO: 93493 - DNA, 25 bp, Rattus norvegicus
actcaaaatacccaaggctgaatta

SEQ ID NO: 93494 - DNA, 25 bp, Rattus norvegicus
actcaaaataccgaaggctgaatta

SEQ ID NO: 93495 - DNA, 25 bp, Rattus norvegicus
actcaaaattcccagcagtgcatgt

SEQ ID NO: 93496 - DNA, 25 bp, Rattus norvegicus
actcaaaattccgagcagtgcatgt

SEQ ID NO: 93497 - DNA, 25 bp, Rattus norvegicus
actcaaacaaaaaccccggcacgag

SEQ ID NO: 93498 - DNA, 25 bp, Rattus norvegicus
actcaaacaaaatccccggcacgag

SEQ ID NO: 93499 - DNA, 25 bp, Rattus norvegicus
actcaaacacagatcaggctccgga

SEQ ID NO: 93500 - DNA, 25 bp, Rattus norvegicus
actcaaacacagttcaggctccgga

SEQ ID NO: 93501 - DNA, 25 bp, Rattus norvegicus
actcaaacccagaaggtgcgttatg

SEQ ID NO: 93502 - DNA, 25 bp, Rattus norvegicus
actcaaacccagtaggtgcgttatg

SEQ ID NO: 93503 - DNA, 25 bp, Rattus norvegicus
actcaaacgctccattcaatcatta

SEQ ID NO: 93504 - DNA, 25 bp, Rattus norvegicus
actcaaacgctcgattcaatcatta

SEQ ID NO: 93505 - DNA, 25 bp, Rattus norvegicus
actcaaaggtgaccctctgagtttg

SEQ ID NO: 93506 - DNA, 25 bp, Rattus norvegicus
actcaaaggtgagcctctgagtttg

SEQ ID NO: 93507 - DNA, 25 bp, Rattus norvegicus
actcaaagtcgcatctgaagtccct

SEQ ID NO: 93508 - DNA, 25 bp, Rattus norvegicus
actcaaagtcgcttctgaagtccct

SEQ ID NO: 93509 - DNA, 25 bp, Rattus norvegicus
actcaaagttgtaccagcagatcca

SEQ ID NO: 93510 - DNA, 25 bp, Rattus norvegicus
actcaaagttgttccagcagatcca

SEQ ID NO: 93511 - DNA, 25 bp, Rattus norvegicus
actcaaattctgatctaacctggga

SEQ ID NO: 93512 - DNA, 25 bp, Rattus norvegicus
actcaaattctgttctaacctggga

SEQ ID NO: 93513 - DNA, 25 bp, Rattus norvegicus
actcaacacctcattctaatcataa

SEQ ID NO: 93514 - DNA, 25 bp, Rattus norvegicus
actcaacacctctttctaatcataa

SEQ ID NO: 93515 - DNA, 25 bp, Rattus norvegicus
actcaacacttcagggctttgcctt

SEQ ID NO: 93516 - DNA, 25 bp, Rattus norvegicus
actcaacacttctgggctttgcctt

SEQ ID NO: 93517 - DNA, 25 bp, Rattus norvegicus
actcaacagccaaggaatcccagga

SEQ ID NO: 93518 - DNA, 25 bp, Rattus norvegicus
actcaacagccatggaatcccagga

SEQ ID NO: 93519 - DNA, 25 bp, Rattus norvegicus
actcaaccaattcgccatcgtcatt

SEQ ID NO: 93520 - DNA, 25 bp, Rattus norvegicus
actcaaccaattggccatcgtcatt

SEQ ID NO: 93521 - DNA, 25 bp, Rattus norvegicus
actcaaccataacctaccatttcga

SEQ ID NO: 93522 - DNA, 25 bp, Rattus norvegicus
actcaaccataagctaccatttcga

SEQ ID NO: 93523 - DNA, 25 bp, Rattus norvegicus
actcaaccttaacatcactgggcag

SEQ ID NO: 93524 - DNA, 25 bp, Rattus norvegicus
actcaaccttaagatcactgggcag

SEQ ID NO: 93525 - DNA, 25 bp, Rattus norvegicus
actcaactaggcctggcacttagta

SEQ ID NO: 93526 - DNA, 25 bp, Rattus norvegicus
actcaactaggcgtggcacttagta

SEQ ID NO: 93527 - DNA, 25 bp, Rattus norvegicus
actcaactcaggagccaaaggagcc

SEQ ID NO: 93528 - DNA, 25 bp, Rattus norvegicus
actcaactcaggtgccaaaggagcc

SEQ ID NO: 93529 - DNA, 25 bp, Rattus norvegicus
actcaactgagcagtgtggcacaca

SEQ ID NO: 93530 - DNA, 25 bp, Rattus norvegicus
actcaactgagctgtgtggcacaca

SEQ ID NO: 93531 - DNA, 25 bp, Rattus norvegicus
actcaactggagctcctatggccta

SEQ ID NO: 93532 - DNA, 25 bp, Rattus norvegicus
actcaactggaggtcctatggccta

SEQ ID NO: 93533 - DNA, 25 bp, Rattus norvegicus
actcaactgtgtctggtgcgctcaa

SEQ ID NO: 93534 - DNA, 25 bp, Rattus norvegicus
actcaactgtgtgtggtgcgctcaa

SEQ ID NO: 93535 - DNA, 25 bp, Rattus norvegicus
actcaagaaagaacgcattgccaag

SEQ ID NO: 93536 - DNA, 25 bp, Rattus norvegicus
actcaagaaagatcgcattgccaag

SEQ ID NO: 93537 - DNA, 25 bp, Rattus norvegicus
actcaagaagagaagtcccctttct

SEQ ID NO: 93538 - DNA, 25 bp, Rattus norvegicus
actcaagaagagtagtcccctttct

SEQ ID NO: 93539 - DNA, 25 bp, Rattus norvegicus
actcaagactaaatgctttgggaag

SEQ ID NO: 93540 - DNA, 25 bp, Rattus norvegicus
actcaagactaattgctttgggaag

SEQ ID NO: 93541 - DNA, 25 bp, Rattus norvegicus
actcaagactgtcaagccgtcctta

SEQ ID NO: 93542 - DNA, 25 bp, Rattus norvegicus
actcaagactgtcctgacacgggaa

SEQ ID NO: 93543 - DNA, 25 bp, Rattus norvegicus
actcaagactgtgaagccgtcctta

SEQ ID NO: 93544 - DNA, 25 bp, Rattus norvegicus
actcaagactgtgctgacacgggaa

SEQ ID NO: 93545 - DNA, 25 bp, Rattus norvegicus
actcaagagcggacccagggtaact

SEQ ID NO: 93546 - DNA, 25 bp, Rattus norvegicus
actcaagagcggtcccagggtaact

SEQ ID NO: 93547 - DNA, 25 bp, Rattus norvegicus
actcaagatgcccaatagcaggttg

SEQ ID NO: 93548 - DNA, 25 bp, Rattus norvegicus
actcaagatgccgaatagcaggttg

SEQ ID NO: 93549 - DNA, 25 bp, Rattus norvegicus
actcaagcacataccttcacacaga

SEQ ID NO: 93550 - DNA, 25 bp, Rattus norvegicus
actcaagcacattccttcacacaga

SEQ ID NO: 93551 - DNA, 25 bp, Rattus norvegicus
actcaagcagcaattacgccaaacg

SEQ ID NO: 93552 - DNA, 25 bp, Rattus norvegicus
actcaagcagcatttacgccaaacg

SEQ ID NO: 93553 - DNA, 25 bp, Rattus norvegicus
actcaagccaagagccaaaggacaa

SEQ ID NO: 93554 - DNA, 25 bp, Rattus norvegicus
actcaagccaagtgccaaaggacaa

SEQ ID NO: 93555 - DNA, 25 bp, Rattus norvegicus
actcaagctaaacctgtctctgtct

SEQ ID NO: 93556 - DNA, 25 bp, Rattus norvegicus
actcaagctaaagctgtctctgtct

SEQ ID NO: 93557 - DNA, 25 bp, Rattus norvegicus
actcaagctagtcagggcttctgct

SEQ ID NO: 93558 - DNA, 25 bp, Rattus norvegicus
actcaagctagtgagggcttctgct

SEQ ID NO: 93559 - DNA, 25 bp, Rattus norvegicus
actcaaggaactccccatttgggtc

SEQ ID NO: 93560 - DNA, 25 bp, Rattus norvegicus
actcaaggaactgcccatttgggtc

SEQ ID NO: 93561 - DNA, 25 bp, Rattus norvegicus
actcaaggactacctctggttctac

SEQ ID NO: 93562 - DNA, 25 bp, Rattus norvegicus
actcaaggactagctctggttctac

SEQ ID NO: 93563 - DNA, 25 bp, Rattus norvegicus
actcaaggtaggactgggtctgctg

SEQ ID NO: 93564 - DNA, 25 bp, Rattus norvegicus
actcaaggtaggtctgggtctgctg

SEQ ID NO: 93565 - DNA, 25 bp, Rattus norvegicus
actcaagtcttgctcctttgaagag

SEQ ID NO: 93566 - DNA, 25 bp, Rattus norvegicus
actcaagtcttggtcctttgaagag

SEQ ID NO: 93567 - DNA, 25 bp, Rattus norvegicus
actcaataagccctttctctagttc

SEQ ID NO: 93568 - DNA, 25 bp, Rattus norvegicus
actcaataagccgtttctctagttc

SEQ ID NO: 93569 - DNA, 25 bp, Rattus norvegicus
actcaatacataccccttagttcta

SEQ ID NO: 93570 - DNA, 25 bp, Rattus norvegicus
actcaatacatagcccttagttcta

SEQ ID NO: 93571 - DNA, 25 bp, Rattus norvegicus
actcaatgcactctcgaagtcaccg

SEQ ID NO: 93572 - DNA, 25 bp, Rattus norvegicus
actcaatgcactgtcgaagtcaccg

SEQ ID NO: 93573 - DNA, 25 bp, Rattus norvegicus
actcaatgctcgagtggccactgtg

SEQ ID NO: 93574 - DNA, 25 bp, Rattus norvegicus
actcaatgctcgtgtggccactgtg

SEQ ID NO: 93575 - DNA, 25 bp, Rattus norvegicus
actcaatggtgcacttgtgggtgct

SEQ ID NO: 93576 - DNA, 25 bp, Rattus norvegicus
actcaatggtgctcttgtgggtgct

SEQ ID NO: 93577 - DNA, 25 bp, Rattus norvegicus
actcaatgtgggatttgccattaca

SEQ ID NO: 93578 - DNA, 25 bp, Rattus norvegicus
actcaatgtgggttttgccattaca

SEQ ID NO: 93579 - DNA, 25 bp, Rattus norvegicus
actcaatgtggtattgccgttacaa

SEQ ID NO: 93580 - DNA, 25 bp, Rattus norvegicus
actcaatgtggttttgccgttacaa

SEQ ID NO: 93581 - DNA, 25 bp, Rattus norvegicus
actcaattatctcacttaacttcta

SEQ ID NO: 93582 - DNA, 25 bp, Rattus norvegicus
actcaattatctgacttaacttcta

SEQ ID NO: 93583 - DNA, 25 bp, Rattus norvegicus
actcaattccaactcttcaacagct

SEQ ID NO: 93584 - DNA, 25 bp, Rattus norvegicus
actcaattccaagtcttcaacagct

SEQ ID NO: 93585 - DNA, 25 bp, Rattus norvegicus
actcaattccctagtagctcagact

SEQ ID NO: 93586 - DNA, 25 bp, Rattus norvegicus
actcaattcccttgtagctcagact

SEQ ID NO: 93587 - DNA, 25 bp, Rattus norvegicus
actcacaaattaagtcgccttgctc

SEQ ID NO: 93588 - DNA, 25 bp, Rattus norvegicus
actcacaaattatgtcgccttgctc

SEQ ID NO: 93589 - DNA, 25 bp, Rattus norvegicus
actcacaagctaccagctcatctta

SEQ ID NO: 93590 - DNA, 25 bp, Rattus norvegicus
actcacaagctagcagctcatctta

SEQ ID NO: 93591 - DNA, 25 bp, Rattus norvegicus
actcacaattttctagtggcttcgt

SEQ ID NO: 93592 - DNA, 25 bp, Rattus norvegicus
actcacaattttgtagtggcttcgt

SEQ ID NO: 93593 - DNA, 25 bp, Rattus norvegicus
actcacacaccgctgggtaggcagg

SEQ ID NO: 93594 - DNA, 25 bp, Rattus norvegicus
actcacacaccggtgggtaggcagg

SEQ ID NO: 93595 - DNA, 25 bp, Rattus norvegicus
actcacacagccattgttacctgga

SEQ ID NO: 93596 - DNA, 25 bp, Rattus norvegicus
actcacacagcctttgttacctgga

SEQ ID NO: 93597 - DNA, 25 bp, Rattus norvegicus
actcacacagtcctcatgaccttta

SEQ ID NO: 93598 - DNA, 25 bp, Rattus norvegicus
actcacacagtcgtcatgaccttta

SEQ ID NO: 93599 - DNA, 25 bp, Rattus norvegicus
actcacaccttgcagctgaagggcc

SEQ ID NO: 93600 - DNA, 25 bp, Rattus norvegicus
actcacaccttggagctgaagggcc

SEQ ID NO: 93601 - DNA, 25 bp, Rattus norvegicus
actcacacttacaaggctgtggcca

SEQ ID NO: 93602 - DNA, 25 bp, Rattus norvegicus
actcacacttactaggctgtggcca

SEQ ID NO: 93603 - DNA, 25 bp, Rattus norvegicus
actcacacttctcaaggctcctgag

SEQ ID NO: 93604 - DNA, 25 bp, Rattus norvegicus
actcacacttctgaaggctcctgag

SEQ ID NO: 93605 - DNA, 25 bp, Rattus norvegicus
actcacagagctccacatgttcccc

SEQ ID NO: 93606 - DNA, 25 bp, Rattus norvegicus
actcacagagctgcacatgttcccc

SEQ ID NO: 93607 - DNA, 25 bp, Rattus norvegicus
actcacagaggtctgccattctctg

SEQ ID NO: 93608 - DNA, 25 bp, Rattus norvegicus
actcacagaggtgtgccattctctg

SEQ ID NO: 93609 - DNA, 25 bp, Rattus norvegicus
actcacagcccacttacatttaaaa

SEQ ID NO: 93610 - DNA, 25 bp, Rattus norvegicus
actcacagcccagttacatttaaaa

SEQ ID NO: 93611 - DNA, 25 bp, Rattus norvegicus
actcacagcggtcgtcagcaggtac

SEQ ID NO: 93612 - DNA, 25 bp, Rattus norvegicus
actcacagcggtggtcagcaggtac

SEQ ID NO: 93613 - DNA, 25 bp, Rattus norvegicus
actcacagctttcctacatctgggc

SEQ ID NO: 93614 - DNA, 25 bp, Rattus norvegicus
actcacagctttgctacatctgggc

SEQ ID NO: 93615 - DNA, 25 bp, Rattus norvegicus
actcacaggcctactgtgggactgg

SEQ ID NO: 93616 - DNA, 25 bp, Rattus norvegicus
actcacaggccttctgtgggactgg

SEQ ID NO: 93617 - DNA, 25 bp, Rattus norvegicus
actcacagtatgaatggtgccatgt

SEQ ID NO: 93618 - DNA, 25 bp, Rattus norvegicus
actcacagtatgtatggtgccatgt

SEQ ID NO: 93619 - DNA, 25 bp, Rattus norvegicus
actcacagttttacatgcacagcac

SEQ ID NO: 93620 - DNA, 25 bp, Rattus norvegicus
actcacagtttttcatgcacagcac

SEQ ID NO: 93621 - DNA, 25 bp, Rattus norvegicus
actcacatccacaaagaggcgtcct

SEQ ID NO: 93622 - DNA, 25 bp, Rattus norvegicus
actcacatccactaagaggcgtcct

SEQ ID NO: 93623 - DNA, 25 bp, Rattus norvegicus
actcacatgcccagtttcttctaga

SEQ ID NO: 93624 - DNA, 25 bp, Rattus norvegicus
actcacatgccctgtttcttctaga

SEQ ID NO: 93625 - DNA, 25 bp, Rattus norvegicus
actcacatgttcacgcttacatagc

SEQ ID NO: 93626 - DNA, 25 bp, Rattus norvegicus
actcacatgttctcgcttacatagc

SEQ ID NO: 93627 - DNA, 25 bp, Rattus norvegicus
actcacatgttgactgcttcggcta

SEQ ID NO: 93628 - DNA, 25 bp, Rattus norvegicus
actcacatgttgtctgcttcggcta

SEQ ID NO: 93629 - DNA, 25 bp, Rattus norvegicus
actcacatttatctgctcatgccgt

SEQ ID NO: 93630 - DNA, 25 bp, Rattus norvegicus
actcacatttatgtgctcatgccgt

SEQ ID NO: 93631 - DNA, 25 bp, Rattus norvegicus
actcaccaacctctgttactcagag

SEQ ID NO: 93632 - DNA, 25 bp, Rattus norvegicus
actcaccaacctgtgttactcagag

SEQ ID NO: 93633 - DNA, 25 bp, Rattus norvegicus
actcaccacagtcaactttgtcctg

SEQ ID NO: 93634 - DNA, 25 bp, Rattus norvegicus
actcaccacagtgaactttgtcctg

SEQ ID NO: 93635 - DNA, 25 bp, Rattus norvegicus
actcaccaggagagtatgctcgctg

SEQ ID NO: 93636 - DNA, 25 bp, Rattus norvegicus
actcaccaggagtgtatgctcgctg

SEQ ID NO: 93637 - DNA, 25 bp, Rattus norvegicus
actcaccaggccaggtcaaacgaga

SEQ ID NO: 93638 - DNA, 25 bp, Rattus norvegicus
actcaccaggcctggtcaaacgaga

SEQ ID NO: 93639 - DNA, 25 bp, Rattus norvegicus
actcaccatctcctgttacaaacag

SEQ ID NO: 93640 - DNA, 25 bp, Rattus norvegicus
actcaccatctcgtgttacaaacag

SEQ ID NO: 93641 - DNA, 25 bp, Rattus norvegicus
actcaccatgataccgatttgtctt

SEQ ID NO: 93642 - DNA, 25 bp, Rattus norvegicus
actcaccatgattccgatttgtctt

SEQ ID NO: 93643 - DNA, 25 bp, Rattus norvegicus
actcaccatgggactttctatacaa

SEQ ID NO: 93644 - DNA, 25 bp, Rattus norvegicus
actcaccatgggtctttctatacaa

SEQ ID NO: 93645 - DNA, 25 bp, Rattus norvegicus
actcacccagtcattcacttaagaa

SEQ ID NO: 93646 - DNA, 25 bp, Rattus norvegicus
actcacccagtctttcacttaagaa

SEQ ID NO: 93647 - DNA, 25 bp, Rattus norvegicus
actcaccctcgaatatgtgcaggct

SEQ ID NO: 93648 - DNA, 25 bp, Rattus norvegicus
actcaccctcgattatgtgcaggct

SEQ ID NO: 93649 - DNA, 25 bp, Rattus norvegicus
actcaccgctggactctgcagagtt

SEQ ID NO: 93650 - DNA, 25 bp, Rattus norvegicus
actcaccgctggtctctgcagagtt

SEQ ID NO: 93651 - DNA, 25 bp, Rattus norvegicus
actcaccgtgctatcttcaaagttt

SEQ ID NO: 93652 - DNA, 25 bp, Rattus norvegicus
actcaccgtgctttcttcaaagttt

SEQ ID NO: 93653 - DNA, 25 bp, Rattus norvegicus
actcaccgtgtgagcgtctgggtgt

SEQ ID NO: 93654 - DNA, 25 bp, Rattus norvegicus
actcaccgtgtgtgcgtctgggtgt

SEQ ID NO: 93655 - DNA, 25 bp, Rattus norvegicus
actcacctccttatgtgacacagat

SEQ ID NO: 93656 - DNA, 25 bp, Rattus norvegicus
actcacctccttttgtgacacagat

SEQ ID NO: 93657 - DNA, 25 bp, Rattus norvegicus
actcacctctttcgtttggctggta

SEQ ID NO: 93658 - DNA, 25 bp, Rattus norvegicus
actcacctctttggtttggctggta

SEQ ID NO: 93659 - DNA, 25 bp, Rattus norvegicus
actcacctgcctcatgggaatggga

SEQ ID NO: 93660 - DNA, 25 bp, Rattus norvegicus
actcacctgcctgatgggaatggga

SEQ ID NO: 93661 - DNA, 25 bp, Rattus norvegicus
actcaccttattccaggagaagttg

SEQ ID NO: 93662 - DNA, 25 bp, Rattus norvegicus
actcaccttattgcaggagaagttg

SEQ ID NO: 93663 - DNA, 25 bp, Rattus norvegicus
actcaccttgtaaacactgtgtaca

SEQ ID NO: 93664 - DNA, 25 bp, Rattus norvegicus
actcaccttgtatacactgtgtaca

SEQ ID NO: 93665 - DNA, 25 bp, Rattus norvegicus
actcacctttccagagcattctgga

SEQ ID NO: 93666 - DNA, 25 bp, Rattus norvegicus
actcacctttcctgagcattctgga

SEQ ID NO: 93667 - DNA, 25 bp, Rattus norvegicus
actcacctttcgaaactagttatct

SEQ ID NO: 93668 - DNA, 25 bp, Rattus norvegicus
actcacctttcgtaactagttatct

SEQ ID NO: 93669 - DNA, 25 bp, Rattus norvegicus
actcacgaatgcattccacatgatg

SEQ ID NO: 93670 - DNA, 25 bp, Rattus norvegicus
actcacgaatgctttccacatgatg

SEQ ID NO: 93671 - DNA, 25 bp, Rattus norvegicus
actcacgaggctcgaaatactgcgc

SEQ ID NO: 93672 - DNA, 25 bp, Rattus norvegicus
actcacgaggctggaaatactgcgc

SEQ ID NO: 93673 - DNA, 25 bp, Rattus norvegicus
actcacgcattcctagtgtttcgtc

SEQ ID NO: 93674 - DNA, 25 bp, Rattus norvegicus
actcacgcattcgtagtgtttcgtc

SEQ ID NO: 93675 - DNA, 25 bp, Rattus norvegicus
actcacgccctgagggtgatggtca

SEQ ID NO: 93676 - DNA, 25 bp, Rattus norvegicus
actcacgccctgtgggtgatggtca

SEQ ID NO: 93677 - DNA, 25 bp, Rattus norvegicus
actcacgctttgcttttactgctta

SEQ ID NO: 93678 - DNA, 25 bp, Rattus norvegicus
actcacgctttggttttactgctta

SEQ ID NO: 93679 - DNA, 25 bp, Rattus norvegicus
actcacggagtgagatcttgcacaa

SEQ ID NO: 93680 - DNA, 25 bp, Rattus norvegicus
actcacggagtgtgatcttgcacaa

SEQ ID NO: 93681 - DNA, 25 bp, Rattus norvegicus
actcacgtgcatcttcttcttgtca

SEQ ID NO: 93682 - DNA, 25 bp, Rattus norvegicus
actcacgtgcatgttcttcttgtca

SEQ ID NO: 93683 - DNA, 25 bp, Rattus norvegicus
actcacgttgagctatcagtcgaac

SEQ ID NO: 93684 - DNA, 25 bp, Rattus norvegicus
actcacgttgaggtatcagtcgaac

SEQ ID NO: 93685 - DNA, 25 bp, Rattus norvegicus
actcactaacgtccagatcctgctg

SEQ ID NO: 93686 - DNA, 25 bp, Rattus norvegicus
actcactaacgtgcagatcctgctg

SEQ ID NO: 93687 - DNA, 25 bp, Rattus norvegicus
actcactaatgtactcttgaagtaa

SEQ ID NO: 93688 - DNA, 25 bp, Rattus norvegicus
actcactaatgttctcttgaagtaa

SEQ ID NO: 93689 - DNA, 25 bp, Rattus norvegicus
actcactcaataaggctcccactgt

SEQ ID NO: 93690 - DNA, 25 bp, Rattus norvegicus
actcactcaatatggctcccactgt

SEQ ID NO: 93691 - DNA, 25 bp, Rattus norvegicus
actcactcactactcaggatctgac

SEQ ID NO: 93692 - DNA, 25 bp, Rattus norvegicus
actcactcactagtcaggatctgac

SEQ ID NO: 93693 - DNA, 25 bp, Rattus norvegicus
actcactcagtgacatgttagaatc

SEQ ID NO: 93694 - DNA, 25 bp, Rattus norvegicus
actcactcagtgtcatgttagaatc

SEQ ID NO: 93695 - DNA, 25 bp, Rattus norvegicus
actcactcccagaggcgggtgcagg

SEQ ID NO: 93696 - DNA, 25 bp, Rattus norvegicus
actcactcccagtggcgggtgcagg

SEQ ID NO: 93697 - DNA, 25 bp, Rattus norvegicus
actcactccttgcttgccaggtgtg

SEQ ID NO: 93698 - DNA, 25 bp, Rattus norvegicus
actcactccttggttgccaggtgtg

SEQ ID NO: 93699 - DNA, 25 bp, Rattus norvegicus
actcactcgaacctcatcagattga

SEQ ID NO: 93700 - DNA, 25 bp, Rattus norvegicus
actcactcgaacgtcatcagattga

SEQ ID NO: 93701 - DNA, 25 bp, Rattus norvegicus
actcactctgtacaacaggcctcta

SEQ ID NO: 93702 - DNA, 25 bp, Rattus norvegicus
actcactctgtagaacaggcctcta

SEQ ID NO: 93703 - DNA, 25 bp, Rattus norvegicus
actcactctgtgctgttctgtgatg

SEQ ID NO: 93704 - DNA, 25 bp, Rattus norvegicus
actcactctgtggtgttctgtgatg

SEQ ID NO: 93705 - DNA, 25 bp, Rattus norvegicus
actcactgaattccaacgtctgctt

SEQ ID NO: 93706 - DNA, 25 bp, Rattus norvegicus
actcactgaattgcaacgtctgctt

SEQ ID NO: 93707 - DNA, 25 bp, Rattus norvegicus
actcactgccagcatggcatcttgt

SEQ ID NO: 93708 - DNA, 25 bp, Rattus norvegicus
actcactgccaggatggcatcttgt

SEQ ID NO: 93709 - DNA, 25 bp, Rattus norvegicus
actcactgctctactagaacttggt

SEQ ID NO: 93710 - DNA, 25 bp, Rattus norvegicus
actcactgctctatgacgatgggct

SEQ ID NO: 93711 - DNA, 25 bp, Rattus norvegicus
actcactgctcttctagaacttggt

SEQ ID NO: 93712 - DNA, 25 bp, Rattus norvegicus
actcactgctctttgacgatgggct

SEQ ID NO: 93713 - DNA, 25 bp, Rattus norvegicus
actcactggatcaacttctagtctg

SEQ ID NO: 93714 - DNA, 25 bp, Rattus norvegicus
actcactggatctacttctagtctg

SEQ ID NO: 93715 - DNA, 25 bp, Rattus norvegicus
actcactgtgtgattcgtggcataa

SEQ ID NO: 93716 - DNA, 25 bp, Rattus norvegicus
actcactgtgtgtttcgtggcataa

SEQ ID NO: 93717 - DNA, 25 bp, Rattus norvegicus
actcacttatgcatacctgcacatg

SEQ ID NO: 93718 - DNA, 25 bp, Rattus norvegicus
actcacttatgcttacctgcacatg

SEQ ID NO: 93719 - DNA, 25 bp, Rattus norvegicus
actcacttccggacactgtacagtt

SEQ ID NO: 93720 - DNA, 25 bp, Rattus norvegicus
actcacttccggtcactgtacagtt

SEQ ID NO: 93721 - DNA, 25 bp, Rattus norvegicus
actcacttcggtccatatgtgcgga

SEQ ID NO: 93722 - DNA, 25 bp, Rattus norvegicus
actcacttcggtgcatatgtgcgga

SEQ ID NO: 93723 - DNA, 25 bp, Rattus norvegicus
actcacttctccacttaatagctag

SEQ ID NO: 93724 - DNA, 25 bp, Rattus norvegicus
actcacttctcctcttaatagctag

SEQ ID NO: 93725 - DNA, 25 bp, Rattus norvegicus
actcacttctctaaaactggtattg

SEQ ID NO: 93726 - DNA, 25 bp, Rattus norvegicus
actcacttctcttaaactggtattg

SEQ ID NO: 93727 - DNA, 25 bp, Rattus norvegicus
actcacttctttctattgcttacaa

SEQ ID NO: 93728 - DNA, 25 bp, Rattus norvegicus
actcacttctttgtattgcttacaa

SEQ ID NO: 93729 - DNA, 25 bp, Rattus norvegicus
actcacttgagtatgcctctgttta

SEQ ID NO: 93730 - DNA, 25 bp, Rattus norvegicus
actcacttgagtttgcctctgttta

SEQ ID NO: 93731 - DNA, 25 bp, Rattus norvegicus
actcacttggttaggcatgtatggc

SEQ ID NO: 93732 - DNA, 25 bp, Rattus norvegicus
actcacttggtttggcatgtatggc

SEQ ID NO: 93733 - DNA, 25 bp, Rattus norvegicus
actcactttctaacatgtctgacgc

SEQ ID NO: 93734 - DNA, 25 bp, Rattus norvegicus
actcactttctatcatgtctgacgc

SEQ ID NO: 93735 - DNA, 25 bp, Rattus norvegicus
actcagaaatccaggagcctttgcc

SEQ ID NO: 93736 - DNA, 25 bp, Rattus norvegicus
actcagaaatcctggagcctttgcc

SEQ ID NO: 93737 - DNA, 25 bp, Rattus norvegicus
actcagaatgcacaaggccttctct

SEQ ID NO: 93738 - DNA, 25 bp, Rattus norvegicus
actcagaatgcagaaggccttctct

SEQ ID NO: 93739 - DNA, 25 bp, Rattus norvegicus
actcagacatctccacatctattta

SEQ ID NO: 93740 - DNA, 25 bp, Rattus norvegicus
actcagacatctgcacatctattta

SEQ ID NO: 93741 - DNA, 25 bp, Rattus norvegicus
actcagacctggagcttcagaacta

SEQ ID NO: 93742 - DNA, 25 bp, Rattus norvegicus
actcagacctggtgcttcagaacta

SEQ ID NO: 93743 - DNA, 25 bp, Rattus norvegicus
actcagagaaacagacccagggcat

SEQ ID NO: 93744 - DNA, 25 bp, Rattus norvegicus
actcagagaaactgacccagggcat

SEQ ID NO: 93745 - DNA, 25 bp, Rattus norvegicus
actcagagagctagctgccttacct

SEQ ID NO: 93746 - DNA, 25 bp, Rattus norvegicus
actcagagagcttgctgccttacct

SEQ ID NO: 93747 - DNA, 25 bp, Rattus norvegicus
actcagaggaggcactttatacaat

SEQ ID NO: 93748 - DNA, 25 bp, Rattus norvegicus
actcagaggagggactttatacaat

SEQ ID NO: 93749 - DNA, 25 bp, Rattus norvegicus
actcagagggctatgggcgcagttc

SEQ ID NO: 93750 - DNA, 25 bp, Rattus norvegicus
actcagagggctttgggcgcagttc

SEQ ID NO: 93751 - DNA, 25 bp, Rattus norvegicus
actcagaggtggatagacgcatttc

SEQ ID NO: 93752 - DNA, 25 bp, Rattus norvegicus
actcagaggtggttagacgcatttc

SEQ ID NO: 93753 - DNA, 25 bp, Rattus norvegicus
actcagagtggtaggacgggacctc

SEQ ID NO: 93754 - DNA, 25 bp, Rattus norvegicus
actcagagtggttggacgggacctc

SEQ ID NO: 93755 - DNA, 25 bp, Rattus norvegicus
actcagatcttcatgcttgtggcac

SEQ ID NO: 93756 - DNA, 25 bp, Rattus norvegicus
actcagatcttcttgcttgtggcac

SEQ ID NO: 93757 - DNA, 25 bp, Rattus norvegicus
actcagattatgaatgccctacaga

SEQ ID NO: 93758 - DNA, 25 bp, Rattus norvegicus
actcagattatgtatgccctacaga

SEQ ID NO: 93759 - DNA, 25 bp, Rattus norvegicus
actcagattattaggtttagcaaca

SEQ ID NO: 93760 - DNA, 25 bp, Rattus norvegicus
actcagattatttggtttagcaaca

SEQ ID NO: 93761 - DNA, 25 bp, Rattus norvegicus
actcagattcccctctggatgcaaa

SEQ ID NO: 93762 - DNA, 25 bp, Rattus norvegicus
actcagattcccgtctggatgcaaa

SEQ ID NO: 93763 - DNA, 25 bp, Rattus norvegicus
actcagattgctctctacctagtca

SEQ ID NO: 93764 - DNA, 25 bp, Rattus norvegicus
actcagattgctgtctacctagtca

SEQ ID NO: 93765 - DNA, 25 bp, Rattus norvegicus
actcagattttactcccatggcctt

SEQ ID NO: 93766 - DNA, 25 bp, Rattus norvegicus
actcagattttagtcccatggcctt

SEQ ID NO: 93767 - DNA, 25 bp, Rattus norvegicus
actcagcaacacaggtcacgtttgg

SEQ ID NO: 93768 - DNA, 25 bp, Rattus norvegicus
actcagcaacactggtcacgtttgg

SEQ ID NO: 93769 - DNA, 25 bp, Rattus norvegicus
actcagcaacggcaggttatccacg

SEQ ID NO: 93770 - DNA, 25 bp, Rattus norvegicus
actcagcaacgggaggttatccacg

SEQ ID NO: 93771 - DNA, 25 bp, Rattus norvegicus
actcagcagacacgagcactcttga

SEQ ID NO: 93772 - DNA, 25 bp, Rattus norvegicus
actcagcagacaggagcactcttga

SEQ ID NO: 93773 - DNA, 25 bp, Rattus norvegicus
actcagcagcctacatcctaattat

SEQ ID NO: 93774 - DNA, 25 bp, Rattus norvegicus
actcagcagccttcatcctaattat

SEQ ID NO: 93775 - DNA, 25 bp, Rattus norvegicus
actcagcagctgaggaggatcctga

SEQ ID NO: 93776 - DNA, 25 bp, Rattus norvegicus
actcagcagctgtggaggatcctga

SEQ ID NO: 93777 - DNA, 25 bp, Rattus norvegicus
actcagcaggctcttacgtgggcta

SEQ ID NO: 93778 - DNA, 25 bp, Rattus norvegicus
actcagcaggctgttacgtgggcta

SEQ ID NO: 93779 - DNA, 25 bp, Rattus norvegicus
actcagcatatgagcctcttgtatg

SEQ ID NO: 93780 - DNA, 25 bp, Rattus norvegicus
actcagcatatgtgcctcttgtatg

SEQ ID NO: 93781 - DNA, 25 bp, Rattus norvegicus
actcagcatcgtccagcgattgtga

SEQ ID NO: 93782 - DNA, 25 bp, Rattus norvegicus
actcagcatcgtgcagcgattgtga

SEQ ID NO: 93783 - DNA, 25 bp, Rattus norvegicus
actcagcatgctattgggaccctaa

SEQ ID NO: 93784 - DNA, 25 bp, Rattus norvegicus
actcagcatgcttttgggaccctaa

SEQ ID NO: 93785 - DNA, 25 bp, Rattus norvegicus
actcagccaaggaagttgatctctt

SEQ ID NO: 93786 - DNA, 25 bp, Rattus norvegicus
actcagccaaggtagttgatctctt

SEQ ID NO: 93787 - DNA, 25 bp, Rattus norvegicus
actcagccagcaacttagcacattt

SEQ ID NO: 93788 - DNA, 25 bp, Rattus norvegicus
actcagccagcatcttagcacattt

SEQ ID NO: 93789 - DNA, 25 bp, Rattus norvegicus
actcagccatgaccttgggtgacct

SEQ ID NO: 93790 - DNA, 25 bp, Rattus norvegicus
actcagccatgagcttgggtgacct

SEQ ID NO: 93791 - DNA, 25 bp, Rattus norvegicus
actcagccctgtatatttgtgtaat

SEQ ID NO: 93792 - DNA, 25 bp, Rattus norvegicus
actcagccctgtttatttgtgtaat

SEQ ID NO: 93793 - DNA, 25 bp, Rattus norvegicus
actcagccgagcattgtgcagccag

SEQ ID NO: 93794 - DNA, 25 bp, Rattus norvegicus
actcagccgagctttgtgcagccag

SEQ ID NO: 93795 - DNA, 25 bp, Rattus norvegicus
actcagctacacaatttgtgcagga

SEQ ID NO: 93796 - DNA, 25 bp, Rattus norvegicus
actcagctacactatttgtgcagga

SEQ ID NO: 93797 - DNA, 25 bp, Rattus norvegicus
actcagctcatcataagggttccaa

SEQ ID NO: 93798 - DNA, 25 bp, Rattus norvegicus
actcagctcatcttaagggttccaa

SEQ ID NO: 93799 - DNA, 25 bp, Rattus norvegicus
actcagctgagcaaagtgacccagt

SEQ ID NO: 93800 - DNA, 25 bp, Rattus norvegicus
actcagctgagctaagtgacccagt

SEQ ID NO: 93801 - DNA, 25 bp, Rattus norvegicus
actcagctgcacctcatcatgggat

SEQ ID NO: 93802 - DNA, 25 bp, Rattus norvegicus
actcagctgcacgtcatcatgggat

SEQ ID NO: 93803 - DNA, 25 bp, Rattus norvegicus
actcagctgcatcaattaactcctc

SEQ ID NO: 93804 - DNA, 25 bp, Rattus norvegicus
actcagctgcatgaattaactcctc

SEQ ID NO: 93805 - DNA, 25 bp, Rattus norvegicus
actcagctggctatgtgtggactgg

SEQ ID NO: 93806 - DNA, 25 bp, Rattus norvegicus
actcagctggctttgtgtggactgg

SEQ ID NO: 93807 - DNA, 25 bp, Rattus norvegicus
actcagctgggcacctgctttgtgt

SEQ ID NO: 93808 - DNA, 25 bp, Rattus norvegicus
actcagctgggctcctgctttgtgt

SEQ ID NO: 93809 - DNA, 25 bp, Rattus norvegicus
actcagcttgctacctatgttttat

SEQ ID NO: 93810 - DNA, 25 bp, Rattus norvegicus
actcagcttgcttcctatgttttat

SEQ ID NO: 93811 - DNA, 25 bp, Rattus norvegicus
actcagcttggacgctatcccttgt

SEQ ID NO: 93812 - DNA, 25 bp, Rattus norvegicus
actcagcttggaggctatcccttgt

SEQ ID NO: 93813 - DNA, 25 bp, Rattus norvegicus
actcagctttcaatcctctgatgag

SEQ ID NO: 93814 - DNA, 25 bp, Rattus norvegicus
actcagctttcattcctctgatgag

SEQ ID NO: 93815 - DNA, 25 bp, Rattus norvegicus
actcaggaaccacgtgtctcccaag

SEQ ID NO: 93816 - DNA, 25 bp, Rattus norvegicus
actcaggaaccaggtgtctcccaag

SEQ ID NO: 93817 - DNA, 25 bp, Rattus norvegicus
actcaggaacctagcagtttagaca

SEQ ID NO: 93818 - DNA, 25 bp, Rattus norvegicus
actcaggaaccttgcagtttagaca

SEQ ID NO: 93819 - DNA, 25 bp, Rattus norvegicus
actcaggaacggacatgctcggtgt

SEQ ID NO: 93820 - DNA, 25 bp, Rattus norvegicus
actcaggaacggtcatgctcggtgt

SEQ ID NO: 93821 - DNA, 25 bp, Rattus norvegicus
actcaggaacttaatgccggtgcaa

SEQ ID NO: 93822 - DNA, 25 bp, Rattus norvegicus
actcaggaactttatgccggtgcaa

SEQ ID NO: 93823 - DNA, 25 bp, Rattus norvegicus
actcaggacagacttggtggctcat

SEQ ID NO: 93824 - DNA, 25 bp, Rattus norvegicus
actcaggacagagttggtggctcat

SEQ ID NO: 93825 - DNA, 25 bp, Rattus norvegicus
actcaggacataagtagcatttcac

SEQ ID NO: 93826 - DNA, 25 bp, Rattus norvegicus
actcaggacatatgtagcatttcac

SEQ ID NO: 93827 - DNA, 25 bp, Rattus norvegicus
actcaggacgttcgattgcaggact

SEQ ID NO: 93828 - DNA, 25 bp, Rattus norvegicus
actcaggacgttggattgcaggact

SEQ ID NO: 93829 - DNA, 25 bp, Rattus norvegicus
actcaggactcaacctggcatgcag

SEQ ID NO: 93830 - DNA, 25 bp, Rattus norvegicus
actcaggactcatcctggcatgcag

SEQ ID NO: 93831 - DNA, 25 bp, Rattus norvegicus
actcaggagcgcatgtgggtacaag

SEQ ID NO: 93832 - DNA, 25 bp, Rattus norvegicus
actcaggagcgcttgtgggtacaag

SEQ ID NO: 93833 - DNA, 25 bp, Rattus norvegicus
actcaggagctgatttcaattatgg

SEQ ID NO: 93834 - DNA, 25 bp, Rattus norvegicus
actcaggagctgttttcaattatgg

SEQ ID NO: 93835 - DNA, 25 bp, Rattus norvegicus
actcaggagttcaagctagtgccag

SEQ ID NO: 93836 - DNA, 25 bp, Rattus norvegicus
actcaggagttctagctagtgccag

SEQ ID NO: 93837 - DNA, 25 bp, Rattus norvegicus
actcaggatgctatcttccaagtca

SEQ ID NO: 93838 - DNA, 25 bp, Rattus norvegicus
actcaggatgctttcttccaagtca

SEQ ID NO: 93839 - DNA, 25 bp, Rattus norvegicus
actcaggattatagttgctggccaa

SEQ ID NO: 93840 - DNA, 25 bp, Rattus norvegicus
actcaggattattgttgctggccaa

SEQ ID NO: 93841 - DNA, 25 bp, Rattus norvegicus
actcaggcaccaatgtgctggctca

SEQ ID NO: 93842 - DNA, 25 bp, Rattus norvegicus
actcaggcaccattgtgctggctca

SEQ ID NO: 93843 - DNA, 25 bp, Rattus norvegicus
actcaggcagacctcctagaggtat

SEQ ID NO: 93844 - DNA, 25 bp, Rattus norvegicus
actcaggcagacgtcctagaggtat

SEQ ID NO: 93845 - DNA, 25 bp, Rattus norvegicus
actcaggcaggaccggtctgtgcca

SEQ ID NO: 93846 - DNA, 25 bp, Rattus norvegicus
actcaggcaggagcggtctgtgcca

SEQ ID NO: 93847 - DNA, 25 bp, Rattus norvegicus
actcaggcctccactagttgggatc

SEQ ID NO: 93848 - DNA, 25 bp, Rattus norvegicus
actcaggcctcctctagttgggatc

SEQ ID NO: 93849 - DNA, 25 bp, Rattus norvegicus
actcaggccttccaggctgtctgaa

SEQ ID NO: 93850 - DNA, 25 bp, Rattus norvegicus
actcaggccttcgaggctgtctgaa

SEQ ID NO: 93851 - DNA, 25 bp, Rattus norvegicus
actcaggctcaacacttgctaattt

SEQ ID NO: 93852 - DNA, 25 bp, Rattus norvegicus
actcaggctcaagacttgctaattt

SEQ ID NO: 93853 - DNA, 25 bp, Rattus norvegicus
actcaggctcccctcatgggcagag

SEQ ID NO: 93854 - DNA, 25 bp, Rattus norvegicus
actcaggctcccgtcatgggcagag

SEQ ID NO: 93855 - DNA, 25 bp, Rattus norvegicus
actcagggcacccactaatggcgaa

SEQ ID NO: 93856 - DNA, 25 bp, Rattus norvegicus
actcagggcaccgactaatggcgaa

SEQ ID NO: 93857 - DNA, 25 bp, Rattus norvegicus
actcagggcagcagcaaatcaggct

SEQ ID NO: 93858 - DNA, 25 bp, Rattus norvegicus
actcagggcagctgcaaatcaggct

SEQ ID NO: 93859 - DNA, 25 bp, Rattus norvegicus
actcagggcaggatcctgggctgaa

SEQ ID NO: 93860 - DNA, 25 bp, Rattus norvegicus
actcagggcaggttcctgggctgaa

SEQ ID NO: 93861 - DNA, 25 bp, Rattus norvegicus
actcagggtgttagtttgcttgtac

SEQ ID NO: 93862 - DNA, 25 bp, Rattus norvegicus
actcagggtgtttgtttgcttgtac

SEQ ID NO: 93863 - DNA, 25 bp, Rattus norvegicus
actcaggtactgaccaaacattctc

SEQ ID NO: 93864 - DNA, 25 bp, Rattus norvegicus
actcaggtactgtccaaacattctc

SEQ ID NO: 93865 - DNA, 25 bp, Rattus norvegicus
actcaggtacttagaatttgatgcc

SEQ ID NO: 93866 - DNA, 25 bp, Rattus norvegicus
actcaggtactttgaatttgatgcc

SEQ ID NO: 93867 - DNA, 25 bp, Rattus norvegicus
actcaggtcataaggcttggcatca

SEQ ID NO: 93868 - DNA, 25 bp, Rattus norvegicus
actcaggtcatatggcttggcatca

SEQ ID NO: 93869 - DNA, 25 bp, Rattus norvegicus
actcaggtcctcatacttgtgtagc

SEQ ID NO: 93870 - DNA, 25 bp, Rattus norvegicus
actcaggtcctcatatttgcatgac

SEQ ID NO: 93871 - DNA, 25 bp, Rattus norvegicus
actcaggtcctcttacttgtgtagc

SEQ ID NO: 93872 - DNA, 25 bp, Rattus norvegicus
actcaggtcctcttatttgcatgac

SEQ ID NO: 93873 - DNA, 25 bp, Rattus norvegicus
actcaggtctccaggcgactcggct

SEQ ID NO: 93874 - DNA, 25 bp, Rattus norvegicus
actcaggtctcctggcgactcggct

SEQ ID NO: 93875 - DNA, 25 bp, Rattus norvegicus
actcaggtctgtattccaaggtggc

SEQ ID NO: 93876 - DNA, 25 bp, Rattus norvegicus
actcaggtctgttttccaaggtggc

SEQ ID NO: 93877 - DNA, 25 bp, Rattus norvegicus
actcaggtgaaaatctttgcagtga

SEQ ID NO: 93878 - DNA, 25 bp, Rattus norvegicus
actcaggtgaaattctttgcagtga

SEQ ID NO: 93879 - DNA, 25 bp, Rattus norvegicus
actcaggtgactaccgaatggtgat

SEQ ID NO: 93880 - DNA, 25 bp, Rattus norvegicus
actcaggtgacttccgaatggtgat

SEQ ID NO: 93881 - DNA, 25 bp, Rattus norvegicus
actcaggtgagcagtgtgactgcac

SEQ ID NO: 93882 - DNA, 25 bp, Rattus norvegicus
actcaggtgagctgtgtgactgcac

SEQ ID NO: 93883 - DNA, 25 bp, Rattus norvegicus
actcaggtggtaaccttggtgcagc

SEQ ID NO: 93884 - DNA, 25 bp, Rattus norvegicus
actcaggtggtatccttggtgcagc

SEQ ID NO: 93885 - DNA, 25 bp, Rattus norvegicus
actcaggtgtttctggatgctcatg

SEQ ID NO: 93886 - DNA, 25 bp, Rattus norvegicus
actcaggtgtttgtggatgctcatg

SEQ ID NO: 93887 - DNA, 25 bp, Rattus norvegicus
actcaggttcagcacccagcttcgt

SEQ ID NO: 93888 - DNA, 25 bp, Rattus norvegicus
actcaggttcaggacccagcttcgt

SEQ ID NO: 93889 - DNA, 25 bp, Rattus norvegicus
actcaggttccacttcagctagaat

SEQ ID NO: 93890 - DNA, 25 bp, Rattus norvegicus
actcaggttccagttcagctagaat

SEQ ID NO: 93891 - DNA, 25 bp, Rattus norvegicus
actcaggttgagctagcagaattgc

SEQ ID NO: 93892 - DNA, 25 bp, Rattus norvegicus
actcaggttgaggtagcagaattgc

SEQ ID NO: 93893 - DNA, 25 bp, Rattus norvegicus
actcaggttgtcaggtttgcttaac

SEQ ID NO: 93894 - DNA, 25 bp, Rattus norvegicus
actcaggttgtctggtttgcttaac

SEQ ID NO: 93895 - DNA, 25 bp, Rattus norvegicus
actcagtaattaagacaatggtcac

SEQ ID NO: 93896 - DNA, 25 bp, Rattus norvegicus
actcagtaattatgacaatggtcac

SEQ ID NO: 93897 - DNA, 25 bp, Rattus norvegicus
actcagtagctgagcctttgcctag

SEQ ID NO: 93898 - DNA, 25 bp, Rattus norvegicus
actcagtagctgtgcctttgcctag

SEQ ID NO: 93899 - DNA, 25 bp, Rattus norvegicus
actcagtagcttcccctccttagaa

SEQ ID NO: 93900 - DNA, 25 bp, Rattus norvegicus
actcagtagcttgccctccttagaa

SEQ ID NO: 93901 - DNA, 25 bp, Rattus norvegicus
actcagtagtttctgtaagctctta

SEQ ID NO: 93902 - DNA, 25 bp, Rattus norvegicus
actcagtagtttgtgtaagctctta

SEQ ID NO: 93903 - DNA, 25 bp, Rattus norvegicus
actcagtataatcggctcctgcctt

SEQ ID NO: 93904 - DNA, 25 bp, Rattus norvegicus
actcagtataatgggctcctgcctt

SEQ ID NO: 93905 - DNA, 25 bp, Rattus norvegicus
actcagtatagtatagccagcataa

SEQ ID NO: 93906 - DNA, 25 bp, Rattus norvegicus
actcagtatagtttagccagcataa

SEQ ID NO: 93907 - DNA, 25 bp, Rattus norvegicus
actcagtatgatcctgtctagtcct

SEQ ID NO: 93908 - DNA, 25 bp, Rattus norvegicus
actcagtatgatgctgtctagtcct

SEQ ID NO: 93909 - DNA, 25 bp, Rattus norvegicus
actcagtatgtacactatgtgggca

SEQ ID NO: 93910 - DNA, 25 bp, Rattus norvegicus
actcagtatgtagactatgtgggca

SEQ ID NO: 93911 - DNA, 25 bp, Rattus norvegicus
actcagtattccagccgacgctcaa

SEQ ID NO: 93912 - DNA, 25 bp, Rattus norvegicus
actcagtattcctgccgacgctcaa

SEQ ID NO: 93913 - DNA, 25 bp, Rattus norvegicus
actcagtattctcccttggatattt

SEQ ID NO: 93914 - DNA, 25 bp, Rattus norvegicus
actcagtattctgccttggatattt

SEQ ID NO: 93915 - DNA, 25 bp, Rattus norvegicus
actcagtcagcaaggcttggcggaa

SEQ ID NO: 93916 - DNA, 25 bp, Rattus norvegicus
actcagtcagcatggcttggcggaa

SEQ ID NO: 93917 - DNA, 25 bp, Rattus norvegicus
actcagtcagtcattctactaggga

SEQ ID NO: 93918 - DNA, 25 bp, Rattus norvegicus
actcagtcagtctttctactaggga

SEQ ID NO: 93919 - DNA, 25 bp, Rattus norvegicus
actcagtcctgaccacttggcaaaa

SEQ ID NO: 93920 - DNA, 25 bp, Rattus norvegicus
actcagtcctgagcacttggcaaaa

SEQ ID NO: 93921 - DNA, 25 bp, Rattus norvegicus
actcagtcctgcctttagggcttag

SEQ ID NO: 93922 - DNA, 25 bp, Rattus norvegicus
actcagtcctgcgtttagggcttag

SEQ ID NO: 93923 - DNA, 25 bp, Rattus norvegicus
actcagtccttgactcatggttcaa

SEQ ID NO: 93924 - DNA, 25 bp, Rattus norvegicus
actcagtccttgtctcatggttcaa

SEQ ID NO: 93925 - DNA, 25 bp, Rattus norvegicus
actcagtctcaaatcctttctatga

SEQ ID NO: 93926 - DNA, 25 bp, Rattus norvegicus
actcagtctcaattcctttctatga

SEQ ID NO: 93927 - DNA, 25 bp, Rattus norvegicus
actcagtctggtactgcgggctgga

SEQ ID NO: 93928 - DNA, 25 bp, Rattus norvegicus
actcagtctggttctgcgggctgga

SEQ ID NO: 93929 - DNA, 25 bp, Rattus norvegicus
actcagtgaagtctaggtctccgct

SEQ ID NO: 93930 - DNA, 25 bp, Rattus norvegicus
actcagtgaagtgtaggtctccgct

SEQ ID NO: 93931 - DNA, 25 bp, Rattus norvegicus
actcagtgacccactttactggaaa

SEQ ID NO: 93932 - DNA, 25 bp, Rattus norvegicus
actcagtgaccctctttactggaaa

SEQ ID NO: 93933 - DNA, 25 bp, Rattus norvegicus
actcagtgcagcctccgtagccaga

SEQ ID NO: 93934 - DNA, 25 bp, Rattus norvegicus
actcagtgcagcgtccgtagccaga

SEQ ID NO: 93935 - DNA, 25 bp, Rattus norvegicus
actcagtgcatcctccttccttgtt

SEQ ID NO: 93936 - DNA, 25 bp, Rattus norvegicus
actcagtgcatcgtccttccttgtt

SEQ ID NO: 93937 - DNA, 25 bp, Rattus norvegicus
actcagtgccgaatcgtgtttgcta

SEQ ID NO: 93938 - DNA, 25 bp, Rattus norvegicus
actcagtgccgattcgtgtttgcta

SEQ ID NO: 93939 - DNA, 25 bp, Rattus norvegicus
actcagtgctgtatacatggtgcta

SEQ ID NO: 93940 - DNA, 25 bp, Rattus norvegicus
actcagtgctgtttacatggtgcta

SEQ ID NO: 93941 - DNA, 25 bp, Rattus norvegicus
actcagtgggaacaaatgacctctt

SEQ ID NO: 93942 - DNA, 25 bp, Rattus norvegicus
actcagtgggaagaaatgacctctt

SEQ ID NO: 93943 - DNA, 25 bp, Rattus norvegicus
actcagtgggtcacatgtggtggat

SEQ ID NO: 93944 - DNA, 25 bp, Rattus norvegicus
actcagtgggtctcatgtggtggat

SEQ ID NO: 93945 - DNA, 25 bp, Rattus norvegicus
actcagtggtgcattgaactgcagc

SEQ ID NO: 93946 - DNA, 25 bp, Rattus norvegicus
actcagtggtgctttgaactgcagc

SEQ ID NO: 93947 - DNA, 25 bp, Rattus norvegicus
actcagtgtaccagtcggcgcagaa

SEQ ID NO: 93948 - DNA, 25 bp, Rattus norvegicus
actcagtgtacctgtcggcgcagaa

SEQ ID NO: 93949 - DNA, 25 bp, Rattus norvegicus
actcagtgtcagacccttgtggtca

SEQ ID NO: 93950 - DNA, 25 bp, Rattus norvegicus
actcagtgtcagtcccttgtggtca

SEQ ID NO: 93951 - DNA, 25 bp, Rattus norvegicus
actcagtgtccacatcttgatttca

SEQ ID NO: 93952 - DNA, 25 bp, Rattus norvegicus
actcagtgtccagatcttgatttca

SEQ ID NO: 93953 - DNA, 25 bp, Rattus norvegicus
actcagtgtgcacgttcggtatgtg

SEQ ID NO: 93954 - DNA, 25 bp, Rattus norvegicus
actcagtgtgcaggttcggtatgtg

SEQ ID NO: 93955 - DNA, 25 bp, Rattus norvegicus
actcagttcaggaaagtcacgtatg

SEQ ID NO: 93956 - DNA, 25 bp, Rattus norvegicus
actcagttcaggtaagtcacgtatg

SEQ ID NO: 93957 - DNA, 25 bp, Rattus norvegicus
actcagttccccaacgtgtttatga

SEQ ID NO: 93958 - DNA, 25 bp, Rattus norvegicus
actcagttcccctacgtgtttatga

SEQ ID NO: 93959 - DNA, 25 bp, Rattus norvegicus
actcagttcttcagttttaaacatt

SEQ ID NO: 93960 - DNA, 25 bp, Rattus norvegicus
actcagttcttctgttttaaacatt

SEQ ID NO: 93961 - DNA, 25 bp, Rattus norvegicus
actcagttgctactgttagccagga

SEQ ID NO: 93962 - DNA, 25 bp, Rattus norvegicus
actcagttgctagtgttagccagga

SEQ ID NO: 93963 - DNA, 25 bp, Rattus norvegicus
actcagtttagaagcacagggcccc

SEQ ID NO: 93964 - DNA, 25 bp, Rattus norvegicus
actcagtttagatgcacagggcccc

SEQ ID NO: 93965 - DNA, 25 bp, Rattus norvegicus
actcagtttcctcactgcttatata

SEQ ID NO: 93966 - DNA, 25 bp, Rattus norvegicus
actcagtttcctgactgcttatata

SEQ ID NO: 93967 - DNA, 25 bp, Rattus norvegicus
actcagttttcaagtagctttctat

SEQ ID NO: 93968 - DNA, 25 bp, Rattus norvegicus
actcagttttcatgtagctttctat

SEQ ID NO: 93969 - DNA, 25 bp, Rattus norvegicus
actcagttttctactatgctcggcg

SEQ ID NO: 93970 - DNA, 25 bp, Rattus norvegicus
actcagttttcttctatgctcggcg

SEQ ID NO: 93971 - DNA, 25 bp, Rattus norvegicus
actcagtttttcaccttctgtaaat

SEQ ID NO: 93972 - DNA, 25 bp, Rattus norvegicus
actcagtttttctccttctgtaaat

SEQ ID NO: 93973 - DNA, 25 bp, Rattus norvegicus
actcataacgttacagtgccacgga

SEQ ID NO: 93974 - DNA, 25 bp, Rattus norvegicus
actcataacgtttcagtgccacgga

SEQ ID NO: 93975 - DNA, 25 bp, Rattus norvegicus
actcataactccaatttaccacttt

SEQ ID NO: 93976 - DNA, 25 bp, Rattus norvegicus
actcataactcctatttaccacttt

SEQ ID NO: 93977 - DNA, 25 bp, Rattus norvegicus
actcatacatctacatccattcatt

SEQ ID NO: 93978 - DNA, 25 bp, Rattus norvegicus
actcatacatcttcatccattcatt

SEQ ID NO: 93979 - DNA, 25 bp, Rattus norvegicus
actcatacggtgatgcttccttgaa

SEQ ID NO: 93980 - DNA, 25 bp, Rattus norvegicus
actcatacggtgttgcttccttgaa

SEQ ID NO: 93981 - DNA, 25 bp, Rattus norvegicus
actcatactgtgcttaatactagat

SEQ ID NO: 93982 - DNA, 25 bp, Rattus norvegicus
actcatactgtggttaatactagat

SEQ ID NO: 93983 - DNA, 25 bp, Rattus norvegicus
actcatacttctagatggttctcaa

SEQ ID NO: 93984 - DNA, 25 bp, Rattus norvegicus
actcatacttcttgatggttctcaa

SEQ ID NO: 93985 - DNA, 25 bp, Rattus norvegicus
actcatacttttaacgctttctcaa

SEQ ID NO: 93986 - DNA, 25 bp, Rattus norvegicus
actcatactttttacgctttctcaa

SEQ ID NO: 93987 - DNA, 25 bp, Rattus norvegicus
actcatagcgcccaagaccgggaga

SEQ ID NO: 93988 - DNA, 25 bp, Rattus norvegicus
actcatagcgccgaagaccgggaga

SEQ ID NO: 93989 - DNA, 25 bp, Rattus norvegicus
actcatatctggacatagtggcaca

SEQ ID NO: 93990 - DNA, 25 bp, Rattus norvegicus
actcatatctggtcatagtggcaca

SEQ ID NO: 93991 - DNA, 25 bp, Rattus norvegicus
actcatatgtttctaactactgcta

SEQ ID NO: 93992 - DNA, 25 bp, Rattus norvegicus
actcatatgtttgtaactactgcta

SEQ ID NO: 93993 - DNA, 25 bp, Rattus norvegicus
actcatatttctacggacttccgtg

SEQ ID NO: 93994 - DNA, 25 bp, Rattus norvegicus
actcatatttcttcggacttccgtg

SEQ ID NO: 93995 - DNA, 25 bp, Rattus norvegicus
actcatcagctcagcctagctagag

SEQ ID NO: 93996 - DNA, 25 bp, Rattus norvegicus
actcatcagctctgcctagctagag

SEQ ID NO: 93997 - DNA, 25 bp, Rattus norvegicus
actcatcatgctagcctctgaatta

SEQ ID NO: 93998 - DNA, 25 bp, Rattus norvegicus
actcatcatgcttgcctctgaatta

SEQ ID NO: 93999 - DNA, 25 bp, Rattus norvegicus
actcatccctttatgatactctatc

SEQ ID NO: 94000 - DNA, 25 bp, Rattus norvegicus
actcatccctttttgatactctatc

SEQ ID NO: 94001 - DNA, 25 bp, Rattus norvegicus
actcatcctgttaccatagtacttg

SEQ ID NO: 94002 - DNA, 25 bp, Rattus norvegicus
actcatcctgtttccatagtacttg

SEQ ID NO: 94003 - DNA, 25 bp, Rattus norvegicus
actcatccttgaagcggtcgcagga

SEQ ID NO: 94004 - DNA, 25 bp, Rattus norvegicus
actcatccttgatgcggtcgcagga

SEQ ID NO: 94005 - DNA, 25 bp, Rattus norvegicus
actcatcgtggtattactgttctta

SEQ ID NO: 94006 - DNA, 25 bp, Rattus norvegicus
actcatcgtggttttactgttctta

SEQ ID NO: 94007 - DNA, 25 bp, Rattus norvegicus
actcatctacgtcccttttttatta

SEQ ID NO: 94008 - DNA, 25 bp, Rattus norvegicus
actcatctacgtgccttttttatta

SEQ ID NO: 94009 - DNA, 25 bp, Rattus norvegicus
actcatctacttctgttccttactt

SEQ ID NO: 94010 - DNA, 25 bp, Rattus norvegicus
actcatctacttgtgttccttactt

SEQ ID NO: 94011 - DNA, 25 bp, Rattus norvegicus
actcatctccacatctctaggataa

SEQ ID NO: 94012 - DNA, 25 bp, Rattus norvegicus
actcatctccacttctctaggataa

SEQ ID NO: 94013 - DNA, 25 bp, Rattus norvegicus
actcatctgagccatttttatatct

SEQ ID NO: 94014 - DNA, 25 bp, Rattus norvegicus
actcatctgagcgatttttatatct

SEQ ID NO: 94015 - DNA, 25 bp, Rattus norvegicus
actcatctggatatgggactgtccc

SEQ ID NO: 94016 - DNA, 25 bp, Rattus norvegicus
actcatctggatcaactgggcactt

SEQ ID NO: 94017 - DNA, 25 bp, Rattus norvegicus
actcatctggatgaactgggcactt

SEQ ID NO: 94018 - DNA, 25 bp, Rattus norvegicus
actcatctggatttgggactgtccc

SEQ ID NO: 94019 - DNA, 25 bp, Rattus norvegicus
actcatcttcccaggagtacagagt

SEQ ID NO: 94020 - DNA, 25 bp, Rattus norvegicus
actcatcttccctggagtacagagt

SEQ ID NO: 94021 - DNA, 25 bp, Rattus norvegicus
actcatctttgtaactagtgcctag

SEQ ID NO: 94022 - DNA, 25 bp, Rattus norvegicus
actcatctttgttactagtgcctag

SEQ ID NO: 94023 - DNA, 25 bp, Rattus norvegicus
actcatgcagtaccatggtcctaat

SEQ ID NO: 94024 - DNA, 25 bp, Rattus norvegicus
actcatgcagtagcatggtcctaat

SEQ ID NO: 94025 - DNA, 25 bp, Rattus norvegicus
actcatgcattcctactgcttggag

SEQ ID NO: 94026 - DNA, 25 bp, Rattus norvegicus
actcatgcattcgtactgcttggag

SEQ ID NO: 94027 - DNA, 25 bp, Rattus norvegicus
actcatgccttcaagtgttttactt

SEQ ID NO: 94028 - DNA, 25 bp, Rattus norvegicus
actcatgccttctagtgttttactt

SEQ ID NO: 94029 - DNA, 25 bp, Rattus norvegicus
actcatgctgtactgcttcctttgt

SEQ ID NO: 94030 - DNA, 25 bp, Rattus norvegicus
actcatgctgtagtgcttcctttgt

SEQ ID NO: 94031 - DNA, 25 bp, Rattus norvegicus
actcatggcaatcaaatggctttgg

SEQ ID NO: 94032 - DNA, 25 bp, Rattus norvegicus
actcatggcaatgaaatggctttgg

SEQ ID NO: 94033 - DNA, 25 bp, Rattus norvegicus
actcatgggtgtcctgtgggactca

SEQ ID NO: 94034 - DNA, 25 bp, Rattus norvegicus
actcatgggtgtgctgtgggactca

SEQ ID NO: 94035 - DNA, 25 bp, Rattus norvegicus
actcatggtaagactgtagcgtttc

SEQ ID NO: 94036 - DNA, 25 bp, Rattus norvegicus
actcatggtaagtctgtagcgtttc

SEQ ID NO: 94037 - DNA, 25 bp, Rattus norvegicus
actcatggtcatacatcctgtttat

SEQ ID NO: 94038 - DNA, 25 bp, Rattus norvegicus
actcatggtcattcatcctgtttat

SEQ ID NO: 94039 - DNA, 25 bp, Rattus norvegicus
actcatggtgaacttgcttgtccta

SEQ ID NO: 94040 - DNA, 25 bp, Rattus norvegicus
actcatggtgaagttgcttgtccta

SEQ ID NO: 94041 - DNA, 25 bp, Rattus norvegicus
actcatggtgacctgcttgcttcaa

SEQ ID NO: 94042 - DNA, 25 bp, Rattus norvegicus
actcatggtgacgtgcttgcttcaa

SEQ ID NO: 94043 - DNA, 25 bp, Rattus norvegicus
actcatggtgggaggcgttgtcata

SEQ ID NO: 94044 - DNA, 25 bp, Rattus norvegicus
actcatggtgggtggcgttgtcata

SEQ ID NO: 94045 - DNA, 25 bp, Rattus norvegicus
actcatggtgtgattggcttttgct

SEQ ID NO: 94046 - DNA, 25 bp, Rattus norvegicus
actcatggtgtgtttggcttttgct

SEQ ID NO: 94047 - DNA, 25 bp, Rattus norvegicus
actcatgtagtacacttacaaacac

SEQ ID NO: 94048 - DNA, 25 bp, Rattus norvegicus
actcatgtagtagacttacaaacac

SEQ ID NO: 94049 - DNA, 25 bp, Rattus norvegicus
actcatgtatgtcaagcggcttcag

SEQ ID NO: 94050 - DNA, 25 bp, Rattus norvegicus
actcatgtatgtgaagcggcttcag

SEQ ID NO: 94051 - DNA, 25 bp, Rattus norvegicus
actcatgtgagtacaagggcagact

SEQ ID NO: 94052 - DNA, 25 bp, Rattus norvegicus
actcatgtgagttcaagggcagact

SEQ ID NO: 94053 - DNA, 25 bp, Rattus norvegicus
actcatgtgtctattgtcgtgctat

SEQ ID NO: 94054 - DNA, 25 bp, Rattus norvegicus
actcatgtgtcttttgtcgtgctat

SEQ ID NO: 94055 - DNA, 25 bp, Rattus norvegicus
actcatgttctacttggtcactgtg

SEQ ID NO: 94056 - DNA, 25 bp, Rattus norvegicus
actcatgttctagttggtcactgtg

SEQ ID NO: 94057 - DNA, 25 bp, Rattus norvegicus
actcatgttcttaaaactcctggtg

SEQ ID NO: 94058 - DNA, 25 bp, Rattus norvegicus
actcatgttctttaaactcctggtg

SEQ ID NO: 94059 - DNA, 25 bp, Rattus norvegicus
actcatgttgggagttgagcacagc

SEQ ID NO: 94060 - DNA, 25 bp, Rattus norvegicus
actcatgttgggtgttgagcacagc

SEQ ID NO: 94061 - DNA, 25 bp, Rattus norvegicus
actcattaacgtaactgcactgcta

SEQ ID NO: 94062 - DNA, 25 bp, Rattus norvegicus
actcattaacgttactgcactgcta

SEQ ID NO: 94063 - DNA, 25 bp, Rattus norvegicus
actcattagtgccacccagtgataa

SEQ ID NO: 94064 - DNA, 25 bp, Rattus norvegicus
actcattagtgcgacccagtgataa

SEQ ID NO: 94065 - DNA, 25 bp, Rattus norvegicus
actcattatgtactctggctccagc

SEQ ID NO: 94066 - DNA, 25 bp, Rattus norvegicus
actcattatgtagtctggctccagc

SEQ ID NO: 94067 - DNA, 25 bp, Rattus norvegicus
actcattcaataactgcttcctcag

SEQ ID NO: 94068 - DNA, 25 bp, Rattus norvegicus
actcattcaatatctgcttcctcag

SEQ ID NO: 94069 - DNA, 25 bp, Rattus norvegicus
actcattccctacttggcatagaac

SEQ ID NO: 94070 - DNA, 25 bp, Rattus norvegicus
actcattccctagttggcatagaac

SEQ ID NO: 94071 - DNA, 25 bp, Rattus norvegicus
actcattcgttgatgtaccttctga

SEQ ID NO: 94072 - DNA, 25 bp, Rattus norvegicus
actcattcgttgttgtaccttctga

SEQ ID NO: 94073 - DNA, 25 bp, Rattus norvegicus
actcattgaatccttacagactgca

SEQ ID NO: 94074 - DNA, 25 bp, Rattus norvegicus
actcattgaatcgttacagactgca

SEQ ID NO: 94075 - DNA, 25 bp, Rattus norvegicus
actcattgactgagctctgcagtga

SEQ ID NO: 94076 - DNA, 25 bp, Rattus norvegicus
actcattgactgtgctctgcagtga

SEQ ID NO: 94077 - DNA, 25 bp, Rattus norvegicus
actcattgagatcgagcagcggctt

SEQ ID NO: 94078 - DNA, 25 bp, Rattus norvegicus
actcattgagatggagcagcggctt

SEQ ID NO: 94079 - DNA, 25 bp, Rattus norvegicus
actcattgcattcctagtgcctata

SEQ ID NO: 94080 - DNA, 25 bp, Rattus norvegicus
actcattgcattgctagtgcctata

SEQ ID NO: 94081 - DNA, 25 bp, Rattus norvegicus
actcattggagaatagtaacctata

SEQ ID NO: 94082 - DNA, 25 bp, Rattus norvegicus
actcattggagattagtaacctata

SEQ ID NO: 94083 - DNA, 25 bp, Rattus norvegicus
actcattggcacaggaagattttct

SEQ ID NO: 94084 - DNA, 25 bp, Rattus norvegicus
actcattggcactggaagattttct

SEQ ID NO: 94085 - DNA, 25 bp, Rattus norvegicus
actcatttcagtagtatcaagtgtt

SEQ ID NO: 94086 - DNA, 25 bp, Rattus norvegicus
actcatttcagttgtatcaagtgtt

SEQ ID NO: 94087 - DNA, 25 bp, Rattus norvegicus
actcatttcttgaggcttccgtctt

SEQ ID NO: 94088 - DNA, 25 bp, Rattus norvegicus
actcatttcttgtggcttccgtctt

SEQ ID NO: 94089 - DNA, 25 bp, Rattus norvegicus
actcatttgactcttcccttggatt

SEQ ID NO: 94090 - DNA, 25 bp, Rattus norvegicus
actcatttgactgttcccttggatt

SEQ ID NO: 94091 - DNA, 25 bp, Rattus norvegicus
actcatttgatgctgtgttatctgg

SEQ ID NO: 94092 - DNA, 25 bp, Rattus norvegicus
actcatttgatggtgtgttatctgg

SEQ ID NO: 94093 - DNA, 25 bp, Rattus norvegicus
actccaaagacgactgttctggctt

SEQ ID NO: 94094 - DNA, 25 bp, Rattus norvegicus
actccaaagacgtctgttctggctt

SEQ ID NO: 94095 - DNA, 25 bp, Rattus norvegicus
actccaaagtcgctttctgtatgca

SEQ ID NO: 94096 - DNA, 25 bp, Rattus norvegicus
actccaaagtcggtttctgtatgca

SEQ ID NO: 94097 - DNA, 25 bp, Rattus norvegicus
actccaaccattactttgcttttgc

SEQ ID NO: 94098 - DNA, 25 bp, Rattus norvegicus
actccaaccatttctttgcttttgc

SEQ ID NO: 94099 - DNA, 25 bp, Rattus norvegicus
actccaactgcccaaggacctttgt

SEQ ID NO: 94100 - DNA, 25 bp, Rattus norvegicus
actccaactgccgaaggacctttgt

SEQ ID NO: 94101 - DNA, 25 bp, Rattus norvegicus
actccaacttggctggcgaatggcg

SEQ ID NO: 94102 - DNA, 25 bp, Rattus norvegicus
actccaacttgggtggcgaatggcg

SEQ ID NO: 94103 - DNA, 25 bp, Rattus norvegicus
actccaagacccagacatatttatg

SEQ ID NO: 94104 - DNA, 25 bp, Rattus norvegicus
actccaagaccctgacatatttatg

SEQ ID NO: 94105 - DNA, 25 bp, Rattus norvegicus
actccaagcactaaagatttgaaga

SEQ ID NO: 94106 - DNA, 25 bp, Rattus norvegicus
actccaagcacttaagatttgaaga

SEQ ID NO: 94107 - DNA, 25 bp, Rattus norvegicus
actccaagcgatctgactgtcaatc

SEQ ID NO: 94108 - DNA, 25 bp, Rattus norvegicus
actccaagcgatgtgactgtcaatc

SEQ ID NO: 94109 - DNA, 25 bp, Rattus norvegicus
actccaagtccacgatttcacactg

SEQ ID NO: 94110 - DNA, 25 bp, Rattus norvegicus
actccaagtccaggatttcacactg

SEQ ID NO: 94111 - DNA, 25 bp, Rattus norvegicus
actccaagtgccatttttacagtga

SEQ ID NO: 94112 - DNA, 25 bp, Rattus norvegicus
actccaagtgccttttttacagtga

SEQ ID NO: 94113 - DNA, 25 bp, Rattus norvegicus
actccaatggagaagctgctgtgtg

SEQ ID NO: 94114 - DNA, 25 bp, Rattus norvegicus
actccaatggagtagctgctgtgtg

SEQ ID NO: 94115 - DNA, 25 bp, Rattus norvegicus
actccacaatataaacagacccctg

SEQ ID NO: 94116 - DNA, 25 bp, Rattus norvegicus
actccacaatattaacagacccctg

SEQ ID NO: 94117 - DNA, 25 bp, Rattus norvegicus
actccacagagacctcaaggccaat

SEQ ID NO: 94118 - DNA, 25 bp, Rattus norvegicus
actccacagagagctcaaggccaat

SEQ ID NO: 94119 - DNA, 25 bp, Rattus norvegicus
actccacagcatccctgttagtcaa

SEQ ID NO: 94120 - DNA, 25 bp, Rattus norvegicus
actccacagcatgcctgttagtcaa

SEQ ID NO: 94121 - DNA, 25 bp, Rattus norvegicus
actccacaggtgaggtgtcttgctt

SEQ ID NO: 94122 - DNA, 25 bp, Rattus norvegicus
actccacaggtgtggtgtcttgctt

SEQ ID NO: 94123 - DNA, 25 bp, Rattus norvegicus
actccacataccagccgggtaagaa

SEQ ID NO: 94124 - DNA, 25 bp, Rattus norvegicus
actccacatacctgccgggtaagaa

SEQ ID NO: 94125 - DNA, 25 bp, Rattus norvegicus
actccacattggcacactgatcaga

SEQ ID NO: 94126 - DNA, 25 bp, Rattus norvegicus
actccacattgggacactgatcaga

SEQ ID NO: 94127 - DNA, 25 bp, Rattus norvegicus
actccaccctgtataaaatctgcaa

SEQ ID NO: 94128 - DNA, 25 bp, Rattus norvegicus
actccaccctgtttaaaatctgcaa

SEQ ID NO: 94129 - DNA, 25 bp, Rattus norvegicus
actccacctggaatctaaacacttg

SEQ ID NO: 94130 - DNA, 25 bp, Rattus norvegicus
actccacctggattctaaacacttg

SEQ ID NO: 94131 - DNA, 25 bp, Rattus norvegicus
actccaccttgtaccacatgatgaa

SEQ ID NO: 94132 - DNA, 25 bp, Rattus norvegicus
actccaccttgttccacatgatgaa

SEQ ID NO: 94133 - DNA, 25 bp, Rattus norvegicus
actccacgcctgagtgcttaataag

SEQ ID NO: 94134 - DNA, 25 bp, Rattus norvegicus
actccacgcctgtgtgcttaataag

SEQ ID NO: 94135 - DNA, 25 bp, Rattus norvegicus
actccacggtttcgtatttgcagca

SEQ ID NO: 94136 - DNA, 25 bp, Rattus norvegicus
actccacggtttggtatttgcagca

SEQ ID NO: 94137 - DNA, 25 bp, Rattus norvegicus
actccactcggaatctaaacgtcat

SEQ ID NO: 94138 - DNA, 25 bp, Rattus norvegicus
actccactcggattctaaacgtcat

SEQ ID NO: 94139 - DNA, 25 bp, Rattus norvegicus
actccactgatgctcgctggttgtg

SEQ ID NO: 94140 - DNA, 25 bp, Rattus norvegicus
actccactgatggtcgctggttgtg

SEQ ID NO: 94141 - DNA, 25 bp, Rattus norvegicus
actccactgtttccagcccaattaa

SEQ ID NO: 94142 - DNA, 25 bp, Rattus norvegicus
actccactgtttgcagcccaattaa

SEQ ID NO: 94143 - DNA, 25 bp, Rattus norvegicus
actccagaaatgaacctgcggcgcg

SEQ ID NO: 94144 - DNA, 25 bp, Rattus norvegicus
actccagaaatgtacctgcggcgcg

SEQ ID NO: 94145 - DNA, 25 bp, Rattus norvegicus
actccagaagtaatcctctaatctc

SEQ ID NO: 94146 - DNA, 25 bp, Rattus norvegicus
actccagaagtattcctctaatctc

SEQ ID NO: 94147 - DNA, 25 bp, Rattus norvegicus
actccagaatggcttccttggcttt

SEQ ID NO: 94148 - DNA, 25 bp, Rattus norvegicus
actccagaatgggttccttggcttt

SEQ ID NO: 94149 - DNA, 25 bp, Rattus norvegicus
actccagagagtctggtccgggaca

SEQ ID NO: 94150 - DNA, 25 bp, Rattus norvegicus
actccagagagtgtggtccgggaca

SEQ ID NO: 94151 - DNA, 25 bp, Rattus norvegicus
actccagagctcactctagggttga

SEQ ID NO: 94152 - DNA, 25 bp, Rattus norvegicus
actccagagctctctctagggttga

SEQ ID NO: 94153 - DNA, 25 bp, Rattus norvegicus
actccagagtatccccactgggtat

SEQ ID NO: 94154 - DNA, 25 bp, Rattus norvegicus
actccagagtatgcccactgggtat

SEQ ID NO: 94155 - DNA, 25 bp, Rattus norvegicus
actccagcactgctgtgtatgcaca

SEQ ID NO: 94156 - DNA, 25 bp, Rattus norvegicus
actccagcactggtgtgtatgcaca

SEQ ID NO: 94157 - DNA, 25 bp, Rattus norvegicus
actccagcaggcacgtgtgaacttt

SEQ ID NO: 94158 - DNA, 25 bp, Rattus norvegicus
actccagcaggctcgtgtgaacttt

SEQ ID NO: 94159 - DNA, 25 bp, Rattus norvegicus
actccagcatcgcttttattttgga

SEQ ID NO: 94160 - DNA, 25 bp, Rattus norvegicus
actccagcatcggttttattttgga

SEQ ID NO: 94161 - DNA, 25 bp, Rattus norvegicus
actccagcatgtctgtcctatgtta

SEQ ID NO: 94162 - DNA, 25 bp, Rattus norvegicus
actccagcatgtgtgtcctatgtta

SEQ ID NO: 94163 - DNA, 25 bp, Rattus norvegicus
actccagccagcctattgtcaaata

SEQ ID NO: 94164 - DNA, 25 bp, Rattus norvegicus
actccagccagcgtattgtcaaata

SEQ ID NO: 94165 - DNA, 25 bp, Rattus norvegicus
actccagcctatatctaagttgcac

SEQ ID NO: 94166 - DNA, 25 bp, Rattus norvegicus
actccagcctatttctaagttgcac

SEQ ID NO: 94167 - DNA, 25 bp, Rattus norvegicus
actccagcctcccagaaggctttga

SEQ ID NO: 94168 - DNA, 25 bp, Rattus norvegicus
actccagcctccgagaaggctttga

SEQ ID NO: 94169 - DNA, 25 bp, Rattus norvegicus
actccagcctgtccatgtgcgggtg

SEQ ID NO: 94170 - DNA, 25 bp, Rattus norvegicus
actccagcctgtgcatgtgcgggtg

SEQ ID NO: 94171 - DNA, 25 bp, Rattus norvegicus
actccagcctttctttggaggctga

SEQ ID NO: 94172 - DNA, 25 bp, Rattus norvegicus
actccagcctttgtttggaggctga

SEQ ID NO: 94173 - DNA, 25 bp, Rattus norvegicus
actccagcgagtactaacatgtgtg

SEQ ID NO: 94174 - DNA, 25 bp, Rattus norvegicus
actccagcgagttctaacatgtgtg

SEQ ID NO: 94175 - DNA, 25 bp, Rattus norvegicus
actccagctcaaatcgatggcctgt

SEQ ID NO: 94176 - DNA, 25 bp, Rattus norvegicus
actccagctcaattcgatggcctgt

SEQ ID NO: 94177 - DNA, 25 bp, Rattus norvegicus
actccagctctcacagaatcaggat

SEQ ID NO: 94178 - DNA, 25 bp, Rattus norvegicus
actccagctctctcagaatcaggat

SEQ ID NO: 94179 - DNA, 25 bp, Rattus norvegicus
actccagctttcattgctgagaaac

SEQ ID NO: 94180 - DNA, 25 bp, Rattus norvegicus
actccagctttctttgctgagaaac

SEQ ID NO: 94181 - DNA, 25 bp, Rattus norvegicus
actccaggacgcagatcagcaaggg

SEQ ID NO: 94182 - DNA, 25 bp, Rattus norvegicus
actccaggacgctgatcagcaaggg

SEQ ID NO: 94183 - DNA, 25 bp, Rattus norvegicus
actccaggaggtacgtgcacaatca

SEQ ID NO: 94184 - DNA, 25 bp, Rattus norvegicus
actccaggaggttcgtgcacaatca

SEQ ID NO: 94185 - DNA, 25 bp, Rattus norvegicus
actccaggcctcagtacaaacagtt

SEQ ID NO: 94186 - DNA, 25 bp, Rattus norvegicus
actccaggcctctgtacaaacagtt

SEQ ID NO: 94187 - DNA, 25 bp, Rattus norvegicus
actccaggcctgaaaattgtgatca

SEQ ID NO: 94188 - DNA, 25 bp, Rattus norvegicus
actccaggcctgtaaattgtgatca

SEQ ID NO: 94189 - DNA, 25 bp, Rattus norvegicus
actccaggctctcacgcatgctagg

SEQ ID NO: 94190 - DNA, 25 bp, Rattus norvegicus
actccaggctctgacgcatgctagg

SEQ ID NO: 94191 - DNA, 25 bp, Rattus norvegicus
actccaggctgtagttggctaacac

SEQ ID NO: 94192 - DNA, 25 bp, Rattus norvegicus
actccaggctgttgttggctaacac

SEQ ID NO: 94193 - DNA, 25 bp, Rattus norvegicus
actccagggaccacgagcatgggaa

SEQ ID NO: 94194 - DNA, 25 bp, Rattus norvegicus
actccagggacctcgagcatgggaa

SEQ ID NO: 94195 - DNA, 25 bp, Rattus norvegicus
actccagggagcagccagcgggtca

SEQ ID NO: 94196 - DNA, 25 bp, Rattus norvegicus
actccagggagctgccagcgggtca

SEQ ID NO: 94197 - DNA, 25 bp, Rattus norvegicus
actccaggtatgatctagttgacta

SEQ ID NO: 94198 - DNA, 25 bp, Rattus norvegicus
actccaggtatgttctagttgacta

SEQ ID NO: 94199 - DNA, 25 bp, Rattus norvegicus
actccaggtcccaacagacatatat

SEQ ID NO: 94200 - DNA, 25 bp, Rattus norvegicus
actccaggtccctacagacatatat

SEQ ID NO: 94201 - DNA, 25 bp, Rattus norvegicus
actccagtaagtatctgttctccta

SEQ ID NO: 94202 - DNA, 25 bp, Rattus norvegicus
actccagtaagtttctgttctccta

SEQ ID NO: 94203 - DNA, 25 bp, Rattus norvegicus
actccagtcaacacctagatttcaa

SEQ ID NO: 94204 - DNA, 25 bp, Rattus norvegicus
actccagtcaactcctagatttcaa

SEQ ID NO: 94205 - DNA, 25 bp, Rattus norvegicus
actccagtcctacgaaatcccatga

SEQ ID NO: 94206 - DNA, 25 bp, Rattus norvegicus
actccagtcctaggaaatcccatga

SEQ ID NO: 94207 - DNA, 25 bp, Rattus norvegicus
actccagtgactattaaagccgctt

SEQ ID NO: 94208 - DNA, 25 bp, Rattus norvegicus
actccagtgacttttaaagccgctt

SEQ ID NO: 94209 - DNA, 25 bp, Rattus norvegicus
actccagtggatcatctttccttga

SEQ ID NO: 94210 - DNA, 25 bp, Rattus norvegicus
actccagtggatgatctttccttga

SEQ ID NO: 94211 - DNA, 25 bp, Rattus norvegicus
actccagttactcgcgaacccaatg

SEQ ID NO: 94212 - DNA, 25 bp, Rattus norvegicus
actccagttactggcgaacccaatg

SEQ ID NO: 94213 - DNA, 25 bp, Rattus norvegicus
actccagttattagccacggtttct

SEQ ID NO: 94214 - DNA, 25 bp, Rattus norvegicus
actccagttatttgccacggtttct

SEQ ID NO: 94215 - DNA, 25 bp, Rattus norvegicus
actccagttccacagcatacttgtg

SEQ ID NO: 94216 - DNA, 25 bp, Rattus norvegicus
actccagttccagagcatacttgtg

SEQ ID NO: 94217 - DNA, 25 bp, Rattus norvegicus
actccagttggaatcccgtgtgaca

SEQ ID NO: 94218 - DNA, 25 bp, Rattus norvegicus
actccagttggattcccgtgtgaca

SEQ ID NO: 94219 - DNA, 25 bp, Rattus norvegicus
actccatacctgctcataagacttg

SEQ ID NO: 94220 - DNA, 25 bp, Rattus norvegicus
actccatacctggtcataagacttg

SEQ ID NO: 94221 - DNA, 25 bp, Rattus norvegicus
actccatagggcaggtttgctgtgg

SEQ ID NO: 94222 - DNA, 25 bp, Rattus norvegicus
actccatagggctggtttgctgtgg

SEQ ID NO: 94223 - DNA, 25 bp, Rattus norvegicus
actccatatagacacctggcttttg

SEQ ID NO: 94224 - DNA, 25 bp, Rattus norvegicus
actccatatagagacctggcttttg

SEQ ID NO: 94225 - DNA, 25 bp, Rattus norvegicus
actccatcagttctttgtgccacat

SEQ ID NO: 94226 - DNA, 25 bp, Rattus norvegicus
actccatcagttgtttgtgccacat

SEQ ID NO: 94227 - DNA, 25 bp, Rattus norvegicus
actccatcatctataaccggattcg

SEQ ID NO: 94228 - DNA, 25 bp, Rattus norvegicus
actccatcatctttaaccggattcg

SEQ ID NO: 94229 - DNA, 25 bp, Rattus norvegicus
actccatccattagcactgttcaag

SEQ ID NO: 94230 - DNA, 25 bp, Rattus norvegicus
actccatccatttgcactgttcaag

SEQ ID NO: 94231 - DNA, 25 bp, Rattus norvegicus
actccatccggtaccaagacatata

SEQ ID NO: 94232 - DNA, 25 bp, Rattus norvegicus
actccatccggttccaagacatata

SEQ ID NO: 94233 - DNA, 25 bp, Rattus norvegicus
actccatgctgcctttgtgacaaac

SEQ ID NO: 94234 - DNA, 25 bp, Rattus norvegicus
actccatgctgcgtttgtgacaaac

SEQ ID NO: 94235 - DNA, 25 bp, Rattus norvegicus
actccatgctgtcatcttgatcagg

SEQ ID NO: 94236 - DNA, 25 bp, Rattus norvegicus
actccatgctgtgatcttgatcagg

SEQ ID NO: 94237 - DNA, 25 bp, Rattus norvegicus
actccatggcaactctccagaaggc

SEQ ID NO: 94238 - DNA, 25 bp, Rattus norvegicus
actccatggcaagtctccagaaggc

SEQ ID NO: 94239 - DNA, 25 bp, Rattus norvegicus
actccatgtagcagtcatccacaaa

SEQ ID NO: 94240 - DNA, 25 bp, Rattus norvegicus
actccatgtagctgtcatccacaaa

SEQ ID NO: 94241 - DNA, 25 bp, Rattus norvegicus
actccatgtggccagtaactcaata

SEQ ID NO: 94242 - DNA, 25 bp, Rattus norvegicus
actccatgtggcgagtaactcaata

SEQ ID NO: 94243 - DNA, 25 bp, Rattus norvegicus
actccattattgaagcacttcacag

SEQ ID NO: 94244 - DNA, 25 bp, Rattus norvegicus
actccattattgtagcacttcacag

SEQ ID NO: 94245 - DNA, 25 bp, Rattus norvegicus
actccattcatgcttggcacttggc

SEQ ID NO: 94246 - DNA, 25 bp, Rattus norvegicus
actccattcatggttggcacttggc

SEQ ID NO: 94247 - DNA, 25 bp, Rattus norvegicus
actccattcgggacactaggtcatg

SEQ ID NO: 94248 - DNA, 25 bp, Rattus norvegicus
actccattcgggtcactaggtcatg

SEQ ID NO: 94249 - DNA, 25 bp, Rattus norvegicus
actccattctcaaccagcagtagat

SEQ ID NO: 94250 - DNA, 25 bp, Rattus norvegicus
actccattctcatccagcagtagat

SEQ ID NO: 94251 - DNA, 25 bp, Rattus norvegicus
actccatttgccctatgggacagtt

SEQ ID NO: 94252 - DNA, 25 bp, Rattus norvegicus
actccatttgccgtatgggacagtt

SEQ ID NO: 94253 - DNA, 25 bp, Rattus norvegicus
actcccaaccagactactgaggagg

SEQ ID NO: 94254 - DNA, 25 bp, Rattus norvegicus
actcccaaccagtctactgaggagg

SEQ ID NO: 94255 - DNA, 25 bp, Rattus norvegicus
actcccaagcctcgacatcatggtg

SEQ ID NO: 94256 - DNA, 25 bp, Rattus norvegicus
actcccaagcctggacatcatggtg

SEQ ID NO: 94257 - DNA, 25 bp, Rattus norvegicus
actcccaagtcacatggatccctgt

SEQ ID NO: 94258 - DNA, 25 bp, Rattus norvegicus
actcccaagtcagatggatccctgt

SEQ ID NO: 94259 - DNA, 25 bp, Rattus norvegicus
actcccaattctctctggtacttag

SEQ ID NO: 94260 - DNA, 25 bp, Rattus norvegicus
actcccaattctgtctggtacttag

SEQ ID NO: 94261 - DNA, 25 bp, Rattus norvegicus
actcccacaccgacttgatgacaag

SEQ ID NO: 94262 - DNA, 25 bp, Rattus norvegicus
actcccacaccgtcttgatgacaag

SEQ ID NO: 94263 - DNA, 25 bp, Rattus norvegicus
actcccacatccacataaacttaaa

SEQ ID NO: 94264 - DNA, 25 bp, Rattus norvegicus
actcccacatcctcataaacttaaa

SEQ ID NO: 94265 - DNA, 25 bp, Rattus norvegicus
actcccacgctaaccaagatggaca

SEQ ID NO: 94266 - DNA, 25 bp, Rattus norvegicus
actcccacgctatccaagatggaca

SEQ ID NO: 94267 - DNA, 25 bp, Rattus norvegicus
actcccactcgtaaaatttgtcttg

SEQ ID NO: 94268 - DNA, 25 bp, Rattus norvegicus
actcccactcgttaaatttgtcttg

SEQ ID NO: 94269 - DNA, 25 bp, Rattus norvegicus
actcccagcttcaaaaactttgcca

SEQ ID NO: 94270 - DNA, 25 bp, Rattus norvegicus
actcccagcttctaaaactttgcca

SEQ ID NO: 94271 - DNA, 25 bp, Rattus norvegicus
actcccagctttcgctctaaagtca

SEQ ID NO: 94272 - DNA, 25 bp, Rattus norvegicus
actcccagctttggctctaaagtca

SEQ ID NO: 94273 - DNA, 25 bp, Rattus norvegicus
actcccaggcggagcggtacagtgt

SEQ ID NO: 94274 - DNA, 25 bp, Rattus norvegicus
actcccaggcggtgcggtacagtgt

SEQ ID NO: 94275 - DNA, 25 bp, Rattus norvegicus
actcccagggctcccatggaaggag

SEQ ID NO: 94276 - DNA, 25 bp, Rattus norvegicus
actcccagggctgccatggaaggag

SEQ ID NO: 94277 - DNA, 25 bp, Rattus norvegicus
actcccagggtcactcagaggacga

SEQ ID NO: 94278 - DNA, 25 bp, Rattus norvegicus
actcccagggtctctcagaggacga

SEQ ID NO: 94279 - DNA, 25 bp, Rattus norvegicus
actcccatccaacggctggaggatt

SEQ ID NO: 94280 - DNA, 25 bp, Rattus norvegicus
actcccatccaagggctggaggatt

SEQ ID NO: 94281 - DNA, 25 bp, Rattus norvegicus
actcccattagtaattctctgacct

SEQ ID NO: 94282 - DNA, 25 bp, Rattus norvegicus
actcccattagttattctctgacct

SEQ ID NO: 94283 - DNA, 25 bp, Rattus norvegicus
actccccaaagcacttcagtaagtt

SEQ ID NO: 94284 - DNA, 25 bp, Rattus norvegicus
actccccaaagctcttcagtaagtt

SEQ ID NO: 94285 - DNA, 25 bp, Rattus norvegicus
actccccaagcacgaaaagcagcaa

SEQ ID NO: 94286 - DNA, 25 bp, Rattus norvegicus
actccccaagcaggaaaagcagcaa

SEQ ID NO: 94287 - DNA, 25 bp, Rattus norvegicus
actccccactctactggaggtgaag

SEQ ID NO: 94288 - DNA, 25 bp, Rattus norvegicus
actccccactcttctggaggtgaag

SEQ ID NO: 94289 - DNA, 25 bp, Rattus norvegicus
actccccatactaaacgatttgcaa

SEQ ID NO: 94290 - DNA, 25 bp, Rattus norvegicus
actccccatacttaacgatttgcaa

SEQ ID NO: 94291 - DNA, 25 bp, Rattus norvegicus
actcccctaggaatttctcttcctg

SEQ ID NO: 94292 - DNA, 25 bp, Rattus norvegicus
actcccctaggattttctcttcctg

SEQ ID NO: 94293 - DNA, 25 bp, Rattus norvegicus
actcccctattgctgattgtctttg

SEQ ID NO: 94294 - DNA, 25 bp, Rattus norvegicus
actcccctattggtgattgtctttg

SEQ ID NO: 94295 - DNA, 25 bp, Rattus norvegicus
actcccctcgcaatgtcagaagaaa

SEQ ID NO: 94296 - DNA, 25 bp, Rattus norvegicus
actcccctcgcattgtcagaagaaa

SEQ ID NO: 94297 - DNA, 25 bp, Rattus norvegicus
actccccttttgaggacagtcttat

SEQ ID NO: 94298 - DNA, 25 bp, Rattus norvegicus
actccccttttgtggacagtcttat

SEQ ID NO: 94299 - DNA, 25 bp, Rattus norvegicus
actcccgaagagctggttactggct

SEQ ID NO: 94300 - DNA, 25 bp, Rattus norvegicus
actcccgaagaggtggttactggct

SEQ ID NO: 94301 - DNA, 25 bp, Rattus norvegicus
actcccgatccacaaagtctgaatc

SEQ ID NO: 94302 - DNA, 25 bp, Rattus norvegicus
actcccgatccagaaagtctgaatc

SEQ ID NO: 94303 - DNA, 25 bp, Rattus norvegicus
actcccgggaccagtcagaaatcgg

SEQ ID NO: 94304 - DNA, 25 bp, Rattus norvegicus
actcccgggacctgtcagaaatcgg

SEQ ID NO: 94305 - DNA, 25 bp, Rattus norvegicus
actcccgggagtcactgctgtgtgc

SEQ ID NO: 94306 - DNA, 25 bp, Rattus norvegicus
actcccgggagtgactgctgtgtgc

SEQ ID NO: 94307 - DNA, 25 bp, Rattus norvegicus
actcccgtgtctctcgcagatttaa

SEQ ID NO: 94308 - DNA, 25 bp, Rattus norvegicus
actcccgtgtctgtcgcagatttaa

SEQ ID NO: 94309 - DNA, 25 bp, Rattus norvegicus
actcccgttggtctgacatttgaat

SEQ ID NO: 94310 - DNA, 25 bp, Rattus norvegicus
actcccgttggtgtgacatttgaat

SEQ ID NO: 94311 - DNA, 25 bp, Rattus norvegicus
actccctacctccaaatgcatttgt

SEQ ID NO: 94312 - DNA, 25 bp, Rattus norvegicus
actccctacctcgaaatgcatttgt

SEQ ID NO: 94313 - DNA, 25 bp, Rattus norvegicus
actccctagcttcttgtgggtcagg

SEQ ID NO: 94314 - DNA, 25 bp, Rattus norvegicus
actccctagcttgttgtgggtcagg

SEQ ID NO: 94315 - DNA, 25 bp, Rattus norvegicus
actccctcagaactcctaaggaagt

SEQ ID NO: 94316 - DNA, 25 bp, Rattus norvegicus
actccctcagaagtcctaaggaagt

SEQ ID NO: 94317 - DNA, 25 bp, Rattus norvegicus
actccctcatcaatcagtttgcaga

SEQ ID NO: 94318 - DNA, 25 bp, Rattus norvegicus
actccctcatcattcagtttgcaga

SEQ ID NO: 94319 - DNA, 25 bp, Rattus norvegicus
actccctccaggctgacacgtgaaa

SEQ ID NO: 94320 - DNA, 25 bp, Rattus norvegicus
actccctccagggtgacacgtgaaa

SEQ ID NO: 94321 - DNA, 25 bp, Rattus norvegicus
actccctcccatagctggaagaaga

SEQ ID NO: 94322 - DNA, 25 bp, Rattus norvegicus
actccctcccattgctggaagaaga

SEQ ID NO: 94323 - DNA, 25 bp, Rattus norvegicus
actccctctaacaagctctttttat

SEQ ID NO: 94324 - DNA, 25 bp, Rattus norvegicus
actccctctaactagctctttttat

SEQ ID NO: 94325 - DNA, 25 bp, Rattus norvegicus
actccctctcatataatacctgtgc

SEQ ID NO: 94326 - DNA, 25 bp, Rattus norvegicus
actccctctcatttaatacctgtgc

SEQ ID NO: 94327 - DNA, 25 bp, Rattus norvegicus
actccctctctaaataaatgtgcta

SEQ ID NO: 94328 - DNA, 25 bp, Rattus norvegicus
actccctctctatataaatgtgcta

SEQ ID NO: 94329 - DNA, 25 bp, Rattus norvegicus
actccctcttcaaagtgctgtgtgt

SEQ ID NO: 94330 - DNA, 25 bp, Rattus norvegicus
actccctcttcatagtgctgtgtgt

SEQ ID NO: 94331 - DNA, 25 bp, Rattus norvegicus
actccctgagacacctgagccagaa

SEQ ID NO: 94332 - DNA, 25 bp, Rattus norvegicus
actccctgagactcctgagccagaa

SEQ ID NO: 94333 - DNA, 25 bp, Rattus norvegicus
actccctggagcctttgttacttga

SEQ ID NO: 94334 - DNA, 25 bp, Rattus norvegicus
actccctggagcgtttgttacttga

SEQ ID NO: 94335 - DNA, 25 bp, Rattus norvegicus
actccctggtctagctttgtttgtg

SEQ ID NO: 94336 - DNA, 25 bp, Rattus norvegicus
actccctggtcttgctttgtttgtg

SEQ ID NO: 94337 - DNA, 25 bp, Rattus norvegicus
actccctgtagaagaagtcactgct

SEQ ID NO: 94338 - DNA, 25 bp, Rattus norvegicus
actccctgtagatgaagtcactgct

SEQ ID NO: 94339 - DNA, 25 bp, Rattus norvegicus
actccctgtatcctacttaatgcaa

SEQ ID NO: 94340 - DNA, 25 bp, Rattus norvegicus
actccctgtatcgtacttaatgcaa

SEQ ID NO: 94341 - DNA, 25 bp, Rattus norvegicus
actccctgtggccattgagactttg

SEQ ID NO: 94342 - DNA, 25 bp, Rattus norvegicus
actccctgtggcgattgagactttg

SEQ ID NO: 94343 - DNA, 25 bp, Rattus norvegicus
actccctgtgtgaggctatcataaa

SEQ ID NO: 94344 - DNA, 25 bp, Rattus norvegicus
actccctgtgtgtggctatcataaa

SEQ ID NO: 94345 - DNA, 25 bp, Rattus norvegicus
actccctgttctctaacctaaatat

SEQ ID NO: 94346 - DNA, 25 bp, Rattus norvegicus
actccctgttctgtaacctaaatat

SEQ ID NO: 94347 - DNA, 25 bp, Rattus norvegicus
actcccttatgacttaccgggccag

SEQ ID NO: 94348 - DNA, 25 bp, Rattus norvegicus
actcccttatgagttaccgggccag

SEQ ID NO: 94349 - DNA, 25 bp, Rattus norvegicus
actcccttcactcccaagtagatgg

SEQ ID NO: 94350 - DNA, 25 bp, Rattus norvegicus
actcccttcactgccaagtagatgg

SEQ ID NO: 94351 - DNA, 25 bp, Rattus norvegicus
actcccttcctcagcaaaaggaatc

SEQ ID NO: 94352 - DNA, 25 bp, Rattus norvegicus
actcccttcctctgcaaaaggaatc

SEQ ID NO: 94353 - DNA, 25 bp, Rattus norvegicus
actcccttcttaccttagatgaact

SEQ ID NO: 94354 - DNA, 25 bp, Rattus norvegicus
actcccttcttagcttagatgaact

SEQ ID NO: 94355 - DNA, 25 bp, Rattus norvegicus
actcccttctttatgagtcttcagt

SEQ ID NO: 94356 - DNA, 25 bp, Rattus norvegicus
actcccttctttttgagtcttcagt

SEQ ID NO: 94357 - DNA, 25 bp, Rattus norvegicus
actcccttgcataatttctttgtgt

SEQ ID NO: 94358 - DNA, 25 bp, Rattus norvegicus
actcccttgcattatttctttgtgt

SEQ ID NO: 94359 - DNA, 25 bp, Rattus norvegicus
actcccttggcaagctagacagtga

SEQ ID NO: 94360 - DNA, 25 bp, Rattus norvegicus
actcccttggcatgctagacagtga

SEQ ID NO: 94361 - DNA, 25 bp, Rattus norvegicus
actccctttgcactgcgacagaagg

SEQ ID NO: 94362 - DNA, 25 bp, Rattus norvegicus
actccctttgcagtgcgacagaagg

SEQ ID NO: 94363 - DNA, 25 bp, Rattus norvegicus
actccgaccaggatttccctgtaat

SEQ ID NO: 94364 - DNA, 25 bp, Rattus norvegicus
actccgaccaggttttccctgtaat

SEQ ID NO: 94365 - DNA, 25 bp, Rattus norvegicus
actccgactgccactcagtctagaa

SEQ ID NO: 94366 - DNA, 25 bp, Rattus norvegicus
actccgactgcctctcagtctagaa

SEQ ID NO: 94367 - DNA, 25 bp, Rattus norvegicus
actccgagacgcagggtatgctcca

SEQ ID NO: 94368 - DNA, 25 bp, Rattus norvegicus
actccgagacgctgggtatgctcca

SEQ ID NO: 94369 - DNA, 25 bp, Rattus norvegicus
actccgaggctgactttgagctggt

SEQ ID NO: 94370 - DNA, 25 bp, Rattus norvegicus
actccgaggctgtctttgagctggt

SEQ ID NO: 94371 - DNA, 25 bp, Rattus norvegicus
actccgagtctcaattgtgtatcaa

SEQ ID NO: 94372 - DNA, 25 bp, Rattus norvegicus
actccgagtctctattgtgtatcaa

SEQ ID NO: 94373 - DNA, 25 bp, Rattus norvegicus
actccgagtgttcctggcggcagtc

SEQ ID NO: 94374 - DNA, 25 bp, Rattus norvegicus
actccgagtgttgctggcggcagtc

SEQ ID NO: 94375 - DNA, 25 bp, Rattus norvegicus
actccgagttctctgacttgatggt

SEQ ID NO: 94376 - DNA, 25 bp, Rattus norvegicus
actccgagttctgtgacttgatggt

SEQ ID NO: 94377 - DNA, 25 bp, Rattus norvegicus
actccgatgtcgatctttgattttg

SEQ ID NO: 94378 - DNA, 25 bp, Rattus norvegicus
actccgatgtcgttctttgattttg

SEQ ID NO: 94379 - DNA, 25 bp, Rattus norvegicus
actccgatgtgtcctctttttcttt

SEQ ID NO: 94380 - DNA, 25 bp, Rattus norvegicus
actccgatgtgtgctctttttcttt

SEQ ID NO: 94381 - DNA, 25 bp, Rattus norvegicus
actccgattatgatactttgtgtga

SEQ ID NO: 94382 - DNA, 25 bp, Rattus norvegicus
actccgattatgttactttgtgtga

SEQ ID NO: 94383 - DNA, 25 bp, Rattus norvegicus
actccgcaggacattggtatgtttg

SEQ ID NO: 94384 - DNA, 25 bp, Rattus norvegicus
actccgcaggactttggtatgtttg

SEQ ID NO: 94385 - DNA, 25 bp, Rattus norvegicus
actccgccacttaagagggaccata

SEQ ID NO: 94386 - DNA, 25 bp, Rattus norvegicus
actccgccactttagagggaccata

SEQ ID NO: 94387 - DNA, 25 bp, Rattus norvegicus
actccgccatgcattagttctacat

SEQ ID NO: 94388 - DNA, 25 bp, Rattus norvegicus
actccgccatgctttagttctacat

SEQ ID NO: 94389 - DNA, 25 bp, Rattus norvegicus
actccgcctgccatcattgaattga

SEQ ID NO: 94390 - DNA, 25 bp, Rattus norvegicus
actccgcctgccttcattgaattga

SEQ ID NO: 94391 - DNA, 25 bp, Rattus norvegicus
actccgcgaaagcacctagcagtaa

SEQ ID NO: 94392 - DNA, 25 bp, Rattus norvegicus
actccgcgaaaggacctagcagtaa

SEQ ID NO: 94393 - DNA, 25 bp, Rattus norvegicus
actccgcggatgagaatgcccggga

SEQ ID NO: 94394 - DNA, 25 bp, Rattus norvegicus
actccgcggatgtgaatgcccggga

SEQ ID NO: 94395 - DNA, 25 bp, Rattus norvegicus
actccgctagctctctatagagggc

SEQ ID NO: 94396 - DNA, 25 bp, Rattus norvegicus
actccgctagctgtctatagagggc

SEQ ID NO: 94397 - DNA, 25 bp, Rattus norvegicus
actccgctgctaacctgaaatgcat

SEQ ID NO: 94398 - DNA, 25 bp, Rattus norvegicus
actccgctgctatcctgaaatgcat

SEQ ID NO: 94399 - DNA, 25 bp, Rattus norvegicus
actccgctgtgcagaaggccgttct

SEQ ID NO: 94400 - DNA, 25 bp, Rattus norvegicus
actccgctgtgctgaaggccgttct

SEQ ID NO: 94401 - DNA, 25 bp, Rattus norvegicus
actccggaacttctgatctccaagg

SEQ ID NO: 94402 - DNA, 25 bp, Rattus norvegicus
actccggaacttgtgatctccaagg

SEQ ID NO: 94403 - DNA, 25 bp, Rattus norvegicus
actccggaagtgacagggctatcat

SEQ ID NO: 94404 - DNA, 25 bp, Rattus norvegicus
actccggaagtgtcagggctatcat

SEQ ID NO: 94405 - DNA, 25 bp, Rattus norvegicus
actccggagggtccgtatgtcagct

SEQ ID NO: 94406 - DNA, 25 bp, Rattus norvegicus
actccggagggtgcgtatgtcagct

SEQ ID NO: 94407 - DNA, 25 bp, Rattus norvegicus
actccgggctgacctagctgaagaa

SEQ ID NO: 94408 - DNA, 25 bp, Rattus norvegicus
actccgggctgagctagctgaagaa

SEQ ID NO: 94409 - DNA, 25 bp, Rattus norvegicus
actccgggttcactgctttgggaat

SEQ ID NO: 94410 - DNA, 25 bp, Rattus norvegicus
actccgggttcagtgctttgggaat

SEQ ID NO: 94411 - DNA, 25 bp, Rattus norvegicus
actccggtgagaagatggtgacgtc

SEQ ID NO: 94412 - DNA, 25 bp, Rattus norvegicus
actccggtgagatgatggtgacgtc

SEQ ID NO: 94413 - DNA, 25 bp, Rattus norvegicus
actccgtaaagcaggttcatcaatc

SEQ ID NO: 94414 - DNA, 25 bp, Rattus norvegicus
actccgtaaagctggttcatcaatc

SEQ ID NO: 94415 - DNA, 25 bp, Rattus norvegicus
actccgtaaatactgatatgttatc

SEQ ID NO: 94416 - DNA, 25 bp, Rattus norvegicus
actccgtaaatagtgatatgttatc

SEQ ID NO: 94417 - DNA, 25 bp, Rattus norvegicus
actccgtatgcaactctgtattctt

SEQ ID NO: 94418 - DNA, 25 bp, Rattus norvegicus
actccgtatgcatctctgtattctt

SEQ ID NO: 94419 - DNA, 25 bp, Rattus norvegicus
actccgtcatggactggcagttact

SEQ ID NO: 94420 - DNA, 25 bp, Rattus norvegicus
actccgtcatggtctggcagttact

SEQ ID NO: 94421 - DNA, 25 bp, Rattus norvegicus
actccgtccacacagttagcgctat

SEQ ID NO: 94422 - DNA, 25 bp, Rattus norvegicus
actccgtccacagagttagcgctat

SEQ ID NO: 94423 - DNA, 25 bp, Rattus norvegicus
actccgtgaatactgatatgtactc

SEQ ID NO: 94424 - DNA, 25 bp, Rattus norvegicus
actccgtgaatagtgatatgtactc

SEQ ID NO: 94425 - DNA, 25 bp, Rattus norvegicus
actccgtgggtcagagaagctccga

SEQ ID NO: 94426 - DNA, 25 bp, Rattus norvegicus
actccgtgggtctgagaagctccga

SEQ ID NO: 94427 - DNA, 25 bp, Rattus norvegicus
actccgtggtgccaaagggtcctgc

SEQ ID NO: 94428 - DNA, 25 bp, Rattus norvegicus
actccgtggtgcgaaagggtcctgc

SEQ ID NO: 94429 - DNA, 25 bp, Rattus norvegicus
actccgttgctgcaactaacgtctt

SEQ ID NO: 94430 - DNA, 25 bp, Rattus norvegicus
actccgttgctggaactaacgtctt

SEQ ID NO: 94431 - DNA, 25 bp, Rattus norvegicus
actccgtttttgatacattcctatt

SEQ ID NO: 94432 - DNA, 25 bp, Rattus norvegicus
actccgtttttgttacattcctatt

SEQ ID NO: 94433 - DNA, 25 bp, Rattus norvegicus
actcctaaagtgatgtctcgaagct

SEQ ID NO: 94434 - DNA, 25 bp, Rattus norvegicus
actcctaaagtgttgtctcgaagct

SEQ ID NO: 94435 - DNA, 25 bp, Rattus norvegicus
actcctaactgcaacctgaacgatg

SEQ ID NO: 94436 - DNA, 25 bp, Rattus norvegicus
actcctaactgctacctgaacgatg

SEQ ID NO: 94437 - DNA, 25 bp, Rattus norvegicus
actcctaatcttacattaactggtc

SEQ ID NO: 94438 - DNA, 25 bp, Rattus norvegicus
actcctaatctttcattaactggtc

SEQ ID NO: 94439 - DNA, 25 bp, Rattus norvegicus
actcctaatttactgacttctggca

SEQ ID NO: 94440 - DNA, 25 bp, Rattus norvegicus
actcctaatttagtgacttctggca

SEQ ID NO: 94441 - DNA, 25 bp, Rattus norvegicus
actcctaatttcaaattcctggtca

SEQ ID NO: 94442 - DNA, 25 bp, Rattus norvegicus
actcctaatttctaattcctggtca

SEQ ID NO: 94443 - DNA, 25 bp, Rattus norvegicus
actcctacagagcacacagttcagt

SEQ ID NO: 94444 - DNA, 25 bp, Rattus norvegicus
actcctacagaggacacagttcagt

SEQ ID NO: 94445 - DNA, 25 bp, Rattus norvegicus
actcctacgtgtctctcagagatgg

SEQ ID NO: 94446 - DNA, 25 bp, Rattus norvegicus
actcctacgtgtgtctcagagatgg

SEQ ID NO: 94447 - DNA, 25 bp, Rattus norvegicus
actcctactggacctaaatttgtaa

SEQ ID NO: 94448 - DNA, 25 bp, Rattus norvegicus
actcctactggagctaaatttgtaa

SEQ ID NO: 94449 - DNA, 25 bp, Rattus norvegicus
actcctacttcaacatcatcttggt

SEQ ID NO: 94450 - DNA, 25 bp, Rattus norvegicus
actcctacttcatcatcatcttggt

SEQ ID NO: 94451 - DNA, 25 bp, Rattus norvegicus
actcctagaaccattagtctctcaa

SEQ ID NO: 94452 - DNA, 25 bp, Rattus norvegicus
actcctagaacctttagtctctcaa

SEQ ID NO: 94453 - DNA, 25 bp, Rattus norvegicus
actcctagccacagccaaagtttgt

SEQ ID NO: 94454 - DNA, 25 bp, Rattus norvegicus
actcctagccactgccaaagtttgt

SEQ ID NO: 94455 - DNA, 25 bp, Rattus norvegicus
actcctagtcccaaacagtgagcaa

SEQ ID NO: 94456 - DNA, 25 bp, Rattus norvegicus
actcctagtccctaacagtgagcaa

SEQ ID NO: 94457 - DNA, 25 bp, Rattus norvegicus
actcctataaaccaacatttcctat

SEQ ID NO: 94458 - DNA, 25 bp, Rattus norvegicus
actcctataaacgaacatttcctat

SEQ ID NO: 94459 - DNA, 25 bp, Rattus norvegicus
actcctatagccacaatgacttgtc

SEQ ID NO: 94460 - DNA, 25 bp, Rattus norvegicus
actcctatagcctcaatgacttgtc

SEQ ID NO: 94461 - DNA, 25 bp, Rattus norvegicus
actcctatgtagctgacgaggctca

SEQ ID NO: 94462 - DNA, 25 bp, Rattus norvegicus
actcctatgtaggtgacgaggctca

SEQ ID NO: 94463 - DNA, 25 bp, Rattus norvegicus
actcctcaaccacggcatggagcat

SEQ ID NO: 94464 - DNA, 25 bp, Rattus norvegicus
actcctcaaccagggcatggagcat

SEQ ID NO: 94465 - DNA, 25 bp, Rattus norvegicus
actcctcaaggcagatggtgtccat

SEQ ID NO: 94466 - DNA, 25 bp, Rattus norvegicus
actcctcaaggctgatggtgtccat

SEQ ID NO: 94467 - DNA, 25 bp, Rattus norvegicus
actcctcaatacaccgcaaatacaa

SEQ ID NO: 94468 - DNA, 25 bp, Rattus norvegicus
actcctcaatactccgcaaatacaa

SEQ ID NO: 94469 - DNA, 25 bp, Rattus norvegicus
actcctcaatatatttctcttttat

SEQ ID NO: 94470 - DNA, 25 bp, Rattus norvegicus
actcctcaatatttttctcttttat

SEQ ID NO: 94471 - DNA, 25 bp, Rattus norvegicus
actcctcacctaaggctaaagctga

SEQ ID NO: 94472 - DNA, 25 bp, Rattus norvegicus
actcctcacctatggctaaagctga

SEQ ID NO: 94473 - DNA, 25 bp, Rattus norvegicus
actcctcagctgatgtgtgcggtat

SEQ ID NO: 94474 - DNA, 25 bp, Rattus norvegicus
actcctcagctgttgtgtgcggtat

SEQ ID NO: 94475 - DNA, 25 bp, Rattus norvegicus
actcctcaggacaccgcggcggtgg

SEQ ID NO: 94476 - DNA, 25 bp, Rattus norvegicus
actcctcaggactccgcggcggtgg

SEQ ID NO: 94477 - DNA, 25 bp, Rattus norvegicus
actcctccaaatcctgccagatgaa

SEQ ID NO: 94478 - DNA, 25 bp, Rattus norvegicus
actcctccaaatgctgccagatgaa

SEQ ID NO: 94479 - DNA, 25 bp, Rattus norvegicus
actcctccacatccaggtgatttcg

SEQ ID NO: 94480 - DNA, 25 bp, Rattus norvegicus
actcctccacatgcaggtgatttcg

SEQ ID NO: 94481 - DNA, 25 bp, Rattus norvegicus
actcctccaggcaaaaggtccatgc

SEQ ID NO: 94482 - DNA, 25 bp, Rattus norvegicus
actcctccaggctaaaggtccatgc

SEQ ID NO: 94483 - DNA, 25 bp, Rattus norvegicus
actcctccaggtctcggcatgttta

SEQ ID NO: 94484 - DNA, 25 bp, Rattus norvegicus
actcctccaggtgtcggcatgttta

SEQ ID NO: 94485 - DNA, 25 bp, Rattus norvegicus
actcctccatttctacctggaagaa

SEQ ID NO: 94486 - DNA, 25 bp, Rattus norvegicus
actcctccatttgtacctggaagaa

SEQ ID NO: 94487 - DNA, 25 bp, Rattus norvegicus
actcctcccattatccagaagtgaa

SEQ ID NO: 94488 - DNA, 25 bp, Rattus norvegicus
actcctcccattttccagaagtgaa

SEQ ID NO: 94489 - DNA, 25 bp, Rattus norvegicus
actcctccgtaacatgttcacacga

SEQ ID NO: 94490 - DNA, 25 bp, Rattus norvegicus
actcctccgtaagatgttcacacga

SEQ ID NO: 94491 - DNA, 25 bp, Rattus norvegicus
actcctcgtaggcaaaatgcttggg

SEQ ID NO: 94492 - DNA, 25 bp, Rattus norvegicus
actcctcgtagggaaaatgcttggg

SEQ ID NO: 94493 - DNA, 25 bp, Rattus norvegicus
actcctcgtatccaatgatcgtcta

SEQ ID NO: 94494 - DNA, 25 bp, Rattus norvegicus
actcctcgtatcgaatgatcgtcta

SEQ ID NO: 94495 - DNA, 25 bp, Rattus norvegicus
actcctcgtcaccaaagtctttgtg

SEQ ID NO: 94496 - DNA, 25 bp, Rattus norvegicus
actcctcgtcacgaaagtctttgtg

SEQ ID NO: 94497 - DNA, 25 bp, Rattus norvegicus
actcctctaggtcttaatcttggta

SEQ ID NO: 94498 - DNA, 25 bp, Rattus norvegicus
actcctctaggtgttaatcttggta

SEQ ID NO: 94499 - DNA, 25 bp, Rattus norvegicus
actcctctatggctcagcttcagtt

SEQ ID NO: 94500 - DNA, 25 bp, Rattus norvegicus
actcctctatgggtcagcttcagtt

SEQ ID NO: 94501 - DNA, 25 bp, Rattus norvegicus
actcctctcagaacacttctggata

SEQ ID NO: 94502 - DNA, 25 bp, Rattus norvegicus
actcctctcagatcacttctggata

SEQ ID NO: 94503 - DNA, 25 bp, Rattus norvegicus
actcctctcatgagaccactttata

SEQ ID NO: 94504 - DNA, 25 bp, Rattus norvegicus
actcctctcatgtgaccactttata

SEQ ID NO: 94505 - DNA, 25 bp, Rattus norvegicus
actcctctgagacacacttgctgat

SEQ ID NO: 94506 - DNA, 25 bp, Rattus norvegicus
actcctctgagagacacttgctgat

SEQ ID NO: 94507 - DNA, 25 bp, Rattus norvegicus
actcctctgattcttgctgcaaagg

SEQ ID NO: 94508 - DNA, 25 bp, Rattus norvegicus
actcctctgattgttgctgcaaagg

SEQ ID NO: 94509 - DNA, 25 bp, Rattus norvegicus
actcctctgcgcagaataactacat

SEQ ID NO: 94510 - DNA, 25 bp, Rattus norvegicus
actcctctgcgctgaataactacat

SEQ ID NO: 94511 - DNA, 25 bp, Rattus norvegicus
actcctctggatattttgctatttt

SEQ ID NO: 94512 - DNA, 25 bp, Rattus norvegicus
actcctctggattttttgctatttt

SEQ ID NO: 94513 - DNA, 25 bp, Rattus norvegicus
actcctctgtatctgctccaggtta

SEQ ID NO: 94514 - DNA, 25 bp, Rattus norvegicus
actcctctgtatgtgctccaggtta

SEQ ID NO: 94515 - DNA, 25 bp, Rattus norvegicus
actcctctgttcacctagggttgag

SEQ ID NO: 94516 - DNA, 25 bp, Rattus norvegicus
actcctctgttctcctagggttgag

SEQ ID NO: 94517 - DNA, 25 bp, Rattus norvegicus
actcctcttgcaccaagcaagaaga

SEQ ID NO: 94518 - DNA, 25 bp, Rattus norvegicus
actcctcttgcagcaagcaagaaga

SEQ ID NO: 94519 - DNA, 25 bp, Rattus norvegicus
actcctcttgccagaatgttagtgt

SEQ ID NO: 94520 - DNA, 25 bp, Rattus norvegicus
actcctcttgcctgaatgttagtgt

SEQ ID NO: 94521 - DNA, 25 bp, Rattus norvegicus
actcctctttttctgacaatctttg

SEQ ID NO: 94522 - DNA, 25 bp, Rattus norvegicus
actcctctttttgtgacaatctttg

SEQ ID NO: 94523 - DNA, 25 bp, Rattus norvegicus
actcctgaaaagagttctctggttt

SEQ ID NO: 94524 - DNA, 25 bp, Rattus norvegicus
actcctgaaaagtgttctctggttt

SEQ ID NO: 94525 - DNA, 25 bp, Rattus norvegicus
actcctgaatagatctccacctctg

SEQ ID NO: 94526 - DNA, 25 bp, Rattus norvegicus
actcctgaatagttctccacctctg

SEQ ID NO: 94527 - DNA, 25 bp, Rattus norvegicus
actcctgaccctcgcaaataaaata

SEQ ID NO: 94528 - DNA, 25 bp, Rattus norvegicus
actcctgaccctggcaaataaaata

SEQ ID NO: 94529 - DNA, 25 bp, Rattus norvegicus
actcctgcaacccagcactgagaaa

SEQ ID NO: 94530 - DNA, 25 bp, Rattus norvegicus
actcctgcaaccgagcactgagaaa

SEQ ID NO: 94531 - DNA, 25 bp, Rattus norvegicus
actcctgcacttaatactatgtatt

SEQ ID NO: 94532 - DNA, 25 bp, Rattus norvegicus
actcctgcactttatactatgtatt

SEQ ID NO: 94533 - DNA, 25 bp, Rattus norvegicus
actcctgcagacagtaggcaaactg

SEQ ID NO: 94534 - DNA, 25 bp, Rattus norvegicus
actcctgcagactgtaggcaaactg

SEQ ID NO: 94535 - DNA, 25 bp, Rattus norvegicus
actcctgcagtaccggtggttgaat

SEQ ID NO: 94536 - DNA, 25 bp, Rattus norvegicus
actcctgcagtagcggtggttgaat

SEQ ID NO: 94537 - DNA, 25 bp, Rattus norvegicus
actcctgcagtcaaagctggttctg

SEQ ID NO: 94538 - DNA, 25 bp, Rattus norvegicus
actcctgcagtctaagctggttctg

SEQ ID NO: 94539 - DNA, 25 bp, Rattus norvegicus
actcctgccaccaaatggaaatgac

SEQ ID NO: 94540 - DNA, 25 bp, Rattus norvegicus
actcctgccacctaatggaaatgac

SEQ ID NO: 94541 - DNA, 25 bp, Rattus norvegicus
actcctgctcgccattttcaagaaa

SEQ ID NO: 94542 - DNA, 25 bp, Rattus norvegicus
actcctgctcgcgattttcaagaaa

SEQ ID NO: 94543 - DNA, 25 bp, Rattus norvegicus
actcctgctgcccagatttcaagaa

SEQ ID NO: 94544 - DNA, 25 bp, Rattus norvegicus
actcctgctgccgagatttcaagaa

SEQ ID NO: 94545 - DNA, 25 bp, Rattus norvegicus
actcctggagctatgaacggtttct

SEQ ID NO: 94546 - DNA, 25 bp, Rattus norvegicus
actcctggagctttgaacggtttct

SEQ ID NO: 94547 - DNA, 25 bp, Rattus norvegicus
actcctggcctgcattgcgggattg

SEQ ID NO: 94548 - DNA, 25 bp, Rattus norvegicus
actcctggcctggattgcgggattg

SEQ ID NO: 94549 - DNA, 25 bp, Rattus norvegicus
actcctggctagctggaagcaactt

SEQ ID NO: 94550 - DNA, 25 bp, Rattus norvegicus
actcctggctaggtggaagcaactt

SEQ ID NO: 94551 - DNA, 25 bp, Rattus norvegicus
actcctgggcagctaatcctgggtt

SEQ ID NO: 94552 - DNA, 25 bp, Rattus norvegicus
actcctgggcaggtaatcctgggtt

SEQ ID NO: 94553 - DNA, 25 bp, Rattus norvegicus
actcctgggtctagggtgagtccaa

SEQ ID NO: 94554 - DNA, 25 bp, Rattus norvegicus
actcctgggtcttgggtgagtccaa

SEQ ID NO: 94555 - DNA, 25 bp, Rattus norvegicus
actcctgggtggaagcagtgcttca

SEQ ID NO: 94556 - DNA, 25 bp, Rattus norvegicus
actcctgggtggtagcagtgcttca

SEQ ID NO: 94557 - DNA, 25 bp, Rattus norvegicus
actcctgggtgtcgttagctgtgaa

SEQ ID NO: 94558 - DNA, 25 bp, Rattus norvegicus
actcctgggtgtggttagctgtgaa

SEQ ID NO: 94559 - DNA, 25 bp, Rattus norvegicus
actcctggttctaagtgtttctcag

SEQ ID NO: 94560 - DNA, 25 bp, Rattus norvegicus
actcctggttcttagtgtttctcag

SEQ ID NO: 94561 - DNA, 25 bp, Rattus norvegicus
actcctgtactcctagaatactctg

SEQ ID NO: 94562 - DNA, 25 bp, Rattus norvegicus
actcctgtactcgtagaatactctg

SEQ ID NO: 94563 - DNA, 25 bp, Rattus norvegicus
actcctgtagttatcgtgtggcttg

SEQ ID NO: 94564 - DNA, 25 bp, Rattus norvegicus
actcctgtagttatctgtaatggct

SEQ ID NO: 94565 - DNA, 25 bp, Rattus norvegicus
actcctgtagttttcgtgtggcttg

SEQ ID NO: 94566 - DNA, 25 bp, Rattus norvegicus
actcctgtagttttctgtaatggct

SEQ ID NO: 94567 - DNA, 25 bp, Rattus norvegicus
actcctgtcagtccacttgattgtg

SEQ ID NO: 94568 - DNA, 25 bp, Rattus norvegicus
actcctgtcagtgcacttgattgtg

SEQ ID NO: 94569 - DNA, 25 bp, Rattus norvegicus
actcctgtcccactgtaggtaactg

SEQ ID NO: 94570 - DNA, 25 bp, Rattus norvegicus
actcctgtcccagtgtaggtaactg

SEQ ID NO: 94571 - DNA, 25 bp, Rattus norvegicus
actcctgtcctgaggtatgtgtcaa

SEQ ID NO: 94572 - DNA, 25 bp, Rattus norvegicus
actcctgtcctgtggtatgtgtcaa

SEQ ID NO: 94573 - DNA, 25 bp, Rattus norvegicus
actcctgtgatgcacttcctaagaa

SEQ ID NO: 94574 - DNA, 25 bp, Rattus norvegicus
actcctgtgatggacttcctaagaa

SEQ ID NO: 94575 - DNA, 25 bp, Rattus norvegicus
actcctgtgcagatgtgtgtccatt

SEQ ID NO: 94576 - DNA, 25 bp, Rattus norvegicus
actcctgtgcagttgtgtgtccatt

SEQ ID NO: 94577 - DNA, 25 bp, Rattus norvegicus
actcctgtggccaatggttgcaaag

SEQ ID NO: 94578 - DNA, 25 bp, Rattus norvegicus
actcctgtggcctatggttgcaaag

SEQ ID NO: 94579 - DNA, 25 bp, Rattus norvegicus
actcctgtgggtctatgtttctatc

SEQ ID NO: 94580 - DNA, 25 bp, Rattus norvegicus
actcctgtgggtgtatgtttctatc

SEQ ID NO: 94581 - DNA, 25 bp, Rattus norvegicus
actcctgtggttagaactgctcctg

SEQ ID NO: 94582 - DNA, 25 bp, Rattus norvegicus
actcctgtggtttgaactgctcctg

SEQ ID NO: 94583 - DNA, 25 bp, Rattus norvegicus
actcctgtgtagactgcttatgttg

SEQ ID NO: 94584 - DNA, 25 bp, Rattus norvegicus
actcctgtgtagtctgcttatgttg

SEQ ID NO: 94585 - DNA, 25 bp, Rattus norvegicus
actcctgtgtcccagaggtctgagg

SEQ ID NO: 94586 - DNA, 25 bp, Rattus norvegicus
actcctgtgtccgagaggtctgagg

SEQ ID NO: 94587 - DNA, 25 bp, Rattus norvegicus
actcctgttcatatctgttctgatg

SEQ ID NO: 94588 - DNA, 25 bp, Rattus norvegicus
actcctgttcatttctgttctgatg

SEQ ID NO: 94589 - DNA, 25 bp, Rattus norvegicus
actcctgttgtaagcctgtgacctt

SEQ ID NO: 94590 - DNA, 25 bp, Rattus norvegicus
actcctgttgtatgcctgtgacctt

SEQ ID NO: 94591 - DNA, 25 bp, Rattus norvegicus
actcctgttgtgaatatgaagaatc

SEQ ID NO: 94592 - DNA, 25 bp, Rattus norvegicus
actcctgttgtgtatatgaagaatc

SEQ ID NO: 94593 - DNA, 25 bp, Rattus norvegicus
actcctgtttctcagcttacaaaac

SEQ ID NO: 94594 - DNA, 25 bp, Rattus norvegicus
actcctgtttctgagcttacaaaac

SEQ ID NO: 94595 - DNA, 25 bp, Rattus norvegicus
actccttagcccagtgtttatcatt

SEQ ID NO: 94596 - DNA, 25 bp, Rattus norvegicus
actccttagccctgtgtttatcatt

SEQ ID NO: 94597 - DNA, 25 bp, Rattus norvegicus
actccttagcgtatgcaccaacttg

SEQ ID NO: 94598 - DNA, 25 bp, Rattus norvegicus
actccttagcgtttgcaccaacttg

SEQ ID NO: 94599 - DNA, 25 bp, Rattus norvegicus
actccttatgatccagtgaatattc

SEQ ID NO: 94600 - DNA, 25 bp, Rattus norvegicus
actccttatgatgcagtgaatattc

SEQ ID NO: 94601 - DNA, 25 bp, Rattus norvegicus
actccttcactgatggtgggatttc

SEQ ID NO: 94602 - DNA, 25 bp, Rattus norvegicus
actccttcactgttggtgggatttc

SEQ ID NO: 94603 - DNA, 25 bp, Rattus norvegicus
actccttcaggtaggcctcttggga

SEQ ID NO: 94604 - DNA, 25 bp, Rattus norvegicus
actccttcaggttggcctcttggga

SEQ ID NO: 94605 - DNA, 25 bp, Rattus norvegicus
actccttcatcacttcatttttggg

SEQ ID NO: 94606 - DNA, 25 bp, Rattus norvegicus
actccttcatcagttcatttttggg

SEQ ID NO: 94607 - DNA, 25 bp, Rattus norvegicus
actccttcatgcaccattatgctac

SEQ ID NO: 94608 - DNA, 25 bp, Rattus norvegicus
actccttcatgctccattatgctac

SEQ ID NO: 94609 - DNA, 25 bp, Rattus norvegicus
actccttccaaaatagaagaccagg

SEQ ID NO: 94610 - DNA, 25 bp, Rattus norvegicus
actccttccaaattagaagaccagg

SEQ ID NO: 94611 - DNA, 25 bp, Rattus norvegicus
actccttccaatagcagacttttgc

SEQ ID NO: 94612 - DNA, 25 bp, Rattus norvegicus
actccttccaattgcagacttttgc

SEQ ID NO: 94613 - DNA, 25 bp, Rattus norvegicus
actccttctcccaaagaagaggacg

SEQ ID NO: 94614 - DNA, 25 bp, Rattus norvegicus
actccttctccctaagaagaggacg

SEQ ID NO: 94615 - DNA, 25 bp, Rattus norvegicus
actccttctgatcagcagccagtat

SEQ ID NO: 94616 - DNA, 25 bp, Rattus norvegicus
actccttctgatgagcagccagtat

SEQ ID NO: 94617 - DNA, 25 bp, Rattus norvegicus
actccttgccttccagtgtatttag

SEQ ID NO: 94618 - DNA, 25 bp, Rattus norvegicus
actccttgccttgcagtgtatttag

SEQ ID NO: 94619 - DNA, 25 bp, Rattus norvegicus
actccttgctttacaaatgcttctc

SEQ ID NO: 94620 - DNA, 25 bp, Rattus norvegicus
actccttgctttctgctgagataag

SEQ ID NO: 94621 - DNA, 25 bp, Rattus norvegicus
actccttgctttgtgctgagataag

SEQ ID NO: 94622 - DNA, 25 bp, Rattus norvegicus
actccttgcttttcaaatgcttctc

SEQ ID NO: 94623 - DNA, 25 bp, Rattus norvegicus
actccttggagtacttttgtgacta

SEQ ID NO: 94624 - DNA, 25 bp, Rattus norvegicus
actccttggagttcttttgtgacta

SEQ ID NO: 94625 - DNA, 25 bp, Rattus norvegicus
actccttgggtgattctcctgacag

SEQ ID NO: 94626 - DNA, 25 bp, Rattus norvegicus
actccttgggtgtttctcctgacag

SEQ ID NO: 94627 - DNA, 25 bp, Rattus norvegicus
actccttggttgctgatctggactc

SEQ ID NO: 94628 - DNA, 25 bp, Rattus norvegicus
actccttggttggtgatctggactc

SEQ ID NO: 94629 - DNA, 25 bp, Rattus norvegicus
actccttgtaaccttctgtaactat

SEQ ID NO: 94630 - DNA, 25 bp, Rattus norvegicus
actccttgtaacgttctgtaactat

SEQ ID NO: 94631 - DNA, 25 bp, Rattus norvegicus
actccttgtccaagtggccgcttaa

SEQ ID NO: 94632 - DNA, 25 bp, Rattus norvegicus
actccttgtccatgtggccgcttaa

SEQ ID NO: 94633 - DNA, 25 bp, Rattus norvegicus
actccttgtcctcagattggctgga

SEQ ID NO: 94634 - DNA, 25 bp, Rattus norvegicus
actccttgtcctgagattggctgga

SEQ ID NO: 94635 - DNA, 25 bp, Rattus norvegicus
actccttgttggcagtcagtgcaga

SEQ ID NO: 94636 - DNA, 25 bp, Rattus norvegicus
actccttgttgggagtcagtgcaga

SEQ ID NO: 94637 - DNA, 25 bp, Rattus norvegicus
actcctttactcatttgcaactgca

SEQ ID NO: 94638 - DNA, 25 bp, Rattus norvegicus
actcctttactcttttgcaactgca

SEQ ID NO: 94639 - DNA, 25 bp, Rattus norvegicus
actcctttatcaaggaccggacaaa

SEQ ID NO: 94640 - DNA, 25 bp, Rattus norvegicus
actcctttatcatggaccggacaaa

SEQ ID NO: 94641 - DNA, 25 bp, Rattus norvegicus
actcctttcccacattggactgaag

SEQ ID NO: 94642 - DNA, 25 bp, Rattus norvegicus
actcctttcccagattggactgaag

SEQ ID NO: 94643 - DNA, 25 bp, Rattus norvegicus
actcctttccgcctgggaggtatga

SEQ ID NO: 94644 - DNA, 25 bp, Rattus norvegicus
actcctttccgcgtgggaggtatga

SEQ ID NO: 94645 - DNA, 25 bp, Rattus norvegicus
actcctttcttccttgtactgtgga

SEQ ID NO: 94646 - DNA, 25 bp, Rattus norvegicus
actcctttcttcgttgtactgtgga

SEQ ID NO: 94647 - DNA, 25 bp, Rattus norvegicus
actcctttggccacaggtgatgatg

SEQ ID NO: 94648 - DNA, 25 bp, Rattus norvegicus
actcctttggcctcaggtgatgatg

SEQ ID NO: 94649 - DNA, 25 bp, Rattus norvegicus
actccttttcctcccgtgtcagaat

SEQ ID NO: 94650 - DNA, 25 bp, Rattus norvegicus
actccttttcctgccgtgtcagaat

SEQ ID NO: 94651 - DNA, 25 bp, Rattus norvegicus
actcgaaccagacagcaaacttgcc

SEQ ID NO: 94652 - DNA, 25 bp, Rattus norvegicus
actcgaaccagagagcaaacttgcc

SEQ ID NO: 94653 - DNA, 25 bp, Rattus norvegicus
actcgaacggctaccttcacagagg

SEQ ID NO: 94654 - DNA, 25 bp, Rattus norvegicus
actcgaacggcttccttcacagagg

SEQ ID NO: 94655 - DNA, 25 bp, Rattus norvegicus
actcgaagcgccagtgtgccggcag

SEQ ID NO: 94656 - DNA, 25 bp, Rattus norvegicus
actcgaagcgcctgtgtgccggcag

SEQ ID NO: 94657 - DNA, 25 bp, Rattus norvegicus
actcgaataactatgtcacacgtgt

SEQ ID NO: 94658 - DNA, 25 bp, Rattus norvegicus
actcgaataactttgtcacacgtgt

SEQ ID NO: 94659 - DNA, 25 bp, Rattus norvegicus
actcgaccagggactgggttgacaa

SEQ ID NO: 94660 - DNA, 25 bp, Rattus norvegicus
actcgaccagggtctgggttgacaa

SEQ ID NO: 94661 - DNA, 25 bp, Rattus norvegicus
actcgacccggaccaagacatggaa

SEQ ID NO: 94662 - DNA, 25 bp, Rattus norvegicus
actcgacccggagcaagacatggaa

SEQ ID NO: 94663 - DNA, 25 bp, Rattus norvegicus
actcgacgtcagacaccagtgataa

SEQ ID NO: 94664 - DNA, 25 bp, Rattus norvegicus
actcgacgtcagtcaccagtgataa

SEQ ID NO: 94665 - DNA, 25 bp, Rattus norvegicus
actcgactacataggcctggcttca

SEQ ID NO: 94666 - DNA, 25 bp, Rattus norvegicus
actcgactacattggcctggcttca

SEQ ID NO: 94667 - DNA, 25 bp, Rattus norvegicus
actcgacttccgctgctgaacttca

SEQ ID NO: 94668 - DNA, 25 bp, Rattus norvegicus
actcgacttccggtgctgaacttca

SEQ ID NO: 94669 - DNA, 25 bp, Rattus norvegicus
actcgagcttaccactgttaggaca

SEQ ID NO: 94670 - DNA, 25 bp, Rattus norvegicus
actcgagcttacgactgttaggaca

SEQ ID NO: 94671 - DNA, 25 bp, Rattus norvegicus
actcgaggcataacaccgtggtcag

SEQ ID NO: 94672 - DNA, 25 bp, Rattus norvegicus
actcgaggcatatcaccgtggtcag

SEQ ID NO: 94673 - DNA, 25 bp, Rattus norvegicus
actcgaggcctgacaagatccgaat

SEQ ID NO: 94674 - DNA, 25 bp, Rattus norvegicus
actcgaggcctgtcaagatccgaat

SEQ ID NO: 94675 - DNA, 25 bp, Rattus norvegicus
actcgaggcgagcatcttttgttta

SEQ ID NO: 94676 - DNA, 25 bp, Rattus norvegicus
actcgaggcgaggatcttttgttta

SEQ ID NO: 94677 - DNA, 25 bp, Rattus norvegicus
actcgaggctgtacgttcatctaca

SEQ ID NO: 94678 - DNA, 25 bp, Rattus norvegicus
actcgaggctgttcgttcatctaca

SEQ ID NO: 94679 - DNA, 25 bp, Rattus norvegicus
actcgagtgatgctttatggtccaa

SEQ ID NO: 94680 - DNA, 25 bp, Rattus norvegicus
actcgagtgatggtttatggtccaa

SEQ ID NO: 94681 - DNA, 25 bp, Rattus norvegicus
actcgagttgttcctaaagggccag

SEQ ID NO: 94682 - DNA, 25 bp, Rattus norvegicus
actcgagttgttgctaaagggccag

SEQ ID NO: 94683 - DNA, 25 bp, Rattus norvegicus
actcgatgacatagctgtccagcag

SEQ ID NO: 94684 - DNA, 25 bp, Rattus norvegicus
actcgatgacattgctgtccagcag

SEQ ID NO: 94685 - DNA, 25 bp, Rattus norvegicus
actcgatgactcattgttttactac

SEQ ID NO: 94686 - DNA, 25 bp, Rattus norvegicus
actcgatgactctttgttttactac

SEQ ID NO: 94687 - DNA, 25 bp, Rattus norvegicus
actcgatgccatagaaacacctagg

SEQ ID NO: 94688 - DNA, 25 bp, Rattus norvegicus
actcgatgccattgaaacacctagg

SEQ ID NO: 94689 - DNA, 25 bp, Rattus norvegicus
actcgatggagtctgcatccttgca

SEQ ID NO: 94690 - DNA, 25 bp, Rattus norvegicus
actcgatggagtgtgcatccttgca

SEQ ID NO: 94691 - DNA, 25 bp, Rattus norvegicus
actcgcaaataaagtgttccccggc

SEQ ID NO: 94692 - DNA, 25 bp, Rattus norvegicus
actcgcaaataatgtgttccccggc

SEQ ID NO: 94693 - DNA, 25 bp, Rattus norvegicus
actcgcaagcccctggaggagaaat

SEQ ID NO: 94694 - DNA, 25 bp, Rattus norvegicus
actcgcaagcccgtggaggagaaat

SEQ ID NO: 94695 - DNA, 25 bp, Rattus norvegicus
actcgcacacacagcagtttgtctc

SEQ ID NO: 94696 - DNA, 25 bp, Rattus norvegicus
actcgcacacactgcagtttgtctc

SEQ ID NO: 94697 - DNA, 25 bp, Rattus norvegicus
actcgcaggtgaatgtgttggacat

SEQ ID NO: 94698 - DNA, 25 bp, Rattus norvegicus
actcgcaggtgattgtgttggacat

SEQ ID NO: 94699 - DNA, 25 bp, Rattus norvegicus
actcgcatcaatctggtggctgcca

SEQ ID NO: 94700 - DNA, 25 bp, Rattus norvegicus
actcgcatcaatgtggtggctgcca

SEQ ID NO: 94701 - DNA, 25 bp, Rattus norvegicus
actcgccacagtacaaaaggttttg

SEQ ID NO: 94702 - DNA, 25 bp, Rattus norvegicus
actcgccacagttcaaaaggttttg

SEQ ID NO: 94703 - DNA, 25 bp, Rattus norvegicus
actcgcccactgacctgacaggaag

SEQ ID NO: 94704 - DNA, 25 bp, Rattus norvegicus
actcgcccactgtcctgacaggaag

SEQ ID NO: 94705 - DNA, 25 bp, Rattus norvegicus
actcgccccgtgagagctactcgag

SEQ ID NO: 94706 - DNA, 25 bp, Rattus norvegicus
actcgccccgtgtgagctactcgag

SEQ ID NO: 94707 - DNA, 25 bp, Rattus norvegicus
actcgccctgtgagactagggagct

SEQ ID NO: 94708 - DNA, 25 bp, Rattus norvegicus
actcgccctgtgtgactagggagct

SEQ ID NO: 94709 - DNA, 25 bp, Rattus norvegicus
actcgcccttctaggagatctggat

SEQ ID NO: 94710 - DNA, 25 bp, Rattus norvegicus
actcgcccttcttggagatctggat

SEQ ID NO: 94711 - DNA, 25 bp, Rattus norvegicus
actcgcctagtgatgctgggccctt

SEQ ID NO: 94712 - DNA, 25 bp, Rattus norvegicus
actcgcctagtgttgctgggccctt

SEQ ID NO: 94713 - DNA, 25 bp, Rattus norvegicus
actcgcctgagcaaaaactcgacac

SEQ ID NO: 94714 - DNA, 25 bp, Rattus norvegicus
actcgcctgagctaaaactcgacac

SEQ ID NO: 94715 - DNA, 25 bp, Rattus norvegicus
actcgcctgatgacaaagctgcaag

SEQ ID NO: 94716 - DNA, 25 bp, Rattus norvegicus
actcgcctgatgtcaaagctgcaag

SEQ ID NO: 94717 - DNA, 25 bp, Rattus norvegicus
actcgcctggagagtgcaaggcttc

SEQ ID NO: 94718 - DNA, 25 bp, Rattus norvegicus
actcgcctggagtgtgcaaggcttc

SEQ ID NO: 94719 - DNA, 25 bp, Rattus norvegicus
actcgcctgtagatgtctctctaga

SEQ ID NO: 94720 - DNA, 25 bp, Rattus norvegicus
actcgcctgtagttgtctctctaga

SEQ ID NO: 94721 - DNA, 25 bp, Rattus norvegicus
actcgcgactgtagggactgattaa

SEQ ID NO: 94722 - DNA, 25 bp, Rattus norvegicus
actcgcgactgttgggactgattaa

SEQ ID NO: 94723 - DNA, 25 bp, Rattus norvegicus
actcgcgccgttctttatctgtcag

SEQ ID NO: 94724 - DNA, 25 bp, Rattus norvegicus
actcgcgccgttgtttatctgtcag

SEQ ID NO: 94725 - DNA, 25 bp, Rattus norvegicus
actcgcgcgtagatttacagcctta

SEQ ID NO: 94726 - DNA, 25 bp, Rattus norvegicus
actcgcgcgtagttttacagcctta

SEQ ID NO: 94727 - DNA, 25 bp, Rattus norvegicus
actcgctcatgtccggcaatgtggc

SEQ ID NO: 94728 - DNA, 25 bp, Rattus norvegicus
actcgctcatgtgcggcaatgtggc

SEQ ID NO: 94729 - DNA, 25 bp, Rattus norvegicus
actcgctctgtgacttacttaatct

SEQ ID NO: 94730 - DNA, 25 bp, Rattus norvegicus
actcgctctgtgtcttacttaatct

SEQ ID NO: 94731 - DNA, 25 bp, Rattus norvegicus
actcgctgagctagtatcgttttgt

SEQ ID NO: 94732 - DNA, 25 bp, Rattus norvegicus
actcgctgagcttgtatcgttttgt

SEQ ID NO: 94733 - DNA, 25 bp, Rattus norvegicus
actcgctgcatcctcaagatcaatg

SEQ ID NO: 94734 - DNA, 25 bp, Rattus norvegicus
actcgctgcatcgtcaagatcaatg

SEQ ID NO: 94735 - DNA, 25 bp, Rattus norvegicus
actcgctgccgaatgtatttctaac

SEQ ID NO: 94736 - DNA, 25 bp, Rattus norvegicus
actcgctgccgattgtatttctaac

SEQ ID NO: 94737 - DNA, 25 bp, Rattus norvegicus
actcgctggagtcttatgctttcaa

SEQ ID NO: 94738 - DNA, 25 bp, Rattus norvegicus
actcgctggagtgttatgctttcaa

SEQ ID NO: 94739 - DNA, 25 bp, Rattus norvegicus
actcgctgtgccactctgagaggca

SEQ ID NO: 94740 - DNA, 25 bp, Rattus norvegicus
actcgctgtgcctctctgagaggca

SEQ ID NO: 94741 - DNA, 25 bp, Rattus norvegicus
actcgctgtgtacactggtcaggcc

SEQ ID NO: 94742 - DNA, 25 bp, Rattus norvegicus
actcgctgtgtagactggtcaggcc

SEQ ID NO: 94743 - DNA, 25 bp, Rattus norvegicus
actcgctgtgttctgcccagttgtt

SEQ ID NO: 94744 - DNA, 25 bp, Rattus norvegicus
actcgctgtgttgtgcccagttgtt

SEQ ID NO: 94745 - DNA, 25 bp, Rattus norvegicus
actcgcttacttcgcagatggtctg

SEQ ID NO: 94746 - DNA, 25 bp, Rattus norvegicus
actcgcttacttggcagatggtctg

SEQ ID NO: 94747 - DNA, 25 bp, Rattus norvegicus
actcgctttgtacgaaactcctctg

SEQ ID NO: 94748 - DNA, 25 bp, Rattus norvegicus
actcgctttgtaggaaactcctctg

SEQ ID NO: 94749 - DNA, 25 bp, Rattus norvegicus
actcggaaagtcactgtttggttca

SEQ ID NO: 94750 - DNA, 25 bp, Rattus norvegicus
actcggaaagtctctgtttggttca

SEQ ID NO: 94751 - DNA, 25 bp, Rattus norvegicus
actcggaaggcccaggattttcact

SEQ ID NO: 94752 - DNA, 25 bp, Rattus norvegicus
actcggaaggccgaggattttcact

SEQ ID NO: 94753 - DNA, 25 bp, Rattus norvegicus
actcggacgatcagtgtggcttcta

SEQ ID NO: 94754 - DNA, 25 bp, Rattus norvegicus
actcggacgatctgtgtggcttcta

SEQ ID NO: 94755 - DNA, 25 bp, Rattus norvegicus
actcggagaggccagaaacaagact

SEQ ID NO: 94756 - DNA, 25 bp, Rattus norvegicus
actcggagaggcgagaaacaagact

SEQ ID NO: 94757 - DNA, 25 bp, Rattus norvegicus
actcggagatacctagctgctctgt

SEQ ID NO: 94758 - DNA, 25 bp, Rattus norvegicus
actcggagatacgtagctgctctgt

SEQ ID NO: 94759 - DNA, 25 bp, Rattus norvegicus
actcggagatcaccaagcgcctggg

SEQ ID NO: 94760 - DNA, 25 bp, Rattus norvegicus
actcggagatcagcaagcgcctggg

SEQ ID NO: 94761 - DNA, 25 bp, Rattus norvegicus
actcggagctgcaagtgcaggcagt

SEQ ID NO: 94762 - DNA, 25 bp, Rattus norvegicus
actcggagctgctagtgcaggcagt

SEQ ID NO: 94763 - DNA, 25 bp, Rattus norvegicus
actcggaggctgaccctatgcaaag

SEQ ID NO: 94764 - DNA, 25 bp, Rattus norvegicus
actcggaggctgtccctatgcaaag

SEQ ID NO: 94765 - DNA, 25 bp, Rattus norvegicus
actcggagtgtaattgttgctgttt

SEQ ID NO: 94766 - DNA, 25 bp, Rattus norvegicus
actcggagtgtatttgttgctgttt

SEQ ID NO: 94767 - DNA, 25 bp, Rattus norvegicus
actcggagtgtgaatctgggtcaga

SEQ ID NO: 94768 - DNA, 25 bp, Rattus norvegicus
actcggagtgtgtatctgggtcaga

SEQ ID NO: 94769 - DNA, 25 bp, Rattus norvegicus
actcggattcacattaacactccac

SEQ ID NO: 94770 - DNA, 25 bp, Rattus norvegicus
actcggattcactttaacactccac

SEQ ID NO: 94771 - DNA, 25 bp, Rattus norvegicus
actcggattggtctctgggctacta

SEQ ID NO: 94772 - DNA, 25 bp, Rattus norvegicus
actcggattggtgtctgggctacta

SEQ ID NO: 94773 - DNA, 25 bp, Rattus norvegicus
actcggcacagcctaggcatggcag

SEQ ID NO: 94774 - DNA, 25 bp, Rattus norvegicus
actcggcacagcgtaggcatggcag

SEQ ID NO: 94775 - DNA, 25 bp, Rattus norvegicus
actcggcaggaaatcattgacggca

SEQ ID NO: 94776 - DNA, 25 bp, Rattus norvegicus
actcggcaggaattcattgacggca

SEQ ID NO: 94777 - DNA, 25 bp, Rattus norvegicus
actcggcagtggcagtgacagcaaa

SEQ ID NO: 94778 - DNA, 25 bp, Rattus norvegicus
actcggcagtgggagtgacagcaaa

SEQ ID NO: 94779 - DNA, 25 bp, Rattus norvegicus
actcggcatgtacctgtcaggtgct

SEQ ID NO: 94780 - DNA, 25 bp, Rattus norvegicus
actcggcatgtagctgtcaggtgct

SEQ ID NO: 94781 - DNA, 25 bp, Rattus norvegicus
actcggccattcacagtgcgattga

SEQ ID NO: 94782 - DNA, 25 bp, Rattus norvegicus
actcggccattctcagtgcgattga

SEQ ID NO: 94783 - DNA, 25 bp, Rattus norvegicus
actcggctagtactccttagaactt

SEQ ID NO: 94784 - DNA, 25 bp, Rattus norvegicus
actcggctagtagtccttagaactt

SEQ ID NO: 94785 - DNA, 25 bp, Rattus norvegicus
actcggcttccccaagtgaaagaat

SEQ ID NO: 94786 - DNA, 25 bp, Rattus norvegicus
actcggcttcccgaagtgaaagaat

SEQ ID NO: 94787 - DNA, 25 bp, Rattus norvegicus
actcgggaccagagaaatgggctga

SEQ ID NO: 94788 - DNA, 25 bp, Rattus norvegicus
actcgggaccagtgaaatgggctga

SEQ ID NO: 94789 - DNA, 25 bp, Rattus norvegicus
actcgggactgtcctcgctgggaac

SEQ ID NO: 94790 - DNA, 25 bp, Rattus norvegicus
actcgggactgtgctcgctgggaac

SEQ ID NO: 94791 - DNA, 25 bp, Rattus norvegicus
actcgggagcttcccgggccactgt

SEQ ID NO: 94792 - DNA, 25 bp, Rattus norvegicus
actcgggagcttgccgggccactgt

SEQ ID NO: 94793 - DNA, 25 bp, Rattus norvegicus
actcgggcatctatgctagggagct

SEQ ID NO: 94794 - DNA, 25 bp, Rattus norvegicus
actcgggcatctttgctagggagct

SEQ ID NO: 94795 - DNA, 25 bp, Rattus norvegicus
actcgggcatgccttgacgtcggaa

SEQ ID NO: 94796 - DNA, 25 bp, Rattus norvegicus
actcgggcatgcgttgacgtcggaa

SEQ ID NO: 94797 - DNA, 25 bp, Rattus norvegicus
actcgggcccaacgtggatctgaga

SEQ ID NO: 94798 - DNA, 25 bp, Rattus norvegicus
actcgggcccaaggtggatctgaga

SEQ ID NO: 94799 - DNA, 25 bp, Rattus norvegicus
actcgggctcataaaaggagaccta

SEQ ID NO: 94800 - DNA, 25 bp, Rattus norvegicus
actcgggctcattaaaggagaccta

SEQ ID NO: 94801 - DNA, 25 bp, Rattus norvegicus
actcgggctccaagtgatctacaaa

SEQ ID NO: 94802 - DNA, 25 bp, Rattus norvegicus
actcgggctccatgtgatctacaaa

SEQ ID NO: 94803 - DNA, 25 bp, Rattus norvegicus
actcgggctcctctggaatgcgaag

SEQ ID NO: 94804 - DNA, 25 bp, Rattus norvegicus
actcgggctcctgtggaatgcgaag

SEQ ID NO: 94805 - DNA, 25 bp, Rattus norvegicus
actcgggcttatctgatcagctcgt

SEQ ID NO: 94806 - DNA, 25 bp, Rattus norvegicus
actcgggcttatgtgatcagctcgt

SEQ ID NO: 94807 - DNA, 25 bp, Rattus norvegicus
actcgggtacacacctgaggcagta

SEQ ID NO: 94808 - DNA, 25 bp, Rattus norvegicus
actcgggtacactcctgaggcagta

SEQ ID NO: 94809 - DNA, 25 bp, Rattus norvegicus
actcgggtatccagcatgtcagggc

SEQ ID NO: 94810 - DNA, 25 bp, Rattus norvegicus
actcgggtatcctgcatgtcagggc

SEQ ID NO: 94811 - DNA, 25 bp, Rattus norvegicus
actcgggtcgtcaacactgctattg

SEQ ID NO: 94812 - DNA, 25 bp, Rattus norvegicus
actcgggtcgtctacactgctattg

SEQ ID NO: 94813 - DNA, 25 bp, Rattus norvegicus
actcgggtctgaagccatgtggcca

SEQ ID NO: 94814 - DNA, 25 bp, Rattus norvegicus
actcgggtctgatgccatgtggcca

SEQ ID NO: 94815 - DNA, 25 bp, Rattus norvegicus
actcgggtgccacactacgtagact

SEQ ID NO: 94816 - DNA, 25 bp, Rattus norvegicus
actcgggtgccagactacgtagact

SEQ ID NO: 94817 - DNA, 25 bp, Rattus norvegicus
actcgggttttaatgtttgtgcaga

SEQ ID NO: 94818 - DNA, 25 bp, Rattus norvegicus
actcgggttttattgtttgtgcaga

SEQ ID NO: 94819 - DNA, 25 bp, Rattus norvegicus
actcggtagctcatatactggatca

SEQ ID NO: 94820 - DNA, 25 bp, Rattus norvegicus
actcggtagctcttatactggatca

SEQ ID NO: 94821 - DNA, 25 bp, Rattus norvegicus
actcggtccagtaatcctcaagaga

SEQ ID NO: 94822 - DNA, 25 bp, Rattus norvegicus
actcggtccagttatcctcaagaga

SEQ ID NO: 94823 - DNA, 25 bp, Rattus norvegicus
actcggtcgggtctaagttctgtca

SEQ ID NO: 94824 - DNA, 25 bp, Rattus norvegicus
actcggtcgggtgtaagttctgtca

SEQ ID NO: 94825 - DNA, 25 bp, Rattus norvegicus
actcggtctactcgaagggctggtt

SEQ ID NO: 94826 - DNA, 25 bp, Rattus norvegicus
actcggtctactggaagggctggtt

SEQ ID NO: 94827 - DNA, 25 bp, Rattus norvegicus
actcggtctgaactctgaagtaggt

SEQ ID NO: 94828 - DNA, 25 bp, Rattus norvegicus
actcggtctgaagtctgaagtaggt

SEQ ID NO: 94829 - DNA, 25 bp, Rattus norvegicus
actcggtgatgcaatgggtatgtat

SEQ ID NO: 94830 - DNA, 25 bp, Rattus norvegicus
actcggtgatgctatgggtatgtat

SEQ ID NO: 94831 - DNA, 25 bp, Rattus norvegicus
actcggtgcaatcggaggccagcct

SEQ ID NO: 94832 - DNA, 25 bp, Rattus norvegicus
actcggtgcaatgggaggccagcct

SEQ ID NO: 94833 - DNA, 25 bp, Rattus norvegicus
actcggtggactacccagcctggga

SEQ ID NO: 94834 - DNA, 25 bp, Rattus norvegicus
actcggtggacttcccagcctggga

SEQ ID NO: 94835 - DNA, 25 bp, Rattus norvegicus
actcggtgtgctcggttaatggcta

SEQ ID NO: 94836 - DNA, 25 bp, Rattus norvegicus
actcggtgtgctgggttaatggcta

SEQ ID NO: 94837 - DNA, 25 bp, Rattus norvegicus
actcggtgttttagctcagttccac

SEQ ID NO: 94838 - DNA, 25 bp, Rattus norvegicus
actcggtgtttttgctcagttccac

SEQ ID NO: 94839 - DNA, 25 bp, Rattus norvegicus
actcggttactgatagcacgcctct

SEQ ID NO: 94840 - DNA, 25 bp, Rattus norvegicus
actcggttactgttagcacgcctct

SEQ ID NO: 94841 - DNA, 25 bp, Rattus norvegicus
actcggttcagcaccttggatagca

SEQ ID NO: 94842 - DNA, 25 bp, Rattus norvegicus
actcggttcagctccttggatagca

SEQ ID NO: 94843 - DNA, 25 bp, Rattus norvegicus
actcggttcctgagttgatttatct

SEQ ID NO: 94844 - DNA, 25 bp, Rattus norvegicus
actcggttcctgtgttgatttatct

SEQ ID NO: 94845 - DNA, 25 bp, Rattus norvegicus
actcggttctgtattgacagccaca

SEQ ID NO: 94846 - DNA, 25 bp, Rattus norvegicus
actcggttctgttttgacagccaca

SEQ ID NO: 94847 - DNA, 25 bp, Rattus norvegicus
actcggttgtcaaatattatgccaa

SEQ ID NO: 94848 - DNA, 25 bp, Rattus norvegicus
actcggttgtcatatattatgccaa

SEQ ID NO: 94849 - DNA, 25 bp, Rattus norvegicus
actcggtttcctccagggttgaaga

SEQ ID NO: 94850 - DNA, 25 bp, Rattus norvegicus
actcggtttcctgcagggttgaaga

SEQ ID NO: 94851 - DNA, 25 bp, Rattus norvegicus
actcggttttctcatggtttagaca

SEQ ID NO: 94852 - DNA, 25 bp, Rattus norvegicus
actcggttttctgatggtttagaca

SEQ ID NO: 94853 - DNA, 25 bp, Rattus norvegicus
actcgtacatctcgtttcatcgtct

SEQ ID NO: 94854 - DNA, 25 bp, Rattus norvegicus
actcgtacatctggtttcatcgtct

SEQ ID NO: 94855 - DNA, 25 bp, Rattus norvegicus
actcgtatcccacgactcagtgaac

SEQ ID NO: 94856 - DNA, 25 bp, Rattus norvegicus
actcgtatcccaggactcagtgaac

SEQ ID NO: 94857 - DNA, 25 bp, Rattus norvegicus
actcgtccacctcgatgatgagtcg

SEQ ID NO: 94858 - DNA, 25 bp, Rattus norvegicus
actcgtccacctggatgatgagtcg

SEQ ID NO: 94859 - DNA, 25 bp, Rattus norvegicus
actcgtcccactcaggtaggcggtc

SEQ ID NO: 94860 - DNA, 25 bp, Rattus norvegicus
actcgtcccactgaggtaggcggtc

SEQ ID NO: 94861 - DNA, 25 bp, Rattus norvegicus
actcgtctgcgtattccattctgga

SEQ ID NO: 94862 - DNA, 25 bp, Rattus norvegicus
actcgtctgcgttttccattctgga

SEQ ID NO: 94863 - DNA, 25 bp, Rattus norvegicus
actcgtcttcagcagctccagagct

SEQ ID NO: 94864 - DNA, 25 bp, Rattus norvegicus
actcgtcttcaggagctccagagct

SEQ ID NO: 94865 - DNA, 25 bp, Rattus norvegicus
actcgtcttcctcttcaagatggag

SEQ ID NO: 94866 - DNA, 25 bp, Rattus norvegicus
actcgtcttcctgttcaagatggag

SEQ ID NO: 94867 - DNA, 25 bp, Rattus norvegicus
actcgtctttatctttctcaaggga

SEQ ID NO: 94868 - DNA, 25 bp, Rattus norvegicus
actcgtctttatgtttctcaaggga

SEQ ID NO: 94869 - DNA, 25 bp, Rattus norvegicus
actcgtcttttgaccctgagagaac

SEQ ID NO: 94870 - DNA, 25 bp, Rattus norvegicus
actcgtcttttgtccctgagagaac

SEQ ID NO: 94871 - DNA, 25 bp, Rattus norvegicus
actcgtgagaccagcatgtgactag

SEQ ID NO: 94872 - DNA, 25 bp, Rattus norvegicus
actcgtgagacctgcatgtgactag

SEQ ID NO: 94873 - DNA, 25 bp, Rattus norvegicus
actcgtgagcttaacaggaacccat

SEQ ID NO: 94874 - DNA, 25 bp, Rattus norvegicus
actcgtgagctttacaggaacccat

SEQ ID NO: 94875 - DNA, 25 bp, Rattus norvegicus
actcgtgcacatcggcggttcgtaa

SEQ ID NO: 94876 - DNA, 25 bp, Rattus norvegicus
actcgtgcacatgggcggttcgtaa

SEQ ID NO: 94877 - DNA, 25 bp, Rattus norvegicus
actcgtgctctaccagttcttataa

SEQ ID NO: 94878 - DNA, 25 bp, Rattus norvegicus
actcgtgctctagcagttcttataa

SEQ ID NO: 94879 - DNA, 25 bp, Rattus norvegicus
actcgtgctttcagtgtttgtagcc

SEQ ID NO: 94880 - DNA, 25 bp, Rattus norvegicus
actcgtgctttctgtgtttgtagcc

SEQ ID NO: 94881 - DNA, 25 bp, Rattus norvegicus
actcgtggttggattatggaataat

SEQ ID NO: 94882 - DNA, 25 bp, Rattus norvegicus
actcgtggttggtttatggaataat

SEQ ID NO: 94883 - DNA, 25 bp, Rattus norvegicus
actcgtgtcctacctgggaggcagc

SEQ ID NO: 94884 - DNA, 25 bp, Rattus norvegicus
actcgtgtcctagctgggaggcagc

SEQ ID NO: 94885 - DNA, 25 bp, Rattus norvegicus
actcgtgttaacatactgtgtactg

SEQ ID NO: 94886 - DNA, 25 bp, Rattus norvegicus
actcgtgttaacttactgtgtactg

SEQ ID NO: 94887 - DNA, 25 bp, Rattus norvegicus
actcgtgttcaaagcagtggcgttt

SEQ ID NO: 94888 - DNA, 25 bp, Rattus norvegicus
actcgtgttcaatgcagtggcgttt

SEQ ID NO: 94889 - DNA, 25 bp, Rattus norvegicus
actcgtgtttccaaggtggttagca

SEQ ID NO: 94890 - DNA, 25 bp, Rattus norvegicus
actcgtgtttcctaggtggttagca

SEQ ID NO: 94891 - DNA, 25 bp, Rattus norvegicus
actcgttacagaagtccagtgcgga

SEQ ID NO: 94892 - DNA, 25 bp, Rattus norvegicus
actcgttacagatgtccagtgcgga

SEQ ID NO: 94893 - DNA, 25 bp, Rattus norvegicus
actcgttccccaagggtctccagtt

SEQ ID NO: 94894 - DNA, 25 bp, Rattus norvegicus
actcgttccccatgggtctccagtt

SEQ ID NO: 94895 - DNA, 25 bp, Rattus norvegicus
actcgttccctgacgtgatcaagaa

SEQ ID NO: 94896 - DNA, 25 bp, Rattus norvegicus
actcgttccctgtcgtgatcaagaa

SEQ ID NO: 94897 - DNA, 25 bp, Rattus norvegicus
actcgttcttgcagagtcccagcac

SEQ ID NO: 94898 - DNA, 25 bp, Rattus norvegicus
actcgttcttgctgagtcccagcac

SEQ ID NO: 94899 - DNA, 25 bp, Rattus norvegicus
actcgttcttttctgcaactactat

SEQ ID NO: 94900 - DNA, 25 bp, Rattus norvegicus
actcgttcttttgtgcaactactat

SEQ ID NO: 94901 - DNA, 25 bp, Rattus norvegicus
actcgttgatagacaaccaagctcg

SEQ ID NO: 94902 - DNA, 25 bp, Rattus norvegicus
actcgttgatagtcaaccaagctcg

SEQ ID NO: 94903 - DNA, 25 bp, Rattus norvegicus
actcgttgatgcatggtgttaattg

SEQ ID NO: 94904 - DNA, 25 bp, Rattus norvegicus
actcgttgatgcttggtgttaattg

SEQ ID NO: 94905 - DNA, 25 bp, Rattus norvegicus
actcgttggaggctacttcagttgc

SEQ ID NO: 94906 - DNA, 25 bp, Rattus norvegicus
actcgttggagggtacttcagttgc

SEQ ID NO: 94907 - DNA, 25 bp, Rattus norvegicus
actcgttgtataagaactggcgcac

SEQ ID NO: 94908 - DNA, 25 bp, Rattus norvegicus
actcgttgtatatgaactggcgcac

SEQ ID NO: 94909 - DNA, 25 bp, Rattus norvegicus
actcgtttagtgacttcctgttaat

SEQ ID NO: 94910 - DNA, 25 bp, Rattus norvegicus
actcgtttagtgtcttcctgttaat

SEQ ID NO: 94911 - DNA, 25 bp, Rattus norvegicus
actcgtttggagcatgctcttctgt

SEQ ID NO: 94912 - DNA, 25 bp, Rattus norvegicus
actcgtttggaggatgctcttctgt

SEQ ID NO: 94913 - DNA, 25 bp, Rattus norvegicus
actctaaaagacaggccccaactag

SEQ ID NO: 94914 - DNA, 25 bp, Rattus norvegicus
actctaaaagactggccccaactag

SEQ ID NO: 94915 - DNA, 25 bp, Rattus norvegicus
actctaaagaggatcatctcatctc

SEQ ID NO: 94916 - DNA, 25 bp, Rattus norvegicus
actctaaagaggttcatctcatctc

SEQ ID NO: 94917 - DNA, 25 bp, Rattus norvegicus
actctaaaggtgatgtctcgggttt

SEQ ID NO: 94918 - DNA, 25 bp, Rattus norvegicus
actctaaaggtgttgtctcgggttt

SEQ ID NO: 94919 - DNA, 25 bp, Rattus norvegicus
actctaacatctacccatcagtgaa

SEQ ID NO: 94920 - DNA, 25 bp, Rattus norvegicus
actctaacatcttcccatcagtgaa

SEQ ID NO: 94921 - DNA, 25 bp, Rattus norvegicus
actctaactgtgagtgtcacccttg

SEQ ID NO: 94922 - DNA, 25 bp, Rattus norvegicus
actctaactgtgtgtgtcacccttg

SEQ ID NO: 94923 - DNA, 25 bp, Rattus norvegicus
actctaagacttcgctaatcacgta

SEQ ID NO: 94924 - DNA, 25 bp, Rattus norvegicus
actctaagacttggctaatcacgta

SEQ ID NO: 94925 - DNA, 25 bp, Rattus norvegicus
actctaagccttacctctgtgtggg

SEQ ID NO: 94926 - DNA, 25 bp, Rattus norvegicus
actctaagcctttcctctgtgtggg

SEQ ID NO: 94927 - DNA, 25 bp, Rattus norvegicus
actctaagcgggagactgcacatcc

SEQ ID NO: 94928 - DNA, 25 bp, Rattus norvegicus
actctaagcgggtgactgcacatcc

SEQ ID NO: 94929 - DNA, 25 bp, Rattus norvegicus
actctaagtcccatcgaaggttctt

SEQ ID NO: 94930 - DNA, 25 bp, Rattus norvegicus
actctaagtcccttcgaaggttctt

SEQ ID NO: 94931 - DNA, 25 bp, Rattus norvegicus
actctaataccaactgtgtaccaga

SEQ ID NO: 94932 - DNA, 25 bp, Rattus norvegicus
actctaataccatctgtgtaccaga

SEQ ID NO: 94933 - DNA, 25 bp, Rattus norvegicus
actctaatgacaactggactcgcct

SEQ ID NO: 94934 - DNA, 25 bp, Rattus norvegicus
actctaatgacatctggactcgcct

SEQ ID NO: 94935 - DNA, 25 bp, Rattus norvegicus
actctacatcataccatcttcagtg

SEQ ID NO: 94936 - DNA, 25 bp, Rattus norvegicus
actctacatcattccatcttcagtg

SEQ ID NO: 94937 - DNA, 25 bp, Rattus norvegicus
actctacatctaaaggccctggcag

SEQ ID NO: 94938 - DNA, 25 bp, Rattus norvegicus
actctacatctataggccctggcag

SEQ ID NO: 94939 - DNA, 25 bp, Rattus norvegicus
actctaccacatactcggacagaga

SEQ ID NO: 94940 - DNA, 25 bp, Rattus norvegicus
actctaccacattctcggacagaga

SEQ ID NO: 94941 - DNA, 25 bp, Rattus norvegicus
actctaccatccaattggctacttt

SEQ ID NO: 94942 - DNA, 25 bp, Rattus norvegicus
actctaccatcctattggctacttt

SEQ ID NO: 94943 - DNA, 25 bp, Rattus norvegicus
actctaccgagcaggactgctggtg

SEQ ID NO: 94944 - DNA, 25 bp, Rattus norvegicus
actctaccgagctggactgctggtg

SEQ ID NO: 94945 - DNA, 25 bp, Rattus norvegicus
actctacctgatacatgcacacatg

SEQ ID NO: 94946 - DNA, 25 bp, Rattus norvegicus
actctacctgattcatgcacacatg

SEQ ID NO: 94947 - DNA, 25 bp, Rattus norvegicus
actctacgttctatgcacactatga

SEQ ID NO: 94948 - DNA, 25 bp, Rattus norvegicus
actctacgttctttgcacactatga

SEQ ID NO: 94949 - DNA, 25 bp, Rattus norvegicus
actctactccttcagcatggtttta

SEQ ID NO: 94950 - DNA, 25 bp, Rattus norvegicus
actctactccttgagcatggtttta

SEQ ID NO: 94951 - DNA, 25 bp, Rattus norvegicus
actctactcgttaaacagaatgtat

SEQ ID NO: 94952 - DNA, 25 bp, Rattus norvegicus
actctactcgtttaacagaatgtat

SEQ ID NO: 94953 - DNA, 25 bp, Rattus norvegicus
actctacttttcacctctagaaact

SEQ ID NO: 94954 - DNA, 25 bp, Rattus norvegicus
actctacttttctcctctagaaact

SEQ ID NO: 94955 - DNA, 25 bp, Rattus norvegicus
actctagaaagacgtgtgcctctcc

SEQ ID NO: 94956 - DNA, 25 bp, Rattus norvegicus
actctagaaagaggtgtgcctctcc

SEQ ID NO: 94957 - DNA, 25 bp, Rattus norvegicus
actctagaccaaattctttcaatga

SEQ ID NO: 94958 - DNA, 25 bp, Rattus norvegicus
actctagaccaatttctttcaatga

SEQ ID NO: 94959 - DNA, 25 bp, Rattus norvegicus
actctagagcttcctgatagcccaa

SEQ ID NO: 94960 - DNA, 25 bp, Rattus norvegicus
actctagagcttgctgatagcccaa

SEQ ID NO: 94961 - DNA, 25 bp, Rattus norvegicus
actctagcagcacccagtttgaatt

SEQ ID NO: 94962 - DNA, 25 bp, Rattus norvegicus
actctagcagcagccagtttgaatt

SEQ ID NO: 94963 - DNA, 25 bp, Rattus norvegicus
actctagctctaagggatctgaccc

SEQ ID NO: 94964 - DNA, 25 bp, Rattus norvegicus
actctagctctatgggatctgaccc

SEQ ID NO: 94965 - DNA, 25 bp, Rattus norvegicus
actctagcttgtctctagcaaggac

SEQ ID NO: 94966 - DNA, 25 bp, Rattus norvegicus
actctagcttgtgtctagcaaggac

SEQ ID NO: 94967 - DNA, 25 bp, Rattus norvegicus
actctagtggtgcatctgtaacaca

SEQ ID NO: 94968 - DNA, 25 bp, Rattus norvegicus
actctagtggtggatctgtaacaca

SEQ ID NO: 94969 - DNA, 25 bp, Rattus norvegicus
actctagttgtaagttttgctcaga

SEQ ID NO: 94970 - DNA, 25 bp, Rattus norvegicus
actctagttgtatgttttgctcaga

SEQ ID NO: 94971 - DNA, 25 bp, Rattus norvegicus
actctatcgtctaattgcctggcag

SEQ ID NO: 94972 - DNA, 25 bp, Rattus norvegicus
actctatcgtcttattgcctggcag

SEQ ID NO: 94973 - DNA, 25 bp, Rattus norvegicus
actctatggtggagggtggttcaca

SEQ ID NO: 94974 - DNA, 25 bp, Rattus norvegicus
actctatggtggtgggtggttcaca

SEQ ID NO: 94975 - DNA, 25 bp, Rattus norvegicus
actctattagtgagtccctgtaacg

SEQ ID NO: 94976 - DNA, 25 bp, Rattus norvegicus
actctattagtgtgtccctgtaacg

SEQ ID NO: 94977 - DNA, 25 bp, Rattus norvegicus
actctattgggtcttgccagcctga

SEQ ID NO: 94978 - DNA, 25 bp, Rattus norvegicus
actctattgggtgttgccagcctga

SEQ ID NO: 94979 - DNA, 25 bp, Rattus norvegicus
actctcaaaaaacggctcttttcag

SEQ ID NO: 94980 - DNA, 25 bp, Rattus norvegicus
actctcaaaaaagggctcttttcag

SEQ ID NO: 94981 - DNA, 25 bp, Rattus norvegicus
actctcaactccagagggcggccgg

SEQ ID NO: 94982 - DNA, 25 bp, Rattus norvegicus
actctcaactcctgagggcggccgg

SEQ ID NO: 94983 - DNA, 25 bp, Rattus norvegicus
actctcaactttctcttccttaaca

SEQ ID NO: 94984 - DNA, 25 bp, Rattus norvegicus
actctcaactttgtcttccttaaca

SEQ ID NO: 94985 - DNA, 25 bp, Rattus norvegicus
actctcaaggccaggctcaatgagc

SEQ ID NO: 94986 - DNA, 25 bp, Rattus norvegicus
actctcaaggcctggctcaatgagc

SEQ ID NO: 94987 - DNA, 25 bp, Rattus norvegicus
actctcaagttcatactctgcacag

SEQ ID NO: 94988 - DNA, 25 bp, Rattus norvegicus
actctcaagttcttactctgcacag

SEQ ID NO: 94989 - DNA, 25 bp, Rattus norvegicus
actctcacccagcagttttctagga

SEQ ID NO: 94990 - DNA, 25 bp, Rattus norvegicus
actctcacccaggagttttctagga

SEQ ID NO: 94991 - DNA, 25 bp, Rattus norvegicus
actctcactggtagggaaatctcga

SEQ ID NO: 94992 - DNA, 25 bp, Rattus norvegicus
actctcactggttgggaaatctcga

SEQ ID NO: 94993 - DNA, 25 bp, Rattus norvegicus
actctcacttgactggcatccagag

SEQ ID NO: 94994 - DNA, 25 bp, Rattus norvegicus
actctcacttgagtggcatccagag

SEQ ID NO: 94995 - DNA, 25 bp, Rattus norvegicus
actctcagagccatcagatgtccag

SEQ ID NO: 94996 - DNA, 25 bp, Rattus norvegicus
actctcagagccttcagatgtccag

SEQ ID NO: 94997 - DNA, 25 bp, Rattus norvegicus
actctcagagtaatgtcctggttga

SEQ ID NO: 94998 - DNA, 25 bp, Rattus norvegicus
actctcagagtattgtcctggttga

SEQ ID NO: 94999 - DNA, 25 bp, Rattus norvegicus
actctcagcagtcttaacagtggta

SEQ ID NO: 95000 - DNA, 25 bp, Rattus norvegicus
actctcagcagtgttaacagtggta

SEQ ID NO: 95001 - DNA, 25 bp, Rattus norvegicus
actctcagctgtctctgggccattg

SEQ ID NO: 95002 - DNA, 25 bp, Rattus norvegicus
actctcagctgtgtctgggccattg

SEQ ID NO: 95003 - DNA, 25 bp, Rattus norvegicus
actctcaggtcactgctaagcagca

SEQ ID NO: 95004 - DNA, 25 bp, Rattus norvegicus
actctcaggtcagtgctaagcagca

SEQ ID NO: 95005 - DNA, 25 bp, Rattus norvegicus
actctcagttgtagcaatgtgcctt

SEQ ID NO: 95006 - DNA, 25 bp, Rattus norvegicus
actctcagttgttgcaatgtgcctt

SEQ ID NO: 95007 - DNA, 25 bp, Rattus norvegicus
actctcatacttccgatggccggat

SEQ ID NO: 95008 - DNA, 25 bp, Rattus norvegicus
actctcatacttgcgatggccggat

SEQ ID NO: 95009 - DNA, 25 bp, Rattus norvegicus
actctcatctttagtgtgtcttggt

SEQ ID NO: 95010 - DNA, 25 bp, Rattus norvegicus
actctcatcttttgtgtgtcttggt

SEQ ID NO: 95011 - DNA, 25 bp, Rattus norvegicus
actctcatgggcatgacgcaccttc

SEQ ID NO: 95012 - DNA, 25 bp, Rattus norvegicus
actctcatgggcttgacgcaccttc

SEQ ID NO: 95013 - DNA, 25 bp, Rattus norvegicus
actctcatggttctgtactggtagg

SEQ ID NO: 95014 - DNA, 25 bp, Rattus norvegicus
actctcatggttgtgtactggtagg

SEQ ID NO: 95015 - DNA, 25 bp, Rattus norvegicus
actctcatttttctcaaatatgcca

SEQ ID NO: 95016 - DNA, 25 bp, Rattus norvegicus
actctcatttttgtcaaatatgcca

SEQ ID NO: 95017 - DNA, 25 bp, Rattus norvegicus
actctccaaaatatacctgttcctg

SEQ ID NO: 95018 - DNA, 25 bp, Rattus norvegicus
actctccaaaatttacctgttcctg

SEQ ID NO: 95019 - DNA, 25 bp, Rattus norvegicus
actctccaatatctctccttgtgta

SEQ ID NO: 95020 - DNA, 25 bp, Rattus norvegicus
actctccaatatgtctccttgtgta

SEQ ID NO: 95021 - DNA, 25 bp, Rattus norvegicus
actctccaatgaaagccctgtacct

SEQ ID NO: 95022 - DNA, 25 bp, Rattus norvegicus
actctccaatgatagccctgtacct

SEQ ID NO: 95023 - DNA, 25 bp, Rattus norvegicus
actctccacctgcttgaacttgttg

SEQ ID NO: 95024 - DNA, 25 bp, Rattus norvegicus
actctccacctggttgaacttgttg

SEQ ID NO: 95025 - DNA, 25 bp, Rattus norvegicus
actctccatcatctgacttcaggaa

SEQ ID NO: 95026 - DNA, 25 bp, Rattus norvegicus
actctccatcatgtgacttcaggaa

SEQ ID NO: 95027 - DNA, 25 bp, Rattus norvegicus
actctccatggcagcggcgtcacag

SEQ ID NO: 95028 - DNA, 25 bp, Rattus norvegicus
actctccatggctgcggcgtcacag

SEQ ID NO: 95029 - DNA, 25 bp, Rattus norvegicus
actctcccagtgaggacggtgtctg

SEQ ID NO: 95030 - DNA, 25 bp, Rattus norvegicus
actctcccagtgatgctattgtgtg

SEQ ID NO: 95031 - DNA, 25 bp, Rattus norvegicus
actctcccagtgtggacggtgtctg

SEQ ID NO: 95032 - DNA, 25 bp, Rattus norvegicus
actctcccagtgttgctattgtgtg

SEQ ID NO: 95033 - DNA, 25 bp, Rattus norvegicus
actctcccatagctgtgttaccaaa

SEQ ID NO: 95034 - DNA, 25 bp, Rattus norvegicus
actctcccataggtgtgttaccaaa

SEQ ID NO: 95035 - DNA, 25 bp, Rattus norvegicus
actctcccattgatcttaacagctg

SEQ ID NO: 95036 - DNA, 25 bp, Rattus norvegicus
actctcccattgttcttaacagctg

SEQ ID NO: 95037 - DNA, 25 bp, Rattus norvegicus
actctccctactaaactgacagtta

SEQ ID NO: 95038 - DNA, 25 bp, Rattus norvegicus
actctccctacttaactgacagtta

SEQ ID NO: 95039 - DNA, 25 bp, Rattus norvegicus
actctccgaaggaaggtctggtatt

SEQ ID NO: 95040 - DNA, 25 bp, Rattus norvegicus
actctccgaaggtaggtctggtatt

SEQ ID NO: 95041 - DNA, 25 bp, Rattus norvegicus
actctccgagaccaagatggctgtt

SEQ ID NO: 95042 - DNA, 25 bp, Rattus norvegicus
actctccgagacgaagatggctgtt

SEQ ID NO: 95043 - DNA, 25 bp, Rattus norvegicus
actctccgcggcaaggcggcagctt

SEQ ID NO: 95044 - DNA, 25 bp, Rattus norvegicus
actctccgcggctaggcggcagctt

SEQ ID NO: 95045 - DNA, 25 bp, Rattus norvegicus
actctccgggagatacttggttagt

SEQ ID NO: 95046 - DNA, 25 bp, Rattus norvegicus
actctccgggagttacttggttagt

SEQ ID NO: 95047 - DNA, 25 bp, Rattus norvegicus
actctcctagagattctggacggga

SEQ ID NO: 95048 - DNA, 25 bp, Rattus norvegicus
actctcctagagtttctggacggga

SEQ ID NO: 95049 - DNA, 25 bp, Rattus norvegicus
actctcctccttcttggtaagtgca

SEQ ID NO: 95050 - DNA, 25 bp, Rattus norvegicus
actctcctccttgttggtaagtgca

SEQ ID NO: 95051 - DNA, 25 bp, Rattus norvegicus
actctcctcggaaggtgaaatttaa

SEQ ID NO: 95052 - DNA, 25 bp, Rattus norvegicus
actctcctcggatggtgaaatttaa

SEQ ID NO: 95053 - DNA, 25 bp, Rattus norvegicus
actctcctgcctagaatcctaataa

SEQ ID NO: 95054 - DNA, 25 bp, Rattus norvegicus
actctcctgccttgaatcctaataa

SEQ ID NO: 95055 - DNA, 25 bp, Rattus norvegicus
actctcctgtaaacatctgtaccta

SEQ ID NO: 95056 - DNA, 25 bp, Rattus norvegicus
actctcctgtaatcatctgtaccta

SEQ ID NO: 95057 - DNA, 25 bp, Rattus norvegicus
actctccttccaaagagttgccagg

SEQ ID NO: 95058 - DNA, 25 bp, Rattus norvegicus
actctccttccatagagttgccagg

SEQ ID NO: 95059 - DNA, 25 bp, Rattus norvegicus
actctccttgttcacctcttagtat

SEQ ID NO: 95060 - DNA, 25 bp, Rattus norvegicus
actctccttgttgacctcttagtat

SEQ ID NO: 95061 - DNA, 25 bp, Rattus norvegicus
actctcgagagccactgactaggat

SEQ ID NO: 95062 - DNA, 25 bp, Rattus norvegicus
actctcgagagcgactgactaggat

SEQ ID NO: 95063 - DNA, 25 bp, Rattus norvegicus
actctcgattctatatttgcaggca

SEQ ID NO: 95064 - DNA, 25 bp, Rattus norvegicus
actctcgattctttatttgcaggca

SEQ ID NO: 95065 - DNA, 25 bp, Rattus norvegicus
actctcggcaatactgaacgccaag

SEQ ID NO: 95066 - DNA, 25 bp, Rattus norvegicus
actctcggcaattctgaacgccaag

SEQ ID NO: 95067 - DNA, 25 bp, Rattus norvegicus
actctcggcctcattgctatgcaat

SEQ ID NO: 95068 - DNA, 25 bp, Rattus norvegicus
actctcggcctctttgctatgcaat

SEQ ID NO: 95069 - DNA, 25 bp, Rattus norvegicus
actctcgtaggacgcctctggtgga

SEQ ID NO: 95070 - DNA, 25 bp, Rattus norvegicus
actctcgtaggaggcctctggtgga

SEQ ID NO: 95071 - DNA, 25 bp, Rattus norvegicus
actctcgtatgtcgcatgtgtgtgc

SEQ ID NO: 95072 - DNA, 25 bp, Rattus norvegicus
actctcgtatgtggcatgtgtgtgc

SEQ ID NO: 95073 - DNA, 25 bp, Rattus norvegicus
actctcgtgataatttatgggctta

SEQ ID NO: 95074 - DNA, 25 bp, Rattus norvegicus
actctcgtgatattttatgggctta

SEQ ID NO: 95075 - DNA, 25 bp, Rattus norvegicus
actctcgtttagcatttcttttcat

SEQ ID NO: 95076 - DNA, 25 bp, Rattus norvegicus
actctcgtttaggatttcttttcat

SEQ ID NO: 95077 - DNA, 25 bp, Rattus norvegicus
actctctacactcactgtttctttg

SEQ ID NO: 95078 - DNA, 25 bp, Rattus norvegicus
actctctacactgactgtttctttg

SEQ ID NO: 95079 - DNA, 25 bp, Rattus norvegicus
actctctacgccacaggaactggta

SEQ ID NO: 95080 - DNA, 25 bp, Rattus norvegicus
actctctacgcctcaggaactggta

SEQ ID NO: 95081 - DNA, 25 bp, Rattus norvegicus
actctctatactatgttgcttgctc

SEQ ID NO: 95082 - DNA, 25 bp, Rattus norvegicus
actctctatactttgttgcttgctc

SEQ ID NO: 95083 - DNA, 25 bp, Rattus norvegicus
actctctatagcatcaagtctgcct

SEQ ID NO: 95084 - DNA, 25 bp, Rattus norvegicus
actctctatagcttcaagtctgcct

SEQ ID NO: 95085 - DNA, 25 bp, Rattus norvegicus
actctctcaagacccacatcaaggg

SEQ ID NO: 95086 - DNA, 25 bp, Rattus norvegicus
actctctcaagagccacatcaaggg

SEQ ID NO: 95087 - DNA, 25 bp, Rattus norvegicus
actctctcagagacttcaagtttga

SEQ ID NO: 95088 - DNA, 25 bp, Rattus norvegicus
actctctcagagtcttcaagtttga

SEQ ID NO: 95089 - DNA, 25 bp, Rattus norvegicus
actctctcatatatgtttttgcccc

SEQ ID NO: 95090 - DNA, 25 bp, Rattus norvegicus
actctctcatatttgtttttgcccc

SEQ ID NO: 95091 - DNA, 25 bp, Rattus norvegicus
actctctcattgctgtctggtatgg

SEQ ID NO: 95092 - DNA, 25 bp, Rattus norvegicus
actctctcattggtgtctggtatgg

SEQ ID NO: 95093 - DNA, 25 bp, Rattus norvegicus
actctctccaggcacatatattgaa

SEQ ID NO: 95094 - DNA, 25 bp, Rattus norvegicus
actctctccagggacatatattgaa

SEQ ID NO: 95095 - DNA, 25 bp, Rattus norvegicus
actctctcccagctgagcaacaatg

SEQ ID NO: 95096 - DNA, 25 bp, Rattus norvegicus
actctctcccaggtgagcaacaatg

SEQ ID NO: 95097 - DNA, 25 bp, Rattus norvegicus
actctctcccttctattgggacaag

SEQ ID NO: 95098 - DNA, 25 bp, Rattus norvegicus
actctctcccttgtattgggacaag

SEQ ID NO: 95099 - DNA, 25 bp, Rattus norvegicus
actctctcctggagatggacttgta

SEQ ID NO: 95100 - DNA, 25 bp, Rattus norvegicus
actctctcctggtgatggacttgta

SEQ ID NO: 95101 - DNA, 25 bp, Rattus norvegicus
actctctctccacatttatttgctt

SEQ ID NO: 95102 - DNA, 25 bp, Rattus norvegicus
actctctctccagatttatttgctt

SEQ ID NO: 95103 - DNA, 25 bp, Rattus norvegicus
actctctctctcaatgtattcagca

SEQ ID NO: 95104 - DNA, 25 bp, Rattus norvegicus
actctctctctcaattagcatttca

SEQ ID NO: 95105 - DNA, 25 bp, Rattus norvegicus
actctctctctctatgtattcagca

SEQ ID NO: 95106 - DNA, 25 bp, Rattus norvegicus
actctctctctctattagcatttca

SEQ ID NO: 95107 - DNA, 25 bp, Rattus norvegicus
actctctctcttcttctgaatggtg

SEQ ID NO: 95108 - DNA, 25 bp, Rattus norvegicus
actctctctcttgttctgaatggtg

SEQ ID NO: 95109 - DNA, 25 bp, Rattus norvegicus
actctctgagcactttctcttgctg

SEQ ID NO: 95110 - DNA, 25 bp, Rattus norvegicus
actctctgagcagtttctcttgctg

SEQ ID NO: 95111 - DNA, 25 bp, Rattus norvegicus
actctctgatccctgctgaataaga

SEQ ID NO: 95112 - DNA, 25 bp, Rattus norvegicus
actctctgatccgtgctgaataaga

SEQ ID NO: 95113 - DNA, 25 bp, Rattus norvegicus
actctctgattcctttggcattcat

SEQ ID NO: 95114 - DNA, 25 bp, Rattus norvegicus
actctctgattcgtttggcattcat

SEQ ID NO: 95115 - DNA, 25 bp, Rattus norvegicus
actctctgcctgaaggatgtactgt

SEQ ID NO: 95116 - DNA, 25 bp, Rattus norvegicus
actctctgcctgtaggatgtactgt

SEQ ID NO: 95117 - DNA, 25 bp, Rattus norvegicus
actctctgccttactttttgataca

SEQ ID NO: 95118 - DNA, 25 bp, Rattus norvegicus
actctctgcctttctttttgataca

SEQ ID NO: 95119 - DNA, 25 bp, Rattus norvegicus
actctctgcgcacaggcatgcggga

SEQ ID NO: 95120 - DNA, 25 bp, Rattus norvegicus
actctctgcgcagaggcatgcggga

SEQ ID NO: 95121 - DNA, 25 bp, Rattus norvegicus
actctctgcttgagtgggctagaat

SEQ ID NO: 95122 - DNA, 25 bp, Rattus norvegicus
actctctgcttgtgtgggctagaat

SEQ ID NO: 95123 - DNA, 25 bp, Rattus norvegicus
actctctgggcacctcctgagatgg

SEQ ID NO: 95124 - DNA, 25 bp, Rattus norvegicus
actctctgggcagctcctgagatgg

SEQ ID NO: 95125 - DNA, 25 bp, Rattus norvegicus
actctctggtctaaacttactctaa

SEQ ID NO: 95126 - DNA, 25 bp, Rattus norvegicus
actctctggtcttaacttactctaa

SEQ ID NO: 95127 - DNA, 25 bp, Rattus norvegicus
actctctgtgggaattttcctctgc

SEQ ID NO: 95128 - DNA, 25 bp, Rattus norvegicus
actctctgtgggtattttcctctgc

SEQ ID NO: 95129 - DNA, 25 bp, Rattus norvegicus
actctctgttatctgtggcttctag

SEQ ID NO: 95130 - DNA, 25 bp, Rattus norvegicus
actctctgttatgtgtggcttctag

SEQ ID NO: 95131 - DNA, 25 bp, Rattus norvegicus
actctctgttgacttgtgtgggttg

SEQ ID NO: 95132 - DNA, 25 bp, Rattus norvegicus
actctctgttgagttgtgtgggttg

SEQ ID NO: 95133 - DNA, 25 bp, Rattus norvegicus
actctcttcttcattggcaattttc

SEQ ID NO: 95134 - DNA, 25 bp, Rattus norvegicus
actctcttcttctttggcaattttc

SEQ ID NO: 95135 - DNA, 25 bp, Rattus norvegicus
actctcttggttcttggtcagctgc

SEQ ID NO: 95136 - DNA, 25 bp, Rattus norvegicus
actctcttggttgttggtcagctgc

SEQ ID NO: 95137 - DNA, 25 bp, Rattus norvegicus
actctctttctgcttggtggaaatt

SEQ ID NO: 95138 - DNA, 25 bp, Rattus norvegicus
actctctttctggttggtggaaatt

SEQ ID NO: 95139 - DNA, 25 bp, Rattus norvegicus
actctctttggtatcatcactccta

SEQ ID NO: 95140 - DNA, 25 bp, Rattus norvegicus
actctctttggtttcatcactccta

SEQ ID NO: 95141 - DNA, 25 bp, Rattus norvegicus
actctcttttacctgctttgtgcga

SEQ ID NO: 95142 - DNA, 25 bp, Rattus norvegicus
actctcttttacgtgctttgtgcga

SEQ ID NO: 95143 - DNA, 25 bp, Rattus norvegicus
actctcttttgactcctcagagttg

SEQ ID NO: 95144 - DNA, 25 bp, Rattus norvegicus
actctcttttgagtcctcagagttg

SEQ ID NO: 95145 - DNA, 25 bp, Rattus norvegicus
actctgaaaggcaggtgtttacagt

SEQ ID NO: 95146 - DNA, 25 bp, Rattus norvegicus
actctgaaaggctggtgtttacagt

SEQ ID NO: 95147 - DNA, 25 bp, Rattus norvegicus
actctgaactggcacaactctgtag

SEQ ID NO: 95148 - DNA, 25 bp, Rattus norvegicus
actctgaactgggacaactctgtag

SEQ ID NO: 95149 - DNA, 25 bp, Rattus norvegicus
actctgaaggctagtgctgcgtcta

SEQ ID NO: 95150 - DNA, 25 bp, Rattus norvegicus
actctgaaggcttgtgctgcgtcta

SEQ ID NO: 95151 - DNA, 25 bp, Rattus norvegicus
actctgaagggcatggcagttctgt

SEQ ID NO: 95152 - DNA, 25 bp, Rattus norvegicus
actctgaagggcttggcagttctgt

SEQ ID NO: 95153 - DNA, 25 bp, Rattus norvegicus
actctgaagttcagctgttcctctc

SEQ ID NO: 95154 - DNA, 25 bp, Rattus norvegicus
actctgaagttctgctgttcctctc

SEQ ID NO: 95155 - DNA, 25 bp, Rattus norvegicus
actctgaataaaaaggtgttgccac

SEQ ID NO: 95156 - DNA, 25 bp, Rattus norvegicus
actctgaataaataggtgttgccac

SEQ ID NO: 95157 - DNA, 25 bp, Rattus norvegicus
actctgacacctctctggattattt

SEQ ID NO: 95158 - DNA, 25 bp, Rattus norvegicus
actctgacacctgtctggattattt

SEQ ID NO: 95159 - DNA, 25 bp, Rattus norvegicus
actctgacagaccttatccatttcc

SEQ ID NO: 95160 - DNA, 25 bp, Rattus norvegicus
actctgacagacgttatccatttcc

SEQ ID NO: 95161 - DNA, 25 bp, Rattus norvegicus
actctgaccagtctttgagctgcca

SEQ ID NO: 95162 - DNA, 25 bp, Rattus norvegicus
actctgaccagtgtttgagctgcca

SEQ ID NO: 95163 - DNA, 25 bp, Rattus norvegicus
actctgaccatgactctgtgggtgg

SEQ ID NO: 95164 - DNA, 25 bp, Rattus norvegicus
actctgaccatgtctctgtgggtgg

SEQ ID NO: 95165 - DNA, 25 bp, Rattus norvegicus
actctgactgatactgacaatgaaa

SEQ ID NO: 95166 - DNA, 25 bp, Rattus norvegicus
actctgactgattctgacaatgaaa

SEQ ID NO: 95167 - DNA, 25 bp, Rattus norvegicus
actctgagaggcatgtctggtttct

SEQ ID NO: 95168 - DNA, 25 bp, Rattus norvegicus
actctgagaggcttgtctggtttct

SEQ ID NO: 95169 - DNA, 25 bp, Rattus norvegicus
actctgagctgtagtggcgtctagc

SEQ ID NO: 95170 - DNA, 25 bp, Rattus norvegicus
actctgagctgttgtggcgtctagc

SEQ ID NO: 95171 - DNA, 25 bp, Rattus norvegicus
actctgaggcatatgatgaacttgt

SEQ ID NO: 95172 - DNA, 25 bp, Rattus norvegicus
actctgaggcatttgatgaacttgt

SEQ ID NO: 95173 - DNA, 25 bp, Rattus norvegicus
actctgagggtgacatcacggttca

SEQ ID NO: 95174 - DNA, 25 bp, Rattus norvegicus
actctgagggtgtcatcacggttca

SEQ ID NO: 95175 - DNA, 25 bp, Rattus norvegicus
actctgagggttctcaccttgttaa

SEQ ID NO: 95176 - DNA, 25 bp, Rattus norvegicus
actctgagggttgtcaccttgttaa

SEQ ID NO: 95177 - DNA, 25 bp, Rattus norvegicus
actctgaggtaccacctaggttgtc

SEQ ID NO: 95178 - DNA, 25 bp, Rattus norvegicus
actctgaggtacgacctaggttgtc

SEQ ID NO: 95179 - DNA, 25 bp, Rattus norvegicus
actctgaggtgtctgtcctccagtg

SEQ ID NO: 95180 - DNA, 25 bp, Rattus norvegicus
actctgaggtgtgtgtcctccagtg

SEQ ID NO: 95181 - DNA, 25 bp, Rattus norvegicus
actctgagtattacccttctcttgg

SEQ ID NO: 95182 - DNA, 25 bp, Rattus norvegicus
actctgagtatttcccttctcttgg

SEQ ID NO: 95183 - DNA, 25 bp, Rattus norvegicus
actctgagttctatgggcgttttgt

SEQ ID NO: 95184 - DNA, 25 bp, Rattus norvegicus
actctgagttctttgggcgttttgt

SEQ ID NO: 95185 - DNA, 25 bp, Rattus norvegicus
actctgatagatctgaccgtcttgc

SEQ ID NO: 95186 - DNA, 25 bp, Rattus norvegicus
actctgatagatgtgaccgtcttgc

SEQ ID NO: 95187 - DNA, 25 bp, Rattus norvegicus
actctgatggtgctttcgctttctc

SEQ ID NO: 95188 - DNA, 25 bp, Rattus norvegicus
actctgatggtggtttcgctttctc

SEQ ID NO: 95189 - DNA, 25 bp, Rattus norvegicus
actctgattgcgatgccaccttgtg

SEQ ID NO: 95190 - DNA, 25 bp, Rattus norvegicus
actctgattgcgttgccaccttgtg

SEQ ID NO: 95191 - DNA, 25 bp, Rattus norvegicus
actctgcaaacaacgcggtggtagg

SEQ ID NO: 95192 - DNA, 25 bp, Rattus norvegicus
actctgcaaacatcgcggtggtagg

SEQ ID NO: 95193 - DNA, 25 bp, Rattus norvegicus
actctgcacgctctcagtggctcag

SEQ ID NO: 95194 - DNA, 25 bp, Rattus norvegicus
actctgcacgctgtcagtggctcag

SEQ ID NO: 95195 - DNA, 25 bp, Rattus norvegicus
actctgcagaagaggctggtcacaa

SEQ ID NO: 95196 - DNA, 25 bp, Rattus norvegicus
actctgcagaagtggctggtcacaa

SEQ ID NO: 95197 - DNA, 25 bp, Rattus norvegicus
actctgcagagaccctttgatgtgt

SEQ ID NO: 95198 - DNA, 25 bp, Rattus norvegicus
actctgcagagagcctttgatgtgt

SEQ ID NO: 95199 - DNA, 25 bp, Rattus norvegicus
actctgcagagtctgactttttaca

SEQ ID NO: 95200 - DNA, 25 bp, Rattus norvegicus
actctgcagagtgtgactttttaca

SEQ ID NO: 95201 - DNA, 25 bp, Rattus norvegicus
actctgcagcctaagctaactgtga

SEQ ID NO: 95202 - DNA, 25 bp, Rattus norvegicus
actctgcagccttagctaactgtga

SEQ ID NO: 95203 - DNA, 25 bp, Rattus norvegicus
actctgcatactaggcttatggcaa

SEQ ID NO: 95204 - DNA, 25 bp, Rattus norvegicus
actctgcatacttggcttatggcaa

SEQ ID NO: 95205 - DNA, 25 bp, Rattus norvegicus
actctgcatcagacgcctcatgcaa

SEQ ID NO: 95206 - DNA, 25 bp, Rattus norvegicus
actctgcatcagtcgcctcatgcaa

SEQ ID NO: 95207 - DNA, 25 bp, Rattus norvegicus
actctgcatgatctgtgtggcaccc

SEQ ID NO: 95208 - DNA, 25 bp, Rattus norvegicus
actctgcatgatgtgtgtggcaccc

SEQ ID NO: 95209 - DNA, 25 bp, Rattus norvegicus
actctgcatgctacttcacgagaac

SEQ ID NO: 95210 - DNA, 25 bp, Rattus norvegicus
actctgcatgcttcttcacgagaac

SEQ ID NO: 95211 - DNA, 25 bp, Rattus norvegicus
actctgcatgtgctgtcctgtggag

SEQ ID NO: 95212 - DNA, 25 bp, Rattus norvegicus
actctgcatgtggtgtcctgtggag

SEQ ID NO: 95213 - DNA, 25 bp, Rattus norvegicus
actctgcattacctcttcttcaggc

SEQ ID NO: 95214 - DNA, 25 bp, Rattus norvegicus
actctgcattacgtcttcttcaggc

SEQ ID NO: 95215 - DNA, 25 bp, Rattus norvegicus
actctgcattgtccccaaaacattg

SEQ ID NO: 95216 - DNA, 25 bp, Rattus norvegicus
actctgcattgtgcccaaaacattg

SEQ ID NO: 95217 - DNA, 25 bp, Rattus norvegicus
actctgccacttcctacatggataa

SEQ ID NO: 95218 - DNA, 25 bp, Rattus norvegicus
actctgccacttgctacatggataa

SEQ ID NO: 95219 - DNA, 25 bp, Rattus norvegicus
actctgccctttctcaggacagaaa

SEQ ID NO: 95220 - DNA, 25 bp, Rattus norvegicus
actctgccctttgtcaggacagaaa

SEQ ID NO: 95221 - DNA, 25 bp, Rattus norvegicus
actctgcctctgagtgtcccgatct

SEQ ID NO: 95222 - DNA, 25 bp, Rattus norvegicus
actctgcctctgtgtgtcccgatct

SEQ ID NO: 95223 - DNA, 25 bp, Rattus norvegicus
actctgcctgaaaatgcccattgcc

SEQ ID NO: 95224 - DNA, 25 bp, Rattus norvegicus
actctgcctgaatatgcccattgcc

SEQ ID NO: 95225 - DNA, 25 bp, Rattus norvegicus
actctgcctgctagcagtctgtctg

SEQ ID NO: 95226 - DNA, 25 bp, Rattus norvegicus
actctgcctgcttgcagtctgtctg

SEQ ID NO: 95227 - DNA, 25 bp, Rattus norvegicus
actctgcctggcatgatttgggttc

SEQ ID NO: 95228 - DNA, 25 bp, Rattus norvegicus
actctgcctggcctgtagtcagata

SEQ ID NO: 95229 - DNA, 25 bp, Rattus norvegicus
actctgcctggcgtgtagtcagata

SEQ ID NO: 95230 - DNA, 25 bp, Rattus norvegicus
actctgcctggcttgatttgggttc

SEQ ID NO: 95231 - DNA, 25 bp, Rattus norvegicus
actctgccttttcctgttctagaat

SEQ ID NO: 95232 - DNA, 25 bp, Rattus norvegicus
actctgccttttgctgttctagaat

SEQ ID NO: 95233 - DNA, 25 bp, Rattus norvegicus
actctgcgtttactacgtgtggatt

SEQ ID NO: 95234 - DNA, 25 bp, Rattus norvegicus
actctgcgtttagtacgtgtggatt

SEQ ID NO: 95235 - DNA, 25 bp, Rattus norvegicus
actctgctatagctgctgtgttatt

SEQ ID NO: 95236 - DNA, 25 bp, Rattus norvegicus
actctgctataggtgctgtgttatt

SEQ ID NO: 95237 - DNA, 25 bp, Rattus norvegicus
actctgctcattagtctccaggaag

SEQ ID NO: 95238 - DNA, 25 bp, Rattus norvegicus
actctgctcatttgtctccaggaag

SEQ ID NO: 95239 - DNA, 25 bp, Rattus norvegicus
actctgctccctattgatcacagaa

SEQ ID NO: 95240 - DNA, 25 bp, Rattus norvegicus
actctgctcccttttgatcacagaa

SEQ ID NO: 95241 - DNA, 25 bp, Rattus norvegicus
actctgctcgtgctggtgctgcgca

SEQ ID NO: 95242 - DNA, 25 bp, Rattus norvegicus
actctgctcgtggtggtgctgcgca

SEQ ID NO: 95243 - DNA, 25 bp, Rattus norvegicus
actctgctctctcatgtgctgaaaa

SEQ ID NO: 95244 - DNA, 25 bp, Rattus norvegicus
actctgctctctgatgtgctgaaaa

SEQ ID NO: 95245 - DNA, 25 bp, Rattus norvegicus
actctgctgcttcatgtgactttaa

SEQ ID NO: 95246 - DNA, 25 bp, Rattus norvegicus
actctgctgcttgatgtgactttaa

SEQ ID NO: 95247 - DNA, 25 bp, Rattus norvegicus
actctgctgggcacaggctgtagcg

SEQ ID NO: 95248 - DNA, 25 bp, Rattus norvegicus
actctgctgggctcaggctgtagcg

SEQ ID NO: 95249 - DNA, 25 bp, Rattus norvegicus
actctgctgtcaacgcagctgtgaa

SEQ ID NO: 95250 - DNA, 25 bp, Rattus norvegicus
actctgctgtcatcgcagctgtgaa

SEQ ID NO: 95251 - DNA, 25 bp, Rattus norvegicus
actctgctgtccacttctaattaaa

SEQ ID NO: 95252 - DNA, 25 bp, Rattus norvegicus
actctgctgtcctcttctaattaaa

SEQ ID NO: 95253 - DNA, 25 bp, Rattus norvegicus
actctgcttcaaaacctgaactctt

SEQ ID NO: 95254 - DNA, 25 bp, Rattus norvegicus
actctgcttcaatacctgaactctt

SEQ ID NO: 95255 - DNA, 25 bp, Rattus norvegicus
actctgcttcagcttcaggtgctgt

SEQ ID NO: 95256 - DNA, 25 bp, Rattus norvegicus
actctgcttcaggttcaggtgctgt

SEQ ID NO: 95257 - DNA, 25 bp, Rattus norvegicus
actctgcttcataattctaacgtct

SEQ ID NO: 95258 - DNA, 25 bp, Rattus norvegicus
actctgcttcattattctaacgtct

SEQ ID NO: 95259 - DNA, 25 bp, Rattus norvegicus
actctgcttcctatctattgttgct

SEQ ID NO: 95260 - DNA, 25 bp, Rattus norvegicus
actctgcttcctttctattgttgct

SEQ ID NO: 95261 - DNA, 25 bp, Rattus norvegicus
actctgctttgtcaatttgccatcc

SEQ ID NO: 95262 - DNA, 25 bp, Rattus norvegicus
actctgctttgtgaatttgccatcc

SEQ ID NO: 95263 - DNA, 25 bp, Rattus norvegicus
actctggaaacaatctgtccccatt

SEQ ID NO: 95264 - DNA, 25 bp, Rattus norvegicus
actctggaaacattctgtccccatt

SEQ ID NO: 95265 - DNA, 25 bp, Rattus norvegicus
actctggaaattatgcctctgtgaa

SEQ ID NO: 95266 - DNA, 25 bp, Rattus norvegicus
actctggaaattttgcctctgtgaa

SEQ ID NO: 95267 - DNA, 25 bp, Rattus norvegicus
actctggactctatcgtgtgcgctc

SEQ ID NO: 95268 - DNA, 25 bp, Rattus norvegicus
actctggactctttcgtgtgcgctc

SEQ ID NO: 95269 - DNA, 25 bp, Rattus norvegicus
actctggactttcgaattacctgtt

SEQ ID NO: 95270 - DNA, 25 bp, Rattus norvegicus
actctggactttggaattacctgtt

SEQ ID NO: 95271 - DNA, 25 bp, Rattus norvegicus
actctggagcccatgatgactgatt

SEQ ID NO: 95272 - DNA, 25 bp, Rattus norvegicus
actctggagcccttgatgactgatt

SEQ ID NO: 95273 - DNA, 25 bp, Rattus norvegicus
actctggaggtacctggccgcatgc

SEQ ID NO: 95274 - DNA, 25 bp, Rattus norvegicus
actctggaggtagctggccgcatgc

SEQ ID NO: 95275 - DNA, 25 bp, Rattus norvegicus
actctggatgtaaccctgaactctt

SEQ ID NO: 95276 - DNA, 25 bp, Rattus norvegicus
actctggatgtatccctgaactctt

SEQ ID NO: 95277 - DNA, 25 bp, Rattus norvegicus
actctggattcaagaccggtcgcta

SEQ ID NO: 95278 - DNA, 25 bp, Rattus norvegicus
actctggattcatgaccggtcgcta

SEQ ID NO: 95279 - DNA, 25 bp, Rattus norvegicus
actctggcactcctatcatggaaaa

SEQ ID NO: 95280 - DNA, 25 bp, Rattus norvegicus
actctggcactcgtatcatggaaaa

SEQ ID NO: 95281 - DNA, 25 bp, Rattus norvegicus
actctggcagcgatgacttcactta

SEQ ID NO: 95282 - DNA, 25 bp, Rattus norvegicus
actctggcagcgttgacttcactta

SEQ ID NO: 95283 - DNA, 25 bp, Rattus norvegicus
actctggccaagctgacgcggtcca

SEQ ID NO: 95284 - DNA, 25 bp, Rattus norvegicus
actctggccaaggtgacgcggtcca

SEQ ID NO: 95285 - DNA, 25 bp, Rattus norvegicus
actctggccagtcttcagtgtctaa

SEQ ID NO: 95286 - DNA, 25 bp, Rattus norvegicus
actctggccagtgttcagtgtctaa

SEQ ID NO: 95287 - DNA, 25 bp, Rattus norvegicus
actctggccgctcgagatgatttgg

SEQ ID NO: 95288 - DNA, 25 bp, Rattus norvegicus
actctggccgctggagatgatttgg

SEQ ID NO: 95289 - DNA, 25 bp, Rattus norvegicus
actctggctcccataggtccctgtg

SEQ ID NO: 95290 - DNA, 25 bp, Rattus norvegicus
actctggctcccttaggtccctgtg

SEQ ID NO: 95291 - DNA, 25 bp, Rattus norvegicus
actctggctgagctacctgaacatg

SEQ ID NO: 95292 - DNA, 25 bp, Rattus norvegicus
actctggctgaggtacctgaacatg

SEQ ID NO: 95293 - DNA, 25 bp, Rattus norvegicus
actctggctgctagttctgtggtcc

SEQ ID NO: 95294 - DNA, 25 bp, Rattus norvegicus
actctggctgcttgttctgtggtcc

SEQ ID NO: 95295 - DNA, 25 bp, Rattus norvegicus
actctggctgggaatcatgtacaag

SEQ ID NO: 95296 - DNA, 25 bp, Rattus norvegicus
actctggctgggtatcatgtacaag

SEQ ID NO: 95297 - DNA, 25 bp, Rattus norvegicus
actctggcttctcttcacgactgga

SEQ ID NO: 95298 - DNA, 25 bp, Rattus norvegicus
actctggcttctgttcacgactgga

SEQ ID NO: 95299 - DNA, 25 bp, Rattus norvegicus
actctgggagtactagggccacctg

SEQ ID NO: 95300 - DNA, 25 bp, Rattus norvegicus
actctgggagtagtagggccacctg

SEQ ID NO: 95301 - DNA, 25 bp, Rattus norvegicus
actctgggatttagattgtcctaaa

SEQ ID NO: 95302 - DNA, 25 bp, Rattus norvegicus
actctgggattttgattgtcctaaa

SEQ ID NO: 95303 - DNA, 25 bp, Rattus norvegicus
actctgggcaaaccctgtcacaagg

SEQ ID NO: 95304 - DNA, 25 bp, Rattus norvegicus
actctgggcaaagcctgtcacaagg

SEQ ID NO: 95305 - DNA, 25 bp, Rattus norvegicus
actctgggcgagacctgataaaaca

SEQ ID NO: 95306 - DNA, 25 bp, Rattus norvegicus
actctgggcgagtcctgataaaaca

SEQ ID NO: 95307 - DNA, 25 bp, Rattus norvegicus
actctgggctgaccgaccatcaggg

SEQ ID NO: 95308 - DNA, 25 bp, Rattus norvegicus
actctgggctgagcgaccatcaggg

SEQ ID NO: 95309 - DNA, 25 bp, Rattus norvegicus
actctgggtaccagcacacctgtga

SEQ ID NO: 95310 - DNA, 25 bp, Rattus norvegicus
actctgggtacctgcacacctgtga

SEQ ID NO: 95311 - DNA, 25 bp, Rattus norvegicus
actctgggtctgcactgtggttttt

SEQ ID NO: 95312 - DNA, 25 bp, Rattus norvegicus
actctgggtctggactgtggttttt

SEQ ID NO: 95313 - DNA, 25 bp, Rattus norvegicus
actctgggttggactgggtcttatt

SEQ ID NO: 95314 - DNA, 25 bp, Rattus norvegicus
actctgggttggtctgggtcttatt

SEQ ID NO: 95315 - DNA, 25 bp, Rattus norvegicus
actctggtacttaggtcggtgtctt

SEQ ID NO: 95316 - DNA, 25 bp, Rattus norvegicus
actctggtactttggtcggtgtctt

SEQ ID NO: 95317 - DNA, 25 bp, Rattus norvegicus
actctggtagagacattttctcaac

SEQ ID NO: 95318 - DNA, 25 bp, Rattus norvegicus
actctggtagagtcattttctcaac

SEQ ID NO: 95319 - DNA, 25 bp, Rattus norvegicus
actctggtcatactaactgttttat

SEQ ID NO: 95320 - DNA, 25 bp, Rattus norvegicus
actctggtcatagtaactgttttat

SEQ ID NO: 95321 - DNA, 25 bp, Rattus norvegicus
actctggtgcataaactgaccggaa

SEQ ID NO: 95322 - DNA, 25 bp, Rattus norvegicus
actctggtgcattaactgaccggaa

SEQ ID NO: 95323 - DNA, 25 bp, Rattus norvegicus
actctggtgtcgagtgtcgctacac

SEQ ID NO: 95324 - DNA, 25 bp, Rattus norvegicus
actctggtgtcgtgtgtcgctacac

SEQ ID NO: 95325 - DNA, 25 bp, Rattus norvegicus
actctggtgtgcacattgggatctc

SEQ ID NO: 95326 - DNA, 25 bp, Rattus norvegicus
actctggtgtgctcattgggatctc

SEQ ID NO: 95327 - DNA, 25 bp, Rattus norvegicus
actctggtgtgtcttactttctttg

SEQ ID NO: 95328 - DNA, 25 bp, Rattus norvegicus
actctggtgtgtgttactttctttg

SEQ ID NO: 95329 - DNA, 25 bp, Rattus norvegicus
actctggttattagccgtgtggccc

SEQ ID NO: 95330 - DNA, 25 bp, Rattus norvegicus
actctggttatttgccgtgtggccc

SEQ ID NO: 95331 - DNA, 25 bp, Rattus norvegicus
actctggttccccaagaagactgtt

SEQ ID NO: 95332 - DNA, 25 bp, Rattus norvegicus
actctggttcccgaagaagactgtt

SEQ ID NO: 95333 - DNA, 25 bp, Rattus norvegicus
actctgtaagccatctgtcagtcct

SEQ ID NO: 95334 - DNA, 25 bp, Rattus norvegicus
actctgtaagccttctgtcagtcct

SEQ ID NO: 95335 - DNA, 25 bp, Rattus norvegicus
actctgtacaccaggctgggcttga

SEQ ID NO: 95336 - DNA, 25 bp, Rattus norvegicus
actctgtacacctggctgggcttga

SEQ ID NO: 95337 - DNA, 25 bp, Rattus norvegicus
actctgtacagtaacttgtgtcatc

SEQ ID NO: 95338 - DNA, 25 bp, Rattus norvegicus
actctgtacagttacttgtgtcatc

SEQ ID NO: 95339 - DNA, 25 bp, Rattus norvegicus
actctgtacccaaggactgtcagaa

SEQ ID NO: 95340 - DNA, 25 bp, Rattus norvegicus
actctgtacccatggactgtcagaa

SEQ ID NO: 95341 - DNA, 25 bp, Rattus norvegicus
actctgtacgtcatgttgcttctca

SEQ ID NO: 95342 - DNA, 25 bp, Rattus norvegicus
actctgtacgtcttgttgcttctca

SEQ ID NO: 95343 - DNA, 25 bp, Rattus norvegicus
actctgtagacaaaactgacctcaa

SEQ ID NO: 95344 - DNA, 25 bp, Rattus norvegicus
actctgtagacataactgacctcaa

SEQ ID NO: 95345 - DNA, 25 bp, Rattus norvegicus
actctgtaggccaccaaggagcatc

SEQ ID NO: 95346 - DNA, 25 bp, Rattus norvegicus
actctgtaggcctccaaggagcatc

SEQ ID NO: 95347 - DNA, 25 bp, Rattus norvegicus
actctgtatgtcatgtgcaggccgt

SEQ ID NO: 95348 - DNA, 25 bp, Rattus norvegicus
actctgtatgtcttgtgcaggccgt

SEQ ID NO: 95349 - DNA, 25 bp, Rattus norvegicus
actctgtcacttacaccacaaaata

SEQ ID NO: 95350 - DNA, 25 bp, Rattus norvegicus
actctgtcactttcaccacaaaata

SEQ ID NO: 95351 - DNA, 25 bp, Rattus norvegicus
actctgtcagtgcttccacatggga

SEQ ID NO: 95352 - DNA, 25 bp, Rattus norvegicus
actctgtcagtggttccacatggga

SEQ ID NO: 95353 - DNA, 25 bp, Rattus norvegicus
actctgtcatgtcctgctgatcgaa

SEQ ID NO: 95354 - DNA, 25 bp, Rattus norvegicus
actctgtcatgtgctgctgatcgaa

SEQ ID NO: 95355 - DNA, 25 bp, Rattus norvegicus
actctgtccaatagatatcaccctt

SEQ ID NO: 95356 - DNA, 25 bp, Rattus norvegicus
actctgtccaattgatatcaccctt

SEQ ID NO: 95357 - DNA, 25 bp, Rattus norvegicus
actctgtccatgatttagctgtgca

SEQ ID NO: 95358 - DNA, 25 bp, Rattus norvegicus
actctgtccatgttttagctgtgca

SEQ ID NO: 95359 - DNA, 25 bp, Rattus norvegicus
actctgtccgagactgatatcttac

SEQ ID NO: 95360 - DNA, 25 bp, Rattus norvegicus
actctgtccgagtctgatatcttac

SEQ ID NO: 95361 - DNA, 25 bp, Rattus norvegicus
actctgtcctcacttctagtattga

SEQ ID NO: 95362 - DNA, 25 bp, Rattus norvegicus
actctgtcctcagttctagtattga

SEQ ID NO: 95363 - DNA, 25 bp, Rattus norvegicus
actctgtcctccaagggcatgggaa

SEQ ID NO: 95364 - DNA, 25 bp, Rattus norvegicus
actctgtcctcctagggcatgggaa

SEQ ID NO: 95365 - DNA, 25 bp, Rattus norvegicus
actctgtccttgcagtggctggaga

SEQ ID NO: 95366 - DNA, 25 bp, Rattus norvegicus
actctgtccttggagtggctggaga

SEQ ID NO: 95367 - DNA, 25 bp, Rattus norvegicus
actctgtctcctattgtatgtgctg

SEQ ID NO: 95368 - DNA, 25 bp, Rattus norvegicus
actctgtctccttttgtatgtgctg

SEQ ID NO: 95369 - DNA, 25 bp, Rattus norvegicus
actctgtctctcattcctgttgaaa

SEQ ID NO: 95370 - DNA, 25 bp, Rattus norvegicus
actctgtctctctttcctgttgaaa

SEQ ID NO: 95371 - DNA, 25 bp, Rattus norvegicus
actctgtctgagaccccacaggaga

SEQ ID NO: 95372 - DNA, 25 bp, Rattus norvegicus
actctgtctgagtccccacaggaga

SEQ ID NO: 95373 - DNA, 25 bp, Rattus norvegicus
actctgtctgtcatgggcattctga

SEQ ID NO: 95374 - DNA, 25 bp, Rattus norvegicus
actctgtctgtcttgggcattctga

SEQ ID NO: 95375 - DNA, 25 bp, Rattus norvegicus
actctgtgaaatcgtctgatggtct

SEQ ID NO: 95376 - DNA, 25 bp, Rattus norvegicus
actctgtgaaatggtctgatggtct

SEQ ID NO: 95377 - DNA, 25 bp, Rattus norvegicus
actctgtgaatgctccatttctgtt

SEQ ID NO: 95378 - DNA, 25 bp, Rattus norvegicus
actctgtgaatggtccatttctgtt

SEQ ID NO: 95379 - DNA, 25 bp, Rattus norvegicus
actctgtgagttcttattggaccca

SEQ ID NO: 95380 - DNA, 25 bp, Rattus norvegicus
actctgtgagttgttattggaccca

SEQ ID NO: 95381 - DNA, 25 bp, Rattus norvegicus
actctgtgattacctgtccacgtta

SEQ ID NO: 95382 - DNA, 25 bp, Rattus norvegicus
actctgtgattagctgtccacgtta

SEQ ID NO: 95383 - DNA, 25 bp, Rattus norvegicus
actctgtggccccatgcttaggaag

SEQ ID NO: 95384 - DNA, 25 bp, Rattus norvegicus
actctgtggcccgatgcttaggaag

SEQ ID NO: 95385 - DNA, 25 bp, Rattus norvegicus
actctgtggctgctgtcaagggtaa

SEQ ID NO: 95386 - DNA, 25 bp, Rattus norvegicus
actctgtggctggtgtcaagggtaa

SEQ ID NO: 95387 - DNA, 25 bp, Rattus norvegicus
actctgtgggcccaaacattcgcca

SEQ ID NO: 95388 - DNA, 25 bp, Rattus norvegicus
actctgtgggccgaaacattcgcca

SEQ ID NO: 95389 - DNA, 25 bp, Rattus norvegicus
actctgtgtacacgaagccctaggc

SEQ ID NO: 95390 - DNA, 25 bp, Rattus norvegicus
actctgtgtacaggaagccctaggc

SEQ ID NO: 95391 - DNA, 25 bp, Rattus norvegicus
actctgtgttgccaggtgtctacaa

SEQ ID NO: 95392 - DNA, 25 bp, Rattus norvegicus
actctgtgttgcgaggtgtctacaa

SEQ ID NO: 95393 - DNA, 25 bp, Rattus norvegicus
actctgttagcacaagccctgggaa

SEQ ID NO: 95394 - DNA, 25 bp, Rattus norvegicus
actctgttagcagaagccctgggaa

SEQ ID NO: 95395 - DNA, 25 bp, Rattus norvegicus
actctgttagggattagcactttgt

SEQ ID NO: 95396 - DNA, 25 bp, Rattus norvegicus
actctgttagggtttagcactttgt

SEQ ID NO: 95397 - DNA, 25 bp, Rattus norvegicus
actctgttcaggcatgctttctagg

SEQ ID NO: 95398 - DNA, 25 bp, Rattus norvegicus
actctgttcagggatgctttctagg

SEQ ID NO: 95399 - DNA, 25 bp, Rattus norvegicus
actctgttccagctgtatgtgttac

SEQ ID NO: 95400 - DNA, 25 bp, Rattus norvegicus
actctgttccaggtgtatgtgttac

SEQ ID NO: 95401 - DNA, 25 bp, Rattus norvegicus
actctgttcccaaagtgtggatcac

SEQ ID NO: 95402 - DNA, 25 bp, Rattus norvegicus
actctgttcccatagtgtggatcac

SEQ ID NO: 95403 - DNA, 25 bp, Rattus norvegicus
actctgttctccagttttctagtca

SEQ ID NO: 95404 - DNA, 25 bp, Rattus norvegicus
actctgttctccatggggctgtgaa

SEQ ID NO: 95405 - DNA, 25 bp, Rattus norvegicus
actctgttctcctgttttctagtca

SEQ ID NO: 95406 - DNA, 25 bp, Rattus norvegicus
actctgttctccttggggctgtgaa

SEQ ID NO: 95407 - DNA, 25 bp, Rattus norvegicus
actctgttctgtcctcaggctagcg

SEQ ID NO: 95408 - DNA, 25 bp, Rattus norvegicus
actctgttctgtccttttccgggag

SEQ ID NO: 95409 - DNA, 25 bp, Rattus norvegicus
actctgttctgtgctcaggctagcg

SEQ ID NO: 95410 - DNA, 25 bp, Rattus norvegicus
actctgttctgtgcttttccgggag

SEQ ID NO: 95411 - DNA, 25 bp, Rattus norvegicus
actctgttctttatggagtttgtgt

SEQ ID NO: 95412 - DNA, 25 bp, Rattus norvegicus
actctgttctttttggagtttgtgt

SEQ ID NO: 95413 - DNA, 25 bp, Rattus norvegicus
actctgttgataatgctggttttat

SEQ ID NO: 95414 - DNA, 25 bp, Rattus norvegicus
actctgttgatattgctggttttat

SEQ ID NO: 95415 - DNA, 25 bp, Rattus norvegicus
actctgttgctccacaagggtattc

SEQ ID NO: 95416 - DNA, 25 bp, Rattus norvegicus
actctgttgctcgacaagggtattc

SEQ ID NO: 95417 - DNA, 25 bp, Rattus norvegicus
actctgttggtcacaatgtcagtgt

SEQ ID NO: 95418 - DNA, 25 bp, Rattus norvegicus
actctgttggtctcaatgtcagtgt

SEQ ID NO: 95419 - DNA, 25 bp, Rattus norvegicus
actctgttgtctcttgttgcctctt

SEQ ID NO: 95420 - DNA, 25 bp, Rattus norvegicus
actctgttgtctgttgttgcctctt

SEQ ID NO: 95421 - DNA, 25 bp, Rattus norvegicus
actctgttttgtagactgggtccta

SEQ ID NO: 95422 - DNA, 25 bp, Rattus norvegicus
actctgttttgttgactgggtccta

SEQ ID NO: 95423 - DNA, 25 bp, Rattus norvegicus
actcttaagtgtatcccagtcagtt

SEQ ID NO: 95424 - DNA, 25 bp, Rattus norvegicus
actcttaagtgtttcccagtcagtt

SEQ ID NO: 95425 - DNA, 25 bp, Rattus norvegicus
actcttacagatctagacgcacctt

SEQ ID NO: 95426 - DNA, 25 bp, Rattus norvegicus
actcttacagatgtagacgcacctt

SEQ ID NO: 95427 - DNA, 25 bp, Rattus norvegicus
actcttacagtcagtcttaggtgtt

SEQ ID NO: 95428 - DNA, 25 bp, Rattus norvegicus
actcttacagtctgtcttaggtgtt

SEQ ID NO: 95429 - DNA, 25 bp, Rattus norvegicus
actcttaccgtaaagcagacctgag

SEQ ID NO: 95430 - DNA, 25 bp, Rattus norvegicus
actcttaccgtatagcagacctgag

SEQ ID NO: 95431 - DNA, 25 bp, Rattus norvegicus
actcttacttacagttgttgtttgt

SEQ ID NO: 95432 - DNA, 25 bp, Rattus norvegicus
actcttacttactgttgttgtttgt

SEQ ID NO: 95433 - DNA, 25 bp, Rattus norvegicus
actcttagaggcctgggatatcccc

SEQ ID NO: 95434 - DNA, 25 bp, Rattus norvegicus
actcttagaggcgtgggatatcccc

SEQ ID NO: 95435 - DNA, 25 bp, Rattus norvegicus
actcttagcactcactgacacaggg

SEQ ID NO: 95436 - DNA, 25 bp, Rattus norvegicus
actcttagcactgactgacacaggg

SEQ ID NO: 95437 - DNA, 25 bp, Rattus norvegicus
actcttaggagtactttttgtgcca

SEQ ID NO: 95438 - DNA, 25 bp, Rattus norvegicus
actcttaggagttctttttgtgcca

SEQ ID NO: 95439 - DNA, 25 bp, Rattus norvegicus
actcttatacccctgagctatgaca

SEQ ID NO: 95440 - DNA, 25 bp, Rattus norvegicus
actcttatacccgtgagctatgaca

SEQ ID NO: 95441 - DNA, 25 bp, Rattus norvegicus
actcttatgatcatggtggcctgtt

SEQ ID NO: 95442 - DNA, 25 bp, Rattus norvegicus
actcttatgatcttggtggcctgtt

SEQ ID NO: 95443 - DNA, 25 bp, Rattus norvegicus
actcttatgcaactgactgtcctta

SEQ ID NO: 95444 - DNA, 25 bp, Rattus norvegicus
actcttatgcaagtgactgtcctta

SEQ ID NO: 95445 - DNA, 25 bp, Rattus norvegicus
actcttatgtataactgtgcgcaat

SEQ ID NO: 95446 - DNA, 25 bp, Rattus norvegicus
actcttatgtattactgtgcgcaat

SEQ ID NO: 95447 - DNA, 25 bp, Rattus norvegicus
actcttcaaggaccaatcacgggcg

SEQ ID NO: 95448 - DNA, 25 bp, Rattus norvegicus
actcttcaaggagcaatcacgggcg

SEQ ID NO: 95449 - DNA, 25 bp, Rattus norvegicus
actcttcaattaattcagcctcagg

SEQ ID NO: 95450 - DNA, 25 bp, Rattus norvegicus
actcttcaattatttcagcctcagg

SEQ ID NO: 95451 - DNA, 25 bp, Rattus norvegicus
actcttcacaggcaatgtcaaggat

SEQ ID NO: 95452 - DNA, 25 bp, Rattus norvegicus
actcttcacagggaatgtcaaggat

SEQ ID NO: 95453 - DNA, 25 bp, Rattus norvegicus
actcttcaccagaccggagattgag

SEQ ID NO: 95454 - DNA, 25 bp, Rattus norvegicus
actcttcaccagtccggagattgag

SEQ ID NO: 95455 - DNA, 25 bp, Rattus norvegicus
actcttcactagctgtttccttgta

SEQ ID NO: 95456 - DNA, 25 bp, Rattus norvegicus
actcttcactaggtgtttccttgta

SEQ ID NO: 95457 - DNA, 25 bp, Rattus norvegicus
actcttcactgcattttccatacaa

SEQ ID NO: 95458 - DNA, 25 bp, Rattus norvegicus
actcttcactgctttttccatacaa

SEQ ID NO: 95459 - DNA, 25 bp, Rattus norvegicus
actcttcagcccctcatgtatagat

SEQ ID NO: 95460 - DNA, 25 bp, Rattus norvegicus
actcttcagcccgtcatgtatagat

SEQ ID NO: 95461 - DNA, 25 bp, Rattus norvegicus
actcttcagttccacaaaatctacc

SEQ ID NO: 95462 - DNA, 25 bp, Rattus norvegicus
actcttcagttcctggtccatggaa

SEQ ID NO: 95463 - DNA, 25 bp, Rattus norvegicus
actcttcagttcgacaaaatctacc

SEQ ID NO: 95464 - DNA, 25 bp, Rattus norvegicus
actcttcagttcgtggtccatggaa

SEQ ID NO: 95465 - DNA, 25 bp, Rattus norvegicus
actcttcagttgacagctttccaga

SEQ ID NO: 95466 - DNA, 25 bp, Rattus norvegicus
actcttcagttgtcagctttccaga

SEQ ID NO: 95467 - DNA, 25 bp, Rattus norvegicus
actcttcatattctcttgctctgta

SEQ ID NO: 95468 - DNA, 25 bp, Rattus norvegicus
actcttcatattgtcttgctctgta

SEQ ID NO: 95469 - DNA, 25 bp, Rattus norvegicus
actcttcattcccaaggtctgttaa

SEQ ID NO: 95470 - DNA, 25 bp, Rattus norvegicus
actcttcattccgaaggtctgttaa

SEQ ID NO: 95471 - DNA, 25 bp, Rattus norvegicus
actcttccagttccctgagggtcaa

SEQ ID NO: 95472 - DNA, 25 bp, Rattus norvegicus
actcttccagttgcctgagggtcaa

SEQ ID NO: 95473 - DNA, 25 bp, Rattus norvegicus
actcttccatacacacctacatagg

SEQ ID NO: 95474 - DNA, 25 bp, Rattus norvegicus
actcttccatactcacctacatagg

SEQ ID NO: 95475 - DNA, 25 bp, Rattus norvegicus
actcttcccagtcatatgcattgtg

SEQ ID NO: 95476 - DNA, 25 bp, Rattus norvegicus
actcttcccagtgatatgcattgtg

SEQ ID NO: 95477 - DNA, 25 bp, Rattus norvegicus
actcttcccggcagagtggaattct

SEQ ID NO: 95478 - DNA, 25 bp, Rattus norvegicus
actcttcccggctgagtggaattct

SEQ ID NO: 95479 - DNA, 25 bp, Rattus norvegicus
actcttcctatccttgaatttcctt

SEQ ID NO: 95480 - DNA, 25 bp, Rattus norvegicus
actcttcctatcgttgaatttcctt

SEQ ID NO: 95481 - DNA, 25 bp, Rattus norvegicus
actcttcctgtgaacttgtgggtta

SEQ ID NO: 95482 - DNA, 25 bp, Rattus norvegicus
actcttcctgtgtacttgtgggtta

SEQ ID NO: 95483 - DNA, 25 bp, Rattus norvegicus
actcttccttcaattgcttttgtca

SEQ ID NO: 95484 - DNA, 25 bp, Rattus norvegicus
actcttccttcatttgcttttgtca

SEQ ID NO: 95485 - DNA, 25 bp, Rattus norvegicus
actcttccttctcctagtggatgca

SEQ ID NO: 95486 - DNA, 25 bp, Rattus norvegicus
actcttccttctgctagtggatgca

SEQ ID NO: 95487 - DNA, 25 bp, Rattus norvegicus
actcttcggagcagggctggcattt

SEQ ID NO: 95488 - DNA, 25 bp, Rattus norvegicus
actcttcggagctgggctggcattt

SEQ ID NO: 95489 - DNA, 25 bp, Rattus norvegicus
actcttcggcttctccattgaatgg

SEQ ID NO: 95490 - DNA, 25 bp, Rattus norvegicus
actcttcggcttgtccattgaatgg

SEQ ID NO: 95491 - DNA, 25 bp, Rattus norvegicus
actcttcgggccagttaaggctcca

SEQ ID NO: 95492 - DNA, 25 bp, Rattus norvegicus
actcttcgggcctgttaaggctcca

SEQ ID NO: 95493 - DNA, 25 bp, Rattus norvegicus
actcttcggtgtcattatgttcctt

SEQ ID NO: 95494 - DNA, 25 bp, Rattus norvegicus
actcttcggtgtgattatgttcctt

SEQ ID NO: 95495 - DNA, 25 bp, Rattus norvegicus
actcttctaccgaccaatgttgtga

SEQ ID NO: 95496 - DNA, 25 bp, Rattus norvegicus
actcttctaccgtccaatgttgtga

SEQ ID NO: 95497 - DNA, 25 bp, Rattus norvegicus
actcttctcagtatttggatctcca

SEQ ID NO: 95498 - DNA, 25 bp, Rattus norvegicus
actcttctcagtcgcctaaagcaag

SEQ ID NO: 95499 - DNA, 25 bp, Rattus norvegicus
actcttctcagtggcctaaagcaag

SEQ ID NO: 95500 - DNA, 25 bp, Rattus norvegicus
actcttctcagtttttggatctcca

SEQ ID NO: 95501 - DNA, 25 bp, Rattus norvegicus
actcttctgatcattgacactggca

SEQ ID NO: 95502 - DNA, 25 bp, Rattus norvegicus
actcttctgatctttgacactggca

SEQ ID NO: 95503 - DNA, 25 bp, Rattus norvegicus
actcttctgctacctaccagttaag

SEQ ID NO: 95504 - DNA, 25 bp, Rattus norvegicus
actcttctgctagctaccagttaag

SEQ ID NO: 95505 - DNA, 25 bp, Rattus norvegicus
actcttctgttacttctggactctt

SEQ ID NO: 95506 - DNA, 25 bp, Rattus norvegicus
actcttctgttagttctggactctt

SEQ ID NO: 95507 - DNA, 25 bp, Rattus norvegicus
actcttcttcctctgaacttcgctt

SEQ ID NO: 95508 - DNA, 25 bp, Rattus norvegicus
actcttcttcctgtgaacttcgctt

SEQ ID NO: 95509 - DNA, 25 bp, Rattus norvegicus
actcttcttcgtctaggtcatgaga

SEQ ID NO: 95510 - DNA, 25 bp, Rattus norvegicus
actcttcttcgtgtaggtcatgaga

SEQ ID NO: 95511 - DNA, 25 bp, Rattus norvegicus
actcttgaagagattgttggatttc

SEQ ID NO: 95512 - DNA, 25 bp, Rattus norvegicus
actcttgaagagtttgttggatttc

SEQ ID NO: 95513 - DNA, 25 bp, Rattus norvegicus
actcttgacactattatgtattcca

SEQ ID NO: 95514 - DNA, 25 bp, Rattus norvegicus
actcttgacacttttatgtattcca

SEQ ID NO: 95515 - DNA, 25 bp, Rattus norvegicus
actcttgaccttcccaatagctaaa

SEQ ID NO: 95516 - DNA, 25 bp, Rattus norvegicus
actcttgaccttgccaatagctaaa

SEQ ID NO: 95517 - DNA, 25 bp, Rattus norvegicus
actcttgagggcatcgccgacttac

SEQ ID NO: 95518 - DNA, 25 bp, Rattus norvegicus
actcttgagggcttcgccgacttac

SEQ ID NO: 95519 - DNA, 25 bp, Rattus norvegicus
actcttgatcaacgtcagtgttgga

SEQ ID NO: 95520 - DNA, 25 bp, Rattus norvegicus
actcttgatcaaggtcagtgttgga

SEQ ID NO: 95521 - DNA, 25 bp, Rattus norvegicus
actcttgatgcaccagcattggcga

SEQ ID NO: 95522 - DNA, 25 bp, Rattus norvegicus
actcttgatgcagcagcattggcga

SEQ ID NO: 95523 - DNA, 25 bp, Rattus norvegicus
actcttgcaagaccccaaaataaag

SEQ ID NO: 95524 - DNA, 25 bp, Rattus norvegicus
actcttgcaagagcccaaaataaag

SEQ ID NO: 95525 - DNA, 25 bp, Rattus norvegicus
actcttgccctgcagcgggatggcc

SEQ ID NO: 95526 - DNA, 25 bp, Rattus norvegicus
actcttgccctggagcgggatggcc

SEQ ID NO: 95527 - DNA, 25 bp, Rattus norvegicus
actcttgccgctcttaagtttcata

SEQ ID NO: 95528 - DNA, 25 bp, Rattus norvegicus
actcttgccgctgttaagtttcata

SEQ ID NO: 95529 - DNA, 25 bp, Rattus norvegicus
actcttgcctagagcttcagctaaa

SEQ ID NO: 95530 - DNA, 25 bp, Rattus norvegicus
actcttgcctagtgcttcagctaaa

SEQ ID NO: 95531 - DNA, 25 bp, Rattus norvegicus
actcttggcccaagttacctaagaa

SEQ ID NO: 95532 - DNA, 25 bp, Rattus norvegicus
actcttggcccatgttacctaagaa

SEQ ID NO: 95533 - DNA, 25 bp, Rattus norvegicus
actcttggctgaccaatgtcctttg

SEQ ID NO: 95534 - DNA, 25 bp, Rattus norvegicus
actcttggctgagcaatgtcctttg

SEQ ID NO: 95535 - DNA, 25 bp, Rattus norvegicus
actcttgggagtctcacctggacca

SEQ ID NO: 95536 - DNA, 25 bp, Rattus norvegicus
actcttgggagtgtcacctggacca

SEQ ID NO: 95537 - DNA, 25 bp, Rattus norvegicus
actcttgggcctatcttaattgatg

SEQ ID NO: 95538 - DNA, 25 bp, Rattus norvegicus
actcttgggcctttcttaattgatg

SEQ ID NO: 95539 - DNA, 25 bp, Rattus norvegicus
actcttgggtgcaaagtgcctggga

SEQ ID NO: 95540 - DNA, 25 bp, Rattus norvegicus
actcttgggtgctaagtgcctggga

SEQ ID NO: 95541 - DNA, 25 bp, Rattus norvegicus
actcttggtgtcagggtctcacgga

SEQ ID NO: 95542 - DNA, 25 bp, Rattus norvegicus
actcttggtgtctgggtctcacgga

SEQ ID NO: 95543 - DNA, 25 bp, Rattus norvegicus
actcttggttgaactctataactta

SEQ ID NO: 95544 - DNA, 25 bp, Rattus norvegicus
actcttggttgatctctataactta

SEQ ID NO: 95545 - DNA, 25 bp, Rattus norvegicus
actcttgtatgtcatttgtcttgaa

SEQ ID NO: 95546 - DNA, 25 bp, Rattus norvegicus
actcttgtatgtgatttgtcttgaa

SEQ ID NO: 95547 - DNA, 25 bp, Rattus norvegicus
actcttgtctctatgaagaccccta

SEQ ID NO: 95548 - DNA, 25 bp, Rattus norvegicus
actcttgtctctttgaagaccccta

SEQ ID NO: 95549 - DNA, 25 bp, Rattus norvegicus
actcttgtgggcactgtcagtcatt

SEQ ID NO: 95550 - DNA, 25 bp, Rattus norvegicus
actcttgtgggctctgtcagtcatt

SEQ ID NO: 95551 - DNA, 25 bp, Rattus norvegicus
actcttgtgttcaaactgtgagcta

SEQ ID NO: 95552 - DNA, 25 bp, Rattus norvegicus
actcttgtgttctaactgtgagcta

SEQ ID NO: 95553 - DNA, 25 bp, Rattus norvegicus
actcttgttcacaactctgcgtaaa

SEQ ID NO: 95554 - DNA, 25 bp, Rattus norvegicus
actcttgttcactactctgcgtaaa

SEQ ID NO: 95555 - DNA, 25 bp, Rattus norvegicus
actcttgttcctcgcatgcttgaag

SEQ ID NO: 95556 - DNA, 25 bp, Rattus norvegicus
actcttgttcctggcatgcttgaag

SEQ ID NO: 95557 - DNA, 25 bp, Rattus norvegicus
actcttgttggtccctttctcctct

SEQ ID NO: 95558 - DNA, 25 bp, Rattus norvegicus
actcttgttggtgcctttctcctct

SEQ ID NO: 95559 - DNA, 25 bp, Rattus norvegicus
actcttgtttcaccagtgcgggtta

SEQ ID NO: 95560 - DNA, 25 bp, Rattus norvegicus
actcttgtttcagcagtgcgggtta

SEQ ID NO: 95561 - DNA, 25 bp, Rattus norvegicus
actcttgtttctacaactagctggc

SEQ ID NO: 95562 - DNA, 25 bp, Rattus norvegicus
actcttgtttcttcaactagctggc

SEQ ID NO: 95563 - DNA, 25 bp, Rattus norvegicus
actctttatcctcatgcctggatca

SEQ ID NO: 95564 - DNA, 25 bp, Rattus norvegicus
actctttatcctgatgcctggatca

SEQ ID NO: 95565 - DNA, 25 bp, Rattus norvegicus
actctttcactcatgttggtttggt

SEQ ID NO: 95566 - DNA, 25 bp, Rattus norvegicus
actctttcactcttgttggtttggt

SEQ ID NO: 95567 - DNA, 25 bp, Rattus norvegicus
actctttcagctcagactttctaga

SEQ ID NO: 95568 - DNA, 25 bp, Rattus norvegicus
actctttcagctgagactttctaga

SEQ ID NO: 95569 - DNA, 25 bp, Rattus norvegicus
actctttcagtgaggtgattttgcc

SEQ ID NO: 95570 - DNA, 25 bp, Rattus norvegicus
actctttcagtgtggtgattttgcc

SEQ ID NO: 95571 - DNA, 25 bp, Rattus norvegicus
actctttcatccactagtttctaaa

SEQ ID NO: 95572 - DNA, 25 bp, Rattus norvegicus
actctttcatcctctagtttctaaa

SEQ ID NO: 95573 - DNA, 25 bp, Rattus norvegicus
actctttcattccaactatcctgaa

SEQ ID NO: 95574 - DNA, 25 bp, Rattus norvegicus
actctttcattcgaactatcctgaa

SEQ ID NO: 95575 - DNA, 25 bp, Rattus norvegicus
actctttccatcaccacatttgttg

SEQ ID NO: 95576 - DNA, 25 bp, Rattus norvegicus
actctttccatctccacatttgttg

SEQ ID NO: 95577 - DNA, 25 bp, Rattus norvegicus
actctttcctatcctgtcttctgaa

SEQ ID NO: 95578 - DNA, 25 bp, Rattus norvegicus
actctttcctatgctgtcttctgaa

SEQ ID NO: 95579 - DNA, 25 bp, Rattus norvegicus
actctttctgggaggcagatgtctg

SEQ ID NO: 95580 - DNA, 25 bp, Rattus norvegicus
actctttctgggtggcagatgtctg

SEQ ID NO: 95581 - DNA, 25 bp, Rattus norvegicus
actctttcttggacaggcagcttca

SEQ ID NO: 95582 - DNA, 25 bp, Rattus norvegicus
actctttcttggtcaggcagcttca

SEQ ID NO: 95583 - DNA, 25 bp, Rattus norvegicus
actctttgacgtctcctggatcaga

SEQ ID NO: 95584 - DNA, 25 bp, Rattus norvegicus
actctttgacgtgtcctggatcaga

SEQ ID NO: 95585 - DNA, 25 bp, Rattus norvegicus
actctttgaggtccatgtgtgtgaa

SEQ ID NO: 95586 - DNA, 25 bp, Rattus norvegicus
actctttgaggtgcatgtgtgtgaa

SEQ ID NO: 95587 - DNA, 25 bp, Rattus norvegicus
actctttgcagtcgctacagttcct

SEQ ID NO: 95588 - DNA, 25 bp, Rattus norvegicus
actctttgcagtggctacagttcct

SEQ ID NO: 95589 - DNA, 25 bp, Rattus norvegicus
actctttgctccactatgattgtga

SEQ ID NO: 95590 - DNA, 25 bp, Rattus norvegicus
actctttgctcctctatgattgtga

SEQ ID NO: 95591 - DNA, 25 bp, Rattus norvegicus
actctttggcatctcagctgaatct

SEQ ID NO: 95592 - DNA, 25 bp, Rattus norvegicus
actctttggcatgtcagctgaatct

SEQ ID NO: 95593 - DNA, 25 bp, Rattus norvegicus
actctttggtatctgtatctgtgtc

SEQ ID NO: 95594 - DNA, 25 bp, Rattus norvegicus
actctttggtatgtgtatctgtgtc

SEQ ID NO: 95595 - DNA, 25 bp, Rattus norvegicus
actctttgtagtcctggtgatcatt

SEQ ID NO: 95596 - DNA, 25 bp, Rattus norvegicus
actctttgtagtgctggtgatcatt

SEQ ID NO: 95597 - DNA, 25 bp, Rattus norvegicus
actctttgtttcagtttctttatga

SEQ ID NO: 95598 - DNA, 25 bp, Rattus norvegicus
actctttgtttctgtttctttatga

SEQ ID NO: 95599 - DNA, 25 bp, Rattus norvegicus
actctttgttttctgatgtgattgc

SEQ ID NO: 95600 - DNA, 25 bp, Rattus norvegicus
actctttgttttgtgatgtgattgc

SEQ ID NO: 95601 - DNA, 25 bp, Rattus norvegicus
actcttttaatgatggccagtcaga

SEQ ID NO: 95602 - DNA, 25 bp, Rattus norvegicus
actcttttaatgttggccagtcaga

SEQ ID NO: 95603 - DNA, 25 bp, Rattus norvegicus
actcttttagcccaaatctgcatgt

SEQ ID NO: 95604 - DNA, 25 bp, Rattus norvegicus
actcttttagccgaaatctgcatgt

SEQ ID NO: 95605 - DNA, 25 bp, Rattus norvegicus
actcttttcagtccgcaggacggat

SEQ ID NO: 95606 - DNA, 25 bp, Rattus norvegicus
actcttttcagtgcgcaggacggat

SEQ ID NO: 95607 - DNA, 25 bp, Rattus norvegicus
actcttttctgtctgtactcctata

SEQ ID NO: 95608 - DNA, 25 bp, Rattus norvegicus
actcttttctgtgtgtactcctata

SEQ ID NO: 95609 - DNA, 25 bp, Rattus norvegicus
actcttttctttcatgcggctttac

SEQ ID NO: 95610 - DNA, 25 bp, Rattus norvegicus
actcttttctttgatgcggctttac

SEQ ID NO: 95611 - DNA, 25 bp, Rattus norvegicus
actcttttgaggcattacactattc

SEQ ID NO: 95612 - DNA, 25 bp, Rattus norvegicus
actcttttgagggattacactattc

SEQ ID NO: 95613 - DNA, 25 bp, Rattus norvegicus
actcttttgagtcctgacatgttgt

SEQ ID NO: 95614 - DNA, 25 bp, Rattus norvegicus
actcttttgagtgctgacatgttgt

SEQ ID NO: 95615 - DNA, 25 bp, Rattus norvegicus
actcttttggagaagatatggcctt

SEQ ID NO: 95616 - DNA, 25 bp, Rattus norvegicus
actcttttggagtagatatggcctt

SEQ ID NO: 95617 - DNA, 25 bp, Rattus norvegicus
actcttttgttaatgttccagcttg

SEQ ID NO: 95618 - DNA, 25 bp, Rattus norvegicus
actcttttgttattgttccagcttg

SEQ ID NO: 95619 - DNA, 25 bp, Rattus norvegicus
actctttttattcctgctcttgcaa

SEQ ID NO: 95620 - DNA, 25 bp, Rattus norvegicus
actctttttattgctgctcttgcaa

SEQ ID NO: 95621 - DNA, 25 bp, Rattus norvegicus
actctttttgagaatcgttacagac

SEQ ID NO: 95622 - DNA, 25 bp, Rattus norvegicus
actctttttgagtatcgttacagac

SEQ ID NO: 95623 - DNA, 25 bp, Rattus norvegicus
actgaaaaagctccaggtggccaca

SEQ ID NO: 95624 - DNA, 25 bp, Rattus norvegicus
actgaaaaagctgcaggtggccaca

SEQ ID NO: 95625 - DNA, 25 bp, Rattus norvegicus
actgaaaacatcaacgtcctacacc

SEQ ID NO: 95626 - DNA, 25 bp, Rattus norvegicus
actgaaaacatctacgtcctacacc

SEQ ID NO: 95627 - DNA, 25 bp, Rattus norvegicus
actgaaaatcggcacctacacgggc

SEQ ID NO: 95628 - DNA, 25 bp, Rattus norvegicus
actgaaaatcgggacctacacgggc

SEQ ID NO: 95629 - DNA, 25 bp, Rattus norvegicus
actgaaacctgcaatgccctaaatg

SEQ ID NO: 95630 - DNA, 25 bp, Rattus norvegicus
actgaaacctgctatgccctaaatg

SEQ ID NO: 95631 - DNA, 25 bp, Rattus norvegicus
actgaaaccttgaaccccattgaga

SEQ ID NO: 95632 - DNA, 25 bp, Rattus norvegicus
actgaaaccttgtaccccattgaga

SEQ ID NO: 95633 - DNA, 25 bp, Rattus norvegicus
actgaaactgcaaccaccgagctgg

SEQ ID NO: 95634 - DNA, 25 bp, Rattus norvegicus
actgaaactgcatccaccgagctgg

SEQ ID NO: 95635 - DNA, 25 bp, Rattus norvegicus
actgaaagaccgacagcctggacat

SEQ ID NO: 95636 - DNA, 25 bp, Rattus norvegicus
actgaaagaccgtcagcctggacat

SEQ ID NO: 95637 - DNA, 25 bp, Rattus norvegicus
actgaaagatttctaggttgttgat

SEQ ID NO: 95638 - DNA, 25 bp, Rattus norvegicus
actgaaagatttgtaggttgttgat

SEQ ID NO: 95639 - DNA, 25 bp, Rattus norvegicus
actgaaatccagaacccatcggtga

SEQ ID NO: 95640 - DNA, 25 bp, Rattus norvegicus
actgaaatccagtacccatcggtga

SEQ ID NO: 95641 - DNA, 25 bp, Rattus norvegicus
actgaaatcgttatcctgggatgga

SEQ ID NO: 95642 - DNA, 25 bp, Rattus norvegicus
actgaaatcgttttcctgggatgga

SEQ ID NO: 95643 - DNA, 25 bp, Rattus norvegicus
actgaaatggagaccctttgggact

SEQ ID NO: 95644 - DNA, 25 bp, Rattus norvegicus
actgaaatggagtccctttgggact

SEQ ID NO: 95645 - DNA, 25 bp, Rattus norvegicus
actgaaatgttgagcctctgtggca

SEQ ID NO: 95646 - DNA, 25 bp, Rattus norvegicus
actgaaatgttgtgcctctgtggca

SEQ ID NO: 95647 - DNA, 25 bp, Rattus norvegicus
actgaaatttcacccagtgcttgga

SEQ ID NO: 95648 - DNA, 25 bp, Rattus norvegicus
actgaaatttcagccagtgcttgga

SEQ ID NO: 95649 - DNA, 25 bp, Rattus norvegicus
actgaacaatggctgctgcctggtt

SEQ ID NO: 95650 - DNA, 25 bp, Rattus norvegicus
actgaacaatgggtgctgcctggtt

SEQ ID NO: 95651 - DNA, 25 bp, Rattus norvegicus
actgaacaccaacagtgaagttcca

SEQ ID NO: 95652 - DNA, 25 bp, Rattus norvegicus
actgaacaccaagagtgaagttcca

SEQ ID NO: 95653 - DNA, 25 bp, Rattus norvegicus
actgaacacttgcttgattctttcc

SEQ ID NO: 95654 - DNA, 25 bp, Rattus norvegicus
actgaacacttggttgattctttcc

SEQ ID NO: 95655 - DNA, 25 bp, Rattus norvegicus
actgaacagccaaacttgtctctca

SEQ ID NO: 95656 - DNA, 25 bp, Rattus norvegicus
actgaacagccatacttgtctctca

SEQ ID NO: 95657 - DNA, 25 bp, Rattus norvegicus
actgaacagtgaaccatgcctccct

SEQ ID NO: 95658 - DNA, 25 bp, Rattus norvegicus
actgaacagtgatccatgcctccct

SEQ ID NO: 95659 - DNA, 25 bp, Rattus norvegicus
actgaaccaacaagtcatagtaata

SEQ ID NO: 95660 - DNA, 25 bp, Rattus norvegicus
actgaaccaacatgtcatagtaata

SEQ ID NO: 95661 - DNA, 25 bp, Rattus norvegicus
actgaaccagggacctctgtgtgaa

SEQ ID NO: 95662 - DNA, 25 bp, Rattus norvegicus
actgaaccagggtcctctgtgtgaa

SEQ ID NO: 95663 - DNA, 25 bp, Rattus norvegicus
actgaaccattgatctttgcctaca

SEQ ID NO: 95664 - DNA, 25 bp, Rattus norvegicus
actgaaccattgttctttgcctaca

SEQ ID NO: 95665 - DNA, 25 bp, Rattus norvegicus
actgaaccccaacatcttcatctag

SEQ ID NO: 95666 - DNA, 25 bp, Rattus norvegicus
actgaaccccaagatcttcatctag

SEQ ID NO: 95667 - DNA, 25 bp, Rattus norvegicus
actgaacctagaacccgagacctgt

SEQ ID NO: 95668 - DNA, 25 bp, Rattus norvegicus
actgaacctagatcccgagacctgt

SEQ ID NO: 95669 - DNA, 25 bp, Rattus norvegicus
actgaacgggccattgaacaagtat

SEQ ID NO: 95670 - DNA, 25 bp, Rattus norvegicus
actgaacgggcctttgaacaagtat

SEQ ID NO: 95671 - DNA, 25 bp, Rattus norvegicus
actgaacggtctctatgtgtgggat

SEQ ID NO: 95672 - DNA, 25 bp, Rattus norvegicus
actgaacggtctgtatgtgtgggat

SEQ ID NO: 95673 - DNA, 25 bp, Rattus norvegicus
actgaactacataacccttcttctt

SEQ ID NO: 95674 - DNA, 25 bp, Rattus norvegicus
actgaactacattacccttcttctt

SEQ ID NO: 95675 - DNA, 25 bp, Rattus norvegicus
actgaactagacatagcagctcatt

SEQ ID NO: 95676 - DNA, 25 bp, Rattus norvegicus
actgaactagacttagcagctcatt

SEQ ID NO: 95677 - DNA, 25 bp, Rattus norvegicus
actgaactcccacggcaggtgagaa

SEQ ID NO: 95678 - DNA, 25 bp, Rattus norvegicus
actgaactcccagggcaggtgagaa

SEQ ID NO: 95679 - DNA, 25 bp, Rattus norvegicus
actgaactcgagattccgctgagaa

SEQ ID NO: 95680 - DNA, 25 bp, Rattus norvegicus
actgaactcgagtttccgctgagaa

SEQ ID NO: 95681 - DNA, 25 bp, Rattus norvegicus
actgaactcgcaatcttctgcataa

SEQ ID NO: 95682 - DNA, 25 bp, Rattus norvegicus
actgaactcgcattcttctgcataa

SEQ ID NO: 95683 - DNA, 25 bp, Rattus norvegicus
actgaactctctagtaaccctgtta

SEQ ID NO: 95684 - DNA, 25 bp, Rattus norvegicus
actgaactctcttgtaaccctgtta

SEQ ID NO: 95685 - DNA, 25 bp, Rattus norvegicus
actgaactcttcagctaatcttgat

SEQ ID NO: 95686 - DNA, 25 bp, Rattus norvegicus
actgaactcttctgctaatcttgat

SEQ ID NO: 95687 - DNA, 25 bp, Rattus norvegicus
actgaactgaggaagtcttgaccca

SEQ ID NO: 95688 - DNA, 25 bp, Rattus norvegicus
actgaactgaggtagtcttgaccca

SEQ ID NO: 95689 - DNA, 25 bp, Rattus norvegicus
actgaactggacctggagcgctcta

SEQ ID NO: 95690 - DNA, 25 bp, Rattus norvegicus
actgaactggacgtggagcgctcta

SEQ ID NO: 95691 - DNA, 25 bp, Rattus norvegicus
actgaactgtgtcatctgggcaggt

SEQ ID NO: 95692 - DNA, 25 bp, Rattus norvegicus
actgaactgtgtgatctgggcaggt

SEQ ID NO: 95693 - DNA, 25 bp, Rattus norvegicus
actgaacttatacttttgctatctt

SEQ ID NO: 95694 - DNA, 25 bp, Rattus norvegicus
actgaacttatagttttgctatctt

SEQ ID NO: 95695 - DNA, 25 bp, Rattus norvegicus
actgaacttcacagatgaatggagc

SEQ ID NO: 95696 - DNA, 25 bp, Rattus norvegicus
actgaacttcactgatgaatggagc

SEQ ID NO: 95697 - DNA, 25 bp, Rattus norvegicus
actgaacttcttccggcagatcaag

SEQ ID NO: 95698 - DNA, 25 bp, Rattus norvegicus
actgaacttcttgcggcagatcaag

SEQ ID NO: 95699 - DNA, 25 bp, Rattus norvegicus
actgaacttgacacctcagagggag

SEQ ID NO: 95700 - DNA, 25 bp, Rattus norvegicus
actgaacttgactcctcagagggag

SEQ ID NO: 95701 - DNA, 25 bp, Rattus norvegicus
actgaacttgatcctctagagctgt

SEQ ID NO: 95702 - DNA, 25 bp, Rattus norvegicus
actgaacttgatgctctagagctgt

SEQ ID NO: 95703 - DNA, 25 bp, Rattus norvegicus
actgaagaatcaaactgtccgaggg

SEQ ID NO: 95704 - DNA, 25 bp, Rattus norvegicus
actgaagaatcatactgtccgaggg

SEQ ID NO: 95705 - DNA, 25 bp, Rattus norvegicus
actgaagactccagggctctgtgta

SEQ ID NO: 95706 - DNA, 25 bp, Rattus norvegicus
actgaagactcctgggctctgtgta

SEQ ID NO: 95707 - DNA, 25 bp, Rattus norvegicus
actgaagagcacctccacatgattg

SEQ ID NO: 95708 - DNA, 25 bp, Rattus norvegicus
actgaagagcacgtccacatgattg

SEQ ID NO: 95709 - DNA, 25 bp, Rattus norvegicus
actgaagagtgtaggttgctgttcc

SEQ ID NO: 95710 - DNA, 25 bp, Rattus norvegicus
actgaagagtgttggttgctgttcc

SEQ ID NO: 95711 - DNA, 25 bp, Rattus norvegicus
actgaagagttaccgcctgtgtgaa

SEQ ID NO: 95712 - DNA, 25 bp, Rattus norvegicus
actgaagagttagcgcctgtgtgaa

SEQ ID NO: 95713 - DNA, 25 bp, Rattus norvegicus
actgaagcaaggatgcgcaagagga

SEQ ID NO: 95714 - DNA, 25 bp, Rattus norvegicus
actgaagcaaggttgcgcaagagga

SEQ ID NO: 95715 - DNA, 25 bp, Rattus norvegicus
actgaagcagacctagccgttgtgt

SEQ ID NO: 95716 - DNA, 25 bp, Rattus norvegicus
actgaagcagacgtagccgttgtgt

SEQ ID NO: 95717 - DNA, 25 bp, Rattus norvegicus
actgaagcatcaccagagcgttctc

SEQ ID NO: 95718 - DNA, 25 bp, Rattus norvegicus
actgaagcatcagcagagcgttctc

SEQ ID NO: 95719 - DNA, 25 bp, Rattus norvegicus
actgaagcccgtacctaagctcgaa

SEQ ID NO: 95720 - DNA, 25 bp, Rattus norvegicus
actgaagcccgttcctaagctcgaa

SEQ ID NO: 95721 - DNA, 25 bp, Rattus norvegicus
actgaagccgagcttgggtgaccct

SEQ ID NO: 95722 - DNA, 25 bp, Rattus norvegicus
actgaagccgaggttgggtgaccct

SEQ ID NO: 95723 - DNA, 25 bp, Rattus norvegicus
actgaagcgattccctccagcaggg

SEQ ID NO: 95724 - DNA, 25 bp, Rattus norvegicus
actgaagcgattgcctccagcaggg

SEQ ID NO: 95725 - DNA, 25 bp, Rattus norvegicus
actgaagcgctgatacacggctaca

SEQ ID NO: 95726 - DNA, 25 bp, Rattus norvegicus
actgaagcgctgttacacggctaca

SEQ ID NO: 95727 - DNA, 25 bp, Rattus norvegicus
actgaagctcggcacatttgctctt

SEQ ID NO: 95728 - DNA, 25 bp, Rattus norvegicus
actgaagctcgggacatttgctctt

SEQ ID NO: 95729 - DNA, 25 bp, Rattus norvegicus
actgaagctgccacaacatttggaa

SEQ ID NO: 95730 - DNA, 25 bp, Rattus norvegicus
actgaagctgcctcaacatttggaa

SEQ ID NO: 95731 - DNA, 25 bp, Rattus norvegicus
actgaagctgttacctgatctaggg

SEQ ID NO: 95732 - DNA, 25 bp, Rattus norvegicus
actgaagctgtttcctgatctaggg

SEQ ID NO: 95733 - DNA, 25 bp, Rattus norvegicus
actgaaggagctcaatgcccggcct

SEQ ID NO: 95734 - DNA, 25 bp, Rattus norvegicus
actgaaggagctgaatgcccggcct

SEQ ID NO: 95735 - DNA, 25 bp, Rattus norvegicus
actgaaggcaatacctgggcggcct

SEQ ID NO: 95736 - DNA, 25 bp, Rattus norvegicus
actgaaggcaattcctgggcggcct

SEQ ID NO: 95737 - DNA, 25 bp, Rattus norvegicus
actgaaggcggtactgaccctgtac

SEQ ID NO: 95738 - DNA, 25 bp, Rattus norvegicus
actgaaggcggttctgaccctgtac

SEQ ID NO: 95739 - DNA, 25 bp, Rattus norvegicus
actgaaggctggaccaaaaacttca

SEQ ID NO: 95740 - DNA, 25 bp, Rattus norvegicus
actgaaggctggtccaaaaacttca

SEQ ID NO: 95741 - DNA, 25 bp, Rattus norvegicus
actgaagtcattaaacaggtacctt

SEQ ID NO: 95742 - DNA, 25 bp, Rattus norvegicus
actgaagtcatttaacaggtacctt

SEQ ID NO: 95743 - DNA, 25 bp, Rattus norvegicus
actgaagtccaacggttctgttttg

SEQ ID NO: 95744 - DNA, 25 bp, Rattus norvegicus
actgaagtccaagggttctgttttg

SEQ ID NO: 95745 - DNA, 25 bp, Rattus norvegicus
actgaagtccttatgtctcttactg

SEQ ID NO: 95746 - DNA, 25 bp, Rattus norvegicus
actgaagtccttttgtctcttactg

SEQ ID NO: 95747 - DNA, 25 bp, Rattus norvegicus
actgaagtcggtcctgttgactcca

SEQ ID NO: 95748 - DNA, 25 bp, Rattus norvegicus
actgaagtcggtgctgttgactcca

SEQ ID NO: 95749 - DNA, 25 bp, Rattus norvegicus
actgaagtcgtgaaggccaaggctg

SEQ ID NO: 95750 - DNA, 25 bp, Rattus norvegicus
actgaagtcgtgtaggccaaggctg

SEQ ID NO: 95751 - DNA, 25 bp, Rattus norvegicus
actgaagtcttgaacactggagtgt

SEQ ID NO: 95752 - DNA, 25 bp, Rattus norvegicus
actgaagtcttgtacactggagtgt

SEQ ID NO: 95753 - DNA, 25 bp, Rattus norvegicus
actgaagtgcccaggagtgcgctga

SEQ ID NO: 95754 - DNA, 25 bp, Rattus norvegicus
actgaagtgccctggagtgcgctga

SEQ ID NO: 95755 - DNA, 25 bp, Rattus norvegicus
actgaagtgcggctccacggactgc

SEQ ID NO: 95756 - DNA, 25 bp, Rattus norvegicus
actgaagtgcgggtccacggactgc

SEQ ID NO: 95757 - DNA, 25 bp, Rattus norvegicus
actgaagtgtccagagggaggtaca

SEQ ID NO: 95758 - DNA, 25 bp, Rattus norvegicus
actgaagtgtcctgagggaggtaca

SEQ ID NO: 95759 - DNA, 25 bp, Rattus norvegicus
actgaataaaacagtccccatattt

SEQ ID NO: 95760 - DNA, 25 bp, Rattus norvegicus
actgaataaaactgtccccatattt

SEQ ID NO: 95761 - DNA, 25 bp, Rattus norvegicus
actgaataaactagtccactgcctt

SEQ ID NO: 95762 - DNA, 25 bp, Rattus norvegicus
actgaataaactcccaccctttctg

SEQ ID NO: 95763 - DNA, 25 bp, Rattus norvegicus
actgaataaactgccaccctttctg

SEQ ID NO: 95764 - DNA, 25 bp, Rattus norvegicus
actgaataaacttgtccactgcctt

SEQ ID NO: 95765 - DNA, 25 bp, Rattus norvegicus
actgaatacgttactggagatctgc

SEQ ID NO: 95766 - DNA, 25 bp, Rattus norvegicus
actgaatacgtttctggagatctgc

SEQ ID NO: 95767 - DNA, 25 bp, Rattus norvegicus
actgaatatagtccacgtgatacaa

SEQ ID NO: 95768 - DNA, 25 bp, Rattus norvegicus
actgaatatagtgcacgtgatacaa

SEQ ID NO: 95769 - DNA, 25 bp, Rattus norvegicus
actgaatctgtacctttcatacaat

SEQ ID NO: 95770 - DNA, 25 bp, Rattus norvegicus
actgaatctgtagctttcatacaat

SEQ ID NO: 95771 - DNA, 25 bp, Rattus norvegicus
actgaatctgtgaccccgtgttagt

SEQ ID NO: 95772 - DNA, 25 bp, Rattus norvegicus
actgaatctgtgtccccgtgttagt

SEQ ID NO: 95773 - DNA, 25 bp, Rattus norvegicus
actgaatgccggctctggctagagc

SEQ ID NO: 95774 - DNA, 25 bp, Rattus norvegicus
actgaatgccgggtctggctagagc

SEQ ID NO: 95775 - DNA, 25 bp, Rattus norvegicus
actgaatgccttactatttggatag

SEQ ID NO: 95776 - DNA, 25 bp, Rattus norvegicus
actgaatgcctttctatttggatag

SEQ ID NO: 95777 - DNA, 25 bp, Rattus norvegicus
actgaatggctacgtgattccctcc

SEQ ID NO: 95778 - DNA, 25 bp, Rattus norvegicus
actgaatggctaggtgattccctcc

SEQ ID NO: 95779 - DNA, 25 bp, Rattus norvegicus
actgaatggtgtccagcctggtgcc

SEQ ID NO: 95780 - DNA, 25 bp, Rattus norvegicus
actgaatggtgtgcagcctggtgcc

SEQ ID NO: 95781 - DNA, 25 bp, Rattus norvegicus
actgaatgtatgagaagctggtgct

SEQ ID NO: 95782 - DNA, 25 bp, Rattus norvegicus
actgaatgtatgtgaagctggtgct

SEQ ID NO: 95783 - DNA, 25 bp, Rattus norvegicus
actgaatgtttcatagccttccact

SEQ ID NO: 95784 - DNA, 25 bp, Rattus norvegicus
actgaatgtttcttagccttccact

SEQ ID NO: 95785 - DNA, 25 bp, Rattus norvegicus
actgaattgggtccatgtctgtcca

SEQ ID NO: 95786 - DNA, 25 bp, Rattus norvegicus
actgaattgggtgcatgtctgtcca

SEQ ID NO: 95787 - DNA, 25 bp, Rattus norvegicus
actgaatttaaaattccatactggg

SEQ ID NO: 95788 - DNA, 25 bp, Rattus norvegicus
actgaatttaaatttccatactggg

SEQ ID NO: 95789 - DNA, 25 bp, Rattus norvegicus
actgacaatggcctttttgttccaa

SEQ ID NO: 95790 - DNA, 25 bp, Rattus norvegicus
actgacaatggcgtttttgttccaa

SEQ ID NO: 95791 - DNA, 25 bp, Rattus norvegicus
actgacacagtccactttttgcaag

SEQ ID NO: 95792 - DNA, 25 bp, Rattus norvegicus
actgacacagtcgactttttgcaag

SEQ ID NO: 95793 - DNA, 25 bp, Rattus norvegicus
actgacacctgtccagatgtgggat

SEQ ID NO: 95794 - DNA, 25 bp, Rattus norvegicus
actgacacctgtgcagatgtgggat

SEQ ID NO: 95795 - DNA, 25 bp, Rattus norvegicus
actgacactcggctctcatggcaga

SEQ ID NO: 95796 - DNA, 25 bp, Rattus norvegicus
actgacactcgggtctcatggcaga

SEQ ID NO: 95797 - DNA, 25 bp, Rattus norvegicus
actgacagcagtagtacctctggta

SEQ ID NO: 95798 - DNA, 25 bp, Rattus norvegicus
actgacagcagttgtacctctggta

SEQ ID NO: 95799 - DNA, 25 bp, Rattus norvegicus
actgacagccaccttgtgcagcctg

SEQ ID NO: 95800 - DNA, 25 bp, Rattus norvegicus
actgacagccacgttgtgcagcctg

SEQ ID NO: 95801 - DNA, 25 bp, Rattus norvegicus
actgacagctttacactgtgtctta

SEQ ID NO: 95802 - DNA, 25 bp, Rattus norvegicus
actgacagcttttcactgtgtctta

SEQ ID NO: 95803 - DNA, 25 bp, Rattus norvegicus
actgacagtgctaccaggcgtgcca

SEQ ID NO: 95804 - DNA, 25 bp, Rattus norvegicus
actgacagtgcttccaggcgtgcca

SEQ ID NO: 95805 - DNA, 25 bp, Rattus norvegicus
actgacagtgtgactactggctcca

SEQ ID NO: 95806 - DNA, 25 bp, Rattus norvegicus
actgacagtgtgtctactggctcca

SEQ ID NO: 95807 - DNA, 25 bp, Rattus norvegicus
actgacatctagaggtcgcttgtat

SEQ ID NO: 95808 - DNA, 25 bp, Rattus norvegicus
actgacatctagtggtcgcttgtat

SEQ ID NO: 95809 - DNA, 25 bp, Rattus norvegicus
actgaccacaggacggccatgttag

SEQ ID NO: 95810 - DNA, 25 bp, Rattus norvegicus
actgaccacaggtcggccatgttag

SEQ ID NO: 95811 - DNA, 25 bp, Rattus norvegicus
actgaccactctaccagaggacagg

SEQ ID NO: 95812 - DNA, 25 bp, Rattus norvegicus
actgaccactcttccagaggacagg

SEQ ID NO: 95813 - DNA, 25 bp, Rattus norvegicus
actgacccagttcccactttggtgc

SEQ ID NO: 95814 - DNA, 25 bp, Rattus norvegicus
actgacccagttgccactttggtgc

SEQ ID NO: 95815 - DNA, 25 bp, Rattus norvegicus
actgaccccaaacaggactctgaaa

SEQ ID NO: 95816 - DNA, 25 bp, Rattus norvegicus
actgaccccaaagaggactctgaaa

SEQ ID NO: 95817 - DNA, 25 bp, Rattus norvegicus
actgacccctgtaacctatagttgt

SEQ ID NO: 95818 - DNA, 25 bp, Rattus norvegicus
actgacccctgttacctatagttgt

SEQ ID NO: 95819 - DNA, 25 bp, Rattus norvegicus
actgaccccttgataacgtatctag

SEQ ID NO: 95820 - DNA, 25 bp, Rattus norvegicus
actgaccccttgttaacgtatctag

SEQ ID NO: 95821 - DNA, 25 bp, Rattus norvegicus
actgaccctcgactcttgtaagaga

SEQ ID NO: 95822 - DNA, 25 bp, Rattus norvegicus
actgaccctcgagtcttgtaagaga

SEQ ID NO: 95823 - DNA, 25 bp, Rattus norvegicus
actgaccctgacaggcagtgtgaca

SEQ ID NO: 95824 - DNA, 25 bp, Rattus norvegicus
actgaccctgactggcagtgtgaca

SEQ ID NO: 95825 - DNA, 25 bp, Rattus norvegicus
actgaccgcacgagcataccggaga

SEQ ID NO: 95826 - DNA, 25 bp, Rattus norvegicus
actgaccgcacgtgcataccggaga

SEQ ID NO: 95827 - DNA, 25 bp, Rattus norvegicus
actgaccggatgaaagaatctttat

SEQ ID NO: 95828 - DNA, 25 bp, Rattus norvegicus
actgaccggatgtaagaatctttat

SEQ ID NO: 95829 - DNA, 25 bp, Rattus norvegicus
actgaccgtggtagtgttgttttct

SEQ ID NO: 95830 - DNA, 25 bp, Rattus norvegicus
actgaccgtggttgtgttgttttct

SEQ ID NO: 95831 - DNA, 25 bp, Rattus norvegicus
actgacctagttctgttagtcccag

SEQ ID NO: 95832 - DNA, 25 bp, Rattus norvegicus
actgacctagttgtgttagtcccag

SEQ ID NO: 95833 - DNA, 25 bp, Rattus norvegicus
actgacctctcactggttgcagtgt

SEQ ID NO: 95834 - DNA, 25 bp, Rattus norvegicus
actgacctctcagtggttgcagtgt

SEQ ID NO: 95835 - DNA, 25 bp, Rattus norvegicus
actgacctgcgaacttttcgaatgc

SEQ ID NO: 95836 - DNA, 25 bp, Rattus norvegicus
actgacctgcgatcttttcgaatgc

SEQ ID NO: 95837 - DNA, 25 bp, Rattus norvegicus
actgacctggtgaatttatgtgact

SEQ ID NO: 95838 - DNA, 25 bp, Rattus norvegicus
actgacctggtgtatttatgtgact

SEQ ID NO: 95839 - DNA, 25 bp, Rattus norvegicus
actgacctgtgacctcatgagagca

SEQ ID NO: 95840 - DNA, 25 bp, Rattus norvegicus
actgacctgtgagctcatgagagca

SEQ ID NO: 95841 - DNA, 25 bp, Rattus norvegicus
actgacctgtttagggacatattac

SEQ ID NO: 95842 - DNA, 25 bp, Rattus norvegicus
actgacctgttttgggacatattac

SEQ ID NO: 95843 - DNA, 25 bp, Rattus norvegicus
actgacgcacatcaatgcttctagg

SEQ ID NO: 95844 - DNA, 25 bp, Rattus norvegicus
actgacgcacatgaatgcttctagg

SEQ ID NO: 95845 - DNA, 25 bp, Rattus norvegicus
actgacgcagacacgtgacagatct

SEQ ID NO: 95846 - DNA, 25 bp, Rattus norvegicus
actgacgcagactcgtgacagatct

SEQ ID NO: 95847 - DNA, 25 bp, Rattus norvegicus
actgacgctagtcacggaggtctcc

SEQ ID NO: 95848 - DNA, 25 bp, Rattus norvegicus
actgacgctagtgacggaggtctcc

SEQ ID NO: 95849 - DNA, 25 bp, Rattus norvegicus
actgacgctcagaacagccacggtg

SEQ ID NO: 95850 - DNA, 25 bp, Rattus norvegicus
actgacgctcagtacagccacggtg

SEQ ID NO: 95851 - DNA, 25 bp, Rattus norvegicus
actgacggcttcaggacatctaatt

SEQ ID NO: 95852 - DNA, 25 bp, Rattus norvegicus
actgacggcttctggacatctaatt

SEQ ID NO: 95853 - DNA, 25 bp, Rattus norvegicus
actgacgtaaccatgtctagctgct

SEQ ID NO: 95854 - DNA, 25 bp, Rattus norvegicus
actgacgtaaccttgtctagctgct

SEQ ID NO: 95855 - DNA, 25 bp, Rattus norvegicus
actgacgtcattatgtctggcagcc

SEQ ID NO: 95856 - DNA, 25 bp, Rattus norvegicus
actgacgtcattttgtctggcagcc

SEQ ID NO: 95857 - DNA, 25 bp, Rattus norvegicus
actgacgtggcaacaacatggagat

SEQ ID NO: 95858 - DNA, 25 bp, Rattus norvegicus
actgacgtggcatcaacatggagat

SEQ ID NO: 95859 - DNA, 25 bp, Rattus norvegicus
actgacgtgtatctcttctgttgta

SEQ ID NO: 95860 - DNA, 25 bp, Rattus norvegicus
actgacgtgtatgtcttctgttgta

SEQ ID NO: 95861 - DNA, 25 bp, Rattus norvegicus
actgacgtgtctatatttccttcta

SEQ ID NO: 95862 - DNA, 25 bp, Rattus norvegicus
actgacgtgtctttatttccttcta

SEQ ID NO: 95863 - DNA, 25 bp, Rattus norvegicus
actgactacaacacattgaatcctt

SEQ ID NO: 95864 - DNA, 25 bp, Rattus norvegicus
actgactacaactcattgaatcctt

SEQ ID NO: 95865 - DNA, 25 bp, Rattus norvegicus
actgactaccaacgctttctgtttg

SEQ ID NO: 95866 - DNA, 25 bp, Rattus norvegicus
actgactaccaaggctttctgtttg

SEQ ID NO: 95867 - DNA, 25 bp, Rattus norvegicus
actgactaccttctcatgctcagag

SEQ ID NO: 95868 - DNA, 25 bp, Rattus norvegicus
actgactaccttgtcatgctcagag

SEQ ID NO: 95869 - DNA, 25 bp, Rattus norvegicus
actgactagctccatgtgatacaca

SEQ ID NO: 95870 - DNA, 25 bp, Rattus norvegicus
actgactagctcgatgtgatacaca

SEQ ID NO: 95871 - DNA, 25 bp, Rattus norvegicus
actgactatgtgcatcaggcatcaa

SEQ ID NO: 95872 - DNA, 25 bp, Rattus norvegicus
actgactatgtggatcaggcatcaa

SEQ ID NO: 95873 - DNA, 25 bp, Rattus norvegicus
actgactcatgtcgttgtctaacat

SEQ ID NO: 95874 - DNA, 25 bp, Rattus norvegicus
actgactcatgtggttgtctaacat

SEQ ID NO: 95875 - DNA, 25 bp, Rattus norvegicus
actgactccaacctggaaaccattg

SEQ ID NO: 95876 - DNA, 25 bp, Rattus norvegicus
actgactccaacgtggaaaccattg

SEQ ID NO: 95877 - DNA, 25 bp, Rattus norvegicus
actgactctactcttgcctttatct

SEQ ID NO: 95878 - DNA, 25 bp, Rattus norvegicus
actgactctactgttgcctttatct

SEQ ID NO: 95879 - DNA, 25 bp, Rattus norvegicus
actgactctagacacactttgctgt

SEQ ID NO: 95880 - DNA, 25 bp, Rattus norvegicus
actgactctagagacactttgctgt

SEQ ID NO: 95881 - DNA, 25 bp, Rattus norvegicus
actgactctcttagctactacataa

SEQ ID NO: 95882 - DNA, 25 bp, Rattus norvegicus
actgactctctttgctactacataa

SEQ ID NO: 95883 - DNA, 25 bp, Rattus norvegicus
actgactctgctccagcgggcagga

SEQ ID NO: 95884 - DNA, 25 bp, Rattus norvegicus
actgactctgctgcagcgggcagga

SEQ ID NO: 95885 - DNA, 25 bp, Rattus norvegicus
actgactgcaggcacgcgatgcgcc

SEQ ID NO: 95886 - DNA, 25 bp, Rattus norvegicus
actgactgcagggacgcgatgcgcc

SEQ ID NO: 95887 - DNA, 25 bp, Rattus norvegicus
actgactgcattagggttcttccga

SEQ ID NO: 95888 - DNA, 25 bp, Rattus norvegicus
actgactgcatttgggttcttccga

SEQ ID NO: 95889 - DNA, 25 bp, Rattus norvegicus
actgactgggagaggctgtgttcat

SEQ ID NO: 95890 - DNA, 25 bp, Rattus norvegicus
actgactgggagtggctgtgttcat

SEQ ID NO: 95891 - DNA, 25 bp, Rattus norvegicus
actgactgggtcattatcgtattcc

SEQ ID NO: 95892 - DNA, 25 bp, Rattus norvegicus
actgactgggtctttatcgtattcc

SEQ ID NO: 95893 - DNA, 25 bp, Rattus norvegicus
actgactgtgacagtccttggacta

SEQ ID NO: 95894 - DNA, 25 bp, Rattus norvegicus
actgactgtgactgtccttggacta

SEQ ID NO: 95895 - DNA, 25 bp, Rattus norvegicus
actgactgtgatagtgaccaggtaa

SEQ ID NO: 95896 - DNA, 25 bp, Rattus norvegicus
actgactgtgattgtgaccaggtaa

SEQ ID NO: 95897 - DNA, 25 bp, Rattus norvegicus
actgactgtgccaaccatcgacgag

SEQ ID NO: 95898 - DNA, 25 bp, Rattus norvegicus
actgactgtgcctaccatcgacgag

SEQ ID NO: 95899 - DNA, 25 bp, Rattus norvegicus
actgactgtgtcctttcttgaactg

SEQ ID NO: 95900 - DNA, 25 bp, Rattus norvegicus
actgactgtgtcgtttcttgaactg

SEQ ID NO: 95901 - DNA, 25 bp, Rattus norvegicus
actgacttactaaattttcccttat

SEQ ID NO: 95902 - DNA, 25 bp, Rattus norvegicus
actgacttactatattttcccttat

SEQ ID NO: 95903 - DNA, 25 bp, Rattus norvegicus
actgacttatttactctctgtgcct

SEQ ID NO: 95904 - DNA, 25 bp, Rattus norvegicus
actgacttattttctctctgtgcct

SEQ ID NO: 95905 - DNA, 25 bp, Rattus norvegicus
actgacttctatccctcctctgagg

SEQ ID NO: 95906 - DNA, 25 bp, Rattus norvegicus
actgacttctatgcctcctctgagg

SEQ ID NO: 95907 - DNA, 25 bp, Rattus norvegicus
actgacttctcaacggacacaatgg

SEQ ID NO: 95908 - DNA, 25 bp, Rattus norvegicus
actgacttctcatcggacacaatgg

SEQ ID NO: 95909 - DNA, 25 bp, Rattus norvegicus
actgacttctggatgttctgaggcc

SEQ ID NO: 95910 - DNA, 25 bp, Rattus norvegicus
actgacttctggttgttctgaggcc

SEQ ID NO: 95911 - DNA, 25 bp, Rattus norvegicus
actgacttctgtctcttcagcaaga

SEQ ID NO: 95912 - DNA, 25 bp, Rattus norvegicus
actgacttctgtgtcttcagcaaga

SEQ ID NO: 95913 - DNA, 25 bp, Rattus norvegicus
actgacttcttaccccgctagaaat

SEQ ID NO: 95914 - DNA, 25 bp, Rattus norvegicus
actgacttcttagcccgctagaaat

SEQ ID NO: 95915 - DNA, 25 bp, Rattus norvegicus
actgacttgattctcttttgtatct

SEQ ID NO: 95916 - DNA, 25 bp, Rattus norvegicus
actgacttgattgtcttttgtatct

SEQ ID NO: 95917 - DNA, 25 bp, Rattus norvegicus
actgacttggcccttacctctgtct

SEQ ID NO: 95918 - DNA, 25 bp, Rattus norvegicus
actgacttggccgttacctctgtct

SEQ ID NO: 95919 - DNA, 25 bp, Rattus norvegicus
actgacttgggtcttctgtagtttt

SEQ ID NO: 95920 - DNA, 25 bp, Rattus norvegicus
actgacttgggtgttctgtagtttt

SEQ ID NO: 95921 - DNA, 25 bp, Rattus norvegicus
actgactttaggcatggagacaatt

SEQ ID NO: 95922 - DNA, 25 bp, Rattus norvegicus
actgactttagggatggagacaatt

SEQ ID NO: 95923 - DNA, 25 bp, Rattus norvegicus
actgacttttacacatcgttgggtt

SEQ ID NO: 95924 - DNA, 25 bp, Rattus norvegicus
actgacttttactcatcgttgggtt

SEQ ID NO: 95925 - DNA, 25 bp, Rattus norvegicus
actgacttttgtatgacactgtcta

SEQ ID NO: 95926 - DNA, 25 bp, Rattus norvegicus
actgacttttgtttgacactgtcta

SEQ ID NO: 95927 - DNA, 25 bp, Rattus norvegicus
actgacttttttccagaggttctga

SEQ ID NO: 95928 - DNA, 25 bp, Rattus norvegicus
actgacttttttgcagaggttctga

SEQ ID NO: 95929 - DNA, 25 bp, Rattus norvegicus
actgagaaactgagagcctgtgatt

SEQ ID NO: 95930 - DNA, 25 bp, Rattus norvegicus
actgagaaactgtgagcctgtgatt

SEQ ID NO: 95931 - DNA, 25 bp, Rattus norvegicus
actgagaaatctctggtgctccttt

SEQ ID NO: 95932 - DNA, 25 bp, Rattus norvegicus
actgagaaatctgtggtgctccttt

SEQ ID NO: 95933 - DNA, 25 bp, Rattus norvegicus
actgagaaggttccgagagcacact

SEQ ID NO: 95934 - DNA, 25 bp, Rattus norvegicus
actgagaaggttgcgagagcacact

SEQ ID NO: 95935 - DNA, 25 bp, Rattus norvegicus
actgagaagttactcctcactcact

SEQ ID NO: 95936 - DNA, 25 bp, Rattus norvegicus
actgagaagttagtcctcactcact

SEQ ID NO: 95937 - DNA, 25 bp, Rattus norvegicus
actgagacccagcaaggcaccggaa

SEQ ID NO: 95938 - DNA, 25 bp, Rattus norvegicus
actgagacccaggaaggcaccggaa

SEQ ID NO: 95939 - DNA, 25 bp, Rattus norvegicus
actgagaccggcagcctggatgaag

SEQ ID NO: 95940 - DNA, 25 bp, Rattus norvegicus
actgagaccggctgcctggatgaag

SEQ ID NO: 95941 - DNA, 25 bp, Rattus norvegicus
actgagagacagatccagagcctcc

SEQ ID NO: 95942 - DNA, 25 bp, Rattus norvegicus
actgagagacagttccagagcctcc

SEQ ID NO: 95943 - DNA, 25 bp, Rattus norvegicus
actgagagctcaaataccaccattg

SEQ ID NO: 95944 - DNA, 25 bp, Rattus norvegicus
actgagagctcatataccaccattg

SEQ ID NO: 95945 - DNA, 25 bp, Rattus norvegicus
actgagatgtgtcctttagctgctg

SEQ ID NO: 95946 - DNA, 25 bp, Rattus norvegicus
actgagatgtgtgctttagctgctg

SEQ ID NO: 95947 - DNA, 25 bp, Rattus norvegicus
actgagattatccatgttcctccca

SEQ ID NO: 95948 - DNA, 25 bp, Rattus norvegicus
actgagattatcgatgttcctccca

SEQ ID NO: 95949 - DNA, 25 bp, Rattus norvegicus
actgagcaactgaacctcttatgtt

SEQ ID NO: 95950 - DNA, 25 bp, Rattus norvegicus
actgagcaactgtacctcttatgtt

SEQ ID NO: 95951 - DNA, 25 bp, Rattus norvegicus
actgagcactttccccttagagaaa

SEQ ID NO: 95952 - DNA, 25 bp, Rattus norvegicus
actgagcactttgcccttagagaaa

SEQ ID NO: 95953 - DNA, 25 bp, Rattus norvegicus
actgagcagcaaaggccttggccat

SEQ ID NO: 95954 - DNA, 25 bp, Rattus norvegicus
actgagcagcaatggccttggccat

SEQ ID NO: 95955 - DNA, 25 bp, Rattus norvegicus
actgagcagcagcatgtctggaaca

SEQ ID NO: 95956 - DNA, 25 bp, Rattus norvegicus
actgagcagcaggatgtctggaaca

SEQ ID NO: 95957 - DNA, 25 bp, Rattus norvegicus
actgagcatctactgaattcttgga

SEQ ID NO: 95958 - DNA, 25 bp, Rattus norvegicus
actgagcatctagtgaattcttgga

SEQ ID NO: 95959 - DNA, 25 bp, Rattus norvegicus
actgagccaaatcccttgtgtggct

SEQ ID NO: 95960 - DNA, 25 bp, Rattus norvegicus
actgagccaaatgccttgtgtggct

SEQ ID NO: 95961 - DNA, 25 bp, Rattus norvegicus
actgagccagccaaggtgatggact

SEQ ID NO: 95962 - DNA, 25 bp, Rattus norvegicus
actgagccagccatgaggtgagaac

SEQ ID NO: 95963 - DNA, 25 bp, Rattus norvegicus
actgagccagcctaggtgatggact

SEQ ID NO: 95964 - DNA, 25 bp, Rattus norvegicus
actgagccagccttgaggtgagaac

SEQ ID NO: 95965 - DNA, 25 bp, Rattus norvegicus
actgagccagggagtttcttgtttt

SEQ ID NO: 95966 - DNA, 25 bp, Rattus norvegicus
actgagccagggtgtttcttgtttt

SEQ ID NO: 95967 - DNA, 25 bp, Rattus norvegicus
actgagccccggacagcagatggga

SEQ ID NO: 95968 - DNA, 25 bp, Rattus norvegicus
actgagccccggtcagcagatggga

SEQ ID NO: 95969 - DNA, 25 bp, Rattus norvegicus
actgagccctggctcccaagggctg

SEQ ID NO: 95970 - DNA, 25 bp, Rattus norvegicus
actgagccctgggtcccaagggctg

SEQ ID NO: 95971 - DNA, 25 bp, Rattus norvegicus
actgagccgtcccatcgatcgatcg

SEQ ID NO: 95972 - DNA, 25 bp, Rattus norvegicus
actgagccgtccgatcgatcgatcg

SEQ ID NO: 95973 - DNA, 25 bp, Rattus norvegicus
actgagcctacccatgtgatacaaa

SEQ ID NO: 95974 - DNA, 25 bp, Rattus norvegicus
actgagcctaccgatgtgatacaaa

SEQ ID NO: 95975 - DNA, 25 bp, Rattus norvegicus
actgagcctcagagatgcatgctta

SEQ ID NO: 95976 - DNA, 25 bp, Rattus norvegicus
actgagcctcagtgatgcatgctta

SEQ ID NO: 95977 - DNA, 25 bp, Rattus norvegicus
actgagccttgaatttgactattaa

SEQ ID NO: 95978 - DNA, 25 bp, Rattus norvegicus
actgagccttgattttgactattaa

SEQ ID NO: 95979 - DNA, 25 bp, Rattus norvegicus
actgagctccttaagtaaaatggta

SEQ ID NO: 95980 - DNA, 25 bp, Rattus norvegicus
actgagctcctttagtaaaatggta

SEQ ID NO: 95981 - DNA, 25 bp, Rattus norvegicus
actgagctctgtccacggatttctg

SEQ ID NO: 95982 - DNA, 25 bp, Rattus norvegicus
actgagctctgtgcacggatttctg

SEQ ID NO: 95983 - DNA, 25 bp, Rattus norvegicus
actgagctcttaattttaaccattg

SEQ ID NO: 95984 - DNA, 25 bp, Rattus norvegicus
actgagctcttatttttaaccattg

SEQ ID NO: 95985 - DNA, 25 bp, Rattus norvegicus
actgagctgctcatctttgagatcc

SEQ ID NO: 95986 - DNA, 25 bp, Rattus norvegicus
actgagctgctcttctttgagatcc

SEQ ID NO: 95987 - DNA, 25 bp, Rattus norvegicus
actgagctgttgcttaagatctaaa

SEQ ID NO: 95988 - DNA, 25 bp, Rattus norvegicus
actgagctgttggttaagatctaaa

SEQ ID NO: 95989 - DNA, 25 bp, Rattus norvegicus
actgagcttcttactctgtagtgga

SEQ ID NO: 95990 - DNA, 25 bp, Rattus norvegicus
actgagcttctttctctgtagtgga

SEQ ID NO: 95991 - DNA, 25 bp, Rattus norvegicus
actgagcttgggacacagaagcagc

SEQ ID NO: 95992 - DNA, 25 bp, Rattus norvegicus
actgagcttgggtcacagaagcagc

SEQ ID NO: 95993 - DNA, 25 bp, Rattus norvegicus
actgagcttgttcgtgcccgggcat

SEQ ID NO: 95994 - DNA, 25 bp, Rattus norvegicus
actgagcttgttggtgcccgggcat

SEQ ID NO: 95995 - DNA, 25 bp, Rattus norvegicus
actgaggaacacatgcctttctggc

SEQ ID NO: 95996 - DNA, 25 bp, Rattus norvegicus
actgaggaacacttgcctttctggc

SEQ ID NO: 95997 - DNA, 25 bp, Rattus norvegicus
actgaggaacagaggcctgccatga

SEQ ID NO: 95998 - DNA, 25 bp, Rattus norvegicus
actgaggaacagtggcctgccatga

SEQ ID NO: 95999 - DNA, 25 bp, Rattus norvegicus
actgaggaaggtccccaagccgagc

SEQ ID NO: 96000 - DNA, 25 bp, Rattus norvegicus
actgaggaaggtgcccaagccgagc

SEQ ID NO: 96001 - DNA, 25 bp, Rattus norvegicus
actgaggaatataaggtggctgcaa

SEQ ID NO: 96002 - DNA, 25 bp, Rattus norvegicus
actgaggaatattaggtggctgcaa

SEQ ID NO: 96003 - DNA, 25 bp, Rattus norvegicus
actgaggaattgctgctgtctctct

SEQ ID NO: 96004 - DNA, 25 bp, Rattus norvegicus
actgaggaattggtgctgtctctct

SEQ ID NO: 96005 - DNA, 25 bp, Rattus norvegicus
actgaggacgttaagaaataggact

SEQ ID NO: 96006 - DNA, 25 bp, Rattus norvegicus
actgaggacgtttagaaataggact

SEQ ID NO: 96007 - DNA, 25 bp, Rattus norvegicus
actgaggactacctgtagctggctg

SEQ ID NO: 96008 - DNA, 25 bp, Rattus norvegicus
actgaggactacgtgtagctggctg

SEQ ID NO: 96009 - DNA, 25 bp, Rattus norvegicus
actgaggagaagagacagcctttct

SEQ ID NO: 96010 - DNA, 25 bp, Rattus norvegicus
actgaggagaagtgacagcctttct

SEQ ID NO: 96011 - DNA, 25 bp, Rattus norvegicus
actgaggaggccctgttcttccatg

SEQ ID NO: 96012 - DNA, 25 bp, Rattus norvegicus
actgaggaggccgtgttcttccatg

SEQ ID NO: 96013 - DNA, 25 bp, Rattus norvegicus
actgaggagttcactgactgagcaa

SEQ ID NO: 96014 - DNA, 25 bp, Rattus norvegicus
actgaggagttctctgactgagcaa

SEQ ID NO: 96015 - DNA, 25 bp, Rattus norvegicus
actgaggatcagctgtgtctttccc

SEQ ID NO: 96016 - DNA, 25 bp, Rattus norvegicus
actgaggatcaggtgtgtctttccc

SEQ ID NO: 96017 - DNA, 25 bp, Rattus norvegicus
actgaggatgcaactggacccatgt

SEQ ID NO: 96018 - DNA, 25 bp, Rattus norvegicus
actgaggatgcatctggacccatgt

SEQ ID NO: 96019 - DNA, 25 bp, Rattus norvegicus
actgaggccattctcactgagggtt

SEQ ID NO: 96020 - DNA, 25 bp, Rattus norvegicus
actgaggccattgtcactgagggtt

SEQ ID NO: 96021 - DNA, 25 bp, Rattus norvegicus
actgaggccctgaagtcaagtgcat

SEQ ID NO: 96022 - DNA, 25 bp, Rattus norvegicus
actgaggccctgtagtcaagtgcat

SEQ ID NO: 96023 - DNA, 25 bp, Rattus norvegicus
actgaggcctctatttctgcttgtt

SEQ ID NO: 96024 - DNA, 25 bp, Rattus norvegicus
actgaggcctctttttctgcttgtt

SEQ ID NO: 96025 - DNA, 25 bp, Rattus norvegicus
actgaggccttcagcgggtctatag

SEQ ID NO: 96026 - DNA, 25 bp, Rattus norvegicus
actgaggccttctgcgggtctatag

SEQ ID NO: 96027 - DNA, 25 bp, Rattus norvegicus
actgaggcgccgcacaatcctgctg

SEQ ID NO: 96028 - DNA, 25 bp, Rattus norvegicus
actgaggcgccggacaatcctgctg

SEQ ID NO: 96029 - DNA, 25 bp, Rattus norvegicus
actgaggcggtacctcaggctgtat

SEQ ID NO: 96030 - DNA, 25 bp, Rattus norvegicus
actgaggcggtagctcaggctgtat

SEQ ID NO: 96031 - DNA, 25 bp, Rattus norvegicus
actgaggcggtgcatcaatcacgga

SEQ ID NO: 96032 - DNA, 25 bp, Rattus norvegicus
actgaggcggtggatcaatcacgga

SEQ ID NO: 96033 - DNA, 25 bp, Rattus norvegicus
actgagggacctcctgcttgggaat

SEQ ID NO: 96034 - DNA, 25 bp, Rattus norvegicus
actgagggacctgctgcttgggaat

SEQ ID NO: 96035 - DNA, 25 bp, Rattus norvegicus
actgagggagagacaccgtgaatct

SEQ ID NO: 96036 - DNA, 25 bp, Rattus norvegicus
actgagggagagtcaccgtgaatct

SEQ ID NO: 96037 - DNA, 25 bp, Rattus norvegicus
actgagggattgacgttagcaccca

SEQ ID NO: 96038 - DNA, 25 bp, Rattus norvegicus
actgagggattgtcgttagcaccca

SEQ ID NO: 96039 - DNA, 25 bp, Rattus norvegicus
actgagggcaaaactgggcactcca

SEQ ID NO: 96040 - DNA, 25 bp, Rattus norvegicus
actgagggcaaatctgggcactcca

SEQ ID NO: 96041 - DNA, 25 bp, Rattus norvegicus
actgagggccagacattgagcaatg

SEQ ID NO: 96042 - DNA, 25 bp, Rattus norvegicus
actgagggccagtcattgagcaatg

SEQ ID NO: 96043 - DNA, 25 bp, Rattus norvegicus
actgagggcgcacaggtcctcttct

SEQ ID NO: 96044 - DNA, 25 bp, Rattus norvegicus
actgagggcgcagaggtcctcttct

SEQ ID NO: 96045 - DNA, 25 bp, Rattus norvegicus
actgagggtcgtcttgttggtcaca

SEQ ID NO: 96046 - DNA, 25 bp, Rattus norvegicus
actgagggtcgtgttgttggtcaca

SEQ ID NO: 96047 - DNA, 25 bp, Rattus norvegicus
actgagggtgtaacgatctgtctgt

SEQ ID NO: 96048 - DNA, 25 bp, Rattus norvegicus
actgagggtgtatcgatctgtctgt

SEQ ID NO: 96049 - DNA, 25 bp, Rattus norvegicus
actgaggtccaacttatggtggcct

SEQ ID NO: 96050 - DNA, 25 bp, Rattus norvegicus
actgaggtccaagttatggtggcct

SEQ ID NO: 96051 - DNA, 25 bp, Rattus norvegicus
actgaggtctaaccacatctgtgcc

SEQ ID NO: 96052 - DNA, 25 bp, Rattus norvegicus
actgaggtctaagcacatctgtgcc

SEQ ID NO: 96053 - DNA, 25 bp, Rattus norvegicus
actgaggtgaacacggaaggccttt

SEQ ID NO: 96054 - DNA, 25 bp, Rattus norvegicus
actgaggtgaactcggaaggccttt

SEQ ID NO: 96055 - DNA, 25 bp, Rattus norvegicus
actgaggtgccgcacccagcagggt

SEQ ID NO: 96056 - DNA, 25 bp, Rattus norvegicus
actgaggtgccggacccagcagggt

SEQ ID NO: 96057 - DNA, 25 bp, Rattus norvegicus
actgaggtgggcatgagcagctccc

SEQ ID NO: 96058 - DNA, 25 bp, Rattus norvegicus
actgaggtgggcttgagcagctccc

SEQ ID NO: 96059 - DNA, 25 bp, Rattus norvegicus
actgaggtgtgtcgaactgttgcaa

SEQ ID NO: 96060 - DNA, 25 bp, Rattus norvegicus
actgaggtgtgtggaactgttgcaa

SEQ ID NO: 96061 - DNA, 25 bp, Rattus norvegicus
actgaggtgttgctgttgtttctag

SEQ ID NO: 96062 - DNA, 25 bp, Rattus norvegicus
actgaggtgttggtgttgtttctag

SEQ ID NO: 96063 - DNA, 25 bp, Rattus norvegicus
actgaggttcagctgttgaaagaca

SEQ ID NO: 96064 - DNA, 25 bp, Rattus norvegicus
actgaggttcaggtgttgaaagaca

SEQ ID NO: 96065 - DNA, 25 bp, Rattus norvegicus
actgagtaccagcatgtccatttga

SEQ ID NO: 96066 - DNA, 25 bp, Rattus norvegicus
actgagtaccaggatgtccatttga

SEQ ID NO: 96067 - DNA, 25 bp, Rattus norvegicus
actgagtacctgcagctcacagcga

SEQ ID NO: 96068 - DNA, 25 bp, Rattus norvegicus
actgagtacctggagctcacagcga

SEQ ID NO: 96069 - DNA, 25 bp, Rattus norvegicus
actgagtagctcactgactgtcact

SEQ ID NO: 96070 - DNA, 25 bp, Rattus norvegicus
actgagtagctctctgactgtcact

SEQ ID NO: 96071 - DNA, 25 bp, Rattus norvegicus
actgagtcaccaatttcacacaaca

SEQ ID NO: 96072 - DNA, 25 bp, Rattus norvegicus
actgagtcaccattttcacacaaca

SEQ ID NO: 96073 - DNA, 25 bp, Rattus norvegicus
actgagtcaccgaggccagccgtga

SEQ ID NO: 96074 - DNA, 25 bp, Rattus norvegicus
actgagtcaccgtggccagccgtga

SEQ ID NO: 96075 - DNA, 25 bp, Rattus norvegicus
actgagtcactccatgctagctgct

SEQ ID NO: 96076 - DNA, 25 bp, Rattus norvegicus
actgagtcactcgatgctagctgct

SEQ ID NO: 96077 - DNA, 25 bp, Rattus norvegicus
actgagtccctgaatgttttatttt

SEQ ID NO: 96078 - DNA, 25 bp, Rattus norvegicus
actgagtccctgtatgttttatttt

SEQ ID NO: 96079 - DNA, 25 bp, Rattus norvegicus
actgagtcctttactgtgttcttga

SEQ ID NO: 96080 - DNA, 25 bp, Rattus norvegicus
actgagtccttttctgtgttcttga

SEQ ID NO: 96081 - DNA, 25 bp, Rattus norvegicus
actgagtctagaccctgcagtcctc

SEQ ID NO: 96082 - DNA, 25 bp, Rattus norvegicus
actgagtctagagcctgcagtcctc

SEQ ID NO: 96083 - DNA, 25 bp, Rattus norvegicus
actgagtctggcatttctcattaga

SEQ ID NO: 96084 - DNA, 25 bp, Rattus norvegicus
actgagtctggcttttctcattaga

SEQ ID NO: 96085 - DNA, 25 bp, Rattus norvegicus
actgagtctgtaacttacttggttc

SEQ ID NO: 96086 - DNA, 25 bp, Rattus norvegicus
actgagtctgtatcttacttggttc

SEQ ID NO: 96087 - DNA, 25 bp, Rattus norvegicus
actgagtcttgaagtctgtgcttgc

SEQ ID NO: 96088 - DNA, 25 bp, Rattus norvegicus
actgagtcttgatgtctgtgcttgc

SEQ ID NO: 96089 - DNA, 25 bp, Rattus norvegicus
actgagtgctttatgcagacactga

SEQ ID NO: 96090 - DNA, 25 bp, Rattus norvegicus
actgagtgctttttgcagacactga

SEQ ID NO: 96091 - DNA, 25 bp, Rattus norvegicus
actgagtggccaagcatcctgggta

SEQ ID NO: 96092 - DNA, 25 bp, Rattus norvegicus
actgagtggccatgcatcctgggta

SEQ ID NO: 96093 - DNA, 25 bp, Rattus norvegicus
actgagtgggaaactgtgctgtgtt

SEQ ID NO: 96094 - DNA, 25 bp, Rattus norvegicus
actgagtgggaatctgtgctgtgtt

SEQ ID NO: 96095 - DNA, 25 bp, Rattus norvegicus
actgagtgggtacatcttggttgct

SEQ ID NO: 96096 - DNA, 25 bp, Rattus norvegicus
actgagtgggtagatcttggttgct

SEQ ID NO: 96097 - DNA, 25 bp, Rattus norvegicus
actgagtgggttcgagccaccactg

SEQ ID NO: 96098 - DNA, 25 bp, Rattus norvegicus
actgagtgggttggagccaccactg

SEQ ID NO: 96099 - DNA, 25 bp, Rattus norvegicus
actgagtgtagaactgctcctgctg

SEQ ID NO: 96100 - DNA, 25 bp, Rattus norvegicus
actgagtgtagatctgctcctgctg

SEQ ID NO: 96101 - DNA, 25 bp, Rattus norvegicus
actgagtgtctgaccaccgtgaaat

SEQ ID NO: 96102 - DNA, 25 bp, Rattus norvegicus
actgagtgtctgtccaccgtgaaat

SEQ ID NO: 96103 - DNA, 25 bp, Rattus norvegicus
actgagttcagcactcttgtggtca

SEQ ID NO: 96104 - DNA, 25 bp, Rattus norvegicus
actgagttcagctctcttgtggtca

SEQ ID NO: 96105 - DNA, 25 bp, Rattus norvegicus
actgagttccagatgcgattgttgt

SEQ ID NO: 96106 - DNA, 25 bp, Rattus norvegicus
actgagttccagttgcgattgttgt

SEQ ID NO: 96107 - DNA, 25 bp, Rattus norvegicus
actgagttcgtcactgtggtcagat

SEQ ID NO: 96108 - DNA, 25 bp, Rattus norvegicus
actgagttcgtctctgtggtcagat

SEQ ID NO: 96109 - DNA, 25 bp, Rattus norvegicus
actgagttctatatgtcctctgact

SEQ ID NO: 96110 - DNA, 25 bp, Rattus norvegicus
actgagttctatttgtcctctgact

SEQ ID NO: 96111 - DNA, 25 bp, Rattus norvegicus
actgagttctggactattcctcggg

SEQ ID NO: 96112 - DNA, 25 bp, Rattus norvegicus
actgagttctggtctattcctcggg

SEQ ID NO: 96113 - DNA, 25 bp, Rattus norvegicus
actgagttggttacctgtcctgagc

SEQ ID NO: 96114 - DNA, 25 bp, Rattus norvegicus
actgagttggtttcctgtcctgagc

SEQ ID NO: 96115 - DNA, 25 bp, Rattus norvegicus
actgagttgtatctgcagcatgcac

SEQ ID NO: 96116 - DNA, 25 bp, Rattus norvegicus
actgagttgtatgtgcagcatgcac

SEQ ID NO: 96117 - DNA, 25 bp, Rattus norvegicus
actgataacctgattggtgcactga

SEQ ID NO: 96118 - DNA, 25 bp, Rattus norvegicus
actgataacctgtttggtgcactga

SEQ ID NO: 96119 - DNA, 25 bp, Rattus norvegicus
actgataatactaaaatggccacta

SEQ ID NO: 96120 - DNA, 25 bp, Rattus norvegicus
actgataatacttaaatggccacta

SEQ ID NO: 96121 - DNA, 25 bp, Rattus norvegicus
actgataatgcccaatgaccctctg

SEQ ID NO: 96122 - DNA, 25 bp, Rattus norvegicus
actgataatgccgaatgaccctctg

SEQ ID NO: 96123 - DNA, 25 bp, Rattus norvegicus
actgatacaatcatggtcttctgtg

SEQ ID NO: 96124 - DNA, 25 bp, Rattus norvegicus
actgatacaatcttggtcttctgtg

SEQ ID NO: 96125 - DNA, 25 bp, Rattus norvegicus
actgatagcggcacaaactggcacc

SEQ ID NO: 96126 - DNA, 25 bp, Rattus norvegicus
actgatagcggctcaaactggcacc

SEQ ID NO: 96127 - DNA, 25 bp, Rattus norvegicus
actgatagcttccaggacccatgga

SEQ ID NO: 96128 - DNA, 25 bp, Rattus norvegicus
actgatagcttcgaggacccatgga

SEQ ID NO: 96129 - DNA, 25 bp, Rattus norvegicus
actgataggtcgagcttctctcaga

SEQ ID NO: 96130 - DNA, 25 bp, Rattus norvegicus
actgataggtcgtgcttctctcaga

SEQ ID NO: 96131 - DNA, 25 bp, Rattus norvegicus
actgatatgcacatgtttgatgata

SEQ ID NO: 96132 - DNA, 25 bp, Rattus norvegicus
actgatatgcacttgtttgatgata

SEQ ID NO: 96133 - DNA, 25 bp, Rattus norvegicus
actgatcaacagcacacgtaatgga

SEQ ID NO: 96134 - DNA, 25 bp, Rattus norvegicus
actgatcaacaggacacgtaatgga

SEQ ID NO: 96135 - DNA, 25 bp, Rattus norvegicus
actgatcaacccactgttctgtgtt

SEQ ID NO: 96136 - DNA, 25 bp, Rattus norvegicus
actgatcaaccctctgttctgtgtt

SEQ ID NO: 96137 - DNA, 25 bp, Rattus norvegicus
actgatcagtgccacagccttggga

SEQ ID NO: 96138 - DNA, 25 bp, Rattus norvegicus
actgatcagtgcgacagccttggga

SEQ ID NO: 96139 - DNA, 25 bp, Rattus norvegicus
actgatcatcttatgttgcagctaa

SEQ ID NO: 96140 - DNA, 25 bp, Rattus norvegicus
actgatcatcttttgttgcagctaa

SEQ ID NO: 96141 - DNA, 25 bp, Rattus norvegicus
actgatcatgaacccgctggccact

SEQ ID NO: 96142 - DNA, 25 bp, Rattus norvegicus
actgatcatgaagccgctggccact

SEQ ID NO: 96143 - DNA, 25 bp, Rattus norvegicus
actgatcattgcaccttctgtaaag

SEQ ID NO: 96144 - DNA, 25 bp, Rattus norvegicus
actgatcattgctccttctgtaaag

SEQ ID NO: 96145 - DNA, 25 bp, Rattus norvegicus
actgatccatacatctgtgactctc

SEQ ID NO: 96146 - DNA, 25 bp, Rattus norvegicus
actgatccatacttctgtgactctc

SEQ ID NO: 96147 - DNA, 25 bp, Rattus norvegicus
actgatcccagaagccgtgatagct

SEQ ID NO: 96148 - DNA, 25 bp, Rattus norvegicus
actgatcccagatgccgtgatagct

SEQ ID NO: 96149 - DNA, 25 bp, Rattus norvegicus
actgatcctggtcaactcactggac

SEQ ID NO: 96150 - DNA, 25 bp, Rattus norvegicus
actgatcctggtgaactcactggac

SEQ ID NO: 96151 - DNA, 25 bp, Rattus norvegicus
actgatccttctcgtgtgggagagc

SEQ ID NO: 96152 - DNA, 25 bp, Rattus norvegicus
actgatccttctggtgtgggagagc

SEQ ID NO: 96153 - DNA, 25 bp, Rattus norvegicus
actgatcgggaaactggttcttcta

SEQ ID NO: 96154 - DNA, 25 bp, Rattus norvegicus
actgatcgggaatctggttcttcta

SEQ ID NO: 96155 - DNA, 25 bp, Rattus norvegicus
actgatcggtcaccacctgtgaatg

SEQ ID NO: 96156 - DNA, 25 bp, Rattus norvegicus
actgatcggtcagcacctgtgaatg

SEQ ID NO: 96157 - DNA, 25 bp, Rattus norvegicus
actgatctatgccatccatgctaag

SEQ ID NO: 96158 - DNA, 25 bp, Rattus norvegicus
actgatctatgcgatccatgctaag

SEQ ID NO: 96159 - DNA, 25 bp, Rattus norvegicus
actgatctctatacctgtttgtcac

SEQ ID NO: 96160 - DNA, 25 bp, Rattus norvegicus
actgatctctattcctgtttgtcac

SEQ ID NO: 96161 - DNA, 25 bp, Rattus norvegicus
actgatctgagtccacccttagaaa

SEQ ID NO: 96162 - DNA, 25 bp, Rattus norvegicus
actgatctgagtgcacccttagaaa

SEQ ID NO: 96163 - DNA, 25 bp, Rattus norvegicus
actgatctgatcacactgttttatg

SEQ ID NO: 96164 - DNA, 25 bp, Rattus norvegicus
actgatctgatctcactgttttatg

SEQ ID NO: 96165 - DNA, 25 bp, Rattus norvegicus
actgatctgggtactttgctctgga

SEQ ID NO: 96166 - DNA, 25 bp, Rattus norvegicus
actgatctgggttctttgctctgga

SEQ ID NO: 96167 - DNA, 25 bp, Rattus norvegicus
actgatctgtttatagtgccagcaa

SEQ ID NO: 96168 - DNA, 25 bp, Rattus norvegicus
actgatctgtttttagtgccagcaa

SEQ ID NO: 96169 - DNA, 25 bp, Rattus norvegicus
actgatcttcagctgtagtttagac

SEQ ID NO: 96170 - DNA, 25 bp, Rattus norvegicus
actgatcttcaggtgtagtttagac

SEQ ID NO: 96171 - DNA, 25 bp, Rattus norvegicus
actgatcttgcgagttctgtgttac

SEQ ID NO: 96172 - DNA, 25 bp, Rattus norvegicus
actgatcttgcgtgttctgtgttac

SEQ ID NO: 96173 - DNA, 25 bp, Rattus norvegicus
actgatgaccccatggagattttga

SEQ ID NO: 96174 - DNA, 25 bp, Rattus norvegicus
actgatgaccccttggagattttga

SEQ ID NO: 96175 - DNA, 25 bp, Rattus norvegicus
actgatgacctcacggatattgcct

SEQ ID NO: 96176 - DNA, 25 bp, Rattus norvegicus
actgatgacctctcggatattgcct

SEQ ID NO: 96177 - DNA, 25 bp, Rattus norvegicus
actgatgactggcagctgctcagcc

SEQ ID NO: 96178 - DNA, 25 bp, Rattus norvegicus
actgatgactgggagctgctcagcc

SEQ ID NO: 96179 - DNA, 25 bp, Rattus norvegicus
actgatgaggatactggccctgctc

SEQ ID NO: 96180 - DNA, 25 bp, Rattus norvegicus
actgatgaggattctggccctgctc

SEQ ID NO: 96181 - DNA, 25 bp, Rattus norvegicus
actgatgatacgcacccctggtggg

SEQ ID NO: 96182 - DNA, 25 bp, Rattus norvegicus
actgatgatacggacccctggtggg

SEQ ID NO: 96183 - DNA, 25 bp, Rattus norvegicus
actgatgatcatcccgtaaggtaca

SEQ ID NO: 96184 - DNA, 25 bp, Rattus norvegicus
actgatgatcatgccgtaaggtaca

SEQ ID NO: 96185 - DNA, 25 bp, Rattus norvegicus
actgatgatgaaatccttcacgcat

SEQ ID NO: 96186 - DNA, 25 bp, Rattus norvegicus
actgatgatgaattccttcacgcat

SEQ ID NO: 96187 - DNA, 25 bp, Rattus norvegicus
actgatgcatttatcctggattgag

SEQ ID NO: 96188 - DNA, 25 bp, Rattus norvegicus
actgatgcatttttcctggattgag

SEQ ID NO: 96189 - DNA, 25 bp, Rattus norvegicus
actgatgctgagaaggctactgtta

SEQ ID NO: 96190 - DNA, 25 bp, Rattus norvegicus
actgatgctgagaaggctgctgtta

SEQ ID NO: 96191 - DNA, 25 bp, Rattus norvegicus
actgatgctgagtaggctactgtta

SEQ ID NO: 96192 - DNA, 25 bp, Rattus norvegicus
actgatgctgagtaggctgctgtta

SEQ ID NO: 96193 - DNA, 25 bp, Rattus norvegicus
actgatgctgcaaggtgcccttaga

SEQ ID NO: 96194 - DNA, 25 bp, Rattus norvegicus
actgatgctgcatggtgcccttaga

SEQ ID NO: 96195 - DNA, 25 bp, Rattus norvegicus
actgatggacatctgctgatctatg

SEQ ID NO: 96196 - DNA, 25 bp, Rattus norvegicus
actgatggacatgtgctgatctatg

SEQ ID NO: 96197 - DNA, 25 bp, Rattus norvegicus
actgatggaccacaacctgaagtgt

SEQ ID NO: 96198 - DNA, 25 bp, Rattus norvegicus
actgatggaccagaacctgaagtgt

SEQ ID NO: 96199 - DNA, 25 bp, Rattus norvegicus
actgatggactgacactggcagccc

SEQ ID NO: 96200 - DNA, 25 bp, Rattus norvegicus
actgatggactgtcactggcagccc

SEQ ID NO: 96201 - DNA, 25 bp, Rattus norvegicus
actgatggagccaggattggtgcct

SEQ ID NO: 96202 - DNA, 25 bp, Rattus norvegicus
actgatggagcctggattggtgcct

SEQ ID NO: 96203 - DNA, 25 bp, Rattus norvegicus
actgatggatcacctccacaggtct

SEQ ID NO: 96204 - DNA, 25 bp, Rattus norvegicus
actgatggatcagctccacaggtct

SEQ ID NO: 96205 - DNA, 25 bp, Rattus norvegicus
actgatggctggctctcactggtca

SEQ ID NO: 96206 - DNA, 25 bp, Rattus norvegicus
actgatggctgggtctcactggtca

SEQ ID NO: 96207 - DNA, 25 bp, Rattus norvegicus
actgatgggcctcaccagtttgtaa

SEQ ID NO: 96208 - DNA, 25 bp, Rattus norvegicus
actgatgggcctgaccagtttgtaa

SEQ ID NO: 96209 - DNA, 25 bp, Rattus norvegicus
actgatggtgttcacagcggctgtc

SEQ ID NO: 96210 - DNA, 25 bp, Rattus norvegicus
actgatggtgttgacagcggctgtc

SEQ ID NO: 96211 - DNA, 25 bp, Rattus norvegicus
actgatgtccaaaatactgtcttaa

SEQ ID NO: 96212 - DNA, 25 bp, Rattus norvegicus
actgatgtccaaagtgttccacttc

SEQ ID NO: 96213 - DNA, 25 bp, Rattus norvegicus
actgatgtccaatatactgtcttaa

SEQ ID NO: 96214 - DNA, 25 bp, Rattus norvegicus
actgatgtccaatgtgttccacttc

SEQ ID NO: 96215 - DNA, 25 bp, Rattus norvegicus
actgatgtcctgacactggctgctg

SEQ ID NO: 96216 - DNA, 25 bp, Rattus norvegicus
actgatgtcctgtcactggctgctg

SEQ ID NO: 96217 - DNA, 25 bp, Rattus norvegicus
actgatgtctctctctgtacaaaca

SEQ ID NO: 96218 - DNA, 25 bp, Rattus norvegicus
actgatgtctctgtctgtacaaaca

SEQ ID NO: 96219 - DNA, 25 bp, Rattus norvegicus
actgatgtctgacatctgggaacca

SEQ ID NO: 96220 - DNA, 25 bp, Rattus norvegicus
actgatgtctgagatctgggaacca

SEQ ID NO: 96221 - DNA, 25 bp, Rattus norvegicus
actgatgtctggaggctgctgctta

SEQ ID NO: 96222 - DNA, 25 bp, Rattus norvegicus
actgatgtctggtggctgctgctta

SEQ ID NO: 96223 - DNA, 25 bp, Rattus norvegicus
actgatgtgcctaaaagctcccttg

SEQ ID NO: 96224 - DNA, 25 bp, Rattus norvegicus
actgatgtgccttaaagctcccttg

SEQ ID NO: 96225 - DNA, 25 bp, Rattus norvegicus
actgatgtgcttacctattgcctgg

SEQ ID NO: 96226 - DNA, 25 bp, Rattus norvegicus
actgatgtgctttcctattgcctgg

SEQ ID NO: 96227 - DNA, 25 bp, Rattus norvegicus
actgatgttgttcgttacttcccca

SEQ ID NO: 96228 - DNA, 25 bp, Rattus norvegicus
actgatgttgttggttacttcccca

SEQ ID NO: 96229 - DNA, 25 bp, Rattus norvegicus
actgatgtttctattccccattaga

SEQ ID NO: 96230 - DNA, 25 bp, Rattus norvegicus
actgatgtttcttttccccattaga

SEQ ID NO: 96231 - DNA, 25 bp, Rattus norvegicus
actgatgttttacctgacggtgact

SEQ ID NO: 96232 - DNA, 25 bp, Rattus norvegicus
actgatgttttagctgacggtgact

SEQ ID NO: 96233 - DNA, 25 bp, Rattus norvegicus
actgattaatggcacgcaccttctt

SEQ ID NO: 96234 - DNA, 25 bp, Rattus norvegicus
actgattaatgggacgcaccttctt

SEQ ID NO: 96235 - DNA, 25 bp, Rattus norvegicus
actgattactgtctccagctgtcac

SEQ ID NO: 96236 - DNA, 25 bp, Rattus norvegicus
actgattactgtgtccagctgtcac

SEQ ID NO: 96237 - DNA, 25 bp, Rattus norvegicus
actgattattcaaggccatggcact

SEQ ID NO: 96238 - DNA, 25 bp, Rattus norvegicus
actgattattcatggccatggcact

SEQ ID NO: 96239 - DNA, 25 bp, Rattus norvegicus
actgattcagaacacccctgggcat

SEQ ID NO: 96240 - DNA, 25 bp, Rattus norvegicus
actgattcagaagacccctgggcat

SEQ ID NO: 96241 - DNA, 25 bp, Rattus norvegicus
actgattcagcgaggcagtgccaac

SEQ ID NO: 96242 - DNA, 25 bp, Rattus norvegicus
actgattcagcgtggcagtgccaac

SEQ ID NO: 96243 - DNA, 25 bp, Rattus norvegicus
actgattcagttcctaaaacctttg

SEQ ID NO: 96244 - DNA, 25 bp, Rattus norvegicus
actgattcagttgctaaaacctttg

SEQ ID NO: 96245 - DNA, 25 bp, Rattus norvegicus
actgattcatttacagatctcacag

SEQ ID NO: 96246 - DNA, 25 bp, Rattus norvegicus
actgattcattttcagatctcacag

SEQ ID NO: 96247 - DNA, 25 bp, Rattus norvegicus
actgattcccgtagtcgcagggtga

SEQ ID NO: 96248 - DNA, 25 bp, Rattus norvegicus
actgattcccgttgtcgcagggtga

SEQ ID NO: 96249 - DNA, 25 bp, Rattus norvegicus
actgattcctgcagtgtggactgca

SEQ ID NO: 96250 - DNA, 25 bp, Rattus norvegicus
actgattcctgctgtgtggactgca

SEQ ID NO: 96251 - DNA, 25 bp, Rattus norvegicus
actgattctatcagacttctcttgg

SEQ ID NO: 96252 - DNA, 25 bp, Rattus norvegicus
actgattctatctgacttctcttgg

SEQ ID NO: 96253 - DNA, 25 bp, Rattus norvegicus
actgattctcttattctgtctgaag

SEQ ID NO: 96254 - DNA, 25 bp, Rattus norvegicus
actgattctctttttctgtctgaag

SEQ ID NO: 96255 - DNA, 25 bp, Rattus norvegicus
actgattgatggcttgaggttttcc

SEQ ID NO: 96256 - DNA, 25 bp, Rattus norvegicus
actgattgatgggttgaggttttcc

SEQ ID NO: 96257 - DNA, 25 bp, Rattus norvegicus
actgattggctacgtctgcttccga

SEQ ID NO: 96258 - DNA, 25 bp, Rattus norvegicus
actgattggctaggtctgcttccga

SEQ ID NO: 96259 - DNA, 25 bp, Rattus norvegicus
actgattggctgcaaggttggttac

SEQ ID NO: 96260 - DNA, 25 bp, Rattus norvegicus
actgattggctggaaggttggttac

SEQ ID NO: 96261 - DNA, 25 bp, Rattus norvegicus
actgattgttaccagcgcttagaat

SEQ ID NO: 96262 - DNA, 25 bp, Rattus norvegicus
actgattgttacgagcgcttagaat

SEQ ID NO: 96263 - DNA, 25 bp, Rattus norvegicus
actgatttactgacttgcaccttca

SEQ ID NO: 96264 - DNA, 25 bp, Rattus norvegicus
actgatttactgtcttgcaccttca

SEQ ID NO: 96265 - DNA, 25 bp, Rattus norvegicus
actgatttccttacgagatgttcta

SEQ ID NO: 96266 - DNA, 25 bp, Rattus norvegicus
actgatttcctttcgagatgttcta

SEQ ID NO: 96267 - DNA, 25 bp, Rattus norvegicus
actgatttctgtctctggtaaccta

SEQ ID NO: 96268 - DNA, 25 bp, Rattus norvegicus
actgatttctgtgtctggtaaccta

SEQ ID NO: 96269 - DNA, 25 bp, Rattus norvegicus
actgatttcttcattggtttcctga

SEQ ID NO: 96270 - DNA, 25 bp, Rattus norvegicus
actgatttcttctttggtttcctga

SEQ ID NO: 96271 - DNA, 25 bp, Rattus norvegicus
actgatttgagaacccgagactccc

SEQ ID NO: 96272 - DNA, 25 bp, Rattus norvegicus
actgatttgagatcccgagactccc

SEQ ID NO: 96273 - DNA, 25 bp, Rattus norvegicus
actgatttgattcttgcctggagac

SEQ ID NO: 96274 - DNA, 25 bp, Rattus norvegicus
actgatttgattgttgcctggagac

SEQ ID NO: 96275 - DNA, 25 bp, Rattus norvegicus
actgatttgttcctgtcctttataa

SEQ ID NO: 96276 - DNA, 25 bp, Rattus norvegicus
actgatttgttcgtgtcctttataa

SEQ ID NO: 96277 - DNA, 25 bp, Rattus norvegicus
actgatttttgtatgcctaccatgc

SEQ ID NO: 96278 - DNA, 25 bp, Rattus norvegicus
actgatttttgtttgcctaccatgc

SEQ ID NO: 96279 - DNA, 25 bp, Rattus norvegicus
actgcaaaatatatcgcccctggga

SEQ ID NO: 96280 - DNA, 25 bp, Rattus norvegicus
actgcaaaatatttcgcccctggga

SEQ ID NO: 96281 - DNA, 25 bp, Rattus norvegicus
actgcaaacctgctccacttagtga

SEQ ID NO: 96282 - DNA, 25 bp, Rattus norvegicus
actgcaaacctggtccacttagtga

SEQ ID NO: 96283 - DNA, 25 bp, Rattus norvegicus
actgcaaagatgagtccaggtgtgt

SEQ ID NO: 96284 - DNA, 25 bp, Rattus norvegicus
actgcaaagatgtgtccaggtgtgt

SEQ ID NO: 96285 - DNA, 25 bp, Rattus norvegicus
actgcaaagcttagagcctgctcat

SEQ ID NO: 96286 - DNA, 25 bp, Rattus norvegicus
actgcaaagctttgagcctgctcat

SEQ ID NO: 96287 - DNA, 25 bp, Rattus norvegicus
actgcaaaggcacaccatgattggt

SEQ ID NO: 96288 - DNA, 25 bp, Rattus norvegicus
actgcaaaggcagaccatgattggt

SEQ ID NO: 96289 - DNA, 25 bp, Rattus norvegicus
actgcaaagtctaagggtctccaag

SEQ ID NO: 96290 - DNA, 25 bp, Rattus norvegicus
actgcaaagtcttagggtctccaag

SEQ ID NO: 96291 - DNA, 25 bp, Rattus norvegicus
actgcaaatcagactttccggaaag

SEQ ID NO: 96292 - DNA, 25 bp, Rattus norvegicus
actgcaaatcagtctttccggaaag

SEQ ID NO: 96293 - DNA, 25 bp, Rattus norvegicus
actgcaacccctcagactgttttgg

SEQ ID NO: 96294 - DNA, 25 bp, Rattus norvegicus
actgcaacccctgagactgttttgg

SEQ ID NO: 96295 - DNA, 25 bp, Rattus norvegicus
actgcaagagcaactggtgttacct

SEQ ID NO: 96296 - DNA, 25 bp, Rattus norvegicus
actgcaagagcacacgtcacaaaca

SEQ ID NO: 96297 - DNA, 25 bp, Rattus norvegicus
actgcaagagcagacgtcacaaaca

SEQ ID NO: 96298 - DNA, 25 bp, Rattus norvegicus
actgcaagagcatctggtgttacct

SEQ ID NO: 96299 - DNA, 25 bp, Rattus norvegicus
actgcaagcgcaacgacgtgatcac

SEQ ID NO: 96300 - DNA, 25 bp, Rattus norvegicus
actgcaagcgcatcgacgtgatcac

SEQ ID NO: 96301 - DNA, 25 bp, Rattus norvegicus
actgcaagctgtcactccaaggaca

SEQ ID NO: 96302 - DNA, 25 bp, Rattus norvegicus
actgcaagctgtgactccaaggaca

SEQ ID NO: 96303 - DNA, 25 bp, Rattus norvegicus
actgcaaggagaaggctccagcctg

SEQ ID NO: 96304 - DNA, 25 bp, Rattus norvegicus
actgcaaggagatggctccagcctg

SEQ ID NO: 96305 - DNA, 25 bp, Rattus norvegicus
actgcaaggcccaggacttacccaa

SEQ ID NO: 96306 - DNA, 25 bp, Rattus norvegicus
actgcaaggccctggacttacccaa

SEQ ID NO: 96307 - DNA, 25 bp, Rattus norvegicus
actgcaagtgctcgatagccgacaa

SEQ ID NO: 96308 - DNA, 25 bp, Rattus norvegicus
actgcaagtgctggatagccgacaa

SEQ ID NO: 96309 - DNA, 25 bp, Rattus norvegicus
actgcaatcgctctgtctgttcctg

SEQ ID NO: 96310 - DNA, 25 bp, Rattus norvegicus
actgcaatcgctgtgtctgttcctg

SEQ ID NO: 96311 - DNA, 25 bp, Rattus norvegicus
actgcacagaagacttgatgttcca

SEQ ID NO: 96312 - DNA, 25 bp, Rattus norvegicus
actgcacagaagtcttgatgttcca

SEQ ID NO: 96313 - DNA, 25 bp, Rattus norvegicus
actgcacagttgaacttcttggcct

SEQ ID NO: 96314 - DNA, 25 bp, Rattus norvegicus
actgcacagttgtacttcttggcct

SEQ ID NO: 96315 - DNA, 25 bp, Rattus norvegicus
actgcacattagaattctgcttcaa

SEQ ID NO: 96316 - DNA, 25 bp, Rattus norvegicus
actgcacattagtattctgcttcaa

SEQ ID NO: 96317 - DNA, 25 bp, Rattus norvegicus
actgcaccaatgcagtcagccttca

SEQ ID NO: 96318 - DNA, 25 bp, Rattus norvegicus
actgcaccaatggagtcagccttca

SEQ ID NO: 96319 - DNA, 25 bp, Rattus norvegicus
actgcaccacagatgttcacgttta

SEQ ID NO: 96320 - DNA, 25 bp, Rattus norvegicus
actgcaccacagttgttcacgttta

SEQ ID NO: 96321 - DNA, 25 bp, Rattus norvegicus
actgcacccttgagtaggccttggg

SEQ ID NO: 96322 - DNA, 25 bp, Rattus norvegicus
actgcacccttgtgtaggccttggg

SEQ ID NO: 96323 - DNA, 25 bp, Rattus norvegicus
actgcacctggcatgtcagtgtctg

SEQ ID NO: 96324 - DNA, 25 bp, Rattus norvegicus
actgcacctggcttgtcagtgtctg

SEQ ID NO: 96325 - DNA, 25 bp, Rattus norvegicus
actgcaccttcaacaacgacttcta

SEQ ID NO: 96326 - DNA, 25 bp, Rattus norvegicus
actgcaccttcatcaacgacttcta

SEQ ID NO: 96327 - DNA, 25 bp, Rattus norvegicus
actgcacgctacctacatttaacgc

SEQ ID NO: 96328 - DNA, 25 bp, Rattus norvegicus
actgcacgctacgtacatttaacgc

SEQ ID NO: 96329 - DNA, 25 bp, Rattus norvegicus
actgcacgctcacaagacagggcct

SEQ ID NO: 96330 - DNA, 25 bp, Rattus norvegicus
actgcacgctcagaagacagggcct

SEQ ID NO: 96331 - DNA, 25 bp, Rattus norvegicus
actgcacgctgtctctgacataaag

SEQ ID NO: 96332 - DNA, 25 bp, Rattus norvegicus
actgcacgctgtgtctgacataaag

SEQ ID NO: 96333 - DNA, 25 bp, Rattus norvegicus
actgcacggcgaactggcgcgagaa

SEQ ID NO: 96334 - DNA, 25 bp, Rattus norvegicus
actgcacggcgatctggcgcgagaa

SEQ ID NO: 96335 - DNA, 25 bp, Rattus norvegicus
actgcacgttatagtctcgaatttg

SEQ ID NO: 96336 - DNA, 25 bp, Rattus norvegicus
actgcacgttattgtctcgaatttg

SEQ ID NO: 96337 - DNA, 25 bp, Rattus norvegicus
actgcacgttcgcaaaggtctttct

SEQ ID NO: 96338 - DNA, 25 bp, Rattus norvegicus
actgcacgttcggaaaggtctttct

SEQ ID NO: 96339 - DNA, 25 bp, Rattus norvegicus
actgcactaccgacactggctatga

SEQ ID NO: 96340 - DNA, 25 bp, Rattus norvegicus
actgcactaccgtcactggctatga

SEQ ID NO: 96341 - DNA, 25 bp, Rattus norvegicus
actgcactatcccagctgagcctgg

SEQ ID NO: 96342 - DNA, 25 bp, Rattus norvegicus
actgcactatccgagctgagcctgg

SEQ ID NO: 96343 - DNA, 25 bp, Rattus norvegicus
actgcactcaccctcgtttataaat

SEQ ID NO: 96344 - DNA, 25 bp, Rattus norvegicus
actgcactcaccgtcgtttataaat

SEQ ID NO: 96345 - DNA, 25 bp, Rattus norvegicus
actgcactctgtcttcagcatggat

SEQ ID NO: 96346 - DNA, 25 bp, Rattus norvegicus
actgcactctgtgttcagcatggat

SEQ ID NO: 96347 - DNA, 25 bp, Rattus norvegicus
actgcactgaagagaagctgtcctg

SEQ ID NO: 96348 - DNA, 25 bp, Rattus norvegicus
actgcactgaagtgaagctgtcctg

SEQ ID NO: 96349 - DNA, 25 bp, Rattus norvegicus
actgcactgacccattctgtatcag

SEQ ID NO: 96350 - DNA, 25 bp, Rattus norvegicus
actgcactgaccgattctgtatcag

SEQ ID NO: 96351 - DNA, 25 bp, Rattus norvegicus
actgcactgcgtcagcgacaggcat

SEQ ID NO: 96352 - DNA, 25 bp, Rattus norvegicus
actgcactgcgtgagcgacaggcat

SEQ ID NO: 96353 - DNA, 25 bp, Rattus norvegicus
actgcactgctgacaatgccgtggc

SEQ ID NO: 96354 - DNA, 25 bp, Rattus norvegicus
actgcactgctgtcaatgccgtggc

SEQ ID NO: 96355 - DNA, 25 bp, Rattus norvegicus
actgcactgggcatctgtgattcaa

SEQ ID NO: 96356 - DNA, 25 bp, Rattus norvegicus
actgcactgggcttctgtgattcaa

SEQ ID NO: 96357 - DNA, 25 bp, Rattus norvegicus
actgcactgtaacaggcctgggacc

SEQ ID NO: 96358 - DNA, 25 bp, Rattus norvegicus
actgcactgtaagaggcctgggacc

SEQ ID NO: 96359 - DNA, 25 bp, Rattus norvegicus
actgcactgtccatccaagggagac

SEQ ID NO: 96360 - DNA, 25 bp, Rattus norvegicus
actgcactgtccttccaagggagac

SEQ ID NO: 96361 - DNA, 25 bp, Rattus norvegicus
actgcactgttcactcaggaatcga

SEQ ID NO: 96362 - DNA, 25 bp, Rattus norvegicus
actgcactgttcatatcatctcggg

SEQ ID NO: 96363 - DNA, 25 bp, Rattus norvegicus
actgcactgttctctcaggaatcga

SEQ ID NO: 96364 - DNA, 25 bp, Rattus norvegicus
actgcactgttcttatcatctcggg

SEQ ID NO: 96365 - DNA, 25 bp, Rattus norvegicus
actgcacttgctagtctgtaatggt

SEQ ID NO: 96366 - DNA, 25 bp, Rattus norvegicus
actgcacttgcttgtctgtaatggt

SEQ ID NO: 96367 - DNA, 25 bp, Rattus norvegicus
actgcacttgtcaggtggccccaat

SEQ ID NO: 96368 - DNA, 25 bp, Rattus norvegicus
actgcacttgtctggtggccccaat

SEQ ID NO: 96369 - DNA, 25 bp, Rattus norvegicus
actgcacttgtgaactttcgtgtca

SEQ ID NO: 96370 - DNA, 25 bp, Rattus norvegicus
actgcacttgtgtactttcgtgtca

SEQ ID NO: 96371 - DNA, 25 bp, Rattus norvegicus
actgcagaagtcaggtacccctcaa

SEQ ID NO: 96372 - DNA, 25 bp, Rattus norvegicus
actgcagaagtctggtacccctcaa

SEQ ID NO: 96373 - DNA, 25 bp, Rattus norvegicus
actgcagaatttcccttcatttcgc

SEQ ID NO: 96374 - DNA, 25 bp, Rattus norvegicus
actgcagaatttgccttcatttcgc

SEQ ID NO: 96375 - DNA, 25 bp, Rattus norvegicus
actgcagacacactgtttccagcca

SEQ ID NO: 96376 - DNA, 25 bp, Rattus norvegicus
actgcagacacagtgtttccagcca

SEQ ID NO: 96377 - DNA, 25 bp, Rattus norvegicus
actgcagaccatctcttcatttgag

SEQ ID NO: 96378 - DNA, 25 bp, Rattus norvegicus
actgcagaccatgtcttcatttgag

SEQ ID NO: 96379 - DNA, 25 bp, Rattus norvegicus
actgcagacggaaggccctcagggt

SEQ ID NO: 96380 - DNA, 25 bp, Rattus norvegicus
actgcagacggatggccctcagggt

SEQ ID NO: 96381 - DNA, 25 bp, Rattus norvegicus
actgcagactcaacatggccaggta

SEQ ID NO: 96382 - DNA, 25 bp, Rattus norvegicus
actgcagactcatcatggccaggta

SEQ ID NO: 96383 - DNA, 25 bp, Rattus norvegicus
actgcagagggtcctcttgttacct

SEQ ID NO: 96384 - DNA, 25 bp, Rattus norvegicus
actgcagagggtgctcttgttacct

SEQ ID NO: 96385 - DNA, 25 bp, Rattus norvegicus
actgcagataccagtgtcaagggcc

SEQ ID NO: 96386 - DNA, 25 bp, Rattus norvegicus
actgcagatacctgtgtcaagggcc

SEQ ID NO: 96387 - DNA, 25 bp, Rattus norvegicus
actgcagatgcaccgtgatcacggt

SEQ ID NO: 96388 - DNA, 25 bp, Rattus norvegicus
actgcagatgcagcgtgatcacggt

SEQ ID NO: 96389 - DNA, 25 bp, Rattus norvegicus
actgcagatgccatggtcctatgag

SEQ ID NO: 96390 - DNA, 25 bp, Rattus norvegicus
actgcagatgccttggtcctatgag

SEQ ID NO: 96391 - DNA, 25 bp, Rattus norvegicus
actgcagatttgcactttctgccct

SEQ ID NO: 96392 - DNA, 25 bp, Rattus norvegicus
actgcagatttggactttctgccct

SEQ ID NO: 96393 - DNA, 25 bp, Rattus norvegicus
actgcagattttccatgttaacact

SEQ ID NO: 96394 - DNA, 25 bp, Rattus norvegicus
actgcagattttgcatgttaacact

SEQ ID NO: 96395 - DNA, 25 bp, Rattus norvegicus
actgcagcacccagaggccgtggta

SEQ ID NO: 96396 - DNA, 25 bp, Rattus norvegicus
actgcagcaccctgaggccgtggta

SEQ ID NO: 96397 - DNA, 25 bp, Rattus norvegicus
actgcagcagaaaggtctatgtcat

SEQ ID NO: 96398 - DNA, 25 bp, Rattus norvegicus
actgcagcagaatggtctatgtcat

SEQ ID NO: 96399 - DNA, 25 bp, Rattus norvegicus
actgcagcagccacacagatgtgta

SEQ ID NO: 96400 - DNA, 25 bp, Rattus norvegicus
actgcagcagcctcacagatgtgta

SEQ ID NO: 96401 - DNA, 25 bp, Rattus norvegicus
actgcagccatcattggtggagtct

SEQ ID NO: 96402 - DNA, 25 bp, Rattus norvegicus
actgcagccatctttggtggagtct

SEQ ID NO: 96403 - DNA, 25 bp, Rattus norvegicus
actgcagcctttagtgatctccacc

SEQ ID NO: 96404 - DNA, 25 bp, Rattus norvegicus
actgcagccttttgtgatctccacc

SEQ ID NO: 96405 - DNA, 25 bp, Rattus norvegicus
actgcagcgcgccacgaggacaacg

SEQ ID NO: 96406 - DNA, 25 bp, Rattus norvegicus
actgcagcgcgcgacgaggacaacg

SEQ ID NO: 96407 - DNA, 25 bp, Rattus norvegicus
actgcagcgtgccagcctgtggcca

SEQ ID NO: 96408 - DNA, 25 bp, Rattus norvegicus
actgcagcgtgcgagcctgtggcca

SEQ ID NO: 96409 - DNA, 25 bp, Rattus norvegicus
actgcagctcagagggaagcgctta

SEQ ID NO: 96410 - DNA, 25 bp, Rattus norvegicus
actgcagctcagtgggaagcgctta

SEQ ID NO: 96411 - DNA, 25 bp, Rattus norvegicus
actgcagctccacgtgaagcacaat

SEQ ID NO: 96412 - DNA, 25 bp, Rattus norvegicus
actgcagctccaggtgaagcacaat

SEQ ID NO: 96413 - DNA, 25 bp, Rattus norvegicus
actgcagctctgatatcatttgttt

SEQ ID NO: 96414 - DNA, 25 bp, Rattus norvegicus
actgcagctctgttatcatttgttt

SEQ ID NO: 96415 - DNA, 25 bp, Rattus norvegicus
actgcagcttgtcgtggtgaatcac

SEQ ID NO: 96416 - DNA, 25 bp, Rattus norvegicus
actgcagcttgtggtggtgaatcac

SEQ ID NO: 96417 - DNA, 25 bp, Rattus norvegicus
actgcagctttaattgcaacagcta

SEQ ID NO: 96418 - DNA, 25 bp, Rattus norvegicus
actgcagctttatttgcaacagcta

SEQ ID NO: 96419 - DNA, 25 bp, Rattus norvegicus
actgcaggactcaactgagacaccc

SEQ ID NO: 96420 - DNA, 25 bp, Rattus norvegicus
actgcaggactctactgagacaccc

SEQ ID NO: 96421 - DNA, 25 bp, Rattus norvegicus
actgcaggagacacacctgttcgct

SEQ ID NO: 96422 - DNA, 25 bp, Rattus norvegicus
actgcaggagactcacctgttcgct

SEQ ID NO: 96423 - DNA, 25 bp, Rattus norvegicus
actgcaggagtcagaaacacatttt

SEQ ID NO: 96424 - DNA, 25 bp, Rattus norvegicus
actgcaggagtctgaaacacatttt

SEQ ID NO: 96425 - DNA, 25 bp, Rattus norvegicus
actgcaggcgccagtgagatcaagc

SEQ ID NO: 96426 - DNA, 25 bp, Rattus norvegicus
actgcaggcgcctgtgagatcaagc

SEQ ID NO: 96427 - DNA, 25 bp, Rattus norvegicus
actgcaggcgctatcgtgttgagga

SEQ ID NO: 96428 - DNA, 25 bp, Rattus norvegicus
actgcaggcgctttcgtgttgagga

SEQ ID NO: 96429 - DNA, 25 bp, Rattus norvegicus
actgcaggcgtcatctgtgatggaa

SEQ ID NO: 96430 - DNA, 25 bp, Rattus norvegicus
actgcaggcgtcttctgtgatggaa

SEQ ID NO: 96431 - DNA, 25 bp, Rattus norvegicus
actgcaggctgcatatttatgctca

SEQ ID NO: 96432 - DNA, 25 bp, Rattus norvegicus
actgcaggctgcttatttatgctca

SEQ ID NO: 96433 - DNA, 25 bp, Rattus norvegicus
actgcaggctggctttattcttgaa

SEQ ID NO: 96434 - DNA, 25 bp, Rattus norvegicus
actgcaggctgggtttattcttgaa

SEQ ID NO: 96435 - DNA, 25 bp, Rattus norvegicus
actgcagggtggaaccatgactctt

SEQ ID NO: 96436 - DNA, 25 bp, Rattus norvegicus
actgcagggtggtaccatgactctt

SEQ ID NO: 96437 - DNA, 25 bp, Rattus norvegicus
actgcaggtgttaccatggccaaat

SEQ ID NO: 96438 - DNA, 25 bp, Rattus norvegicus
actgcaggtgtttccatggccaaat

SEQ ID NO: 96439 - DNA, 25 bp, Rattus norvegicus
actgcaggttgtcttatatactcta

SEQ ID NO: 96440 - DNA, 25 bp, Rattus norvegicus
actgcaggttgtgttatatactcta

SEQ ID NO: 96441 - DNA, 25 bp, Rattus norvegicus
actgcagtaactatttctcaaaggc

SEQ ID NO: 96442 - DNA, 25 bp, Rattus norvegicus
actgcagtaactttttctcaaaggc

SEQ ID NO: 96443 - DNA, 25 bp, Rattus norvegicus
actgcagtacctcagtgttcttacc

SEQ ID NO: 96444 - DNA, 25 bp, Rattus norvegicus
actgcagtacctgagtgttcttacc

SEQ ID NO: 96445 - DNA, 25 bp, Rattus norvegicus
actgcagtagcacctgtgttgtaga

SEQ ID NO: 96446 - DNA, 25 bp, Rattus norvegicus
actgcagtagcagctgtgttgtaga

SEQ ID NO: 96447 - DNA, 25 bp, Rattus norvegicus
actgcagtagttcactttgctgtat

SEQ ID NO: 96448 - DNA, 25 bp, Rattus norvegicus
actgcagtagttgactttgctgtat

SEQ ID NO: 96449 - DNA, 25 bp, Rattus norvegicus
actgcagtcaatatgtgagtgctct

SEQ ID NO: 96450 - DNA, 25 bp, Rattus norvegicus
actgcagtcaatttgtgagtgctct

SEQ ID NO: 96451 - DNA, 25 bp, Rattus norvegicus
actgcagtctcaccagagctcctag

SEQ ID NO: 96452 - DNA, 25 bp, Rattus norvegicus
actgcagtctcagcagagctcctag

SEQ ID NO: 96453 - DNA, 25 bp, Rattus norvegicus
actgcagtctctccatggtagacag

SEQ ID NO: 96454 - DNA, 25 bp, Rattus norvegicus
actgcagtctctgcatggtagacag

SEQ ID NO: 96455 - DNA, 25 bp, Rattus norvegicus
actgcagtctgcacacgttgtaaat

SEQ ID NO: 96456 - DNA, 25 bp, Rattus norvegicus
actgcagtctgctcacgttgtaaat

SEQ ID NO: 96457 - DNA, 25 bp, Rattus norvegicus
actgcagtgacaactacctgcgtgg

SEQ ID NO: 96458 - DNA, 25 bp, Rattus norvegicus
actgcagtgacatctacctgcgtgg

SEQ ID NO: 96459 - DNA, 25 bp, Rattus norvegicus
actgcagtgacccatgtgaacgtgt

SEQ ID NO: 96460 - DNA, 25 bp, Rattus norvegicus
actgcagtgaccgatgtgaacgtgt

SEQ ID NO: 96461 - DNA, 25 bp, Rattus norvegicus
actgcagtgcctagatctgtaacca

SEQ ID NO: 96462 - DNA, 25 bp, Rattus norvegicus
actgcagtgccttgatctgtaacca

SEQ ID NO: 96463 - DNA, 25 bp, Rattus norvegicus
actgcagtgctaacatatcttggaa

SEQ ID NO: 96464 - DNA, 25 bp, Rattus norvegicus
actgcagtgctatcatatcttggaa

SEQ ID NO: 96465 - DNA, 25 bp, Rattus norvegicus
actgcagtgcttaggcaaggtgcct

SEQ ID NO: 96466 - DNA, 25 bp, Rattus norvegicus
actgcagtgctttggcaaggtgcct

SEQ ID NO: 96467 - DNA, 25 bp, Rattus norvegicus
actgcagtgggcactaaggaaacat

SEQ ID NO: 96468 - DNA, 25 bp, Rattus norvegicus
actgcagtgggctctaaggaaacat

SEQ ID NO: 96469 - DNA, 25 bp, Rattus norvegicus
actgcagtggtcacagaggctagag

SEQ ID NO: 96470 - DNA, 25 bp, Rattus norvegicus
actgcagtggtctcagaggctagag

SEQ ID NO: 96471 - DNA, 25 bp, Rattus norvegicus
actgcagtgtccaacagactctgaa

SEQ ID NO: 96472 - DNA, 25 bp, Rattus norvegicus
actgcagtgtcctacagactctgaa

SEQ ID NO: 96473 - DNA, 25 bp, Rattus norvegicus
actgcagtgttgctggtgcttgtct

SEQ ID NO: 96474 - DNA, 25 bp, Rattus norvegicus
actgcagtgttggtggtgcttgtct

SEQ ID NO: 96475 - DNA, 25 bp, Rattus norvegicus
actgcagttcctacagctcttcagg

SEQ ID NO: 96476 - DNA, 25 bp, Rattus norvegicus
actgcagttccttcagctcttcagg

SEQ ID NO: 96477 - DNA, 25 bp, Rattus norvegicus
actgcataattgaatgtatcccttg

SEQ ID NO: 96478 - DNA, 25 bp, Rattus norvegicus
actgcataattgtatgtatcccttg

SEQ ID NO: 96479 - DNA, 25 bp, Rattus norvegicus
actgcatacatccaccaggtgacga

SEQ ID NO: 96480 - DNA, 25 bp, Rattus norvegicus
actgcatacatcgaccaggtgacga

SEQ ID NO: 96481 - DNA, 25 bp, Rattus norvegicus
actgcatcaggccttgcttcggttg

SEQ ID NO: 96482 - DNA, 25 bp, Rattus norvegicus
actgcatcaggcgttgcttcggttg

SEQ ID NO: 96483 - DNA, 25 bp, Rattus norvegicus
actgcatcatttaaggacttccacc

SEQ ID NO: 96484 - DNA, 25 bp, Rattus norvegicus
actgcatcattttaggacttccacc

SEQ ID NO: 96485 - DNA, 25 bp, Rattus norvegicus
actgcatcccgtagcaccacgaggg

SEQ ID NO: 96486 - DNA, 25 bp, Rattus norvegicus
actgcatcccgttgcaccacgaggg

SEQ ID NO: 96487 - DNA, 25 bp, Rattus norvegicus
actgcatcctaaagattgtccaccc

SEQ ID NO: 96488 - DNA, 25 bp, Rattus norvegicus
actgcatcctaatgattgtccaccc

SEQ ID NO: 96489 - DNA, 25 bp, Rattus norvegicus
actgcatccttacgccggtgagcct

SEQ ID NO: 96490 - DNA, 25 bp, Rattus norvegicus
actgcatccttaggccggtgagcct

SEQ ID NO: 96491 - DNA, 25 bp, Rattus norvegicus
actgcatcgatccagtcgacaggcg

SEQ ID NO: 96492 - DNA, 25 bp, Rattus norvegicus
actgcatcgatcgagtcgacaggcg

SEQ ID NO: 96493 - DNA, 25 bp, Rattus norvegicus
actgcatcgggaatcatctactacg

SEQ ID NO: 96494 - DNA, 25 bp, Rattus norvegicus
actgcatcgggattcatctactacg

SEQ ID NO: 96495 - DNA, 25 bp, Rattus norvegicus
actgcatctattatgctggcaatgt

SEQ ID NO: 96496 - DNA, 25 bp, Rattus norvegicus
actgcatctattttgctggcaatgt

SEQ ID NO: 96497 - DNA, 25 bp, Rattus norvegicus
actgcatctgccatagacatgcttt

SEQ ID NO: 96498 - DNA, 25 bp, Rattus norvegicus
actgcatctgccttagacatgcttt

SEQ ID NO: 96499 - DNA, 25 bp, Rattus norvegicus
actgcatgacccactctgataattc

SEQ ID NO: 96500 - DNA, 25 bp, Rattus norvegicus
actgcatgaccctctctgataattc

SEQ ID NO: 96501 - DNA, 25 bp, Rattus norvegicus
actgcatgagcccagccttcaggct

SEQ ID NO: 96502 - DNA, 25 bp, Rattus norvegicus
actgcatgagccgagccttcaggct

SEQ ID NO: 96503 - DNA, 25 bp, Rattus norvegicus
actgcatgatttctgttcgtgtgga

SEQ ID NO: 96504 - DNA, 25 bp, Rattus norvegicus
actgcatgatttgtgttcgtgtgga

SEQ ID NO: 96505 - DNA, 25 bp, Rattus norvegicus
actgcatgcagccttatgtgggttc

SEQ ID NO: 96506 - DNA, 25 bp, Rattus norvegicus
actgcatgcagcgttatgtgggttc

SEQ ID NO: 96507 - DNA, 25 bp, Rattus norvegicus
actgcatgcaggctttgattaccct

SEQ ID NO: 96508 - DNA, 25 bp, Rattus norvegicus
actgcatgcagggtttgattaccct

SEQ ID NO: 96509 - DNA, 25 bp, Rattus norvegicus
actgcatgcagtatgaggagttcct

SEQ ID NO: 96510 - DNA, 25 bp, Rattus norvegicus
actgcatgcagtcgcacatccttta

SEQ ID NO: 96511 - DNA, 25 bp, Rattus norvegicus
actgcatgcagtggcacatccttta

SEQ ID NO: 96512 - DNA, 25 bp, Rattus norvegicus
actgcatgcagtttgaggagttcct

SEQ ID NO: 96513 - DNA, 25 bp, Rattus norvegicus
actgcatgcgtgaacctactggagg

SEQ ID NO: 96514 - DNA, 25 bp, Rattus norvegicus
actgcatgcgtgtacctactggagg

SEQ ID NO: 96515 - DNA, 25 bp, Rattus norvegicus
actgcatgctctcttagtcgtcata

SEQ ID NO: 96516 - DNA, 25 bp, Rattus norvegicus
actgcatgctctgttagtcgtcata

SEQ ID NO: 96517 - DNA, 25 bp, Rattus norvegicus
actgcatggttgaccaatggcttga

SEQ ID NO: 96518 - DNA, 25 bp, Rattus norvegicus
actgcatggttgtccaatggcttga

SEQ ID NO: 96519 - DNA, 25 bp, Rattus norvegicus
actgcatgtcccaaaactcagcatg

SEQ ID NO: 96520 - DNA, 25 bp, Rattus norvegicus
actgcatgtccctaaactcagcatg

SEQ ID NO: 96521 - DNA, 25 bp, Rattus norvegicus
actgcatgtgctctctccttggtgg

SEQ ID NO: 96522 - DNA, 25 bp, Rattus norvegicus
actgcatgtgctgtctccttggtgg

SEQ ID NO: 96523 - DNA, 25 bp, Rattus norvegicus
actgcatgtggcagctgccaaccgg

SEQ ID NO: 96524 - DNA, 25 bp, Rattus norvegicus
actgcatgtggctgctgccaaccgg

SEQ ID NO: 96525 - DNA, 25 bp, Rattus norvegicus
actgcatgtgtaaatatgtcatcct

SEQ ID NO: 96526 - DNA, 25 bp, Rattus norvegicus
actgcatgtgtatatatgtcatcct

SEQ ID NO: 96527 - DNA, 25 bp, Rattus norvegicus
actgcatgttttaggcttctgttaa

SEQ ID NO: 96528 - DNA, 25 bp, Rattus norvegicus
actgcatgtttttggcttctgttaa

SEQ ID NO: 96529 - DNA, 25 bp, Rattus norvegicus
actgcattcatgactaagccgtgtg

SEQ ID NO: 96530 - DNA, 25 bp, Rattus norvegicus
actgcattcatgtctaagccgtgtg

SEQ ID NO: 96531 - DNA, 25 bp, Rattus norvegicus
actgcattcccaatcagaaccagct

SEQ ID NO: 96532 - DNA, 25 bp, Rattus norvegicus
actgcattcccattcagaaccagct

SEQ ID NO: 96533 - DNA, 25 bp, Rattus norvegicus
actgcattccctatcctgggaggag

SEQ ID NO: 96534 - DNA, 25 bp, Rattus norvegicus
actgcattccctttcctgggaggag

SEQ ID NO: 96535 - DNA, 25 bp, Rattus norvegicus
actgcattcggcatcagttttttct

SEQ ID NO: 96536 - DNA, 25 bp, Rattus norvegicus
actgcattcggcttcagttttttct

SEQ ID NO: 96537 - DNA, 25 bp, Rattus norvegicus
actgcattctgaccaatgaggccga

SEQ ID NO: 96538 - DNA, 25 bp, Rattus norvegicus
actgcattctgagcaatgaggccga

SEQ ID NO: 96539 - DNA, 25 bp, Rattus norvegicus
actgcattgactcctgctgtcagga

SEQ ID NO: 96540 - DNA, 25 bp, Rattus norvegicus
actgcattgactgctgctgtcagga

SEQ ID NO: 96541 - DNA, 25 bp, Rattus norvegicus
actgcattgctcctggcactaggga

SEQ ID NO: 96542 - DNA, 25 bp, Rattus norvegicus
actgcattgctcgtggcactaggga

SEQ ID NO: 96543 - DNA, 25 bp, Rattus norvegicus
actgcattgtatcctttaacctaag

SEQ ID NO: 96544 - DNA, 25 bp, Rattus norvegicus
actgcattgtatgctttaacctaag

SEQ ID NO: 96545 - DNA, 25 bp, Rattus norvegicus
actgcatttcctacaactgctgaga

SEQ ID NO: 96546 - DNA, 25 bp, Rattus norvegicus
actgcatttccttcaactgctgaga

SEQ ID NO: 96547 - DNA, 25 bp, Rattus norvegicus
actgcatttcttaaattagccttag

SEQ ID NO: 96548 - DNA, 25 bp, Rattus norvegicus
actgcatttctttaattagccttag

SEQ ID NO: 96549 - DNA, 25 bp, Rattus norvegicus
actgccaaacctcacctgaatttta

SEQ ID NO: 96550 - DNA, 25 bp, Rattus norvegicus
actgccaaacctgacctgaatttta

SEQ ID NO: 96551 - DNA, 25 bp, Rattus norvegicus
actgccaaagatcgtactgtatttt

SEQ ID NO: 96552 - DNA, 25 bp, Rattus norvegicus
actgccaaagatggtactgtatttt

SEQ ID NO: 96553 - DNA, 25 bp, Rattus norvegicus
actgccaactccagccataagagga

SEQ ID NO: 96554 - DNA, 25 bp, Rattus norvegicus
actgccaactcctgccataagagga

SEQ ID NO: 96555 - DNA, 25 bp, Rattus norvegicus
actgccaagcacctgtcttgataac

SEQ ID NO: 96556 - DNA, 25 bp, Rattus norvegicus
actgccaagcacgtgtcttgataac

SEQ ID NO: 96557 - DNA, 25 bp, Rattus norvegicus
actgccaaggatccgcttaaccata

SEQ ID NO: 96558 - DNA, 25 bp, Rattus norvegicus
actgccaaggatgcgcttaaccata

SEQ ID NO: 96559 - DNA, 25 bp, Rattus norvegicus
actgccaatgcaatttgtcccaaaa

SEQ ID NO: 96560 - DNA, 25 bp, Rattus norvegicus
actgccaatgcattttgtcccaaaa

SEQ ID NO: 96561 - DNA, 25 bp, Rattus norvegicus
actgccaccagtatgaatgactttg

SEQ ID NO: 96562 - DNA, 25 bp, Rattus norvegicus
actgccaccagtttgaatgactttg

SEQ ID NO: 96563 - DNA, 25 bp, Rattus norvegicus
actgccactctcaggagaacagtca

SEQ ID NO: 96564 - DNA, 25 bp, Rattus norvegicus
actgccactctctggagaacagtca

SEQ ID NO: 96565 - DNA, 25 bp, Rattus norvegicus
actgccactgtgagcttacggaact

SEQ ID NO: 96566 - DNA, 25 bp, Rattus norvegicus
actgccactgtgatatatatagtta

SEQ ID NO: 96567 - DNA, 25 bp, Rattus norvegicus
actgccactgtgtgcttacggaact

SEQ ID NO: 96568 - DNA, 25 bp, Rattus norvegicus
actgccactgtgttatatatagtta

SEQ ID NO: 96569 - DNA, 25 bp, Rattus norvegicus
actgccagaccaaacaggccttaca

SEQ ID NO: 96570 - DNA, 25 bp, Rattus norvegicus
actgccagaccatacaggccttaca

SEQ ID NO: 96571 - DNA, 25 bp, Rattus norvegicus
actgccagcaaactttctaactcat

SEQ ID NO: 96572 - DNA, 25 bp, Rattus norvegicus
actgccagcaaagtttctaactcat

SEQ ID NO: 96573 - DNA, 25 bp, Rattus norvegicus
actgccagcactataagttccgcta

SEQ ID NO: 96574 - DNA, 25 bp, Rattus norvegicus
actgccagcactttaagttccgcta

SEQ ID NO: 96575 - DNA, 25 bp, Rattus norvegicus
actgccagcagcacatctgatgttg

SEQ ID NO: 96576 - DNA, 25 bp, Rattus norvegicus
actgccagcagctcatctgatgttg

SEQ ID NO: 96577 - DNA, 25 bp, Rattus norvegicus
actgccagcatcataccaggcgatg

SEQ ID NO: 96578 - DNA, 25 bp, Rattus norvegicus
actgccagcatcttaccaggcgatg

SEQ ID NO: 96579 - DNA, 25 bp, Rattus norvegicus
actgccagctctagaagccgagtga

SEQ ID NO: 96580 - DNA, 25 bp, Rattus norvegicus
actgccagctcttgaagccgagtga

SEQ ID NO: 96581 - DNA, 25 bp, Rattus norvegicus
actgccagcttcattagggttatct

SEQ ID NO: 96582 - DNA, 25 bp, Rattus norvegicus
actgccagcttctttagggttatct

SEQ ID NO: 96583 - DNA, 25 bp, Rattus norvegicus
actgccaggtctactgacgtcgcgg

SEQ ID NO: 96584 - DNA, 25 bp, Rattus norvegicus
actgccaggtctccgtacagtcaga

SEQ ID NO: 96585 - DNA, 25 bp, Rattus norvegicus
actgccaggtctgcgtacagtcaga

SEQ ID NO: 96586 - DNA, 25 bp, Rattus norvegicus
actgccaggtcttctgacgtcgcgg

SEQ ID NO: 96587 - DNA, 25 bp, Rattus norvegicus
actgccagtggcatgcgtgcttaat

SEQ ID NO: 96588 - DNA, 25 bp, Rattus norvegicus
actgccagtggcttgcgtgcttaat

SEQ ID NO: 96589 - DNA, 25 bp, Rattus norvegicus
actgccagtgggactttcctccaca

SEQ ID NO: 96590 - DNA, 25 bp, Rattus norvegicus
actgccagtgggtctttcctccaca

SEQ ID NO: 96591 - DNA, 25 bp, Rattus norvegicus
actgccagtggtcatctcacagtgt

SEQ ID NO: 96592 - DNA, 25 bp, Rattus norvegicus
actgccagtggtgatctcacagtgt

SEQ ID NO: 96593 - DNA, 25 bp, Rattus norvegicus
actgccatagtaatttgctttgtgt

SEQ ID NO: 96594 - DNA, 25 bp, Rattus norvegicus
actgccatagtattttgctttgtgt

SEQ ID NO: 96595 - DNA, 25 bp, Rattus norvegicus
actgccatatctaactcctttttaa

SEQ ID NO: 96596 - DNA, 25 bp, Rattus norvegicus
actgccatatcttactcctttttaa

SEQ ID NO: 96597 - DNA, 25 bp, Rattus norvegicus
actgccatcatcctcgttgtatcga

SEQ ID NO: 96598 - DNA, 25 bp, Rattus norvegicus
actgccatcatcgtcgttgtatcga

SEQ ID NO: 96599 - DNA, 25 bp, Rattus norvegicus
actgccatcatgctggattttgtct

SEQ ID NO: 96600 - DNA, 25 bp, Rattus norvegicus
actgccatcatggtggattttgtct

SEQ ID NO: 96601 - DNA, 25 bp, Rattus norvegicus
actgccatcctgaatattccttgta

SEQ ID NO: 96602 - DNA, 25 bp, Rattus norvegicus
actgccatcctgtatattccttgta

SEQ ID NO: 96603 - DNA, 25 bp, Rattus norvegicus
actgccatccttagtcaggtagtct

SEQ ID NO: 96604 - DNA, 25 bp, Rattus norvegicus
actgccatcctttgtcaggtagtct

SEQ ID NO: 96605 - DNA, 25 bp, Rattus norvegicus
actgccatcttgcaagctggatcga

SEQ ID NO: 96606 - DNA, 25 bp, Rattus norvegicus
actgccatcttggaagctggatcga

SEQ ID NO: 96607 - DNA, 25 bp, Rattus norvegicus
actgccatgcatctcctgagggtca

SEQ ID NO: 96608 - DNA, 25 bp, Rattus norvegicus
actgccatgcatgtcctgagggtca

SEQ ID NO: 96609 - DNA, 25 bp, Rattus norvegicus
actgccatgcctacgctgtgccgag

SEQ ID NO: 96610 - DNA, 25 bp, Rattus norvegicus
actgccatgccttcgctgtgccgag

SEQ ID NO: 96611 - DNA, 25 bp, Rattus norvegicus
actgccatgcttctcgccataatgg

SEQ ID NO: 96612 - DNA, 25 bp, Rattus norvegicus
actgccatgcttgtcgccataatgg

SEQ ID NO: 96613 - DNA, 25 bp, Rattus norvegicus
actgccatgggcaggtagcaaaact

SEQ ID NO: 96614 - DNA, 25 bp, Rattus norvegicus
actgccatgggctggtagcaaaact

SEQ ID NO: 96615 - DNA, 25 bp, Rattus norvegicus
actgccatgtctcttttctttattt

SEQ ID NO: 96616 - DNA, 25 bp, Rattus norvegicus
actgccatgtctgttttctttattt

SEQ ID NO: 96617 - DNA, 25 bp, Rattus norvegicus
actgccattcatccgcatgtttaaa

SEQ ID NO: 96618 - DNA, 25 bp, Rattus norvegicus
actgccattcatgcgcatgtttaaa

SEQ ID NO: 96619 - DNA, 25 bp, Rattus norvegicus
actgccatttctctggtcaagtcac

SEQ ID NO: 96620 - DNA, 25 bp, Rattus norvegicus
actgccatttctgtggtcaagtcac

SEQ ID NO: 96621 - DNA, 25 bp, Rattus norvegicus
actgcccaacaaacactacaggatc

SEQ ID NO: 96622 - DNA, 25 bp, Rattus norvegicus
actgcccaacaatcactacaggatc

SEQ ID NO: 96623 - DNA, 25 bp, Rattus norvegicus
actgcccacattctgacatttttgt

SEQ ID NO: 96624 - DNA, 25 bp, Rattus norvegicus
actgcccacattgtgacatttttgt

SEQ ID NO: 96625 - DNA, 25 bp, Rattus norvegicus
actgcccacgtgcacagcggatgaa

SEQ ID NO: 96626 - DNA, 25 bp, Rattus norvegicus
actgcccacgtggacagcggatgaa

SEQ ID NO: 96627 - DNA, 25 bp, Rattus norvegicus
actgcccactgtcggcttagaagag

SEQ ID NO: 96628 - DNA, 25 bp, Rattus norvegicus
actgcccactgtgggcttagaagag

SEQ ID NO: 96629 - DNA, 25 bp, Rattus norvegicus
actgcccacttgctatggagcggat

SEQ ID NO: 96630 - DNA, 25 bp, Rattus norvegicus
actgcccacttggtatggagcggat

SEQ ID NO: 96631 - DNA, 25 bp, Rattus norvegicus
actgcccagcccacagatatataaa

SEQ ID NO: 96632 - DNA, 25 bp, Rattus norvegicus
actgcccagccctcagatatataaa

SEQ ID NO: 96633 - DNA, 25 bp, Rattus norvegicus
actgcccagtgccatgtgaaggaac

SEQ ID NO: 96634 - DNA, 25 bp, Rattus norvegicus
actgcccagtgcgatgtgaaggaac

SEQ ID NO: 96635 - DNA, 25 bp, Rattus norvegicus
actgcccatccaagcacaaaaaagg

SEQ ID NO: 96636 - DNA, 25 bp, Rattus norvegicus
actgcccatccatgcacaaaaaagg

SEQ ID NO: 96637 - DNA, 25 bp, Rattus norvegicus
actgcccatgctctggctggatcaa

SEQ ID NO: 96638 - DNA, 25 bp, Rattus norvegicus
actgcccatgctgtggctggatcaa

SEQ ID NO: 96639 - DNA, 25 bp, Rattus norvegicus
actgcccatggcacagacccaggaa

SEQ ID NO: 96640 - DNA, 25 bp, Rattus norvegicus
actgcccatggctcagacccaggaa

SEQ ID NO: 96641 - DNA, 25 bp, Rattus norvegicus
actgcccattacctcacagattttg

SEQ ID NO: 96642 - DNA, 25 bp, Rattus norvegicus
actgcccattacgtcacagattttg

SEQ ID NO: 96643 - DNA, 25 bp, Rattus norvegicus
actgccccactcagactaatcaggt

SEQ ID NO: 96644 - DNA, 25 bp, Rattus norvegicus
actgccccactctgactaatcaggt

SEQ ID NO: 96645 - DNA, 25 bp, Rattus norvegicus
actgccccatggattcatttagcgt

SEQ ID NO: 96646 - DNA, 25 bp, Rattus norvegicus
actgccccatggtttcatttagcgt

SEQ ID NO: 96647 - DNA, 25 bp, Rattus norvegicus
actgccccatgtctcgacaggagtg

SEQ ID NO: 96648 - DNA, 25 bp, Rattus norvegicus
actgccccatgtgtcgacaggagtg

SEQ ID NO: 96649 - DNA, 25 bp, Rattus norvegicus
actgccccgtaaatctgctgaagag

SEQ ID NO: 96650 - DNA, 25 bp, Rattus norvegicus
actgccccgtaattctgctgaagag

SEQ ID NO: 96651 - DNA, 25 bp, Rattus norvegicus
actgcccctgaacctcttaattatg

SEQ ID NO: 96652 - DNA, 25 bp, Rattus norvegicus
actgcccctgaagctcttaattatg

SEQ ID NO: 96653 - DNA, 25 bp, Rattus norvegicus
actgcccctgagaaactgacaagta

SEQ ID NO: 96654 - DNA, 25 bp, Rattus norvegicus
actgcccctgagtaactgacaagta

SEQ ID NO: 96655 - DNA, 25 bp, Rattus norvegicus
actgcccctgggattcagatttcat

SEQ ID NO: 96656 - DNA, 25 bp, Rattus norvegicus
actgcccctgggtttcagatttcat

SEQ ID NO: 96657 - DNA, 25 bp, Rattus norvegicus
actgcccctgtgagtttgcgtgtct

SEQ ID NO: 96658 - DNA, 25 bp, Rattus norvegicus
actgcccctgtgtgtttgcgtgtct

SEQ ID NO: 96659 - DNA, 25 bp, Rattus norvegicus
actgcccgcaaaaccactggtggta

SEQ ID NO: 96660 - DNA, 25 bp, Rattus norvegicus
actgcccgcaaatccactggtggta

SEQ ID NO: 96661 - DNA, 25 bp, Rattus norvegicus
actgcccggcagcaaaccaaggaga

SEQ ID NO: 96662 - DNA, 25 bp, Rattus norvegicus
actgcccggcaggaaaccaaggaga

SEQ ID NO: 96663 - DNA, 25 bp, Rattus norvegicus
actgcccggtgaattggccaagcac

SEQ ID NO: 96664 - DNA, 25 bp, Rattus norvegicus
actgcccggtgatttggccaagcac

SEQ ID NO: 96665 - DNA, 25 bp, Rattus norvegicus
actgcccgtcgtccaaatagtttaa

SEQ ID NO: 96666 - DNA, 25 bp, Rattus norvegicus
actgcccgtcgtgcaaatagtttaa

SEQ ID NO: 96667 - DNA, 25 bp, Rattus norvegicus
actgccctaactctacgtgtgaatc

SEQ ID NO: 96668 - DNA, 25 bp, Rattus norvegicus
actgccctaactgtacgtgtgaatc

SEQ ID NO: 96669 - DNA, 25 bp, Rattus norvegicus
actgccctagcgatttatttggata

SEQ ID NO: 96670 - DNA, 25 bp, Rattus norvegicus
actgccctagcgttttatttggata

SEQ ID NO: 96671 - DNA, 25 bp, Rattus norvegicus
actgccctctggaactgaacggtta

SEQ ID NO: 96672 - DNA, 25 bp, Rattus norvegicus
actgccctctggtactgaacggtta

SEQ ID NO: 96673 - DNA, 25 bp, Rattus norvegicus
actgccctgagcaggtgactttgaa

SEQ ID NO: 96674 - DNA, 25 bp, Rattus norvegicus
actgccctgagctggtgactttgaa

SEQ ID NO: 96675 - DNA, 25 bp, Rattus norvegicus
actgccctgctactatttctgatct

SEQ ID NO: 96676 - DNA, 25 bp, Rattus norvegicus
actgccctgctagtatttctgatct

SEQ ID NO: 96677 - DNA, 25 bp, Rattus norvegicus
actgccctgcttacgctgagaatga

SEQ ID NO: 96678 - DNA, 25 bp, Rattus norvegicus
actgccctgctttcgctgagaatga

SEQ ID NO: 96679 - DNA, 25 bp, Rattus norvegicus
actgccctgtgtcttgtctaaattt

SEQ ID NO: 96680 - DNA, 25 bp, Rattus norvegicus
actgccctgtgtgttgtctaaattt

SEQ ID NO: 96681 - DNA, 25 bp, Rattus norvegicus
actgccctgtttcctgccatgaggg

SEQ ID NO: 96682 - DNA, 25 bp, Rattus norvegicus
actgccctgtttgctgccatgaggg

SEQ ID NO: 96683 - DNA, 25 bp, Rattus norvegicus
actgcccttcagagtctgttgtgaa

SEQ ID NO: 96684 - DNA, 25 bp, Rattus norvegicus
actgcccttcagtgtctgttgtgaa

SEQ ID NO: 96685 - DNA, 25 bp, Rattus norvegicus
actgcccttgcacgagtggaagttt

SEQ ID NO: 96686 - DNA, 25 bp, Rattus norvegicus
actgcccttgcaggagtggaagttt

SEQ ID NO: 96687 - DNA, 25 bp, Rattus norvegicus
actgccctttacattgctaatttca

SEQ ID NO: 96688 - DNA, 25 bp, Rattus norvegicus
actgccctttactttgctaatttca

SEQ ID NO: 96689 - DNA, 25 bp, Rattus norvegicus
actgccctttccatagctttatata

SEQ ID NO: 96690 - DNA, 25 bp, Rattus norvegicus
actgccctttccttagctttatata

SEQ ID NO: 96691 - DNA, 25 bp, Rattus norvegicus
actgccgagtccagctcagcgggtg

SEQ ID NO: 96692 - DNA, 25 bp, Rattus norvegicus
actgccgagtcctgctcagcgggtg

SEQ ID NO: 96693 - DNA, 25 bp, Rattus norvegicus
actgccgcaatgctgttgatttctt

SEQ ID NO: 96694 - DNA, 25 bp, Rattus norvegicus
actgccgcaatggtgttgatttctt

SEQ ID NO: 96695 - DNA, 25 bp, Rattus norvegicus
actgccgcagaacccgtttagcaat

SEQ ID NO: 96696 - DNA, 25 bp, Rattus norvegicus
actgccgcagaagccgtttagcaat

SEQ ID NO: 96697 - DNA, 25 bp, Rattus norvegicus
actgccggagctccagccaagcagg

SEQ ID NO: 96698 - DNA, 25 bp, Rattus norvegicus
actgccggagctgcagccaagcagg

SEQ ID NO: 96699 - DNA, 25 bp, Rattus norvegicus
actgccggcccgagcaaatgaaaca

SEQ ID NO: 96700 - DNA, 25 bp, Rattus norvegicus
actgccggcccgtgcaaatgaaaca

SEQ ID NO: 96701 - DNA, 25 bp, Rattus norvegicus
actgccgggagcaacgcctggatga

SEQ ID NO: 96702 - DNA, 25 bp, Rattus norvegicus
actgccgggagctacgcctggatga

SEQ ID NO: 96703 - DNA, 25 bp, Rattus norvegicus
actgccggtcctcgttgagcgtgta

SEQ ID NO: 96704 - DNA, 25 bp, Rattus norvegicus
actgccggtcctggttgagcgtgta

SEQ ID NO: 96705 - DNA, 25 bp, Rattus norvegicus
actgccgtgactaacttgaagcctt

SEQ ID NO: 96706 - DNA, 25 bp, Rattus norvegicus
actgccgtgacttacttgaagcctt

SEQ ID NO: 96707 - DNA, 25 bp, Rattus norvegicus
actgccgtgccccactaggtagagg

SEQ ID NO: 96708 - DNA, 25 bp, Rattus norvegicus
actgccgtgcccgactaggtagagg

SEQ ID NO: 96709 - DNA, 25 bp, Rattus norvegicus
actgccgtgtctctggaaaccaaaa

SEQ ID NO: 96710 - DNA, 25 bp, Rattus norvegicus
actgccgtgtctgtggaaaccaaaa

SEQ ID NO: 96711 - DNA, 25 bp, Rattus norvegicus
actgccgtgtttatatgaaaagggc

SEQ ID NO: 96712 - DNA, 25 bp, Rattus norvegicus
actgccgtgtttttatgaaaagggc

SEQ ID NO: 96713 - DNA, 25 bp, Rattus norvegicus
actgccgttgttcatctttactgtt

SEQ ID NO: 96714 - DNA, 25 bp, Rattus norvegicus
actgccgttgttgatctttactgtt

SEQ ID NO: 96715 - DNA, 25 bp, Rattus norvegicus
actgcctacaggatcagtctggcct

SEQ ID NO: 96716 - DNA, 25 bp, Rattus norvegicus
actgcctacaggttcagtctggcct

SEQ ID NO: 96717 - DNA, 25 bp, Rattus norvegicus
actgcctacggtcctcggagccaga

SEQ ID NO: 96718 - DNA, 25 bp, Rattus norvegicus
actgcctacggtgctcggagccaga

SEQ ID NO: 96719 - DNA, 25 bp, Rattus norvegicus
actgcctacttcaggaaccgattaa

SEQ ID NO: 96720 - DNA, 25 bp, Rattus norvegicus
actgcctacttctggaaccgattaa

SEQ ID NO: 96721 - DNA, 25 bp, Rattus norvegicus
actgcctactttcgagcctgtatga

SEQ ID NO: 96722 - DNA, 25 bp, Rattus norvegicus
actgcctactttggagcctgtatga

SEQ ID NO: 96723 - DNA, 25 bp, Rattus norvegicus
actgcctagtcgacggaagtcttat

SEQ ID NO: 96724 - DNA, 25 bp, Rattus norvegicus
actgcctagtcgtcggaagtcttat

SEQ ID NO: 96725 - DNA, 25 bp, Rattus norvegicus
actgcctatgagcttcctttgtaaa

SEQ ID NO: 96726 - DNA, 25 bp, Rattus norvegicus
actgcctatgaggttcctttgtaaa

SEQ ID NO: 96727 - DNA, 25 bp, Rattus norvegicus
actgcctatgcacttctgaatgtta

SEQ ID NO: 96728 - DNA, 25 bp, Rattus norvegicus
actgcctatgcagttctgaatgtta

SEQ ID NO: 96729 - DNA, 25 bp, Rattus norvegicus
actgcctcatcaacaacaacgtgaa

SEQ ID NO: 96730 - DNA, 25 bp, Rattus norvegicus
actgcctcatcatcaacaacgtgaa

SEQ ID NO: 96731 - DNA, 25 bp, Rattus norvegicus
actgcctcatggcaaggctcctgta

SEQ ID NO: 96732 - DNA, 25 bp, Rattus norvegicus
actgcctcatgggaaggctcctgta

SEQ ID NO: 96733 - DNA, 25 bp, Rattus norvegicus
actgcctcatttccttacaaacaag

SEQ ID NO: 96734 - DNA, 25 bp, Rattus norvegicus
actgcctcatttgcttacaaacaag

SEQ ID NO: 96735 - DNA, 25 bp, Rattus norvegicus
actgcctccaatcaatcatgtgaaa

SEQ ID NO: 96736 - DNA, 25 bp, Rattus norvegicus
actgcctccaatgaatcatgtgaaa

SEQ ID NO: 96737 - DNA, 25 bp, Rattus norvegicus
actgcctcgcggagtggcctgagct

SEQ ID NO: 96738 - DNA, 25 bp, Rattus norvegicus
actgcctcgcggtgtggcctgagct

SEQ ID NO: 96739 - DNA, 25 bp, Rattus norvegicus
actgcctctgctcttaagattttat

SEQ ID NO: 96740 - DNA, 25 bp, Rattus norvegicus
actgcctctgctgttaagattttat

SEQ ID NO: 96741 - DNA, 25 bp, Rattus norvegicus
actgcctctgtccagtttcaggaaa

SEQ ID NO: 96742 - DNA, 25 bp, Rattus norvegicus
actgcctctgtcgagtttcaggaaa

SEQ ID NO: 96743 - DNA, 25 bp, Rattus norvegicus
actgcctctgttccttcaagggctt

SEQ ID NO: 96744 - DNA, 25 bp, Rattus norvegicus
actgcctctgttgcttcaagggctt

SEQ ID NO: 96745 - DNA, 25 bp, Rattus norvegicus
actgcctgaagtcacttttggaaga

SEQ ID NO: 96746 - DNA, 25 bp, Rattus norvegicus
actgcctgaagtgacttttggaaga

SEQ ID NO: 96747 - DNA, 25 bp, Rattus norvegicus
actgcctgaccccaagcatgtaaat

SEQ ID NO: 96748 - DNA, 25 bp, Rattus norvegicus
actgcctgacccgaagcatgtaaat

SEQ ID NO: 96749 - DNA, 25 bp, Rattus norvegicus
actgcctgatgtatcagtggcctct

SEQ ID NO: 96750 - DNA, 25 bp, Rattus norvegicus
actgcctgatgtttcagtggcctct

SEQ ID NO: 96751 - DNA, 25 bp, Rattus norvegicus
actgcctgcctgagggaacctggaa

SEQ ID NO: 96752 - DNA, 25 bp, Rattus norvegicus
actgcctgcctgtgggaacctggaa

SEQ ID NO: 96753 - DNA, 25 bp, Rattus norvegicus
actgcctgccttaagtgaggacatg

SEQ ID NO: 96754 - DNA, 25 bp, Rattus norvegicus
actgcctgccttattagacaagcat

SEQ ID NO: 96755 - DNA, 25 bp, Rattus norvegicus
actgcctgcctttagtgaggacatg

SEQ ID NO: 96756 - DNA, 25 bp, Rattus norvegicus
actgcctgcctttttagacaagcat

SEQ ID NO: 96757 - DNA, 25 bp, Rattus norvegicus
actgcctggagcactgaatgggatg

SEQ ID NO: 96758 - DNA, 25 bp, Rattus norvegicus
actgcctggagctctgaatgggatg

SEQ ID NO: 96759 - DNA, 25 bp, Rattus norvegicus
actgcctggcaactggtgagtcctg

SEQ ID NO: 96760 - DNA, 25 bp, Rattus norvegicus
actgcctggcaagtggtgagtcctg

SEQ ID NO: 96761 - DNA, 25 bp, Rattus norvegicus
actgcctggcctcctgctgatgagg

SEQ ID NO: 96762 - DNA, 25 bp, Rattus norvegicus
actgcctggcctgctgctgatgagg

SEQ ID NO: 96763 - DNA, 25 bp, Rattus norvegicus
actgcctgggcacccgagatttcga

SEQ ID NO: 96764 - DNA, 25 bp, Rattus norvegicus
actgcctgggcagccgagatttcga

SEQ ID NO: 96765 - DNA, 25 bp, Rattus norvegicus
actgcctgtggcaggtgtctgatag

SEQ ID NO: 96766 - DNA, 25 bp, Rattus norvegicus
actgcctgtggctggtgtctgatag

SEQ ID NO: 96767 - DNA, 25 bp, Rattus norvegicus
actgcctgtgtaaagtataaatata

SEQ ID NO: 96768 - DNA, 25 bp, Rattus norvegicus
actgcctgtgtatagtataaatata

SEQ ID NO: 96769 - DNA, 25 bp, Rattus norvegicus
actgcctgttccacctgaatgatgg

SEQ ID NO: 96770 - DNA, 25 bp, Rattus norvegicus
actgcctgttcctcctgaatgatgg

SEQ ID NO: 96771 - DNA, 25 bp, Rattus norvegicus
actgcctgttgcatatgtgtagaaa

SEQ ID NO: 96772 - DNA, 25 bp, Rattus norvegicus
actgcctgttgcttatgtgtagaaa

SEQ ID NO: 96773 - DNA, 25 bp, Rattus norvegicus
actgcctgttggaagaacatcccat

SEQ ID NO: 96774 - DNA, 25 bp, Rattus norvegicus
actgcctgttggtagaacatcccat

SEQ ID NO: 96775 - DNA, 25 bp, Rattus norvegicus
actgccttagctcctgcttgctcat

SEQ ID NO: 96776 - DNA, 25 bp, Rattus norvegicus
actgccttagctgctgcttgctcat

SEQ ID NO: 96777 - DNA, 25 bp, Rattus norvegicus
actgccttaggacttcttttgaact

SEQ ID NO: 96778 - DNA, 25 bp, Rattus norvegicus
actgccttaggagttcttttgaact

SEQ ID NO: 96779 - DNA, 25 bp, Rattus norvegicus
actgccttatgaacactgggagaga

SEQ ID NO: 96780 - DNA, 25 bp, Rattus norvegicus
actgccttatgatcactgggagaga

SEQ ID NO: 96781 - DNA, 25 bp, Rattus norvegicus
actgccttcaggcacactgatgtct

SEQ ID NO: 96782 - DNA, 25 bp, Rattus norvegicus
actgccttcagggacactgatgtct

SEQ ID NO: 96783 - DNA, 25 bp, Rattus norvegicus
actgccttcatcaatgtgtctattt

SEQ ID NO: 96784 - DNA, 25 bp, Rattus norvegicus
actgccttcatctatgtgtctattt

SEQ ID NO: 96785 - DNA, 25 bp, Rattus norvegicus
actgccttccctctggaggtaatac

SEQ ID NO: 96786 - DNA, 25 bp, Rattus norvegicus
actgccttccctgtggaggtaatac

SEQ ID NO: 96787 - DNA, 25 bp, Rattus norvegicus
actgccttcgacaacgtggagttca

SEQ ID NO: 96788 - DNA, 25 bp, Rattus norvegicus
actgccttcgactacgtggagttca

SEQ ID NO: 96789 - DNA, 25 bp, Rattus norvegicus
actgccttctacacacttggtagtg

SEQ ID NO: 96790 - DNA, 25 bp, Rattus norvegicus
actgccttctactcacttggtagtg

SEQ ID NO: 96791 - DNA, 25 bp, Rattus norvegicus
actgccttctgaagacttccttttt

SEQ ID NO: 96792 - DNA, 25 bp, Rattus norvegicus
actgccttctgatgacttccttttt

SEQ ID NO: 96793 - DNA, 25 bp, Rattus norvegicus
actgccttctgcacttgagggtctg

SEQ ID NO: 96794 - DNA, 25 bp, Rattus norvegicus
actgccttctgctcttgagggtctg

SEQ ID NO: 96795 - DNA, 25 bp, Rattus norvegicus
actgccttctttctttcagacctga

SEQ ID NO: 96796 - DNA, 25 bp, Rattus norvegicus
actgccttctttgtttcagacctga

SEQ ID NO: 96797 - DNA, 25 bp, Rattus norvegicus
actgccttgaaaactcgtgtcctag

SEQ ID NO: 96798 - DNA, 25 bp, Rattus norvegicus
actgccttgaaatctcgtgtcctag

SEQ ID NO: 96799 - DNA, 25 bp, Rattus norvegicus
actgccttgaacaggcccaataatc

SEQ ID NO: 96800 - DNA, 25 bp, Rattus norvegicus
actgccttgaactggcccaataatc

SEQ ID NO: 96801 - DNA, 25 bp, Rattus norvegicus
actgccttgcagatgaatgttcaca

SEQ ID NO: 96802 - DNA, 25 bp, Rattus norvegicus
actgccttgcagttgaatgttcaca

SEQ ID NO: 96803 - DNA, 25 bp, Rattus norvegicus
actgccttgggtacctttgtcataa

SEQ ID NO: 96804 - DNA, 25 bp, Rattus norvegicus
actgccttgggttcctttgtcataa

SEQ ID NO: 96805 - DNA, 25 bp, Rattus norvegicus
actgcctttcagactttatgcaaac

SEQ ID NO: 96806 - DNA, 25 bp, Rattus norvegicus
actgcctttcagtctttatgcaaac

SEQ ID NO: 96807 - DNA, 25 bp, Rattus norvegicus
actgcctttcatctgtttgttgcct

SEQ ID NO: 96808 - DNA, 25 bp, Rattus norvegicus
actgcctttcatgtgtttgttgcct

SEQ ID NO: 96809 - DNA, 25 bp, Rattus norvegicus
actgcctttgaacccgaagcattgg

SEQ ID NO: 96810 - DNA, 25 bp, Rattus norvegicus
actgcctttgaagccgaagcattgg

SEQ ID NO: 96811 - DNA, 25 bp, Rattus norvegicus
actgcgacagtcatgtggtgtccct

SEQ ID NO: 96812 - DNA, 25 bp, Rattus norvegicus
actgcgacagtcttgtggtgtccct

SEQ ID NO: 96813 - DNA, 25 bp, Rattus norvegicus
actgcgatattacatttttcactta

SEQ ID NO: 96814 - DNA, 25 bp, Rattus norvegicus
actgcgatattagatttttcactta

SEQ ID NO: 96815 - DNA, 25 bp, Rattus norvegicus
actgcgatgcatcctttaccacact

SEQ ID NO: 96816 - DNA, 25 bp, Rattus norvegicus
actgcgatgcatgctttaccacact

SEQ ID NO: 96817 - DNA, 25 bp, Rattus norvegicus
actgcgcaccttaacactgaggatg

SEQ ID NO: 96818 - DNA, 25 bp, Rattus norvegicus
actgcgcacctttacactgaggatg

SEQ ID NO: 96819 - DNA, 25 bp, Rattus norvegicus
actgcgcacgcacatgtaggtttat

SEQ ID NO: 96820 - DNA, 25 bp, Rattus norvegicus
actgcgcacgcagatgtaggtttat

SEQ ID NO: 96821 - DNA, 25 bp, Rattus norvegicus
actgcgcatcccatttcttatttat

SEQ ID NO: 96822 - DNA, 25 bp, Rattus norvegicus
actgcgcatcccttttcttatttat

SEQ ID NO: 96823 - DNA, 25 bp, Rattus norvegicus
actgcgcccgttctaccaatgttca

SEQ ID NO: 96824 - DNA, 25 bp, Rattus norvegicus
actgcgcccgttgtaccaatgttca

SEQ ID NO: 96825 - DNA, 25 bp, Rattus norvegicus
actgcgcctaaacagaaacccctgg

SEQ ID NO: 96826 - DNA, 25 bp, Rattus norvegicus
actgcgcctaaagagaaacccctgg

SEQ ID NO: 96827 - DNA, 25 bp, Rattus norvegicus
actgcgcgcgctccacatgaaggag

SEQ ID NO: 96828 - DNA, 25 bp, Rattus norvegicus
actgcgcgcgctgcacatgaaggag

SEQ ID NO: 96829 - DNA, 25 bp, Rattus norvegicus
actgcgcgtacaccattgccaaata

SEQ ID NO: 96830 - DNA, 25 bp, Rattus norvegicus
actgcgcgtacagcattgccaaata

SEQ ID NO: 96831 - DNA, 25 bp, Rattus norvegicus
actgcgctggtgattgtcacgtcct

SEQ ID NO: 96832 - DNA, 25 bp, Rattus norvegicus
actgcgctggtgtttgtcacgtcct

SEQ ID NO: 96833 - DNA, 25 bp, Rattus norvegicus
actgcgctttctcgagtgccaagca

SEQ ID NO: 96834 - DNA, 25 bp, Rattus norvegicus
actgcgctttctggagtgccaagca

SEQ ID NO: 96835 - DNA, 25 bp, Rattus norvegicus
actgcggaagcaagatttacacaat

SEQ ID NO: 96836 - DNA, 25 bp, Rattus norvegicus
actgcggaagcatgatttacacaat

SEQ ID NO: 96837 - DNA, 25 bp, Rattus norvegicus
actgcggaagtacgaccactgtgtg

SEQ ID NO: 96838 - DNA, 25 bp, Rattus norvegicus
actgcggaagtaggaccactgtgtg

SEQ ID NO: 96839 - DNA, 25 bp, Rattus norvegicus
actgcggactgcaggcgtgcacaga

SEQ ID NO: 96840 - DNA, 25 bp, Rattus norvegicus
actgcggactgctggcgtgcacaga

SEQ ID NO: 96841 - DNA, 25 bp, Rattus norvegicus
actgcggagggacaatccccaactt

SEQ ID NO: 96842 - DNA, 25 bp, Rattus norvegicus
actgcggagggagaatccccaactt

SEQ ID NO: 96843 - DNA, 25 bp, Rattus norvegicus
actgcggccaggcatagacagcctt

SEQ ID NO: 96844 - DNA, 25 bp, Rattus norvegicus
actgcggccagggatagacagcctt

SEQ ID NO: 96845 - DNA, 25 bp, Rattus norvegicus
actgcggcgcagaatcctgatggca

SEQ ID NO: 96846 - DNA, 25 bp, Rattus norvegicus
actgcggcgcagtatcctgatggca

SEQ ID NO: 96847 - DNA, 25 bp, Rattus norvegicus
actgcggctcctatgtgtggaatat

SEQ ID NO: 96848 - DNA, 25 bp, Rattus norvegicus
actgcggctcctttgtgtggaatat

SEQ ID NO: 96849 - DNA, 25 bp, Rattus norvegicus
actgcgggacgaactgggctctaac

SEQ ID NO: 96850 - DNA, 25 bp, Rattus norvegicus
actgcgggacgatctgggctctaac

SEQ ID NO: 96851 - DNA, 25 bp, Rattus norvegicus
actgcgggagatacatttcatacaa

SEQ ID NO: 96852 - DNA, 25 bp, Rattus norvegicus
actgcgggagattcatttcatacaa

SEQ ID NO: 96853 - DNA, 25 bp, Rattus norvegicus
actgcgggattgctacatattccac

SEQ ID NO: 96854 - DNA, 25 bp, Rattus norvegicus
actgcgggattggtacatattccac

SEQ ID NO: 96855 - DNA, 25 bp, Rattus norvegicus
actgcgggcggtaacttccgacagt

SEQ ID NO: 96856 - DNA, 25 bp, Rattus norvegicus
actgcgggcggttacttccgacagt

SEQ ID NO: 96857 - DNA, 25 bp, Rattus norvegicus
actgcggtccaacagatggcgcgat

SEQ ID NO: 96858 - DNA, 25 bp, Rattus norvegicus
actgcggtccaagagatggcgcgat

SEQ ID NO: 96859 - DNA, 25 bp, Rattus norvegicus
actgcggtcctgacatgagaagcca

SEQ ID NO: 96860 - DNA, 25 bp, Rattus norvegicus
actgcggtcctgtcatgagaagcca

SEQ ID NO: 96861 - DNA, 25 bp, Rattus norvegicus
actgcggtgtttctgactggctgaa

SEQ ID NO: 96862 - DNA, 25 bp, Rattus norvegicus
actgcggtgtttgtgactggctgaa

SEQ ID NO: 96863 - DNA, 25 bp, Rattus norvegicus
actgcgtatcccaaggcactgaaga

SEQ ID NO: 96864 - DNA, 25 bp, Rattus norvegicus
actgcgtatccctaggcactgaaga

SEQ ID NO: 96865 - DNA, 25 bp, Rattus norvegicus
actgcgtcaggtagtgtctctgctc

SEQ ID NO: 96866 - DNA, 25 bp, Rattus norvegicus
actgcgtcaggttgtgtctctgctc

SEQ ID NO: 96867 - DNA, 25 bp, Rattus norvegicus
actgcgtcccagatgagtgacacaa

SEQ ID NO: 96868 - DNA, 25 bp, Rattus norvegicus
actgcgtcccagttgagtgacacaa

SEQ ID NO: 96869 - DNA, 25 bp, Rattus norvegicus
actgcgtctgagcatctcctgagaa

SEQ ID NO: 96870 - DNA, 25 bp, Rattus norvegicus
actgcgtctgaggatctcctgagaa

SEQ ID NO: 96871 - DNA, 25 bp, Rattus norvegicus
actgcgtctttcacactgaatatca

SEQ ID NO: 96872 - DNA, 25 bp, Rattus norvegicus
actgcgtctttctcactgaatatca

SEQ ID NO: 96873 - DNA, 25 bp, Rattus norvegicus
actgcgtgacaaagccaattgggaa

SEQ ID NO: 96874 - DNA, 25 bp, Rattus norvegicus
actgcgtgacaatgccaattgggaa

SEQ ID NO: 96875 - DNA, 25 bp, Rattus norvegicus
actgcgtggcttagctgttattaca

SEQ ID NO: 96876 - DNA, 25 bp, Rattus norvegicus
actgcgtggctttgctgttattaca

SEQ ID NO: 96877 - DNA, 25 bp, Rattus norvegicus
actgcgtgtgtaccttgggtactgt

SEQ ID NO: 96878 - DNA, 25 bp, Rattus norvegicus
actgcgtgtgtagcttgggtactgt

SEQ ID NO: 96879 - DNA, 25 bp, Rattus norvegicus
actgcgtgttgtagccatccaggga

SEQ ID NO: 96880 - DNA, 25 bp, Rattus norvegicus
actgcgtgttgttgccatccaggga

SEQ ID NO: 96881 - DNA, 25 bp, Rattus norvegicus
actgcgttcttgaccagatggttgt

SEQ ID NO: 96882 - DNA, 25 bp, Rattus norvegicus
actgcgttcttgtccagatggttgt

SEQ ID NO: 96883 - DNA, 25 bp, Rattus norvegicus
actgcgtttcagagcaagggttgac

SEQ ID NO: 96884 - DNA, 25 bp, Rattus norvegicus
actgcgtttcagtgcaagggttgac

SEQ ID NO: 96885 - DNA, 25 bp, Rattus norvegicus
actgctaaagacagtgccagccggc

SEQ ID NO: 96886 - DNA, 25 bp, Rattus norvegicus
actgctaaagactgtgccagccggc

SEQ ID NO: 96887 - DNA, 25 bp, Rattus norvegicus
actgctaacctcatatttctatgga

SEQ ID NO: 96888 - DNA, 25 bp, Rattus norvegicus
actgctaacctcttatttctatgga

SEQ ID NO: 96889 - DNA, 25 bp, Rattus norvegicus
actgctaagcagagtgttgtattat

SEQ ID NO: 96890 - DNA, 25 bp, Rattus norvegicus
actgctaagcagtgtgttgtattat

SEQ ID NO: 96891 - DNA, 25 bp, Rattus norvegicus
actgctaattgtcatctctggtctg

SEQ ID NO: 96892 - DNA, 25 bp, Rattus norvegicus
actgctaattgtgatctctggtctg

SEQ ID NO: 96893 - DNA, 25 bp, Rattus norvegicus
actgctacaagcaactcttcagctt

SEQ ID NO: 96894 - DNA, 25 bp, Rattus norvegicus
actgctacaagctactcttcagctt

SEQ ID NO: 96895 - DNA, 25 bp, Rattus norvegicus
actgctaccgctctgaggactgtgg

SEQ ID NO: 96896 - DNA, 25 bp, Rattus norvegicus
actgctaccgctgtgaggactgtgg

SEQ ID NO: 96897 - DNA, 25 bp, Rattus norvegicus
actgctaccttacagggaccgttgt

SEQ ID NO: 96898 - DNA, 25 bp, Rattus norvegicus
actgctaccttagagggaccgttgt

SEQ ID NO: 96899 - DNA, 25 bp, Rattus norvegicus
actgctacgatgagtgtgagcctct

SEQ ID NO: 96900 - DNA, 25 bp, Rattus norvegicus
actgctacgatgtgtgtgagcctct

SEQ ID NO: 96901 - DNA, 25 bp, Rattus norvegicus
actgctactaacatggtccacttgt

SEQ ID NO: 96902 - DNA, 25 bp, Rattus norvegicus
actgctactaacttggtccacttgt

SEQ ID NO: 96903 - DNA, 25 bp, Rattus norvegicus
actgctactcagatcctacaagact

SEQ ID NO: 96904 - DNA, 25 bp, Rattus norvegicus
actgctactcagttcctacaagact

SEQ ID NO: 96905 - DNA, 25 bp, Rattus norvegicus
actgctactggactcctgggattca

SEQ ID NO: 96906 - DNA, 25 bp, Rattus norvegicus
actgctactggagtcctgggattca

SEQ ID NO: 96907 - DNA, 25 bp, Rattus norvegicus
actgctactgtgacttggaggaccc

SEQ ID NO: 96908 - DNA, 25 bp, Rattus norvegicus
actgctactgtgtcttggaggaccc

SEQ ID NO: 96909 - DNA, 25 bp, Rattus norvegicus
actgctagagtcacagcttttctga

SEQ ID NO: 96910 - DNA, 25 bp, Rattus norvegicus
actgctagagtctcagcttttctga

SEQ ID NO: 96911 - DNA, 25 bp, Rattus norvegicus
actgctagatttcagcttctcaaga

SEQ ID NO: 96912 - DNA, 25 bp, Rattus norvegicus
actgctagatttgagcttctcaaga

SEQ ID NO: 96913 - DNA, 25 bp, Rattus norvegicus
actgctaggatgattgtccctgcac

SEQ ID NO: 96914 - DNA, 25 bp, Rattus norvegicus
actgctaggatgtttgtccctgcac

SEQ ID NO: 96915 - DNA, 25 bp, Rattus norvegicus
actgctagtgacatttggccacgac

SEQ ID NO: 96916 - DNA, 25 bp, Rattus norvegicus
actgctagtgacttttggccacgac

SEQ ID NO: 96917 - DNA, 25 bp, Rattus norvegicus
actgctatctctctatactcttgga

SEQ ID NO: 96918 - DNA, 25 bp, Rattus norvegicus
actgctatctctgtatactcttgga

SEQ ID NO: 96919 - DNA, 25 bp, Rattus norvegicus
actgctatctgactgctgaacgtgc

SEQ ID NO: 96920 - DNA, 25 bp, Rattus norvegicus
actgctatctgagtgctgaacgtgc

SEQ ID NO: 96921 - DNA, 25 bp, Rattus norvegicus
actgctatgtaaactggttctggaa

SEQ ID NO: 96922 - DNA, 25 bp, Rattus norvegicus
actgctatgtaatctggttctggaa

SEQ ID NO: 96923 - DNA, 25 bp, Rattus norvegicus
actgctatgtgtctttttgacctca

SEQ ID NO: 96924 - DNA, 25 bp, Rattus norvegicus
actgctatgtgtgtttttgacctca

SEQ ID NO: 96925 - DNA, 25 bp, Rattus norvegicus
actgctatgttaccgccttgatgat

SEQ ID NO: 96926 - DNA, 25 bp, Rattus norvegicus
actgctatgttagcgccttgatgat

SEQ ID NO: 96927 - DNA, 25 bp, Rattus norvegicus
actgctattcttcgatgatctggct

SEQ ID NO: 96928 - DNA, 25 bp, Rattus norvegicus
actgctattcttggatgatctggct

SEQ ID NO: 96929 - DNA, 25 bp, Rattus norvegicus
actgctcaagctcctggaccatagg

SEQ ID NO: 96930 - DNA, 25 bp, Rattus norvegicus
actgctcaagctgctggaccatagg

SEQ ID NO: 96931 - DNA, 25 bp, Rattus norvegicus
actgctcacaacaattcttaactcc

SEQ ID NO: 96932 - DNA, 25 bp, Rattus norvegicus
actgctcacaactattcttaactcc

SEQ ID NO: 96933 - DNA, 25 bp, Rattus norvegicus
actgctcaccttaggaggcactcac

SEQ ID NO: 96934 - DNA, 25 bp, Rattus norvegicus
actgctcacctttggaggcactcac

SEQ ID NO: 96935 - DNA, 25 bp, Rattus norvegicus
actgctcactgcacagtggactggt

SEQ ID NO: 96936 - DNA, 25 bp, Rattus norvegicus
actgctcactgctcagtggactggt

SEQ ID NO: 96937 - DNA, 25 bp, Rattus norvegicus
actgctcactggctggcacagtaga

SEQ ID NO: 96938 - DNA, 25 bp, Rattus norvegicus
actgctcactgggtggcacagtaga

SEQ ID NO: 96939 - DNA, 25 bp, Rattus norvegicus
actgctcacttccttaaattgtctt

SEQ ID NO: 96940 - DNA, 25 bp, Rattus norvegicus
actgctcacttcgttaaattgtctt

SEQ ID NO: 96941 - DNA, 25 bp, Rattus norvegicus
actgctcagctgaatgctgcaggca

SEQ ID NO: 96942 - DNA, 25 bp, Rattus norvegicus
actgctcagctgtatgctgcaggca

SEQ ID NO: 96943 - DNA, 25 bp, Rattus norvegicus
actgctcaggaaaggaaatgctatt

SEQ ID NO: 96944 - DNA, 25 bp, Rattus norvegicus
actgctcaggaatggaaatgctatt

SEQ ID NO: 96945 - DNA, 25 bp, Rattus norvegicus
actgctcagggacacctgttgggac

SEQ ID NO: 96946 - DNA, 25 bp, Rattus norvegicus
actgctcagggagacctgttgggac

SEQ ID NO: 96947 - DNA, 25 bp, Rattus norvegicus
actgctcataataggctgcttcgta

SEQ ID NO: 96948 - DNA, 25 bp, Rattus norvegicus
actgctcataattggctgcttcgta

SEQ ID NO: 96949 - DNA, 25 bp, Rattus norvegicus
actgctcatgctccctacagaggag

SEQ ID NO: 96950 - DNA, 25 bp, Rattus norvegicus
actgctcatgctgcctacagaggag

SEQ ID NO: 96951 - DNA, 25 bp, Rattus norvegicus
actgctcatgggataaagtctgcac

SEQ ID NO: 96952 - DNA, 25 bp, Rattus norvegicus
actgctcatgggttaaagtctgcac

SEQ ID NO: 96953 - DNA, 25 bp, Rattus norvegicus
actgctcccgagacttatttataaa

SEQ ID NO: 96954 - DNA, 25 bp, Rattus norvegicus
actgctcccgagtcttatttataaa

SEQ ID NO: 96955 - DNA, 25 bp, Rattus norvegicus
actgctcccgttcttcaaaagcaaa

SEQ ID NO: 96956 - DNA, 25 bp, Rattus norvegicus
actgctcccgttgttcaaaagcaaa

SEQ ID NO: 96957 - DNA, 25 bp, Rattus norvegicus
actgctcctattcaggtgtccaatg

SEQ ID NO: 96958 - DNA, 25 bp, Rattus norvegicus
actgctcctattgaggtgtccaatg

SEQ ID NO: 96959 - DNA, 25 bp, Rattus norvegicus
actgctcctgctctgaaagactcag

SEQ ID NO: 96960 - DNA, 25 bp, Rattus norvegicus
actgctcctgctgtgaaagactcag

SEQ ID NO: 96961 - DNA, 25 bp, Rattus norvegicus
actgctcctgtgaccatgatccttt

SEQ ID NO: 96962 - DNA, 25 bp, Rattus norvegicus
actgctcctgtgtccatgatccttt

SEQ ID NO: 96963 - DNA, 25 bp, Rattus norvegicus
actgctcctttaacagctttgccaa

SEQ ID NO: 96964 - DNA, 25 bp, Rattus norvegicus
actgctcctttatcagctttgccaa

SEQ ID NO: 96965 - DNA, 25 bp, Rattus norvegicus
actgctcggcttattgttttcttct

SEQ ID NO: 96966 - DNA, 25 bp, Rattus norvegicus
actgctcggctttttgttttcttct

SEQ ID NO: 96967 - DNA, 25 bp, Rattus norvegicus
actgctcgtattatttctgctcacc

SEQ ID NO: 96968 - DNA, 25 bp, Rattus norvegicus
actgctcgtattttttctgctcacc

SEQ ID NO: 96969 - DNA, 25 bp, Rattus norvegicus
actgctcgttggcattccgggaagt

SEQ ID NO: 96970 - DNA, 25 bp, Rattus norvegicus
actgctcgttgggattccgggaagt

SEQ ID NO: 96971 - DNA, 25 bp, Rattus norvegicus
actgctctactgaatgccatattta

SEQ ID NO: 96972 - DNA, 25 bp, Rattus norvegicus
actgctctactgtatgccatattta

SEQ ID NO: 96973 - DNA, 25 bp, Rattus norvegicus
actgctctagatattgcttcagaaa

SEQ ID NO: 96974 - DNA, 25 bp, Rattus norvegicus
actgctctagattttgcttcagaaa

SEQ ID NO: 96975 - DNA, 25 bp, Rattus norvegicus
actgctctagctacttgtgtacaat

SEQ ID NO: 96976 - DNA, 25 bp, Rattus norvegicus
actgctctagcttcttgtgtacaat

SEQ ID NO: 96977 - DNA, 25 bp, Rattus norvegicus
actgctctagtcagaacatggtttt

SEQ ID NO: 96978 - DNA, 25 bp, Rattus norvegicus
actgctctagtctgaacatggtttt

SEQ ID NO: 96979 - DNA, 25 bp, Rattus norvegicus
actgctctagttagcttctttgtga

SEQ ID NO: 96980 - DNA, 25 bp, Rattus norvegicus
actgctctagtttgcttctttgtga

SEQ ID NO: 96981 - DNA, 25 bp, Rattus norvegicus
actgctctatgtctgtccggttggt

SEQ ID NO: 96982 - DNA, 25 bp, Rattus norvegicus
actgctctatgtgtgtccggttggt

SEQ ID NO: 96983 - DNA, 25 bp, Rattus norvegicus
actgctctcatcacaatgaccataa

SEQ ID NO: 96984 - DNA, 25 bp, Rattus norvegicus
actgctctcatctcaatgaccataa

SEQ ID NO: 96985 - DNA, 25 bp, Rattus norvegicus
actgctctctagcaacacgtgctga

SEQ ID NO: 96986 - DNA, 25 bp, Rattus norvegicus
actgctctctaggaacacgtgctga

SEQ ID NO: 96987 - DNA, 25 bp, Rattus norvegicus
actgctctctttcgctattctataa

SEQ ID NO: 96988 - DNA, 25 bp, Rattus norvegicus
actgctctctttggctattctataa

SEQ ID NO: 96989 - DNA, 25 bp, Rattus norvegicus
actgctctggcacatgagtgttgga

SEQ ID NO: 96990 - DNA, 25 bp, Rattus norvegicus
actgctctggcagatgagtgttgga

SEQ ID NO: 96991 - DNA, 25 bp, Rattus norvegicus
actgctctggctagatggtctgacc

SEQ ID NO: 96992 - DNA, 25 bp, Rattus norvegicus
actgctctggcttgatggtctgacc

SEQ ID NO: 96993 - DNA, 25 bp, Rattus norvegicus
actgctctgtaacattccgaggaga

SEQ ID NO: 96994 - DNA, 25 bp, Rattus norvegicus
actgctctgtaagattccgaggaga

SEQ ID NO: 96995 - DNA, 25 bp, Rattus norvegicus
actgctctgtgaatggtgtcccttg

SEQ ID NO: 96996 - DNA, 25 bp, Rattus norvegicus
actgctctgtgattggtgtcccttg

SEQ ID NO: 96997 - DNA, 25 bp, Rattus norvegicus
actgctctgtgcagaatatacctgc

SEQ ID NO: 96998 - DNA, 25 bp, Rattus norvegicus
actgctctgtgctgaatatacctgc

SEQ ID NO: 96999 - DNA, 25 bp, Rattus norvegicus
actgctctgttcactagttgatggt

SEQ ID NO: 97000 - DNA, 25 bp, Rattus norvegicus
actgctctgttctctagttgatggt

SEQ ID NO: 97001 - DNA, 25 bp, Rattus norvegicus
actgctcttcaaagtctgaggtctt

SEQ ID NO: 97002 - DNA, 25 bp, Rattus norvegicus
actgctcttcaatgtctgaggtctt

SEQ ID NO: 97003 - DNA, 25 bp, Rattus norvegicus
actgctcttcggaggactgtgaact

SEQ ID NO: 97004 - DNA, 25 bp, Rattus norvegicus
actgctcttcggtggactgtgaact

SEQ ID NO: 97005 - DNA, 25 bp, Rattus norvegicus
actgctgaacctcatccagaatgac

SEQ ID NO: 97006 - DNA, 25 bp, Rattus norvegicus
actgctgaacctgatccagaatgac

SEQ ID NO: 97007 - DNA, 25 bp, Rattus norvegicus
actgctgaactaagcacccctagag

SEQ ID NO: 97008 - DNA, 25 bp, Rattus norvegicus
actgctgaactatgcacccctagag

SEQ ID NO: 97009 - DNA, 25 bp, Rattus norvegicus
actgctgaagccctactgagagctg

SEQ ID NO: 97010 - DNA, 25 bp, Rattus norvegicus
actgctgaagccgtactgagagctg

SEQ ID NO: 97011 - DNA, 25 bp, Rattus norvegicus
actgctgacaaccttgctagcttgt

SEQ ID NO: 97012 - DNA, 25 bp, Rattus norvegicus
actgctgacaacgttgctagcttgt

SEQ ID NO: 97013 - DNA, 25 bp, Rattus norvegicus
actgctgacactcgctacttactgg

SEQ ID NO: 97014 - DNA, 25 bp, Rattus norvegicus
actgctgacactggctacttactgg

SEQ ID NO: 97015 - DNA, 25 bp, Rattus norvegicus
actgctgacagaacaaggaattccg

SEQ ID NO: 97016 - DNA, 25 bp, Rattus norvegicus
actgctgacagatcaaggaattccg

SEQ ID NO: 97017 - DNA, 25 bp, Rattus norvegicus
actgctgacgtcattcaaccaactg

SEQ ID NO: 97018 - DNA, 25 bp, Rattus norvegicus
actgctgacgtctttcaaccaactg

SEQ ID NO: 97019 - DNA, 25 bp, Rattus norvegicus
actgctgacgttccagaggacccag

SEQ ID NO: 97020 - DNA, 25 bp, Rattus norvegicus
actgctgacgttgcagaggacccag

SEQ ID NO: 97021 - DNA, 25 bp, Rattus norvegicus
actgctgactctcgcagaatatcat

SEQ ID NO: 97022 - DNA, 25 bp, Rattus norvegicus
actgctgactctcgctgggtatcat

SEQ ID NO: 97023 - DNA, 25 bp, Rattus norvegicus
actgctgactctggcagaatatcat

SEQ ID NO: 97024 - DNA, 25 bp, Rattus norvegicus
actgctgactctggctgggtatcat

SEQ ID NO: 97025 - DNA, 25 bp, Rattus norvegicus
actgctgactgtcctcggctgtggt

SEQ ID NO: 97026 - DNA, 25 bp, Rattus norvegicus
actgctgactgtgctcggctgtggt

SEQ ID NO: 97027 - DNA, 25 bp, Rattus norvegicus
actgctgagagcaagaggccagcct

SEQ ID NO: 97028 - DNA, 25 bp, Rattus norvegicus
actgctgagagctagaggccagcct

SEQ ID NO: 97029 - DNA, 25 bp, Rattus norvegicus
actgctgagcctactttctgagggt

SEQ ID NO: 97030 - DNA, 25 bp, Rattus norvegicus
actgctgagccttctttctgagggt

SEQ ID NO: 97031 - DNA, 25 bp, Rattus norvegicus
actgctgagctaactccaatttaaa

SEQ ID NO: 97032 - DNA, 25 bp, Rattus norvegicus
actgctgagctatctccaatttaaa

SEQ ID NO: 97033 - DNA, 25 bp, Rattus norvegicus
actgctgagctgagtatctcccggc

SEQ ID NO: 97034 - DNA, 25 bp, Rattus norvegicus
actgctgagctgtgtatctcccggc

SEQ ID NO: 97035 - DNA, 25 bp, Rattus norvegicus
actgctgagtcactgagtcctcatt

SEQ ID NO: 97036 - DNA, 25 bp, Rattus norvegicus
actgctgagtcagtgagtcctcatt

SEQ ID NO: 97037 - DNA, 25 bp, Rattus norvegicus
actgctgatccactttttctctgac

SEQ ID NO: 97038 - DNA, 25 bp, Rattus norvegicus
actgctgatccagtttttctctgac

SEQ ID NO: 97039 - DNA, 25 bp, Rattus norvegicus
actgctgattcgagtggactgaact

SEQ ID NO: 97040 - DNA, 25 bp, Rattus norvegicus
actgctgattcgtgtggactgaact

SEQ ID NO: 97041 - DNA, 25 bp, Rattus norvegicus
actgctgattgtcactttgagaaaa

SEQ ID NO: 97042 - DNA, 25 bp, Rattus norvegicus
actgctgattgtgactttgagaaaa

SEQ ID NO: 97043 - DNA, 25 bp, Rattus norvegicus
actgctgcagaccttgtcagtgcaa

SEQ ID NO: 97044 - DNA, 25 bp, Rattus norvegicus
actgctgcagacgttgtcagtgcaa

SEQ ID NO: 97045 - DNA, 25 bp, Rattus norvegicus
actgctgcaggtccactcagtggtt

SEQ ID NO: 97046 - DNA, 25 bp, Rattus norvegicus
actgctgcaggtgcactcagtggtt

SEQ ID NO: 97047 - DNA, 25 bp, Rattus norvegicus
actgctgcagtcattcttggcttga

SEQ ID NO: 97048 - DNA, 25 bp, Rattus norvegicus
actgctgcagtctttcttggcttga

SEQ ID NO: 97049 - DNA, 25 bp, Rattus norvegicus
actgctgcagtgaagtaaaccccaa

SEQ ID NO: 97050 - DNA, 25 bp, Rattus norvegicus
actgctgcagtgtagtaaaccccaa

SEQ ID NO: 97051 - DNA, 25 bp, Rattus norvegicus
actgctgcatccaaacagactctgg

SEQ ID NO: 97052 - DNA, 25 bp, Rattus norvegicus
actgctgcatcctaacagactctgg

SEQ ID NO: 97053 - DNA, 25 bp, Rattus norvegicus
actgctgcccagcattttaaacttg

SEQ ID NO: 97054 - DNA, 25 bp, Rattus norvegicus
actgctgcccaggattttaaacttg

SEQ ID NO: 97055 - DNA, 25 bp, Rattus norvegicus
actgctgcccatacctttatagaaa

SEQ ID NO: 97056 - DNA, 25 bp, Rattus norvegicus
actgctgcccattcctttatagaaa

SEQ ID NO: 97057 - DNA, 25 bp, Rattus norvegicus
actgctgccctgaatctgtgtctac

SEQ ID NO: 97058 - DNA, 25 bp, Rattus norvegicus
actgctgccctgtatctgtgtctac

SEQ ID NO: 97059 - DNA, 25 bp, Rattus norvegicus
actgctgccgtcactcagagaaaaa

SEQ ID NO: 97060 - DNA, 25 bp, Rattus norvegicus
actgctgccgtctctcagagaaaaa

SEQ ID NO: 97061 - DNA, 25 bp, Rattus norvegicus
actgctgcgtgacagtcatcggttt

SEQ ID NO: 97062 - DNA, 25 bp, Rattus norvegicus
actgctgcgtgagagtcatcggttt

SEQ ID NO: 97063 - DNA, 25 bp, Rattus norvegicus
actgctgcgtgtctagtcttgttac

SEQ ID NO: 97064 - DNA, 25 bp, Rattus norvegicus
actgctgcgtgtgtagtcttgttac

SEQ ID NO: 97065 - DNA, 25 bp, Rattus norvegicus
actgctgctaggatgtttgaggtat

SEQ ID NO: 97066 - DNA, 25 bp, Rattus norvegicus
actgctgctaggttgtttgaggtat

SEQ ID NO: 97067 - DNA, 25 bp, Rattus norvegicus
actgctgctctgatttgtgttcggt

SEQ ID NO: 97068 - DNA, 25 bp, Rattus norvegicus
actgctgctctgttttgtgttcggt

SEQ ID NO: 97069 - DNA, 25 bp, Rattus norvegicus
actgctgctgcaaaagttacttttc

SEQ ID NO: 97070 - DNA, 25 bp, Rattus norvegicus
actgctgctgcataagttacttttc

SEQ ID NO: 97071 - DNA, 25 bp, Rattus norvegicus
actgctgctgccacttccagggaaa

SEQ ID NO: 97072 - DNA, 25 bp, Rattus norvegicus
actgctgctgcctcttccagggaaa

SEQ ID NO: 97073 - DNA, 25 bp, Rattus norvegicus
actgctgctgctcaaaaacttcatt

SEQ ID NO: 97074 - DNA, 25 bp, Rattus norvegicus
actgctgctgctgaaaaacttcatt

SEQ ID NO: 97075 - DNA, 25 bp, Rattus norvegicus
actgctgcttagaaaccttactgag

SEQ ID NO: 97076 - DNA, 25 bp, Rattus norvegicus
actgctgcttagtaaccttactgag

SEQ ID NO: 97077 - DNA, 25 bp, Rattus norvegicus
actgctgcttgtcgttctctgacga

SEQ ID NO: 97078 - DNA, 25 bp, Rattus norvegicus
actgctgcttgtggttctctgacga

SEQ ID NO: 97079 - DNA, 25 bp, Rattus norvegicus
actgctggacaaaaccaatcttaag

SEQ ID NO: 97080 - DNA, 25 bp, Rattus norvegicus
actgctggacaacaaggtctcctcc

SEQ ID NO: 97081 - DNA, 25 bp, Rattus norvegicus
actgctggacaagaaggtctcctcc

SEQ ID NO: 97082 - DNA, 25 bp, Rattus norvegicus
actgctggacaataccaatcttaag

SEQ ID NO: 97083 - DNA, 25 bp, Rattus norvegicus
actgctggagcaagctactgtggca

SEQ ID NO: 97084 - DNA, 25 bp, Rattus norvegicus
actgctggagcatgctactgtggca

SEQ ID NO: 97085 - DNA, 25 bp, Rattus norvegicus
actgctggattcatctgtccaaggt

SEQ ID NO: 97086 - DNA, 25 bp, Rattus norvegicus
actgctggattcttctgtccaaggt

SEQ ID NO: 97087 - DNA, 25 bp, Rattus norvegicus
actgctggccaaacttgaattttct

SEQ ID NO: 97088 - DNA, 25 bp, Rattus norvegicus
actgctggccaatcttgaattttct

SEQ ID NO: 97089 - DNA, 25 bp, Rattus norvegicus
actgctggccccaaggtgagcacat

SEQ ID NO: 97090 - DNA, 25 bp, Rattus norvegicus
actgctggcccctaggtgagcacat

SEQ ID NO: 97091 - DNA, 25 bp, Rattus norvegicus
actgctggccttctgaatcatgatg

SEQ ID NO: 97092 - DNA, 25 bp, Rattus norvegicus
actgctggccttgtgaatcatgatg

SEQ ID NO: 97093 - DNA, 25 bp, Rattus norvegicus
actgctggctccacagagggacaac

SEQ ID NO: 97094 - DNA, 25 bp, Rattus norvegicus
actgctggctcctcagagggacaac

SEQ ID NO: 97095 - DNA, 25 bp, Rattus norvegicus
actgctggctgaatcagagttcagg

SEQ ID NO: 97096 - DNA, 25 bp, Rattus norvegicus
actgctggctgattcagagttcagg

SEQ ID NO: 97097 - DNA, 25 bp, Rattus norvegicus
actgctggcttgatggatatctttt

SEQ ID NO: 97098 - DNA, 25 bp, Rattus norvegicus
actgctggcttgttggatatctttt

SEQ ID NO: 97099 - DNA, 25 bp, Rattus norvegicus
actgctggctttaccgtcagtttgg

SEQ ID NO: 97100 - DNA, 25 bp, Rattus norvegicus
actgctggcttttccgtcagtttgg

SEQ ID NO: 97101 - DNA, 25 bp, Rattus norvegicus
actgctgggcagctgctagaaatca

SEQ ID NO: 97102 - DNA, 25 bp, Rattus norvegicus
actgctgggcaggtgctagaaatca

SEQ ID NO: 97103 - DNA, 25 bp, Rattus norvegicus
actgctgggcccaaccttgctctgt

SEQ ID NO: 97104 - DNA, 25 bp, Rattus norvegicus
actgctgggccctaccttgctctgt

SEQ ID NO: 97105 - DNA, 25 bp, Rattus norvegicus
actgctgggtcaaacactgaggtct

SEQ ID NO: 97106 - DNA, 25 bp, Rattus norvegicus
actgctgggtcatacactgaggtct

SEQ ID NO: 97107 - DNA, 25 bp, Rattus norvegicus
actgctgggttcagtatgtaatcat

SEQ ID NO: 97108 - DNA, 25 bp, Rattus norvegicus
actgctgggttctgtatgtaatcat

SEQ ID NO: 97109 - DNA, 25 bp, Rattus norvegicus
actgctggtcagctttttcttactt

SEQ ID NO: 97110 - DNA, 25 bp, Rattus norvegicus
actgctggtcaggtttttcttactt

SEQ ID NO: 97111 - DNA, 25 bp, Rattus norvegicus
actgctggtgggaaagattcgcctt

SEQ ID NO: 97112 - DNA, 25 bp, Rattus norvegicus
actgctggtgggactaaagtggcct

SEQ ID NO: 97113 - DNA, 25 bp, Rattus norvegicus
actgctggtgggtaagattcgcctt

SEQ ID NO: 97114 - DNA, 25 bp, Rattus norvegicus
actgctggtgggtctaaagtggcct

SEQ ID NO: 97115 - DNA, 25 bp, Rattus norvegicus
actgctgtagatatgtttgtgttca

SEQ ID NO: 97116 - DNA, 25 bp, Rattus norvegicus
actgctgtagatttgtttgtgttca

SEQ ID NO: 97117 - DNA, 25 bp, Rattus norvegicus
actgctgtatccattagttcccaga

SEQ ID NO: 97118 - DNA, 25 bp, Rattus norvegicus
actgctgtatcctttagttcccaga

SEQ ID NO: 97119 - DNA, 25 bp, Rattus norvegicus
actgctgtatctagtctctgtgttg

SEQ ID NO: 97120 - DNA, 25 bp, Rattus norvegicus
actgctgtatcttgtctctgtgttg

SEQ ID NO: 97121 - DNA, 25 bp, Rattus norvegicus
actgctgtcacacgaaatggacgct

SEQ ID NO: 97122 - DNA, 25 bp, Rattus norvegicus
actgctgtcacaggaaatggacgct

SEQ ID NO: 97123 - DNA, 25 bp, Rattus norvegicus
actgctgtcagaaacctcagacctg

SEQ ID NO: 97124 - DNA, 25 bp, Rattus norvegicus
actgctgtcagatacctcagacctg

SEQ ID NO: 97125 - DNA, 25 bp, Rattus norvegicus
actgctgtcagcactgggcccacat

SEQ ID NO: 97126 - DNA, 25 bp, Rattus norvegicus
actgctgtcagctctgggcccacat

SEQ ID NO: 97127 - DNA, 25 bp, Rattus norvegicus
actgctgtcagtccagaatgggttt

SEQ ID NO: 97128 - DNA, 25 bp, Rattus norvegicus
actgctgtcagtgcagaatgggttt

SEQ ID NO: 97129 - DNA, 25 bp, Rattus norvegicus
actgctgtcattcctagaacccagg

SEQ ID NO: 97130 - DNA, 25 bp, Rattus norvegicus
actgctgtcattgctagaacccagg

SEQ ID NO: 97131 - DNA, 25 bp, Rattus norvegicus
actgctgtcctaaatgtttgccctg

SEQ ID NO: 97132 - DNA, 25 bp, Rattus norvegicus
actgctgtcctatatgtttgccctg

SEQ ID NO: 97133 - DNA, 25 bp, Rattus norvegicus
actgctgtccttatggtttcgaatg

SEQ ID NO: 97134 - DNA, 25 bp, Rattus norvegicus
actgctgtccttttggtttcgaatg

SEQ ID NO: 97135 - DNA, 25 bp, Rattus norvegicus
actgctgtctgaaactcctttgtca

SEQ ID NO: 97136 - DNA, 25 bp, Rattus norvegicus
actgctgtctgatactcctttgtca

SEQ ID NO: 97137 - DNA, 25 bp, Rattus norvegicus
actgctgtctggatcaggaaagtct

SEQ ID NO: 97138 - DNA, 25 bp, Rattus norvegicus
actgctgtctggttcaggaaagtct

SEQ ID NO: 97139 - DNA, 25 bp, Rattus norvegicus
actgctgtctttagtttggctactc

SEQ ID NO: 97140 - DNA, 25 bp, Rattus norvegicus
actgctgtctttctggccctcttca

SEQ ID NO: 97141 - DNA, 25 bp, Rattus norvegicus
actgctgtctttgtggccctcttca

SEQ ID NO: 97142 - DNA, 25 bp, Rattus norvegicus
actgctgtcttttgtttggctactc

SEQ ID NO: 97143 - DNA, 25 bp, Rattus norvegicus
actgctgtggaaattggtgcccaac

SEQ ID NO: 97144 - DNA, 25 bp, Rattus norvegicus
actgctgtggaatttggtgcccaac

SEQ ID NO: 97145 - DNA, 25 bp, Rattus norvegicus
actgctgtggagaaaactgctttct

SEQ ID NO: 97146 - DNA, 25 bp, Rattus norvegicus
actgctgtggagtaaactgctttct

SEQ ID NO: 97147 - DNA, 25 bp, Rattus norvegicus
actgctgtggcacacgtctggactt

SEQ ID NO: 97148 - DNA, 25 bp, Rattus norvegicus
actgctgtggcagacgtctggactt

SEQ ID NO: 97149 - DNA, 25 bp, Rattus norvegicus
actgctgtggtgaacacctgtagcc

SEQ ID NO: 97150 - DNA, 25 bp, Rattus norvegicus
actgctgtggtgtacacctgtagcc

SEQ ID NO: 97151 - DNA, 25 bp, Rattus norvegicus
actgctgtgtaaaacctgggccgga

SEQ ID NO: 97152 - DNA, 25 bp, Rattus norvegicus
actgctgtgtaaaccttggcccaga

SEQ ID NO: 97153 - DNA, 25 bp, Rattus norvegicus
actgctgtgtaatacctgggccgga

SEQ ID NO: 97154 - DNA, 25 bp, Rattus norvegicus
actgctgtgtaatccttggcccaga

SEQ ID NO: 97155 - DNA, 25 bp, Rattus norvegicus
actgctgtgtacaaagaacttgacc

SEQ ID NO: 97156 - DNA, 25 bp, Rattus norvegicus
actgctgtgtactaagaacttgacc

SEQ ID NO: 97157 - DNA, 25 bp, Rattus norvegicus
actgctgtgtgtcgtggctgcaaat

SEQ ID NO: 97158 - DNA, 25 bp, Rattus norvegicus
actgctgtgtgtggtggctgcaaat

SEQ ID NO: 97159 - DNA, 25 bp, Rattus norvegicus
actgctgtgttcagcttcgtgggag

SEQ ID NO: 97160 - DNA, 25 bp, Rattus norvegicus
actgctgtgttctgcttcgtgggag

SEQ ID NO: 97161 - DNA, 25 bp, Rattus norvegicus
actgctgttagcctagtttgtttct

SEQ ID NO: 97162 - DNA, 25 bp, Rattus norvegicus
actgctgttagcgtagtttgtttct

SEQ ID NO: 97163 - DNA, 25 bp, Rattus norvegicus
actgctgttcagacttgggtttaca

SEQ ID NO: 97164 - DNA, 25 bp, Rattus norvegicus
actgctgttcagtcttgggtttaca

SEQ ID NO: 97165 - DNA, 25 bp, Rattus norvegicus
actgctgttgtgaagtgtttcctct

SEQ ID NO: 97166 - DNA, 25 bp, Rattus norvegicus
actgctgttgtgtagtgtttcctct

SEQ ID NO: 97167 - DNA, 25 bp, Rattus norvegicus
actgctgtttctagcctacaaggat

SEQ ID NO: 97168 - DNA, 25 bp, Rattus norvegicus
actgctgtttcttgcctacaaggat

SEQ ID NO: 97169 - DNA, 25 bp, Rattus norvegicus
actgctgtttgaagtggcgcgattc

SEQ ID NO: 97170 - DNA, 25 bp, Rattus norvegicus
actgctgtttgatgtggcgcgattc

SEQ ID NO: 97171 - DNA, 25 bp, Rattus norvegicus
actgcttaatctaggccattgtgtg

SEQ ID NO: 97172 - DNA, 25 bp, Rattus norvegicus
actgcttaatcttggccattgtgtg

SEQ ID NO: 97173 - DNA, 25 bp, Rattus norvegicus
actgcttagcatatgtgtccgggtg

SEQ ID NO: 97174 - DNA, 25 bp, Rattus norvegicus
actgcttagcatttgtgtccgggtg

SEQ ID NO: 97175 - DNA, 25 bp, Rattus norvegicus
actgcttaggtccattttgtctgta

SEQ ID NO: 97176 - DNA, 25 bp, Rattus norvegicus
actgcttaggtcgattttgtctgta

SEQ ID NO: 97177 - DNA, 25 bp, Rattus norvegicus
actgcttaggttctgaggtggcttc

SEQ ID NO: 97178 - DNA, 25 bp, Rattus norvegicus
actgcttaggttgtgaggtggcttc

SEQ ID NO: 97179 - DNA, 25 bp, Rattus norvegicus
actgcttagtccaaaggccatgcca

SEQ ID NO: 97180 - DNA, 25 bp, Rattus norvegicus
actgcttagtcctaaggccatgcca

SEQ ID NO: 97181 - DNA, 25 bp, Rattus norvegicus
actgcttatcgcattggttctacaa

SEQ ID NO: 97182 - DNA, 25 bp, Rattus norvegicus
actgcttatcgctttggttctacaa

SEQ ID NO: 97183 - DNA, 25 bp, Rattus norvegicus
actgcttatgacctcctcatggaat

SEQ ID NO: 97184 - DNA, 25 bp, Rattus norvegicus
actgcttatgacgtcctcatggaat

SEQ ID NO: 97185 - DNA, 25 bp, Rattus norvegicus
actgcttcaataccaactacctgag

SEQ ID NO: 97186 - DNA, 25 bp, Rattus norvegicus
actgcttcaatagcaactacctgag

SEQ ID NO: 97187 - DNA, 25 bp, Rattus norvegicus
actgcttcacacaggccatgatgag

SEQ ID NO: 97188 - DNA, 25 bp, Rattus norvegicus
actgcttcacactggccatgatgag

SEQ ID NO: 97189 - DNA, 25 bp, Rattus norvegicus
actgcttcattcactcttggatgta

SEQ ID NO: 97190 - DNA, 25 bp, Rattus norvegicus
actgcttcattctctcttggatgta

SEQ ID NO: 97191 - DNA, 25 bp, Rattus norvegicus
actgcttccaacagctgcagaacac

SEQ ID NO: 97192 - DNA, 25 bp, Rattus norvegicus
actgcttccaactgctgcagaacac

SEQ ID NO: 97193 - DNA, 25 bp, Rattus norvegicus
actgcttccagcatattgcggtgta

SEQ ID NO: 97194 - DNA, 25 bp, Rattus norvegicus
actgcttccagcttattgcggtgta

SEQ ID NO: 97195 - DNA, 25 bp, Rattus norvegicus
actgcttccattcttagctactgca

SEQ ID NO: 97196 - DNA, 25 bp, Rattus norvegicus
actgcttccattgttagctactgca

SEQ ID NO: 97197 - DNA, 25 bp, Rattus norvegicus
actgcttccgggagacttcccagga

SEQ ID NO: 97198 - DNA, 25 bp, Rattus norvegicus
actgcttccgggtgacttcccagga

SEQ ID NO: 97199 - DNA, 25 bp, Rattus norvegicus
actgcttcgccactgaggggccaaa

SEQ ID NO: 97200 - DNA, 25 bp, Rattus norvegicus
actgcttcgccagtgaggggccaaa

SEQ ID NO: 97201 - DNA, 25 bp, Rattus norvegicus
actgcttcggctctgggccacatga

SEQ ID NO: 97202 - DNA, 25 bp, Rattus norvegicus
actgcttcggctgtgggccacatga

SEQ ID NO: 97203 - DNA, 25 bp, Rattus norvegicus
actgcttctctcaacctgggaatgg

SEQ ID NO: 97204 - DNA, 25 bp, Rattus norvegicus
actgcttctctctacctgggaatgg

SEQ ID NO: 97205 - DNA, 25 bp, Rattus norvegicus
actgcttctctgagacactggagtg

SEQ ID NO: 97206 - DNA, 25 bp, Rattus norvegicus
actgcttctctgtgacactggagtg

SEQ ID NO: 97207 - DNA, 25 bp, Rattus norvegicus
actgcttctgcaagtggccaagtgg

SEQ ID NO: 97208 - DNA, 25 bp, Rattus norvegicus
actgcttctgcatgtggccaagtgg

SEQ ID NO: 97209 - DNA, 25 bp, Rattus norvegicus
actgcttctgtcagtcttaatgctg

SEQ ID NO: 97210 - DNA, 25 bp, Rattus norvegicus
actgcttctgtcagtgacaccacag

SEQ ID NO: 97211 - DNA, 25 bp, Rattus norvegicus
actgcttctgtctgtcttaatgctg

SEQ ID NO: 97212 - DNA, 25 bp, Rattus norvegicus
actgcttctgtctgtgacaccacag

SEQ ID NO: 97213 - DNA, 25 bp, Rattus norvegicus
actgcttcttacctcagtctcctga

SEQ ID NO: 97214 - DNA, 25 bp, Rattus norvegicus
actgcttcttacgtcagtctcctga

SEQ ID NO: 97215 - DNA, 25 bp, Rattus norvegicus
actgcttcttggagtcattgcgtcc

SEQ ID NO: 97216 - DNA, 25 bp, Rattus norvegicus
actgcttcttggtgtcattgcgtcc

SEQ ID NO: 97217 - DNA, 25 bp, Rattus norvegicus
actgcttgaccacttcacgtataat

SEQ ID NO: 97218 - DNA, 25 bp, Rattus norvegicus
actgcttgaccagttcacgtataat

SEQ ID NO: 97219 - DNA, 25 bp, Rattus norvegicus
actgcttgagaccttgaccgttaat

SEQ ID NO: 97220 - DNA, 25 bp, Rattus norvegicus
actgcttgagacgttgaccgttaat

SEQ ID NO: 97221 - DNA, 25 bp, Rattus norvegicus
actgcttgatgacaggtggcccctg

SEQ ID NO: 97222 - DNA, 25 bp, Rattus norvegicus
actgcttgatgagaggtggcccctg

SEQ ID NO: 97223 - DNA, 25 bp, Rattus norvegicus
actgcttgcacaacattgtacacca

SEQ ID NO: 97224 - DNA, 25 bp, Rattus norvegicus
actgcttgcacatcattgtacacca

SEQ ID NO: 97225 - DNA, 25 bp, Rattus norvegicus
actgcttgcattatctggtgagcca

SEQ ID NO: 97226 - DNA, 25 bp, Rattus norvegicus
actgcttgcattttctggtgagcca

SEQ ID NO: 97227 - DNA, 25 bp, Rattus norvegicus
actgcttgctccaggatagactgac

SEQ ID NO: 97228 - DNA, 25 bp, Rattus norvegicus
actgcttgctcctggatagactgac

SEQ ID NO: 97229 - DNA, 25 bp, Rattus norvegicus
actgcttgctggcaagagggttctt

SEQ ID NO: 97230 - DNA, 25 bp, Rattus norvegicus
actgcttgctgggaagagggttctt

SEQ ID NO: 97231 - DNA, 25 bp, Rattus norvegicus
actgcttggcagctcatgtaacgga

SEQ ID NO: 97232 - DNA, 25 bp, Rattus norvegicus
actgcttggcaggtcatgtaacgga

SEQ ID NO: 97233 - DNA, 25 bp, Rattus norvegicus
actgcttggcatagtgcatttacac

SEQ ID NO: 97234 - DNA, 25 bp, Rattus norvegicus
actgcttggcattgtgcatttacac

SEQ ID NO: 97235 - DNA, 25 bp, Rattus norvegicus
actgcttgggtcagtctgctgagag

SEQ ID NO: 97236 - DNA, 25 bp, Rattus norvegicus
actgcttgggtctgtctgctgagag

SEQ ID NO: 97237 - DNA, 25 bp, Rattus norvegicus
actgcttgttatctatgagggcctc

SEQ ID NO: 97238 - DNA, 25 bp, Rattus norvegicus
actgcttgttatgtatgagggcctc

SEQ ID NO: 97239 - DNA, 25 bp, Rattus norvegicus
actgctttaaaaactgtggcccctg

SEQ ID NO: 97240 - DNA, 25 bp, Rattus norvegicus
actgctttaaaatctgtggcccctg

SEQ ID NO: 97241 - DNA, 25 bp, Rattus norvegicus
actgctttcaagcttttggctgcct

SEQ ID NO: 97242 - DNA, 25 bp, Rattus norvegicus
actgctttcaaggttttggctgcct

SEQ ID NO: 97243 - DNA, 25 bp, Rattus norvegicus
actgctttcagcaacagatccaaac

SEQ ID NO: 97244 - DNA, 25 bp, Rattus norvegicus
actgctttcagctacagatccaaac

SEQ ID NO: 97245 - DNA, 25 bp, Rattus norvegicus
actgctttccgtagtgtggccattc

SEQ ID NO: 97246 - DNA, 25 bp, Rattus norvegicus
actgctttccgttgtgtggccattc

SEQ ID NO: 97247 - DNA, 25 bp, Rattus norvegicus
actgctttctctaccagaatcttaa

SEQ ID NO: 97248 - DNA, 25 bp, Rattus norvegicus
actgctttctcttccagaatcttaa

SEQ ID NO: 97249 - DNA, 25 bp, Rattus norvegicus
actgctttctgactgattgccttga

SEQ ID NO: 97250 - DNA, 25 bp, Rattus norvegicus
actgctttctgagtgattgccttga

SEQ ID NO: 97251 - DNA, 25 bp, Rattus norvegicus
actgctttgaaacccttgttcggat

SEQ ID NO: 97252 - DNA, 25 bp, Rattus norvegicus
actgctttgaaagccttgttcggat

SEQ ID NO: 97253 - DNA, 25 bp, Rattus norvegicus
actgctttgagtattcatgtcttag

SEQ ID NO: 97254 - DNA, 25 bp, Rattus norvegicus
actgctttgagttttcatgtcttag

SEQ ID NO: 97255 - DNA, 25 bp, Rattus norvegicus
actgctttgatcaatggtcctgtct

SEQ ID NO: 97256 - DNA, 25 bp, Rattus norvegicus
actgctttgatctatggtcctgtct

SEQ ID NO: 97257 - DNA, 25 bp, Rattus norvegicus
actgctttggctaatgatccacgtt

SEQ ID NO: 97258 - DNA, 25 bp, Rattus norvegicus
actgctttggcttatgatccacgtt

SEQ ID NO: 97259 - DNA, 25 bp, Rattus norvegicus
actgctttgtacaaatcccatgtaa

SEQ ID NO: 97260 - DNA, 25 bp, Rattus norvegicus
actgctttgtactaatcccatgtaa

SEQ ID NO: 97261 - DNA, 25 bp, Rattus norvegicus
actgcttttatgattttctgtcttg

SEQ ID NO: 97262 - DNA, 25 bp, Rattus norvegicus
actgcttttatgtttttctgtcttg

SEQ ID NO: 97263 - DNA, 25 bp, Rattus norvegicus
actgcttttcaaacctcagcttttg

SEQ ID NO: 97264 - DNA, 25 bp, Rattus norvegicus
actgcttttcaatcctcagcttttg

SEQ ID NO: 97265 - DNA, 25 bp, Rattus norvegicus
actgcttttcagagtgttttgtaaa

SEQ ID NO: 97266 - DNA, 25 bp, Rattus norvegicus
actgcttttcagtgtgttttgtaaa

SEQ ID NO: 97267 - DNA, 25 bp, Rattus norvegicus
actgcttttctaagggagacactct

SEQ ID NO: 97268 - DNA, 25 bp, Rattus norvegicus
actgcttttctatgggagacactct

SEQ ID NO: 97269 - DNA, 25 bp, Rattus norvegicus
actgcttttcttatggccctacaat

SEQ ID NO: 97270 - DNA, 25 bp, Rattus norvegicus
actgcttttcttttggccctacaat

SEQ ID NO: 97271 - DNA, 25 bp, Rattus norvegicus
actgcttttgacagggacactgggt

SEQ ID NO: 97272 - DNA, 25 bp, Rattus norvegicus
actgcttttgactgggacactgggt

SEQ ID NO: 97273 - DNA, 25 bp, Rattus norvegicus
actgcttttgcaataggtttcctca

SEQ ID NO: 97274 - DNA, 25 bp, Rattus norvegicus
actgcttttgcattaggtttcctca

SEQ ID NO: 97275 - DNA, 25 bp, Rattus norvegicus
actgcttttggtaaattctcattag

SEQ ID NO: 97276 - DNA, 25 bp, Rattus norvegicus
actgcttttggttaattctcattag

SEQ ID NO: 97277 - DNA, 25 bp, Rattus norvegicus
actgcttttgtcatactgtgggaaa

SEQ ID NO: 97278 - DNA, 25 bp, Rattus norvegicus
actgcttttgtcttactgtgggaaa

SEQ ID NO: 97279 - DNA, 25 bp, Rattus norvegicus
actggaaaatgtccctccctcatat

SEQ ID NO: 97280 - DNA, 25 bp, Rattus norvegicus
actggaaaatgtgcctccctcatat

SEQ ID NO: 97281 - DNA, 25 bp, Rattus norvegicus
actggaaaattcactgaggcataac

SEQ ID NO: 97282 - DNA, 25 bp, Rattus norvegicus
actggaaaattctctgaggcataac

SEQ ID NO: 97283 - DNA, 25 bp, Rattus norvegicus
actggaaactgaagctgggctcctt

SEQ ID NO: 97284 - DNA, 25 bp, Rattus norvegicus
actggaaactgatgctgggctcctt

SEQ ID NO: 97285 - DNA, 25 bp, Rattus norvegicus
actggaaagatcattatccctcccc

SEQ ID NO: 97286 - DNA, 25 bp, Rattus norvegicus
actggaaagatctttatccctcccc

SEQ ID NO: 97287 - DNA, 25 bp, Rattus norvegicus
actggaaagcaacccctgtctctgt

SEQ ID NO: 97288 - DNA, 25 bp, Rattus norvegicus
actggaaagcaagccctgtctctgt

SEQ ID NO: 97289 - DNA, 25 bp, Rattus norvegicus
actggaaagcgaaggctgccccaag

SEQ ID NO: 97290 - DNA, 25 bp, Rattus norvegicus
actggaaagcgatggctgccccaag

SEQ ID NO: 97291 - DNA, 25 bp, Rattus norvegicus
actggaaagtctaggctacctcttg

SEQ ID NO: 97292 - DNA, 25 bp, Rattus norvegicus
actggaaagtcttggctacctcttg

SEQ ID NO: 97293 - DNA, 25 bp, Rattus norvegicus
actggaaatcctattgttttgagag

SEQ ID NO: 97294 - DNA, 25 bp, Rattus norvegicus
actggaaatccttttgttttgagag

SEQ ID NO: 97295 - DNA, 25 bp, Rattus norvegicus
actggaacaagaccatacacggctt

SEQ ID NO: 97296 - DNA, 25 bp, Rattus norvegicus
actggaacaagagcatacacggctt

SEQ ID NO: 97297 - DNA, 25 bp, Rattus norvegicus
actggaacacagacaccttttcatc

SEQ ID NO: 97298 - DNA, 25 bp, Rattus norvegicus
actggaacacagtcaccttttcatc

SEQ ID NO: 97299 - DNA, 25 bp, Rattus norvegicus
actggaacagctccgtgagtcacga

SEQ ID NO: 97300 - DNA, 25 bp, Rattus norvegicus
actggaacagctgcgtgagtcacga

SEQ ID NO: 97301 - DNA, 25 bp, Rattus norvegicus
actggaacatttatcaactgataat

SEQ ID NO: 97302 - DNA, 25 bp, Rattus norvegicus
actggaacatttttcaactgataat

SEQ ID NO: 97303 - DNA, 25 bp, Rattus norvegicus
actggaaccagacactgtcagcaca

SEQ ID NO: 97304 - DNA, 25 bp, Rattus norvegicus
actggaaccagagactgtcagcaca

SEQ ID NO: 97305 - DNA, 25 bp, Rattus norvegicus
actggaacctcaagagcctctggat

SEQ ID NO: 97306 - DNA, 25 bp, Rattus norvegicus
actggaacctcatgagcctctggat

SEQ ID NO: 97307 - DNA, 25 bp, Rattus norvegicus
actggaacgcttcgagtgtcttttc

SEQ ID NO: 97308 - DNA, 25 bp, Rattus norvegicus
actggaacgcttggagtgtcttttc

SEQ ID NO: 97309 - DNA, 25 bp, Rattus norvegicus
actggaactcgcaatgccgaactac

SEQ ID NO: 97310 - DNA, 25 bp, Rattus norvegicus
actggaactcgctatgccgaactac

SEQ ID NO: 97311 - DNA, 25 bp, Rattus norvegicus
actggaactgctcatggccgcgaac

SEQ ID NO: 97312 - DNA, 25 bp, Rattus norvegicus
actggaactgctgatggccgcgaac

SEQ ID NO: 97313 - DNA, 25 bp, Rattus norvegicus
actggaagccagaccttacgataaa

SEQ ID NO: 97314 - DNA, 25 bp, Rattus norvegicus
actggaagccagtccttacgataaa

SEQ ID NO: 97315 - DNA, 25 bp, Rattus norvegicus
actggaagccttcagagttccctct

SEQ ID NO: 97316 - DNA, 25 bp, Rattus norvegicus
actggaagccttgagagttccctct

SEQ ID NO: 97317 - DNA, 25 bp, Rattus norvegicus
actggaaggacaattaggagggaca

SEQ ID NO: 97318 - DNA, 25 bp, Rattus norvegicus
actggaaggacatttaggagggaca

SEQ ID NO: 97319 - DNA, 25 bp, Rattus norvegicus
actggaaggattctgcgatccggtt

SEQ ID NO: 97320 - DNA, 25 bp, Rattus norvegicus
actggaaggattgtgcgatccggtt

SEQ ID NO: 97321 - DNA, 25 bp, Rattus norvegicus
actggaaggcaaaattcaaggaaat

SEQ ID NO: 97322 - DNA, 25 bp, Rattus norvegicus
actggaaggcaatattcaaggaaat

SEQ ID NO: 97323 - DNA, 25 bp, Rattus norvegicus
actggaaggcagagagctacataca

SEQ ID NO: 97324 - DNA, 25 bp, Rattus norvegicus
actggaaggcagtgagctacataca

SEQ ID NO: 97325 - DNA, 25 bp, Rattus norvegicus
actggaaggtgcaccctctggctgg

SEQ ID NO: 97326 - DNA, 25 bp, Rattus norvegicus
actggaaggtgctccctctggctgg

SEQ ID NO: 97327 - DNA, 25 bp, Rattus norvegicus
actggaatagacaggctgggcttgt

SEQ ID NO: 97328 - DNA, 25 bp, Rattus norvegicus
actggaatagactggctgggcttgt

SEQ ID NO: 97329 - DNA, 25 bp, Rattus norvegicus
actggaatcccacactgtatgctgt

SEQ ID NO: 97330 - DNA, 25 bp, Rattus norvegicus
actggaatcccagactgtatgctgt

SEQ ID NO: 97331 - DNA, 25 bp, Rattus norvegicus
actggaatgagtcccatgttgtctg

SEQ ID NO: 97332 - DNA, 25 bp, Rattus norvegicus
actggaatgagtgccatgttgtctg

SEQ ID NO: 97333 - DNA, 25 bp, Rattus norvegicus
actggaatgggtctgtctgatacaa

SEQ ID NO: 97334 - DNA, 25 bp, Rattus norvegicus
actggaatgggtgtgtctgatacaa

SEQ ID NO: 97335 - DNA, 25 bp, Rattus norvegicus
actggacaaagtcatgggccctctc

SEQ ID NO: 97336 - DNA, 25 bp, Rattus norvegicus
actggacaaagtgatgggccctctc

SEQ ID NO: 97337 - DNA, 25 bp, Rattus norvegicus
actggacacactcattcctgagctc

SEQ ID NO: 97338 - DNA, 25 bp, Rattus norvegicus
actggacacactgattcctgagctc

SEQ ID NO: 97339 - DNA, 25 bp, Rattus norvegicus
actggacagatcaccctctctttga

SEQ ID NO: 97340 - DNA, 25 bp, Rattus norvegicus
actggacagatctccctctctttga

SEQ ID NO: 97341 - DNA, 25 bp, Rattus norvegicus
actggacagcttcctctgctgcttg

SEQ ID NO: 97342 - DNA, 25 bp, Rattus norvegicus
actggacagcttgctctgctgcttg

SEQ ID NO: 97343 - DNA, 25 bp, Rattus norvegicus
actggacaggtcctacaggcacaag

SEQ ID NO: 97344 - DNA, 25 bp, Rattus norvegicus
actggacaggtcgtacaggcacaag

SEQ ID NO: 97345 - DNA, 25 bp, Rattus norvegicus
actggacagtccataactcatcaag

SEQ ID NO: 97346 - DNA, 25 bp, Rattus norvegicus
actggacagtccttaactcatcaag

SEQ ID NO: 97347 - DNA, 25 bp, Rattus norvegicus
actggacagtggaacaggtggccaa

SEQ ID NO: 97348 - DNA, 25 bp, Rattus norvegicus
actggacagtggtacaggtggccaa

SEQ ID NO: 97349 - DNA, 25 bp, Rattus norvegicus
actggacagttgctggacctgcttc

SEQ ID NO: 97350 - DNA, 25 bp, Rattus norvegicus
actggacagttggtggacctgcttc

SEQ ID NO: 97351 - DNA, 25 bp, Rattus norvegicus
actggaccagacactaaacgaactt

SEQ ID NO: 97352 - DNA, 25 bp, Rattus norvegicus
actggaccagactctaaacgaactt

SEQ ID NO: 97353 - DNA, 25 bp, Rattus norvegicus
actggaccagtacttctggacccaa

SEQ ID NO: 97354 - DNA, 25 bp, Rattus norvegicus
actggaccagtagttctggacccaa

SEQ ID NO: 97355 - DNA, 25 bp, Rattus norvegicus
actggaccagtcattatatataatg

SEQ ID NO: 97356 - DNA, 25 bp, Rattus norvegicus
actggaccagtctttatatataatg

SEQ ID NO: 97357 - DNA, 25 bp, Rattus norvegicus
actggaccatcgacccggctagcga

SEQ ID NO: 97358 - DNA, 25 bp, Rattus norvegicus
actggaccatcgtcccggctagcga

SEQ ID NO: 97359 - DNA, 25 bp, Rattus norvegicus
actggacccagtccaaccttggata

SEQ ID NO: 97360 - DNA, 25 bp, Rattus norvegicus
actggacccagtgcaaccttggata

SEQ ID NO: 97361 - DNA, 25 bp, Rattus norvegicus
actggacccatcactcgttgaaagt

SEQ ID NO: 97362 - DNA, 25 bp, Rattus norvegicus
actggacccatctctcgttgaaagt

SEQ ID NO: 97363 - DNA, 25 bp, Rattus norvegicus
actggaccccatctgaaggtcagaa

SEQ ID NO: 97364 - DNA, 25 bp, Rattus norvegicus
actggaccccatgtgaaggtcagaa

SEQ ID NO: 97365 - DNA, 25 bp, Rattus norvegicus
actggaccgccacgagtttgtctgt

SEQ ID NO: 97366 - DNA, 25 bp, Rattus norvegicus
actggaccgccaggagtttgtctgt

SEQ ID NO: 97367 - DNA, 25 bp, Rattus norvegicus
actggaccggtcatgcagaaccaaa

SEQ ID NO: 97368 - DNA, 25 bp, Rattus norvegicus
actggaccggtcttgcagaaccaaa

SEQ ID NO: 97369 - DNA, 25 bp, Rattus norvegicus
actggaccgtgcaggcctgtgaacg

SEQ ID NO: 97370 - DNA, 25 bp, Rattus norvegicus
actggaccgtgctggcctgtgaacg

SEQ ID NO: 97371 - DNA, 25 bp, Rattus norvegicus
actggacctgctatctgaccaagat

SEQ ID NO: 97372 - DNA, 25 bp, Rattus norvegicus
actggacctgctttctgaccaagat

SEQ ID NO: 97373 - DNA, 25 bp, Rattus norvegicus
actggacctgttctgtggctatagc

SEQ ID NO: 97374 - DNA, 25 bp, Rattus norvegicus
actggacctgttgtgtggctatagc

SEQ ID NO: 97375 - DNA, 25 bp, Rattus norvegicus
actggacggtggctagcgactcctc

SEQ ID NO: 97376 - DNA, 25 bp, Rattus norvegicus
actggacggtgggtagcgactcctc

SEQ ID NO: 97377 - DNA, 25 bp, Rattus norvegicus
actggactacacagacttcggttca

SEQ ID NO: 97378 - DNA, 25 bp, Rattus norvegicus
actggactacactgacttcggttca

SEQ ID NO: 97379 - DNA, 25 bp, Rattus norvegicus
actggactacctctgtttgattgct

SEQ ID NO: 97380 - DNA, 25 bp, Rattus norvegicus
actggactacctgtgtttgattgct

SEQ ID NO: 97381 - DNA, 25 bp, Rattus norvegicus
actggactaggactttttaaatgca

SEQ ID NO: 97382 - DNA, 25 bp, Rattus norvegicus
actggactaggagtttttaaatgca

SEQ ID NO: 97383 - DNA, 25 bp, Rattus norvegicus
actggactcagccacggacaaagtt

SEQ ID NO: 97384 - DNA, 25 bp, Rattus norvegicus
actggactcagcgacggacaaagtt

SEQ ID NO: 97385 - DNA, 25 bp, Rattus norvegicus
actggactctcacaactggtcttgt

SEQ ID NO: 97386 - DNA, 25 bp, Rattus norvegicus
actggactctcagaactggtcttgt

SEQ ID NO: 97387 - DNA, 25 bp, Rattus norvegicus
actggactctcccaaagaggcctgt

SEQ ID NO: 97388 - DNA, 25 bp, Rattus norvegicus
actggactctccgaaagaggcctgt

SEQ ID NO: 97389 - DNA, 25 bp, Rattus norvegicus
actggactctcgctgacatgtctta

SEQ ID NO: 97390 - DNA, 25 bp, Rattus norvegicus
actggactctcggtgacatgtctta

SEQ ID NO: 97391 - DNA, 25 bp, Rattus norvegicus
actggactctgaatctggtggtttc

SEQ ID NO: 97392 - DNA, 25 bp, Rattus norvegicus
actggactctgattctggtggtttc

SEQ ID NO: 97393 - DNA, 25 bp, Rattus norvegicus
actggactgagacacctgggagcaa

SEQ ID NO: 97394 - DNA, 25 bp, Rattus norvegicus
actggactgagagacctgggagcaa

SEQ ID NO: 97395 - DNA, 25 bp, Rattus norvegicus
actggactgctgctcacaggacttc

SEQ ID NO: 97396 - DNA, 25 bp, Rattus norvegicus
actggactgctggtcacaggacttc

SEQ ID NO: 97397 - DNA, 25 bp, Rattus norvegicus
actggactgttcataggcctctcta

SEQ ID NO: 97398 - DNA, 25 bp, Rattus norvegicus
actggactgttcttaggcctctcta

SEQ ID NO: 97399 - DNA, 25 bp, Rattus norvegicus
actggacttagtcctgtggttgtaa

SEQ ID NO: 97400 - DNA, 25 bp, Rattus norvegicus
actggacttagtgctgtggttgtaa

SEQ ID NO: 97401 - DNA, 25 bp, Rattus norvegicus
actggacttgtcatcattggcctat

SEQ ID NO: 97402 - DNA, 25 bp, Rattus norvegicus
actggacttgtcttcattggcctat

SEQ ID NO: 97403 - DNA, 25 bp, Rattus norvegicus
actggagaaaaaacctattcatata

SEQ ID NO: 97404 - DNA, 25 bp, Rattus norvegicus
actggagaaaaatcctattcatata

SEQ ID NO: 97405 - DNA, 25 bp, Rattus norvegicus
actggagaaattacagtgttcccaa

SEQ ID NO: 97406 - DNA, 25 bp, Rattus norvegicus
actggagaaatttcagtgttcccaa

SEQ ID NO: 97407 - DNA, 25 bp, Rattus norvegicus
actggagaatgtagcgtgatgtgaa

SEQ ID NO: 97408 - DNA, 25 bp, Rattus norvegicus
actggagaatgttgcgtgatgtgaa

SEQ ID NO: 97409 - DNA, 25 bp, Rattus norvegicus
actggagacgaaatacactggtacc

SEQ ID NO: 97410 - DNA, 25 bp, Rattus norvegicus
actggagacgaattacactggtacc

SEQ ID NO: 97411 - DNA, 25 bp, Rattus norvegicus
actggagacgtcattggcaggtccc

SEQ ID NO: 97412 - DNA, 25 bp, Rattus norvegicus
actggagacgtctttggcaggtccc

SEQ ID NO: 97413 - DNA, 25 bp, Rattus norvegicus
actggagactctcgccttaccatgt

SEQ ID NO: 97414 - DNA, 25 bp, Rattus norvegicus
actggagactctggccttaccatgt

SEQ ID NO: 97415 - DNA, 25 bp, Rattus norvegicus
actggagactgacgcctgagctgca

SEQ ID NO: 97416 - DNA, 25 bp, Rattus norvegicus
actggagactgaggcctgagctgca

SEQ ID NO: 97417 - DNA, 25 bp, Rattus norvegicus
actggagactttctgtgcgcttgta

SEQ ID NO: 97418 - DNA, 25 bp, Rattus norvegicus
actggagactttgtgtgcgcttgta

SEQ ID NO: 97419 - DNA, 25 bp, Rattus norvegicus
actggagagatacctctgtggtcaa

SEQ ID NO: 97420 - DNA, 25 bp, Rattus norvegicus
actggagagatagctctgtggtcaa

SEQ ID NO: 97421 - DNA, 25 bp, Rattus norvegicus
actggagatgacagaacccggctgc

SEQ ID NO: 97422 - DNA, 25 bp, Rattus norvegicus
actggagatgactgaacccggctgc

SEQ ID NO: 97423 - DNA, 25 bp, Rattus norvegicus
actggagatggtcacccgcaaggaa

SEQ ID NO: 97424 - DNA, 25 bp, Rattus norvegicus
actggagatggtgacccgcaaggaa

SEQ ID NO: 97425 - DNA, 25 bp, Rattus norvegicus
actggagcaaatccctgagctacag

SEQ ID NO: 97426 - DNA, 25 bp, Rattus norvegicus
actggagcaaatgcctgagctacag

SEQ ID NO: 97427 - DNA, 25 bp, Rattus norvegicus
actggagcagacaggaaacccttgg

SEQ ID NO: 97428 - DNA, 25 bp, Rattus norvegicus
actggagcagactggaaacccttgg

SEQ ID NO: 97429 - DNA, 25 bp, Rattus norvegicus
actggagcaggaatcgaaggcttta

SEQ ID NO: 97430 - DNA, 25 bp, Rattus norvegicus
actggagcaggattcgaaggcttta

SEQ ID NO: 97431 - DNA, 25 bp, Rattus norvegicus
actggagccatgatggtctatgacc

SEQ ID NO: 97432 - DNA, 25 bp, Rattus norvegicus
actggagccatgttggtctatgacc

SEQ ID NO: 97433 - DNA, 25 bp, Rattus norvegicus
actggagcgccaactagtggacaga

SEQ ID NO: 97434 - DNA, 25 bp, Rattus norvegicus
actggagcgccatctagtggacaga

SEQ ID NO: 97435 - DNA, 25 bp, Rattus norvegicus
actggagcttagaggcagggtccct

SEQ ID NO: 97436 - DNA, 25 bp, Rattus norvegicus
actggagcttagtggcagggtccct

SEQ ID NO: 97437 - DNA, 25 bp, Rattus norvegicus
actggagcttgtaattttttaactg

SEQ ID NO: 97438 - DNA, 25 bp, Rattus norvegicus
actggagcttgttattttttaactg

SEQ ID NO: 97439 - DNA, 25 bp, Rattus norvegicus
actggaggatacagactttaagaaa

SEQ ID NO: 97440 - DNA, 25 bp, Rattus norvegicus
actggaggatactgactttaagaaa

SEQ ID NO: 97441 - DNA, 25 bp, Rattus norvegicus
actggaggcagaagttttgtccatc

SEQ ID NO: 97442 - DNA, 25 bp, Rattus norvegicus
actggaggcagatgttttgtccatc

SEQ ID NO: 97443 - DNA, 25 bp, Rattus norvegicus
actggaggcctgctctctaggccct

SEQ ID NO: 97444 - DNA, 25 bp, Rattus norvegicus
actggaggcctgcttaccactggaa

SEQ ID NO: 97445 - DNA, 25 bp, Rattus norvegicus
actggaggcctggtctctaggccct

SEQ ID NO: 97446 - DNA, 25 bp, Rattus norvegicus
actggaggcctggttaccactggaa

SEQ ID NO: 97447 - DNA, 25 bp, Rattus norvegicus
actggagggattccccagatctgtt

SEQ ID NO: 97448 - DNA, 25 bp, Rattus norvegicus
actggagggattgcccagatctgtt

SEQ ID NO: 97449 - DNA, 25 bp, Rattus norvegicus
actggagggtctcatgtttgacacc

SEQ ID NO: 97450 - DNA, 25 bp, Rattus norvegicus
actggagggtctgatgtttgacacc

SEQ ID NO: 97451 - DNA, 25 bp, Rattus norvegicus
actggaggtagaaatgtcttgtttt

SEQ ID NO: 97452 - DNA, 25 bp, Rattus norvegicus
actggaggtagatatgtcttgtttt

SEQ ID NO: 97453 - DNA, 25 bp, Rattus norvegicus
actggagtacagagcagagcaggct

SEQ ID NO: 97454 - DNA, 25 bp, Rattus norvegicus
actggagtacagtgcagagcaggct

SEQ ID NO: 97455 - DNA, 25 bp, Rattus norvegicus
actggagtagagagcccgggcgagt

SEQ ID NO: 97456 - DNA, 25 bp, Rattus norvegicus
actggagtagagtgcccgggcgagt

SEQ ID NO: 97457 - DNA, 25 bp, Rattus norvegicus
actggagtccagactgagctacgtg

SEQ ID NO: 97458 - DNA, 25 bp, Rattus norvegicus
actggagtccagtctgagctacgtg

SEQ ID NO: 97459 - DNA, 25 bp, Rattus norvegicus
actggagtcccgcagatctgcaacg

SEQ ID NO: 97460 - DNA, 25 bp, Rattus norvegicus
actggagtcccggagatctgcaacg

SEQ ID NO: 97461 - DNA, 25 bp, Rattus norvegicus
actggagtctccaaattgatcatat

SEQ ID NO: 97462 - DNA, 25 bp, Rattus norvegicus
actggagtctcctaattgatcatat

SEQ ID NO: 97463 - DNA, 25 bp, Rattus norvegicus
actggagtctgaaagctggagcgcc

SEQ ID NO: 97464 - DNA, 25 bp, Rattus norvegicus
actggagtctgatagctggagcgcc

SEQ ID NO: 97465 - DNA, 25 bp, Rattus norvegicus
actggagttccgattctgctggagt

SEQ ID NO: 97466 - DNA, 25 bp, Rattus norvegicus
actggagttccgtttctgctggagt

SEQ ID NO: 97467 - DNA, 25 bp, Rattus norvegicus
actggagtttgacgttcccatgcca

SEQ ID NO: 97468 - DNA, 25 bp, Rattus norvegicus
actggagtttgaggttcccatgcca

SEQ ID NO: 97469 - DNA, 25 bp, Rattus norvegicus
actggataagccagttttaacctgc

SEQ ID NO: 97470 - DNA, 25 bp, Rattus norvegicus
actggataagcctgttttaacctgc

SEQ ID NO: 97471 - DNA, 25 bp, Rattus norvegicus
actggatacgtcaggcccttaatgt

SEQ ID NO: 97472 - DNA, 25 bp, Rattus norvegicus
actggatacgtctggcccttaatgt

SEQ ID NO: 97473 - DNA, 25 bp, Rattus norvegicus
actggatacttcacagctgactgga

SEQ ID NO: 97474 - DNA, 25 bp, Rattus norvegicus
actggatacttctcagctgactgga

SEQ ID NO: 97475 - DNA, 25 bp, Rattus norvegicus
actggatagctcaccttggctttga

SEQ ID NO: 97476 - DNA, 25 bp, Rattus norvegicus
actggatagctctccttggctttga

SEQ ID NO: 97477 - DNA, 25 bp, Rattus norvegicus
actggataggctccaatgtctcctc

SEQ ID NO: 97478 - DNA, 25 bp, Rattus norvegicus
actggataggctgcaatgtctcctc

SEQ ID NO: 97479 - DNA, 25 bp, Rattus norvegicus
actggatatttccacttggcaagga

SEQ ID NO: 97480 - DNA, 25 bp, Rattus norvegicus
actggatatttcgacttggcaagga

SEQ ID NO: 97481 - DNA, 25 bp, Rattus norvegicus
actggatcaagacagggcttttgct

SEQ ID NO: 97482 - DNA, 25 bp, Rattus norvegicus
actggatcaagagagggcttttgct

SEQ ID NO: 97483 - DNA, 25 bp, Rattus norvegicus
actggatcatgaaatatgtaagtct

SEQ ID NO: 97484 - DNA, 25 bp, Rattus norvegicus
actggatcatgatatatgtaagtct

SEQ ID NO: 97485 - DNA, 25 bp, Rattus norvegicus
actggatccccactgagatcagtgt

SEQ ID NO: 97486 - DNA, 25 bp, Rattus norvegicus
actggatccccagtgagatcagtgt

SEQ ID NO: 97487 - DNA, 25 bp, Rattus norvegicus
actggatccctgatttgcttcaaga

SEQ ID NO: 97488 - DNA, 25 bp, Rattus norvegicus
actggatccctgttttgcttcaaga

SEQ ID NO: 97489 - DNA, 25 bp, Rattus norvegicus
actggatcgcagacagttcttactg

SEQ ID NO: 97490 - DNA, 25 bp, Rattus norvegicus
actggatcgcagtcagttcttactg

SEQ ID NO: 97491 - DNA, 25 bp, Rattus norvegicus
actggatctaagctgctgcagctta

SEQ ID NO: 97492 - DNA, 25 bp, Rattus norvegicus
actggatctaaggtgctgcagctta

SEQ ID NO: 97493 - DNA, 25 bp, Rattus norvegicus
actggatctatcaaaatgccgattt

SEQ ID NO: 97494 - DNA, 25 bp, Rattus norvegicus
actggatctatctaaatgccgattt

SEQ ID NO: 97495 - DNA, 25 bp, Rattus norvegicus
actggatctcaaccttcatcaagga

SEQ ID NO: 97496 - DNA, 25 bp, Rattus norvegicus
actggatctcaagcttcatcaagga

SEQ ID NO: 97497 - DNA, 25 bp, Rattus norvegicus
actggatctgaacgttgtcgccgcc

SEQ ID NO: 97498 - DNA, 25 bp, Rattus norvegicus
actggatctgaaggttgtcgccgcc

SEQ ID NO: 97499 - DNA, 25 bp, Rattus norvegicus
actggatctgtcatgtatgtgcttg

SEQ ID NO: 97500 - DNA, 25 bp, Rattus norvegicus
actggatctgtcttgtatgtgcttg

SEQ ID NO: 97501 - DNA, 25 bp, Rattus norvegicus
actggatgacaccaaattccgctct

SEQ ID NO: 97502 - DNA, 25 bp, Rattus norvegicus
actggatgacacgaaattccgctct

SEQ ID NO: 97503 - DNA, 25 bp, Rattus norvegicus
actggatgccaactaggccagcgtt

SEQ ID NO: 97504 - DNA, 25 bp, Rattus norvegicus
actggatgccaagtaggccagcgtt

SEQ ID NO: 97505 - DNA, 25 bp, Rattus norvegicus
actggatgcgctccctgtacggtga

SEQ ID NO: 97506 - DNA, 25 bp, Rattus norvegicus
actggatgcgctgcctgtacggtga

SEQ ID NO: 97507 - DNA, 25 bp, Rattus norvegicus
actggatgcttactgtctgtgactt

SEQ ID NO: 97508 - DNA, 25 bp, Rattus norvegicus
actggatgcttagtgtctgtgactt

SEQ ID NO: 97509 - DNA, 25 bp, Rattus norvegicus
actggatggacgcaccaagttctct

SEQ ID NO: 97510 - DNA, 25 bp, Rattus norvegicus
actggatggacggaccaagttctct

SEQ ID NO: 97511 - DNA, 25 bp, Rattus norvegicus
actggatgggatacaccttctggac

SEQ ID NO: 97512 - DNA, 25 bp, Rattus norvegicus
actggatgggattcaccttctggac

SEQ ID NO: 97513 - DNA, 25 bp, Rattus norvegicus
actggatgggccctcgaaccgtgaa

SEQ ID NO: 97514 - DNA, 25 bp, Rattus norvegicus
actggatgggccgtcgaaccgtgaa

SEQ ID NO: 97515 - DNA, 25 bp, Rattus norvegicus
actggatgggcgctttttgaaatgt

SEQ ID NO: 97516 - DNA, 25 bp, Rattus norvegicus
actggatgggcggtttttgaaatgt

SEQ ID NO: 97517 - DNA, 25 bp, Rattus norvegicus
actggatggtctccttttaaatgtg

SEQ ID NO: 97518 - DNA, 25 bp, Rattus norvegicus
actggatggtctgcttttaaatgtg

SEQ ID NO: 97519 - DNA, 25 bp, Rattus norvegicus
actggatggtttatgtgcgtggccc

SEQ ID NO: 97520 - DNA, 25 bp, Rattus norvegicus
actggatggtttttgtgcgtggccc

SEQ ID NO: 97521 - DNA, 25 bp, Rattus norvegicus
actggatgtccaattgtgagctata

SEQ ID NO: 97522 - DNA, 25 bp, Rattus norvegicus
actggatgtccatttgtgagctata

SEQ ID NO: 97523 - DNA, 25 bp, Rattus norvegicus
actggatgtgaaactggccctactg

SEQ ID NO: 97524 - DNA, 25 bp, Rattus norvegicus
actggatgtgaatctggccctactg

SEQ ID NO: 97525 - DNA, 25 bp, Rattus norvegicus
actggatgttaacccgtgtctctga

SEQ ID NO: 97526 - DNA, 25 bp, Rattus norvegicus
actggatgttaagccgtgtctctga

SEQ ID NO: 97527 - DNA, 25 bp, Rattus norvegicus
actggatgtttgacacttgagggcc

SEQ ID NO: 97528 - DNA, 25 bp, Rattus norvegicus
actggatgtttgtcacttgagggcc

SEQ ID NO: 97529 - DNA, 25 bp, Rattus norvegicus
actggattattgagggtggaaaagc

SEQ ID NO: 97530 - DNA, 25 bp, Rattus norvegicus
actggattattgtgggtggaaaagc

SEQ ID NO: 97531 - DNA, 25 bp, Rattus norvegicus
actggattcagacaaccctggcgga

SEQ ID NO: 97532 - DNA, 25 bp, Rattus norvegicus
actggattcagagaaccctggcgga

SEQ ID NO: 97533 - DNA, 25 bp, Rattus norvegicus
actggattcccaagggccacaccga

SEQ ID NO: 97534 - DNA, 25 bp, Rattus norvegicus
actggattcccatgggccacaccga

SEQ ID NO: 97535 - DNA, 25 bp, Rattus norvegicus
actggattcttgaacaccttcgagg

SEQ ID NO: 97536 - DNA, 25 bp, Rattus norvegicus
actggattcttgtacaccttcgagg

SEQ ID NO: 97537 - DNA, 25 bp, Rattus norvegicus
actggattctttatgttcttactgg

SEQ ID NO: 97538 - DNA, 25 bp, Rattus norvegicus
actggattctttttgttcttactgg

SEQ ID NO: 97539 - DNA, 25 bp, Rattus norvegicus
actggattgatgaagccttgctgct

SEQ ID NO: 97540 - DNA, 25 bp, Rattus norvegicus
actggattgatgtagccttgctgct

SEQ ID NO: 97541 - DNA, 25 bp, Rattus norvegicus
actggattgcttcactgctggacaa

SEQ ID NO: 97542 - DNA, 25 bp, Rattus norvegicus
actggattgcttgactgctggacaa

SEQ ID NO: 97543 - DNA, 25 bp, Rattus norvegicus
actggattgtctatggaggcactgt

SEQ ID NO: 97544 - DNA, 25 bp, Rattus norvegicus
actggattgtctttggaggcactgt

SEQ ID NO: 97545 - DNA, 25 bp, Rattus norvegicus
actggatttcagacttggctgtcgc

SEQ ID NO: 97546 - DNA, 25 bp, Rattus norvegicus
actggatttcagtcttggctgtcgc

SEQ ID NO: 97547 - DNA, 25 bp, Rattus norvegicus
actggcaaacacagcaacacagaag

SEQ ID NO: 97548 - DNA, 25 bp, Rattus norvegicus
actggcaaacactgcaacacagaag

SEQ ID NO: 97549 - DNA, 25 bp, Rattus norvegicus
actggcaacagcattccttggagga

SEQ ID NO: 97550 - DNA, 25 bp, Rattus norvegicus
actggcaacagctttccttggagga

SEQ ID NO: 97551 - DNA, 25 bp, Rattus norvegicus
actggcaagccaccagctagtctaa

SEQ ID NO: 97552 - DNA, 25 bp, Rattus norvegicus
actggcaagccagcagctagtctaa

SEQ ID NO: 97553 - DNA, 25 bp, Rattus norvegicus
actggcaatgaacaattccgacctg

SEQ ID NO: 97554 - DNA, 25 bp, Rattus norvegicus
actggcaatgaagaattccgacctg

SEQ ID NO: 97555 - DNA, 25 bp, Rattus norvegicus
actggcaatgtcctctgacacagaa

SEQ ID NO: 97556 - DNA, 25 bp, Rattus norvegicus
actggcaatgtcgtctgacacagaa

SEQ ID NO: 97557 - DNA, 25 bp, Rattus norvegicus
actggcacaatacctcaattctttc

SEQ ID NO: 97558 - DNA, 25 bp, Rattus norvegicus
actggcacaatagctcaattctttc

SEQ ID NO: 97559 - DNA, 25 bp, Rattus norvegicus
actggcacacccaactggatgagtc

SEQ ID NO: 97560 - DNA, 25 bp, Rattus norvegicus
actggcacaccctactggatgagtc

SEQ ID NO: 97561 - DNA, 25 bp, Rattus norvegicus
actggcacagtaacctgcctcataa

SEQ ID NO: 97562 - DNA, 25 bp, Rattus norvegicus
actggcacagtatcctgcctcataa

SEQ ID NO: 97563 - DNA, 25 bp, Rattus norvegicus
actggcacagtgcatgttaacttta

SEQ ID NO: 97564 - DNA, 25 bp, Rattus norvegicus
actggcacagtggatgttaacttta

SEQ ID NO: 97565 - DNA, 25 bp, Rattus norvegicus
actggcacccacaggtgtggttctt

SEQ ID NO: 97566 - DNA, 25 bp, Rattus norvegicus
actggcacccactggtgtggttctt

SEQ ID NO: 97567 - DNA, 25 bp, Rattus norvegicus
actggcaccctgagttgggtcctga

SEQ ID NO: 97568 - DNA, 25 bp, Rattus norvegicus
actggcaccctgtgttgggtcctga

SEQ ID NO: 97569 - DNA, 25 bp, Rattus norvegicus
actggcacctggagcccgggctcag

SEQ ID NO: 97570 - DNA, 25 bp, Rattus norvegicus
actggcacctggtgcccgggctcag

SEQ ID NO: 97571 - DNA, 25 bp, Rattus norvegicus
actggcacctttactctatgatggt

SEQ ID NO: 97572 - DNA, 25 bp, Rattus norvegicus
actggcaccttttctctatgatggt

SEQ ID NO: 97573 - DNA, 25 bp, Rattus norvegicus
actggcacgatgctcaccttgtggg

SEQ ID NO: 97574 - DNA, 25 bp, Rattus norvegicus
actggcacgatggtcaccttgtggg

SEQ ID NO: 97575 - DNA, 25 bp, Rattus norvegicus
actggcacgcatcgagctgttcata

SEQ ID NO: 97576 - DNA, 25 bp, Rattus norvegicus
actggcacgcatggagctgttcata

SEQ ID NO: 97577 - DNA, 25 bp, Rattus norvegicus
actggcactctgcagtttcgccaag

SEQ ID NO: 97578 - DNA, 25 bp, Rattus norvegicus
actggcactctggagtttcgccaag

SEQ ID NO: 97579 - DNA, 25 bp, Rattus norvegicus
actggcagaatcatcgaatagcttc

SEQ ID NO: 97580 - DNA, 25 bp, Rattus norvegicus
actggcagaatcttcgaatagcttc

SEQ ID NO: 97581 - DNA, 25 bp, Rattus norvegicus
actggcagcagtatttgactctgga

SEQ ID NO: 97582 - DNA, 25 bp, Rattus norvegicus
actggcagcagtttttgactctgga

SEQ ID NO: 97583 - DNA, 25 bp, Rattus norvegicus
actggcaggcagatccacaagaaag

SEQ ID NO: 97584 - DNA, 25 bp, Rattus norvegicus
actggcaggcagttccacaagaaag

SEQ ID NO: 97585 - DNA, 25 bp, Rattus norvegicus
actggcaggttgatcgggctccatt

SEQ ID NO: 97586 - DNA, 25 bp, Rattus norvegicus
actggcaggttgttcgggctccatt

SEQ ID NO: 97587 - DNA, 25 bp, Rattus norvegicus
actggcagtgacagtaaaaggcact

SEQ ID NO: 97588 - DNA, 25 bp, Rattus norvegicus
actggcagtgactgtaaaaggcact

SEQ ID NO: 97589 - DNA, 25 bp, Rattus norvegicus
actggcagtgtccttgaggcctcag

SEQ ID NO: 97590 - DNA, 25 bp, Rattus norvegicus
actggcagtgtcgttgaggcctcag

SEQ ID NO: 97591 - DNA, 25 bp, Rattus norvegicus
actggcatacagatattagggtata

SEQ ID NO: 97592 - DNA, 25 bp, Rattus norvegicus
actggcatacagttattagggtata

SEQ ID NO: 97593 - DNA, 25 bp, Rattus norvegicus
actggcatagatctgtgtttctcaa

SEQ ID NO: 97594 - DNA, 25 bp, Rattus norvegicus
actggcatagatgtgtgtttctcaa

SEQ ID NO: 97595 - DNA, 25 bp, Rattus norvegicus
actggcatagccatgtactcagcag

SEQ ID NO: 97596 - DNA, 25 bp, Rattus norvegicus
actggcatagccttgtactcagcag

SEQ ID NO: 97597 - DNA, 25 bp, Rattus norvegicus
actggcatcaacagagcccatgaac

SEQ ID NO: 97598 - DNA, 25 bp, Rattus norvegicus
actggcatcaactgagcccatgaac

SEQ ID NO: 97599 - DNA, 25 bp, Rattus norvegicus
actggcatcaatctcttaattcctc

SEQ ID NO: 97600 - DNA, 25 bp, Rattus norvegicus
actggcatcaatgtcttaattcctc

SEQ ID NO: 97601 - DNA, 25 bp, Rattus norvegicus
actggcatcatactcctctctggtt

SEQ ID NO: 97602 - DNA, 25 bp, Rattus norvegicus
actggcatcatagtcctctctggtt

SEQ ID NO: 97603 - DNA, 25 bp, Rattus norvegicus
actggcatccagagaaggtgtcttt

SEQ ID NO: 97604 - DNA, 25 bp, Rattus norvegicus
actggcatccagtgaaggtgtcttt

SEQ ID NO: 97605 - DNA, 25 bp, Rattus norvegicus
actggcatgcatcacaaaactcttg

SEQ ID NO: 97606 - DNA, 25 bp, Rattus norvegicus
actggcatgcatgacaaaactcttg

SEQ ID NO: 97607 - DNA, 25 bp, Rattus norvegicus
actggcatggccatccgtgttccta

SEQ ID NO: 97608 - DNA, 25 bp, Rattus norvegicus
actggcatggccttccgtgttccta

SEQ ID NO: 97609 - DNA, 25 bp, Rattus norvegicus
actggcatggtaccgttctccacgt

SEQ ID NO: 97610 - DNA, 25 bp, Rattus norvegicus
actggcatggtagcgttctccacgt

SEQ ID NO: 97611 - DNA, 25 bp, Rattus norvegicus
actggcatgtgccttatgactctgg

SEQ ID NO: 97612 - DNA, 25 bp, Rattus norvegicus
actggcatgtgcgttatgactctgg

SEQ ID NO: 97613 - DNA, 25 bp, Rattus norvegicus
actggcatgttactggtccctttga

SEQ ID NO: 97614 - DNA, 25 bp, Rattus norvegicus
actggcatgttagtggtccctttga

SEQ ID NO: 97615 - DNA, 25 bp, Rattus norvegicus
actggcattgccctgctgggaattg

SEQ ID NO: 97616 - DNA, 25 bp, Rattus norvegicus
actggcattgccgtgctgggaattg

SEQ ID NO: 97617 - DNA, 25 bp, Rattus norvegicus
actggcattgtgatggactccggag

SEQ ID NO: 97618 - DNA, 25 bp, Rattus norvegicus
actggcattgtgttggactccggag

SEQ ID NO: 97619 - DNA, 25 bp, Rattus norvegicus
actggccaacgaccacaagaaaatt

SEQ ID NO: 97620 - DNA, 25 bp, Rattus norvegicus
actggccaacgagcacaagaaaatt

SEQ ID NO: 97621 - DNA, 25 bp, Rattus norvegicus
actggccaactgagaggacattctc

SEQ ID NO: 97622 - DNA, 25 bp, Rattus norvegicus
actggccaactgtgaggacattctc

SEQ ID NO: 97623 - DNA, 25 bp, Rattus norvegicus
actggccaaggcaatctgattatac

SEQ ID NO: 97624 - DNA, 25 bp, Rattus norvegicus
actggccaaggctatctgattatac

SEQ ID NO: 97625 - DNA, 25 bp, Rattus norvegicus
actggccaccagagtgctgtgcaaa

SEQ ID NO: 97626 - DNA, 25 bp, Rattus norvegicus
actggccaccagtgtgctgtgcaaa

SEQ ID NO: 97627 - DNA, 25 bp, Rattus norvegicus
actggccacgctcggctgggctaat

SEQ ID NO: 97628 - DNA, 25 bp, Rattus norvegicus
actggccacgctgggctgggctaat

SEQ ID NO: 97629 - DNA, 25 bp, Rattus norvegicus
actggccagagcagggtgcacccaa

SEQ ID NO: 97630 - DNA, 25 bp, Rattus norvegicus
actggccagagctgggtgcacccaa

SEQ ID NO: 97631 - DNA, 25 bp, Rattus norvegicus
actggccagagtaagccctgtaagc

SEQ ID NO: 97632 - DNA, 25 bp, Rattus norvegicus
actggccagagttagccctgtaagc

SEQ ID NO: 97633 - DNA, 25 bp, Rattus norvegicus
actggccagcctacagagtgttttt

SEQ ID NO: 97634 - DNA, 25 bp, Rattus norvegicus
actggccagccttcagagtgttttt

SEQ ID NO: 97635 - DNA, 25 bp, Rattus norvegicus
actggccaggctccttttgatattc

SEQ ID NO: 97636 - DNA, 25 bp, Rattus norvegicus
actggccaggctgcttttgatattc

SEQ ID NO: 97637 - DNA, 25 bp, Rattus norvegicus
actggccagggcaacgaataggcga

SEQ ID NO: 97638 - DNA, 25 bp, Rattus norvegicus
actggccagggcactacaggttgat

SEQ ID NO: 97639 - DNA, 25 bp, Rattus norvegicus
actggccagggctacgaataggcga

SEQ ID NO: 97640 - DNA, 25 bp, Rattus norvegicus
actggccagggctctacaggttgat

SEQ ID NO: 97641 - DNA, 25 bp, Rattus norvegicus
actggccatatgaaatctgtgacac

SEQ ID NO: 97642 - DNA, 25 bp, Rattus norvegicus
actggccatatgtaatctgtgacac

SEQ ID NO: 97643 - DNA, 25 bp, Rattus norvegicus
actggcccaacgagctgagaattac

SEQ ID NO: 97644 - DNA, 25 bp, Rattus norvegicus
actggcccaacgtgctgagaattac

SEQ ID NO: 97645 - DNA, 25 bp, Rattus norvegicus
actggccccagccacatgggttgca

SEQ ID NO: 97646 - DNA, 25 bp, Rattus norvegicus
actggccccagcgacatgggttgca

SEQ ID NO: 97647 - DNA, 25 bp, Rattus norvegicus
actggcccgcgtctgcactgaggtt

SEQ ID NO: 97648 - DNA, 25 bp, Rattus norvegicus
actggcccgcgtgtgcactgaggtt

SEQ ID NO: 97649 - DNA, 25 bp, Rattus norvegicus
actggccctgcacacacttgttcgg

SEQ ID NO: 97650 - DNA, 25 bp, Rattus norvegicus
actggccctgcagacacttgttcgg

SEQ ID NO: 97651 - DNA, 25 bp, Rattus norvegicus
actggccctggaaagaatcccacta

SEQ ID NO: 97652 - DNA, 25 bp, Rattus norvegicus
actggccctggatagaatcccacta

SEQ ID NO: 97653 - DNA, 25 bp, Rattus norvegicus
actggccctggtacatttctctgat

SEQ ID NO: 97654 - DNA, 25 bp, Rattus norvegicus
actggccctggttcatttctctgat

SEQ ID NO: 97655 - DNA, 25 bp, Rattus norvegicus
actggccctgtcagagaggtaccta

SEQ ID NO: 97656 - DNA, 25 bp, Rattus norvegicus
actggccctgtctgagaggtaccta

SEQ ID NO: 97657 - DNA, 25 bp, Rattus norvegicus
actggccctgtgactttgacagctt

SEQ ID NO: 97658 - DNA, 25 bp, Rattus norvegicus
actggccctgtgtctttgacagctt

SEQ ID NO: 97659 - DNA, 25 bp, Rattus norvegicus
actggcccttgtctagtcatagtac

SEQ ID NO: 97660 - DNA, 25 bp, Rattus norvegicus
actggcccttgtgtagtcatagtac

SEQ ID NO: 97661 - DNA, 25 bp, Rattus norvegicus
actggccgacagcaaataatcaaat

SEQ ID NO: 97662 - DNA, 25 bp, Rattus norvegicus
actggccgacaggaaataatcaaat

SEQ ID NO: 97663 - DNA, 25 bp, Rattus norvegicus
actggccgtgttcctggcaaacaaa

SEQ ID NO: 97664 - DNA, 25 bp, Rattus norvegicus
actggccgtgttgctggcaaacaaa

SEQ ID NO: 97665 - DNA, 25 bp, Rattus norvegicus
actggcctaactattctgtgcgtct

SEQ ID NO: 97666 - DNA, 25 bp, Rattus norvegicus
actggcctaacttttctgtgcgtct

SEQ ID NO: 97667 - DNA, 25 bp, Rattus norvegicus
actggcctagcaaaccgtaacttgt

SEQ ID NO: 97668 - DNA, 25 bp, Rattus norvegicus
actggcctagcataccgtaacttgt

SEQ ID NO: 97669 - DNA, 25 bp, Rattus norvegicus
actggcctcgagctctaagcaggac

SEQ ID NO: 97670 - DNA, 25 bp, Rattus norvegicus
actggcctcgaggtctaagcaggac

SEQ ID NO: 97671 - DNA, 25 bp, Rattus norvegicus
actggcctcgctcgttgtcattgtg

SEQ ID NO: 97672 - DNA, 25 bp, Rattus norvegicus
actggcctcgctggttgtcattgtg

SEQ ID NO: 97673 - DNA, 25 bp, Rattus norvegicus
actggcctctggacgagaacctgag

SEQ ID NO: 97674 - DNA, 25 bp, Rattus norvegicus
actggcctctggtcgagaacctgag

SEQ ID NO: 97675 - DNA, 25 bp, Rattus norvegicus
actggcctgaggatctgcacagaaa

SEQ ID NO: 97676 - DNA, 25 bp, Rattus norvegicus
actggcctgaggttctgcacagaaa

SEQ ID NO: 97677 - DNA, 25 bp, Rattus norvegicus
actggcctgcccagaggactctgaa

SEQ ID NO: 97678 - DNA, 25 bp, Rattus norvegicus
actggcctgccctgaggactctgaa

SEQ ID NO: 97679 - DNA, 25 bp, Rattus norvegicus
actggcctgctgattgtgtcattaa

SEQ ID NO: 97680 - DNA, 25 bp, Rattus norvegicus
actggcctgctgctgaggtcgccat

SEQ ID NO: 97681 - DNA, 25 bp, Rattus norvegicus
actggcctgctggtgaggtcgccat

SEQ ID NO: 97682 - DNA, 25 bp, Rattus norvegicus
actggcctgctgtttgtgtcattaa

SEQ ID NO: 97683 - DNA, 25 bp, Rattus norvegicus
actggcctggagcatgtctttcctc

SEQ ID NO: 97684 - DNA, 25 bp, Rattus norvegicus
actggcctggaggatgtctttcctc

SEQ ID NO: 97685 - DNA, 25 bp, Rattus norvegicus
actggcctggccataaaagactcaa

SEQ ID NO: 97686 - DNA, 25 bp, Rattus norvegicus
actggcctggccttaaaagactcaa

SEQ ID NO: 97687 - DNA, 25 bp, Rattus norvegicus
actggcctgggactcggttataagc

SEQ ID NO: 97688 - DNA, 25 bp, Rattus norvegicus
actggcctgggagtcggttataagc

SEQ ID NO: 97689 - DNA, 25 bp, Rattus norvegicus
actggccttaagagctaccttttct

SEQ ID NO: 97690 - DNA, 25 bp, Rattus norvegicus
actggccttaagtgctaccttttct

SEQ ID NO: 97691 - DNA, 25 bp, Rattus norvegicus
actggccttagacgtctgtacgacc

SEQ ID NO: 97692 - DNA, 25 bp, Rattus norvegicus
actggccttagaggtctgtacgacc

SEQ ID NO: 97693 - DNA, 25 bp, Rattus norvegicus
actggccttcatcgtctcaatgatc

SEQ ID NO: 97694 - DNA, 25 bp, Rattus norvegicus
actggccttcatggtctcaatgatc

SEQ ID NO: 97695 - DNA, 25 bp, Rattus norvegicus
actggccttgacatttatcaggaaa

SEQ ID NO: 97696 - DNA, 25 bp, Rattus norvegicus
actggccttgacttttatcaggaaa

SEQ ID NO: 97697 - DNA, 25 bp, Rattus norvegicus
actggccttggcagcagaggtgaca

SEQ ID NO: 97698 - DNA, 25 bp, Rattus norvegicus
actggccttggctgcagaggtgaca

SEQ ID NO: 97699 - DNA, 25 bp, Rattus norvegicus
actggcgagcaaagttttctgtttt

SEQ ID NO: 97700 - DNA, 25 bp, Rattus norvegicus
actggcgagcaatgttttctgtttt

SEQ ID NO: 97701 - DNA, 25 bp, Rattus norvegicus
actggcgaggttcgcaggtccccaa

SEQ ID NO: 97702 - DNA, 25 bp, Rattus norvegicus
actggcgaggttggcaggtccccaa

SEQ ID NO: 97703 - DNA, 25 bp, Rattus norvegicus
actggcgcagtgatttgctcttgaa

SEQ ID NO: 97704 - DNA, 25 bp, Rattus norvegicus
actggcgcagtgttttgctcttgaa

SEQ ID NO: 97705 - DNA, 25 bp, Rattus norvegicus
actggcgccactcttgagggtgact

SEQ ID NO: 97706 - DNA, 25 bp, Rattus norvegicus
actggcgccactgttgagggtgact

SEQ ID NO: 97707 - DNA, 25 bp, Rattus norvegicus
actggcgctggacactactttggga

SEQ ID NO: 97708 - DNA, 25 bp, Rattus norvegicus
actggcgctggagactactttggga

SEQ ID NO: 97709 - DNA, 25 bp, Rattus norvegicus
actggcgcttttcatggtcttacat

SEQ ID NO: 97710 - DNA, 25 bp, Rattus norvegicus
actggcgcttttgatggtcttacat

SEQ ID NO: 97711 - DNA, 25 bp, Rattus norvegicus
actggcgtagacagggtgacactcc

SEQ ID NO: 97712 - DNA, 25 bp, Rattus norvegicus
actggcgtagactgggtgacactcc

SEQ ID NO: 97713 - DNA, 25 bp, Rattus norvegicus
actggcgtagctattcctgttgaat

SEQ ID NO: 97714 - DNA, 25 bp, Rattus norvegicus
actggcgtagcttttcctgttgaat

SEQ ID NO: 97715 - DNA, 25 bp, Rattus norvegicus
actggctaactgagaattgctgttg

SEQ ID NO: 97716 - DNA, 25 bp, Rattus norvegicus
actggctaactgtgaattgctgttg

SEQ ID NO: 97717 - DNA, 25 bp, Rattus norvegicus
actggctaagctcttttcactgtcc

SEQ ID NO: 97718 - DNA, 25 bp, Rattus norvegicus
actggctaagctgttttcactgtcc

SEQ ID NO: 97719 - DNA, 25 bp, Rattus norvegicus
actggctaatgtccccaagaggtta

SEQ ID NO: 97720 - DNA, 25 bp, Rattus norvegicus
actggctaatgtgcccaagaggtta

SEQ ID NO: 97721 - DNA, 25 bp, Rattus norvegicus
actggctacaccagctctggcatag

SEQ ID NO: 97722 - DNA, 25 bp, Rattus norvegicus
actggctacacctgctctggcatag

SEQ ID NO: 97723 - DNA, 25 bp, Rattus norvegicus
actggctaccatcaatgctcgctgg

SEQ ID NO: 97724 - DNA, 25 bp, Rattus norvegicus
actggctaccatgaatgctcgctgg

SEQ ID NO: 97725 - DNA, 25 bp, Rattus norvegicus
actggctactacctgcacaagtgca

SEQ ID NO: 97726 - DNA, 25 bp, Rattus norvegicus
actggctactacgtgcacaagtgca

SEQ ID NO: 97727 - DNA, 25 bp, Rattus norvegicus
actggctactgtatcttgtactgta

SEQ ID NO: 97728 - DNA, 25 bp, Rattus norvegicus
actggctactgtttcttgtactgta

SEQ ID NO: 97729 - DNA, 25 bp, Rattus norvegicus
actggctatgaacttatggtgctaa

SEQ ID NO: 97730 - DNA, 25 bp, Rattus norvegicus
actggctatgaagttatggtgctaa

SEQ ID NO: 97731 - DNA, 25 bp, Rattus norvegicus
actggctatgtgacctagggtattc

SEQ ID NO: 97732 - DNA, 25 bp, Rattus norvegicus
actggctatgtgtcctagggtattc

SEQ ID NO: 97733 - DNA, 25 bp, Rattus norvegicus
actggctattcaagttttactgtcc

SEQ ID NO: 97734 - DNA, 25 bp, Rattus norvegicus
actggctattcatgttttactgtcc

SEQ ID NO: 97735 - DNA, 25 bp, Rattus norvegicus
actggctcacagctatttgaaataa

SEQ ID NO: 97736 - DNA, 25 bp, Rattus norvegicus
actggctcacaggtatttgaaataa

SEQ ID NO: 97737 - DNA, 25 bp, Rattus norvegicus
actggctcagcactgcagtttgtaa

SEQ ID NO: 97738 - DNA, 25 bp, Rattus norvegicus
actggctcagcagtgcagtttgtaa

SEQ ID NO: 97739 - DNA, 25 bp, Rattus norvegicus
actggctcagtactgggcccttaac

SEQ ID NO: 97740 - DNA, 25 bp, Rattus norvegicus
actggctcagtagtgggcccttaac

SEQ ID NO: 97741 - DNA, 25 bp, Rattus norvegicus
actggctcatagcttctggctgtag

SEQ ID NO: 97742 - DNA, 25 bp, Rattus norvegicus
actggctcataggttctggctgtag

SEQ ID NO: 97743 - DNA, 25 bp, Rattus norvegicus
actggctccatcaaagcaggtggct

SEQ ID NO: 97744 - DNA, 25 bp, Rattus norvegicus
actggctccatctaagcaggtggct

SEQ ID NO: 97745 - DNA, 25 bp, Rattus norvegicus
actggctccgtcagttcctgaagag

SEQ ID NO: 97746 - DNA, 25 bp, Rattus norvegicus
actggctccgtctgttcctgaagag

SEQ ID NO: 97747 - DNA, 25 bp, Rattus norvegicus
actggctctcctaacagaaacaaag

SEQ ID NO: 97748 - DNA, 25 bp, Rattus norvegicus
actggctctccttacagaaacaaag

SEQ ID NO: 97749 - DNA, 25 bp, Rattus norvegicus
actggctctgcaaggtcacaagcaa

SEQ ID NO: 97750 - DNA, 25 bp, Rattus norvegicus
actggctctgcatggtcacaagcaa

SEQ ID NO: 97751 - DNA, 25 bp, Rattus norvegicus
actggctctttacagatcgggctag

SEQ ID NO: 97752 - DNA, 25 bp, Rattus norvegicus
actggctctttagagatcgggctag

SEQ ID NO: 97753 - DNA, 25 bp, Rattus norvegicus
actggctgactcctggtactgtagt

SEQ ID NO: 97754 - DNA, 25 bp, Rattus norvegicus
actggctgactcgtggtactgtagt

SEQ ID NO: 97755 - DNA, 25 bp, Rattus norvegicus
actggctgagacaagcatttcaaaa

SEQ ID NO: 97756 - DNA, 25 bp, Rattus norvegicus
actggctgagactagcatttcaaaa

SEQ ID NO: 97757 - DNA, 25 bp, Rattus norvegicus
actggctgatggcaaacctgtgatt

SEQ ID NO: 97758 - DNA, 25 bp, Rattus norvegicus
actggctgatgggaaacctgtgatt

SEQ ID NO: 97759 - DNA, 25 bp, Rattus norvegicus
actggctgcaaccttcttttaagaa

SEQ ID NO: 97760 - DNA, 25 bp, Rattus norvegicus
actggctgcaacgttcttttaagaa

SEQ ID NO: 97761 - DNA, 25 bp, Rattus norvegicus
actggctgccaacataatctcatct

SEQ ID NO: 97762 - DNA, 25 bp, Rattus norvegicus
actggctgccaagataatctcatct

SEQ ID NO: 97763 - DNA, 25 bp, Rattus norvegicus
actggctgccatactaaaggacctg

SEQ ID NO: 97764 - DNA, 25 bp, Rattus norvegicus
actggctgccattctaaaggacctg

SEQ ID NO: 97765 - DNA, 25 bp, Rattus norvegicus
actggctgcctcacagctagagaaa

SEQ ID NO: 97766 - DNA, 25 bp, Rattus norvegicus
actggctgcctcagggagttgtcat

SEQ ID NO: 97767 - DNA, 25 bp, Rattus norvegicus
actggctgcctctcagctagagaaa

SEQ ID NO: 97768 - DNA, 25 bp, Rattus norvegicus
actggctgcctctgggagttgtcat

SEQ ID NO: 97769 - DNA, 25 bp, Rattus norvegicus
actggctgctctcatcacgaatcaa

SEQ ID NO: 97770 - DNA, 25 bp, Rattus norvegicus
actggctgctctgatcacgaatcaa

SEQ ID NO: 97771 - DNA, 25 bp, Rattus norvegicus
actggctggattagacgtgtctggt

SEQ ID NO: 97772 - DNA, 25 bp, Rattus norvegicus
actggctggatttgacgtgtctggt

SEQ ID NO: 97773 - DNA, 25 bp, Rattus norvegicus
actggctgggtccagttttgaccta

SEQ ID NO: 97774 - DNA, 25 bp, Rattus norvegicus
actggctgggtcgagttttgaccta

SEQ ID NO: 97775 - DNA, 25 bp, Rattus norvegicus
actggctggttgaggacatgttcat

SEQ ID NO: 97776 - DNA, 25 bp, Rattus norvegicus
actggctggttgtggacatgttcat

SEQ ID NO: 97777 - DNA, 25 bp, Rattus norvegicus
actggctgtgacacgaggtgttacc

SEQ ID NO: 97778 - DNA, 25 bp, Rattus norvegicus
actggctgtgactcgaggtgttacc

SEQ ID NO: 97779 - DNA, 25 bp, Rattus norvegicus
actggctgttcacaaaggctttctc

SEQ ID NO: 97780 - DNA, 25 bp, Rattus norvegicus
actggctgttcagaaaggctttctc

SEQ ID NO: 97781 - DNA, 25 bp, Rattus norvegicus
actggctgtttcaatgacgtattta

SEQ ID NO: 97782 - DNA, 25 bp, Rattus norvegicus
actggctgtttctatgacgtattta

SEQ ID NO: 97783 - DNA, 25 bp, Rattus norvegicus
actggcttaaagacagcttgtccca

SEQ ID NO: 97784 - DNA, 25 bp, Rattus norvegicus
actggcttaaagcttccctggtgct

SEQ ID NO: 97785 - DNA, 25 bp, Rattus norvegicus
actggcttaaaggttccctggtgct

SEQ ID NO: 97786 - DNA, 25 bp, Rattus norvegicus
actggcttaaagtcagcttgtccca

SEQ ID NO: 97787 - DNA, 25 bp, Rattus norvegicus
actggcttagaaagctttgccttct

SEQ ID NO: 97788 - DNA, 25 bp, Rattus norvegicus
actggcttagaatgctttgccttct

SEQ ID NO: 97789 - DNA, 25 bp, Rattus norvegicus
actggcttcaaacggtactgtggca

SEQ ID NO: 97790 - DNA, 25 bp, Rattus norvegicus
actggcttcaaagggtactgtggca

SEQ ID NO: 97791 - DNA, 25 bp, Rattus norvegicus
actggcttcaagctgagactatctt

SEQ ID NO: 97792 - DNA, 25 bp, Rattus norvegicus
actggcttcaaggtgagactatctt

SEQ ID NO: 97793 - DNA, 25 bp, Rattus norvegicus
actggcttcaggacctctctgtggg

SEQ ID NO: 97794 - DNA, 25 bp, Rattus norvegicus
actggcttcaggtcctctctgtggg

SEQ ID NO: 97795 - DNA, 25 bp, Rattus norvegicus
actggcttctgaccctgttgaggtg

SEQ ID NO: 97796 - DNA, 25 bp, Rattus norvegicus
actggcttctgagcctgttgaggtg

SEQ ID NO: 97797 - DNA, 25 bp, Rattus norvegicus
actggcttggccagcgcagctggaa

SEQ ID NO: 97798 - DNA, 25 bp, Rattus norvegicus
actggcttggcctgcgcagctggaa

SEQ ID NO: 97799 - DNA, 25 bp, Rattus norvegicus
actggctttagacaactggcgttca

SEQ ID NO: 97800 - DNA, 25 bp, Rattus norvegicus
actggctttagagaactggcgttca

SEQ ID NO: 97801 - DNA, 25 bp, Rattus norvegicus
actggctttattatctcaacaacaa

SEQ ID NO: 97802 - DNA, 25 bp, Rattus norvegicus
actggctttattttctcaacaacaa

SEQ ID NO: 97803 - DNA, 25 bp, Rattus norvegicus
actggctttctgatggcccaagaaa

SEQ ID NO: 97804 - DNA, 25 bp, Rattus norvegicus
actggctttctgattctagttgaca

SEQ ID NO: 97805 - DNA, 25 bp, Rattus norvegicus
actggctttctgttggcccaagaaa

SEQ ID NO: 97806 - DNA, 25 bp, Rattus norvegicus
actggctttctgtttctagttgaca

SEQ ID NO: 97807 - DNA, 25 bp, Rattus norvegicus
actggctttgcacacgcagatggct

SEQ ID NO: 97808 - DNA, 25 bp, Rattus norvegicus
actggctttgcacagagttgcccat

SEQ ID NO: 97809 - DNA, 25 bp, Rattus norvegicus
actggctttgcagacgcagatggct

SEQ ID NO: 97810 - DNA, 25 bp, Rattus norvegicus
actggctttgcagagagttgcccat

SEQ ID NO: 97811 - DNA, 25 bp, Rattus norvegicus
actggctttggtagggttgagatcc

SEQ ID NO: 97812 - DNA, 25 bp, Rattus norvegicus
actggctttggttgggttgagatcc

SEQ ID NO: 97813 - DNA, 25 bp, Rattus norvegicus
actggctttgtgatctggcttaggt

SEQ ID NO: 97814 - DNA, 25 bp, Rattus norvegicus
actggctttgtgttctggcttaggt

SEQ ID NO: 97815 - DNA, 25 bp, Rattus norvegicus
actgggaaacatactcaccctgtat

SEQ ID NO: 97816 - DNA, 25 bp, Rattus norvegicus
actgggaaacattctcaccctgtat

SEQ ID NO: 97817 - DNA, 25 bp, Rattus norvegicus
actgggaaagcacgcttgcttccac

SEQ ID NO: 97818 - DNA, 25 bp, Rattus norvegicus
actgggaaagcaggcttgcttccac

SEQ ID NO: 97819 - DNA, 25 bp, Rattus norvegicus
actgggaacccgagtggtcaggcac

SEQ ID NO: 97820 - DNA, 25 bp, Rattus norvegicus
actgggaacccgtgtggtcaggcac

SEQ ID NO: 97821 - DNA, 25 bp, Rattus norvegicus
actgggaacggtcctttatccattc

SEQ ID NO: 97822 - DNA, 25 bp, Rattus norvegicus
actgggaacggtgctttatccattc

SEQ ID NO: 97823 - DNA, 25 bp, Rattus norvegicus
actgggaactgtaccctgggccctg

SEQ ID NO: 97824 - DNA, 25 bp, Rattus norvegicus
actgggaactgttccctgggccctg

SEQ ID NO: 97825 - DNA, 25 bp, Rattus norvegicus
actgggaacttcacgtatgtcctta

SEQ ID NO: 97826 - DNA, 25 bp, Rattus norvegicus
actgggaacttctcgtatgtcctta

SEQ ID NO: 97827 - DNA, 25 bp, Rattus norvegicus
actgggaagccgcacatttagctgt

SEQ ID NO: 97828 - DNA, 25 bp, Rattus norvegicus
actgggaagccggacatttagctgt

SEQ ID NO: 97829 - DNA, 25 bp, Rattus norvegicus
actgggaatccacggttactgttgg

SEQ ID NO: 97830 - DNA, 25 bp, Rattus norvegicus
actgggaatccagggttactgttgg

SEQ ID NO: 97831 - DNA, 25 bp, Rattus norvegicus
actgggacagtaaagcacttgacct

SEQ ID NO: 97832 - DNA, 25 bp, Rattus norvegicus
actgggacagtatagcacttgacct

SEQ ID NO: 97833 - DNA, 25 bp, Rattus norvegicus
actgggaccactacaaggctgggca

SEQ ID NO: 97834 - DNA, 25 bp, Rattus norvegicus
actgggaccacttcaaggctgggca

SEQ ID NO: 97835 - DNA, 25 bp, Rattus norvegicus
actgggacccagactcgaagaataa

SEQ ID NO: 97836 - DNA, 25 bp, Rattus norvegicus
actgggacccagcacaagttagaag

SEQ ID NO: 97837 - DNA, 25 bp, Rattus norvegicus
actgggacccaggacaagttagaag

SEQ ID NO: 97838 - DNA, 25 bp, Rattus norvegicus
actgggacccagtctcgaagaataa

SEQ ID NO: 97839 - DNA, 25 bp, Rattus norvegicus
actgggaccctcactaagcaaggac

SEQ ID NO: 97840 - DNA, 25 bp, Rattus norvegicus
actgggaccctctctaagcaaggac

SEQ ID NO: 97841 - DNA, 25 bp, Rattus norvegicus
actgggacctgtccatacctggcat

SEQ ID NO: 97842 - DNA, 25 bp, Rattus norvegicus
actgggacctgtgcatacctggcat

SEQ ID NO: 97843 - DNA, 25 bp, Rattus norvegicus
actgggactaggcatggtgggactg

SEQ ID NO: 97844 - DNA, 25 bp, Rattus norvegicus
actgggactagggatggtgggactg

SEQ ID NO: 97845 - DNA, 25 bp, Rattus norvegicus
actgggactcacaaattttctctga

SEQ ID NO: 97846 - DNA, 25 bp, Rattus norvegicus
actgggactcactaattttctctga

SEQ ID NO: 97847 - DNA, 25 bp, Rattus norvegicus
actgggacttggaactcgcaatcga

SEQ ID NO: 97848 - DNA, 25 bp, Rattus norvegicus
actgggacttggatctggccctgag

SEQ ID NO: 97849 - DNA, 25 bp, Rattus norvegicus
actgggacttggctctaaccattga

SEQ ID NO: 97850 - DNA, 25 bp, Rattus norvegicus
actgggacttgggtctaaccattga

SEQ ID NO: 97851 - DNA, 25 bp, Rattus norvegicus
actgggacttggtactcgcaatcga

SEQ ID NO: 97852 - DNA, 25 bp, Rattus norvegicus
actgggacttggttctggccctgag

SEQ ID NO: 97853 - DNA, 25 bp, Rattus norvegicus
actgggagacgaatccttcttctgt

SEQ ID NO: 97854 - DNA, 25 bp, Rattus norvegicus
actgggagacgattccttcttctgt

SEQ ID NO: 97855 - DNA, 25 bp, Rattus norvegicus
actgggaggccaagagcggttcaca

SEQ ID NO: 97856 - DNA, 25 bp, Rattus norvegicus
actgggaggccatgagcggttcaca

SEQ ID NO: 97857 - DNA, 25 bp, Rattus norvegicus
actgggatcctgactggttctgcct

SEQ ID NO: 97858 - DNA, 25 bp, Rattus norvegicus
actgggatcctgtctggttctgcct

SEQ ID NO: 97859 - DNA, 25 bp, Rattus norvegicus
actgggatcgatcactctgctttac

SEQ ID NO: 97860 - DNA, 25 bp, Rattus norvegicus
actgggatcgatgactctgctttac

SEQ ID NO: 97861 - DNA, 25 bp, Rattus norvegicus
actgggatctggcatcgtcttacca

SEQ ID NO: 97862 - DNA, 25 bp, Rattus norvegicus
actgggatctgggatcgtcttacca

SEQ ID NO: 97863 - DNA, 25 bp, Rattus norvegicus
actgggatgagtccctagcttccat

SEQ ID NO: 97864 - DNA, 25 bp, Rattus norvegicus
actgggatgagtgcctagcttccat

SEQ ID NO: 97865 - DNA, 25 bp, Rattus norvegicus
actgggattccaattttacacctct

SEQ ID NO: 97866 - DNA, 25 bp, Rattus norvegicus
actgggattccatttttacacctct

SEQ ID NO: 97867 - DNA, 25 bp, Rattus norvegicus
actgggattcgtctttgtagctctg

SEQ ID NO: 97868 - DNA, 25 bp, Rattus norvegicus
actgggattcgtgtttgtagctctg

SEQ ID NO: 97869 - DNA, 25 bp, Rattus norvegicus
actgggattggtcgcattgtgttaa

SEQ ID NO: 97870 - DNA, 25 bp, Rattus norvegicus
actgggattggtggcattgtgttaa

SEQ ID NO: 97871 - DNA, 25 bp, Rattus norvegicus
actgggattgtgctactgcatctcc

SEQ ID NO: 97872 - DNA, 25 bp, Rattus norvegicus
actgggattgtggtactgcatctcc

SEQ ID NO: 97873 - DNA, 25 bp, Rattus norvegicus
actgggatttttccacttttcaaca

SEQ ID NO: 97874 - DNA, 25 bp, Rattus norvegicus
actgggatttttgcacttttcaaca

SEQ ID NO: 97875 - DNA, 25 bp, Rattus norvegicus
actgggcaaactacgtgtacatcta

SEQ ID NO: 97876 - DNA, 25 bp, Rattus norvegicus
actgggcaaacttcgtgtacatcta

SEQ ID NO: 97877 - DNA, 25 bp, Rattus norvegicus
actgggcaaggtagcacctgtactc

SEQ ID NO: 97878 - DNA, 25 bp, Rattus norvegicus
actgggcaaggttgcacctgtactc

SEQ ID NO: 97879 - DNA, 25 bp, Rattus norvegicus
actgggcaccggaagtctgcttaag

SEQ ID NO: 97880 - DNA, 25 bp, Rattus norvegicus
actgggcaccggtagtctgcttaag

SEQ ID NO: 97881 - DNA, 25 bp, Rattus norvegicus
actgggcactgcacagggacacctg

SEQ ID NO: 97882 - DNA, 25 bp, Rattus norvegicus
actgggcactgctcagggacacctg

SEQ ID NO: 97883 - DNA, 25 bp, Rattus norvegicus
actgggcactgtatgatgggcatgg

SEQ ID NO: 97884 - DNA, 25 bp, Rattus norvegicus
actgggcactgtttgatgggcatgg

SEQ ID NO: 97885 - DNA, 25 bp, Rattus norvegicus
actgggcaggcgctaaccaagcagc

SEQ ID NO: 97886 - DNA, 25 bp, Rattus norvegicus
actgggcaggcggtaaccaagcagc

SEQ ID NO: 97887 - DNA, 25 bp, Rattus norvegicus
actgggcattgtcgccatagttatg

SEQ ID NO: 97888 - DNA, 25 bp, Rattus norvegicus
actgggcattgtggccatagttatg

SEQ ID NO: 97889 - DNA, 25 bp, Rattus norvegicus
actgggccactcagagtgatgactg

SEQ ID NO: 97890 - DNA, 25 bp, Rattus norvegicus
actgggccactctgagtgatgactg

SEQ ID NO: 97891 - DNA, 25 bp, Rattus norvegicus
actgggccagcactgtgatcatctt

SEQ ID NO: 97892 - DNA, 25 bp, Rattus norvegicus
actgggccagcagtgtgatcatctt

SEQ ID NO: 97893 - DNA, 25 bp, Rattus norvegicus
actgggccagctcacaggctatgag

SEQ ID NO: 97894 - DNA, 25 bp, Rattus norvegicus
actgggccagctgacaggctatgag

SEQ ID NO: 97895 - DNA, 25 bp, Rattus norvegicus
actgggccaggacgtagtctctcat

SEQ ID NO: 97896 - DNA, 25 bp, Rattus norvegicus
actgggccaggaggtagtctctcat

SEQ ID NO: 97897 - DNA, 25 bp, Rattus norvegicus
actgggccaggtcaagcacacaatg

SEQ ID NO: 97898 - DNA, 25 bp, Rattus norvegicus
actgggccaggtgaagcacacaatg

SEQ ID NO: 97899 - DNA, 25 bp, Rattus norvegicus
actgggccagttcccttacgtaagt

SEQ ID NO: 97900 - DNA, 25 bp, Rattus norvegicus
actgggccagttgccttacgtaagt

SEQ ID NO: 97901 - DNA, 25 bp, Rattus norvegicus
actgggccatctctatagccagata

SEQ ID NO: 97902 - DNA, 25 bp, Rattus norvegicus
actgggccatctgtatagccagata

SEQ ID NO: 97903 - DNA, 25 bp, Rattus norvegicus
actgggcccatgatccccacggagg

SEQ ID NO: 97904 - DNA, 25 bp, Rattus norvegicus
actgggcccatgttccccacggagg

SEQ ID NO: 97905 - DNA, 25 bp, Rattus norvegicus
actgggcccctgactcaagaagtcg

SEQ ID NO: 97906 - DNA, 25 bp, Rattus norvegicus
actgggcccctgcaagatctggagc

SEQ ID NO: 97907 - DNA, 25 bp, Rattus norvegicus
actgggcccctggaagatctggagc

SEQ ID NO: 97908 - DNA, 25 bp, Rattus norvegicus
actgggcccctgtctcaagaagtcg

SEQ ID NO: 97909 - DNA, 25 bp, Rattus norvegicus
actgggccgagtacctgcggatgaa

SEQ ID NO: 97910 - DNA, 25 bp, Rattus norvegicus
actgggccgagttcctgcggatgaa

SEQ ID NO: 97911 - DNA, 25 bp, Rattus norvegicus
actgggcctacacacaagggcggaa

SEQ ID NO: 97912 - DNA, 25 bp, Rattus norvegicus
actgggcctacagacaagggcggaa

SEQ ID NO: 97913 - DNA, 25 bp, Rattus norvegicus
actgggcctatcacagtcatcagga

SEQ ID NO: 97914 - DNA, 25 bp, Rattus norvegicus
actgggcctatctcagtcatcagga

SEQ ID NO: 97915 - DNA, 25 bp, Rattus norvegicus
actgggcctcacatggaacggtttt

SEQ ID NO: 97916 - DNA, 25 bp, Rattus norvegicus
actgggcctcacttggaacggtttt

SEQ ID NO: 97917 - DNA, 25 bp, Rattus norvegicus
actgggcctgacaccatgttttatg

SEQ ID NO: 97918 - DNA, 25 bp, Rattus norvegicus
actgggcctgactccatgttttatg

SEQ ID NO: 97919 - DNA, 25 bp, Rattus norvegicus
actgggcctggaatcctggtcagca

SEQ ID NO: 97920 - DNA, 25 bp, Rattus norvegicus
actgggcctggattcctggtcagca

SEQ ID NO: 97921 - DNA, 25 bp, Rattus norvegicus
actgggcctggtaatggctctgaga

SEQ ID NO: 97922 - DNA, 25 bp, Rattus norvegicus
actgggcctggttatggctctgaga

SEQ ID NO: 97923 - DNA, 25 bp, Rattus norvegicus
actgggcctttgactgtgagctcat

SEQ ID NO: 97924 - DNA, 25 bp, Rattus norvegicus
actgggcctttgtctgtgagctcat

SEQ ID NO: 97925 - DNA, 25 bp, Rattus norvegicus
actgggcgccttatgacttttgttg

SEQ ID NO: 97926 - DNA, 25 bp, Rattus norvegicus
actgggcgccttttgacttttgttg

SEQ ID NO: 97927 - DNA, 25 bp, Rattus norvegicus
actgggcgctctcgttaaaggagcc

SEQ ID NO: 97928 - DNA, 25 bp, Rattus norvegicus
actgggcgctctggttaaaggagcc

SEQ ID NO: 97929 - DNA, 25 bp, Rattus norvegicus
actgggcgggaccacaggagaggct

SEQ ID NO: 97930 - DNA, 25 bp, Rattus norvegicus
actgggcgggacgacaggagaggct

SEQ ID NO: 97931 - DNA, 25 bp, Rattus norvegicus
actgggctaaggagtgtcgagtctt

SEQ ID NO: 97932 - DNA, 25 bp, Rattus norvegicus
actgggctaaggtgtgtcgagtctt

SEQ ID NO: 97933 - DNA, 25 bp, Rattus norvegicus
actgggctaagtccctcaaatctta

SEQ ID NO: 97934 - DNA, 25 bp, Rattus norvegicus
actgggctaagtgcctcaaatctta

SEQ ID NO: 97935 - DNA, 25 bp, Rattus norvegicus
actgggctaggcactggcagcaaag

SEQ ID NO: 97936 - DNA, 25 bp, Rattus norvegicus
actgggctaggctctggcagcaaag

SEQ ID NO: 97937 - DNA, 25 bp, Rattus norvegicus
actgggctagtgagggctctcctga

SEQ ID NO: 97938 - DNA, 25 bp, Rattus norvegicus
actgggctagtgtgggctctcctga

SEQ ID NO: 97939 - DNA, 25 bp, Rattus norvegicus
actgggctatggcaagtgatccaaa

SEQ ID NO: 97940 - DNA, 25 bp, Rattus norvegicus
actgggctatgggaagtgatccaaa

SEQ ID NO: 97941 - DNA, 25 bp, Rattus norvegicus
actgggctccacagatacacacact

SEQ ID NO: 97942 - DNA, 25 bp, Rattus norvegicus
actgggctccactgatacacacact

SEQ ID NO: 97943 - DNA, 25 bp, Rattus norvegicus
actgggctccccattaatggctggg

SEQ ID NO: 97944 - DNA, 25 bp, Rattus norvegicus
actgggctcccctttaatggctggg

SEQ ID NO: 97945 - DNA, 25 bp, Rattus norvegicus
actgggctccttaagcttggtataa

SEQ ID NO: 97946 - DNA, 25 bp, Rattus norvegicus
actgggctcctttagcttggtataa

SEQ ID NO: 97947 - DNA, 25 bp, Rattus norvegicus
actgggctctaactgcctatgactt

SEQ ID NO: 97948 - DNA, 25 bp, Rattus norvegicus
actgggctctaagtgcctatgactt

SEQ ID NO: 97949 - DNA, 25 bp, Rattus norvegicus
actgggctgggcacaaacttgcaaa

SEQ ID NO: 97950 - DNA, 25 bp, Rattus norvegicus
actgggctgggctcaaacttgcaaa

SEQ ID NO: 97951 - DNA, 25 bp, Rattus norvegicus
actgggctgtctacgtgggcaattt

SEQ ID NO: 97952 - DNA, 25 bp, Rattus norvegicus
actgggctgtcttcgtgggcaattt

SEQ ID NO: 97953 - DNA, 25 bp, Rattus norvegicus
actgggctgtttccttctgctatag

SEQ ID NO: 97954 - DNA, 25 bp, Rattus norvegicus
actgggctgtttgcttctgctatag

SEQ ID NO: 97955 - DNA, 25 bp, Rattus norvegicus
actgggcttcacagaggcattagaa

SEQ ID NO: 97956 - DNA, 25 bp, Rattus norvegicus
actgggcttcactgaggcattagaa

SEQ ID NO: 97957 - DNA, 25 bp, Rattus norvegicus
actgggcttcatatatgtggatcta

SEQ ID NO: 97958 - DNA, 25 bp, Rattus norvegicus
actgggcttcatttatgtggatcta

SEQ ID NO: 97959 - DNA, 25 bp, Rattus norvegicus
actgggcttctacagcaggctgtca

SEQ ID NO: 97960 - DNA, 25 bp, Rattus norvegicus
actgggcttctagagcaggctgtca

SEQ ID NO: 97961 - DNA, 25 bp, Rattus norvegicus
actgggcttgtgaggcattgtcgtc

SEQ ID NO: 97962 - DNA, 25 bp, Rattus norvegicus
actgggcttgtgtggcattgtcgtc

SEQ ID NO: 97963 - DNA, 25 bp, Rattus norvegicus
actggggctaaaaccgcagcaaact

SEQ ID NO: 97964 - DNA, 25 bp, Rattus norvegicus
actggggctaaatccgcagcaaact

SEQ ID NO: 97965 - DNA, 25 bp, Rattus norvegicus
actgggtactgcagccagcctagaa

SEQ ID NO: 97966 - DNA, 25 bp, Rattus norvegicus
actgggtactgctgccagcctagaa

SEQ ID NO: 97967 - DNA, 25 bp, Rattus norvegicus
actgggtatggactctgcctatagc

SEQ ID NO: 97968 - DNA, 25 bp, Rattus norvegicus
actgggtatggagtctgcctatagc

SEQ ID NO: 97969 - DNA, 25 bp, Rattus norvegicus
actgggtcatacactgggtagctgc

SEQ ID NO: 97970 - DNA, 25 bp, Rattus norvegicus
actgggtcatactctgggtagctgc

SEQ ID NO: 97971 - DNA, 25 bp, Rattus norvegicus
actgggtcccaaatacatgtctgaa

SEQ ID NO: 97972 - DNA, 25 bp, Rattus norvegicus
actgggtcccaattacatgtctgaa

SEQ ID NO: 97973 - DNA, 25 bp, Rattus norvegicus
actgggtcccacagcccaggtgtca

SEQ ID NO: 97974 - DNA, 25 bp, Rattus norvegicus
actgggtcccactgcccaggtgtca

SEQ ID NO: 97975 - DNA, 25 bp, Rattus norvegicus
actgggtcctatccgagaactgaaa

SEQ ID NO: 97976 - DNA, 25 bp, Rattus norvegicus
actgggtcctatgcgagaactgaaa

SEQ ID NO: 97977 - DNA, 25 bp, Rattus norvegicus
actgggtctcccagagacaccagaa

SEQ ID NO: 97978 - DNA, 25 bp, Rattus norvegicus
actgggtctccctgagacaccagaa

SEQ ID NO: 97979 - DNA, 25 bp, Rattus norvegicus
actgggtctcttaccaaaataacat

SEQ ID NO: 97980 - DNA, 25 bp, Rattus norvegicus
actgggtctctttccaaaataacat

SEQ ID NO: 97981 - DNA, 25 bp, Rattus norvegicus
actgggtgaagacgccctgagctct

SEQ ID NO: 97982 - DNA, 25 bp, Rattus norvegicus
actgggtgaagaggccctgagctct

SEQ ID NO: 97983 - DNA, 25 bp, Rattus norvegicus
actgggtgatccctaatacctaatg

SEQ ID NO: 97984 - DNA, 25 bp, Rattus norvegicus
actgggtgatccgtaatacctaatg

SEQ ID NO: 97985 - DNA, 25 bp, Rattus norvegicus
actgggtgccagatcacagacgagt

SEQ ID NO: 97986 - DNA, 25 bp, Rattus norvegicus
actgggtgccagttcacagacgagt

SEQ ID NO: 97987 - DNA, 25 bp, Rattus norvegicus
actgggtgcttcaggtgatctgtgt

SEQ ID NO: 97988 - DNA, 25 bp, Rattus norvegicus
actgggtgcttctggtgatctgtgt

SEQ ID NO: 97989 - DNA, 25 bp, Rattus norvegicus
actgggtggtcacgtgttgttcttc

SEQ ID NO: 97990 - DNA, 25 bp, Rattus norvegicus
actgggtggtcaggtgttgttcttc

SEQ ID NO: 97991 - DNA, 25 bp, Rattus norvegicus
actgggtgtctcctttgcaggtaag

SEQ ID NO: 97992 - DNA, 25 bp, Rattus norvegicus
actgggtgtctcgtttgcaggtaag

SEQ ID NO: 97993 - DNA, 25 bp, Rattus norvegicus
actgggtgtggcactggaatgctta

SEQ ID NO: 97994 - DNA, 25 bp, Rattus norvegicus
actgggtgtggctctggaatgctta

SEQ ID NO: 97995 - DNA, 25 bp, Rattus norvegicus
actgggttacagacgtactctgcca

SEQ ID NO: 97996 - DNA, 25 bp, Rattus norvegicus
actgggttacagtcgtactctgcca

SEQ ID NO: 97997 - DNA, 25 bp, Rattus norvegicus
actgggttatagctcagtgccctga

SEQ ID NO: 97998 - DNA, 25 bp, Rattus norvegicus
actgggttataggtcagtgccctga

SEQ ID NO: 97999 - DNA, 25 bp, Rattus norvegicus
actgggttccacacgttggatggag

SEQ ID NO: 98000 - DNA, 25 bp, Rattus norvegicus
actgggttccactcgttggatggag

SEQ ID NO: 98001 - DNA, 25 bp, Rattus norvegicus
actgggttccagatttgcgtctagg

SEQ ID NO: 98002 - DNA, 25 bp, Rattus norvegicus
actgggttccagttttgcgtctagg

SEQ ID NO: 98003 - DNA, 25 bp, Rattus norvegicus
actgggtttccgagggttcctgcag

SEQ ID NO: 98004 - DNA, 25 bp, Rattus norvegicus
actgggtttccgtgggttcctgcag

SEQ ID NO: 98005 - DNA, 25 bp, Rattus norvegicus
actggtaaatatcgtgacacccact

SEQ ID NO: 98006 - DNA, 25 bp, Rattus norvegicus
actggtaaatatggtgacacccact

SEQ ID NO: 98007 - DNA, 25 bp, Rattus norvegicus
actggtaacagacgaaactggcttc

SEQ ID NO: 98008 - DNA, 25 bp, Rattus norvegicus
actggtaacagaggaaactggcttc

SEQ ID NO: 98009 - DNA, 25 bp, Rattus norvegicus
actggtaaccagactctgtctatag

SEQ ID NO: 98010 - DNA, 25 bp, Rattus norvegicus
actggtaaccagtctctgtctatag

SEQ ID NO: 98011 - DNA, 25 bp, Rattus norvegicus
actggtaactggcaagaggctctca

SEQ ID NO: 98012 - DNA, 25 bp, Rattus norvegicus
actggtaactgggaagaggctctca

SEQ ID NO: 98013 - DNA, 25 bp, Rattus norvegicus
actggtacaccaacacgaacgtgag

SEQ ID NO: 98014 - DNA, 25 bp, Rattus norvegicus
actggtacaccatcacgaacgtgag

SEQ ID NO: 98015 - DNA, 25 bp, Rattus norvegicus
actggtacccaaacaccattttgac

SEQ ID NO: 98016 - DNA, 25 bp, Rattus norvegicus
actggtacccaatcaccattttgac

SEQ ID NO: 98017 - DNA, 25 bp, Rattus norvegicus
actggtactgctcaactcctttgtg

SEQ ID NO: 98018 - DNA, 25 bp, Rattus norvegicus
actggtactgctgaactcctttgtg

SEQ ID NO: 98019 - DNA, 25 bp, Rattus norvegicus
actggtacttcaacaaccgcagctt

SEQ ID NO: 98020 - DNA, 25 bp, Rattus norvegicus
actggtacttcatcaaccgcagctt

SEQ ID NO: 98021 - DNA, 25 bp, Rattus norvegicus
actggtacttgcaaacctgagttgt

SEQ ID NO: 98022 - DNA, 25 bp, Rattus norvegicus
actggtacttgctaacctgagttgt

SEQ ID NO: 98023 - DNA, 25 bp, Rattus norvegicus
actggtagacgtcgccatctgggtc

SEQ ID NO: 98024 - DNA, 25 bp, Rattus norvegicus
actggtagacgtggccatctgggtc

SEQ ID NO: 98025 - DNA, 25 bp, Rattus norvegicus
actggtagagcacattccccaagtg

SEQ ID NO: 98026 - DNA, 25 bp, Rattus norvegicus
actggtagagcagattccccaagtg

SEQ ID NO: 98027 - DNA, 25 bp, Rattus norvegicus
actggtagctttcggcgctttagca

SEQ ID NO: 98028 - DNA, 25 bp, Rattus norvegicus
actggtagctttgggcgctttagca

SEQ ID NO: 98029 - DNA, 25 bp, Rattus norvegicus
actggtagtttactgtctccggcac

SEQ ID NO: 98030 - DNA, 25 bp, Rattus norvegicus
actggtagtttagtgtctccggcac

SEQ ID NO: 98031 - DNA, 25 bp, Rattus norvegicus
actggtatattccactcttggcctg

SEQ ID NO: 98032 - DNA, 25 bp, Rattus norvegicus
actggtatattcgactcttggcctg

SEQ ID NO: 98033 - DNA, 25 bp, Rattus norvegicus
actggtatgttcatttgcatgtaaa

SEQ ID NO: 98034 - DNA, 25 bp, Rattus norvegicus
actggtatgttcttttgcatgtaaa

SEQ ID NO: 98035 - DNA, 25 bp, Rattus norvegicus
actggtattacaactggcatagcca

SEQ ID NO: 98036 - DNA, 25 bp, Rattus norvegicus
actggtattacatctggcatagcca

SEQ ID NO: 98037 - DNA, 25 bp, Rattus norvegicus
actggtatttagctagtctggctaa

SEQ ID NO: 98038 - DNA, 25 bp, Rattus norvegicus
actggtatttaggtagtctggctaa

SEQ ID NO: 98039 - DNA, 25 bp, Rattus norvegicus
actggtatttggcaactgcttgctt

SEQ ID NO: 98040 - DNA, 25 bp, Rattus norvegicus
actggtatttgggaactgcttgctt

SEQ ID NO: 98041 - DNA, 25 bp, Rattus norvegicus
actggtcaagtacatgactgaggaa

SEQ ID NO: 98042 - DNA, 25 bp, Rattus norvegicus
actggtcaagtagatgactgaggaa

SEQ ID NO: 98043 - DNA, 25 bp, Rattus norvegicus
actggtcataaaacttagccttaca

SEQ ID NO: 98044 - DNA, 25 bp, Rattus norvegicus
actggtcataaatcttagccttaca

SEQ ID NO: 98045 - DNA, 25 bp, Rattus norvegicus
actggtcattcacctctagaacttt

SEQ ID NO: 98046 - DNA, 25 bp, Rattus norvegicus
actggtcattcagctctagaacttt

SEQ ID NO: 98047 - DNA, 25 bp, Rattus norvegicus
actggtccataacccgctgctggga

SEQ ID NO: 98048 - DNA, 25 bp, Rattus norvegicus
actggtccataagccgctgctggga

SEQ ID NO: 98049 - DNA, 25 bp, Rattus norvegicus
actggtccccacagtaactcaaaag

SEQ ID NO: 98050 - DNA, 25 bp, Rattus norvegicus
actggtccccactgtaactcaaaag

SEQ ID NO: 98051 - DNA, 25 bp, Rattus norvegicus
actggtcccttgctctgcaagcagg

SEQ ID NO: 98052 - DNA, 25 bp, Rattus norvegicus
actggtcccttggtctgcaagcagg

SEQ ID NO: 98053 - DNA, 25 bp, Rattus norvegicus
actggtcctacaatactgcaaatca

SEQ ID NO: 98054 - DNA, 25 bp, Rattus norvegicus
actggtcctacattactgcaaatca

SEQ ID NO: 98055 - DNA, 25 bp, Rattus norvegicus
actggtcctatcattgtctgtaatt

SEQ ID NO: 98056 - DNA, 25 bp, Rattus norvegicus
actggtcctatctttgtctgtaatt

SEQ ID NO: 98057 - DNA, 25 bp, Rattus norvegicus
actggtcctcttccccaaatgggta

SEQ ID NO: 98058 - DNA, 25 bp, Rattus norvegicus
actggtcctcttgcccaaatgggta

SEQ ID NO: 98059 - DNA, 25 bp, Rattus norvegicus
actggtcctgggattgtgtctctca

SEQ ID NO: 98060 - DNA, 25 bp, Rattus norvegicus
actggtcctgggtttgtgtctctca

SEQ ID NO: 98061 - DNA, 25 bp, Rattus norvegicus
actggtcgaccaataaattacacta

SEQ ID NO: 98062 - DNA, 25 bp, Rattus norvegicus
actggtcgaccattaaattacacta

SEQ ID NO: 98063 - DNA, 25 bp, Rattus norvegicus
actggtcgctggattcttagaaata

SEQ ID NO: 98064 - DNA, 25 bp, Rattus norvegicus
actggtcgctggtttcttagaaata

SEQ ID NO: 98065 - DNA, 25 bp, Rattus norvegicus
actggtcgtcagcaagcagaaccct

SEQ ID NO: 98066 - DNA, 25 bp, Rattus norvegicus
actggtcgtcaggaagcagaaccct

SEQ ID NO: 98067 - DNA, 25 bp, Rattus norvegicus
actggtctagtgattttctcatgaa

SEQ ID NO: 98068 - DNA, 25 bp, Rattus norvegicus
actggtctagtgtttttctcatgaa

SEQ ID NO: 98069 - DNA, 25 bp, Rattus norvegicus
actggtctcaaactctcaatatatg

SEQ ID NO: 98070 - DNA, 25 bp, Rattus norvegicus
actggtctcaaagtctcaatatatg

SEQ ID NO: 98071 - DNA, 25 bp, Rattus norvegicus
actggtctcaccatgtagagatatc

SEQ ID NO: 98072 - DNA, 25 bp, Rattus norvegicus
actggtctcaccttgtagagatatc

SEQ ID NO: 98073 - DNA, 25 bp, Rattus norvegicus
actggtctccacagataccaagtat

SEQ ID NO: 98074 - DNA, 25 bp, Rattus norvegicus
actggtctccactgataccaagtat

SEQ ID NO: 98075 - DNA, 25 bp, Rattus norvegicus
actggtctccagagaaaacttcgag

SEQ ID NO: 98076 - DNA, 25 bp, Rattus norvegicus
actggtctccagtgaaaacttcgag

SEQ ID NO: 98077 - DNA, 25 bp, Rattus norvegicus
actggtctccatcctggtctggaaa

SEQ ID NO: 98078 - DNA, 25 bp, Rattus norvegicus
actggtctccatgctggtctggaaa

SEQ ID NO: 98079 - DNA, 25 bp, Rattus norvegicus
actggtctccccaacataatttgtt

SEQ ID NO: 98080 - DNA, 25 bp, Rattus norvegicus
actggtctcccctacataatttgtt

SEQ ID NO: 98081 - DNA, 25 bp, Rattus norvegicus
actggtctcggcatggatcccctgt

SEQ ID NO: 98082 - DNA, 25 bp, Rattus norvegicus
actggtctcggcttggatcccctgt

SEQ ID NO: 98083 - DNA, 25 bp, Rattus norvegicus
actggtctgagcaccttttcaatta

SEQ ID NO: 98084 - DNA, 25 bp, Rattus norvegicus
actggtctgagctccttttcaatta

SEQ ID NO: 98085 - DNA, 25 bp, Rattus norvegicus
actggtctgccccaagtttatctgg

SEQ ID NO: 98086 - DNA, 25 bp, Rattus norvegicus
actggtctgcccgaagtttatctgg

SEQ ID NO: 98087 - DNA, 25 bp, Rattus norvegicus
actggtctgcggagtgaacacttct

SEQ ID NO: 98088 - DNA, 25 bp, Rattus norvegicus
actggtctgcggtgtgaacacttct

SEQ ID NO: 98089 - DNA, 25 bp, Rattus norvegicus
actggtctggatatctaccggaaga

SEQ ID NO: 98090 - DNA, 25 bp, Rattus norvegicus
actggtctggatcgcagctggtacc

SEQ ID NO: 98091 - DNA, 25 bp, Rattus norvegicus
actggtctggatggcagctggtacc

SEQ ID NO: 98092 - DNA, 25 bp, Rattus norvegicus
actggtctggatttctaccggaaga

SEQ ID NO: 98093 - DNA, 25 bp, Rattus norvegicus
actggtcttcttcgctacactgtgt

SEQ ID NO: 98094 - DNA, 25 bp, Rattus norvegicus
actggtcttcttggctacactgtgt

SEQ ID NO: 98095 - DNA, 25 bp, Rattus norvegicus
actggtcttgctagctgttgccaac

SEQ ID NO: 98096 - DNA, 25 bp, Rattus norvegicus
actggtcttgctctttttgcttcct

SEQ ID NO: 98097 - DNA, 25 bp, Rattus norvegicus
actggtcttgctgtttttgcttcct

SEQ ID NO: 98098 - DNA, 25 bp, Rattus norvegicus
actggtcttgcttgctgttgccaac

SEQ ID NO: 98099 - DNA, 25 bp, Rattus norvegicus
actggtcttgtcacagtcatcctgg

SEQ ID NO: 98100 - DNA, 25 bp, Rattus norvegicus
actggtcttgtctcagtcatcctgg

SEQ ID NO: 98101 - DNA, 25 bp, Rattus norvegicus
actggtgaacgaccttctcaggctg

SEQ ID NO: 98102 - DNA, 25 bp, Rattus norvegicus
actggtgaacgagcttctcaggctg

SEQ ID NO: 98103 - DNA, 25 bp, Rattus norvegicus
actggtgaactacattcaatcccca

SEQ ID NO: 98104 - DNA, 25 bp, Rattus norvegicus
actggtgaactagattcaatcccca

SEQ ID NO: 98105 - DNA, 25 bp, Rattus norvegicus
actggtgaagtcactctgcgccaag

SEQ ID NO: 98106 - DNA, 25 bp, Rattus norvegicus
actggtgaagtctctctgcgccaag

SEQ ID NO: 98107 - DNA, 25 bp, Rattus norvegicus
actggtgacaagcagctgcaggtac

SEQ ID NO: 98108 - DNA, 25 bp, Rattus norvegicus
actggtgacaaggagctgcaggtac

SEQ ID NO: 98109 - DNA, 25 bp, Rattus norvegicus
actggtgacacgagaggtgcccttt

SEQ ID NO: 98110 - DNA, 25 bp, Rattus norvegicus
actggtgacacgtgaggtgcccttt

SEQ ID NO: 98111 - DNA, 25 bp, Rattus norvegicus
actggtgacagtatcgtgcgggttt

SEQ ID NO: 98112 - DNA, 25 bp, Rattus norvegicus
actggtgacagtttcgtgcgggttt

SEQ ID NO: 98113 - DNA, 25 bp, Rattus norvegicus
actggtgagagtccctgtgtatgta

SEQ ID NO: 98114 - DNA, 25 bp, Rattus norvegicus
actggtgagagtgcctgtgtatgta

SEQ ID NO: 98115 - DNA, 25 bp, Rattus norvegicus
actggtgagccgaccaggccctaca

SEQ ID NO: 98116 - DNA, 25 bp, Rattus norvegicus
actggtgagccgtccaggccctaca

SEQ ID NO: 98117 - DNA, 25 bp, Rattus norvegicus
actggtgatcagatcaagtcattgt

SEQ ID NO: 98118 - DNA, 25 bp, Rattus norvegicus
actggtgatcagttcaagtcattgt

SEQ ID NO: 98119 - DNA, 25 bp, Rattus norvegicus
actggtgatcctccgtcggcataag

SEQ ID NO: 98120 - DNA, 25 bp, Rattus norvegicus
actggtgatcctgcgtcggcataag

SEQ ID NO: 98121 - DNA, 25 bp, Rattus norvegicus
actggtgatcttagagactagattt

SEQ ID NO: 98122 - DNA, 25 bp, Rattus norvegicus
actggtgatctttgagactagattt

SEQ ID NO: 98123 - DNA, 25 bp, Rattus norvegicus
actggtgattgtacttggtttctat

SEQ ID NO: 98124 - DNA, 25 bp, Rattus norvegicus
actggtgattgttcttggtttctat

SEQ ID NO: 98125 - DNA, 25 bp, Rattus norvegicus
actggtgatttcctcatacttttga

SEQ ID NO: 98126 - DNA, 25 bp, Rattus norvegicus
actggtgatttcgtcatacttttga

SEQ ID NO: 98127 - DNA, 25 bp, Rattus norvegicus
actggtgcaataaacttcctgccgt

SEQ ID NO: 98128 - DNA, 25 bp, Rattus norvegicus
actggtgcaatatacttcctgccgt

SEQ ID NO: 98129 - DNA, 25 bp, Rattus norvegicus
actggtgcacttcttcctgctgggt

SEQ ID NO: 98130 - DNA, 25 bp, Rattus norvegicus
actggtgcacttgttcctgctgggt

SEQ ID NO: 98131 - DNA, 25 bp, Rattus norvegicus
actggtgccactattgagtgctcaa

SEQ ID NO: 98132 - DNA, 25 bp, Rattus norvegicus
actggtgccacttttgagtgctcaa

SEQ ID NO: 98133 - DNA, 25 bp, Rattus norvegicus
actggtgccaggcacactatttcag

SEQ ID NO: 98134 - DNA, 25 bp, Rattus norvegicus
actggtgccagggacactatttcag

SEQ ID NO: 98135 - DNA, 25 bp, Rattus norvegicus
actggtgcctacacacataggagga

SEQ ID NO: 98136 - DNA, 25 bp, Rattus norvegicus
actggtgcctactcacataggagga

SEQ ID NO: 98137 - DNA, 25 bp, Rattus norvegicus
actggtgcctgtctgatggatgctc

SEQ ID NO: 98138 - DNA, 25 bp, Rattus norvegicus
actggtgcctgtgtgatggatgctc

SEQ ID NO: 98139 - DNA, 25 bp, Rattus norvegicus
actggtgcctttatattacttgcct

SEQ ID NO: 98140 - DNA, 25 bp, Rattus norvegicus
actggtgcctttttattacttgcct

SEQ ID NO: 98141 - DNA, 25 bp, Rattus norvegicus
actggtgctactactttggtggctg

SEQ ID NO: 98142 - DNA, 25 bp, Rattus norvegicus
actggtgctacttctttggtggctg

SEQ ID NO: 98143 - DNA, 25 bp, Rattus norvegicus
actggtgcttgacctgtgctgcaac

SEQ ID NO: 98144 - DNA, 25 bp, Rattus norvegicus
actggtgcttgagctgtgctgcaac

SEQ ID NO: 98145 - DNA, 25 bp, Rattus norvegicus
actggtggacagactgagtgctcga

SEQ ID NO: 98146 - DNA, 25 bp, Rattus norvegicus
actggtggacagtctgagtgctcga

SEQ ID NO: 98147 - DNA, 25 bp, Rattus norvegicus
actggtggccctctgtttgagataa

SEQ ID NO: 98148 - DNA, 25 bp, Rattus norvegicus
actggtggccctgtgtttgagataa

SEQ ID NO: 98149 - DNA, 25 bp, Rattus norvegicus
actggtgggagcagttgttgctaca

SEQ ID NO: 98150 - DNA, 25 bp, Rattus norvegicus
actggtgggagctgttgttgctaca

SEQ ID NO: 98151 - DNA, 25 bp, Rattus norvegicus
actggtggttcaacaaggtccggaa

SEQ ID NO: 98152 - DNA, 25 bp, Rattus norvegicus
actggtggttcatcaaggtccggaa

SEQ ID NO: 98153 - DNA, 25 bp, Rattus norvegicus
actggtgtaccacgtgccgcagagc

SEQ ID NO: 98154 - DNA, 25 bp, Rattus norvegicus
actggtgtaccaggtgccgcagagc

SEQ ID NO: 98155 - DNA, 25 bp, Rattus norvegicus
actggtgtattgagctagatttgaa

SEQ ID NO: 98156 - DNA, 25 bp, Rattus norvegicus
actggtgtattgtgctagatttgaa

SEQ ID NO: 98157 - DNA, 25 bp, Rattus norvegicus
actggtgtcacaaaagtccctcggt

SEQ ID NO: 98158 - DNA, 25 bp, Rattus norvegicus
actggtgtcacataagtccctcggt

SEQ ID NO: 98159 - DNA, 25 bp, Rattus norvegicus
actggtgtcatcagggtctaaaact

SEQ ID NO: 98160 - DNA, 25 bp, Rattus norvegicus
actggtgtcatctgggtctaaaact

SEQ ID NO: 98161 - DNA, 25 bp, Rattus norvegicus
actggtgtccggctgtatgtattac

SEQ ID NO: 98162 - DNA, 25 bp, Rattus norvegicus
actggtgtccgggtgtatgtattac

SEQ ID NO: 98163 - DNA, 25 bp, Rattus norvegicus
actggtgtcctgatagcgtgtgaat

SEQ ID NO: 98164 - DNA, 25 bp, Rattus norvegicus
actggtgtcctgttagcgtgtgaat

SEQ ID NO: 98165 - DNA, 25 bp, Rattus norvegicus
actggtgtccttactttgttgtgat

SEQ ID NO: 98166 - DNA, 25 bp, Rattus norvegicus
actggtgtcctttctttgttgtgat

SEQ ID NO: 98167 - DNA, 25 bp, Rattus norvegicus
actggtgtgaagaaaattcttgttc

SEQ ID NO: 98168 - DNA, 25 bp, Rattus norvegicus
actggtgtgaagtaaattcttgttc

SEQ ID NO: 98169 - DNA, 25 bp, Rattus norvegicus
actggtgtgctcaatgctgtagtca

SEQ ID NO: 98170 - DNA, 25 bp, Rattus norvegicus
actggtgtgctctatgctgtagtca

SEQ ID NO: 98171 - DNA, 25 bp, Rattus norvegicus
actggtgtgtcaattgtggaagctg

SEQ ID NO: 98172 - DNA, 25 bp, Rattus norvegicus
actggtgtgtcatttgtggaagctg

SEQ ID NO: 98173 - DNA, 25 bp, Rattus norvegicus
actggtgtgtcccattctgtaagca

SEQ ID NO: 98174 - DNA, 25 bp, Rattus norvegicus
actggtgtgtccgattctgtaagca

SEQ ID NO: 98175 - DNA, 25 bp, Rattus norvegicus
actggtgtgtctagtcacgggagca

SEQ ID NO: 98176 - DNA, 25 bp, Rattus norvegicus
actggtgtgtcttgtcacgggagca

SEQ ID NO: 98177 - DNA, 25 bp, Rattus norvegicus
actggtgtgttcaagtctggctggc

SEQ ID NO: 98178 - DNA, 25 bp, Rattus norvegicus
actggtgtgttccagttgacggcca

SEQ ID NO: 98179 - DNA, 25 bp, Rattus norvegicus
actggtgtgttcgagttgacggcca

SEQ ID NO: 98180 - DNA, 25 bp, Rattus norvegicus
actggtgtgttctagtctggctggc

SEQ ID NO: 98181 - DNA, 25 bp, Rattus norvegicus
actggtgttctgagggcgaatgcct

SEQ ID NO: 98182 - DNA, 25 bp, Rattus norvegicus
actggtgttctgtgggcgaatgcct

SEQ ID NO: 98183 - DNA, 25 bp, Rattus norvegicus
actggttactgcaccctgaggccaa

SEQ ID NO: 98184 - DNA, 25 bp, Rattus norvegicus
actggttactgctccctgaggccaa

SEQ ID NO: 98185 - DNA, 25 bp, Rattus norvegicus
actggttagtctctggctccttggt

SEQ ID NO: 98186 - DNA, 25 bp, Rattus norvegicus
actggttagtctgtggctccttggt

SEQ ID NO: 98187 - DNA, 25 bp, Rattus norvegicus
actggttatataattggccattata

SEQ ID NO: 98188 - DNA, 25 bp, Rattus norvegicus
actggttatatatttggccattata

SEQ ID NO: 98189 - DNA, 25 bp, Rattus norvegicus
actggttccctgctttggtcctgat

SEQ ID NO: 98190 - DNA, 25 bp, Rattus norvegicus
actggttccctggtttggtcctgat

SEQ ID NO: 98191 - DNA, 25 bp, Rattus norvegicus
actggttcttaaacttgtgcactgg

SEQ ID NO: 98192 - DNA, 25 bp, Rattus norvegicus
actggttcttaatcttgtgcactgg

SEQ ID NO: 98193 - DNA, 25 bp, Rattus norvegicus
actggttcttgtcatgaaacactca

SEQ ID NO: 98194 - DNA, 25 bp, Rattus norvegicus
actggttcttgtgatgaaacactca

SEQ ID NO: 98195 - DNA, 25 bp, Rattus norvegicus
actggttgaaacctctgcttacaat

SEQ ID NO: 98196 - DNA, 25 bp, Rattus norvegicus
actggttgaaacgtctgcttacaat

SEQ ID NO: 98197 - DNA, 25 bp, Rattus norvegicus
actggttgacgccacatgaacagaa

SEQ ID NO: 98198 - DNA, 25 bp, Rattus norvegicus
actggttgacgcgacatgaacagaa

SEQ ID NO: 98199 - DNA, 25 bp, Rattus norvegicus
actggttgcaagctggcacatgcct

SEQ ID NO: 98200 - DNA, 25 bp, Rattus norvegicus
actggttgcaaggtggcacatgcct

SEQ ID NO: 98201 - DNA, 25 bp, Rattus norvegicus
actggttgcgtaagattgacttcaa

SEQ ID NO: 98202 - DNA, 25 bp, Rattus norvegicus
actggttgcgtatgattgacttcaa

SEQ ID NO: 98203 - DNA, 25 bp, Rattus norvegicus
actggttggagacctctaccctgac

SEQ ID NO: 98204 - DNA, 25 bp, Rattus norvegicus
actggttggagagctctaccctgac

SEQ ID NO: 98205 - DNA, 25 bp, Rattus norvegicus
actggttggatcactagctactggc

SEQ ID NO: 98206 - DNA, 25 bp, Rattus norvegicus
actggttggatctctagctactggc

SEQ ID NO: 98207 - DNA, 25 bp, Rattus norvegicus
actggttgggagatgcccgagacgc

SEQ ID NO: 98208 - DNA, 25 bp, Rattus norvegicus
actggttgggagttgcccgagacgc

SEQ ID NO: 98209 - DNA, 25 bp, Rattus norvegicus
actggttggtcacccattgagcagc

SEQ ID NO: 98210 - DNA, 25 bp, Rattus norvegicus
actggttggtcagccattgagcagc

SEQ ID NO: 98211 - DNA, 25 bp, Rattus norvegicus
actggttgttgccatcctcatctat

SEQ ID NO: 98212 - DNA, 25 bp, Rattus norvegicus
actggttgttgcgatcctcatctat

SEQ ID NO: 98213 - DNA, 25 bp, Rattus norvegicus
actggtttgccacagccatcgggat

SEQ ID NO: 98214 - DNA, 25 bp, Rattus norvegicus
actggtttgccagagccatcgggat

SEQ ID NO: 98215 - DNA, 25 bp, Rattus norvegicus
actggtttggtcaggaggatcctcc

SEQ ID NO: 98216 - DNA, 25 bp, Rattus norvegicus
actggtttggtctggaggatcctcc

SEQ ID NO: 98217 - DNA, 25 bp, Rattus norvegicus
actggttttattccctgctattgtg

SEQ ID NO: 98218 - DNA, 25 bp, Rattus norvegicus
actggttttattgcctgctattgtg

SEQ ID NO: 98219 - DNA, 25 bp, Rattus norvegicus
actgtaaaagtgcatggaaaggttc

SEQ ID NO: 98220 - DNA, 25 bp, Rattus norvegicus
actgtaaaagtggatggaaaggttc

SEQ ID NO: 98221 - DNA, 25 bp, Rattus norvegicus
actgtaaaatgtcctccttcctggg

SEQ ID NO: 98222 - DNA, 25 bp, Rattus norvegicus
actgtaaaatgtgctccttcctggg

SEQ ID NO: 98223 - DNA, 25 bp, Rattus norvegicus
actgtaaaccataagccctattcct

SEQ ID NO: 98224 - DNA, 25 bp, Rattus norvegicus
actgtaaaccattagccctattcct

SEQ ID NO: 98225 - DNA, 25 bp, Rattus norvegicus
actgtaaaccttaagagcctggctc

SEQ ID NO: 98226 - DNA, 25 bp, Rattus norvegicus
actgtaaacctttagagcctggctc

SEQ ID NO: 98227 - DNA, 25 bp, Rattus norvegicus
actgtaaacttgaccttatctctct

SEQ ID NO: 98228 - DNA, 25 bp, Rattus norvegicus
actgtaaacttgtccttatctctct

SEQ ID NO: 98229 - DNA, 25 bp, Rattus norvegicus
actgtaaaggtgctgtgtctgccat

SEQ ID NO: 98230 - DNA, 25 bp, Rattus norvegicus
actgtaaaggtggtgtgtctgccat

SEQ ID NO: 98231 - DNA, 25 bp, Rattus norvegicus
actgtaaatctgaccatgcctatcc

SEQ ID NO: 98232 - DNA, 25 bp, Rattus norvegicus
actgtaaatctgtccatgcctatcc

SEQ ID NO: 98233 - DNA, 25 bp, Rattus norvegicus
actgtaaccagccttctgctgttgc

SEQ ID NO: 98234 - DNA, 25 bp, Rattus norvegicus
actgtaaccagcgttctgctgttgc

SEQ ID NO: 98235 - DNA, 25 bp, Rattus norvegicus
actgtaacccataccaatttgcttt

SEQ ID NO: 98236 - DNA, 25 bp, Rattus norvegicus
actgtaacccattccaatttgcttt

SEQ ID NO: 98237 - DNA, 25 bp, Rattus norvegicus
actgtaacgctgaggaagccctttt

SEQ ID NO: 98238 - DNA, 25 bp, Rattus norvegicus
actgtaacgctgtggaagccctttt

SEQ ID NO: 98239 - DNA, 25 bp, Rattus norvegicus
actgtaactcagaagacttggcgaa

SEQ ID NO: 98240 - DNA, 25 bp, Rattus norvegicus
actgtaactcagtagacttggcgaa

SEQ ID NO: 98241 - DNA, 25 bp, Rattus norvegicus
actgtaactccgactactgaatggc

SEQ ID NO: 98242 - DNA, 25 bp, Rattus norvegicus
actgtaactccgtctactgaatggc

SEQ ID NO: 98243 - DNA, 25 bp, Rattus norvegicus
actgtaacttccctgtctagatgta

SEQ ID NO: 98244 - DNA, 25 bp, Rattus norvegicus
actgtaacttccgtgtctagatgta

SEQ ID NO: 98245 - DNA, 25 bp, Rattus norvegicus
actgtaaggtttcggcgctgccgac

SEQ ID NO: 98246 - DNA, 25 bp, Rattus norvegicus
actgtaaggtttgggcgctgccgac

SEQ ID NO: 98247 - DNA, 25 bp, Rattus norvegicus
actgtaagtccaatgagctccacca

SEQ ID NO: 98248 - DNA, 25 bp, Rattus norvegicus
actgtaagtccattgagctccacca

SEQ ID NO: 98249 - DNA, 25 bp, Rattus norvegicus
actgtaagttgaatggctgccgaga

SEQ ID NO: 98250 - DNA, 25 bp, Rattus norvegicus
actgtaagttgattggctgccgaga

SEQ ID NO: 98251 - DNA, 25 bp, Rattus norvegicus
actgtaatcacccatcgacttagaa

SEQ ID NO: 98252 - DNA, 25 bp, Rattus norvegicus
actgtaatcaccgatcgacttagaa

SEQ ID NO: 98253 - DNA, 25 bp, Rattus norvegicus
actgtaatgactactggccccacga

SEQ ID NO: 98254 - DNA, 25 bp, Rattus norvegicus
actgtaatgacttctggccccacga

SEQ ID NO: 98255 - DNA, 25 bp, Rattus norvegicus
actgtaatgctcacccactgcatat

SEQ ID NO: 98256 - DNA, 25 bp, Rattus norvegicus
actgtaatgctctcccactgcatat

SEQ ID NO: 98257 - DNA, 25 bp, Rattus norvegicus
actgtaatgggtctgctcctgccta

SEQ ID NO: 98258 - DNA, 25 bp, Rattus norvegicus
actgtaatgggtgtgctcctgccta

SEQ ID NO: 98259 - DNA, 25 bp, Rattus norvegicus
actgtaattgtcatcctgttgtgct

SEQ ID NO: 98260 - DNA, 25 bp, Rattus norvegicus
actgtaattgtcttcctgttgtgct

SEQ ID NO: 98261 - DNA, 25 bp, Rattus norvegicus
actgtaattgttcctggaaatgttc

SEQ ID NO: 98262 - DNA, 25 bp, Rattus norvegicus
actgtaattgttgctggaaatgttc

SEQ ID NO: 98263 - DNA, 25 bp, Rattus norvegicus
actgtacaacagacacttcaaggtt

SEQ ID NO: 98264 - DNA, 25 bp, Rattus norvegicus
actgtacaacagactgcactgctta

SEQ ID NO: 98265 - DNA, 25 bp, Rattus norvegicus
actgtacaacagacttcatcactcc

SEQ ID NO: 98266 - DNA, 25 bp, Rattus norvegicus
actgtacaacagtcacttcaaggtt

SEQ ID NO: 98267 - DNA, 25 bp, Rattus norvegicus
actgtacaacagtctgcactgctta

SEQ ID NO: 98268 - DNA, 25 bp, Rattus norvegicus
actgtacaacagtcttcatcactcc

SEQ ID NO: 98269 - DNA, 25 bp, Rattus norvegicus
actgtacagaacagtttgtccccgt

SEQ ID NO: 98270 - DNA, 25 bp, Rattus norvegicus
actgtacagaactgtttgtccccgt

SEQ ID NO: 98271 - DNA, 25 bp, Rattus norvegicus
actgtacagattactgcccacttag

SEQ ID NO: 98272 - DNA, 25 bp, Rattus norvegicus
actgtacagatttctgcccacttag

SEQ ID NO: 98273 - DNA, 25 bp, Rattus norvegicus
actgtacagtagacctatggcaccc

SEQ ID NO: 98274 - DNA, 25 bp, Rattus norvegicus
actgtacagtagtcctatggcaccc

SEQ ID NO: 98275 - DNA, 25 bp, Rattus norvegicus
actgtacagttaaacatgcaggcaa

SEQ ID NO: 98276 - DNA, 25 bp, Rattus norvegicus
actgtacagttatacatgcaggcaa

SEQ ID NO: 98277 - DNA, 25 bp, Rattus norvegicus
actgtacatatgagtgaaattctca

SEQ ID NO: 98278 - DNA, 25 bp, Rattus norvegicus
actgtacatatgtgtgaaattctca

SEQ ID NO: 98279 - DNA, 25 bp, Rattus norvegicus
actgtacattgtcagctctggttat

SEQ ID NO: 98280 - DNA, 25 bp, Rattus norvegicus
actgtacattgtgagctctggttat

SEQ ID NO: 98281 - DNA, 25 bp, Rattus norvegicus
actgtacatttgatttctattcttc

SEQ ID NO: 98282 - DNA, 25 bp, Rattus norvegicus
actgtacatttgttttctattcttc

SEQ ID NO: 98283 - DNA, 25 bp, Rattus norvegicus
actgtacattttactcgctgttgga

SEQ ID NO: 98284 - DNA, 25 bp, Rattus norvegicus
actgtacatttttctcgctgttgga

SEQ ID NO: 98285 - DNA, 25 bp, Rattus norvegicus
actgtaccaggacgcctctagacta

SEQ ID NO: 98286 - DNA, 25 bp, Rattus norvegicus
actgtaccaggaggcctctagacta

SEQ ID NO: 98287 - DNA, 25 bp, Rattus norvegicus
actgtacccagcatagaactcttaa

SEQ ID NO: 98288 - DNA, 25 bp, Rattus norvegicus
actgtacccagcttagaactcttaa

SEQ ID NO: 98289 - DNA, 25 bp, Rattus norvegicus
actgtacccgtgctgaacttcgttg

SEQ ID NO: 98290 - DNA, 25 bp, Rattus norvegicus
actgtacccgtggtgaacttcgttg

SEQ ID NO: 98291 - DNA, 25 bp, Rattus norvegicus
actgtacccttcaagccctgtcagg

SEQ ID NO: 98292 - DNA, 25 bp, Rattus norvegicus
actgtacccttctagccctgtcagg

SEQ ID NO: 98293 - DNA, 25 bp, Rattus norvegicus
actgtacctggtcctcaagattaga

SEQ ID NO: 98294 - DNA, 25 bp, Rattus norvegicus
actgtacctggtgctcaagattaga

SEQ ID NO: 98295 - DNA, 25 bp, Rattus norvegicus
actgtacctgtgagtattctgccaa

SEQ ID NO: 98296 - DNA, 25 bp, Rattus norvegicus
actgtacctgtgtgtattctgccaa

SEQ ID NO: 98297 - DNA, 25 bp, Rattus norvegicus
actgtaccttagatactcgctagag

SEQ ID NO: 98298 - DNA, 25 bp, Rattus norvegicus
actgtaccttagttactcgctagag

SEQ ID NO: 98299 - DNA, 25 bp, Rattus norvegicus
actgtacgtcgtatggtgtgctgga

SEQ ID NO: 98300 - DNA, 25 bp, Rattus norvegicus
actgtacgtcgtttggtgtgctgga

SEQ ID NO: 98301 - DNA, 25 bp, Rattus norvegicus
actgtactcactcagactggataaa

SEQ ID NO: 98302 - DNA, 25 bp, Rattus norvegicus
actgtactcactgagactggataaa

SEQ ID NO: 98303 - DNA, 25 bp, Rattus norvegicus
actgtactcatgatgcattccctgt

SEQ ID NO: 98304 - DNA, 25 bp, Rattus norvegicus
actgtactcatgttgcattccctgt

SEQ ID NO: 98305 - DNA, 25 bp, Rattus norvegicus
actgtactcattatactgttaggga

SEQ ID NO: 98306 - DNA, 25 bp, Rattus norvegicus
actgtactcattttactgttaggga

SEQ ID NO: 98307 - DNA, 25 bp, Rattus norvegicus
actgtactccaacctctttcttgtc

SEQ ID NO: 98308 - DNA, 25 bp, Rattus norvegicus
actgtactccaagctctttcttgtc

SEQ ID NO: 98309 - DNA, 25 bp, Rattus norvegicus
actgtactctggaaaggtttgctca

SEQ ID NO: 98310 - DNA, 25 bp, Rattus norvegicus
actgtactctggtaaggtttgctca

SEQ ID NO: 98311 - DNA, 25 bp, Rattus norvegicus
actgtactgtatccacgggtcgctc

SEQ ID NO: 98312 - DNA, 25 bp, Rattus norvegicus
actgtactgtatcttttcctacctg

SEQ ID NO: 98313 - DNA, 25 bp, Rattus norvegicus
actgtactgtatgcacgggtcgctc

SEQ ID NO: 98314 - DNA, 25 bp, Rattus norvegicus
actgtactgtatgttttcctacctg

SEQ ID NO: 98315 - DNA, 25 bp, Rattus norvegicus
actgtactgtgcaaggagttcccta

SEQ ID NO: 98316 - DNA, 25 bp, Rattus norvegicus
actgtactgtgctaggagttcccta

SEQ ID NO: 98317 - DNA, 25 bp, Rattus norvegicus
actgtacttagtccgattcgtttct

SEQ ID NO: 98318 - DNA, 25 bp, Rattus norvegicus
actgtacttagtgcgattcgtttct

SEQ ID NO: 98319 - DNA, 25 bp, Rattus norvegicus
actgtacttcagaccttgccaaaga

SEQ ID NO: 98320 - DNA, 25 bp, Rattus norvegicus
actgtacttcagtccttgccaaaga

SEQ ID NO: 98321 - DNA, 25 bp, Rattus norvegicus
actgtagaactgatggtgcccacga

SEQ ID NO: 98322 - DNA, 25 bp, Rattus norvegicus
actgtagaactgttggtgcccacga

SEQ ID NO: 98323 - DNA, 25 bp, Rattus norvegicus
actgtagaagtaagtgtctgtgcta

SEQ ID NO: 98324 - DNA, 25 bp, Rattus norvegicus
actgtagaagtatgtgtctgtgcta

SEQ ID NO: 98325 - DNA, 25 bp, Rattus norvegicus
actgtagacaaacctgtggatgcac

SEQ ID NO: 98326 - DNA, 25 bp, Rattus norvegicus
actgtagacaaagctgtggatgcac

SEQ ID NO: 98327 - DNA, 25 bp, Rattus norvegicus
actgtagatagaagcctgggaccca

SEQ ID NO: 98328 - DNA, 25 bp, Rattus norvegicus
actgtagatagatgcctgggaccca

SEQ ID NO: 98329 - DNA, 25 bp, Rattus norvegicus
actgtagatctcctgtttttcagcc

SEQ ID NO: 98330 - DNA, 25 bp, Rattus norvegicus
actgtagatctcgtgtttttcagcc

SEQ ID NO: 98331 - DNA, 25 bp, Rattus norvegicus
actgtagatcttactcttgtttcct

SEQ ID NO: 98332 - DNA, 25 bp, Rattus norvegicus
actgtagatctttctcttgtttcct

SEQ ID NO: 98333 - DNA, 25 bp, Rattus norvegicus
actgtagcccatactatgactgaga

SEQ ID NO: 98334 - DNA, 25 bp, Rattus norvegicus
actgtagcccattctatgactgaga

SEQ ID NO: 98335 - DNA, 25 bp, Rattus norvegicus
actgtagccctgaacaattcttctg

SEQ ID NO: 98336 - DNA, 25 bp, Rattus norvegicus
actgtagccctgtacaattcttctg

SEQ ID NO: 98337 - DNA, 25 bp, Rattus norvegicus
actgtagcctgaattcatattgtat

SEQ ID NO: 98338 - DNA, 25 bp, Rattus norvegicus
actgtagcctgatttcatattgtat

SEQ ID NO: 98339 - DNA, 25 bp, Rattus norvegicus
actgtagccttaaaccattgcctag

SEQ ID NO: 98340 - DNA, 25 bp, Rattus norvegicus
actgtagccttataccattgcctag

SEQ ID NO: 98341 - DNA, 25 bp, Rattus norvegicus
actgtagcgggcactgacctggtca

SEQ ID NO: 98342 - DNA, 25 bp, Rattus norvegicus
actgtagcgggctctgacctggtca

SEQ ID NO: 98343 - DNA, 25 bp, Rattus norvegicus
actgtagctcttcaaaatacccacc

SEQ ID NO: 98344 - DNA, 25 bp, Rattus norvegicus
actgtagctcttgaaaatacccacc

SEQ ID NO: 98345 - DNA, 25 bp, Rattus norvegicus
actgtaggctctacatgtgccgttc

SEQ ID NO: 98346 - DNA, 25 bp, Rattus norvegicus
actgtaggctcttcatgtgccgttc

SEQ ID NO: 98347 - DNA, 25 bp, Rattus norvegicus
actgtagtacagcttcttgccgtaa

SEQ ID NO: 98348 - DNA, 25 bp, Rattus norvegicus
actgtagtacaggttcttgccgtaa

SEQ ID NO: 98349 - DNA, 25 bp, Rattus norvegicus
actgtagtgctgcattttacattta

SEQ ID NO: 98350 - DNA, 25 bp, Rattus norvegicus
actgtagtgctggattttacattta

SEQ ID NO: 98351 - DNA, 25 bp, Rattus norvegicus
actgtagtgtgtcccaggctgagta

SEQ ID NO: 98352 - DNA, 25 bp, Rattus norvegicus
actgtagtgtgtgccaggctgagta

SEQ ID NO: 98353 - DNA, 25 bp, Rattus norvegicus
actgtagtgttgaatctgtgtcctg

SEQ ID NO: 98354 - DNA, 25 bp, Rattus norvegicus
actgtagtgttgtatctgtgtcctg

SEQ ID NO: 98355 - DNA, 25 bp, Rattus norvegicus
actgtagtttgcaaaatgggttcta

SEQ ID NO: 98356 - DNA, 25 bp, Rattus norvegicus
actgtagtttgctaaatgggttcta

SEQ ID NO: 98357 - DNA, 25 bp, Rattus norvegicus
actgtagtttgtcttgtgtcctttt

SEQ ID NO: 98358 - DNA, 25 bp, Rattus norvegicus
actgtagtttgtgttgtgtcctttt

SEQ ID NO: 98359 - DNA, 25 bp, Rattus norvegicus
actgtataaacacacacgggcatct

SEQ ID NO: 98360 - DNA, 25 bp, Rattus norvegicus
actgtataaacagacacgggcatct

SEQ ID NO: 98361 - DNA, 25 bp, Rattus norvegicus
actgtataagctagtgaacctgagg

SEQ ID NO: 98362 - DNA, 25 bp, Rattus norvegicus
actgtataagcttgtgaacctgagg

SEQ ID NO: 98363 - DNA, 25 bp, Rattus norvegicus
actgtataatttccatatgtgtatc

SEQ ID NO: 98364 - DNA, 25 bp, Rattus norvegicus
actgtataatttgcatatgtgtatc

SEQ ID NO: 98365 - DNA, 25 bp, Rattus norvegicus
actgtatatagcctgaatccaaaga

SEQ ID NO: 98366 - DNA, 25 bp, Rattus norvegicus
actgtatatagcgtgaatccaaaga

SEQ ID NO: 98367 - DNA, 25 bp, Rattus norvegicus
actgtatattcacctttccttctta

SEQ ID NO: 98368 - DNA, 25 bp, Rattus norvegicus
actgtatattcagctttccttctta

SEQ ID NO: 98369 - DNA, 25 bp, Rattus norvegicus
actgtatctattatgtgctctccat

SEQ ID NO: 98370 - DNA, 25 bp, Rattus norvegicus
actgtatctattattaattcatctg

SEQ ID NO: 98371 - DNA, 25 bp, Rattus norvegicus
actgtatctattttgtgctctccat

SEQ ID NO: 98372 - DNA, 25 bp, Rattus norvegicus
actgtatctatttttaattcatctg

SEQ ID NO: 98373 - DNA, 25 bp, Rattus norvegicus
actgtatcttgtctgttctgttcat

SEQ ID NO: 98374 - DNA, 25 bp, Rattus norvegicus
actgtatcttgtgtgttctgttcat

SEQ ID NO: 98375 - DNA, 25 bp, Rattus norvegicus
actgtatgcatgaggctgggctggg

SEQ ID NO: 98376 - DNA, 25 bp, Rattus norvegicus
actgtatgcatgtggctgggctggg

SEQ ID NO: 98377 - DNA, 25 bp, Rattus norvegicus
actgtatgcattccttagacctttc

SEQ ID NO: 98378 - DNA, 25 bp, Rattus norvegicus
actgtatgcattgcttagacctttc

SEQ ID NO: 98379 - DNA, 25 bp, Rattus norvegicus
actgtatggagtcagtgctttggat

SEQ ID NO: 98380 - DNA, 25 bp, Rattus norvegicus
actgtatggagtgagtgctttggat

SEQ ID NO: 98381 - DNA, 25 bp, Rattus norvegicus
actgtatggccacttgctgcagcta

SEQ ID NO: 98382 - DNA, 25 bp, Rattus norvegicus
actgtatggccagttgctgcagcta

SEQ ID NO: 98383 - DNA, 25 bp, Rattus norvegicus
actgtatgggtgactttttccagaa

SEQ ID NO: 98384 - DNA, 25 bp, Rattus norvegicus
actgtatgggtgtctttttccagaa

SEQ ID NO: 98385 - DNA, 25 bp, Rattus norvegicus
actgtatggtcacgccacgtcacta

SEQ ID NO: 98386 - DNA, 25 bp, Rattus norvegicus
actgtatggtcaggccacgtcacta

SEQ ID NO: 98387 - DNA, 25 bp, Rattus norvegicus
actgtatgtactcttgctgtcggtc

SEQ ID NO: 98388 - DNA, 25 bp, Rattus norvegicus
actgtatgtactgttgctgtcggtc

SEQ ID NO: 98389 - DNA, 25 bp, Rattus norvegicus
actgtatgtaggctcctgtggccaa

SEQ ID NO: 98390 - DNA, 25 bp, Rattus norvegicus
actgtatgtagggtcctgtggccaa

SEQ ID NO: 98391 - DNA, 25 bp, Rattus norvegicus
actgtattaggactccgcggtgtgc

SEQ ID NO: 98392 - DNA, 25 bp, Rattus norvegicus
actgtattaggagtccgcggtgtgc

SEQ ID NO: 98393 - DNA, 25 bp, Rattus norvegicus
actgtattctgcaatgccatcaggc

SEQ ID NO: 98394 - DNA, 25 bp, Rattus norvegicus
actgtattctgctatgccatcaggc

SEQ ID NO: 98395 - DNA, 25 bp, Rattus norvegicus
actgtattcttgagtcattgttagg

SEQ ID NO: 98396 - DNA, 25 bp, Rattus norvegicus
actgtattcttgtgtcattgttagg

SEQ ID NO: 98397 - DNA, 25 bp, Rattus norvegicus
actgtattgccgctatctgctgaat

SEQ ID NO: 98398 - DNA, 25 bp, Rattus norvegicus
actgtattgccggtatctgctgaat

SEQ ID NO: 98399 - DNA, 25 bp, Rattus norvegicus
actgtattgcctccgtttcatgtaa

SEQ ID NO: 98400 - DNA, 25 bp, Rattus norvegicus
actgtattgcctgcgtttcatgtaa

SEQ ID NO: 98401 - DNA, 25 bp, Rattus norvegicus
actgtatttcagatgcagcctattt

SEQ ID NO: 98402 - DNA, 25 bp, Rattus norvegicus
actgtatttcagttgcagcctattt

SEQ ID NO: 98403 - DNA, 25 bp, Rattus norvegicus
actgtatttctgaaactctgagcat

SEQ ID NO: 98404 - DNA, 25 bp, Rattus norvegicus
actgtatttctgtaactctgagcat

SEQ ID NO: 98405 - DNA, 25 bp, Rattus norvegicus
actgtcaactatccctttgcctagt

SEQ ID NO: 98406 - DNA, 25 bp, Rattus norvegicus
actgtcaactatgcctttgcctagt

SEQ ID NO: 98407 - DNA, 25 bp, Rattus norvegicus
actgtcaactctatcatgagctgga

SEQ ID NO: 98408 - DNA, 25 bp, Rattus norvegicus
actgtcaactctttcatgagctgga

SEQ ID NO: 98409 - DNA, 25 bp, Rattus norvegicus
actgtcaagataacagcttcctggc

SEQ ID NO: 98410 - DNA, 25 bp, Rattus norvegicus
actgtcaagatatcagcttcctggc

SEQ ID NO: 98411 - DNA, 25 bp, Rattus norvegicus
actgtcaaggtactgtgcctagcct

SEQ ID NO: 98412 - DNA, 25 bp, Rattus norvegicus
actgtcaaggtagtgtgcctagcct

SEQ ID NO: 98413 - DNA, 25 bp, Rattus norvegicus
actgtcaattccactttcagctttc

SEQ ID NO: 98414 - DNA, 25 bp, Rattus norvegicus
actgtcaattcctctttcagctttc

SEQ ID NO: 98415 - DNA, 25 bp, Rattus norvegicus
actgtcacaaagcacccacgaaaaa

SEQ ID NO: 98416 - DNA, 25 bp, Rattus norvegicus
actgtcacaaaggacccacgaaaaa

SEQ ID NO: 98417 - DNA, 25 bp, Rattus norvegicus
actgtcacatttacttaggaaggat

SEQ ID NO: 98418 - DNA, 25 bp, Rattus norvegicus
actgtcacattttcttaggaaggat

SEQ ID NO: 98419 - DNA, 25 bp, Rattus norvegicus
actgtcacctagacatttcctcttt

SEQ ID NO: 98420 - DNA, 25 bp, Rattus norvegicus
actgtcacctagtcatttcctcttt

SEQ ID NO: 98421 - DNA, 25 bp, Rattus norvegicus
actgtcacgttgctggaggcctctg

SEQ ID NO: 98422 - DNA, 25 bp, Rattus norvegicus
actgtcacgttggtggaggcctctg

SEQ ID NO: 98423 - DNA, 25 bp, Rattus norvegicus
actgtcactaacactcggtgtgtct

SEQ ID NO: 98424 - DNA, 25 bp, Rattus norvegicus
actgtcactaactctcggtgtgtct

SEQ ID NO: 98425 - DNA, 25 bp, Rattus norvegicus
actgtcactgtgatgctggcttctc

SEQ ID NO: 98426 - DNA, 25 bp, Rattus norvegicus
actgtcactgtgttgctggcttctc

SEQ ID NO: 98427 - DNA, 25 bp, Rattus norvegicus
actgtcacttgtcaatagcttctcc

SEQ ID NO: 98428 - DNA, 25 bp, Rattus norvegicus
actgtcacttgtgaatagcttctcc

SEQ ID NO: 98429 - DNA, 25 bp, Rattus norvegicus
actgtcagatgtaatgccggagccc

SEQ ID NO: 98430 - DNA, 25 bp, Rattus norvegicus
actgtcagatgttatgccggagccc

SEQ ID NO: 98431 - DNA, 25 bp, Rattus norvegicus
actgtcaggacacgccacatgcatg

SEQ ID NO: 98432 - DNA, 25 bp, Rattus norvegicus
actgtcaggacaggccacatgcatg

SEQ ID NO: 98433 - DNA, 25 bp, Rattus norvegicus
actgtcaggtgcacaagtggaatct

SEQ ID NO: 98434 - DNA, 25 bp, Rattus norvegicus
actgtcaggtgctcaagtggaatct

SEQ ID NO: 98435 - DNA, 25 bp, Rattus norvegicus
actgtcagtgacactagttttaggg

SEQ ID NO: 98436 - DNA, 25 bp, Rattus norvegicus
actgtcagtgactctagttttaggg

SEQ ID NO: 98437 - DNA, 25 bp, Rattus norvegicus
actgtcagtgccaagagtggtgccc

SEQ ID NO: 98438 - DNA, 25 bp, Rattus norvegicus
actgtcagtgccagtgcctgtgaag

SEQ ID NO: 98439 - DNA, 25 bp, Rattus norvegicus
actgtcagtgcctagagtggtgccc

SEQ ID NO: 98440 - DNA, 25 bp, Rattus norvegicus
actgtcagtgcctgtgcctgtgaag

SEQ ID NO: 98441 - DNA, 25 bp, Rattus norvegicus
actgtcagtgtgaatgcagggcctt

SEQ ID NO: 98442 - DNA, 25 bp, Rattus norvegicus
actgtcagtgtgtatgcagggcctt

SEQ ID NO: 98443 - DNA, 25 bp, Rattus norvegicus
actgtcatagttagcagcccttata

SEQ ID NO: 98444 - DNA, 25 bp, Rattus norvegicus
actgtcatagtttgcagcccttata

SEQ ID NO: 98445 - DNA, 25 bp, Rattus norvegicus
actgtcatcatgaacccacttagaa

SEQ ID NO: 98446 - DNA, 25 bp, Rattus norvegicus
actgtcatcatgtacccacttagaa

SEQ ID NO: 98447 - DNA, 25 bp, Rattus norvegicus
actgtcatcccaagtgccattctga

SEQ ID NO: 98448 - DNA, 25 bp, Rattus norvegicus
actgtcatcccatgtgccattctga

SEQ ID NO: 98449 - DNA, 25 bp, Rattus norvegicus
actgtcatctgaaaaccccttttgg

SEQ ID NO: 98450 - DNA, 25 bp, Rattus norvegicus
actgtcatctgataaccccttttgg

SEQ ID NO: 98451 - DNA, 25 bp, Rattus norvegicus
actgtcatgactccaggcctgtggg

SEQ ID NO: 98452 - DNA, 25 bp, Rattus norvegicus
actgtcatgactgcaggcctgtggg

SEQ ID NO: 98453 - DNA, 25 bp, Rattus norvegicus
actgtcatgcttatggtggtgtgtg

SEQ ID NO: 98454 - DNA, 25 bp, Rattus norvegicus
actgtcatgcttttggtggtgtgtg

SEQ ID NO: 98455 - DNA, 25 bp, Rattus norvegicus
actgtcatgtgcctacccagtaagg

SEQ ID NO: 98456 - DNA, 25 bp, Rattus norvegicus
actgtcatgtgcgtacccagtaagg

SEQ ID NO: 98457 - DNA, 25 bp, Rattus norvegicus
actgtcattgtgacctaacttttca

SEQ ID NO: 98458 - DNA, 25 bp, Rattus norvegicus
actgtcattgtgtcctaacttttca

SEQ ID NO: 98459 - DNA, 25 bp, Rattus norvegicus
actgtcatttcaattctatctctta

SEQ ID NO: 98460 - DNA, 25 bp, Rattus norvegicus
actgtcatttcatttctatctctta

SEQ ID NO: 98461 - DNA, 25 bp, Rattus norvegicus
actgtcatttctcccgtgggtacca

SEQ ID NO: 98462 - DNA, 25 bp, Rattus norvegicus
actgtcatttctgccgtgggtacca

SEQ ID NO: 98463 - DNA, 25 bp, Rattus norvegicus
actgtcattttgatgctgcgaagca

SEQ ID NO: 98464 - DNA, 25 bp, Rattus norvegicus
actgtcattttgttgctgcgaagca

SEQ ID NO: 98465 - DNA, 25 bp, Rattus norvegicus
actgtccaccaaactaatccaggga

SEQ ID NO: 98466 - DNA, 25 bp, Rattus norvegicus
actgtccaccaatctaatccaggga

SEQ ID NO: 98467 - DNA, 25 bp, Rattus norvegicus
actgtccacctgaaatactgtgccg

SEQ ID NO: 98468 - DNA, 25 bp, Rattus norvegicus
actgtccacctgtaatactgtgccg

SEQ ID NO: 98469 - DNA, 25 bp, Rattus norvegicus
actgtccagacgagcccaagtatag

SEQ ID NO: 98470 - DNA, 25 bp, Rattus norvegicus
actgtccagacgtgcccaagtatag

SEQ ID NO: 98471 - DNA, 25 bp, Rattus norvegicus
actgtccagagaaaggtctgcccct

SEQ ID NO: 98472 - DNA, 25 bp, Rattus norvegicus
actgtccagagataggtctgcccct

SEQ ID NO: 98473 - DNA, 25 bp, Rattus norvegicus
actgtccagcaactgacccgtgact

SEQ ID NO: 98474 - DNA, 25 bp, Rattus norvegicus
actgtccagcaagtgacccgtgact

SEQ ID NO: 98475 - DNA, 25 bp, Rattus norvegicus
actgtccagctgagaaaccaatcat

SEQ ID NO: 98476 - DNA, 25 bp, Rattus norvegicus
actgtccagctgtgaaaccaatcat

SEQ ID NO: 98477 - DNA, 25 bp, Rattus norvegicus
actgtccaggagctgtttctgtgat

SEQ ID NO: 98478 - DNA, 25 bp, Rattus norvegicus
actgtccaggaggtgtttctgtgat

SEQ ID NO: 98479 - DNA, 25 bp, Rattus norvegicus
actgtccaggatatgctgttgtgca

SEQ ID NO: 98480 - DNA, 25 bp, Rattus norvegicus
actgtccaggatttgctgttgtgca

SEQ ID NO: 98481 - DNA, 25 bp, Rattus norvegicus
actgtccatcagagagcatgtacga

SEQ ID NO: 98482 - DNA, 25 bp, Rattus norvegicus
actgtccatcagctgggccagagga

SEQ ID NO: 98483 - DNA, 25 bp, Rattus norvegicus
actgtccatcaggtgggccagagga

SEQ ID NO: 98484 - DNA, 25 bp, Rattus norvegicus
actgtccatcagtgagcatgtacga

SEQ ID NO: 98485 - DNA, 25 bp, Rattus norvegicus
actgtccatctcaggaacctataac

SEQ ID NO: 98486 - DNA, 25 bp, Rattus norvegicus
actgtccatctctggaacctataac

SEQ ID NO: 98487 - DNA, 25 bp, Rattus norvegicus
actgtccatgctactcgaattaaag

SEQ ID NO: 98488 - DNA, 25 bp, Rattus norvegicus
actgtccatgcttctcgaattaaag

SEQ ID NO: 98489 - DNA, 25 bp, Rattus norvegicus
actgtcccaatgaaagatgccacca

SEQ ID NO: 98490 - DNA, 25 bp, Rattus norvegicus
actgtcccaatgtaagatgccacca

SEQ ID NO: 98491 - DNA, 25 bp, Rattus norvegicus
actgtcccatgtattactaatattg

SEQ ID NO: 98492 - DNA, 25 bp, Rattus norvegicus
actgtcccatgttttactaatattg

SEQ ID NO: 98493 - DNA, 25 bp, Rattus norvegicus
actgtccccaaacaactgagcaact

SEQ ID NO: 98494 - DNA, 25 bp, Rattus norvegicus
actgtccccaaagaactgagcaact

SEQ ID NO: 98495 - DNA, 25 bp, Rattus norvegicus
actgtccccaacacttgttgatgta

SEQ ID NO: 98496 - DNA, 25 bp, Rattus norvegicus
actgtccccaactcttgttgatgta

SEQ ID NO: 98497 - DNA, 25 bp, Rattus norvegicus
actgtccccactcaaatatcgaaaa

SEQ ID NO: 98498 - DNA, 25 bp, Rattus norvegicus
actgtccccactgaaatatcgaaaa

SEQ ID NO: 98499 - DNA, 25 bp, Rattus norvegicus
actgtcccctacattgcagaaggct

SEQ ID NO: 98500 - DNA, 25 bp, Rattus norvegicus
actgtcccctactttgcagaaggct

SEQ ID NO: 98501 - DNA, 25 bp, Rattus norvegicus
actgtccctgaacgctggtatccga

SEQ ID NO: 98502 - DNA, 25 bp, Rattus norvegicus
actgtccctgaaggctggtatccga

SEQ ID NO: 98503 - DNA, 25 bp, Rattus norvegicus
actgtccctggtctacgtgctgtaa

SEQ ID NO: 98504 - DNA, 25 bp, Rattus norvegicus
actgtccctggtgtacgtgctgtaa

SEQ ID NO: 98505 - DNA, 25 bp, Rattus norvegicus
actgtccctgtgattgacctgctga

SEQ ID NO: 98506 - DNA, 25 bp, Rattus norvegicus
actgtccctgtgtttgacctgctga

SEQ ID NO: 98507 - DNA, 25 bp, Rattus norvegicus
actgtcccttcaacctggcaagagg

SEQ ID NO: 98508 - DNA, 25 bp, Rattus norvegicus
actgtcccttcatcctggcaagagg

SEQ ID NO: 98509 - DNA, 25 bp, Rattus norvegicus
actgtcccttttcctcggtatctag

SEQ ID NO: 98510 - DNA, 25 bp, Rattus norvegicus
actgtcccttttgctcggtatctag

SEQ ID NO: 98511 - DNA, 25 bp, Rattus norvegicus
actgtccgtgacacattgtctacag

SEQ ID NO: 98512 - DNA, 25 bp, Rattus norvegicus
actgtccgtgactcattgtctacag

SEQ ID NO: 98513 - DNA, 25 bp, Rattus norvegicus
actgtcctatctatttatatgtttg

SEQ ID NO: 98514 - DNA, 25 bp, Rattus norvegicus
actgtcctatctttttatatgtttg

SEQ ID NO: 98515 - DNA, 25 bp, Rattus norvegicus
actgtcctccaacagtcatttcgtg

SEQ ID NO: 98516 - DNA, 25 bp, Rattus norvegicus
actgtcctccaagagtcatttcgtg

SEQ ID NO: 98517 - DNA, 25 bp, Rattus norvegicus
actgtcctcccaaaagcacaaagca

SEQ ID NO: 98518 - DNA, 25 bp, Rattus norvegicus
actgtcctcccataagcacaaagca

SEQ ID NO: 98519 - DNA, 25 bp, Rattus norvegicus
actgtcctctgtctggtcaaagcca

SEQ ID NO: 98520 - DNA, 25 bp, Rattus norvegicus
actgtcctctgtgtggtcaaagcca

SEQ ID NO: 98521 - DNA, 25 bp, Rattus norvegicus
actgtcctgacacctggtagcaaaa

SEQ ID NO: 98522 - DNA, 25 bp, Rattus norvegicus
actgtcctgacagctggtagcaaaa

SEQ ID NO: 98523 - DNA, 25 bp, Rattus norvegicus
actgtcctgaccctgtactggaaaa

SEQ ID NO: 98524 - DNA, 25 bp, Rattus norvegicus
actgtcctgaccgtgtactggaaaa

SEQ ID NO: 98525 - DNA, 25 bp, Rattus norvegicus
actgtcctgataaagtaacttctgc

SEQ ID NO: 98526 - DNA, 25 bp, Rattus norvegicus
actgtcctgatatagtaacttctgc

SEQ ID NO: 98527 - DNA, 25 bp, Rattus norvegicus
actgtcctgattccaggacgatgca

SEQ ID NO: 98528 - DNA, 25 bp, Rattus norvegicus
actgtcctgattgcaggacgatgca

SEQ ID NO: 98529 - DNA, 25 bp, Rattus norvegicus
actgtcctgcaccatgactggaaga

SEQ ID NO: 98530 - DNA, 25 bp, Rattus norvegicus
actgtcctgcacgatgactggaaga

SEQ ID NO: 98531 - DNA, 25 bp, Rattus norvegicus
actgtcctggcactaccagggtacc

SEQ ID NO: 98532 - DNA, 25 bp, Rattus norvegicus
actgtcctggcagtaccagggtacc

SEQ ID NO: 98533 - DNA, 25 bp, Rattus norvegicus
actgtcctggtgatttctgatgtaa

SEQ ID NO: 98534 - DNA, 25 bp, Rattus norvegicus
actgtcctggtgttttctgatgtaa

SEQ ID NO: 98535 - DNA, 25 bp, Rattus norvegicus
actgtcctgtgtatgactacgtgcc

SEQ ID NO: 98536 - DNA, 25 bp, Rattus norvegicus
actgtcctgtgtttgactacgtgcc

SEQ ID NO: 98537 - DNA, 25 bp, Rattus norvegicus
actgtccttagccagcaggttttat

SEQ ID NO: 98538 - DNA, 25 bp, Rattus norvegicus
actgtccttagcgagcaggttttat

SEQ ID NO: 98539 - DNA, 25 bp, Rattus norvegicus
actgtccttcctaggtacatgggca

SEQ ID NO: 98540 - DNA, 25 bp, Rattus norvegicus
actgtccttccttggtacatgggca

SEQ ID NO: 98541 - DNA, 25 bp, Rattus norvegicus
actgtccttctcactaaaaacccag

SEQ ID NO: 98542 - DNA, 25 bp, Rattus norvegicus
actgtccttctcctgtaagaacttt

SEQ ID NO: 98543 - DNA, 25 bp, Rattus norvegicus
actgtccttctcgtgtaagaacttt

SEQ ID NO: 98544 - DNA, 25 bp, Rattus norvegicus
actgtccttctctctaaaaacccag

SEQ ID NO: 98545 - DNA, 25 bp, Rattus norvegicus
actgtccttggaagccaatgtcctt

SEQ ID NO: 98546 - DNA, 25 bp, Rattus norvegicus
actgtccttggatgccaatgtcctt

SEQ ID NO: 98547 - DNA, 25 bp, Rattus norvegicus
actgtccttgttatgtttatccttg

SEQ ID NO: 98548 - DNA, 25 bp, Rattus norvegicus
actgtccttgttttgtttatccttg

SEQ ID NO: 98549 - DNA, 25 bp, Rattus norvegicus
actgtcctttgaactgtttaactct

SEQ ID NO: 98550 - DNA, 25 bp, Rattus norvegicus
actgtcctttgatctgtttaactct

SEQ ID NO: 98551 - DNA, 25 bp, Rattus norvegicus
actgtcctttgccaggatgcaatgg

SEQ ID NO: 98552 - DNA, 25 bp, Rattus norvegicus
actgtcctttgcgaggatgcaatgg

SEQ ID NO: 98553 - DNA, 25 bp, Rattus norvegicus
actgtcgaggtcatcttctgtgtct

SEQ ID NO: 98554 - DNA, 25 bp, Rattus norvegicus
actgtcgaggtcttcttctgtgtct

SEQ ID NO: 98555 - DNA, 25 bp, Rattus norvegicus
actgtcgctgtcagtgttacagatc

SEQ ID NO: 98556 - DNA, 25 bp, Rattus norvegicus
actgtcgctgtctgtgttacagatc

SEQ ID NO: 98557 - DNA, 25 bp, Rattus norvegicus
actgtcgcttggaattccgtgttaa

SEQ ID NO: 98558 - DNA, 25 bp, Rattus norvegicus
actgtcgcttggtattccgtgttaa

SEQ ID NO: 98559 - DNA, 25 bp, Rattus norvegicus
actgtcggacgcacatttagcttag

SEQ ID NO: 98560 - DNA, 25 bp, Rattus norvegicus
actgtcggacgctcatttagcttag

SEQ ID NO: 98561 - DNA, 25 bp, Rattus norvegicus
actgtcgggtttacctgggccagag

SEQ ID NO: 98562 - DNA, 25 bp, Rattus norvegicus
actgtcgggttttcctgggccagag

SEQ ID NO: 98563 - DNA, 25 bp, Rattus norvegicus
actgtcgtatggacctttacttctt

SEQ ID NO: 98564 - DNA, 25 bp, Rattus norvegicus
actgtcgtatggtcctttacttctt

SEQ ID NO: 98565 - DNA, 25 bp, Rattus norvegicus
actgtcgtcggccacgaggactctt

SEQ ID NO: 98566 - DNA, 25 bp, Rattus norvegicus
actgtcgtcggcgacgaggactctt

SEQ ID NO: 98567 - DNA, 25 bp, Rattus norvegicus
actgtctacaggagcgttcatttca

SEQ ID NO: 98568 - DNA, 25 bp, Rattus norvegicus
actgtctacaggtgcgttcatttca

SEQ ID NO: 98569 - DNA, 25 bp, Rattus norvegicus
actgtctaccacaaagcgattttca

SEQ ID NO: 98570 - DNA, 25 bp, Rattus norvegicus
actgtctaccactaagcgattttca

SEQ ID NO: 98571 - DNA, 25 bp, Rattus norvegicus
actgtctagctcatctgtgtttgaa

SEQ ID NO: 98572 - DNA, 25 bp, Rattus norvegicus
actgtctagctcttctgtgtttgaa

SEQ ID NO: 98573 - DNA, 25 bp, Rattus norvegicus
actgtctataacacaaagatctgac

SEQ ID NO: 98574 - DNA, 25 bp, Rattus norvegicus
actgtctataactcaaagatctgac

SEQ ID NO: 98575 - DNA, 25 bp, Rattus norvegicus
actgtctatagccatacgcctgatg

SEQ ID NO: 98576 - DNA, 25 bp, Rattus norvegicus
actgtctatagcgatacgcctgatg

SEQ ID NO: 98577 - DNA, 25 bp, Rattus norvegicus
actgtctcaactctgtgctctaact

SEQ ID NO: 98578 - DNA, 25 bp, Rattus norvegicus
actgtctcaactgtgtgctctaact

SEQ ID NO: 98579 - DNA, 25 bp, Rattus norvegicus
actgtctcaatgactccaccaatct

SEQ ID NO: 98580 - DNA, 25 bp, Rattus norvegicus
actgtctcaatgtctccaccaatct

SEQ ID NO: 98581 - DNA, 25 bp, Rattus norvegicus
actgtctcacggagcaactgtccca

SEQ ID NO: 98582 - DNA, 25 bp, Rattus norvegicus
actgtctcacggtgcaactgtccca

SEQ ID NO: 98583 - DNA, 25 bp, Rattus norvegicus
actgtctcagcccaatgggttggca

SEQ ID NO: 98584 - DNA, 25 bp, Rattus norvegicus
actgtctcagccgaatgggttggca

SEQ ID NO: 98585 - DNA, 25 bp, Rattus norvegicus
actgtctcaggcctcaagccaggca

SEQ ID NO: 98586 - DNA, 25 bp, Rattus norvegicus
actgtctcaggcgtcaagccaggca

SEQ ID NO: 98587 - DNA, 25 bp, Rattus norvegicus
actgtctccaggctatcgcacaagg

SEQ ID NO: 98588 - DNA, 25 bp, Rattus norvegicus
actgtctccagggtatcgcacaagg

SEQ ID NO: 98589 - DNA, 25 bp, Rattus norvegicus
actgtctccatcaccacagagagtg

SEQ ID NO: 98590 - DNA, 25 bp, Rattus norvegicus
actgtctccatctccacagagagtg

SEQ ID NO: 98591 - DNA, 25 bp, Rattus norvegicus
actgtctcccatcttctttgggtca

SEQ ID NO: 98592 - DNA, 25 bp, Rattus norvegicus
actgtctcccatgttctttgggtca

SEQ ID NO: 98593 - DNA, 25 bp, Rattus norvegicus
actgtctcccgaaataaagcctcat

SEQ ID NO: 98594 - DNA, 25 bp, Rattus norvegicus
actgtctcccgatataaagcctcat

SEQ ID NO: 98595 - DNA, 25 bp, Rattus norvegicus
actgtctcccttaagctagagtcaa

SEQ ID NO: 98596 - DNA, 25 bp, Rattus norvegicus
actgtctccctttagctagagtcaa

SEQ ID NO: 98597 - DNA, 25 bp, Rattus norvegicus
actgtctcctcactttaagtaaact

SEQ ID NO: 98598 - DNA, 25 bp, Rattus norvegicus
actgtctcctcagtttaagtaaact

SEQ ID NO: 98599 - DNA, 25 bp, Rattus norvegicus
actgtctccttacgtgtcaaaccaa

SEQ ID NO: 98600 - DNA, 25 bp, Rattus norvegicus
actgtctccttaggtgtcaaaccaa

SEQ ID NO: 98601 - DNA, 25 bp, Rattus norvegicus
actgtctcgttgacccgggccacga

SEQ ID NO: 98602 - DNA, 25 bp, Rattus norvegicus
actgtctcgttgtcccgggccacga

SEQ ID NO: 98603 - DNA, 25 bp, Rattus norvegicus
actgtctctaacctcatatgctggc

SEQ ID NO: 98604 - DNA, 25 bp, Rattus norvegicus
actgtctctaacgtcatatgctggc

SEQ ID NO: 98605 - DNA, 25 bp, Rattus norvegicus
actgtctctaatatgtgttcttgca

SEQ ID NO: 98606 - DNA, 25 bp, Rattus norvegicus
actgtctctaatttgtgttcttgca

SEQ ID NO: 98607 - DNA, 25 bp, Rattus norvegicus
actgtctctcaccagtggatggttt

SEQ ID NO: 98608 - DNA, 25 bp, Rattus norvegicus
actgtctctcacgagtggatggttt

SEQ ID NO: 98609 - DNA, 25 bp, Rattus norvegicus
actgtctctcagataaagctaagta

SEQ ID NO: 98610 - DNA, 25 bp, Rattus norvegicus
actgtctctcagatcggagtttgta

SEQ ID NO: 98611 - DNA, 25 bp, Rattus norvegicus
actgtctctcagttaaagctaagta

SEQ ID NO: 98612 - DNA, 25 bp, Rattus norvegicus
actgtctctcagttcggagtttgta

SEQ ID NO: 98613 - DNA, 25 bp, Rattus norvegicus
actgtctctgagcatgtggagttaa

SEQ ID NO: 98614 - DNA, 25 bp, Rattus norvegicus
actgtctctgaggatgtggagttaa

SEQ ID NO: 98615 - DNA, 25 bp, Rattus norvegicus
actgtctctgctaagattttttgta

SEQ ID NO: 98616 - DNA, 25 bp, Rattus norvegicus
actgtctctgcttagattttttgta

SEQ ID NO: 98617 - DNA, 25 bp, Rattus norvegicus
actgtctcttcgaactgagggctaa

SEQ ID NO: 98618 - DNA, 25 bp, Rattus norvegicus
actgtctcttcgtactgagggctaa

SEQ ID NO: 98619 - DNA, 25 bp, Rattus norvegicus
actgtctcttgaataatcccatttg

SEQ ID NO: 98620 - DNA, 25 bp, Rattus norvegicus
actgtctcttgattaatcccatttg

SEQ ID NO: 98621 - DNA, 25 bp, Rattus norvegicus
actgtctgaggaaaacctgagccaa

SEQ ID NO: 98622 - DNA, 25 bp, Rattus norvegicus
actgtctgaggaacctgccatttga

SEQ ID NO: 98623 - DNA, 25 bp, Rattus norvegicus
actgtctgaggataacctgagccaa

SEQ ID NO: 98624 - DNA, 25 bp, Rattus norvegicus
actgtctgaggatcctgccatttga

SEQ ID NO: 98625 - DNA, 25 bp, Rattus norvegicus
actgtctgccgtctcaaacttgtgt

SEQ ID NO: 98626 - DNA, 25 bp, Rattus norvegicus
actgtctgccgtgtcaaacttgtgt

SEQ ID NO: 98627 - DNA, 25 bp, Rattus norvegicus
actgtctgccttcatctcgagggat

SEQ ID NO: 98628 - DNA, 25 bp, Rattus norvegicus
actgtctgccttgatctcgagggat

SEQ ID NO: 98629 - DNA, 25 bp, Rattus norvegicus
actgtctgctctccatttctgtgca

SEQ ID NO: 98630 - DNA, 25 bp, Rattus norvegicus
actgtctgctctgcatttctgtgca

SEQ ID NO: 98631 - DNA, 25 bp, Rattus norvegicus
actgtctggattaatcgtgtggtga

SEQ ID NO: 98632 - DNA, 25 bp, Rattus norvegicus
actgtctggatttatcgtgtggtga

SEQ ID NO: 98633 - DNA, 25 bp, Rattus norvegicus
actgtctggcacaagatttccttta

SEQ ID NO: 98634 - DNA, 25 bp, Rattus norvegicus
actgtctggcactagatttccttta

SEQ ID NO: 98635 - DNA, 25 bp, Rattus norvegicus
actgtctggccaagcagttctacca

SEQ ID NO: 98636 - DNA, 25 bp, Rattus norvegicus
actgtctggccatgcagttctacca

SEQ ID NO: 98637 - DNA, 25 bp, Rattus norvegicus
actgtctgggccaggcgatggacat

SEQ ID NO: 98638 - DNA, 25 bp, Rattus norvegicus
actgtctgggcctggcgatggacat

SEQ ID NO: 98639 - DNA, 25 bp, Rattus norvegicus
actgtctgtaacacctaattctggg

SEQ ID NO: 98640 - DNA, 25 bp, Rattus norvegicus
actgtctgtaactcctaattctggg

SEQ ID NO: 98641 - DNA, 25 bp, Rattus norvegicus
actgtctgtagtcacatctgatgcc

SEQ ID NO: 98642 - DNA, 25 bp, Rattus norvegicus
actgtctgtagtgacatctgatgcc

SEQ ID NO: 98643 - DNA, 25 bp, Rattus norvegicus
actgtctgtgtacttgtgctttaaa

SEQ ID NO: 98644 - DNA, 25 bp, Rattus norvegicus
actgtctgtgtagttgtgctttaaa

SEQ ID NO: 98645 - DNA, 25 bp, Rattus norvegicus
actgtcttcccactgactgaagagc

SEQ ID NO: 98646 - DNA, 25 bp, Rattus norvegicus
actgtcttcccagtgactgaagagc

SEQ ID NO: 98647 - DNA, 25 bp, Rattus norvegicus
actgtcttcccgactgtgcataagt

SEQ ID NO: 98648 - DNA, 25 bp, Rattus norvegicus
actgtcttcccgtctgtgcataagt

SEQ ID NO: 98649 - DNA, 25 bp, Rattus norvegicus
actgtcttcctgagactccatttac

SEQ ID NO: 98650 - DNA, 25 bp, Rattus norvegicus
actgtcttcctgtgactccatttac

SEQ ID NO: 98651 - DNA, 25 bp, Rattus norvegicus
actgtcttcttgacctccaagtttg

SEQ ID NO: 98652 - DNA, 25 bp, Rattus norvegicus
actgtcttcttgtcctccaagtttg

SEQ ID NO: 98653 - DNA, 25 bp, Rattus norvegicus
actgtcttgagacggtttacataga

SEQ ID NO: 98654 - DNA, 25 bp, Rattus norvegicus
actgtcttgagagggtttacataga

SEQ ID NO: 98655 - DNA, 25 bp, Rattus norvegicus
actgtcttgagtccatgttatcttg

SEQ ID NO: 98656 - DNA, 25 bp, Rattus norvegicus
actgtcttgagtgcatgttatcttg

SEQ ID NO: 98657 - DNA, 25 bp, Rattus norvegicus
actgtcttggcgctatttgtcatct

SEQ ID NO: 98658 - DNA, 25 bp, Rattus norvegicus
actgtcttggcggtatttgtcatct

SEQ ID NO: 98659 - DNA, 25 bp, Rattus norvegicus
actgtcttgggtagggtggctccac

SEQ ID NO: 98660 - DNA, 25 bp, Rattus norvegicus
actgtcttgggttgggtggctccac

SEQ ID NO: 98661 - DNA, 25 bp, Rattus norvegicus
actgtctttctcatgccggagggca

SEQ ID NO: 98662 - DNA, 25 bp, Rattus norvegicus
actgtctttctcttgccggagggca

SEQ ID NO: 98663 - DNA, 25 bp, Rattus norvegicus
actgtctttgccacattgtttgtta

SEQ ID NO: 98664 - DNA, 25 bp, Rattus norvegicus
actgtctttgcctcattgtttgtta

SEQ ID NO: 98665 - DNA, 25 bp, Rattus norvegicus
actgtctttggaccggttgacttca

SEQ ID NO: 98666 - DNA, 25 bp, Rattus norvegicus
actgtctttggagcggttgacttca

SEQ ID NO: 98667 - DNA, 25 bp, Rattus norvegicus
actgtctttgttagatctgagcccc

SEQ ID NO: 98668 - DNA, 25 bp, Rattus norvegicus
actgtctttgtttgatctgagcccc

SEQ ID NO: 98669 - DNA, 25 bp, Rattus norvegicus
actgtgaaaattctccatcatcccc

SEQ ID NO: 98670 - DNA, 25 bp, Rattus norvegicus
actgtgaaaattgtccatcatcccc

SEQ ID NO: 98671 - DNA, 25 bp, Rattus norvegicus
actgtgaaagccagagccccatact

SEQ ID NO: 98672 - DNA, 25 bp, Rattus norvegicus
actgtgaaagcctgagccccatact

SEQ ID NO: 98673 - DNA, 25 bp, Rattus norvegicus
actgtgaaagcgcagtcttcccctt

SEQ ID NO: 98674 - DNA, 25 bp, Rattus norvegicus
actgtgaaagcggagtcttcccctt

SEQ ID NO: 98675 - DNA, 25 bp, Rattus norvegicus
actgtgaaagtcaccccattaatgt

SEQ ID NO: 98676 - DNA, 25 bp, Rattus norvegicus
actgtgaaagtctccccattaatgt

SEQ ID NO: 98677 - DNA, 25 bp, Rattus norvegicus
actgtgaacgttatcttcagccctc

SEQ ID NO: 98678 - DNA, 25 bp, Rattus norvegicus
actgtgaacgttttcttcagccctc

SEQ ID NO: 98679 - DNA, 25 bp, Rattus norvegicus
actgtgaactgacttccccgcgtaa

SEQ ID NO: 98680 - DNA, 25 bp, Rattus norvegicus
actgtgaactgagttccccgcgtaa

SEQ ID NO: 98681 - DNA, 25 bp, Rattus norvegicus
actgtgaagtcgctgacgttactta

SEQ ID NO: 98682 - DNA, 25 bp, Rattus norvegicus
actgtgaagtcggtgacgttactta

SEQ ID NO: 98683 - DNA, 25 bp, Rattus norvegicus
actgtgaagtttaatctcttgcata

SEQ ID NO: 98684 - DNA, 25 bp, Rattus norvegicus
actgtgaagttttatctcttgcata

SEQ ID NO: 98685 - DNA, 25 bp, Rattus norvegicus
actgtgaattgtcctctgatggtta

SEQ ID NO: 98686 - DNA, 25 bp, Rattus norvegicus
actgtgaattgtgctctgatggtta

SEQ ID NO: 98687 - DNA, 25 bp, Rattus norvegicus
actgtgacagaccttacgccaatgg

SEQ ID NO: 98688 - DNA, 25 bp, Rattus norvegicus
actgtgacagacgttacgccaatgg

SEQ ID NO: 98689 - DNA, 25 bp, Rattus norvegicus
actgtgacagggactcatgggcttc

SEQ ID NO: 98690 - DNA, 25 bp, Rattus norvegicus
actgtgacagggtctcatgggcttc

SEQ ID NO: 98691 - DNA, 25 bp, Rattus norvegicus
actgtgacagttctctgttgctcca

SEQ ID NO: 98692 - DNA, 25 bp, Rattus norvegicus
actgtgacagttgtctgttgctcca

SEQ ID NO: 98693 - DNA, 25 bp, Rattus norvegicus
actgtgacatggagccgctttcctg

SEQ ID NO: 98694 - DNA, 25 bp, Rattus norvegicus
actgtgacatggtgccgctttcctg

SEQ ID NO: 98695 - DNA, 25 bp, Rattus norvegicus
actgtgacccctcaaagcaatgcca

SEQ ID NO: 98696 - DNA, 25 bp, Rattus norvegicus
actgtgacccctgaaagcaatgcca

SEQ ID NO: 98697 - DNA, 25 bp, Rattus norvegicus
actgtgacccgactgggcagtgtca

SEQ ID NO: 98698 - DNA, 25 bp, Rattus norvegicus
actgtgacccgagtgggcagtgtca

SEQ ID NO: 98699 - DNA, 25 bp, Rattus norvegicus
actgtgaccctgctaatctattttt

SEQ ID NO: 98700 - DNA, 25 bp, Rattus norvegicus
actgtgaccctggtaatctattttt

SEQ ID NO: 98701 - DNA, 25 bp, Rattus norvegicus
actgtgacctttatgctgttcttac

SEQ ID NO: 98702 - DNA, 25 bp, Rattus norvegicus
actgtgacctttttgctgttcttac

SEQ ID NO: 98703 - DNA, 25 bp, Rattus norvegicus
actgtgactccaagcggtgtgtccc

SEQ ID NO: 98704 - DNA, 25 bp, Rattus norvegicus
actgtgactccatgcggtgtgtccc

SEQ ID NO: 98705 - DNA, 25 bp, Rattus norvegicus
actgtgactgtcatccaatttgcca

SEQ ID NO: 98706 - DNA, 25 bp, Rattus norvegicus
actgtgactgtcttccaatttgcca

SEQ ID NO: 98707 - DNA, 25 bp, Rattus norvegicus
actgtgactgtgactgtgagcggct

SEQ ID NO: 98708 - DNA, 25 bp, Rattus norvegicus
actgtgactgtgtctgtgagcggct

SEQ ID NO: 98709 - DNA, 25 bp, Rattus norvegicus
actgtgagaactagcctcagtgtgt

SEQ ID NO: 98710 - DNA, 25 bp, Rattus norvegicus
actgtgagaacttgcctcagtgtgt

SEQ ID NO: 98711 - DNA, 25 bp, Rattus norvegicus
actgtgagatctattcctccaggac

SEQ ID NO: 98712 - DNA, 25 bp, Rattus norvegicus
actgtgagatcttttcctccaggac

SEQ ID NO: 98713 - DNA, 25 bp, Rattus norvegicus
actgtgagcaggagtttgagcatac

SEQ ID NO: 98714 - DNA, 25 bp, Rattus norvegicus
actgtgagcaggtgtttgagcatac

SEQ ID NO: 98715 - DNA, 25 bp, Rattus norvegicus
actgtgagctagcttgctgtccata

SEQ ID NO: 98716 - DNA, 25 bp, Rattus norvegicus
actgtgagctaggttgctgtccata

SEQ ID NO: 98717 - DNA, 25 bp, Rattus norvegicus
actgtgagctccatgcgagtcagga

SEQ ID NO: 98718 - DNA, 25 bp, Rattus norvegicus
actgtgagctccctttgatttttcc

SEQ ID NO: 98719 - DNA, 25 bp, Rattus norvegicus
actgtgagctccgtttgatttttcc

SEQ ID NO: 98720 - DNA, 25 bp, Rattus norvegicus
actgtgagctccttgcgagtcagga

SEQ ID NO: 98721 - DNA, 25 bp, Rattus norvegicus
actgtgagggcaccatgtctctgaa

SEQ ID NO: 98722 - DNA, 25 bp, Rattus norvegicus
actgtgagggcagcatgtctctgaa

SEQ ID NO: 98723 - DNA, 25 bp, Rattus norvegicus
actgtgagtagacttccctgcggac

SEQ ID NO: 98724 - DNA, 25 bp, Rattus norvegicus
actgtgagtagagttccctgcggac

SEQ ID NO: 98725 - DNA, 25 bp, Rattus norvegicus
actgtgagtctactgctttcccttc

SEQ ID NO: 98726 - DNA, 25 bp, Rattus norvegicus
actgtgagtctagtgctttcccttc

SEQ ID NO: 98727 - DNA, 25 bp, Rattus norvegicus
actgtgagttatagattgcttcgtc

SEQ ID NO: 98728 - DNA, 25 bp, Rattus norvegicus
actgtgagttattgattgcttcgtc

SEQ ID NO: 98729 - DNA, 25 bp, Rattus norvegicus
actgtgagttgtctatacactgaac

SEQ ID NO: 98730 - DNA, 25 bp, Rattus norvegicus
actgtgagttgtgtatacactgaac

SEQ ID NO: 98731 - DNA, 25 bp, Rattus norvegicus
actgtgataggcagtttgcccttta

SEQ ID NO: 98732 - DNA, 25 bp, Rattus norvegicus
actgtgataggctgtttgcccttta

SEQ ID NO: 98733 - DNA, 25 bp, Rattus norvegicus
actgtgatagtgaggccccaggaca

SEQ ID NO: 98734 - DNA, 25 bp, Rattus norvegicus
actgtgatagtgtggccccaggaca

SEQ ID NO: 98735 - DNA, 25 bp, Rattus norvegicus
actgtgatcccaagcaagggtgcat

SEQ ID NO: 98736 - DNA, 25 bp, Rattus norvegicus
actgtgatcccatgcaagggtgcat

SEQ ID NO: 98737 - DNA, 25 bp, Rattus norvegicus
actgtgatcctgattgttgcacaga

SEQ ID NO: 98738 - DNA, 25 bp, Rattus norvegicus
actgtgatcctgtttgttgcacaga

SEQ ID NO: 98739 - DNA, 25 bp, Rattus norvegicus
actgtgatgggtctaatggcccctc

SEQ ID NO: 98740 - DNA, 25 bp, Rattus norvegicus
actgtgatgggtgtaatggcccctc

SEQ ID NO: 98741 - DNA, 25 bp, Rattus norvegicus
actgtgatggtacttttgttgtcta

SEQ ID NO: 98742 - DNA, 25 bp, Rattus norvegicus
actgtgatggtagttttgttgtcta

SEQ ID NO: 98743 - DNA, 25 bp, Rattus norvegicus
actgtgatgttacgccgttctctga

SEQ ID NO: 98744 - DNA, 25 bp, Rattus norvegicus
actgtgatgttaggccgttctctga

SEQ ID NO: 98745 - DNA, 25 bp, Rattus norvegicus
actgtgatgttgcaatggctggcac

SEQ ID NO: 98746 - DNA, 25 bp, Rattus norvegicus
actgtgatgttggaatggctggcac

SEQ ID NO: 98747 - DNA, 25 bp, Rattus norvegicus
actgtgattcctatgctatgtttta

SEQ ID NO: 98748 - DNA, 25 bp, Rattus norvegicus
actgtgattcctttgctatgtttta

SEQ ID NO: 98749 - DNA, 25 bp, Rattus norvegicus
actgtgattgttatgcctgctttaa

SEQ ID NO: 98750 - DNA, 25 bp, Rattus norvegicus
actgtgattgttttgcctgctttaa

SEQ ID NO: 98751 - DNA, 25 bp, Rattus norvegicus
actgtgatttgtatgcccgtactga

SEQ ID NO: 98752 - DNA, 25 bp, Rattus norvegicus
actgtgatttgtttgcccgtactga

SEQ ID NO: 98753 - DNA, 25 bp, Rattus norvegicus
actgtgcaaacaaggccgcctcgag

SEQ ID NO: 98754 - DNA, 25 bp, Rattus norvegicus
actgtgcaaacatggccgcctcgag

SEQ ID NO: 98755 - DNA, 25 bp, Rattus norvegicus
actgtgcacacgacaaacaacctga

SEQ ID NO: 98756 - DNA, 25 bp, Rattus norvegicus
actgtgcacacgtcaaacaacctga

SEQ ID NO: 98757 - DNA, 25 bp, Rattus norvegicus
actgtgcactccatcggatccagaa

SEQ ID NO: 98758 - DNA, 25 bp, Rattus norvegicus
actgtgcactccttcggatccagaa

SEQ ID NO: 98759 - DNA, 25 bp, Rattus norvegicus
actgtgcacttcatcctagtgacaa

SEQ ID NO: 98760 - DNA, 25 bp, Rattus norvegicus
actgtgcacttcttcctagtgacaa

SEQ ID NO: 98761 - DNA, 25 bp, Rattus norvegicus
actgtgcagatgaggatcaacgttt

SEQ ID NO: 98762 - DNA, 25 bp, Rattus norvegicus
actgtgcagatgtggatcaacgttt

SEQ ID NO: 98763 - DNA, 25 bp, Rattus norvegicus
actgtgcagcacagccagacagtgc

SEQ ID NO: 98764 - DNA, 25 bp, Rattus norvegicus
actgtgcagcactgccagacagtgc

SEQ ID NO: 98765 - DNA, 25 bp, Rattus norvegicus
actgtgcagcgcaggcatgcacctc

SEQ ID NO: 98766 - DNA, 25 bp, Rattus norvegicus
actgtgcagcgctggcatgcacctc

SEQ ID NO: 98767 - DNA, 25 bp, Rattus norvegicus
actgtgcagggcattgcggacgatt

SEQ ID NO: 98768 - DNA, 25 bp, Rattus norvegicus
actgtgcagggctttgcggacgatt

SEQ ID NO: 98769 - DNA, 25 bp, Rattus norvegicus
actgtgcagtcacttgtgttgggcc

SEQ ID NO: 98770 - DNA, 25 bp, Rattus norvegicus
actgtgcagtcagttgtgttgggcc

SEQ ID NO: 98771 - DNA, 25 bp, Rattus norvegicus
actgtgcagtgcatggactcctgaa

SEQ ID NO: 98772 - DNA, 25 bp, Rattus norvegicus
actgtgcagtgcttggactcctgaa

SEQ ID NO: 98773 - DNA, 25 bp, Rattus norvegicus
actgtgcatgctccaaagatcctat

SEQ ID NO: 98774 - DNA, 25 bp, Rattus norvegicus
actgtgcatgctccttagtgattaa

SEQ ID NO: 98775 - DNA, 25 bp, Rattus norvegicus
actgtgcatgctgcaaagatcctat

SEQ ID NO: 98776 - DNA, 25 bp, Rattus norvegicus
actgtgcatgctgcttagtgattaa

SEQ ID NO: 98777 - DNA, 25 bp, Rattus norvegicus
actgtgcatgtccagttcctttggg

SEQ ID NO: 98778 - DNA, 25 bp, Rattus norvegicus
actgtgcatgtcgagttcctttggg

SEQ ID NO: 98779 - DNA, 25 bp, Rattus norvegicus
actgtgcatttccttgtagacagaa

SEQ ID NO: 98780 - DNA, 25 bp, Rattus norvegicus
actgtgcatttcgttgtagacagaa

SEQ ID NO: 98781 - DNA, 25 bp, Rattus norvegicus
actgtgccaaatctactgtatcaaa

SEQ ID NO: 98782 - DNA, 25 bp, Rattus norvegicus
actgtgccaaatgtactgtatcaaa

SEQ ID NO: 98783 - DNA, 25 bp, Rattus norvegicus
actgtgccacatcccctttgagaat

SEQ ID NO: 98784 - DNA, 25 bp, Rattus norvegicus
actgtgccacatgccctttgagaat

SEQ ID NO: 98785 - DNA, 25 bp, Rattus norvegicus
actgtgccaggaatacatccctttc

SEQ ID NO: 98786 - DNA, 25 bp, Rattus norvegicus
actgtgccaggattacatccctttc

SEQ ID NO: 98787 - DNA, 25 bp, Rattus norvegicus
actgtgccaggcatgttggacttta

SEQ ID NO: 98788 - DNA, 25 bp, Rattus norvegicus
actgtgccaggcttgttggacttta

SEQ ID NO: 98789 - DNA, 25 bp, Rattus norvegicus
actgtgcccaaccaggatagcattt

SEQ ID NO: 98790 - DNA, 25 bp, Rattus norvegicus
actgtgcccaacgaggatagcattt

SEQ ID NO: 98791 - DNA, 25 bp, Rattus norvegicus
actgtgcccggtactggacagtttc

SEQ ID NO: 98792 - DNA, 25 bp, Rattus norvegicus
actgtgcccggttctggacagtttc

SEQ ID NO: 98793 - DNA, 25 bp, Rattus norvegicus
actgtgccctgcatgactgtgttgt

SEQ ID NO: 98794 - DNA, 25 bp, Rattus norvegicus
actgtgccctgcttgactgtgttgt

SEQ ID NO: 98795 - DNA, 25 bp, Rattus norvegicus
actgtgcccttaaattgtgtctctg

SEQ ID NO: 98796 - DNA, 25 bp, Rattus norvegicus
actgtgcccttatattgtgtctctg

SEQ ID NO: 98797 - DNA, 25 bp, Rattus norvegicus
actgtgccctttagatcttattcag

SEQ ID NO: 98798 - DNA, 25 bp, Rattus norvegicus
actgtgcccttttgatcttattcag

SEQ ID NO: 98799 - DNA, 25 bp, Rattus norvegicus
actgtgccgttaaccatgtcgtgaa

SEQ ID NO: 98800 - DNA, 25 bp, Rattus norvegicus
actgtgccgttatccatgtcgtgaa

SEQ ID NO: 98801 - DNA, 25 bp, Rattus norvegicus
actgtgcctaatctgtaatgtaaac

SEQ ID NO: 98802 - DNA, 25 bp, Rattus norvegicus
actgtgcctaatgtgtaatgtaaac

SEQ ID NO: 98803 - DNA, 25 bp, Rattus norvegicus
actgtgcctattcacctggtgagat

SEQ ID NO: 98804 - DNA, 25 bp, Rattus norvegicus
actgtgcctattgacctggtgagat

SEQ ID NO: 98805 - DNA, 25 bp, Rattus norvegicus
actgtgcctcccaggtgagcaggat

SEQ ID NO: 98806 - DNA, 25 bp, Rattus norvegicus
actgtgcctccctggtgagcaggat

SEQ ID NO: 98807 - DNA, 25 bp, Rattus norvegicus
actgtgcctgcactgcgatatgaac

SEQ ID NO: 98808 - DNA, 25 bp, Rattus norvegicus
actgtgcctgcagtgcgatatgaac

SEQ ID NO: 98809 - DNA, 25 bp, Rattus norvegicus
actgtgcctggaacaagagtatgct

SEQ ID NO: 98810 - DNA, 25 bp, Rattus norvegicus
actgtgcctggatcaagagtatgct

SEQ ID NO: 98811 - DNA, 25 bp, Rattus norvegicus
actgtgcctgtgacattgcttgtgt

SEQ ID NO: 98812 - DNA, 25 bp, Rattus norvegicus
actgtgcctgtgtcattgcttgtgt

SEQ ID NO: 98813 - DNA, 25 bp, Rattus norvegicus
actgtgccttctcttatgttgtgaa

SEQ ID NO: 98814 - DNA, 25 bp, Rattus norvegicus
actgtgccttctgttatgttgtgaa

SEQ ID NO: 98815 - DNA, 25 bp, Rattus norvegicus
actgtgcgaagtcctttctttccca

SEQ ID NO: 98816 - DNA, 25 bp, Rattus norvegicus
actgtgcgaagtgctttctttccca

SEQ ID NO: 98817 - DNA, 25 bp, Rattus norvegicus
actgtgcgcagaaccgtcgtctgta

SEQ ID NO: 98818 - DNA, 25 bp, Rattus norvegicus
actgtgcgcagatccgtcgtctgta

SEQ ID NO: 98819 - DNA, 25 bp, Rattus norvegicus
actgtgcgtgacatgccgatctagg

SEQ ID NO: 98820 - DNA, 25 bp, Rattus norvegicus
actgtgcgtgacttgccgatctagg

SEQ ID NO: 98821 - DNA, 25 bp, Rattus norvegicus
actgtgctaggcatgtcccaggaca

SEQ ID NO: 98822 - DNA, 25 bp, Rattus norvegicus
actgtgctaggcttgtcccaggaca

SEQ ID NO: 98823 - DNA, 25 bp, Rattus norvegicus
actgtgctatgtcttgagtgaacca

SEQ ID NO: 98824 - DNA, 25 bp, Rattus norvegicus
actgtgctatgtgttgagtgaacca

SEQ ID NO: 98825 - DNA, 25 bp, Rattus norvegicus
actgtgctcacaagacaggcgggca

SEQ ID NO: 98826 - DNA, 25 bp, Rattus norvegicus
actgtgctcacatgacaggcgggca

SEQ ID NO: 98827 - DNA, 25 bp, Rattus norvegicus
actgtgctcagacccttatgatgta

SEQ ID NO: 98828 - DNA, 25 bp, Rattus norvegicus
actgtgctcagagccttatgatgta

SEQ ID NO: 98829 - DNA, 25 bp, Rattus norvegicus
actgtgctcaggatttgtctcgttc

SEQ ID NO: 98830 - DNA, 25 bp, Rattus norvegicus
actgtgctcaggttttgtctcgttc

SEQ ID NO: 98831 - DNA, 25 bp, Rattus norvegicus
actgtgctcattccagacctggact

SEQ ID NO: 98832 - DNA, 25 bp, Rattus norvegicus
actgtgctcattgcagacctggact

SEQ ID NO: 98833 - DNA, 25 bp, Rattus norvegicus
actgtgctccatactgggtttcaga

SEQ ID NO: 98834 - DNA, 25 bp, Rattus norvegicus
actgtgctccattctgggtttcaga

SEQ ID NO: 98835 - DNA, 25 bp, Rattus norvegicus
actgtgctctagaaccagcttcact

SEQ ID NO: 98836 - DNA, 25 bp, Rattus norvegicus
actgtgctctagtaccagcttcact

SEQ ID NO: 98837 - DNA, 25 bp, Rattus norvegicus
actgtgctctgaagggcatctctga

SEQ ID NO: 98838 - DNA, 25 bp, Rattus norvegicus
actgtgctctgatgggcatctctga

SEQ ID NO: 98839 - DNA, 25 bp, Rattus norvegicus
actgtgctgactccccagaaggatt

SEQ ID NO: 98840 - DNA, 25 bp, Rattus norvegicus
actgtgctgactgcccagaaggatt

SEQ ID NO: 98841 - DNA, 25 bp, Rattus norvegicus
actgtgctgagacagggaccaaact

SEQ ID NO: 98842 - DNA, 25 bp, Rattus norvegicus
actgtgctgagagagggaccaaact

SEQ ID NO: 98843 - DNA, 25 bp, Rattus norvegicus
actgtgctgagtattgtgcgcttcc

SEQ ID NO: 98844 - DNA, 25 bp, Rattus norvegicus
actgtgctgagttttgtgcgcttcc

SEQ ID NO: 98845 - DNA, 25 bp, Rattus norvegicus
actgtgctgcacatttctgcgtcaa

SEQ ID NO: 98846 - DNA, 25 bp, Rattus norvegicus
actgtgctgcacttttctgcgtcaa

SEQ ID NO: 98847 - DNA, 25 bp, Rattus norvegicus
actgtgctgccccaaattgagaaac

SEQ ID NO: 98848 - DNA, 25 bp, Rattus norvegicus
actgtgctgcccgaaattgagaaac

SEQ ID NO: 98849 - DNA, 25 bp, Rattus norvegicus
actgtgctggcgcactcactggttg

SEQ ID NO: 98850 - DNA, 25 bp, Rattus norvegicus
actgtgctggcggactcactggttg

SEQ ID NO: 98851 - DNA, 25 bp, Rattus norvegicus
actgtgctgtctcccctgagtgagg

SEQ ID NO: 98852 - DNA, 25 bp, Rattus norvegicus
actgtgctgtctgccctgagtgagg

SEQ ID NO: 98853 - DNA, 25 bp, Rattus norvegicus
actgtgcttcagagtggaaccttca

SEQ ID NO: 98854 - DNA, 25 bp, Rattus norvegicus
actgtgcttcagtgtggaaccttca

SEQ ID NO: 98855 - DNA, 25 bp, Rattus norvegicus
actgtgcttctgagcagtctggaca

SEQ ID NO: 98856 - DNA, 25 bp, Rattus norvegicus
actgtgcttctgtgcagtctggaca

SEQ ID NO: 98857 - DNA, 25 bp, Rattus norvegicus
actgtgcttgtcatgaactgtctca

SEQ ID NO: 98858 - DNA, 25 bp, Rattus norvegicus
actgtgcttgtcttgaactgtctca

SEQ ID NO: 98859 - DNA, 25 bp, Rattus norvegicus
actgtggacaatcaggaccttccta

SEQ ID NO: 98860 - DNA, 25 bp, Rattus norvegicus
actgtggacaatgaggaccttccta

SEQ ID NO: 98861 - DNA, 25 bp, Rattus norvegicus
actgtggacatgattgtctccctgc

SEQ ID NO: 98862 - DNA, 25 bp, Rattus norvegicus
actgtggacatgtttgtctccctgc

SEQ ID NO: 98863 - DNA, 25 bp, Rattus norvegicus
actgtggagctgactcaggagcagc

SEQ ID NO: 98864 - DNA, 25 bp, Rattus norvegicus
actgtggagctgtctcaggagcagc

SEQ ID NO: 98865 - DNA, 25 bp, Rattus norvegicus
actgtggaggcccagatgtgtcatc

SEQ ID NO: 98866 - DNA, 25 bp, Rattus norvegicus
actgtggaggccgagatgtgtcatc

SEQ ID NO: 98867 - DNA, 25 bp, Rattus norvegicus
actgtggatgccactggatgctata

SEQ ID NO: 98868 - DNA, 25 bp, Rattus norvegicus
actgtggatgcctctggatgctata

SEQ ID NO: 98869 - DNA, 25 bp, Rattus norvegicus
actgtggatggcaccatttcctgga

SEQ ID NO: 98870 - DNA, 25 bp, Rattus norvegicus
actgtggatggctccatttcctgga

SEQ ID NO: 98871 - DNA, 25 bp, Rattus norvegicus
actgtggattacattcccagctcta

SEQ ID NO: 98872 - DNA, 25 bp, Rattus norvegicus
actgtggattactttcccagctcta

SEQ ID NO: 98873 - DNA, 25 bp, Rattus norvegicus
actgtggcaccaatctcaattagac

SEQ ID NO: 98874 - DNA, 25 bp, Rattus norvegicus
actgtggcaccattctcaattagac

SEQ ID NO: 98875 - DNA, 25 bp, Rattus norvegicus
actgtggcacgcagtatcgatcggc

SEQ ID NO: 98876 - DNA, 25 bp, Rattus norvegicus
actgtggcacgctgtatcgatcggc

SEQ ID NO: 98877 - DNA, 25 bp, Rattus norvegicus
actgtggcagtaccaggtggtccta

SEQ ID NO: 98878 - DNA, 25 bp, Rattus norvegicus
actgtggcagtagcaggtggtccta

SEQ ID NO: 98879 - DNA, 25 bp, Rattus norvegicus
actgtggcattgataagctctttga

SEQ ID NO: 98880 - DNA, 25 bp, Rattus norvegicus
actgtggcattgttaagctctttga

SEQ ID NO: 98881 - DNA, 25 bp, Rattus norvegicus
actgtggccactatcttgtacatag

SEQ ID NO: 98882 - DNA, 25 bp, Rattus norvegicus
actgtggccactttcttgtacatag

SEQ ID NO: 98883 - DNA, 25 bp, Rattus norvegicus
actgtggcccagcttaccgatgtgc

SEQ ID NO: 98884 - DNA, 25 bp, Rattus norvegicus
actgtggcccagcttcgaggagcaa

SEQ ID NO: 98885 - DNA, 25 bp, Rattus norvegicus
actgtggcccaggttaccgatgtgc

SEQ ID NO: 98886 - DNA, 25 bp, Rattus norvegicus
actgtggcccaggttcgaggagcaa

SEQ ID NO: 98887 - DNA, 25 bp, Rattus norvegicus
actgtggccgtaacagctcctgaaa

SEQ ID NO: 98888 - DNA, 25 bp, Rattus norvegicus
actgtggccgtatcagctcctgaaa

SEQ ID NO: 98889 - DNA, 25 bp, Rattus norvegicus
actgtggcctctatgatctttttca

SEQ ID NO: 98890 - DNA, 25 bp, Rattus norvegicus
actgtggcctctttgatctttttca

SEQ ID NO: 98891 - DNA, 25 bp, Rattus norvegicus
actgtggcggtacaaccctgtcctg

SEQ ID NO: 98892 - DNA, 25 bp, Rattus norvegicus
actgtggcggtagaaccctgtcctg

SEQ ID NO: 98893 - DNA, 25 bp, Rattus norvegicus
actgtggctataatatctgacgata

SEQ ID NO: 98894 - DNA, 25 bp, Rattus norvegicus
actgtggctatattatctgacgata

SEQ ID NO: 98895 - DNA, 25 bp, Rattus norvegicus
actgtggctctaaccttgcagagaa

SEQ ID NO: 98896 - DNA, 25 bp, Rattus norvegicus
actgtggctctatccttgcagagaa

SEQ ID NO: 98897 - DNA, 25 bp, Rattus norvegicus
actgtggctctcaatcacatatctg

SEQ ID NO: 98898 - DNA, 25 bp, Rattus norvegicus
actgtggctctctatcacatatctg

SEQ ID NO: 98899 - DNA, 25 bp, Rattus norvegicus
actgtggctgcccttgctgttgctc

SEQ ID NO: 98900 - DNA, 25 bp, Rattus norvegicus
actgtggctgccgttgctgttgctc

SEQ ID NO: 98901 - DNA, 25 bp, Rattus norvegicus
actgtggctgtcatattcactagca

SEQ ID NO: 98902 - DNA, 25 bp, Rattus norvegicus
actgtggctgtcttattcactagca

SEQ ID NO: 98903 - DNA, 25 bp, Rattus norvegicus
actgtggctgttagctgattgcttt

SEQ ID NO: 98904 - DNA, 25 bp, Rattus norvegicus
actgtggctgtttgctgattgcttt

SEQ ID NO: 98905 - DNA, 25 bp, Rattus norvegicus
actgtggcttgtcttctgactgtga

SEQ ID NO: 98906 - DNA, 25 bp, Rattus norvegicus
actgtggcttgtgttctgactgtga

SEQ ID NO: 98907 - DNA, 25 bp, Rattus norvegicus
actgtgggaaacagagtctcttgta

SEQ ID NO: 98908 - DNA, 25 bp, Rattus norvegicus
actgtgggaaactgagtctcttgta

SEQ ID NO: 98909 - DNA, 25 bp, Rattus norvegicus
actgtgggactccaggtagcttcga

SEQ ID NO: 98910 - DNA, 25 bp, Rattus norvegicus
actgtgggactcgaggtagcttcga

SEQ ID NO: 98911 - DNA, 25 bp, Rattus norvegicus
actgtgggcagcctcattccttagg

SEQ ID NO: 98912 - DNA, 25 bp, Rattus norvegicus
actgtgggcagcgtcattccttagg

SEQ ID NO: 98913 - DNA, 25 bp, Rattus norvegicus
actgtgggccttatctaagctgaga

SEQ ID NO: 98914 - DNA, 25 bp, Rattus norvegicus
actgtgggccttttctaagctgaga

SEQ ID NO: 98915 - DNA, 25 bp, Rattus norvegicus
actgtgggctatcgcgtagctacat

SEQ ID NO: 98916 - DNA, 25 bp, Rattus norvegicus
actgtgggctatggcgtagctacat

SEQ ID NO: 98917 - DNA, 25 bp, Rattus norvegicus
actgtggggtaacgtgatattctca

SEQ ID NO: 98918 - DNA, 25 bp, Rattus norvegicus
actgtggggtaaggtgatattctca

SEQ ID NO: 98919 - DNA, 25 bp, Rattus norvegicus
actgtgggttcaccgggtgtcacaa

SEQ ID NO: 98920 - DNA, 25 bp, Rattus norvegicus
actgtgggttcagcgggtgtcacaa

SEQ ID NO: 98921 - DNA, 25 bp, Rattus norvegicus
actgtggtacttactatatgtggac

SEQ ID NO: 98922 - DNA, 25 bp, Rattus norvegicus
actgtggtactttctatatgtggac

SEQ ID NO: 98923 - DNA, 25 bp, Rattus norvegicus
actgtggtagatatgactggccctg

SEQ ID NO: 98924 - DNA, 25 bp, Rattus norvegicus
actgtggtagatttgactggccctg

SEQ ID NO: 98925 - DNA, 25 bp, Rattus norvegicus
actgtggtagccatcaccaagcaga

SEQ ID NO: 98926 - DNA, 25 bp, Rattus norvegicus
actgtggtagccttcaccaagcaga

SEQ ID NO: 98927 - DNA, 25 bp, Rattus norvegicus
actgtggtcaggctgtgttgttgta

SEQ ID NO: 98928 - DNA, 25 bp, Rattus norvegicus
actgtggtcagggtgtgttgttgta

SEQ ID NO: 98929 - DNA, 25 bp, Rattus norvegicus
actgtggtccccagagctgttgtaa

SEQ ID NO: 98930 - DNA, 25 bp, Rattus norvegicus
actgtggtcccctgagctgttgtaa

SEQ ID NO: 98931 - DNA, 25 bp, Rattus norvegicus
actgtggtccctcatctattgtgat

SEQ ID NO: 98932 - DNA, 25 bp, Rattus norvegicus
actgtggtccctgatctattgtgat

SEQ ID NO: 98933 - DNA, 25 bp, Rattus norvegicus
actgtggtcctaccaggcgtgcaga

SEQ ID NO: 98934 - DNA, 25 bp, Rattus norvegicus
actgtggtcctagcaggcgtgcaga

SEQ ID NO: 98935 - DNA, 25 bp, Rattus norvegicus
actgtggtcctcctacaacatgcta

SEQ ID NO: 98936 - DNA, 25 bp, Rattus norvegicus
actgtggtcctcgtacaacatgcta

SEQ ID NO: 98937 - DNA, 25 bp, Rattus norvegicus
actgtggtcgtgaaacccgggccat

SEQ ID NO: 98938 - DNA, 25 bp, Rattus norvegicus
actgtggtcgtgtaacccgggccat

SEQ ID NO: 98939 - DNA, 25 bp, Rattus norvegicus
actgtggtgcacacgtgtagggcct

SEQ ID NO: 98940 - DNA, 25 bp, Rattus norvegicus
actgtggtgcactcgtgtagggcct

SEQ ID NO: 98941 - DNA, 25 bp, Rattus norvegicus
actgtggtggttctcacgatggcta

SEQ ID NO: 98942 - DNA, 25 bp, Rattus norvegicus
actgtggtggttgtcacgatggcta

SEQ ID NO: 98943 - DNA, 25 bp, Rattus norvegicus
actgtggttttgagtgcaccttctc

SEQ ID NO: 98944 - DNA, 25 bp, Rattus norvegicus
actgtggttttgtgtgcaccttctc

SEQ ID NO: 98945 - DNA, 25 bp, Rattus norvegicus
actgtggtttttctcattagctgta

SEQ ID NO: 98946 - DNA, 25 bp, Rattus norvegicus
actgtggtttttgtcattagctgta

SEQ ID NO: 98947 - DNA, 25 bp, Rattus norvegicus
actgtgtaaaggactcttctgtctt

SEQ ID NO: 98948 - DNA, 25 bp, Rattus norvegicus
actgtgtaaaggtctcttctgtctt

SEQ ID NO: 98949 - DNA, 25 bp, Rattus norvegicus
actgtgtagatcaggttaacctcaa

SEQ ID NO: 98950 - DNA, 25 bp, Rattus norvegicus
actgtgtagatctggttaacctcaa

SEQ ID NO: 98951 - DNA, 25 bp, Rattus norvegicus
actgtgtagcacctgtttctccaac

SEQ ID NO: 98952 - DNA, 25 bp, Rattus norvegicus
actgtgtagcacgtgtttctccaac

SEQ ID NO: 98953 - DNA, 25 bp, Rattus norvegicus
actgtgtagccgactcctggagtac

SEQ ID NO: 98954 - DNA, 25 bp, Rattus norvegicus
actgtgtagccgtctcctggagtac

SEQ ID NO: 98955 - DNA, 25 bp, Rattus norvegicus
actgtgtagctccaggtgacttgga

SEQ ID NO: 98956 - DNA, 25 bp, Rattus norvegicus
actgtgtagctcgaggtgacttgga

SEQ ID NO: 98957 - DNA, 25 bp, Rattus norvegicus
actgtgtagttcactcattttaaaa

SEQ ID NO: 98958 - DNA, 25 bp, Rattus norvegicus
actgtgtagttctctcattttaaaa

SEQ ID NO: 98959 - DNA, 25 bp, Rattus norvegicus
actgtgtagtttcttattctcctgc

SEQ ID NO: 98960 - DNA, 25 bp, Rattus norvegicus
actgtgtagtttgttattctcctgc

SEQ ID NO: 98961 - DNA, 25 bp, Rattus norvegicus
actgtgtatcccagattgtctttga

SEQ ID NO: 98962 - DNA, 25 bp, Rattus norvegicus
actgtgtatccctgattgtctttga

SEQ ID NO: 98963 - DNA, 25 bp, Rattus norvegicus
actgtgtatctaaattttgtatgga

SEQ ID NO: 98964 - DNA, 25 bp, Rattus norvegicus
actgtgtatctatattttgtatgga

SEQ ID NO: 98965 - DNA, 25 bp, Rattus norvegicus
actgtgtcattcatggtgagtccaa

SEQ ID NO: 98966 - DNA, 25 bp, Rattus norvegicus
actgtgtcattcttggtgagtccaa

SEQ ID NO: 98967 - DNA, 25 bp, Rattus norvegicus
actgtgtccagtatggttttgcgga

SEQ ID NO: 98968 - DNA, 25 bp, Rattus norvegicus
actgtgtccagtttggttttgcgga

SEQ ID NO: 98969 - DNA, 25 bp, Rattus norvegicus
actgtgtcctcaactacagtggaat

SEQ ID NO: 98970 - DNA, 25 bp, Rattus norvegicus
actgtgtcctcatctacagtggaat

SEQ ID NO: 98971 - DNA, 25 bp, Rattus norvegicus
actgtgtcctgtcttttgttccaaa

SEQ ID NO: 98972 - DNA, 25 bp, Rattus norvegicus
actgtgtcctgtgttttgttccaaa

SEQ ID NO: 98973 - DNA, 25 bp, Rattus norvegicus
actgtgtcctttatcactgcaatgg

SEQ ID NO: 98974 - DNA, 25 bp, Rattus norvegicus
actgtgtcctttcttagatgcttca

SEQ ID NO: 98975 - DNA, 25 bp, Rattus norvegicus
actgtgtcctttgttagatgcttca

SEQ ID NO: 98976 - DNA, 25 bp, Rattus norvegicus
actgtgtcctttttcactgcaatgg

SEQ ID NO: 98977 - DNA, 25 bp, Rattus norvegicus
actgtgtctagcagaagggccactt

SEQ ID NO: 98978 - DNA, 25 bp, Rattus norvegicus
actgtgtctagctgaagggccactt

SEQ ID NO: 98979 - DNA, 25 bp, Rattus norvegicus
actgtgtctctgaaacctgctggta

SEQ ID NO: 98980 - DNA, 25 bp, Rattus norvegicus
actgtgtctctgtaacctgctggta

SEQ ID NO: 98981 - DNA, 25 bp, Rattus norvegicus
actgtgtctgtccatcgggatgcac

SEQ ID NO: 98982 - DNA, 25 bp, Rattus norvegicus
actgtgtctgtcgatcgggatgcac

SEQ ID NO: 98983 - DNA, 25 bp, Rattus norvegicus
actgtgtctttgcatgtttcttccc

SEQ ID NO: 98984 - DNA, 25 bp, Rattus norvegicus
actgtgtctttggatgtttcttccc

SEQ ID NO: 98985 - DNA, 25 bp, Rattus norvegicus
actgtgtgaagcctgcggcctgtca

SEQ ID NO: 98986 - DNA, 25 bp, Rattus norvegicus
actgtgtgaagcgtgcggcctgtca

SEQ ID NO: 98987 - DNA, 25 bp, Rattus norvegicus
actgtgtgaatcaggcggctgaata

SEQ ID NO: 98988 - DNA, 25 bp, Rattus norvegicus
actgtgtgaatctggcggctgaata

SEQ ID NO: 98989 - DNA, 25 bp, Rattus norvegicus
actgtgtgacaacctggtctccagc

SEQ ID NO: 98990 - DNA, 25 bp, Rattus norvegicus
actgtgtgacaagctggtctccagc

SEQ ID NO: 98991 - DNA, 25 bp, Rattus norvegicus
actgtgtgaccaaagttcaccctac

SEQ ID NO: 98992 - DNA, 25 bp, Rattus norvegicus
actgtgtgaccatagttcaccctac

SEQ ID NO: 98993 - DNA, 25 bp, Rattus norvegicus
actgtgtgactgaagagtggcaacc

SEQ ID NO: 98994 - DNA, 25 bp, Rattus norvegicus
actgtgtgactgtagagtggcaacc

SEQ ID NO: 98995 - DNA, 25 bp, Rattus norvegicus
actgtgtgatagaccttggctccag

SEQ ID NO: 98996 - DNA, 25 bp, Rattus norvegicus
actgtgtgatagtccttggctccag

SEQ ID NO: 98997 - DNA, 25 bp, Rattus norvegicus
actgtgtgcagcatcattccctaag

SEQ ID NO: 98998 - DNA, 25 bp, Rattus norvegicus
actgtgtgcagcttcattccctaag

SEQ ID NO: 98999 - DNA, 25 bp, Rattus norvegicus
actgtgtgccccacgaggaggcgac

SEQ ID NO: 99000 - DNA, 25 bp, Rattus norvegicus
actgtgtgcccctcgaggaggcgac

SEQ ID NO: 99001 - DNA, 25 bp, Rattus norvegicus
actgtgtgcgtgattttgtaaatca

SEQ ID NO: 99002 - DNA, 25 bp, Rattus norvegicus
actgtgtgcgtgtttttgtaaatca

SEQ ID NO: 99003 - DNA, 25 bp, Rattus norvegicus
actgtgtgctgcagatgccacggca

SEQ ID NO: 99004 - DNA, 25 bp, Rattus norvegicus
actgtgtgctgctgatgccacggca

SEQ ID NO: 99005 - DNA, 25 bp, Rattus norvegicus
actgtgtggcacagaattcctgtta

SEQ ID NO: 99006 - DNA, 25 bp, Rattus norvegicus
actgtgtggcactgaattcctgtta

SEQ ID NO: 99007 - DNA, 25 bp, Rattus norvegicus
actgtgtggcctaagtcttagattg

SEQ ID NO: 99008 - DNA, 25 bp, Rattus norvegicus
actgtgtggccttagtcttagattg

SEQ ID NO: 99009 - DNA, 25 bp, Rattus norvegicus
actgtgtgggtgaagactcctctta

SEQ ID NO: 99010 - DNA, 25 bp, Rattus norvegicus
actgtgtgggtgtagactcctctta

SEQ ID NO: 99011 - DNA, 25 bp, Rattus norvegicus
actgtgtgtaaaaagcctgtatcat

SEQ ID NO: 99012 - DNA, 25 bp, Rattus norvegicus
actgtgtgtaaatagcctgtatcat

SEQ ID NO: 99013 - DNA, 25 bp, Rattus norvegicus
actgtgtgtcggaccagcacatctg

SEQ ID NO: 99014 - DNA, 25 bp, Rattus norvegicus
actgtgtgtcggtccagcacatctg

SEQ ID NO: 99015 - DNA, 25 bp, Rattus norvegicus
actgtgtgtgacaaaacctgttcta

SEQ ID NO: 99016 - DNA, 25 bp, Rattus norvegicus
actgtgtgtgactaaacctgttcta

SEQ ID NO: 99017 - DNA, 25 bp, Rattus norvegicus
actgtgtgttctatggtggccccag

SEQ ID NO: 99018 - DNA, 25 bp, Rattus norvegicus
actgtgtgttctttggtggccccag

SEQ ID NO: 99019 - DNA, 25 bp, Rattus norvegicus
actgtgttagctatggtctgtcttt

SEQ ID NO: 99020 - DNA, 25 bp, Rattus norvegicus
actgtgttagctttggtctgtcttt

SEQ ID NO: 99021 - DNA, 25 bp, Rattus norvegicus
actgtgttagttatcccaatgtcca

SEQ ID NO: 99022 - DNA, 25 bp, Rattus norvegicus
actgtgttagttttcccaatgtcca

SEQ ID NO: 99023 - DNA, 25 bp, Rattus norvegicus
actgtgttcatcacgaaggcttggg

SEQ ID NO: 99024 - DNA, 25 bp, Rattus norvegicus
actgtgttcatctcgaaggcttggg

SEQ ID NO: 99025 - DNA, 25 bp, Rattus norvegicus
actgtgttcattcctgagtcctaag

SEQ ID NO: 99026 - DNA, 25 bp, Rattus norvegicus
actgtgttcattgctgagtcctaag

SEQ ID NO: 99027 - DNA, 25 bp, Rattus norvegicus
actgtgttccctactcagtatgaag

SEQ ID NO: 99028 - DNA, 25 bp, Rattus norvegicus
actgtgttccctcggcatctttgga

SEQ ID NO: 99029 - DNA, 25 bp, Rattus norvegicus
actgtgttccctgggcatctttgga

SEQ ID NO: 99030 - DNA, 25 bp, Rattus norvegicus
actgtgttcccttctcagtatgaag

SEQ ID NO: 99031 - DNA, 25 bp, Rattus norvegicus
actgtgttccttaaaccatatgtgg

SEQ ID NO: 99032 - DNA, 25 bp, Rattus norvegicus
actgtgttcctttaaccatatgtgg

SEQ ID NO: 99033 - DNA, 25 bp, Rattus norvegicus
actgtgttctagaccatctgtgtaa

SEQ ID NO: 99034 - DNA, 25 bp, Rattus norvegicus
actgtgttctagtccatctgtgtaa

SEQ ID NO: 99035 - DNA, 25 bp, Rattus norvegicus
actgtgttcttcacttcatgggttg

SEQ ID NO: 99036 - DNA, 25 bp, Rattus norvegicus
actgtgttcttctcttcatgggttg

SEQ ID NO: 99037 - DNA, 25 bp, Rattus norvegicus
actgtgttgcgtctgcttgtaggaa

SEQ ID NO: 99038 - DNA, 25 bp, Rattus norvegicus
actgtgttgcgtgtgcttgtaggaa

SEQ ID NO: 99039 - DNA, 25 bp, Rattus norvegicus
actgtgttgctgaccctgagggcat

SEQ ID NO: 99040 - DNA, 25 bp, Rattus norvegicus
actgtgttgctgtccctgagggcat

SEQ ID NO: 99041 - DNA, 25 bp, Rattus norvegicus
actgtgttgtgaattcaactcccaa

SEQ ID NO: 99042 - DNA, 25 bp, Rattus norvegicus
actgtgttgtgatttcaactcccaa

SEQ ID NO: 99043 - DNA, 25 bp, Rattus norvegicus
actgtgtttacaaagctgcttctgg

SEQ ID NO: 99044 - DNA, 25 bp, Rattus norvegicus
actgtgtttacatagctgcttctgg

SEQ ID NO: 99045 - DNA, 25 bp, Rattus norvegicus
actgtgtttaggctggatcctggac

SEQ ID NO: 99046 - DNA, 25 bp, Rattus norvegicus
actgtgtttagggtggatcctggac

SEQ ID NO: 99047 - DNA, 25 bp, Rattus norvegicus
actgtgtttatcagtccagatggaa

SEQ ID NO: 99048 - DNA, 25 bp, Rattus norvegicus
actgtgtttatctgtccagatggaa

SEQ ID NO: 99049 - DNA, 25 bp, Rattus norvegicus
actgtgtttccaaggcaagtcattg

SEQ ID NO: 99050 - DNA, 25 bp, Rattus norvegicus
actgtgtttccatggcaagtcattg

SEQ ID NO: 99051 - DNA, 25 bp, Rattus norvegicus
actgtgtttgacagggtgctgactg

SEQ ID NO: 99052 - DNA, 25 bp, Rattus norvegicus
actgtgtttgactgggtgctgactg

SEQ ID NO: 99053 - DNA, 25 bp, Rattus norvegicus
actgtgtttggcctatgttcatcga

SEQ ID NO: 99054 - DNA, 25 bp, Rattus norvegicus
actgtgtttggcgtatgttcatcga

SEQ ID NO: 99055 - DNA, 25 bp, Rattus norvegicus
actgtgtttgtaccatggcctctgg

SEQ ID NO: 99056 - DNA, 25 bp, Rattus norvegicus
actgtgtttgtagcatggcctctgg

SEQ ID NO: 99057 - DNA, 25 bp, Rattus norvegicus
actgttaaatgcatcagcgatgacc

SEQ ID NO: 99058 - DNA, 25 bp, Rattus norvegicus
actgttaaatgcttcagcgatgacc

SEQ ID NO: 99059 - DNA, 25 bp, Rattus norvegicus
actgttaacctcaccaaatgttgtt

SEQ ID NO: 99060 - DNA, 25 bp, Rattus norvegicus
actgttaacctctccaaatgttgtt

SEQ ID NO: 99061 - DNA, 25 bp, Rattus norvegicus
actgttaagcctaggatgtcctttg

SEQ ID NO: 99062 - DNA, 25 bp, Rattus norvegicus
actgttaagccttggatgtcctttg

SEQ ID NO: 99063 - DNA, 25 bp, Rattus norvegicus
actgttaagctgattgtttactaat

SEQ ID NO: 99064 - DNA, 25 bp, Rattus norvegicus
actgttaagctgtttgtttactaat

SEQ ID NO: 99065 - DNA, 25 bp, Rattus norvegicus
actgttaagttgctctagtctttga

SEQ ID NO: 99066 - DNA, 25 bp, Rattus norvegicus
actgttaagttggtctagtctttga

SEQ ID NO: 99067 - DNA, 25 bp, Rattus norvegicus
actgttaatagtccatgctcggcca

SEQ ID NO: 99068 - DNA, 25 bp, Rattus norvegicus
actgttaatagtgcatgctcggcca

SEQ ID NO: 99069 - DNA, 25 bp, Rattus norvegicus
actgttaatgttctcacttgtgagc

SEQ ID NO: 99070 - DNA, 25 bp, Rattus norvegicus
actgttaatgttgtcacttgtgagc

SEQ ID NO: 99071 - DNA, 25 bp, Rattus norvegicus
actgttaccagtattgtgacccatc

SEQ ID NO: 99072 - DNA, 25 bp, Rattus norvegicus
actgttaccagttttgtgacccatc

SEQ ID NO: 99073 - DNA, 25 bp, Rattus norvegicus
actgttacctaactcacatttgcgc

SEQ ID NO: 99074 - DNA, 25 bp, Rattus norvegicus
actgttacctaagtcacatttgcgc

SEQ ID NO: 99075 - DNA, 25 bp, Rattus norvegicus
actgttacgattcatcttccgtctg

SEQ ID NO: 99076 - DNA, 25 bp, Rattus norvegicus
actgttacgattgatcttccgtctg

SEQ ID NO: 99077 - DNA, 25 bp, Rattus norvegicus
actgttactcttctcattgctgttg

SEQ ID NO: 99078 - DNA, 25 bp, Rattus norvegicus
actgttactcttgtcattgctgttg

SEQ ID NO: 99079 - DNA, 25 bp, Rattus norvegicus
actgttactgccctgagtgtttgtg

SEQ ID NO: 99080 - DNA, 25 bp, Rattus norvegicus
actgttactgccgtgagtgtttgtg

SEQ ID NO: 99081 - DNA, 25 bp, Rattus norvegicus
actgttactgtcattcagagacatg

SEQ ID NO: 99082 - DNA, 25 bp, Rattus norvegicus
actgttactgtctttcagagacatg

SEQ ID NO: 99083 - DNA, 25 bp, Rattus norvegicus
actgttacttcaagctgtcttctta

SEQ ID NO: 99084 - DNA, 25 bp, Rattus norvegicus
actgttacttcatgctgtcttctta

SEQ ID NO: 99085 - DNA, 25 bp, Rattus norvegicus
actgttacttccagtattctgtccc

SEQ ID NO: 99086 - DNA, 25 bp, Rattus norvegicus
actgttacttcctgtattctgtccc

SEQ ID NO: 99087 - DNA, 25 bp, Rattus norvegicus
actgttacttctcagccacgcaaag

SEQ ID NO: 99088 - DNA, 25 bp, Rattus norvegicus
actgttacttctgagccacgcaaag

SEQ ID NO: 99089 - DNA, 25 bp, Rattus norvegicus
actgttactttgaagccatggctga

SEQ ID NO: 99090 - DNA, 25 bp, Rattus norvegicus
actgttactttgtagccatggctga

SEQ ID NO: 99091 - DNA, 25 bp, Rattus norvegicus
actgttagacagattctgcacatag

SEQ ID NO: 99092 - DNA, 25 bp, Rattus norvegicus
actgttagacagtttctgcacatag

SEQ ID NO: 99093 - DNA, 25 bp, Rattus norvegicus
actgttagccatcgctcctgccaga

SEQ ID NO: 99094 - DNA, 25 bp, Rattus norvegicus
actgttagccatggctcctgccaga

SEQ ID NO: 99095 - DNA, 25 bp, Rattus norvegicus
actgttagccccagtgtgttctgta

SEQ ID NO: 99096 - DNA, 25 bp, Rattus norvegicus
actgttagcccctgtgtgttctgta

SEQ ID NO: 99097 - DNA, 25 bp, Rattus norvegicus
actgttagtaacaccgtcacaactc

SEQ ID NO: 99098 - DNA, 25 bp, Rattus norvegicus
actgttagtaactccgtcacaactc

SEQ ID NO: 99099 - DNA, 25 bp, Rattus norvegicus
actgttagtgatccaccagcagcaa

SEQ ID NO: 99100 - DNA, 25 bp, Rattus norvegicus
actgttagtgatgcaccagcagcaa

SEQ ID NO: 99101 - DNA, 25 bp, Rattus norvegicus
actgttagtgtcaggaatccacgaa

SEQ ID NO: 99102 - DNA, 25 bp, Rattus norvegicus
actgttagtgtctggaatccacgaa

SEQ ID NO: 99103 - DNA, 25 bp, Rattus norvegicus
actgttatcccaagtgctcttattc

SEQ ID NO: 99104 - DNA, 25 bp, Rattus norvegicus
actgttatcccatgtgctcttattc

SEQ ID NO: 99105 - DNA, 25 bp, Rattus norvegicus
actgttatctatcacacattcccgc

SEQ ID NO: 99106 - DNA, 25 bp, Rattus norvegicus
actgttatctatgacacattcccgc

SEQ ID NO: 99107 - DNA, 25 bp, Rattus norvegicus
actgttatggcacacgtgatactaa

SEQ ID NO: 99108 - DNA, 25 bp, Rattus norvegicus
actgttatggcagacgtgatactaa

SEQ ID NO: 99109 - DNA, 25 bp, Rattus norvegicus
actgttatgggtccagagctccgtc

SEQ ID NO: 99110 - DNA, 25 bp, Rattus norvegicus
actgttatgggtgcagagctccgtc

SEQ ID NO: 99111 - DNA, 25 bp, Rattus norvegicus
actgttatggtacttgtcaatgcta

SEQ ID NO: 99112 - DNA, 25 bp, Rattus norvegicus
actgttatggtagttgtcaatgcta

SEQ ID NO: 99113 - DNA, 25 bp, Rattus norvegicus
actgttatgtttcttgtctgcacca

SEQ ID NO: 99114 - DNA, 25 bp, Rattus norvegicus
actgttatgtttgttgtctgcacca

SEQ ID NO: 99115 - DNA, 25 bp, Rattus norvegicus
actgttcaagtacgatgggctgctc

SEQ ID NO: 99116 - DNA, 25 bp, Rattus norvegicus
actgttcaagtaggatgggctgctc

SEQ ID NO: 99117 - DNA, 25 bp, Rattus norvegicus
actgttcagacaagggcaggccaca

SEQ ID NO: 99118 - DNA, 25 bp, Rattus norvegicus
actgttcagacatgggcaggccaca

SEQ ID NO: 99119 - DNA, 25 bp, Rattus norvegicus
actgttcaggttccccagagggaaa

SEQ ID NO: 99120 - DNA, 25 bp, Rattus norvegicus
actgttcaggttgcccagagggaaa

SEQ ID NO: 99121 - DNA, 25 bp, Rattus norvegicus
actgttcagtctaaagaaggagcca

SEQ ID NO: 99122 - DNA, 25 bp, Rattus norvegicus
actgttcagtcttaagaaggagcca

SEQ ID NO: 99123 - DNA, 25 bp, Rattus norvegicus
actgttcatcccctagtgttggaag

SEQ ID NO: 99124 - DNA, 25 bp, Rattus norvegicus
actgttcatcccgtagtgttggaag

SEQ ID NO: 99125 - DNA, 25 bp, Rattus norvegicus
actgttcatgaaaccgtacctgcca

SEQ ID NO: 99126 - DNA, 25 bp, Rattus norvegicus
actgttcatgaatccgtacctgcca

SEQ ID NO: 99127 - DNA, 25 bp, Rattus norvegicus
actgttcattggactgtgtgtgcac

SEQ ID NO: 99128 - DNA, 25 bp, Rattus norvegicus
actgttcattggtctgtgtgtgcac

SEQ ID NO: 99129 - DNA, 25 bp, Rattus norvegicus
actgttccaggaactttcatgttga

SEQ ID NO: 99130 - DNA, 25 bp, Rattus norvegicus
actgttccaggatctttcatgttga

SEQ ID NO: 99131 - DNA, 25 bp, Rattus norvegicus
actgttccattaacgagacctgctt

SEQ ID NO: 99132 - DNA, 25 bp, Rattus norvegicus
actgttccattatcgagacctgctt

SEQ ID NO: 99133 - DNA, 25 bp, Rattus norvegicus
actgttcccacaacatttctgttaa

SEQ ID NO: 99134 - DNA, 25 bp, Rattus norvegicus
actgttcccacatcatttctgttaa

SEQ ID NO: 99135 - DNA, 25 bp, Rattus norvegicus
actgttcccctcacaagtgaatcag

SEQ ID NO: 99136 - DNA, 25 bp, Rattus norvegicus
actgttcccctctcaagtgaatcag

SEQ ID NO: 99137 - DNA, 25 bp, Rattus norvegicus
actgttccgattactgtctttacaa

SEQ ID NO: 99138 - DNA, 25 bp, Rattus norvegicus
actgttccgatttctgtctttacaa

SEQ ID NO: 99139 - DNA, 25 bp, Rattus norvegicus
actgttcctaacagctgtccgggaa

SEQ ID NO: 99140 - DNA, 25 bp, Rattus norvegicus
actgttcctaactgctgtccgggaa

SEQ ID NO: 99141 - DNA, 25 bp, Rattus norvegicus
actgttcctggtacatggcatgggt

SEQ ID NO: 99142 - DNA, 25 bp, Rattus norvegicus
actgttcctggttcatggcatgggt

SEQ ID NO: 99143 - DNA, 25 bp, Rattus norvegicus
actgttcctgttagcccatggtgag

SEQ ID NO: 99144 - DNA, 25 bp, Rattus norvegicus
actgttcctgtttgcccatggtgag

SEQ ID NO: 99145 - DNA, 25 bp, Rattus norvegicus
actgttccttcaaacattgggacgg

SEQ ID NO: 99146 - DNA, 25 bp, Rattus norvegicus
actgttccttcatacattgggacgg

SEQ ID NO: 99147 - DNA, 25 bp, Rattus norvegicus
actgttcgccggcttgatgagcgtc

SEQ ID NO: 99148 - DNA, 25 bp, Rattus norvegicus
actgttcgccgggttgatgagcgtc

SEQ ID NO: 99149 - DNA, 25 bp, Rattus norvegicus
actgttctacaaagtgtccatctcc

SEQ ID NO: 99150 - DNA, 25 bp, Rattus norvegicus
actgttctacaatgtgtccatctcc

SEQ ID NO: 99151 - DNA, 25 bp, Rattus norvegicus
actgttctagagctgcaggtttaca

SEQ ID NO: 99152 - DNA, 25 bp, Rattus norvegicus
actgttctagaggtgcaggtttaca

SEQ ID NO: 99153 - DNA, 25 bp, Rattus norvegicus
actgttctcaccagatcaggctgat

SEQ ID NO: 99154 - DNA, 25 bp, Rattus norvegicus
actgttctcacctgatcaggctgat

SEQ ID NO: 99155 - DNA, 25 bp, Rattus norvegicus
actgttctcaggctcaggagcattc

SEQ ID NO: 99156 - DNA, 25 bp, Rattus norvegicus
actgttctcagggtcaggagcattc

SEQ ID NO: 99157 - DNA, 25 bp, Rattus norvegicus
actgttctcatcatggctgtcatca

SEQ ID NO: 99158 - DNA, 25 bp, Rattus norvegicus
actgttctcatcttggctgtcatca

SEQ ID NO: 99159 - DNA, 25 bp, Rattus norvegicus
actgttctgatgactggctgtggcc

SEQ ID NO: 99160 - DNA, 25 bp, Rattus norvegicus
actgttctgatgtctggctgtggcc

SEQ ID NO: 99161 - DNA, 25 bp, Rattus norvegicus
actgttctgccccaaagcttgatat

SEQ ID NO: 99162 - DNA, 25 bp, Rattus norvegicus
actgttctgcccgaaagcttgatat

SEQ ID NO: 99163 - DNA, 25 bp, Rattus norvegicus
actgttctgtgaagagtgtctggct

SEQ ID NO: 99164 - DNA, 25 bp, Rattus norvegicus
actgttctgtgatgagtgtctggct

SEQ ID NO: 99165 - DNA, 25 bp, Rattus norvegicus
actgttctgtgcacttggatgtaga

SEQ ID NO: 99166 - DNA, 25 bp, Rattus norvegicus
actgttctgtgctcttggatgtaga

SEQ ID NO: 99167 - DNA, 25 bp, Rattus norvegicus
actgttcttattccatcagctaaga

SEQ ID NO: 99168 - DNA, 25 bp, Rattus norvegicus
actgttcttattgcatcagctaaga

SEQ ID NO: 99169 - DNA, 25 bp, Rattus norvegicus
actgttcttcccaaatcataacttg

SEQ ID NO: 99170 - DNA, 25 bp, Rattus norvegicus
actgttcttccctaatcataacttg

SEQ ID NO: 99171 - DNA, 25 bp, Rattus norvegicus
actgttcttggtactcagggacctt

SEQ ID NO: 99172 - DNA, 25 bp, Rattus norvegicus
actgttcttggttctcagggacctt

SEQ ID NO: 99173 - DNA, 25 bp, Rattus norvegicus
actgttcttgtgaaagctgctctcc

SEQ ID NO: 99174 - DNA, 25 bp, Rattus norvegicus
actgttcttgtgtaagctgctctcc

SEQ ID NO: 99175 - DNA, 25 bp, Rattus norvegicus
actgttcttgttccactgttctaaa

SEQ ID NO: 99176 - DNA, 25 bp, Rattus norvegicus
actgttcttgttgcactgttctaaa

SEQ ID NO: 99177 - DNA, 25 bp, Rattus norvegicus
actgttctttctccaaccgatgtag

SEQ ID NO: 99178 - DNA, 25 bp, Rattus norvegicus
actgttctttctgcaaccgatgtag

SEQ ID NO: 99179 - DNA, 25 bp, Rattus norvegicus
actgttgaaaccatgttcatgttta

SEQ ID NO: 99180 - DNA, 25 bp, Rattus norvegicus
actgttgaaaccttgttcatgttta

SEQ ID NO: 99181 - DNA, 25 bp, Rattus norvegicus
actgttgaacctacttgagtggccc

SEQ ID NO: 99182 - DNA, 25 bp, Rattus norvegicus
actgttgaaccttcttgagtggccc

SEQ ID NO: 99183 - DNA, 25 bp, Rattus norvegicus
actgttgaagacactgcattgccac

SEQ ID NO: 99184 - DNA, 25 bp, Rattus norvegicus
actgttgaagactctgcattgccac

SEQ ID NO: 99185 - DNA, 25 bp, Rattus norvegicus
actgttgacctcagttcctgggtat

SEQ ID NO: 99186 - DNA, 25 bp, Rattus norvegicus
actgttgacctctgttcctgggtat

SEQ ID NO: 99187 - DNA, 25 bp, Rattus norvegicus
actgttgacttcaatgcccctgaag

SEQ ID NO: 99188 - DNA, 25 bp, Rattus norvegicus
actgttgacttctatgcccctgaag

SEQ ID NO: 99189 - DNA, 25 bp, Rattus norvegicus
actgttgacttgaatgtgcctaaag

SEQ ID NO: 99190 - DNA, 25 bp, Rattus norvegicus
actgttgacttgtatgtgcctaaag

SEQ ID NO: 99191 - DNA, 25 bp, Rattus norvegicus
actgttgcaaatcttcctttttctc

SEQ ID NO: 99192 - DNA, 25 bp, Rattus norvegicus
actgttgcaaatgttcctttttctc

SEQ ID NO: 99193 - DNA, 25 bp, Rattus norvegicus
actgttgcaacacctagtctgtttg

SEQ ID NO: 99194 - DNA, 25 bp, Rattus norvegicus
actgttgcaacagctagtctgtttg

SEQ ID NO: 99195 - DNA, 25 bp, Rattus norvegicus
actgttgccccgaaaggtgacatgt

SEQ ID NO: 99196 - DNA, 25 bp, Rattus norvegicus
actgttgccccgtaaggtgacatgt

SEQ ID NO: 99197 - DNA, 25 bp, Rattus norvegicus
actgttgccctgagctaccgccagg

SEQ ID NO: 99198 - DNA, 25 bp, Rattus norvegicus
actgttgccctgtgctaccgccagg

SEQ ID NO: 99199 - DNA, 25 bp, Rattus norvegicus
actgttgccgaaacctcagatgcat

SEQ ID NO: 99200 - DNA, 25 bp, Rattus norvegicus
actgttgccgaatcctcagatgcat

SEQ ID NO: 99201 - DNA, 25 bp, Rattus norvegicus
actgttgccgagctgtagccctttg

SEQ ID NO: 99202 - DNA, 25 bp, Rattus norvegicus
actgttgccgaggtgtagccctttg

SEQ ID NO: 99203 - DNA, 25 bp, Rattus norvegicus
actgttgcggtcataaattctgtat

SEQ ID NO: 99204 - DNA, 25 bp, Rattus norvegicus
actgttgcggtcttaaattctgtat

SEQ ID NO: 99205 - DNA, 25 bp, Rattus norvegicus
actgttgctcatccgacgatactaa

SEQ ID NO: 99206 - DNA, 25 bp, Rattus norvegicus
actgttgctcatgcgacgatactaa

SEQ ID NO: 99207 - DNA, 25 bp, Rattus norvegicus
actgttgctgggactttgtgctatc

SEQ ID NO: 99208 - DNA, 25 bp, Rattus norvegicus
actgttgctgggtctttgtgctatc

SEQ ID NO: 99209 - DNA, 25 bp, Rattus norvegicus
actgttgctttgaccccattgttta

SEQ ID NO: 99210 - DNA, 25 bp, Rattus norvegicus
actgttgctttgtccccattgttta

SEQ ID NO: 99211 - DNA, 25 bp, Rattus norvegicus
actgttggacgcactcctcagaggt

SEQ ID NO: 99212 - DNA, 25 bp, Rattus norvegicus
actgttggacgctctcctcagaggt

SEQ ID NO: 99213 - DNA, 25 bp, Rattus norvegicus
actgttggactaaggaccgtctatt

SEQ ID NO: 99214 - DNA, 25 bp, Rattus norvegicus
actgttggactatggaccgtctatt

SEQ ID NO: 99215 - DNA, 25 bp, Rattus norvegicus
actgttggagaaacttttacttgaa

SEQ ID NO: 99216 - DNA, 25 bp, Rattus norvegicus
actgttggagaatcttttacttgaa

SEQ ID NO: 99217 - DNA, 25 bp, Rattus norvegicus
actgttggctccacaggaaaagaaa

SEQ ID NO: 99218 - DNA, 25 bp, Rattus norvegicus
actgttggctcctcaggaaaagaaa

SEQ ID NO: 99219 - DNA, 25 bp, Rattus norvegicus
actgttgggttcaaggcattcctga

SEQ ID NO: 99220 - DNA, 25 bp, Rattus norvegicus
actgttgggttctaggcattcctga

SEQ ID NO: 99221 - DNA, 25 bp, Rattus norvegicus
actgttggtaggacttgccccaagg

SEQ ID NO: 99222 - DNA, 25 bp, Rattus norvegicus
actgttggtaggtcttgccccaagg

SEQ ID NO: 99223 - DNA, 25 bp, Rattus norvegicus
actgttggtcaactgtgtgccttaa

SEQ ID NO: 99224 - DNA, 25 bp, Rattus norvegicus
actgttggtcaagtgtgtgccttaa

SEQ ID NO: 99225 - DNA, 25 bp, Rattus norvegicus
actgttggtttcaacagaggtgaag

SEQ ID NO: 99226 - DNA, 25 bp, Rattus norvegicus
actgttggtttctacagaggtgaag

SEQ ID NO: 99227 - DNA, 25 bp, Rattus norvegicus
actgttgtaaccctgtacccatcga

SEQ ID NO: 99228 - DNA, 25 bp, Rattus norvegicus
actgttgtaaccgtgtacccatcga

SEQ ID NO: 99229 - DNA, 25 bp, Rattus norvegicus
actgttgtagccactgtttatggaa

SEQ ID NO: 99230 - DNA, 25 bp, Rattus norvegicus
actgttgtagcctctgtttatggaa

SEQ ID NO: 99231 - DNA, 25 bp, Rattus norvegicus
actgttgtatttactgccgtcgagg

SEQ ID NO: 99232 - DNA, 25 bp, Rattus norvegicus
actgttgtattttctgccgtcgagg

SEQ ID NO: 99233 - DNA, 25 bp, Rattus norvegicus
actgttgtcgacatgaagatttcct

SEQ ID NO: 99234 - DNA, 25 bp, Rattus norvegicus
actgttgtcgacttgaagatttcct

SEQ ID NO: 99235 - DNA, 25 bp, Rattus norvegicus
actgttgtgaaaataccagagtaca

SEQ ID NO: 99236 - DNA, 25 bp, Rattus norvegicus
actgttgtgaaattaccagagtaca

SEQ ID NO: 99237 - DNA, 25 bp, Rattus norvegicus
actgttgtgacgaagtatttcccga

SEQ ID NO: 99238 - DNA, 25 bp, Rattus norvegicus
actgttgtgacgtagtatttcccga

SEQ ID NO: 99239 - DNA, 25 bp, Rattus norvegicus
actgttgtgtagacgagcttcgctc

SEQ ID NO: 99240 - DNA, 25 bp, Rattus norvegicus
actgttgtgtagtcgagcttcgctc

SEQ ID NO: 99241 - DNA, 25 bp, Rattus norvegicus
actgttgttcaaagtgttttcccca

SEQ ID NO: 99242 - DNA, 25 bp, Rattus norvegicus
actgttgttcaatgtgttttcccca

SEQ ID NO: 99243 - DNA, 25 bp, Rattus norvegicus
actgttgtttatcggtatggtgtaa

SEQ ID NO: 99244 - DNA, 25 bp, Rattus norvegicus
actgttgtttatgggtatggtgtaa

SEQ ID NO: 99245 - DNA, 25 bp, Rattus norvegicus
actgtttaatcgagtctgtgctcaa

SEQ ID NO: 99246 - DNA, 25 bp, Rattus norvegicus
actgtttaatcgtgtctgtgctcaa

SEQ ID NO: 99247 - DNA, 25 bp, Rattus norvegicus
actgtttaggtgctgactgtccctt

SEQ ID NO: 99248 - DNA, 25 bp, Rattus norvegicus
actgtttaggtggtgactgtccctt

SEQ ID NO: 99249 - DNA, 25 bp, Rattus norvegicus
actgtttataccacagatgtttctg

SEQ ID NO: 99250 - DNA, 25 bp, Rattus norvegicus
actgtttatacctcagatgtttctg

SEQ ID NO: 99251 - DNA, 25 bp, Rattus norvegicus
actgtttatgccagggtgtatatat

SEQ ID NO: 99252 - DNA, 25 bp, Rattus norvegicus
actgtttatgcctgggtgtatatat

SEQ ID NO: 99253 - DNA, 25 bp, Rattus norvegicus
actgtttcagtcaagcttaaccacc

SEQ ID NO: 99254 - DNA, 25 bp, Rattus norvegicus
actgtttcagtctagcttaaccacc

SEQ ID NO: 99255 - DNA, 25 bp, Rattus norvegicus
actgtttcattgagacccgcgagct

SEQ ID NO: 99256 - DNA, 25 bp, Rattus norvegicus
actgtttcattgtgacccgcgagct

SEQ ID NO: 99257 - DNA, 25 bp, Rattus norvegicus
actgtttcccatctgatcatacctc

SEQ ID NO: 99258 - DNA, 25 bp, Rattus norvegicus
actgtttcccatgtgatcatacctc

SEQ ID NO: 99259 - DNA, 25 bp, Rattus norvegicus
actgtttctgctcgtggattctata

SEQ ID NO: 99260 - DNA, 25 bp, Rattus norvegicus
actgtttctgctggtggattctata

SEQ ID NO: 99261 - DNA, 25 bp, Rattus norvegicus
actgtttctggcagggtgagattcc

SEQ ID NO: 99262 - DNA, 25 bp, Rattus norvegicus
actgtttctggctgggtgagattcc

SEQ ID NO: 99263 - DNA, 25 bp, Rattus norvegicus
actgtttctgttcttgtgattttca

SEQ ID NO: 99264 - DNA, 25 bp, Rattus norvegicus
actgtttctgttgttgtgattttca

SEQ ID NO: 99265 - DNA, 25 bp, Rattus norvegicus
actgtttcttcaccggcaactgcat

SEQ ID NO: 99266 - DNA, 25 bp, Rattus norvegicus
actgtttcttcagcggcaactgcat

SEQ ID NO: 99267 - DNA, 25 bp, Rattus norvegicus
actgtttgagccagttcaaggccaa

SEQ ID NO: 99268 - DNA, 25 bp, Rattus norvegicus
actgtttgagcctgttcaaggccaa

SEQ ID NO: 99269 - DNA, 25 bp, Rattus norvegicus
actgtttgaggaaacggccctcgct

SEQ ID NO: 99270 - DNA, 25 bp, Rattus norvegicus
actgtttgaggatacggccctcgct

SEQ ID NO: 99271 - DNA, 25 bp, Rattus norvegicus
actgtttgatccaggtcgtcagcag

SEQ ID NO: 99272 - DNA, 25 bp, Rattus norvegicus
actgtttgatcctggtcgtcagcag

SEQ ID NO: 99273 - DNA, 25 bp, Rattus norvegicus
actgtttgcaaacgaagcatgcctt

SEQ ID NO: 99274 - DNA, 25 bp, Rattus norvegicus
actgtttgcaaaggaagcatgcctt

SEQ ID NO: 99275 - DNA, 25 bp, Rattus norvegicus
actgtttgctgacgttcactgactg

SEQ ID NO: 99276 - DNA, 25 bp, Rattus norvegicus
actgtttgctgaggttcactgactg

SEQ ID NO: 99277 - DNA, 25 bp, Rattus norvegicus
actgtttggagcctgagttttgttc

SEQ ID NO: 99278 - DNA, 25 bp, Rattus norvegicus
actgtttggagcgtgagttttgttc

SEQ ID NO: 99279 - DNA, 25 bp, Rattus norvegicus
actgtttggcttcattactgtctgt

SEQ ID NO: 99280 - DNA, 25 bp, Rattus norvegicus
actgtttggcttgattactgtctgt

SEQ ID NO: 99281 - DNA, 25 bp, Rattus norvegicus
actgtttgtaacatgagctcctggg

SEQ ID NO: 99282 - DNA, 25 bp, Rattus norvegicus
actgtttgtaacttgagctcctggg

SEQ ID NO: 99283 - DNA, 25 bp, Rattus norvegicus
actgtttgtctcaggcatacatggt

SEQ ID NO: 99284 - DNA, 25 bp, Rattus norvegicus
actgtttgtctctggcatacatggt

SEQ ID NO: 99285 - DNA, 25 bp, Rattus norvegicus
actgttttaaacctttgtgtgctgg

SEQ ID NO: 99286 - DNA, 25 bp, Rattus norvegicus
actgttttaaacgtttgtgtgctgg

SEQ ID NO: 99287 - DNA, 25 bp, Rattus norvegicus
actgttttacctacttgtactgatg

SEQ ID NO: 99288 - DNA, 25 bp, Rattus norvegicus
actgttttaccttcttgtactgatg

SEQ ID NO: 99289 - DNA, 25 bp, Rattus norvegicus
actgttttatgtagctttctagaga

SEQ ID NO: 99290 - DNA, 25 bp, Rattus norvegicus
actgttttatgttgctttctagaga

SEQ ID NO: 99291 - DNA, 25 bp, Rattus norvegicus
actgttttcaaaccaatgtgactga

SEQ ID NO: 99292 - DNA, 25 bp, Rattus norvegicus
actgttttcaaagcaatgtgactga

SEQ ID NO: 99293 - DNA, 25 bp, Rattus norvegicus
actgttttcttgatgcatggttgac

SEQ ID NO: 99294 - DNA, 25 bp, Rattus norvegicus
actgttttcttgttgcatggttgac

SEQ ID NO: 99295 - DNA, 25 bp, Rattus norvegicus
actgttttgatgctggactgggtac

SEQ ID NO: 99296 - DNA, 25 bp, Rattus norvegicus
actgttttgatggtggactgggtac

SEQ ID NO: 99297 - DNA, 25 bp, Rattus norvegicus
actgttttggcaaggactgtattta

SEQ ID NO: 99298 - DNA, 25 bp, Rattus norvegicus
actgttttggcatggactgtattta

SEQ ID NO: 99299 - DNA, 25 bp, Rattus norvegicus
actgttttggttatggcaccatcca

SEQ ID NO: 99300 - DNA, 25 bp, Rattus norvegicus
actgttttggttttggcaccatcca

SEQ ID NO: 99301 - DNA, 25 bp, Rattus norvegicus
actgttttgtgtatgagtcttcgat

SEQ ID NO: 99302 - DNA, 25 bp, Rattus norvegicus
actgttttgtgtttgagtcttcgat

SEQ ID NO: 99303 - DNA, 25 bp, Rattus norvegicus
actgttttgttaagcctttctcccg

SEQ ID NO: 99304 - DNA, 25 bp, Rattus norvegicus
actgttttgttatgcctttctcccg

SEQ ID NO: 99305 - DNA, 25 bp, Rattus norvegicus
actgtttttctaacgtaactcccag

SEQ ID NO: 99306 - DNA, 25 bp, Rattus norvegicus
actgtttttctatcgtaactcccag

SEQ ID NO: 99307 - DNA, 25 bp, Rattus norvegicus
acttaaaacttgactggtgtatgga

SEQ ID NO: 99308 - DNA, 25 bp, Rattus norvegicus
acttaaaacttgtctggtgtatgga

SEQ ID NO: 99309 - DNA, 25 bp, Rattus norvegicus
acttaaaagatactgtttccatcct

SEQ ID NO: 99310 - DNA, 25 bp, Rattus norvegicus
acttaaaagatagtgtttccatcct

SEQ ID NO: 99311 - DNA, 25 bp, Rattus norvegicus
acttaaaagctcatcctgggaaagg

SEQ ID NO: 99312 - DNA, 25 bp, Rattus norvegicus
acttaaaagctcttcctgggaaagg

SEQ ID NO: 99313 - DNA, 25 bp, Rattus norvegicus
acttaaaatcgccaggtgtggtagc

SEQ ID NO: 99314 - DNA, 25 bp, Rattus norvegicus
acttaaaatcgcgaggtgtggtagc

SEQ ID NO: 99315 - DNA, 25 bp, Rattus norvegicus
acttaaactagtctacatgggtggg

SEQ ID NO: 99316 - DNA, 25 bp, Rattus norvegicus
acttaaactagtgtacatgggtggg

SEQ ID NO: 99317 - DNA, 25 bp, Rattus norvegicus
acttaaagcacaccagaaggccatg

SEQ ID NO: 99318 - DNA, 25 bp, Rattus norvegicus
acttaaagcacagcagaaggccatg

SEQ ID NO: 99319 - DNA, 25 bp, Rattus norvegicus
acttaaagctgaacccaacctgcat

SEQ ID NO: 99320 - DNA, 25 bp, Rattus norvegicus
acttaaagctgatcccaacctgcat

SEQ ID NO: 99321 - DNA, 25 bp, Rattus norvegicus
acttaaagtcttagggcctacacat

SEQ ID NO: 99322 - DNA, 25 bp, Rattus norvegicus
acttaaagtctttgggcctacacat

SEQ ID NO: 99323 - DNA, 25 bp, Rattus norvegicus
acttaaatatgtatgtcctggaact

SEQ ID NO: 99324 - DNA, 25 bp, Rattus norvegicus
acttaaatatgtttgtcctggaact

SEQ ID NO: 99325 - DNA, 25 bp, Rattus norvegicus
acttaacacagtagattgctttcaa

SEQ ID NO: 99326 - DNA, 25 bp, Rattus norvegicus
acttaacacagttgattgctttcaa

SEQ ID NO: 99327 - DNA, 25 bp, Rattus norvegicus
acttaacacatgatctttctgcctc

SEQ ID NO: 99328 - DNA, 25 bp, Rattus norvegicus
acttaacacatgttctttctgcctc

SEQ ID NO: 99329 - DNA, 25 bp, Rattus norvegicus
acttaacactttctactgtcatgca

SEQ ID NO: 99330 - DNA, 25 bp, Rattus norvegicus
acttaacactttgtactgtcatgca

SEQ ID NO: 99331 - DNA, 25 bp, Rattus norvegicus
acttaacagggactttcaggctagc

SEQ ID NO: 99332 - DNA, 25 bp, Rattus norvegicus
acttaacagggagtttcaggctagc

SEQ ID NO: 99333 - DNA, 25 bp, Rattus norvegicus
acttaacagttcaggctttcattaa

SEQ ID NO: 99334 - DNA, 25 bp, Rattus norvegicus
acttaacagttcctgctgtggtttg

SEQ ID NO: 99335 - DNA, 25 bp, Rattus norvegicus
acttaacagttcgtgctgtggtttg

SEQ ID NO: 99336 - DNA, 25 bp, Rattus norvegicus
acttaacagttctggctttcattaa

SEQ ID NO: 99337 - DNA, 25 bp, Rattus norvegicus
acttaacatttcatttacagggctg

SEQ ID NO: 99338 - DNA, 25 bp, Rattus norvegicus
acttaacatttcttttacagggctg

SEQ ID NO: 99339 - DNA, 25 bp, Rattus norvegicus
acttaacctgccatgcgctaggctt

SEQ ID NO: 99340 - DNA, 25 bp, Rattus norvegicus
acttaacctgccttgcgctaggctt

SEQ ID NO: 99341 - DNA, 25 bp, Rattus norvegicus
acttaactagagcttctccatgtga

SEQ ID NO: 99342 - DNA, 25 bp, Rattus norvegicus
acttaactagaggttctccatgtga

SEQ ID NO: 99343 - DNA, 25 bp, Rattus norvegicus
acttaactctctcgtcagtgcttaa

SEQ ID NO: 99344 - DNA, 25 bp, Rattus norvegicus
acttaactctctggtcagtgcttaa

SEQ ID NO: 99345 - DNA, 25 bp, Rattus norvegicus
acttaactgtgaacctcctgcatgt

SEQ ID NO: 99346 - DNA, 25 bp, Rattus norvegicus
acttaactgtgatcctcctgcatgt

SEQ ID NO: 99347 - DNA, 25 bp, Rattus norvegicus
acttaagactttcctttggcactgt

SEQ ID NO: 99348 - DNA, 25 bp, Rattus norvegicus
acttaagactttgctttggcactgt

SEQ ID NO: 99349 - DNA, 25 bp, Rattus norvegicus
acttaagagggaatgtgggtagaca

SEQ ID NO: 99350 - DNA, 25 bp, Rattus norvegicus
acttaagagggattgtgggtagaca

SEQ ID NO: 99351 - DNA, 25 bp, Rattus norvegicus
acttaagcaagccatctgaccctga

SEQ ID NO: 99352 - DNA, 25 bp, Rattus norvegicus
acttaagcaagcgatctgaccctga

SEQ ID NO: 99353 - DNA, 25 bp, Rattus norvegicus
acttaagcattcatattggctagga

SEQ ID NO: 99354 - DNA, 25 bp, Rattus norvegicus
acttaagcattcttattggctagga

SEQ ID NO: 99355 - DNA, 25 bp, Rattus norvegicus
acttaagctatgaggtgcttacccc

SEQ ID NO: 99356 - DNA, 25 bp, Rattus norvegicus
acttaagctatgtggtgcttacccc

SEQ ID NO: 99357 - DNA, 25 bp, Rattus norvegicus
acttaaggattcaaccaactgggat

SEQ ID NO: 99358 - DNA, 25 bp, Rattus norvegicus
acttaaggattctaccaactgggat

SEQ ID NO: 99359 - DNA, 25 bp, Rattus norvegicus
acttaaggctgtcaggctccttttt

SEQ ID NO: 99360 - DNA, 25 bp, Rattus norvegicus
acttaaggctgtgaggctccttttt

SEQ ID NO: 99361 - DNA, 25 bp, Rattus norvegicus
acttaagtgagtaggcctggtgcct

SEQ ID NO: 99362 - DNA, 25 bp, Rattus norvegicus
acttaagtgagttggcctggtgcct

SEQ ID NO: 99363 - DNA, 25 bp, Rattus norvegicus
acttaagttcagagctccttgtcta

SEQ ID NO: 99364 - DNA, 25 bp, Rattus norvegicus
acttaagttcagtgctccttgtcta

SEQ ID NO: 99365 - DNA, 25 bp, Rattus norvegicus
acttaatgcccgctctgcacgttct

SEQ ID NO: 99366 - DNA, 25 bp, Rattus norvegicus
acttaatgcccggtctgcacgttct

SEQ ID NO: 99367 - DNA, 25 bp, Rattus norvegicus
acttaatggagaactggcatcagca

SEQ ID NO: 99368 - DNA, 25 bp, Rattus norvegicus
acttaatggagatctggcatcagca

SEQ ID NO: 99369 - DNA, 25 bp, Rattus norvegicus
acttaatgtttcctgtgctaatcat

SEQ ID NO: 99370 - DNA, 25 bp, Rattus norvegicus
acttaatgtttcgtgtgctaatcat

SEQ ID NO: 99371 - DNA, 25 bp, Rattus norvegicus
acttaattgctgaagggactcattc

SEQ ID NO: 99372 - DNA, 25 bp, Rattus norvegicus
acttaattgctgctctgggcctccg

SEQ ID NO: 99373 - DNA, 25 bp, Rattus norvegicus
acttaattgctggtctgggcctccg

SEQ ID NO: 99374 - DNA, 25 bp, Rattus norvegicus
acttaattgctgtagggactcattc

SEQ ID NO: 99375 - DNA, 25 bp, Rattus norvegicus
acttaatttctcacatttggacttg

SEQ ID NO: 99376 - DNA, 25 bp, Rattus norvegicus
acttaatttctctcatttggacttg

SEQ ID NO: 99377 - DNA, 25 bp, Rattus norvegicus
acttaattttccagcacaccgggag

SEQ ID NO: 99378 - DNA, 25 bp, Rattus norvegicus
acttaattttcctgcacaccgggag

SEQ ID NO: 99379 - DNA, 25 bp, Rattus norvegicus
acttaatttttgacctgccattcac

SEQ ID NO: 99380 - DNA, 25 bp, Rattus norvegicus
acttaatttttgtcctgccattcac

SEQ ID NO: 99381 - DNA, 25 bp, Rattus norvegicus
acttacaaccccatcatgagagtga

SEQ ID NO: 99382 - DNA, 25 bp, Rattus norvegicus
acttacaaccccttcatgagagtga

SEQ ID NO: 99383 - DNA, 25 bp, Rattus norvegicus
acttacaataacaccgacttcaggg

SEQ ID NO: 99384 - DNA, 25 bp, Rattus norvegicus
acttacaataactccgacttcaggg

SEQ ID NO: 99385 - DNA, 25 bp, Rattus norvegicus
acttacaatgtaagccctgctgcct

SEQ ID NO: 99386 - DNA, 25 bp, Rattus norvegicus
acttacaatgtatgccctgctgcct

SEQ ID NO: 99387 - DNA, 25 bp, Rattus norvegicus
acttacacagtcaggatgggctcct

SEQ ID NO: 99388 - DNA, 25 bp, Rattus norvegicus
acttacacagtccttcagagattgt

SEQ ID NO: 99389 - DNA, 25 bp, Rattus norvegicus
acttacacagtcgttcagagattgt

SEQ ID NO: 99390 - DNA, 25 bp, Rattus norvegicus
acttacacagtctggatgggctcct

SEQ ID NO: 99391 - DNA, 25 bp, Rattus norvegicus
acttacagacagacttgtcccttgt

SEQ ID NO: 99392 - DNA, 25 bp, Rattus norvegicus
acttacagacagtcttgtcccttgt

SEQ ID NO: 99393 - DNA, 25 bp, Rattus norvegicus
acttacatctgcaatgctgtctcag

SEQ ID NO: 99394 - DNA, 25 bp, Rattus norvegicus
acttacatctgctatgctgtctcag

SEQ ID NO: 99395 - DNA, 25 bp, Rattus norvegicus
acttacatgcctctagtgtgtgtgt

SEQ ID NO: 99396 - DNA, 25 bp, Rattus norvegicus
acttacatgcctgtagtgtgtgtgt

SEQ ID NO: 99397 - DNA, 25 bp, Rattus norvegicus
acttaccaccttatacagctccagg

SEQ ID NO: 99398 - DNA, 25 bp, Rattus norvegicus
acttaccaccttttacagctccagg

SEQ ID NO: 99399 - DNA, 25 bp, Rattus norvegicus
acttaccagtgaaatatcctcatct

SEQ ID NO: 99400 - DNA, 25 bp, Rattus norvegicus
acttaccagtgatatatcctcatct

SEQ ID NO: 99401 - DNA, 25 bp, Rattus norvegicus
acttacccatgtccttgcttgtgag

SEQ ID NO: 99402 - DNA, 25 bp, Rattus norvegicus
acttacccatgtgcttgcttgtgag

SEQ ID NO: 99403 - DNA, 25 bp, Rattus norvegicus
acttaccccagtcaatgcagtctgt

SEQ ID NO: 99404 - DNA, 25 bp, Rattus norvegicus
acttaccccagtgaatgcagtctgt

SEQ ID NO: 99405 - DNA, 25 bp, Rattus norvegicus
acttaccctcatatagagccattgc

SEQ ID NO: 99406 - DNA, 25 bp, Rattus norvegicus
acttaccctcatttagagccattgc

SEQ ID NO: 99407 - DNA, 25 bp, Rattus norvegicus
acttaccgcaaaactgtagcctgag

SEQ ID NO: 99408 - DNA, 25 bp, Rattus norvegicus
acttaccgcaaatctgtagcctgag

SEQ ID NO: 99409 - DNA, 25 bp, Rattus norvegicus
acttaccgcaagaggatgtccagga

SEQ ID NO: 99410 - DNA, 25 bp, Rattus norvegicus
acttaccgcaagtggatgtccagga

SEQ ID NO: 99411 - DNA, 25 bp, Rattus norvegicus
acttaccggatgctggttccaggac

SEQ ID NO: 99412 - DNA, 25 bp, Rattus norvegicus
acttaccggatggtggttccaggac

SEQ ID NO: 99413 - DNA, 25 bp, Rattus norvegicus
acttacctcccaagccacagatgaa

SEQ ID NO: 99414 - DNA, 25 bp, Rattus norvegicus
acttacctcccatgccacagatgaa

SEQ ID NO: 99415 - DNA, 25 bp, Rattus norvegicus
acttacctgaacatgggcacagctt

SEQ ID NO: 99416 - DNA, 25 bp, Rattus norvegicus
acttacctgaacttgggcacagctt

SEQ ID NO: 99417 - DNA, 25 bp, Rattus norvegicus
acttacctggagagacacatgtctg

SEQ ID NO: 99418 - DNA, 25 bp, Rattus norvegicus
acttacctggagtgacacatgtctg

SEQ ID NO: 99419 - DNA, 25 bp, Rattus norvegicus
acttacgatgccatttctcttatgt

SEQ ID NO: 99420 - DNA, 25 bp, Rattus norvegicus
acttacgatgccttttctcttatgt

SEQ ID NO: 99421 - DNA, 25 bp, Rattus norvegicus
acttacggccgtccttgtaatgatc

SEQ ID NO: 99422 - DNA, 25 bp, Rattus norvegicus
acttacggccgtgcttgtaatgatc

SEQ ID NO: 99423 - DNA, 25 bp, Rattus norvegicus
acttacgtccttagggtcatcttgg

SEQ ID NO: 99424 - DNA, 25 bp, Rattus norvegicus
acttacgtcctttgggtcatcttgg

SEQ ID NO: 99425 - DNA, 25 bp, Rattus norvegicus
acttacgtgatgatgcctcgcatta

SEQ ID NO: 99426 - DNA, 25 bp, Rattus norvegicus
acttacgtgatgttgcctcgcatta

SEQ ID NO: 99427 - DNA, 25 bp, Rattus norvegicus
acttactagccaagtgaccttggcc

SEQ ID NO: 99428 - DNA, 25 bp, Rattus norvegicus
acttactagccatgtgaccttggcc

SEQ ID NO: 99429 - DNA, 25 bp, Rattus norvegicus
acttactcagttagcttctttccac

SEQ ID NO: 99430 - DNA, 25 bp, Rattus norvegicus
acttactcagtttgcttctttccac

SEQ ID NO: 99431 - DNA, 25 bp, Rattus norvegicus
acttactcctcgaggccaagaagat

SEQ ID NO: 99432 - DNA, 25 bp, Rattus norvegicus
acttactcctcgtggccaagaagat

SEQ ID NO: 99433 - DNA, 25 bp, Rattus norvegicus
acttactccttaactcttagtccag

SEQ ID NO: 99434 - DNA, 25 bp, Rattus norvegicus
acttactccttatctcttagtccag

SEQ ID NO: 99435 - DNA, 25 bp, Rattus norvegicus
acttactcttatctcagcaacgcag

SEQ ID NO: 99436 - DNA, 25 bp, Rattus norvegicus
acttactcttatgtcagcaacgcag

SEQ ID NO: 99437 - DNA, 25 bp, Rattus norvegicus
acttactgcccaaacatacatgtgt

SEQ ID NO: 99438 - DNA, 25 bp, Rattus norvegicus
acttactgcccatacatacatgtgt

SEQ ID NO: 99439 - DNA, 25 bp, Rattus norvegicus
acttactgcgacaccttgtaggtat

SEQ ID NO: 99440 - DNA, 25 bp, Rattus norvegicus
acttactgcgactccttgtaggtat

SEQ ID NO: 99441 - DNA, 25 bp, Rattus norvegicus
acttactgctgaaattctggcacgt

SEQ ID NO: 99442 - DNA, 25 bp, Rattus norvegicus
acttactgctgatattctggcacgt

SEQ ID NO: 99443 - DNA, 25 bp, Rattus norvegicus
acttacttcctcaacccagtgtttg

SEQ ID NO: 99444 - DNA, 25 bp, Rattus norvegicus
acttacttcctctacccagtgtttg

SEQ ID NO: 99445 - DNA, 25 bp, Rattus norvegicus
acttacttctgtaccttagatctgc

SEQ ID NO: 99446 - DNA, 25 bp, Rattus norvegicus
acttacttctgttccttagatctgc

SEQ ID NO: 99447 - DNA, 25 bp, Rattus norvegicus
acttactttataagctgtgatgtca

SEQ ID NO: 99448 - DNA, 25 bp, Rattus norvegicus
acttactttatatgctgtgatgtca

SEQ ID NO: 99449 - DNA, 25 bp, Rattus norvegicus
acttactttgctagtagttgcttac

SEQ ID NO: 99450 - DNA, 25 bp, Rattus norvegicus
acttactttgcttgtagttgcttac

SEQ ID NO: 99451 - DNA, 25 bp, Rattus norvegicus
acttagaaaacactcctgctgctga

SEQ ID NO: 99452 - DNA, 25 bp, Rattus norvegicus
acttagaaaacagtcctgctgctga

SEQ ID NO: 99453 - DNA, 25 bp, Rattus norvegicus
acttagacccttcaagttctgcctc

SEQ ID NO: 99454 - DNA, 25 bp, Rattus norvegicus
acttagacccttgaagttctgcctc

SEQ ID NO: 99455 - DNA, 25 bp, Rattus norvegicus
acttagactcaccagcttatgatga

SEQ ID NO: 99456 - DNA, 25 bp, Rattus norvegicus
acttagactcacgagcttatgatga

SEQ ID NO: 99457 - DNA, 25 bp, Rattus norvegicus
acttagaggctgaccgaatccggca

SEQ ID NO: 99458 - DNA, 25 bp, Rattus norvegicus
acttagaggctgtccgaatccggca

SEQ ID NO: 99459 - DNA, 25 bp, Rattus norvegicus
acttagagggttctgctgtggcttc

SEQ ID NO: 99460 - DNA, 25 bp, Rattus norvegicus
acttagagggttgtgctgtggcttc

SEQ ID NO: 99461 - DNA, 25 bp, Rattus norvegicus
acttagatgcatattgtgttcctta

SEQ ID NO: 99462 - DNA, 25 bp, Rattus norvegicus
acttagatgcattttgtgttcctta

SEQ ID NO: 99463 - DNA, 25 bp, Rattus norvegicus
acttagattatcataatggttcaac

SEQ ID NO: 99464 - DNA, 25 bp, Rattus norvegicus
acttagattatcttaatggttcaac

SEQ ID NO: 99465 - DNA, 25 bp, Rattus norvegicus
acttagatttcaccgtactttctgg

SEQ ID NO: 99466 - DNA, 25 bp, Rattus norvegicus
acttagatttcagcgtactttctgg

SEQ ID NO: 99467 - DNA, 25 bp, Rattus norvegicus
acttagatttctattacgctatgta

SEQ ID NO: 99468 - DNA, 25 bp, Rattus norvegicus
acttagatttcttttacgctatgta

SEQ ID NO: 99469 - DNA, 25 bp, Rattus norvegicus
acttagcactcaagcactcacgaat

SEQ ID NO: 99470 - DNA, 25 bp, Rattus norvegicus
acttagcactcatgcactcacgaat

SEQ ID NO: 99471 - DNA, 25 bp, Rattus norvegicus
acttagccagcaagtgagtctgcga

SEQ ID NO: 99472 - DNA, 25 bp, Rattus norvegicus
acttagccagcatgtgagtctgcga

SEQ ID NO: 99473 - DNA, 25 bp, Rattus norvegicus
acttagccaggcattagcacaccag

SEQ ID NO: 99474 - DNA, 25 bp, Rattus norvegicus
acttagccaggctttagcacaccag

SEQ ID NO: 99475 - DNA, 25 bp, Rattus norvegicus
acttagccatttctctattcctttc

SEQ ID NO: 99476 - DNA, 25 bp, Rattus norvegicus
acttagccatttgtctattcctttc

SEQ ID NO: 99477 - DNA, 25 bp, Rattus norvegicus
acttagcgacttatcttcatttctc

SEQ ID NO: 99478 - DNA, 25 bp, Rattus norvegicus
acttagcgacttttcttcatttctc

SEQ ID NO: 99479 - DNA, 25 bp, Rattus norvegicus
acttagctaaatctttgtgtcctga

SEQ ID NO: 99480 - DNA, 25 bp, Rattus norvegicus
acttagctaaatgtttgtgtcctga

SEQ ID NO: 99481 - DNA, 25 bp, Rattus norvegicus
acttagctagtcaagtgcctttacc

SEQ ID NO: 99482 - DNA, 25 bp, Rattus norvegicus
acttagctagtctagtgcctttacc

SEQ ID NO: 99483 - DNA, 25 bp, Rattus norvegicus
acttagctctggactctgcattgta

SEQ ID NO: 99484 - DNA, 25 bp, Rattus norvegicus
acttagctctggtctctgcattgta

SEQ ID NO: 99485 - DNA, 25 bp, Rattus norvegicus
acttagctttgtctactttgggatg

SEQ ID NO: 99486 - DNA, 25 bp, Rattus norvegicus
acttagctttgtgtactttgggatg

SEQ ID NO: 99487 - DNA, 25 bp, Rattus norvegicus
acttaggaagtcagtgtcactggcc

SEQ ID NO: 99488 - DNA, 25 bp, Rattus norvegicus
acttaggaagtctgtgtcactggcc

SEQ ID NO: 99489 - DNA, 25 bp, Rattus norvegicus
acttaggactacatgttgctcttgc

SEQ ID NO: 99490 - DNA, 25 bp, Rattus norvegicus
acttaggactacttgttgctcttgc

SEQ ID NO: 99491 - DNA, 25 bp, Rattus norvegicus
acttaggattccagggattcccaca

SEQ ID NO: 99492 - DNA, 25 bp, Rattus norvegicus
acttaggattcctgggattcccaca

SEQ ID NO: 99493 - DNA, 25 bp, Rattus norvegicus
acttaggcatggaaggtccttcgct

SEQ ID NO: 99494 - DNA, 25 bp, Rattus norvegicus
acttaggcatggtaggtccttcgct

SEQ ID NO: 99495 - DNA, 25 bp, Rattus norvegicus
acttaggctataagttgtgctgaga

SEQ ID NO: 99496 - DNA, 25 bp, Rattus norvegicus
acttaggctatatgttgtgctgaga

SEQ ID NO: 99497 - DNA, 25 bp, Rattus norvegicus
acttaggctccaacgtaactgcaat

SEQ ID NO: 99498 - DNA, 25 bp, Rattus norvegicus
acttaggctccatcgtaactgcaat

SEQ ID NO: 99499 - DNA, 25 bp, Rattus norvegicus
acttaggctgcaacaacgatcggaa

SEQ ID NO: 99500 - DNA, 25 bp, Rattus norvegicus
acttaggctgcatcaacgatcggaa

SEQ ID NO: 99501 - DNA, 25 bp, Rattus norvegicus
acttagggcctgcagtgacggctca

SEQ ID NO: 99502 - DNA, 25 bp, Rattus norvegicus
acttagggcctggagtgacggctca

SEQ ID NO: 99503 - DNA, 25 bp, Rattus norvegicus
acttagtaatggaagccctgtcttt

SEQ ID NO: 99504 - DNA, 25 bp, Rattus norvegicus
acttagtaatggtagccctgtcttt

SEQ ID NO: 99505 - DNA, 25 bp, Rattus norvegicus
acttagtccggcagcgatgggcctt

SEQ ID NO: 99506 - DNA, 25 bp, Rattus norvegicus
acttagtccggctgcgatgggcctt

SEQ ID NO: 99507 - DNA, 25 bp, Rattus norvegicus
acttagtcctatctctttatgttat

SEQ ID NO: 99508 - DNA, 25 bp, Rattus norvegicus
acttagtcctatgtctttatgttat

SEQ ID NO: 99509 - DNA, 25 bp, Rattus norvegicus
acttagtcctcaaccatgtgatgtg

SEQ ID NO: 99510 - DNA, 25 bp, Rattus norvegicus
acttagtcctcatccatgtgatgtg

SEQ ID NO: 99511 - DNA, 25 bp, Rattus norvegicus
acttagtctctcaccatttggctga

SEQ ID NO: 99512 - DNA, 25 bp, Rattus norvegicus
acttagtctctctccatttggctga

SEQ ID NO: 99513 - DNA, 25 bp, Rattus norvegicus
acttagtgcgagagcttcaacatct

SEQ ID NO: 99514 - DNA, 25 bp, Rattus norvegicus
acttagtgcgagtgcttcaacatct

SEQ ID NO: 99515 - DNA, 25 bp, Rattus norvegicus
acttagttccctagcagtagcctat

SEQ ID NO: 99516 - DNA, 25 bp, Rattus norvegicus
acttagttccctcgatgtatcctgt

SEQ ID NO: 99517 - DNA, 25 bp, Rattus norvegicus
acttagttccctggatgtatcctgt

SEQ ID NO: 99518 - DNA, 25 bp, Rattus norvegicus
acttagttcccttgcagtagcctat

SEQ ID NO: 99519 - DNA, 25 bp, Rattus norvegicus
acttagtttagcaagtgtccctggc

SEQ ID NO: 99520 - DNA, 25 bp, Rattus norvegicus
acttagtttagctagtgtccctggc

SEQ ID NO: 99521 - DNA, 25 bp, Rattus norvegicus
acttagtttgtcattatgtcatatt

SEQ ID NO: 99522 - DNA, 25 bp, Rattus norvegicus
acttagtttgtctttatgtcatatt

SEQ ID NO: 99523 - DNA, 25 bp, Rattus norvegicus
acttagttttggctaatggcgccca

SEQ ID NO: 99524 - DNA, 25 bp, Rattus norvegicus
acttagttttgggtaatggcgccca

SEQ ID NO: 99525 - DNA, 25 bp, Rattus norvegicus
acttagtttttacatgtcacattca

SEQ ID NO: 99526 - DNA, 25 bp, Rattus norvegicus
acttagtttttagatgtcacattca

SEQ ID NO: 99527 - DNA, 25 bp, Rattus norvegicus
acttataaactaatcctgggcctgg

SEQ ID NO: 99528 - DNA, 25 bp, Rattus norvegicus
acttataaactattcctgggcctgg

SEQ ID NO: 99529 - DNA, 25 bp, Rattus norvegicus
acttataaaggaagctgcccaccca

SEQ ID NO: 99530 - DNA, 25 bp, Rattus norvegicus
acttataaaggatgctgcccaccca

SEQ ID NO: 99531 - DNA, 25 bp, Rattus norvegicus
acttataactacagccctcaggagg

SEQ ID NO: 99532 - DNA, 25 bp, Rattus norvegicus
acttataactactgccctcaggagg

SEQ ID NO: 99533 - DNA, 25 bp, Rattus norvegicus
acttataagcgcccggctccgggag

SEQ ID NO: 99534 - DNA, 25 bp, Rattus norvegicus
acttataagcgcgcggctccgggag

SEQ ID NO: 99535 - DNA, 25 bp, Rattus norvegicus
acttatagtcccctcttattctgag

SEQ ID NO: 99536 - DNA, 25 bp, Rattus norvegicus
acttatagtcccgtcttattctgag

SEQ ID NO: 99537 - DNA, 25 bp, Rattus norvegicus
acttatatgtggctagtctgcgaag

SEQ ID NO: 99538 - DNA, 25 bp, Rattus norvegicus
acttatatgtgggtagtctgcgaag

SEQ ID NO: 99539 - DNA, 25 bp, Rattus norvegicus
acttatcaagatatcccctttcagc

SEQ ID NO: 99540 - DNA, 25 bp, Rattus norvegicus
acttatcaagatttcccctttcagc

SEQ ID NO: 99541 - DNA, 25 bp, Rattus norvegicus
acttatcagtgtatcctcagagaga

SEQ ID NO: 99542 - DNA, 25 bp, Rattus norvegicus
acttatcagtgtttcctcagagaga

SEQ ID NO: 99543 - DNA, 25 bp, Rattus norvegicus
acttatcgcaggatggaggtgttct

SEQ ID NO: 99544 - DNA, 25 bp, Rattus norvegicus
acttatcgcaggttggaggtgttct

SEQ ID NO: 99545 - DNA, 25 bp, Rattus norvegicus
acttatctactgatgattccaactg

SEQ ID NO: 99546 - DNA, 25 bp, Rattus norvegicus
acttatctactgttgattccaactg

SEQ ID NO: 99547 - DNA, 25 bp, Rattus norvegicus
acttatctgagtaagcttccatgtt

SEQ ID NO: 99548 - DNA, 25 bp, Rattus norvegicus
acttatctgagtcggctttggtgaa

SEQ ID NO: 99549 - DNA, 25 bp, Rattus norvegicus
acttatctgagtgggctttggtgaa

SEQ ID NO: 99550 - DNA, 25 bp, Rattus norvegicus
acttatctgagttagcttccatgtt

SEQ ID NO: 99551 - DNA, 25 bp, Rattus norvegicus
acttatctttctactgcatgtcctg

SEQ ID NO: 99552 - DNA, 25 bp, Rattus norvegicus
acttatctttcttctgcatgtcctg

SEQ ID NO: 99553 - DNA, 25 bp, Rattus norvegicus
acttatgagctcagtggcgtgcctt

SEQ ID NO: 99554 - DNA, 25 bp, Rattus norvegicus
acttatgagctctgtggcgtgcctt

SEQ ID NO: 99555 - DNA, 25 bp, Rattus norvegicus
acttatgcatgtatcagattatcaa

SEQ ID NO: 99556 - DNA, 25 bp, Rattus norvegicus
acttatgcatgtttcagattatcaa

SEQ ID NO: 99557 - DNA, 25 bp, Rattus norvegicus
acttatgctgagaggtgctgactaa

SEQ ID NO: 99558 - DNA, 25 bp, Rattus norvegicus
acttatgctgagtggtgctgactaa

SEQ ID NO: 99559 - DNA, 25 bp, Rattus norvegicus
acttatgcttaaatgttacaccgta

SEQ ID NO: 99560 - DNA, 25 bp, Rattus norvegicus
acttatgcttaattgttacaccgta

SEQ ID NO: 99561 - DNA, 25 bp, Rattus norvegicus
acttatggtcccactgctgttcaga

SEQ ID NO: 99562 - DNA, 25 bp, Rattus norvegicus
acttatggtccctctgctgttcaga

SEQ ID NO: 99563 - DNA, 25 bp, Rattus norvegicus
acttatgtctgcaaggtcttgctca

SEQ ID NO: 99564 - DNA, 25 bp, Rattus norvegicus
acttatgtctgctaggtcttgctca

SEQ ID NO: 99565 - DNA, 25 bp, Rattus norvegicus
acttatgtgcatagttaggctgtta

SEQ ID NO: 99566 - DNA, 25 bp, Rattus norvegicus
acttatgtgcatatgtgttccccag

SEQ ID NO: 99567 - DNA, 25 bp, Rattus norvegicus
acttatgtgcattgttaggctgtta

SEQ ID NO: 99568 - DNA, 25 bp, Rattus norvegicus
acttatgtgcatttgtgttccccag

SEQ ID NO: 99569 - DNA, 25 bp, Rattus norvegicus
acttatgtttcaacttttcctcggg

SEQ ID NO: 99570 - DNA, 25 bp, Rattus norvegicus
acttatgtttcatcttttcctcggg

SEQ ID NO: 99571 - DNA, 25 bp, Rattus norvegicus
acttattaggcaagtgaggtgcact

SEQ ID NO: 99572 - DNA, 25 bp, Rattus norvegicus
acttattaggcatgtgaggtgcact

SEQ ID NO: 99573 - DNA, 25 bp, Rattus norvegicus
acttattcaaccctattccactagg

SEQ ID NO: 99574 - DNA, 25 bp, Rattus norvegicus
acttattcaaccgtattccactagg

SEQ ID NO: 99575 - DNA, 25 bp, Rattus norvegicus
acttattctagtcttgctggcttat

SEQ ID NO: 99576 - DNA, 25 bp, Rattus norvegicus
acttattctagtgttgctggcttat

SEQ ID NO: 99577 - DNA, 25 bp, Rattus norvegicus
acttattctgatcgttttaggtgac

SEQ ID NO: 99578 - DNA, 25 bp, Rattus norvegicus
acttattctgatggttttaggtgac

SEQ ID NO: 99579 - DNA, 25 bp, Rattus norvegicus
acttcaaactgtctgtccaaggaca

SEQ ID NO: 99580 - DNA, 25 bp, Rattus norvegicus
acttcaaactgtgtgtccaaggaca

SEQ ID NO: 99581 - DNA, 25 bp, Rattus norvegicus
acttcaaatttaatgctctcctttt

SEQ ID NO: 99582 - DNA, 25 bp, Rattus norvegicus
acttcaaatttattgctctcctttt

SEQ ID NO: 99583 - DNA, 25 bp, Rattus norvegicus
acttcaacaaggacgctgggtcatt

SEQ ID NO: 99584 - DNA, 25 bp, Rattus norvegicus
acttcaacaaggtcgctgggtcatt

SEQ ID NO: 99585 - DNA, 25 bp, Rattus norvegicus
acttcaaccacgaggctcacatggg

SEQ ID NO: 99586 - DNA, 25 bp, Rattus norvegicus
acttcaaccacgtggctcacatggg

SEQ ID NO: 99587 - DNA, 25 bp, Rattus norvegicus
acttcaaccagcacctttaggcaga

SEQ ID NO: 99588 - DNA, 25 bp, Rattus norvegicus
acttcaaccagctcctttaggcaga

SEQ ID NO: 99589 - DNA, 25 bp, Rattus norvegicus
acttcaaccctgagtttcattttgg

SEQ ID NO: 99590 - DNA, 25 bp, Rattus norvegicus
acttcaaccctgtgtttcattttgg

SEQ ID NO: 99591 - DNA, 25 bp, Rattus norvegicus
acttcaactgtcatgtgctctgcga

SEQ ID NO: 99592 - DNA, 25 bp, Rattus norvegicus
acttcaactgtcttgtgctctgcga

SEQ ID NO: 99593 - DNA, 25 bp, Rattus norvegicus
acttcaacttaaacatgtcagggca

SEQ ID NO: 99594 - DNA, 25 bp, Rattus norvegicus
acttcaacttaatcatgtcagggca

SEQ ID NO: 99595 - DNA, 25 bp, Rattus norvegicus
acttcaactttgctggatagtcttg

SEQ ID NO: 99596 - DNA, 25 bp, Rattus norvegicus
acttcaactttggtggatagtcttg

SEQ ID NO: 99597 - DNA, 25 bp, Rattus norvegicus
acttcaagcattcctgctggcagaa

SEQ ID NO: 99598 - DNA, 25 bp, Rattus norvegicus
acttcaagcattgctgctggcagaa

SEQ ID NO: 99599 - DNA, 25 bp, Rattus norvegicus
acttcaagccgcagacgcctgtggg

SEQ ID NO: 99600 - DNA, 25 bp, Rattus norvegicus
acttcaagccgctgacgcctgtggg

SEQ ID NO: 99601 - DNA, 25 bp, Rattus norvegicus
acttcaaggctacaatttcatcttc

SEQ ID NO: 99602 - DNA, 25 bp, Rattus norvegicus
acttcaaggctagaatttcatcttc

SEQ ID NO: 99603 - DNA, 25 bp, Rattus norvegicus
acttcaagtcatagcagtttctttt

SEQ ID NO: 99604 - DNA, 25 bp, Rattus norvegicus
acttcaagtcattgcagtttctttt

SEQ ID NO: 99605 - DNA, 25 bp, Rattus norvegicus
acttcaatgtgtcatttccggctgc

SEQ ID NO: 99606 - DNA, 25 bp, Rattus norvegicus
acttcaatgtgtgatttccggctgc

SEQ ID NO: 99607 - DNA, 25 bp, Rattus norvegicus
acttcacacggactcttgccttatt

SEQ ID NO: 99608 - DNA, 25 bp, Rattus norvegicus
acttcacacggagtcttgccttatt

SEQ ID NO: 99609 - DNA, 25 bp, Rattus norvegicus
acttcacagctcaggcttgtcggga

SEQ ID NO: 99610 - DNA, 25 bp, Rattus norvegicus
acttcacagctctggcttgtcggga

SEQ ID NO: 99611 - DNA, 25 bp, Rattus norvegicus
acttcacagtcaaggcagtcctcta

SEQ ID NO: 99612 - DNA, 25 bp, Rattus norvegicus
acttcacagtcatggcagtcctcta

SEQ ID NO: 99613 - DNA, 25 bp, Rattus norvegicus
acttcacagtgtaggcggcagggac

SEQ ID NO: 99614 - DNA, 25 bp, Rattus norvegicus
acttcacagtgttggcggcagggac

SEQ ID NO: 99615 - DNA, 25 bp, Rattus norvegicus
acttcaccaagtaaaggcccaagag

SEQ ID NO: 99616 - DNA, 25 bp, Rattus norvegicus
acttcaccaagttaaggcccaagag

SEQ ID NO: 99617 - DNA, 25 bp, Rattus norvegicus
acttcaccagttacatctccagaga

SEQ ID NO: 99618 - DNA, 25 bp, Rattus norvegicus
acttcaccagtttcatctccagaga

SEQ ID NO: 99619 - DNA, 25 bp, Rattus norvegicus
acttcacccagcatattttctattc

SEQ ID NO: 99620 - DNA, 25 bp, Rattus norvegicus
acttcacccagcttattttctattc

SEQ ID NO: 99621 - DNA, 25 bp, Rattus norvegicus
acttcaccggcactatggtgcatgt

SEQ ID NO: 99622 - DNA, 25 bp, Rattus norvegicus
acttcaccggcagtatggtgcatgt

SEQ ID NO: 99623 - DNA, 25 bp, Rattus norvegicus
acttcacctcagatggtcgctggaa

SEQ ID NO: 99624 - DNA, 25 bp, Rattus norvegicus
acttcacctcagttggtcgctggaa

SEQ ID NO: 99625 - DNA, 25 bp, Rattus norvegicus
acttcacgagtaaaattttgctgct

SEQ ID NO: 99626 - DNA, 25 bp, Rattus norvegicus
acttcacgagtataattttgctgct

SEQ ID NO: 99627 - DNA, 25 bp, Rattus norvegicus
acttcacgcaggacaattttatgga

SEQ ID NO: 99628 - DNA, 25 bp, Rattus norvegicus
acttcacgcaggtcaattttatgga

SEQ ID NO: 99629 - DNA, 25 bp, Rattus norvegicus
acttcacggcagctcatggcggcaa

SEQ ID NO: 99630 - DNA, 25 bp, Rattus norvegicus
acttcacggcaggtcatggcggcaa

SEQ ID NO: 99631 - DNA, 25 bp, Rattus norvegicus
acttcacgggataagcactgcgaga

SEQ ID NO: 99632 - DNA, 25 bp, Rattus norvegicus
acttcacgggattagcactgcgaga

SEQ ID NO: 99633 - DNA, 25 bp, Rattus norvegicus
acttcactaaggcttttcagaaatg

SEQ ID NO: 99634 - DNA, 25 bp, Rattus norvegicus
acttcactaagggttttcagaaatg

SEQ ID NO: 99635 - DNA, 25 bp, Rattus norvegicus
acttcactcgtgactgttaccaggt

SEQ ID NO: 99636 - DNA, 25 bp, Rattus norvegicus
acttcactcgtgtctgttaccaggt

SEQ ID NO: 99637 - DNA, 25 bp, Rattus norvegicus
acttcactgacaattaccttttctg

SEQ ID NO: 99638 - DNA, 25 bp, Rattus norvegicus
acttcactgacatttaccttttctg

SEQ ID NO: 99639 - DNA, 25 bp, Rattus norvegicus
acttcactgtcaacccctggttaga

SEQ ID NO: 99640 - DNA, 25 bp, Rattus norvegicus
acttcactgtcatcccctggttaga

SEQ ID NO: 99641 - DNA, 25 bp, Rattus norvegicus
acttcactgtctagctgctgccaaa

SEQ ID NO: 99642 - DNA, 25 bp, Rattus norvegicus
acttcactgtcttgctgctgccaaa

SEQ ID NO: 99643 - DNA, 25 bp, Rattus norvegicus
acttcacttattacagggtctccaa

SEQ ID NO: 99644 - DNA, 25 bp, Rattus norvegicus
acttcacttatttcagggtctccaa

SEQ ID NO: 99645 - DNA, 25 bp, Rattus norvegicus
acttcacttctaccacacatcagat

SEQ ID NO: 99646 - DNA, 25 bp, Rattus norvegicus
acttcacttctagcacacatcagat

SEQ ID NO: 99647 - DNA, 25 bp, Rattus norvegicus
acttcactttagcttcgacatccac

SEQ ID NO: 99648 - DNA, 25 bp, Rattus norvegicus
acttcactttaggttcgacatccac

SEQ ID NO: 99649 - DNA, 25 bp, Rattus norvegicus
acttcagaacaacagccactcttgt

SEQ ID NO: 99650 - DNA, 25 bp, Rattus norvegicus
acttcagaacaagagccactcttgt

SEQ ID NO: 99651 - DNA, 25 bp, Rattus norvegicus
acttcagaatatacacaagcctaaa

SEQ ID NO: 99652 - DNA, 25 bp, Rattus norvegicus
acttcagaatattcacaagcctaaa

SEQ ID NO: 99653 - DNA, 25 bp, Rattus norvegicus
acttcagacataattgagtgctttt

SEQ ID NO: 99654 - DNA, 25 bp, Rattus norvegicus
acttcagacatatttgagtgctttt

SEQ ID NO: 99655 - DNA, 25 bp, Rattus norvegicus
acttcagacccacgattgtgaggca

SEQ ID NO: 99656 - DNA, 25 bp, Rattus norvegicus
acttcagacccaggattgtgaggca

SEQ ID NO: 99657 - DNA, 25 bp, Rattus norvegicus
acttcagactgcatagagccagcct

SEQ ID NO: 99658 - DNA, 25 bp, Rattus norvegicus
acttcagactgcttagagccagcct

SEQ ID NO: 99659 - DNA, 25 bp, Rattus norvegicus
acttcagagcggctagcagaggctt

SEQ ID NO: 99660 - DNA, 25 bp, Rattus norvegicus
acttcagagcgggtagcagaggctt

SEQ ID NO: 99661 - DNA, 25 bp, Rattus norvegicus
acttcagaggctaagctcttaccct

SEQ ID NO: 99662 - DNA, 25 bp, Rattus norvegicus
acttcagaggcttagctcttaccct

SEQ ID NO: 99663 - DNA, 25 bp, Rattus norvegicus
acttcagatcacatgtcccattggg

SEQ ID NO: 99664 - DNA, 25 bp, Rattus norvegicus
acttcagatcacttgtcccattggg

SEQ ID NO: 99665 - DNA, 25 bp, Rattus norvegicus
acttcagatgatctttgctgccgaa

SEQ ID NO: 99666 - DNA, 25 bp, Rattus norvegicus
acttcagatgatgtttgctgccgaa

SEQ ID NO: 99667 - DNA, 25 bp, Rattus norvegicus
acttcagatgtacatttttccccac

SEQ ID NO: 99668 - DNA, 25 bp, Rattus norvegicus
acttcagatgtagatttttccccac

SEQ ID NO: 99669 - DNA, 25 bp, Rattus norvegicus
acttcagcagtccttttgcatggcg

SEQ ID NO: 99670 - DNA, 25 bp, Rattus norvegicus
acttcagcagtcgttttgcatggcg

SEQ ID NO: 99671 - DNA, 25 bp, Rattus norvegicus
acttcagcagttatccattcacaaa

SEQ ID NO: 99672 - DNA, 25 bp, Rattus norvegicus
acttcagcagttttccattcacaaa

SEQ ID NO: 99673 - DNA, 25 bp, Rattus norvegicus
acttcagcatatcggtcttacacac

SEQ ID NO: 99674 - DNA, 25 bp, Rattus norvegicus
acttcagcatatgggtcttacacac

SEQ ID NO: 99675 - DNA, 25 bp, Rattus norvegicus
acttcagcatccagcagatcctcgg

SEQ ID NO: 99676 - DNA, 25 bp, Rattus norvegicus
acttcagcatcctgcagatcctcgg

SEQ ID NO: 99677 - DNA, 25 bp, Rattus norvegicus
acttcagccaccactgcaaggaggt

SEQ ID NO: 99678 - DNA, 25 bp, Rattus norvegicus
acttcagccacctctgcaaggaggt

SEQ ID NO: 99679 - DNA, 25 bp, Rattus norvegicus
acttcagcccggagaactgcagatt

SEQ ID NO: 99680 - DNA, 25 bp, Rattus norvegicus
acttcagcccggtgaactgcagatt

SEQ ID NO: 99681 - DNA, 25 bp, Rattus norvegicus
acttcagccctcatagaaagatgtg

SEQ ID NO: 99682 - DNA, 25 bp, Rattus norvegicus
acttcagccctcttagaaagatgtg

SEQ ID NO: 99683 - DNA, 25 bp, Rattus norvegicus
acttcagccttgaccgatttacaaa

SEQ ID NO: 99684 - DNA, 25 bp, Rattus norvegicus
acttcagccttgtccgatttacaaa

SEQ ID NO: 99685 - DNA, 25 bp, Rattus norvegicus
acttcagctcctctggaaacatctg

SEQ ID NO: 99686 - DNA, 25 bp, Rattus norvegicus
acttcagctcctgtggaaacatctg

SEQ ID NO: 99687 - DNA, 25 bp, Rattus norvegicus
acttcagctcttaatatgccattgt

SEQ ID NO: 99688 - DNA, 25 bp, Rattus norvegicus
acttcagctctttatatgccattgt

SEQ ID NO: 99689 - DNA, 25 bp, Rattus norvegicus
acttcagctgctacagggtatggcc

SEQ ID NO: 99690 - DNA, 25 bp, Rattus norvegicus
acttcagctgcttcagggtatggcc

SEQ ID NO: 99691 - DNA, 25 bp, Rattus norvegicus
acttcagcttgcatgctcagtgcaa

SEQ ID NO: 99692 - DNA, 25 bp, Rattus norvegicus
acttcagcttgcttgctcagtgcaa

SEQ ID NO: 99693 - DNA, 25 bp, Rattus norvegicus
acttcaggcacaccacgtgcacttg

SEQ ID NO: 99694 - DNA, 25 bp, Rattus norvegicus
acttcaggcacagcacgtgcacttg

SEQ ID NO: 99695 - DNA, 25 bp, Rattus norvegicus
acttcagggaggcactggactcgct

SEQ ID NO: 99696 - DNA, 25 bp, Rattus norvegicus
acttcagggagggactggactcgct

SEQ ID NO: 99697 - DNA, 25 bp, Rattus norvegicus
acttcagggccaacaattggttcat

SEQ ID NO: 99698 - DNA, 25 bp, Rattus norvegicus
acttcagggccatcaattggttcat

SEQ ID NO: 99699 - DNA, 25 bp, Rattus norvegicus
acttcaggtagcaactgcagcctca

SEQ ID NO: 99700 - DNA, 25 bp, Rattus norvegicus
acttcaggtagctactgcagcctca

SEQ ID NO: 99701 - DNA, 25 bp, Rattus norvegicus
acttcaggttctcgtccatcagtct

SEQ ID NO: 99702 - DNA, 25 bp, Rattus norvegicus
acttcaggttctggtccatcagtct

SEQ ID NO: 99703 - DNA, 25 bp, Rattus norvegicus
acttcaggttttcccagacactgga

SEQ ID NO: 99704 - DNA, 25 bp, Rattus norvegicus
acttcaggttttgccagacactgga

SEQ ID NO: 99705 - DNA, 25 bp, Rattus norvegicus
acttcagtcaggatcgtgcgtgtgc

SEQ ID NO: 99706 - DNA, 25 bp, Rattus norvegicus
acttcagtcaggttcgtgcgtgtgc

SEQ ID NO: 99707 - DNA, 25 bp, Rattus norvegicus
acttcagtcccactatttcaaacta

SEQ ID NO: 99708 - DNA, 25 bp, Rattus norvegicus
acttcagtcccagtatttcaaacta

SEQ ID NO: 99709 - DNA, 25 bp, Rattus norvegicus
acttcagtctaacgtttatatgtca

SEQ ID NO: 99710 - DNA, 25 bp, Rattus norvegicus
acttcagtctaaggtttatatgtca

SEQ ID NO: 99711 - DNA, 25 bp, Rattus norvegicus
acttcagtggagacaccaaggccga

SEQ ID NO: 99712 - DNA, 25 bp, Rattus norvegicus
acttcagtggagtcaccaaggccga

SEQ ID NO: 99713 - DNA, 25 bp, Rattus norvegicus
acttcagtgtcgagcgccttgggca

SEQ ID NO: 99714 - DNA, 25 bp, Rattus norvegicus
acttcagtgtcgtgcgccttgggca

SEQ ID NO: 99715 - DNA, 25 bp, Rattus norvegicus
acttcagttagtatgcacccttgca

SEQ ID NO: 99716 - DNA, 25 bp, Rattus norvegicus
acttcagttagtttgcacccttgca

SEQ ID NO: 99717 - DNA, 25 bp, Rattus norvegicus
acttcagttcatactaatgcaggtg

SEQ ID NO: 99718 - DNA, 25 bp, Rattus norvegicus
acttcagttcattctaatgcaggtg

SEQ ID NO: 99719 - DNA, 25 bp, Rattus norvegicus
acttcagttgtcctgctgctacaaa

SEQ ID NO: 99720 - DNA, 25 bp, Rattus norvegicus
acttcagttgtcgtgctgctacaaa

SEQ ID NO: 99721 - DNA, 25 bp, Rattus norvegicus
acttcagtttagatcatttgaacac

SEQ ID NO: 99722 - DNA, 25 bp, Rattus norvegicus
acttcagtttagttcatttgaacac

SEQ ID NO: 99723 - DNA, 25 bp, Rattus norvegicus
acttcagtttcaatgactagaggga

SEQ ID NO: 99724 - DNA, 25 bp, Rattus norvegicus
acttcagtttcattgactagaggga

SEQ ID NO: 99725 - DNA, 25 bp, Rattus norvegicus
acttcataggtgctgtgtctctggg

SEQ ID NO: 99726 - DNA, 25 bp, Rattus norvegicus
acttcataggtggtgtgtctctggg

SEQ ID NO: 99727 - DNA, 25 bp, Rattus norvegicus
acttcatagtttcagactgttcccc

SEQ ID NO: 99728 - DNA, 25 bp, Rattus norvegicus
acttcatagtttgagactgttcccc

SEQ ID NO: 99729 - DNA, 25 bp, Rattus norvegicus
acttcatcactaaggcttcgagctt

SEQ ID NO: 99730 - DNA, 25 bp, Rattus norvegicus
acttcatcactatggcttcgagctt

SEQ ID NO: 99731 - DNA, 25 bp, Rattus norvegicus
acttcatcatgaacgtacaaacggg

SEQ ID NO: 99732 - DNA, 25 bp, Rattus norvegicus
acttcatcatgatcgtacaaacggg

SEQ ID NO: 99733 - DNA, 25 bp, Rattus norvegicus
acttcatccctgactccaatggagt

SEQ ID NO: 99734 - DNA, 25 bp, Rattus norvegicus
acttcatccctgtctccaatggagt

SEQ ID NO: 99735 - DNA, 25 bp, Rattus norvegicus
acttcatcctagagccgggctcctg

SEQ ID NO: 99736 - DNA, 25 bp, Rattus norvegicus
acttcatcctagtgccgggctcctg

SEQ ID NO: 99737 - DNA, 25 bp, Rattus norvegicus
acttcatcctgcagcgggaaccata

SEQ ID NO: 99738 - DNA, 25 bp, Rattus norvegicus
acttcatcctgctgcgggaaccata

SEQ ID NO: 99739 - DNA, 25 bp, Rattus norvegicus
acttcatctcacaacattactctga

SEQ ID NO: 99740 - DNA, 25 bp, Rattus norvegicus
acttcatctcactacattactctga

SEQ ID NO: 99741 - DNA, 25 bp, Rattus norvegicus
acttcatctgaacctgaggccttaa

SEQ ID NO: 99742 - DNA, 25 bp, Rattus norvegicus
acttcatctgaagctgaggccttaa

SEQ ID NO: 99743 - DNA, 25 bp, Rattus norvegicus
acttcatgacccagtgacctgattt

SEQ ID NO: 99744 - DNA, 25 bp, Rattus norvegicus
acttcatgaccctgtgacctgattt

SEQ ID NO: 99745 - DNA, 25 bp, Rattus norvegicus
acttcatgccttctttctctttaga

SEQ ID NO: 99746 - DNA, 25 bp, Rattus norvegicus
acttcatgccttgtttctctttaga

SEQ ID NO: 99747 - DNA, 25 bp, Rattus norvegicus
acttcatggagcatatccagcgccg

SEQ ID NO: 99748 - DNA, 25 bp, Rattus norvegicus
acttcatggagcttatccagcgccg

SEQ ID NO: 99749 - DNA, 25 bp, Rattus norvegicus
acttcatggcttcgcagatgctcaa

SEQ ID NO: 99750 - DNA, 25 bp, Rattus norvegicus
acttcatggcttggcagatgctcaa

SEQ ID NO: 99751 - DNA, 25 bp, Rattus norvegicus
acttcatgtgccatacagagcttca

SEQ ID NO: 99752 - DNA, 25 bp, Rattus norvegicus
acttcatgtgccattcagacttcaa

SEQ ID NO: 99753 - DNA, 25 bp, Rattus norvegicus
acttcatgtgccttacagagcttca

SEQ ID NO: 99754 - DNA, 25 bp, Rattus norvegicus
acttcatgtgcctttcagacttcaa

SEQ ID NO: 99755 - DNA, 25 bp, Rattus norvegicus
acttcatgtgtaacaggtgccctca

SEQ ID NO: 99756 - DNA, 25 bp, Rattus norvegicus
acttcatgtgtactcttcgtgatca

SEQ ID NO: 99757 - DNA, 25 bp, Rattus norvegicus
acttcatgtgtagtcttcgtgatca

SEQ ID NO: 99758 - DNA, 25 bp, Rattus norvegicus
acttcatgtgtatcaggtgccctca

SEQ ID NO: 99759 - DNA, 25 bp, Rattus norvegicus
acttcatgttccatggttccatcta

SEQ ID NO: 99760 - DNA, 25 bp, Rattus norvegicus
acttcatgttccttggttccatcta

SEQ ID NO: 99761 - DNA, 25 bp, Rattus norvegicus
acttcatgttgtattctgtatcctc

SEQ ID NO: 99762 - DNA, 25 bp, Rattus norvegicus
acttcatgttgttttctgtatcctc

SEQ ID NO: 99763 - DNA, 25 bp, Rattus norvegicus
acttcattagaacctccacgtggga

SEQ ID NO: 99764 - DNA, 25 bp, Rattus norvegicus
acttcattagaagctccacgtggga

SEQ ID NO: 99765 - DNA, 25 bp, Rattus norvegicus
acttcattattcctcatgccagagc

SEQ ID NO: 99766 - DNA, 25 bp, Rattus norvegicus
acttcattattcgtcatgccagagc

SEQ ID NO: 99767 - DNA, 25 bp, Rattus norvegicus
acttcattccacatctgtctaagag

SEQ ID NO: 99768 - DNA, 25 bp, Rattus norvegicus
acttcattccacttctgtctaagag

SEQ ID NO: 99769 - DNA, 25 bp, Rattus norvegicus
acttcattcctaatcatctttcgac

SEQ ID NO: 99770 - DNA, 25 bp, Rattus norvegicus
acttcattcctattcatctttcgac

SEQ ID NO: 99771 - DNA, 25 bp, Rattus norvegicus
acttcatttggaacagttgcctggc

SEQ ID NO: 99772 - DNA, 25 bp, Rattus norvegicus
acttcatttggatcagttgcctggc

SEQ ID NO: 99773 - DNA, 25 bp, Rattus norvegicus
acttcatttttccttaccaccagat

SEQ ID NO: 99774 - DNA, 25 bp, Rattus norvegicus
acttcatttttcgttaccaccagat

SEQ ID NO: 99775 - DNA, 25 bp, Rattus norvegicus
acttccaagaagacccactgtaggg

SEQ ID NO: 99776 - DNA, 25 bp, Rattus norvegicus
acttccaagaagtcccactgtaggg

SEQ ID NO: 99777 - DNA, 25 bp, Rattus norvegicus
acttccaagggaacattctgtttag

SEQ ID NO: 99778 - DNA, 25 bp, Rattus norvegicus
acttccaagggatcattctgtttag

SEQ ID NO: 99779 - DNA, 25 bp, Rattus norvegicus
acttccaagttcactgacgatatcc

SEQ ID NO: 99780 - DNA, 25 bp, Rattus norvegicus
acttccaagttctctgacgatatcc

SEQ ID NO: 99781 - DNA, 25 bp, Rattus norvegicus
acttccacacatcagtatcaggtta

SEQ ID NO: 99782 - DNA, 25 bp, Rattus norvegicus
acttccacacatgagtatcaggtta

SEQ ID NO: 99783 - DNA, 25 bp, Rattus norvegicus
acttccaccggcagagtccaagagc

SEQ ID NO: 99784 - DNA, 25 bp, Rattus norvegicus
acttccaccggctgagtccaagagc

SEQ ID NO: 99785 - DNA, 25 bp, Rattus norvegicus
acttccacctgtccacctgttggga

SEQ ID NO: 99786 - DNA, 25 bp, Rattus norvegicus
acttccacctgtgcacctgttggga

SEQ ID NO: 99787 - DNA, 25 bp, Rattus norvegicus
acttccactctcatgtttgttcaaa

SEQ ID NO: 99788 - DNA, 25 bp, Rattus norvegicus
acttccactctcttgtttgttcaaa

SEQ ID NO: 99789 - DNA, 25 bp, Rattus norvegicus
acttccacttcacggaggccattga

SEQ ID NO: 99790 - DNA, 25 bp, Rattus norvegicus
acttccacttcagggaggccattga

SEQ ID NO: 99791 - DNA, 25 bp, Rattus norvegicus
acttccagacgcagaagtgtcgctg

SEQ ID NO: 99792 - DNA, 25 bp, Rattus norvegicus
acttccagacgctgaagtgtcgctg

SEQ ID NO: 99793 - DNA, 25 bp, Rattus norvegicus
acttccagagcaccagcgcttacag

SEQ ID NO: 99794 - DNA, 25 bp, Rattus norvegicus
acttccagagcagcagcgcttacag

SEQ ID NO: 99795 - DNA, 25 bp, Rattus norvegicus
acttccagctagacctagagttcta

SEQ ID NO: 99796 - DNA, 25 bp, Rattus norvegicus
acttccagctagtcctagagttcta

SEQ ID NO: 99797 - DNA, 25 bp, Rattus norvegicus
acttccagctcactgggatttccat

SEQ ID NO: 99798 - DNA, 25 bp, Rattus norvegicus
acttccagctcagtgggatttccat

SEQ ID NO: 99799 - DNA, 25 bp, Rattus norvegicus
acttccagctgaatttgagccccag

SEQ ID NO: 99800 - DNA, 25 bp, Rattus norvegicus
acttccagctgattttgagccccag

SEQ ID NO: 99801 - DNA, 25 bp, Rattus norvegicus
acttccagggttcttgatacctgtt

SEQ ID NO: 99802 - DNA, 25 bp, Rattus norvegicus
acttccagggttgttgatacctgtt

SEQ ID NO: 99803 - DNA, 25 bp, Rattus norvegicus
acttccaggttcacatctatgcagg

SEQ ID NO: 99804 - DNA, 25 bp, Rattus norvegicus
acttccaggttctcatctatgcagg

SEQ ID NO: 99805 - DNA, 25 bp, Rattus norvegicus
acttccagtttcagcaagcagagct

SEQ ID NO: 99806 - DNA, 25 bp, Rattus norvegicus
acttccagtttctgcaagcagagct

SEQ ID NO: 99807 - DNA, 25 bp, Rattus norvegicus
acttccataactactagtttgggca

SEQ ID NO: 99808 - DNA, 25 bp, Rattus norvegicus
acttccataacttctagtttgggca

SEQ ID NO: 99809 - DNA, 25 bp, Rattus norvegicus
acttccatgtgtccaggcctgcaag

SEQ ID NO: 99810 - DNA, 25 bp, Rattus norvegicus
acttccatgtgtgcaggcctgcaag

SEQ ID NO: 99811 - DNA, 25 bp, Rattus norvegicus
acttcccaatgactgggtcctctga

SEQ ID NO: 99812 - DNA, 25 bp, Rattus norvegicus
acttcccaatgagtgggtcctctga

SEQ ID NO: 99813 - DNA, 25 bp, Rattus norvegicus
acttcccacagaatgcttctagcat

SEQ ID NO: 99814 - DNA, 25 bp, Rattus norvegicus
acttcccacagattgcttctagcat

SEQ ID NO: 99815 - DNA, 25 bp, Rattus norvegicus
acttcccacaggacagactcagtgt

SEQ ID NO: 99816 - DNA, 25 bp, Rattus norvegicus
acttcccacaggtcagactcagtgt

SEQ ID NO: 99817 - DNA, 25 bp, Rattus norvegicus
acttcccaccatcatgcatgttcga

SEQ ID NO: 99818 - DNA, 25 bp, Rattus norvegicus
acttcccaccatgatgcatgttcga

SEQ ID NO: 99819 - DNA, 25 bp, Rattus norvegicus
acttcccagatcaacatttcagcaa

SEQ ID NO: 99820 - DNA, 25 bp, Rattus norvegicus
acttcccagatctacatttcagcaa

SEQ ID NO: 99821 - DNA, 25 bp, Rattus norvegicus
acttcccagtacaacaacatgcgtg

SEQ ID NO: 99822 - DNA, 25 bp, Rattus norvegicus
acttcccagtactacaacatgcgtg

SEQ ID NO: 99823 - DNA, 25 bp, Rattus norvegicus
acttcccagtgaaagccaagagcta

SEQ ID NO: 99824 - DNA, 25 bp, Rattus norvegicus
acttcccagtgacccaaactaggtg

SEQ ID NO: 99825 - DNA, 25 bp, Rattus norvegicus
acttcccagtgagccaaactaggtg

SEQ ID NO: 99826 - DNA, 25 bp, Rattus norvegicus
acttcccagtgatagccaagagcta

SEQ ID NO: 99827 - DNA, 25 bp, Rattus norvegicus
acttcccagttccaaaagcttcttg

SEQ ID NO: 99828 - DNA, 25 bp, Rattus norvegicus
acttcccagttcgaaaagcttcttg

SEQ ID NO: 99829 - DNA, 25 bp, Rattus norvegicus
acttcccatgtaactgtcacctgtt

SEQ ID NO: 99830 - DNA, 25 bp, Rattus norvegicus
acttcccatgtatctgtcacctgtt

SEQ ID NO: 99831 - DNA, 25 bp, Rattus norvegicus
acttccccacatcatttgttgtagg

SEQ ID NO: 99832 - DNA, 25 bp, Rattus norvegicus
acttccccacatgatttgttgtagg

SEQ ID NO: 99833 - DNA, 25 bp, Rattus norvegicus
acttccccgtggattgctgtttgaa

SEQ ID NO: 99834 - DNA, 25 bp, Rattus norvegicus
acttccccgtggtttgctgtttgaa

SEQ ID NO: 99835 - DNA, 25 bp, Rattus norvegicus
acttccccttgcatagttacaggta

SEQ ID NO: 99836 - DNA, 25 bp, Rattus norvegicus
acttccccttgcttagttacaggta

SEQ ID NO: 99837 - DNA, 25 bp, Rattus norvegicus
acttcccgaagtctgatccaggttg

SEQ ID NO: 99838 - DNA, 25 bp, Rattus norvegicus
acttcccgaagtgtgatccaggttg

SEQ ID NO: 99839 - DNA, 25 bp, Rattus norvegicus
acttcccggccactcagaatggagg

SEQ ID NO: 99840 - DNA, 25 bp, Rattus norvegicus
acttcccggccagtcagaatggagg

SEQ ID NO: 99841 - DNA, 25 bp, Rattus norvegicus
acttcccgtggaaaccgagagtcag

SEQ ID NO: 99842 - DNA, 25 bp, Rattus norvegicus
acttcccgtggataccgagagtcag

SEQ ID NO: 99843 - DNA, 25 bp, Rattus norvegicus
acttcccgttatcctgagtgattga

SEQ ID NO: 99844 - DNA, 25 bp, Rattus norvegicus
acttcccgttatgctgagtgattga

SEQ ID NO: 99845 - DNA, 25 bp, Rattus norvegicus
acttccctcaggctgttcgagaatg

SEQ ID NO: 99846 - DNA, 25 bp, Rattus norvegicus
acttccctcagggtgttcgagaatg

SEQ ID NO: 99847 - DNA, 25 bp, Rattus norvegicus
acttccctcctgacagcttgactga

SEQ ID NO: 99848 - DNA, 25 bp, Rattus norvegicus
acttccctcctgtcagcttgactga

SEQ ID NO: 99849 - DNA, 25 bp, Rattus norvegicus
acttccctctgtagctgagttgttc

SEQ ID NO: 99850 - DNA, 25 bp, Rattus norvegicus
acttccctctgttgctgagttgttc

SEQ ID NO: 99851 - DNA, 25 bp, Rattus norvegicus
acttccctctttcagtgactcgtgt

SEQ ID NO: 99852 - DNA, 25 bp, Rattus norvegicus
acttccctctttgagtgactcgtgt

SEQ ID NO: 99853 - DNA, 25 bp, Rattus norvegicus
acttccctgaaactcttaatcctga

SEQ ID NO: 99854 - DNA, 25 bp, Rattus norvegicus
acttccctgaaagtcttaatcctga

SEQ ID NO: 99855 - DNA, 25 bp, Rattus norvegicus
acttccctgaggagagcatgcggtc

SEQ ID NO: 99856 - DNA, 25 bp, Rattus norvegicus
acttccctgaggtgagcatgcggtc

SEQ ID NO: 99857 - DNA, 25 bp, Rattus norvegicus
acttccctgattcagttcatccctt

SEQ ID NO: 99858 - DNA, 25 bp, Rattus norvegicus
acttccctgattgagttcatccctt

SEQ ID NO: 99859 - DNA, 25 bp, Rattus norvegicus
acttccctgcacactgctacaggaa

SEQ ID NO: 99860 - DNA, 25 bp, Rattus norvegicus
acttccctgcactctgctacaggaa

SEQ ID NO: 99861 - DNA, 25 bp, Rattus norvegicus
acttccctgtgaattgccaaaccag

SEQ ID NO: 99862 - DNA, 25 bp, Rattus norvegicus
acttccctgtgatttgccaaaccag

SEQ ID NO: 99863 - DNA, 25 bp, Rattus norvegicus
acttcccttatgacctgagtgaaac

SEQ ID NO: 99864 - DNA, 25 bp, Rattus norvegicus
acttcccttatgtcctgagtgaaac

SEQ ID NO: 99865 - DNA, 25 bp, Rattus norvegicus
acttcccttcaaccctgtgtggtga

SEQ ID NO: 99866 - DNA, 25 bp, Rattus norvegicus
acttcccttcaagcctgtgtggtga

SEQ ID NO: 99867 - DNA, 25 bp, Rattus norvegicus
acttcccttgttcccagaacagtta

SEQ ID NO: 99868 - DNA, 25 bp, Rattus norvegicus
acttcccttgttgccagaacagtta

SEQ ID NO: 99869 - DNA, 25 bp, Rattus norvegicus
acttccgaatcgagcgtggcatcaa

SEQ ID NO: 99870 - DNA, 25 bp, Rattus norvegicus
acttccgaatcgtgcgtggcatcaa

SEQ ID NO: 99871 - DNA, 25 bp, Rattus norvegicus
acttccgcagtacgatgggcgatca

SEQ ID NO: 99872 - DNA, 25 bp, Rattus norvegicus
acttccgcagtaggatgggcgatca

SEQ ID NO: 99873 - DNA, 25 bp, Rattus norvegicus
acttccgcatccatgtggagaacca

SEQ ID NO: 99874 - DNA, 25 bp, Rattus norvegicus
acttccgcatccttgtggagaacca

SEQ ID NO: 99875 - DNA, 25 bp, Rattus norvegicus
acttccgcattgagtccgtggtgtg

SEQ ID NO: 99876 - DNA, 25 bp, Rattus norvegicus
acttccgcattgtgtccgtggtgtg

SEQ ID NO: 99877 - DNA, 25 bp, Rattus norvegicus
acttccgctggtacctaccaaagat

SEQ ID NO: 99878 - DNA, 25 bp, Rattus norvegicus
acttccgctggttcctaccaaagat

SEQ ID NO: 99879 - DNA, 25 bp, Rattus norvegicus
acttccgcttttcattttctcatat

SEQ ID NO: 99880 - DNA, 25 bp, Rattus norvegicus
acttccgcttttgattttctcatat

SEQ ID NO: 99881 - DNA, 25 bp, Rattus norvegicus
acttccggtactagggctttggctg

SEQ ID NO: 99882 - DNA, 25 bp, Rattus norvegicus
acttccggtacttgggctttggctg

SEQ ID NO: 99883 - DNA, 25 bp, Rattus norvegicus
acttccgtcaccattataaacagcg

SEQ ID NO: 99884 - DNA, 25 bp, Rattus norvegicus
acttccgtcacctttataaacagcg

SEQ ID NO: 99885 - DNA, 25 bp, Rattus norvegicus
acttccgtgagaatggctggcatga

SEQ ID NO: 99886 - DNA, 25 bp, Rattus norvegicus
acttccgtgagattggctggcatga

SEQ ID NO: 99887 - DNA, 25 bp, Rattus norvegicus
acttccgtggtcaggtgatgaacct

SEQ ID NO: 99888 - DNA, 25 bp, Rattus norvegicus
acttccgtggtctggtgatgaacct

SEQ ID NO: 99889 - DNA, 25 bp, Rattus norvegicus
acttccgtggttcgcatctgtctga

SEQ ID NO: 99890 - DNA, 25 bp, Rattus norvegicus
acttccgtggttggcatctgtctga

SEQ ID NO: 99891 - DNA, 25 bp, Rattus norvegicus
acttccgtgtttcctcagatgatca

SEQ ID NO: 99892 - DNA, 25 bp, Rattus norvegicus
acttccgtgtttgctcagatgatca

SEQ ID NO: 99893 - DNA, 25 bp, Rattus norvegicus
acttcctaaatcagggtgcacccgt

SEQ ID NO: 99894 - DNA, 25 bp, Rattus norvegicus
acttcctaaatctgggtgcacccgt

SEQ ID NO: 99895 - DNA, 25 bp, Rattus norvegicus
acttcctaatagatcgtcttctacc

SEQ ID NO: 99896 - DNA, 25 bp, Rattus norvegicus
acttcctaatagttcgtcttctacc

SEQ ID NO: 99897 - DNA, 25 bp, Rattus norvegicus
acttcctagcggagatagatgccat

SEQ ID NO: 99898 - DNA, 25 bp, Rattus norvegicus
acttcctagcggtgatagatgccat

SEQ ID NO: 99899 - DNA, 25 bp, Rattus norvegicus
acttcctagtcaatgagtttttgtt

SEQ ID NO: 99900 - DNA, 25 bp, Rattus norvegicus
acttcctagtcattgagtttttgtt

SEQ ID NO: 99901 - DNA, 25 bp, Rattus norvegicus
acttcctagtttctgatttctcttc

SEQ ID NO: 99902 - DNA, 25 bp, Rattus norvegicus
acttcctagtttgtgatttctcttc

SEQ ID NO: 99903 - DNA, 25 bp, Rattus norvegicus
acttcctataccatctgctattcaa

SEQ ID NO: 99904 - DNA, 25 bp, Rattus norvegicus
acttcctataccttctgctattcaa

SEQ ID NO: 99905 - DNA, 25 bp, Rattus norvegicus
acttcctatgtgagtctagtcagtg

SEQ ID NO: 99906 - DNA, 25 bp, Rattus norvegicus
acttcctatgtgtgtctagtcagtg

SEQ ID NO: 99907 - DNA, 25 bp, Rattus norvegicus
acttcctattcgcaggccaagtgag

SEQ ID NO: 99908 - DNA, 25 bp, Rattus norvegicus
acttcctattcggaggccaagtgag

SEQ ID NO: 99909 - DNA, 25 bp, Rattus norvegicus
acttcctcattgatgaccctattga

SEQ ID NO: 99910 - DNA, 25 bp, Rattus norvegicus
acttcctcattgttgaccctattga

SEQ ID NO: 99911 - DNA, 25 bp, Rattus norvegicus
acttcctcccagagatgacgtagat

SEQ ID NO: 99912 - DNA, 25 bp, Rattus norvegicus
acttcctcccagtgatgacgtagat

SEQ ID NO: 99913 - DNA, 25 bp, Rattus norvegicus
acttcctccctcagaacaagttaga

SEQ ID NO: 99914 - DNA, 25 bp, Rattus norvegicus
acttcctccctctgaacaagttaga

SEQ ID NO: 99915 - DNA, 25 bp, Rattus norvegicus
acttcctccttgcttatttcagact

SEQ ID NO: 99916 - DNA, 25 bp, Rattus norvegicus
acttcctccttggttatttcagact

SEQ ID NO: 99917 - DNA, 25 bp, Rattus norvegicus
acttcctcgccaatggtgatgttga

SEQ ID NO: 99918 - DNA, 25 bp, Rattus norvegicus
acttcctcgccattggtgatgttga

SEQ ID NO: 99919 - DNA, 25 bp, Rattus norvegicus
acttcctctatcatctagtggtttt

SEQ ID NO: 99920 - DNA, 25 bp, Rattus norvegicus
acttcctctatcttctagtggtttt

SEQ ID NO: 99921 - DNA, 25 bp, Rattus norvegicus
acttcctctgggacagacatgctgg

SEQ ID NO: 99922 - DNA, 25 bp, Rattus norvegicus
acttcctctgggatctggctggaca

SEQ ID NO: 99923 - DNA, 25 bp, Rattus norvegicus
acttcctctgggtcagacatgctgg

SEQ ID NO: 99924 - DNA, 25 bp, Rattus norvegicus
acttcctctgggttctggctggaca

SEQ ID NO: 99925 - DNA, 25 bp, Rattus norvegicus
acttcctctggtagtacatttgtgt

SEQ ID NO: 99926 - DNA, 25 bp, Rattus norvegicus
acttcctctggttgtacatttgtgt

SEQ ID NO: 99927 - DNA, 25 bp, Rattus norvegicus
acttcctgaagtctagccacactta

SEQ ID NO: 99928 - DNA, 25 bp, Rattus norvegicus
acttcctgaagtgtagccacactta

SEQ ID NO: 99929 - DNA, 25 bp, Rattus norvegicus
acttcctgagaacctgtcaacctaa

SEQ ID NO: 99930 - DNA, 25 bp, Rattus norvegicus
acttcctgagaagctgtcaacctaa

SEQ ID NO: 99931 - DNA, 25 bp, Rattus norvegicus
acttcctgagctctttgtggtttga

SEQ ID NO: 99932 - DNA, 25 bp, Rattus norvegicus
acttcctgagctgtttgtggtttga

SEQ ID NO: 99933 - DNA, 25 bp, Rattus norvegicus
acttcctgagtgatgcatgcagcca

SEQ ID NO: 99934 - DNA, 25 bp, Rattus norvegicus
acttcctgagtgttgcatgcagcca

SEQ ID NO: 99935 - DNA, 25 bp, Rattus norvegicus
acttcctgatgtcagggattagaga

SEQ ID NO: 99936 - DNA, 25 bp, Rattus norvegicus
acttcctgatgtgagggattagaga

SEQ ID NO: 99937 - DNA, 25 bp, Rattus norvegicus
acttcctgcagtaaacagttacctt

SEQ ID NO: 99938 - DNA, 25 bp, Rattus norvegicus
acttcctgcagttaacagttacctt

SEQ ID NO: 99939 - DNA, 25 bp, Rattus norvegicus
acttcctgcatgctaggcaaacatt

SEQ ID NO: 99940 - DNA, 25 bp, Rattus norvegicus
acttcctgcatggtaggcaaacatt

SEQ ID NO: 99941 - DNA, 25 bp, Rattus norvegicus
acttcctgccttagcgatgtaaaca

SEQ ID NO: 99942 - DNA, 25 bp, Rattus norvegicus
acttcctgcctttgcgatgtaaaca

SEQ ID NO: 99943 - DNA, 25 bp, Rattus norvegicus
acttcctgctgcctagtacctaaga

SEQ ID NO: 99944 - DNA, 25 bp, Rattus norvegicus
acttcctgctgcgtagtacctaaga

SEQ ID NO: 99945 - DNA, 25 bp, Rattus norvegicus
acttcctggaggattcactgcttct

SEQ ID NO: 99946 - DNA, 25 bp, Rattus norvegicus
acttcctggaggtttcactgcttct

SEQ ID NO: 99947 - DNA, 25 bp, Rattus norvegicus
acttcctggagtaggctgagagcat

SEQ ID NO: 99948 - DNA, 25 bp, Rattus norvegicus
acttcctggagttggctgagagcat

SEQ ID NO: 99949 - DNA, 25 bp, Rattus norvegicus
acttcctggtgccagtgatgggcta

SEQ ID NO: 99950 - DNA, 25 bp, Rattus norvegicus
acttcctggtgcgagtgatgggcta

SEQ ID NO: 99951 - DNA, 25 bp, Rattus norvegicus
acttcctgtcccatctgaaatgtga

SEQ ID NO: 99952 - DNA, 25 bp, Rattus norvegicus
acttcctgtcccttctgaaatgtga

SEQ ID NO: 99953 - DNA, 25 bp, Rattus norvegicus
acttcctgtcggacttgccttctga

SEQ ID NO: 99954 - DNA, 25 bp, Rattus norvegicus
acttcctgtcggtcttgccttctga

SEQ ID NO: 99955 - DNA, 25 bp, Rattus norvegicus
acttcctgtgctagttagtgcctga

SEQ ID NO: 99956 - DNA, 25 bp, Rattus norvegicus
acttcctgtgcttgttagtgcctga

SEQ ID NO: 99957 - DNA, 25 bp, Rattus norvegicus
acttcctgtgtcaccatttctagat

SEQ ID NO: 99958 - DNA, 25 bp, Rattus norvegicus
acttcctgtgtctccatttctagat

SEQ ID NO: 99959 - DNA, 25 bp, Rattus norvegicus
acttcctgttttatgcagctcaaaa

SEQ ID NO: 99960 - DNA, 25 bp, Rattus norvegicus
acttcctgttttcgctctgcctcgg

SEQ ID NO: 99961 - DNA, 25 bp, Rattus norvegicus
acttcctgttttggctctgcctcgg

SEQ ID NO: 99962 - DNA, 25 bp, Rattus norvegicus
acttcctgttttttgcagctcaaaa

SEQ ID NO: 99963 - DNA, 25 bp, Rattus norvegicus
acttccttattcagtgtttatcttc

SEQ ID NO: 99964 - DNA, 25 bp, Rattus norvegicus
acttccttattctgtgtttatcttc

SEQ ID NO: 99965 - DNA, 25 bp, Rattus norvegicus
acttccttctaacggcaggtgggat

SEQ ID NO: 99966 - DNA, 25 bp, Rattus norvegicus
acttccttctaagggcaggtgggat

SEQ ID NO: 99967 - DNA, 25 bp, Rattus norvegicus
acttccttctacattggtcttctag

SEQ ID NO: 99968 - DNA, 25 bp, Rattus norvegicus
acttccttctactttggtcttctag

SEQ ID NO: 99969 - DNA, 25 bp, Rattus norvegicus
acttccttctcactggattccggga

SEQ ID NO: 99970 - DNA, 25 bp, Rattus norvegicus
acttccttctcagtggattccggga

SEQ ID NO: 99971 - DNA, 25 bp, Rattus norvegicus
acttccttctctctgatgtttatgc

SEQ ID NO: 99972 - DNA, 25 bp, Rattus norvegicus
acttccttctctgtgatgtttatgc

SEQ ID NO: 99973 - DNA, 25 bp, Rattus norvegicus
acttccttgagtcactgctttgacc

SEQ ID NO: 99974 - DNA, 25 bp, Rattus norvegicus
acttccttgagtgactgctttgacc

SEQ ID NO: 99975 - DNA, 25 bp, Rattus norvegicus
acttccttgcggcatacactggcgt

SEQ ID NO: 99976 - DNA, 25 bp, Rattus norvegicus
acttccttgcgggatacactggcgt

SEQ ID NO: 99977 - DNA, 25 bp, Rattus norvegicus
acttccttgggcagctgtgtagact

SEQ ID NO: 99978 - DNA, 25 bp, Rattus norvegicus
acttccttgggctgctgtgtagact

SEQ ID NO: 99979 - DNA, 25 bp, Rattus norvegicus
acttccttgttgctagccagccata

SEQ ID NO: 99980 - DNA, 25 bp, Rattus norvegicus
acttccttgttggtagccagccata

SEQ ID NO: 99981 - DNA, 25 bp, Rattus norvegicus
acttcctttcgtagtcattaaatat

SEQ ID NO: 99982 - DNA, 25 bp, Rattus norvegicus
acttcctttcgttgtcattaaatat

SEQ ID NO: 99983 - DNA, 25 bp, Rattus norvegicus
acttcctttctcagttgcactatga

SEQ ID NO: 99984 - DNA, 25 bp, Rattus norvegicus
acttcctttctcctcaagcagagta

SEQ ID NO: 99985 - DNA, 25 bp, Rattus norvegicus
acttcctttctcgtcaagcagagta

SEQ ID NO: 99986 - DNA, 25 bp, Rattus norvegicus
acttcctttctctgttgcactatga

SEQ ID NO: 99987 - DNA, 25 bp, Rattus norvegicus
acttcctttcttcagctctattgtg

SEQ ID NO: 99988 - DNA, 25 bp, Rattus norvegicus
acttcctttcttgagctctattgtg

SEQ ID NO: 99989 - DNA, 25 bp, Rattus norvegicus
acttcgaactgcctgcagacgccat

SEQ ID NO: 99990 - DNA, 25 bp, Rattus norvegicus
acttcgaactgcgtgcagacgccat

SEQ ID NO: 99991 - DNA, 25 bp, Rattus norvegicus
acttcgaagagtaacctgtgtcaaa

SEQ ID NO: 99992 - DNA, 25 bp, Rattus norvegicus
acttcgaagagttacctgtgtcaaa

SEQ ID NO: 99993 - DNA, 25 bp, Rattus norvegicus
acttcgaatgcgcttggctcaaggt

SEQ ID NO: 99994 - DNA, 25 bp, Rattus norvegicus
acttcgaatgcggttggctcaaggt

SEQ ID NO: 99995 - DNA, 25 bp, Rattus norvegicus
acttcgaggctcagcggcatgtgcc

SEQ ID NO: 99996 - DNA, 25 bp, Rattus norvegicus
acttcgaggctctgcggcatgtgcc

SEQ ID NO: 99997 - DNA, 25 bp, Rattus norvegicus
acttcgcaagaacgcctgggaccgc

SEQ ID NO: 99998 - DNA, 25 bp, Rattus norvegicus
acttcgcaagaaggcctgggaccgc

SEQ ID NO: 99999 - DNA, 25 bp, Rattus norvegicus
acttcgctcgctcttttgcgctcat

SEQ ID NO: 100000 - DNA, 25 bp, Rattus norvegicus
acttcgctcgctgttttgcgctcat

SEQ ID NO: 100001 - DNA, 25 bp, Rattus norvegicus
acttcgctgatgagggtgcttgtcg

SEQ ID NO: 100002 - DNA, 25 bp, Rattus norvegicus
acttcgctgatgtgggtgcttgtcg

SEQ ID NO: 100003 - DNA, 25 bp, Rattus norvegicus
acttcggacctgctgctagaggagt

SEQ ID NO: 100004 - DNA, 25 bp, Rattus norvegicus
acttcggacctggtgctagaggagt

SEQ ID NO: 100005 - DNA, 25 bp, Rattus norvegicus
acttcggagcaaaagcacagttttc

SEQ ID NO: 100006 - DNA, 25 bp, Rattus norvegicus
acttcggagcaatagcacagttttc

SEQ ID NO: 100007 - DNA, 25 bp, Rattus norvegicus
acttcggcatgtactattcactggc

SEQ ID NO: 100008 - DNA, 25 bp, Rattus norvegicus
acttcggcatgttctattcactggc

SEQ ID NO: 100009 - DNA, 25 bp, Rattus norvegicus
acttcgggccgcagagactacggga

SEQ ID NO: 100010 - DNA, 25 bp, Rattus norvegicus
acttcgggccgctgagactacggga

SEQ ID NO: 100011 - DNA, 25 bp, Rattus norvegicus
acttcggtagctagcgagcgctcgg

SEQ ID NO: 100012 - DNA, 25 bp, Rattus norvegicus
acttcggtagctctctgcttggcca

SEQ ID NO: 100013 - DNA, 25 bp, Rattus norvegicus
acttcggtagctgtctgcttggcca

SEQ ID NO: 100014 - DNA, 25 bp, Rattus norvegicus
acttcggtagcttgcgagcgctcgg

SEQ ID NO: 100015 - DNA, 25 bp, Rattus norvegicus
acttcgtaagaccaggtgtgccgat

SEQ ID NO: 100016 - DNA, 25 bp, Rattus norvegicus
acttcgtaagacgaggtgtgccgat

SEQ ID NO: 100017 - DNA, 25 bp, Rattus norvegicus
acttcgtagttaccagtggctgcag

SEQ ID NO: 100018 - DNA, 25 bp, Rattus norvegicus
acttcgtagttagcagtggctgcag

SEQ ID NO: 100019 - DNA, 25 bp, Rattus norvegicus
acttcgtattgtagcttcatgttga

SEQ ID NO: 100020 - DNA, 25 bp, Rattus norvegicus
acttcgtattgttgcttcatgttga

SEQ ID NO: 100021 - DNA, 25 bp, Rattus norvegicus
acttcgtcatgcacgtggctatgga

SEQ ID NO: 100022 - DNA, 25 bp, Rattus norvegicus
acttcgtcatgctcgtggctatgga

SEQ ID NO: 100023 - DNA, 25 bp, Rattus norvegicus
acttcgtccaaaacgtggccgtggg

SEQ ID NO: 100024 - DNA, 25 bp, Rattus norvegicus
acttcgtccaaatcgtggccgtggg

SEQ ID NO: 100025 - DNA, 25 bp, Rattus norvegicus
acttcgtctgtactgagtgtgcccc

SEQ ID NO: 100026 - DNA, 25 bp, Rattus norvegicus
acttcgtctgtagtgagtgtgcccc

SEQ ID NO: 100027 - DNA, 25 bp, Rattus norvegicus
acttcgttcattagaccttttcatg

SEQ ID NO: 100028 - DNA, 25 bp, Rattus norvegicus
acttcgttcatttgaccttttcatg

SEQ ID NO: 100029 - DNA, 25 bp, Rattus norvegicus
acttcgttctgaattctccgtgaga

SEQ ID NO: 100030 - DNA, 25 bp, Rattus norvegicus
acttcgttctgatttctccgtgaga

SEQ ID NO: 100031 - DNA, 25 bp, Rattus norvegicus
acttcgttgtctaccaaagcagtgg

SEQ ID NO: 100032 - DNA, 25 bp, Rattus norvegicus
acttcgttgtcttccaaagcagtgg

SEQ ID NO: 100033 - DNA, 25 bp, Rattus norvegicus
acttcgtttccccatagtggatgcc

SEQ ID NO: 100034 - DNA, 25 bp, Rattus norvegicus
acttcgtttcccgatagtggatgcc

SEQ ID NO: 100035 - DNA, 25 bp, Rattus norvegicus
acttctaagcacaacgggacctctg

SEQ ID NO: 100036 - DNA, 25 bp, Rattus norvegicus
acttctaagcactacgggacctctg

SEQ ID NO: 100037 - DNA, 25 bp, Rattus norvegicus
acttctaagttcagaggtccactct

SEQ ID NO: 100038 - DNA, 25 bp, Rattus norvegicus
acttctaagttctgaggtccactct

SEQ ID NO: 100039 - DNA, 25 bp, Rattus norvegicus
acttctacaacaaggccaagctgca

SEQ ID NO: 100040 - DNA, 25 bp, Rattus norvegicus
acttctacaacatggccaagctgca

SEQ ID NO: 100041 - DNA, 25 bp, Rattus norvegicus
acttctacagtgaccggtgacgcgt

SEQ ID NO: 100042 - DNA, 25 bp, Rattus norvegicus
acttctacagtgtccggtgacgcgt

SEQ ID NO: 100043 - DNA, 25 bp, Rattus norvegicus
acttctactgaacacggagccatta

SEQ ID NO: 100044 - DNA, 25 bp, Rattus norvegicus
acttctactgaagacggagccatta

SEQ ID NO: 100045 - DNA, 25 bp, Rattus norvegicus
acttctactggaaactctggactct

SEQ ID NO: 100046 - DNA, 25 bp, Rattus norvegicus
acttctactggatactctggactct

SEQ ID NO: 100047 - DNA, 25 bp, Rattus norvegicus
acttctagaactcttaggctgcctg

SEQ ID NO: 100048 - DNA, 25 bp, Rattus norvegicus
acttctagaactgttaggctgcctg

SEQ ID NO: 100049 - DNA, 25 bp, Rattus norvegicus
acttctagcgaaccccaggatctgt

SEQ ID NO: 100050 - DNA, 25 bp, Rattus norvegicus
acttctagcgaagcccaggatctgt

SEQ ID NO: 100051 - DNA, 25 bp, Rattus norvegicus
acttctaggattagatgactttgtc

SEQ ID NO: 100052 - DNA, 25 bp, Rattus norvegicus
acttctaggatttgatgactttgtc

SEQ ID NO: 100053 - DNA, 25 bp, Rattus norvegicus
acttctagtaaaccacgtcgtgcct

SEQ ID NO: 100054 - DNA, 25 bp, Rattus norvegicus
acttctagtaaagcacgtcgtgcct

SEQ ID NO: 100055 - DNA, 25 bp, Rattus norvegicus
acttctagtatcacctccaaagggc

SEQ ID NO: 100056 - DNA, 25 bp, Rattus norvegicus
acttctagtatctcctccaaagggc

SEQ ID NO: 100057 - DNA, 25 bp, Rattus norvegicus
acttctagtcacaaagctgaggcag

SEQ ID NO: 100058 - DNA, 25 bp, Rattus norvegicus
acttctagtcactaagctgaggcag

SEQ ID NO: 100059 - DNA, 25 bp, Rattus norvegicus
acttctatattcacaagacccctga

SEQ ID NO: 100060 - DNA, 25 bp, Rattus norvegicus
acttctatattctcaagacccctga

SEQ ID NO: 100061 - DNA, 25 bp, Rattus norvegicus
acttctatcctaatatccctttggt

SEQ ID NO: 100062 - DNA, 25 bp, Rattus norvegicus
acttctatcctattatccctttggt

SEQ ID NO: 100063 - DNA, 25 bp, Rattus norvegicus
acttctatgtagagttcgccctgta

SEQ ID NO: 100064 - DNA, 25 bp, Rattus norvegicus
acttctatgtagtgttcgccctgta

SEQ ID NO: 100065 - DNA, 25 bp, Rattus norvegicus
acttctatgtgtcttgctggtgtta

SEQ ID NO: 100066 - DNA, 25 bp, Rattus norvegicus
acttctatgtgtgttgctggtgtta

SEQ ID NO: 100067 - DNA, 25 bp, Rattus norvegicus
acttctattcgactgtgctctgggc

SEQ ID NO: 100068 - DNA, 25 bp, Rattus norvegicus
acttctattcgagtgtgctctgggc

SEQ ID NO: 100069 - DNA, 25 bp, Rattus norvegicus
acttctattcttcagacagggatcg

SEQ ID NO: 100070 - DNA, 25 bp, Rattus norvegicus
acttctattcttgagacagggatcg

SEQ ID NO: 100071 - DNA, 25 bp, Rattus norvegicus
acttctcaacagcttcctcaataag

SEQ ID NO: 100072 - DNA, 25 bp, Rattus norvegicus
acttctcaacaggttcctcaataag

SEQ ID NO: 100073 - DNA, 25 bp, Rattus norvegicus
acttctcaagccatcgtgaacgctg

SEQ ID NO: 100074 - DNA, 25 bp, Rattus norvegicus
acttctcaagccttcgtgaacgctg

SEQ ID NO: 100075 - DNA, 25 bp, Rattus norvegicus
acttctcaccaaagcagtcgtcaat

SEQ ID NO: 100076 - DNA, 25 bp, Rattus norvegicus
acttctcaccaatgcagtcgtcaat

SEQ ID NO: 100077 - DNA, 25 bp, Rattus norvegicus
acttctcactatatcccaggatcta

SEQ ID NO: 100078 - DNA, 25 bp, Rattus norvegicus
acttctcactatttcccaggatcta

SEQ ID NO: 100079 - DNA, 25 bp, Rattus norvegicus
acttctcacttcagtattctccaat

SEQ ID NO: 100080 - DNA, 25 bp, Rattus norvegicus
acttctcacttctgtattctccaat

SEQ ID NO: 100081 - DNA, 25 bp, Rattus norvegicus
acttctcagagcctgtgttcacaaa

SEQ ID NO: 100082 - DNA, 25 bp, Rattus norvegicus
acttctcagagcgtgtgttcacaaa

SEQ ID NO: 100083 - DNA, 25 bp, Rattus norvegicus
acttctcaggagaactctaccttga

SEQ ID NO: 100084 - DNA, 25 bp, Rattus norvegicus
acttctcaggagtactctaccttga

SEQ ID NO: 100085 - DNA, 25 bp, Rattus norvegicus
acttctcatgccacacacaaaaaca

SEQ ID NO: 100086 - DNA, 25 bp, Rattus norvegicus
acttctcatgcctcacacaaaaaca

SEQ ID NO: 100087 - DNA, 25 bp, Rattus norvegicus
acttctccacctcagacagtttaga

SEQ ID NO: 100088 - DNA, 25 bp, Rattus norvegicus
acttctccacctgagacagtttaga

SEQ ID NO: 100089 - DNA, 25 bp, Rattus norvegicus
acttctccagaaacatgcaccaaac

SEQ ID NO: 100090 - DNA, 25 bp, Rattus norvegicus
acttctccagaatcatgcaccaaac

SEQ ID NO: 100091 - DNA, 25 bp, Rattus norvegicus
acttctcccaggatggtgtggtcta

SEQ ID NO: 100092 - DNA, 25 bp, Rattus norvegicus
acttctcccaggttggtgtggtcta

SEQ ID NO: 100093 - DNA, 25 bp, Rattus norvegicus
acttctccccatacgagactgtgca

SEQ ID NO: 100094 - DNA, 25 bp, Rattus norvegicus
acttctccccattcgagactgtgca

SEQ ID NO: 100095 - DNA, 25 bp, Rattus norvegicus
acttctcccgcaaaacctgaaggtg

SEQ ID NO: 100096 - DNA, 25 bp, Rattus norvegicus
acttctcccgcataacctgaaggtg

SEQ ID NO: 100097 - DNA, 25 bp, Rattus norvegicus
acttctccctgtcatcagagggtga

SEQ ID NO: 100098 - DNA, 25 bp, Rattus norvegicus
acttctccctgtgatcagagggtga

SEQ ID NO: 100099 - DNA, 25 bp, Rattus norvegicus
acttctcccttcatgttgtcaggag

SEQ ID NO: 100100 - DNA, 25 bp, Rattus norvegicus
acttctcccttcttgttgtcaggag

SEQ ID NO: 100101 - DNA, 25 bp, Rattus norvegicus
acttctccgtctatttctaatactg

SEQ ID NO: 100102 - DNA, 25 bp, Rattus norvegicus
acttctccgtctttttctaatactg

SEQ ID NO: 100103 - DNA, 25 bp, Rattus norvegicus
acttctccgtgaagtgtggtgactt

SEQ ID NO: 100104 - DNA, 25 bp, Rattus norvegicus
acttctccgtgatgtgtggtgactt

SEQ ID NO: 100105 - DNA, 25 bp, Rattus norvegicus
acttctccttgcatgactaagtcag

SEQ ID NO: 100106 - DNA, 25 bp, Rattus norvegicus
acttctccttgcttgactaagtcag

SEQ ID NO: 100107 - DNA, 25 bp, Rattus norvegicus
acttctccttgtctgcttaagcgta

SEQ ID NO: 100108 - DNA, 25 bp, Rattus norvegicus
acttctccttgtgtgcttaagcgta

SEQ ID NO: 100109 - DNA, 25 bp, Rattus norvegicus
acttctcgagcgacgaggagcgcga

SEQ ID NO: 100110 - DNA, 25 bp, Rattus norvegicus
acttctcgagcgtcgaggagcgcga

SEQ ID NO: 100111 - DNA, 25 bp, Rattus norvegicus
acttctcgtctactctgtaagctgg

SEQ ID NO: 100112 - DNA, 25 bp, Rattus norvegicus
acttctcgtctagtctgtaagctgg

SEQ ID NO: 100113 - DNA, 25 bp, Rattus norvegicus
acttctctacttcctcagggactac

SEQ ID NO: 100114 - DNA, 25 bp, Rattus norvegicus
acttctctacttgctcagggactac

SEQ ID NO: 100115 - DNA, 25 bp, Rattus norvegicus
acttctctattactaactctgctga

SEQ ID NO: 100116 - DNA, 25 bp, Rattus norvegicus
acttctctattagtaactctgctga

SEQ ID NO: 100117 - DNA, 25 bp, Rattus norvegicus
acttctctccagacacatcaaaaga

SEQ ID NO: 100118 - DNA, 25 bp, Rattus norvegicus
acttctctccagtcacatcaaaaga

SEQ ID NO: 100119 - DNA, 25 bp, Rattus norvegicus
acttctctcgtgacattttctatac

SEQ ID NO: 100120 - DNA, 25 bp, Rattus norvegicus
acttctctcgtgtcattttctatac

SEQ ID NO: 100121 - DNA, 25 bp, Rattus norvegicus
acttctctgagccttggttttctta

SEQ ID NO: 100122 - DNA, 25 bp, Rattus norvegicus
acttctctgagcgttggttttctta

SEQ ID NO: 100123 - DNA, 25 bp, Rattus norvegicus
acttctctgataaaggacctctggc

SEQ ID NO: 100124 - DNA, 25 bp, Rattus norvegicus
acttctctgatataggacctctggc

SEQ ID NO: 100125 - DNA, 25 bp, Rattus norvegicus
acttctctgctcagtgctgagtgtt

SEQ ID NO: 100126 - DNA, 25 bp, Rattus norvegicus
acttctctgctctgtgctgagtgtt

SEQ ID NO: 100127 - DNA, 25 bp, Rattus norvegicus
acttctctgcttactgctggagcgg

SEQ ID NO: 100128 - DNA, 25 bp, Rattus norvegicus
acttctctgcttaggttgccatgga

SEQ ID NO: 100129 - DNA, 25 bp, Rattus norvegicus
acttctctgctttctgctggagcgg

SEQ ID NO: 100130 - DNA, 25 bp, Rattus norvegicus
acttctctgctttggttgccatgga

SEQ ID NO: 100131 - DNA, 25 bp, Rattus norvegicus
acttctctgtggctgtctgtctgga

SEQ ID NO: 100132 - DNA, 25 bp, Rattus norvegicus
acttctctgtgggtgtctgtctgga

SEQ ID NO: 100133 - DNA, 25 bp, Rattus norvegicus
acttctcttcatatcgtctttggaa

SEQ ID NO: 100134 - DNA, 25 bp, Rattus norvegicus
acttctcttcatttcgtctttggaa

SEQ ID NO: 100135 - DNA, 25 bp, Rattus norvegicus
acttctcttctgatgtatagctctt

SEQ ID NO: 100136 - DNA, 25 bp, Rattus norvegicus
acttctcttctgttgtatagctctt

SEQ ID NO: 100137 - DNA, 25 bp, Rattus norvegicus
acttctcttgagatttgctcaccct

SEQ ID NO: 100138 - DNA, 25 bp, Rattus norvegicus
acttctcttgagttttgctcaccct

SEQ ID NO: 100139 - DNA, 25 bp, Rattus norvegicus
acttctcttgtcattaacatggcac

SEQ ID NO: 100140 - DNA, 25 bp, Rattus norvegicus
acttctcttgtctttaacatggcac

SEQ ID NO: 100141 - DNA, 25 bp, Rattus norvegicus
acttctcttttgaaactgctgtctc

SEQ ID NO: 100142 - DNA, 25 bp, Rattus norvegicus
acttctcttttgtaactgctgtctc

SEQ ID NO: 100143 - DNA, 25 bp, Rattus norvegicus
acttctgaacagaggacccaaggca

SEQ ID NO: 100144 - DNA, 25 bp, Rattus norvegicus
acttctgaacagtggacccaaggca

SEQ ID NO: 100145 - DNA, 25 bp, Rattus norvegicus
acttctgaacctcctttatgttgct

SEQ ID NO: 100146 - DNA, 25 bp, Rattus norvegicus
acttctgaacctgctttatgttgct

SEQ ID NO: 100147 - DNA, 25 bp, Rattus norvegicus
acttctgaagaacaggagcgagcat

SEQ ID NO: 100148 - DNA, 25 bp, Rattus norvegicus
acttctgaagaagaggagcgagcat

SEQ ID NO: 100149 - DNA, 25 bp, Rattus norvegicus
acttctgaagtgacacaggatgtca

SEQ ID NO: 100150 - DNA, 25 bp, Rattus norvegicus
acttctgaagtgtcacaggatgtca

SEQ ID NO: 100151 - DNA, 25 bp, Rattus norvegicus
acttctgaatctctggtggtgagca

SEQ ID NO: 100152 - DNA, 25 bp, Rattus norvegicus
acttctgaatctgtggtggtgagca

SEQ ID NO: 100153 - DNA, 25 bp, Rattus norvegicus
acttctgaccttctgtgcttgcatt

SEQ ID NO: 100154 - DNA, 25 bp, Rattus norvegicus
acttctgaccttgtgtgcttgcatt

SEQ ID NO: 100155 - DNA, 25 bp, Rattus norvegicus
acttctgacgaacagcgcccatgta

SEQ ID NO: 100156 - DNA, 25 bp, Rattus norvegicus
acttctgacgaagagcgcccatgta

SEQ ID NO: 100157 - DNA, 25 bp, Rattus norvegicus
acttctgacgtgaaaccaaaatcaa

SEQ ID NO: 100158 - DNA, 25 bp, Rattus norvegicus
acttctgacgtgtaaccaaaatcaa

SEQ ID NO: 100159 - DNA, 25 bp, Rattus norvegicus
acttctgagaacattggtctggtac

SEQ ID NO: 100160 - DNA, 25 bp, Rattus norvegicus
acttctgagaactttggtctggtac

SEQ ID NO: 100161 - DNA, 25 bp, Rattus norvegicus
acttctgaggatccttttccggaaa

SEQ ID NO: 100162 - DNA, 25 bp, Rattus norvegicus
acttctgaggatgcttttccggaaa

SEQ ID NO: 100163 - DNA, 25 bp, Rattus norvegicus
acttctgattttctatttccatttg

SEQ ID NO: 100164 - DNA, 25 bp, Rattus norvegicus
acttctgattttgtatttccatttg

SEQ ID NO: 100165 - DNA, 25 bp, Rattus norvegicus
acttctgcaagtcgacccttgtgaa

SEQ ID NO: 100166 - DNA, 25 bp, Rattus norvegicus
acttctgcaagtggacccttgtgaa

SEQ ID NO: 100167 - DNA, 25 bp, Rattus norvegicus
acttctgcaccacggctcaaggtta

SEQ ID NO: 100168 - DNA, 25 bp, Rattus norvegicus
acttctgcaccagggctcaaggtta

SEQ ID NO: 100169 - DNA, 25 bp, Rattus norvegicus
acttctgcacccagatgtacagtgt

SEQ ID NO: 100170 - DNA, 25 bp, Rattus norvegicus
acttctgcaccctgatgtacagtgt

SEQ ID NO: 100171 - DNA, 25 bp, Rattus norvegicus
acttctgcagaacacaggatggaca

SEQ ID NO: 100172 - DNA, 25 bp, Rattus norvegicus
acttctgcagaagacaggatggaca

SEQ ID NO: 100173 - DNA, 25 bp, Rattus norvegicus
acttctgcatctccgttgacgtcaa

SEQ ID NO: 100174 - DNA, 25 bp, Rattus norvegicus
acttctgcatctgcgttgacgtcaa

SEQ ID NO: 100175 - DNA, 25 bp, Rattus norvegicus
acttctgcatgaaggctaatcctcc

SEQ ID NO: 100176 - DNA, 25 bp, Rattus norvegicus
acttctgcatgatggctaatcctcc

SEQ ID NO: 100177 - DNA, 25 bp, Rattus norvegicus
acttctgccagccttgttgaatcaa

SEQ ID NO: 100178 - DNA, 25 bp, Rattus norvegicus
acttctgccagcgttgttgaatcaa

SEQ ID NO: 100179 - DNA, 25 bp, Rattus norvegicus
acttctgccgacacagcattaacaa

SEQ ID NO: 100180 - DNA, 25 bp, Rattus norvegicus
acttctgccgactcagcattaacaa

SEQ ID NO: 100181 - DNA, 25 bp, Rattus norvegicus
acttctgcctcaatttgtgtttgac

SEQ ID NO: 100182 - DNA, 25 bp, Rattus norvegicus
acttctgcctcattttgtgtttgac

SEQ ID NO: 100183 - DNA, 25 bp, Rattus norvegicus
acttctgcctccacaagtgtttaca

SEQ ID NO: 100184 - DNA, 25 bp, Rattus norvegicus
acttctgcctccacatgtttagata

SEQ ID NO: 100185 - DNA, 25 bp, Rattus norvegicus
acttctgcctcctcaagtgtttaca

SEQ ID NO: 100186 - DNA, 25 bp, Rattus norvegicus
acttctgcctcctcatgtttagata

SEQ ID NO: 100187 - DNA, 25 bp, Rattus norvegicus
acttctgcctgtagacttcaaaacg

SEQ ID NO: 100188 - DNA, 25 bp, Rattus norvegicus
acttctgcctgttgacttcaaaacg

SEQ ID NO: 100189 - DNA, 25 bp, Rattus norvegicus
acttctgccttccagtatgttagag

SEQ ID NO: 100190 - DNA, 25 bp, Rattus norvegicus
acttctgccttcgagtatgttagag

SEQ ID NO: 100191 - DNA, 25 bp, Rattus norvegicus
acttctgctcctagttctgtatgaa

SEQ ID NO: 100192 - DNA, 25 bp, Rattus norvegicus
acttctgctccttgttctgtatgaa

SEQ ID NO: 100193 - DNA, 25 bp, Rattus norvegicus
acttctgcttctagccggaagaaac

SEQ ID NO: 100194 - DNA, 25 bp, Rattus norvegicus
acttctgcttcttgccggaagaaac

SEQ ID NO: 100195 - DNA, 25 bp, Rattus norvegicus
acttctgcttttaaagggcctctgg

SEQ ID NO: 100196 - DNA, 25 bp, Rattus norvegicus
acttctgcttttcattggtcacaac

SEQ ID NO: 100197 - DNA, 25 bp, Rattus norvegicus
acttctgcttttgattggtcacaac

SEQ ID NO: 100198 - DNA, 25 bp, Rattus norvegicus
acttctgctttttaagggcctctgg

SEQ ID NO: 100199 - DNA, 25 bp, Rattus norvegicus
acttctggaaaaccgactgttgctc

SEQ ID NO: 100200 - DNA, 25 bp, Rattus norvegicus
acttctggaaaagcgactgttgctc

SEQ ID NO: 100201 - DNA, 25 bp, Rattus norvegicus
acttctggagccagacctcggtgta

SEQ ID NO: 100202 - DNA, 25 bp, Rattus norvegicus
acttctggagcctgacctcggtgta

SEQ ID NO: 100203 - DNA, 25 bp, Rattus norvegicus
acttctggcttcatgcagatcagga

SEQ ID NO: 100204 - DNA, 25 bp, Rattus norvegicus
acttctggcttcttgcagatcagga

SEQ ID NO: 100205 - DNA, 25 bp, Rattus norvegicus
acttctggcttgatgcaagagatgc

SEQ ID NO: 100206 - DNA, 25 bp, Rattus norvegicus
acttctggcttgttgcaagagatgc

SEQ ID NO: 100207 - DNA, 25 bp, Rattus norvegicus
acttctgggtaaagcactatgtctt

SEQ ID NO: 100208 - DNA, 25 bp, Rattus norvegicus
acttctgggtaatgcactatgtctt

SEQ ID NO: 100209 - DNA, 25 bp, Rattus norvegicus
acttctgggttactgggctacctgc

SEQ ID NO: 100210 - DNA, 25 bp, Rattus norvegicus
acttctgggttagtgggctacctgc

SEQ ID NO: 100211 - DNA, 25 bp, Rattus norvegicus
acttctggttgtatgtgtctggagt

SEQ ID NO: 100212 - DNA, 25 bp, Rattus norvegicus
acttctggttgtttgtgtctggagt

SEQ ID NO: 100213 - DNA, 25 bp, Rattus norvegicus
acttctgtctctctgctatgtaggt

SEQ ID NO: 100214 - DNA, 25 bp, Rattus norvegicus
acttctgtctctgtgctatgtaggt

SEQ ID NO: 100215 - DNA, 25 bp, Rattus norvegicus
acttctgtctgccacatgaggaggg

SEQ ID NO: 100216 - DNA, 25 bp, Rattus norvegicus
acttctgtctgcgacatgaggaggg

SEQ ID NO: 100217 - DNA, 25 bp, Rattus norvegicus
acttctgtcttcagtgtgtgacgtt

SEQ ID NO: 100218 - DNA, 25 bp, Rattus norvegicus
acttctgtcttctgtgtgtgacgtt

SEQ ID NO: 100219 - DNA, 25 bp, Rattus norvegicus
acttctgtgcaaaatggtctcttag

SEQ ID NO: 100220 - DNA, 25 bp, Rattus norvegicus
acttctgtgcaatatggtctcttag

SEQ ID NO: 100221 - DNA, 25 bp, Rattus norvegicus
acttctgtgggaacctttgccaaaa

SEQ ID NO: 100222 - DNA, 25 bp, Rattus norvegicus
acttctgtgggatcctttgccaaaa

SEQ ID NO: 100223 - DNA, 25 bp, Rattus norvegicus
acttctgtgtccagtaaagtgtgac

SEQ ID NO: 100224 - DNA, 25 bp, Rattus norvegicus
acttctgtgtcctgtaaagtgtgac

SEQ ID NO: 100225 - DNA, 25 bp, Rattus norvegicus
acttctgtgtttacttctgggcaaa

SEQ ID NO: 100226 - DNA, 25 bp, Rattus norvegicus
acttctgtgttttcttctgggcaaa

SEQ ID NO: 100227 - DNA, 25 bp, Rattus norvegicus
acttctgttaccacagggccttggt

SEQ ID NO: 100228 - DNA, 25 bp, Rattus norvegicus
acttctgttacctcagggccttggt

SEQ ID NO: 100229 - DNA, 25 bp, Rattus norvegicus
acttctgttcaaagatggcggttca

SEQ ID NO: 100230 - DNA, 25 bp, Rattus norvegicus
acttctgttcaatgatggcggttca

SEQ ID NO: 100231 - DNA, 25 bp, Rattus norvegicus
acttctgttgatagctttttgtcct

SEQ ID NO: 100232 - DNA, 25 bp, Rattus norvegicus
acttctgttgattgctttttgtcct

SEQ ID NO: 100233 - DNA, 25 bp, Rattus norvegicus
acttcttacagaccaggcttctgcc

SEQ ID NO: 100234 - DNA, 25 bp, Rattus norvegicus
acttcttacagagcaggcttctgcc

SEQ ID NO: 100235 - DNA, 25 bp, Rattus norvegicus
acttcttaccttcctggcttttcta

SEQ ID NO: 100236 - DNA, 25 bp, Rattus norvegicus
acttcttaccttgctggcttttcta

SEQ ID NO: 100237 - DNA, 25 bp, Rattus norvegicus
acttcttacgaaacccactgatgtc

SEQ ID NO: 100238 - DNA, 25 bp, Rattus norvegicus
acttcttacgaatcccactgatgtc

SEQ ID NO: 100239 - DNA, 25 bp, Rattus norvegicus
acttcttaggaaagtgtgttctcca

SEQ ID NO: 100240 - DNA, 25 bp, Rattus norvegicus
acttcttaggaatgtgtgttctcca

SEQ ID NO: 100241 - DNA, 25 bp, Rattus norvegicus
acttcttcagctactgtgggtgcta

SEQ ID NO: 100242 - DNA, 25 bp, Rattus norvegicus
acttcttcagcttctgtgggtgcta

SEQ ID NO: 100243 - DNA, 25 bp, Rattus norvegicus
acttcttcattcagttggtgcggcc

SEQ ID NO: 100244 - DNA, 25 bp, Rattus norvegicus
acttcttcattctgttggtgcggcc

SEQ ID NO: 100245 - DNA, 25 bp, Rattus norvegicus
acttcttcattgagcttaccagctg

SEQ ID NO: 100246 - DNA, 25 bp, Rattus norvegicus
acttcttcattgtgcttaccagctg

SEQ ID NO: 100247 - DNA, 25 bp, Rattus norvegicus
acttcttccaagctgtgaccccttg

SEQ ID NO: 100248 - DNA, 25 bp, Rattus norvegicus
acttcttccaaggtgtgaccccttg

SEQ ID NO: 100249 - DNA, 25 bp, Rattus norvegicus
acttcttcccaactggagtctggtt

SEQ ID NO: 100250 - DNA, 25 bp, Rattus norvegicus
acttcttcccaagtggagtctggtt

SEQ ID NO: 100251 - DNA, 25 bp, Rattus norvegicus
acttcttccccaaaatgctgcatta

SEQ ID NO: 100252 - DNA, 25 bp, Rattus norvegicus
acttcttccccataatgctgcatta

SEQ ID NO: 100253 - DNA, 25 bp, Rattus norvegicus
acttcttccctacttgtggcatgaa

SEQ ID NO: 100254 - DNA, 25 bp, Rattus norvegicus
acttcttccctagttgtggcatgaa

SEQ ID NO: 100255 - DNA, 25 bp, Rattus norvegicus
acttcttccgcgaattggccgagga

SEQ ID NO: 100256 - DNA, 25 bp, Rattus norvegicus
acttcttccgcgtattggccgagga

SEQ ID NO: 100257 - DNA, 25 bp, Rattus norvegicus
acttcttctgcgacgggacagagca

SEQ ID NO: 100258 - DNA, 25 bp, Rattus norvegicus
acttcttctgcgtcgggacagagca

SEQ ID NO: 100259 - DNA, 25 bp, Rattus norvegicus
acttcttctgtgatggaactcccct

SEQ ID NO: 100260 - DNA, 25 bp, Rattus norvegicus
acttcttctgtgttggaactcccct

SEQ ID NO: 100261 - DNA, 25 bp, Rattus norvegicus
acttcttgagaacgcggttccagtt

SEQ ID NO: 100262 - DNA, 25 bp, Rattus norvegicus
acttcttgagaaggcggttccagtt

SEQ ID NO: 100263 - DNA, 25 bp, Rattus norvegicus
acttcttggagcacctgtgggaaca

SEQ ID NO: 100264 - DNA, 25 bp, Rattus norvegicus
acttcttggagctcctgtgggaaca

SEQ ID NO: 100265 - DNA, 25 bp, Rattus norvegicus
acttcttggcagaactgctgtccga

SEQ ID NO: 100266 - DNA, 25 bp, Rattus norvegicus
acttcttggcagtactgctgtccga

SEQ ID NO: 100267 - DNA, 25 bp, Rattus norvegicus
acttcttgggctaggcatagtgtcc

SEQ ID NO: 100268 - DNA, 25 bp, Rattus norvegicus
acttcttgggcttggcatagtgtcc

SEQ ID NO: 100269 - DNA, 25 bp, Rattus norvegicus
acttcttgtcacattgttatgccaa

SEQ ID NO: 100270 - DNA, 25 bp, Rattus norvegicus
acttcttgtcactttgttatgccaa

SEQ ID NO: 100271 - DNA, 25 bp, Rattus norvegicus
acttcttgtccacttgagggcttga

SEQ ID NO: 100272 - DNA, 25 bp, Rattus norvegicus
acttcttgtccagttgagggcttga

SEQ ID NO: 100273 - DNA, 25 bp, Rattus norvegicus
acttcttgtcgcctgtgtgcagact

SEQ ID NO: 100274 - DNA, 25 bp, Rattus norvegicus
acttcttgtcgcgtgtgtgcagact

SEQ ID NO: 100275 - DNA, 25 bp, Rattus norvegicus
acttctttaaatatcttggagatcc

SEQ ID NO: 100276 - DNA, 25 bp, Rattus norvegicus
acttctttaaatttcttggagatcc

SEQ ID NO: 100277 - DNA, 25 bp, Rattus norvegicus
acttctttacaaccttctgcagatc

SEQ ID NO: 100278 - DNA, 25 bp, Rattus norvegicus
acttctttacaagcttctgcagatc

SEQ ID NO: 100279 - DNA, 25 bp, Rattus norvegicus
acttctttcatactggctgccagga

SEQ ID NO: 100280 - DNA, 25 bp, Rattus norvegicus
acttctttcatagtggctgccagga

SEQ ID NO: 100281 - DNA, 25 bp, Rattus norvegicus
acttctttccagagtcatagtccag

SEQ ID NO: 100282 - DNA, 25 bp, Rattus norvegicus
acttctttccagtgtcatagtccag

SEQ ID NO: 100283 - DNA, 25 bp, Rattus norvegicus
acttctttccttacatactagctgt

SEQ ID NO: 100284 - DNA, 25 bp, Rattus norvegicus
acttctttcctttcatactagctgt

SEQ ID NO: 100285 - DNA, 25 bp, Rattus norvegicus
acttctttctttcatcacaacagac

SEQ ID NO: 100286 - DNA, 25 bp, Rattus norvegicus
acttctttctttctgtccttgtttg

SEQ ID NO: 100287 - DNA, 25 bp, Rattus norvegicus
acttctttctttgatcacaacagac

SEQ ID NO: 100288 - DNA, 25 bp, Rattus norvegicus
acttctttctttgtgtccttgtttg

SEQ ID NO: 100289 - DNA, 25 bp, Rattus norvegicus
acttctttgaagacacctgggatgt

SEQ ID NO: 100290 - DNA, 25 bp, Rattus norvegicus
acttctttgaagtcacctgggatgt

SEQ ID NO: 100291 - DNA, 25 bp, Rattus norvegicus
acttctttggacagatggcggctgc

SEQ ID NO: 100292 - DNA, 25 bp, Rattus norvegicus
acttctttggactgatggcggctgc

SEQ ID NO: 100293 - DNA, 25 bp, Rattus norvegicus
acttctttgtgtatccacttcatga

SEQ ID NO: 100294 - DNA, 25 bp, Rattus norvegicus
acttctttgtgtttccacttcatga

SEQ ID NO: 100295 - DNA, 25 bp, Rattus norvegicus
acttcttttattcttctctggtgga

SEQ ID NO: 100296 - DNA, 25 bp, Rattus norvegicus
acttcttttattgttctctggtgga

SEQ ID NO: 100297 - DNA, 25 bp, Rattus norvegicus
acttcttttctgagccaaaatcagt

SEQ ID NO: 100298 - DNA, 25 bp, Rattus norvegicus
acttcttttctgtgccaaaatcagt

SEQ ID NO: 100299 - DNA, 25 bp, Rattus norvegicus
acttcttttgcactgcagcgtataa

SEQ ID NO: 100300 - DNA, 25 bp, Rattus norvegicus
acttcttttgcagtgcagcgtataa

SEQ ID NO: 100301 - DNA, 25 bp, Rattus norvegicus
acttgaaaccaaccctggtccggat

SEQ ID NO: 100302 - DNA, 25 bp, Rattus norvegicus
acttgaaaccaagcctggtccggat

SEQ ID NO: 100303 - DNA, 25 bp, Rattus norvegicus
acttgaaagggcactgactgcttca

SEQ ID NO: 100304 - DNA, 25 bp, Rattus norvegicus
acttgaaagggctctgactgcttca

SEQ ID NO: 100305 - DNA, 25 bp, Rattus norvegicus
acttgaaatggtagctctcccaggt

SEQ ID NO: 100306 - DNA, 25 bp, Rattus norvegicus
acttgaaatggttgctctcccaggt

SEQ ID NO: 100307 - DNA, 25 bp, Rattus norvegicus
acttgaacaaggactccaacaggga

SEQ ID NO: 100308 - DNA, 25 bp, Rattus norvegicus
acttgaacaaggtctccaacaggga

SEQ ID NO: 100309 - DNA, 25 bp, Rattus norvegicus
acttgaactagtctcttcagtctcc

SEQ ID NO: 100310 - DNA, 25 bp, Rattus norvegicus
acttgaactagtgtcttcagtctcc

SEQ ID NO: 100311 - DNA, 25 bp, Rattus norvegicus
acttgaactgtaacagggacccata

SEQ ID NO: 100312 - DNA, 25 bp, Rattus norvegicus
acttgaactgtatcagggacccata

SEQ ID NO: 100313 - DNA, 25 bp, Rattus norvegicus
acttgaactgtcattccatttagga

SEQ ID NO: 100314 - DNA, 25 bp, Rattus norvegicus
acttgaactgtctttccatttagga

SEQ ID NO: 100315 - DNA, 25 bp, Rattus norvegicus
acttgaagatctcccttccaactgc

SEQ ID NO: 100316 - DNA, 25 bp, Rattus norvegicus
acttgaagatctgccttccaactgc

SEQ ID NO: 100317 - DNA, 25 bp, Rattus norvegicus
acttgaagccccatagaggctctgt

SEQ ID NO: 100318 - DNA, 25 bp, Rattus norvegicus
acttgaagccccttagaggctctgt

SEQ ID NO: 100319 - DNA, 25 bp, Rattus norvegicus
acttgaagcctccaaagccaggaca

SEQ ID NO: 100320 - DNA, 25 bp, Rattus norvegicus
acttgaagcctcgaaagccaggaca

SEQ ID NO: 100321 - DNA, 25 bp, Rattus norvegicus
acttgaagctttagtttgcactgaa

SEQ ID NO: 100322 - DNA, 25 bp, Rattus norvegicus
acttgaagcttttgtttgcactgaa

SEQ ID NO: 100323 - DNA, 25 bp, Rattus norvegicus
acttgaagtgaccattcctccttgg

SEQ ID NO: 100324 - DNA, 25 bp, Rattus norvegicus
acttgaagtgacgattcctccttgg

SEQ ID NO: 100325 - DNA, 25 bp, Rattus norvegicus
acttgaagttctcttttggcctcca

SEQ ID NO: 100326 - DNA, 25 bp, Rattus norvegicus
acttgaagttctgttttggcctcca

SEQ ID NO: 100327 - DNA, 25 bp, Rattus norvegicus
acttgaatccgtctgtgtgaaacac

SEQ ID NO: 100328 - DNA, 25 bp, Rattus norvegicus
acttgaatccgtgtgtgtgaaacac

SEQ ID NO: 100329 - DNA, 25 bp, Rattus norvegicus
acttgaatccttacgcgcttaccaa

SEQ ID NO: 100330 - DNA, 25 bp, Rattus norvegicus
acttgaatcctttcgcgcttaccaa

SEQ ID NO: 100331 - DNA, 25 bp, Rattus norvegicus
acttgaatctggaacatcagtgcca

SEQ ID NO: 100332 - DNA, 25 bp, Rattus norvegicus
acttgaatctggtacatcagtgcca

SEQ ID NO: 100333 - DNA, 25 bp, Rattus norvegicus
acttgaatggaccacgccggtgaaa

SEQ ID NO: 100334 - DNA, 25 bp, Rattus norvegicus
acttgaatggacgacgccggtgaaa

SEQ ID NO: 100335 - DNA, 25 bp, Rattus norvegicus
acttgaatgtgtacatcctgccgct

SEQ ID NO: 100336 - DNA, 25 bp, Rattus norvegicus
acttgaatgtgttcatcctgccgct

SEQ ID NO: 100337 - DNA, 25 bp, Rattus norvegicus
acttgaattagtctgtttcctccca

SEQ ID NO: 100338 - DNA, 25 bp, Rattus norvegicus
acttgaattagtgtgtttcctccca

SEQ ID NO: 100339 - DNA, 25 bp, Rattus norvegicus
acttgaattctgcacactgtgcttt

SEQ ID NO: 100340 - DNA, 25 bp, Rattus norvegicus
acttgaattctggacactgtgcttt

SEQ ID NO: 100341 - DNA, 25 bp, Rattus norvegicus
acttgacacaaaccagggtcacctg

SEQ ID NO: 100342 - DNA, 25 bp, Rattus norvegicus
acttgacacaaagcagggtcacctg

SEQ ID NO: 100343 - DNA, 25 bp, Rattus norvegicus
acttgacactctctgatgcctgaga

SEQ ID NO: 100344 - DNA, 25 bp, Rattus norvegicus
acttgacactctgtgatgcctgaga

SEQ ID NO: 100345 - DNA, 25 bp, Rattus norvegicus
acttgacagatacccacccatagat

SEQ ID NO: 100346 - DNA, 25 bp, Rattus norvegicus
acttgacagatagccacccatagat

SEQ ID NO: 100347 - DNA, 25 bp, Rattus norvegicus
acttgacaggagctagggccatcta

SEQ ID NO: 100348 - DNA, 25 bp, Rattus norvegicus
acttgacaggaggtagggccatcta

SEQ ID NO: 100349 - DNA, 25 bp, Rattus norvegicus
acttgacagtctatggttgtttcca

SEQ ID NO: 100350 - DNA, 25 bp, Rattus norvegicus
acttgacagtctttggttgtttcca

SEQ ID NO: 100351 - DNA, 25 bp, Rattus norvegicus
acttgacagtgtacattttaatgac

SEQ ID NO: 100352 - DNA, 25 bp, Rattus norvegicus
acttgacagtgttcattttaatgac

SEQ ID NO: 100353 - DNA, 25 bp, Rattus norvegicus
acttgacataagctagggtcatcta

SEQ ID NO: 100354 - DNA, 25 bp, Rattus norvegicus
acttgacataaggtagggtcatcta

SEQ ID NO: 100355 - DNA, 25 bp, Rattus norvegicus
acttgacattttacatggtatttca

SEQ ID NO: 100356 - DNA, 25 bp, Rattus norvegicus
acttgacatttttcatggtatttca

SEQ ID NO: 100357 - DNA, 25 bp, Rattus norvegicus
acttgaccccatactcaaatctggg

SEQ ID NO: 100358 - DNA, 25 bp, Rattus norvegicus
acttgaccccattctcaaatctggg

SEQ ID NO: 100359 - DNA, 25 bp, Rattus norvegicus
acttgacccctgaggcctatgcgca

SEQ ID NO: 100360 - DNA, 25 bp, Rattus norvegicus
acttgacccctgtggcctatgcgca

SEQ ID NO: 100361 - DNA, 25 bp, Rattus norvegicus
acttgaccttccatagagccactga

SEQ ID NO: 100362 - DNA, 25 bp, Rattus norvegicus
acttgaccttccttagagccactga

SEQ ID NO: 100363 - DNA, 25 bp, Rattus norvegicus
acttgaccttttaatgcaccatctc

SEQ ID NO: 100364 - DNA, 25 bp, Rattus norvegicus
acttgacctttttatgcaccatctc

SEQ ID NO: 100365 - DNA, 25 bp, Rattus norvegicus
acttgacgagtgctgaaacttctta

SEQ ID NO: 100366 - DNA, 25 bp, Rattus norvegicus
acttgacgagtggtgaaacttctta

SEQ ID NO: 100367 - DNA, 25 bp, Rattus norvegicus
acttgacgtctaagtttgagtacct

SEQ ID NO: 100368 - DNA, 25 bp, Rattus norvegicus
acttgacgtctatgtttgagtacct

SEQ ID NO: 100369 - DNA, 25 bp, Rattus norvegicus
acttgactaagcaacctgggtcctg

SEQ ID NO: 100370 - DNA, 25 bp, Rattus norvegicus
acttgactaagctacctgggtcctg

SEQ ID NO: 100371 - DNA, 25 bp, Rattus norvegicus
acttgactatccatttgttacgtgc

SEQ ID NO: 100372 - DNA, 25 bp, Rattus norvegicus
acttgactatccttttgttacgtgc

SEQ ID NO: 100373 - DNA, 25 bp, Rattus norvegicus
acttgactccttactgaggctatac

SEQ ID NO: 100374 - DNA, 25 bp, Rattus norvegicus
acttgactcctttctgaggctatac

SEQ ID NO: 100375 - DNA, 25 bp, Rattus norvegicus
acttgactctacatgcaggtggttt

SEQ ID NO: 100376 - DNA, 25 bp, Rattus norvegicus
acttgactctacttgcaggtggttt

SEQ ID NO: 100377 - DNA, 25 bp, Rattus norvegicus
acttgactgattatcatccagtttt

SEQ ID NO: 100378 - DNA, 25 bp, Rattus norvegicus
acttgactgattttcatccagtttt

SEQ ID NO: 100379 - DNA, 25 bp, Rattus norvegicus
acttgactgctgagtggcattgggc

SEQ ID NO: 100380 - DNA, 25 bp, Rattus norvegicus
acttgactgctgtgtggcattgggc

SEQ ID NO: 100381 - DNA, 25 bp, Rattus norvegicus
acttgacttgtgaagcagatgccta

SEQ ID NO: 100382 - DNA, 25 bp, Rattus norvegicus
acttgacttgtgtagcagatgccta

SEQ ID NO: 100383 - DNA, 25 bp, Rattus norvegicus
acttgagaacccctctgtatgtatt

SEQ ID NO: 100384 - DNA, 25 bp, Rattus norvegicus
acttgagaacccgtctgtatgtatt

SEQ ID NO: 100385 - DNA, 25 bp, Rattus norvegicus
acttgagacgcccttcactaatgga

SEQ ID NO: 100386 - DNA, 25 bp, Rattus norvegicus
acttgagacgccgttcactaatgga

SEQ ID NO: 100387 - DNA, 25 bp, Rattus norvegicus
acttgagacttgatcttgggccagt

SEQ ID NO: 100388 - DNA, 25 bp, Rattus norvegicus
acttgagacttgttcttgggccagt

SEQ ID NO: 100389 - DNA, 25 bp, Rattus norvegicus
acttgagagtgcagcgttttctgcc

SEQ ID NO: 100390 - DNA, 25 bp, Rattus norvegicus
acttgagagtgctgcgttttctgcc

SEQ ID NO: 100391 - DNA, 25 bp, Rattus norvegicus
acttgagccggaagtgccagtagca

SEQ ID NO: 100392 - DNA, 25 bp, Rattus norvegicus
acttgagccggatgtgccagtagca

SEQ ID NO: 100393 - DNA, 25 bp, Rattus norvegicus
acttgagcggctacggccagggctt

SEQ ID NO: 100394 - DNA, 25 bp, Rattus norvegicus
acttgagcggcttcggccagggctt

SEQ ID NO: 100395 - DNA, 25 bp, Rattus norvegicus
acttgagctctgagtttcagggaca

SEQ ID NO: 100396 - DNA, 25 bp, Rattus norvegicus
acttgagctctgtgtttcagggaca

SEQ ID NO: 100397 - DNA, 25 bp, Rattus norvegicus
acttgagctgaactcccgagctggg

SEQ ID NO: 100398 - DNA, 25 bp, Rattus norvegicus
acttgagctgaagtcccgagctggg

SEQ ID NO: 100399 - DNA, 25 bp, Rattus norvegicus
acttgaggcacacatgtggcaccta

SEQ ID NO: 100400 - DNA, 25 bp, Rattus norvegicus
acttgaggcacagatgtggcaccta

SEQ ID NO: 100401 - DNA, 25 bp, Rattus norvegicus
acttgaggctctaatgctgccgtaa

SEQ ID NO: 100402 - DNA, 25 bp, Rattus norvegicus
acttgaggctcttatgctgccgtaa

SEQ ID NO: 100403 - DNA, 25 bp, Rattus norvegicus
acttgagggcctcaatttggtggat

SEQ ID NO: 100404 - DNA, 25 bp, Rattus norvegicus
acttgagggcctgaatttggtggat

SEQ ID NO: 100405 - DNA, 25 bp, Rattus norvegicus
acttgagtaaagaccgcatcttccc

SEQ ID NO: 100406 - DNA, 25 bp, Rattus norvegicus
acttgagtaaagtccgcatcttccc

SEQ ID NO: 100407 - DNA, 25 bp, Rattus norvegicus
acttgagtacacagcacaaattaaa

SEQ ID NO: 100408 - DNA, 25 bp, Rattus norvegicus
acttgagtacactgcacaaattaaa

SEQ ID NO: 100409 - DNA, 25 bp, Rattus norvegicus
acttgagtccacagggtggcccaga

SEQ ID NO: 100410 - DNA, 25 bp, Rattus norvegicus
acttgagtccactgggtggcccaga

SEQ ID NO: 100411 - DNA, 25 bp, Rattus norvegicus
acttgagtcctcaccagttttgaag

SEQ ID NO: 100412 - DNA, 25 bp, Rattus norvegicus
acttgagtcctctccagttttgaag

SEQ ID NO: 100413 - DNA, 25 bp, Rattus norvegicus
acttgagtcttgatttgtctcccag

SEQ ID NO: 100414 - DNA, 25 bp, Rattus norvegicus
acttgagtcttgttttgtctcccag

SEQ ID NO: 100415 - DNA, 25 bp, Rattus norvegicus
acttgagtgaaaatgccagggctga

SEQ ID NO: 100416 - DNA, 25 bp, Rattus norvegicus
acttgagtgaaattgccagggctga

SEQ ID NO: 100417 - DNA, 25 bp, Rattus norvegicus
acttgagtgcatatctagagctatt

SEQ ID NO: 100418 - DNA, 25 bp, Rattus norvegicus
acttgagtgcatttctagagctatt

SEQ ID NO: 100419 - DNA, 25 bp, Rattus norvegicus
acttgagtttcaatcaccccagtaa

SEQ ID NO: 100420 - DNA, 25 bp, Rattus norvegicus
acttgagtttcattcaccccagtaa

SEQ ID NO: 100421 - DNA, 25 bp, Rattus norvegicus
acttgataaatgagaccgtcctgca

SEQ ID NO: 100422 - DNA, 25 bp, Rattus norvegicus
acttgataaatgtgaccgtcctgca

SEQ ID NO: 100423 - DNA, 25 bp, Rattus norvegicus
acttgataagccatctttcacctac

SEQ ID NO: 100424 - DNA, 25 bp, Rattus norvegicus
acttgataagccttctttcacctac

SEQ ID NO: 100425 - DNA, 25 bp, Rattus norvegicus
acttgataagttatggcatgttgaa

SEQ ID NO: 100426 - DNA, 25 bp, Rattus norvegicus
acttgataagttttggcatgttgaa

SEQ ID NO: 100427 - DNA, 25 bp, Rattus norvegicus
acttgataataaactcccgtgctac

SEQ ID NO: 100428 - DNA, 25 bp, Rattus norvegicus
acttgataataatctcccgtgctac

SEQ ID NO: 100429 - DNA, 25 bp, Rattus norvegicus
acttgataccttctccatgagcagt

SEQ ID NO: 100430 - DNA, 25 bp, Rattus norvegicus
acttgataccttgtccatgagcagt

SEQ ID NO: 100431 - DNA, 25 bp, Rattus norvegicus
acttgatcaggccacattcagacat

SEQ ID NO: 100432 - DNA, 25 bp, Rattus norvegicus
acttgatcaggcgacattcagacat

SEQ ID NO: 100433 - DNA, 25 bp, Rattus norvegicus
acttgatcagggaatcaggtctcct

SEQ ID NO: 100434 - DNA, 25 bp, Rattus norvegicus
acttgatcagggtatcaggtctcct

SEQ ID NO: 100435 - DNA, 25 bp, Rattus norvegicus
acttgatcatccaagctaccagctt

SEQ ID NO: 100436 - DNA, 25 bp, Rattus norvegicus
acttgatcatcctagctaccagctt

SEQ ID NO: 100437 - DNA, 25 bp, Rattus norvegicus
acttgatccataatcttcctcggag

SEQ ID NO: 100438 - DNA, 25 bp, Rattus norvegicus
acttgatccatattcttcctcggag

SEQ ID NO: 100439 - DNA, 25 bp, Rattus norvegicus
acttgatcctaaagcctctgtctat

SEQ ID NO: 100440 - DNA, 25 bp, Rattus norvegicus
acttgatcctaatgcctctgtctat

SEQ ID NO: 100441 - DNA, 25 bp, Rattus norvegicus
acttgatgagctcttttggaaccca

SEQ ID NO: 100442 - DNA, 25 bp, Rattus norvegicus
acttgatgagctgttttggaaccca

SEQ ID NO: 100443 - DNA, 25 bp, Rattus norvegicus
acttgatgatacagccattgcctgc

SEQ ID NO: 100444 - DNA, 25 bp, Rattus norvegicus
acttgatgatactgccattgcctgc

SEQ ID NO: 100445 - DNA, 25 bp, Rattus norvegicus
acttgatgattgacacaggtgctgt

SEQ ID NO: 100446 - DNA, 25 bp, Rattus norvegicus
acttgatgattgtcacaggtgctgt

SEQ ID NO: 100447 - DNA, 25 bp, Rattus norvegicus
acttgatgcacgacctgaactgcgt

SEQ ID NO: 100448 - DNA, 25 bp, Rattus norvegicus
acttgatgcacgtcctgaactgcgt

SEQ ID NO: 100449 - DNA, 25 bp, Rattus norvegicus
acttgatgcggcagtcagaaccaca

SEQ ID NO: 100450 - DNA, 25 bp, Rattus norvegicus
acttgatgcggctgtcagaaccaca

SEQ ID NO: 100451 - DNA, 25 bp, Rattus norvegicus
acttgatgcgtaatctgtggccgct

SEQ ID NO: 100452 - DNA, 25 bp, Rattus norvegicus
acttgatgcgtattctgtggccgct

SEQ ID NO: 100453 - DNA, 25 bp, Rattus norvegicus
acttgatggagcctttgcctcgcat

SEQ ID NO: 100454 - DNA, 25 bp, Rattus norvegicus
acttgatggagcgtttgcctcgcat

SEQ ID NO: 100455 - DNA, 25 bp, Rattus norvegicus
acttgatgtaaacctcagagaagct

SEQ ID NO: 100456 - DNA, 25 bp, Rattus norvegicus
acttgatgtaaagctcagagaagct

SEQ ID NO: 100457 - DNA, 25 bp, Rattus norvegicus
acttgatgtgtgagttttgggagaa

SEQ ID NO: 100458 - DNA, 25 bp, Rattus norvegicus
acttgatgtgtgtgttttgggagaa

SEQ ID NO: 100459 - DNA, 25 bp, Rattus norvegicus
acttgattaatcacattcccaaccc

SEQ ID NO: 100460 - DNA, 25 bp, Rattus norvegicus
acttgattaatctcattcccaaccc

SEQ ID NO: 100461 - DNA, 25 bp, Rattus norvegicus
acttgattatgactccccacatggg

SEQ ID NO: 100462 - DNA, 25 bp, Rattus norvegicus
acttgattatgagtccccacatggg

SEQ ID NO: 100463 - DNA, 25 bp, Rattus norvegicus
acttgattctgtattacctccttgt

SEQ ID NO: 100464 - DNA, 25 bp, Rattus norvegicus
acttgattctgttttacctccttgt

SEQ ID NO: 100465 - DNA, 25 bp, Rattus norvegicus
acttgattcttacgacctgagtgtc

SEQ ID NO: 100466 - DNA, 25 bp, Rattus norvegicus
acttgattcttaggacctgagtgtc

SEQ ID NO: 100467 - DNA, 25 bp, Rattus norvegicus
acttgattgaagagttccgtccttg

SEQ ID NO: 100468 - DNA, 25 bp, Rattus norvegicus
acttgattgaagtgttccgtccttg

SEQ ID NO: 100469 - DNA, 25 bp, Rattus norvegicus
acttgattgtgactgtccctcctga

SEQ ID NO: 100470 - DNA, 25 bp, Rattus norvegicus
acttgattgtgagtgtccctcctga

SEQ ID NO: 100471 - DNA, 25 bp, Rattus norvegicus
acttgatttcccattgtagcatgag

SEQ ID NO: 100472 - DNA, 25 bp, Rattus norvegicus
acttgatttccctttgtagcatgag

SEQ ID NO: 100473 - DNA, 25 bp, Rattus norvegicus
acttgatttcttatcacagccgtgg

SEQ ID NO: 100474 - DNA, 25 bp, Rattus norvegicus
acttgatttcttttcacagccgtgg

SEQ ID NO: 100475 - DNA, 25 bp, Rattus norvegicus
acttgattttcacatgtaccactgt

SEQ ID NO: 100476 - DNA, 25 bp, Rattus norvegicus
acttgattttcagatgtaccactgt

SEQ ID NO: 100477 - DNA, 25 bp, Rattus norvegicus
acttgcaaatgtaagcaggcgtttc

SEQ ID NO: 100478 - DNA, 25 bp, Rattus norvegicus
acttgcaaatgttagcaggcgtttc

SEQ ID NO: 100479 - DNA, 25 bp, Rattus norvegicus
acttgcaagatgctaccagctggat

SEQ ID NO: 100480 - DNA, 25 bp, Rattus norvegicus
acttgcaagatggtaccagctggat

SEQ ID NO: 100481 - DNA, 25 bp, Rattus norvegicus
acttgcaaggcacctggaacggctt

SEQ ID NO: 100482 - DNA, 25 bp, Rattus norvegicus
acttgcaaggcagctggaacggctt

SEQ ID NO: 100483 - DNA, 25 bp, Rattus norvegicus
acttgcaatgagatgcccctcatca

SEQ ID NO: 100484 - DNA, 25 bp, Rattus norvegicus
acttgcaatgagttgcccctcatca

SEQ ID NO: 100485 - DNA, 25 bp, Rattus norvegicus
acttgcacactgatagcgaagcttt

SEQ ID NO: 100486 - DNA, 25 bp, Rattus norvegicus
acttgcacactgttagcgaagcttt

SEQ ID NO: 100487 - DNA, 25 bp, Rattus norvegicus
acttgcacagtgctgacgtcatcgt

SEQ ID NO: 100488 - DNA, 25 bp, Rattus norvegicus
acttgcacagtggtgacgtcatcgt

SEQ ID NO: 100489 - DNA, 25 bp, Rattus norvegicus
acttgcacataaagtcgctttccag

SEQ ID NO: 100490 - DNA, 25 bp, Rattus norvegicus
acttgcacataatgtcgctttccag

SEQ ID NO: 100491 - DNA, 25 bp, Rattus norvegicus
acttgcacatgcatgtacctgcgca

SEQ ID NO: 100492 - DNA, 25 bp, Rattus norvegicus
acttgcacatgcttgtacctgcgca

SEQ ID NO: 100493 - DNA, 25 bp, Rattus norvegicus
acttgcacccctataacgtgacagt

SEQ ID NO: 100494 - DNA, 25 bp, Rattus norvegicus
acttgcacccctttaacgtgacagt

SEQ ID NO: 100495 - DNA, 25 bp, Rattus norvegicus
acttgcagagtgctgcgctccgaac

SEQ ID NO: 100496 - DNA, 25 bp, Rattus norvegicus
acttgcagagtggtgcgctccgaac

SEQ ID NO: 100497 - DNA, 25 bp, Rattus norvegicus
acttgcagcagtccttgtgagaacc

SEQ ID NO: 100498 - DNA, 25 bp, Rattus norvegicus
acttgcagcagtgcttgtgagaacc

SEQ ID NO: 100499 - DNA, 25 bp, Rattus norvegicus
acttgcagctctactctatggaggg

SEQ ID NO: 100500 - DNA, 25 bp, Rattus norvegicus
acttgcagctcttctctatggaggg

SEQ ID NO: 100501 - DNA, 25 bp, Rattus norvegicus
acttgcagctttagcctgaggtcca

SEQ ID NO: 100502 - DNA, 25 bp, Rattus norvegicus
acttgcagcttttgcctgaggtcca

SEQ ID NO: 100503 - DNA, 25 bp, Rattus norvegicus
acttgcaggttaaattcacgtacat

SEQ ID NO: 100504 - DNA, 25 bp, Rattus norvegicus
acttgcaggttatattcacgtacat

SEQ ID NO: 100505 - DNA, 25 bp, Rattus norvegicus
acttgcagtcagctggttgtcttta

SEQ ID NO: 100506 - DNA, 25 bp, Rattus norvegicus
acttgcagtcaggtggttgtcttta

SEQ ID NO: 100507 - DNA, 25 bp, Rattus norvegicus
acttgcagtgaactggcagcgcaga

SEQ ID NO: 100508 - DNA, 25 bp, Rattus norvegicus
acttgcagtgaagtggcagcgcaga

SEQ ID NO: 100509 - DNA, 25 bp, Rattus norvegicus
acttgcagttccagatcgcacactg

SEQ ID NO: 100510 - DNA, 25 bp, Rattus norvegicus
acttgcagttcctgatcgcacactg

SEQ ID NO: 100511 - DNA, 25 bp, Rattus norvegicus
acttgcatcctacaactgtgcattc

SEQ ID NO: 100512 - DNA, 25 bp, Rattus norvegicus
acttgcatcctagaactgtgcattc

SEQ ID NO: 100513 - DNA, 25 bp, Rattus norvegicus
acttgcatgcataattgtgacttca

SEQ ID NO: 100514 - DNA, 25 bp, Rattus norvegicus
acttgcatgcattattgtgacttca

SEQ ID NO: 100515 - DNA, 25 bp, Rattus norvegicus
acttgcatgcctattttcctgagga

SEQ ID NO: 100516 - DNA, 25 bp, Rattus norvegicus
acttgcatgccttttttcctgagga

SEQ ID NO: 100517 - DNA, 25 bp, Rattus norvegicus
acttgcatggttcttgtctttctga

SEQ ID NO: 100518 - DNA, 25 bp, Rattus norvegicus
acttgcatggttgttgtctttctga

SEQ ID NO: 100519 - DNA, 25 bp, Rattus norvegicus
acttgcattgtcagtgtacacacac

SEQ ID NO: 100520 - DNA, 25 bp, Rattus norvegicus
acttgcattgtctgtgtacacacac

SEQ ID NO: 100521 - DNA, 25 bp, Rattus norvegicus
acttgcattgtgattccggtttttg

SEQ ID NO: 100522 - DNA, 25 bp, Rattus norvegicus
acttgcattgtgtttccggtttttg

SEQ ID NO: 100523 - DNA, 25 bp, Rattus norvegicus
acttgcatttgcagatggtaatttc

SEQ ID NO: 100524 - DNA, 25 bp, Rattus norvegicus
acttgcatttgctgatggtaatttc

SEQ ID NO: 100525 - DNA, 25 bp, Rattus norvegicus
acttgccaaacaatgcaggatgtga

SEQ ID NO: 100526 - DNA, 25 bp, Rattus norvegicus
acttgccaaacattgcaggatgtga

SEQ ID NO: 100527 - DNA, 25 bp, Rattus norvegicus
acttgccacgtaattctattctttt

SEQ ID NO: 100528 - DNA, 25 bp, Rattus norvegicus
acttgccacgtatttctattctttt

SEQ ID NO: 100529 - DNA, 25 bp, Rattus norvegicus
acttgccacgtgacataaactattg

SEQ ID NO: 100530 - DNA, 25 bp, Rattus norvegicus
acttgccacgtgtcataaactattg

SEQ ID NO: 100531 - DNA, 25 bp, Rattus norvegicus
acttgcccaaagacacgcagcagat

SEQ ID NO: 100532 - DNA, 25 bp, Rattus norvegicus
acttgcccaaagtcacgcagcagat

SEQ ID NO: 100533 - DNA, 25 bp, Rattus norvegicus
acttgcccagcacagggtttttgat

SEQ ID NO: 100534 - DNA, 25 bp, Rattus norvegicus
acttgcccagcagagggtttttgat

SEQ ID NO: 100535 - DNA, 25 bp, Rattus norvegicus
acttgcccaggactcatgctgagag

SEQ ID NO: 100536 - DNA, 25 bp, Rattus norvegicus
acttgcccaggagtcatgctgagag

SEQ ID NO: 100537 - DNA, 25 bp, Rattus norvegicus
acttgcccatttagaactcttactg

SEQ ID NO: 100538 - DNA, 25 bp, Rattus norvegicus
acttgcccattttgaactcttactg

SEQ ID NO: 100539 - DNA, 25 bp, Rattus norvegicus
acttgccccatgaccctgaagatca

SEQ ID NO: 100540 - DNA, 25 bp, Rattus norvegicus
acttgccccatgtccctgaagatca

SEQ ID NO: 100541 - DNA, 25 bp, Rattus norvegicus
acttgccccattctccttaagaagg

SEQ ID NO: 100542 - DNA, 25 bp, Rattus norvegicus
acttgccccattgtccttaagaagg

SEQ ID NO: 100543 - DNA, 25 bp, Rattus norvegicus
acttgccccgctattgagttgcata

SEQ ID NO: 100544 - DNA, 25 bp, Rattus norvegicus
acttgccccgcttttgagttgcata

SEQ ID NO: 100545 - DNA, 25 bp, Rattus norvegicus
acttgccccgtacagatttcaatct

SEQ ID NO: 100546 - DNA, 25 bp, Rattus norvegicus
acttgccccgtagagatttcaatct

SEQ ID NO: 100547 - DNA, 25 bp, Rattus norvegicus
acttgccctagcattccttgttctt

SEQ ID NO: 100548 - DNA, 25 bp, Rattus norvegicus
acttgccctagctttccttgttctt

SEQ ID NO: 100549 - DNA, 25 bp, Rattus norvegicus
acttgccctggaaacttctatttta

SEQ ID NO: 100550 - DNA, 25 bp, Rattus norvegicus
acttgccctggatacttctatttta

SEQ ID NO: 100551 - DNA, 25 bp, Rattus norvegicus
acttgcccttgaagagatttattac

SEQ ID NO: 100552 - DNA, 25 bp, Rattus norvegicus
acttgcccttgatgagatttattac

SEQ ID NO: 100553 - DNA, 25 bp, Rattus norvegicus
acttgccctttgctggtagtagcca

SEQ ID NO: 100554 - DNA, 25 bp, Rattus norvegicus
acttgccctttggtggtagtagcca

SEQ ID NO: 100555 - DNA, 25 bp, Rattus norvegicus
acttgccgcagaagccacaggaatg

SEQ ID NO: 100556 - DNA, 25 bp, Rattus norvegicus
acttgccgcagatgccacaggaatg

SEQ ID NO: 100557 - DNA, 25 bp, Rattus norvegicus
acttgccgtgggacttactgaggtg

SEQ ID NO: 100558 - DNA, 25 bp, Rattus norvegicus
acttgccgtgggtcttactgaggtg

SEQ ID NO: 100559 - DNA, 25 bp, Rattus norvegicus
acttgcctaccgaggagtcaccgat

SEQ ID NO: 100560 - DNA, 25 bp, Rattus norvegicus
acttgcctaccgtggagtcaccgat

SEQ ID NO: 100561 - DNA, 25 bp, Rattus norvegicus
acttgcctccacatgctgtcttgga

SEQ ID NO: 100562 - DNA, 25 bp, Rattus norvegicus
acttgcctccacttgctgtcttgga

SEQ ID NO: 100563 - DNA, 25 bp, Rattus norvegicus
acttgcctgattaagaaatcttatt

SEQ ID NO: 100564 - DNA, 25 bp, Rattus norvegicus
acttgcctgatttagaaatcttatt

SEQ ID NO: 100565 - DNA, 25 bp, Rattus norvegicus
acttgcctgttgagccagcccaggg

SEQ ID NO: 100566 - DNA, 25 bp, Rattus norvegicus
acttgcctgttgtgccagcccaggg

SEQ ID NO: 100567 - DNA, 25 bp, Rattus norvegicus
acttgcctgtttcagctgtggtaaa

SEQ ID NO: 100568 - DNA, 25 bp, Rattus norvegicus
acttgcctgtttgagctgtggtaaa

SEQ ID NO: 100569 - DNA, 25 bp, Rattus norvegicus
acttgccttggacgttgagtctgga

SEQ ID NO: 100570 - DNA, 25 bp, Rattus norvegicus
acttgccttggaggttgagtctgga

SEQ ID NO: 100571 - DNA, 25 bp, Rattus norvegicus
acttgccttgttaaccaggatcctg

SEQ ID NO: 100572 - DNA, 25 bp, Rattus norvegicus
acttgccttgtttaccaggatcctg

SEQ ID NO: 100573 - DNA, 25 bp, Rattus norvegicus
acttgcctttgccagactgagccaa

SEQ ID NO: 100574 - DNA, 25 bp, Rattus norvegicus
acttgcctttgcgagactgagccaa

SEQ ID NO: 100575 - DNA, 25 bp, Rattus norvegicus
acttgcgcaggcctgggacctttct

SEQ ID NO: 100576 - DNA, 25 bp, Rattus norvegicus
acttgcgcaggcgtgggacctttct

SEQ ID NO: 100577 - DNA, 25 bp, Rattus norvegicus
acttgcgctgatcctgctgtctttg

SEQ ID NO: 100578 - DNA, 25 bp, Rattus norvegicus
acttgcgctgatgctgctgtctttg

SEQ ID NO: 100579 - DNA, 25 bp, Rattus norvegicus
acttgcggccctagggcactttggg

SEQ ID NO: 100580 - DNA, 25 bp, Rattus norvegicus
acttgcggcccttgggcactttggg

SEQ ID NO: 100581 - DNA, 25 bp, Rattus norvegicus
acttgcgtggcaatgggtcctgacc

SEQ ID NO: 100582 - DNA, 25 bp, Rattus norvegicus
acttgcgtggcattgggtcctgacc

SEQ ID NO: 100583 - DNA, 25 bp, Rattus norvegicus
acttgcgttccaatcttcaattcaa

SEQ ID NO: 100584 - DNA, 25 bp, Rattus norvegicus
acttgcgttccattcttcaattcaa

SEQ ID NO: 100585 - DNA, 25 bp, Rattus norvegicus
acttgctaacaaaggcagctcctgc

SEQ ID NO: 100586 - DNA, 25 bp, Rattus norvegicus
acttgctaacaatggcagctcctgc

SEQ ID NO: 100587 - DNA, 25 bp, Rattus norvegicus
acttgctaaggtactgtccagatca

SEQ ID NO: 100588 - DNA, 25 bp, Rattus norvegicus
acttgctaaggttctgtccagatca

SEQ ID NO: 100589 - DNA, 25 bp, Rattus norvegicus
acttgctaatttaacctctttcctg

SEQ ID NO: 100590 - DNA, 25 bp, Rattus norvegicus
acttgctaattttacctctttcctg

SEQ ID NO: 100591 - DNA, 25 bp, Rattus norvegicus
acttgctaggcacgccatggtattt

SEQ ID NO: 100592 - DNA, 25 bp, Rattus norvegicus
acttgctaggcaggccatggtattt

SEQ ID NO: 100593 - DNA, 25 bp, Rattus norvegicus
acttgctagtctcccagtcagccaa

SEQ ID NO: 100594 - DNA, 25 bp, Rattus norvegicus
acttgctagtctgccagtcagccaa

SEQ ID NO: 100595 - DNA, 25 bp, Rattus norvegicus
acttgctcaaggatacacatctggt

SEQ ID NO: 100596 - DNA, 25 bp, Rattus norvegicus
acttgctcaaggttacacatctggt

SEQ ID NO: 100597 - DNA, 25 bp, Rattus norvegicus
acttgctccaggactcactgaagat

SEQ ID NO: 100598 - DNA, 25 bp, Rattus norvegicus
acttgctccaggtctcactgaagat

SEQ ID NO: 100599 - DNA, 25 bp, Rattus norvegicus
acttgctccagtagtgatattcccc

SEQ ID NO: 100600 - DNA, 25 bp, Rattus norvegicus
acttgctccagttgtgatattcccc

SEQ ID NO: 100601 - DNA, 25 bp, Rattus norvegicus
acttgctccatgatgttcgtggtgt

SEQ ID NO: 100602 - DNA, 25 bp, Rattus norvegicus
acttgctccatgttgttcgtggtgt

SEQ ID NO: 100603 - DNA, 25 bp, Rattus norvegicus
acttgctccgacactcctttgagga

SEQ ID NO: 100604 - DNA, 25 bp, Rattus norvegicus
acttgctccgactctcctttgagga

SEQ ID NO: 100605 - DNA, 25 bp, Rattus norvegicus
acttgctctcgaaaatgctggtcta

SEQ ID NO: 100606 - DNA, 25 bp, Rattus norvegicus
acttgctctcgataatgctggtcta

SEQ ID NO: 100607 - DNA, 25 bp, Rattus norvegicus
acttgctctctgacactaacactaa

SEQ ID NO: 100608 - DNA, 25 bp, Rattus norvegicus
acttgctctctgtcactaacactaa

SEQ ID NO: 100609 - DNA, 25 bp, Rattus norvegicus
acttgctctggacaggttggagcct

SEQ ID NO: 100610 - DNA, 25 bp, Rattus norvegicus
acttgctctggagaggttggagcct

SEQ ID NO: 100611 - DNA, 25 bp, Rattus norvegicus
acttgctcttttcagattccttgga

SEQ ID NO: 100612 - DNA, 25 bp, Rattus norvegicus
acttgctcttttgagattccttgga

SEQ ID NO: 100613 - DNA, 25 bp, Rattus norvegicus
acttgctgaatcagaacgtggctcc

SEQ ID NO: 100614 - DNA, 25 bp, Rattus norvegicus
acttgctgaatctgaacgtggctcc

SEQ ID NO: 100615 - DNA, 25 bp, Rattus norvegicus
acttgctgagaaactattggtgggc

SEQ ID NO: 100616 - DNA, 25 bp, Rattus norvegicus
acttgctgagaatctattggtgggc

SEQ ID NO: 100617 - DNA, 25 bp, Rattus norvegicus
acttgctgatcaattcttgtggaga

SEQ ID NO: 100618 - DNA, 25 bp, Rattus norvegicus
acttgctgatcatttcttgtggaga

SEQ ID NO: 100619 - DNA, 25 bp, Rattus norvegicus
acttgctgcaaaccttctagggaag

SEQ ID NO: 100620 - DNA, 25 bp, Rattus norvegicus
acttgctgcaaagcttctagggaag

SEQ ID NO: 100621 - DNA, 25 bp, Rattus norvegicus
acttgctgcccacttggaaatcatt

SEQ ID NO: 100622 - DNA, 25 bp, Rattus norvegicus
acttgctgcccagttggaaatcatt

SEQ ID NO: 100623 - DNA, 25 bp, Rattus norvegicus
acttgctgcggcattgaaatcttga

SEQ ID NO: 100624 - DNA, 25 bp, Rattus norvegicus
acttgctgcggctttgaaatcttga

SEQ ID NO: 100625 - DNA, 25 bp, Rattus norvegicus
acttgctgctctctgctgaggagaa

SEQ ID NO: 100626 - DNA, 25 bp, Rattus norvegicus
acttgctgctctgtgctgaggagaa

SEQ ID NO: 100627 - DNA, 25 bp, Rattus norvegicus
acttgctggttacgtttgctactta

SEQ ID NO: 100628 - DNA, 25 bp, Rattus norvegicus
acttgctggttaggtttgctactta

SEQ ID NO: 100629 - DNA, 25 bp, Rattus norvegicus
acttgctgtcacaggcggagccaca

SEQ ID NO: 100630 - DNA, 25 bp, Rattus norvegicus
acttgctgtcactggcggagccaca

SEQ ID NO: 100631 - DNA, 25 bp, Rattus norvegicus
acttgctgtctgctgaaacgaggat

SEQ ID NO: 100632 - DNA, 25 bp, Rattus norvegicus
acttgctgtctggtgaaacgaggat

SEQ ID NO: 100633 - DNA, 25 bp, Rattus norvegicus
acttgctgtgaaccatgtgtgatga

SEQ ID NO: 100634 - DNA, 25 bp, Rattus norvegicus
acttgctgtgaagcatgtgtgatga

SEQ ID NO: 100635 - DNA, 25 bp, Rattus norvegicus
acttgctgttctaggagagtgcctt

SEQ ID NO: 100636 - DNA, 25 bp, Rattus norvegicus
acttgctgttcttggagagtgcctt

SEQ ID NO: 100637 - DNA, 25 bp, Rattus norvegicus
acttgctgttgtccattgctggcta

SEQ ID NO: 100638 - DNA, 25 bp, Rattus norvegicus
acttgctgttgtgcattgctggcta

SEQ ID NO: 100639 - DNA, 25 bp, Rattus norvegicus
acttgcttacatagctaaacggttc

SEQ ID NO: 100640 - DNA, 25 bp, Rattus norvegicus
acttgcttacattgctaaacggttc

SEQ ID NO: 100641 - DNA, 25 bp, Rattus norvegicus
acttgcttaggtaccccatcatggg

SEQ ID NO: 100642 - DNA, 25 bp, Rattus norvegicus
acttgcttaggttccccatcatggg

SEQ ID NO: 100643 - DNA, 25 bp, Rattus norvegicus
acttgcttagtccattgtgtattca

SEQ ID NO: 100644 - DNA, 25 bp, Rattus norvegicus
acttgcttagtcgattgtgtattca

SEQ ID NO: 100645 - DNA, 25 bp, Rattus norvegicus
acttgcttcctactaagtgcacgta

SEQ ID NO: 100646 - DNA, 25 bp, Rattus norvegicus
acttgcttcctagtaagtgcacgta

SEQ ID NO: 100647 - DNA, 25 bp, Rattus norvegicus
acttgcttcctgcagtgggtttggc

SEQ ID NO: 100648 - DNA, 25 bp, Rattus norvegicus
acttgcttcctggagtgggtttggc

SEQ ID NO: 100649 - DNA, 25 bp, Rattus norvegicus
acttgcttgagtatgacaatttgtt

SEQ ID NO: 100650 - DNA, 25 bp, Rattus norvegicus
acttgcttgagtttgacaatttgtt

SEQ ID NO: 100651 - DNA, 25 bp, Rattus norvegicus
acttgcttggctaccagggtccggg

SEQ ID NO: 100652 - DNA, 25 bp, Rattus norvegicus
acttgcttggcttccagggtccggg

SEQ ID NO: 100653 - DNA, 25 bp, Rattus norvegicus
acttgctttacaacatccatggacc

SEQ ID NO: 100654 - DNA, 25 bp, Rattus norvegicus
acttgctttacatcatccatggacc

SEQ ID NO: 100655 - DNA, 25 bp, Rattus norvegicus
acttgctttgtgatgtcactgctgt

SEQ ID NO: 100656 - DNA, 25 bp, Rattus norvegicus
acttgctttgtgttgtcactgctgt

SEQ ID NO: 100657 - DNA, 25 bp, Rattus norvegicus
acttgcttttcactgtcctaatgcc

SEQ ID NO: 100658 - DNA, 25 bp, Rattus norvegicus
acttgcttttcagtgtcctaatgcc

SEQ ID NO: 100659 - DNA, 25 bp, Rattus norvegicus
acttggaaaatgatgctgggctctt

SEQ ID NO: 100660 - DNA, 25 bp, Rattus norvegicus
acttggaaaatgttgctgggctctt

SEQ ID NO: 100661 - DNA, 25 bp, Rattus norvegicus
acttggaaattgagccactggccca

SEQ ID NO: 100662 - DNA, 25 bp, Rattus norvegicus
acttggaaattgtgccactggccca

SEQ ID NO: 100663 - DNA, 25 bp, Rattus norvegicus
acttggaaggtcactagcaggttct

SEQ ID NO: 100664 - DNA, 25 bp, Rattus norvegicus
acttggaaggtctctagcaggttct

SEQ ID NO: 100665 - DNA, 25 bp, Rattus norvegicus
acttggacaactcgctacgctactt

SEQ ID NO: 100666 - DNA, 25 bp, Rattus norvegicus
acttggacaactggctacgctactt

SEQ ID NO: 100667 - DNA, 25 bp, Rattus norvegicus
acttggacatccctgcgtcatggac

SEQ ID NO: 100668 - DNA, 25 bp, Rattus norvegicus
acttggacatccgtgcgtcatggac

SEQ ID NO: 100669 - DNA, 25 bp, Rattus norvegicus
acttggacccctctagaatctgaat

SEQ ID NO: 100670 - DNA, 25 bp, Rattus norvegicus
acttggacccctgtagaatctgaat

SEQ ID NO: 100671 - DNA, 25 bp, Rattus norvegicus
acttggacctccacggtgtgcttag

SEQ ID NO: 100672 - DNA, 25 bp, Rattus norvegicus
acttggacctcctcggtgtgcttag

SEQ ID NO: 100673 - DNA, 25 bp, Rattus norvegicus
acttggactagaaccctctggaaaa

SEQ ID NO: 100674 - DNA, 25 bp, Rattus norvegicus
acttggactagatccctctggaaaa

SEQ ID NO: 100675 - DNA, 25 bp, Rattus norvegicus
acttggactcagctcattgtgttaa

SEQ ID NO: 100676 - DNA, 25 bp, Rattus norvegicus
acttggactcaggtcattgtgttaa

SEQ ID NO: 100677 - DNA, 25 bp, Rattus norvegicus
acttggactgatattctttcctcct

SEQ ID NO: 100678 - DNA, 25 bp, Rattus norvegicus
acttggactgattttctttcctcct

SEQ ID NO: 100679 - DNA, 25 bp, Rattus norvegicus
acttggactttgctttgcaaaacaa

SEQ ID NO: 100680 - DNA, 25 bp, Rattus norvegicus
acttggactttggtttgcaaaacaa

SEQ ID NO: 100681 - DNA, 25 bp, Rattus norvegicus
acttggagaaggagataacccttga

SEQ ID NO: 100682 - DNA, 25 bp, Rattus norvegicus
acttggagaaggtgataacccttga

SEQ ID NO: 100683 - DNA, 25 bp, Rattus norvegicus
acttggagaggcctggacttcttgt

SEQ ID NO: 100684 - DNA, 25 bp, Rattus norvegicus
acttggagaggcgtggacttcttgt

SEQ ID NO: 100685 - DNA, 25 bp, Rattus norvegicus
acttggagagtcaggaagccgctaa

SEQ ID NO: 100686 - DNA, 25 bp, Rattus norvegicus
acttggagagtctggaagccgctaa

SEQ ID NO: 100687 - DNA, 25 bp, Rattus norvegicus
acttggagcaacatcctgatatcag

SEQ ID NO: 100688 - DNA, 25 bp, Rattus norvegicus
acttggagcaacttcctgatatcag

SEQ ID NO: 100689 - DNA, 25 bp, Rattus norvegicus
acttggagcaggcagcagacacttg

SEQ ID NO: 100690 - DNA, 25 bp, Rattus norvegicus
acttggagcagggagcagacacttg

SEQ ID NO: 100691 - DNA, 25 bp, Rattus norvegicus
acttggagcccaactcagtgttgaa

SEQ ID NO: 100692 - DNA, 25 bp, Rattus norvegicus
acttggagcccatctcagtgttgaa

SEQ ID NO: 100693 - DNA, 25 bp, Rattus norvegicus
acttggataccacccagcagatgat

SEQ ID NO: 100694 - DNA, 25 bp, Rattus norvegicus
acttggataccagccagcagatgat

SEQ ID NO: 100695 - DNA, 25 bp, Rattus norvegicus
acttggatacttcagcaggcaccga

SEQ ID NO: 100696 - DNA, 25 bp, Rattus norvegicus
acttggatacttgagcaggcaccga

SEQ ID NO: 100697 - DNA, 25 bp, Rattus norvegicus
acttggatcccacgtttatcttata

SEQ ID NO: 100698 - DNA, 25 bp, Rattus norvegicus
acttggatcccaggtttatcttata

SEQ ID NO: 100699 - DNA, 25 bp, Rattus norvegicus
acttggatcctcactatgactgtgt

SEQ ID NO: 100700 - DNA, 25 bp, Rattus norvegicus
acttggatcctctctatgactgtgt

SEQ ID NO: 100701 - DNA, 25 bp, Rattus norvegicus
acttggatgaaaccagtccctgtca

SEQ ID NO: 100702 - DNA, 25 bp, Rattus norvegicus
acttggatgaaagcagtccctgtca

SEQ ID NO: 100703 - DNA, 25 bp, Rattus norvegicus
acttggatgggcctgaagctcttca

SEQ ID NO: 100704 - DNA, 25 bp, Rattus norvegicus
acttggatgggcgtgaagctcttca

SEQ ID NO: 100705 - DNA, 25 bp, Rattus norvegicus
acttggatgtttcttctcgttggaa

SEQ ID NO: 100706 - DNA, 25 bp, Rattus norvegicus
acttggatgtttgttctcgttggaa

SEQ ID NO: 100707 - DNA, 25 bp, Rattus norvegicus
acttggatttttaagcattctcaat

SEQ ID NO: 100708 - DNA, 25 bp, Rattus norvegicus
acttggattttttagcattctcaat

SEQ ID NO: 100709 - DNA, 25 bp, Rattus norvegicus
acttggcaagcccaatggacagcac

SEQ ID NO: 100710 - DNA, 25 bp, Rattus norvegicus
acttggcaagccgaatggacagcac

SEQ ID NO: 100711 - DNA, 25 bp, Rattus norvegicus
acttggcacaacactactactttat

SEQ ID NO: 100712 - DNA, 25 bp, Rattus norvegicus
acttggcacaactctactactttat

SEQ ID NO: 100713 - DNA, 25 bp, Rattus norvegicus
acttggcaccttatgtcacttagag

SEQ ID NO: 100714 - DNA, 25 bp, Rattus norvegicus
acttggcaccttttgtcacttagag

SEQ ID NO: 100715 - DNA, 25 bp, Rattus norvegicus
acttggcacgttctatcattgtcat

SEQ ID NO: 100716 - DNA, 25 bp, Rattus norvegicus
acttggcacgttgtatcattgtcat

SEQ ID NO: 100717 - DNA, 25 bp, Rattus norvegicus
acttggcagggaaccaacaactcca

SEQ ID NO: 100718 - DNA, 25 bp, Rattus norvegicus
acttggcagggatccaacaactcca

SEQ ID NO: 100719 - DNA, 25 bp, Rattus norvegicus
acttggcatctgatgcacttgtgta

SEQ ID NO: 100720 - DNA, 25 bp, Rattus norvegicus
acttggcatctgttgcacttgtgta

SEQ ID NO: 100721 - DNA, 25 bp, Rattus norvegicus
acttggcatgcacacatcttttggg

SEQ ID NO: 100722 - DNA, 25 bp, Rattus norvegicus
acttggcatgcagacatcttttggg

SEQ ID NO: 100723 - DNA, 25 bp, Rattus norvegicus
acttggccaaggagtgcgagctgct

SEQ ID NO: 100724 - DNA, 25 bp, Rattus norvegicus
acttggccaaggtgtgcgagctgct

SEQ ID NO: 100725 - DNA, 25 bp, Rattus norvegicus
acttggccaccacagagaacttgct

SEQ ID NO: 100726 - DNA, 25 bp, Rattus norvegicus
acttggccaccagagagaacttgct

SEQ ID NO: 100727 - DNA, 25 bp, Rattus norvegicus
acttggccaggcaacggaacacagg

SEQ ID NO: 100728 - DNA, 25 bp, Rattus norvegicus
acttggccaggcacagagagcagag

SEQ ID NO: 100729 - DNA, 25 bp, Rattus norvegicus
acttggccaggctacggaacacagg

SEQ ID NO: 100730 - DNA, 25 bp, Rattus norvegicus
acttggccaggctcagagagcagag

SEQ ID NO: 100731 - DNA, 25 bp, Rattus norvegicus
acttggcccaataatctcagtcact

SEQ ID NO: 100732 - DNA, 25 bp, Rattus norvegicus
acttggcccaattatctcagtcact

SEQ ID NO: 100733 - DNA, 25 bp, Rattus norvegicus
acttggcccctgaggattttcagca

SEQ ID NO: 100734 - DNA, 25 bp, Rattus norvegicus
acttggcccctgtggattttcagca

SEQ ID NO: 100735 - DNA, 25 bp, Rattus norvegicus
acttggccctcgatgtgtggaattt

SEQ ID NO: 100736 - DNA, 25 bp, Rattus norvegicus
acttggccctcgttgtgtggaattt

SEQ ID NO: 100737 - DNA, 25 bp, Rattus norvegicus
acttggccctgaaggcctgctaaga

SEQ ID NO: 100738 - DNA, 25 bp, Rattus norvegicus
acttggccctgatggcctgctaaga

SEQ ID NO: 100739 - DNA, 25 bp, Rattus norvegicus
acttggccctggaggactacttgac

SEQ ID NO: 100740 - DNA, 25 bp, Rattus norvegicus
acttggccctggtggactacttgac

SEQ ID NO: 100741 - DNA, 25 bp, Rattus norvegicus
acttggccctttaaaaagctgcatt

SEQ ID NO: 100742 - DNA, 25 bp, Rattus norvegicus
acttggcccttttaaaagctgcatt

SEQ ID NO: 100743 - DNA, 25 bp, Rattus norvegicus
acttggccgcagaagaagcccgaga

SEQ ID NO: 100744 - DNA, 25 bp, Rattus norvegicus
acttggccgcagtagaagcccgaga

SEQ ID NO: 100745 - DNA, 25 bp, Rattus norvegicus
acttggcctccaactttgctgaggg

SEQ ID NO: 100746 - DNA, 25 bp, Rattus norvegicus
acttggcctccatctttgctgaggg

SEQ ID NO: 100747 - DNA, 25 bp, Rattus norvegicus
acttggcctgctcctgagaagctag

SEQ ID NO: 100748 - DNA, 25 bp, Rattus norvegicus
acttggcctgctgctgagaagctag

SEQ ID NO: 100749 - DNA, 25 bp, Rattus norvegicus
acttggcgctcgagggccgcatcca

SEQ ID NO: 100750 - DNA, 25 bp, Rattus norvegicus
acttggcgctcgtgggccgcatcca

SEQ ID NO: 100751 - DNA, 25 bp, Rattus norvegicus
acttggcgtctgatccagtgaaatc

SEQ ID NO: 100752 - DNA, 25 bp, Rattus norvegicus
acttggcgtctgttccagtgaaatc

SEQ ID NO: 100753 - DNA, 25 bp, Rattus norvegicus
acttggcgtgatccgggcttaaatc

SEQ ID NO: 100754 - DNA, 25 bp, Rattus norvegicus
acttggcgtgatgcgggcttaaatc

SEQ ID NO: 100755 - DNA, 25 bp, Rattus norvegicus
acttggctaaggctgcactgctgaa

SEQ ID NO: 100756 - DNA, 25 bp, Rattus norvegicus
acttggctaagggtgcactgctgaa

SEQ ID NO: 100757 - DNA, 25 bp, Rattus norvegicus
acttggctatttacagccttctcaa

SEQ ID NO: 100758 - DNA, 25 bp, Rattus norvegicus
acttggctattttcagccttctcaa

SEQ ID NO: 100759 - DNA, 25 bp, Rattus norvegicus
acttggctcaggataatcaggacat

SEQ ID NO: 100760 - DNA, 25 bp, Rattus norvegicus
acttggctcaggttaatcaggacat

SEQ ID NO: 100761 - DNA, 25 bp, Rattus norvegicus
acttggctcattctttcatctgcga

SEQ ID NO: 100762 - DNA, 25 bp, Rattus norvegicus
acttggctcattgtttcatctgcga

SEQ ID NO: 100763 - DNA, 25 bp, Rattus norvegicus
acttggctccccagtgcatttggaa

SEQ ID NO: 100764 - DNA, 25 bp, Rattus norvegicus
acttggctcccctgtgcatttggaa

SEQ ID NO: 100765 - DNA, 25 bp, Rattus norvegicus
acttggctctctcccagtacagaat

SEQ ID NO: 100766 - DNA, 25 bp, Rattus norvegicus
acttggctctctgccagtacagaat

SEQ ID NO: 100767 - DNA, 25 bp, Rattus norvegicus
acttggctgtacatgtaatgggcac

SEQ ID NO: 100768 - DNA, 25 bp, Rattus norvegicus
acttggctgtacttgtaatgggcac

SEQ ID NO: 100769 - DNA, 25 bp, Rattus norvegicus
acttggctgtgtatatctgttcctt

SEQ ID NO: 100770 - DNA, 25 bp, Rattus norvegicus
acttggctgtgtttatctgttcctt

SEQ ID NO: 100771 - DNA, 25 bp, Rattus norvegicus
acttggcttaccacacacttgagtc

SEQ ID NO: 100772 - DNA, 25 bp, Rattus norvegicus
acttggcttacctcacacttgagtc

SEQ ID NO: 100773 - DNA, 25 bp, Rattus norvegicus
acttggcttctgaacttactaatga

SEQ ID NO: 100774 - DNA, 25 bp, Rattus norvegicus
acttggcttctgtacttactaatga

SEQ ID NO: 100775 - DNA, 25 bp, Rattus norvegicus
acttggcttgccatgatgaaggtaa

SEQ ID NO: 100776 - DNA, 25 bp, Rattus norvegicus
acttggcttgccttgatgaaggtaa

SEQ ID NO: 100777 - DNA, 25 bp, Rattus norvegicus
acttgggaagacaagagagttacta

SEQ ID NO: 100778 - DNA, 25 bp, Rattus norvegicus
acttgggaagactagagagttacta

SEQ ID NO: 100779 - DNA, 25 bp, Rattus norvegicus
acttgggaattcacaccctgttgtc

SEQ ID NO: 100780 - DNA, 25 bp, Rattus norvegicus
acttgggaattctcaccctgttgtc

SEQ ID NO: 100781 - DNA, 25 bp, Rattus norvegicus
acttgggacacgatatggcctgtca

SEQ ID NO: 100782 - DNA, 25 bp, Rattus norvegicus
acttgggacacgttatggcctgtca

SEQ ID NO: 100783 - DNA, 25 bp, Rattus norvegicus
acttgggactgtaatctacctctaa

SEQ ID NO: 100784 - DNA, 25 bp, Rattus norvegicus
acttgggactgttatctacctctaa

SEQ ID NO: 100785 - DNA, 25 bp, Rattus norvegicus
acttgggagcgcaatgggcctgccc

SEQ ID NO: 100786 - DNA, 25 bp, Rattus norvegicus
acttgggagcgctatgggcctgccc

SEQ ID NO: 100787 - DNA, 25 bp, Rattus norvegicus
acttgggaggacctgttgctcttca

SEQ ID NO: 100788 - DNA, 25 bp, Rattus norvegicus
acttgggaggacgtgttgctcttca

SEQ ID NO: 100789 - DNA, 25 bp, Rattus norvegicus
acttgggaggtgaccacatcttctt

SEQ ID NO: 100790 - DNA, 25 bp, Rattus norvegicus
acttgggaggtgtccacatcttctt

SEQ ID NO: 100791 - DNA, 25 bp, Rattus norvegicus
acttgggatgccagcccgagaaaga

SEQ ID NO: 100792 - DNA, 25 bp, Rattus norvegicus
acttgggatgcctgcccgagaaaga

SEQ ID NO: 100793 - DNA, 25 bp, Rattus norvegicus
acttgggattcccaggtatgacctt

SEQ ID NO: 100794 - DNA, 25 bp, Rattus norvegicus
acttgggattccgaggtatgacctt

SEQ ID NO: 100795 - DNA, 25 bp, Rattus norvegicus
acttgggcctggaaatggcttacca

SEQ ID NO: 100796 - DNA, 25 bp, Rattus norvegicus
acttgggcctggtaatggcttacca

SEQ ID NO: 100797 - DNA, 25 bp, Rattus norvegicus
acttgggcctgtacacatccgatta

SEQ ID NO: 100798 - DNA, 25 bp, Rattus norvegicus
acttgggcctgttcacatccgatta

SEQ ID NO: 100799 - DNA, 25 bp, Rattus norvegicus
acttgggctcataagcagcagttat

SEQ ID NO: 100800 - DNA, 25 bp, Rattus norvegicus
acttgggctcattagcagcagttat

SEQ ID NO: 100801 - DNA, 25 bp, Rattus norvegicus
acttgggctcttcttccagattaga

SEQ ID NO: 100802 - DNA, 25 bp, Rattus norvegicus
acttgggctcttgttccagattaga

SEQ ID NO: 100803 - DNA, 25 bp, Rattus norvegicus
acttgggtcagtcggctctcatgtc

SEQ ID NO: 100804 - DNA, 25 bp, Rattus norvegicus
acttgggtcagtcttctctcagtaa

SEQ ID NO: 100805 - DNA, 25 bp, Rattus norvegicus
acttgggtcagtgggctctcatgtc

SEQ ID NO: 100806 - DNA, 25 bp, Rattus norvegicus
acttgggtcagtgttctctcagtaa

SEQ ID NO: 100807 - DNA, 25 bp, Rattus norvegicus
acttgggtcataccaggtacctcta

SEQ ID NO: 100808 - DNA, 25 bp, Rattus norvegicus
acttgggtcatagcaggtacctcta

SEQ ID NO: 100809 - DNA, 25 bp, Rattus norvegicus
acttgggtctgtcgacactggtgca

SEQ ID NO: 100810 - DNA, 25 bp, Rattus norvegicus
acttgggtctgtggacactggtgca

SEQ ID NO: 100811 - DNA, 25 bp, Rattus norvegicus
acttgggtgactattttctactgtg

SEQ ID NO: 100812 - DNA, 25 bp, Rattus norvegicus
acttgggtgacttttttctactgtg

SEQ ID NO: 100813 - DNA, 25 bp, Rattus norvegicus
acttgggtgatcacatcatggctct

SEQ ID NO: 100814 - DNA, 25 bp, Rattus norvegicus
acttgggtgatctcatcatggctct

SEQ ID NO: 100815 - DNA, 25 bp, Rattus norvegicus
acttgggtgcctaaagctggaggac

SEQ ID NO: 100816 - DNA, 25 bp, Rattus norvegicus
acttgggtgccttaagctggaggac

SEQ ID NO: 100817 - DNA, 25 bp, Rattus norvegicus
acttgggttggaagaccagaggatc

SEQ ID NO: 100818 - DNA, 25 bp, Rattus norvegicus
acttgggttggatgaccagaggatc

SEQ ID NO: 100819 - DNA, 25 bp, Rattus norvegicus
acttggtactggctgtttcttgact

SEQ ID NO: 100820 - DNA, 25 bp, Rattus norvegicus
acttggtactgggtgtttcttgact

SEQ ID NO: 100821 - DNA, 25 bp, Rattus norvegicus
acttggtactttacagtggtctgtc

SEQ ID NO: 100822 - DNA, 25 bp, Rattus norvegicus
acttggtacttttcagtggtctgtc

SEQ ID NO: 100823 - DNA, 25 bp, Rattus norvegicus
acttggtagacacaggctggcagat

SEQ ID NO: 100824 - DNA, 25 bp, Rattus norvegicus
acttggtagacagaggctggcagat

SEQ ID NO: 100825 - DNA, 25 bp, Rattus norvegicus
acttggtcattcatggttggtgccc

SEQ ID NO: 100826 - DNA, 25 bp, Rattus norvegicus
acttggtcattcttggttggtgccc

SEQ ID NO: 100827 - DNA, 25 bp, Rattus norvegicus
acttggtcccaacagcttatcagac

SEQ ID NO: 100828 - DNA, 25 bp, Rattus norvegicus
acttggtcccaagagcttatcagac

SEQ ID NO: 100829 - DNA, 25 bp, Rattus norvegicus
acttggtccctgattctctcagcaa

SEQ ID NO: 100830 - DNA, 25 bp, Rattus norvegicus
acttggtccctgtttctctcagcaa

SEQ ID NO: 100831 - DNA, 25 bp, Rattus norvegicus
acttggtcgctgacagcacagcttc

SEQ ID NO: 100832 - DNA, 25 bp, Rattus norvegicus
acttggtcgctgtcagcacagcttc

SEQ ID NO: 100833 - DNA, 25 bp, Rattus norvegicus
acttggtctccactgatggttctgt

SEQ ID NO: 100834 - DNA, 25 bp, Rattus norvegicus
acttggtctccagtgatggttctgt

SEQ ID NO: 100835 - DNA, 25 bp, Rattus norvegicus
acttggtctctcagtgcatatttta

SEQ ID NO: 100836 - DNA, 25 bp, Rattus norvegicus
acttggtctctctgtgcatatttta

SEQ ID NO: 100837 - DNA, 25 bp, Rattus norvegicus
acttggtgacttccttcatacgtga

SEQ ID NO: 100838 - DNA, 25 bp, Rattus norvegicus
acttggtgacttgcttcatacgtga

SEQ ID NO: 100839 - DNA, 25 bp, Rattus norvegicus
acttggtgagtcagaggccttggtt

SEQ ID NO: 100840 - DNA, 25 bp, Rattus norvegicus
acttggtgagtctgaggccttggtt

SEQ ID NO: 100841 - DNA, 25 bp, Rattus norvegicus
acttggtgcagtactcctgctttaa

SEQ ID NO: 100842 - DNA, 25 bp, Rattus norvegicus
acttggtgcagttctcctgctttaa

SEQ ID NO: 100843 - DNA, 25 bp, Rattus norvegicus
acttggtgccatatggagtttacta

SEQ ID NO: 100844 - DNA, 25 bp, Rattus norvegicus
acttggtgccatttggagtttacta

SEQ ID NO: 100845 - DNA, 25 bp, Rattus norvegicus
acttggtgcccacagacacttgtaa

SEQ ID NO: 100846 - DNA, 25 bp, Rattus norvegicus
acttggtgcccagagacacttgtaa

SEQ ID NO: 100847 - DNA, 25 bp, Rattus norvegicus
acttggtgctgacggctgtgactta

SEQ ID NO: 100848 - DNA, 25 bp, Rattus norvegicus
acttggtgctgagggctgtgactta

SEQ ID NO: 100849 - DNA, 25 bp, Rattus norvegicus
acttggtggacgattcatgggctca

SEQ ID NO: 100850 - DNA, 25 bp, Rattus norvegicus
acttggtggacgtttcatgggctca

SEQ ID NO: 100851 - DNA, 25 bp, Rattus norvegicus
acttggtggctcaggtttctccagc

SEQ ID NO: 100852 - DNA, 25 bp, Rattus norvegicus
acttggtggctctggtttctccagc

SEQ ID NO: 100853 - DNA, 25 bp, Rattus norvegicus
acttggtgggtcaattggaagcctt

SEQ ID NO: 100854 - DNA, 25 bp, Rattus norvegicus
acttggtgggtctattggaagcctt

SEQ ID NO: 100855 - DNA, 25 bp, Rattus norvegicus
acttggtggtcactagggtgccttt

SEQ ID NO: 100856 - DNA, 25 bp, Rattus norvegicus
acttggtggtcagtagggtgccttt

SEQ ID NO: 100857 - DNA, 25 bp, Rattus norvegicus
acttggtgtcaaaggatctaactgg

SEQ ID NO: 100858 - DNA, 25 bp, Rattus norvegicus
acttggtgtcaatggatctaactgg

SEQ ID NO: 100859 - DNA, 25 bp, Rattus norvegicus
acttggtgtctgaaaatagaagccc

SEQ ID NO: 100860 - DNA, 25 bp, Rattus norvegicus
acttggtgtctgtaaatagaagccc

SEQ ID NO: 100861 - DNA, 25 bp, Rattus norvegicus
acttggtgtgagctcttgggaaact

SEQ ID NO: 100862 - DNA, 25 bp, Rattus norvegicus
acttggtgtgaggtcttgggaaact

SEQ ID NO: 100863 - DNA, 25 bp, Rattus norvegicus
acttggttactgatcgcatccgcag

SEQ ID NO: 100864 - DNA, 25 bp, Rattus norvegicus
acttggttactgttcgcatccgcag

SEQ ID NO: 100865 - DNA, 25 bp, Rattus norvegicus
acttggttcctactttggtggctgt

SEQ ID NO: 100866 - DNA, 25 bp, Rattus norvegicus
acttggttcctagtttggtggctgt

SEQ ID NO: 100867 - DNA, 25 bp, Rattus norvegicus
acttggttgatgatgccaccagcct

SEQ ID NO: 100868 - DNA, 25 bp, Rattus norvegicus
acttggttgatgttgccaccagcct

SEQ ID NO: 100869 - DNA, 25 bp, Rattus norvegicus
acttggttttacagtctgggctggc

SEQ ID NO: 100870 - DNA, 25 bp, Rattus norvegicus
acttggttttactgtctgggctggc

SEQ ID NO: 100871 - DNA, 25 bp, Rattus norvegicus
acttggttttcaagtctattcctac

SEQ ID NO: 100872 - DNA, 25 bp, Rattus norvegicus
acttggttttcatgtctattcctac

SEQ ID NO: 100873 - DNA, 25 bp, Rattus norvegicus
acttgtaaaatgaagtttgcagccc

SEQ ID NO: 100874 - DNA, 25 bp, Rattus norvegicus
acttgtaaaatgtagtttgcagccc

SEQ ID NO: 100875 - DNA, 25 bp, Rattus norvegicus
acttgtaaggatctgtctgcctcta

SEQ ID NO: 100876 - DNA, 25 bp, Rattus norvegicus
acttgtaaggatgtgtctgcctcta

SEQ ID NO: 100877 - DNA, 25 bp, Rattus norvegicus
acttgtaaggctcgtggctcatctc

SEQ ID NO: 100878 - DNA, 25 bp, Rattus norvegicus
acttgtaaggctggtggctcatctc

SEQ ID NO: 100879 - DNA, 25 bp, Rattus norvegicus
acttgtaagtaacctctccatccag

SEQ ID NO: 100880 - DNA, 25 bp, Rattus norvegicus
acttgtaagtaagctctccatccag

SEQ ID NO: 100881 - DNA, 25 bp, Rattus norvegicus
acttgtaatgtcacgcagctggagt

SEQ ID NO: 100882 - DNA, 25 bp, Rattus norvegicus
acttgtaatgtctcgcagctggagt

SEQ ID NO: 100883 - DNA, 25 bp, Rattus norvegicus
acttgtaatgtgcaatacttatgta

SEQ ID NO: 100884 - DNA, 25 bp, Rattus norvegicus
acttgtaatgtggaatacttatgta

SEQ ID NO: 100885 - DNA, 25 bp, Rattus norvegicus
acttgtaattctattcttggtcatg

SEQ ID NO: 100886 - DNA, 25 bp, Rattus norvegicus
acttgtaattcttttcttggtcatg

SEQ ID NO: 100887 - DNA, 25 bp, Rattus norvegicus
acttgtacacgaaaaatactggcat

SEQ ID NO: 100888 - DNA, 25 bp, Rattus norvegicus
acttgtacacgataaatactggcat

SEQ ID NO: 100889 - DNA, 25 bp, Rattus norvegicus
acttgtacactgctttgatgccacc

SEQ ID NO: 100890 - DNA, 25 bp, Rattus norvegicus
acttgtacactggtttgatgccacc

SEQ ID NO: 100891 - DNA, 25 bp, Rattus norvegicus
acttgtacatgtatgtgctttggaa

SEQ ID NO: 100892 - DNA, 25 bp, Rattus norvegicus
acttgtacatgtttgtgctttggaa

SEQ ID NO: 100893 - DNA, 25 bp, Rattus norvegicus
acttgtacattgcttgactccttgg

SEQ ID NO: 100894 - DNA, 25 bp, Rattus norvegicus
acttgtacattggttgactccttgg

SEQ ID NO: 100895 - DNA, 25 bp, Rattus norvegicus
acttgtaccagtcccacacttgaag

SEQ ID NO: 100896 - DNA, 25 bp, Rattus norvegicus
acttgtaccagtgccacacttgaag

SEQ ID NO: 100897 - DNA, 25 bp, Rattus norvegicus
acttgtacgcttagtctactttgca

SEQ ID NO: 100898 - DNA, 25 bp, Rattus norvegicus
acttgtacgctttgtctactttgca

SEQ ID NO: 100899 - DNA, 25 bp, Rattus norvegicus
acttgtactggaaacttgggcctta

SEQ ID NO: 100900 - DNA, 25 bp, Rattus norvegicus
acttgtactggatacttgggcctta

SEQ ID NO: 100901 - DNA, 25 bp, Rattus norvegicus
acttgtactgtaattcctgaacgtt

SEQ ID NO: 100902 - DNA, 25 bp, Rattus norvegicus
acttgtactgtatttcctgaacgtt

SEQ ID NO: 100903 - DNA, 25 bp, Rattus norvegicus
acttgtagctttcgctgtgccggaa

SEQ ID NO: 100904 - DNA, 25 bp, Rattus norvegicus
acttgtagctttggctgtgccggaa

SEQ ID NO: 100905 - DNA, 25 bp, Rattus norvegicus
acttgtaggcttagttcttcggaga

SEQ ID NO: 100906 - DNA, 25 bp, Rattus norvegicus
acttgtaggctttgttcttcggaga

SEQ ID NO: 100907 - DNA, 25 bp, Rattus norvegicus
acttgtagtaggcttccactgtgga

SEQ ID NO: 100908 - DNA, 25 bp, Rattus norvegicus
acttgtagtagggttccactgtgga

SEQ ID NO: 100909 - DNA, 25 bp, Rattus norvegicus
acttgtagtcctctcttagtatcac

SEQ ID NO: 100910 - DNA, 25 bp, Rattus norvegicus
acttgtagtcctgtcttagtatcac

SEQ ID NO: 100911 - DNA, 25 bp, Rattus norvegicus
acttgtatcaaacgctcccagtgtc

SEQ ID NO: 100912 - DNA, 25 bp, Rattus norvegicus
acttgtatcaaaggctcccagtgtc

SEQ ID NO: 100913 - DNA, 25 bp, Rattus norvegicus
acttgtatcctcaaactttctctgg

SEQ ID NO: 100914 - DNA, 25 bp, Rattus norvegicus
acttgtatcctctaactttctctgg

SEQ ID NO: 100915 - DNA, 25 bp, Rattus norvegicus
acttgtatggttactctcccgtgtg

SEQ ID NO: 100916 - DNA, 25 bp, Rattus norvegicus
acttgtatggtttctctcccgtgtg

SEQ ID NO: 100917 - DNA, 25 bp, Rattus norvegicus
acttgtatgtggagtgagctcttaa

SEQ ID NO: 100918 - DNA, 25 bp, Rattus norvegicus
acttgtatgtggtgtgagctcttaa

SEQ ID NO: 100919 - DNA, 25 bp, Rattus norvegicus
acttgtattcttactacctcctaga

SEQ ID NO: 100920 - DNA, 25 bp, Rattus norvegicus
acttgtattctttctacctcctaga

SEQ ID NO: 100921 - DNA, 25 bp, Rattus norvegicus
acttgtattgtaatctcacctgtca

SEQ ID NO: 100922 - DNA, 25 bp, Rattus norvegicus
acttgtattgtattctcacctgtca

SEQ ID NO: 100923 - DNA, 25 bp, Rattus norvegicus
acttgtcaaagcctagacccctatc

SEQ ID NO: 100924 - DNA, 25 bp, Rattus norvegicus
acttgtcaaagcgtagacccctatc

SEQ ID NO: 100925 - DNA, 25 bp, Rattus norvegicus
acttgtcaacatctcaggttagcgt

SEQ ID NO: 100926 - DNA, 25 bp, Rattus norvegicus
acttgtcaacatgtcaggttagcgt

SEQ ID NO: 100927 - DNA, 25 bp, Rattus norvegicus
acttgtcaacttaatttctcaccat

SEQ ID NO: 100928 - DNA, 25 bp, Rattus norvegicus
acttgtcaactttatttctcaccat

SEQ ID NO: 100929 - DNA, 25 bp, Rattus norvegicus
acttgtcacattagtcttctccagt

SEQ ID NO: 100930 - DNA, 25 bp, Rattus norvegicus
acttgtcacatttgtcttctccagt

SEQ ID NO: 100931 - DNA, 25 bp, Rattus norvegicus
acttgtcagaaactcgtgctttttg

SEQ ID NO: 100932 - DNA, 25 bp, Rattus norvegicus
acttgtcagaaagtcgtgctttttg

SEQ ID NO: 100933 - DNA, 25 bp, Rattus norvegicus
acttgtcagctgaccaaacatgtct

SEQ ID NO: 100934 - DNA, 25 bp, Rattus norvegicus
acttgtcagctgtccaaacatgtct

SEQ ID NO: 100935 - DNA, 25 bp, Rattus norvegicus
acttgtcagcttacttacttcttta

SEQ ID NO: 100936 - DNA, 25 bp, Rattus norvegicus
acttgtcagctttcttacttcttta

SEQ ID NO: 100937 - DNA, 25 bp, Rattus norvegicus
acttgtcaggacaccagccgaaaag

SEQ ID NO: 100938 - DNA, 25 bp, Rattus norvegicus
acttgtcaggactccagccgaaaag

SEQ ID NO: 100939 - DNA, 25 bp, Rattus norvegicus
acttgtcaggtgaactgctgctagg

SEQ ID NO: 100940 - DNA, 25 bp, Rattus norvegicus
acttgtcaggtgtactgctgctagg

SEQ ID NO: 100941 - DNA, 25 bp, Rattus norvegicus
acttgtcagtgtacaggtgtatttt

SEQ ID NO: 100942 - DNA, 25 bp, Rattus norvegicus
acttgtcagtgttcaggtgtatttt

SEQ ID NO: 100943 - DNA, 25 bp, Rattus norvegicus
acttgtcatggtcatccctgtgaga

SEQ ID NO: 100944 - DNA, 25 bp, Rattus norvegicus
acttgtcatggtgatccctgtgaga

SEQ ID NO: 100945 - DNA, 25 bp, Rattus norvegicus
acttgtcatgttcaatgtggctgca

SEQ ID NO: 100946 - DNA, 25 bp, Rattus norvegicus
acttgtcatgttgaatgtggctgca

SEQ ID NO: 100947 - DNA, 25 bp, Rattus norvegicus
acttgtcattctctgtcctagtgtc

SEQ ID NO: 100948 - DNA, 25 bp, Rattus norvegicus
acttgtcattctgtgtcctagtgtc

SEQ ID NO: 100949 - DNA, 25 bp, Rattus norvegicus
acttgtccaaagagtcttacctgtt

SEQ ID NO: 100950 - DNA, 25 bp, Rattus norvegicus
acttgtccaaagtgtcttacctgtt

SEQ ID NO: 100951 - DNA, 25 bp, Rattus norvegicus
acttgtccacgcctatacttaaata

SEQ ID NO: 100952 - DNA, 25 bp, Rattus norvegicus
acttgtccacgcgtatacttaaata

SEQ ID NO: 100953 - DNA, 25 bp, Rattus norvegicus
acttgtccattgcttggtttagtta

SEQ ID NO: 100954 - DNA, 25 bp, Rattus norvegicus
acttgtccattggttggtttagtta

SEQ ID NO: 100955 - DNA, 25 bp, Rattus norvegicus
acttgtcccctgctctgttagtgag

SEQ ID NO: 100956 - DNA, 25 bp, Rattus norvegicus
acttgtcccctggtctgttagtgag

SEQ ID NO: 100957 - DNA, 25 bp, Rattus norvegicus
acttgtcccggactgaacagcactg

SEQ ID NO: 100958 - DNA, 25 bp, Rattus norvegicus
acttgtcccggagtgaacagcactg

SEQ ID NO: 100959 - DNA, 25 bp, Rattus norvegicus
acttgtccctgcctgccaggtttgg

SEQ ID NO: 100960 - DNA, 25 bp, Rattus norvegicus
acttgtccctgcgtgccaggtttgg

SEQ ID NO: 100961 - DNA, 25 bp, Rattus norvegicus
acttgtccctgtcacttcattgaag

SEQ ID NO: 100962 - DNA, 25 bp, Rattus norvegicus
acttgtccctgtgacttcattgaag

SEQ ID NO: 100963 - DNA, 25 bp, Rattus norvegicus
acttgtcctgacagagttctctgtg

SEQ ID NO: 100964 - DNA, 25 bp, Rattus norvegicus
acttgtcctgactgagttctctgtg

SEQ ID NO: 100965 - DNA, 25 bp, Rattus norvegicus
acttgtcctgagagctgtcgccgcg

SEQ ID NO: 100966 - DNA, 25 bp, Rattus norvegicus
acttgtcctgagtgctgtcgccgcg

SEQ ID NO: 100967 - DNA, 25 bp, Rattus norvegicus
acttgtccttaaagttgcagctcca

SEQ ID NO: 100968 - DNA, 25 bp, Rattus norvegicus
acttgtccttaatgttgcagctcca

SEQ ID NO: 100969 - DNA, 25 bp, Rattus norvegicus
acttgtcgtatgcgactttcaagta

SEQ ID NO: 100970 - DNA, 25 bp, Rattus norvegicus
acttgtcgtatgggactttcaagta

SEQ ID NO: 100971 - DNA, 25 bp, Rattus norvegicus
acttgtctacttaggcagtgtgtga

SEQ ID NO: 100972 - DNA, 25 bp, Rattus norvegicus
acttgtctactttggcagtgtgtga

SEQ ID NO: 100973 - DNA, 25 bp, Rattus norvegicus
acttgtctagctaagctctcggcat

SEQ ID NO: 100974 - DNA, 25 bp, Rattus norvegicus
acttgtctagcttagctctcggcat

SEQ ID NO: 100975 - DNA, 25 bp, Rattus norvegicus
acttgtctagtgaggctgacccttg

SEQ ID NO: 100976 - DNA, 25 bp, Rattus norvegicus
acttgtctagtgtggctgacccttg

SEQ ID NO: 100977 - DNA, 25 bp, Rattus norvegicus
acttgtctatctacatttggtttaa

SEQ ID NO: 100978 - DNA, 25 bp, Rattus norvegicus
acttgtctatcttcatttggtttaa

SEQ ID NO: 100979 - DNA, 25 bp, Rattus norvegicus
acttgtctccagactcgccttaggc

SEQ ID NO: 100980 - DNA, 25 bp, Rattus norvegicus
acttgtctccagtctcgccttaggc

SEQ ID NO: 100981 - DNA, 25 bp, Rattus norvegicus
acttgtctctccaatgccagggtta

SEQ ID NO: 100982 - DNA, 25 bp, Rattus norvegicus
acttgtctctcctatgccagggtta

SEQ ID NO: 100983 - DNA, 25 bp, Rattus norvegicus
acttgtctctgcagagggctcggga

SEQ ID NO: 100984 - DNA, 25 bp, Rattus norvegicus
acttgtctctgctgagggctcggga

SEQ ID NO: 100985 - DNA, 25 bp, Rattus norvegicus
acttgtctgactcaatttcaccaca

SEQ ID NO: 100986 - DNA, 25 bp, Rattus norvegicus
acttgtctgactgaatttcaccaca

SEQ ID NO: 100987 - DNA, 25 bp, Rattus norvegicus
acttgtctggcaaacttctagtctt

SEQ ID NO: 100988 - DNA, 25 bp, Rattus norvegicus
acttgtctggcatacttctagtctt

SEQ ID NO: 100989 - DNA, 25 bp, Rattus norvegicus
acttgtctgggtaaccatcagctgc

SEQ ID NO: 100990 - DNA, 25 bp, Rattus norvegicus
acttgtctgggttaccatcagctgc

SEQ ID NO: 100991 - DNA, 25 bp, Rattus norvegicus
acttgtctggtgaatggattggacc

SEQ ID NO: 100992 - DNA, 25 bp, Rattus norvegicus
acttgtctggtgtatggattggacc

SEQ ID NO: 100993 - DNA, 25 bp, Rattus norvegicus
acttgtcttcccagtttgactggag

SEQ ID NO: 100994 - DNA, 25 bp, Rattus norvegicus
acttgtcttccctgtttgactggag

SEQ ID NO: 100995 - DNA, 25 bp, Rattus norvegicus
acttgtctttgtctcatgcaatcca

SEQ ID NO: 100996 - DNA, 25 bp, Rattus norvegicus
acttgtctttgtgtcatgcaatcca

SEQ ID NO: 100997 - DNA, 25 bp, Rattus norvegicus
acttgtcttttccatgttactgcac

SEQ ID NO: 100998 - DNA, 25 bp, Rattus norvegicus
acttgtcttttcgatgttactgcac

SEQ ID NO: 100999 - DNA, 25 bp, Rattus norvegicus
acttgtgaatcacggctactaaata

SEQ ID NO: 101000 - DNA, 25 bp, Rattus norvegicus
acttgtgaatcagggctactaaata

SEQ ID NO: 101001 - DNA, 25 bp, Rattus norvegicus
acttgtgaatccaaggctgtgtctc

SEQ ID NO: 101002 - DNA, 25 bp, Rattus norvegicus
acttgtgaatcctaggctgtgtctc

SEQ ID NO: 101003 - DNA, 25 bp, Rattus norvegicus
acttgtgaattacaccctctatccc

SEQ ID NO: 101004 - DNA, 25 bp, Rattus norvegicus
acttgtgaattagaccctctatccc

SEQ ID NO: 101005 - DNA, 25 bp, Rattus norvegicus
acttgtgacactcggttagcattac

SEQ ID NO: 101006 - DNA, 25 bp, Rattus norvegicus
acttgtgacactgggttagcattac

SEQ ID NO: 101007 - DNA, 25 bp, Rattus norvegicus
acttgtgacgtgctgccgaggcctt

SEQ ID NO: 101008 - DNA, 25 bp, Rattus norvegicus
acttgtgacgtggtgccgaggcctt

SEQ ID NO: 101009 - DNA, 25 bp, Rattus norvegicus
acttgtgactcaacctgttctgttc

SEQ ID NO: 101010 - DNA, 25 bp, Rattus norvegicus
acttgtgactcatcctgttctgttc

SEQ ID NO: 101011 - DNA, 25 bp, Rattus norvegicus
acttgtgactgaaatggtgtagatt

SEQ ID NO: 101012 - DNA, 25 bp, Rattus norvegicus
acttgtgactgatatggtgtagatt

SEQ ID NO: 101013 - DNA, 25 bp, Rattus norvegicus
acttgtgagagtcagttttcccctc

SEQ ID NO: 101014 - DNA, 25 bp, Rattus norvegicus
acttgtgagagtgagttttcccctc

SEQ ID NO: 101015 - DNA, 25 bp, Rattus norvegicus
acttgtgagattctgctgctgttgc

SEQ ID NO: 101016 - DNA, 25 bp, Rattus norvegicus
acttgtgagattgtgctgctgttgc

SEQ ID NO: 101017 - DNA, 25 bp, Rattus norvegicus
acttgtgagcaaacaggtcctcctg

SEQ ID NO: 101018 - DNA, 25 bp, Rattus norvegicus
acttgtgagcaatcaggtcctcctg

SEQ ID NO: 101019 - DNA, 25 bp, Rattus norvegicus
acttgtgatctaccagacactgggc

SEQ ID NO: 101020 - DNA, 25 bp, Rattus norvegicus
acttgtgatctagcagacactgggc

SEQ ID NO: 101021 - DNA, 25 bp, Rattus norvegicus
acttgtgcaaaaccatggtcatcac

SEQ ID NO: 101022 - DNA, 25 bp, Rattus norvegicus
acttgtgcaaaagcatggtcatcac

SEQ ID NO: 101023 - DNA, 25 bp, Rattus norvegicus
acttgtgcaagtccccaaatgagtt

SEQ ID NO: 101024 - DNA, 25 bp, Rattus norvegicus
acttgtgcaagtgcccaaatgagtt

SEQ ID NO: 101025 - DNA, 25 bp, Rattus norvegicus
acttgtgcacttagccacgtgagga

SEQ ID NO: 101026 - DNA, 25 bp, Rattus norvegicus
acttgtgcactttgccacgtgagga

SEQ ID NO: 101027 - DNA, 25 bp, Rattus norvegicus
acttgtgcagaaagtacagccctgt

SEQ ID NO: 101028 - DNA, 25 bp, Rattus norvegicus
acttgtgcagaatgtacagccctgt

SEQ ID NO: 101029 - DNA, 25 bp, Rattus norvegicus
acttgtgcatctagtgccttaggca

SEQ ID NO: 101030 - DNA, 25 bp, Rattus norvegicus
acttgtgcatcttgtgccttaggca

SEQ ID NO: 101031 - DNA, 25 bp, Rattus norvegicus
acttgtgccagacacatttttccca

SEQ ID NO: 101032 - DNA, 25 bp, Rattus norvegicus
acttgtgccagagacatttttccca

SEQ ID NO: 101033 - DNA, 25 bp, Rattus norvegicus
acttgtgcccaaactatcccaggtt

SEQ ID NO: 101034 - DNA, 25 bp, Rattus norvegicus
acttgtgcccaatctatcccaggtt

SEQ ID NO: 101035 - DNA, 25 bp, Rattus norvegicus
acttgtgcccagaggtcctggctta

SEQ ID NO: 101036 - DNA, 25 bp, Rattus norvegicus
acttgtgcccagtggtcctggctta

SEQ ID NO: 101037 - DNA, 25 bp, Rattus norvegicus
acttgtgccccacgtcatggaaaat

SEQ ID NO: 101038 - DNA, 25 bp, Rattus norvegicus
acttgtgccccaggtcatggaaaat

SEQ ID NO: 101039 - DNA, 25 bp, Rattus norvegicus
acttgtgcccttatgacaatcctgg

SEQ ID NO: 101040 - DNA, 25 bp, Rattus norvegicus
acttgtgcccttttgacaatcctgg

SEQ ID NO: 101041 - DNA, 25 bp, Rattus norvegicus
acttgtgcctatattccagatggga

SEQ ID NO: 101042 - DNA, 25 bp, Rattus norvegicus
acttgtgcctattttccagatggga

SEQ ID NO: 101043 - DNA, 25 bp, Rattus norvegicus
acttgtgcctggagagtgagcttga

SEQ ID NO: 101044 - DNA, 25 bp, Rattus norvegicus
acttgtgcctggtgagtgagcttga

SEQ ID NO: 101045 - DNA, 25 bp, Rattus norvegicus
acttgtgccttcaatatgtactgtg

SEQ ID NO: 101046 - DNA, 25 bp, Rattus norvegicus
acttgtgccttctatatgtactgtg

SEQ ID NO: 101047 - DNA, 25 bp, Rattus norvegicus
acttgtgctacgctgggagcccaga

SEQ ID NO: 101048 - DNA, 25 bp, Rattus norvegicus
acttgtgctacggtgggagcccaga

SEQ ID NO: 101049 - DNA, 25 bp, Rattus norvegicus
acttgtgctattactggtctgtctc

SEQ ID NO: 101050 - DNA, 25 bp, Rattus norvegicus
acttgtgctatttctggtctgtctc

SEQ ID NO: 101051 - DNA, 25 bp, Rattus norvegicus
acttgtgcttctctatggtactctc

SEQ ID NO: 101052 - DNA, 25 bp, Rattus norvegicus
acttgtgcttctgtatggtactctc

SEQ ID NO: 101053 - DNA, 25 bp, Rattus norvegicus
acttgtgcttggagtgcactctagt

SEQ ID NO: 101054 - DNA, 25 bp, Rattus norvegicus
acttgtgcttggtgtgcactctagt

SEQ ID NO: 101055 - DNA, 25 bp, Rattus norvegicus
acttgtgcttgtcagtcacctacca

SEQ ID NO: 101056 - DNA, 25 bp, Rattus norvegicus
acttgtgcttgtgagtcacctacca

SEQ ID NO: 101057 - DNA, 25 bp, Rattus norvegicus
acttgtggagccagtttccaggcag

SEQ ID NO: 101058 - DNA, 25 bp, Rattus norvegicus
acttgtggagcctgtttccaggcag

SEQ ID NO: 101059 - DNA, 25 bp, Rattus norvegicus
acttgtggcctcaggatgctatcca

SEQ ID NO: 101060 - DNA, 25 bp, Rattus norvegicus
acttgtggcctctggatgctatcca

SEQ ID NO: 101061 - DNA, 25 bp, Rattus norvegicus
acttgtggttcactttttgggtctg

SEQ ID NO: 101062 - DNA, 25 bp, Rattus norvegicus
acttgtggttcagtttttgggtctg

SEQ ID NO: 101063 - DNA, 25 bp, Rattus norvegicus
acttgtggttctcatctctctgtgg

SEQ ID NO: 101064 - DNA, 25 bp, Rattus norvegicus
acttgtggttctgatctctctgtgg

SEQ ID NO: 101065 - DNA, 25 bp, Rattus norvegicus
acttgtggttgtcgacatgtctgcc

SEQ ID NO: 101066 - DNA, 25 bp, Rattus norvegicus
acttgtggttgtggacatgtctgcc

SEQ ID NO: 101067 - DNA, 25 bp, Rattus norvegicus
acttgtggtttaaggcttggttctc

SEQ ID NO: 101068 - DNA, 25 bp, Rattus norvegicus
acttgtggtttatggcttggttctc

SEQ ID NO: 101069 - DNA, 25 bp, Rattus norvegicus
acttgtgtaaaaaatcggatgacgt

SEQ ID NO: 101070 - DNA, 25 bp, Rattus norvegicus
acttgtgtaaaatatcggatgacgt

SEQ ID NO: 101071 - DNA, 25 bp, Rattus norvegicus
acttgtgtagcaccagtgcttggca

SEQ ID NO: 101072 - DNA, 25 bp, Rattus norvegicus
acttgtgtagcagcagtgcttggca

SEQ ID NO: 101073 - DNA, 25 bp, Rattus norvegicus
acttgtgtataactccaattcaggg

SEQ ID NO: 101074 - DNA, 25 bp, Rattus norvegicus
acttgtgtataagtccaattcaggg

SEQ ID NO: 101075 - DNA, 25 bp, Rattus norvegicus
acttgtgtcactccggtttgggtca

SEQ ID NO: 101076 - DNA, 25 bp, Rattus norvegicus
acttgtgtcactgcggtttgggtca

SEQ ID NO: 101077 - DNA, 25 bp, Rattus norvegicus
acttgtgtcatacaagagccctgga

SEQ ID NO: 101078 - DNA, 25 bp, Rattus norvegicus
acttgtgtcatagaagagccctgga

SEQ ID NO: 101079 - DNA, 25 bp, Rattus norvegicus
acttgtgtccttacgtgatgttcag

SEQ ID NO: 101080 - DNA, 25 bp, Rattus norvegicus
acttgtgtcctttcgtgatgttcag

SEQ ID NO: 101081 - DNA, 25 bp, Rattus norvegicus
acttgtgtcttcatgttgctctgtc

SEQ ID NO: 101082 - DNA, 25 bp, Rattus norvegicus
acttgtgtcttcattattacctcat

SEQ ID NO: 101083 - DNA, 25 bp, Rattus norvegicus
acttgtgtcttcttgttgctctgtc

SEQ ID NO: 101084 - DNA, 25 bp, Rattus norvegicus
acttgtgtcttctttattacctcat

SEQ ID NO: 101085 - DNA, 25 bp, Rattus norvegicus
acttgtgtgactccagtgcttacca

SEQ ID NO: 101086 - DNA, 25 bp, Rattus norvegicus
acttgtgtgactgcagtgcttacca

SEQ ID NO: 101087 - DNA, 25 bp, Rattus norvegicus
acttgtgtgagccaccctgtgtgga

SEQ ID NO: 101088 - DNA, 25 bp, Rattus norvegicus
acttgtgtgagcgaccctgtgtgga

SEQ ID NO: 101089 - DNA, 25 bp, Rattus norvegicus
acttgtgtgagtcgctcaggcccca

SEQ ID NO: 101090 - DNA, 25 bp, Rattus norvegicus
acttgtgtgagtggctcaggcccca

SEQ ID NO: 101091 - DNA, 25 bp, Rattus norvegicus
acttgtgtgcacaggcctgtgtgga

SEQ ID NO: 101092 - DNA, 25 bp, Rattus norvegicus
acttgtgtgcacattaactgtggaa

SEQ ID NO: 101093 - DNA, 25 bp, Rattus norvegicus
acttgtgtgcactggcctgtgtgga

SEQ ID NO: 101094 - DNA, 25 bp, Rattus norvegicus
acttgtgtgcactttaactgtggaa

SEQ ID NO: 101095 - DNA, 25 bp, Rattus norvegicus
acttgtgtgcttatgcaactaatga

SEQ ID NO: 101096 - DNA, 25 bp, Rattus norvegicus
acttgtgtgcttttgcaactaatga

SEQ ID NO: 101097 - DNA, 25 bp, Rattus norvegicus
acttgtgtgtctccttatttcttta

SEQ ID NO: 101098 - DNA, 25 bp, Rattus norvegicus
acttgtgtgtctgcttatttcttta

SEQ ID NO: 101099 - DNA, 25 bp, Rattus norvegicus
acttgtgttacaccgtgagaggtct

SEQ ID NO: 101100 - DNA, 25 bp, Rattus norvegicus
acttgtgttacagcgtgagaggtct

SEQ ID NO: 101101 - DNA, 25 bp, Rattus norvegicus
acttgtgttgccactgggtctaatc

SEQ ID NO: 101102 - DNA, 25 bp, Rattus norvegicus
acttgtgttgcctctgggtctaatc

SEQ ID NO: 101103 - DNA, 25 bp, Rattus norvegicus
acttgtgtttcaagtcactttttta

SEQ ID NO: 101104 - DNA, 25 bp, Rattus norvegicus
acttgtgtttcatgtcactttttta

SEQ ID NO: 101105 - DNA, 25 bp, Rattus norvegicus
acttgttaacgactggtgtcctgtt

SEQ ID NO: 101106 - DNA, 25 bp, Rattus norvegicus
acttgttaacgagtggtgtcctgtt

SEQ ID NO: 101107 - DNA, 25 bp, Rattus norvegicus
acttgttaggtcactgtagcatcgg

SEQ ID NO: 101108 - DNA, 25 bp, Rattus norvegicus
acttgttaggtctctgtagcatcgg

SEQ ID NO: 101109 - DNA, 25 bp, Rattus norvegicus
acttgttcacctaccagtgtttacg

SEQ ID NO: 101110 - DNA, 25 bp, Rattus norvegicus
acttgttcaccttccagtgtttacg

SEQ ID NO: 101111 - DNA, 25 bp, Rattus norvegicus
acttgttcattcaaatcctgcacct

SEQ ID NO: 101112 - DNA, 25 bp, Rattus norvegicus
acttgttcattctaatcctgcacct

SEQ ID NO: 101113 - DNA, 25 bp, Rattus norvegicus
acttgttccacaatcaggcgggtat

SEQ ID NO: 101114 - DNA, 25 bp, Rattus norvegicus
acttgttccacattcaggcgggtat

SEQ ID NO: 101115 - DNA, 25 bp, Rattus norvegicus
acttgttcggccatttctgtaattg

SEQ ID NO: 101116 - DNA, 25 bp, Rattus norvegicus
acttgttcggccttttctgtaattg

SEQ ID NO: 101117 - DNA, 25 bp, Rattus norvegicus
acttgttctctcagctgctaaagat

SEQ ID NO: 101118 - DNA, 25 bp, Rattus norvegicus
acttgttctctctgctgctaaagat

SEQ ID NO: 101119 - DNA, 25 bp, Rattus norvegicus
acttgttctggtctctgttcacgta

SEQ ID NO: 101120 - DNA, 25 bp, Rattus norvegicus
acttgttctggtgtctgttcacgta

SEQ ID NO: 101121 - DNA, 25 bp, Rattus norvegicus
acttgttcttgtacagctgtggctt

SEQ ID NO: 101122 - DNA, 25 bp, Rattus norvegicus
acttgttcttgttcagctgtggctt

SEQ ID NO: 101123 - DNA, 25 bp, Rattus norvegicus
acttgttctttaaccatgggcccaa

SEQ ID NO: 101124 - DNA, 25 bp, Rattus norvegicus
acttgttctttatccatgggcccaa

SEQ ID NO: 101125 - DNA, 25 bp, Rattus norvegicus
acttgttgacagcagaggcccaggt

SEQ ID NO: 101126 - DNA, 25 bp, Rattus norvegicus
acttgttgacaggagaggcccaggt

SEQ ID NO: 101127 - DNA, 25 bp, Rattus norvegicus
acttgttgagatctatccctcctct

SEQ ID NO: 101128 - DNA, 25 bp, Rattus norvegicus
acttgttgagatgtatccctcctct

SEQ ID NO: 101129 - DNA, 25 bp, Rattus norvegicus
acttgttgcaatatgagcccttcca

SEQ ID NO: 101130 - DNA, 25 bp, Rattus norvegicus
acttgttgcaatttgagcccttcca

SEQ ID NO: 101131 - DNA, 25 bp, Rattus norvegicus
acttgttgcccaaggcctcaggaga

SEQ ID NO: 101132 - DNA, 25 bp, Rattus norvegicus
acttgttgcccatggcctcaggaga

SEQ ID NO: 101133 - DNA, 25 bp, Rattus norvegicus
acttgttggcaacatgagcactaaa

SEQ ID NO: 101134 - DNA, 25 bp, Rattus norvegicus
acttgttggcaagatgagcactaaa

SEQ ID NO: 101135 - DNA, 25 bp, Rattus norvegicus
acttgttgggctcattctggtttta

SEQ ID NO: 101136 - DNA, 25 bp, Rattus norvegicus
acttgttgggctgattctggtttta

SEQ ID NO: 101137 - DNA, 25 bp, Rattus norvegicus
acttgtttacatctttgtctcccct

SEQ ID NO: 101138 - DNA, 25 bp, Rattus norvegicus
acttgtttacatgtttgtctcccct

SEQ ID NO: 101139 - DNA, 25 bp, Rattus norvegicus
acttgtttcaaaatcagcggctctg

SEQ ID NO: 101140 - DNA, 25 bp, Rattus norvegicus
acttgtttcaaattcagcggctctg

SEQ ID NO: 101141 - DNA, 25 bp, Rattus norvegicus
acttgtttcaggctcagatgccttc

SEQ ID NO: 101142 - DNA, 25 bp, Rattus norvegicus
acttgtttcagggtcagatgccttc

SEQ ID NO: 101143 - DNA, 25 bp, Rattus norvegicus
acttgtttcatacgtggctggctga

SEQ ID NO: 101144 - DNA, 25 bp, Rattus norvegicus
acttgtttcataggtggctggctga

SEQ ID NO: 101145 - DNA, 25 bp, Rattus norvegicus
acttgtttctgccttgtcctgcgtc

SEQ ID NO: 101146 - DNA, 25 bp, Rattus norvegicus
acttgtttctgcgttgtcctgcgtc

SEQ ID NO: 101147 - DNA, 25 bp, Rattus norvegicus
acttgtttgacaatgtgccggatga

SEQ ID NO: 101148 - DNA, 25 bp, Rattus norvegicus
acttgtttgacattgtgccggatga

SEQ ID NO: 101149 - DNA, 25 bp, Rattus norvegicus
acttgtttgattacagctctctgtt

SEQ ID NO: 101150 - DNA, 25 bp, Rattus norvegicus
acttgtttgatttcagctctctgtt

SEQ ID NO: 101151 - DNA, 25 bp, Rattus norvegicus
acttgtttgtgcaactggtgtggac

SEQ ID NO: 101152 - DNA, 25 bp, Rattus norvegicus
acttgtttgtgctactggtgtggac

SEQ ID NO: 101153 - DNA, 25 bp, Rattus norvegicus
acttgttttagtcttcactgggctt

SEQ ID NO: 101154 - DNA, 25 bp, Rattus norvegicus
acttgttttagtgttcactgggctt

SEQ ID NO: 101155 - DNA, 25 bp, Rattus norvegicus
acttgttttatcatgcactcttgaa

SEQ ID NO: 101156 - DNA, 25 bp, Rattus norvegicus
acttgttttatcttgcactcttgaa

SEQ ID NO: 101157 - DNA, 25 bp, Rattus norvegicus
acttgttttgcacagacgtgggcct

SEQ ID NO: 101158 - DNA, 25 bp, Rattus norvegicus
acttgttttgcagagacgtgggcct

SEQ ID NO: 101159 - DNA, 25 bp, Rattus norvegicus
actttaaaagcacatccctcaggtc

SEQ ID NO: 101160 - DNA, 25 bp, Rattus norvegicus
actttaaaagcagatccctcaggtc

SEQ ID NO: 101161 - DNA, 25 bp, Rattus norvegicus
actttaaacttcatgcctgcactga

SEQ ID NO: 101162 - DNA, 25 bp, Rattus norvegicus
actttaaacttcttgcctgcactga

SEQ ID NO: 101163 - DNA, 25 bp, Rattus norvegicus
actttaaatttgagccaggtcaggg

SEQ ID NO: 101164 - DNA, 25 bp, Rattus norvegicus
actttaaatttgtgccaggtcaggg

SEQ ID NO: 101165 - DNA, 25 bp, Rattus norvegicus
actttaacagtgaggtcagctatca

SEQ ID NO: 101166 - DNA, 25 bp, Rattus norvegicus
actttaacagtgtggtcagctatca

SEQ ID NO: 101167 - DNA, 25 bp, Rattus norvegicus
actttaaccagacctggtgccttga

SEQ ID NO: 101168 - DNA, 25 bp, Rattus norvegicus
actttaaccagagctggtgccttga

SEQ ID NO: 101169 - DNA, 25 bp, Rattus norvegicus
actttaacctggacagcttagctat

SEQ ID NO: 101170 - DNA, 25 bp, Rattus norvegicus
actttaacctggtcagcttagctat

SEQ ID NO: 101171 - DNA, 25 bp, Rattus norvegicus
actttaatcaccactcttcagggaa

SEQ ID NO: 101172 - DNA, 25 bp, Rattus norvegicus
actttaatcacctctcttcagggaa

SEQ ID NO: 101173 - DNA, 25 bp, Rattus norvegicus
actttaatccttctcttgcgagcat

SEQ ID NO: 101174 - DNA, 25 bp, Rattus norvegicus
actttaatccttgtcttgcgagcat

SEQ ID NO: 101175 - DNA, 25 bp, Rattus norvegicus
actttaatgctcaacgtattcccaa

SEQ ID NO: 101176 - DNA, 25 bp, Rattus norvegicus
actttaatgctctacgtattcccaa

SEQ ID NO: 101177 - DNA, 25 bp, Rattus norvegicus
actttaatgtctctgtttcttccct

SEQ ID NO: 101178 - DNA, 25 bp, Rattus norvegicus
actttaatgtctgtgtttcttccct

SEQ ID NO: 101179 - DNA, 25 bp, Rattus norvegicus
actttacaatgtacccttaagcgag

SEQ ID NO: 101180 - DNA, 25 bp, Rattus norvegicus
actttacaatgttcccttaagcgag

SEQ ID NO: 101181 - DNA, 25 bp, Rattus norvegicus
actttacaggccaaagcaggatctg

SEQ ID NO: 101182 - DNA, 25 bp, Rattus norvegicus
actttacaggcctaagcaggatctg

SEQ ID NO: 101183 - DNA, 25 bp, Rattus norvegicus
actttacagggtcagttccgcttca

SEQ ID NO: 101184 - DNA, 25 bp, Rattus norvegicus
actttacagggtgagttccgcttca

SEQ ID NO: 101185 - DNA, 25 bp, Rattus norvegicus
actttacagtgtaagcctgcctggc

SEQ ID NO: 101186 - DNA, 25 bp, Rattus norvegicus
actttacagtgttagcctgcctggc

SEQ ID NO: 101187 - DNA, 25 bp, Rattus norvegicus
actttaccaggcatctggttcttac

SEQ ID NO: 101188 - DNA, 25 bp, Rattus norvegicus
actttaccaggcttctggttcttac

SEQ ID NO: 101189 - DNA, 25 bp, Rattus norvegicus
actttaccctgactctgagccagag

SEQ ID NO: 101190 - DNA, 25 bp, Rattus norvegicus
actttaccctgagtctgagccagag

SEQ ID NO: 101191 - DNA, 25 bp, Rattus norvegicus
actttaccgctaaggcacactcaac

SEQ ID NO: 101192 - DNA, 25 bp, Rattus norvegicus
actttaccgctatggcacactcaac

SEQ ID NO: 101193 - DNA, 25 bp, Rattus norvegicus
actttacctcagatgacagtttgtt

SEQ ID NO: 101194 - DNA, 25 bp, Rattus norvegicus
actttacctcagttgacagtttgtt

SEQ ID NO: 101195 - DNA, 25 bp, Rattus norvegicus
actttacctcttcccataaggcatg

SEQ ID NO: 101196 - DNA, 25 bp, Rattus norvegicus
actttacctcttgccataaggcatg

SEQ ID NO: 101197 - DNA, 25 bp, Rattus norvegicus
actttaccttcacagcactgcagaa

SEQ ID NO: 101198 - DNA, 25 bp, Rattus norvegicus
actttaccttcagagcactgcagaa

SEQ ID NO: 101199 - DNA, 25 bp, Rattus norvegicus
actttacgaagtcatctgcagctga

SEQ ID NO: 101200 - DNA, 25 bp, Rattus norvegicus
actttacgaagtgatctgcagctga

SEQ ID NO: 101201 - DNA, 25 bp, Rattus norvegicus
actttacgatagctttccctacaga

SEQ ID NO: 101202 - DNA, 25 bp, Rattus norvegicus
actttacgataggtttccctacaga

SEQ ID NO: 101203 - DNA, 25 bp, Rattus norvegicus
actttactacacaggcaccacagga

SEQ ID NO: 101204 - DNA, 25 bp, Rattus norvegicus
actttactacactggcaccacagga

SEQ ID NO: 101205 - DNA, 25 bp, Rattus norvegicus
actttactctccagttcacaactag

SEQ ID NO: 101206 - DNA, 25 bp, Rattus norvegicus
actttactctcctgttcacaactag

SEQ ID NO: 101207 - DNA, 25 bp, Rattus norvegicus
actttactgggcattggtactgact

SEQ ID NO: 101208 - DNA, 25 bp, Rattus norvegicus
actttactgggctttggtactgact

SEQ ID NO: 101209 - DNA, 25 bp, Rattus norvegicus
actttacttaaccacacttgctaga

SEQ ID NO: 101210 - DNA, 25 bp, Rattus norvegicus
actttacttaacgacacttgctaga

SEQ ID NO: 101211 - DNA, 25 bp, Rattus norvegicus
actttagaaaatctcaatcccttga

SEQ ID NO: 101212 - DNA, 25 bp, Rattus norvegicus
actttagaaaatgtcaatcccttga

SEQ ID NO: 101213 - DNA, 25 bp, Rattus norvegicus
actttagaaccactcacatctctct

SEQ ID NO: 101214 - DNA, 25 bp, Rattus norvegicus
actttagaaccagtcacatctctct

SEQ ID NO: 101215 - DNA, 25 bp, Rattus norvegicus
actttagacacacctactgctttct

SEQ ID NO: 101216 - DNA, 25 bp, Rattus norvegicus
actttagacacagctactgctttct

SEQ ID NO: 101217 - DNA, 25 bp, Rattus norvegicus
actttagagcctccttggttaccta

SEQ ID NO: 101218 - DNA, 25 bp, Rattus norvegicus
actttagagcctgcttggttaccta

SEQ ID NO: 101219 - DNA, 25 bp, Rattus norvegicus
actttagatagcctgttgtaacttt

SEQ ID NO: 101220 - DNA, 25 bp, Rattus norvegicus
actttagatagcgtgttgtaacttt

SEQ ID NO: 101221 - DNA, 25 bp, Rattus norvegicus
actttagcaccaaggccatgcggga

SEQ ID NO: 101222 - DNA, 25 bp, Rattus norvegicus
actttagcaccatggccatgcggga

SEQ ID NO: 101223 - DNA, 25 bp, Rattus norvegicus
actttagcatttacctgtcattctc

SEQ ID NO: 101224 - DNA, 25 bp, Rattus norvegicus
actttagcattttcctgtcattctc

SEQ ID NO: 101225 - DNA, 25 bp, Rattus norvegicus
actttagccattctcgtaggtgtaa

SEQ ID NO: 101226 - DNA, 25 bp, Rattus norvegicus
actttagccattgtcgtaggtgtaa

SEQ ID NO: 101227 - DNA, 25 bp, Rattus norvegicus
actttagctgctctcttgctgaaga

SEQ ID NO: 101228 - DNA, 25 bp, Rattus norvegicus
actttagctgctgtcttgctgaaga

SEQ ID NO: 101229 - DNA, 25 bp, Rattus norvegicus
actttaggactgctaaggtatctca

SEQ ID NO: 101230 - DNA, 25 bp, Rattus norvegicus
actttaggactggtaaggtatctca

SEQ ID NO: 101231 - DNA, 25 bp, Rattus norvegicus
actttaggatctcctctgtgggaac

SEQ ID NO: 101232 - DNA, 25 bp, Rattus norvegicus
actttaggatctgctctgtgggaac

SEQ ID NO: 101233 - DNA, 25 bp, Rattus norvegicus
actttaggcacaatgaccattccaa

SEQ ID NO: 101234 - DNA, 25 bp, Rattus norvegicus
actttaggcacattgaccattccaa

SEQ ID NO: 101235 - DNA, 25 bp, Rattus norvegicus
actttaggcagaccagactgatctc

SEQ ID NO: 101236 - DNA, 25 bp, Rattus norvegicus
actttaggcagagcagactgatctc

SEQ ID NO: 101237 - DNA, 25 bp, Rattus norvegicus
actttaggcatcagtagcattgggc

SEQ ID NO: 101238 - DNA, 25 bp, Rattus norvegicus
actttaggcatctgtagcattgggc

SEQ ID NO: 101239 - DNA, 25 bp, Rattus norvegicus
actttaggcattagtgtctgtttaa

SEQ ID NO: 101240 - DNA, 25 bp, Rattus norvegicus
actttaggcatttgtgtctgtttaa

SEQ ID NO: 101241 - DNA, 25 bp, Rattus norvegicus
actttagggctaagctgacctggca

SEQ ID NO: 101242 - DNA, 25 bp, Rattus norvegicus
actttagggctatgctgacctggca

SEQ ID NO: 101243 - DNA, 25 bp, Rattus norvegicus
actttagtgactctatatgtgtgta

SEQ ID NO: 101244 - DNA, 25 bp, Rattus norvegicus
actttagtgactgtatatgtgtgta

SEQ ID NO: 101245 - DNA, 25 bp, Rattus norvegicus
actttagtggccctggtactcttct

SEQ ID NO: 101246 - DNA, 25 bp, Rattus norvegicus
actttagtggccgtggtactcttct

SEQ ID NO: 101247 - DNA, 25 bp, Rattus norvegicus
actttatccaaacctgtgtcatgcc

SEQ ID NO: 101248 - DNA, 25 bp, Rattus norvegicus
actttatccaaagctgtgtcatgcc

SEQ ID NO: 101249 - DNA, 25 bp, Rattus norvegicus
actttatcctccactgactgtgagc

SEQ ID NO: 101250 - DNA, 25 bp, Rattus norvegicus
actttatcctcctctgactgtgagc

SEQ ID NO: 101251 - DNA, 25 bp, Rattus norvegicus
actttatctgatcactggcttggag

SEQ ID NO: 101252 - DNA, 25 bp, Rattus norvegicus
actttatctgatgactggcttggag

SEQ ID NO: 101253 - DNA, 25 bp, Rattus norvegicus
actttatcttgtatcctgacaccaa

SEQ ID NO: 101254 - DNA, 25 bp, Rattus norvegicus
actttatcttgtttcctgacaccaa

SEQ ID NO: 101255 - DNA, 25 bp, Rattus norvegicus
actttatgacacaccccgagtttag

SEQ ID NO: 101256 - DNA, 25 bp, Rattus norvegicus
actttatgacactccccgagtttag

SEQ ID NO: 101257 - DNA, 25 bp, Rattus norvegicus
actttatgactccatgtttcaccgg

SEQ ID NO: 101258 - DNA, 25 bp, Rattus norvegicus
actttatgactcgatgtttcaccgg

SEQ ID NO: 101259 - DNA, 25 bp, Rattus norvegicus
actttatgagtcaagccagtctgat

SEQ ID NO: 101260 - DNA, 25 bp, Rattus norvegicus
actttatgagtctagccagtctgat

SEQ ID NO: 101261 - DNA, 25 bp, Rattus norvegicus
actttatgagtgactggctccctgc

SEQ ID NO: 101262 - DNA, 25 bp, Rattus norvegicus
actttatgagtgtctggctccctgc

SEQ ID NO: 101263 - DNA, 25 bp, Rattus norvegicus
actttatgcaaacctccagactgag

SEQ ID NO: 101264 - DNA, 25 bp, Rattus norvegicus
actttatgcaaagctccagactgag

SEQ ID NO: 101265 - DNA, 25 bp, Rattus norvegicus
actttatgcccacctttgctttaaa

SEQ ID NO: 101266 - DNA, 25 bp, Rattus norvegicus
actttatgcccagctttgctttaaa

SEQ ID NO: 101267 - DNA, 25 bp, Rattus norvegicus
actttatgtgtcagtcttcttctga

SEQ ID NO: 101268 - DNA, 25 bp, Rattus norvegicus
actttatgtgtctgtcttcttctga

SEQ ID NO: 101269 - DNA, 25 bp, Rattus norvegicus
actttattaaccactcactttgcta

SEQ ID NO: 101270 - DNA, 25 bp, Rattus norvegicus
actttattaacctctcactttgcta

SEQ ID NO: 101271 - DNA, 25 bp, Rattus norvegicus
actttattaccaatgcaatcttctt

SEQ ID NO: 101272 - DNA, 25 bp, Rattus norvegicus
actttattaccattgcaatcttctt

SEQ ID NO: 101273 - DNA, 25 bp, Rattus norvegicus
actttattctcacagtcacaattag

SEQ ID NO: 101274 - DNA, 25 bp, Rattus norvegicus
actttattctcagagtcacaattag

SEQ ID NO: 101275 - DNA, 25 bp, Rattus norvegicus
actttattgcctctttttcacactt

SEQ ID NO: 101276 - DNA, 25 bp, Rattus norvegicus
actttattgcctgtttttcacactt

SEQ ID NO: 101277 - DNA, 25 bp, Rattus norvegicus
actttcaaatgtctaatcaccggga

SEQ ID NO: 101278 - DNA, 25 bp, Rattus norvegicus
actttcaaatgtgtaatcaccggga

SEQ ID NO: 101279 - DNA, 25 bp, Rattus norvegicus
actttcaaggtccagggcctcagat

SEQ ID NO: 101280 - DNA, 25 bp, Rattus norvegicus
actttcaaggtcgagggcctcagat

SEQ ID NO: 101281 - DNA, 25 bp, Rattus norvegicus
actttcaattgcagcagtcactgcc

SEQ ID NO: 101282 - DNA, 25 bp, Rattus norvegicus
actttcaattgctgcagtcactgcc

SEQ ID NO: 101283 - DNA, 25 bp, Rattus norvegicus
actttcacacgtacctgcatttgaa

SEQ ID NO: 101284 - DNA, 25 bp, Rattus norvegicus
actttcacacgttcctgcatttgaa

SEQ ID NO: 101285 - DNA, 25 bp, Rattus norvegicus
actttcacagatctcctggacaatg

SEQ ID NO: 101286 - DNA, 25 bp, Rattus norvegicus
actttcacagatgtcctggacaatg

SEQ ID NO: 101287 - DNA, 25 bp, Rattus norvegicus
actttcacatttagatgagcagaga

SEQ ID NO: 101288 - DNA, 25 bp, Rattus norvegicus
actttcacattttgatgagcagaga

SEQ ID NO: 101289 - DNA, 25 bp, Rattus norvegicus
actttcacgattcttgcttcccaag

SEQ ID NO: 101290 - DNA, 25 bp, Rattus norvegicus
actttcacgattgttgcttcccaag

SEQ ID NO: 101291 - DNA, 25 bp, Rattus norvegicus
actttcacggtccaggctcgatgtc

SEQ ID NO: 101292 - DNA, 25 bp, Rattus norvegicus
actttcacggtcgaggctcgatgtc

SEQ ID NO: 101293 - DNA, 25 bp, Rattus norvegicus
actttcacgtgtactgtgctgcatg

SEQ ID NO: 101294 - DNA, 25 bp, Rattus norvegicus
actttcacgtgttctgtgctgcatg

SEQ ID NO: 101295 - DNA, 25 bp, Rattus norvegicus
actttcactcttcggctcttttgtg

SEQ ID NO: 101296 - DNA, 25 bp, Rattus norvegicus
actttcactcttgggctcttttgtg

SEQ ID NO: 101297 - DNA, 25 bp, Rattus norvegicus
actttcagagcaatcgatgcccttg

SEQ ID NO: 101298 - DNA, 25 bp, Rattus norvegicus
actttcagagcattcgatgcccttg

SEQ ID NO: 101299 - DNA, 25 bp, Rattus norvegicus
actttcagatatcgcctcttacagt

SEQ ID NO: 101300 - DNA, 25 bp, Rattus norvegicus
actttcagatatggcctcttacagt

SEQ ID NO: 101301 - DNA, 25 bp, Rattus norvegicus
actttcagattgcacatccttggac

SEQ ID NO: 101302 - DNA, 25 bp, Rattus norvegicus
actttcagattggacatccttggac

SEQ ID NO: 101303 - DNA, 25 bp, Rattus norvegicus
actttcagcccactcagacagggtt

SEQ ID NO: 101304 - DNA, 25 bp, Rattus norvegicus
actttcagcccagtcagacagggtt

SEQ ID NO: 101305 - DNA, 25 bp, Rattus norvegicus
actttcaggagtcaggtgttagtga

SEQ ID NO: 101306 - DNA, 25 bp, Rattus norvegicus
actttcaggagtgaggtgttagtga

SEQ ID NO: 101307 - DNA, 25 bp, Rattus norvegicus
actttcagtcaaaaagtctgttgca

SEQ ID NO: 101308 - DNA, 25 bp, Rattus norvegicus
actttcagtcaaataggagcttctt

SEQ ID NO: 101309 - DNA, 25 bp, Rattus norvegicus
actttcagtcaataagtctgttgca

SEQ ID NO: 101310 - DNA, 25 bp, Rattus norvegicus
actttcagtcaattaggagcttctt

SEQ ID NO: 101311 - DNA, 25 bp, Rattus norvegicus
actttcattaaaacttgtgctcagc

SEQ ID NO: 101312 - DNA, 25 bp, Rattus norvegicus
actttcattaaatcttgtgctcagc

SEQ ID NO: 101313 - DNA, 25 bp, Rattus norvegicus
actttcattgcccacctggtggtgg

SEQ ID NO: 101314 - DNA, 25 bp, Rattus norvegicus
actttcattgccgacctggtggtgg

SEQ ID NO: 101315 - DNA, 25 bp, Rattus norvegicus
actttcattttccaattgtccctgt

SEQ ID NO: 101316 - DNA, 25 bp, Rattus norvegicus
actttcattttcgaattgtccctgt

SEQ ID NO: 101317 - DNA, 25 bp, Rattus norvegicus
actttccaagggagagattactcta

SEQ ID NO: 101318 - DNA, 25 bp, Rattus norvegicus
actttccaagggtgagattactcta

SEQ ID NO: 101319 - DNA, 25 bp, Rattus norvegicus
actttccagctaatcagagggttct

SEQ ID NO: 101320 - DNA, 25 bp, Rattus norvegicus
actttccagctattcagagggttct

SEQ ID NO: 101321 - DNA, 25 bp, Rattus norvegicus
actttccatccgagttctaatatcc

SEQ ID NO: 101322 - DNA, 25 bp, Rattus norvegicus
actttccatccgtgttctaatatcc

SEQ ID NO: 101323 - DNA, 25 bp, Rattus norvegicus
actttccatgcaaatactttccact

SEQ ID NO: 101324 - DNA, 25 bp, Rattus norvegicus
actttccatgcatatactttccact

SEQ ID NO: 101325 - DNA, 25 bp, Rattus norvegicus
actttccatgggagtctgctacagg

SEQ ID NO: 101326 - DNA, 25 bp, Rattus norvegicus
actttccatgggtgtctgctacagg

SEQ ID NO: 101327 - DNA, 25 bp, Rattus norvegicus
actttccccagaagtcagtttcctt

SEQ ID NO: 101328 - DNA, 25 bp, Rattus norvegicus
actttccccagatgtcagtttcctt

SEQ ID NO: 101329 - DNA, 25 bp, Rattus norvegicus
actttccccgggatgcaactgacgt

SEQ ID NO: 101330 - DNA, 25 bp, Rattus norvegicus
actttccccgggttgcaactgacgt

SEQ ID NO: 101331 - DNA, 25 bp, Rattus norvegicus
actttccctgaaaatctgacacatt

SEQ ID NO: 101332 - DNA, 25 bp, Rattus norvegicus
actttccctgaatatctgacacatt

SEQ ID NO: 101333 - DNA, 25 bp, Rattus norvegicus
actttccctgttacttgttcttgat

SEQ ID NO: 101334 - DNA, 25 bp, Rattus norvegicus
actttccctgtttcttgttcttgat

SEQ ID NO: 101335 - DNA, 25 bp, Rattus norvegicus
actttccgagacaggatctccattt

SEQ ID NO: 101336 - DNA, 25 bp, Rattus norvegicus
actttccgagactggatctccattt

SEQ ID NO: 101337 - DNA, 25 bp, Rattus norvegicus
actttccgcaagagtagttgcagac

SEQ ID NO: 101338 - DNA, 25 bp, Rattus norvegicus
actttccgcaagtgtagttgcagac

SEQ ID NO: 101339 - DNA, 25 bp, Rattus norvegicus
actttccgcacactcagattgatgt

SEQ ID NO: 101340 - DNA, 25 bp, Rattus norvegicus
actttccgcacagtcagattgatgt

SEQ ID NO: 101341 - DNA, 25 bp, Rattus norvegicus
actttccggcagatggtgcagagca

SEQ ID NO: 101342 - DNA, 25 bp, Rattus norvegicus
actttccggcagttggtgcagagca

SEQ ID NO: 101343 - DNA, 25 bp, Rattus norvegicus
actttccgggtacttgtgcagtgat

SEQ ID NO: 101344 - DNA, 25 bp, Rattus norvegicus
actttccgggtagttgtgcagtgat

SEQ ID NO: 101345 - DNA, 25 bp, Rattus norvegicus
actttccgtcagagtcgtactgtat

SEQ ID NO: 101346 - DNA, 25 bp, Rattus norvegicus
actttccgtcagtgtcgtactgtat

SEQ ID NO: 101347 - DNA, 25 bp, Rattus norvegicus
actttcctaccaccgctgagtcaga

SEQ ID NO: 101348 - DNA, 25 bp, Rattus norvegicus
actttcctaccagcgctgagtcaga

SEQ ID NO: 101349 - DNA, 25 bp, Rattus norvegicus
actttcctagagctggcccttagta

SEQ ID NO: 101350 - DNA, 25 bp, Rattus norvegicus
actttcctagaggtggcccttagta

SEQ ID NO: 101351 - DNA, 25 bp, Rattus norvegicus
actttcctaggcctctgtttgtgca

SEQ ID NO: 101352 - DNA, 25 bp, Rattus norvegicus
actttcctaggcgtctgtttgtgca

SEQ ID NO: 101353 - DNA, 25 bp, Rattus norvegicus
actttcctcagcctgagaggtctaa

SEQ ID NO: 101354 - DNA, 25 bp, Rattus norvegicus
actttcctcagcgtgagaggtctaa

SEQ ID NO: 101355 - DNA, 25 bp, Rattus norvegicus
actttcctctagaccagattgcttt

SEQ ID NO: 101356 - DNA, 25 bp, Rattus norvegicus
actttcctctagtccagattgcttt

SEQ ID NO: 101357 - DNA, 25 bp, Rattus norvegicus
actttcctggacatgacttgtctgc

SEQ ID NO: 101358 - DNA, 25 bp, Rattus norvegicus
actttcctggacttgacttgtctgc

SEQ ID NO: 101359 - DNA, 25 bp, Rattus norvegicus
actttcctgggtcctgctgacagta

SEQ ID NO: 101360 - DNA, 25 bp, Rattus norvegicus
actttcctgggtgctgctgacagta

SEQ ID NO: 101361 - DNA, 25 bp, Rattus norvegicus
actttcctggtcacctagtggatgt

SEQ ID NO: 101362 - DNA, 25 bp, Rattus norvegicus
actttcctggtctcctagtggatgt

SEQ ID NO: 101363 - DNA, 25 bp, Rattus norvegicus
actttcctgtacagcctgtgcagag

SEQ ID NO: 101364 - DNA, 25 bp, Rattus norvegicus
actttcctgtactgcctgtgcagag

SEQ ID NO: 101365 - DNA, 25 bp, Rattus norvegicus
actttccttctgagccattatctaa

SEQ ID NO: 101366 - DNA, 25 bp, Rattus norvegicus
actttccttctgtgccattatctaa

SEQ ID NO: 101367 - DNA, 25 bp, Rattus norvegicus
actttccttgacagttccagcaaag

SEQ ID NO: 101368 - DNA, 25 bp, Rattus norvegicus
actttccttgactgttccagcaaag

SEQ ID NO: 101369 - DNA, 25 bp, Rattus norvegicus
actttcctttcgctgggcgagctga

SEQ ID NO: 101370 - DNA, 25 bp, Rattus norvegicus
actttcctttcggtgggcgagctga

SEQ ID NO: 101371 - DNA, 25 bp, Rattus norvegicus
actttcgaacatatgccatctcttg

SEQ ID NO: 101372 - DNA, 25 bp, Rattus norvegicus
actttcgaacatttgccatctcttg

SEQ ID NO: 101373 - DNA, 25 bp, Rattus norvegicus
actttcgatatgattttccactaca

SEQ ID NO: 101374 - DNA, 25 bp, Rattus norvegicus
actttcgatatgtttttccactaca

SEQ ID NO: 101375 - DNA, 25 bp, Rattus norvegicus
actttcggcgttatctttgtgatct

SEQ ID NO: 101376 - DNA, 25 bp, Rattus norvegicus
actttcggcgttttctttgtgatct

SEQ ID NO: 101377 - DNA, 25 bp, Rattus norvegicus
actttctaccagagtaactgtgatg

SEQ ID NO: 101378 - DNA, 25 bp, Rattus norvegicus
actttctaccagtgtaactgtgatg

SEQ ID NO: 101379 - DNA, 25 bp, Rattus norvegicus
actttctagcatagttggactccga

SEQ ID NO: 101380 - DNA, 25 bp, Rattus norvegicus
actttctagcattgttggactccga

SEQ ID NO: 101381 - DNA, 25 bp, Rattus norvegicus
actttctaggacaagcacggcttct

SEQ ID NO: 101382 - DNA, 25 bp, Rattus norvegicus
actttctaggactagcacggcttct

SEQ ID NO: 101383 - DNA, 25 bp, Rattus norvegicus
actttctaggtaatgtggctgtgca

SEQ ID NO: 101384 - DNA, 25 bp, Rattus norvegicus
actttctaggtattgtggctgtgca

SEQ ID NO: 101385 - DNA, 25 bp, Rattus norvegicus
actttctatggaacacagtggctca

SEQ ID NO: 101386 - DNA, 25 bp, Rattus norvegicus
actttctatggatcacagtggctca

SEQ ID NO: 101387 - DNA, 25 bp, Rattus norvegicus
actttctcaatacctcattccagag

SEQ ID NO: 101388 - DNA, 25 bp, Rattus norvegicus
actttctcaatagctcattccagag

SEQ ID NO: 101389 - DNA, 25 bp, Rattus norvegicus
actttctcagtgcaacttcaggtct

SEQ ID NO: 101390 - DNA, 25 bp, Rattus norvegicus
actttctcagtggaacttcaggtct

SEQ ID NO: 101391 - DNA, 25 bp, Rattus norvegicus
actttctcatagctttctgctgtta

SEQ ID NO: 101392 - DNA, 25 bp, Rattus norvegicus
actttctcataggtttctgctgtta

SEQ ID NO: 101393 - DNA, 25 bp, Rattus norvegicus
actttctccaacaatcatcagcggt

SEQ ID NO: 101394 - DNA, 25 bp, Rattus norvegicus
actttctccaactatcatcagcggt

SEQ ID NO: 101395 - DNA, 25 bp, Rattus norvegicus
actttctccacaacgtcttcattct

SEQ ID NO: 101396 - DNA, 25 bp, Rattus norvegicus
actttctccacatcgtcttcattct

SEQ ID NO: 101397 - DNA, 25 bp, Rattus norvegicus
actttctccacgctgctgcagatgg

SEQ ID NO: 101398 - DNA, 25 bp, Rattus norvegicus
actttctccacggtgctgcagatgg

SEQ ID NO: 101399 - DNA, 25 bp, Rattus norvegicus
actttctccctacctattcattata

SEQ ID NO: 101400 - DNA, 25 bp, Rattus norvegicus
actttctccctagctattcattata

SEQ ID NO: 101401 - DNA, 25 bp, Rattus norvegicus
actttctcctttaatgcagtctggg

SEQ ID NO: 101402 - DNA, 25 bp, Rattus norvegicus
actttctccttttatgcagtctggg

SEQ ID NO: 101403 - DNA, 25 bp, Rattus norvegicus
actttctcgtttctattggcagcac

SEQ ID NO: 101404 - DNA, 25 bp, Rattus norvegicus
actttctcgtttgtattggcagcac

SEQ ID NO: 101405 - DNA, 25 bp, Rattus norvegicus
actttctctactcagtggcaagcac

SEQ ID NO: 101406 - DNA, 25 bp, Rattus norvegicus
actttctctactcatctctttgtgt

SEQ ID NO: 101407 - DNA, 25 bp, Rattus norvegicus
actttctctactgagtggcaagcac

SEQ ID NO: 101408 - DNA, 25 bp, Rattus norvegicus
actttctctactgatctctttgtgt

SEQ ID NO: 101409 - DNA, 25 bp, Rattus norvegicus
actttctctcttctttgcatcggtt

SEQ ID NO: 101410 - DNA, 25 bp, Rattus norvegicus
actttctctcttgtttgcatcggtt

SEQ ID NO: 101411 - DNA, 25 bp, Rattus norvegicus
actttctctggacaagctcaggttt

SEQ ID NO: 101412 - DNA, 25 bp, Rattus norvegicus
actttctctggagaagctcaggttt

SEQ ID NO: 101413 - DNA, 25 bp, Rattus norvegicus
actttctctgtgctctttgtgagta

SEQ ID NO: 101414 - DNA, 25 bp, Rattus norvegicus
actttctctgtggtctttgtgagta

SEQ ID NO: 101415 - DNA, 25 bp, Rattus norvegicus
actttctcttaaccactggtggtct

SEQ ID NO: 101416 - DNA, 25 bp, Rattus norvegicus
actttctcttaagcactggtggtct

SEQ ID NO: 101417 - DNA, 25 bp, Rattus norvegicus
actttctcttgcatgtggaaacccg

SEQ ID NO: 101418 - DNA, 25 bp, Rattus norvegicus
actttctcttgcttgtggaaacccg

SEQ ID NO: 101419 - DNA, 25 bp, Rattus norvegicus
actttctctttaaatctgcttctct

SEQ ID NO: 101420 - DNA, 25 bp, Rattus norvegicus
actttctctttatatctgcttctct

SEQ ID NO: 101421 - DNA, 25 bp, Rattus norvegicus
actttctctttgaacatattcgtgc

SEQ ID NO: 101422 - DNA, 25 bp, Rattus norvegicus
actttctctttgtacatattcgtgc

SEQ ID NO: 101423 - DNA, 25 bp, Rattus norvegicus
actttctgaaaacccaacattctgc

SEQ ID NO: 101424 - DNA, 25 bp, Rattus norvegicus
actttctgaaaagccaacattctgc

SEQ ID NO: 101425 - DNA, 25 bp, Rattus norvegicus
actttctgcaagactttgttattga

SEQ ID NO: 101426 - DNA, 25 bp, Rattus norvegicus
actttctgcaagtctttgttattga

SEQ ID NO: 101427 - DNA, 25 bp, Rattus norvegicus
actttctgcgggagcctcccaggaa

SEQ ID NO: 101428 - DNA, 25 bp, Rattus norvegicus
actttctgcgggattgaagccctca

SEQ ID NO: 101429 - DNA, 25 bp, Rattus norvegicus
actttctgcgggtgcctcccaggaa

SEQ ID NO: 101430 - DNA, 25 bp, Rattus norvegicus
actttctgcgggtttgaagccctca

SEQ ID NO: 101431 - DNA, 25 bp, Rattus norvegicus
actttctgctgcatgagttgcctga

SEQ ID NO: 101432 - DNA, 25 bp, Rattus norvegicus
actttctgctgcttgagttgcctga

SEQ ID NO: 101433 - DNA, 25 bp, Rattus norvegicus
actttctgctggagatcatgtctta

SEQ ID NO: 101434 - DNA, 25 bp, Rattus norvegicus
actttctgctggtgatcatgtctta

SEQ ID NO: 101435 - DNA, 25 bp, Rattus norvegicus
actttctgctgtcacagtcggtgga

SEQ ID NO: 101436 - DNA, 25 bp, Rattus norvegicus
actttctgctgtgacagtcggtgga

SEQ ID NO: 101437 - DNA, 25 bp, Rattus norvegicus
actttctggaggctgacgacttgct

SEQ ID NO: 101438 - DNA, 25 bp, Rattus norvegicus
actttctggagggtgacgacttgct

SEQ ID NO: 101439 - DNA, 25 bp, Rattus norvegicus
actttctggttacatctgaggctgc

SEQ ID NO: 101440 - DNA, 25 bp, Rattus norvegicus
actttctggttagatctgaggctgc

SEQ ID NO: 101441 - DNA, 25 bp, Rattus norvegicus
actttctgttaaatcatccctggtg

SEQ ID NO: 101442 - DNA, 25 bp, Rattus norvegicus
actttctgttaattcatccctggtg

SEQ ID NO: 101443 - DNA, 25 bp, Rattus norvegicus
actttctgttctaatcacttggtct

SEQ ID NO: 101444 - DNA, 25 bp, Rattus norvegicus
actttctgttcttatcacttggtct

SEQ ID NO: 101445 - DNA, 25 bp, Rattus norvegicus
actttcttactgaagcgtcagtctg

SEQ ID NO: 101446 - DNA, 25 bp, Rattus norvegicus
actttcttactgtagcgtcagtctg

SEQ ID NO: 101447 - DNA, 25 bp, Rattus norvegicus
actttcttagttatgatggccttga

SEQ ID NO: 101448 - DNA, 25 bp, Rattus norvegicus
actttcttagttttgatggccttga

SEQ ID NO: 101449 - DNA, 25 bp, Rattus norvegicus
actttcttatatagcttccctaacg

SEQ ID NO: 101450 - DNA, 25 bp, Rattus norvegicus
actttcttatattgcttccctaacg

SEQ ID NO: 101451 - DNA, 25 bp, Rattus norvegicus
actttcttcaagacctgagcctgga

SEQ ID NO: 101452 - DNA, 25 bp, Rattus norvegicus
actttcttcaagtcctgagcctgga

SEQ ID NO: 101453 - DNA, 25 bp, Rattus norvegicus
actttcttgcctaaaccacgtatgg

SEQ ID NO: 101454 - DNA, 25 bp, Rattus norvegicus
actttcttgccttaaccacgtatgg

SEQ ID NO: 101455 - DNA, 25 bp, Rattus norvegicus
actttcttgtgcagttatttaccat

SEQ ID NO: 101456 - DNA, 25 bp, Rattus norvegicus
actttcttgtgctgttatttaccat

SEQ ID NO: 101457 - DNA, 25 bp, Rattus norvegicus
actttctttcatctctttcttattg

SEQ ID NO: 101458 - DNA, 25 bp, Rattus norvegicus
actttctttcatgtctttcttattg

SEQ ID NO: 101459 - DNA, 25 bp, Rattus norvegicus
actttctttcgcactgcattcaaag

SEQ ID NO: 101460 - DNA, 25 bp, Rattus norvegicus
actttctttcgctctgcattcaaag

SEQ ID NO: 101461 - DNA, 25 bp, Rattus norvegicus
actttctttgcaaccagagaggcag

SEQ ID NO: 101462 - DNA, 25 bp, Rattus norvegicus
actttctttgcatccagagaggcag

SEQ ID NO: 101463 - DNA, 25 bp, Rattus norvegicus
actttcttttccattgtcacaggag

SEQ ID NO: 101464 - DNA, 25 bp, Rattus norvegicus
actttcttttcctttgtcacaggag

SEQ ID NO: 101465 - DNA, 25 bp, Rattus norvegicus
actttgaacctgaattacatttggg

SEQ ID NO: 101466 - DNA, 25 bp, Rattus norvegicus
actttgaacctgtattacatttggg

SEQ ID NO: 101467 - DNA, 25 bp, Rattus norvegicus
actttgaagaagctggtggccgcca

SEQ ID NO: 101468 - DNA, 25 bp, Rattus norvegicus
actttgaagaaggtggtggccgcca

SEQ ID NO: 101469 - DNA, 25 bp, Rattus norvegicus
actttgaaggccaatgctagaccca

SEQ ID NO: 101470 - DNA, 25 bp, Rattus norvegicus
actttgaaggcctatgctagaccca

SEQ ID NO: 101471 - DNA, 25 bp, Rattus norvegicus
actttgaattaactgcactccttga

SEQ ID NO: 101472 - DNA, 25 bp, Rattus norvegicus
actttgaattaagtgcactccttga

SEQ ID NO: 101473 - DNA, 25 bp, Rattus norvegicus
actttgacaagtcaggccctaacca

SEQ ID NO: 101474 - DNA, 25 bp, Rattus norvegicus
actttgacaagtgaggccctaacca

SEQ ID NO: 101475 - DNA, 25 bp, Rattus norvegicus
actttgaccaagacgctggtgctgg

SEQ ID NO: 101476 - DNA, 25 bp, Rattus norvegicus
actttgaccaagtcgctggtgctgg

SEQ ID NO: 101477 - DNA, 25 bp, Rattus norvegicus
actttgacgatcagttactgtttga

SEQ ID NO: 101478 - DNA, 25 bp, Rattus norvegicus
actttgacgatctgttactgtttga

SEQ ID NO: 101479 - DNA, 25 bp, Rattus norvegicus
actttgactactatctacagaggag

SEQ ID NO: 101480 - DNA, 25 bp, Rattus norvegicus
actttgactactttctacagaggag

SEQ ID NO: 101481 - DNA, 25 bp, Rattus norvegicus
actttgagacctaaccagactgtgt

SEQ ID NO: 101482 - DNA, 25 bp, Rattus norvegicus
actttgagaccttaccagactgtgt

SEQ ID NO: 101483 - DNA, 25 bp, Rattus norvegicus
actttgagcctcacccgaatgggat

SEQ ID NO: 101484 - DNA, 25 bp, Rattus norvegicus
actttgagcctctcccgaatgggat

SEQ ID NO: 101485 - DNA, 25 bp, Rattus norvegicus
actttgagctgaagtaaacgtgttc

SEQ ID NO: 101486 - DNA, 25 bp, Rattus norvegicus
actttgagctgatgtaaacgtgttc

SEQ ID NO: 101487 - DNA, 25 bp, Rattus norvegicus
actttgagggctaggctggcccaaa

SEQ ID NO: 101488 - DNA, 25 bp, Rattus norvegicus
actttgagggcttggctggcccaaa

SEQ ID NO: 101489 - DNA, 25 bp, Rattus norvegicus
actttgatccacatgggtacccatc

SEQ ID NO: 101490 - DNA, 25 bp, Rattus norvegicus
actttgatccacttgggtacccatc

SEQ ID NO: 101491 - DNA, 25 bp, Rattus norvegicus
actttgatgcgtatctgtttctgga

SEQ ID NO: 101492 - DNA, 25 bp, Rattus norvegicus
actttgatgcgtttctgtttctgga

SEQ ID NO: 101493 - DNA, 25 bp, Rattus norvegicus
actttgattcatcgccacagggaca

SEQ ID NO: 101494 - DNA, 25 bp, Rattus norvegicus
actttgattcatggccacagggaca

SEQ ID NO: 101495 - DNA, 25 bp, Rattus norvegicus
actttgcaaatccaccctgggagga

SEQ ID NO: 101496 - DNA, 25 bp, Rattus norvegicus
actttgcaaatcgaccctgggagga

SEQ ID NO: 101497 - DNA, 25 bp, Rattus norvegicus
actttgcacaaaaatgggatcccca

SEQ ID NO: 101498 - DNA, 25 bp, Rattus norvegicus
actttgcacaaatatgggatcccca

SEQ ID NO: 101499 - DNA, 25 bp, Rattus norvegicus
actttgcagcgtcaagttgcctcaa

SEQ ID NO: 101500 - DNA, 25 bp, Rattus norvegicus
actttgcagcgtgaagttgcctcaa

SEQ ID NO: 101501 - DNA, 25 bp, Rattus norvegicus
actttgcagtatacgtgtgtttttt

SEQ ID NO: 101502 - DNA, 25 bp, Rattus norvegicus
actttgcagtattcgtgtgtttttt

SEQ ID NO: 101503 - DNA, 25 bp, Rattus norvegicus
actttgcagtttatgtgacccacag

SEQ ID NO: 101504 - DNA, 25 bp, Rattus norvegicus
actttgcagtttttgtgacccacag

SEQ ID NO: 101505 - DNA, 25 bp, Rattus norvegicus
actttgcatccactctgaagctaaa

SEQ ID NO: 101506 - DNA, 25 bp, Rattus norvegicus
actttgcatccagtctgaagctaaa

SEQ ID NO: 101507 - DNA, 25 bp, Rattus norvegicus
actttgcatgcaactactgaggaaa

SEQ ID NO: 101508 - DNA, 25 bp, Rattus norvegicus
actttgcatgcatctactgaggaaa

SEQ ID NO: 101509 - DNA, 25 bp, Rattus norvegicus
actttgccagcaaactgcattcatt

SEQ ID NO: 101510 - DNA, 25 bp, Rattus norvegicus
actttgccagcatactgcattcatt

SEQ ID NO: 101511 - DNA, 25 bp, Rattus norvegicus
actttgccatgaatcactttagtga

SEQ ID NO: 101512 - DNA, 25 bp, Rattus norvegicus
actttgccatgattcactttagtga

SEQ ID NO: 101513 - DNA, 25 bp, Rattus norvegicus
actttgccattgaccctgaaggtct

SEQ ID NO: 101514 - DNA, 25 bp, Rattus norvegicus
actttgccattgtccctgaaggtct

SEQ ID NO: 101515 - DNA, 25 bp, Rattus norvegicus
actttgccctgcctgtcagtcgcat

SEQ ID NO: 101516 - DNA, 25 bp, Rattus norvegicus
actttgccctgcgtgtcagtcgcat

SEQ ID NO: 101517 - DNA, 25 bp, Rattus norvegicus
actttgcccttcagagttgttctaa

SEQ ID NO: 101518 - DNA, 25 bp, Rattus norvegicus
actttgcccttctgagttgttctaa

SEQ ID NO: 101519 - DNA, 25 bp, Rattus norvegicus
actttgcctgctattcacttagtct

SEQ ID NO: 101520 - DNA, 25 bp, Rattus norvegicus
actttgcctgcttttcacttagtct

SEQ ID NO: 101521 - DNA, 25 bp, Rattus norvegicus
actttgcctggacggagggtctcca

SEQ ID NO: 101522 - DNA, 25 bp, Rattus norvegicus
actttgcctggagggagggtctcca

SEQ ID NO: 101523 - DNA, 25 bp, Rattus norvegicus
actttgcctttcaccatagttagga

SEQ ID NO: 101524 - DNA, 25 bp, Rattus norvegicus
actttgcctttctccatagttagga

SEQ ID NO: 101525 - DNA, 25 bp, Rattus norvegicus
actttgcgccatcctgaaactgtac

SEQ ID NO: 101526 - DNA, 25 bp, Rattus norvegicus
actttgcgccatgctgaaactgtac

SEQ ID NO: 101527 - DNA, 25 bp, Rattus norvegicus
actttgcgtaacacagggtgagcca

SEQ ID NO: 101528 - DNA, 25 bp, Rattus norvegicus
actttgcgtaactcagggtgagcca

SEQ ID NO: 101529 - DNA, 25 bp, Rattus norvegicus
actttgctctagattgtgctgtata

SEQ ID NO: 101530 - DNA, 25 bp, Rattus norvegicus
actttgctctagtttgtgctgtata

SEQ ID NO: 101531 - DNA, 25 bp, Rattus norvegicus
actttgctcttcaattctccaggct

SEQ ID NO: 101532 - DNA, 25 bp, Rattus norvegicus
actttgctcttcagagcgtgagtat

SEQ ID NO: 101533 - DNA, 25 bp, Rattus norvegicus
actttgctcttctattctccaggct

SEQ ID NO: 101534 - DNA, 25 bp, Rattus norvegicus
actttgctcttctgagcgtgagtat

SEQ ID NO: 101535 - DNA, 25 bp, Rattus norvegicus
actttgctgcatcacttctggaatg

SEQ ID NO: 101536 - DNA, 25 bp, Rattus norvegicus
actttgctgcatgacttctggaatg

SEQ ID NO: 101537 - DNA, 25 bp, Rattus norvegicus
actttgctgcctatgaagagcccaa

SEQ ID NO: 101538 - DNA, 25 bp, Rattus norvegicus
actttgctgcctttgaagagcccaa

SEQ ID NO: 101539 - DNA, 25 bp, Rattus norvegicus
actttgctgctgaaatgctgcctct

SEQ ID NO: 101540 - DNA, 25 bp, Rattus norvegicus
actttgctgctgcagggccttgcaa

SEQ ID NO: 101541 - DNA, 25 bp, Rattus norvegicus
actttgctgctggagggccttgcaa

SEQ ID NO: 101542 - DNA, 25 bp, Rattus norvegicus
actttgctgctgtaatgctgcctct

SEQ ID NO: 101543 - DNA, 25 bp, Rattus norvegicus
actttgctgtgcaccacgatgagga

SEQ ID NO: 101544 - DNA, 25 bp, Rattus norvegicus
actttgctgtgctccacgatgagga

SEQ ID NO: 101545 - DNA, 25 bp, Rattus norvegicus
actttgcttagaagtccctggataa

SEQ ID NO: 101546 - DNA, 25 bp, Rattus norvegicus
actttgcttagatgtccctggataa

SEQ ID NO: 101547 - DNA, 25 bp, Rattus norvegicus
actttgcttgaaattgttccttcca

SEQ ID NO: 101548 - DNA, 25 bp, Rattus norvegicus
actttgcttgaatttgttccttcca

SEQ ID NO: 101549 - DNA, 25 bp, Rattus norvegicus
actttggaagacacagagcacactg

SEQ ID NO: 101550 - DNA, 25 bp, Rattus norvegicus
actttggaagactcagagcacactg

SEQ ID NO: 101551 - DNA, 25 bp, Rattus norvegicus
actttggaaggcaagttcctgcttt

SEQ ID NO: 101552 - DNA, 25 bp, Rattus norvegicus
actttggaaggctagttcctgcttt

SEQ ID NO: 101553 - DNA, 25 bp, Rattus norvegicus
actttggaccccaatactgtgatat

SEQ ID NO: 101554 - DNA, 25 bp, Rattus norvegicus
actttggacccctatactgtgatat

SEQ ID NO: 101555 - DNA, 25 bp, Rattus norvegicus
actttggacttgaaccctctcgaat

SEQ ID NO: 101556 - DNA, 25 bp, Rattus norvegicus
actttggacttgtaccctctcgaat

SEQ ID NO: 101557 - DNA, 25 bp, Rattus norvegicus
actttggagagaacacctgctgagg

SEQ ID NO: 101558 - DNA, 25 bp, Rattus norvegicus
actttggagagatcacctgctgagg

SEQ ID NO: 101559 - DNA, 25 bp, Rattus norvegicus
actttggaggacactgatgggaccc

SEQ ID NO: 101560 - DNA, 25 bp, Rattus norvegicus
actttggaggactctgatgggaccc

SEQ ID NO: 101561 - DNA, 25 bp, Rattus norvegicus
actttggcagccaggagcagtgata

SEQ ID NO: 101562 - DNA, 25 bp, Rattus norvegicus
actttggcagcctggagcagtgata

SEQ ID NO: 101563 - DNA, 25 bp, Rattus norvegicus
actttggcatcgaggaagggctcat

SEQ ID NO: 101564 - DNA, 25 bp, Rattus norvegicus
actttggcatcgtggaagggctcat

SEQ ID NO: 101565 - DNA, 25 bp, Rattus norvegicus
actttggcccatacctttgataaat

SEQ ID NO: 101566 - DNA, 25 bp, Rattus norvegicus
actttggcccatacgctcgtatagg

SEQ ID NO: 101567 - DNA, 25 bp, Rattus norvegicus
actttggcccattcctttgataaat

SEQ ID NO: 101568 - DNA, 25 bp, Rattus norvegicus
actttggcccattcgctcgtatagg

SEQ ID NO: 101569 - DNA, 25 bp, Rattus norvegicus
actttggccgtgacagacgtggcag

SEQ ID NO: 101570 - DNA, 25 bp, Rattus norvegicus
actttggccgtgtcagacgtggcag

SEQ ID NO: 101571 - DNA, 25 bp, Rattus norvegicus
actttggcctctctaggaacatcta

SEQ ID NO: 101572 - DNA, 25 bp, Rattus norvegicus
actttggcctctgtaggaacatcta

SEQ ID NO: 101573 - DNA, 25 bp, Rattus norvegicus
actttggctatacttatgtgtgact

SEQ ID NO: 101574 - DNA, 25 bp, Rattus norvegicus
actttggctatagttatgtgtgact

SEQ ID NO: 101575 - DNA, 25 bp, Rattus norvegicus
actttggctccactcaatgttaggg

SEQ ID NO: 101576 - DNA, 25 bp, Rattus norvegicus
actttggctccagtcaatgttaggg

SEQ ID NO: 101577 - DNA, 25 bp, Rattus norvegicus
actttggctgcaccattggtctgaa

SEQ ID NO: 101578 - DNA, 25 bp, Rattus norvegicus
actttggctgcagcattggtctgaa

SEQ ID NO: 101579 - DNA, 25 bp, Rattus norvegicus
actttgggaaatactggctttggca

SEQ ID NO: 101580 - DNA, 25 bp, Rattus norvegicus
actttgggaaattctggctttggca

SEQ ID NO: 101581 - DNA, 25 bp, Rattus norvegicus
actttgggccagagggatgtgcttt

SEQ ID NO: 101582 - DNA, 25 bp, Rattus norvegicus
actttgggccagtgggatgtgcttt

SEQ ID NO: 101583 - DNA, 25 bp, Rattus norvegicus
actttgggtctacagcagttgcaac

SEQ ID NO: 101584 - DNA, 25 bp, Rattus norvegicus
actttgggtctagagcagttgcaac

SEQ ID NO: 101585 - DNA, 25 bp, Rattus norvegicus
actttggtacggaggtgctttgcaa

SEQ ID NO: 101586 - DNA, 25 bp, Rattus norvegicus
actttggtacggtggtgctttgcaa

SEQ ID NO: 101587 - DNA, 25 bp, Rattus norvegicus
actttggtactcagcgctttctgta

SEQ ID NO: 101588 - DNA, 25 bp, Rattus norvegicus
actttggtactctgcgctttctgta

SEQ ID NO: 101589 - DNA, 25 bp, Rattus norvegicus
actttggtcccaagatgtgaaggaa

SEQ ID NO: 101590 - DNA, 25 bp, Rattus norvegicus
actttggtcccatgatgtgaaggaa

SEQ ID NO: 101591 - DNA, 25 bp, Rattus norvegicus
actttggtgcatatgattcttgggt

SEQ ID NO: 101592 - DNA, 25 bp, Rattus norvegicus
actttggtgcatttgattcttgggt

SEQ ID NO: 101593 - DNA, 25 bp, Rattus norvegicus
actttggtggccagactgtggcctg

SEQ ID NO: 101594 - DNA, 25 bp, Rattus norvegicus
actttggtggcctgactgtggcctg

SEQ ID NO: 101595 - DNA, 25 bp, Rattus norvegicus
actttggtggctaaggctagccggt

SEQ ID NO: 101596 - DNA, 25 bp, Rattus norvegicus
actttggtggcttaggctagccggt

SEQ ID NO: 101597 - DNA, 25 bp, Rattus norvegicus
actttggtgggcaggacagctcatc

SEQ ID NO: 101598 - DNA, 25 bp, Rattus norvegicus
actttggtgggctggacagctcatc

SEQ ID NO: 101599 - DNA, 25 bp, Rattus norvegicus
actttggtgtgtctcagctgtgtta

SEQ ID NO: 101600 - DNA, 25 bp, Rattus norvegicus
actttggtgtgtgtcagctgtgtta

SEQ ID NO: 101601 - DNA, 25 bp, Rattus norvegicus
actttggttatgactgcatttctgc

SEQ ID NO: 101602 - DNA, 25 bp, Rattus norvegicus
actttggttatgtctgcatttctgc

SEQ ID NO: 101603 - DNA, 25 bp, Rattus norvegicus
actttggttgctacagactttatat

SEQ ID NO: 101604 - DNA, 25 bp, Rattus norvegicus
actttggttgcttcagactttatat

SEQ ID NO: 101605 - DNA, 25 bp, Rattus norvegicus
actttggtttgtcctgtatgttgga

SEQ ID NO: 101606 - DNA, 25 bp, Rattus norvegicus
actttggtttgtgctgtatgttgga

SEQ ID NO: 101607 - DNA, 25 bp, Rattus norvegicus
actttgtacctgagctcatcggctc

SEQ ID NO: 101608 - DNA, 25 bp, Rattus norvegicus
actttgtacctgtgctcatcggctc

SEQ ID NO: 101609 - DNA, 25 bp, Rattus norvegicus
actttgtaccttagctcatctgcta

SEQ ID NO: 101610 - DNA, 25 bp, Rattus norvegicus
actttgtacctttgctcatctgcta

SEQ ID NO: 101611 - DNA, 25 bp, Rattus norvegicus
actttgtactcaccacggagcactg

SEQ ID NO: 101612 - DNA, 25 bp, Rattus norvegicus
actttgtactcagcacggagcactg

SEQ ID NO: 101613 - DNA, 25 bp, Rattus norvegicus
actttgtagaagctggttggtgtat

SEQ ID NO: 101614 - DNA, 25 bp, Rattus norvegicus
actttgtagaaggtggttggtgtat

SEQ ID NO: 101615 - DNA, 25 bp, Rattus norvegicus
actttgtagcaaccaagaccctgtg

SEQ ID NO: 101616 - DNA, 25 bp, Rattus norvegicus
actttgtagcaagcaagaccctgtg

SEQ ID NO: 101617 - DNA, 25 bp, Rattus norvegicus
actttgtagccgaggctagcctgaa

SEQ ID NO: 101618 - DNA, 25 bp, Rattus norvegicus
actttgtagccgtggctagcctgaa

SEQ ID NO: 101619 - DNA, 25 bp, Rattus norvegicus
actttgtagtgtatgctggtcccaa

SEQ ID NO: 101620 - DNA, 25 bp, Rattus norvegicus
actttgtagtgtttgctggtcccaa

SEQ ID NO: 101621 - DNA, 25 bp, Rattus norvegicus
actttgtagtttagactgtcctgga

SEQ ID NO: 101622 - DNA, 25 bp, Rattus norvegicus
actttgtagttttgactgtcctgga

SEQ ID NO: 101623 - DNA, 25 bp, Rattus norvegicus
actttgtatattactggtctgcagg

SEQ ID NO: 101624 - DNA, 25 bp, Rattus norvegicus
actttgtatattaggaactgctgta

SEQ ID NO: 101625 - DNA, 25 bp, Rattus norvegicus
actttgtatatttctggtctgcagg

SEQ ID NO: 101626 - DNA, 25 bp, Rattus norvegicus
actttgtatatttggaactgctgta

SEQ ID NO: 101627 - DNA, 25 bp, Rattus norvegicus
actttgtatggcctcagttcatcac

SEQ ID NO: 101628 - DNA, 25 bp, Rattus norvegicus
actttgtatggcgtcagttcatcac

SEQ ID NO: 101629 - DNA, 25 bp, Rattus norvegicus
actttgtcagaacttaccgcctcac

SEQ ID NO: 101630 - DNA, 25 bp, Rattus norvegicus
actttgtcagaagttaccgcctcac

SEQ ID NO: 101631 - DNA, 25 bp, Rattus norvegicus
actttgtccatgaccattcctggtc

SEQ ID NO: 101632 - DNA, 25 bp, Rattus norvegicus
actttgtccatgtccattcctggtc

SEQ ID NO: 101633 - DNA, 25 bp, Rattus norvegicus
actttgtcctgtactaggtcacttt

SEQ ID NO: 101634 - DNA, 25 bp, Rattus norvegicus
actttgtcctgttctaggtcacttt

SEQ ID NO: 101635 - DNA, 25 bp, Rattus norvegicus
actttgtctctcattctgtattata

SEQ ID NO: 101636 - DNA, 25 bp, Rattus norvegicus
actttgtctctctttctgtattata

SEQ ID NO: 101637 - DNA, 25 bp, Rattus norvegicus
actttgtgactgcatgtctctctgc

SEQ ID NO: 101638 - DNA, 25 bp, Rattus norvegicus
actttgtgactggatgtctctctgc

SEQ ID NO: 101639 - DNA, 25 bp, Rattus norvegicus
actttgtgcctgaacagtgccgtga

SEQ ID NO: 101640 - DNA, 25 bp, Rattus norvegicus
actttgtgcctgtacagtgccgtga

SEQ ID NO: 101641 - DNA, 25 bp, Rattus norvegicus
actttgtgcgctacgaatgtggaga

SEQ ID NO: 101642 - DNA, 25 bp, Rattus norvegicus
actttgtgcgcttcgaatgtggaga

SEQ ID NO: 101643 - DNA, 25 bp, Rattus norvegicus
actttgtgcggaacgattcactgcc

SEQ ID NO: 101644 - DNA, 25 bp, Rattus norvegicus
actttgtgcggatcgattcactgcc

SEQ ID NO: 101645 - DNA, 25 bp, Rattus norvegicus
actttgtggcctctagatgccagca

SEQ ID NO: 101646 - DNA, 25 bp, Rattus norvegicus
actttgtggcctgtagatgccagca

SEQ ID NO: 101647 - DNA, 25 bp, Rattus norvegicus
actttgtgtcacaagctgcacttgg

SEQ ID NO: 101648 - DNA, 25 bp, Rattus norvegicus
actttgtgtcactagctgcacttgg

SEQ ID NO: 101649 - DNA, 25 bp, Rattus norvegicus
actttgtgtcctagtgtgaggcggt

SEQ ID NO: 101650 - DNA, 25 bp, Rattus norvegicus
actttgtgtccttgtgtgaggcggt

SEQ ID NO: 101651 - DNA, 25 bp, Rattus norvegicus
actttgtgtgctatatggatcttga

SEQ ID NO: 101652 - DNA, 25 bp, Rattus norvegicus
actttgtgtgctttatggatcttga

SEQ ID NO: 101653 - DNA, 25 bp, Rattus norvegicus
actttgtgttaacattatgccccaa

SEQ ID NO: 101654 - DNA, 25 bp, Rattus norvegicus
actttgtgttaagattatgccccaa

SEQ ID NO: 101655 - DNA, 25 bp, Rattus norvegicus
actttgttccttctctctgtagtat

SEQ ID NO: 101656 - DNA, 25 bp, Rattus norvegicus
actttgttccttgtctctgtagtat

SEQ ID NO: 101657 - DNA, 25 bp, Rattus norvegicus
actttgttgctgagcgactgcttta

SEQ ID NO: 101658 - DNA, 25 bp, Rattus norvegicus
actttgttgctgtgcgactgcttta

SEQ ID NO: 101659 - DNA, 25 bp, Rattus norvegicus
actttgttgtttctcagatctgtca

SEQ ID NO: 101660 - DNA, 25 bp, Rattus norvegicus
actttgttgtttgtcagatctgtca

SEQ ID NO: 101661 - DNA, 25 bp, Rattus norvegicus
actttgtttcctatgccagttgaag

SEQ ID NO: 101662 - DNA, 25 bp, Rattus norvegicus
actttgtttcctttgccagttgaag

SEQ ID NO: 101663 - DNA, 25 bp, Rattus norvegicus
actttgtttcttccagctgagctgt

SEQ ID NO: 101664 - DNA, 25 bp, Rattus norvegicus
actttgtttcttcgtgtcttgagga

SEQ ID NO: 101665 - DNA, 25 bp, Rattus norvegicus
actttgtttcttgcagctgagctgt

SEQ ID NO: 101666 - DNA, 25 bp, Rattus norvegicus
actttgtttcttggtgtcttgagga

SEQ ID NO: 101667 - DNA, 25 bp, Rattus norvegicus
actttgtttttacggcactgcttca

SEQ ID NO: 101668 - DNA, 25 bp, Rattus norvegicus
actttgtttttactgactgtatacg

SEQ ID NO: 101669 - DNA, 25 bp, Rattus norvegicus
actttgtttttagggcactgcttca

SEQ ID NO: 101670 - DNA, 25 bp, Rattus norvegicus
actttgtttttagtgactgtatacg

SEQ ID NO: 101671 - DNA, 25 bp, Rattus norvegicus
acttttaaaggaagtgcctcggctg

SEQ ID NO: 101672 - DNA, 25 bp, Rattus norvegicus
acttttaaaggatgtgcctcggctg

SEQ ID NO: 101673 - DNA, 25 bp, Rattus norvegicus
acttttaagcccagagcatctctcc

SEQ ID NO: 101674 - DNA, 25 bp, Rattus norvegicus
acttttaagccctgagcatctctcc

SEQ ID NO: 101675 - DNA, 25 bp, Rattus norvegicus
acttttaatcccaccactctggagg

SEQ ID NO: 101676 - DNA, 25 bp, Rattus norvegicus
acttttaatccctccactctggagg

SEQ ID NO: 101677 - DNA, 25 bp, Rattus norvegicus
acttttaccggtatatgtcactcag

SEQ ID NO: 101678 - DNA, 25 bp, Rattus norvegicus
acttttaccggtttatgtcactcag

SEQ ID NO: 101679 - DNA, 25 bp, Rattus norvegicus
acttttacctttctctctgaagcac

SEQ ID NO: 101680 - DNA, 25 bp, Rattus norvegicus
acttttacctttgtctctgaagcac

SEQ ID NO: 101681 - DNA, 25 bp, Rattus norvegicus
acttttagagttaggcatactttgc

SEQ ID NO: 101682 - DNA, 25 bp, Rattus norvegicus
acttttagagtttggcatactttgc

SEQ ID NO: 101683 - DNA, 25 bp, Rattus norvegicus
acttttagccagaggattctcctaa

SEQ ID NO: 101684 - DNA, 25 bp, Rattus norvegicus
acttttagccagtggattctcctaa

SEQ ID NO: 101685 - DNA, 25 bp, Rattus norvegicus
acttttagctctagaactgacccga

SEQ ID NO: 101686 - DNA, 25 bp, Rattus norvegicus
acttttagctcttgaactgacccga

SEQ ID NO: 101687 - DNA, 25 bp, Rattus norvegicus
acttttaggtggagctctgttttgt

SEQ ID NO: 101688 - DNA, 25 bp, Rattus norvegicus
acttttaggtggtgctctgttttgt

SEQ ID NO: 101689 - DNA, 25 bp, Rattus norvegicus
acttttatcttgaccactctagtgg

SEQ ID NO: 101690 - DNA, 25 bp, Rattus norvegicus
acttttatcttgtccactctagtgg

SEQ ID NO: 101691 - DNA, 25 bp, Rattus norvegicus
acttttatggaccacctctgtacct

SEQ ID NO: 101692 - DNA, 25 bp, Rattus norvegicus
acttttatggacgacctctgtacct

SEQ ID NO: 101693 - DNA, 25 bp, Rattus norvegicus
acttttatgtttcccgacctcaagg

SEQ ID NO: 101694 - DNA, 25 bp, Rattus norvegicus
acttttatgtttgccgacctcaagg

SEQ ID NO: 101695 - DNA, 25 bp, Rattus norvegicus
acttttattttgatagctcggacag

SEQ ID NO: 101696 - DNA, 25 bp, Rattus norvegicus
acttttattttgttagctcggacag

SEQ ID NO: 101697 - DNA, 25 bp, Rattus norvegicus
acttttcaagacatcctggttgcta

SEQ ID NO: 101698 - DNA, 25 bp, Rattus norvegicus
acttttcaagacttcctggttgcta

SEQ ID NO: 101699 - DNA, 25 bp, Rattus norvegicus
acttttcaatgcctgttttgtgctt

SEQ ID NO: 101700 - DNA, 25 bp, Rattus norvegicus
acttttcaatgcgtgttttgtgctt

SEQ ID NO: 101701 - DNA, 25 bp, Rattus norvegicus
acttttcacatacgcaggactggac

SEQ ID NO: 101702 - DNA, 25 bp, Rattus norvegicus
acttttcacataggcaggactggac

SEQ ID NO: 101703 - DNA, 25 bp, Rattus norvegicus
acttttcacgtgcttcagagtgctg

SEQ ID NO: 101704 - DNA, 25 bp, Rattus norvegicus
acttttcacgtggttcagagtgctg

SEQ ID NO: 101705 - DNA, 25 bp, Rattus norvegicus
acttttcaggagagatccccacttt

SEQ ID NO: 101706 - DNA, 25 bp, Rattus norvegicus
acttttcaggagtgatccccacttt

SEQ ID NO: 101707 - DNA, 25 bp, Rattus norvegicus
acttttcaggatattctcttcttag

SEQ ID NO: 101708 - DNA, 25 bp, Rattus norvegicus
acttttcaggattttctcttcttag

SEQ ID NO: 101709 - DNA, 25 bp, Rattus norvegicus
acttttcagtacacgtccacatgac

SEQ ID NO: 101710 - DNA, 25 bp, Rattus norvegicus
acttttcagtactcgtccacatgac

SEQ ID NO: 101711 - DNA, 25 bp, Rattus norvegicus
acttttcagtgtcaacggcagtgga

SEQ ID NO: 101712 - DNA, 25 bp, Rattus norvegicus
acttttcagtgtgaacggcagtgga

SEQ ID NO: 101713 - DNA, 25 bp, Rattus norvegicus
acttttcatttcacaactgtccttt

SEQ ID NO: 101714 - DNA, 25 bp, Rattus norvegicus
acttttcatttcagcacttctactg

SEQ ID NO: 101715 - DNA, 25 bp, Rattus norvegicus
acttttcatttctcaactgtccttt

SEQ ID NO: 101716 - DNA, 25 bp, Rattus norvegicus
acttttcatttctgcacttctactg

SEQ ID NO: 101717 - DNA, 25 bp, Rattus norvegicus
acttttccaggcaataactattgaa

SEQ ID NO: 101718 - DNA, 25 bp, Rattus norvegicus
acttttccaggctataactattgaa

SEQ ID NO: 101719 - DNA, 25 bp, Rattus norvegicus
acttttccagtcaaataagctgagg

SEQ ID NO: 101720 - DNA, 25 bp, Rattus norvegicus
acttttccagtctaataagctgagg

SEQ ID NO: 101721 - DNA, 25 bp, Rattus norvegicus
acttttcccgggagtcagacgagtg

SEQ ID NO: 101722 - DNA, 25 bp, Rattus norvegicus
acttttcccgggtgtcagacgagtg

SEQ ID NO: 101723 - DNA, 25 bp, Rattus norvegicus
acttttccgtcaatgagtccagtga

SEQ ID NO: 101724 - DNA, 25 bp, Rattus norvegicus
acttttccgtcattgagtccagtga

SEQ ID NO: 101725 - DNA, 25 bp, Rattus norvegicus
acttttcggagacccagctcaggca

SEQ ID NO: 101726 - DNA, 25 bp, Rattus norvegicus
acttttcggagagccagctcaggca

SEQ ID NO: 101727 - DNA, 25 bp, Rattus norvegicus
acttttcgtagacagtgtggctcca

SEQ ID NO: 101728 - DNA, 25 bp, Rattus norvegicus
acttttcgtagagagtgtggctcca

SEQ ID NO: 101729 - DNA, 25 bp, Rattus norvegicus
acttttctacatagcactccagaga

SEQ ID NO: 101730 - DNA, 25 bp, Rattus norvegicus
acttttctacattgcactccagaga

SEQ ID NO: 101731 - DNA, 25 bp, Rattus norvegicus
acttttctacttagctttaatgcaa

SEQ ID NO: 101732 - DNA, 25 bp, Rattus norvegicus
acttttctactttgctttaatgcaa

SEQ ID NO: 101733 - DNA, 25 bp, Rattus norvegicus
acttttctcagtcagcttttgttct

SEQ ID NO: 101734 - DNA, 25 bp, Rattus norvegicus
acttttctcagtgagcttttgttct

SEQ ID NO: 101735 - DNA, 25 bp, Rattus norvegicus
acttttctccccaggcatttagata

SEQ ID NO: 101736 - DNA, 25 bp, Rattus norvegicus
acttttctcccctggcatttagata

SEQ ID NO: 101737 - DNA, 25 bp, Rattus norvegicus
acttttctctagatgctgtctgcca

SEQ ID NO: 101738 - DNA, 25 bp, Rattus norvegicus
acttttctctagttgctgtctgcca

SEQ ID NO: 101739 - DNA, 25 bp, Rattus norvegicus
acttttcttctaacttcaagcacta

SEQ ID NO: 101740 - DNA, 25 bp, Rattus norvegicus
acttttcttctatcttcaagcacta

SEQ ID NO: 101741 - DNA, 25 bp, Rattus norvegicus
acttttctttgtcttctatctatca

SEQ ID NO: 101742 - DNA, 25 bp, Rattus norvegicus
acttttctttgtgttctatctatca

SEQ ID NO: 101743 - DNA, 25 bp, Rattus norvegicus
acttttgatcccaacactgtttgat

SEQ ID NO: 101744 - DNA, 25 bp, Rattus norvegicus
acttttgatccctacactgtttgat

SEQ ID NO: 101745 - DNA, 25 bp, Rattus norvegicus
acttttgcaaacattcaagctgtgt

SEQ ID NO: 101746 - DNA, 25 bp, Rattus norvegicus
acttttgcaaactttcaagctgtgt

SEQ ID NO: 101747 - DNA, 25 bp, Rattus norvegicus
acttttgcacttcaacggtactgta

SEQ ID NO: 101748 - DNA, 25 bp, Rattus norvegicus
acttttgcacttgaacggtactgta

SEQ ID NO: 101749 - DNA, 25 bp, Rattus norvegicus
acttttgcagatagggtaacacagg

SEQ ID NO: 101750 - DNA, 25 bp, Rattus norvegicus
acttttgcagattgggtaacacagg

SEQ ID NO: 101751 - DNA, 25 bp, Rattus norvegicus
acttttgccacacaacagcagcagg

SEQ ID NO: 101752 - DNA, 25 bp, Rattus norvegicus
acttttgccacagaacagcagcagg

SEQ ID NO: 101753 - DNA, 25 bp, Rattus norvegicus
acttttgcctttctgtcagagtctc

SEQ ID NO: 101754 - DNA, 25 bp, Rattus norvegicus
acttttgcctttgtgtcagagtctc

SEQ ID NO: 101755 - DNA, 25 bp, Rattus norvegicus
acttttgcgtggctccaggagtcaa

SEQ ID NO: 101756 - DNA, 25 bp, Rattus norvegicus
acttttgcgtgggtccaggagtcaa

SEQ ID NO: 101757 - DNA, 25 bp, Rattus norvegicus
acttttgctatgatcacgtgaccct

SEQ ID NO: 101758 - DNA, 25 bp, Rattus norvegicus
acttttgctatgttcacgtgaccct

SEQ ID NO: 101759 - DNA, 25 bp, Rattus norvegicus
acttttggaatgcagccccttggct

SEQ ID NO: 101760 - DNA, 25 bp, Rattus norvegicus
acttttggaatggagccccttggct

SEQ ID NO: 101761 - DNA, 25 bp, Rattus norvegicus
acttttggatccattctgttttgct

SEQ ID NO: 101762 - DNA, 25 bp, Rattus norvegicus
acttttggatcctttctgttttgct

SEQ ID NO: 101763 - DNA, 25 bp, Rattus norvegicus
acttttgtacatactagcagtgtct

SEQ ID NO: 101764 - DNA, 25 bp, Rattus norvegicus
acttttgtacattctagcagtgtct

SEQ ID NO: 101765 - DNA, 25 bp, Rattus norvegicus
acttttgtactcatagggatctgga

SEQ ID NO: 101766 - DNA, 25 bp, Rattus norvegicus
acttttgtactcttagggatctgga

SEQ ID NO: 101767 - DNA, 25 bp, Rattus norvegicus
acttttgtattcactgcactgttgc

SEQ ID NO: 101768 - DNA, 25 bp, Rattus norvegicus
acttttgtattctctgcactgttgc

SEQ ID NO: 101769 - DNA, 25 bp, Rattus norvegicus
acttttgtcagcctttataccctgg

SEQ ID NO: 101770 - DNA, 25 bp, Rattus norvegicus
acttttgtcagcgtttataccctgg

SEQ ID NO: 101771 - DNA, 25 bp, Rattus norvegicus
acttttgtgaaaaccgccctgctgt

SEQ ID NO: 101772 - DNA, 25 bp, Rattus norvegicus
acttttgtgaaatccgccctgctgt

SEQ ID NO: 101773 - DNA, 25 bp, Rattus norvegicus
acttttgtgctccagaaaattttct

SEQ ID NO: 101774 - DNA, 25 bp, Rattus norvegicus
acttttgtgctcgagaaaattttct

SEQ ID NO: 101775 - DNA, 25 bp, Rattus norvegicus
acttttgtgtttccatttcagctcc

SEQ ID NO: 101776 - DNA, 25 bp, Rattus norvegicus
acttttgtgtttgcatttcagctcc

SEQ ID NO: 101777 - DNA, 25 bp, Rattus norvegicus
acttttgttttgctactatgcactc

SEQ ID NO: 101778 - DNA, 25 bp, Rattus norvegicus
acttttgttttggtactatgcactc

SEQ ID NO: 101779 - DNA, 25 bp, Rattus norvegicus
actttttagggccaggccatgggca

SEQ ID NO: 101780 - DNA, 25 bp, Rattus norvegicus
actttttagggcgaggccatgggca

SEQ ID NO: 101781 - DNA, 25 bp, Rattus norvegicus
actttttatactctgtctcgtctcg

SEQ ID NO: 101782 - DNA, 25 bp, Rattus norvegicus
actttttatactgtgtctcgtctcg

SEQ ID NO: 101783 - DNA, 25 bp, Rattus norvegicus
actttttatgtcctgggcatgctac

SEQ ID NO: 101784 - DNA, 25 bp, Rattus norvegicus
actttttatgtcgtgggcatgctac

SEQ ID NO: 101785 - DNA, 25 bp, Rattus norvegicus
actttttattgccttctcaccagct

SEQ ID NO: 101786 - DNA, 25 bp, Rattus norvegicus
actttttattgcgttctcaccagct

SEQ ID NO: 101787 - DNA, 25 bp, Rattus norvegicus
actttttcaaggactttcactgtag

SEQ ID NO: 101788 - DNA, 25 bp, Rattus norvegicus
actttttcaaggtctttcactgtag

SEQ ID NO: 101789 - DNA, 25 bp, Rattus norvegicus
actttttccctgctgagaacctgag

SEQ ID NO: 101790 - DNA, 25 bp, Rattus norvegicus
actttttccctggtgagaacctgag

SEQ ID NO: 101791 - DNA, 25 bp, Rattus norvegicus
actttttcctgccagtgttcatccg

SEQ ID NO: 101792 - DNA, 25 bp, Rattus norvegicus
actttttcctgcgagtgttcatccg

SEQ ID NO: 101793 - DNA, 25 bp, Rattus norvegicus
actttttcctgtagagtgtcccaag

SEQ ID NO: 101794 - DNA, 25 bp, Rattus norvegicus
actttttcctgttgagtgtcccaag

SEQ ID NO: 101795 - DNA, 25 bp, Rattus norvegicus
actttttgatggatgtctatggctt

SEQ ID NO: 101796 - DNA, 25 bp, Rattus norvegicus
actttttgatggttgtctatggctt

SEQ ID NO: 101797 - DNA, 25 bp, Rattus norvegicus
actttttgtccacgtccaaggcact

SEQ ID NO: 101798 - DNA, 25 bp, Rattus norvegicus
actttttgtccaggtccaaggcact

SEQ ID NO: 101799 - DNA, 25 bp, Rattus norvegicus
actttttgtgtgagtcgatcctggt

SEQ ID NO: 101800 - DNA, 25 bp, Rattus norvegicus
actttttgtgtgtgtcgatcctggt

SEQ ID NO: 101801 - DNA, 25 bp, Rattus norvegicus
actttttgttgtactatgtgcatgc

SEQ ID NO: 101802 - DNA, 25 bp, Rattus norvegicus
actttttgttgttctatgtgcatgc

SEQ ID NO: 101803 - DNA, 25 bp, Rattus norvegicus
acttttttaagtcacagtgttctga

SEQ ID NO: 101804 - DNA, 25 bp, Rattus norvegicus
acttttttaagtgacagtgttctga

SEQ ID NO: 101805 - DNA, 25 bp, Rattus norvegicus
acttttttgtagagagtcttcagaa

SEQ ID NO: 101806 - DNA, 25 bp, Rattus norvegicus
acttttttgtagtgagtcttcagaa

SEQ ID NO: 101807 - DNA, 25 bp, Rattus norvegicus
acttttttgtcaccttgacccaagt

SEQ ID NO: 101808 - DNA, 25 bp, Rattus norvegicus
acttttttgtcagcttgacccaagt

SEQ ID NO: 101809 - DNA, 25 bp, Rattus norvegicus
agaaaaaacatgcacacccacctag

SEQ ID NO: 101810 - DNA, 25 bp, Rattus norvegicus
agaaaaaacatggacacccacctag

SEQ ID NO: 101811 - DNA, 25 bp, Rattus norvegicus
agaaaaacacacaccagcttcaact

SEQ ID NO: 101812 - DNA, 25 bp, Rattus norvegicus
agaaaaacacactccagcttcaact

SEQ ID NO: 101813 - DNA, 25 bp, Rattus norvegicus
agaaaaacactgaactcacctgccc

SEQ ID NO: 101814 - DNA, 25 bp, Rattus norvegicus
agaaaaacactgtactcacctgccc

SEQ ID NO: 101815 - DNA, 25 bp, Rattus norvegicus
agaaaaaccacgctgtaccctcaat

SEQ ID NO: 101816 - DNA, 25 bp, Rattus norvegicus
agaaaaaccacggtgtaccctcaat

SEQ ID NO: 101817 - DNA, 25 bp, Rattus norvegicus
agaaaaacctatccctgtaaagaag

SEQ ID NO: 101818 - DNA, 25 bp, Rattus norvegicus
agaaaaacctatgcctgtaaagaag

SEQ ID NO: 101819 - DNA, 25 bp, Rattus norvegicus
agaaaaagcacgcagcacggcgcgc

SEQ ID NO: 101820 - DNA, 25 bp, Rattus norvegicus
agaaaaagcacggagcacggcgcgc

SEQ ID NO: 101821 - DNA, 25 bp, Rattus norvegicus
agaaaaagcctcaagctcccagcgc

SEQ ID NO: 101822 - DNA, 25 bp, Rattus norvegicus
agaaaaagcctctagctcccagcgc

SEQ ID NO: 101823 - DNA, 25 bp, Rattus norvegicus
agaaaaagcgccactccgagtagga

SEQ ID NO: 101824 - DNA, 25 bp, Rattus norvegicus
agaaaaagcgcctctccgagtagga

SEQ ID NO: 101825 - DNA, 25 bp, Rattus norvegicus
agaaaaaggccccagtctgtctact

SEQ ID NO: 101826 - DNA, 25 bp, Rattus norvegicus
agaaaaaggcccgagtctgtctact

SEQ ID NO: 101827 - DNA, 25 bp, Rattus norvegicus
agaaaaatacaaacaccactgcccc

SEQ ID NO: 101828 - DNA, 25 bp, Rattus norvegicus
agaaaaatacaatcaccactgcccc

SEQ ID NO: 101829 - DNA, 25 bp, Rattus norvegicus
agaaaaatacagactcctaagaagt

SEQ ID NO: 101830 - DNA, 25 bp, Rattus norvegicus
agaaaaatacagtctcctaagaagt

SEQ ID NO: 101831 - DNA, 25 bp, Rattus norvegicus
agaaaaatcaacaccctcgatcaac

SEQ ID NO: 101832 - DNA, 25 bp, Rattus norvegicus
agaaaaatcaactccctcgatcaac

SEQ ID NO: 101833 - DNA, 25 bp, Rattus norvegicus
agaaaaatttcccacagcctacttg

SEQ ID NO: 101834 - DNA, 25 bp, Rattus norvegicus
agaaaaatttccgacagcctacttg

SEQ ID NO: 101835 - DNA, 25 bp, Rattus norvegicus
agaaaacacactcctgggctacaga

SEQ ID NO: 101836 - DNA, 25 bp, Rattus norvegicus
agaaaacacactgctgggctacaga

SEQ ID NO: 101837 - DNA, 25 bp, Rattus norvegicus
agaaaacactctcatcctacgtggc

SEQ ID NO: 101838 - DNA, 25 bp, Rattus norvegicus
agaaaacactctgatcctacgtggc

SEQ ID NO: 101839 - DNA, 25 bp, Rattus norvegicus
agaaaacacttgacagcctagccag

SEQ ID NO: 101840 - DNA, 25 bp, Rattus norvegicus
agaaaacacttgtcagcctagccag

SEQ ID NO: 101841 - DNA, 25 bp, Rattus norvegicus
agaaaacagccacactcctattagt

SEQ ID NO: 101842 - DNA, 25 bp, Rattus norvegicus
agaaaacagccagactcctattagt

SEQ ID NO: 101843 - DNA, 25 bp, Rattus norvegicus
agaaaacagcccaacatgcttcctc

SEQ ID NO: 101844 - DNA, 25 bp, Rattus norvegicus
agaaaacagccctacatgcttcctc

SEQ ID NO: 101845 - DNA, 25 bp, Rattus norvegicus
agaaaacagctcaccttatcatgag

SEQ ID NO: 101846 - DNA, 25 bp, Rattus norvegicus
agaaaacagctctccttatcatgag

SEQ ID NO: 101847 - DNA, 25 bp, Rattus norvegicus
agaaaacagcttccaagcctgcttc

SEQ ID NO: 101848 - DNA, 25 bp, Rattus norvegicus
agaaaacagcttgcaagcctgcttc

SEQ ID NO: 101849 - DNA, 25 bp, Rattus norvegicus
agaaaacaggtactccccagagcag

SEQ ID NO: 101850 - DNA, 25 bp, Rattus norvegicus
agaaaacaggtagtccccagagcag

SEQ ID NO: 101851 - DNA, 25 bp, Rattus norvegicus
agaaaacatgctcgctctccacaaa

SEQ ID NO: 101852 - DNA, 25 bp, Rattus norvegicus
agaaaacatgctggctctccacaaa

SEQ ID NO: 101853 - DNA, 25 bp, Rattus norvegicus
agaaaacatggtacggcctcaccgt

SEQ ID NO: 101854 - DNA, 25 bp, Rattus norvegicus
agaaaacatggttcggcctcaccgt

SEQ ID NO: 101855 - DNA, 25 bp, Rattus norvegicus
agaaaacattgaatcctcagcagga

SEQ ID NO: 101856 - DNA, 25 bp, Rattus norvegicus
agaaaacattgattcctcagcagga

SEQ ID NO: 101857 - DNA, 25 bp, Rattus norvegicus
agaaaaccacacactttgaatgtgt

SEQ ID NO: 101858 - DNA, 25 bp, Rattus norvegicus
agaaaaccacactctttgaatgtgt

SEQ ID NO: 101859 - DNA, 25 bp, Rattus norvegicus
agaaaaccacctagacgtagcactg

SEQ ID NO: 101860 - DNA, 25 bp, Rattus norvegicus
agaaaaccaccttgacgtagcactg

SEQ ID NO: 101861 - DNA, 25 bp, Rattus norvegicus
agaaaaccagcaccacaccagcagg

SEQ ID NO: 101862 - DNA, 25 bp, Rattus norvegicus
agaaaaccagcagcacaccagcagg

SEQ ID NO: 101863 - DNA, 25 bp, Rattus norvegicus
agaaaaccaggcaattcaaaaaatg

SEQ ID NO: 101864 - DNA, 25 bp, Rattus norvegicus
agaaaaccaggcatgttagtcacat

SEQ ID NO: 101865 - DNA, 25 bp, Rattus norvegicus
agaaaaccaggctattcaaaaaatg

SEQ ID NO: 101866 - DNA, 25 bp, Rattus norvegicus
agaaaaccaggcttgttagtcacat

SEQ ID NO: 101867 - DNA, 25 bp, Rattus norvegicus
agaaaaccagtcacttctcaacagc

SEQ ID NO: 101868 - DNA, 25 bp, Rattus norvegicus
agaaaaccagtctcttctcaacagc

SEQ ID NO: 101869 - DNA, 25 bp, Rattus norvegicus
agaaaaccatggaggcagctgtcat

SEQ ID NO: 101870 - DNA, 25 bp, Rattus norvegicus
agaaaaccatggtggcagctgtcat

SEQ ID NO: 101871 - DNA, 25 bp, Rattus norvegicus
agaaaacccacacaagaggtcacct

SEQ ID NO: 101872 - DNA, 25 bp, Rattus norvegicus
agaaaacccacagaagaggtcacct

SEQ ID NO: 101873 - DNA, 25 bp, Rattus norvegicus
agaaaacccagacctgagccagcct

SEQ ID NO: 101874 - DNA, 25 bp, Rattus norvegicus
agaaaacccagagctgagccagcct

SEQ ID NO: 101875 - DNA, 25 bp, Rattus norvegicus
agaaaacccctcagagctgccaaag

SEQ ID NO: 101876 - DNA, 25 bp, Rattus norvegicus
agaaaacccctctgagctgccaaag

SEQ ID NO: 101877 - DNA, 25 bp, Rattus norvegicus
agaaaaccctacagctcacagcaat

SEQ ID NO: 101878 - DNA, 25 bp, Rattus norvegicus
agaaaaccctactgctcacagcaat

SEQ ID NO: 101879 - DNA, 25 bp, Rattus norvegicus
agaaaacccttgagccttacctgtg

SEQ ID NO: 101880 - DNA, 25 bp, Rattus norvegicus
agaaaacccttgtgccttacctgtg

SEQ ID NO: 101881 - DNA, 25 bp, Rattus norvegicus
agaaaaccgagacttatctcccctg

SEQ ID NO: 101882 - DNA, 25 bp, Rattus norvegicus
agaaaaccgagagttatctcccctg

SEQ ID NO: 101883 - DNA, 25 bp, Rattus norvegicus
agaaaacctattagcaatgcctaca

SEQ ID NO: 101884 - DNA, 25 bp, Rattus norvegicus
agaaaacctatttgcaatgcctaca

SEQ ID NO: 101885 - DNA, 25 bp, Rattus norvegicus
agaaaacctcagacagactccctgt

SEQ ID NO: 101886 - DNA, 25 bp, Rattus norvegicus
agaaaacctcagtcagactccctgt

SEQ ID NO: 101887 - DNA, 25 bp, Rattus norvegicus
agaaaacctgacactctcatgcaac

SEQ ID NO: 101888 - DNA, 25 bp, Rattus norvegicus
agaaaacctgactctctcatgcaac

SEQ ID NO: 101889 - DNA, 25 bp, Rattus norvegicus
agaaaacctggcagtagagatggct

SEQ ID NO: 101890 - DNA, 25 bp, Rattus norvegicus
agaaaacctggctgtagagatggct

SEQ ID NO: 101891 - DNA, 25 bp, Rattus norvegicus
agaaaacctggtctggctcccagtt

SEQ ID NO: 101892 - DNA, 25 bp, Rattus norvegicus
agaaaacctggtgtggctcccagtt

SEQ ID NO: 101893 - DNA, 25 bp, Rattus norvegicus
agaaaacctgtgaattcctcctggt

SEQ ID NO: 101894 - DNA, 25 bp, Rattus norvegicus
agaaaacctgtgtattcctcctggt

SEQ ID NO: 101895 - DNA, 25 bp, Rattus norvegicus
agaaaacgtctgactctctcttaat

SEQ ID NO: 101896 - DNA, 25 bp, Rattus norvegicus
agaaaacgtctgtctctctcttaat

SEQ ID NO: 101897 - DNA, 25 bp, Rattus norvegicus
agaaaactcactctttcacaacgtc

SEQ ID NO: 101898 - DNA, 25 bp, Rattus norvegicus
agaaaactcactgtttcacaacgtc

SEQ ID NO: 101899 - DNA, 25 bp, Rattus norvegicus
agaaaactcattacttccctcgtgt

SEQ ID NO: 101900 - DNA, 25 bp, Rattus norvegicus
agaaaactcatttcttccctcgtgt

SEQ ID NO: 101901 - DNA, 25 bp, Rattus norvegicus
agaaaactccccaacacatggtgct

SEQ ID NO: 101902 - DNA, 25 bp, Rattus norvegicus
agaaaactcccctacacatggtgct

SEQ ID NO: 101903 - DNA, 25 bp, Rattus norvegicus
agaaaactcggcagtttgctctttg

SEQ ID NO: 101904 - DNA, 25 bp, Rattus norvegicus
agaaaactcggctgtttgctctttg

SEQ ID NO: 101905 - DNA, 25 bp, Rattus norvegicus
agaaaactcgtgaactcaaccaatc

SEQ ID NO: 101906 - DNA, 25 bp, Rattus norvegicus
agaaaactcgtgtactcaaccaatc

SEQ ID NO: 101907 - DNA, 25 bp, Rattus norvegicus
agaaaactgcaaaccagcacgcccg

SEQ ID NO: 101908 - DNA, 25 bp, Rattus norvegicus
agaaaactgcaatccagcacgcccg

SEQ ID NO: 101909 - DNA, 25 bp, Rattus norvegicus
agaaaactgcgtccctttgttatca

SEQ ID NO: 101910 - DNA, 25 bp, Rattus norvegicus
agaaaactgcgtgcctttgttatca

SEQ ID NO: 101911 - DNA, 25 bp, Rattus norvegicus
agaaaactgctacaagccgcccttc

SEQ ID NO: 101912 - DNA, 25 bp, Rattus norvegicus
agaaaactgctagaagccgcccttc

SEQ ID NO: 101913 - DNA, 25 bp, Rattus norvegicus
agaaaactgctgatctccaagaaat

SEQ ID NO: 101914 - DNA, 25 bp, Rattus norvegicus
agaaaactgctgttctccaagaaat

SEQ ID NO: 101915 - DNA, 25 bp, Rattus norvegicus
agaaaacttactctgtctgaccact

SEQ ID NO: 101916 - DNA, 25 bp, Rattus norvegicus
agaaaacttactgtgtctgaccact

SEQ ID NO: 101917 - DNA, 25 bp, Rattus norvegicus
agaaaacttagtccttccagtccct

SEQ ID NO: 101918 - DNA, 25 bp, Rattus norvegicus
agaaaacttagtgcttccagtccct

SEQ ID NO: 101919 - DNA, 25 bp, Rattus norvegicus
agaaaacttccaagtgctttttgta

SEQ ID NO: 101920 - DNA, 25 bp, Rattus norvegicus
agaaaacttccatgtgctttttgta

SEQ ID NO: 101921 - DNA, 25 bp, Rattus norvegicus
agaaaactttctactctgctccttc

SEQ ID NO: 101922 - DNA, 25 bp, Rattus norvegicus
agaaaactttcttctctgctccttc

SEQ ID NO: 101923 - DNA, 25 bp, Rattus norvegicus
agaaaagacaccattagctgccatg

SEQ ID NO: 101924 - DNA, 25 bp, Rattus norvegicus
agaaaagacacctttagctgccatg

SEQ ID NO: 101925 - DNA, 25 bp, Rattus norvegicus
agaaaagacgacctttctcacatct

SEQ ID NO: 101926 - DNA, 25 bp, Rattus norvegicus
agaaaagacgacgtttctcacatct

SEQ ID NO: 101927 - DNA, 25 bp, Rattus norvegicus
agaaaagacggccaagtcccttgtg

SEQ ID NO: 101928 - DNA, 25 bp, Rattus norvegicus
agaaaagacggcgaagtcccttgtg

SEQ ID NO: 101929 - DNA, 25 bp, Rattus norvegicus
agaaaagaggcaccccaactgatct

SEQ ID NO: 101930 - DNA, 25 bp, Rattus norvegicus
agaaaagaggcagcccaactgatct

SEQ ID NO: 101931 - DNA, 25 bp, Rattus norvegicus
agaaaagccaggatctcttcctacc

SEQ ID NO: 101932 - DNA, 25 bp, Rattus norvegicus
agaaaagccaggttctcttcctacc

SEQ ID NO: 101933 - DNA, 25 bp, Rattus norvegicus
agaaaagccataaggtcgcctcctg

SEQ ID NO: 101934 - DNA, 25 bp, Rattus norvegicus
agaaaagccatatggtcgcctcctg

SEQ ID NO: 101935 - DNA, 25 bp, Rattus norvegicus
agaaaagccccacgagccaacagat

SEQ ID NO: 101936 - DNA, 25 bp, Rattus norvegicus
agaaaagccccaggagccaacagat

SEQ ID NO: 101937 - DNA, 25 bp, Rattus norvegicus
agaaaagcccctaccaggagagctg

SEQ ID NO: 101938 - DNA, 25 bp, Rattus norvegicus
agaaaagccccttccaggagagctg

SEQ ID NO: 101939 - DNA, 25 bp, Rattus norvegicus
agaaaagccgcaagataccatcaaa

SEQ ID NO: 101940 - DNA, 25 bp, Rattus norvegicus
agaaaagccgcatgataccatcaaa

SEQ ID NO: 101941 - DNA, 25 bp, Rattus norvegicus
agaaaagcctcacagtcccatccgg

SEQ ID NO: 101942 - DNA, 25 bp, Rattus norvegicus
agaaaagcctcagagtcccatccgg

SEQ ID NO: 101943 - DNA, 25 bp, Rattus norvegicus
agaaaagcctgcatattttgtacag

SEQ ID NO: 101944 - DNA, 25 bp, Rattus norvegicus
agaaaagcctgcttattttgtacag

SEQ ID NO: 101945 - DNA, 25 bp, Rattus norvegicus
agaaaagcgcctatgtgtctgcctg

SEQ ID NO: 101946 - DNA, 25 bp, Rattus norvegicus
agaaaagcgcctttgtgtctgcctg

SEQ ID NO: 101947 - DNA, 25 bp, Rattus norvegicus
agaaaagcttacatatcccattgaa

SEQ ID NO: 101948 - DNA, 25 bp, Rattus norvegicus
agaaaagcttacttatcccattgaa

SEQ ID NO: 101949 - DNA, 25 bp, Rattus norvegicus
agaaaagcttcgagaccttctccca

SEQ ID NO: 101950 - DNA, 25 bp, Rattus norvegicus
agaaaagcttcgtgaccttctccca

SEQ ID NO: 101951 - DNA, 25 bp, Rattus norvegicus
agaaaaggacatcgccctcgtcaag

SEQ ID NO: 101952 - DNA, 25 bp, Rattus norvegicus
agaaaaggacatggccctcgtcaag

SEQ ID NO: 101953 - DNA, 25 bp, Rattus norvegicus
agaaaaggacccaccagagactcca

SEQ ID NO: 101954 - DNA, 25 bp, Rattus norvegicus
agaaaaggaccctccagagactcca

SEQ ID NO: 101955 - DNA, 25 bp, Rattus norvegicus
agaaaaggacttccgcctgttctat

SEQ ID NO: 101956 - DNA, 25 bp, Rattus norvegicus
agaaaaggacttgcgcctgttctat

SEQ ID NO: 101957 - DNA, 25 bp, Rattus norvegicus
agaaaaggccacctgcccttctcag

SEQ ID NO: 101958 - DNA, 25 bp, Rattus norvegicus
agaaaaggccacgtgcccttctcag

SEQ ID NO: 101959 - DNA, 25 bp, Rattus norvegicus
agaaaagggcctacagtcctcgaag

SEQ ID NO: 101960 - DNA, 25 bp, Rattus norvegicus
agaaaagggccttcagtcctcgaag

SEQ ID NO: 101961 - DNA, 25 bp, Rattus norvegicus
agaaaagggtctagccaatgtgaag

SEQ ID NO: 101962 - DNA, 25 bp, Rattus norvegicus
agaaaagggtcttgccaatgtgaag

SEQ ID NO: 101963 - DNA, 25 bp, Rattus norvegicus
agaaaaggtctcagctgcgtcagca

SEQ ID NO: 101964 - DNA, 25 bp, Rattus norvegicus
agaaaaggtctctgctgcgtcagca

SEQ ID NO: 101965 - DNA, 25 bp, Rattus norvegicus
agaaaagtagatatcaccatagaaa

SEQ ID NO: 101966 - DNA, 25 bp, Rattus norvegicus
agaaaagtagatttcaccatagaaa

SEQ ID NO: 101967 - DNA, 25 bp, Rattus norvegicus
agaaaagtcctgcattgctgccgtt

SEQ ID NO: 101968 - DNA, 25 bp, Rattus norvegicus
agaaaagtcctggattgctgccgtt

SEQ ID NO: 101969 - DNA, 25 bp, Rattus norvegicus
agaaaagtctgcattgggcccgagc

SEQ ID NO: 101970 - DNA, 25 bp, Rattus norvegicus
agaaaagtctgctttgggcccgagc

SEQ ID NO: 101971 - DNA, 25 bp, Rattus norvegicus
agaaaagtgacacctgccatgggca

SEQ ID NO: 101972 - DNA, 25 bp, Rattus norvegicus
agaaaagtgacagctgccatgggca

SEQ ID NO: 101973 - DNA, 25 bp, Rattus norvegicus
agaaaagtgcctacttgtcccctgg

SEQ ID NO: 101974 - DNA, 25 bp, Rattus norvegicus
agaaaagtgccttcttgtcccctgg

SEQ ID NO: 101975 - DNA, 25 bp, Rattus norvegicus
agaaaagtgcgtacctgaccgcagt

SEQ ID NO: 101976 - DNA, 25 bp, Rattus norvegicus
agaaaagtgcgttcctgaccgcagt

SEQ ID NO: 101977 - DNA, 25 bp, Rattus norvegicus
agaaaagtgctcatgggtctccatg

SEQ ID NO: 101978 - DNA, 25 bp, Rattus norvegicus
agaaaagtgctcttgggtctccatg

SEQ ID NO: 101979 - DNA, 25 bp, Rattus norvegicus
agaaaagttgctacgacgtgtaaat

SEQ ID NO: 101980 - DNA, 25 bp, Rattus norvegicus
agaaaagttgcttcgacgtgtaaat

SEQ ID NO: 101981 - DNA, 25 bp, Rattus norvegicus
agaaaagtttccacgagccacggct

SEQ ID NO: 101982 - DNA, 25 bp, Rattus norvegicus
agaaaagtttcctcgagccacggct

SEQ ID NO: 101983 - DNA, 25 bp, Rattus norvegicus
agaaaataacctagccactgaccca

SEQ ID NO: 101984 - DNA, 25 bp, Rattus norvegicus
agaaaataaccttgccactgaccca

SEQ ID NO: 101985 - DNA, 25 bp, Rattus norvegicus
agaaaataatacagggaacggtgag

SEQ ID NO: 101986 - DNA, 25 bp, Rattus norvegicus
agaaaataatactgggaacggtgag

SEQ ID NO: 101987 - DNA, 25 bp, Rattus norvegicus
agaaaatacctgagctttcagcaaa

SEQ ID NO: 101988 - DNA, 25 bp, Rattus norvegicus
agaaaatacctgtgctttcagcaaa

SEQ ID NO: 101989 - DNA, 25 bp, Rattus norvegicus
agaaaataccttcgctccttctaca

SEQ ID NO: 101990 - DNA, 25 bp, Rattus norvegicus
agaaaataccttggctccttctaca

SEQ ID NO: 101991 - DNA, 25 bp, Rattus norvegicus
agaaaatagagcagcccctaggttt

SEQ ID NO: 101992 - DNA, 25 bp, Rattus norvegicus
agaaaatagagctgcccctaggttt

SEQ ID NO: 101993 - DNA, 25 bp, Rattus norvegicus
agaaaatccccaaaatgctcttcct

SEQ ID NO: 101994 - DNA, 25 bp, Rattus norvegicus
agaaaatccccataatgctcttcct

SEQ ID NO: 101995 - DNA, 25 bp, Rattus norvegicus
agaaaatccctcaggtgtgtccagc

SEQ ID NO: 101996 - DNA, 25 bp, Rattus norvegicus
agaaaatccctctggtgtgtccagc

SEQ ID NO: 101997 - DNA, 25 bp, Rattus norvegicus
agaaaatcctgtctacactcccatg

SEQ ID NO: 101998 - DNA, 25 bp, Rattus norvegicus
agaaaatcctgtgtacactcccatg

SEQ ID NO: 101999 - DNA, 25 bp, Rattus norvegicus
agaaaatcgctgatcactgcactgt

SEQ ID NO: 102000 - DNA, 25 bp, Rattus norvegicus
agaaaatcgctgttcactgcactgt

SEQ ID NO: 102001 - DNA, 25 bp, Rattus norvegicus
agaaaatctcttccttctctggctt

SEQ ID NO: 102002 - DNA, 25 bp, Rattus norvegicus
agaaaatctcttgcttctctggctt

SEQ ID NO: 102003 - DNA, 25 bp, Rattus norvegicus
agaaaatctgcactcgtcaaccatt

SEQ ID NO: 102004 - DNA, 25 bp, Rattus norvegicus
agaaaatctgcagtcgtcaaccatt

SEQ ID NO: 102005 - DNA, 25 bp, Rattus norvegicus
agaaaatctgcgctcagggcgccta

SEQ ID NO: 102006 - DNA, 25 bp, Rattus norvegicus
agaaaatctgcggtcagggcgccta

SEQ ID NO: 102007 - DNA, 25 bp, Rattus norvegicus
agaaaatcttggaaaacatctgcct

SEQ ID NO: 102008 - DNA, 25 bp, Rattus norvegicus
agaaaatcttggtaaacatctgcct

SEQ ID NO: 102009 - DNA, 25 bp, Rattus norvegicus
agaaaatcttgtatctcttcctcca

SEQ ID NO: 102010 - DNA, 25 bp, Rattus norvegicus
agaaaatcttgtttctcttcctcca

SEQ ID NO: 102011 - DNA, 25 bp, Rattus norvegicus
agaaaatgacccagtgcgtggccca

SEQ ID NO: 102012 - DNA, 25 bp, Rattus norvegicus
agaaaatgaccctgtgcgtggccca

SEQ ID NO: 102013 - DNA, 25 bp, Rattus norvegicus
agaaaatgagccctctctcctgtag

SEQ ID NO: 102014 - DNA, 25 bp, Rattus norvegicus
agaaaatgagccgtctctcctgtag

SEQ ID NO: 102015 - DNA, 25 bp, Rattus norvegicus
agaaaatgatctagcttgcttacac

SEQ ID NO: 102016 - DNA, 25 bp, Rattus norvegicus
agaaaatgatcttgcttgcttacac

SEQ ID NO: 102017 - DNA, 25 bp, Rattus norvegicus
agaaaatgcactcatctccgcactg

SEQ ID NO: 102018 - DNA, 25 bp, Rattus norvegicus
agaaaatgcactgatctccgcactg

SEQ ID NO: 102019 - DNA, 25 bp, Rattus norvegicus
agaaaatgcatcacgagaccgcaaa

SEQ ID NO: 102020 - DNA, 25 bp, Rattus norvegicus
agaaaatgcatctcgagaccgcaaa

SEQ ID NO: 102021 - DNA, 25 bp, Rattus norvegicus
agaaaatgccacctcaccgcaagat

SEQ ID NO: 102022 - DNA, 25 bp, Rattus norvegicus
agaaaatgccacgtcaccgcaagat

SEQ ID NO: 102023 - DNA, 25 bp, Rattus norvegicus
agaaaatggcatcctcaagtcagaa

SEQ ID NO: 102024 - DNA, 25 bp, Rattus norvegicus
agaaaatggcatgctcaagtcagaa

SEQ ID NO: 102025 - DNA, 25 bp, Rattus norvegicus
agaaaatggcccacatcttctcatt

SEQ ID NO: 102026 - DNA, 25 bp, Rattus norvegicus
agaaaatggccctcatcttctcatt

SEQ ID NO: 102027 - DNA, 25 bp, Rattus norvegicus
agaaaatggcgacacgaacacccca

SEQ ID NO: 102028 - DNA, 25 bp, Rattus norvegicus
agaaaatggcgagacgaacacccca

SEQ ID NO: 102029 - DNA, 25 bp, Rattus norvegicus
agaaaatggctgcaccaaggcctct

SEQ ID NO: 102030 - DNA, 25 bp, Rattus norvegicus
agaaaatggctggaccaaggcctct

SEQ ID NO: 102031 - DNA, 25 bp, Rattus norvegicus
agaaaatggttactgctctgtataa

SEQ ID NO: 102032 - DNA, 25 bp, Rattus norvegicus
agaaaatggttagtgctctgtataa

SEQ ID NO: 102033 - DNA, 25 bp, Rattus norvegicus
agaaaatggttgctctactccacat

SEQ ID NO: 102034 - DNA, 25 bp, Rattus norvegicus
agaaaatggttggtctactccacat

SEQ ID NO: 102035 - DNA, 25 bp, Rattus norvegicus
agaaaatgtcgccatcactccggag

SEQ ID NO: 102036 - DNA, 25 bp, Rattus norvegicus
agaaaatgtcgcgatcactccggag

SEQ ID NO: 102037 - DNA, 25 bp, Rattus norvegicus
agaaaatttccacactcttctctgg

SEQ ID NO: 102038 - DNA, 25 bp, Rattus norvegicus
agaaaatttccacccctccagaact

SEQ ID NO: 102039 - DNA, 25 bp, Rattus norvegicus
agaaaatttccagactcttctctgg

SEQ ID NO: 102040 - DNA, 25 bp, Rattus norvegicus
agaaaatttccagccctccagaact

SEQ ID NO: 102041 - DNA, 25 bp, Rattus norvegicus
agaaacaaacctcccgtcttgctgt

SEQ ID NO: 102042 - DNA, 25 bp, Rattus norvegicus
agaaacaaacctgccgtcttgctgt

SEQ ID NO: 102043 - DNA, 25 bp, Rattus norvegicus
agaaacaacactctcctatacgagt

SEQ ID NO: 102044 - DNA, 25 bp, Rattus norvegicus
agaaacaacactgtcctatacgagt

SEQ ID NO: 102045 - DNA, 25 bp, Rattus norvegicus
agaaacaactcacctggcttctaac

SEQ ID NO: 102046 - DNA, 25 bp, Rattus norvegicus
agaaacaactcagctggcttctaac

SEQ ID NO: 102047 - DNA, 25 bp, Rattus norvegicus
agaaacaagaccagaagcccttcca

SEQ ID NO: 102048 - DNA, 25 bp, Rattus norvegicus
agaaacaagacctgaagcccttcca

SEQ ID NO: 102049 - DNA, 25 bp, Rattus norvegicus
agaaacaagcatcttcactcctgtt

SEQ ID NO: 102050 - DNA, 25 bp, Rattus norvegicus
agaaacaagcatgttcactcctgtt

SEQ ID NO: 102051 - DNA, 25 bp, Rattus norvegicus
agaaacaagctgagcggacctggcc

SEQ ID NO: 102052 - DNA, 25 bp, Rattus norvegicus
agaaacaagctgtgcggacctggcc

SEQ ID NO: 102053 - DNA, 25 bp, Rattus norvegicus
agaaacaattctccccaacttacac

SEQ ID NO: 102054 - DNA, 25 bp, Rattus norvegicus
agaaacaattctgcccaacttacac

SEQ ID NO: 102055 - DNA, 25 bp, Rattus norvegicus
agaaacacaagactccacctcagtt

SEQ ID NO: 102056 - DNA, 25 bp, Rattus norvegicus
agaaacacaagagtccacctcagtt

SEQ ID NO: 102057 - DNA, 25 bp, Rattus norvegicus
agaaacacaagcatgccttccttcc

SEQ ID NO: 102058 - DNA, 25 bp, Rattus norvegicus
agaaacacaagcttgccttccttcc

SEQ ID NO: 102059 - DNA, 25 bp, Rattus norvegicus
agaaacacacttccttcttgggcag

SEQ ID NO: 102060 - DNA, 25 bp, Rattus norvegicus
agaaacacacttgcttcttgggcag

SEQ ID NO: 102061 - DNA, 25 bp, Rattus norvegicus
agaaacacatgacaacacccgctat

SEQ ID NO: 102062 - DNA, 25 bp, Rattus norvegicus
agaaacacatgagaacacccgctat

SEQ ID NO: 102063 - DNA, 25 bp, Rattus norvegicus
agaaacacccagaaggcagcagtaa

SEQ ID NO: 102064 - DNA, 25 bp, Rattus norvegicus
agaaacacccagtaggcagcagtaa

SEQ ID NO: 102065 - DNA, 25 bp, Rattus norvegicus
agaaacaccgtgagcttcatgcagc

SEQ ID NO: 102066 - DNA, 25 bp, Rattus norvegicus
agaaacaccgtgtgcttcatgcagc

SEQ ID NO: 102067 - DNA, 25 bp, Rattus norvegicus
agaaacacctctccccaagaagaat

SEQ ID NO: 102068 - DNA, 25 bp, Rattus norvegicus
agaaacacctctgcccaagaagaat

SEQ ID NO: 102069 - DNA, 25 bp, Rattus norvegicus
agaaacacgcaaagcacttcgggtg

SEQ ID NO: 102070 - DNA, 25 bp, Rattus norvegicus
agaaacacgcaatgcacttcgggtg

SEQ ID NO: 102071 - DNA, 25 bp, Rattus norvegicus
agaaacacgtcaactgtacttaaga

SEQ ID NO: 102072 - DNA, 25 bp, Rattus norvegicus
agaaacacgtcatctgtacttaaga

SEQ ID NO: 102073 - DNA, 25 bp, Rattus norvegicus
agaaacactatactgctgcattccc

SEQ ID NO: 102074 - DNA, 25 bp, Rattus norvegicus
agaaacactatagtgctgcattccc

SEQ ID NO: 102075 - DNA, 25 bp, Rattus norvegicus
agaaacactatcattacaggagaaa

SEQ ID NO: 102076 - DNA, 25 bp, Rattus norvegicus
agaaacactatctttacaggagaaa

SEQ ID NO: 102077 - DNA, 25 bp, Rattus norvegicus
agaaacactcgcattgacgtcctct

SEQ ID NO: 102078 - DNA, 25 bp, Rattus norvegicus
agaaacactcgctttgacgtcctct

SEQ ID NO: 102079 - DNA, 25 bp, Rattus norvegicus
agaaacactctacacatccagcctt

SEQ ID NO: 102080 - DNA, 25 bp, Rattus norvegicus
agaaacactctagacatccagcctt

SEQ ID NO: 102081 - DNA, 25 bp, Rattus norvegicus
agaaacactctgagtttcgccttcc

SEQ ID NO: 102082 - DNA, 25 bp, Rattus norvegicus
agaaacactctgtgtttcgccttcc

SEQ ID NO: 102083 - DNA, 25 bp, Rattus norvegicus
agaaacactgaacccatcctaaatc

SEQ ID NO: 102084 - DNA, 25 bp, Rattus norvegicus
agaaacactgaagccatcctaaatc

SEQ ID NO: 102085 - DNA, 25 bp, Rattus norvegicus
agaaacactgcaccatcctggagct

SEQ ID NO: 102086 - DNA, 25 bp, Rattus norvegicus
agaaacactgcagcatcctggagct

SEQ ID NO: 102087 - DNA, 25 bp, Rattus norvegicus
agaaacactgttaggctgtcacccc

SEQ ID NO: 102088 - DNA, 25 bp, Rattus norvegicus
agaaacactgtttggctgtcacccc

SEQ ID NO: 102089 - DNA, 25 bp, Rattus norvegicus
agaaacactttcatatttactgcgt

SEQ ID NO: 102090 - DNA, 25 bp, Rattus norvegicus
agaaacactttcttatttactgcgt

SEQ ID NO: 102091 - DNA, 25 bp, Rattus norvegicus
agaaacagacagatcctatgggctc

SEQ ID NO: 102092 - DNA, 25 bp, Rattus norvegicus
agaaacagacagttcctatgggctc

SEQ ID NO: 102093 - DNA, 25 bp, Rattus norvegicus
agaaacagatgtacccaaggtccca

SEQ ID NO: 102094 - DNA, 25 bp, Rattus norvegicus
agaaacagatgttcccaaggtccca

SEQ ID NO: 102095 - DNA, 25 bp, Rattus norvegicus
agaaacaggctcactgactactctc

SEQ ID NO: 102096 - DNA, 25 bp, Rattus norvegicus
agaaacaggctctctgactactctc

SEQ ID NO: 102097 - DNA, 25 bp, Rattus norvegicus
agaaacagtactcgtcccacttctg

SEQ ID NO: 102098 - DNA, 25 bp, Rattus norvegicus
agaaacagtactggtcccacttctg

SEQ ID NO: 102099 - DNA, 25 bp, Rattus norvegicus
agaaacagtgatcgcgcctttcccc

SEQ ID NO: 102100 - DNA, 25 bp, Rattus norvegicus
agaaacagtgatggcgcctttcccc

SEQ ID NO: 102101 - DNA, 25 bp, Rattus norvegicus
agaaacatagtcagctgccactacc

SEQ ID NO: 102102 - DNA, 25 bp, Rattus norvegicus
agaaacatagtctgctgccactacc

SEQ ID NO: 102103 - DNA, 25 bp, Rattus norvegicus
agaaacatccaaccctgacttacct

SEQ ID NO: 102104 - DNA, 25 bp, Rattus norvegicus
agaaacatccaagcctgacttacct

SEQ ID NO: 102105 - DNA, 25 bp, Rattus norvegicus
agaaacatccggatcaccaggactt

SEQ ID NO: 102106 - DNA, 25 bp, Rattus norvegicus
agaaacatccggttcaccaggactt

SEQ ID NO: 102107 - DNA, 25 bp, Rattus norvegicus
agaaacatctctcgcccataggcca

SEQ ID NO: 102108 - DNA, 25 bp, Rattus norvegicus
agaaacatctctggcccataggcca

SEQ ID NO: 102109 - DNA, 25 bp, Rattus norvegicus
agaaacatctgtaccctttgggtgt

SEQ ID NO: 102110 - DNA, 25 bp, Rattus norvegicus
agaaacatctgttccctttgggtgt

SEQ ID NO: 102111 - DNA, 25 bp, Rattus norvegicus
agaaacatcttaaggcaggctgcaa

SEQ ID NO: 102112 - DNA, 25 bp, Rattus norvegicus
agaaacatcttatggcaggctgcaa

SEQ ID NO: 102113 - DNA, 25 bp, Rattus norvegicus
agaaacatgacacccacactgccag

SEQ ID NO: 102114 - DNA, 25 bp, Rattus norvegicus
agaaacatgacagccacactgccag

SEQ ID NO: 102115 - DNA, 25 bp, Rattus norvegicus
agaaacatgagccaggttgcccttg

SEQ ID NO: 102116 - DNA, 25 bp, Rattus norvegicus
agaaacatgagcgaggttgcccttg

SEQ ID NO: 102117 - DNA, 25 bp, Rattus norvegicus
agaaacatgatcagaccctctctgt

SEQ ID NO: 102118 - DNA, 25 bp, Rattus norvegicus
agaaacatgatctgaccctctctgt

SEQ ID NO: 102119 - DNA, 25 bp, Rattus norvegicus
agaaacatggtcaacatcatcagaa

SEQ ID NO: 102120 - DNA, 25 bp, Rattus norvegicus
agaaacatggtcctatagtcctttg

SEQ ID NO: 102121 - DNA, 25 bp, Rattus norvegicus
agaaacatggtcgtatagtcctttg

SEQ ID NO: 102122 - DNA, 25 bp, Rattus norvegicus
agaaacatggtctacatcatcagaa

SEQ ID NO: 102123 - DNA, 25 bp, Rattus norvegicus
agaaaccaaaccagtatgcctccta

SEQ ID NO: 102124 - DNA, 25 bp, Rattus norvegicus
agaaaccaaacctgtatgcctccta

SEQ ID NO: 102125 - DNA, 25 bp, Rattus norvegicus
agaaaccaatccagacaccctgagt

SEQ ID NO: 102126 - DNA, 25 bp, Rattus norvegicus
agaaaccaatcctgacaccctgagt

SEQ ID NO: 102127 - DNA, 25 bp, Rattus norvegicus
agaaaccaccaccattgactgactg

SEQ ID NO: 102128 - DNA, 25 bp, Rattus norvegicus
agaaaccaccacgattgactgactg

SEQ ID NO: 102129 - DNA, 25 bp, Rattus norvegicus
agaaaccacgttctcttggacggtg

SEQ ID NO: 102130 - DNA, 25 bp, Rattus norvegicus
agaaaccacgttgtcttggacggtg

SEQ ID NO: 102131 - DNA, 25 bp, Rattus norvegicus
agaaaccactgcagagtcccactta

SEQ ID NO: 102132 - DNA, 25 bp, Rattus norvegicus
agaaaccactgctgagtcccactta

SEQ ID NO: 102133 - DNA, 25 bp, Rattus norvegicus
agaaaccagaagaggtccatcccac

SEQ ID NO: 102134 - DNA, 25 bp, Rattus norvegicus
agaaaccagaagtggtccatcccac

SEQ ID NO: 102135 - DNA, 25 bp, Rattus norvegicus
agaaaccagaggacatcacttccca

SEQ ID NO: 102136 - DNA, 25 bp, Rattus norvegicus
agaaaccagaggtcatcacttccca

SEQ ID NO: 102137 - DNA, 25 bp, Rattus norvegicus
agaaaccagcaacatgactcaggat

SEQ ID NO: 102138 - DNA, 25 bp, Rattus norvegicus
agaaaccagcaagatgactcaggat

SEQ ID NO: 102139 - DNA, 25 bp, Rattus norvegicus
agaaaccaggcaacagagtctgaca

SEQ ID NO: 102140 - DNA, 25 bp, Rattus norvegicus
agaaaccaggcatcagagtctgaca

SEQ ID NO: 102141 - DNA, 25 bp, Rattus norvegicus
agaaaccagggacttcacactccat

SEQ ID NO: 102142 - DNA, 25 bp, Rattus norvegicus
agaaaccagggagttcacactccat

SEQ ID NO: 102143 - DNA, 25 bp, Rattus norvegicus
agaaaccagtttccctctgcctctt

SEQ ID NO: 102144 - DNA, 25 bp, Rattus norvegicus
agaaaccagtttgcctctgcctctt

SEQ ID NO: 102145 - DNA, 25 bp, Rattus norvegicus
agaaaccatgacaactaccagcctg

SEQ ID NO: 102146 - DNA, 25 bp, Rattus norvegicus
agaaaccatgactactaccagcctg

SEQ ID NO: 102147 - DNA, 25 bp, Rattus norvegicus
agaaaccatggaagccggtgcggca

SEQ ID NO: 102148 - DNA, 25 bp, Rattus norvegicus
agaaaccatggatgccggtgcggca

SEQ ID NO: 102149 - DNA, 25 bp, Rattus norvegicus
agaaaccatggtagctctgggctca

SEQ ID NO: 102150 - DNA, 25 bp, Rattus norvegicus
agaaaccatggtcgcatcactgtta

SEQ ID NO: 102151 - DNA, 25 bp, Rattus norvegicus
agaaaccatggtggcatcactgtta

SEQ ID NO: 102152 - DNA, 25 bp, Rattus norvegicus
agaaaccatggttgctctgggctca

SEQ ID NO: 102153 - DNA, 25 bp, Rattus norvegicus
agaaaccatgttctctctttgtaag

SEQ ID NO: 102154 - DNA, 25 bp, Rattus norvegicus
agaaaccatgttgtctctttgtaag

SEQ ID NO: 102155 - DNA, 25 bp, Rattus norvegicus
agaaaccattggctcacttttaatg

SEQ ID NO: 102156 - DNA, 25 bp, Rattus norvegicus
agaaaccattgggtcacttttaatg

SEQ ID NO: 102157 - DNA, 25 bp, Rattus norvegicus
agaaacccaaggagtctctccagaa

SEQ ID NO: 102158 - DNA, 25 bp, Rattus norvegicus
agaaacccaaggtgtctctccagaa

SEQ ID NO: 102159 - DNA, 25 bp, Rattus norvegicus
agaaacccaccaatactctcagtgc

SEQ ID NO: 102160 - DNA, 25 bp, Rattus norvegicus
agaaacccaccattactctcagtgc

SEQ ID NO: 102161 - DNA, 25 bp, Rattus norvegicus
agaaacccacttagacgtcttcttg

SEQ ID NO: 102162 - DNA, 25 bp, Rattus norvegicus
agaaacccactttgacgtcttcttg

SEQ ID NO: 102163 - DNA, 25 bp, Rattus norvegicus
agaaaccccgtgctggattgagatt

SEQ ID NO: 102164 - DNA, 25 bp, Rattus norvegicus
agaaaccccgtggtggattgagatt

SEQ ID NO: 102165 - DNA, 25 bp, Rattus norvegicus
agaaacccctgaccccagactgtga

SEQ ID NO: 102166 - DNA, 25 bp, Rattus norvegicus
agaaacccctgagcccagactgtga

SEQ ID NO: 102167 - DNA, 25 bp, Rattus norvegicus
agaaacccctggatcagatccttag

SEQ ID NO: 102168 - DNA, 25 bp, Rattus norvegicus
agaaacccctggatgttctcataca

SEQ ID NO: 102169 - DNA, 25 bp, Rattus norvegicus
agaaacccctggttcagatccttag

SEQ ID NO: 102170 - DNA, 25 bp, Rattus norvegicus
agaaacccctggttgttctcataca

SEQ ID NO: 102171 - DNA, 25 bp, Rattus norvegicus
agaaaccccttgacccatgaggagg

SEQ ID NO: 102172 - DNA, 25 bp, Rattus norvegicus
agaaaccccttgagggtggcaagct

SEQ ID NO: 102173 - DNA, 25 bp, Rattus norvegicus
agaaaccccttgtcccatgaggagg

SEQ ID NO: 102174 - DNA, 25 bp, Rattus norvegicus
agaaaccccttgtgggtggcaagct

SEQ ID NO: 102175 - DNA, 25 bp, Rattus norvegicus
agaaacccggatcaagcccgcttag

SEQ ID NO: 102176 - DNA, 25 bp, Rattus norvegicus
agaaacccggatgaagcccgcttag

SEQ ID NO: 102177 - DNA, 25 bp, Rattus norvegicus
agaaaccctatgacgatgacgcaga

SEQ ID NO: 102178 - DNA, 25 bp, Rattus norvegicus
agaaaccctatgtcgatgacgcaga

SEQ ID NO: 102179 - DNA, 25 bp, Rattus norvegicus
agaaaccctggacgatgggctccca

SEQ ID NO: 102180 - DNA, 25 bp, Rattus norvegicus
agaaaccctggaggatgggctccca

SEQ ID NO: 102181 - DNA, 25 bp, Rattus norvegicus
agaaaccctgggacgagctggtgtt

SEQ ID NO: 102182 - DNA, 25 bp, Rattus norvegicus
agaaaccctgggtcgagctggtgtt

SEQ ID NO: 102183 - DNA, 25 bp, Rattus norvegicus
agaaaccctttgacggtggtgctgc

SEQ ID NO: 102184 - DNA, 25 bp, Rattus norvegicus
agaaaccctttgtcggtggtgctgc

SEQ ID NO: 102185 - DNA, 25 bp, Rattus norvegicus
agaaaccgccatccccaaggagaaa

SEQ ID NO: 102186 - DNA, 25 bp, Rattus norvegicus
agaaaccgccatgcccaaggagaaa

SEQ ID NO: 102187 - DNA, 25 bp, Rattus norvegicus
agaaaccgctcaccgtatttcaggg

SEQ ID NO: 102188 - DNA, 25 bp, Rattus norvegicus
agaaaccgctcagcgtatttcaggg

SEQ ID NO: 102189 - DNA, 25 bp, Rattus norvegicus
agaaaccgctttaggaactatgagt

SEQ ID NO: 102190 - DNA, 25 bp, Rattus norvegicus
agaaaccgcttttggaactatgagt

SEQ ID NO: 102191 - DNA, 25 bp, Rattus norvegicus
agaaaccggtagactgctccaggct

SEQ ID NO: 102192 - DNA, 25 bp, Rattus norvegicus
agaaaccggtagtctgctccaggct

SEQ ID NO: 102193 - DNA, 25 bp, Rattus norvegicus
agaaaccgtggtactggcagttttg

SEQ ID NO: 102194 - DNA, 25 bp, Rattus norvegicus
agaaaccgtggttctggcagttttg

SEQ ID NO: 102195 - DNA, 25 bp, Rattus norvegicus
agaaacctcaatcagtcgcctgtta

SEQ ID NO: 102196 - DNA, 25 bp, Rattus norvegicus
agaaacctcaatgagtcgcctgtta

SEQ ID NO: 102197 - DNA, 25 bp, Rattus norvegicus
agaaacctcagcctggtcatcctgg

SEQ ID NO: 102198 - DNA, 25 bp, Rattus norvegicus
agaaacctcagcgtggtcatcctgg

SEQ ID NO: 102199 - DNA, 25 bp, Rattus norvegicus
agaaacctcaggctgttgtgcctct

SEQ ID NO: 102200 - DNA, 25 bp, Rattus norvegicus
agaaacctcagggtgttgtgcctct

SEQ ID NO: 102201 - DNA, 25 bp, Rattus norvegicus
agaaacctcttgactctcattttgt

SEQ ID NO: 102202 - DNA, 25 bp, Rattus norvegicus
agaaacctcttgtctctcattttgt

SEQ ID NO: 102203 - DNA, 25 bp, Rattus norvegicus
agaaacctgctaacactgctgtgta

SEQ ID NO: 102204 - DNA, 25 bp, Rattus norvegicus
agaaacctgctatcactgctgtgta

SEQ ID NO: 102205 - DNA, 25 bp, Rattus norvegicus
agaaacctgctgaaagaaaacttga

SEQ ID NO: 102206 - DNA, 25 bp, Rattus norvegicus
agaaacctgctgtaagaaaacttga

SEQ ID NO: 102207 - DNA, 25 bp, Rattus norvegicus
agaaacctggacacttcagccctca

SEQ ID NO: 102208 - DNA, 25 bp, Rattus norvegicus
agaaacctggacagctgagaaaata

SEQ ID NO: 102209 - DNA, 25 bp, Rattus norvegicus
agaaacctggactcttcagccctca

SEQ ID NO: 102210 - DNA, 25 bp, Rattus norvegicus
agaaacctggactgctgagaaaata

SEQ ID NO: 102211 - DNA, 25 bp, Rattus norvegicus
agaaacctgggcagctttctaccac

SEQ ID NO: 102212 - DNA, 25 bp, Rattus norvegicus
agaaacctgggcagttgcttatgag

SEQ ID NO: 102213 - DNA, 25 bp, Rattus norvegicus
agaaacctgggctgctttctaccac

SEQ ID NO: 102214 - DNA, 25 bp, Rattus norvegicus
agaaacctgggctgttgcttatgag

SEQ ID NO: 102215 - DNA, 25 bp, Rattus norvegicus
agaaacctgtctctatctggtgtct

SEQ ID NO: 102216 - DNA, 25 bp, Rattus norvegicus
agaaacctgtctgtatctggtgtct

SEQ ID NO: 102217 - DNA, 25 bp, Rattus norvegicus
agaaacctgtgaatgcagtcattgt

SEQ ID NO: 102218 - DNA, 25 bp, Rattus norvegicus
agaaacctgtgattgcagtcattgt

SEQ ID NO: 102219 - DNA, 25 bp, Rattus norvegicus
agaaaccttaacaaccaaccagcag

SEQ ID NO: 102220 - DNA, 25 bp, Rattus norvegicus
agaaaccttaactaccaaccagcag

SEQ ID NO: 102221 - DNA, 25 bp, Rattus norvegicus
agaaacgagaacaggcgcaggccac

SEQ ID NO: 102222 - DNA, 25 bp, Rattus norvegicus
agaaacgagaactggcgcaggccac

SEQ ID NO: 102223 - DNA, 25 bp, Rattus norvegicus
agaaacgcagccctcagatcctgag

SEQ ID NO: 102224 - DNA, 25 bp, Rattus norvegicus
agaaacgcagccgtcagatcctgag

SEQ ID NO: 102225 - DNA, 25 bp, Rattus norvegicus
agaaacgctattcatctctgacata

SEQ ID NO: 102226 - DNA, 25 bp, Rattus norvegicus
agaaacgctattgatctctgacata

SEQ ID NO: 102227 - DNA, 25 bp, Rattus norvegicus
agaaacgctttccacttagtacttg

SEQ ID NO: 102228 - DNA, 25 bp, Rattus norvegicus
agaaacgctttcgacttagtacttg

SEQ ID NO: 102229 - DNA, 25 bp, Rattus norvegicus
agaaacggcgagagcttatcgtcct

SEQ ID NO: 102230 - DNA, 25 bp, Rattus norvegicus
agaaacggcgagtgcttatcgtcct

SEQ ID NO: 102231 - DNA, 25 bp, Rattus norvegicus
agaaacggtcccagagacttgtctc

SEQ ID NO: 102232 - DNA, 25 bp, Rattus norvegicus
agaaacggtccctgagacttgtctc

SEQ ID NO: 102233 - DNA, 25 bp, Rattus norvegicus
agaaacggtgcacaaatcatccctc

SEQ ID NO: 102234 - DNA, 25 bp, Rattus norvegicus
agaaacggtgcagaaatcatccctc

SEQ ID NO: 102235 - DNA, 25 bp, Rattus norvegicus
agaaacggtggcacctgccagaact

SEQ ID NO: 102236 - DNA, 25 bp, Rattus norvegicus
agaaacggtggctcctgccagaact

SEQ ID NO: 102237 - DNA, 25 bp, Rattus norvegicus
agaaacggttctcctggttcgattt

SEQ ID NO: 102238 - DNA, 25 bp, Rattus norvegicus
agaaacggttctgctggttcgattt

SEQ ID NO: 102239 - DNA, 25 bp, Rattus norvegicus
agaaacgtcagcacctggacggaac

SEQ ID NO: 102240 - DNA, 25 bp, Rattus norvegicus
agaaacgtcagctcctggacggaac

SEQ ID NO: 102241 - DNA, 25 bp, Rattus norvegicus
agaaacgtgcatcctgggtgccttt

SEQ ID NO: 102242 - DNA, 25 bp, Rattus norvegicus
agaaacgtgcatgctgggtgccttt

SEQ ID NO: 102243 - DNA, 25 bp, Rattus norvegicus
agaaacgtgtggatcactgtcccat

SEQ ID NO: 102244 - DNA, 25 bp, Rattus norvegicus
agaaacgtgtggttcactgtcccat

SEQ ID NO: 102245 - DNA, 25 bp, Rattus norvegicus
agaaactaaccacgagcctccagga

SEQ ID NO: 102246 - DNA, 25 bp, Rattus norvegicus
agaaactaaccaggagcctccagga

SEQ ID NO: 102247 - DNA, 25 bp, Rattus norvegicus
agaaactacctcagaaggcttcgcc

SEQ ID NO: 102248 - DNA, 25 bp, Rattus norvegicus
agaaactacctctgaaggcttcgcc

SEQ ID NO: 102249 - DNA, 25 bp, Rattus norvegicus
agaaactactgcctgtcgggctaga

SEQ ID NO: 102250 - DNA, 25 bp, Rattus norvegicus
agaaactactgcgtgtcgggctaga

SEQ ID NO: 102251 - DNA, 25 bp, Rattus norvegicus
agaaactagggtcactctggctaac

SEQ ID NO: 102252 - DNA, 25 bp, Rattus norvegicus
agaaactagggtgactctggctaac

SEQ ID NO: 102253 - DNA, 25 bp, Rattus norvegicus
agaaactatcctatatatcccacct

SEQ ID NO: 102254 - DNA, 25 bp, Rattus norvegicus
agaaactatcctttatatcccacct

SEQ ID NO: 102255 - DNA, 25 bp, Rattus norvegicus
agaaactattccacccaaggcttat

SEQ ID NO: 102256 - DNA, 25 bp, Rattus norvegicus
agaaactattcctcccaaggcttat

SEQ ID NO: 102257 - DNA, 25 bp, Rattus norvegicus
agaaactattctccccttgtaatcc

SEQ ID NO: 102258 - DNA, 25 bp, Rattus norvegicus
agaaactattctctgttcctctggt

SEQ ID NO: 102259 - DNA, 25 bp, Rattus norvegicus
agaaactattctgcccttgtaatcc

SEQ ID NO: 102260 - DNA, 25 bp, Rattus norvegicus
agaaactattctgtgttcctctggt

SEQ ID NO: 102261 - DNA, 25 bp, Rattus norvegicus
agaaactatttgctttctctcccgc

SEQ ID NO: 102262 - DNA, 25 bp, Rattus norvegicus
agaaactatttggtttctctcccgc

SEQ ID NO: 102263 - DNA, 25 bp, Rattus norvegicus
agaaactcatacctgtcttgctgct

SEQ ID NO: 102264 - DNA, 25 bp, Rattus norvegicus
agaaactcatacgtgtcttgctgct

SEQ ID NO: 102265 - DNA, 25 bp, Rattus norvegicus
agaaactcatcacggacaccttccg

SEQ ID NO: 102266 - DNA, 25 bp, Rattus norvegicus
agaaactcatcagggacaccttccg

SEQ ID NO: 102267 - DNA, 25 bp, Rattus norvegicus
agaaactcattcatcacattcctta

SEQ ID NO: 102268 - DNA, 25 bp, Rattus norvegicus
agaaactcattcttcacattcctta

SEQ ID NO: 102269 - DNA, 25 bp, Rattus norvegicus
agaaactcctatacacaattggtgg

SEQ ID NO: 102270 - DNA, 25 bp, Rattus norvegicus
agaaactcctattcacaattggtgg

SEQ ID NO: 102271 - DNA, 25 bp, Rattus norvegicus
agaaactcgggcatgtccagtcatt

SEQ ID NO: 102272 - DNA, 25 bp, Rattus norvegicus
agaaactcgggcttgtccagtcatt

SEQ ID NO: 102273 - DNA, 25 bp, Rattus norvegicus
agaaactctctgcagagtgcgcgaa

SEQ ID NO: 102274 - DNA, 25 bp, Rattus norvegicus
agaaactctctggagagtgcgcgaa

SEQ ID NO: 102275 - DNA, 25 bp, Rattus norvegicus
agaaactctgaacacccaggccgac

SEQ ID NO: 102276 - DNA, 25 bp, Rattus norvegicus
agaaactctgaagacccaggccgac

SEQ ID NO: 102277 - DNA, 25 bp, Rattus norvegicus
agaaactcttttagcatggacacag

SEQ ID NO: 102278 - DNA, 25 bp, Rattus norvegicus
agaaactctttttgcatggacacag

SEQ ID NO: 102279 - DNA, 25 bp, Rattus norvegicus
agaaactgacgaaacaaccctggag

SEQ ID NO: 102280 - DNA, 25 bp, Rattus norvegicus
agaaactgacgatacaaccctggag

SEQ ID NO: 102281 - DNA, 25 bp, Rattus norvegicus
agaaactgacttcagccccgagctt

SEQ ID NO: 102282 - DNA, 25 bp, Rattus norvegicus
agaaactgacttgagccccgagctt

SEQ ID NO: 102283 - DNA, 25 bp, Rattus norvegicus
agaaactgagccctcgaagtcacga

SEQ ID NO: 102284 - DNA, 25 bp, Rattus norvegicus
agaaactgagccgtcgaagtcacga

SEQ ID NO: 102285 - DNA, 25 bp, Rattus norvegicus
agaaactgagctcccaacagcactg

SEQ ID NO: 102286 - DNA, 25 bp, Rattus norvegicus
agaaactgagctgccaacagcactg

SEQ ID NO: 102287 - DNA, 25 bp, Rattus norvegicus
agaaactgagtcacctgctgccatt

SEQ ID NO: 102288 - DNA, 25 bp, Rattus norvegicus
agaaactgagtctcctgctgccatt

SEQ ID NO: 102289 - DNA, 25 bp, Rattus norvegicus
agaaactgatacattccctgtctgc

SEQ ID NO: 102290 - DNA, 25 bp, Rattus norvegicus
agaaactgatactttccctgtctgc

SEQ ID NO: 102291 - DNA, 25 bp, Rattus norvegicus
agaaactgcattaggccgatgcgca

SEQ ID NO: 102292 - DNA, 25 bp, Rattus norvegicus
agaaactgcatttggccgatgcgca

SEQ ID NO: 102293 - DNA, 25 bp, Rattus norvegicus
agaaactgccttagcagattccccg

SEQ ID NO: 102294 - DNA, 25 bp, Rattus norvegicus
agaaactgcctttgcagattccccg

SEQ ID NO: 102295 - DNA, 25 bp, Rattus norvegicus
agaaactgcgtgagaagaagatcca

SEQ ID NO: 102296 - DNA, 25 bp, Rattus norvegicus
agaaactgcgtgtgaagaagatcca

SEQ ID NO: 102297 - DNA, 25 bp, Rattus norvegicus
agaaactgctttacgtacttccctg

SEQ ID NO: 102298 - DNA, 25 bp, Rattus norvegicus
agaaactgcttttcgtacttccctg

SEQ ID NO: 102299 - DNA, 25 bp, Rattus norvegicus
agaaactggaacacgtcctgctcct

SEQ ID NO: 102300 - DNA, 25 bp, Rattus norvegicus
agaaactggaactcgtcctgctcct

SEQ ID NO: 102301 - DNA, 25 bp, Rattus norvegicus
agaaactggtctctctacctcctga

SEQ ID NO: 102302 - DNA, 25 bp, Rattus norvegicus
agaaactggtctgtctacctcctga

SEQ ID NO: 102303 - DNA, 25 bp, Rattus norvegicus
agaaactggttcaccgctggaggaa

SEQ ID NO: 102304 - DNA, 25 bp, Rattus norvegicus
agaaactggttctccgctggaggaa

SEQ ID NO: 102305 - DNA, 25 bp, Rattus norvegicus
agaaactgtcatagggacccaccag

SEQ ID NO: 102306 - DNA, 25 bp, Rattus norvegicus
agaaactgtcattgggacccaccag

SEQ ID NO: 102307 - DNA, 25 bp, Rattus norvegicus
agaaactgtcccatactctcttctg

SEQ ID NO: 102308 - DNA, 25 bp, Rattus norvegicus
agaaactgtcccttactctcttctg

SEQ ID NO: 102309 - DNA, 25 bp, Rattus norvegicus
agaaactgtgggagcctccaagaac

SEQ ID NO: 102310 - DNA, 25 bp, Rattus norvegicus
agaaactgtgggtgcctccaagaac

SEQ ID NO: 102311 - DNA, 25 bp, Rattus norvegicus
agaaactgttaactctcatctcctc

SEQ ID NO: 102312 - DNA, 25 bp, Rattus norvegicus
agaaactgttaagtctcatctcctc

SEQ ID NO: 102313 - DNA, 25 bp, Rattus norvegicus
agaaactgttgcaactgtcctccag

SEQ ID NO: 102314 - DNA, 25 bp, Rattus norvegicus
agaaactgttgctactgtcctccag

SEQ ID NO: 102315 - DNA, 25 bp, Rattus norvegicus
agaaactgttggctacagcggcctt

SEQ ID NO: 102316 - DNA, 25 bp, Rattus norvegicus
agaaactgttgggtacagcggcctt

SEQ ID NO: 102317 - DNA, 25 bp, Rattus norvegicus
agaaacttacttactgtccaggcag

SEQ ID NO: 102318 - DNA, 25 bp, Rattus norvegicus
agaaacttactttctgtccaggcag

SEQ ID NO: 102319 - DNA, 25 bp, Rattus norvegicus
agaaacttcaccaggacagccatct

SEQ ID NO: 102320 - DNA, 25 bp, Rattus norvegicus
agaaacttcacctggacagccatct

SEQ ID NO: 102321 - DNA, 25 bp, Rattus norvegicus
agaaacttcatgaatcagggtggag

SEQ ID NO: 102322 - DNA, 25 bp, Rattus norvegicus
agaaacttcatgtatcagggtggag

SEQ ID NO: 102323 - DNA, 25 bp, Rattus norvegicus
agaaacttcctcaggtttctccata

SEQ ID NO: 102324 - DNA, 25 bp, Rattus norvegicus
agaaacttcctctggtttctccata

SEQ ID NO: 102325 - DNA, 25 bp, Rattus norvegicus
agaaacttctttcaggcataacttg

SEQ ID NO: 102326 - DNA, 25 bp, Rattus norvegicus
agaaacttctttgaggcataacttg

SEQ ID NO: 102327 - DNA, 25 bp, Rattus norvegicus
agaaacttgcccagagccatacagt

SEQ ID NO: 102328 - DNA, 25 bp, Rattus norvegicus
agaaacttgccctgagccatacagt

SEQ ID NO: 102329 - DNA, 25 bp, Rattus norvegicus
agaaacttgggacctgcccggtgct

SEQ ID NO: 102330 - DNA, 25 bp, Rattus norvegicus
agaaacttgggagctgcccggtgct

SEQ ID NO: 102331 - DNA, 25 bp, Rattus norvegicus
agaaacttgttcaattttgtggcag

SEQ ID NO: 102332 - DNA, 25 bp, Rattus norvegicus
agaaacttgttctattttgtggcag

SEQ ID NO: 102333 - DNA, 25 bp, Rattus norvegicus
agaaactttataagtgcgtccacgt

SEQ ID NO: 102334 - DNA, 25 bp, Rattus norvegicus
agaaactttatatgtgcgtccacgt

SEQ ID NO: 102335 - DNA, 25 bp, Rattus norvegicus
agaaactttgctcatgctgcctact

SEQ ID NO: 102336 - DNA, 25 bp, Rattus norvegicus
agaaactttgctgatgctgcctact

SEQ ID NO: 102337 - DNA, 25 bp, Rattus norvegicus
agaaacttttgtctcatcctctctg

SEQ ID NO: 102338 - DNA, 25 bp, Rattus norvegicus
agaaacttttgtgtcatcctctctg

SEQ ID NO: 102339 - DNA, 25 bp, Rattus norvegicus
agaaagaaacaaacacatgggtcag

SEQ ID NO: 102340 - DNA, 25 bp, Rattus norvegicus
agaaagaaacaatcacatgggtcag

SEQ ID NO: 102341 - DNA, 25 bp, Rattus norvegicus
agaaagaacaccagcctcccagttc

SEQ ID NO: 102342 - DNA, 25 bp, Rattus norvegicus
agaaagaacacctgcctcccagttc

SEQ ID NO: 102343 - DNA, 25 bp, Rattus norvegicus
agaaagaactgtcgcttcccgggca

SEQ ID NO: 102344 - DNA, 25 bp, Rattus norvegicus
agaaagaactgtggcttcccgggca

SEQ ID NO: 102345 - DNA, 25 bp, Rattus norvegicus
agaaagaagcccctggagctcagct

SEQ ID NO: 102346 - DNA, 25 bp, Rattus norvegicus
agaaagaagcccgtggagctcagct

SEQ ID NO: 102347 - DNA, 25 bp, Rattus norvegicus
agaaagaatggcagcttggtccctc

SEQ ID NO: 102348 - DNA, 25 bp, Rattus norvegicus
agaaagaatggctgcttggtccctc

SEQ ID NO: 102349 - DNA, 25 bp, Rattus norvegicus
agaaagacaactaccggctgagccc

SEQ ID NO: 102350 - DNA, 25 bp, Rattus norvegicus
agaaagacaacttccggctgagccc

SEQ ID NO: 102351 - DNA, 25 bp, Rattus norvegicus
agaaagacatccaatgcgcagcacc

SEQ ID NO: 102352 - DNA, 25 bp, Rattus norvegicus
agaaagacatcctatgcgcagcacc

SEQ ID NO: 102353 - DNA, 25 bp, Rattus norvegicus
agaaagacatcgacctgtaccacac

SEQ ID NO: 102354 - DNA, 25 bp, Rattus norvegicus
agaaagacatcgtcctgtaccacac

SEQ ID NO: 102355 - DNA, 25 bp, Rattus norvegicus
agaaagacctaaatcactccttcca

SEQ ID NO: 102356 - DNA, 25 bp, Rattus norvegicus
agaaagacctaattcactccttcca

SEQ ID NO: 102357 - DNA, 25 bp, Rattus norvegicus
agaaagacctctacctcccagtatt

SEQ ID NO: 102358 - DNA, 25 bp, Rattus norvegicus
agaaagacctcttcctcccagtatt

SEQ ID NO: 102359 - DNA, 25 bp, Rattus norvegicus
agaaagacgtgacctactcctacgg

SEQ ID NO: 102360 - DNA, 25 bp, Rattus norvegicus
agaaagacgtgagctactcctacgg

SEQ ID NO: 102361 - DNA, 25 bp, Rattus norvegicus
agaaagactgcgctgcctggccttg

SEQ ID NO: 102362 - DNA, 25 bp, Rattus norvegicus
agaaagactgcggtgcctggccttg

SEQ ID NO: 102363 - DNA, 25 bp, Rattus norvegicus
agaaagacttctacaagctgcccag

SEQ ID NO: 102364 - DNA, 25 bp, Rattus norvegicus
agaaagacttcttcaagctgcccag

SEQ ID NO: 102365 - DNA, 25 bp, Rattus norvegicus
agaaagacttgacctgtgccaggag

SEQ ID NO: 102366 - DNA, 25 bp, Rattus norvegicus
agaaagacttgagctgtgccaggag

SEQ ID NO: 102367 - DNA, 25 bp, Rattus norvegicus
agaaagagactcacaccctggaggg

SEQ ID NO: 102368 - DNA, 25 bp, Rattus norvegicus
agaaagagactcctggccgccaagc

SEQ ID NO: 102369 - DNA, 25 bp, Rattus norvegicus
agaaagagactcgtggccgccaagc

SEQ ID NO: 102370 - DNA, 25 bp, Rattus norvegicus
agaaagagactctcaccctggaggg

SEQ ID NO: 102371 - DNA, 25 bp, Rattus norvegicus
agaaagagacttcggtgcgtcccta

SEQ ID NO: 102372 - DNA, 25 bp, Rattus norvegicus
agaaagagacttgggtgcgtcccta

SEQ ID NO: 102373 - DNA, 25 bp, Rattus norvegicus
agaaagagagtacatgccaggtgct

SEQ ID NO: 102374 - DNA, 25 bp, Rattus norvegicus
agaaagagagtagatgccaggtgct

SEQ ID NO: 102375 - DNA, 25 bp, Rattus norvegicus
agaaagagccgcctgtaccaagttt

SEQ ID NO: 102376 - DNA, 25 bp, Rattus norvegicus
agaaagagccgcgtgtaccaagttt

SEQ ID NO: 102377 - DNA, 25 bp, Rattus norvegicus
agaaagaggatccaccttcagacct

SEQ ID NO: 102378 - DNA, 25 bp, Rattus norvegicus
agaaagaggatcgaccttcagacct

SEQ ID NO: 102379 - DNA, 25 bp, Rattus norvegicus
agaaagagggacctgcgcagctctc

SEQ ID NO: 102380 - DNA, 25 bp, Rattus norvegicus
agaaagagggacgtgcgcagctctc

SEQ ID NO: 102381 - DNA, 25 bp, Rattus norvegicus
agaaagagggccatcccctgcagtc

SEQ ID NO: 102382 - DNA, 25 bp, Rattus norvegicus
agaaagagggccttcccctgcagtc

SEQ ID NO: 102383 - DNA, 25 bp, Rattus norvegicus
agaaagagtctcagcactggaagag

SEQ ID NO: 102384 - DNA, 25 bp, Rattus norvegicus
agaaagagtctctgcactggaagag

SEQ ID NO: 102385 - DNA, 25 bp, Rattus norvegicus
agaaagagtgtcacccagggaagga

SEQ ID NO: 102386 - DNA, 25 bp, Rattus norvegicus
agaaagagtgtctcccagggaagga

SEQ ID NO: 102387 - DNA, 25 bp, Rattus norvegicus
agaaagagtttcctctcttgcgcca

SEQ ID NO: 102388 - DNA, 25 bp, Rattus norvegicus
agaaagagtttcgtctcttgcgcca

SEQ ID NO: 102389 - DNA, 25 bp, Rattus norvegicus
agaaagatactcaggtgatgtaccc

SEQ ID NO: 102390 - DNA, 25 bp, Rattus norvegicus
agaaagatactctggtgatgtaccc

SEQ ID NO: 102391 - DNA, 25 bp, Rattus norvegicus
agaaagatcacccatgaacagcccc

SEQ ID NO: 102392 - DNA, 25 bp, Rattus norvegicus
agaaagatcaccgatgaacagcccc

SEQ ID NO: 102393 - DNA, 25 bp, Rattus norvegicus
agaaagatgctcatacattctctga

SEQ ID NO: 102394 - DNA, 25 bp, Rattus norvegicus
agaaagatgctcttacattctctga

SEQ ID NO: 102395 - DNA, 25 bp, Rattus norvegicus
agaaagattccacagtcagtgtcac

SEQ ID NO: 102396 - DNA, 25 bp, Rattus norvegicus
agaaagattccagagtcagtgtcac

SEQ ID NO: 102397 - DNA, 25 bp, Rattus norvegicus
agaaagatttctccctgtttggaca

SEQ ID NO: 102398 - DNA, 25 bp, Rattus norvegicus
agaaagatttctgcctgtttggaca

SEQ ID NO: 102399 - DNA, 25 bp, Rattus norvegicus
agaaagcaaaaaccctcaactgttg

SEQ ID NO: 102400 - DNA, 25 bp, Rattus norvegicus
agaaagcaaaaagcctcaactgttg

SEQ ID NO: 102401 - DNA, 25 bp, Rattus norvegicus
agaaagcaaaccacggccgcccgag

SEQ ID NO: 102402 - DNA, 25 bp, Rattus norvegicus
agaaagcaaacctcggccgcccgag

SEQ ID NO: 102403 - DNA, 25 bp, Rattus norvegicus
agaaagcaaagacccactgcttcct

SEQ ID NO: 102404 - DNA, 25 bp, Rattus norvegicus
agaaagcaaagagccactgcttcct

SEQ ID NO: 102405 - DNA, 25 bp, Rattus norvegicus
agaaagcaagcaacgggtcccctgg

SEQ ID NO: 102406 - DNA, 25 bp, Rattus norvegicus
agaaagcaagcatcgggtcccctgg

SEQ ID NO: 102407 - DNA, 25 bp, Rattus norvegicus
agaaagcacacacccagtaaatttg

SEQ ID NO: 102408 - DNA, 25 bp, Rattus norvegicus
agaaagcacacagccagtaaatttg

SEQ ID NO: 102409 - DNA, 25 bp, Rattus norvegicus
agaaagcacagcactcactcagagt

SEQ ID NO: 102410 - DNA, 25 bp, Rattus norvegicus
agaaagcacagctctcactcagagt

SEQ ID NO: 102411 - DNA, 25 bp, Rattus norvegicus
agaaagcaccttagttccactcatg

SEQ ID NO: 102412 - DNA, 25 bp, Rattus norvegicus
agaaagcacctttgttccactcatg

SEQ ID NO: 102413 - DNA, 25 bp, Rattus norvegicus
agaaagcactctctgggtcagccac

SEQ ID NO: 102414 - DNA, 25 bp, Rattus norvegicus
agaaagcactctgtgggtcagccac

SEQ ID NO: 102415 - DNA, 25 bp, Rattus norvegicus
agaaagcactttcttcccagcctgg

SEQ ID NO: 102416 - DNA, 25 bp, Rattus norvegicus
agaaagcactttgttcccagcctgg

SEQ ID NO: 102417 - DNA, 25 bp, Rattus norvegicus
agaaagcagaggactccccaaggga

SEQ ID NO: 102418 - DNA, 25 bp, Rattus norvegicus
agaaagcagaggtctccccaaggga

SEQ ID NO: 102419 - DNA, 25 bp, Rattus norvegicus
agaaagcagcagaatccctcgctga

SEQ ID NO: 102420 - DNA, 25 bp, Rattus norvegicus
agaaagcagcagtatccctcgctga

SEQ ID NO: 102421 - DNA, 25 bp, Rattus norvegicus
agaaagcagcggcttcaccttacag

SEQ ID NO: 102422 - DNA, 25 bp, Rattus norvegicus
agaaagcagcgggttcaccttacag

SEQ ID NO: 102423 - DNA, 25 bp, Rattus norvegicus
agaaagcaggttacaccctcaacaa

SEQ ID NO: 102424 - DNA, 25 bp, Rattus norvegicus
agaaagcaggtttcaccctcaacaa

SEQ ID NO: 102425 - DNA, 25 bp, Rattus norvegicus
agaaagcagtgccatgcttccacag

SEQ ID NO: 102426 - DNA, 25 bp, Rattus norvegicus
agaaagcagtgcgatgcttccacag

SEQ ID NO: 102427 - DNA, 25 bp, Rattus norvegicus
agaaagcagttaagccccaagccaa

SEQ ID NO: 102428 - DNA, 25 bp, Rattus norvegicus
agaaagcagttatgccccaagccaa

SEQ ID NO: 102429 - DNA, 25 bp, Rattus norvegicus
agaaagcatgacaagcatcccacct

SEQ ID NO: 102430 - DNA, 25 bp, Rattus norvegicus
agaaagcatgactagcatcccacct

SEQ ID NO: 102431 - DNA, 25 bp, Rattus norvegicus
agaaagcatgcacggcacactgagt

SEQ ID NO: 102432 - DNA, 25 bp, Rattus norvegicus
agaaagcatgcagggcacactgagt

SEQ ID NO: 102433 - DNA, 25 bp, Rattus norvegicus
agaaagcattgcatgccatctgcgc

SEQ ID NO: 102434 - DNA, 25 bp, Rattus norvegicus
agaaagcattgcttgccatctgcgc

SEQ ID NO: 102435 - DNA, 25 bp, Rattus norvegicus
agaaagccaagacatatatctggtg

SEQ ID NO: 102436 - DNA, 25 bp, Rattus norvegicus
agaaagccaagagatatatctggtg

SEQ ID NO: 102437 - DNA, 25 bp, Rattus norvegicus
agaaagccaagcaacattctcctcc

SEQ ID NO: 102438 - DNA, 25 bp, Rattus norvegicus
agaaagccaagctacattctcctcc

SEQ ID NO: 102439 - DNA, 25 bp, Rattus norvegicus
agaaagccacagcactgccaattca

SEQ ID NO: 102440 - DNA, 25 bp, Rattus norvegicus
agaaagccacaggactgccaattca

SEQ ID NO: 102441 - DNA, 25 bp, Rattus norvegicus
agaaagccacttcttctcaggctgc

SEQ ID NO: 102442 - DNA, 25 bp, Rattus norvegicus
agaaagccacttgttctcaggctgc

SEQ ID NO: 102443 - DNA, 25 bp, Rattus norvegicus
agaaagccagagcttcccagtgtct

SEQ ID NO: 102444 - DNA, 25 bp, Rattus norvegicus
agaaagccagaggttcccagtgtct

SEQ ID NO: 102445 - DNA, 25 bp, Rattus norvegicus
agaaagccaggacccctaaacgcca

SEQ ID NO: 102446 - DNA, 25 bp, Rattus norvegicus
agaaagccaggagccctaaacgcca

SEQ ID NO: 102447 - DNA, 25 bp, Rattus norvegicus
agaaagccatccacatgcattcatt

SEQ ID NO: 102448 - DNA, 25 bp, Rattus norvegicus
agaaagccatcctcatgcattcatt

SEQ ID NO: 102449 - DNA, 25 bp, Rattus norvegicus
agaaagccattcatcctcctgtgag

SEQ ID NO: 102450 - DNA, 25 bp, Rattus norvegicus
agaaagccattcttcctcctgtgag

SEQ ID NO: 102451 - DNA, 25 bp, Rattus norvegicus
agaaagcccctcaacaagaaagtag

SEQ ID NO: 102452 - DNA, 25 bp, Rattus norvegicus
agaaagcccctctacaagaaagtag

SEQ ID NO: 102453 - DNA, 25 bp, Rattus norvegicus
agaaagccctacatagttcaagaag

SEQ ID NO: 102454 - DNA, 25 bp, Rattus norvegicus
agaaagccctacttagttcaagaag

SEQ ID NO: 102455 - DNA, 25 bp, Rattus norvegicus
agaaagccctcaacctgtgatacag

SEQ ID NO: 102456 - DNA, 25 bp, Rattus norvegicus
agaaagccctcatcctgtgatacag

SEQ ID NO: 102457 - DNA, 25 bp, Rattus norvegicus
agaaagcccttcaccattgtggaat

SEQ ID NO: 102458 - DNA, 25 bp, Rattus norvegicus
agaaagcccttctccattgtggaat

SEQ ID NO: 102459 - DNA, 25 bp, Rattus norvegicus
agaaagccgaccagttcattttgac

SEQ ID NO: 102460 - DNA, 25 bp, Rattus norvegicus
agaaagccgacctgttcattttgac

SEQ ID NO: 102461 - DNA, 25 bp, Rattus norvegicus
agaaagccgatacttctcacaccca

SEQ ID NO: 102462 - DNA, 25 bp, Rattus norvegicus
agaaagccgatagttctcacaccca

SEQ ID NO: 102463 - DNA, 25 bp, Rattus norvegicus
agaaagccgctcaattttggtctct

SEQ ID NO: 102464 - DNA, 25 bp, Rattus norvegicus
agaaagccgctctattttggtctct

SEQ ID NO: 102465 - DNA, 25 bp, Rattus norvegicus
agaaagcctacgagggcagccctga

SEQ ID NO: 102466 - DNA, 25 bp, Rattus norvegicus
agaaagcctacgtgggcagccctga

SEQ ID NO: 102467 - DNA, 25 bp, Rattus norvegicus
agaaagcctcagaccaaaagcccaa

SEQ ID NO: 102468 - DNA, 25 bp, Rattus norvegicus
agaaagcctcagtccaaaagcccaa

SEQ ID NO: 102469 - DNA, 25 bp, Rattus norvegicus
agaaagcctccgatacctgcttctt

SEQ ID NO: 102470 - DNA, 25 bp, Rattus norvegicus
agaaagcctccgttacctgcttctt

SEQ ID NO: 102471 - DNA, 25 bp, Rattus norvegicus
agaaagcctcctcgcttagctgtgt

SEQ ID NO: 102472 - DNA, 25 bp, Rattus norvegicus
agaaagcctcctggcttagctgtgt

SEQ ID NO: 102473 - DNA, 25 bp, Rattus norvegicus
agaaagcctttaagcttcagtggag

SEQ ID NO: 102474 - DNA, 25 bp, Rattus norvegicus
agaaagcctttatgcttcagtggag

SEQ ID NO: 102475 - DNA, 25 bp, Rattus norvegicus
agaaagcgagacaggcccgtggaca

SEQ ID NO: 102476 - DNA, 25 bp, Rattus norvegicus
agaaagcgagactggcccgtggaca

SEQ ID NO: 102477 - DNA, 25 bp, Rattus norvegicus
agaaagcgctctcctgggtctccat

SEQ ID NO: 102478 - DNA, 25 bp, Rattus norvegicus
agaaagcgctctgctgggtctccat

SEQ ID NO: 102479 - DNA, 25 bp, Rattus norvegicus
agaaagcggccccatgaagacggtc

SEQ ID NO: 102480 - DNA, 25 bp, Rattus norvegicus
agaaagcggcccgatgaagacggtc

SEQ ID NO: 102481 - DNA, 25 bp, Rattus norvegicus
agaaagcggtttacttcccatcact

SEQ ID NO: 102482 - DNA, 25 bp, Rattus norvegicus
agaaagcggttttcttcccatcact

SEQ ID NO: 102483 - DNA, 25 bp, Rattus norvegicus
agaaagctattgactgccgttcgca

SEQ ID NO: 102484 - DNA, 25 bp, Rattus norvegicus
agaaagctattgtctgccgttcgca

SEQ ID NO: 102485 - DNA, 25 bp, Rattus norvegicus
agaaagctcaggaggagccgcctgc

SEQ ID NO: 102486 - DNA, 25 bp, Rattus norvegicus
agaaagctcaggtggagccgcctgc

SEQ ID NO: 102487 - DNA, 25 bp, Rattus norvegicus
agaaagctccatcccaaactatttg

SEQ ID NO: 102488 - DNA, 25 bp, Rattus norvegicus
agaaagctccatgccaaactatttg

SEQ ID NO: 102489 - DNA, 25 bp, Rattus norvegicus
agaaagctctctcgtgccttttggt

SEQ ID NO: 102490 - DNA, 25 bp, Rattus norvegicus
agaaagctctctggtgccttttggt

SEQ ID NO: 102491 - DNA, 25 bp, Rattus norvegicus
agaaagctgaccaatggcgtgcacc

SEQ ID NO: 102492 - DNA, 25 bp, Rattus norvegicus
agaaagctgacctatggcgtgcacc

SEQ ID NO: 102493 - DNA, 25 bp, Rattus norvegicus
agaaagctgagcagacccgagtccc

SEQ ID NO: 102494 - DNA, 25 bp, Rattus norvegicus
agaaagctgagctgacccgagtccc

SEQ ID NO: 102495 - DNA, 25 bp, Rattus norvegicus
agaaagctgatcaccgctgtaaccc

SEQ ID NO: 102496 - DNA, 25 bp, Rattus norvegicus
agaaagctgatctccgctgtaaccc

SEQ ID NO: 102497 - DNA, 25 bp, Rattus norvegicus
agaaagctgcatcgaacctttagca

SEQ ID NO: 102498 - DNA, 25 bp, Rattus norvegicus
agaaagctgcatggaacctttagca

SEQ ID NO: 102499 - DNA, 25 bp, Rattus norvegicus
agaaagctgccccatgagctgtgca

SEQ ID NO: 102500 - DNA, 25 bp, Rattus norvegicus
agaaagctgcccgatgagctgtgca

SEQ ID NO: 102501 - DNA, 25 bp, Rattus norvegicus
agaaagctgccgagacactgggccg

SEQ ID NO: 102502 - DNA, 25 bp, Rattus norvegicus
agaaagctgccgtgacactgggccg

SEQ ID NO: 102503 - DNA, 25 bp, Rattus norvegicus
agaaagctggtcacctactgactct

SEQ ID NO: 102504 - DNA, 25 bp, Rattus norvegicus
agaaagctggtcatggcacctgggt

SEQ ID NO: 102505 - DNA, 25 bp, Rattus norvegicus
agaaagctggtctcctactgactct

SEQ ID NO: 102506 - DNA, 25 bp, Rattus norvegicus
agaaagctggtcttggcacctgggt

SEQ ID NO: 102507 - DNA, 25 bp, Rattus norvegicus
agaaagctgtggattctggcaaatg

SEQ ID NO: 102508 - DNA, 25 bp, Rattus norvegicus
agaaagctgtggtttctggcaaatg

SEQ ID NO: 102509 - DNA, 25 bp, Rattus norvegicus
agaaagcttaggactcatccttcct

SEQ ID NO: 102510 - DNA, 25 bp, Rattus norvegicus
agaaagcttaggtctcatccttcct

SEQ ID NO: 102511 - DNA, 25 bp, Rattus norvegicus
agaaagcttcctcaacaatgtttta

SEQ ID NO: 102512 - DNA, 25 bp, Rattus norvegicus
agaaagcttcctgaacaatgtttta

SEQ ID NO: 102513 - DNA, 25 bp, Rattus norvegicus
agaaagctttagaggtactggccca

SEQ ID NO: 102514 - DNA, 25 bp, Rattus norvegicus
agaaagctttagtggtactggccca

SEQ ID NO: 102515 - DNA, 25 bp, Rattus norvegicus
agaaaggaaccaacacccttgccat

SEQ ID NO: 102516 - DNA, 25 bp, Rattus norvegicus
agaaaggaaccatcacccttgccat

SEQ ID NO: 102517 - DNA, 25 bp, Rattus norvegicus
agaaaggaatctagactcgagtcgt

SEQ ID NO: 102518 - DNA, 25 bp, Rattus norvegicus
agaaaggaatcttgactcgagtcgt

SEQ ID NO: 102519 - DNA, 25 bp, Rattus norvegicus
agaaaggacgccctgagaactcctg

SEQ ID NO: 102520 - DNA, 25 bp, Rattus norvegicus
agaaaggacgccgtgagaactcctg

SEQ ID NO: 102521 - DNA, 25 bp, Rattus norvegicus
agaaaggatacacctggagtcagtt

SEQ ID NO: 102522 - DNA, 25 bp, Rattus norvegicus
agaaaggatacagctggagtcagtt

SEQ ID NO: 102523 - DNA, 25 bp, Rattus norvegicus
agaaaggatactcggctccgcacag

SEQ ID NO: 102524 - DNA, 25 bp, Rattus norvegicus
agaaaggatactgggctccgcacag

SEQ ID NO: 102525 - DNA, 25 bp, Rattus norvegicus
agaaaggatagcagtacctggagac

SEQ ID NO: 102526 - DNA, 25 bp, Rattus norvegicus
agaaaggatagctgtacctggagac

SEQ ID NO: 102527 - DNA, 25 bp, Rattus norvegicus
agaaaggatcatccttctctctgtg

SEQ ID NO: 102528 - DNA, 25 bp, Rattus norvegicus
agaaaggatcatgcttctctctgtg

SEQ ID NO: 102529 - DNA, 25 bp, Rattus norvegicus
agaaaggatttcaccttccccagat

SEQ ID NO: 102530 - DNA, 25 bp, Rattus norvegicus
agaaaggatttctccttccccagat

SEQ ID NO: 102531 - DNA, 25 bp, Rattus norvegicus
agaaaggcaagcagttctcccctgt

SEQ ID NO: 102532 - DNA, 25 bp, Rattus norvegicus
agaaaggcaagctgttctcccctgt

SEQ ID NO: 102533 - DNA, 25 bp, Rattus norvegicus
agaaaggcaatcacagccgttctct

SEQ ID NO: 102534 - DNA, 25 bp, Rattus norvegicus
agaaaggcaatctcagccgttctct

SEQ ID NO: 102535 - DNA, 25 bp, Rattus norvegicus
agaaaggcacacaaggcaagctctc

SEQ ID NO: 102536 - DNA, 25 bp, Rattus norvegicus
agaaaggcacactaggcaagctctc

SEQ ID NO: 102537 - DNA, 25 bp, Rattus norvegicus
agaaaggcagcccttcagtcggctc

SEQ ID NO: 102538 - DNA, 25 bp, Rattus norvegicus
agaaaggcagccgttcagtcggctc

SEQ ID NO: 102539 - DNA, 25 bp, Rattus norvegicus
agaaaggcatctctcgggcccaggc

SEQ ID NO: 102540 - DNA, 25 bp, Rattus norvegicus
agaaaggcatctgtcgggcccaggc

SEQ ID NO: 102541 - DNA, 25 bp, Rattus norvegicus
agaaaggcatgtcggcttcatgtct

SEQ ID NO: 102542 - DNA, 25 bp, Rattus norvegicus
agaaaggcatgtgggcttcatgtct

SEQ ID NO: 102543 - DNA, 25 bp, Rattus norvegicus
agaaaggcccagagcgcttctgcgg

SEQ ID NO: 102544 - DNA, 25 bp, Rattus norvegicus
agaaaggcccagtgcgcttctgcgg

SEQ ID NO: 102545 - DNA, 25 bp, Rattus norvegicus
agaaaggccctaattgtctccagct

SEQ ID NO: 102546 - DNA, 25 bp, Rattus norvegicus
agaaaggccctatttgtctccagct

SEQ ID NO: 102547 - DNA, 25 bp, Rattus norvegicus
agaaaggccctcacgcctcctgttt

SEQ ID NO: 102548 - DNA, 25 bp, Rattus norvegicus
agaaaggccctctcgcctcctgttt

SEQ ID NO: 102549 - DNA, 25 bp, Rattus norvegicus
agaaaggccgctaccagggcaaggc

SEQ ID NO: 102550 - DNA, 25 bp, Rattus norvegicus
agaaaggccgcttccagggcaaggc

SEQ ID NO: 102551 - DNA, 25 bp, Rattus norvegicus
agaaaggccggacctggccaagcca

SEQ ID NO: 102552 - DNA, 25 bp, Rattus norvegicus
agaaaggccggagctggccaagcca

SEQ ID NO: 102553 - DNA, 25 bp, Rattus norvegicus
agaaaggcctcaaactcgcagagct

SEQ ID NO: 102554 - DNA, 25 bp, Rattus norvegicus
agaaaggcctcaagatctcgctgtc

SEQ ID NO: 102555 - DNA, 25 bp, Rattus norvegicus
agaaaggcctcatactcgcagagct

SEQ ID NO: 102556 - DNA, 25 bp, Rattus norvegicus
agaaaggcctcatgatctcgctgtc

SEQ ID NO: 102557 - DNA, 25 bp, Rattus norvegicus
agaaaggcctcgagccttccaattt

SEQ ID NO: 102558 - DNA, 25 bp, Rattus norvegicus
agaaaggcctcgtgccttccaattt

SEQ ID NO: 102559 - DNA, 25 bp, Rattus norvegicus
agaaaggcctctccgcataactaca

SEQ ID NO: 102560 - DNA, 25 bp, Rattus norvegicus
agaaaggcctctgcgcataactaca

SEQ ID NO: 102561 - DNA, 25 bp, Rattus norvegicus
agaaaggcctttcaatctccgaatt

SEQ ID NO: 102562 - DNA, 25 bp, Rattus norvegicus
agaaaggcctttgaatctccgaatt

SEQ ID NO: 102563 - DNA, 25 bp, Rattus norvegicus
agaaaggctaccacctacagatctt

SEQ ID NO: 102564 - DNA, 25 bp, Rattus norvegicus
agaaaggctacctcctacagatctt

SEQ ID NO: 102565 - DNA, 25 bp, Rattus norvegicus
agaaaggctatactccaggcatggt

SEQ ID NO: 102566 - DNA, 25 bp, Rattus norvegicus
agaaaggctatagtccaggcatggt

SEQ ID NO: 102567 - DNA, 25 bp, Rattus norvegicus
agaaaggctctgaccaggcaaggaa

SEQ ID NO: 102568 - DNA, 25 bp, Rattus norvegicus
agaaaggctctgtccaggcaaggaa

SEQ ID NO: 102569 - DNA, 25 bp, Rattus norvegicus
agaaagggaggcaccgaacctcagg

SEQ ID NO: 102570 - DNA, 25 bp, Rattus norvegicus
agaaagggaggctccgaacctcagg

SEQ ID NO: 102571 - DNA, 25 bp, Rattus norvegicus
agaaagggcattctttgtcgcctgt

SEQ ID NO: 102572 - DNA, 25 bp, Rattus norvegicus
agaaagggcattgtttgtcgcctgt

SEQ ID NO: 102573 - DNA, 25 bp, Rattus norvegicus
agaaagggccaaagctgtcgtctct

SEQ ID NO: 102574 - DNA, 25 bp, Rattus norvegicus
agaaagggccaatgctgtcgtctct

SEQ ID NO: 102575 - DNA, 25 bp, Rattus norvegicus
agaaagggccacatcccatctattc

SEQ ID NO: 102576 - DNA, 25 bp, Rattus norvegicus
agaaagggccacttcccatctattc

SEQ ID NO: 102577 - DNA, 25 bp, Rattus norvegicus
agaaagggtacgacatacactgtgt

SEQ ID NO: 102578 - DNA, 25 bp, Rattus norvegicus
agaaagggtacgtcatacactgtgt

SEQ ID NO: 102579 - DNA, 25 bp, Rattus norvegicus
agaaagggtcttcctgtattaaaca

SEQ ID NO: 102580 - DNA, 25 bp, Rattus norvegicus
agaaagggtcttgctgtattaaaca

SEQ ID NO: 102581 - DNA, 25 bp, Rattus norvegicus
agaaagggtgtcattgtgactcaaa

SEQ ID NO: 102582 - DNA, 25 bp, Rattus norvegicus
agaaagggtgtctttgtgactcaaa

SEQ ID NO: 102583 - DNA, 25 bp, Rattus norvegicus
agaaaggtaatcagcctgctgcttc

SEQ ID NO: 102584 - DNA, 25 bp, Rattus norvegicus
agaaaggtaatctgcctgctgcttc

SEQ ID NO: 102585 - DNA, 25 bp, Rattus norvegicus
agaaaggtatttcatcactgggatg

SEQ ID NO: 102586 - DNA, 25 bp, Rattus norvegicus
agaaaggtatttgatcactgggatg

SEQ ID NO: 102587 - DNA, 25 bp, Rattus norvegicus
agaaaggtcaggctccctctccata

SEQ ID NO: 102588 - DNA, 25 bp, Rattus norvegicus
agaaaggtcagggtccctctccata

SEQ ID NO: 102589 - DNA, 25 bp, Rattus norvegicus
agaaaggtcccaatgaagccgccca

SEQ ID NO: 102590 - DNA, 25 bp, Rattus norvegicus
agaaaggtcccattgaagccgccca

SEQ ID NO: 102591 - DNA, 25 bp, Rattus norvegicus
agaaaggtcgtgagtccgcagcctc

SEQ ID NO: 102592 - DNA, 25 bp, Rattus norvegicus
agaaaggtcgtgtgtccgcagcctc

SEQ ID NO: 102593 - DNA, 25 bp, Rattus norvegicus
agaaaggtctggcacctcatgcctt

SEQ ID NO: 102594 - DNA, 25 bp, Rattus norvegicus
agaaaggtctgggacctcatgcctt

SEQ ID NO: 102595 - DNA, 25 bp, Rattus norvegicus
agaaaggtgactcgcccagcatcga

SEQ ID NO: 102596 - DNA, 25 bp, Rattus norvegicus
agaaaggtgactggcccagcatcga

SEQ ID NO: 102597 - DNA, 25 bp, Rattus norvegicus
agaaaggtgcgtacctcgtagagaa

SEQ ID NO: 102598 - DNA, 25 bp, Rattus norvegicus
agaaaggtgcgttcctcgtagagaa

SEQ ID NO: 102599 - DNA, 25 bp, Rattus norvegicus
agaaaggtggcaatcaggctgcaga

SEQ ID NO: 102600 - DNA, 25 bp, Rattus norvegicus
agaaaggtggcattcaggctgcaga

SEQ ID NO: 102601 - DNA, 25 bp, Rattus norvegicus
agaaaggtgtgtcccgagagtcttc

SEQ ID NO: 102602 - DNA, 25 bp, Rattus norvegicus
agaaaggtgtgtgccgagagtcttc

SEQ ID NO: 102603 - DNA, 25 bp, Rattus norvegicus
agaaaggttgggagctaggctctcc

SEQ ID NO: 102604 - DNA, 25 bp, Rattus norvegicus
agaaaggttgggtgctaggctctcc

SEQ ID NO: 102605 - DNA, 25 bp, Rattus norvegicus
agaaagtacactcagcggcccgagc

SEQ ID NO: 102606 - DNA, 25 bp, Rattus norvegicus
agaaagtacactgagcggcccgagc

SEQ ID NO: 102607 - DNA, 25 bp, Rattus norvegicus
agaaagtaccgcatccactgaggca

SEQ ID NO: 102608 - DNA, 25 bp, Rattus norvegicus
agaaagtaccgcttccactgaggca

SEQ ID NO: 102609 - DNA, 25 bp, Rattus norvegicus
agaaagtatcccacatctcgtccat

SEQ ID NO: 102610 - DNA, 25 bp, Rattus norvegicus
agaaagtatccctcatctcgtccat

SEQ ID NO: 102611 - DNA, 25 bp, Rattus norvegicus
agaaagtcagctcgcccacagttcc

SEQ ID NO: 102612 - DNA, 25 bp, Rattus norvegicus
agaaagtcagctggcccacagttcc

SEQ ID NO: 102613 - DNA, 25 bp, Rattus norvegicus
agaaagtccaatagtaccgcatcca

SEQ ID NO: 102614 - DNA, 25 bp, Rattus norvegicus
agaaagtccaattgtaccgcatcca

SEQ ID NO: 102615 - DNA, 25 bp, Rattus norvegicus
agaaagtcccacatgtaagccgctc

SEQ ID NO: 102616 - DNA, 25 bp, Rattus norvegicus
agaaagtcccacttgtaagccgctc

SEQ ID NO: 102617 - DNA, 25 bp, Rattus norvegicus
agaaagtcctgtcagcttgggctct

SEQ ID NO: 102618 - DNA, 25 bp, Rattus norvegicus
agaaagtcctgtgagcttgggctct

SEQ ID NO: 102619 - DNA, 25 bp, Rattus norvegicus
agaaagtcgtgtctggtgtccactt

SEQ ID NO: 102620 - DNA, 25 bp, Rattus norvegicus
agaaagtcgtgtgtggtgtccactt

SEQ ID NO: 102621 - DNA, 25 bp, Rattus norvegicus
agaaagtctgtgagattcatttcca

SEQ ID NO: 102622 - DNA, 25 bp, Rattus norvegicus
agaaagtctgtgtgattcatttcca

SEQ ID NO: 102623 - DNA, 25 bp, Rattus norvegicus
agaaagtgacacctgctcattgcca

SEQ ID NO: 102624 - DNA, 25 bp, Rattus norvegicus
agaaagtgacacgtgctcattgcca

SEQ ID NO: 102625 - DNA, 25 bp, Rattus norvegicus
agaaagtgagacctcctagtgggaa

SEQ ID NO: 102626 - DNA, 25 bp, Rattus norvegicus
agaaagtgagacgtcctagtgggaa

SEQ ID NO: 102627 - DNA, 25 bp, Rattus norvegicus
agaaagtgcccacaggctttttcat

SEQ ID NO: 102628 - DNA, 25 bp, Rattus norvegicus
agaaagtgcccagaggctttttcat

SEQ ID NO: 102629 - DNA, 25 bp, Rattus norvegicus
agaaagtgctgtagttacctgtgga

SEQ ID NO: 102630 - DNA, 25 bp, Rattus norvegicus
agaaagtgctgttgttacctgtgga

SEQ ID NO: 102631 - DNA, 25 bp, Rattus norvegicus
agaaagtggaaaccatcctcccctc

SEQ ID NO: 102632 - DNA, 25 bp, Rattus norvegicus
agaaagtggaaagcatcctcccctc

SEQ ID NO: 102633 - DNA, 25 bp, Rattus norvegicus
agaaagtggagcatgggctgcccct

SEQ ID NO: 102634 - DNA, 25 bp, Rattus norvegicus
agaaagtggagcttgggctgcccct

SEQ ID NO: 102635 - DNA, 25 bp, Rattus norvegicus
agaaagtggcagaccacctgcacct

SEQ ID NO: 102636 - DNA, 25 bp, Rattus norvegicus
agaaagtggcagtccacctgcacct

SEQ ID NO: 102637 - DNA, 25 bp, Rattus norvegicus
agaaagtggccacaagctattcccc

SEQ ID NO: 102638 - DNA, 25 bp, Rattus norvegicus
agaaagtggccagaagctattcccc

SEQ ID NO: 102639 - DNA, 25 bp, Rattus norvegicus
agaaagtggcttaattttactctct

SEQ ID NO: 102640 - DNA, 25 bp, Rattus norvegicus
agaaagtggcttagctccgtgccag

SEQ ID NO: 102641 - DNA, 25 bp, Rattus norvegicus
agaaagtggctttattttactctct

SEQ ID NO: 102642 - DNA, 25 bp, Rattus norvegicus
agaaagtggctttgctccgtgccag

SEQ ID NO: 102643 - DNA, 25 bp, Rattus norvegicus
agaaagtggtccctgccagctcaag

SEQ ID NO: 102644 - DNA, 25 bp, Rattus norvegicus
agaaagtggtccgtgccagctcaag

SEQ ID NO: 102645 - DNA, 25 bp, Rattus norvegicus
agaaagtgtatcatccttgctcacc

SEQ ID NO: 102646 - DNA, 25 bp, Rattus norvegicus
agaaagtgtatcttccttgctcacc

SEQ ID NO: 102647 - DNA, 25 bp, Rattus norvegicus
agaaagttagctagcttgcttacac

SEQ ID NO: 102648 - DNA, 25 bp, Rattus norvegicus
agaaagttagcttgcttgcttacac

SEQ ID NO: 102649 - DNA, 25 bp, Rattus norvegicus
agaaagttcatcagcacccatcaga

SEQ ID NO: 102650 - DNA, 25 bp, Rattus norvegicus
agaaagttcatctgcacccatcaga

SEQ ID NO: 102651 - DNA, 25 bp, Rattus norvegicus
agaaagttccagcatcatgccccag

SEQ ID NO: 102652 - DNA, 25 bp, Rattus norvegicus
agaaagttccaggatcatgccccag

SEQ ID NO: 102653 - DNA, 25 bp, Rattus norvegicus
agaaagttccttatcttgccagcca

SEQ ID NO: 102654 - DNA, 25 bp, Rattus norvegicus
agaaagttccttttcttgccagcca

SEQ ID NO: 102655 - DNA, 25 bp, Rattus norvegicus
agaaagttctagactgtggcccaga

SEQ ID NO: 102656 - DNA, 25 bp, Rattus norvegicus
agaaagttctagcacactgtccctg

SEQ ID NO: 102657 - DNA, 25 bp, Rattus norvegicus
agaaagttctaggacactgtccctg

SEQ ID NO: 102658 - DNA, 25 bp, Rattus norvegicus
agaaagttctagtctgtggcccaga

SEQ ID NO: 102659 - DNA, 25 bp, Rattus norvegicus
agaaagttctctatgtagcctaggc

SEQ ID NO: 102660 - DNA, 25 bp, Rattus norvegicus
agaaagttctctttgtagcctaggc

SEQ ID NO: 102661 - DNA, 25 bp, Rattus norvegicus
agaaagttcttcacagcctgtcaca

SEQ ID NO: 102662 - DNA, 25 bp, Rattus norvegicus
agaaagttcttctcagcctgtcaca

SEQ ID NO: 102663 - DNA, 25 bp, Rattus norvegicus
agaaagttctttccttgccctggat

SEQ ID NO: 102664 - DNA, 25 bp, Rattus norvegicus
agaaagttctttgcttgccctggat

SEQ ID NO: 102665 - DNA, 25 bp, Rattus norvegicus
agaaagttgttacctcagtcagtgg

SEQ ID NO: 102666 - DNA, 25 bp, Rattus norvegicus
agaaagttgttagctcagtcagtgg

SEQ ID NO: 102667 - DNA, 25 bp, Rattus norvegicus
agaaagtttccgatggcagccatgg

SEQ ID NO: 102668 - DNA, 25 bp, Rattus norvegicus
agaaagtttccgttggcagccatgg

SEQ ID NO: 102669 - DNA, 25 bp, Rattus norvegicus
agaaagtttgccagtgaccaatcat

SEQ ID NO: 102670 - DNA, 25 bp, Rattus norvegicus
agaaagtttgcctgtgaccaatcat

SEQ ID NO: 102671 - DNA, 25 bp, Rattus norvegicus
agaaataaacctagactcccagcct

SEQ ID NO: 102672 - DNA, 25 bp, Rattus norvegicus
agaaataaaccttgactcccagcct

SEQ ID NO: 102673 - DNA, 25 bp, Rattus norvegicus
agaaataaaggcagaccgatctctt

SEQ ID NO: 102674 - DNA, 25 bp, Rattus norvegicus
agaaataaaggctgaccgatctctt

SEQ ID NO: 102675 - DNA, 25 bp, Rattus norvegicus
agaaataagtccacagtgccagcct

SEQ ID NO: 102676 - DNA, 25 bp, Rattus norvegicus
agaaataagtcctcagtgccagcct

SEQ ID NO: 102677 - DNA, 25 bp, Rattus norvegicus
agaaataatgcacaccctgcccagc

SEQ ID NO: 102678 - DNA, 25 bp, Rattus norvegicus
agaaataatgcagaccctgcccagc

SEQ ID NO: 102679 - DNA, 25 bp, Rattus norvegicus
agaaataattgtctgcaccggcctt

SEQ ID NO: 102680 - DNA, 25 bp, Rattus norvegicus
agaaataattgtgtgcaccggcctt

SEQ ID NO: 102681 - DNA, 25 bp, Rattus norvegicus
agaaatacccagcatgccaggtgtg

SEQ ID NO: 102682 - DNA, 25 bp, Rattus norvegicus
agaaatacccaggatgccaggtgtg

SEQ ID NO: 102683 - DNA, 25 bp, Rattus norvegicus
agaaatacgagccttccttcaccta

SEQ ID NO: 102684 - DNA, 25 bp, Rattus norvegicus
agaaatacgagcgttccttcaccta

SEQ ID NO: 102685 - DNA, 25 bp, Rattus norvegicus
agaaatactaccatgtgctgaccca

SEQ ID NO: 102686 - DNA, 25 bp, Rattus norvegicus
agaaatactaccttgtgctgaccca

SEQ ID NO: 102687 - DNA, 25 bp, Rattus norvegicus
agaaatactccaactgccctacaga

SEQ ID NO: 102688 - DNA, 25 bp, Rattus norvegicus
agaaatactccatctgccctacaga

SEQ ID NO: 102689 - DNA, 25 bp, Rattus norvegicus
agaaatagacttcgccctgcagctg

SEQ ID NO: 102690 - DNA, 25 bp, Rattus norvegicus
agaaatagacttggccctgcagctg

SEQ ID NO: 102691 - DNA, 25 bp, Rattus norvegicus
agaaatagatcccactttaggcctc

SEQ ID NO: 102692 - DNA, 25 bp, Rattus norvegicus
agaaatagatccgactttaggcctc

SEQ ID NO: 102693 - DNA, 25 bp, Rattus norvegicus
agaaatagcctcaaagcccttagca

SEQ ID NO: 102694 - DNA, 25 bp, Rattus norvegicus
agaaatagcctctaagcccttagca

SEQ ID NO: 102695 - DNA, 25 bp, Rattus norvegicus
agaaatatagacctgggccaatcct

SEQ ID NO: 102696 - DNA, 25 bp, Rattus norvegicus
agaaatatagacgtgggccaatcct

SEQ ID NO: 102697 - DNA, 25 bp, Rattus norvegicus
agaaatatccagaccgagtgtctcg

SEQ ID NO: 102698 - DNA, 25 bp, Rattus norvegicus
agaaatatccagtccgagtgtctcg

SEQ ID NO: 102699 - DNA, 25 bp, Rattus norvegicus
agaaatatgctcacggaggccacgc

SEQ ID NO: 102700 - DNA, 25 bp, Rattus norvegicus
agaaatatgctctcggaggccacgc

SEQ ID NO: 102701 - DNA, 25 bp, Rattus norvegicus
agaaatcaaatcagcaggccaaaca

SEQ ID NO: 102702 - DNA, 25 bp, Rattus norvegicus
agaaatcaaatctgcaggccaaaca

SEQ ID NO: 102703 - DNA, 25 bp, Rattus norvegicus
agaaatcaagccagctcagctcaga

SEQ ID NO: 102704 - DNA, 25 bp, Rattus norvegicus
agaaatcaagcctgctcagctcaga

SEQ ID NO: 102705 - DNA, 25 bp, Rattus norvegicus
agaaatcaattcctttgaccaaatt

SEQ ID NO: 102706 - DNA, 25 bp, Rattus norvegicus
agaaatcaattcgtttgaccaaatt

SEQ ID NO: 102707 - DNA, 25 bp, Rattus norvegicus
agaaatcacaaaactgacaaagcct

SEQ ID NO: 102708 - DNA, 25 bp, Rattus norvegicus
agaaatcacaaatctgacaaagcct

SEQ ID NO: 102709 - DNA, 25 bp, Rattus norvegicus
agaaatcaccgaacttctcagtctc

SEQ ID NO: 102710 - DNA, 25 bp, Rattus norvegicus
agaaatcaccgatcttctcagtctc

SEQ ID NO: 102711 - DNA, 25 bp, Rattus norvegicus
agaaatcacgttagcctgggtctcc

SEQ ID NO: 102712 - DNA, 25 bp, Rattus norvegicus
agaaatcacgtttgcctgggtctcc

SEQ ID NO: 102713 - DNA, 25 bp, Rattus norvegicus
agaaatcagacacacttcttacccc

SEQ ID NO: 102714 - DNA, 25 bp, Rattus norvegicus
agaaatcagacagacttcttacccc

SEQ ID NO: 102715 - DNA, 25 bp, Rattus norvegicus
agaaatcagctgagcggtcagctcc

SEQ ID NO: 102716 - DNA, 25 bp, Rattus norvegicus
agaaatcagctgtgcggtcagctcc

SEQ ID NO: 102717 - DNA, 25 bp, Rattus norvegicus
agaaatcagcttccaagggcctccg

SEQ ID NO: 102718 - DNA, 25 bp, Rattus norvegicus
agaaatcagcttgcaagggcctccg

SEQ ID NO: 102719 - DNA, 25 bp, Rattus norvegicus
agaaatcagtctacgcagtcagctc

SEQ ID NO: 102720 - DNA, 25 bp, Rattus norvegicus
agaaatcagtcttcgcagtcagctc

SEQ ID NO: 102721 - DNA, 25 bp, Rattus norvegicus
agaaatcagtgcacagtattgtaac

SEQ ID NO: 102722 - DNA, 25 bp, Rattus norvegicus
agaaatcagtgctcagtattgtaac

SEQ ID NO: 102723 - DNA, 25 bp, Rattus norvegicus
agaaatcagtggatcccggctttgc

SEQ ID NO: 102724 - DNA, 25 bp, Rattus norvegicus
agaaatcagtggttcccggctttgc

SEQ ID NO: 102725 - DNA, 25 bp, Rattus norvegicus
agaaatcatgctcccatgggtcaca

SEQ ID NO: 102726 - DNA, 25 bp, Rattus norvegicus
agaaatcatgctgccatgggtcaca

SEQ ID NO: 102727 - DNA, 25 bp, Rattus norvegicus
agaaatcattgacttctgcctgccc

SEQ ID NO: 102728 - DNA, 25 bp, Rattus norvegicus
agaaatcattgagttctgcctgccc

SEQ ID NO: 102729 - DNA, 25 bp, Rattus norvegicus
agaaatccaaagagccttcgccatg

SEQ ID NO: 102730 - DNA, 25 bp, Rattus norvegicus
agaaatccaaagtgccttcgccatg

SEQ ID NO: 102731 - DNA, 25 bp, Rattus norvegicus
agaaatccacccagtgctctaaata

SEQ ID NO: 102732 - DNA, 25 bp, Rattus norvegicus
agaaatccaccctgtgctctaaata

SEQ ID NO: 102733 - DNA, 25 bp, Rattus norvegicus
agaaatccactgagccccagtaaca

SEQ ID NO: 102734 - DNA, 25 bp, Rattus norvegicus
agaaatccactgtgccccagtaaca

SEQ ID NO: 102735 - DNA, 25 bp, Rattus norvegicus
agaaatccagcaaacgacgtctcag

SEQ ID NO: 102736 - DNA, 25 bp, Rattus norvegicus
agaaatccagcatacgacgtctcag

SEQ ID NO: 102737 - DNA, 25 bp, Rattus norvegicus
agaaatccatccagattcactcact

SEQ ID NO: 102738 - DNA, 25 bp, Rattus norvegicus
agaaatccatcctgattcactcact

SEQ ID NO: 102739 - DNA, 25 bp, Rattus norvegicus
agaaatccattcaaagtgctctgta

SEQ ID NO: 102740 - DNA, 25 bp, Rattus norvegicus
agaaatccattctaagtgctctgta

SEQ ID NO: 102741 - DNA, 25 bp, Rattus norvegicus
agaaatcccaaaaggcggccagcca

SEQ ID NO: 102742 - DNA, 25 bp, Rattus norvegicus
agaaatcccaaatggcggccagcca

SEQ ID NO: 102743 - DNA, 25 bp, Rattus norvegicus
agaaatcccaagactggtcttccca

SEQ ID NO: 102744 - DNA, 25 bp, Rattus norvegicus
agaaatcccaagtctggtcttccca

SEQ ID NO: 102745 - DNA, 25 bp, Rattus norvegicus
agaaatcccatcaggtcacgtcgag

SEQ ID NO: 102746 - DNA, 25 bp, Rattus norvegicus
agaaatcccatctggtcacgtcgag

SEQ ID NO: 102747 - DNA, 25 bp, Rattus norvegicus
agaaatcccgatctgctctacccat

SEQ ID NO: 102748 - DNA, 25 bp, Rattus norvegicus
agaaatcccgatgtgctctacccat

SEQ ID NO: 102749 - DNA, 25 bp, Rattus norvegicus
agaaatccctatcaccagaagcaga

SEQ ID NO: 102750 - DNA, 25 bp, Rattus norvegicus
agaaatccctatgaccagaagcaga

SEQ ID NO: 102751 - DNA, 25 bp, Rattus norvegicus
agaaatccctctagtaccgtgatgc

SEQ ID NO: 102752 - DNA, 25 bp, Rattus norvegicus
agaaatccctcttgtaccgtgatgc

SEQ ID NO: 102753 - DNA, 25 bp, Rattus norvegicus
agaaatccctgtactcactgagagc

SEQ ID NO: 102754 - DNA, 25 bp, Rattus norvegicus
agaaatccctgttctcactgagagc

SEQ ID NO: 102755 - DNA, 25 bp, Rattus norvegicus
agaaatcccttgctgctcatcatgt

SEQ ID NO: 102756 - DNA, 25 bp, Rattus norvegicus
agaaatcccttggtgctcatcatgt

SEQ ID NO: 102757 - DNA, 25 bp, Rattus norvegicus
agaaatccgtgtcttctttgttctc

SEQ ID NO: 102758 - DNA, 25 bp, Rattus norvegicus
agaaatccgtgtgttctttgttctc

SEQ ID NO: 102759 - DNA, 25 bp, Rattus norvegicus
agaaatcctacacgcagggctggag

SEQ ID NO: 102760 - DNA, 25 bp, Rattus norvegicus
agaaatcctacaggcagggctggag

SEQ ID NO: 102761 - DNA, 25 bp, Rattus norvegicus
agaaatcctcctcagttcttacctt

SEQ ID NO: 102762 - DNA, 25 bp, Rattus norvegicus
agaaatcctcctgagttcttacctt

SEQ ID NO: 102763 - DNA, 25 bp, Rattus norvegicus
agaaatcctggtatctacaccatcc

SEQ ID NO: 102764 - DNA, 25 bp, Rattus norvegicus
agaaatcctggtttctacaccatcc

SEQ ID NO: 102765 - DNA, 25 bp, Rattus norvegicus
agaaatccttccaactgtgacagcc

SEQ ID NO: 102766 - DNA, 25 bp, Rattus norvegicus
agaaatccttcctactgtgacagcc

SEQ ID NO: 102767 - DNA, 25 bp, Rattus norvegicus
agaaatcgacaacggctctgcctat

SEQ ID NO: 102768 - DNA, 25 bp, Rattus norvegicus
agaaatcgacaagggctctgcctat

SEQ ID NO: 102769 - DNA, 25 bp, Rattus norvegicus
agaaatcgccgaccaccttaagtct

SEQ ID NO: 102770 - DNA, 25 bp, Rattus norvegicus
agaaatcgccgagcaccttaagtct

SEQ ID NO: 102771 - DNA, 25 bp, Rattus norvegicus
agaaatcgcttccttgaactgctgc

SEQ ID NO: 102772 - DNA, 25 bp, Rattus norvegicus
agaaatcgcttcgttgaactgctgc

SEQ ID NO: 102773 - DNA, 25 bp, Rattus norvegicus
agaaatcgggtgaccacttggccct

SEQ ID NO: 102774 - DNA, 25 bp, Rattus norvegicus
agaaatcgggtgtccacttggccct

SEQ ID NO: 102775 - DNA, 25 bp, Rattus norvegicus
agaaatcgtgttagcctgcacacca

SEQ ID NO: 102776 - DNA, 25 bp, Rattus norvegicus
agaaatcgtgtttgcctgcacacca

SEQ ID NO: 102777 - DNA, 25 bp, Rattus norvegicus
agaaatctacgaaggtctccactat

SEQ ID NO: 102778 - DNA, 25 bp, Rattus norvegicus
agaaatctacgatggtctccactat

SEQ ID NO: 102779 - DNA, 25 bp, Rattus norvegicus
agaaatctactcctgtagctcagcc

SEQ ID NO: 102780 - DNA, 25 bp, Rattus norvegicus
agaaatctactcgtgtagctcagcc

SEQ ID NO: 102781 - DNA, 25 bp, Rattus norvegicus
agaaatctagtccttgcttgtagac

SEQ ID NO: 102782 - DNA, 25 bp, Rattus norvegicus
agaaatctagtcgttgcttgtagac

SEQ ID NO: 102783 - DNA, 25 bp, Rattus norvegicus
agaaatctatggattgtagccaagt

SEQ ID NO: 102784 - DNA, 25 bp, Rattus norvegicus
agaaatctatggtttgtagccaagt

SEQ ID NO: 102785 - DNA, 25 bp, Rattus norvegicus
agaaatctccaacattgcccgggtg

SEQ ID NO: 102786 - DNA, 25 bp, Rattus norvegicus
agaaatctccaagattgcccgggtg

SEQ ID NO: 102787 - DNA, 25 bp, Rattus norvegicus
agaaatctgaccattgccgatgctg

SEQ ID NO: 102788 - DNA, 25 bp, Rattus norvegicus
agaaatctgacctttgccgatgctg

SEQ ID NO: 102789 - DNA, 25 bp, Rattus norvegicus
agaaatctgcccatcttaacctgaa

SEQ ID NO: 102790 - DNA, 25 bp, Rattus norvegicus
agaaatctgcccttcttaacctgaa

SEQ ID NO: 102791 - DNA, 25 bp, Rattus norvegicus
agaaatctgctcaaagctggcagca

SEQ ID NO: 102792 - DNA, 25 bp, Rattus norvegicus
agaaatctgctctaagctggcagca

SEQ ID NO: 102793 - DNA, 25 bp, Rattus norvegicus
agaaatctgggaagccttgaaggct

SEQ ID NO: 102794 - DNA, 25 bp, Rattus norvegicus
agaaatctgggatgccttgaaggct

SEQ ID NO: 102795 - DNA, 25 bp, Rattus norvegicus
agaaatctgggcaaggtctcctcag

SEQ ID NO: 102796 - DNA, 25 bp, Rattus norvegicus
agaaatctgggctaggtctcctcag

SEQ ID NO: 102797 - DNA, 25 bp, Rattus norvegicus
agaaatcttacccaatcaatggaat

SEQ ID NO: 102798 - DNA, 25 bp, Rattus norvegicus
agaaatcttaccgaatcaatggaat

SEQ ID NO: 102799 - DNA, 25 bp, Rattus norvegicus
agaaatcttagccactttcctgcac

SEQ ID NO: 102800 - DNA, 25 bp, Rattus norvegicus
agaaatcttagcgactttcctgcac

SEQ ID NO: 102801 - DNA, 25 bp, Rattus norvegicus
agaaatcttttgaggatatgtatac

SEQ ID NO: 102802 - DNA, 25 bp, Rattus norvegicus
agaaatcttttgtggatatgtatac

SEQ ID NO: 102803 - DNA, 25 bp, Rattus norvegicus
agaaatgaatcaccccgtagagcct

SEQ ID NO: 102804 - DNA, 25 bp, Rattus norvegicus
agaaatgaatcagcccgtagagcct

SEQ ID NO: 102805 - DNA, 25 bp, Rattus norvegicus
agaaatgaccgcatgggcagaagta

SEQ ID NO: 102806 - DNA, 25 bp, Rattus norvegicus
agaaatgaccgcttgggcagaagta

SEQ ID NO: 102807 - DNA, 25 bp, Rattus norvegicus
agaaatgacctgctgcttcagccct

SEQ ID NO: 102808 - DNA, 25 bp, Rattus norvegicus
agaaatgacctggtgcttcagccct

SEQ ID NO: 102809 - DNA, 25 bp, Rattus norvegicus
agaaatgactcaccaagctctcaag

SEQ ID NO: 102810 - DNA, 25 bp, Rattus norvegicus
agaaatgactcagcaagctctcaag

SEQ ID NO: 102811 - DNA, 25 bp, Rattus norvegicus
agaaatgagctcagctggctccttg

SEQ ID NO: 102812 - DNA, 25 bp, Rattus norvegicus
agaaatgagctctgctggctccttg

SEQ ID NO: 102813 - DNA, 25 bp, Rattus norvegicus
agaaatgaggaaaccggccctgctg

SEQ ID NO: 102814 - DNA, 25 bp, Rattus norvegicus
agaaatgaggaatccggccctgctg

SEQ ID NO: 102815 - DNA, 25 bp, Rattus norvegicus
agaaatgatcctctgttggctcttt

SEQ ID NO: 102816 - DNA, 25 bp, Rattus norvegicus
agaaatgatcctgtgttggctcttt

SEQ ID NO: 102817 - DNA, 25 bp, Rattus norvegicus
agaaatgatctcagtccctgtgggc

SEQ ID NO: 102818 - DNA, 25 bp, Rattus norvegicus
agaaatgatctctgtccctgtgggc

SEQ ID NO: 102819 - DNA, 25 bp, Rattus norvegicus
agaaatgattctagcctggtggtgg

SEQ ID NO: 102820 - DNA, 25 bp, Rattus norvegicus
agaaatgattcttgcctggtggtgg

SEQ ID NO: 102821 - DNA, 25 bp, Rattus norvegicus
agaaatgcaaacactctgatccctg

SEQ ID NO: 102822 - DNA, 25 bp, Rattus norvegicus
agaaatgcaaactctctgatccctg

SEQ ID NO: 102823 - DNA, 25 bp, Rattus norvegicus
agaaatgcaactcactcctgcggtc

SEQ ID NO: 102824 - DNA, 25 bp, Rattus norvegicus
agaaatgcaactgactcctgcggtc

SEQ ID NO: 102825 - DNA, 25 bp, Rattus norvegicus
agaaatgcacctacacacaatgtaa

SEQ ID NO: 102826 - DNA, 25 bp, Rattus norvegicus
agaaatgcaccttcacacaatgtaa

SEQ ID NO: 102827 - DNA, 25 bp, Rattus norvegicus
agaaatgcagcacaatactaaaggt

SEQ ID NO: 102828 - DNA, 25 bp, Rattus norvegicus
agaaatgcagcagaatactaaaggt

SEQ ID NO: 102829 - DNA, 25 bp, Rattus norvegicus
agaaatgcagtcagggtcacatcca

SEQ ID NO: 102830 - DNA, 25 bp, Rattus norvegicus
agaaatgcagtctgggtcacatcca

SEQ ID NO: 102831 - DNA, 25 bp, Rattus norvegicus
agaaatgcatacaacgtgcctatga

SEQ ID NO: 102832 - DNA, 25 bp, Rattus norvegicus
agaaatgcatactacgtgcctatga

SEQ ID NO: 102833 - DNA, 25 bp, Rattus norvegicus
agaaatgccctacttggtcatacaa

SEQ ID NO: 102834 - DNA, 25 bp, Rattus norvegicus
agaaatgccctagttggtcatacaa

SEQ ID NO: 102835 - DNA, 25 bp, Rattus norvegicus
agaaatgccgtgattgctgcttctc

SEQ ID NO: 102836 - DNA, 25 bp, Rattus norvegicus
agaaatgccgtgtttgctgcttctc

SEQ ID NO: 102837 - DNA, 25 bp, Rattus norvegicus
agaaatgcgaggatggatgccaaga

SEQ ID NO: 102838 - DNA, 25 bp, Rattus norvegicus
agaaatgcgaggttggatgccaaga

SEQ ID NO: 102839 - DNA, 25 bp, Rattus norvegicus
agaaatgcgctcacatgggtctaag

SEQ ID NO: 102840 - DNA, 25 bp, Rattus norvegicus
agaaatgcgctctcatgggtctaag

SEQ ID NO: 102841 - DNA, 25 bp, Rattus norvegicus
agaaatgctcagaggcaacatgaat

SEQ ID NO: 102842 - DNA, 25 bp, Rattus norvegicus
agaaatgctcagtggcaacatgaat

SEQ ID NO: 102843 - DNA, 25 bp, Rattus norvegicus
agaaatgctgctaattgccctgtac

SEQ ID NO: 102844 - DNA, 25 bp, Rattus norvegicus
agaaatgctgcttattgccctgtac

SEQ ID NO: 102845 - DNA, 25 bp, Rattus norvegicus
agaaatgcttctagctgtttgtcag

SEQ ID NO: 102846 - DNA, 25 bp, Rattus norvegicus
agaaatgcttcttgctgtttgtcag

SEQ ID NO: 102847 - DNA, 25 bp, Rattus norvegicus
agaaatgctttcagccctgtaacag

SEQ ID NO: 102848 - DNA, 25 bp, Rattus norvegicus
agaaatgctttctgccctgtaacag

SEQ ID NO: 102849 - DNA, 25 bp, Rattus norvegicus
agaaatggaccacggccaaggtgcc

SEQ ID NO: 102850 - DNA, 25 bp, Rattus norvegicus
agaaatggaccagggccaaggtgcc

SEQ ID NO: 102851 - DNA, 25 bp, Rattus norvegicus
agaaatggagacattcttatccggg

SEQ ID NO: 102852 - DNA, 25 bp, Rattus norvegicus
agaaatggagactttcttatccggg

SEQ ID NO: 102853 - DNA, 25 bp, Rattus norvegicus
agaaatggagccatccctcatggat

SEQ ID NO: 102854 - DNA, 25 bp, Rattus norvegicus
agaaatggagccttccctcatggat

SEQ ID NO: 102855 - DNA, 25 bp, Rattus norvegicus
agaaatggatcaagctgccccttag

SEQ ID NO: 102856 - DNA, 25 bp, Rattus norvegicus
agaaatggatcatgctgccccttag

SEQ ID NO: 102857 - DNA, 25 bp, Rattus norvegicus
agaaatggcactccctctattcagc

SEQ ID NO: 102858 - DNA, 25 bp, Rattus norvegicus
agaaatggcactgcctctattcagc

SEQ ID NO: 102859 - DNA, 25 bp, Rattus norvegicus
agaaatggcattcttggagtttgct

SEQ ID NO: 102860 - DNA, 25 bp, Rattus norvegicus
agaaatggcattgttggagtttgct

SEQ ID NO: 102861 - DNA, 25 bp, Rattus norvegicus
agaaatggccgtcgatttgtcacac

SEQ ID NO: 102862 - DNA, 25 bp, Rattus norvegicus
agaaatggccgtggatttgtcacac

SEQ ID NO: 102863 - DNA, 25 bp, Rattus norvegicus
agaaatggcgtgctcccaaatccag

SEQ ID NO: 102864 - DNA, 25 bp, Rattus norvegicus
agaaatggcgtggtcccaaatccag

SEQ ID NO: 102865 - DNA, 25 bp, Rattus norvegicus
agaaatgggacaatctcattcctgg

SEQ ID NO: 102866 - DNA, 25 bp, Rattus norvegicus
agaaatgggacattctcattcctgg

SEQ ID NO: 102867 - DNA, 25 bp, Rattus norvegicus
agaaatgggatcacactacctagcc

SEQ ID NO: 102868 - DNA, 25 bp, Rattus norvegicus
agaaatgggatctcactacctagcc

SEQ ID NO: 102869 - DNA, 25 bp, Rattus norvegicus
agaaatggtggaactggccgcccag

SEQ ID NO: 102870 - DNA, 25 bp, Rattus norvegicus
agaaatggtggatctggccgcccag

SEQ ID NO: 102871 - DNA, 25 bp, Rattus norvegicus
agaaatggtgttactcacgggcttg

SEQ ID NO: 102872 - DNA, 25 bp, Rattus norvegicus
agaaatggtgtttctcacgggcttg

SEQ ID NO: 102873 - DNA, 25 bp, Rattus norvegicus
agaaatgtcaacagcaccagcccag

SEQ ID NO: 102874 - DNA, 25 bp, Rattus norvegicus
agaaatgtcaactgcaccagcccag

SEQ ID NO: 102875 - DNA, 25 bp, Rattus norvegicus
agaaatgtcatcatctgtcactccc

SEQ ID NO: 102876 - DNA, 25 bp, Rattus norvegicus
agaaatgtcatcttctgtcactccc

SEQ ID NO: 102877 - DNA, 25 bp, Rattus norvegicus
agaaatgtcattagcttttcttggg

SEQ ID NO: 102878 - DNA, 25 bp, Rattus norvegicus
agaaatgtcatttgcttttcttggg

SEQ ID NO: 102879 - DNA, 25 bp, Rattus norvegicus
agaaatgtccctagtttgtctatag

SEQ ID NO: 102880 - DNA, 25 bp, Rattus norvegicus
agaaatgtcccttgtttgtctatag

SEQ ID NO: 102881 - DNA, 25 bp, Rattus norvegicus
agaaatgtcctacacctctgaatgt

SEQ ID NO: 102882 - DNA, 25 bp, Rattus norvegicus
agaaatgtcctagacctctgaatgt

SEQ ID NO: 102883 - DNA, 25 bp, Rattus norvegicus
agaaatgtctccacatctcatcttt

SEQ ID NO: 102884 - DNA, 25 bp, Rattus norvegicus
agaaatgtctcctcatctcatcttt

SEQ ID NO: 102885 - DNA, 25 bp, Rattus norvegicus
agaaatgtctgccatcctgttaagc

SEQ ID NO: 102886 - DNA, 25 bp, Rattus norvegicus
agaaatgtctgcgatcctgttaagc

SEQ ID NO: 102887 - DNA, 25 bp, Rattus norvegicus
agaaatgtctttccttgcacttgct

SEQ ID NO: 102888 - DNA, 25 bp, Rattus norvegicus
agaaatgtctttgcttgcacttgct

SEQ ID NO: 102889 - DNA, 25 bp, Rattus norvegicus
agaaatgtgcacaggcccatggttc

SEQ ID NO: 102890 - DNA, 25 bp, Rattus norvegicus
agaaatgtgcactggcccatggttc

SEQ ID NO: 102891 - DNA, 25 bp, Rattus norvegicus
agaaatgtgcctaactgctacctct

SEQ ID NO: 102892 - DNA, 25 bp, Rattus norvegicus
agaaatgtgccttactgctacctct

SEQ ID NO: 102893 - DNA, 25 bp, Rattus norvegicus
agaaatgtgctgatccttcctgtag

SEQ ID NO: 102894 - DNA, 25 bp, Rattus norvegicus
agaaatgtgctgttccttcctgtag

SEQ ID NO: 102895 - DNA, 25 bp, Rattus norvegicus
agaaatgtgcttacctgcagagccc

SEQ ID NO: 102896 - DNA, 25 bp, Rattus norvegicus
agaaatgtgctttcctgcagagccc

SEQ ID NO: 102897 - DNA, 25 bp, Rattus norvegicus
agaaatgtgggaagcaccaacccca

SEQ ID NO: 102898 - DNA, 25 bp, Rattus norvegicus
agaaatgtgggatgcaccaacccca

SEQ ID NO: 102899 - DNA, 25 bp, Rattus norvegicus
agaaatgttactctctctcctctgt

SEQ ID NO: 102900 - DNA, 25 bp, Rattus norvegicus
agaaatgttactgtctctcctctgt

SEQ ID NO: 102901 - DNA, 25 bp, Rattus norvegicus
agaaatgttctgactttcccctcta

SEQ ID NO: 102902 - DNA, 25 bp, Rattus norvegicus
agaaatgttctgtctttcccctcta

SEQ ID NO: 102903 - DNA, 25 bp, Rattus norvegicus
agaaatgttgtgctcttttgaagac

SEQ ID NO: 102904 - DNA, 25 bp, Rattus norvegicus
agaaatgttgtggtcttttgaagac

SEQ ID NO: 102905 - DNA, 25 bp, Rattus norvegicus
agaaattaaactcctccatcgagag

SEQ ID NO: 102906 - DNA, 25 bp, Rattus norvegicus
agaaattaaactgctccatcgagag

SEQ ID NO: 102907 - DNA, 25 bp, Rattus norvegicus
agaaattaagcaaacagcctcgttg

SEQ ID NO: 102908 - DNA, 25 bp, Rattus norvegicus
agaaattaagcatacagcctcgttg

SEQ ID NO: 102909 - DNA, 25 bp, Rattus norvegicus
agaaattagacaagaccccacttcc

SEQ ID NO: 102910 - DNA, 25 bp, Rattus norvegicus
agaaattagacatgaccccacttcc

SEQ ID NO: 102911 - DNA, 25 bp, Rattus norvegicus
agaaattattcaaggtcattgcacc

SEQ ID NO: 102912 - DNA, 25 bp, Rattus norvegicus
agaaattattcatggtcattgcacc

SEQ ID NO: 102913 - DNA, 25 bp, Rattus norvegicus
agaaattcaagacccgcctgggcat

SEQ ID NO: 102914 - DNA, 25 bp, Rattus norvegicus
agaaattcaagagccgcctgggcat

SEQ ID NO: 102915 - DNA, 25 bp, Rattus norvegicus
agaaattcactcactttttacccag

SEQ ID NO: 102916 - DNA, 25 bp, Rattus norvegicus
agaaattcactctctttttacccag

SEQ ID NO: 102917 - DNA, 25 bp, Rattus norvegicus
agaaattcagcccactcttgtaggc

SEQ ID NO: 102918 - DNA, 25 bp, Rattus norvegicus
agaaattcagccgactcttgtaggc

SEQ ID NO: 102919 - DNA, 25 bp, Rattus norvegicus
agaaattcatcacgctgctcaaggc

SEQ ID NO: 102920 - DNA, 25 bp, Rattus norvegicus
agaaattcatcaggctgctcaaggc

SEQ ID NO: 102921 - DNA, 25 bp, Rattus norvegicus
agaaattcatctcttaccttcgctg

SEQ ID NO: 102922 - DNA, 25 bp, Rattus norvegicus
agaaattcatctgttaccttcgctg

SEQ ID NO: 102923 - DNA, 25 bp, Rattus norvegicus
agaaattcattaagccaggcctgtg

SEQ ID NO: 102924 - DNA, 25 bp, Rattus norvegicus
agaaattcattatgccaggcctgtg

SEQ ID NO: 102925 - DNA, 25 bp, Rattus norvegicus
agaaattccgcaagtacatcgccca

SEQ ID NO: 102926 - DNA, 25 bp, Rattus norvegicus
agaaattccgcatgtacatcgccca

SEQ ID NO: 102927 - DNA, 25 bp, Rattus norvegicus
agaaattctagtccagcctctacct

SEQ ID NO: 102928 - DNA, 25 bp, Rattus norvegicus
agaaattctagtgcagcctctacct

SEQ ID NO: 102929 - DNA, 25 bp, Rattus norvegicus
agaaattctgacctgcgtgtttgca

SEQ ID NO: 102930 - DNA, 25 bp, Rattus norvegicus
agaaattctgacgtgcgtgtttgca

SEQ ID NO: 102931 - DNA, 25 bp, Rattus norvegicus
agaaattctgtaccctgattgttca

SEQ ID NO: 102932 - DNA, 25 bp, Rattus norvegicus
agaaattctgtagcctgattgttca

SEQ ID NO: 102933 - DNA, 25 bp, Rattus norvegicus
agaaattcttatactctgcctttga

SEQ ID NO: 102934 - DNA, 25 bp, Rattus norvegicus
agaaattcttattctctgcctttga

SEQ ID NO: 102935 - DNA, 25 bp, Rattus norvegicus
agaaattcttccacaaccacttggc

SEQ ID NO: 102936 - DNA, 25 bp, Rattus norvegicus
agaaattcttcctcaaccacttggc

SEQ ID NO: 102937 - DNA, 25 bp, Rattus norvegicus
agaaattcttctaggaatcctggaa

SEQ ID NO: 102938 - DNA, 25 bp, Rattus norvegicus
agaaattcttcttggaatcctggaa

SEQ ID NO: 102939 - DNA, 25 bp, Rattus norvegicus
agaaattcttgaacccttctctgtc

SEQ ID NO: 102940 - DNA, 25 bp, Rattus norvegicus
agaaattcttgatcccttctctgtc

SEQ ID NO: 102941 - DNA, 25 bp, Rattus norvegicus
agaaattcttggcagggtcctccac

SEQ ID NO: 102942 - DNA, 25 bp, Rattus norvegicus
agaaattcttgggagggtcctccac

SEQ ID NO: 102943 - DNA, 25 bp, Rattus norvegicus
agaaattgaccccatctgtgctctg

SEQ ID NO: 102944 - DNA, 25 bp, Rattus norvegicus
agaaattgacccgatctgtgctctg

SEQ ID NO: 102945 - DNA, 25 bp, Rattus norvegicus
agaaattgccctacactagtcacac

SEQ ID NO: 102946 - DNA, 25 bp, Rattus norvegicus
agaaattgcccttcactagtcacac

SEQ ID NO: 102947 - DNA, 25 bp, Rattus norvegicus
agaaattgctacactcatccaacct

SEQ ID NO: 102948 - DNA, 25 bp, Rattus norvegicus
agaaattgctactctcatccaacct

SEQ ID NO: 102949 - DNA, 25 bp, Rattus norvegicus
agaaattggcctagctgaagctcct

SEQ ID NO: 102950 - DNA, 25 bp, Rattus norvegicus
agaaattggccttgctgaagctcct

SEQ ID NO: 102951 - DNA, 25 bp, Rattus norvegicus
agaaattggcgtacttagcctactg

SEQ ID NO: 102952 - DNA, 25 bp, Rattus norvegicus
agaaattggcgttcttagcctactg

SEQ ID NO: 102953 - DNA, 25 bp, Rattus norvegicus
agaaattgggcccatgtcctgcttc

SEQ ID NO: 102954 - DNA, 25 bp, Rattus norvegicus
agaaattgggccgatgtcctgcttc

SEQ ID NO: 102955 - DNA, 25 bp, Rattus norvegicus
agaaattgtgcacctcaggcatgct

SEQ ID NO: 102956 - DNA, 25 bp, Rattus norvegicus
agaaattgtgcagctcaggcatgct

SEQ ID NO: 102957 - DNA, 25 bp, Rattus norvegicus
agaaattgttctctcatccatgtaa

SEQ ID NO: 102958 - DNA, 25 bp, Rattus norvegicus
agaaattgttctgtcatccatgtaa

SEQ ID NO: 102959 - DNA, 25 bp, Rattus norvegicus
agaaattgttgcattgtttctctga

SEQ ID NO: 102960 - DNA, 25 bp, Rattus norvegicus
agaaattgttgctttgtttctctga

SEQ ID NO: 102961 - DNA, 25 bp, Rattus norvegicus
agaaatttcactagccaactgcctt

SEQ ID NO: 102962 - DNA, 25 bp, Rattus norvegicus
agaaatttcacttgccaactgcctt

SEQ ID NO: 102963 - DNA, 25 bp, Rattus norvegicus
agaaatttcagcaccttcagagcct

SEQ ID NO: 102964 - DNA, 25 bp, Rattus norvegicus
agaaatttcagctccttcagagcct

SEQ ID NO: 102965 - DNA, 25 bp, Rattus norvegicus
agaaatttctgtccacagctgtggg

SEQ ID NO: 102966 - DNA, 25 bp, Rattus norvegicus
agaaatttctgtgcacagctgtggg

SEQ ID NO: 102967 - DNA, 25 bp, Rattus norvegicus
agaaatttcttcagaatcctgtgaa

SEQ ID NO: 102968 - DNA, 25 bp, Rattus norvegicus
agaaatttcttcagtcttcaatatc

SEQ ID NO: 102969 - DNA, 25 bp, Rattus norvegicus
agaaatttcttctgaatcctgtgaa

SEQ ID NO: 102970 - DNA, 25 bp, Rattus norvegicus
agaaatttcttctgtcttcaatatc

SEQ ID NO: 102971 - DNA, 25 bp, Rattus norvegicus
agaaattttctcaacagcccatggg

SEQ ID NO: 102972 - DNA, 25 bp, Rattus norvegicus
agaaattttctcaccatgctaaaag

SEQ ID NO: 102973 - DNA, 25 bp, Rattus norvegicus
agaaattttctctacagcccatggg

SEQ ID NO: 102974 - DNA, 25 bp, Rattus norvegicus
agaaattttctctccatgctaaaag

SEQ ID NO: 102975 - DNA, 25 bp, Rattus norvegicus
agaacaaacccaccttttgtccaca

SEQ ID NO: 102976 - DNA, 25 bp, Rattus norvegicus
agaacaaacccagcttttgtccaca

SEQ ID NO: 102977 - DNA, 25 bp, Rattus norvegicus
agaacaaacgcccaattgtcccttg

SEQ ID NO: 102978 - DNA, 25 bp, Rattus norvegicus
agaacaaacgccgaattgtcccttg

SEQ ID NO: 102979 - DNA, 25 bp, Rattus norvegicus
agaacaaagagtcagcacccaccac

SEQ ID NO: 102980 - DNA, 25 bp, Rattus norvegicus
agaacaaagagtgagcacccaccac

SEQ ID NO: 102981 - DNA, 25 bp, Rattus norvegicus
agaacaaagcgaagagtggcccgga

SEQ ID NO: 102982 - DNA, 25 bp, Rattus norvegicus
agaacaaagcgatgagtggcccgga

SEQ ID NO: 102983 - DNA, 25 bp, Rattus norvegicus
agaacaaaggtgatatctggacaga

SEQ ID NO: 102984 - DNA, 25 bp, Rattus norvegicus
agaacaaaggtgttatctggacaga

SEQ ID NO: 102985 - DNA, 25 bp, Rattus norvegicus
agaacaaatggcagtgacacccctg

SEQ ID NO: 102986 - DNA, 25 bp, Rattus norvegicus
agaacaaatggctgtgacacccctg

SEQ ID NO: 102987 - DNA, 25 bp, Rattus norvegicus
agaacaaattatcaccgtattccgt

SEQ ID NO: 102988 - DNA, 25 bp, Rattus norvegicus
agaacaaattatgaccgtattccgt

SEQ ID NO: 102989 - DNA, 25 bp, Rattus norvegicus
agaacaacagacaccatcctatcaa

SEQ ID NO: 102990 - DNA, 25 bp, Rattus norvegicus
agaacaacagactccatcctatcaa

SEQ ID NO: 102991 - DNA, 25 bp, Rattus norvegicus
agaacaacattgacctcagtgcagg

SEQ ID NO: 102992 - DNA, 25 bp, Rattus norvegicus
agaacaacattgtcctcagtgcagg

SEQ ID NO: 102993 - DNA, 25 bp, Rattus norvegicus
agaacaacctcacctagtatccctt

SEQ ID NO: 102994 - DNA, 25 bp, Rattus norvegicus
agaacaacctcagctagtatccctt

SEQ ID NO: 102995 - DNA, 25 bp, Rattus norvegicus
agaacaacctctcgattttcctctg

SEQ ID NO: 102996 - DNA, 25 bp, Rattus norvegicus
agaacaacctctggattttcctctg

SEQ ID NO: 102997 - DNA, 25 bp, Rattus norvegicus
agaacaacgaatatgctaccagatt

SEQ ID NO: 102998 - DNA, 25 bp, Rattus norvegicus
agaacaacgaatttgctaccagatt

SEQ ID NO: 102999 - DNA, 25 bp, Rattus norvegicus
agaacaacgcacactgtccatgatg

SEQ ID NO: 103000 - DNA, 25 bp, Rattus norvegicus
agaacaacgcactctgtccatgatg

SEQ ID NO: 103001 - DNA, 25 bp, Rattus norvegicus
agaacaacttccaagcaggctatga

SEQ ID NO: 103002 - DNA, 25 bp, Rattus norvegicus
agaacaacttcctagcaggctatga

SEQ ID NO: 103003 - DNA, 25 bp, Rattus norvegicus
agaacaacttctctgccttcaacct

SEQ ID NO: 103004 - DNA, 25 bp, Rattus norvegicus
agaacaacttctgtgccttcaacct

SEQ ID NO: 103005 - DNA, 25 bp, Rattus norvegicus
agaacaagacataaacacctctccc

SEQ ID NO: 103006 - DNA, 25 bp, Rattus norvegicus
agaacaagacattaacacctctccc

SEQ ID NO: 103007 - DNA, 25 bp, Rattus norvegicus
agaacaagccccagtactttgctga

SEQ ID NO: 103008 - DNA, 25 bp, Rattus norvegicus
agaacaagcccctgtactttgctga

SEQ ID NO: 103009 - DNA, 25 bp, Rattus norvegicus
agaacaagcgccagctgggtctagt

SEQ ID NO: 103010 - DNA, 25 bp, Rattus norvegicus
agaacaagcgcctgctgggtctagt

SEQ ID NO: 103011 - DNA, 25 bp, Rattus norvegicus
agaacaaggaacagccccagactgg

SEQ ID NO: 103012 - DNA, 25 bp, Rattus norvegicus
agaacaaggaactgccccagactgg

SEQ ID NO: 103013 - DNA, 25 bp, Rattus norvegicus
agaacaaggccaccacgtacggtct

SEQ ID NO: 103014 - DNA, 25 bp, Rattus norvegicus
agaacaaggccagcacgtacggtct

SEQ ID NO: 103015 - DNA, 25 bp, Rattus norvegicus
agaacaagtgctctttcccactggg

SEQ ID NO: 103016 - DNA, 25 bp, Rattus norvegicus
agaacaagtgctgtttcccactggg

SEQ ID NO: 103017 - DNA, 25 bp, Rattus norvegicus
agaacaagtgtgctcctcctgggtc

SEQ ID NO: 103018 - DNA, 25 bp, Rattus norvegicus
agaacaagtgtggtcctcctgggtc

SEQ ID NO: 103019 - DNA, 25 bp, Rattus norvegicus
agaacaagttatagcccactccagc

SEQ ID NO: 103020 - DNA, 25 bp, Rattus norvegicus
agaacaagttattgcccactccagc

SEQ ID NO: 103021 - DNA, 25 bp, Rattus norvegicus
agaacaatcacaatccctgtatgaa

SEQ ID NO: 103022 - DNA, 25 bp, Rattus norvegicus
agaacaatcacattccctgtatgaa

SEQ ID NO: 103023 - DNA, 25 bp, Rattus norvegicus
agaacaatcagcactggtgcagaat

SEQ ID NO: 103024 - DNA, 25 bp, Rattus norvegicus
agaacaatcagctctggtgcagaat

SEQ ID NO: 103025 - DNA, 25 bp, Rattus norvegicus
agaacaatccctccctgtttagaat

SEQ ID NO: 103026 - DNA, 25 bp, Rattus norvegicus
agaacaatccctgcctgtttagaat

SEQ ID NO: 103027 - DNA, 25 bp, Rattus norvegicus
agaacaatcttgaagccttgacaga

SEQ ID NO: 103028 - DNA, 25 bp, Rattus norvegicus
agaacaatcttgtagccttgacaga

SEQ ID NO: 103029 - DNA, 25 bp, Rattus norvegicus
agaacaatggccacactgactcttt

SEQ ID NO: 103030 - DNA, 25 bp, Rattus norvegicus
agaacaatggcctcactgactcttt

SEQ ID NO: 103031 - DNA, 25 bp, Rattus norvegicus
agaacaattatgagagcctcagacc

SEQ ID NO: 103032 - DNA, 25 bp, Rattus norvegicus
agaacaattatgtgagcctcagacc

SEQ ID NO: 103033 - DNA, 25 bp, Rattus norvegicus
agaacaattctaatatcgcatccag

SEQ ID NO: 103034 - DNA, 25 bp, Rattus norvegicus
agaacaattctattatcgcatccag

SEQ ID NO: 103035 - DNA, 25 bp, Rattus norvegicus
agaacaattgtactctccaaactac

SEQ ID NO: 103036 - DNA, 25 bp, Rattus norvegicus
agaacaattgtagtctccaaactac

SEQ ID NO: 103037 - DNA, 25 bp, Rattus norvegicus
agaacaattttactcctcgtcaggc

SEQ ID NO: 103038 - DNA, 25 bp, Rattus norvegicus
agaacaattttagtcctcgtcaggc

SEQ ID NO: 103039 - DNA, 25 bp, Rattus norvegicus
agaacacaacctaccgtggcttctt

SEQ ID NO: 103040 - DNA, 25 bp, Rattus norvegicus
agaacacaaccttccgtggcttctt

SEQ ID NO: 103041 - DNA, 25 bp, Rattus norvegicus
agaacacaagaactccaatccctgg

SEQ ID NO: 103042 - DNA, 25 bp, Rattus norvegicus
agaacacaagaagtccaatccctgg

SEQ ID NO: 103043 - DNA, 25 bp, Rattus norvegicus
agaacacaagtcatcaccctgaacg

SEQ ID NO: 103044 - DNA, 25 bp, Rattus norvegicus
agaacacaagtcttcaccctgaacg

SEQ ID NO: 103045 - DNA, 25 bp, Rattus norvegicus
agaacacaatgtatctctacacccc

SEQ ID NO: 103046 - DNA, 25 bp, Rattus norvegicus
agaacacaatgtttctctacacccc

SEQ ID NO: 103047 - DNA, 25 bp, Rattus norvegicus
agaacacacaacatcctcttcggtg

SEQ ID NO: 103048 - DNA, 25 bp, Rattus norvegicus
agaacacacaacttcctcttcggtg

SEQ ID NO: 103049 - DNA, 25 bp, Rattus norvegicus
agaacacacgtcaacacacacgatg

SEQ ID NO: 103050 - DNA, 25 bp, Rattus norvegicus
agaacacacgtctacacacacgatg

SEQ ID NO: 103051 - DNA, 25 bp, Rattus norvegicus
agaacacactcacatgcaagcgatg

SEQ ID NO: 103052 - DNA, 25 bp, Rattus norvegicus
agaacacactcagatgcaagcgatg

SEQ ID NO: 103053 - DNA, 25 bp, Rattus norvegicus
agaacacagcatccggtttgcctca

SEQ ID NO: 103054 - DNA, 25 bp, Rattus norvegicus
agaacacagcatgcggtttgcctca

SEQ ID NO: 103055 - DNA, 25 bp, Rattus norvegicus
agaacacagccccactagagtgcgg

SEQ ID NO: 103056 - DNA, 25 bp, Rattus norvegicus
agaacacagcccgactagagtgcgg

SEQ ID NO: 103057 - DNA, 25 bp, Rattus norvegicus
agaacacagcctactcggtgataaa

SEQ ID NO: 103058 - DNA, 25 bp, Rattus norvegicus
agaacacagccttctcggtgataaa

SEQ ID NO: 103059 - DNA, 25 bp, Rattus norvegicus
agaacacaggcaacactgtcactct

SEQ ID NO: 103060 - DNA, 25 bp, Rattus norvegicus
agaacacaggcatcactgtcactct

SEQ ID NO: 103061 - DNA, 25 bp, Rattus norvegicus
agaacacaggcccatctggtcagga

SEQ ID NO: 103062 - DNA, 25 bp, Rattus norvegicus
agaacacaggccgatctggtcagga

SEQ ID NO: 103063 - DNA, 25 bp, Rattus norvegicus
agaacacagtcacttacagtgatgt

SEQ ID NO: 103064 - DNA, 25 bp, Rattus norvegicus
agaacacagtcagttacagtgatgt

SEQ ID NO: 103065 - DNA, 25 bp, Rattus norvegicus
agaacacatggaagcccaggtgaat

SEQ ID NO: 103066 - DNA, 25 bp, Rattus norvegicus
agaacacatggatgcccaggtgaat

SEQ ID NO: 103067 - DNA, 25 bp, Rattus norvegicus
agaacacattcacacttgccctaat

SEQ ID NO: 103068 - DNA, 25 bp, Rattus norvegicus
agaacacattcagacttgccctaat

SEQ ID NO: 103069 - DNA, 25 bp, Rattus norvegicus
agaacacattgtcagcttcagcccc

SEQ ID NO: 103070 - DNA, 25 bp, Rattus norvegicus
agaacacattgtgagcttcagcccc

SEQ ID NO: 103071 - DNA, 25 bp, Rattus norvegicus
agaacaccaacgatgctaactcctg

SEQ ID NO: 103072 - DNA, 25 bp, Rattus norvegicus
agaacaccaacgttgctaactcctg

SEQ ID NO: 103073 - DNA, 25 bp, Rattus norvegicus
agaacaccacgtctctgttttcagc

SEQ ID NO: 103074 - DNA, 25 bp, Rattus norvegicus
agaacaccacgtgtctgttttcagc

SEQ ID NO: 103075 - DNA, 25 bp, Rattus norvegicus
agaacaccactgagtgctccagaag

SEQ ID NO: 103076 - DNA, 25 bp, Rattus norvegicus
agaacaccactgtgtgctccagaag

SEQ ID NO: 103077 - DNA, 25 bp, Rattus norvegicus
agaacaccattcaagggaactgcga

SEQ ID NO: 103078 - DNA, 25 bp, Rattus norvegicus
agaacaccattctagggaactgcga

SEQ ID NO: 103079 - DNA, 25 bp, Rattus norvegicus
agaacacccaagattggccttgaat

SEQ ID NO: 103080 - DNA, 25 bp, Rattus norvegicus
agaacacccaagtttggccttgaat

SEQ ID NO: 103081 - DNA, 25 bp, Rattus norvegicus
agaacacccagccagtatggtagaa

SEQ ID NO: 103082 - DNA, 25 bp, Rattus norvegicus
agaacacccagcgagtatggtagaa

SEQ ID NO: 103083 - DNA, 25 bp, Rattus norvegicus
agaacacccaggactcttcccatga

SEQ ID NO: 103084 - DNA, 25 bp, Rattus norvegicus
agaacacccaggatgcagaacccga

SEQ ID NO: 103085 - DNA, 25 bp, Rattus norvegicus
agaacacccaggtctcttcccatga

SEQ ID NO: 103086 - DNA, 25 bp, Rattus norvegicus
agaacacccaggttgcagaacccga

SEQ ID NO: 103087 - DNA, 25 bp, Rattus norvegicus
agaacacccctgaacatatcacggc

SEQ ID NO: 103088 - DNA, 25 bp, Rattus norvegicus
agaacacccctgtacatatcacggc

SEQ ID NO: 103089 - DNA, 25 bp, Rattus norvegicus
agaacaccctttcctatgtactcat

SEQ ID NO: 103090 - DNA, 25 bp, Rattus norvegicus
agaacaccctttgctatgtactcat

SEQ ID NO: 103091 - DNA, 25 bp, Rattus norvegicus
agaacaccgagactcacaggcaggc

SEQ ID NO: 103092 - DNA, 25 bp, Rattus norvegicus
agaacaccgagagtcacaggcaggc

SEQ ID NO: 103093 - DNA, 25 bp, Rattus norvegicus
agaacaccgcacaacaattttcacc

SEQ ID NO: 103094 - DNA, 25 bp, Rattus norvegicus
agaacaccgcactacaattttcacc

SEQ ID NO: 103095 - DNA, 25 bp, Rattus norvegicus
agaacaccgcagatcttaaccaagg

SEQ ID NO: 103096 - DNA, 25 bp, Rattus norvegicus
agaacaccgcagttcttaaccaagg

SEQ ID NO: 103097 - DNA, 25 bp, Rattus norvegicus
agaacaccgctcacatctgactgat

SEQ ID NO: 103098 - DNA, 25 bp, Rattus norvegicus
agaacaccgctctcatctgactgat

SEQ ID NO: 103099 - DNA, 25 bp, Rattus norvegicus
agaacaccggtaccagtcttcataa

SEQ ID NO: 103100 - DNA, 25 bp, Rattus norvegicus
agaacaccggtagcagtcttcataa

SEQ ID NO: 103101 - DNA, 25 bp, Rattus norvegicus
agaacacctactaatgaacacaaag

SEQ ID NO: 103102 - DNA, 25 bp, Rattus norvegicus
agaacacctacttatgaacacaaag

SEQ ID NO: 103103 - DNA, 25 bp, Rattus norvegicus
agaacacctataaccttttgacctc

SEQ ID NO: 103104 - DNA, 25 bp, Rattus norvegicus
agaacacctataatcgttacgaact

SEQ ID NO: 103105 - DNA, 25 bp, Rattus norvegicus
agaacacctatatccttttgacctc

SEQ ID NO: 103106 - DNA, 25 bp, Rattus norvegicus
agaacacctatattcgttacgaact

SEQ ID NO: 103107 - DNA, 25 bp, Rattus norvegicus
agaacacctcccaggcagtcaaatg

SEQ ID NO: 103108 - DNA, 25 bp, Rattus norvegicus
agaacacctccctggcagtcaaatg

SEQ ID NO: 103109 - DNA, 25 bp, Rattus norvegicus
agaacacctgttcccagcgctgaag

SEQ ID NO: 103110 - DNA, 25 bp, Rattus norvegicus
agaacacctgttgccagcgctgaag

SEQ ID NO: 103111 - DNA, 25 bp, Rattus norvegicus
agaacacggagcagcgaggtctttg

SEQ ID NO: 103112 - DNA, 25 bp, Rattus norvegicus
agaacacggagctgcgaggtctttg

SEQ ID NO: 103113 - DNA, 25 bp, Rattus norvegicus
agaacacggctcctatagctttgtt

SEQ ID NO: 103114 - DNA, 25 bp, Rattus norvegicus
agaacacggctcgtatagctttgtt

SEQ ID NO: 103115 - DNA, 25 bp, Rattus norvegicus
agaacacgggtcacagccgtggcca

SEQ ID NO: 103116 - DNA, 25 bp, Rattus norvegicus
agaacacgggtctcagccgtggcca

SEQ ID NO: 103117 - DNA, 25 bp, Rattus norvegicus
agaacacggtagctagaacacagat

SEQ ID NO: 103118 - DNA, 25 bp, Rattus norvegicus
agaacacggtaggtagaacacagat

SEQ ID NO: 103119 - DNA, 25 bp, Rattus norvegicus
agaacacggttcagacacatcctgc

SEQ ID NO: 103120 - DNA, 25 bp, Rattus norvegicus
agaacacggttctgacacatcctgc

SEQ ID NO: 103121 - DNA, 25 bp, Rattus norvegicus
agaacacggtttactgccagaactt

SEQ ID NO: 103122 - DNA, 25 bp, Rattus norvegicus
agaacacggttttctgccagaactt

SEQ ID NO: 103123 - DNA, 25 bp, Rattus norvegicus
agaacacgtattaccatggccttgg

SEQ ID NO: 103124 - DNA, 25 bp, Rattus norvegicus
agaacacgtatttccatggccttgg

SEQ ID NO: 103125 - DNA, 25 bp, Rattus norvegicus
agaacacgttgtaaactgagcgcaa

SEQ ID NO: 103126 - DNA, 25 bp, Rattus norvegicus
agaacacgttgtctttgtccctttg

SEQ ID NO: 103127 - DNA, 25 bp, Rattus norvegicus
agaacacgttgtgtttgtccctttg

SEQ ID NO: 103128 - DNA, 25 bp, Rattus norvegicus
agaacacgttgttaactgagcgcaa

SEQ ID NO: 103129 - DNA, 25 bp, Rattus norvegicus
agaacactaaccagaccatgggcgg

SEQ ID NO: 103130 - DNA, 25 bp, Rattus norvegicus
agaacactaacctgaccatgggcgg

SEQ ID NO: 103131 - DNA, 25 bp, Rattus norvegicus
agaacactatcaatggtccgcgggc

SEQ ID NO: 103132 - DNA, 25 bp, Rattus norvegicus
agaacactatcattggtccgcgggc

SEQ ID NO: 103133 - DNA, 25 bp, Rattus norvegicus
agaacactcattcacgcatgcgcac

SEQ ID NO: 103134 - DNA, 25 bp, Rattus norvegicus
agaacactcattcggtgtccttgcc

SEQ ID NO: 103135 - DNA, 25 bp, Rattus norvegicus
agaacactcattgacgcatgcgcac

SEQ ID NO: 103136 - DNA, 25 bp, Rattus norvegicus
agaacactcattgggtgtccttgcc

SEQ ID NO: 103137 - DNA, 25 bp, Rattus norvegicus
agaacactcccacccattgagatgt

SEQ ID NO: 103138 - DNA, 25 bp, Rattus norvegicus
agaacactcccagccattgagatgt

SEQ ID NO: 103139 - DNA, 25 bp, Rattus norvegicus
agaacactccctacttcaatggatt

SEQ ID NO: 103140 - DNA, 25 bp, Rattus norvegicus
agaacactccctagtcctggtagga

SEQ ID NO: 103141 - DNA, 25 bp, Rattus norvegicus
agaacactcccttcttcaatggatt

SEQ ID NO: 103142 - DNA, 25 bp, Rattus norvegicus
agaacactcccttgtcctggtagga

SEQ ID NO: 103143 - DNA, 25 bp, Rattus norvegicus
agaacactccgccattacagcaatt

SEQ ID NO: 103144 - DNA, 25 bp, Rattus norvegicus
agaacactccgcgattacagcaatt

SEQ ID NO: 103145 - DNA, 25 bp, Rattus norvegicus
agaacactgaccacattcagctgga

SEQ ID NO: 103146 - DNA, 25 bp, Rattus norvegicus
agaacactgacctcattcagctgga

SEQ ID NO: 103147 - DNA, 25 bp, Rattus norvegicus
agaacactgattctaatgtgagaaa

SEQ ID NO: 103148 - DNA, 25 bp, Rattus norvegicus
agaacactgattgtaatgtgagaaa

SEQ ID NO: 103149 - DNA, 25 bp, Rattus norvegicus
agaacactgcaaactgtgccttgcc

SEQ ID NO: 103150 - DNA, 25 bp, Rattus norvegicus
agaacactgcaatctgtgccttgcc

SEQ ID NO: 103151 - DNA, 25 bp, Rattus norvegicus
agaacactgcttagcctgggatggg

SEQ ID NO: 103152 - DNA, 25 bp, Rattus norvegicus
agaacactgctttgcctgggatggg

SEQ ID NO: 103153 - DNA, 25 bp, Rattus norvegicus
agaacactggataaatccttctggg

SEQ ID NO: 103154 - DNA, 25 bp, Rattus norvegicus
agaacactggattaatccttctggg

SEQ ID NO: 103155 - DNA, 25 bp, Rattus norvegicus
agaacactggcccaaatgtctcagg

SEQ ID NO: 103156 - DNA, 25 bp, Rattus norvegicus
agaacactggccgaaatgtctcagg

SEQ ID NO: 103157 - DNA, 25 bp, Rattus norvegicus
agaacactggcgaccaaggagcctt

SEQ ID NO: 103158 - DNA, 25 bp, Rattus norvegicus
agaacactggcgtccaaggagcctt

SEQ ID NO: 103159 - DNA, 25 bp, Rattus norvegicus
agaacactgggcactggcttcctat

SEQ ID NO: 103160 - DNA, 25 bp, Rattus norvegicus
agaacactgggcagcccttgactgc

SEQ ID NO: 103161 - DNA, 25 bp, Rattus norvegicus
agaacactgggctctggcttcctat

SEQ ID NO: 103162 - DNA, 25 bp, Rattus norvegicus
agaacactgggctgcccttgactgc

SEQ ID NO: 103163 - DNA, 25 bp, Rattus norvegicus
agaacactgtggcatcggcccattt

SEQ ID NO: 103164 - DNA, 25 bp, Rattus norvegicus
agaacactgtgggatcggcccattt

SEQ ID NO: 103165 - DNA, 25 bp, Rattus norvegicus
agaacactgttgaaatatccatatc

SEQ ID NO: 103166 - DNA, 25 bp, Rattus norvegicus
agaacactgttgtaatatccatatc

SEQ ID NO: 103167 - DNA, 25 bp, Rattus norvegicus
agaacacttaacagcgacgaggaga

SEQ ID NO: 103168 - DNA, 25 bp, Rattus norvegicus
agaacacttaactgcgacgaggaga

SEQ ID NO: 103169 - DNA, 25 bp, Rattus norvegicus
agaacacttattaccattgaccatt

SEQ ID NO: 103170 - DNA, 25 bp, Rattus norvegicus
agaacacttatttccattgaccatt

SEQ ID NO: 103171 - DNA, 25 bp, Rattus norvegicus
agaacacttcatccaaatccaaaac

SEQ ID NO: 103172 - DNA, 25 bp, Rattus norvegicus
agaacacttcatgcaaatccaaaac

SEQ ID NO: 103173 - DNA, 25 bp, Rattus norvegicus
agaacacttgccacgtgatcagtac

SEQ ID NO: 103174 - DNA, 25 bp, Rattus norvegicus
agaacacttgcctcgtgatcagtac

SEQ ID NO: 103175 - DNA, 25 bp, Rattus norvegicus
agaacactttcacatttacgcccag

SEQ ID NO: 103176 - DNA, 25 bp, Rattus norvegicus
agaacactttcagatttacgcccag

SEQ ID NO: 103177 - DNA, 25 bp, Rattus norvegicus
agaacactttggactacctacacca

SEQ ID NO: 103178 - DNA, 25 bp, Rattus norvegicus
agaacactttggtctacctacacca

SEQ ID NO: 103179 - DNA, 25 bp, Rattus norvegicus
agaacacttttaacgaggaggcaga

SEQ ID NO: 103180 - DNA, 25 bp, Rattus norvegicus
agaacacttttatcgaggaggcaga

SEQ ID NO: 103181 - DNA, 25 bp, Rattus norvegicus
agaacagaacttctcttccctgaca

SEQ ID NO: 103182 - DNA, 25 bp, Rattus norvegicus
agaacagaacttgtcttccctgaca

SEQ ID NO: 103183 - DNA, 25 bp, Rattus norvegicus
agaacagaagcccattcacggctgc

SEQ ID NO: 103184 - DNA, 25 bp, Rattus norvegicus
agaacagaagcccttaccccgtgag

SEQ ID NO: 103185 - DNA, 25 bp, Rattus norvegicus
agaacagaagccgattcacggctgc

SEQ ID NO: 103186 - DNA, 25 bp, Rattus norvegicus
agaacagaagccgttaccccgtgag

SEQ ID NO: 103187 - DNA, 25 bp, Rattus norvegicus
agaacagacacaccaagcaagaaaa

SEQ ID NO: 103188 - DNA, 25 bp, Rattus norvegicus
agaacagacacagcaagcaagaaaa

SEQ ID NO: 103189 - DNA, 25 bp, Rattus norvegicus
agaacagacaccatcatagcctacc

SEQ ID NO: 103190 - DNA, 25 bp, Rattus norvegicus
agaacagacaccttcatagcctacc

SEQ ID NO: 103191 - DNA, 25 bp, Rattus norvegicus
agaacagacattccactgaccggat

SEQ ID NO: 103192 - DNA, 25 bp, Rattus norvegicus
agaacagacattgcactgaccggat

SEQ ID NO: 103193 - DNA, 25 bp, Rattus norvegicus
agaacagaccaccagagacttgctc

SEQ ID NO: 103194 - DNA, 25 bp, Rattus norvegicus
agaacagaccacgagagacttgctc

SEQ ID NO: 103195 - DNA, 25 bp, Rattus norvegicus
agaacagagcttatcgataaggaat

SEQ ID NO: 103196 - DNA, 25 bp, Rattus norvegicus
agaacagagcttttcgataaggaat

SEQ ID NO: 103197 - DNA, 25 bp, Rattus norvegicus
agaacagaggtgcagtgctcccctg

SEQ ID NO: 103198 - DNA, 25 bp, Rattus norvegicus
agaacagaggtggagtgctcccctg

SEQ ID NO: 103199 - DNA, 25 bp, Rattus norvegicus
agaacagatacacaggctctctcac

SEQ ID NO: 103200 - DNA, 25 bp, Rattus norvegicus
agaacagatacagaggctctctcac

SEQ ID NO: 103201 - DNA, 25 bp, Rattus norvegicus
agaacagcaagcactctcaagccag

SEQ ID NO: 103202 - DNA, 25 bp, Rattus norvegicus
agaacagcaagctctctcaagccag

SEQ ID NO: 103203 - DNA, 25 bp, Rattus norvegicus
agaacagcacaaaggcctcctggtg

SEQ ID NO: 103204 - DNA, 25 bp, Rattus norvegicus
agaacagcacaatggcctcctggtg

SEQ ID NO: 103205 - DNA, 25 bp, Rattus norvegicus
agaacagcactgctacccgtttcac

SEQ ID NO: 103206 - DNA, 25 bp, Rattus norvegicus
agaacagcactggtacccgtttcac

SEQ ID NO: 103207 - DNA, 25 bp, Rattus norvegicus
agaacagcagatatgggaactccac

SEQ ID NO: 103208 - DNA, 25 bp, Rattus norvegicus
agaacagcagatttgggaactccac

SEQ ID NO: 103209 - DNA, 25 bp, Rattus norvegicus
agaacagcaggcctgactctgagca

SEQ ID NO: 103210 - DNA, 25 bp, Rattus norvegicus
agaacagcaggcgtgactctgagca

SEQ ID NO: 103211 - DNA, 25 bp, Rattus norvegicus
agaacagcagtacttgcaccacact

SEQ ID NO: 103212 - DNA, 25 bp, Rattus norvegicus
agaacagcagtagttgcaccacact

SEQ ID NO: 103213 - DNA, 25 bp, Rattus norvegicus
agaacagcatcacttggcagttact

SEQ ID NO: 103214 - DNA, 25 bp, Rattus norvegicus
agaacagcatcagttggcagttact

SEQ ID NO: 103215 - DNA, 25 bp, Rattus norvegicus
agaacagccaagctgccgatggcac

SEQ ID NO: 103216 - DNA, 25 bp, Rattus norvegicus
agaacagccaaggtgccgatggcac

SEQ ID NO: 103217 - DNA, 25 bp, Rattus norvegicus
agaacagccccacagagagccagct

SEQ ID NO: 103218 - DNA, 25 bp, Rattus norvegicus
agaacagccccagagagagccagct

SEQ ID NO: 103219 - DNA, 25 bp, Rattus norvegicus
agaacagccctgactacatagcaaa

SEQ ID NO: 103220 - DNA, 25 bp, Rattus norvegicus
agaacagccctgtctacatagcaaa

SEQ ID NO: 103221 - DNA, 25 bp, Rattus norvegicus
agaacagcctgtctctcgtgccctg

SEQ ID NO: 103222 - DNA, 25 bp, Rattus norvegicus
agaacagcctgtgtctcgtgccctg

SEQ ID NO: 103223 - DNA, 25 bp, Rattus norvegicus
agaacagccttccacaggagtcttg

SEQ ID NO: 103224 - DNA, 25 bp, Rattus norvegicus
agaacagccttcgacaggagtcttg

SEQ ID NO: 103225 - DNA, 25 bp, Rattus norvegicus
agaacagcgcgcaacttttatatga

SEQ ID NO: 103226 - DNA, 25 bp, Rattus norvegicus
agaacagcgcgctacttttatatga

SEQ ID NO: 103227 - DNA, 25 bp, Rattus norvegicus
agaacagcggccatttgtctagcct

SEQ ID NO: 103228 - DNA, 25 bp, Rattus norvegicus
agaacagcggccttttgtctagcct

SEQ ID NO: 103229 - DNA, 25 bp, Rattus norvegicus
agaacagcgtccaggccgcgtgcga

SEQ ID NO: 103230 - DNA, 25 bp, Rattus norvegicus
agaacagcgtcctggccgcgtgcga

SEQ ID NO: 103231 - DNA, 25 bp, Rattus norvegicus
agaacagctaccatgagcatctggc

SEQ ID NO: 103232 - DNA, 25 bp, Rattus norvegicus
agaacagctaccttgagcatctggc

SEQ ID NO: 103233 - DNA, 25 bp, Rattus norvegicus
agaacagctcctctcgatgcagaga

SEQ ID NO: 103234 - DNA, 25 bp, Rattus norvegicus
agaacagctcctgtcgatgcagaga

SEQ ID NO: 103235 - DNA, 25 bp, Rattus norvegicus
agaacagctctcatctagggaccac

SEQ ID NO: 103236 - DNA, 25 bp, Rattus norvegicus
agaacagctctcttctagggaccac

SEQ ID NO: 103237 - DNA, 25 bp, Rattus norvegicus
agaacagctgatctttttctcccca

SEQ ID NO: 103238 - DNA, 25 bp, Rattus norvegicus
agaacagctgatgtttttctcccca

SEQ ID NO: 103239 - DNA, 25 bp, Rattus norvegicus
agaacagctggaatcactcgctctg

SEQ ID NO: 103240 - DNA, 25 bp, Rattus norvegicus
agaacagctggattcactcgctctg

SEQ ID NO: 103241 - DNA, 25 bp, Rattus norvegicus
agaacagctggcacagctccgtggt

SEQ ID NO: 103242 - DNA, 25 bp, Rattus norvegicus
agaacagctggctcagctccgtggt

SEQ ID NO: 103243 - DNA, 25 bp, Rattus norvegicus
agaacagctgtgagtacgccttaat

SEQ ID NO: 103244 - DNA, 25 bp, Rattus norvegicus
agaacagctgtgtgtacgccttaat

SEQ ID NO: 103245 - DNA, 25 bp, Rattus norvegicus
agaacagctgttcgactccttcagt

SEQ ID NO: 103246 - DNA, 25 bp, Rattus norvegicus
agaacagctgttggactccttcagt

SEQ ID NO: 103247 - DNA, 25 bp, Rattus norvegicus
agaacagcttccaacattggctttc

SEQ ID NO: 103248 - DNA, 25 bp, Rattus norvegicus
agaacagcttcctacattggctttc

SEQ ID NO: 103249 - DNA, 25 bp, Rattus norvegicus
agaacagctttaatgacaggcctca

SEQ ID NO: 103250 - DNA, 25 bp, Rattus norvegicus
agaacagctttattgacaggcctca

SEQ ID NO: 103251 - DNA, 25 bp, Rattus norvegicus
agaacaggaagaaaccgctcgccat

SEQ ID NO: 103252 - DNA, 25 bp, Rattus norvegicus
agaacaggaagataccgctcgccat

SEQ ID NO: 103253 - DNA, 25 bp, Rattus norvegicus
agaacaggaccccagctaagagctg

SEQ ID NO: 103254 - DNA, 25 bp, Rattus norvegicus
agaacaggacccgagctaagagctg

SEQ ID NO: 103255 - DNA, 25 bp, Rattus norvegicus
agaacaggactgacttccgtactta

SEQ ID NO: 103256 - DNA, 25 bp, Rattus norvegicus
agaacaggactgtcttccgtactta

SEQ ID NO: 103257 - DNA, 25 bp, Rattus norvegicus
agaacaggagtcactcaccctgtga

SEQ ID NO: 103258 - DNA, 25 bp, Rattus norvegicus
agaacaggagtctctcaccctgtga

SEQ ID NO: 103259 - DNA, 25 bp, Rattus norvegicus
agaacaggatttcctgacctcagca

SEQ ID NO: 103260 - DNA, 25 bp, Rattus norvegicus
agaacaggatttgctgacctcagca

SEQ ID NO: 103261 - DNA, 25 bp, Rattus norvegicus
agaacaggccaaatggtcattgaat

SEQ ID NO: 103262 - DNA, 25 bp, Rattus norvegicus
agaacaggccaattggtcattgaat

SEQ ID NO: 103263 - DNA, 25 bp, Rattus norvegicus
agaacaggccagagcagccattcag

SEQ ID NO: 103264 - DNA, 25 bp, Rattus norvegicus
agaacaggccagtgcagccattcag

SEQ ID NO: 103265 - DNA, 25 bp, Rattus norvegicus
agaacaggcctgaggcagggcatct

SEQ ID NO: 103266 - DNA, 25 bp, Rattus norvegicus
agaacaggcctgtggcagggcatct

SEQ ID NO: 103267 - DNA, 25 bp, Rattus norvegicus
agaacaggcgctagcaactggaaat

SEQ ID NO: 103268 - DNA, 25 bp, Rattus norvegicus
agaacaggcgcttgcaactggaaat

SEQ ID NO: 103269 - DNA, 25 bp, Rattus norvegicus
agaacaggctccaacctttatgctt

SEQ ID NO: 103270 - DNA, 25 bp, Rattus norvegicus
agaacaggctcctacctttatgctt

SEQ ID NO: 103271 - DNA, 25 bp, Rattus norvegicus
agaacaggctgcaggactctatgct

SEQ ID NO: 103272 - DNA, 25 bp, Rattus norvegicus
agaacaggctgctggactctatgct

SEQ ID NO: 103273 - DNA, 25 bp, Rattus norvegicus
agaacaggcttgagaatcagagact

SEQ ID NO: 103274 - DNA, 25 bp, Rattus norvegicus
agaacaggcttgtgaatcagagact

SEQ ID NO: 103275 - DNA, 25 bp, Rattus norvegicus
agaacagggatcattagtctcactt

SEQ ID NO: 103276 - DNA, 25 bp, Rattus norvegicus
agaacagggatctttagtctcactt

SEQ ID NO: 103277 - DNA, 25 bp, Rattus norvegicus
agaacagggctgaggctttaaatcc

SEQ ID NO: 103278 - DNA, 25 bp, Rattus norvegicus
agaacagggctgtggctttaaatcc

SEQ ID NO: 103279 - DNA, 25 bp, Rattus norvegicus
agaacagggcttcgaagttcagtgt

SEQ ID NO: 103280 - DNA, 25 bp, Rattus norvegicus
agaacagggcttctctgccgatgta

SEQ ID NO: 103281 - DNA, 25 bp, Rattus norvegicus
agaacagggcttggaagttcagtgt

SEQ ID NO: 103282 - DNA, 25 bp, Rattus norvegicus
agaacagggcttgtctgccgatgta

SEQ ID NO: 103283 - DNA, 25 bp, Rattus norvegicus
agaacagggtggctctgcataacca

SEQ ID NO: 103284 - DNA, 25 bp, Rattus norvegicus
agaacagggtgggtctgcataacca

SEQ ID NO: 103285 - DNA, 25 bp, Rattus norvegicus
agaacaggtcctcctacgggcaaat

SEQ ID NO: 103286 - DNA, 25 bp, Rattus norvegicus
agaacaggtcctgctacgggcaaat

SEQ ID NO: 103287 - DNA, 25 bp, Rattus norvegicus
agaacaggtctcatggtacagtaat

SEQ ID NO: 103288 - DNA, 25 bp, Rattus norvegicus
agaacaggtctcttggtacagtaat

SEQ ID NO: 103289 - DNA, 25 bp, Rattus norvegicus
agaacagtacatccactcgctgacc

SEQ ID NO: 103290 - DNA, 25 bp, Rattus norvegicus
agaacagtacatgcactcgctgacc

SEQ ID NO: 103291 - DNA, 25 bp, Rattus norvegicus
agaacagtagctcgcttgcgttgtc

SEQ ID NO: 103292 - DNA, 25 bp, Rattus norvegicus
agaacagtagctggcttgcgttgtc

SEQ ID NO: 103293 - DNA, 25 bp, Rattus norvegicus
agaacagtatcccttttgcctctgg

SEQ ID NO: 103294 - DNA, 25 bp, Rattus norvegicus
agaacagtatccgttttgcctctgg

SEQ ID NO: 103295 - DNA, 25 bp, Rattus norvegicus
agaacagtatcgacttgtgcacaaa

SEQ ID NO: 103296 - DNA, 25 bp, Rattus norvegicus
agaacagtatcgtcttgtgcacaaa

SEQ ID NO: 103297 - DNA, 25 bp, Rattus norvegicus
agaacagtcaagagctccacgatga

SEQ ID NO: 103298 - DNA, 25 bp, Rattus norvegicus
agaacagtcaagtgctccacgatga

SEQ ID NO: 103299 - DNA, 25 bp, Rattus norvegicus
agaacagtcacacggtggcctgctg

SEQ ID NO: 103300 - DNA, 25 bp, Rattus norvegicus
agaacagtcacagggtggcctgctg

SEQ ID NO: 103301 - DNA, 25 bp, Rattus norvegicus
agaacagtcagcactttttgcctcg

SEQ ID NO: 103302 - DNA, 25 bp, Rattus norvegicus
agaacagtcagctctttttgcctcg

SEQ ID NO: 103303 - DNA, 25 bp, Rattus norvegicus
agaacagtcatcatcggctctgcaa

SEQ ID NO: 103304 - DNA, 25 bp, Rattus norvegicus
agaacagtcatcttcggctctgcaa

SEQ ID NO: 103305 - DNA, 25 bp, Rattus norvegicus
agaacagtccggctgacagagtcag

SEQ ID NO: 103306 - DNA, 25 bp, Rattus norvegicus
agaacagtccgggtgacagagtcag

SEQ ID NO: 103307 - DNA, 25 bp, Rattus norvegicus
agaacagtcggaactgcacaggaca

SEQ ID NO: 103308 - DNA, 25 bp, Rattus norvegicus
agaacagtcggatctgcacaggaca

SEQ ID NO: 103309 - DNA, 25 bp, Rattus norvegicus
agaacagtcgtcagtgcagccacca

SEQ ID NO: 103310 - DNA, 25 bp, Rattus norvegicus
agaacagtcgtctgtgcagccacca

SEQ ID NO: 103311 - DNA, 25 bp, Rattus norvegicus
agaacagtgcccaggctcctaggca

SEQ ID NO: 103312 - DNA, 25 bp, Rattus norvegicus
agaacagtgccctggctcctaggca

SEQ ID NO: 103313 - DNA, 25 bp, Rattus norvegicus
agaacagtgccgaccggtgcgccaa

SEQ ID NO: 103314 - DNA, 25 bp, Rattus norvegicus
agaacagtgccgtccggtgcgccaa

SEQ ID NO: 103315 - DNA, 25 bp, Rattus norvegicus
agaacagtggctactggcacagcag

SEQ ID NO: 103316 - DNA, 25 bp, Rattus norvegicus
agaacagtggcttctggcacagcag

SEQ ID NO: 103317 - DNA, 25 bp, Rattus norvegicus
agaacagtgggtcctggtttgcccc

SEQ ID NO: 103318 - DNA, 25 bp, Rattus norvegicus
agaacagtgggtgctggtttgcccc

SEQ ID NO: 103319 - DNA, 25 bp, Rattus norvegicus
agaacagtgtatacgacctggcctt

SEQ ID NO: 103320 - DNA, 25 bp, Rattus norvegicus
agaacagtgtattcgacctggcctt

SEQ ID NO: 103321 - DNA, 25 bp, Rattus norvegicus
agaacagtgtctccatctaggccct

SEQ ID NO: 103322 - DNA, 25 bp, Rattus norvegicus
agaacagtgtctgcatctaggccct

SEQ ID NO: 103323 - DNA, 25 bp, Rattus norvegicus
agaacagtgtttcatatgacccatt

SEQ ID NO: 103324 - DNA, 25 bp, Rattus norvegicus
agaacagtgtttgatatgacccatt

SEQ ID NO: 103325 - DNA, 25 bp, Rattus norvegicus
agaacagttattcgcaagtatgcag

SEQ ID NO: 103326 - DNA, 25 bp, Rattus norvegicus
agaacagttattggcaagtatgcag

SEQ ID NO: 103327 - DNA, 25 bp, Rattus norvegicus
agaacagttctcaacgttgcctcag

SEQ ID NO: 103328 - DNA, 25 bp, Rattus norvegicus
agaacagttctctacgttgcctcag

SEQ ID NO: 103329 - DNA, 25 bp, Rattus norvegicus
agaacagttgttcctcttccgaagc

SEQ ID NO: 103330 - DNA, 25 bp, Rattus norvegicus
agaacagttgttgctcttccgaagc

SEQ ID NO: 103331 - DNA, 25 bp, Rattus norvegicus
agaacataactcagcgcggcaacgt

SEQ ID NO: 103332 - DNA, 25 bp, Rattus norvegicus
agaacataactctgcgcggcaacgt

SEQ ID NO: 103333 - DNA, 25 bp, Rattus norvegicus
agaacataatccaattgtctgcagc

SEQ ID NO: 103334 - DNA, 25 bp, Rattus norvegicus
agaacataatcctattgtctgcagc

SEQ ID NO: 103335 - DNA, 25 bp, Rattus norvegicus
agaacatacttgctctttttccttt

SEQ ID NO: 103336 - DNA, 25 bp, Rattus norvegicus
agaacatacttggtctttttccttt

SEQ ID NO: 103337 - DNA, 25 bp, Rattus norvegicus
agaacatagattctcaagagcgata

SEQ ID NO: 103338 - DNA, 25 bp, Rattus norvegicus
agaacatagattgtcaagagcgata

SEQ ID NO: 103339 - DNA, 25 bp, Rattus norvegicus
agaacatatacccagtacccgtcct

SEQ ID NO: 103340 - DNA, 25 bp, Rattus norvegicus
agaacatataccgagtacccgtcct

SEQ ID NO: 103341 - DNA, 25 bp, Rattus norvegicus
agaacatcagtgagaggcaggcctt

SEQ ID NO: 103342 - DNA, 25 bp, Rattus norvegicus
agaacatcagtgtgaggcaggcctt

SEQ ID NO: 103343 - DNA, 25 bp, Rattus norvegicus
agaacatcattcagcaggactgtat

SEQ ID NO: 103344 - DNA, 25 bp, Rattus norvegicus
agaacatcattctgcaggactgtat

SEQ ID NO: 103345 - DNA, 25 bp, Rattus norvegicus
agaacatccgagcttctcctgtgga

SEQ ID NO: 103346 - DNA, 25 bp, Rattus norvegicus
agaacatccgaggttctcctgtgga

SEQ ID NO: 103347 - DNA, 25 bp, Rattus norvegicus
agaacatcctccactgcaagtgaac

SEQ ID NO: 103348 - DNA, 25 bp, Rattus norvegicus
agaacatcctcccaactttgaaatg

SEQ ID NO: 103349 - DNA, 25 bp, Rattus norvegicus
agaacatcctccgaactttgaaatg

SEQ ID NO: 103350 - DNA, 25 bp, Rattus norvegicus
agaacatcctcctctgcaagtgaac

SEQ ID NO: 103351 - DNA, 25 bp, Rattus norvegicus
agaacatcgacgcatccacacgggt

SEQ ID NO: 103352 - DNA, 25 bp, Rattus norvegicus
agaacatcgacggatccacacgggt

SEQ ID NO: 103353 - DNA, 25 bp, Rattus norvegicus
agaacatctcagcctaggccccagt

SEQ ID NO: 103354 - DNA, 25 bp, Rattus norvegicus
agaacatctcaggctaggccccagt

SEQ ID NO: 103355 - DNA, 25 bp, Rattus norvegicus
agaacatctccccatgtgttatcac

SEQ ID NO: 103356 - DNA, 25 bp, Rattus norvegicus
agaacatctcccgatgtgttatcac

SEQ ID NO: 103357 - DNA, 25 bp, Rattus norvegicus
agaacatctgtaatgcatctggtgt

SEQ ID NO: 103358 - DNA, 25 bp, Rattus norvegicus
agaacatctgtattgcatctggtgt

SEQ ID NO: 103359 - DNA, 25 bp, Rattus norvegicus
agaacatctgttcaagtcgacgccc

SEQ ID NO: 103360 - DNA, 25 bp, Rattus norvegicus
agaacatctgttgaagtcgacgccc

SEQ ID NO: 103361 - DNA, 25 bp, Rattus norvegicus
agaacatcttaaaggcggccaggaa

SEQ ID NO: 103362 - DNA, 25 bp, Rattus norvegicus
agaacatcttaatggcggccaggaa

SEQ ID NO: 103363 - DNA, 25 bp, Rattus norvegicus
agaacatgaagcatggtgcccctat

SEQ ID NO: 103364 - DNA, 25 bp, Rattus norvegicus
agaacatgaagcttggtgcccctat

SEQ ID NO: 103365 - DNA, 25 bp, Rattus norvegicus
agaacatgagtactccgggctgctg

SEQ ID NO: 103366 - DNA, 25 bp, Rattus norvegicus
agaacatgagtagtccgggctgctg

SEQ ID NO: 103367 - DNA, 25 bp, Rattus norvegicus
agaacatgagttccccggatgcctg

SEQ ID NO: 103368 - DNA, 25 bp, Rattus norvegicus
agaacatgagttgcccggatgcctg

SEQ ID NO: 103369 - DNA, 25 bp, Rattus norvegicus
agaacatgctccagcggttgttgtc

SEQ ID NO: 103370 - DNA, 25 bp, Rattus norvegicus
agaacatgctcctgcggttgttgtc

SEQ ID NO: 103371 - DNA, 25 bp, Rattus norvegicus
agaacatggacgatacctcaggctc

SEQ ID NO: 103372 - DNA, 25 bp, Rattus norvegicus
agaacatggacgttacctcaggctc

SEQ ID NO: 103373 - DNA, 25 bp, Rattus norvegicus
agaacatggagtcgtggtacatgct

SEQ ID NO: 103374 - DNA, 25 bp, Rattus norvegicus
agaacatggagtggtggtacatgct

SEQ ID NO: 103375 - DNA, 25 bp, Rattus norvegicus
agaacatggccaatgctgctctttt

SEQ ID NO: 103376 - DNA, 25 bp, Rattus norvegicus
agaacatggccattgctgctctttt

SEQ ID NO: 103377 - DNA, 25 bp, Rattus norvegicus
agaacatggcctacactggttaccc

SEQ ID NO: 103378 - DNA, 25 bp, Rattus norvegicus
agaacatggccttcactggttaccc

SEQ ID NO: 103379 - DNA, 25 bp, Rattus norvegicus
agaacatgggttagcgctcgccggc

SEQ ID NO: 103380 - DNA, 25 bp, Rattus norvegicus
agaacatgggtttgcgctcgccggc

SEQ ID NO: 103381 - DNA, 25 bp, Rattus norvegicus
agaacatgtactccagcacccgcag

SEQ ID NO: 103382 - DNA, 25 bp, Rattus norvegicus
agaacatgtactgcagcacccgcag

SEQ ID NO: 103383 - DNA, 25 bp, Rattus norvegicus
agaacatgtatcagcttttgcccat

SEQ ID NO: 103384 - DNA, 25 bp, Rattus norvegicus
agaacatgtatctgcttttgcccat

SEQ ID NO: 103385 - DNA, 25 bp, Rattus norvegicus
agaacatgtatgagcctccaggcct

SEQ ID NO: 103386 - DNA, 25 bp, Rattus norvegicus
agaacatgtatgtgcctccaggcct

SEQ ID NO: 103387 - DNA, 25 bp, Rattus norvegicus
agaacatgtgggattctgccatcgt

SEQ ID NO: 103388 - DNA, 25 bp, Rattus norvegicus
agaacatgtgggtttctgccatcgt

SEQ ID NO: 103389 - DNA, 25 bp, Rattus norvegicus
agaacatgtgtcaggtgtaccagcc

SEQ ID NO: 103390 - DNA, 25 bp, Rattus norvegicus
agaacatgtgtctggtgtaccagcc

SEQ ID NO: 103391 - DNA, 25 bp, Rattus norvegicus
agaacattagtcagaaatacattaa

SEQ ID NO: 103392 - DNA, 25 bp, Rattus norvegicus
agaacattagtctgaaatacattaa

SEQ ID NO: 103393 - DNA, 25 bp, Rattus norvegicus
agaacattcaccaggtgccacccat

SEQ ID NO: 103394 - DNA, 25 bp, Rattus norvegicus
agaacattcacctggtgccacccat

SEQ ID NO: 103395 - DNA, 25 bp, Rattus norvegicus
agaacattccatcgcctcaggaagt

SEQ ID NO: 103396 - DNA, 25 bp, Rattus norvegicus
agaacattccatggcctcaggaagt

SEQ ID NO: 103397 - DNA, 25 bp, Rattus norvegicus
agaacattcccgaaacttggccaat

SEQ ID NO: 103398 - DNA, 25 bp, Rattus norvegicus
agaacattcccgtaacttggccaat

SEQ ID NO: 103399 - DNA, 25 bp, Rattus norvegicus
agaacattcgttccaagctccaggc

SEQ ID NO: 103400 - DNA, 25 bp, Rattus norvegicus
agaacattcgttgcaagctccaggc

SEQ ID NO: 103401 - DNA, 25 bp, Rattus norvegicus
agaacattctggactgcctttgcac

SEQ ID NO: 103402 - DNA, 25 bp, Rattus norvegicus
agaacattctggtctgcctttgcac

SEQ ID NO: 103403 - DNA, 25 bp, Rattus norvegicus
agaacattgcttacctgctaatacc

SEQ ID NO: 103404 - DNA, 25 bp, Rattus norvegicus
agaacattgctttcctgctaatacc

SEQ ID NO: 103405 - DNA, 25 bp, Rattus norvegicus
agaacattggacagctttccaaccc

SEQ ID NO: 103406 - DNA, 25 bp, Rattus norvegicus
agaacattggactgctttccaaccc

SEQ ID NO: 103407 - DNA, 25 bp, Rattus norvegicus
agaacattgggcatcctgtccctca

SEQ ID NO: 103408 - DNA, 25 bp, Rattus norvegicus
agaacattgggcttcctgtccctca

SEQ ID NO: 103409 - DNA, 25 bp, Rattus norvegicus
agaacattgtgacacctcgtacacc

SEQ ID NO: 103410 - DNA, 25 bp, Rattus norvegicus
agaacattgtgaccgctgtggagcc

SEQ ID NO: 103411 - DNA, 25 bp, Rattus norvegicus
agaacattgtgagacctcgtacacc

SEQ ID NO: 103412 - DNA, 25 bp, Rattus norvegicus
agaacattgtgagcgctgtggagcc

SEQ ID NO: 103413 - DNA, 25 bp, Rattus norvegicus
agaacattgtgtaccaaactctggc

SEQ ID NO: 103414 - DNA, 25 bp, Rattus norvegicus
agaacattgtgtagcttaccacgca

SEQ ID NO: 103415 - DNA, 25 bp, Rattus norvegicus
agaacattgtgttccaaactctggc

SEQ ID NO: 103416 - DNA, 25 bp, Rattus norvegicus
agaacattgtgttgcttaccacgca

SEQ ID NO: 103417 - DNA, 25 bp, Rattus norvegicus
agaacatttatacgccaggctggga

SEQ ID NO: 103418 - DNA, 25 bp, Rattus norvegicus
agaacatttataggccaggctggga

SEQ ID NO: 103419 - DNA, 25 bp, Rattus norvegicus
agaacatttcataattttgcagcag

SEQ ID NO: 103420 - DNA, 25 bp, Rattus norvegicus
agaacatttcattattttgcagcag

SEQ ID NO: 103421 - DNA, 25 bp, Rattus norvegicus
agaacatttccaaacactgcttccc

SEQ ID NO: 103422 - DNA, 25 bp, Rattus norvegicus
agaacatttccatacactgcttccc

SEQ ID NO: 103423 - DNA, 25 bp, Rattus norvegicus
agaacatttcttcggctatacttgg

SEQ ID NO: 103424 - DNA, 25 bp, Rattus norvegicus
agaacatttcttgggctatacttgg

SEQ ID NO: 103425 - DNA, 25 bp, Rattus norvegicus
agaaccaaaggcctgcactagcgaa

SEQ ID NO: 103426 - DNA, 25 bp, Rattus norvegicus
agaaccaaaggcgtgcactagcgaa

SEQ ID NO: 103427 - DNA, 25 bp, Rattus norvegicus
agaaccaaattactggctccctccg

SEQ ID NO: 103428 - DNA, 25 bp, Rattus norvegicus
agaaccaaattagtggctccctccg

SEQ ID NO: 103429 - DNA, 25 bp, Rattus norvegicus
agaaccaaggccatccagcaagtac

SEQ ID NO: 103430 - DNA, 25 bp, Rattus norvegicus
agaaccaaggccttccagcaagtac

SEQ ID NO: 103431 - DNA, 25 bp, Rattus norvegicus
agaaccaataatctcttccctacag

SEQ ID NO: 103432 - DNA, 25 bp, Rattus norvegicus
agaaccaataatgtcttccctacag

SEQ ID NO: 103433 - DNA, 25 bp, Rattus norvegicus
agaaccaatcatctcaggctttttt

SEQ ID NO: 103434 - DNA, 25 bp, Rattus norvegicus
agaaccaatcatcttatccatctga

SEQ ID NO: 103435 - DNA, 25 bp, Rattus norvegicus
agaaccaatcatgtcaggctttttt

SEQ ID NO: 103436 - DNA, 25 bp, Rattus norvegicus
agaaccaatcatgttatccatctga

SEQ ID NO: 103437 - DNA, 25 bp, Rattus norvegicus
agaaccacaataatctcccggctgt

SEQ ID NO: 103438 - DNA, 25 bp, Rattus norvegicus
agaaccacaatattctcccggctgt

SEQ ID NO: 103439 - DNA, 25 bp, Rattus norvegicus
agaaccacaggacaacgcatgccac

SEQ ID NO: 103440 - DNA, 25 bp, Rattus norvegicus
agaaccacaggagaacgcatgccac

SEQ ID NO: 103441 - DNA, 25 bp, Rattus norvegicus
agaaccacagggactgactgacagt

SEQ ID NO: 103442 - DNA, 25 bp, Rattus norvegicus
agaaccacagggtctgactgacagt

SEQ ID NO: 103443 - DNA, 25 bp, Rattus norvegicus
agaaccacaggtcttgaccctatcc

SEQ ID NO: 103444 - DNA, 25 bp, Rattus norvegicus
agaaccacaggtgttgaccctatcc

SEQ ID NO: 103445 - DNA, 25 bp, Rattus norvegicus
agaaccacagttaatcatcccatca

SEQ ID NO: 103446 - DNA, 25 bp, Rattus norvegicus
agaaccacagtttatcatcccatca

SEQ ID NO: 103447 - DNA, 25 bp, Rattus norvegicus
agaaccacatttacatgcaccaaat

SEQ ID NO: 103448 - DNA, 25 bp, Rattus norvegicus
agaaccacattttcatgcaccaaat

SEQ ID NO: 103449 - DNA, 25 bp, Rattus norvegicus
agaaccaccgagactggccccagag

SEQ ID NO: 103450 - DNA, 25 bp, Rattus norvegicus
agaaccaccgagtctggccccagag

SEQ ID NO: 103451 - DNA, 25 bp, Rattus norvegicus
agaaccaccggtatgaagtcgccgt

SEQ ID NO: 103452 - DNA, 25 bp, Rattus norvegicus
agaaccaccggtttgaagtcgccgt

SEQ ID NO: 103453 - DNA, 25 bp, Rattus norvegicus
agaaccacctctccattgaatttgt

SEQ ID NO: 103454 - DNA, 25 bp, Rattus norvegicus
agaaccacctctgcattgaatttgt

SEQ ID NO: 103455 - DNA, 25 bp, Rattus norvegicus
agaaccacctgtagctttcacagga

SEQ ID NO: 103456 - DNA, 25 bp, Rattus norvegicus
agaaccacctgttgctttcacagga

SEQ ID NO: 103457 - DNA, 25 bp, Rattus norvegicus
agaaccacgtcaagcttgggagcct

SEQ ID NO: 103458 - DNA, 25 bp, Rattus norvegicus
agaaccacgtcatgcttgggagcct

SEQ ID NO: 103459 - DNA, 25 bp, Rattus norvegicus
agaaccactaacacgtgactgctgg

SEQ ID NO: 103460 - DNA, 25 bp, Rattus norvegicus
agaaccactaactcgtgactgctgg

SEQ ID NO: 103461 - DNA, 25 bp, Rattus norvegicus
agaaccactcatctcatggagctga

SEQ ID NO: 103462 - DNA, 25 bp, Rattus norvegicus
agaaccactcatgtcatggagctga

SEQ ID NO: 103463 - DNA, 25 bp, Rattus norvegicus
agaaccactctgatgcctacggatg

SEQ ID NO: 103464 - DNA, 25 bp, Rattus norvegicus
agaaccactctgttgcctacggatg

SEQ ID NO: 103465 - DNA, 25 bp, Rattus norvegicus
agaaccactggtattgtcctggtgt

SEQ ID NO: 103466 - DNA, 25 bp, Rattus norvegicus
agaaccactggttttgtcctggtgt

SEQ ID NO: 103467 - DNA, 25 bp, Rattus norvegicus
agaaccactgtcattcagtacccag

SEQ ID NO: 103468 - DNA, 25 bp, Rattus norvegicus
agaaccactgtctttcagtacccag

SEQ ID NO: 103469 - DNA, 25 bp, Rattus norvegicus
agaaccacttggatgctgcagaatc

SEQ ID NO: 103470 - DNA, 25 bp, Rattus norvegicus
agaaccacttggttgctgcagaatc

SEQ ID NO: 103471 - DNA, 25 bp, Rattus norvegicus
agaaccagaggaacaccagctcagc

SEQ ID NO: 103472 - DNA, 25 bp, Rattus norvegicus
agaaccagaggatcaccagctcagc

SEQ ID NO: 103473 - DNA, 25 bp, Rattus norvegicus
agaaccagatgaaccgtgaccttca

SEQ ID NO: 103474 - DNA, 25 bp, Rattus norvegicus
agaaccagatgatccgtgaccttca

SEQ ID NO: 103475 - DNA, 25 bp, Rattus norvegicus
agaaccagatgcagctgaacgcctt

SEQ ID NO: 103476 - DNA, 25 bp, Rattus norvegicus
agaaccagatgctgctgaacgcctt

SEQ ID NO: 103477 - DNA, 25 bp, Rattus norvegicus
agaaccagccgcattctgcatatag

SEQ ID NO: 103478 - DNA, 25 bp, Rattus norvegicus
agaaccagccgctttctgcatatag

SEQ ID NO: 103479 - DNA, 25 bp, Rattus norvegicus
agaaccagcgacactgaccagcagg

SEQ ID NO: 103480 - DNA, 25 bp, Rattus norvegicus
agaaccagcgactctgaccagcagg

SEQ ID NO: 103481 - DNA, 25 bp, Rattus norvegicus
agaaccagcgttccttctccaggag

SEQ ID NO: 103482 - DNA, 25 bp, Rattus norvegicus
agaaccagcgttgcttctccaggag

SEQ ID NO: 103483 - DNA, 25 bp, Rattus norvegicus
agaaccagctggatatttggaagta

SEQ ID NO: 103484 - DNA, 25 bp, Rattus norvegicus
agaaccagctggttatttggaagta

SEQ ID NO: 103485 - DNA, 25 bp, Rattus norvegicus
agaaccagcttcagatccctgtgct

SEQ ID NO: 103486 - DNA, 25 bp, Rattus norvegicus
agaaccagcttctgatccctgtgct

SEQ ID NO: 103487 - DNA, 25 bp, Rattus norvegicus
agaaccaggaatcgactgcccctaa

SEQ ID NO: 103488 - DNA, 25 bp, Rattus norvegicus
agaaccaggaatggactgcccctaa

SEQ ID NO: 103489 - DNA, 25 bp, Rattus norvegicus
agaaccaggcacctgctgtctttaa

SEQ ID NO: 103490 - DNA, 25 bp, Rattus norvegicus
agaaccaggcacgtgctgtctttaa

SEQ ID NO: 103491 - DNA, 25 bp, Rattus norvegicus
agaaccaggtagcatggcttctcct

SEQ ID NO: 103492 - DNA, 25 bp, Rattus norvegicus
agaaccaggtaggatggcttctcct

SEQ ID NO: 103493 - DNA, 25 bp, Rattus norvegicus
agaaccaggtccaagtgttgcctcc

SEQ ID NO: 103494 - DNA, 25 bp, Rattus norvegicus
agaaccaggtcctagtgttgcctcc

SEQ ID NO: 103495 - DNA, 25 bp, Rattus norvegicus
agaaccaggtgaacagtgcttgtcg

SEQ ID NO: 103496 - DNA, 25 bp, Rattus norvegicus
agaaccaggtgatcagtgcttgtcg

SEQ ID NO: 103497 - DNA, 25 bp, Rattus norvegicus
agaaccagtgaacggctccatccag

SEQ ID NO: 103498 - DNA, 25 bp, Rattus norvegicus
agaaccagtgaagggctccatccag

SEQ ID NO: 103499 - DNA, 25 bp, Rattus norvegicus
agaaccagtgcacgctcttaggaga

SEQ ID NO: 103500 - DNA, 25 bp, Rattus norvegicus
agaaccagtgcaggctcttaggaga

SEQ ID NO: 103501 - DNA, 25 bp, Rattus norvegicus
agaaccagttctactcggcagggat

SEQ ID NO: 103502 - DNA, 25 bp, Rattus norvegicus
agaaccagttcttctcggcagggat

SEQ ID NO: 103503 - DNA, 25 bp, Rattus norvegicus
agaaccataaccaccagctgaaggg

SEQ ID NO: 103504 - DNA, 25 bp, Rattus norvegicus
agaaccataacctccagctgaaggg

SEQ ID NO: 103505 - DNA, 25 bp, Rattus norvegicus
agaaccataattacgctgctgctgt

SEQ ID NO: 103506 - DNA, 25 bp, Rattus norvegicus
agaaccataatttcgctgctgctgt

SEQ ID NO: 103507 - DNA, 25 bp, Rattus norvegicus
agaaccatacacctaggtcgtcctt

SEQ ID NO: 103508 - DNA, 25 bp, Rattus norvegicus
agaaccatacacgtaggtcgtcctt

SEQ ID NO: 103509 - DNA, 25 bp, Rattus norvegicus
agaaccataccacctctatatcgat

SEQ ID NO: 103510 - DNA, 25 bp, Rattus norvegicus
agaaccataccagctctatatcgat

SEQ ID NO: 103511 - DNA, 25 bp, Rattus norvegicus
agaaccatctccaagtgatactgtt

SEQ ID NO: 103512 - DNA, 25 bp, Rattus norvegicus
agaaccatctcctagtgatactgtt

SEQ ID NO: 103513 - DNA, 25 bp, Rattus norvegicus
agaaccatctgtccaacccaggatg

SEQ ID NO: 103514 - DNA, 25 bp, Rattus norvegicus
agaaccatctgtgcaacccaggatg

SEQ ID NO: 103515 - DNA, 25 bp, Rattus norvegicus
agaaccatgtgtcactgagcacctt

SEQ ID NO: 103516 - DNA, 25 bp, Rattus norvegicus
agaaccatgtgtgactgagcacctt

SEQ ID NO: 103517 - DNA, 25 bp, Rattus norvegicus
agaaccattctaacccatgggccat

SEQ ID NO: 103518 - DNA, 25 bp, Rattus norvegicus
agaaccattctaattatcctgtaaa

SEQ ID NO: 103519 - DNA, 25 bp, Rattus norvegicus
agaaccattctatcccatgggccat

SEQ ID NO: 103520 - DNA, 25 bp, Rattus norvegicus
agaaccattctatttatcctgtaaa

SEQ ID NO: 103521 - DNA, 25 bp, Rattus norvegicus
agaaccattctcatctgtcgccact

SEQ ID NO: 103522 - DNA, 25 bp, Rattus norvegicus
agaaccattctcttctgtcgccact

SEQ ID NO: 103523 - DNA, 25 bp, Rattus norvegicus
agaaccattgagatttggtgtccca

SEQ ID NO: 103524 - DNA, 25 bp, Rattus norvegicus
agaaccattgagttttggtgtccca

SEQ ID NO: 103525 - DNA, 25 bp, Rattus norvegicus
agaaccattgcacccggctcagagt

SEQ ID NO: 103526 - DNA, 25 bp, Rattus norvegicus
agaaccattgcagccggctcagagt

SEQ ID NO: 103527 - DNA, 25 bp, Rattus norvegicus
agaaccattgttaatttatagccac

SEQ ID NO: 103528 - DNA, 25 bp, Rattus norvegicus
agaaccattgtttatttatagccac

SEQ ID NO: 103529 - DNA, 25 bp, Rattus norvegicus
agaaccatttagctgggtgtcccca

SEQ ID NO: 103530 - DNA, 25 bp, Rattus norvegicus
agaaccatttaggtgggtgtcccca

SEQ ID NO: 103531 - DNA, 25 bp, Rattus norvegicus
agaaccatttctcagtgctcgtcaa

SEQ ID NO: 103532 - DNA, 25 bp, Rattus norvegicus
agaaccatttctgagtgctcgtcaa

SEQ ID NO: 103533 - DNA, 25 bp, Rattus norvegicus
agaacccacatgaagcttggagcga

SEQ ID NO: 103534 - DNA, 25 bp, Rattus norvegicus
agaacccacatgtagcttggagcga

SEQ ID NO: 103535 - DNA, 25 bp, Rattus norvegicus
agaacccacattagaagccagacat

SEQ ID NO: 103536 - DNA, 25 bp, Rattus norvegicus
agaacccacatttgaagccagacat

SEQ ID NO: 103537 - DNA, 25 bp, Rattus norvegicus
agaacccactgcctgacttcaagca

SEQ ID NO: 103538 - DNA, 25 bp, Rattus norvegicus
agaacccactgcgtgacttcaagca

SEQ ID NO: 103539 - DNA, 25 bp, Rattus norvegicus
agaacccagccgctagtggtcgcga

SEQ ID NO: 103540 - DNA, 25 bp, Rattus norvegicus
agaacccagccggtagtggtcgcga

SEQ ID NO: 103541 - DNA, 25 bp, Rattus norvegicus
agaacccagcctacagtgggcgcaa

SEQ ID NO: 103542 - DNA, 25 bp, Rattus norvegicus
agaacccagccttcagtgggcgcaa

SEQ ID NO: 103543 - DNA, 25 bp, Rattus norvegicus
agaacccaggaaaccagtcagccaa

SEQ ID NO: 103544 - DNA, 25 bp, Rattus norvegicus
agaacccaggaatccagtcagccaa

SEQ ID NO: 103545 - DNA, 25 bp, Rattus norvegicus
agaacccaggatcaacactttgaaa

SEQ ID NO: 103546 - DNA, 25 bp, Rattus norvegicus
agaacccaggatgaacactttgaaa

SEQ ID NO: 103547 - DNA, 25 bp, Rattus norvegicus
agaacccaggctcggcggtagctca

SEQ ID NO: 103548 - DNA, 25 bp, Rattus norvegicus
agaacccaggctgggcggtagctca

SEQ ID NO: 103549 - DNA, 25 bp, Rattus norvegicus
agaacccatacaaagcttgaggcag

SEQ ID NO: 103550 - DNA, 25 bp, Rattus norvegicus
agaacccatacatagcttgaggcag

SEQ ID NO: 103551 - DNA, 25 bp, Rattus norvegicus
agaacccatagtacttcctagtgcc

SEQ ID NO: 103552 - DNA, 25 bp, Rattus norvegicus
agaacccatagttcttcctagtgcc

SEQ ID NO: 103553 - DNA, 25 bp, Rattus norvegicus
agaacccatcccagtgatcatttct

SEQ ID NO: 103554 - DNA, 25 bp, Rattus norvegicus
agaacccatccctgtgatcatttct

SEQ ID NO: 103555 - DNA, 25 bp, Rattus norvegicus
agaacccatgcaagctctaggtctt

SEQ ID NO: 103556 - DNA, 25 bp, Rattus norvegicus
agaacccatgcatgctctaggtctt

SEQ ID NO: 103557 - DNA, 25 bp, Rattus norvegicus
agaacccatgtaaagctgcctagcc

SEQ ID NO: 103558 - DNA, 25 bp, Rattus norvegicus
agaacccatgtatagctgcctagcc

SEQ ID NO: 103559 - DNA, 25 bp, Rattus norvegicus
agaaccccagaaactgcttattccc

SEQ ID NO: 103560 - DNA, 25 bp, Rattus norvegicus
agaaccccagaatctgcttattccc

SEQ ID NO: 103561 - DNA, 25 bp, Rattus norvegicus
agaaccccgatacaccaacttctgt

SEQ ID NO: 103562 - DNA, 25 bp, Rattus norvegicus
agaaccccgatagaccaacttctgt

SEQ ID NO: 103563 - DNA, 25 bp, Rattus norvegicus
agaaccccgctacattggcctgtgg

SEQ ID NO: 103564 - DNA, 25 bp, Rattus norvegicus
agaaccccgctagattggcctgtgg

SEQ ID NO: 103565 - DNA, 25 bp, Rattus norvegicus
agaaccccgtgtctgcttgagacaa

SEQ ID NO: 103566 - DNA, 25 bp, Rattus norvegicus
agaaccccgtgtgtgcttgagacaa

SEQ ID NO: 103567 - DNA, 25 bp, Rattus norvegicus
agaacccctgggaatcctgcatgga

SEQ ID NO: 103568 - DNA, 25 bp, Rattus norvegicus
agaacccctgggtatcctgcatgga

SEQ ID NO: 103569 - DNA, 25 bp, Rattus norvegicus
agaacccgaatgagtgaaagaagtc

SEQ ID NO: 103570 - DNA, 25 bp, Rattus norvegicus
agaacccgaatgtgtgaaagaagtc

SEQ ID NO: 103571 - DNA, 25 bp, Rattus norvegicus
agaacccgagtcacccatagcgtag

SEQ ID NO: 103572 - DNA, 25 bp, Rattus norvegicus
agaacccgagtctcccatagcgtag

SEQ ID NO: 103573 - DNA, 25 bp, Rattus norvegicus
agaacccgctggagctcaggcgctg

SEQ ID NO: 103574 - DNA, 25 bp, Rattus norvegicus
agaacccgctggtgctcaggcgctg

SEQ ID NO: 103575 - DNA, 25 bp, Rattus norvegicus
agaacccgggtaacctgaggcctca

SEQ ID NO: 103576 - DNA, 25 bp, Rattus norvegicus
agaacccgggtatcctgaggcctca

SEQ ID NO: 103577 - DNA, 25 bp, Rattus norvegicus
agaacccgtaaacatctggcttctg

SEQ ID NO: 103578 - DNA, 25 bp, Rattus norvegicus
agaacccgtaaagatctggcttctg

SEQ ID NO: 103579 - DNA, 25 bp, Rattus norvegicus
agaaccctaaggaccacacaccagt

SEQ ID NO: 103580 - DNA, 25 bp, Rattus norvegicus
agaaccctaaggtccacacaccagt

SEQ ID NO: 103581 - DNA, 25 bp, Rattus norvegicus
agaaccctatcgatttcaaccatgg

SEQ ID NO: 103582 - DNA, 25 bp, Rattus norvegicus
agaaccctatcgttttcaaccatgg

SEQ ID NO: 103583 - DNA, 25 bp, Rattus norvegicus
agaaccctcagtagctgcagcaaat

SEQ ID NO: 103584 - DNA, 25 bp, Rattus norvegicus
agaaccctcagttgctgcagcaaat

SEQ ID NO: 103585 - DNA, 25 bp, Rattus norvegicus
agaaccctccttcgataagtcaaat

SEQ ID NO: 103586 - DNA, 25 bp, Rattus norvegicus
agaaccctccttggataagtcaaat

SEQ ID NO: 103587 - DNA, 25 bp, Rattus norvegicus
agaaccctctacatggtggctgcct

SEQ ID NO: 103588 - DNA, 25 bp, Rattus norvegicus
agaaccctctacttggtggctgcct

SEQ ID NO: 103589 - DNA, 25 bp, Rattus norvegicus
agaaccctctggcaggaccaaacat

SEQ ID NO: 103590 - DNA, 25 bp, Rattus norvegicus
agaaccctctgggaggaccaaacat

SEQ ID NO: 103591 - DNA, 25 bp, Rattus norvegicus
agaaccctgcacatgataggcctgg

SEQ ID NO: 103592 - DNA, 25 bp, Rattus norvegicus
agaaccctgcacttgataggcctgg

SEQ ID NO: 103593 - DNA, 25 bp, Rattus norvegicus
agaaccctgggacccggagatgaca

SEQ ID NO: 103594 - DNA, 25 bp, Rattus norvegicus
agaaccctgggagccggagatgaca

SEQ ID NO: 103595 - DNA, 25 bp, Rattus norvegicus
agaaccctgggcatggatttagtat

SEQ ID NO: 103596 - DNA, 25 bp, Rattus norvegicus
agaaccctgggcttggatttagtat

SEQ ID NO: 103597 - DNA, 25 bp, Rattus norvegicus
agaaccctgtgcctgacgctaaaga

SEQ ID NO: 103598 - DNA, 25 bp, Rattus norvegicus
agaaccctgtgcgtgacgctaaaga

SEQ ID NO: 103599 - DNA, 25 bp, Rattus norvegicus
agaaccctgttcatttcctctttca

SEQ ID NO: 103600 - DNA, 25 bp, Rattus norvegicus
agaaccctgttcttttcctctttca

SEQ ID NO: 103601 - DNA, 25 bp, Rattus norvegicus
agaacccttagaagctctcagacct

SEQ ID NO: 103602 - DNA, 25 bp, Rattus norvegicus
agaacccttagatgctctcagacct

SEQ ID NO: 103603 - DNA, 25 bp, Rattus norvegicus
agaacccttaggactggagtcagca

SEQ ID NO: 103604 - DNA, 25 bp, Rattus norvegicus
agaacccttaggtctggagtcagca

SEQ ID NO: 103605 - DNA, 25 bp, Rattus norvegicus
agaacccttctgcaagctgagtctg

SEQ ID NO: 103606 - DNA, 25 bp, Rattus norvegicus
agaacccttctgctagtcactgtat

SEQ ID NO: 103607 - DNA, 25 bp, Rattus norvegicus
agaacccttctggaagctgagtctg

SEQ ID NO: 103608 - DNA, 25 bp, Rattus norvegicus
agaacccttctggtagtcactgtat

SEQ ID NO: 103609 - DNA, 25 bp, Rattus norvegicus
agaaccctttctagagtctgcaggt

SEQ ID NO: 103610 - DNA, 25 bp, Rattus norvegicus
agaaccctttcttgagtctgcaggt

SEQ ID NO: 103611 - DNA, 25 bp, Rattus norvegicus
agaaccgactgacgtatgccaccat

SEQ ID NO: 103612 - DNA, 25 bp, Rattus norvegicus
agaaccgactgaggtatgccaccat

SEQ ID NO: 103613 - DNA, 25 bp, Rattus norvegicus
agaaccgagatcctgggtaccgttg

SEQ ID NO: 103614 - DNA, 25 bp, Rattus norvegicus
agaaccgagatcgtgggtaccgttg

SEQ ID NO: 103615 - DNA, 25 bp, Rattus norvegicus
agaaccgagcgacccgggcatacaa

SEQ ID NO: 103616 - DNA, 25 bp, Rattus norvegicus
agaaccgagcgagccgggcatacaa

SEQ ID NO: 103617 - DNA, 25 bp, Rattus norvegicus
agaaccgagttgctttcacatcctg

SEQ ID NO: 103618 - DNA, 25 bp, Rattus norvegicus
agaaccgagttggtttcacatcctg

SEQ ID NO: 103619 - DNA, 25 bp, Rattus norvegicus
agaaccgcaccgatgtggtgctcat

SEQ ID NO: 103620 - DNA, 25 bp, Rattus norvegicus
agaaccgcaccgttgtggtgctcat

SEQ ID NO: 103621 - DNA, 25 bp, Rattus norvegicus
agaaccgcagagactcatcgtgctt

SEQ ID NO: 103622 - DNA, 25 bp, Rattus norvegicus
agaaccgcagagtctcatcgtgctt

SEQ ID NO: 103623 - DNA, 25 bp, Rattus norvegicus
agaaccgcagtccttccttagaggg

SEQ ID NO: 103624 - DNA, 25 bp, Rattus norvegicus
agaaccgcagtcgttccttagaggg

SEQ ID NO: 103625 - DNA, 25 bp, Rattus norvegicus
agaaccgcctctcttcaaggaccaa

SEQ ID NO: 103626 - DNA, 25 bp, Rattus norvegicus
agaaccgcctctgttcaaggaccaa

SEQ ID NO: 103627 - DNA, 25 bp, Rattus norvegicus
agaaccgcgacgaggtgcaggccat

SEQ ID NO: 103628 - DNA, 25 bp, Rattus norvegicus
agaaccgcgacgtggtgcaggccat

SEQ ID NO: 103629 - DNA, 25 bp, Rattus norvegicus
agaaccgcgctccaatctgcaagga

SEQ ID NO: 103630 - DNA, 25 bp, Rattus norvegicus
agaaccgcgctcgaatctgcaagga

SEQ ID NO: 103631 - DNA, 25 bp, Rattus norvegicus
agaaccgctgtgatgggctggcacc

SEQ ID NO: 103632 - DNA, 25 bp, Rattus norvegicus
agaaccgctgtgttgggctggcacc

SEQ ID NO: 103633 - DNA, 25 bp, Rattus norvegicus
agaaccggatctatctcacagctga

SEQ ID NO: 103634 - DNA, 25 bp, Rattus norvegicus
agaaccggatctttctcacagctga

SEQ ID NO: 103635 - DNA, 25 bp, Rattus norvegicus
agaaccggctgaacgcgactggtga

SEQ ID NO: 103636 - DNA, 25 bp, Rattus norvegicus
agaaccggctgatcgcgactggtga

SEQ ID NO: 103637 - DNA, 25 bp, Rattus norvegicus
agaaccggcttgacgcagcagatct

SEQ ID NO: 103638 - DNA, 25 bp, Rattus norvegicus
agaaccggcttgtcgcagcagatct

SEQ ID NO: 103639 - DNA, 25 bp, Rattus norvegicus
agaaccgggttcacaaacagctgtc

SEQ ID NO: 103640 - DNA, 25 bp, Rattus norvegicus
agaaccgggttctcaaacagctgtc

SEQ ID NO: 103641 - DNA, 25 bp, Rattus norvegicus
agaaccgtcccgatgtgttgtacat

SEQ ID NO: 103642 - DNA, 25 bp, Rattus norvegicus
agaaccgtcccgttgtgttgtacat

SEQ ID NO: 103643 - DNA, 25 bp, Rattus norvegicus
agaaccgtcctacgctgcatagtga

SEQ ID NO: 103644 - DNA, 25 bp, Rattus norvegicus
agaaccgtcctaggctgcatagtga

SEQ ID NO: 103645 - DNA, 25 bp, Rattus norvegicus
agaaccgtcgtcatctttgtgctgt

SEQ ID NO: 103646 - DNA, 25 bp, Rattus norvegicus
agaaccgtcgtcttctttgtgctgt

SEQ ID NO: 103647 - DNA, 25 bp, Rattus norvegicus
agaaccgtgaaactgcagctgctgc

SEQ ID NO: 103648 - DNA, 25 bp, Rattus norvegicus
agaaccgtgaaagtgcagctgctgc

SEQ ID NO: 103649 - DNA, 25 bp, Rattus norvegicus
agaaccgtgatgattgctgtccttt

SEQ ID NO: 103650 - DNA, 25 bp, Rattus norvegicus
agaaccgtgatgtttgctgtccttt

SEQ ID NO: 103651 - DNA, 25 bp, Rattus norvegicus
agaaccgtgtgaagccacccaagga

SEQ ID NO: 103652 - DNA, 25 bp, Rattus norvegicus
agaaccgtgtgatgccacccaagga

SEQ ID NO: 103653 - DNA, 25 bp, Rattus norvegicus
agaaccgtttccctgtggtctgctg

SEQ ID NO: 103654 - DNA, 25 bp, Rattus norvegicus
agaaccgtttccgtgtggtctgctg

SEQ ID NO: 103655 - DNA, 25 bp, Rattus norvegicus
agaacctactcgcacacagactctt

SEQ ID NO: 103656 - DNA, 25 bp, Rattus norvegicus
agaacctactcggacacagactctt

SEQ ID NO: 103657 - DNA, 25 bp, Rattus norvegicus
agaacctactgaccaaccggaaaag

SEQ ID NO: 103658 - DNA, 25 bp, Rattus norvegicus
agaacctactgagcaaccggaaaag

SEQ ID NO: 103659 - DNA, 25 bp, Rattus norvegicus
agaacctactgcctactgacaggag

SEQ ID NO: 103660 - DNA, 25 bp, Rattus norvegicus
agaacctactgcgtactgacaggag

SEQ ID NO: 103661 - DNA, 25 bp, Rattus norvegicus
agaacctagagtatcctgtgtccta

SEQ ID NO: 103662 - DNA, 25 bp, Rattus norvegicus
agaacctagagtttcctgtgtccta

SEQ ID NO: 103663 - DNA, 25 bp, Rattus norvegicus
agaacctagctgattggcaggcctg

SEQ ID NO: 103664 - DNA, 25 bp, Rattus norvegicus
agaacctagctgtttggcaggcctg

SEQ ID NO: 103665 - DNA, 25 bp, Rattus norvegicus
agaacctagtgccacctcttggaag

SEQ ID NO: 103666 - DNA, 25 bp, Rattus norvegicus
agaacctagtgcgacctcttggaag

SEQ ID NO: 103667 - DNA, 25 bp, Rattus norvegicus
agaacctatgatcatccaaccacag

SEQ ID NO: 103668 - DNA, 25 bp, Rattus norvegicus
agaacctatgatgatccaaccacag

SEQ ID NO: 103669 - DNA, 25 bp, Rattus norvegicus
agaacctcacatactttctgggcat

SEQ ID NO: 103670 - DNA, 25 bp, Rattus norvegicus
agaacctcacattctttctgggcat

SEQ ID NO: 103671 - DNA, 25 bp, Rattus norvegicus
agaacctcacctcataagagaccct

SEQ ID NO: 103672 - DNA, 25 bp, Rattus norvegicus
agaacctcacctgataagagaccct

SEQ ID NO: 103673 - DNA, 25 bp, Rattus norvegicus
agaacctcacttctcaggcaagcat

SEQ ID NO: 103674 - DNA, 25 bp, Rattus norvegicus
agaacctcacttgtcaggcaagcat

SEQ ID NO: 103675 - DNA, 25 bp, Rattus norvegicus
agaacctcagccatgctgtggaaga

SEQ ID NO: 103676 - DNA, 25 bp, Rattus norvegicus
agaacctcagccttgctgtggaaga

SEQ ID NO: 103677 - DNA, 25 bp, Rattus norvegicus
agaacctccaggatcgctggctgct

SEQ ID NO: 103678 - DNA, 25 bp, Rattus norvegicus
agaacctccaggttcgctggctgct

SEQ ID NO: 103679 - DNA, 25 bp, Rattus norvegicus
agaacctccttcctgtagtcagtaa

SEQ ID NO: 103680 - DNA, 25 bp, Rattus norvegicus
agaacctccttcgtgtagtcagtaa

SEQ ID NO: 103681 - DNA, 25 bp, Rattus norvegicus
agaacctccttgctcaaggcttgag

SEQ ID NO: 103682 - DNA, 25 bp, Rattus norvegicus
agaacctccttggtcaaggcttgag

SEQ ID NO: 103683 - DNA, 25 bp, Rattus norvegicus
agaacctcgcgtccttgaagggtct

SEQ ID NO: 103684 - DNA, 25 bp, Rattus norvegicus
agaacctcgcgtgcttgaagggtct

SEQ ID NO: 103685 - DNA, 25 bp, Rattus norvegicus
agaacctctacacctggagacacgt

SEQ ID NO: 103686 - DNA, 25 bp, Rattus norvegicus
agaacctctacagctggagacacgt

SEQ ID NO: 103687 - DNA, 25 bp, Rattus norvegicus
agaacctctatgagggacctcagac

SEQ ID NO: 103688 - DNA, 25 bp, Rattus norvegicus
agaacctctatgtgggacctcagac

SEQ ID NO: 103689 - DNA, 25 bp, Rattus norvegicus
agaacctctcagcaaagcaccaaaa

SEQ ID NO: 103690 - DNA, 25 bp, Rattus norvegicus
agaacctctcaggaaagcaccaaaa

SEQ ID NO: 103691 - DNA, 25 bp, Rattus norvegicus
agaacctctcccagttagatttctg

SEQ ID NO: 103692 - DNA, 25 bp, Rattus norvegicus
agaacctctccctgttagatttctg

SEQ ID NO: 103693 - DNA, 25 bp, Rattus norvegicus
agaacctctgagacgacttccttag

SEQ ID NO: 103694 - DNA, 25 bp, Rattus norvegicus
agaacctctgagtcgacttccttag

SEQ ID NO: 103695 - DNA, 25 bp, Rattus norvegicus
agaacctctgcaatctcactttttt

SEQ ID NO: 103696 - DNA, 25 bp, Rattus norvegicus
agaacctctgcattctcactttttt

SEQ ID NO: 103697 - DNA, 25 bp, Rattus norvegicus
agaacctctggcagctgtacgatag

SEQ ID NO: 103698 - DNA, 25 bp, Rattus norvegicus
agaacctctggctgctgtacgatag

SEQ ID NO: 103699 - DNA, 25 bp, Rattus norvegicus
agaacctgacctccctgcggacatt

SEQ ID NO: 103700 - DNA, 25 bp, Rattus norvegicus
agaacctgacctgcctgcggacatt

SEQ ID NO: 103701 - DNA, 25 bp, Rattus norvegicus
agaacctgagttcctggtgcgtgta

SEQ ID NO: 103702 - DNA, 25 bp, Rattus norvegicus
agaacctgagttgctggtgcgtgta

SEQ ID NO: 103703 - DNA, 25 bp, Rattus norvegicus
agaacctgcaggagggccaagtcac

SEQ ID NO: 103704 - DNA, 25 bp, Rattus norvegicus
agaacctgcaggtgggccaagtcac

SEQ ID NO: 103705 - DNA, 25 bp, Rattus norvegicus
agaacctgccgtcttgttccaggct

SEQ ID NO: 103706 - DNA, 25 bp, Rattus norvegicus
agaacctgccgtgttgttccaggct

SEQ ID NO: 103707 - DNA, 25 bp, Rattus norvegicus
agaacctgcgcgagctccaggctgc

SEQ ID NO: 103708 - DNA, 25 bp, Rattus norvegicus
agaacctgcgcgtgctccaggctgc

SEQ ID NO: 103709 - DNA, 25 bp, Rattus norvegicus
agaacctgcggaacctgggagcaga

SEQ ID NO: 103710 - DNA, 25 bp, Rattus norvegicus
agaacctgcggatcctgggagcaga

SEQ ID NO: 103711 - DNA, 25 bp, Rattus norvegicus
agaacctgcttcaacacgggctgta

SEQ ID NO: 103712 - DNA, 25 bp, Rattus norvegicus
agaacctgcttctacacgggctgta

SEQ ID NO: 103713 - DNA, 25 bp, Rattus norvegicus
agaacctgcttgaagacctggctgc

SEQ ID NO: 103714 - DNA, 25 bp, Rattus norvegicus
agaacctgcttgtagacctggctgc

SEQ ID NO: 103715 - DNA, 25 bp, Rattus norvegicus
agaacctggacactgtgcgagctgt

SEQ ID NO: 103716 - DNA, 25 bp, Rattus norvegicus
agaacctggacagtgtgcgagctgt

SEQ ID NO: 103717 - DNA, 25 bp, Rattus norvegicus
agaacctggaccatgcagctagcag

SEQ ID NO: 103718 - DNA, 25 bp, Rattus norvegicus
agaacctggaccttgcagctagcag

SEQ ID NO: 103719 - DNA, 25 bp, Rattus norvegicus
agaacctggctcaacagacattgct

SEQ ID NO: 103720 - DNA, 25 bp, Rattus norvegicus
agaacctggctctacagacattgct

SEQ ID NO: 103721 - DNA, 25 bp, Rattus norvegicus
agaacctgggagagcctgctgtata

SEQ ID NO: 103722 - DNA, 25 bp, Rattus norvegicus
agaacctgggagtgcctgctgtata

SEQ ID NO: 103723 - DNA, 25 bp, Rattus norvegicus
agaacctggtgtcctagcaagtcct

SEQ ID NO: 103724 - DNA, 25 bp, Rattus norvegicus
agaacctggtgtgctagcaagtcct

SEQ ID NO: 103725 - DNA, 25 bp, Rattus norvegicus
agaacctgtaacatcaggcctcagg

SEQ ID NO: 103726 - DNA, 25 bp, Rattus norvegicus
agaacctgtaacttcaggcctcagg

SEQ ID NO: 103727 - DNA, 25 bp, Rattus norvegicus
agaacctgtcacacacctgaagtgg

SEQ ID NO: 103728 - DNA, 25 bp, Rattus norvegicus
agaacctgtcactcacctgaagtgg

SEQ ID NO: 103729 - DNA, 25 bp, Rattus norvegicus
agaacctgttccattgcactgcatg

SEQ ID NO: 103730 - DNA, 25 bp, Rattus norvegicus
agaacctgttcctttgcactgcatg

SEQ ID NO: 103731 - DNA, 25 bp, Rattus norvegicus
agaaccttaagtatccattccacag

SEQ ID NO: 103732 - DNA, 25 bp, Rattus norvegicus
agaaccttaagtttccattccacag

SEQ ID NO: 103733 - DNA, 25 bp, Rattus norvegicus
agaaccttaatcctctgtcgctgag

SEQ ID NO: 103734 - DNA, 25 bp, Rattus norvegicus
agaaccttaatcgtctgtcgctgag

SEQ ID NO: 103735 - DNA, 25 bp, Rattus norvegicus
agaaccttacagagcaccagccatt

SEQ ID NO: 103736 - DNA, 25 bp, Rattus norvegicus
agaaccttacagtgcaccagccatt

SEQ ID NO: 103737 - DNA, 25 bp, Rattus norvegicus
agaaccttagggatgctacctcctt

SEQ ID NO: 103738 - DNA, 25 bp, Rattus norvegicus
agaaccttagggttgctacctcctt

SEQ ID NO: 103739 - DNA, 25 bp, Rattus norvegicus
agaaccttagtaactgcccatagac

SEQ ID NO: 103740 - DNA, 25 bp, Rattus norvegicus
agaaccttagtatctgcccatagac

SEQ ID NO: 103741 - DNA, 25 bp, Rattus norvegicus
agaaccttcaaacatggtccttgtt

SEQ ID NO: 103742 - DNA, 25 bp, Rattus norvegicus
agaaccttcaaagatggtccttgtt

SEQ ID NO: 103743 - DNA, 25 bp, Rattus norvegicus
agaaccttccttcttctgttgtgtc

SEQ ID NO: 103744 - DNA, 25 bp, Rattus norvegicus
agaaccttccttgttctgttgtgtc

SEQ ID NO: 103745 - DNA, 25 bp, Rattus norvegicus
agaaccttgactacagttgacccct

SEQ ID NO: 103746 - DNA, 25 bp, Rattus norvegicus
agaaccttgacttcagttgacccct

SEQ ID NO: 103747 - DNA, 25 bp, Rattus norvegicus
agaaccttgagtcttacgtctaccg

SEQ ID NO: 103748 - DNA, 25 bp, Rattus norvegicus
agaaccttgagtcttgtgctcagga

SEQ ID NO: 103749 - DNA, 25 bp, Rattus norvegicus
agaaccttgagtgttacgtctaccg

SEQ ID NO: 103750 - DNA, 25 bp, Rattus norvegicus
agaaccttgagtgttgtgctcagga

SEQ ID NO: 103751 - DNA, 25 bp, Rattus norvegicus
agaaccttgcctctaagactgcctg

SEQ ID NO: 103752 - DNA, 25 bp, Rattus norvegicus
agaaccttgcctgtaagactgcctg

SEQ ID NO: 103753 - DNA, 25 bp, Rattus norvegicus
agaaccttgcttcgtctccttcttt

SEQ ID NO: 103754 - DNA, 25 bp, Rattus norvegicus
agaaccttgcttggtctccttcttt

SEQ ID NO: 103755 - DNA, 25 bp, Rattus norvegicus
agaaccttgggtcctatgctgaatt

SEQ ID NO: 103756 - DNA, 25 bp, Rattus norvegicus
agaaccttgggtgctatgctgaatt

SEQ ID NO: 103757 - DNA, 25 bp, Rattus norvegicus
agaaccttgttcactgcagctggga

SEQ ID NO: 103758 - DNA, 25 bp, Rattus norvegicus
agaaccttgttctctgcagctggga

SEQ ID NO: 103759 - DNA, 25 bp, Rattus norvegicus
agaacctttcttctttctgtcccat

SEQ ID NO: 103760 - DNA, 25 bp, Rattus norvegicus
agaacctttcttgtttctgtcccat

SEQ ID NO: 103761 - DNA, 25 bp, Rattus norvegicus
agaacctttggtcatgccagcgaca

SEQ ID NO: 103762 - DNA, 25 bp, Rattus norvegicus
agaacctttggtgatgccagcgaca

SEQ ID NO: 103763 - DNA, 25 bp, Rattus norvegicus
agaacgaaccggctgcttccagcga

SEQ ID NO: 103764 - DNA, 25 bp, Rattus norvegicus
agaacgaaccgggtgcttccagcga

SEQ ID NO: 103765 - DNA, 25 bp, Rattus norvegicus
agaacgaatcgtctatcctggtccc

SEQ ID NO: 103766 - DNA, 25 bp, Rattus norvegicus
agaacgaatcgtgtatcctggtccc

SEQ ID NO: 103767 - DNA, 25 bp, Rattus norvegicus
agaacgacaagtaccgtgtggtgct

SEQ ID NO: 103768 - DNA, 25 bp, Rattus norvegicus
agaacgacaagttccgtgtggtgct

SEQ ID NO: 103769 - DNA, 25 bp, Rattus norvegicus
agaacgacattcagagagagctgga

SEQ ID NO: 103770 - DNA, 25 bp, Rattus norvegicus
agaacgacattctgagagagctgga

SEQ ID NO: 103771 - DNA, 25 bp, Rattus norvegicus
agaacgacccacagagccaccatga

SEQ ID NO: 103772 - DNA, 25 bp, Rattus norvegicus
agaacgacccactgagccaccatga

SEQ ID NO: 103773 - DNA, 25 bp, Rattus norvegicus
agaacgagcgagactccagcccgag

SEQ ID NO: 103774 - DNA, 25 bp, Rattus norvegicus
agaacgagcgagtctccagcccgag

SEQ ID NO: 103775 - DNA, 25 bp, Rattus norvegicus
agaacgagtagcacaggcagtccac

SEQ ID NO: 103776 - DNA, 25 bp, Rattus norvegicus
agaacgagtagctcaggcagtccac

SEQ ID NO: 103777 - DNA, 25 bp, Rattus norvegicus
agaacgagtccaaagctgcccttgg

SEQ ID NO: 103778 - DNA, 25 bp, Rattus norvegicus
agaacgagtccatagctgcccttgg

SEQ ID NO: 103779 - DNA, 25 bp, Rattus norvegicus
agaacgatgagcaggcagccagcgc

SEQ ID NO: 103780 - DNA, 25 bp, Rattus norvegicus
agaacgatgagctggcagccagcgc

SEQ ID NO: 103781 - DNA, 25 bp, Rattus norvegicus
agaacgatgcccaggagcctgagga

SEQ ID NO: 103782 - DNA, 25 bp, Rattus norvegicus
agaacgatgccctggagcctgagga

SEQ ID NO: 103783 - DNA, 25 bp, Rattus norvegicus
agaacgatttggctcttcccaggaa

SEQ ID NO: 103784 - DNA, 25 bp, Rattus norvegicus
agaacgatttgggtcttcccaggaa

SEQ ID NO: 103785 - DNA, 25 bp, Rattus norvegicus
agaacgcaaggtcgtcccggagcat

SEQ ID NO: 103786 - DNA, 25 bp, Rattus norvegicus
agaacgcaaggtggtcccggagcat

SEQ ID NO: 103787 - DNA, 25 bp, Rattus norvegicus
agaacgcaccagatggcacttgcca

SEQ ID NO: 103788 - DNA, 25 bp, Rattus norvegicus
agaacgcaccagttggcacttgcca

SEQ ID NO: 103789 - DNA, 25 bp, Rattus norvegicus
agaacgcatttcacctcaaaacatg

SEQ ID NO: 103790 - DNA, 25 bp, Rattus norvegicus
agaacgcatttctcctcaaaacatg

SEQ ID NO: 103791 - DNA, 25 bp, Rattus norvegicus
agaacgcccagtaatcactcaggca

SEQ ID NO: 103792 - DNA, 25 bp, Rattus norvegicus
agaacgcccagttatcactcaggca

SEQ ID NO: 103793 - DNA, 25 bp, Rattus norvegicus
agaacgccggctcttaaggtcctga

SEQ ID NO: 103794 - DNA, 25 bp, Rattus norvegicus
agaacgccggctgttaaggtcctga

SEQ ID NO: 103795 - DNA, 25 bp, Rattus norvegicus
agaacgcgattcagacgatggagct

SEQ ID NO: 103796 - DNA, 25 bp, Rattus norvegicus
agaacgcgattctgacgatggagct

SEQ ID NO: 103797 - DNA, 25 bp, Rattus norvegicus
agaacgctcgtcaacgtgaatctca

SEQ ID NO: 103798 - DNA, 25 bp, Rattus norvegicus
agaacgctcgtctacgtgaatctca

SEQ ID NO: 103799 - DNA, 25 bp, Rattus norvegicus
agaacgctgacacgctttacctaag

SEQ ID NO: 103800 - DNA, 25 bp, Rattus norvegicus
agaacgctgacaggctttacctaag

SEQ ID NO: 103801 - DNA, 25 bp, Rattus norvegicus
agaacgctgggcagccccagagtga

SEQ ID NO: 103802 - DNA, 25 bp, Rattus norvegicus
agaacgctgggctgccccagagtga

SEQ ID NO: 103803 - DNA, 25 bp, Rattus norvegicus
agaacgctgtgacatccctaagtga

SEQ ID NO: 103804 - DNA, 25 bp, Rattus norvegicus
agaacgctgtgagatccctaagtga

SEQ ID NO: 103805 - DNA, 25 bp, Rattus norvegicus
agaacgcttctgacattgcccggga

SEQ ID NO: 103806 - DNA, 25 bp, Rattus norvegicus
agaacgcttctgtcattgcccggga

SEQ ID NO: 103807 - DNA, 25 bp, Rattus norvegicus
agaacggaagctatacgagtgcagt

SEQ ID NO: 103808 - DNA, 25 bp, Rattus norvegicus
agaacggaagctttacgagtgcagt

SEQ ID NO: 103809 - DNA, 25 bp, Rattus norvegicus
agaacggacaagctgcctaggcctc

SEQ ID NO: 103810 - DNA, 25 bp, Rattus norvegicus
agaacggacaaggtgcctaggcctc

SEQ ID NO: 103811 - DNA, 25 bp, Rattus norvegicus
agaacggactgtccactagagactt

SEQ ID NO: 103812 - DNA, 25 bp, Rattus norvegicus
agaacggactgtgcactagagactt

SEQ ID NO: 103813 - DNA, 25 bp, Rattus norvegicus
agaacggatttcctgtcatgtgatc

SEQ ID NO: 103814 - DNA, 25 bp, Rattus norvegicus
agaacggatttcgtgtcatgtgatc

SEQ ID NO: 103815 - DNA, 25 bp, Rattus norvegicus
agaacggcagcgcaagtccaaactt

SEQ ID NO: 103816 - DNA, 25 bp, Rattus norvegicus
agaacggcagcggaagtccaaactt

SEQ ID NO: 103817 - DNA, 25 bp, Rattus norvegicus
agaacggccctcagaacatatacaa

SEQ ID NO: 103818 - DNA, 25 bp, Rattus norvegicus
agaacggccctctgaacatatacaa

SEQ ID NO: 103819 - DNA, 25 bp, Rattus norvegicus
agaacggccgctatgtgtaccgcat

SEQ ID NO: 103820 - DNA, 25 bp, Rattus norvegicus
agaacggccgctttgtgtaccgcat

SEQ ID NO: 103821 - DNA, 25 bp, Rattus norvegicus
agaacggccttcagcacagcggagt

SEQ ID NO: 103822 - DNA, 25 bp, Rattus norvegicus
agaacggccttctgcacagcggagt

SEQ ID NO: 103823 - DNA, 25 bp, Rattus norvegicus
agaacggcgcctcagctctctgtgc

SEQ ID NO: 103824 - DNA, 25 bp, Rattus norvegicus
agaacggcgcctgagctctctgtgc

SEQ ID NO: 103825 - DNA, 25 bp, Rattus norvegicus
agaacggcgtttaccccatatgaag

SEQ ID NO: 103826 - DNA, 25 bp, Rattus norvegicus
agaacggcgttttccccatatgaag

SEQ ID NO: 103827 - DNA, 25 bp, Rattus norvegicus
agaacggctccaccttctccgggat

SEQ ID NO: 103828 - DNA, 25 bp, Rattus norvegicus
agaacggctccagcttctccgggat

SEQ ID NO: 103829 - DNA, 25 bp, Rattus norvegicus
agaacggcttgactagctaggcagt

SEQ ID NO: 103830 - DNA, 25 bp, Rattus norvegicus
agaacggcttgagtagctaggcagt

SEQ ID NO: 103831 - DNA, 25 bp, Rattus norvegicus
agaacgggactcaacgggcagcgga

SEQ ID NO: 103832 - DNA, 25 bp, Rattus norvegicus
agaacgggactctacgggcagcgga

SEQ ID NO: 103833 - DNA, 25 bp, Rattus norvegicus
agaacgggcctcagtttcaatcaga

SEQ ID NO: 103834 - DNA, 25 bp, Rattus norvegicus
agaacgggcctctgtttcaatcaga

SEQ ID NO: 103835 - DNA, 25 bp, Rattus norvegicus
agaacgggttcgactgcctgacgac

SEQ ID NO: 103836 - DNA, 25 bp, Rattus norvegicus
agaacgggttcgtctgcctgacgac

SEQ ID NO: 103837 - DNA, 25 bp, Rattus norvegicus
agaacggtgaatcccaccctaatga

SEQ ID NO: 103838 - DNA, 25 bp, Rattus norvegicus
agaacggtgaatgccaccctaatga

SEQ ID NO: 103839 - DNA, 25 bp, Rattus norvegicus
agaacggtgctcatcaggtgttggc

SEQ ID NO: 103840 - DNA, 25 bp, Rattus norvegicus
agaacggtgctcttcaggtgttggc

SEQ ID NO: 103841 - DNA, 25 bp, Rattus norvegicus
agaacgtatttacccattacccatg

SEQ ID NO: 103842 - DNA, 25 bp, Rattus norvegicus
agaacgtatttagccattacccatg

SEQ ID NO: 103843 - DNA, 25 bp, Rattus norvegicus
agaacgtcaactctgcaatcctgct

SEQ ID NO: 103844 - DNA, 25 bp, Rattus norvegicus
agaacgtcaactgtgcaatcctgct

SEQ ID NO: 103845 - DNA, 25 bp, Rattus norvegicus
agaacgtccagccactgcggatcaa

SEQ ID NO: 103846 - DNA, 25 bp, Rattus norvegicus
agaacgtccagcgactgcggatcaa

SEQ ID NO: 103847 - DNA, 25 bp, Rattus norvegicus
agaacgtccgatatgtgtccgaagc

SEQ ID NO: 103848 - DNA, 25 bp, Rattus norvegicus
agaacgtccgatttgtgtccgaagc

SEQ ID NO: 103849 - DNA, 25 bp, Rattus norvegicus
agaacgtcctcaccccataaagaag

SEQ ID NO: 103850 - DNA, 25 bp, Rattus norvegicus
agaacgtcctcagcccataaagaag

SEQ ID NO: 103851 - DNA, 25 bp, Rattus norvegicus
agaacgtcctgacgccatgtacggt

SEQ ID NO: 103852 - DNA, 25 bp, Rattus norvegicus
agaacgtcctgaggccatgtacggt

SEQ ID NO: 103853 - DNA, 25 bp, Rattus norvegicus
agaacgtcgggcatagagctctggt

SEQ ID NO: 103854 - DNA, 25 bp, Rattus norvegicus
agaacgtcgggcttagagctctggt

SEQ ID NO: 103855 - DNA, 25 bp, Rattus norvegicus
agaacgtctaccacggaagggctgg

SEQ ID NO: 103856 - DNA, 25 bp, Rattus norvegicus
agaacgtctacctcggaagggctgg

SEQ ID NO: 103857 - DNA, 25 bp, Rattus norvegicus
agaacgtctgctattggcctgacta

SEQ ID NO: 103858 - DNA, 25 bp, Rattus norvegicus
agaacgtctgcttttggcctgacta

SEQ ID NO: 103859 - DNA, 25 bp, Rattus norvegicus
agaacgtgaggtctacagatgctgt

SEQ ID NO: 103860 - DNA, 25 bp, Rattus norvegicus
agaacgtgaggtgtacagatgctgt

SEQ ID NO: 103861 - DNA, 25 bp, Rattus norvegicus
agaacgtgccagagtttctgcagct

SEQ ID NO: 103862 - DNA, 25 bp, Rattus norvegicus
agaacgtgccagtgtttctgcagct

SEQ ID NO: 103863 - DNA, 25 bp, Rattus norvegicus
agaacgtgctagacatttgccacca

SEQ ID NO: 103864 - DNA, 25 bp, Rattus norvegicus
agaacgtgctagtcatttgccacca

SEQ ID NO: 103865 - DNA, 25 bp, Rattus norvegicus
agaacgtgcttacggcggtctcgaa

SEQ ID NO: 103866 - DNA, 25 bp, Rattus norvegicus
agaacgtgcttagggcggtctcgaa

SEQ ID NO: 103867 - DNA, 25 bp, Rattus norvegicus
agaacgtggcgacaacactcagctt

SEQ ID NO: 103868 - DNA, 25 bp, Rattus norvegicus
agaacgtggcgagaacactcagctt

SEQ ID NO: 103869 - DNA, 25 bp, Rattus norvegicus
agaacgtgggccacatgcagcagca

SEQ ID NO: 103870 - DNA, 25 bp, Rattus norvegicus
agaacgtgggcctcatgcagcagca

SEQ ID NO: 103871 - DNA, 25 bp, Rattus norvegicus
agaacgtgtcaaaacggcccggctc

SEQ ID NO: 103872 - DNA, 25 bp, Rattus norvegicus
agaacgtgtcaatacggcccggctc

SEQ ID NO: 103873 - DNA, 25 bp, Rattus norvegicus
agaacgtgtcaccacagaaggcagc

SEQ ID NO: 103874 - DNA, 25 bp, Rattus norvegicus
agaacgtgtcacgacagaaggcagc

SEQ ID NO: 103875 - DNA, 25 bp, Rattus norvegicus
agaacgtgtcccctgctggcgtcag

SEQ ID NO: 103876 - DNA, 25 bp, Rattus norvegicus
agaacgtgtcccgtgctggcgtcag

SEQ ID NO: 103877 - DNA, 25 bp, Rattus norvegicus
agaacgttctggagaggatcctctg

SEQ ID NO: 103878 - DNA, 25 bp, Rattus norvegicus
agaacgttctggtgaggatcctctg

SEQ ID NO: 103879 - DNA, 25 bp, Rattus norvegicus
agaacgttgaacagtcgcctgacct

SEQ ID NO: 103880 - DNA, 25 bp, Rattus norvegicus
agaacgttgaactgtcgcctgacct

SEQ ID NO: 103881 - DNA, 25 bp, Rattus norvegicus
agaactaaaactaccactgtccaca

SEQ ID NO: 103882 - DNA, 25 bp, Rattus norvegicus
agaactaaaacttccactgtccaca

SEQ ID NO: 103883 - DNA, 25 bp, Rattus norvegicus
agaactaaactccaccgaaggcagt

SEQ ID NO: 103884 - DNA, 25 bp, Rattus norvegicus
agaactaaactcgaccgaaggcagt

SEQ ID NO: 103885 - DNA, 25 bp, Rattus norvegicus
agaactaaagacagctctctcgtgc

SEQ ID NO: 103886 - DNA, 25 bp, Rattus norvegicus
agaactaaagactgctctctcgtgc

SEQ ID NO: 103887 - DNA, 25 bp, Rattus norvegicus
agaactaaaggcatccaggacacca

SEQ ID NO: 103888 - DNA, 25 bp, Rattus norvegicus
agaactaaaggcttccaggacacca

SEQ ID NO: 103889 - DNA, 25 bp, Rattus norvegicus
agaactaatcaccaggcacgccaag

SEQ ID NO: 103890 - DNA, 25 bp, Rattus norvegicus
agaactaatcacgaggcacgccaag

SEQ ID NO: 103891 - DNA, 25 bp, Rattus norvegicus
agaactaattcaacaagccctacag

SEQ ID NO: 103892 - DNA, 25 bp, Rattus norvegicus
agaactaattcatcaagccctacag

SEQ ID NO: 103893 - DNA, 25 bp, Rattus norvegicus
agaactacacatacccaacttatat

SEQ ID NO: 103894 - DNA, 25 bp, Rattus norvegicus
agaactacacattcccaacttatat

SEQ ID NO: 103895 - DNA, 25 bp, Rattus norvegicus
agaactacagacattggaaccagct

SEQ ID NO: 103896 - DNA, 25 bp, Rattus norvegicus
agaactacagactttggaaccagct

SEQ ID NO: 103897 - DNA, 25 bp, Rattus norvegicus
agaactacagctacctggcatttcg

SEQ ID NO: 103898 - DNA, 25 bp, Rattus norvegicus
agaactacagctcctgcttatcatt

SEQ ID NO: 103899 - DNA, 25 bp, Rattus norvegicus
agaactacagctgctgcttatcatt

SEQ ID NO: 103900 - DNA, 25 bp, Rattus norvegicus
agaactacagcttcctggcatttcg

SEQ ID NO: 103901 - DNA, 25 bp, Rattus norvegicus
agaactaccacccagtcagtttagt

SEQ ID NO: 103902 - DNA, 25 bp, Rattus norvegicus
agaactaccaccgagtcagtttagt

SEQ ID NO: 103903 - DNA, 25 bp, Rattus norvegicus
agaactaccgaccagtgctgctgcg

SEQ ID NO: 103904 - DNA, 25 bp, Rattus norvegicus
agaactaccgacgagtgctgctgcg

SEQ ID NO: 103905 - DNA, 25 bp, Rattus norvegicus
agaactacgtgaagactgtctccag

SEQ ID NO: 103906 - DNA, 25 bp, Rattus norvegicus
agaactacgtgatgactgtctccag

SEQ ID NO: 103907 - DNA, 25 bp, Rattus norvegicus
agaactagacgcctgagactcctga

SEQ ID NO: 103908 - DNA, 25 bp, Rattus norvegicus
agaactagacgcgtgagactcctga

SEQ ID NO: 103909 - DNA, 25 bp, Rattus norvegicus
agaactagatataagccccagcttg

SEQ ID NO: 103910 - DNA, 25 bp, Rattus norvegicus
agaactagatattagccccagcttg

SEQ ID NO: 103911 - DNA, 25 bp, Rattus norvegicus
agaactagccccaggaaggcagaga

SEQ ID NO: 103912 - DNA, 25 bp, Rattus norvegicus
agaactagcccctggaaggcagaga

SEQ ID NO: 103913 - DNA, 25 bp, Rattus norvegicus
agaactagggttctgagctgtcata

SEQ ID NO: 103914 - DNA, 25 bp, Rattus norvegicus
agaactagggttgtgagctgtcata

SEQ ID NO: 103915 - DNA, 25 bp, Rattus norvegicus
agaactatccggagacaactcccag

SEQ ID NO: 103916 - DNA, 25 bp, Rattus norvegicus
agaactatccggtgacaactcccag

SEQ ID NO: 103917 - DNA, 25 bp, Rattus norvegicus
agaactatgcaaacgcctgatggtg

SEQ ID NO: 103918 - DNA, 25 bp, Rattus norvegicus
agaactatgcaatcgcctgatggtg

SEQ ID NO: 103919 - DNA, 25 bp, Rattus norvegicus
agaactatgtccctatgcaaaaccc

SEQ ID NO: 103920 - DNA, 25 bp, Rattus norvegicus
agaactatgtccgtatgcaaaaccc

SEQ ID NO: 103921 - DNA, 25 bp, Rattus norvegicus
agaactatgtgcaccgaatcggccg

SEQ ID NO: 103922 - DNA, 25 bp, Rattus norvegicus
agaactatgtgctccgaatcggccg

SEQ ID NO: 103923 - DNA, 25 bp, Rattus norvegicus
agaactattggcctccatggtcctc

SEQ ID NO: 103924 - DNA, 25 bp, Rattus norvegicus
agaactattggcgtccatggtcctc

SEQ ID NO: 103925 - DNA, 25 bp, Rattus norvegicus
agaactattgtaccaccatctggtg

SEQ ID NO: 103926 - DNA, 25 bp, Rattus norvegicus
agaactattgtagcaccatctggtg

SEQ ID NO: 103927 - DNA, 25 bp, Rattus norvegicus
agaactatttcaagcgctccatttt

SEQ ID NO: 103928 - DNA, 25 bp, Rattus norvegicus
agaactatttcatgcgctccatttt

SEQ ID NO: 103929 - DNA, 25 bp, Rattus norvegicus
agaactatttctatggatgcctcag

SEQ ID NO: 103930 - DNA, 25 bp, Rattus norvegicus
agaactatttctttggatgcctcag

SEQ ID NO: 103931 - DNA, 25 bp, Rattus norvegicus
agaactcaacaaaagtcccactcgc

SEQ ID NO: 103932 - DNA, 25 bp, Rattus norvegicus
agaactcaacaatagtcccactcgc

SEQ ID NO: 103933 - DNA, 25 bp, Rattus norvegicus
agaactcaacatcgcgccttcaagg

SEQ ID NO: 103934 - DNA, 25 bp, Rattus norvegicus
agaactcaacatggcgccttcaagg

SEQ ID NO: 103935 - DNA, 25 bp, Rattus norvegicus
agaactcaagacaaggacgaacctt

SEQ ID NO: 103936 - DNA, 25 bp, Rattus norvegicus
agaactcaagactaggacgaacctt

SEQ ID NO: 103937 - DNA, 25 bp, Rattus norvegicus
agaactcacagactccatttgctac

SEQ ID NO: 103938 - DNA, 25 bp, Rattus norvegicus
agaactcacagagtccatttgctac

SEQ ID NO: 103939 - DNA, 25 bp, Rattus norvegicus
agaactcaccagaggctatggccca

SEQ ID NO: 103940 - DNA, 25 bp, Rattus norvegicus
agaactcaccagtggctatggccca

SEQ ID NO: 103941 - DNA, 25 bp, Rattus norvegicus
agaactcacctgctgtgtggtacag

SEQ ID NO: 103942 - DNA, 25 bp, Rattus norvegicus
agaactcacctggtgtgtggtacag

SEQ ID NO: 103943 - DNA, 25 bp, Rattus norvegicus
agaactcacgccagtggacctgggc

SEQ ID NO: 103944 - DNA, 25 bp, Rattus norvegicus
agaactcacgcctgtggacctgggc

SEQ ID NO: 103945 - DNA, 25 bp, Rattus norvegicus
agaactcacgctctgcataagggca

SEQ ID NO: 103946 - DNA, 25 bp, Rattus norvegicus
agaactcacgctgtgcataagggca

SEQ ID NO: 103947 - DNA, 25 bp, Rattus norvegicus
agaactcacggtctggcctatgcta

SEQ ID NO: 103948 - DNA, 25 bp, Rattus norvegicus
agaactcacggtgtggcctatgcta

SEQ ID NO: 103949 - DNA, 25 bp, Rattus norvegicus
agaactcactaccaggctgacttgg

SEQ ID NO: 103950 - DNA, 25 bp, Rattus norvegicus
agaactcactacgaggctgacttgg

SEQ ID NO: 103951 - DNA, 25 bp, Rattus norvegicus
agaactcactttatcctcaatgctg

SEQ ID NO: 103952 - DNA, 25 bp, Rattus norvegicus
agaactcactttttcctcaatgctg

SEQ ID NO: 103953 - DNA, 25 bp, Rattus norvegicus
agaactcagaacacaatgcaggtgt

SEQ ID NO: 103954 - DNA, 25 bp, Rattus norvegicus
agaactcagaactcaatgcaggtgt

SEQ ID NO: 103955 - DNA, 25 bp, Rattus norvegicus
agaactcagatgattcttgctctgt

SEQ ID NO: 103956 - DNA, 25 bp, Rattus norvegicus
agaactcagatgtttcttgctctgt

SEQ ID NO: 103957 - DNA, 25 bp, Rattus norvegicus
agaactcagcctatgtctactgcag

SEQ ID NO: 103958 - DNA, 25 bp, Rattus norvegicus
agaactcagcctctgatggcagcca

SEQ ID NO: 103959 - DNA, 25 bp, Rattus norvegicus
agaactcagcctgtgatggcagcca

SEQ ID NO: 103960 - DNA, 25 bp, Rattus norvegicus
agaactcagcctttgtctactgcag

SEQ ID NO: 103961 - DNA, 25 bp, Rattus norvegicus
agaactcagctcattgacaccttag

SEQ ID NO: 103962 - DNA, 25 bp, Rattus norvegicus
agaactcagctctttgacaccttag

SEQ ID NO: 103963 - DNA, 25 bp, Rattus norvegicus
agaactcaggctccgtctttgagat

SEQ ID NO: 103964 - DNA, 25 bp, Rattus norvegicus
agaactcaggctgcgtctttgagat

SEQ ID NO: 103965 - DNA, 25 bp, Rattus norvegicus
agaactcaggtaagtccagcctcat

SEQ ID NO: 103966 - DNA, 25 bp, Rattus norvegicus
agaactcaggtatgtccagcctcat

SEQ ID NO: 103967 - DNA, 25 bp, Rattus norvegicus
agaactcagtgacttctctgtcgtg

SEQ ID NO: 103968 - DNA, 25 bp, Rattus norvegicus
agaactcagtgagttctctgtcgtg

SEQ ID NO: 103969 - DNA, 25 bp, Rattus norvegicus
agaactcatcacactggtctcagaa

SEQ ID NO: 103970 - DNA, 25 bp, Rattus norvegicus
agaactcatcactctggtctcagaa

SEQ ID NO: 103971 - DNA, 25 bp, Rattus norvegicus
agaactcatctcagttgccaagcaa

SEQ ID NO: 103972 - DNA, 25 bp, Rattus norvegicus
agaactcatctctgttgccaagcaa

SEQ ID NO: 103973 - DNA, 25 bp, Rattus norvegicus
agaactcatgtgacagggccagcgg

SEQ ID NO: 103974 - DNA, 25 bp, Rattus norvegicus
agaactcatgtgtcagggccagcgg

SEQ ID NO: 103975 - DNA, 25 bp, Rattus norvegicus
agaactcatgttctatcgacttaaa

SEQ ID NO: 103976 - DNA, 25 bp, Rattus norvegicus
agaactcatgttgtatcgacttaaa

SEQ ID NO: 103977 - DNA, 25 bp, Rattus norvegicus
agaactcattgtctccttgtttcaa

SEQ ID NO: 103978 - DNA, 25 bp, Rattus norvegicus
agaactcattgtgtccttgtttcaa

SEQ ID NO: 103979 - DNA, 25 bp, Rattus norvegicus
agaactcatttgacccctcaactgt

SEQ ID NO: 103980 - DNA, 25 bp, Rattus norvegicus
agaactcatttgtcccctcaactgt

SEQ ID NO: 103981 - DNA, 25 bp, Rattus norvegicus
agaactccacacaggctgaaacttg

SEQ ID NO: 103982 - DNA, 25 bp, Rattus norvegicus
agaactccacactggctgaaacttg

SEQ ID NO: 103983 - DNA, 25 bp, Rattus norvegicus
agaactccagccctgtgctgtagaa

SEQ ID NO: 103984 - DNA, 25 bp, Rattus norvegicus
agaactccagccgtgtgctgtagaa

SEQ ID NO: 103985 - DNA, 25 bp, Rattus norvegicus
agaactcccattcctgagggacttg

SEQ ID NO: 103986 - DNA, 25 bp, Rattus norvegicus
agaactcccattgctgagggacttg

SEQ ID NO: 103987 - DNA, 25 bp, Rattus norvegicus
agaactccgaccagaggccaagaat

SEQ ID NO: 103988 - DNA, 25 bp, Rattus norvegicus
agaactccgacctgaggccaagaat

SEQ ID NO: 103989 - DNA, 25 bp, Rattus norvegicus
agaactccgaggatccagacaacgt

SEQ ID NO: 103990 - DNA, 25 bp, Rattus norvegicus
agaactccgaggttccagacaacgt

SEQ ID NO: 103991 - DNA, 25 bp, Rattus norvegicus
agaactccgcgtcggttacaagtgc

SEQ ID NO: 103992 - DNA, 25 bp, Rattus norvegicus
agaactccgcgtgggttacaagtgc

SEQ ID NO: 103993 - DNA, 25 bp, Rattus norvegicus
agaactcctatcagttttcagtttc

SEQ ID NO: 103994 - DNA, 25 bp, Rattus norvegicus
agaactcctatctgttttcagtttc

SEQ ID NO: 103995 - DNA, 25 bp, Rattus norvegicus
agaactcctattaagagcctcttac

SEQ ID NO: 103996 - DNA, 25 bp, Rattus norvegicus
agaactcctatttagagcctcttac

SEQ ID NO: 103997 - DNA, 25 bp, Rattus norvegicus
agaactcctcagagtctcctataga

SEQ ID NO: 103998 - DNA, 25 bp, Rattus norvegicus
agaactcctcagtgtctcctataga

SEQ ID NO: 103999 - DNA, 25 bp, Rattus norvegicus
agaactcctcttatgtaattgcctt

SEQ ID NO: 104000 - DNA, 25 bp, Rattus norvegicus
agaactcctcttcctgtggcactga

SEQ ID NO: 104001 - DNA, 25 bp, Rattus norvegicus
agaactcctcttgctgtggcactga

SEQ ID NO: 104002 - DNA, 25 bp, Rattus norvegicus
agaactcctcttttgtaattgcctt

SEQ ID NO: 104003 - DNA, 25 bp, Rattus norvegicus
agaactccttcactgttatgtgcca

SEQ ID NO: 104004 - DNA, 25 bp, Rattus norvegicus
agaactccttcagtgttatgtgcca

SEQ ID NO: 104005 - DNA, 25 bp, Rattus norvegicus
agaactcgagccataattcaagcct

SEQ ID NO: 104006 - DNA, 25 bp, Rattus norvegicus
agaactcgagccttaattcaagcct

SEQ ID NO: 104007 - DNA, 25 bp, Rattus norvegicus
agaactcgagtcatattgccttgcc

SEQ ID NO: 104008 - DNA, 25 bp, Rattus norvegicus
agaactcgagtcttattgccttgcc

SEQ ID NO: 104009 - DNA, 25 bp, Rattus norvegicus
agaactcgatatcttgcctgctctc

SEQ ID NO: 104010 - DNA, 25 bp, Rattus norvegicus
agaactcgatatgttgcctgctctc

SEQ ID NO: 104011 - DNA, 25 bp, Rattus norvegicus
agaactcgatctacatcttttagga

SEQ ID NO: 104012 - DNA, 25 bp, Rattus norvegicus
agaactcgatcttcatcttttagga

SEQ ID NO: 104013 - DNA, 25 bp, Rattus norvegicus
agaactcgatgaagccttggatgaa

SEQ ID NO: 104014 - DNA, 25 bp, Rattus norvegicus
agaactcgatgatgccttggatgaa

SEQ ID NO: 104015 - DNA, 25 bp, Rattus norvegicus
agaactcgcaatcccttcaaagtta

SEQ ID NO: 104016 - DNA, 25 bp, Rattus norvegicus
agaactcgcaatgccttcaaagtta

SEQ ID NO: 104017 - DNA, 25 bp, Rattus norvegicus
agaactcgccacaaagctgggttaa

SEQ ID NO: 104018 - DNA, 25 bp, Rattus norvegicus
agaactcgccactaagctgggttaa

SEQ ID NO: 104019 - DNA, 25 bp, Rattus norvegicus
agaactcggccaagcggctgatggt

SEQ ID NO: 104020 - DNA, 25 bp, Rattus norvegicus
agaactcggccatgcggctgatggt

SEQ ID NO: 104021 - DNA, 25 bp, Rattus norvegicus
agaactcgggagctctgcactccag

SEQ ID NO: 104022 - DNA, 25 bp, Rattus norvegicus
agaactcgggaggtctgcactccag

SEQ ID NO: 104023 - DNA, 25 bp, Rattus norvegicus
agaactcggtcaccagagactcttg

SEQ ID NO: 104024 - DNA, 25 bp, Rattus norvegicus
agaactcggtcagcagagactcttg

SEQ ID NO: 104025 - DNA, 25 bp, Rattus norvegicus
agaactcgtaagacaagagccgtgt

SEQ ID NO: 104026 - DNA, 25 bp, Rattus norvegicus
agaactcgtaagtcaagagccgtgt

SEQ ID NO: 104027 - DNA, 25 bp, Rattus norvegicus
agaactcgtggtacttcagtgtccc

SEQ ID NO: 104028 - DNA, 25 bp, Rattus norvegicus
agaactcgtggttcttcagtgtccc

SEQ ID NO: 104029 - DNA, 25 bp, Rattus norvegicus
agaactctaaacaaccctgaagctc

SEQ ID NO: 104030 - DNA, 25 bp, Rattus norvegicus
agaactctaaactaccctgaagctc

SEQ ID NO: 104031 - DNA, 25 bp, Rattus norvegicus
agaactctagatatgacccactcca

SEQ ID NO: 104032 - DNA, 25 bp, Rattus norvegicus
agaactctagatttgacccactcca

SEQ ID NO: 104033 - DNA, 25 bp, Rattus norvegicus
agaactctaggtcgtcattgccatc

SEQ ID NO: 104034 - DNA, 25 bp, Rattus norvegicus
agaactctaggtggtcattgccatc

SEQ ID NO: 104035 - DNA, 25 bp, Rattus norvegicus
agaactctataacccaacaatgttt

SEQ ID NO: 104036 - DNA, 25 bp, Rattus norvegicus
agaactctataagccaacaatgttt

SEQ ID NO: 104037 - DNA, 25 bp, Rattus norvegicus
agaactctcactcggagctgtggta

SEQ ID NO: 104038 - DNA, 25 bp, Rattus norvegicus
agaactctcactgggagctgtggta

SEQ ID NO: 104039 - DNA, 25 bp, Rattus norvegicus
agaactctcagcatttttcccagca

SEQ ID NO: 104040 - DNA, 25 bp, Rattus norvegicus
agaactctcagcttttttcccagca

SEQ ID NO: 104041 - DNA, 25 bp, Rattus norvegicus
agaactctctaccttgtgcaacagt

SEQ ID NO: 104042 - DNA, 25 bp, Rattus norvegicus
agaactctctacctttgatccttgt

SEQ ID NO: 104043 - DNA, 25 bp, Rattus norvegicus
agaactctctacgttgtgcaacagt

SEQ ID NO: 104044 - DNA, 25 bp, Rattus norvegicus
agaactctctacgtttgatccttgt

SEQ ID NO: 104045 - DNA, 25 bp, Rattus norvegicus
agaactctcttaccacacagccggg

SEQ ID NO: 104046 - DNA, 25 bp, Rattus norvegicus
agaactctcttagcacacagccggg

SEQ ID NO: 104047 - DNA, 25 bp, Rattus norvegicus
agaactctgccaagtgcatgacgct

SEQ ID NO: 104048 - DNA, 25 bp, Rattus norvegicus
agaactctgccacagtgctgctgag

SEQ ID NO: 104049 - DNA, 25 bp, Rattus norvegicus
agaactctgccagagtgctgctgag

SEQ ID NO: 104050 - DNA, 25 bp, Rattus norvegicus
agaactctgccatgtgcatgacgct

SEQ ID NO: 104051 - DNA, 25 bp, Rattus norvegicus
agaactctgctcaaccctctgatgc

SEQ ID NO: 104052 - DNA, 25 bp, Rattus norvegicus
agaactctgctctaccctctgatgc

SEQ ID NO: 104053 - DNA, 25 bp, Rattus norvegicus
agaactctgggcacactgccgtcag

SEQ ID NO: 104054 - DNA, 25 bp, Rattus norvegicus
agaactctgggccttgctatctagg

SEQ ID NO: 104055 - DNA, 25 bp, Rattus norvegicus
agaactctgggcgttgctatctagg

SEQ ID NO: 104056 - DNA, 25 bp, Rattus norvegicus
agaactctgggctcactgccgtcag

SEQ ID NO: 104057 - DNA, 25 bp, Rattus norvegicus
agaactctggtcactcagccttgat

SEQ ID NO: 104058 - DNA, 25 bp, Rattus norvegicus
agaactctggtctctcagccttgat

SEQ ID NO: 104059 - DNA, 25 bp, Rattus norvegicus
agaactctgtacataggaccgctag

SEQ ID NO: 104060 - DNA, 25 bp, Rattus norvegicus
agaactctgtacttaggaccgctag

SEQ ID NO: 104061 - DNA, 25 bp, Rattus norvegicus
agaactctgtgcagcgcagggagat

SEQ ID NO: 104062 - DNA, 25 bp, Rattus norvegicus
agaactctgtgctgcgcagggagat

SEQ ID NO: 104063 - DNA, 25 bp, Rattus norvegicus
agaactctgtggagatctagatgga

SEQ ID NO: 104064 - DNA, 25 bp, Rattus norvegicus
agaactctgtggtgatctagatgga

SEQ ID NO: 104065 - DNA, 25 bp, Rattus norvegicus
agaactctgtttccagcttaagccg

SEQ ID NO: 104066 - DNA, 25 bp, Rattus norvegicus
agaactctgtttgcagcttaagccg

SEQ ID NO: 104067 - DNA, 25 bp, Rattus norvegicus
agaactcttaggagcaacgcttcgt

SEQ ID NO: 104068 - DNA, 25 bp, Rattus norvegicus
agaactcttaggctcaaatttgcat

SEQ ID NO: 104069 - DNA, 25 bp, Rattus norvegicus
agaactcttagggtcaaatttgcat

SEQ ID NO: 104070 - DNA, 25 bp, Rattus norvegicus
agaactcttaggtgcaacgcttcgt

SEQ ID NO: 104071 - DNA, 25 bp, Rattus norvegicus
agaactcttagtagctttccgtgca

SEQ ID NO: 104072 - DNA, 25 bp, Rattus norvegicus
agaactcttagttgctttccgtgca

SEQ ID NO: 104073 - DNA, 25 bp, Rattus norvegicus
agaactcttcctcagccatttagag

SEQ ID NO: 104074 - DNA, 25 bp, Rattus norvegicus
agaactcttcctgagccatttagag

SEQ ID NO: 104075 - DNA, 25 bp, Rattus norvegicus
agaactcttcggatcaggcaaatga

SEQ ID NO: 104076 - DNA, 25 bp, Rattus norvegicus
agaactcttcggttcaggcaaatga

SEQ ID NO: 104077 - DNA, 25 bp, Rattus norvegicus
agaactcttgccaggtgaccgggaa

SEQ ID NO: 104078 - DNA, 25 bp, Rattus norvegicus
agaactcttgcctggtgaccgggaa

SEQ ID NO: 104079 - DNA, 25 bp, Rattus norvegicus
agaactctttatctaccattccaac

SEQ ID NO: 104080 - DNA, 25 bp, Rattus norvegicus
agaactctttatgtaccattccaac

SEQ ID NO: 104081 - DNA, 25 bp, Rattus norvegicus
agaactctttctaaggcatccattt

SEQ ID NO: 104082 - DNA, 25 bp, Rattus norvegicus
agaactctttcttaggcatccattt

SEQ ID NO: 104083 - DNA, 25 bp, Rattus norvegicus
agaactgaaactaccttctgtcctc

SEQ ID NO: 104084 - DNA, 25 bp, Rattus norvegicus
agaactgaaacttccttctgtcctc

SEQ ID NO: 104085 - DNA, 25 bp, Rattus norvegicus
agaactgaaatcagatgtcccacca

SEQ ID NO: 104086 - DNA, 25 bp, Rattus norvegicus
agaactgaaatctgatgtcccacca

SEQ ID NO: 104087 - DNA, 25 bp, Rattus norvegicus
agaactgaagtaacgttagccctac

SEQ ID NO: 104088 - DNA, 25 bp, Rattus norvegicus
agaactgaagtatcgttagccctac

SEQ ID NO: 104089 - DNA, 25 bp, Rattus norvegicus
agaactgaagttccactctcagcac

SEQ ID NO: 104090 - DNA, 25 bp, Rattus norvegicus
agaactgaagttgcactctcagcac

SEQ ID NO: 104091 - DNA, 25 bp, Rattus norvegicus
agaactgaatagcacctgtctccaa

SEQ ID NO: 104092 - DNA, 25 bp, Rattus norvegicus
agaactgaataggacctgtctccaa

SEQ ID NO: 104093 - DNA, 25 bp, Rattus norvegicus
agaactgaatctccgcaggaccaac

SEQ ID NO: 104094 - DNA, 25 bp, Rattus norvegicus
agaactgaatctgcgcaggaccaac

SEQ ID NO: 104095 - DNA, 25 bp, Rattus norvegicus
agaactgaatgcagtctcctctgcc

SEQ ID NO: 104096 - DNA, 25 bp, Rattus norvegicus
agaactgaatgctgtctcctctgcc

SEQ ID NO: 104097 - DNA, 25 bp, Rattus norvegicus
agaactgacactcaaaggccgcctg

SEQ ID NO: 104098 - DNA, 25 bp, Rattus norvegicus
agaactgacactgaaaggccgcctg

SEQ ID NO: 104099 - DNA, 25 bp, Rattus norvegicus
agaactgacagacggatttgcttgt

SEQ ID NO: 104100 - DNA, 25 bp, Rattus norvegicus
agaactgacagagggatttgcttgt

SEQ ID NO: 104101 - DNA, 25 bp, Rattus norvegicus
agaactgacatgagactgcctggat

SEQ ID NO: 104102 - DNA, 25 bp, Rattus norvegicus
agaactgacatgtgactgcctggat

SEQ ID NO: 104103 - DNA, 25 bp, Rattus norvegicus
agaactgacgccatactttgcatta

SEQ ID NO: 104104 - DNA, 25 bp, Rattus norvegicus
agaactgacgccttactttgcatta

SEQ ID NO: 104105 - DNA, 25 bp, Rattus norvegicus
agaactgactctcggactgcgggca

SEQ ID NO: 104106 - DNA, 25 bp, Rattus norvegicus
agaactgactctgggactgcgggca

SEQ ID NO: 104107 - DNA, 25 bp, Rattus norvegicus
agaactgactgaccgcttgtgggat

SEQ ID NO: 104108 - DNA, 25 bp, Rattus norvegicus
agaactgactgagcgcttgtgggat

SEQ ID NO: 104109 - DNA, 25 bp, Rattus norvegicus
agaactgactttaaccaggtagcct

SEQ ID NO: 104110 - DNA, 25 bp, Rattus norvegicus
agaactgacttttaccaggtagcct

SEQ ID NO: 104111 - DNA, 25 bp, Rattus norvegicus
agaactgagcatacatcgcaggata

SEQ ID NO: 104112 - DNA, 25 bp, Rattus norvegicus
agaactgagcattcatcgcaggata

SEQ ID NO: 104113 - DNA, 25 bp, Rattus norvegicus
agaactgagctgaaaacctactgca

SEQ ID NO: 104114 - DNA, 25 bp, Rattus norvegicus
agaactgagctgtaaacctactgca

SEQ ID NO: 104115 - DNA, 25 bp, Rattus norvegicus
agaactgaggagagactgttaacca

SEQ ID NO: 104116 - DNA, 25 bp, Rattus norvegicus
agaactgaggagtgactgttaacca

SEQ ID NO: 104117 - DNA, 25 bp, Rattus norvegicus
agaactgagggcacctctggaggtt

SEQ ID NO: 104118 - DNA, 25 bp, Rattus norvegicus
agaactgagggctcctctggaggtt

SEQ ID NO: 104119 - DNA, 25 bp, Rattus norvegicus
agaactgagtgaccagacttctccc

SEQ ID NO: 104120 - DNA, 25 bp, Rattus norvegicus
agaactgagtgagcagacttctccc

SEQ ID NO: 104121 - DNA, 25 bp, Rattus norvegicus
agaactgatagtatctccactgaaa

SEQ ID NO: 104122 - DNA, 25 bp, Rattus norvegicus
agaactgatagtttctccactgaaa

SEQ ID NO: 104123 - DNA, 25 bp, Rattus norvegicus
agaactgatcagaacaaccggcctt

SEQ ID NO: 104124 - DNA, 25 bp, Rattus norvegicus
agaactgatcagtacaaccggcctt

SEQ ID NO: 104125 - DNA, 25 bp, Rattus norvegicus
agaactgatctcatagaaccctaaa

SEQ ID NO: 104126 - DNA, 25 bp, Rattus norvegicus
agaactgatctcttagaaccctaaa

SEQ ID NO: 104127 - DNA, 25 bp, Rattus norvegicus
agaactgatgttaggacacctggcc

SEQ ID NO: 104128 - DNA, 25 bp, Rattus norvegicus
agaactgatgtttggacacctggcc

SEQ ID NO: 104129 - DNA, 25 bp, Rattus norvegicus
agaactgattctccaaggctagccc

SEQ ID NO: 104130 - DNA, 25 bp, Rattus norvegicus
agaactgattctgcaaggctagccc

SEQ ID NO: 104131 - DNA, 25 bp, Rattus norvegicus
agaactgcaactcatgttccccttc

SEQ ID NO: 104132 - DNA, 25 bp, Rattus norvegicus
agaactgcaactgatgttccccttc

SEQ ID NO: 104133 - DNA, 25 bp, Rattus norvegicus
agaactgcacacagggccttgtgag

SEQ ID NO: 104134 - DNA, 25 bp, Rattus norvegicus
agaactgcacactgggccttgtgag

SEQ ID NO: 104135 - DNA, 25 bp, Rattus norvegicus
agaactgcagtacccacgtgagccg

SEQ ID NO: 104136 - DNA, 25 bp, Rattus norvegicus
agaactgcagtagccacgtgagccg

SEQ ID NO: 104137 - DNA, 25 bp, Rattus norvegicus
agaactgccagaagtctttctggaa

SEQ ID NO: 104138 - DNA, 25 bp, Rattus norvegicus
agaactgccagatgtctttctggaa

SEQ ID NO: 104139 - DNA, 25 bp, Rattus norvegicus
agaactgcccatccttaaaatgatc

SEQ ID NO: 104140 - DNA, 25 bp, Rattus norvegicus
agaactgcccatgcttaaaatgatc

SEQ ID NO: 104141 - DNA, 25 bp, Rattus norvegicus
agaactgcccggagggtggcactca

SEQ ID NO: 104142 - DNA, 25 bp, Rattus norvegicus
agaactgcccggtgggtggcactca

SEQ ID NO: 104143 - DNA, 25 bp, Rattus norvegicus
agaactgcctgcagtgggcccgtga

SEQ ID NO: 104144 - DNA, 25 bp, Rattus norvegicus
agaactgcctgctgtgggcccgtga

SEQ ID NO: 104145 - DNA, 25 bp, Rattus norvegicus
agaactgcgagaccggcaaagccaa

SEQ ID NO: 104146 - DNA, 25 bp, Rattus norvegicus
agaactgcgagagcggcaaagccaa

SEQ ID NO: 104147 - DNA, 25 bp, Rattus norvegicus
agaactgcgccacgtcatgacaaac

SEQ ID NO: 104148 - DNA, 25 bp, Rattus norvegicus
agaactgcgccaggtcatgacaaac

SEQ ID NO: 104149 - DNA, 25 bp, Rattus norvegicus
agaactgcgtagatgcgtaccccac

SEQ ID NO: 104150 - DNA, 25 bp, Rattus norvegicus
agaactgcgtagttgcgtaccccac

SEQ ID NO: 104151 - DNA, 25 bp, Rattus norvegicus
agaactgcgtgtctaccctgaggaa

SEQ ID NO: 104152 - DNA, 25 bp, Rattus norvegicus
agaactgcgtgtgtaccctgaggaa

SEQ ID NO: 104153 - DNA, 25 bp, Rattus norvegicus
agaactgctgcgcactgcactgtcc

SEQ ID NO: 104154 - DNA, 25 bp, Rattus norvegicus
agaactgctgcggactgcactgtcc

SEQ ID NO: 104155 - DNA, 25 bp, Rattus norvegicus
agaactgctgtacagagcttgtgct

SEQ ID NO: 104156 - DNA, 25 bp, Rattus norvegicus
agaactgctgtagagagcttgtgct

SEQ ID NO: 104157 - DNA, 25 bp, Rattus norvegicus
agaactgcttgtccccaactgtaac

SEQ ID NO: 104158 - DNA, 25 bp, Rattus norvegicus
agaactgcttgtgcccaactgtaac

SEQ ID NO: 104159 - DNA, 25 bp, Rattus norvegicus
agaactggaacactcaccacactct

SEQ ID NO: 104160 - DNA, 25 bp, Rattus norvegicus
agaactggaacagtcaccacactct

SEQ ID NO: 104161 - DNA, 25 bp, Rattus norvegicus
agaactggacccagccgaatttggg

SEQ ID NO: 104162 - DNA, 25 bp, Rattus norvegicus
agaactggacccatggagccgtcga

SEQ ID NO: 104163 - DNA, 25 bp, Rattus norvegicus
agaactggaccctgccgaatttggg

SEQ ID NO: 104164 - DNA, 25 bp, Rattus norvegicus
agaactggacccttggagccgtcga

SEQ ID NO: 104165 - DNA, 25 bp, Rattus norvegicus
agaactggacctcagttattcccac

SEQ ID NO: 104166 - DNA, 25 bp, Rattus norvegicus
agaactggacctgagttattcccac

SEQ ID NO: 104167 - DNA, 25 bp, Rattus norvegicus
agaactggcaatcccagaccttctt

SEQ ID NO: 104168 - DNA, 25 bp, Rattus norvegicus
agaactggcaatgccagaccttctt

SEQ ID NO: 104169 - DNA, 25 bp, Rattus norvegicus
agaactggcaggctttatccaccat

SEQ ID NO: 104170 - DNA, 25 bp, Rattus norvegicus
agaactggcagggtttatccaccat

SEQ ID NO: 104171 - DNA, 25 bp, Rattus norvegicus
agaactggcccactaagagagtccc

SEQ ID NO: 104172 - DNA, 25 bp, Rattus norvegicus
agaactggcccagtaagagagtccc

SEQ ID NO: 104173 - DNA, 25 bp, Rattus norvegicus
agaactggccgacctggtgcggtca

SEQ ID NO: 104174 - DNA, 25 bp, Rattus norvegicus
agaactggccgagctggtgcggtca

SEQ ID NO: 104175 - DNA, 25 bp, Rattus norvegicus
agaactggcctcctgtctgaagagg

SEQ ID NO: 104176 - DNA, 25 bp, Rattus norvegicus
agaactggcctccttcaaggaactc

SEQ ID NO: 104177 - DNA, 25 bp, Rattus norvegicus
agaactggcctcgtgtctgaagagg

SEQ ID NO: 104178 - DNA, 25 bp, Rattus norvegicus
agaactggcctcgttcaaggaactc

SEQ ID NO: 104179 - DNA, 25 bp, Rattus norvegicus
agaactggccttctgatgaaatgcc

SEQ ID NO: 104180 - DNA, 25 bp, Rattus norvegicus
agaactggccttgtgatgaaatgcc

SEQ ID NO: 104181 - DNA, 25 bp, Rattus norvegicus
agaactggcgagcttgtggtctccc

SEQ ID NO: 104182 - DNA, 25 bp, Rattus norvegicus
agaactggcgaggttgtggtctccc

SEQ ID NO: 104183 - DNA, 25 bp, Rattus norvegicus
agaactggcgcactctgcaaaaaag

SEQ ID NO: 104184 - DNA, 25 bp, Rattus norvegicus
agaactggcgcagtctgcaaaaaag

SEQ ID NO: 104185 - DNA, 25 bp, Rattus norvegicus
agaactggctgcattctgtgggtca

SEQ ID NO: 104186 - DNA, 25 bp, Rattus norvegicus
agaactggctgctttctgtgggtca

SEQ ID NO: 104187 - DNA, 25 bp, Rattus norvegicus
agaactggcttcaacagtgcccctg

SEQ ID NO: 104188 - DNA, 25 bp, Rattus norvegicus
agaactggcttctacagtgcccctg

SEQ ID NO: 104189 - DNA, 25 bp, Rattus norvegicus
agaactgggaggagactcctcactt

SEQ ID NO: 104190 - DNA, 25 bp, Rattus norvegicus
agaactgggaggtgactcctcactt

SEQ ID NO: 104191 - DNA, 25 bp, Rattus norvegicus
agaactgggctcctgactcgcgctg

SEQ ID NO: 104192 - DNA, 25 bp, Rattus norvegicus
agaactgggctcgtgactcgcgctg

SEQ ID NO: 104193 - DNA, 25 bp, Rattus norvegicus
agaactgggtgaccacgtgaccaac

SEQ ID NO: 104194 - DNA, 25 bp, Rattus norvegicus
agaactgggtgagcacgtgaccaac

SEQ ID NO: 104195 - DNA, 25 bp, Rattus norvegicus
agaactggtaggagccttgctgcac

SEQ ID NO: 104196 - DNA, 25 bp, Rattus norvegicus
agaactggtaggtgccttgctgcac

SEQ ID NO: 104197 - DNA, 25 bp, Rattus norvegicus
agaactggtcagacctgctgtgcag

SEQ ID NO: 104198 - DNA, 25 bp, Rattus norvegicus
agaactggtcagtcctgctgtgcag

SEQ ID NO: 104199 - DNA, 25 bp, Rattus norvegicus
agaactggttctacacacgagctgc

SEQ ID NO: 104200 - DNA, 25 bp, Rattus norvegicus
agaactggttcttcacacgagctgc

SEQ ID NO: 104201 - DNA, 25 bp, Rattus norvegicus
agaactggttgaccgttacagcgtt

SEQ ID NO: 104202 - DNA, 25 bp, Rattus norvegicus
agaactggttgagcgttacagcgtt

SEQ ID NO: 104203 - DNA, 25 bp, Rattus norvegicus
agaactgtaaacctctgcctcttga

SEQ ID NO: 104204 - DNA, 25 bp, Rattus norvegicus
agaactgtaaacgtctgcctcttga

SEQ ID NO: 104205 - DNA, 25 bp, Rattus norvegicus
agaactgtaccaactgggtgctgga

SEQ ID NO: 104206 - DNA, 25 bp, Rattus norvegicus
agaactgtaccatctgggtgctgga

SEQ ID NO: 104207 - DNA, 25 bp, Rattus norvegicus
agaactgtactgatgtcactgtgca

SEQ ID NO: 104208 - DNA, 25 bp, Rattus norvegicus
agaactgtactgttgtcactgtgca

SEQ ID NO: 104209 - DNA, 25 bp, Rattus norvegicus
agaactgtaggcaccaatggatctc

SEQ ID NO: 104210 - DNA, 25 bp, Rattus norvegicus
agaactgtaggctccaatggatctc

SEQ ID NO: 104211 - DNA, 25 bp, Rattus norvegicus
agaactgtcacaatgacacacccct

SEQ ID NO: 104212 - DNA, 25 bp, Rattus norvegicus
agaactgtcacattgacacacccct

SEQ ID NO: 104213 - DNA, 25 bp, Rattus norvegicus
agaactgtcaccactaggcttttgg

SEQ ID NO: 104214 - DNA, 25 bp, Rattus norvegicus
agaactgtcacctctaggcttttgg

SEQ ID NO: 104215 - DNA, 25 bp, Rattus norvegicus
agaactgtccagatgagctctatga

SEQ ID NO: 104216 - DNA, 25 bp, Rattus norvegicus
agaactgtccagttgagctctatga

SEQ ID NO: 104217 - DNA, 25 bp, Rattus norvegicus
agaactgtccctaattctctgtatc

SEQ ID NO: 104218 - DNA, 25 bp, Rattus norvegicus
agaactgtcccttattctctgtatc

SEQ ID NO: 104219 - DNA, 25 bp, Rattus norvegicus
agaactgtctggaaactgtttctct

SEQ ID NO: 104220 - DNA, 25 bp, Rattus norvegicus
agaactgtctggtaactgtttctct

SEQ ID NO: 104221 - DNA, 25 bp, Rattus norvegicus
agaactgtcttactgctctgagctg

SEQ ID NO: 104222 - DNA, 25 bp, Rattus norvegicus
agaactgtcttagtgctctgagctg

SEQ ID NO: 104223 - DNA, 25 bp, Rattus norvegicus
agaactgtcttcaagcagtaaggca

SEQ ID NO: 104224 - DNA, 25 bp, Rattus norvegicus
agaactgtcttctagcagtaaggca

SEQ ID NO: 104225 - DNA, 25 bp, Rattus norvegicus
agaactgtcttgcagatggcgccct

SEQ ID NO: 104226 - DNA, 25 bp, Rattus norvegicus
agaactgtcttggagatggcgccct

SEQ ID NO: 104227 - DNA, 25 bp, Rattus norvegicus
agaactgtgagtatcgccactgcaa

SEQ ID NO: 104228 - DNA, 25 bp, Rattus norvegicus
agaactgtgagtttcgccactgcaa

SEQ ID NO: 104229 - DNA, 25 bp, Rattus norvegicus
agaactgtgccaaggtcacctaggt

SEQ ID NO: 104230 - DNA, 25 bp, Rattus norvegicus
agaactgtgccatggtcacctaggt

SEQ ID NO: 104231 - DNA, 25 bp, Rattus norvegicus
agaactgtgctcacatctttagaac

SEQ ID NO: 104232 - DNA, 25 bp, Rattus norvegicus
agaactgtgctctcatctttagaac

SEQ ID NO: 104233 - DNA, 25 bp, Rattus norvegicus
agaactgtggtcatctaccaacgca

SEQ ID NO: 104234 - DNA, 25 bp, Rattus norvegicus
agaactgtggtcttctaccaacgca

SEQ ID NO: 104235 - DNA, 25 bp, Rattus norvegicus
agaactgtggtgctgttgcttcccc

SEQ ID NO: 104236 - DNA, 25 bp, Rattus norvegicus
agaactgtggtggtgttgcttcccc

SEQ ID NO: 104237 - DNA, 25 bp, Rattus norvegicus
agaactgtgtcacctgctacaccga

SEQ ID NO: 104238 - DNA, 25 bp, Rattus norvegicus
agaactgtgtcagctgctacaccga

SEQ ID NO: 104239 - DNA, 25 bp, Rattus norvegicus
agaactgtgtccagtggatctcacc

SEQ ID NO: 104240 - DNA, 25 bp, Rattus norvegicus
agaactgtgtcctgtggatctcacc

SEQ ID NO: 104241 - DNA, 25 bp, Rattus norvegicus
agaactgtgtctctacagactccag

SEQ ID NO: 104242 - DNA, 25 bp, Rattus norvegicus
agaactgtgtctgtacagactccag

SEQ ID NO: 104243 - DNA, 25 bp, Rattus norvegicus
agaactgtgtgcctgtagtgaccag

SEQ ID NO: 104244 - DNA, 25 bp, Rattus norvegicus
agaactgtgtgcgtgtagtgaccag

SEQ ID NO: 104245 - DNA, 25 bp, Rattus norvegicus
agaactgtgttcattgagagggaaa

SEQ ID NO: 104246 - DNA, 25 bp, Rattus norvegicus
agaactgtgttctttgagagggaaa

SEQ ID NO: 104247 - DNA, 25 bp, Rattus norvegicus
agaactgttacacaagccctctgcc

SEQ ID NO: 104248 - DNA, 25 bp, Rattus norvegicus
agaactgttacagaagccctctgcc

SEQ ID NO: 104249 - DNA, 25 bp, Rattus norvegicus
agaactgttagtacctctggtccct

SEQ ID NO: 104250 - DNA, 25 bp, Rattus norvegicus
agaactgttagttcctctggtccct

SEQ ID NO: 104251 - DNA, 25 bp, Rattus norvegicus
agaactgttcctcagtgggtctgga

SEQ ID NO: 104252 - DNA, 25 bp, Rattus norvegicus
agaactgttcctgagtgggtctgga

SEQ ID NO: 104253 - DNA, 25 bp, Rattus norvegicus
agaactgttctaacgagtgtatgtt

SEQ ID NO: 104254 - DNA, 25 bp, Rattus norvegicus
agaactgttctatcgagtgtatgtt

SEQ ID NO: 104255 - DNA, 25 bp, Rattus norvegicus
agaactgttctcacaatggtccttc

SEQ ID NO: 104256 - DNA, 25 bp, Rattus norvegicus
agaactgttctctcaatggtccttc

SEQ ID NO: 104257 - DNA, 25 bp, Rattus norvegicus
agaactgttgctacctgggtgtgac

SEQ ID NO: 104258 - DNA, 25 bp, Rattus norvegicus
agaactgttgcttcctgggtgtgac

SEQ ID NO: 104259 - DNA, 25 bp, Rattus norvegicus
agaactgttgtccacgaacacagag

SEQ ID NO: 104260 - DNA, 25 bp, Rattus norvegicus
agaactgttgtcgacgaacacagag

SEQ ID NO: 104261 - DNA, 25 bp, Rattus norvegicus
agaactgtttcccttcagcttggga

SEQ ID NO: 104262 - DNA, 25 bp, Rattus norvegicus
agaactgtttccgttcagcttggga

SEQ ID NO: 104263 - DNA, 25 bp, Rattus norvegicus
agaactgtttgacagcgcaaggccc

SEQ ID NO: 104264 - DNA, 25 bp, Rattus norvegicus
agaactgtttgagagcgcaaggccc

SEQ ID NO: 104265 - DNA, 25 bp, Rattus norvegicus
agaactgttttcagtgtgccacagt

SEQ ID NO: 104266 - DNA, 25 bp, Rattus norvegicus
agaactgttttctgtgtgccacagt

SEQ ID NO: 104267 - DNA, 25 bp, Rattus norvegicus
agaacttaattcactgtctagggag

SEQ ID NO: 104268 - DNA, 25 bp, Rattus norvegicus
agaacttaattctctgtctagggag

SEQ ID NO: 104269 - DNA, 25 bp, Rattus norvegicus
agaacttacagcagcatccactgca

SEQ ID NO: 104270 - DNA, 25 bp, Rattus norvegicus
agaacttacagctgcatccactgca

SEQ ID NO: 104271 - DNA, 25 bp, Rattus norvegicus
agaacttactggattgctctctctc

SEQ ID NO: 104272 - DNA, 25 bp, Rattus norvegicus
agaacttactggtttgctctctctc

SEQ ID NO: 104273 - DNA, 25 bp, Rattus norvegicus
agaacttacttacctttaactgaga

SEQ ID NO: 104274 - DNA, 25 bp, Rattus norvegicus
agaacttacttagctttaactgaga

SEQ ID NO: 104275 - DNA, 25 bp, Rattus norvegicus
agaacttagctgaactcgggagagt

SEQ ID NO: 104276 - DNA, 25 bp, Rattus norvegicus
agaacttagctgtactcgggagagt

SEQ ID NO: 104277 - DNA, 25 bp, Rattus norvegicus
agaacttagttcagccttctttctc

SEQ ID NO: 104278 - DNA, 25 bp, Rattus norvegicus
agaacttagttctgccttctttctc

SEQ ID NO: 104279 - DNA, 25 bp, Rattus norvegicus
agaacttatttcatcactccacaac

SEQ ID NO: 104280 - DNA, 25 bp, Rattus norvegicus
agaacttatttcttcactccacaac

SEQ ID NO: 104281 - DNA, 25 bp, Rattus norvegicus
agaacttcaaggacacatgcaagga

SEQ ID NO: 104282 - DNA, 25 bp, Rattus norvegicus
agaacttcaaggtcacatgcaagga

SEQ ID NO: 104283 - DNA, 25 bp, Rattus norvegicus
agaacttcacctcctttagtctcaa

SEQ ID NO: 104284 - DNA, 25 bp, Rattus norvegicus
agaacttcacctgctttagtctcaa

SEQ ID NO: 104285 - DNA, 25 bp, Rattus norvegicus
agaacttcacgtagcatccgctggt

SEQ ID NO: 104286 - DNA, 25 bp, Rattus norvegicus
agaacttcacgttgcatccgctggt

SEQ ID NO: 104287 - DNA, 25 bp, Rattus norvegicus
agaacttcagagatcctcactcact

SEQ ID NO: 104288 - DNA, 25 bp, Rattus norvegicus
agaacttcagagttcctcactcact

SEQ ID NO: 104289 - DNA, 25 bp, Rattus norvegicus
agaacttcagcgatggacagagaca

SEQ ID NO: 104290 - DNA, 25 bp, Rattus norvegicus
agaacttcagcgttggacagagaca

SEQ ID NO: 104291 - DNA, 25 bp, Rattus norvegicus
agaacttcagctactggcggtccaa

SEQ ID NO: 104292 - DNA, 25 bp, Rattus norvegicus
agaacttcagcttctggcggtccaa

SEQ ID NO: 104293 - DNA, 25 bp, Rattus norvegicus
agaacttcagttaatggcctgggcc

SEQ ID NO: 104294 - DNA, 25 bp, Rattus norvegicus
agaacttcagtttatggcctgggcc

SEQ ID NO: 104295 - DNA, 25 bp, Rattus norvegicus
agaacttcatctagcagcttcttcc

SEQ ID NO: 104296 - DNA, 25 bp, Rattus norvegicus
agaacttcatcttgcagcttcttcc

SEQ ID NO: 104297 - DNA, 25 bp, Rattus norvegicus
agaacttccagtcaccttagatctt

SEQ ID NO: 104298 - DNA, 25 bp, Rattus norvegicus
agaacttccagtgaccttagatctt

SEQ ID NO: 104299 - DNA, 25 bp, Rattus norvegicus
agaacttcccatattgcggcttttg

SEQ ID NO: 104300 - DNA, 25 bp, Rattus norvegicus
agaacttcccattttgcggcttttg

SEQ ID NO: 104301 - DNA, 25 bp, Rattus norvegicus
agaacttcccggagtgcggcccagg

SEQ ID NO: 104302 - DNA, 25 bp, Rattus norvegicus
agaacttcccggtgtgcggcccagg

SEQ ID NO: 104303 - DNA, 25 bp, Rattus norvegicus
agaacttcctctcagggctcttggc

SEQ ID NO: 104304 - DNA, 25 bp, Rattus norvegicus
agaacttcctctgagggctcttggc

SEQ ID NO: 104305 - DNA, 25 bp, Rattus norvegicus
agaacttcctgtccttgccatcttt

SEQ ID NO: 104306 - DNA, 25 bp, Rattus norvegicus
agaacttcctgtgcttgccatcttt

SEQ ID NO: 104307 - DNA, 25 bp, Rattus norvegicus
agaacttccttaatgtgtcacattt

SEQ ID NO: 104308 - DNA, 25 bp, Rattus norvegicus
agaacttccttattgtgtcacattt

SEQ ID NO: 104309 - DNA, 25 bp, Rattus norvegicus
agaacttcgactccaagaggcgcat

SEQ ID NO: 104310 - DNA, 25 bp, Rattus norvegicus
agaacttcgactgcaagaggcgcat

SEQ ID NO: 104311 - DNA, 25 bp, Rattus norvegicus
agaacttcgagaatttattttgcag

SEQ ID NO: 104312 - DNA, 25 bp, Rattus norvegicus
agaacttcgagattttattttgcag

SEQ ID NO: 104313 - DNA, 25 bp, Rattus norvegicus
agaacttcggtcacattgacggtcg

SEQ ID NO: 104314 - DNA, 25 bp, Rattus norvegicus
agaacttcggtctcattgacggtcg

SEQ ID NO: 104315 - DNA, 25 bp, Rattus norvegicus
agaacttcggtgctctgtcgtcttt

SEQ ID NO: 104316 - DNA, 25 bp, Rattus norvegicus
agaacttcggtggtctgtcgtcttt

SEQ ID NO: 104317 - DNA, 25 bp, Rattus norvegicus
agaacttctcacattagccacggga

SEQ ID NO: 104318 - DNA, 25 bp, Rattus norvegicus
agaacttctcactttagccacggga

SEQ ID NO: 104319 - DNA, 25 bp, Rattus norvegicus
agaacttctcctacggtattatcac

SEQ ID NO: 104320 - DNA, 25 bp, Rattus norvegicus
agaacttctccttcggtattatcac

SEQ ID NO: 104321 - DNA, 25 bp, Rattus norvegicus
agaacttctcggatacattgtgcac

SEQ ID NO: 104322 - DNA, 25 bp, Rattus norvegicus
agaacttctcggttacattgtgcac

SEQ ID NO: 104323 - DNA, 25 bp, Rattus norvegicus
agaacttctcttctgggaccaatcg

SEQ ID NO: 104324 - DNA, 25 bp, Rattus norvegicus
agaacttctcttgtgggaccaatcg

SEQ ID NO: 104325 - DNA, 25 bp, Rattus norvegicus
agaacttctgacagtgtcaccttgg

SEQ ID NO: 104326 - DNA, 25 bp, Rattus norvegicus
agaacttctgactgtgtcaccttgg

SEQ ID NO: 104327 - DNA, 25 bp, Rattus norvegicus
agaacttctgctaccgtcttgatgg

SEQ ID NO: 104328 - DNA, 25 bp, Rattus norvegicus
agaacttctgcttccgtcttgatgg

SEQ ID NO: 104329 - DNA, 25 bp, Rattus norvegicus
agaacttcttttcgtggaccaccag

SEQ ID NO: 104330 - DNA, 25 bp, Rattus norvegicus
agaacttcttttggtggaccaccag

SEQ ID NO: 104331 - DNA, 25 bp, Rattus norvegicus
agaacttgacagattgtccctgctc

SEQ ID NO: 104332 - DNA, 25 bp, Rattus norvegicus
agaacttgacagtttgtccctgctc

SEQ ID NO: 104333 - DNA, 25 bp, Rattus norvegicus
agaacttgactcaccatcttcaaaa

SEQ ID NO: 104334 - DNA, 25 bp, Rattus norvegicus
agaacttgactctccatcttcaaaa

SEQ ID NO: 104335 - DNA, 25 bp, Rattus norvegicus
agaacttgccagctttatccaaatg

SEQ ID NO: 104336 - DNA, 25 bp, Rattus norvegicus
agaacttgccaggtttatccaaatg

SEQ ID NO: 104337 - DNA, 25 bp, Rattus norvegicus
agaacttgccctccatccagatagt

SEQ ID NO: 104338 - DNA, 25 bp, Rattus norvegicus
agaacttgccctcttggtccaagat

SEQ ID NO: 104339 - DNA, 25 bp, Rattus norvegicus
agaacttgccctgcatccagatagt

SEQ ID NO: 104340 - DNA, 25 bp, Rattus norvegicus
agaacttgccctgttggtccaagat

SEQ ID NO: 104341 - DNA, 25 bp, Rattus norvegicus
agaacttgcgtaacctgtttgctag

SEQ ID NO: 104342 - DNA, 25 bp, Rattus norvegicus
agaacttgcgtatcctgtttgctag

SEQ ID NO: 104343 - DNA, 25 bp, Rattus norvegicus
agaacttggaccactggcctgattt

SEQ ID NO: 104344 - DNA, 25 bp, Rattus norvegicus
agaacttggacctctggcctgattt

SEQ ID NO: 104345 - DNA, 25 bp, Rattus norvegicus
agaacttggagccaactgcctggcc

SEQ ID NO: 104346 - DNA, 25 bp, Rattus norvegicus
agaacttggagcgaactgcctggcc

SEQ ID NO: 104347 - DNA, 25 bp, Rattus norvegicus
agaacttggcgtagtgcaacggcga

SEQ ID NO: 104348 - DNA, 25 bp, Rattus norvegicus
agaacttggcgttgtgcaacggcga

SEQ ID NO: 104349 - DNA, 25 bp, Rattus norvegicus
agaacttgtcctcctgagggttcca

SEQ ID NO: 104350 - DNA, 25 bp, Rattus norvegicus
agaacttgtcctgctgagggttcca

SEQ ID NO: 104351 - DNA, 25 bp, Rattus norvegicus
agaacttgttccatgaggccttgag

SEQ ID NO: 104352 - DNA, 25 bp, Rattus norvegicus
agaacttgttccttgaggccttgag

SEQ ID NO: 104353 - DNA, 25 bp, Rattus norvegicus
agaacttgttctccgtcatgtatca

SEQ ID NO: 104354 - DNA, 25 bp, Rattus norvegicus
agaacttgttctgcgtcatgtatca

SEQ ID NO: 104355 - DNA, 25 bp, Rattus norvegicus
agaacttgtttcagttgatacctgg

SEQ ID NO: 104356 - DNA, 25 bp, Rattus norvegicus
agaacttgtttctgttgatacctgg

SEQ ID NO: 104357 - DNA, 25 bp, Rattus norvegicus
agaactttaaggcagatcccaccat

SEQ ID NO: 104358 - DNA, 25 bp, Rattus norvegicus
agaactttaagggagatcccaccat

SEQ ID NO: 104359 - DNA, 25 bp, Rattus norvegicus
agaactttacctatgcaggcatcga

SEQ ID NO: 104360 - DNA, 25 bp, Rattus norvegicus
agaactttacctttgcaggcatcga

SEQ ID NO: 104361 - DNA, 25 bp, Rattus norvegicus
agaactttactgattgtcaacggag

SEQ ID NO: 104362 - DNA, 25 bp, Rattus norvegicus
agaactttactgtttgtcaacggag

SEQ ID NO: 104363 - DNA, 25 bp, Rattus norvegicus
agaactttagtcagttctacccctg

SEQ ID NO: 104364 - DNA, 25 bp, Rattus norvegicus
agaactttagtctgttctacccctg

SEQ ID NO: 104365 - DNA, 25 bp, Rattus norvegicus
agaactttcaacactgacctcgtga

SEQ ID NO: 104366 - DNA, 25 bp, Rattus norvegicus
agaactttcaactctgacctcgtga

SEQ ID NO: 104367 - DNA, 25 bp, Rattus norvegicus
agaactttcagcagttactttccca

SEQ ID NO: 104368 - DNA, 25 bp, Rattus norvegicus
agaactttcagctgttactttccca

SEQ ID NO: 104369 - DNA, 25 bp, Rattus norvegicus
agaactttcatgcatcttgtagtgt

SEQ ID NO: 104370 - DNA, 25 bp, Rattus norvegicus
agaactttcatggatcttgtagtgt

SEQ ID NO: 104371 - DNA, 25 bp, Rattus norvegicus
agaactttccagcactgcagagtga

SEQ ID NO: 104372 - DNA, 25 bp, Rattus norvegicus
agaactttccaggactgcagagtga

SEQ ID NO: 104373 - DNA, 25 bp, Rattus norvegicus
agaactttcccacacctgtggagat

SEQ ID NO: 104374 - DNA, 25 bp, Rattus norvegicus
agaactttcccagacctgtggagat

SEQ ID NO: 104375 - DNA, 25 bp, Rattus norvegicus
agaactttcctgatgctacggcttt

SEQ ID NO: 104376 - DNA, 25 bp, Rattus norvegicus
agaactttcctgttgctacggcttt

SEQ ID NO: 104377 - DNA, 25 bp, Rattus norvegicus
agaactttctgcaggctcacaacgg

SEQ ID NO: 104378 - DNA, 25 bp, Rattus norvegicus
agaactttctgctggctcacaacgg

SEQ ID NO: 104379 - DNA, 25 bp, Rattus norvegicus
agaactttcttcacatcatggatat

SEQ ID NO: 104380 - DNA, 25 bp, Rattus norvegicus
agaactttcttctcatcatggatat

SEQ ID NO: 104381 - DNA, 25 bp, Rattus norvegicus
agaactttgggcatactccctctct

SEQ ID NO: 104382 - DNA, 25 bp, Rattus norvegicus
agaactttgggcttactccctctct

SEQ ID NO: 104383 - DNA, 25 bp, Rattus norvegicus
agaactttggtcacttcactaaggg

SEQ ID NO: 104384 - DNA, 25 bp, Rattus norvegicus
agaactttggtctcttcactaaggg

SEQ ID NO: 104385 - DNA, 25 bp, Rattus norvegicus
agaactttgtacagcaagtccagca

SEQ ID NO: 104386 - DNA, 25 bp, Rattus norvegicus
agaactttgtaccttacatgcccca

SEQ ID NO: 104387 - DNA, 25 bp, Rattus norvegicus
agaactttgtacgttacatgcccca

SEQ ID NO: 104388 - DNA, 25 bp, Rattus norvegicus
agaactttgtactgcaagtccagca

SEQ ID NO: 104389 - DNA, 25 bp, Rattus norvegicus
agaactttgtctaccattcaggcta

SEQ ID NO: 104390 - DNA, 25 bp, Rattus norvegicus
agaactttgtcttccattcaggcta

SEQ ID NO: 104391 - DNA, 25 bp, Rattus norvegicus
agaactttgtgactgccagggccgc

SEQ ID NO: 104392 - DNA, 25 bp, Rattus norvegicus
agaactttgtgagtgccagggccgc

SEQ ID NO: 104393 - DNA, 25 bp, Rattus norvegicus
agaactttgtgtcagcagagcggct

SEQ ID NO: 104394 - DNA, 25 bp, Rattus norvegicus
agaactttgtgtctgctactgacat

SEQ ID NO: 104395 - DNA, 25 bp, Rattus norvegicus
agaactttgtgtgagcagagcggct

SEQ ID NO: 104396 - DNA, 25 bp, Rattus norvegicus
agaactttgtgtgtgctactgacat

SEQ ID NO: 104397 - DNA, 25 bp, Rattus norvegicus
agaactttgttgcatggtaacctcc

SEQ ID NO: 104398 - DNA, 25 bp, Rattus norvegicus
agaactttgttggatggtaacctcc

SEQ ID NO: 104399 - DNA, 25 bp, Rattus norvegicus
agaacttttacaccaccagtgggat

SEQ ID NO: 104400 - DNA, 25 bp, Rattus norvegicus
agaacttttacagcaccagtgggat

SEQ ID NO: 104401 - DNA, 25 bp, Rattus norvegicus
agaacttttatcactgtccagtgcc

SEQ ID NO: 104402 - DNA, 25 bp, Rattus norvegicus
agaacttttatctctgtccagtgcc

SEQ ID NO: 104403 - DNA, 25 bp, Rattus norvegicus
agaacttttcctctgttaatgcaaa

SEQ ID NO: 104404 - DNA, 25 bp, Rattus norvegicus
agaacttttcctgtgttaatgcaaa

SEQ ID NO: 104405 - DNA, 25 bp, Rattus norvegicus
agaactttttacacctgaatgcaag

SEQ ID NO: 104406 - DNA, 25 bp, Rattus norvegicus
agaactttttactcctgaatgcaag

SEQ ID NO: 104407 - DNA, 25 bp, Rattus norvegicus
agaagaaaaactacagagcagccct

SEQ ID NO: 104408 - DNA, 25 bp, Rattus norvegicus
agaagaaaaacttcagagcagccct

SEQ ID NO: 104409 - DNA, 25 bp, Rattus norvegicus
agaagaaacaccagtcactcccttc

SEQ ID NO: 104410 - DNA, 25 bp, Rattus norvegicus
agaagaaacacctgtcactcccttc

SEQ ID NO: 104411 - DNA, 25 bp, Rattus norvegicus
agaagaaaccagactcgctgggaac

SEQ ID NO: 104412 - DNA, 25 bp, Rattus norvegicus
agaagaaaccagtctcgctgggaac

SEQ ID NO: 104413 - DNA, 25 bp, Rattus norvegicus
agaagaaactcaaggccgctaggga

SEQ ID NO: 104414 - DNA, 25 bp, Rattus norvegicus
agaagaaactcacccagtcagctgg

SEQ ID NO: 104415 - DNA, 25 bp, Rattus norvegicus
agaagaaactcagccagtcagctgg

SEQ ID NO: 104416 - DNA, 25 bp, Rattus norvegicus
agaagaaactcatggccgctaggga

SEQ ID NO: 104417 - DNA, 25 bp, Rattus norvegicus
agaagaaacttcagtctgcaccagc

SEQ ID NO: 104418 - DNA, 25 bp, Rattus norvegicus
agaagaaacttctgtctgcaccagc

SEQ ID NO: 104419 - DNA, 25 bp, Rattus norvegicus
agaagaaagcatagtatcccctgga

SEQ ID NO: 104420 - DNA, 25 bp, Rattus norvegicus
agaagaaagcattgtatcccctgga

SEQ ID NO: 104421 - DNA, 25 bp, Rattus norvegicus
agaagaaagcctctgagccgctgtc

SEQ ID NO: 104422 - DNA, 25 bp, Rattus norvegicus
agaagaaagcctgtgagccgctgtc

SEQ ID NO: 104423 - DNA, 25 bp, Rattus norvegicus
agaagaaatcaccaccagttccagc

SEQ ID NO: 104424 - DNA, 25 bp, Rattus norvegicus
agaagaaatcacgaccagttccagc

SEQ ID NO: 104425 - DNA, 25 bp, Rattus norvegicus
agaagaaatccaacatcccattacc

SEQ ID NO: 104426 - DNA, 25 bp, Rattus norvegicus
agaagaaatccatcatcccattacc

SEQ ID NO: 104427 - DNA, 25 bp, Rattus norvegicus
agaagaaattcacccgtcctctgct

SEQ ID NO: 104428 - DNA, 25 bp, Rattus norvegicus
agaagaaattcagccgtcctctgct

SEQ ID NO: 104429 - DNA, 25 bp, Rattus norvegicus
agaagaaattctactcctgagcata

SEQ ID NO: 104430 - DNA, 25 bp, Rattus norvegicus
agaagaaattcttctcctgagcata

SEQ ID NO: 104431 - DNA, 25 bp, Rattus norvegicus
agaagaacacctccctgagacgaca

SEQ ID NO: 104432 - DNA, 25 bp, Rattus norvegicus
agaagaacacctgcctgagacgaca

SEQ ID NO: 104433 - DNA, 25 bp, Rattus norvegicus
agaagaacagcgctagtcctcccag

SEQ ID NO: 104434 - DNA, 25 bp, Rattus norvegicus
agaagaacagcggtagtcctcccag

SEQ ID NO: 104435 - DNA, 25 bp, Rattus norvegicus
agaagaacagttccaagatttggat

SEQ ID NO: 104436 - DNA, 25 bp, Rattus norvegicus
agaagaacagttgcaagatttggat

SEQ ID NO: 104437 - DNA, 25 bp, Rattus norvegicus
agaagaacatcactctcccagtggc

SEQ ID NO: 104438 - DNA, 25 bp, Rattus norvegicus
agaagaacatcagtctcccagtggc

SEQ ID NO: 104439 - DNA, 25 bp, Rattus norvegicus
agaagaacatctcgtgctgagggct

SEQ ID NO: 104440 - DNA, 25 bp, Rattus norvegicus
agaagaacatctggtgctgagggct

SEQ ID NO: 104441 - DNA, 25 bp, Rattus norvegicus
agaagaaccgggactctgcagccca

SEQ ID NO: 104442 - DNA, 25 bp, Rattus norvegicus
agaagaaccgggtctctgcagccca

SEQ ID NO: 104443 - DNA, 25 bp, Rattus norvegicus
agaagaacctccattgcaggactgc

SEQ ID NO: 104444 - DNA, 25 bp, Rattus norvegicus
agaagaacctcctttgcaggactgc

SEQ ID NO: 104445 - DNA, 25 bp, Rattus norvegicus
agaagaacctctcccttgtttagcc

SEQ ID NO: 104446 - DNA, 25 bp, Rattus norvegicus
agaagaacctctgccttgtttagcc

SEQ ID NO: 104447 - DNA, 25 bp, Rattus norvegicus
agaagaacctggctctgtccttgca

SEQ ID NO: 104448 - DNA, 25 bp, Rattus norvegicus
agaagaacctgggtctgtccttgca

SEQ ID NO: 104449 - DNA, 25 bp, Rattus norvegicus
agaagaacctgtagtctcctgtcac

SEQ ID NO: 104450 - DNA, 25 bp, Rattus norvegicus
agaagaacctgtcccgctctcctgg

SEQ ID NO: 104451 - DNA, 25 bp, Rattus norvegicus
agaagaacctgtgccgctctcctgg

SEQ ID NO: 104452 - DNA, 25 bp, Rattus norvegicus
agaagaacctgttgtctcctgtcac

SEQ ID NO: 104453 - DNA, 25 bp, Rattus norvegicus
agaagaaccttgactggaaccagtc

SEQ ID NO: 104454 - DNA, 25 bp, Rattus norvegicus
agaagaaccttgtctggaaccagtc

SEQ ID NO: 104455 - DNA, 25 bp, Rattus norvegicus
agaagaacgccaactatcggcacta

SEQ ID NO: 104456 - DNA, 25 bp, Rattus norvegicus
agaagaacgccatctatcggcacta

SEQ ID NO: 104457 - DNA, 25 bp, Rattus norvegicus
agaagaactgccatacatttccacc

SEQ ID NO: 104458 - DNA, 25 bp, Rattus norvegicus
agaagaactgccttacatttccacc

SEQ ID NO: 104459 - DNA, 25 bp, Rattus norvegicus
agaagaacttcgatcctgttctgcc

SEQ ID NO: 104460 - DNA, 25 bp, Rattus norvegicus
agaagaacttcgttcctgttctgcc

SEQ ID NO: 104461 - DNA, 25 bp, Rattus norvegicus
agaagaagacttcccagtgctccca

SEQ ID NO: 104462 - DNA, 25 bp, Rattus norvegicus
agaagaagacttgccagtgctccca

SEQ ID NO: 104463 - DNA, 25 bp, Rattus norvegicus
agaagaagagtcaccgccttggcgc

SEQ ID NO: 104464 - DNA, 25 bp, Rattus norvegicus
agaagaagagtctccgccttggcgc

SEQ ID NO: 104465 - DNA, 25 bp, Rattus norvegicus
agaagaagcagcagaagcagcccgc

SEQ ID NO: 104466 - DNA, 25 bp, Rattus norvegicus
agaagaagcagctgaagcagcccgc

SEQ ID NO: 104467 - DNA, 25 bp, Rattus norvegicus
agaagaagcagtacttcctcctgct

SEQ ID NO: 104468 - DNA, 25 bp, Rattus norvegicus
agaagaagcagttcttcctcctgct

SEQ ID NO: 104469 - DNA, 25 bp, Rattus norvegicus
agaagaagcattcccggcctctggt

SEQ ID NO: 104470 - DNA, 25 bp, Rattus norvegicus
agaagaagcattgccggcctctggt

SEQ ID NO: 104471 - DNA, 25 bp, Rattus norvegicus
agaagaagccacctggatcccgacg

SEQ ID NO: 104472 - DNA, 25 bp, Rattus norvegicus
agaagaagccacgtggatcccgacg

SEQ ID NO: 104473 - DNA, 25 bp, Rattus norvegicus
agaagaagccatatgcggaacactg

SEQ ID NO: 104474 - DNA, 25 bp, Rattus norvegicus
agaagaagccatctcccgaggtcca

SEQ ID NO: 104475 - DNA, 25 bp, Rattus norvegicus
agaagaagccatgtcccgaggtcca

SEQ ID NO: 104476 - DNA, 25 bp, Rattus norvegicus
agaagaagccatttgcggaacactg

SEQ ID NO: 104477 - DNA, 25 bp, Rattus norvegicus
agaagaagccccaaagtcctcagtt

SEQ ID NO: 104478 - DNA, 25 bp, Rattus norvegicus
agaagaagcccctaagtcctcagtt

SEQ ID NO: 104479 - DNA, 25 bp, Rattus norvegicus
agaagaagcctccttgctgcagctg

SEQ ID NO: 104480 - DNA, 25 bp, Rattus norvegicus
agaagaagcctcgttgctgcagctg

SEQ ID NO: 104481 - DNA, 25 bp, Rattus norvegicus
agaagaagcgcaaggccatggccat

SEQ ID NO: 104482 - DNA, 25 bp, Rattus norvegicus
agaagaagcgcatggccatggccat

SEQ ID NO: 104483 - DNA, 25 bp, Rattus norvegicus
agaagaagcggacggcccagctttc

SEQ ID NO: 104484 - DNA, 25 bp, Rattus norvegicus
agaagaagcggagggcccagctttc

SEQ ID NO: 104485 - DNA, 25 bp, Rattus norvegicus
agaagaagctgaccccacctttcaa

SEQ ID NO: 104486 - DNA, 25 bp, Rattus norvegicus
agaagaagctgagcccacctttcaa

SEQ ID NO: 104487 - DNA, 25 bp, Rattus norvegicus
agaagaaggagcaccgacaccacct

SEQ ID NO: 104488 - DNA, 25 bp, Rattus norvegicus
agaagaaggagctccgacaccacct

SEQ ID NO: 104489 - DNA, 25 bp, Rattus norvegicus
agaagaagggcgacttccgcgagcc

SEQ ID NO: 104490 - DNA, 25 bp, Rattus norvegicus
agaagaagggcgtcttccgcgagcc

SEQ ID NO: 104491 - DNA, 25 bp, Rattus norvegicus
agaagaaggtctccctgctactcag

SEQ ID NO: 104492 - DNA, 25 bp, Rattus norvegicus
agaagaaggtctgcctgctactcag

SEQ ID NO: 104493 - DNA, 25 bp, Rattus norvegicus
agaagaaggtgtcagatctcattac

SEQ ID NO: 104494 - DNA, 25 bp, Rattus norvegicus
agaagaaggtgtgagatctcattac

SEQ ID NO: 104495 - DNA, 25 bp, Rattus norvegicus
agaagaagtcttagtcccacaacct

SEQ ID NO: 104496 - DNA, 25 bp, Rattus norvegicus
agaagaagtctttgtcccacaacct

SEQ ID NO: 104497 - DNA, 25 bp, Rattus norvegicus
agaagaagtgcaacctctccatcag

SEQ ID NO: 104498 - DNA, 25 bp, Rattus norvegicus
agaagaagtgcatcctctccatcag

SEQ ID NO: 104499 - DNA, 25 bp, Rattus norvegicus
agaagaagtgttacccgagatcggc

SEQ ID NO: 104500 - DNA, 25 bp, Rattus norvegicus
agaagaagtgtttcccgagatcggc

SEQ ID NO: 104501 - DNA, 25 bp, Rattus norvegicus
agaagaataccaatgcccttgctat

SEQ ID NO: 104502 - DNA, 25 bp, Rattus norvegicus
agaagaataccattgcccttgctat

SEQ ID NO: 104503 - DNA, 25 bp, Rattus norvegicus
agaagaatattaccctgcctcacct

SEQ ID NO: 104504 - DNA, 25 bp, Rattus norvegicus
agaagaatattagcctgcctcacct

SEQ ID NO: 104505 - DNA, 25 bp, Rattus norvegicus
agaagaatatttcgcccaggctgtg

SEQ ID NO: 104506 - DNA, 25 bp, Rattus norvegicus
agaagaatatttggcccaggctgtg

SEQ ID NO: 104507 - DNA, 25 bp, Rattus norvegicus
agaagaatcacacccaattccccaa

SEQ ID NO: 104508 - DNA, 25 bp, Rattus norvegicus
agaagaatcacagccaattccccaa

SEQ ID NO: 104509 - DNA, 25 bp, Rattus norvegicus
agaagaatcataactgtcagtacta

SEQ ID NO: 104510 - DNA, 25 bp, Rattus norvegicus
agaagaatcatatctgtcagtacta

SEQ ID NO: 104511 - DNA, 25 bp, Rattus norvegicus
agaagaatcctccatgggctactca

SEQ ID NO: 104512 - DNA, 25 bp, Rattus norvegicus
agaagaatcctcgatgggctactca

SEQ ID NO: 104513 - DNA, 25 bp, Rattus norvegicus
agaagaatgccacccagttgggtag

SEQ ID NO: 104514 - DNA, 25 bp, Rattus norvegicus
agaagaatgccagccagttgggtag

SEQ ID NO: 104515 - DNA, 25 bp, Rattus norvegicus
agaagaatgctgaccgtgtatcgtc

SEQ ID NO: 104516 - DNA, 25 bp, Rattus norvegicus
agaagaatgctgtccgtgtatcgtc

SEQ ID NO: 104517 - DNA, 25 bp, Rattus norvegicus
agaagaattcccatgcttacccaag

SEQ ID NO: 104518 - DNA, 25 bp, Rattus norvegicus
agaagaattccccaaacttggccag

SEQ ID NO: 104519 - DNA, 25 bp, Rattus norvegicus
agaagaattcccgaaacttggccag

SEQ ID NO: 104520 - DNA, 25 bp, Rattus norvegicus
agaagaattcccttgcttacccaag

SEQ ID NO: 104521 - DNA, 25 bp, Rattus norvegicus
agaagaattctcacctgtgaaagac

SEQ ID NO: 104522 - DNA, 25 bp, Rattus norvegicus
agaagaattctctcctgtgaaagac

SEQ ID NO: 104523 - DNA, 25 bp, Rattus norvegicus
agaagaattttgaagttggtcactt

SEQ ID NO: 104524 - DNA, 25 bp, Rattus norvegicus
agaagaattttgtagttggtcactt

SEQ ID NO: 104525 - DNA, 25 bp, Rattus norvegicus
agaagacaaatgagccccttggact

SEQ ID NO: 104526 - DNA, 25 bp, Rattus norvegicus
agaagacaaatgtgccccttggact

SEQ ID NO: 104527 - DNA, 25 bp, Rattus norvegicus
agaagacaacgactgccctgatatt

SEQ ID NO: 104528 - DNA, 25 bp, Rattus norvegicus
agaagacaacgagtgccctgatatt

SEQ ID NO: 104529 - DNA, 25 bp, Rattus norvegicus
agaagacaaggcagcaccgtgcaca

SEQ ID NO: 104530 - DNA, 25 bp, Rattus norvegicus
agaagacaaggctgcaccgtgcaca

SEQ ID NO: 104531 - DNA, 25 bp, Rattus norvegicus
agaagacaatttcccctttgccgat

SEQ ID NO: 104532 - DNA, 25 bp, Rattus norvegicus
agaagacaatttgccctttgccgat

SEQ ID NO: 104533 - DNA, 25 bp, Rattus norvegicus
agaagacacacaattcatcctctgc

SEQ ID NO: 104534 - DNA, 25 bp, Rattus norvegicus
agaagacacacatttcatcctctgc

SEQ ID NO: 104535 - DNA, 25 bp, Rattus norvegicus
agaagacacagcactacttcctgct

SEQ ID NO: 104536 - DNA, 25 bp, Rattus norvegicus
agaagacacagccaccagtcgaatt

SEQ ID NO: 104537 - DNA, 25 bp, Rattus norvegicus
agaagacacagcgaccagtcgaatt

SEQ ID NO: 104538 - DNA, 25 bp, Rattus norvegicus
agaagacacagctctacttcctgct

SEQ ID NO: 104539 - DNA, 25 bp, Rattus norvegicus
agaagacacctcacatctcactgtt

SEQ ID NO: 104540 - DNA, 25 bp, Rattus norvegicus
agaagacacctctcatctcactgtt

SEQ ID NO: 104541 - DNA, 25 bp, Rattus norvegicus
agaagacacgccatcgaatctccag

SEQ ID NO: 104542 - DNA, 25 bp, Rattus norvegicus
agaagacacgccttcgaatctccag

SEQ ID NO: 104543 - DNA, 25 bp, Rattus norvegicus
agaagacactcaacaagcacgcacg

SEQ ID NO: 104544 - DNA, 25 bp, Rattus norvegicus
agaagacactcatcaagcacgcacg

SEQ ID NO: 104545 - DNA, 25 bp, Rattus norvegicus
agaagacagaagaagccccagggca

SEQ ID NO: 104546 - DNA, 25 bp, Rattus norvegicus
agaagacagaagtagccccagggca

SEQ ID NO: 104547 - DNA, 25 bp, Rattus norvegicus
agaagacagaccctgtccctctgaa

SEQ ID NO: 104548 - DNA, 25 bp, Rattus norvegicus
agaagacagaccgtgtccctctgaa

SEQ ID NO: 104549 - DNA, 25 bp, Rattus norvegicus
agaagacagcttcctccaataacct

SEQ ID NO: 104550 - DNA, 25 bp, Rattus norvegicus
agaagacagcttgctccaataacct

SEQ ID NO: 104551 - DNA, 25 bp, Rattus norvegicus
agaagacaggccacagttcatcagc

SEQ ID NO: 104552 - DNA, 25 bp, Rattus norvegicus
agaagacaggcctcagttcatcagc

SEQ ID NO: 104553 - DNA, 25 bp, Rattus norvegicus
agaagacaggctacaggaagccata

SEQ ID NO: 104554 - DNA, 25 bp, Rattus norvegicus
agaagacaggctactgctggtgcag

SEQ ID NO: 104555 - DNA, 25 bp, Rattus norvegicus
agaagacaggcttcaggaagccata

SEQ ID NO: 104556 - DNA, 25 bp, Rattus norvegicus
agaagacaggcttctgctggtgcag

SEQ ID NO: 104557 - DNA, 25 bp, Rattus norvegicus
agaagacagtctatcgcatacgctc

SEQ ID NO: 104558 - DNA, 25 bp, Rattus norvegicus
agaagacagtctttcgcatacgctc

SEQ ID NO: 104559 - DNA, 25 bp, Rattus norvegicus
agaagacagttgcagccttccctca

SEQ ID NO: 104560 - DNA, 25 bp, Rattus norvegicus
agaagacagttggagccttccctca

SEQ ID NO: 104561 - DNA, 25 bp, Rattus norvegicus
agaagacatatcaatgcccctctca

SEQ ID NO: 104562 - DNA, 25 bp, Rattus norvegicus
agaagacatatctatgcccctctca

SEQ ID NO: 104563 - DNA, 25 bp, Rattus norvegicus
agaagacatcaacaaattcactctg

SEQ ID NO: 104564 - DNA, 25 bp, Rattus norvegicus
agaagacatcaagaaattcactctg

SEQ ID NO: 104565 - DNA, 25 bp, Rattus norvegicus
agaagacatcagctttctccctcca

SEQ ID NO: 104566 - DNA, 25 bp, Rattus norvegicus
agaagacatcaggtttctccctcca

SEQ ID NO: 104567 - DNA, 25 bp, Rattus norvegicus
agaagacatcttcggccagaggcat

SEQ ID NO: 104568 - DNA, 25 bp, Rattus norvegicus
agaagacatcttgggccagaggcat

SEQ ID NO: 104569 - DNA, 25 bp, Rattus norvegicus
agaagacatttcacttttccccttg

SEQ ID NO: 104570 - DNA, 25 bp, Rattus norvegicus
agaagacatttccatcaactctcct

SEQ ID NO: 104571 - DNA, 25 bp, Rattus norvegicus
agaagacatttcgatcaactctcct

SEQ ID NO: 104572 - DNA, 25 bp, Rattus norvegicus
agaagacatttctcttttccccttg

SEQ ID NO: 104573 - DNA, 25 bp, Rattus norvegicus
agaagaccaagaccggcctcacagg

SEQ ID NO: 104574 - DNA, 25 bp, Rattus norvegicus
agaagaccaagagcggcctcacagg

SEQ ID NO: 104575 - DNA, 25 bp, Rattus norvegicus
agaagaccaatgagctgttaatgag

SEQ ID NO: 104576 - DNA, 25 bp, Rattus norvegicus
agaagaccaatgtgctgttaatgag

SEQ ID NO: 104577 - DNA, 25 bp, Rattus norvegicus
agaagaccaggcaattctgactgag

SEQ ID NO: 104578 - DNA, 25 bp, Rattus norvegicus
agaagaccaggctattctgactgag

SEQ ID NO: 104579 - DNA, 25 bp, Rattus norvegicus
agaagacccagtaaggagctagctt

SEQ ID NO: 104580 - DNA, 25 bp, Rattus norvegicus
agaagacccagttaggagctagctt

SEQ ID NO: 104581 - DNA, 25 bp, Rattus norvegicus
agaagaccccttcaccatttctgaa

SEQ ID NO: 104582 - DNA, 25 bp, Rattus norvegicus
agaagaccccttgaccatttctgaa

SEQ ID NO: 104583 - DNA, 25 bp, Rattus norvegicus
agaagaccctaactgtggacccatg

SEQ ID NO: 104584 - DNA, 25 bp, Rattus norvegicus
agaagaccctaagtgtggacccatg

SEQ ID NO: 104585 - DNA, 25 bp, Rattus norvegicus
agaagaccctgcactgattttacat

SEQ ID NO: 104586 - DNA, 25 bp, Rattus norvegicus
agaagaccctgctctgattttacat

SEQ ID NO: 104587 - DNA, 25 bp, Rattus norvegicus
agaagacccttgaaaactccctgtg

SEQ ID NO: 104588 - DNA, 25 bp, Rattus norvegicus
agaagacccttgaactggactgcca

SEQ ID NO: 104589 - DNA, 25 bp, Rattus norvegicus
agaagacccttgtaaactccctgtg

SEQ ID NO: 104590 - DNA, 25 bp, Rattus norvegicus
agaagacccttgtactggactgcca

SEQ ID NO: 104591 - DNA, 25 bp, Rattus norvegicus
agaagaccgtatctgaacccctaga

SEQ ID NO: 104592 - DNA, 25 bp, Rattus norvegicus
agaagaccgtatgtgaacccctaga

SEQ ID NO: 104593 - DNA, 25 bp, Rattus norvegicus
agaagacctactccttcgatgcttt

SEQ ID NO: 104594 - DNA, 25 bp, Rattus norvegicus
agaagacctactgcttcgatgcttt

SEQ ID NO: 104595 - DNA, 25 bp, Rattus norvegicus
agaagacctcccagtgaagatcatg

SEQ ID NO: 104596 - DNA, 25 bp, Rattus norvegicus
agaagacctccctgtgaagatcatg

SEQ ID NO: 104597 - DNA, 25 bp, Rattus norvegicus
agaagacctctcactttacacagac

SEQ ID NO: 104598 - DNA, 25 bp, Rattus norvegicus
agaagacctctctctttacacagac

SEQ ID NO: 104599 - DNA, 25 bp, Rattus norvegicus
agaagacctgtcattcgttggcaca

SEQ ID NO: 104600 - DNA, 25 bp, Rattus norvegicus
agaagacctgtctttcgttggcaca

SEQ ID NO: 104601 - DNA, 25 bp, Rattus norvegicus
agaagaccttatccaatttccgaag

SEQ ID NO: 104602 - DNA, 25 bp, Rattus norvegicus
agaagaccttatgcaatttccgaag

SEQ ID NO: 104603 - DNA, 25 bp, Rattus norvegicus
agaagacctttactcggagctccca

SEQ ID NO: 104604 - DNA, 25 bp, Rattus norvegicus
agaagacctttagtcggagctccca

SEQ ID NO: 104605 - DNA, 25 bp, Rattus norvegicus
agaagacgaagcagcccactcaagg

SEQ ID NO: 104606 - DNA, 25 bp, Rattus norvegicus
agaagacgaagctgcccactcaagg

SEQ ID NO: 104607 - DNA, 25 bp, Rattus norvegicus
agaagacgacctactgtgttccggt

SEQ ID NO: 104608 - DNA, 25 bp, Rattus norvegicus
agaagacgaccttctgtgttccggt

SEQ ID NO: 104609 - DNA, 25 bp, Rattus norvegicus
agaagacgatctatagcctgttcca

SEQ ID NO: 104610 - DNA, 25 bp, Rattus norvegicus
agaagacgatctttagcctgttcca

SEQ ID NO: 104611 - DNA, 25 bp, Rattus norvegicus
agaagacgcaaaaccagatctcctt

SEQ ID NO: 104612 - DNA, 25 bp, Rattus norvegicus
agaagacgcaaatccagatctcctt

SEQ ID NO: 104613 - DNA, 25 bp, Rattus norvegicus
agaagacgcaggatccggacactgt

SEQ ID NO: 104614 - DNA, 25 bp, Rattus norvegicus
agaagacgcaggttccggacactgt

SEQ ID NO: 104615 - DNA, 25 bp, Rattus norvegicus
agaagacgcagtcatgcccagtgtg

SEQ ID NO: 104616 - DNA, 25 bp, Rattus norvegicus
agaagacgcagtgatgcccagtgtg

SEQ ID NO: 104617 - DNA, 25 bp, Rattus norvegicus
agaagacgccatagagtaaccacct

SEQ ID NO: 104618 - DNA, 25 bp, Rattus norvegicus
agaagacgccatagcagtgctcagt

SEQ ID NO: 104619 - DNA, 25 bp, Rattus norvegicus
agaagacgccattgagtaaccacct

SEQ ID NO: 104620 - DNA, 25 bp, Rattus norvegicus
agaagacgccattgcagtgctcagt

SEQ ID NO: 104621 - DNA, 25 bp, Rattus norvegicus
agaagacggctcatggcaggtgcac

SEQ ID NO: 104622 - DNA, 25 bp, Rattus norvegicus
agaagacggctcttggcaggtgcac

SEQ ID NO: 104623 - DNA, 25 bp, Rattus norvegicus
agaagacggttcaggtcgaccgcag

SEQ ID NO: 104624 - DNA, 25 bp, Rattus norvegicus
agaagacggttctggtcgaccgcag

SEQ ID NO: 104625 - DNA, 25 bp, Rattus norvegicus
agaagacgtgggagcccacctccct

SEQ ID NO: 104626 - DNA, 25 bp, Rattus norvegicus
agaagacgtgggtgcccacctccct

SEQ ID NO: 104627 - DNA, 25 bp, Rattus norvegicus
agaagacgtgttcctgccgtctcta

SEQ ID NO: 104628 - DNA, 25 bp, Rattus norvegicus
agaagacgtgttccttccccttgca

SEQ ID NO: 104629 - DNA, 25 bp, Rattus norvegicus
agaagacgtgttgctgccgtctcta

SEQ ID NO: 104630 - DNA, 25 bp, Rattus norvegicus
agaagacgtgttgcttccccttgca

SEQ ID NO: 104631 - DNA, 25 bp, Rattus norvegicus
agaagactaattcccagctgctggg

SEQ ID NO: 104632 - DNA, 25 bp, Rattus norvegicus
agaagactaattgccagctgctggg

SEQ ID NO: 104633 - DNA, 25 bp, Rattus norvegicus
agaagactacagacacaccaggcgt

SEQ ID NO: 104634 - DNA, 25 bp, Rattus norvegicus
agaagactacagtcacaccaggcgt

SEQ ID NO: 104635 - DNA, 25 bp, Rattus norvegicus
agaagactacatctgtgtgcgctgt

SEQ ID NO: 104636 - DNA, 25 bp, Rattus norvegicus
agaagactacatgtgtgtgcgctgt

SEQ ID NO: 104637 - DNA, 25 bp, Rattus norvegicus
agaagactcaggcactccgaggaga

SEQ ID NO: 104638 - DNA, 25 bp, Rattus norvegicus
agaagactcagggactccgaggaga

SEQ ID NO: 104639 - DNA, 25 bp, Rattus norvegicus
agaagactcatcacggccaggctga

SEQ ID NO: 104640 - DNA, 25 bp, Rattus norvegicus
agaagactcatctcggccaggctga

SEQ ID NO: 104641 - DNA, 25 bp, Rattus norvegicus
agaagactcatgagtttggcctgct

SEQ ID NO: 104642 - DNA, 25 bp, Rattus norvegicus
agaagactcatgtgtttggcctgct

SEQ ID NO: 104643 - DNA, 25 bp, Rattus norvegicus
agaagactccctcttggacttgggt

SEQ ID NO: 104644 - DNA, 25 bp, Rattus norvegicus
agaagactccctgttggacttgggt

SEQ ID NO: 104645 - DNA, 25 bp, Rattus norvegicus
agaagactccgtcaggacgtcctgg

SEQ ID NO: 104646 - DNA, 25 bp, Rattus norvegicus
agaagactccgtgaggacgtcctgg

SEQ ID NO: 104647 - DNA, 25 bp, Rattus norvegicus
agaagactcctaagacagttttggg

SEQ ID NO: 104648 - DNA, 25 bp, Rattus norvegicus
agaagactcctatgacagttttggg

SEQ ID NO: 104649 - DNA, 25 bp, Rattus norvegicus
agaagactccttaccacatgtctct

SEQ ID NO: 104650 - DNA, 25 bp, Rattus norvegicus
agaagactcctttccacatgtctct

SEQ ID NO: 104651 - DNA, 25 bp, Rattus norvegicus
agaagactcgctatgccattcttga

SEQ ID NO: 104652 - DNA, 25 bp, Rattus norvegicus
agaagactcgctttgccattcttga

SEQ ID NO: 104653 - DNA, 25 bp, Rattus norvegicus
agaagactctgtatggacggcccaa

SEQ ID NO: 104654 - DNA, 25 bp, Rattus norvegicus
agaagactctgtttggacggcccaa

SEQ ID NO: 104655 - DNA, 25 bp, Rattus norvegicus
agaagactcttccagcattagaccc

SEQ ID NO: 104656 - DNA, 25 bp, Rattus norvegicus
agaagactcttcgagcattagaccc

SEQ ID NO: 104657 - DNA, 25 bp, Rattus norvegicus
agaagactgcgaattcctgctcatg

SEQ ID NO: 104658 - DNA, 25 bp, Rattus norvegicus
agaagactgcgatttcctgctcatg

SEQ ID NO: 104659 - DNA, 25 bp, Rattus norvegicus
agaagactgcgcaagcacaccggag

SEQ ID NO: 104660 - DNA, 25 bp, Rattus norvegicus
agaagactgcgctagcacaccggag

SEQ ID NO: 104661 - DNA, 25 bp, Rattus norvegicus
agaagactggtgatctgtttccctt

SEQ ID NO: 104662 - DNA, 25 bp, Rattus norvegicus
agaagactggtgttctgtttccctt

SEQ ID NO: 104663 - DNA, 25 bp, Rattus norvegicus
agaagactggttcctcggcttcact

SEQ ID NO: 104664 - DNA, 25 bp, Rattus norvegicus
agaagactggttgctcggcttcact

SEQ ID NO: 104665 - DNA, 25 bp, Rattus norvegicus
agaagactgtctaaggatgcctgga

SEQ ID NO: 104666 - DNA, 25 bp, Rattus norvegicus
agaagactgtcttaggatgcctgga

SEQ ID NO: 104667 - DNA, 25 bp, Rattus norvegicus
agaagactgtggatggcccctctgg

SEQ ID NO: 104668 - DNA, 25 bp, Rattus norvegicus
agaagactgtggttggcccctctgg

SEQ ID NO: 104669 - DNA, 25 bp, Rattus norvegicus
agaagacttacaccggattctgcag

SEQ ID NO: 104670 - DNA, 25 bp, Rattus norvegicus
agaagacttacagcggattctgcag

SEQ ID NO: 104671 - DNA, 25 bp, Rattus norvegicus
agaagacttcagactgtgttcagtc

SEQ ID NO: 104672 - DNA, 25 bp, Rattus norvegicus
agaagacttcagtctgtgttcagtc

SEQ ID NO: 104673 - DNA, 25 bp, Rattus norvegicus
agaagacttcccagtgcaacagcag

SEQ ID NO: 104674 - DNA, 25 bp, Rattus norvegicus
agaagacttccctgtgcaacagcag

SEQ ID NO: 104675 - DNA, 25 bp, Rattus norvegicus
agaagacttctcagcagttctcatg

SEQ ID NO: 104676 - DNA, 25 bp, Rattus norvegicus
agaagacttctctgcagttctcatg

SEQ ID NO: 104677 - DNA, 25 bp, Rattus norvegicus
agaagacttgtcagcgctgcgtgac

SEQ ID NO: 104678 - DNA, 25 bp, Rattus norvegicus
agaagacttgtctgcgctgcgtgac

SEQ ID NO: 104679 - DNA, 25 bp, Rattus norvegicus
agaagacttgtgatcccttgtacca

SEQ ID NO: 104680 - DNA, 25 bp, Rattus norvegicus
agaagacttgtgttcccttgtacca

SEQ ID NO: 104681 - DNA, 25 bp, Rattus norvegicus
agaagactttcaaccggcagaacgc

SEQ ID NO: 104682 - DNA, 25 bp, Rattus norvegicus
agaagactttcatccggcagaacgc

SEQ ID NO: 104683 - DNA, 25 bp, Rattus norvegicus
agaagactttgtatcgaccatcgtt

SEQ ID NO: 104684 - DNA, 25 bp, Rattus norvegicus
agaagactttgtttcgaccatcgtt

SEQ ID NO: 104685 - DNA, 25 bp, Rattus norvegicus
agaagagaaaatcgccctggctttg

SEQ ID NO: 104686 - DNA, 25 bp, Rattus norvegicus
agaagagaaaatggccctggctttg

SEQ ID NO: 104687 - DNA, 25 bp, Rattus norvegicus
agaagagaaaccaagcaccgaccat

SEQ ID NO: 104688 - DNA, 25 bp, Rattus norvegicus
agaagagaaacctagcaccgaccat

SEQ ID NO: 104689 - DNA, 25 bp, Rattus norvegicus
agaagagaacgtcctcagctcaggt

SEQ ID NO: 104690 - DNA, 25 bp, Rattus norvegicus
agaagagaacgtgctcagctcaggt

SEQ ID NO: 104691 - DNA, 25 bp, Rattus norvegicus
agaagagaagctcccggttaccttg

SEQ ID NO: 104692 - DNA, 25 bp, Rattus norvegicus
agaagagaagctgccggttaccttg

SEQ ID NO: 104693 - DNA, 25 bp, Rattus norvegicus
agaagagaatcaactgccctgtggc

SEQ ID NO: 104694 - DNA, 25 bp, Rattus norvegicus
agaagagaatcatctgccctgtggc

SEQ ID NO: 104695 - DNA, 25 bp, Rattus norvegicus
agaagagaatgtccgctgaatgtgc

SEQ ID NO: 104696 - DNA, 25 bp, Rattus norvegicus
agaagagaatgtctcacccctcact

SEQ ID NO: 104697 - DNA, 25 bp, Rattus norvegicus
agaagagaatgtgcgctgaatgtgc

SEQ ID NO: 104698 - DNA, 25 bp, Rattus norvegicus
agaagagaatgtgtcacccctcact

SEQ ID NO: 104699 - DNA, 25 bp, Rattus norvegicus
agaagagacaggatgcatccccgca

SEQ ID NO: 104700 - DNA, 25 bp, Rattus norvegicus
agaagagacaggttgcatccccgca

SEQ ID NO: 104701 - DNA, 25 bp, Rattus norvegicus
agaagagacattccccgtggtatgc

SEQ ID NO: 104702 - DNA, 25 bp, Rattus norvegicus
agaagagacattgcccgtggtatgc

SEQ ID NO: 104703 - DNA, 25 bp, Rattus norvegicus
agaagagaccacctcatcatcctga

SEQ ID NO: 104704 - DNA, 25 bp, Rattus norvegicus
agaagagaccacgtcatcatcctga

SEQ ID NO: 104705 - DNA, 25 bp, Rattus norvegicus
agaagagaccgccattagccccagg

SEQ ID NO: 104706 - DNA, 25 bp, Rattus norvegicus
agaagagaccgcgattagccccagg

SEQ ID NO: 104707 - DNA, 25 bp, Rattus norvegicus
agaagagacgcaatcactcctcagg

SEQ ID NO: 104708 - DNA, 25 bp, Rattus norvegicus
agaagagacgcattcactcctcagg

SEQ ID NO: 104709 - DNA, 25 bp, Rattus norvegicus
agaagagactgaagacgccgcgaaa

SEQ ID NO: 104710 - DNA, 25 bp, Rattus norvegicus
agaagagactgatgacgccgcgaaa

SEQ ID NO: 104711 - DNA, 25 bp, Rattus norvegicus
agaagagagaatcccagtcctcctg

SEQ ID NO: 104712 - DNA, 25 bp, Rattus norvegicus
agaagagagaatgccagtcctcctg

SEQ ID NO: 104713 - DNA, 25 bp, Rattus norvegicus
agaagagagcaccacatcccctgga

SEQ ID NO: 104714 - DNA, 25 bp, Rattus norvegicus
agaagagagcacgacatcccctgga

SEQ ID NO: 104715 - DNA, 25 bp, Rattus norvegicus
agaagagagccaagtgttcacaccc

SEQ ID NO: 104716 - DNA, 25 bp, Rattus norvegicus
agaagagagccacgcccatagttgt

SEQ ID NO: 104717 - DNA, 25 bp, Rattus norvegicus
agaagagagccaggcccatagttgt

SEQ ID NO: 104718 - DNA, 25 bp, Rattus norvegicus
agaagagagccatgtgttcacaccc

SEQ ID NO: 104719 - DNA, 25 bp, Rattus norvegicus
agaagagagcccatgcctcctttaa

SEQ ID NO: 104720 - DNA, 25 bp, Rattus norvegicus
agaagagagcccttgcctcctttaa

SEQ ID NO: 104721 - DNA, 25 bp, Rattus norvegicus
agaagagagcctagggtcccctgga

SEQ ID NO: 104722 - DNA, 25 bp, Rattus norvegicus
agaagagagccttgggtcccctgga

SEQ ID NO: 104723 - DNA, 25 bp, Rattus norvegicus
agaagagagctgaccgtgccaggcc

SEQ ID NO: 104724 - DNA, 25 bp, Rattus norvegicus
agaagagagctgtccgtgccaggcc

SEQ ID NO: 104725 - DNA, 25 bp, Rattus norvegicus
agaagagatgtcaggcctttccctc

SEQ ID NO: 104726 - DNA, 25 bp, Rattus norvegicus
agaagagatgtctggcctttccctc

SEQ ID NO: 104727 - DNA, 25 bp, Rattus norvegicus
agaagagatttcagtccctggcacc

SEQ ID NO: 104728 - DNA, 25 bp, Rattus norvegicus
agaagagatttctgtccctggcacc

SEQ ID NO: 104729 - DNA, 25 bp, Rattus norvegicus
agaagagcaactcatccacctttgt

SEQ ID NO: 104730 - DNA, 25 bp, Rattus norvegicus
agaagagcaactccctggacaaggt

SEQ ID NO: 104731 - DNA, 25 bp, Rattus norvegicus
agaagagcaactgatccacctttgt

SEQ ID NO: 104732 - DNA, 25 bp, Rattus norvegicus
agaagagcaactgcctggacaaggt

SEQ ID NO: 104733 - DNA, 25 bp, Rattus norvegicus
agaagagcacaaaccaaggccattg

SEQ ID NO: 104734 - DNA, 25 bp, Rattus norvegicus
agaagagcacaatccaaggccattg

SEQ ID NO: 104735 - DNA, 25 bp, Rattus norvegicus
agaagagcacacagtctgacttgta

SEQ ID NO: 104736 - DNA, 25 bp, Rattus norvegicus
agaagagcacactgtctgacttgta

SEQ ID NO: 104737 - DNA, 25 bp, Rattus norvegicus
agaagagcacccaggctaacctggt

SEQ ID NO: 104738 - DNA, 25 bp, Rattus norvegicus
agaagagcaccctggctaacctggt

SEQ ID NO: 104739 - DNA, 25 bp, Rattus norvegicus
agaagagcacctcagtcctggctgg

SEQ ID NO: 104740 - DNA, 25 bp, Rattus norvegicus
agaagagcacctgagtcctggctgg

SEQ ID NO: 104741 - DNA, 25 bp, Rattus norvegicus
agaagagcacggatcttggcctcac

SEQ ID NO: 104742 - DNA, 25 bp, Rattus norvegicus
agaagagcacggttcttggcctcac

SEQ ID NO: 104743 - DNA, 25 bp, Rattus norvegicus
agaagagcagcactgcactcccggg

SEQ ID NO: 104744 - DNA, 25 bp, Rattus norvegicus
agaagagcagcagtgcactcccggg

SEQ ID NO: 104745 - DNA, 25 bp, Rattus norvegicus
agaagagcagttccatgaggcccac

SEQ ID NO: 104746 - DNA, 25 bp, Rattus norvegicus
agaagagcagttgcatgaggcccac

SEQ ID NO: 104747 - DNA, 25 bp, Rattus norvegicus
agaagagcatcaacatccacacgtc

SEQ ID NO: 104748 - DNA, 25 bp, Rattus norvegicus
agaagagcatcatcatccacacgtc

SEQ ID NO: 104749 - DNA, 25 bp, Rattus norvegicus
agaagagcatccataccacctgtca

SEQ ID NO: 104750 - DNA, 25 bp, Rattus norvegicus
agaagagcatccttaccacctgtca

SEQ ID NO: 104751 - DNA, 25 bp, Rattus norvegicus
agaagagcatgcagccgtctgtgtt

SEQ ID NO: 104752 - DNA, 25 bp, Rattus norvegicus
agaagagcatgctgccgtctgtgtt

SEQ ID NO: 104753 - DNA, 25 bp, Rattus norvegicus
agaagagccaagatcttactcaggc

SEQ ID NO: 104754 - DNA, 25 bp, Rattus norvegicus
agaagagccaagttcttactcaggc

SEQ ID NO: 104755 - DNA, 25 bp, Rattus norvegicus
agaagagccaccaactttctctgga

SEQ ID NO: 104756 - DNA, 25 bp, Rattus norvegicus
agaagagccacctactttctctgga

SEQ ID NO: 104757 - DNA, 25 bp, Rattus norvegicus
agaagagccaggatcgctgtccaga

SEQ ID NO: 104758 - DNA, 25 bp, Rattus norvegicus
agaagagccaggttcgctgtccaga

SEQ ID NO: 104759 - DNA, 25 bp, Rattus norvegicus
agaagagcccagacctaattctcca

SEQ ID NO: 104760 - DNA, 25 bp, Rattus norvegicus
agaagagcccagtcctaattctcca

SEQ ID NO: 104761 - DNA, 25 bp, Rattus norvegicus
agaagagcctacatcctgttcaagt

SEQ ID NO: 104762 - DNA, 25 bp, Rattus norvegicus
agaagagcctacttcctgttcaagt

SEQ ID NO: 104763 - DNA, 25 bp, Rattus norvegicus
agaagagcctctaactgacagtgtg

SEQ ID NO: 104764 - DNA, 25 bp, Rattus norvegicus
agaagagcctcttactgacagtgtg

SEQ ID NO: 104765 - DNA, 25 bp, Rattus norvegicus
agaagagcgcctactctgtgttcaa

SEQ ID NO: 104766 - DNA, 25 bp, Rattus norvegicus
agaagagcgccttctctgtgttcaa

SEQ ID NO: 104767 - DNA, 25 bp, Rattus norvegicus
agaagagctacaccggagcccagta

SEQ ID NO: 104768 - DNA, 25 bp, Rattus norvegicus
agaagagctacagcggagcccagta

SEQ ID NO: 104769 - DNA, 25 bp, Rattus norvegicus
agaagagctacgagtatggccccat

SEQ ID NO: 104770 - DNA, 25 bp, Rattus norvegicus
agaagagctacgtgtatggccccat

SEQ ID NO: 104771 - DNA, 25 bp, Rattus norvegicus
agaagagctcataggccaagcccct

SEQ ID NO: 104772 - DNA, 25 bp, Rattus norvegicus
agaagagctcattggccaagcccct

SEQ ID NO: 104773 - DNA, 25 bp, Rattus norvegicus
agaagagctcccagtgtaaatgaaa

SEQ ID NO: 104774 - DNA, 25 bp, Rattus norvegicus
agaagagctccctgtgtaaatgaaa

SEQ ID NO: 104775 - DNA, 25 bp, Rattus norvegicus
agaagagctctcacctatattcctg

SEQ ID NO: 104776 - DNA, 25 bp, Rattus norvegicus
agaagagctctctcctatattcctg

SEQ ID NO: 104777 - DNA, 25 bp, Rattus norvegicus
agaagagctggaccatggaatccca

SEQ ID NO: 104778 - DNA, 25 bp, Rattus norvegicus
agaagagctggagcatggaatccca

SEQ ID NO: 104779 - DNA, 25 bp, Rattus norvegicus
agaagagcttacaggtgcgcacatc

SEQ ID NO: 104780 - DNA, 25 bp, Rattus norvegicus
agaagagcttactggtgcgcacatc

SEQ ID NO: 104781 - DNA, 25 bp, Rattus norvegicus
agaagagcttggatctcgaccccag

SEQ ID NO: 104782 - DNA, 25 bp, Rattus norvegicus
agaagagcttggttctcgaccccag

SEQ ID NO: 104783 - DNA, 25 bp, Rattus norvegicus
agaagagcttttacttgggtgcccg

SEQ ID NO: 104784 - DNA, 25 bp, Rattus norvegicus
agaagagctttttcttgggtgcccg

SEQ ID NO: 104785 - DNA, 25 bp, Rattus norvegicus
agaagaggaataagccctgccccgt

SEQ ID NO: 104786 - DNA, 25 bp, Rattus norvegicus
agaagaggaatatgccctgccccgt

SEQ ID NO: 104787 - DNA, 25 bp, Rattus norvegicus
agaagaggatttcacactccccacc

SEQ ID NO: 104788 - DNA, 25 bp, Rattus norvegicus
agaagaggatttgacactccccacc

SEQ ID NO: 104789 - DNA, 25 bp, Rattus norvegicus
agaagaggcccacacccattggcag

SEQ ID NO: 104790 - DNA, 25 bp, Rattus norvegicus
agaagaggcccagacccattggcag

SEQ ID NO: 104791 - DNA, 25 bp, Rattus norvegicus
agaagaggccctacaagtcggcatc

SEQ ID NO: 104792 - DNA, 25 bp, Rattus norvegicus
agaagaggcccttcaagtcggcatc

SEQ ID NO: 104793 - DNA, 25 bp, Rattus norvegicus
agaagaggcttcatattctcccttc

SEQ ID NO: 104794 - DNA, 25 bp, Rattus norvegicus
agaagaggcttcttattctcccttc

SEQ ID NO: 104795 - DNA, 25 bp, Rattus norvegicus
agaagagggccgactgtaatttcca

SEQ ID NO: 104796 - DNA, 25 bp, Rattus norvegicus
agaagagggccgtctgtaatttcca

SEQ ID NO: 104797 - DNA, 25 bp, Rattus norvegicus
agaagagggtctctagctctcgtct

SEQ ID NO: 104798 - DNA, 25 bp, Rattus norvegicus
agaagagggtctgtagctctcgtct

SEQ ID NO: 104799 - DNA, 25 bp, Rattus norvegicus
agaagaggtcaaacccagctgctgc

SEQ ID NO: 104800 - DNA, 25 bp, Rattus norvegicus
agaagaggtcaatcccagctgctgc

SEQ ID NO: 104801 - DNA, 25 bp, Rattus norvegicus
agaagaggtctcacactgggacttg

SEQ ID NO: 104802 - DNA, 25 bp, Rattus norvegicus
agaagaggtctctcactgggacttg

SEQ ID NO: 104803 - DNA, 25 bp, Rattus norvegicus
agaagaggtctgcttttctgtcgca

SEQ ID NO: 104804 - DNA, 25 bp, Rattus norvegicus
agaagaggtctggttttctgtcgca

SEQ ID NO: 104805 - DNA, 25 bp, Rattus norvegicus
agaagaggttgtaggctctccttga

SEQ ID NO: 104806 - DNA, 25 bp, Rattus norvegicus
agaagaggttgttggctctccttga

SEQ ID NO: 104807 - DNA, 25 bp, Rattus norvegicus
agaagagtacccacatctattctcc

SEQ ID NO: 104808 - DNA, 25 bp, Rattus norvegicus
agaagagtaccctcatctattctcc

SEQ ID NO: 104809 - DNA, 25 bp, Rattus norvegicus
agaagagtacctcagcacacagctt

SEQ ID NO: 104810 - DNA, 25 bp, Rattus norvegicus
agaagagtacctgagcacacagctt

SEQ ID NO: 104811 - DNA, 25 bp, Rattus norvegicus
agaagagtccgccactccagtgtat

SEQ ID NO: 104812 - DNA, 25 bp, Rattus norvegicus
agaagagtccgcgactccagtgtat

SEQ ID NO: 104813 - DNA, 25 bp, Rattus norvegicus
agaagagtcgctcgctctgcagaaa

SEQ ID NO: 104814 - DNA, 25 bp, Rattus norvegicus
agaagagtcgctggctctgcagaaa

SEQ ID NO: 104815 - DNA, 25 bp, Rattus norvegicus
agaagagtcggtccacgtagctgaa

SEQ ID NO: 104816 - DNA, 25 bp, Rattus norvegicus
agaagagtcggtgcacgtagctgaa

SEQ ID NO: 104817 - DNA, 25 bp, Rattus norvegicus
agaagagtctatcgctcatcactac

SEQ ID NO: 104818 - DNA, 25 bp, Rattus norvegicus
agaagagtctatggctcatcactac

SEQ ID NO: 104819 - DNA, 25 bp, Rattus norvegicus
agaagagtgactcctgaaggcccac

SEQ ID NO: 104820 - DNA, 25 bp, Rattus norvegicus
agaagagtgactgctgaaggcccac

SEQ ID NO: 104821 - DNA, 25 bp, Rattus norvegicus
agaagagtgttcatgcctgggccac

SEQ ID NO: 104822 - DNA, 25 bp, Rattus norvegicus
agaagagtgttcttgcctgggccac

SEQ ID NO: 104823 - DNA, 25 bp, Rattus norvegicus
agaagagttacactgcctttgccat

SEQ ID NO: 104824 - DNA, 25 bp, Rattus norvegicus
agaagagttacagtgcctttgccat

SEQ ID NO: 104825 - DNA, 25 bp, Rattus norvegicus
agaagagttgccacctcttgaatct

SEQ ID NO: 104826 - DNA, 25 bp, Rattus norvegicus
agaagagttgcctcctcttgaatct

SEQ ID NO: 104827 - DNA, 25 bp, Rattus norvegicus
agaagagttgctctcccacattgct

SEQ ID NO: 104828 - DNA, 25 bp, Rattus norvegicus
agaagagttgctgtcccacattgct

SEQ ID NO: 104829 - DNA, 25 bp, Rattus norvegicus
agaagatacctcagctctgtgtgac

SEQ ID NO: 104830 - DNA, 25 bp, Rattus norvegicus
agaagatacctctgctctgtgtgac

SEQ ID NO: 104831 - DNA, 25 bp, Rattus norvegicus
agaagatagagcctcatcgccttga

SEQ ID NO: 104832 - DNA, 25 bp, Rattus norvegicus
agaagatagagcgtcatcgccttga

SEQ ID NO: 104833 - DNA, 25 bp, Rattus norvegicus
agaagatagaggaggtcctctctgg

SEQ ID NO: 104834 - DNA, 25 bp, Rattus norvegicus
agaagatagaggtggtcctctctgg

SEQ ID NO: 104835 - DNA, 25 bp, Rattus norvegicus
agaagataggctacttcctcaggcc

SEQ ID NO: 104836 - DNA, 25 bp, Rattus norvegicus
agaagataggcttcttcctcaggcc

SEQ ID NO: 104837 - DNA, 25 bp, Rattus norvegicus
agaagatatttgaccatgcctcccc

SEQ ID NO: 104838 - DNA, 25 bp, Rattus norvegicus
agaagatatttgtccatgcctcccc

SEQ ID NO: 104839 - DNA, 25 bp, Rattus norvegicus
agaagatcaagcagtccagtcccaa

SEQ ID NO: 104840 - DNA, 25 bp, Rattus norvegicus
agaagatcaagctgtccagtcccaa

SEQ ID NO: 104841 - DNA, 25 bp, Rattus norvegicus
agaagatcacagcaggccgcagcat

SEQ ID NO: 104842 - DNA, 25 bp, Rattus norvegicus
agaagatcacaggaggccgcagcat

SEQ ID NO: 104843 - DNA, 25 bp, Rattus norvegicus
agaagatcacccagaacggcatcta

SEQ ID NO: 104844 - DNA, 25 bp, Rattus norvegicus
agaagatcaccctgaacggcatcta

SEQ ID NO: 104845 - DNA, 25 bp, Rattus norvegicus
agaagatcactgagcccacggaggt

SEQ ID NO: 104846 - DNA, 25 bp, Rattus norvegicus
agaagatcactgtgcccacggaggt

SEQ ID NO: 104847 - DNA, 25 bp, Rattus norvegicus
agaagatcagacaggactgtcccct

SEQ ID NO: 104848 - DNA, 25 bp, Rattus norvegicus
agaagatcagactggactgtcccct

SEQ ID NO: 104849 - DNA, 25 bp, Rattus norvegicus
agaagatcagcacgaaccccacctt

SEQ ID NO: 104850 - DNA, 25 bp, Rattus norvegicus
agaagatcagcaggaaccccacctt

SEQ ID NO: 104851 - DNA, 25 bp, Rattus norvegicus
agaagatcatcaattccttgaggat

SEQ ID NO: 104852 - DNA, 25 bp, Rattus norvegicus
agaagatcatcatttccttgaggat

SEQ ID NO: 104853 - DNA, 25 bp, Rattus norvegicus
agaagatcatgcaggccatcatcac

SEQ ID NO: 104854 - DNA, 25 bp, Rattus norvegicus
agaagatcatgctggccatcatcac

SEQ ID NO: 104855 - DNA, 25 bp, Rattus norvegicus
agaagatccaggaaggtcaccatgg

SEQ ID NO: 104856 - DNA, 25 bp, Rattus norvegicus
agaagatccaggtaggtcaccatgg

SEQ ID NO: 104857 - DNA, 25 bp, Rattus norvegicus
agaagatccggaactcggtgcctgc

SEQ ID NO: 104858 - DNA, 25 bp, Rattus norvegicus
agaagatccggatctcggtgcctgc

SEQ ID NO: 104859 - DNA, 25 bp, Rattus norvegicus
agaagatcctgcagtctctccatca

SEQ ID NO: 104860 - DNA, 25 bp, Rattus norvegicus
agaagatcctgctgtctctccatca

SEQ ID NO: 104861 - DNA, 25 bp, Rattus norvegicus
agaagatcctgtcctcgagagctgt

SEQ ID NO: 104862 - DNA, 25 bp, Rattus norvegicus
agaagatcctgtgctcgagagctgt

SEQ ID NO: 104863 - DNA, 25 bp, Rattus norvegicus
agaagatcgagaacgcgttggccct

SEQ ID NO: 104864 - DNA, 25 bp, Rattus norvegicus
agaagatcgagatcgcgttggccct

SEQ ID NO: 104865 - DNA, 25 bp, Rattus norvegicus
agaagatcggagacgcctcttcaga

SEQ ID NO: 104866 - DNA, 25 bp, Rattus norvegicus
agaagatcggagtcgcctcttcaga

SEQ ID NO: 104867 - DNA, 25 bp, Rattus norvegicus
agaagatcggccaattccagctgat

SEQ ID NO: 104868 - DNA, 25 bp, Rattus norvegicus
agaagatcggcctattccagctgat

SEQ ID NO: 104869 - DNA, 25 bp, Rattus norvegicus
agaagatcggctcgactgtctgcta

SEQ ID NO: 104870 - DNA, 25 bp, Rattus norvegicus
agaagatcggctggactgtctgcta

SEQ ID NO: 104871 - DNA, 25 bp, Rattus norvegicus
agaagatcgtggctcccatcggtga

SEQ ID NO: 104872 - DNA, 25 bp, Rattus norvegicus
agaagatcgtgggtcccatcggtga

SEQ ID NO: 104873 - DNA, 25 bp, Rattus norvegicus
agaagatctatgacctgcgtggcaa

SEQ ID NO: 104874 - DNA, 25 bp, Rattus norvegicus
agaagatctatgtcctgcgtggcaa

SEQ ID NO: 104875 - DNA, 25 bp, Rattus norvegicus
agaagatctcccaggattccaactg

SEQ ID NO: 104876 - DNA, 25 bp, Rattus norvegicus
agaagatctccctggattccaactg

SEQ ID NO: 104877 - DNA, 25 bp, Rattus norvegicus
agaagatctctgaatctctgagttc

SEQ ID NO: 104878 - DNA, 25 bp, Rattus norvegicus
agaagatctctgtatctctgagttc

SEQ ID NO: 104879 - DNA, 25 bp, Rattus norvegicus
agaagatctcttagcctctctggta

SEQ ID NO: 104880 - DNA, 25 bp, Rattus norvegicus
agaagatctcttcgtattccctcag

SEQ ID NO: 104881 - DNA, 25 bp, Rattus norvegicus
agaagatctcttggtattccctcag

SEQ ID NO: 104882 - DNA, 25 bp, Rattus norvegicus
agaagatctctttgcctctctggta

SEQ ID NO: 104883 - DNA, 25 bp, Rattus norvegicus
agaagatctggaagctctgttatca

SEQ ID NO: 104884 - DNA, 25 bp, Rattus norvegicus
agaagatctggatgctctgttatca

SEQ ID NO: 104885 - DNA, 25 bp, Rattus norvegicus
agaagatctggcctggcatcccaag

SEQ ID NO: 104886 - DNA, 25 bp, Rattus norvegicus
agaagatctggcgtggcatcccaag

SEQ ID NO: 104887 - DNA, 25 bp, Rattus norvegicus
agaagatctgtacagacgtcccatt

SEQ ID NO: 104888 - DNA, 25 bp, Rattus norvegicus
agaagatctgtagagacgtcccatt

SEQ ID NO: 104889 - DNA, 25 bp, Rattus norvegicus
agaagatctgtgaggactctcccct

SEQ ID NO: 104890 - DNA, 25 bp, Rattus norvegicus
agaagatctgtgtggactctcccct

SEQ ID NO: 104891 - DNA, 25 bp, Rattus norvegicus
agaagatctgttcaatggtctgaaa

SEQ ID NO: 104892 - DNA, 25 bp, Rattus norvegicus
agaagatctgttgaatggtctgaaa

SEQ ID NO: 104893 - DNA, 25 bp, Rattus norvegicus
agaagatcttctctgctgtcccggt

SEQ ID NO: 104894 - DNA, 25 bp, Rattus norvegicus
agaagatcttctgtgctgtcccggt

SEQ ID NO: 104895 - DNA, 25 bp, Rattus norvegicus
agaagatgaaggacccagtggcccc

SEQ ID NO: 104896 - DNA, 25 bp, Rattus norvegicus
agaagatgaaggtcccagtggcccc

SEQ ID NO: 104897 - DNA, 25 bp, Rattus norvegicus
agaagatgacatccggtgtcctctc

SEQ ID NO: 104898 - DNA, 25 bp, Rattus norvegicus
agaagatgacatgcggtgtcctctc

SEQ ID NO: 104899 - DNA, 25 bp, Rattus norvegicus
agaagatgactaagccccgggacag

SEQ ID NO: 104900 - DNA, 25 bp, Rattus norvegicus
agaagatgactatgccccgggacag

SEQ ID NO: 104901 - DNA, 25 bp, Rattus norvegicus
agaagatgctctctttcttatcacc

SEQ ID NO: 104902 - DNA, 25 bp, Rattus norvegicus
agaagatgctctgtttcttatcacc

SEQ ID NO: 104903 - DNA, 25 bp, Rattus norvegicus
agaagatgctgtcacacccccagtt

SEQ ID NO: 104904 - DNA, 25 bp, Rattus norvegicus
agaagatgctgtgacacccccagtt

SEQ ID NO: 104905 - DNA, 25 bp, Rattus norvegicus
agaagatgcttgagccaggtggcac

SEQ ID NO: 104906 - DNA, 25 bp, Rattus norvegicus
agaagatgcttgtgccaggtggcac

SEQ ID NO: 104907 - DNA, 25 bp, Rattus norvegicus
agaagatggatcacccatcctcttg

SEQ ID NO: 104908 - DNA, 25 bp, Rattus norvegicus
agaagatggatctcccatcctcttg

SEQ ID NO: 104909 - DNA, 25 bp, Rattus norvegicus
agaagatggctcctcttggaacagt

SEQ ID NO: 104910 - DNA, 25 bp, Rattus norvegicus
agaagatggctcgtcttggaacagt

SEQ ID NO: 104911 - DNA, 25 bp, Rattus norvegicus
agaagatggctgaccctgccaagaa

SEQ ID NO: 104912 - DNA, 25 bp, Rattus norvegicus
agaagatggctgtccctgccaagaa

SEQ ID NO: 104913 - DNA, 25 bp, Rattus norvegicus
agaagatgggagattccttctttgt

SEQ ID NO: 104914 - DNA, 25 bp, Rattus norvegicus
agaagatgggagtttccttctttgt

SEQ ID NO: 104915 - DNA, 25 bp, Rattus norvegicus
agaagatgggcacctgcttgtgctt

SEQ ID NO: 104916 - DNA, 25 bp, Rattus norvegicus
agaagatgggcagctgcttgtgctt

SEQ ID NO: 104917 - DNA, 25 bp, Rattus norvegicus
agaagatgtcaacgccgatcgaggt

SEQ ID NO: 104918 - DNA, 25 bp, Rattus norvegicus
agaagatgtcaaggccgatcgaggt

SEQ ID NO: 104919 - DNA, 25 bp, Rattus norvegicus
agaagatgtcttcacaccctgagcc

SEQ ID NO: 104920 - DNA, 25 bp, Rattus norvegicus
agaagatgtcttcccgggatgccac

SEQ ID NO: 104921 - DNA, 25 bp, Rattus norvegicus
agaagatgtcttgacaccctgagcc

SEQ ID NO: 104922 - DNA, 25 bp, Rattus norvegicus
agaagatgtcttgccgggatgccac

SEQ ID NO: 104923 - DNA, 25 bp, Rattus norvegicus
agaagatgttggcaggtcactcagt

SEQ ID NO: 104924 - DNA, 25 bp, Rattus norvegicus
agaagatgttgggaggtcactcagt

SEQ ID NO: 104925 - DNA, 25 bp, Rattus norvegicus
agaagattcaggcttccacccctga

SEQ ID NO: 104926 - DNA, 25 bp, Rattus norvegicus
agaagattcagggttccacccctga

SEQ ID NO: 104927 - DNA, 25 bp, Rattus norvegicus
agaagattcatgactccttggccct

SEQ ID NO: 104928 - DNA, 25 bp, Rattus norvegicus
agaagattcatgtctccttggccct

SEQ ID NO: 104929 - DNA, 25 bp, Rattus norvegicus
agaagattctggaccttggcgctat

SEQ ID NO: 104930 - DNA, 25 bp, Rattus norvegicus
agaagattctggtccttggcgctat

SEQ ID NO: 104931 - DNA, 25 bp, Rattus norvegicus
agaagattctgtcgtccttgcctca

SEQ ID NO: 104932 - DNA, 25 bp, Rattus norvegicus
agaagattctgtggtccttgcctca

SEQ ID NO: 104933 - DNA, 25 bp, Rattus norvegicus
agaagattcttcaccgtagtcttgg

SEQ ID NO: 104934 - DNA, 25 bp, Rattus norvegicus
agaagattcttctccgtagtcttgg

SEQ ID NO: 104935 - DNA, 25 bp, Rattus norvegicus
agaagattctttcgcagacctacct

SEQ ID NO: 104936 - DNA, 25 bp, Rattus norvegicus
agaagattctttggcagacctacct

SEQ ID NO: 104937 - DNA, 25 bp, Rattus norvegicus
agaagattgaagacacctccagaat

SEQ ID NO: 104938 - DNA, 25 bp, Rattus norvegicus
agaagattgaagtcacctccagaat

SEQ ID NO: 104939 - DNA, 25 bp, Rattus norvegicus
agaagattgtacctgaggctcctgg

SEQ ID NO: 104940 - DNA, 25 bp, Rattus norvegicus
agaagattgtacgtgaggctcctgg

SEQ ID NO: 104941 - DNA, 25 bp, Rattus norvegicus
agaagattgtgtatgctggactgcg

SEQ ID NO: 104942 - DNA, 25 bp, Rattus norvegicus
agaagattgtgtttgctggactgcg

SEQ ID NO: 104943 - DNA, 25 bp, Rattus norvegicus
agaagatttcaaaggagacgtggag

SEQ ID NO: 104944 - DNA, 25 bp, Rattus norvegicus
agaagatttcaatggagacgtggag

SEQ ID NO: 104945 - DNA, 25 bp, Rattus norvegicus
agaagatttccaacacggagcccag

SEQ ID NO: 104946 - DNA, 25 bp, Rattus norvegicus
agaagatttccatcacggagcccag

SEQ ID NO: 104947 - DNA, 25 bp, Rattus norvegicus
agaagcaaaactaactcccccgatg

SEQ ID NO: 104948 - DNA, 25 bp, Rattus norvegicus
agaagcaaaacttactcccccgatg

SEQ ID NO: 104949 - DNA, 25 bp, Rattus norvegicus
agaagcaaacggctctcgctgagct

SEQ ID NO: 104950 - DNA, 25 bp, Rattus norvegicus
agaagcaaacgggtctcgctgagct

SEQ ID NO: 104951 - DNA, 25 bp, Rattus norvegicus
agaagcaaactcacaggtctggcac

SEQ ID NO: 104952 - DNA, 25 bp, Rattus norvegicus
agaagcaaactctcaggtctggcac

SEQ ID NO: 104953 - DNA, 25 bp, Rattus norvegicus
agaagcaaacttcgctgcgtctttt

SEQ ID NO: 104954 - DNA, 25 bp, Rattus norvegicus
agaagcaaacttggctgcgtctttt

SEQ ID NO: 104955 - DNA, 25 bp, Rattus norvegicus
agaagcaaagacattcccctggcat

SEQ ID NO: 104956 - DNA, 25 bp, Rattus norvegicus
agaagcaaagactttcccctggcat

SEQ ID NO: 104957 - DNA, 25 bp, Rattus norvegicus
agaagcaacatcaaggtgccggaaa

SEQ ID NO: 104958 - DNA, 25 bp, Rattus norvegicus
agaagcaacatctaggtgccggaaa

SEQ ID NO: 104959 - DNA, 25 bp, Rattus norvegicus
agaagcaactgtactcctgccttag

SEQ ID NO: 104960 - DNA, 25 bp, Rattus norvegicus
agaagcaactgttctcctgccttag

SEQ ID NO: 104961 - DNA, 25 bp, Rattus norvegicus
agaagcaacttcagcctttgctggt

SEQ ID NO: 104962 - DNA, 25 bp, Rattus norvegicus
agaagcaacttctgcctttgctggt

SEQ ID NO: 104963 - DNA, 25 bp, Rattus norvegicus
agaagcaagactcacggactccgga

SEQ ID NO: 104964 - DNA, 25 bp, Rattus norvegicus
agaagcaagactgacggactccgga

SEQ ID NO: 104965 - DNA, 25 bp, Rattus norvegicus
agaagcaagagcaagccctgtctct

SEQ ID NO: 104966 - DNA, 25 bp, Rattus norvegicus
agaagcaagagctagccctgtctct

SEQ ID NO: 104967 - DNA, 25 bp, Rattus norvegicus
agaagcaagcgtctgcctctgagca

SEQ ID NO: 104968 - DNA, 25 bp, Rattus norvegicus
agaagcaagcgtgtgcctctgagca

SEQ ID NO: 104969 - DNA, 25 bp, Rattus norvegicus
agaagcaagcttcacacctgtgtgc

SEQ ID NO: 104970 - DNA, 25 bp, Rattus norvegicus
agaagcaagcttgacacctgtgtgc

SEQ ID NO: 104971 - DNA, 25 bp, Rattus norvegicus
agaagcaagtgcagtggtccctttc

SEQ ID NO: 104972 - DNA, 25 bp, Rattus norvegicus
agaagcaagtgctgtggtccctttc

SEQ ID NO: 104973 - DNA, 25 bp, Rattus norvegicus
agaagcaatcctaggcgctcccgcc

SEQ ID NO: 104974 - DNA, 25 bp, Rattus norvegicus
agaagcaatccttggcgctcccgcc

SEQ ID NO: 104975 - DNA, 25 bp, Rattus norvegicus
agaagcaatggtactcttcagccct

SEQ ID NO: 104976 - DNA, 25 bp, Rattus norvegicus
agaagcaatggttctcttcagccct

SEQ ID NO: 104977 - DNA, 25 bp, Rattus norvegicus
agaagcaattgcaccccaagttggc

SEQ ID NO: 104978 - DNA, 25 bp, Rattus norvegicus
agaagcaattgctccccaagttggc

SEQ ID NO: 104979 - DNA, 25 bp, Rattus norvegicus
agaagcaatttcaccagcactgggt

SEQ ID NO: 104980 - DNA, 25 bp, Rattus norvegicus
agaagcaatttctccagcactgggt

SEQ ID NO: 104981 - DNA, 25 bp, Rattus norvegicus
agaagcacaaatccagcgccccatt

SEQ ID NO: 104982 - DNA, 25 bp, Rattus norvegicus
agaagcacaaatgcagcgccccatt

SEQ ID NO: 104983 - DNA, 25 bp, Rattus norvegicus
agaagcacaagccacccaaggttcc

SEQ ID NO: 104984 - DNA, 25 bp, Rattus norvegicus
agaagcacaagcgacccaaggttcc

SEQ ID NO: 104985 - DNA, 25 bp, Rattus norvegicus
agaagcacaaggatcaagaggtcaa

SEQ ID NO: 104986 - DNA, 25 bp, Rattus norvegicus
agaagcacaaggttcaagaggtcaa

SEQ ID NO: 104987 - DNA, 25 bp, Rattus norvegicus
agaagcacacttcggtcctctgtga

SEQ ID NO: 104988 - DNA, 25 bp, Rattus norvegicus
agaagcacacttgggtcctctgtga

SEQ ID NO: 104989 - DNA, 25 bp, Rattus norvegicus
agaagcacagcgaaagcctcagtgt

SEQ ID NO: 104990 - DNA, 25 bp, Rattus norvegicus
agaagcacagcgtaagcctcagtgt

SEQ ID NO: 104991 - DNA, 25 bp, Rattus norvegicus
agaagcacagtaccggttcatctac

SEQ ID NO: 104992 - DNA, 25 bp, Rattus norvegicus
agaagcacagtagcggttcatctac

SEQ ID NO: 104993 - DNA, 25 bp, Rattus norvegicus
agaagcaccaccagctggagcacca

SEQ ID NO: 104994 - DNA, 25 bp, Rattus norvegicus
agaagcaccacctgctggagcacca

SEQ ID NO: 104995 - DNA, 25 bp, Rattus norvegicus
agaagcaccgtgactgaaccgttgc

SEQ ID NO: 104996 - DNA, 25 bp, Rattus norvegicus
agaagcaccgtgtctgaaccgttgc

SEQ ID NO: 104997 - DNA, 25 bp, Rattus norvegicus
agaagcaccgttctggactggcagt

SEQ ID NO: 104998 - DNA, 25 bp, Rattus norvegicus
agaagcaccgttgtggactggcagt

SEQ ID NO: 104999 - DNA, 25 bp, Rattus norvegicus
agaagcacctgcagagccctgtgtg

SEQ ID NO: 105000 - DNA, 25 bp, Rattus norvegicus
agaagcacctgcagtcttgacaatc

SEQ ID NO: 105001 - DNA, 25 bp, Rattus norvegicus
agaagcacctgcagtgcggtactgt

SEQ ID NO: 105002 - DNA, 25 bp, Rattus norvegicus
agaagcacctgctgagccctgtgtg

SEQ ID NO: 105003 - DNA, 25 bp, Rattus norvegicus
agaagcacctgctgtcttgacaatc

SEQ ID NO: 105004 - DNA, 25 bp, Rattus norvegicus
agaagcacctgctgtgcggtactgt

SEQ ID NO: 105005 - DNA, 25 bp, Rattus norvegicus
agaagcacctggaggatttccccaa

SEQ ID NO: 105006 - DNA, 25 bp, Rattus norvegicus
agaagcacctggtggatttccccaa

SEQ ID NO: 105007 - DNA, 25 bp, Rattus norvegicus
agaagcacggttagcatatctccct

SEQ ID NO: 105008 - DNA, 25 bp, Rattus norvegicus
agaagcacggtttgcatatctccct

SEQ ID NO: 105009 - DNA, 25 bp, Rattus norvegicus
agaagcactattaaggagaaagcct

SEQ ID NO: 105010 - DNA, 25 bp, Rattus norvegicus
agaagcactatttaggagaaagcct

SEQ ID NO: 105011 - DNA, 25 bp, Rattus norvegicus
agaagcactgccatgctaaaacaaa

SEQ ID NO: 105012 - DNA, 25 bp, Rattus norvegicus
agaagcactgccttgctaaaacaaa

SEQ ID NO: 105013 - DNA, 25 bp, Rattus norvegicus
agaagcactgtcagtaccagctcca

SEQ ID NO: 105014 - DNA, 25 bp, Rattus norvegicus
agaagcactgtccttgtcttttctg

SEQ ID NO: 105015 - DNA, 25 bp, Rattus norvegicus
agaagcactgtcgttgtcttttctg

SEQ ID NO: 105016 - DNA, 25 bp, Rattus norvegicus
agaagcactgtctgtaccagctcca

SEQ ID NO: 105017 - DNA, 25 bp, Rattus norvegicus
agaagcactgtgcacctgccgatga

SEQ ID NO: 105018 - DNA, 25 bp, Rattus norvegicus
agaagcactgtggacctgccgatga

SEQ ID NO: 105019 - DNA, 25 bp, Rattus norvegicus
agaagcacttgccttcccaacagtg

SEQ ID NO: 105020 - DNA, 25 bp, Rattus norvegicus
agaagcacttgcgttcccaacagtg

SEQ ID NO: 105021 - DNA, 25 bp, Rattus norvegicus
agaagcacttttccctattttaatg

SEQ ID NO: 105022 - DNA, 25 bp, Rattus norvegicus
agaagcacttttgcctattttaatg

SEQ ID NO: 105023 - DNA, 25 bp, Rattus norvegicus
agaagcagaaggacccactgagtct

SEQ ID NO: 105024 - DNA, 25 bp, Rattus norvegicus
agaagcagaaggtcccactgagtct

SEQ ID NO: 105025 - DNA, 25 bp, Rattus norvegicus
agaagcagaatgatgccgttctccc

SEQ ID NO: 105026 - DNA, 25 bp, Rattus norvegicus
agaagcagaatgttgccgttctccc

SEQ ID NO: 105027 - DNA, 25 bp, Rattus norvegicus
agaagcagacagctgttgcatcctc

SEQ ID NO: 105028 - DNA, 25 bp, Rattus norvegicus
agaagcagacaggtgttgcatcctc

SEQ ID NO: 105029 - DNA, 25 bp, Rattus norvegicus
agaagcagaccaaaggcacctcttt

SEQ ID NO: 105030 - DNA, 25 bp, Rattus norvegicus
agaagcagaccataggcacctcttt

SEQ ID NO: 105031 - DNA, 25 bp, Rattus norvegicus
agaagcagagataggcactcaccat

SEQ ID NO: 105032 - DNA, 25 bp, Rattus norvegicus
agaagcagagattggcactcaccat

SEQ ID NO: 105033 - DNA, 25 bp, Rattus norvegicus
agaagcagagccacccgtacttgga

SEQ ID NO: 105034 - DNA, 25 bp, Rattus norvegicus
agaagcagagcctcccgtacttgga

SEQ ID NO: 105035 - DNA, 25 bp, Rattus norvegicus
agaagcagagcgatggtcagactat

SEQ ID NO: 105036 - DNA, 25 bp, Rattus norvegicus
agaagcagagcgttggtcagactat

SEQ ID NO: 105037 - DNA, 25 bp, Rattus norvegicus
agaagcagagtaacgtttcctgccc

SEQ ID NO: 105038 - DNA, 25 bp, Rattus norvegicus
agaagcagagtatcgtttcctgccc

SEQ ID NO: 105039 - DNA, 25 bp, Rattus norvegicus
agaagcagatgaagccgctccaggc

SEQ ID NO: 105040 - DNA, 25 bp, Rattus norvegicus
agaagcagatgatgccgctccaggc

SEQ ID NO: 105041 - DNA, 25 bp, Rattus norvegicus
agaagcagcacaatacggttcctgt

SEQ ID NO: 105042 - DNA, 25 bp, Rattus norvegicus
agaagcagcacattacggttcctgt

SEQ ID NO: 105043 - DNA, 25 bp, Rattus norvegicus
agaagcagcaggcacaccaaggtcc

SEQ ID NO: 105044 - DNA, 25 bp, Rattus norvegicus
agaagcagcagggacaccaaggtcc

SEQ ID NO: 105045 - DNA, 25 bp, Rattus norvegicus
agaagcagcatcaatgacctccagc

SEQ ID NO: 105046 - DNA, 25 bp, Rattus norvegicus
agaagcagcatcaccccaaggctga

SEQ ID NO: 105047 - DNA, 25 bp, Rattus norvegicus
agaagcagcatctatgacctccagc

SEQ ID NO: 105048 - DNA, 25 bp, Rattus norvegicus
agaagcagcatctccccaaggctga

SEQ ID NO: 105049 - DNA, 25 bp, Rattus norvegicus
agaagcagccagacatgcatcctag

SEQ ID NO: 105050 - DNA, 25 bp, Rattus norvegicus
agaagcagccagtcatgcatcctag

SEQ ID NO: 105051 - DNA, 25 bp, Rattus norvegicus
agaagcagcctcagcttttggtcag

SEQ ID NO: 105052 - DNA, 25 bp, Rattus norvegicus
agaagcagcctctgcttttggtcag

SEQ ID NO: 105053 - DNA, 25 bp, Rattus norvegicus
agaagcagcctgagcctcccagaga

SEQ ID NO: 105054 - DNA, 25 bp, Rattus norvegicus
agaagcagcctgtgcctcccagaga

SEQ ID NO: 105055 - DNA, 25 bp, Rattus norvegicus
agaagcagccttcatgccagaggtc

SEQ ID NO: 105056 - DNA, 25 bp, Rattus norvegicus
agaagcagccttgatgccagaggtc

SEQ ID NO: 105057 - DNA, 25 bp, Rattus norvegicus
agaagcagcgcaacgccatcgcgcg

SEQ ID NO: 105058 - DNA, 25 bp, Rattus norvegicus
agaagcagcgcatcgccatcgcgcg

SEQ ID NO: 105059 - DNA, 25 bp, Rattus norvegicus
agaagcagcgctaccagcagctggt

SEQ ID NO: 105060 - DNA, 25 bp, Rattus norvegicus
agaagcagcgcttccagcagctggt

SEQ ID NO: 105061 - DNA, 25 bp, Rattus norvegicus
agaagcagctagaagactatgggat

SEQ ID NO: 105062 - DNA, 25 bp, Rattus norvegicus
agaagcagctagtagactatgggat

SEQ ID NO: 105063 - DNA, 25 bp, Rattus norvegicus
agaagcagctccacggacggtcgtc

SEQ ID NO: 105064 - DNA, 25 bp, Rattus norvegicus
agaagcagctcctcggacggtcgtc

SEQ ID NO: 105065 - DNA, 25 bp, Rattus norvegicus
agaagcaggcacctgggtctgccac

SEQ ID NO: 105066 - DNA, 25 bp, Rattus norvegicus
agaagcaggcacgtgggtctgccac

SEQ ID NO: 105067 - DNA, 25 bp, Rattus norvegicus
agaagcaggctccacagattgtcac

SEQ ID NO: 105068 - DNA, 25 bp, Rattus norvegicus
agaagcaggctcgacagattgtcac

SEQ ID NO: 105069 - DNA, 25 bp, Rattus norvegicus
agaagcaggctgaggccaccgacca

SEQ ID NO: 105070 - DNA, 25 bp, Rattus norvegicus
agaagcaggctgtggccaccgacca

SEQ ID NO: 105071 - DNA, 25 bp, Rattus norvegicus
agaagcaggcttcccaagctgtcac

SEQ ID NO: 105072 - DNA, 25 bp, Rattus norvegicus
agaagcaggcttgccaagctgtcac

SEQ ID NO: 105073 - DNA, 25 bp, Rattus norvegicus
agaagcagggctctaatgacgccaa

SEQ ID NO: 105074 - DNA, 25 bp, Rattus norvegicus
agaagcagggctgtaatgacgccaa

SEQ ID NO: 105075 - DNA, 25 bp, Rattus norvegicus
agaagcaggtgcagtgctgcccctg

SEQ ID NO: 105076 - DNA, 25 bp, Rattus norvegicus
agaagcaggtgcatctccgtgaggt

SEQ ID NO: 105077 - DNA, 25 bp, Rattus norvegicus
agaagcaggtgctgtgctgcccctg

SEQ ID NO: 105078 - DNA, 25 bp, Rattus norvegicus
agaagcaggtgcttctccgtgaggt

SEQ ID NO: 105079 - DNA, 25 bp, Rattus norvegicus
agaagcaggtggaccagccctggca

SEQ ID NO: 105080 - DNA, 25 bp, Rattus norvegicus
agaagcaggtggtccagccctggca

SEQ ID NO: 105081 - DNA, 25 bp, Rattus norvegicus
agaagcaggtttctgtctccttttc

SEQ ID NO: 105082 - DNA, 25 bp, Rattus norvegicus
agaagcaggtttgtgtctccttttc

SEQ ID NO: 105083 - DNA, 25 bp, Rattus norvegicus
agaagcagtagcacagaaccacccc

SEQ ID NO: 105084 - DNA, 25 bp, Rattus norvegicus
agaagcagtagctcagaaccacccc

SEQ ID NO: 105085 - DNA, 25 bp, Rattus norvegicus
agaagcagtcttctccctaggctat

SEQ ID NO: 105086 - DNA, 25 bp, Rattus norvegicus
agaagcagtcttgtccctaggctat

SEQ ID NO: 105087 - DNA, 25 bp, Rattus norvegicus
agaagcagtggtccgctgtttttct

SEQ ID NO: 105088 - DNA, 25 bp, Rattus norvegicus
agaagcagtggtgcgctgtttttct

SEQ ID NO: 105089 - DNA, 25 bp, Rattus norvegicus
agaagcagtgtaactctctcaagcc

SEQ ID NO: 105090 - DNA, 25 bp, Rattus norvegicus
agaagcagtgtatctctctcaagcc

SEQ ID NO: 105091 - DNA, 25 bp, Rattus norvegicus
agaagcagtgtgagccattccggcg

SEQ ID NO: 105092 - DNA, 25 bp, Rattus norvegicus
agaagcagtgtgtgccattccggcg

SEQ ID NO: 105093 - DNA, 25 bp, Rattus norvegicus
agaagcatatctcactttttgatca

SEQ ID NO: 105094 - DNA, 25 bp, Rattus norvegicus
agaagcatatctgactttttgatca

SEQ ID NO: 105095 - DNA, 25 bp, Rattus norvegicus
agaagcatctgcaaggtcacctctg

SEQ ID NO: 105096 - DNA, 25 bp, Rattus norvegicus
agaagcatctgctaggtcacctctg

SEQ ID NO: 105097 - DNA, 25 bp, Rattus norvegicus
agaagcatctttcgcagacccatga

SEQ ID NO: 105098 - DNA, 25 bp, Rattus norvegicus
agaagcatctttggcagacccatga

SEQ ID NO: 105099 - DNA, 25 bp, Rattus norvegicus
agaagcatgcatagttgtgtttcaa

SEQ ID NO: 105100 - DNA, 25 bp, Rattus norvegicus
agaagcatgcattgttgtgtttcaa

SEQ ID NO: 105101 - DNA, 25 bp, Rattus norvegicus
agaagcatgctcagtccggcctagt

SEQ ID NO: 105102 - DNA, 25 bp, Rattus norvegicus
agaagcatgctctgtccggcctagt

SEQ ID NO: 105103 - DNA, 25 bp, Rattus norvegicus
agaagcatggtgactctgtctctct

SEQ ID NO: 105104 - DNA, 25 bp, Rattus norvegicus
agaagcatggtgtctctgtctctct

SEQ ID NO: 105105 - DNA, 25 bp, Rattus norvegicus
agaagcattaccagcagcctagagt

SEQ ID NO: 105106 - DNA, 25 bp, Rattus norvegicus
agaagcattacctgcagcctagagt

SEQ ID NO: 105107 - DNA, 25 bp, Rattus norvegicus
agaagcattctcatgcatctgggtt

SEQ ID NO: 105108 - DNA, 25 bp, Rattus norvegicus
agaagcattctcttgcatctgggtt

SEQ ID NO: 105109 - DNA, 25 bp, Rattus norvegicus
agaagcattcttatgggccctcctg

SEQ ID NO: 105110 - DNA, 25 bp, Rattus norvegicus
agaagcattcttttgggccctcctg

SEQ ID NO: 105111 - DNA, 25 bp, Rattus norvegicus
agaagccaaagtcaggcaccctttt

SEQ ID NO: 105112 - DNA, 25 bp, Rattus norvegicus
agaagccaaagtgaggcaccctttt

SEQ ID NO: 105113 - DNA, 25 bp, Rattus norvegicus
agaagccaacttaactaatcaggaa

SEQ ID NO: 105114 - DNA, 25 bp, Rattus norvegicus
agaagccaactttactaatcaggaa

SEQ ID NO: 105115 - DNA, 25 bp, Rattus norvegicus
agaagccaagagagggcgctctcgc

SEQ ID NO: 105116 - DNA, 25 bp, Rattus norvegicus
agaagccaagagtgggcgctctcgc

SEQ ID NO: 105117 - DNA, 25 bp, Rattus norvegicus
agaagccaagatatagacatagact

SEQ ID NO: 105118 - DNA, 25 bp, Rattus norvegicus
agaagccaagatttagacatagact

SEQ ID NO: 105119 - DNA, 25 bp, Rattus norvegicus
agaagccaccccaattctttgtggt

SEQ ID NO: 105120 - DNA, 25 bp, Rattus norvegicus
agaagccacccctattctttgtggt

SEQ ID NO: 105121 - DNA, 25 bp, Rattus norvegicus
agaagccacctgagcactttagcat

SEQ ID NO: 105122 - DNA, 25 bp, Rattus norvegicus
agaagccacctgtgcactttagcat

SEQ ID NO: 105123 - DNA, 25 bp, Rattus norvegicus
agaagccacgaacccaccggagagg

SEQ ID NO: 105124 - DNA, 25 bp, Rattus norvegicus
agaagccacgaagccaccggagagg

SEQ ID NO: 105125 - DNA, 25 bp, Rattus norvegicus
agaagccacgagcttacacacacac

SEQ ID NO: 105126 - DNA, 25 bp, Rattus norvegicus
agaagccacgaggttacacacacac

SEQ ID NO: 105127 - DNA, 25 bp, Rattus norvegicus
agaagccacgcaacagcacggagtt

SEQ ID NO: 105128 - DNA, 25 bp, Rattus norvegicus
agaagccacgcatcagcacggagtt

SEQ ID NO: 105129 - DNA, 25 bp, Rattus norvegicus
agaagccacgctagaaacagcaaag

SEQ ID NO: 105130 - DNA, 25 bp, Rattus norvegicus
agaagccacgcttgaaacagcaaag

SEQ ID NO: 105131 - DNA, 25 bp, Rattus norvegicus
agaagccactagaaaggtcacccgt

SEQ ID NO: 105132 - DNA, 25 bp, Rattus norvegicus
agaagccactagtaaggtcacccgt

SEQ ID NO: 105133 - DNA, 25 bp, Rattus norvegicus
agaagccactgcaagatgctgccga

SEQ ID NO: 105134 - DNA, 25 bp, Rattus norvegicus
agaagccactgctagatgctgccga

SEQ ID NO: 105135 - DNA, 25 bp, Rattus norvegicus
agaagccagaatcggtctctcctgt

SEQ ID NO: 105136 - DNA, 25 bp, Rattus norvegicus
agaagccagaatgggtctctcctgt

SEQ ID NO: 105137 - DNA, 25 bp, Rattus norvegicus
agaagccagcagaccgcaggcagtt

SEQ ID NO: 105138 - DNA, 25 bp, Rattus norvegicus
agaagccagcagcaagtcgagagca

SEQ ID NO: 105139 - DNA, 25 bp, Rattus norvegicus
agaagccagcaggaagtcgagagca

SEQ ID NO: 105140 - DNA, 25 bp, Rattus norvegicus
agaagccagcagtccgcaggcagtt

SEQ ID NO: 105141 - DNA, 25 bp, Rattus norvegicus
agaagccaggccatgtcacagggag

SEQ ID NO: 105142 - DNA, 25 bp, Rattus norvegicus
agaagccaggccttgtcacagggag

SEQ ID NO: 105143 - DNA, 25 bp, Rattus norvegicus
agaagccaggctagcttagcctatt

SEQ ID NO: 105144 - DNA, 25 bp, Rattus norvegicus
agaagccaggcttgcttagcctatt

SEQ ID NO: 105145 - DNA, 25 bp, Rattus norvegicus
agaagccagtgacctgatgcagccc

SEQ ID NO: 105146 - DNA, 25 bp, Rattus norvegicus
agaagccagtgagctgatgcagccc

SEQ ID NO: 105147 - DNA, 25 bp, Rattus norvegicus
agaagccatatcagacctctttgtg

SEQ ID NO: 105148 - DNA, 25 bp, Rattus norvegicus
agaagccatatctgacctctttgtg

SEQ ID NO: 105149 - DNA, 25 bp, Rattus norvegicus
agaagccatcccaactgtgcgacgt

SEQ ID NO: 105150 - DNA, 25 bp, Rattus norvegicus
agaagccatccctactgtgcgacgt

SEQ ID NO: 105151 - DNA, 25 bp, Rattus norvegicus
agaagccatgagctgggcctatgcc

SEQ ID NO: 105152 - DNA, 25 bp, Rattus norvegicus
agaagccatgaggtgggcctatgcc

SEQ ID NO: 105153 - DNA, 25 bp, Rattus norvegicus
agaagccatgatacgattccgcaag

SEQ ID NO: 105154 - DNA, 25 bp, Rattus norvegicus
agaagccatgattcgattccgcaag

SEQ ID NO: 105155 - DNA, 25 bp, Rattus norvegicus
agaagccatggtctgcataggttcc

SEQ ID NO: 105156 - DNA, 25 bp, Rattus norvegicus
agaagccatggtgtgcataggttcc

SEQ ID NO: 105157 - DNA, 25 bp, Rattus norvegicus
agaagccattcccaggctgggacct

SEQ ID NO: 105158 - DNA, 25 bp, Rattus norvegicus
agaagccattccgaggctgggacct

SEQ ID NO: 105159 - DNA, 25 bp, Rattus norvegicus
agaagcccaaagatgaaccctctct

SEQ ID NO: 105160 - DNA, 25 bp, Rattus norvegicus
agaagcccaaagttgaaccctctct

SEQ ID NO: 105161 - DNA, 25 bp, Rattus norvegicus
agaagcccacagagcaggaccagtt

SEQ ID NO: 105162 - DNA, 25 bp, Rattus norvegicus
agaagcccacagtgcaggaccagtt

SEQ ID NO: 105163 - DNA, 25 bp, Rattus norvegicus
agaagcccaccccaggcagtgatgg

SEQ ID NO: 105164 - DNA, 25 bp, Rattus norvegicus
agaagcccacccgaggcagtgatgg

SEQ ID NO: 105165 - DNA, 25 bp, Rattus norvegicus
agaagcccagatcgacacagcacag

SEQ ID NO: 105166 - DNA, 25 bp, Rattus norvegicus
agaagcccagatggacacagcacag

SEQ ID NO: 105167 - DNA, 25 bp, Rattus norvegicus
agaagcccagtcacacaaaacagga

SEQ ID NO: 105168 - DNA, 25 bp, Rattus norvegicus
agaagcccagtcctcaatacaaatc

SEQ ID NO: 105169 - DNA, 25 bp, Rattus norvegicus
agaagcccagtcgtcaatacaaatc

SEQ ID NO: 105170 - DNA, 25 bp, Rattus norvegicus
agaagcccagtctcacaaaacagga

SEQ ID NO: 105171 - DNA, 25 bp, Rattus norvegicus
agaagcccagttagtctgcctgaca

SEQ ID NO: 105172 - DNA, 25 bp, Rattus norvegicus
agaagcccagtttgtctgcctgaca

SEQ ID NO: 105173 - DNA, 25 bp, Rattus norvegicus
agaagcccatgcagagccttcatgt

SEQ ID NO: 105174 - DNA, 25 bp, Rattus norvegicus
agaagcccatgccaaatccagtgcc

SEQ ID NO: 105175 - DNA, 25 bp, Rattus norvegicus
agaagcccatgcgaaatccagtgcc

SEQ ID NO: 105176 - DNA, 25 bp, Rattus norvegicus
agaagcccatgctgagccttcatgt

SEQ ID NO: 105177 - DNA, 25 bp, Rattus norvegicus
agaagcccatttacttcatctcggt

SEQ ID NO: 105178 - DNA, 25 bp, Rattus norvegicus
agaagcccattttcttcatctcggt

SEQ ID NO: 105179 - DNA, 25 bp, Rattus norvegicus
agaagccccgagaggaactcttcca

SEQ ID NO: 105180 - DNA, 25 bp, Rattus norvegicus
agaagccccgagtggaactcttcca

SEQ ID NO: 105181 - DNA, 25 bp, Rattus norvegicus
agaagccccgcaaggatcatctgta

SEQ ID NO: 105182 - DNA, 25 bp, Rattus norvegicus
agaagccccgcatggatcatctgta

SEQ ID NO: 105183 - DNA, 25 bp, Rattus norvegicus
agaagcccctatccttaaatctctt

SEQ ID NO: 105184 - DNA, 25 bp, Rattus norvegicus
agaagcccctatgcttaaatctctt

SEQ ID NO: 105185 - DNA, 25 bp, Rattus norvegicus
agaagcccctgcacatcagtgtaaa

SEQ ID NO: 105186 - DNA, 25 bp, Rattus norvegicus
agaagcccctgctcatcagtgtaaa

SEQ ID NO: 105187 - DNA, 25 bp, Rattus norvegicus
agaagccccttgcagacacagaagc

SEQ ID NO: 105188 - DNA, 25 bp, Rattus norvegicus
agaagccccttggagacacagaagc

SEQ ID NO: 105189 - DNA, 25 bp, Rattus norvegicus
agaagcccgcctcaaagtcatctgg

SEQ ID NO: 105190 - DNA, 25 bp, Rattus norvegicus
agaagcccgcctgaaagtcatctgg

SEQ ID NO: 105191 - DNA, 25 bp, Rattus norvegicus
agaagccctgcgcagatgctctcta

SEQ ID NO: 105192 - DNA, 25 bp, Rattus norvegicus
agaagccctgcggagatgctctcta

SEQ ID NO: 105193 - DNA, 25 bp, Rattus norvegicus
agaagccctgctcgtacagctccag

SEQ ID NO: 105194 - DNA, 25 bp, Rattus norvegicus
agaagccctgctggtacagctccag

SEQ ID NO: 105195 - DNA, 25 bp, Rattus norvegicus
agaagccctggcacagaagttcttg

SEQ ID NO: 105196 - DNA, 25 bp, Rattus norvegicus
agaagccctggctcagaagttcttg

SEQ ID NO: 105197 - DNA, 25 bp, Rattus norvegicus
agaagcccttcaagatcatcatcac

SEQ ID NO: 105198 - DNA, 25 bp, Rattus norvegicus
agaagcccttcatgatcatcatcac

SEQ ID NO: 105199 - DNA, 25 bp, Rattus norvegicus
agaagcccttggaaacctcgtggag

SEQ ID NO: 105200 - DNA, 25 bp, Rattus norvegicus
agaagcccttggtaacctcgtggag

SEQ ID NO: 105201 - DNA, 25 bp, Rattus norvegicus
agaagccgacatactgtttggcaca

SEQ ID NO: 105202 - DNA, 25 bp, Rattus norvegicus
agaagccgacattctgtttggcaca

SEQ ID NO: 105203 - DNA, 25 bp, Rattus norvegicus
agaagccgagtgctgtgccatctga

SEQ ID NO: 105204 - DNA, 25 bp, Rattus norvegicus
agaagccgagtggtgtgccatctga

SEQ ID NO: 105205 - DNA, 25 bp, Rattus norvegicus
agaagccgccagactcctgggcaag

SEQ ID NO: 105206 - DNA, 25 bp, Rattus norvegicus
agaagccgccagtctcctgggcaag

SEQ ID NO: 105207 - DNA, 25 bp, Rattus norvegicus
agaagccgcgctcacgtaatttccg

SEQ ID NO: 105208 - DNA, 25 bp, Rattus norvegicus
agaagccgcgctgacgtaatttccg

SEQ ID NO: 105209 - DNA, 25 bp, Rattus norvegicus
agaagccgctctccgcctcagatgg

SEQ ID NO: 105210 - DNA, 25 bp, Rattus norvegicus
agaagccgctctgcgcctcagatgg

SEQ ID NO: 105211 - DNA, 25 bp, Rattus norvegicus
agaagccgcttgaagtcagtcacag

SEQ ID NO: 105212 - DNA, 25 bp, Rattus norvegicus
agaagccgcttgtagtcagtcacag

SEQ ID NO: 105213 - DNA, 25 bp, Rattus norvegicus
agaagccggaagcagctccagccag

SEQ ID NO: 105214 - DNA, 25 bp, Rattus norvegicus
agaagccggaaggagctccagccag

SEQ ID NO: 105215 - DNA, 25 bp, Rattus norvegicus
agaagccgtcggctctctgagttcc

SEQ ID NO: 105216 - DNA, 25 bp, Rattus norvegicus
agaagccgtcgggtctctgagttcc

SEQ ID NO: 105217 - DNA, 25 bp, Rattus norvegicus
agaagccgtggcagagaccgaccag

SEQ ID NO: 105218 - DNA, 25 bp, Rattus norvegicus
agaagccgtggctgagaccgaccag

SEQ ID NO: 105219 - DNA, 25 bp, Rattus norvegicus
agaagcctaagaagtcaacctggag

SEQ ID NO: 105220 - DNA, 25 bp, Rattus norvegicus
agaagcctaagatgtcaacctggag

SEQ ID NO: 105221 - DNA, 25 bp, Rattus norvegicus
agaagcctatctctgcttagcctgt

SEQ ID NO: 105222 - DNA, 25 bp, Rattus norvegicus
agaagcctatctgtgcttagcctgt

SEQ ID NO: 105223 - DNA, 25 bp, Rattus norvegicus
agaagcctatggctcatcatccgag

SEQ ID NO: 105224 - DNA, 25 bp, Rattus norvegicus
agaagcctatgggtcatcatccgag

SEQ ID NO: 105225 - DNA, 25 bp, Rattus norvegicus
agaagcctatgtcttgcctgccttg

SEQ ID NO: 105226 - DNA, 25 bp, Rattus norvegicus
agaagcctatgtgttgcctgccttg

SEQ ID NO: 105227 - DNA, 25 bp, Rattus norvegicus
agaagcctcaatcaggtggtacctg

SEQ ID NO: 105228 - DNA, 25 bp, Rattus norvegicus
agaagcctcaatgaggtggtacctg

SEQ ID NO: 105229 - DNA, 25 bp, Rattus norvegicus
agaagcctcacactgcgtatctttt

SEQ ID NO: 105230 - DNA, 25 bp, Rattus norvegicus
agaagcctcacagtgcgtatctttt

SEQ ID NO: 105231 - DNA, 25 bp, Rattus norvegicus
agaagcctcaggacactagggagcc

SEQ ID NO: 105232 - DNA, 25 bp, Rattus norvegicus
agaagcctcaggtcactagggagcc

SEQ ID NO: 105233 - DNA, 25 bp, Rattus norvegicus
agaagcctccagaactcattgcaag

SEQ ID NO: 105234 - DNA, 25 bp, Rattus norvegicus
agaagcctccagtactcattgcaag

SEQ ID NO: 105235 - DNA, 25 bp, Rattus norvegicus
agaagcctcctgactcagagtggtt

SEQ ID NO: 105236 - DNA, 25 bp, Rattus norvegicus
agaagcctcctgtctcagagtggtt

SEQ ID NO: 105237 - DNA, 25 bp, Rattus norvegicus
agaagcctcggcacatgagaggtct

SEQ ID NO: 105238 - DNA, 25 bp, Rattus norvegicus
agaagcctcggctcatgagaggtct

SEQ ID NO: 105239 - DNA, 25 bp, Rattus norvegicus
agaagcctcgtcatgacgcctagag

SEQ ID NO: 105240 - DNA, 25 bp, Rattus norvegicus
agaagcctcgtcttgacgcctagag

SEQ ID NO: 105241 - DNA, 25 bp, Rattus norvegicus
agaagcctcgttaattcctcaggaa

SEQ ID NO: 105242 - DNA, 25 bp, Rattus norvegicus
agaagcctcgtttattcctcaggaa

SEQ ID NO: 105243 - DNA, 25 bp, Rattus norvegicus
agaagcctctaacattgtctagtgt

SEQ ID NO: 105244 - DNA, 25 bp, Rattus norvegicus
agaagcctctaagattgtctagtgt

SEQ ID NO: 105245 - DNA, 25 bp, Rattus norvegicus
agaagcctctagctgtgtcccagca

SEQ ID NO: 105246 - DNA, 25 bp, Rattus norvegicus
agaagcctctaggtgtgtcccagca

SEQ ID NO: 105247 - DNA, 25 bp, Rattus norvegicus
agaagcctctcacagcctcgacaga

SEQ ID NO: 105248 - DNA, 25 bp, Rattus norvegicus
agaagcctctcagagcctcgacaga

SEQ ID NO: 105249 - DNA, 25 bp, Rattus norvegicus
agaagcctctctctaggttttcagc

SEQ ID NO: 105250 - DNA, 25 bp, Rattus norvegicus
agaagcctctctgtaggttttcagc

SEQ ID NO: 105251 - DNA, 25 bp, Rattus norvegicus
agaagcctctggacgcagctgtctg

SEQ ID NO: 105252 - DNA, 25 bp, Rattus norvegicus
agaagcctctggtcgcagctgtctg

SEQ ID NO: 105253 - DNA, 25 bp, Rattus norvegicus
agaagcctgcagacagctgagcgca

SEQ ID NO: 105254 - DNA, 25 bp, Rattus norvegicus
agaagcctgcagacctagccaggcc

SEQ ID NO: 105255 - DNA, 25 bp, Rattus norvegicus
agaagcctgcagtcagctgagcgca

SEQ ID NO: 105256 - DNA, 25 bp, Rattus norvegicus
agaagcctgcagtcctagccaggcc

SEQ ID NO: 105257 - DNA, 25 bp, Rattus norvegicus
agaagcctgctgattgtgggctaag

SEQ ID NO: 105258 - DNA, 25 bp, Rattus norvegicus
agaagcctgctgtttgtgggctaag

SEQ ID NO: 105259 - DNA, 25 bp, Rattus norvegicus
agaagcctggagacccaggacgtct

SEQ ID NO: 105260 - DNA, 25 bp, Rattus norvegicus
agaagcctggagcatggccttctgc

SEQ ID NO: 105261 - DNA, 25 bp, Rattus norvegicus
agaagcctggaggatggccttctgc

SEQ ID NO: 105262 - DNA, 25 bp, Rattus norvegicus
agaagcctggagtcccaggacgtct

SEQ ID NO: 105263 - DNA, 25 bp, Rattus norvegicus
agaagcctgtataatgccatcctaa

SEQ ID NO: 105264 - DNA, 25 bp, Rattus norvegicus
agaagcctgtattatgccatcctaa

SEQ ID NO: 105265 - DNA, 25 bp, Rattus norvegicus
agaagccttaccacacagtaactaa

SEQ ID NO: 105266 - DNA, 25 bp, Rattus norvegicus
agaagccttacctcacagtaactaa

SEQ ID NO: 105267 - DNA, 25 bp, Rattus norvegicus
agaagccttcaacctctgagggaaa

SEQ ID NO: 105268 - DNA, 25 bp, Rattus norvegicus
agaagccttcaagctctgagggaaa

SEQ ID NO: 105269 - DNA, 25 bp, Rattus norvegicus
agaagccttgtgatgctgtgaccat

SEQ ID NO: 105270 - DNA, 25 bp, Rattus norvegicus
agaagccttgtgttgctgtgaccat

SEQ ID NO: 105271 - DNA, 25 bp, Rattus norvegicus
agaagcctttgaacctgaactcggg

SEQ ID NO: 105272 - DNA, 25 bp, Rattus norvegicus
agaagcctttgatcctgaactcggg

SEQ ID NO: 105273 - DNA, 25 bp, Rattus norvegicus
agaagcgaagcgacagcctgttcca

SEQ ID NO: 105274 - DNA, 25 bp, Rattus norvegicus
agaagcgaagcgtcagcctgttcca

SEQ ID NO: 105275 - DNA, 25 bp, Rattus norvegicus
agaagcgaaggcacttcacttcctg

SEQ ID NO: 105276 - DNA, 25 bp, Rattus norvegicus
agaagcgaaggctcttcacttcctg

SEQ ID NO: 105277 - DNA, 25 bp, Rattus norvegicus
agaagcgacgtgacatctgtcctct

SEQ ID NO: 105278 - DNA, 25 bp, Rattus norvegicus
agaagcgacgtgtcatctgtcctct

SEQ ID NO: 105279 - DNA, 25 bp, Rattus norvegicus
agaagcgactggctgtactgcgcct

SEQ ID NO: 105280 - DNA, 25 bp, Rattus norvegicus
agaagcgactgggtgtactgcgcct

SEQ ID NO: 105281 - DNA, 25 bp, Rattus norvegicus
agaagcgagcaacctaggccttgtc

SEQ ID NO: 105282 - DNA, 25 bp, Rattus norvegicus
agaagcgagcaagctaggccttgtc

SEQ ID NO: 105283 - DNA, 25 bp, Rattus norvegicus
agaagcgagcctagacggagtgcca

SEQ ID NO: 105284 - DNA, 25 bp, Rattus norvegicus
agaagcgagccttgacggagtgcca

SEQ ID NO: 105285 - DNA, 25 bp, Rattus norvegicus
agaagcgagctcagaagccctctca

SEQ ID NO: 105286 - DNA, 25 bp, Rattus norvegicus
agaagcgagctcagcgacctcagtg

SEQ ID NO: 105287 - DNA, 25 bp, Rattus norvegicus
agaagcgagctctgaagccctctca

SEQ ID NO: 105288 - DNA, 25 bp, Rattus norvegicus
agaagcgagctctgcgacctcagtg

SEQ ID NO: 105289 - DNA, 25 bp, Rattus norvegicus
agaagcgagcttcacactgtgccca

SEQ ID NO: 105290 - DNA, 25 bp, Rattus norvegicus
agaagcgagcttgacactgtgccca

SEQ ID NO: 105291 - DNA, 25 bp, Rattus norvegicus
agaagcgagtgcatactctccggaa

SEQ ID NO: 105292 - DNA, 25 bp, Rattus norvegicus
agaagcgagtgcttactctccggaa

SEQ ID NO: 105293 - DNA, 25 bp, Rattus norvegicus
agaagcgagtttatcctgtgcacca

SEQ ID NO: 105294 - DNA, 25 bp, Rattus norvegicus
agaagcgagtttttcctgtgcacca

SEQ ID NO: 105295 - DNA, 25 bp, Rattus norvegicus
agaagcgatccaccacagctctgtc

SEQ ID NO: 105296 - DNA, 25 bp, Rattus norvegicus
agaagcgatccagcacagctctgtc

SEQ ID NO: 105297 - DNA, 25 bp, Rattus norvegicus
agaagcgcagttcctgattcccagt

SEQ ID NO: 105298 - DNA, 25 bp, Rattus norvegicus
agaagcgcagttgctgattcccagt

SEQ ID NO: 105299 - DNA, 25 bp, Rattus norvegicus
agaagcgcatcaagcattgcctggg

SEQ ID NO: 105300 - DNA, 25 bp, Rattus norvegicus
agaagcgcatcatgcattgcctggg

SEQ ID NO: 105301 - DNA, 25 bp, Rattus norvegicus
agaagcgcatggaacagactccctg

SEQ ID NO: 105302 - DNA, 25 bp, Rattus norvegicus
agaagcgcatggtacagactccctg

SEQ ID NO: 105303 - DNA, 25 bp, Rattus norvegicus
agaagcgcctttacttcagactgct

SEQ ID NO: 105304 - DNA, 25 bp, Rattus norvegicus
agaagcgccttttcttcagactgct

SEQ ID NO: 105305 - DNA, 25 bp, Rattus norvegicus
agaagcgctcttaatccttttgtat

SEQ ID NO: 105306 - DNA, 25 bp, Rattus norvegicus
agaagcgctctttatccttttgtat

SEQ ID NO: 105307 - DNA, 25 bp, Rattus norvegicus
agaagcgctgctatggcgagtacaa

SEQ ID NO: 105308 - DNA, 25 bp, Rattus norvegicus
agaagcgctgctttggcgagtacaa

SEQ ID NO: 105309 - DNA, 25 bp, Rattus norvegicus
agaagcgctgttcactgtgtctgtc

SEQ ID NO: 105310 - DNA, 25 bp, Rattus norvegicus
agaagcgctgttgactgtgtctgtc

SEQ ID NO: 105311 - DNA, 25 bp, Rattus norvegicus
agaagcgcttgtcgcattccgggca

SEQ ID NO: 105312 - DNA, 25 bp, Rattus norvegicus
agaagcgcttgtggcattccgggca

SEQ ID NO: 105313 - DNA, 25 bp, Rattus norvegicus
agaagcggaagaattgcctccaatt

SEQ ID NO: 105314 - DNA, 25 bp, Rattus norvegicus
agaagcggaagatttgcctccaatt

SEQ ID NO: 105315 - DNA, 25 bp, Rattus norvegicus
agaagcggcccgagaggccggtggt

SEQ ID NO: 105316 - DNA, 25 bp, Rattus norvegicus
agaagcggcccgtgaggccggtggt

SEQ ID NO: 105317 - DNA, 25 bp, Rattus norvegicus
agaagcgggtggatcctggtttcct

SEQ ID NO: 105318 - DNA, 25 bp, Rattus norvegicus
agaagcgggtggttcctggtttcct

SEQ ID NO: 105319 - DNA, 25 bp, Rattus norvegicus
agaagcgggttcagggacttcgcat

SEQ ID NO: 105320 - DNA, 25 bp, Rattus norvegicus
agaagcgggttctgggacttcgcat

SEQ ID NO: 105321 - DNA, 25 bp, Rattus norvegicus
agaagcggtcatattggcaagtaac

SEQ ID NO: 105322 - DNA, 25 bp, Rattus norvegicus
agaagcggtcattttggcaagtaac

SEQ ID NO: 105323 - DNA, 25 bp, Rattus norvegicus
agaagcggtctcactgactgtatac

SEQ ID NO: 105324 - DNA, 25 bp, Rattus norvegicus
agaagcggtctctctgactgtatac

SEQ ID NO: 105325 - DNA, 25 bp, Rattus norvegicus
agaagcgtatctaaccctctccatt

SEQ ID NO: 105326 - DNA, 25 bp, Rattus norvegicus
agaagcgtatcttaccctctccatt

SEQ ID NO: 105327 - DNA, 25 bp, Rattus norvegicus
agaagcgtcagtcccttcgttgtta

SEQ ID NO: 105328 - DNA, 25 bp, Rattus norvegicus
agaagcgtcagtgccttcgttgtta

SEQ ID NO: 105329 - DNA, 25 bp, Rattus norvegicus
agaagcgtccagagtcaccatgtta

SEQ ID NO: 105330 - DNA, 25 bp, Rattus norvegicus
agaagcgtccagtgtcaccatgtta

SEQ ID NO: 105331 - DNA, 25 bp, Rattus norvegicus
agaagcgtcctgatctggtgaggca

SEQ ID NO: 105332 - DNA, 25 bp, Rattus norvegicus
agaagcgtcctgttctggtgaggca

SEQ ID NO: 105333 - DNA, 25 bp, Rattus norvegicus
agaagcgtgacaacaagacccggga

SEQ ID NO: 105334 - DNA, 25 bp, Rattus norvegicus
agaagcgtgacatcaagacccggga

SEQ ID NO: 105335 - DNA, 25 bp, Rattus norvegicus
agaagcgttcagagtctcccgggaa

SEQ ID NO: 105336 - DNA, 25 bp, Rattus norvegicus
agaagcgttcagtgtctcccgggaa

SEQ ID NO: 105337 - DNA, 25 bp, Rattus norvegicus
agaagcgttgacagttgggtactgt

SEQ ID NO: 105338 - DNA, 25 bp, Rattus norvegicus
agaagcgttgactgttgggtactgt

SEQ ID NO: 105339 - DNA, 25 bp, Rattus norvegicus
agaagctaaactctgcgtcctctag

SEQ ID NO: 105340 - DNA, 25 bp, Rattus norvegicus
agaagctaaactgtgcgtcctctag

SEQ ID NO: 105341 - DNA, 25 bp, Rattus norvegicus
agaagctaacgtcagcctggcagtg

SEQ ID NO: 105342 - DNA, 25 bp, Rattus norvegicus
agaagctaacgtgagcctggcagtg

SEQ ID NO: 105343 - DNA, 25 bp, Rattus norvegicus
agaagctacaaaccctcctataatt

SEQ ID NO: 105344 - DNA, 25 bp, Rattus norvegicus
agaagctacaaagcctcctataatt

SEQ ID NO: 105345 - DNA, 25 bp, Rattus norvegicus
agaagctagcctaggacatggccac

SEQ ID NO: 105346 - DNA, 25 bp, Rattus norvegicus
agaagctagccttggacatggccac

SEQ ID NO: 105347 - DNA, 25 bp, Rattus norvegicus
agaagctagctcagaacctctgttc

SEQ ID NO: 105348 - DNA, 25 bp, Rattus norvegicus
agaagctagctctgaacctctgttc

SEQ ID NO: 105349 - DNA, 25 bp, Rattus norvegicus
agaagctatcaacagggtgcccaag

SEQ ID NO: 105350 - DNA, 25 bp, Rattus norvegicus
agaagctatcaagagggtgcccaag

SEQ ID NO: 105351 - DNA, 25 bp, Rattus norvegicus
agaagctatcacacattgtcacgtg

SEQ ID NO: 105352 - DNA, 25 bp, Rattus norvegicus
agaagctatcactcattgtcacgtg

SEQ ID NO: 105353 - DNA, 25 bp, Rattus norvegicus
agaagctatcagaattccaacggag

SEQ ID NO: 105354 - DNA, 25 bp, Rattus norvegicus
agaagctatcagtattccaacggag

SEQ ID NO: 105355 - DNA, 25 bp, Rattus norvegicus
agaagctatcataccaagaacaagg

SEQ ID NO: 105356 - DNA, 25 bp, Rattus norvegicus
agaagctatcattccaagaacaagg

SEQ ID NO: 105357 - DNA, 25 bp, Rattus norvegicus
agaagctattacacctggctcattt

SEQ ID NO: 105358 - DNA, 25 bp, Rattus norvegicus
agaagctattactcctggctcattt

SEQ ID NO: 105359 - DNA, 25 bp, Rattus norvegicus
agaagctattgacgacgatgacgat

SEQ ID NO: 105360 - DNA, 25 bp, Rattus norvegicus
agaagctattgaggacgatgacgat

SEQ ID NO: 105361 - DNA, 25 bp, Rattus norvegicus
agaagctcacagctgtgcgtttctg

SEQ ID NO: 105362 - DNA, 25 bp, Rattus norvegicus
agaagctcacaggtgtgcgtttctg

SEQ ID NO: 105363 - DNA, 25 bp, Rattus norvegicus
agaagctcaccaacttctttttctt

SEQ ID NO: 105364 - DNA, 25 bp, Rattus norvegicus
agaagctcaccatcttctttttctt

SEQ ID NO: 105365 - DNA, 25 bp, Rattus norvegicus
agaagctcactcagggcagatccta

SEQ ID NO: 105366 - DNA, 25 bp, Rattus norvegicus
agaagctcactctgggcagatccta

SEQ ID NO: 105367 - DNA, 25 bp, Rattus norvegicus
agaagctcactgatcggcgtagcct

SEQ ID NO: 105368 - DNA, 25 bp, Rattus norvegicus
agaagctcactgctgtctgactgta

SEQ ID NO: 105369 - DNA, 25 bp, Rattus norvegicus
agaagctcactggtgtctgactgta

SEQ ID NO: 105370 - DNA, 25 bp, Rattus norvegicus
agaagctcactgttcggcgtagcct

SEQ ID NO: 105371 - DNA, 25 bp, Rattus norvegicus
agaagctcacttattctcaggctga

SEQ ID NO: 105372 - DNA, 25 bp, Rattus norvegicus
agaagctcactttttctcaggctga

SEQ ID NO: 105373 - DNA, 25 bp, Rattus norvegicus
agaagctcagagactatggcatccg

SEQ ID NO: 105374 - DNA, 25 bp, Rattus norvegicus
agaagctcagagtctatggcatccg

SEQ ID NO: 105375 - DNA, 25 bp, Rattus norvegicus
agaagctcagttagttctgcgagga

SEQ ID NO: 105376 - DNA, 25 bp, Rattus norvegicus
agaagctcagtttgttctgcgagga

SEQ ID NO: 105377 - DNA, 25 bp, Rattus norvegicus
agaagctcatggagcacaactggga

SEQ ID NO: 105378 - DNA, 25 bp, Rattus norvegicus
agaagctcatggtgcacaactggga

SEQ ID NO: 105379 - DNA, 25 bp, Rattus norvegicus
agaagctccctgagtgattctccac

SEQ ID NO: 105380 - DNA, 25 bp, Rattus norvegicus
agaagctccctgctcttattttagc

SEQ ID NO: 105381 - DNA, 25 bp, Rattus norvegicus
agaagctccctggtcttattttagc

SEQ ID NO: 105382 - DNA, 25 bp, Rattus norvegicus
agaagctccctgtgtgattctccac

SEQ ID NO: 105383 - DNA, 25 bp, Rattus norvegicus
agaagctccgagctcaggttcgacg

SEQ ID NO: 105384 - DNA, 25 bp, Rattus norvegicus
agaagctccgaggtcaggttcgacg

SEQ ID NO: 105385 - DNA, 25 bp, Rattus norvegicus
agaagctccgttcgtgtctggatgt

SEQ ID NO: 105386 - DNA, 25 bp, Rattus norvegicus
agaagctccgttggtgtctggatgt

SEQ ID NO: 105387 - DNA, 25 bp, Rattus norvegicus
agaagctcctatatctgaggcgttc

SEQ ID NO: 105388 - DNA, 25 bp, Rattus norvegicus
agaagctcctatttctgaggcgttc

SEQ ID NO: 105389 - DNA, 25 bp, Rattus norvegicus
agaagctcctggctgcagatgcaga

SEQ ID NO: 105390 - DNA, 25 bp, Rattus norvegicus
agaagctcctgggtgcagatgcaga

SEQ ID NO: 105391 - DNA, 25 bp, Rattus norvegicus
agaagctcgagcctcctggcggtat

SEQ ID NO: 105392 - DNA, 25 bp, Rattus norvegicus
agaagctcgagcgtcctggcggtat

SEQ ID NO: 105393 - DNA, 25 bp, Rattus norvegicus
agaagctcgtatctggcacgcatcc

SEQ ID NO: 105394 - DNA, 25 bp, Rattus norvegicus
agaagctcgtatgtggcacgcatcc

SEQ ID NO: 105395 - DNA, 25 bp, Rattus norvegicus
agaagctctaagactccggacagcc

SEQ ID NO: 105396 - DNA, 25 bp, Rattus norvegicus
agaagctctaagtctccggacagcc

SEQ ID NO: 105397 - DNA, 25 bp, Rattus norvegicus
agaagctctcatacctgtcaggcat

SEQ ID NO: 105398 - DNA, 25 bp, Rattus norvegicus
agaagctctcattcctgtcaggcat

SEQ ID NO: 105399 - DNA, 25 bp, Rattus norvegicus
agaagctctctcagaagggtccctc

SEQ ID NO: 105400 - DNA, 25 bp, Rattus norvegicus
agaagctctctctgaagggtccctc

SEQ ID NO: 105401 - DNA, 25 bp, Rattus norvegicus
agaagctctctgagctggtacctga

SEQ ID NO: 105402 - DNA, 25 bp, Rattus norvegicus
agaagctctctgatgggatccgcaa

SEQ ID NO: 105403 - DNA, 25 bp, Rattus norvegicus
agaagctctctgtgctggtacctga

SEQ ID NO: 105404 - DNA, 25 bp, Rattus norvegicus
agaagctctctgttgggatccgcaa

SEQ ID NO: 105405 - DNA, 25 bp, Rattus norvegicus
agaagctctggacccagttacgaca

SEQ ID NO: 105406 - DNA, 25 bp, Rattus norvegicus
agaagctctggagccagttacgaca

SEQ ID NO: 105407 - DNA, 25 bp, Rattus norvegicus
agaagctctggcagcagcacagcat

SEQ ID NO: 105408 - DNA, 25 bp, Rattus norvegicus
agaagctctggctgcagcacagcat

SEQ ID NO: 105409 - DNA, 25 bp, Rattus norvegicus
agaagctctgggacttgtaaacaag

SEQ ID NO: 105410 - DNA, 25 bp, Rattus norvegicus
agaagctctgggtcttgtaaacaag

SEQ ID NO: 105411 - DNA, 25 bp, Rattus norvegicus
agaagctctgtactgcagcctgtgt

SEQ ID NO: 105412 - DNA, 25 bp, Rattus norvegicus
agaagctctgtagtgcagcctgtgt

SEQ ID NO: 105413 - DNA, 25 bp, Rattus norvegicus
agaagctcttagcatatgtggcccc

SEQ ID NO: 105414 - DNA, 25 bp, Rattus norvegicus
agaagctcttaggatatgtggcccc

SEQ ID NO: 105415 - DNA, 25 bp, Rattus norvegicus
agaagctcttgtcgcaggtgctgca

SEQ ID NO: 105416 - DNA, 25 bp, Rattus norvegicus
agaagctcttgtggcaggtgctgca

SEQ ID NO: 105417 - DNA, 25 bp, Rattus norvegicus
agaagctctttcaggtacacagccc

SEQ ID NO: 105418 - DNA, 25 bp, Rattus norvegicus
agaagctctttctggtacacagccc

SEQ ID NO: 105419 - DNA, 25 bp, Rattus norvegicus
agaagctgaaacaggcccattggtt

SEQ ID NO: 105420 - DNA, 25 bp, Rattus norvegicus
agaagctgaaactggcccattggtt

SEQ ID NO: 105421 - DNA, 25 bp, Rattus norvegicus
agaagctgaagaaactgagggcaaa

SEQ ID NO: 105422 - DNA, 25 bp, Rattus norvegicus
agaagctgaagatactgagggcaaa

SEQ ID NO: 105423 - DNA, 25 bp, Rattus norvegicus
agaagctgaagtctgccatcctgtc

SEQ ID NO: 105424 - DNA, 25 bp, Rattus norvegicus
agaagctgaagtgtgccatcctgtc

SEQ ID NO: 105425 - DNA, 25 bp, Rattus norvegicus
agaagctgaccacgccagcagcatc

SEQ ID NO: 105426 - DNA, 25 bp, Rattus norvegicus
agaagctgaccacggagaccaggct

SEQ ID NO: 105427 - DNA, 25 bp, Rattus norvegicus
agaagctgaccaggccagcagcatc

SEQ ID NO: 105428 - DNA, 25 bp, Rattus norvegicus
agaagctgaccagggagaccaggct

SEQ ID NO: 105429 - DNA, 25 bp, Rattus norvegicus
agaagctgagacagtcaccgccatg

SEQ ID NO: 105430 - DNA, 25 bp, Rattus norvegicus
agaagctgagactgtcaccgccatg

SEQ ID NO: 105431 - DNA, 25 bp, Rattus norvegicus
agaagctgagcccaggtctacgtta

SEQ ID NO: 105432 - DNA, 25 bp, Rattus norvegicus
agaagctgagccgaggtctacgtta

SEQ ID NO: 105433 - DNA, 25 bp, Rattus norvegicus
agaagctgagttagcccagggtcct

SEQ ID NO: 105434 - DNA, 25 bp, Rattus norvegicus
agaagctgagtttgcccagggtcct

SEQ ID NO: 105435 - DNA, 25 bp, Rattus norvegicus
agaagctgatggctacactgcccaa

SEQ ID NO: 105436 - DNA, 25 bp, Rattus norvegicus
agaagctgatgggtacactgcccaa

SEQ ID NO: 105437 - DNA, 25 bp, Rattus norvegicus
agaagctgattacagctcccactgc

SEQ ID NO: 105438 - DNA, 25 bp, Rattus norvegicus
agaagctgattagagctcccactgc

SEQ ID NO: 105439 - DNA, 25 bp, Rattus norvegicus
agaagctgattgaggacccctgggt

SEQ ID NO: 105440 - DNA, 25 bp, Rattus norvegicus
agaagctgattgtggacccctgggt

SEQ ID NO: 105441 - DNA, 25 bp, Rattus norvegicus
agaagctgcaaccagtccccagtgt

SEQ ID NO: 105442 - DNA, 25 bp, Rattus norvegicus
agaagctgcaacgagtccccagtgt

SEQ ID NO: 105443 - DNA, 25 bp, Rattus norvegicus
agaagctgccgcaaggattgtccca

SEQ ID NO: 105444 - DNA, 25 bp, Rattus norvegicus
agaagctgccgctaggattgtccca

SEQ ID NO: 105445 - DNA, 25 bp, Rattus norvegicus
agaagctgccggaatgagaactcac

SEQ ID NO: 105446 - DNA, 25 bp, Rattus norvegicus
agaagctgccggtatgagaactcac

SEQ ID NO: 105447 - DNA, 25 bp, Rattus norvegicus
agaagctgcctgatcacctttgagt

SEQ ID NO: 105448 - DNA, 25 bp, Rattus norvegicus
agaagctgcctgttcacctttgagt

SEQ ID NO: 105449 - DNA, 25 bp, Rattus norvegicus
agaagctgcggcactccttgacaga

SEQ ID NO: 105450 - DNA, 25 bp, Rattus norvegicus
agaagctgcggctctccttgacaga

SEQ ID NO: 105451 - DNA, 25 bp, Rattus norvegicus
agaagctgcgtgagaaaggccccgt

SEQ ID NO: 105452 - DNA, 25 bp, Rattus norvegicus
agaagctgcgtgtgaaaggccccgt

SEQ ID NO: 105453 - DNA, 25 bp, Rattus norvegicus
agaagctgctccaacagactcttag

SEQ ID NO: 105454 - DNA, 25 bp, Rattus norvegicus
agaagctgctcctacagactcttag

SEQ ID NO: 105455 - DNA, 25 bp, Rattus norvegicus
agaagctgctctatcgggaaatgga

SEQ ID NO: 105456 - DNA, 25 bp, Rattus norvegicus
agaagctgctctctgagtttgtcct

SEQ ID NO: 105457 - DNA, 25 bp, Rattus norvegicus
agaagctgctctgtgagtttgtcct

SEQ ID NO: 105458 - DNA, 25 bp, Rattus norvegicus
agaagctgctctttcgggaaatgga

SEQ ID NO: 105459 - DNA, 25 bp, Rattus norvegicus
agaagctgctgacctcgggaatcct

SEQ ID NO: 105460 - DNA, 25 bp, Rattus norvegicus
agaagctgctgagctcgggaatcct

SEQ ID NO: 105461 - DNA, 25 bp, Rattus norvegicus
agaagctgctgcacacgtggaagcg

SEQ ID NO: 105462 - DNA, 25 bp, Rattus norvegicus
agaagctgctgctcacgtggaagcg

SEQ ID NO: 105463 - DNA, 25 bp, Rattus norvegicus
agaagctgcttcagaggtttgccct

SEQ ID NO: 105464 - DNA, 25 bp, Rattus norvegicus
agaagctgcttctgaggtttgccct

SEQ ID NO: 105465 - DNA, 25 bp, Rattus norvegicus
agaagctggaacctgaggccatcct

SEQ ID NO: 105466 - DNA, 25 bp, Rattus norvegicus
agaagctggaacgtgaggccatcct

SEQ ID NO: 105467 - DNA, 25 bp, Rattus norvegicus
agaagctggaagatggccccaaatt

SEQ ID NO: 105468 - DNA, 25 bp, Rattus norvegicus
agaagctggaagttggccccaaatt

SEQ ID NO: 105469 - DNA, 25 bp, Rattus norvegicus
agaagctggaatcctttctgcccag

SEQ ID NO: 105470 - DNA, 25 bp, Rattus norvegicus
agaagctggaatgctttctgcccag

SEQ ID NO: 105471 - DNA, 25 bp, Rattus norvegicus
agaagctggcctatgatcctctaac

SEQ ID NO: 105472 - DNA, 25 bp, Rattus norvegicus
agaagctggcctttgatcctctaac

SEQ ID NO: 105473 - DNA, 25 bp, Rattus norvegicus
agaagctgggctacttctgacctgg

SEQ ID NO: 105474 - DNA, 25 bp, Rattus norvegicus
agaagctgggcttcttctgacctgg

SEQ ID NO: 105475 - DNA, 25 bp, Rattus norvegicus
agaagctgtacacgcagtatcacgt

SEQ ID NO: 105476 - DNA, 25 bp, Rattus norvegicus
agaagctgtacaggcagtatcacgt

SEQ ID NO: 105477 - DNA, 25 bp, Rattus norvegicus
agaagctgtcacagtgaggcctgtg

SEQ ID NO: 105478 - DNA, 25 bp, Rattus norvegicus
agaagctgtcacatctttgtgctgt

SEQ ID NO: 105479 - DNA, 25 bp, Rattus norvegicus
agaagctgtcactgtgaggcctgtg

SEQ ID NO: 105480 - DNA, 25 bp, Rattus norvegicus
agaagctgtcacttctttgtgctgt

SEQ ID NO: 105481 - DNA, 25 bp, Rattus norvegicus
agaagctgtccacaccttcagttac

SEQ ID NO: 105482 - DNA, 25 bp, Rattus norvegicus
agaagctgtccagaccttcagttac

SEQ ID NO: 105483 - DNA, 25 bp, Rattus norvegicus
agaagctgtcgcatgagctgctgga

SEQ ID NO: 105484 - DNA, 25 bp, Rattus norvegicus
agaagctgtcgcttgagctgctgga

SEQ ID NO: 105485 - DNA, 25 bp, Rattus norvegicus
agaagctgtcggagccctggaaagt

SEQ ID NO: 105486 - DNA, 25 bp, Rattus norvegicus
agaagctgtcggtgccctggaaagt

SEQ ID NO: 105487 - DNA, 25 bp, Rattus norvegicus
agaagctgtgagcactctgcccagg

SEQ ID NO: 105488 - DNA, 25 bp, Rattus norvegicus
agaagctgtgaggactctgcccagg

SEQ ID NO: 105489 - DNA, 25 bp, Rattus norvegicus
agaagctgtggtccagttttgtccc

SEQ ID NO: 105490 - DNA, 25 bp, Rattus norvegicus
agaagctgtggtgcagttttgtccc

SEQ ID NO: 105491 - DNA, 25 bp, Rattus norvegicus
agaagctgttcaaagtctcctgcac

SEQ ID NO: 105492 - DNA, 25 bp, Rattus norvegicus
agaagctgttcatagtctcctgcac

SEQ ID NO: 105493 - DNA, 25 bp, Rattus norvegicus
agaagctgttctagtcactgatgga

SEQ ID NO: 105494 - DNA, 25 bp, Rattus norvegicus
agaagctgttcttgtcactgatgga

SEQ ID NO: 105495 - DNA, 25 bp, Rattus norvegicus
agaagctgttgccagtgtctccaag

SEQ ID NO: 105496 - DNA, 25 bp, Rattus norvegicus
agaagctgttgcgagtgtctccaag

SEQ ID NO: 105497 - DNA, 25 bp, Rattus norvegicus
agaagctgttttaccattactgtgt

SEQ ID NO: 105498 - DNA, 25 bp, Rattus norvegicus
agaagctgtttttccattactgtgt

SEQ ID NO: 105499 - DNA, 25 bp, Rattus norvegicus
agaagcttagctcgtacttccactt

SEQ ID NO: 105500 - DNA, 25 bp, Rattus norvegicus
agaagcttagctggtacttccactt

SEQ ID NO: 105501 - DNA, 25 bp, Rattus norvegicus
agaagcttcagcatttatgtcaata

SEQ ID NO: 105502 - DNA, 25 bp, Rattus norvegicus
agaagcttcagcttttatgtcaata

SEQ ID NO: 105503 - DNA, 25 bp, Rattus norvegicus
agaagcttcagtcccggttgttgta

SEQ ID NO: 105504 - DNA, 25 bp, Rattus norvegicus
agaagcttcagtgccggttgttgta

SEQ ID NO: 105505 - DNA, 25 bp, Rattus norvegicus
agaagcttccctacagagtgacctg

SEQ ID NO: 105506 - DNA, 25 bp, Rattus norvegicus
agaagcttcccttcagagtgacctg

SEQ ID NO: 105507 - DNA, 25 bp, Rattus norvegicus
agaagcttccttactttgtgagaat

SEQ ID NO: 105508 - DNA, 25 bp, Rattus norvegicus
agaagcttcctttctttgtgagaat

SEQ ID NO: 105509 - DNA, 25 bp, Rattus norvegicus
agaagcttcgggatgagccttgcac

SEQ ID NO: 105510 - DNA, 25 bp, Rattus norvegicus
agaagcttcgggttgagccttgcac

SEQ ID NO: 105511 - DNA, 25 bp, Rattus norvegicus
agaagcttctccagacaacaggcct

SEQ ID NO: 105512 - DNA, 25 bp, Rattus norvegicus
agaagcttctcctgacaacaggcct

SEQ ID NO: 105513 - DNA, 25 bp, Rattus norvegicus
agaagcttctctataacacgtgcca

SEQ ID NO: 105514 - DNA, 25 bp, Rattus norvegicus
agaagcttctctcgtcaagttgcaa

SEQ ID NO: 105515 - DNA, 25 bp, Rattus norvegicus
agaagcttctctggtcaagttgcaa

SEQ ID NO: 105516 - DNA, 25 bp, Rattus norvegicus
agaagcttctctttaacacgtgcca

SEQ ID NO: 105517 - DNA, 25 bp, Rattus norvegicus
agaagcttctgcagaggatcctcaa

SEQ ID NO: 105518 - DNA, 25 bp, Rattus norvegicus
agaagcttctgctgaggatcctcaa

SEQ ID NO: 105519 - DNA, 25 bp, Rattus norvegicus
agaagcttcttcagtgcagggtgaa

SEQ ID NO: 105520 - DNA, 25 bp, Rattus norvegicus
agaagcttcttctgtgcagggtgaa

SEQ ID NO: 105521 - DNA, 25 bp, Rattus norvegicus
agaagcttgatgctgcctctagagc

SEQ ID NO: 105522 - DNA, 25 bp, Rattus norvegicus
agaagcttgatggtgcctctagagc

SEQ ID NO: 105523 - DNA, 25 bp, Rattus norvegicus
agaagcttggccagcacttgacctg

SEQ ID NO: 105524 - DNA, 25 bp, Rattus norvegicus
agaagcttggcctgcacttgacctg

SEQ ID NO: 105525 - DNA, 25 bp, Rattus norvegicus
agaagcttgtccagctgctgctatc

SEQ ID NO: 105526 - DNA, 25 bp, Rattus norvegicus
agaagcttgtcctgctgctgctatc

SEQ ID NO: 105527 - DNA, 25 bp, Rattus norvegicus
agaagctttcagactccgtttcagt

SEQ ID NO: 105528 - DNA, 25 bp, Rattus norvegicus
agaagctttcagtctccgtttcagt

SEQ ID NO: 105529 - DNA, 25 bp, Rattus norvegicus
agaagctttcctcaagtgcgcacgc

SEQ ID NO: 105530 - DNA, 25 bp, Rattus norvegicus
agaagctttcctgaagtgcgcacgc

SEQ ID NO: 105531 - DNA, 25 bp, Rattus norvegicus
agaaggaaccgcacctttattctca

SEQ ID NO: 105532 - DNA, 25 bp, Rattus norvegicus
agaaggaaccgctcctttattctca

SEQ ID NO: 105533 - DNA, 25 bp, Rattus norvegicus
agaaggaactgcacgctgctgaggt

SEQ ID NO: 105534 - DNA, 25 bp, Rattus norvegicus
agaaggaactgctcgctgctgaggt

SEQ ID NO: 105535 - DNA, 25 bp, Rattus norvegicus
agaaggaactgtcgctcagccagaa

SEQ ID NO: 105536 - DNA, 25 bp, Rattus norvegicus
agaaggaactgtggctcagccagaa

SEQ ID NO: 105537 - DNA, 25 bp, Rattus norvegicus
agaaggaagactcaccaggcatggt

SEQ ID NO: 105538 - DNA, 25 bp, Rattus norvegicus
agaaggaagactgaccaggcatggt

SEQ ID NO: 105539 - DNA, 25 bp, Rattus norvegicus
agaaggaatgacctggaactgcaga

SEQ ID NO: 105540 - DNA, 25 bp, Rattus norvegicus
agaaggaatgacgtggaactgcaga

SEQ ID NO: 105541 - DNA, 25 bp, Rattus norvegicus
agaaggacaagtactcgctggccgg

SEQ ID NO: 105542 - DNA, 25 bp, Rattus norvegicus
agaaggacaagttctcgctggccgg

SEQ ID NO: 105543 - DNA, 25 bp, Rattus norvegicus
agaaggacaccccgacaatgctggc

SEQ ID NO: 105544 - DNA, 25 bp, Rattus norvegicus
agaaggacacccggacaatgctggc

SEQ ID NO: 105545 - DNA, 25 bp, Rattus norvegicus
agaaggacacgcaaacgctcatcac

SEQ ID NO: 105546 - DNA, 25 bp, Rattus norvegicus
agaaggacacgctaacgctcatcac

SEQ ID NO: 105547 - DNA, 25 bp, Rattus norvegicus
agaaggacatctctgcaggccctgc

SEQ ID NO: 105548 - DNA, 25 bp, Rattus norvegicus
agaaggacatctgtgcaggccctgc

SEQ ID NO: 105549 - DNA, 25 bp, Rattus norvegicus
agaaggacatgacctcccttatgcc

SEQ ID NO: 105550 - DNA, 25 bp, Rattus norvegicus
agaaggacatgagctcccttatgcc

SEQ ID NO: 105551 - DNA, 25 bp, Rattus norvegicus
agaaggacatgcaggctctacttcc

SEQ ID NO: 105552 - DNA, 25 bp, Rattus norvegicus
agaaggacatgctggctctacttcc

SEQ ID NO: 105553 - DNA, 25 bp, Rattus norvegicus
agaaggaccaaccagcacagcgaaa

SEQ ID NO: 105554 - DNA, 25 bp, Rattus norvegicus
agaaggaccaacgagcacagcgaaa

SEQ ID NO: 105555 - DNA, 25 bp, Rattus norvegicus
agaaggaccagcacatcaccaagtg

SEQ ID NO: 105556 - DNA, 25 bp, Rattus norvegicus
agaaggaccagctcatcaccaagtg

SEQ ID NO: 105557 - DNA, 25 bp, Rattus norvegicus
agaaggaccctcagccagcacagag

SEQ ID NO: 105558 - DNA, 25 bp, Rattus norvegicus
agaaggaccctctgccagcacagag

SEQ ID NO: 105559 - DNA, 25 bp, Rattus norvegicus
agaaggaccctgatatgttggctaa

SEQ ID NO: 105560 - DNA, 25 bp, Rattus norvegicus
agaaggaccctgttatgttggctaa

SEQ ID NO: 105561 - DNA, 25 bp, Rattus norvegicus
agaaggacctgcagggatctcagtc

SEQ ID NO: 105562 - DNA, 25 bp, Rattus norvegicus
agaaggacctgctgggatctcagtc

SEQ ID NO: 105563 - DNA, 25 bp, Rattus norvegicus
agaaggacgaagagctgcgccgcat

SEQ ID NO: 105564 - DNA, 25 bp, Rattus norvegicus
agaaggacgaagtgctgcgccgcat

SEQ ID NO: 105565 - DNA, 25 bp, Rattus norvegicus
agaaggacgcggagaaggacaagga

SEQ ID NO: 105566 - DNA, 25 bp, Rattus norvegicus
agaaggacgcggtgaaggacaagga

SEQ ID NO: 105567 - DNA, 25 bp, Rattus norvegicus
agaaggacgctcacctggctgagct

SEQ ID NO: 105568 - DNA, 25 bp, Rattus norvegicus
agaaggacgctctcctggctgagct

SEQ ID NO: 105569 - DNA, 25 bp, Rattus norvegicus
agaaggacgtctcatttgccgccaa

SEQ ID NO: 105570 - DNA, 25 bp, Rattus norvegicus
agaaggacgtctgatttgccgccaa

SEQ ID NO: 105571 - DNA, 25 bp, Rattus norvegicus
agaaggactagtacctccgaggcat

SEQ ID NO: 105572 - DNA, 25 bp, Rattus norvegicus
agaaggactagttcctccgaggcat

SEQ ID NO: 105573 - DNA, 25 bp, Rattus norvegicus
agaaggactcccaggatccagcaac

SEQ ID NO: 105574 - DNA, 25 bp, Rattus norvegicus
agaaggactccctggatccagcaac

SEQ ID NO: 105575 - DNA, 25 bp, Rattus norvegicus
agaaggactgagctctgcccggaca

SEQ ID NO: 105576 - DNA, 25 bp, Rattus norvegicus
agaaggactgaggtctgcccggaca

SEQ ID NO: 105577 - DNA, 25 bp, Rattus norvegicus
agaaggactgcaagaggcgatacaa

SEQ ID NO: 105578 - DNA, 25 bp, Rattus norvegicus
agaaggactgcatgaggcgatacaa

SEQ ID NO: 105579 - DNA, 25 bp, Rattus norvegicus
agaaggacttggattcactcggcat

SEQ ID NO: 105580 - DNA, 25 bp, Rattus norvegicus
agaaggacttggtttcactcggcat

SEQ ID NO: 105581 - DNA, 25 bp, Rattus norvegicus
agaaggagagcaagactacagtcag

SEQ ID NO: 105582 - DNA, 25 bp, Rattus norvegicus
agaaggagagcatgactacagtcag

SEQ ID NO: 105583 - DNA, 25 bp, Rattus norvegicus
agaaggagcacgagccgacctggct

SEQ ID NO: 105584 - DNA, 25 bp, Rattus norvegicus
agaaggagcacgtgccgacctggct

SEQ ID NO: 105585 - DNA, 25 bp, Rattus norvegicus
agaaggagccagagcactctcctgt

SEQ ID NO: 105586 - DNA, 25 bp, Rattus norvegicus
agaaggagccagtgcactctcctgt

SEQ ID NO: 105587 - DNA, 25 bp, Rattus norvegicus
agaaggagcctcctgtgagtcagcc

SEQ ID NO: 105588 - DNA, 25 bp, Rattus norvegicus
agaaggagcctcgtgtgagtcagcc

SEQ ID NO: 105589 - DNA, 25 bp, Rattus norvegicus
agaaggagcgcacaccctgaggtct

SEQ ID NO: 105590 - DNA, 25 bp, Rattus norvegicus
agaaggagcgcaccaagctcatcac

SEQ ID NO: 105591 - DNA, 25 bp, Rattus norvegicus
agaaggagcgcagaccctgaggtct

SEQ ID NO: 105592 - DNA, 25 bp, Rattus norvegicus
agaaggagcgcagcaagctcatcac

SEQ ID NO: 105593 - DNA, 25 bp, Rattus norvegicus
agaaggagctctaggaccagcgatt

SEQ ID NO: 105594 - DNA, 25 bp, Rattus norvegicus
agaaggagctcttggaccagcgatt

SEQ ID NO: 105595 - DNA, 25 bp, Rattus norvegicus
agaaggagctgacctgtcccagtca

SEQ ID NO: 105596 - DNA, 25 bp, Rattus norvegicus
agaaggagctgagctgtcccagtca

SEQ ID NO: 105597 - DNA, 25 bp, Rattus norvegicus
agaaggagctgcagtccctgtaccg

SEQ ID NO: 105598 - DNA, 25 bp, Rattus norvegicus
agaaggagctgctgtccctgtaccg

SEQ ID NO: 105599 - DNA, 25 bp, Rattus norvegicus
agaaggagcttaacaccttgcgagt

SEQ ID NO: 105600 - DNA, 25 bp, Rattus norvegicus
agaaggagcttatcaccttgcgagt

SEQ ID NO: 105601 - DNA, 25 bp, Rattus norvegicus
agaaggagcttcctttcttcatcca

SEQ ID NO: 105602 - DNA, 25 bp, Rattus norvegicus
agaaggagcttcgtttcttcatcca

SEQ ID NO: 105603 - DNA, 25 bp, Rattus norvegicus
agaaggaggcctagaacacccgctg

SEQ ID NO: 105604 - DNA, 25 bp, Rattus norvegicus
agaaggaggccttgaacacccgctg

SEQ ID NO: 105605 - DNA, 25 bp, Rattus norvegicus
agaaggagtcagacgcgtgtccatg

SEQ ID NO: 105606 - DNA, 25 bp, Rattus norvegicus
agaaggagtcagctcggtccatcgc

SEQ ID NO: 105607 - DNA, 25 bp, Rattus norvegicus
agaaggagtcaggtcggtccatcgc

SEQ ID NO: 105608 - DNA, 25 bp, Rattus norvegicus
agaaggagtcagtcgcgtgtccatg

SEQ ID NO: 105609 - DNA, 25 bp, Rattus norvegicus
agaaggagtgcactggccgggatca

SEQ ID NO: 105610 - DNA, 25 bp, Rattus norvegicus
agaaggagtgcagtggccgggatca

SEQ ID NO: 105611 - DNA, 25 bp, Rattus norvegicus
agaaggagtggaactgggcagaggt

SEQ ID NO: 105612 - DNA, 25 bp, Rattus norvegicus
agaaggagtggatctgggcagaggt

SEQ ID NO: 105613 - DNA, 25 bp, Rattus norvegicus
agaaggagtggtagcgctctcctga

SEQ ID NO: 105614 - DNA, 25 bp, Rattus norvegicus
agaaggagtggttgcgctctcctga

SEQ ID NO: 105615 - DNA, 25 bp, Rattus norvegicus
agaaggagttccatgagttaaatac

SEQ ID NO: 105616 - DNA, 25 bp, Rattus norvegicus
agaaggagttccctggcgattccac

SEQ ID NO: 105617 - DNA, 25 bp, Rattus norvegicus
agaaggagttccgtggcgattccac

SEQ ID NO: 105618 - DNA, 25 bp, Rattus norvegicus
agaaggagttccttgagttaaatac

SEQ ID NO: 105619 - DNA, 25 bp, Rattus norvegicus
agaaggagtttgcagccgactgcaa

SEQ ID NO: 105620 - DNA, 25 bp, Rattus norvegicus
agaaggagtttggagccgactgcaa

SEQ ID NO: 105621 - DNA, 25 bp, Rattus norvegicus
agaaggatactactgcgggaaaata

SEQ ID NO: 105622 - DNA, 25 bp, Rattus norvegicus
agaaggatactagtgcgggaaaata

SEQ ID NO: 105623 - DNA, 25 bp, Rattus norvegicus
agaaggatagctctcatccgacccc

SEQ ID NO: 105624 - DNA, 25 bp, Rattus norvegicus
agaaggatagctgtcatccgacccc

SEQ ID NO: 105625 - DNA, 25 bp, Rattus norvegicus
agaaggatccacagtaccggcggaa

SEQ ID NO: 105626 - DNA, 25 bp, Rattus norvegicus
agaaggatccactgtaccggcggaa

SEQ ID NO: 105627 - DNA, 25 bp, Rattus norvegicus
agaaggatcgacacggtcaccaaga

SEQ ID NO: 105628 - DNA, 25 bp, Rattus norvegicus
agaaggatcgactcggtcaccaaga

SEQ ID NO: 105629 - DNA, 25 bp, Rattus norvegicus
agaaggatgcagacctgcgggccat

SEQ ID NO: 105630 - DNA, 25 bp, Rattus norvegicus
agaaggatgcagtcctgcgggccat

SEQ ID NO: 105631 - DNA, 25 bp, Rattus norvegicus
agaaggatgccgcagaccattatct

SEQ ID NO: 105632 - DNA, 25 bp, Rattus norvegicus
agaaggatgccggagaccattatct

SEQ ID NO: 105633 - DNA, 25 bp, Rattus norvegicus
agaaggatggacagactgcccacag

SEQ ID NO: 105634 - DNA, 25 bp, Rattus norvegicus
agaaggatggactgactgcccacag

SEQ ID NO: 105635 - DNA, 25 bp, Rattus norvegicus
agaaggatggtgcttcggctcttta

SEQ ID NO: 105636 - DNA, 25 bp, Rattus norvegicus
agaaggatggtggttcggctcttta

SEQ ID NO: 105637 - DNA, 25 bp, Rattus norvegicus
agaaggatgttcaccggcttcaggt

SEQ ID NO: 105638 - DNA, 25 bp, Rattus norvegicus
agaaggatgttctccggcttcaggt

SEQ ID NO: 105639 - DNA, 25 bp, Rattus norvegicus
agaaggattccacctagggtgatca

SEQ ID NO: 105640 - DNA, 25 bp, Rattus norvegicus
agaaggattccagctagggtgatca

SEQ ID NO: 105641 - DNA, 25 bp, Rattus norvegicus
agaaggatttgacagaccccatcac

SEQ ID NO: 105642 - DNA, 25 bp, Rattus norvegicus
agaaggatttgagagaccccatcac

SEQ ID NO: 105643 - DNA, 25 bp, Rattus norvegicus
agaaggcaaaagcaggcggcatctc

SEQ ID NO: 105644 - DNA, 25 bp, Rattus norvegicus
agaaggcaaaaggaggcggcatctc

SEQ ID NO: 105645 - DNA, 25 bp, Rattus norvegicus
agaaggcaagctacctcagagctca

SEQ ID NO: 105646 - DNA, 25 bp, Rattus norvegicus
agaaggcaagcttcctcagagctca

SEQ ID NO: 105647 - DNA, 25 bp, Rattus norvegicus
agaaggcaaggtacagctcctggct

SEQ ID NO: 105648 - DNA, 25 bp, Rattus norvegicus
agaaggcaaggttcagctcctggct

SEQ ID NO: 105649 - DNA, 25 bp, Rattus norvegicus
agaaggcaatgaagtcatgactcca

SEQ ID NO: 105650 - DNA, 25 bp, Rattus norvegicus
agaaggcaatgatgtcatgactcca

SEQ ID NO: 105651 - DNA, 25 bp, Rattus norvegicus
agaaggcacagtacactgcgcaggt

SEQ ID NO: 105652 - DNA, 25 bp, Rattus norvegicus
agaaggcacagttcactgcgcaggt

SEQ ID NO: 105653 - DNA, 25 bp, Rattus norvegicus
agaaggcaccctcgaactggttcct

SEQ ID NO: 105654 - DNA, 25 bp, Rattus norvegicus
agaaggcaccctggaactggttcct

SEQ ID NO: 105655 - DNA, 25 bp, Rattus norvegicus
agaaggcactcgaggccaaggctct

SEQ ID NO: 105656 - DNA, 25 bp, Rattus norvegicus
agaaggcactcgtggccaaggctct

SEQ ID NO: 105657 - DNA, 25 bp, Rattus norvegicus
agaaggcacttacaccactccaggg

SEQ ID NO: 105658 - DNA, 25 bp, Rattus norvegicus
agaaggcacttagaccactccaggg

SEQ ID NO: 105659 - DNA, 25 bp, Rattus norvegicus
agaaggcagaagcagtccagccttg

SEQ ID NO: 105660 - DNA, 25 bp, Rattus norvegicus
agaaggcagaaggagtccagccttg

SEQ ID NO: 105661 - DNA, 25 bp, Rattus norvegicus
agaaggcagattctctcgccaaaga

SEQ ID NO: 105662 - DNA, 25 bp, Rattus norvegicus
agaaggcagattgtctcgccaaaga

SEQ ID NO: 105663 - DNA, 25 bp, Rattus norvegicus
agaaggcagcctacgcggcagaaat

SEQ ID NO: 105664 - DNA, 25 bp, Rattus norvegicus
agaaggcagccttcgcggcagaaat

SEQ ID NO: 105665 - DNA, 25 bp, Rattus norvegicus
agaaggcagctcagtatcctacctt

SEQ ID NO: 105666 - DNA, 25 bp, Rattus norvegicus
agaaggcagctctgtatcctacctt

SEQ ID NO: 105667 - DNA, 25 bp, Rattus norvegicus
agaaggcagctgatggacacctctt

SEQ ID NO: 105668 - DNA, 25 bp, Rattus norvegicus
agaaggcagctgttggacacctctt

SEQ ID NO: 105669 - DNA, 25 bp, Rattus norvegicus
agaaggcaggcaacgccatagtgga

SEQ ID NO: 105670 - DNA, 25 bp, Rattus norvegicus
agaaggcaggcaagacccagggctt

SEQ ID NO: 105671 - DNA, 25 bp, Rattus norvegicus
agaaggcaggcaagtctactccgcg

SEQ ID NO: 105672 - DNA, 25 bp, Rattus norvegicus
agaaggcaggcatcgccatagtgga

SEQ ID NO: 105673 - DNA, 25 bp, Rattus norvegicus
agaaggcaggcatgacccagggctt

SEQ ID NO: 105674 - DNA, 25 bp, Rattus norvegicus
agaaggcaggcatgtctactccgcg

SEQ ID NO: 105675 - DNA, 25 bp, Rattus norvegicus
agaaggcagggcactccggctactg

SEQ ID NO: 105676 - DNA, 25 bp, Rattus norvegicus
agaaggcagggctctccggctactg

SEQ ID NO: 105677 - DNA, 25 bp, Rattus norvegicus
agaaggcagtcaaccccgggagaag

SEQ ID NO: 105678 - DNA, 25 bp, Rattus norvegicus
agaaggcagtcatccccgggagaag

SEQ ID NO: 105679 - DNA, 25 bp, Rattus norvegicus
agaaggcatagcagtccactgcaca

SEQ ID NO: 105680 - DNA, 25 bp, Rattus norvegicus
agaaggcatagctgtccactgcaca

SEQ ID NO: 105681 - DNA, 25 bp, Rattus norvegicus
agaaggcattgcactctgtagcaga

SEQ ID NO: 105682 - DNA, 25 bp, Rattus norvegicus
agaaggcattgctctctgtagcaga

SEQ ID NO: 105683 - DNA, 25 bp, Rattus norvegicus
agaaggccaatcactcatttgaccg

SEQ ID NO: 105684 - DNA, 25 bp, Rattus norvegicus
agaaggccaatctctcatttgaccg

SEQ ID NO: 105685 - DNA, 25 bp, Rattus norvegicus
agaaggccacaccatttgtgctctg

SEQ ID NO: 105686 - DNA, 25 bp, Rattus norvegicus
agaaggccacacgatttgtgctctg

SEQ ID NO: 105687 - DNA, 25 bp, Rattus norvegicus
agaaggccacagacagtgctgtgtt

SEQ ID NO: 105688 - DNA, 25 bp, Rattus norvegicus
agaaggccacagtcagtgctgtgtt

SEQ ID NO: 105689 - DNA, 25 bp, Rattus norvegicus
agaaggccacttcatcagagaccct

SEQ ID NO: 105690 - DNA, 25 bp, Rattus norvegicus
agaaggccacttgatcagagaccct

SEQ ID NO: 105691 - DNA, 25 bp, Rattus norvegicus
agaaggccagctaggatccacgtac

SEQ ID NO: 105692 - DNA, 25 bp, Rattus norvegicus
agaaggccagcttggatccacgtac

SEQ ID NO: 105693 - DNA, 25 bp, Rattus norvegicus
agaaggccaggcctgaggaccccgc

SEQ ID NO: 105694 - DNA, 25 bp, Rattus norvegicus
agaaggccaggcgtgaggaccccgc

SEQ ID NO: 105695 - DNA, 25 bp, Rattus norvegicus
agaaggccagtcaatcaaatcagat

SEQ ID NO: 105696 - DNA, 25 bp, Rattus norvegicus
agaaggccagtctatcaaatcagat

SEQ ID NO: 105697 - DNA, 25 bp, Rattus norvegicus
agaaggccatgcagacggtgtatct

SEQ ID NO: 105698 - DNA, 25 bp, Rattus norvegicus
agaaggccatgctgacggtgtatct

SEQ ID NO: 105699 - DNA, 25 bp, Rattus norvegicus
agaaggcccataacttttccctgga

SEQ ID NO: 105700 - DNA, 25 bp, Rattus norvegicus
agaaggcccatatcttttccctgga

SEQ ID NO: 105701 - DNA, 25 bp, Rattus norvegicus
agaaggccccaaagcacagccctgg

SEQ ID NO: 105702 - DNA, 25 bp, Rattus norvegicus
agaaggccccaatgcacagccctgg

SEQ ID NO: 105703 - DNA, 25 bp, Rattus norvegicus
agaaggcccctactagcttttctgt

SEQ ID NO: 105704 - DNA, 25 bp, Rattus norvegicus
agaaggcccctagtagcttttctgt

SEQ ID NO: 105705 - DNA, 25 bp, Rattus norvegicus
agaaggcccgagcttagacgtgcac

SEQ ID NO: 105706 - DNA, 25 bp, Rattus norvegicus
agaaggcccgaggttagacgtgcac

SEQ ID NO: 105707 - DNA, 25 bp, Rattus norvegicus
agaaggcccggtatagccaccatag

SEQ ID NO: 105708 - DNA, 25 bp, Rattus norvegicus
agaaggcccggtttagccaccatag

SEQ ID NO: 105709 - DNA, 25 bp, Rattus norvegicus
agaaggccctgcaggccaatcctta

SEQ ID NO: 105710 - DNA, 25 bp, Rattus norvegicus
agaaggccctgctggccaatcctta

SEQ ID NO: 105711 - DNA, 25 bp, Rattus norvegicus
agaaggccctggcagtgttcactct

SEQ ID NO: 105712 - DNA, 25 bp, Rattus norvegicus
agaaggccctgggagtgttcactct

SEQ ID NO: 105713 - DNA, 25 bp, Rattus norvegicus
agaaggccgacaacctggagatggc

SEQ ID NO: 105714 - DNA, 25 bp, Rattus norvegicus
agaaggccgacatcctggagatggc

SEQ ID NO: 105715 - DNA, 25 bp, Rattus norvegicus
agaaggccgacgagtcggcggccat

SEQ ID NO: 105716 - DNA, 25 bp, Rattus norvegicus
agaaggccgacgtgtcggcggccat

SEQ ID NO: 105717 - DNA, 25 bp, Rattus norvegicus
agaaggccgcatcatcttcctgggt

SEQ ID NO: 105718 - DNA, 25 bp, Rattus norvegicus
agaaggccgcatgatcttcctgggt

SEQ ID NO: 105719 - DNA, 25 bp, Rattus norvegicus
agaaggcctatcaatgtgcagcccc

SEQ ID NO: 105720 - DNA, 25 bp, Rattus norvegicus
agaaggcctatctatgtgcagcccc

SEQ ID NO: 105721 - DNA, 25 bp, Rattus norvegicus
agaaggcctcacagactttggctca

SEQ ID NO: 105722 - DNA, 25 bp, Rattus norvegicus
agaaggcctcactgactttggctca

SEQ ID NO: 105723 - DNA, 25 bp, Rattus norvegicus
agaaggcctcccctgtgcatacata

SEQ ID NO: 105724 - DNA, 25 bp, Rattus norvegicus
agaaggcctcccgtgtgcatacata

SEQ ID NO: 105725 - DNA, 25 bp, Rattus norvegicus
agaaggcctcgtccagaggcgctct

SEQ ID NO: 105726 - DNA, 25 bp, Rattus norvegicus
agaaggcctcgtgcagaggcgctct

SEQ ID NO: 105727 - DNA, 25 bp, Rattus norvegicus
agaaggcctctgaagctgatgcact

SEQ ID NO: 105728 - DNA, 25 bp, Rattus norvegicus
agaaggcctctgtagctgatgcact

SEQ ID NO: 105729 - DNA, 25 bp, Rattus norvegicus
agaaggcctgtcacgccaacatgtt

SEQ ID NO: 105730 - DNA, 25 bp, Rattus norvegicus
agaaggcctgtcagagaggtcccac

SEQ ID NO: 105731 - DNA, 25 bp, Rattus norvegicus
agaaggcctgtctcgccaacatgtt

SEQ ID NO: 105732 - DNA, 25 bp, Rattus norvegicus
agaaggcctgtctgagaggtcccac

SEQ ID NO: 105733 - DNA, 25 bp, Rattus norvegicus
agaaggccttctcgcagccctacag

SEQ ID NO: 105734 - DNA, 25 bp, Rattus norvegicus
agaaggccttctggcagccctacag

SEQ ID NO: 105735 - DNA, 25 bp, Rattus norvegicus
agaaggcctttcagtgcagtagaaa

SEQ ID NO: 105736 - DNA, 25 bp, Rattus norvegicus
agaaggcctttctgtgcagtagaaa

SEQ ID NO: 105737 - DNA, 25 bp, Rattus norvegicus
agaaggcgctagactcagagacccc

SEQ ID NO: 105738 - DNA, 25 bp, Rattus norvegicus
agaaggcgctagtctcagagacccc

SEQ ID NO: 105739 - DNA, 25 bp, Rattus norvegicus
agaaggcggcctaacaaagaatgta

SEQ ID NO: 105740 - DNA, 25 bp, Rattus norvegicus
agaaggcggccttacaaagaatgta

SEQ ID NO: 105741 - DNA, 25 bp, Rattus norvegicus
agaaggcggtctacctcaaacagta

SEQ ID NO: 105742 - DNA, 25 bp, Rattus norvegicus
agaaggcggtcttcctcaaacagta

SEQ ID NO: 105743 - DNA, 25 bp, Rattus norvegicus
agaaggcggttacaactgctcaaga

SEQ ID NO: 105744 - DNA, 25 bp, Rattus norvegicus
agaaggcggttagaactgctcaaga

SEQ ID NO: 105745 - DNA, 25 bp, Rattus norvegicus
agaaggcgttagatccactgaaagt

SEQ ID NO: 105746 - DNA, 25 bp, Rattus norvegicus
agaaggcgttagttccactgaaagt

SEQ ID NO: 105747 - DNA, 25 bp, Rattus norvegicus
agaaggctaaggagaccccagctac

SEQ ID NO: 105748 - DNA, 25 bp, Rattus norvegicus
agaaggctaaggtgaccccagctac

SEQ ID NO: 105749 - DNA, 25 bp, Rattus norvegicus
agaaggctacagatccatcctatcc

SEQ ID NO: 105750 - DNA, 25 bp, Rattus norvegicus
agaaggctacagttccatcctatcc

SEQ ID NO: 105751 - DNA, 25 bp, Rattus norvegicus
agaaggctactgatagtggcctgtg

SEQ ID NO: 105752 - DNA, 25 bp, Rattus norvegicus
agaaggctactgttagtggcctgtg

SEQ ID NO: 105753 - DNA, 25 bp, Rattus norvegicus
agaaggctatggcaacacgtcacag

SEQ ID NO: 105754 - DNA, 25 bp, Rattus norvegicus
agaaggctatgggaacacgtcacag

SEQ ID NO: 105755 - DNA, 25 bp, Rattus norvegicus
agaaggctcatccattcatctggtg

SEQ ID NO: 105756 - DNA, 25 bp, Rattus norvegicus
agaaggctcatcgattcatctggtg

SEQ ID NO: 105757 - DNA, 25 bp, Rattus norvegicus
agaaggctccatccatgcaactgca

SEQ ID NO: 105758 - DNA, 25 bp, Rattus norvegicus
agaaggctccatgcatgcaactgca

SEQ ID NO: 105759 - DNA, 25 bp, Rattus norvegicus
agaaggctcccgctgtagcacggct

SEQ ID NO: 105760 - DNA, 25 bp, Rattus norvegicus
agaaggctcccggtgtagcacggct

SEQ ID NO: 105761 - DNA, 25 bp, Rattus norvegicus
agaaggctctcccagtcctgaggag

SEQ ID NO: 105762 - DNA, 25 bp, Rattus norvegicus
agaaggctctccgagtcctgaggag

SEQ ID NO: 105763 - DNA, 25 bp, Rattus norvegicus
agaaggctctggacttggtgccact

SEQ ID NO: 105764 - DNA, 25 bp, Rattus norvegicus
agaaggctctggtcttggtgccact

SEQ ID NO: 105765 - DNA, 25 bp, Rattus norvegicus
agaaggctgaacagtcaagagcact

SEQ ID NO: 105766 - DNA, 25 bp, Rattus norvegicus
agaaggctgaactgtcaagagcact

SEQ ID NO: 105767 - DNA, 25 bp, Rattus norvegicus
agaaggctgcaacatcctgtgagga

SEQ ID NO: 105768 - DNA, 25 bp, Rattus norvegicus
agaaggctgcaagatcctgtgagga

SEQ ID NO: 105769 - DNA, 25 bp, Rattus norvegicus
agaaggctgccaagacgccgtgcgt

SEQ ID NO: 105770 - DNA, 25 bp, Rattus norvegicus
agaaggctgccatgacgccgtgcgt

SEQ ID NO: 105771 - DNA, 25 bp, Rattus norvegicus
agaaggctgcctagcactgagtgtg

SEQ ID NO: 105772 - DNA, 25 bp, Rattus norvegicus
agaaggctgccttgcactgagtgtg

SEQ ID NO: 105773 - DNA, 25 bp, Rattus norvegicus
agaaggctgctgataatggcctgtg

SEQ ID NO: 105774 - DNA, 25 bp, Rattus norvegicus
agaaggctgctgttaatggcctgtg

SEQ ID NO: 105775 - DNA, 25 bp, Rattus norvegicus
agaaggctggccatgaacctcagac

SEQ ID NO: 105776 - DNA, 25 bp, Rattus norvegicus
agaaggctggcccaatagtgcatat

SEQ ID NO: 105777 - DNA, 25 bp, Rattus norvegicus
agaaggctggccgaatagtgcatat

SEQ ID NO: 105778 - DNA, 25 bp, Rattus norvegicus
agaaggctggccttgaacctcagac

SEQ ID NO: 105779 - DNA, 25 bp, Rattus norvegicus
agaaggcttccaattactactaaag

SEQ ID NO: 105780 - DNA, 25 bp, Rattus norvegicus
agaaggcttccatttactactaaag

SEQ ID NO: 105781 - DNA, 25 bp, Rattus norvegicus
agaaggcttcggagctcaaggctca

SEQ ID NO: 105782 - DNA, 25 bp, Rattus norvegicus
agaaggcttcggtgctcaaggctca

SEQ ID NO: 105783 - DNA, 25 bp, Rattus norvegicus
agaaggcttctgctgtatccctgac

SEQ ID NO: 105784 - DNA, 25 bp, Rattus norvegicus
agaaggcttctggtgtatccctgac

SEQ ID NO: 105785 - DNA, 25 bp, Rattus norvegicus
agaaggcttcttcatggctgggctc

SEQ ID NO: 105786 - DNA, 25 bp, Rattus norvegicus
agaaggcttcttccagagctgtcct

SEQ ID NO: 105787 - DNA, 25 bp, Rattus norvegicus
agaaggcttcttgatggctgggctc

SEQ ID NO: 105788 - DNA, 25 bp, Rattus norvegicus
agaaggcttcttgcagagctgtcct

SEQ ID NO: 105789 - DNA, 25 bp, Rattus norvegicus
agaaggcttgacctgctttctcaat

SEQ ID NO: 105790 - DNA, 25 bp, Rattus norvegicus
agaaggcttgacgtgctttctcaat

SEQ ID NO: 105791 - DNA, 25 bp, Rattus norvegicus
agaaggcttgccaggtgacccagtc

SEQ ID NO: 105792 - DNA, 25 bp, Rattus norvegicus
agaaggcttgcctggtgacccagtc

SEQ ID NO: 105793 - DNA, 25 bp, Rattus norvegicus
agaaggcttggtactactcctggac

SEQ ID NO: 105794 - DNA, 25 bp, Rattus norvegicus
agaaggcttggttctactcctggac

SEQ ID NO: 105795 - DNA, 25 bp, Rattus norvegicus
agaaggctttgaactgtatccccag

SEQ ID NO: 105796 - DNA, 25 bp, Rattus norvegicus
agaaggctttgatctgtatccccag

SEQ ID NO: 105797 - DNA, 25 bp, Rattus norvegicus
agaaggctttgcattggtgctgcag

SEQ ID NO: 105798 - DNA, 25 bp, Rattus norvegicus
agaaggctttgctttggtgctgcag

SEQ ID NO: 105799 - DNA, 25 bp, Rattus norvegicus
agaagggaaccgaccagcagcctga

SEQ ID NO: 105800 - DNA, 25 bp, Rattus norvegicus
agaagggaaccgtccagcagcctga

SEQ ID NO: 105801 - DNA, 25 bp, Rattus norvegicus
agaagggacagtacccaagaggaag

SEQ ID NO: 105802 - DNA, 25 bp, Rattus norvegicus
agaagggacagttcccaagaggaag

SEQ ID NO: 105803 - DNA, 25 bp, Rattus norvegicus
agaagggaccaaacaaatgttattt

SEQ ID NO: 105804 - DNA, 25 bp, Rattus norvegicus
agaagggaccaatcaaatgttattt

SEQ ID NO: 105805 - DNA, 25 bp, Rattus norvegicus
agaagggaccacatgcatttgctgc

SEQ ID NO: 105806 - DNA, 25 bp, Rattus norvegicus
agaagggaccacttgcatttgctgc

SEQ ID NO: 105807 - DNA, 25 bp, Rattus norvegicus
agaagggaccgtaatgttagctcat

SEQ ID NO: 105808 - DNA, 25 bp, Rattus norvegicus
agaagggaccgttatgttagctcat

SEQ ID NO: 105809 - DNA, 25 bp, Rattus norvegicus
agaagggacgttcgcagctctgttc

SEQ ID NO: 105810 - DNA, 25 bp, Rattus norvegicus
agaagggacgttggcagctctgttc

SEQ ID NO: 105811 - DNA, 25 bp, Rattus norvegicus
agaagggagagtacaacgtccagga

SEQ ID NO: 105812 - DNA, 25 bp, Rattus norvegicus
agaagggagagttcaacgtccagga

SEQ ID NO: 105813 - DNA, 25 bp, Rattus norvegicus
agaagggagcctacttcctgtcaca

SEQ ID NO: 105814 - DNA, 25 bp, Rattus norvegicus
agaagggagccttcttcctgtcaca

SEQ ID NO: 105815 - DNA, 25 bp, Rattus norvegicus
agaagggagggaagccagttacatt

SEQ ID NO: 105816 - DNA, 25 bp, Rattus norvegicus
agaagggagggatgccagttacatt

SEQ ID NO: 105817 - DNA, 25 bp, Rattus norvegicus
agaagggagtgcacatgaccatagt

SEQ ID NO: 105818 - DNA, 25 bp, Rattus norvegicus
agaagggagtgctcatgaccatagt

SEQ ID NO: 105819 - DNA, 25 bp, Rattus norvegicus
agaagggatccacaccatgtttgaa

SEQ ID NO: 105820 - DNA, 25 bp, Rattus norvegicus
agaagggatccagaccatgtttgaa

SEQ ID NO: 105821 - DNA, 25 bp, Rattus norvegicus
agaagggatcccctgctttcaggtg

SEQ ID NO: 105822 - DNA, 25 bp, Rattus norvegicus
agaagggatcccgtgctttcaggtg

SEQ ID NO: 105823 - DNA, 25 bp, Rattus norvegicus
agaagggcaagcctcgccacagttc

SEQ ID NO: 105824 - DNA, 25 bp, Rattus norvegicus
agaagggcaagcgtcgccacagttc

SEQ ID NO: 105825 - DNA, 25 bp, Rattus norvegicus
agaagggcactcatttgctctggcg

SEQ ID NO: 105826 - DNA, 25 bp, Rattus norvegicus
agaagggcactcttttgctctggcg

SEQ ID NO: 105827 - DNA, 25 bp, Rattus norvegicus
agaagggcatcactgtctcaggcct

SEQ ID NO: 105828 - DNA, 25 bp, Rattus norvegicus
agaagggcatcagtgtctcaggcct

SEQ ID NO: 105829 - DNA, 25 bp, Rattus norvegicus
agaagggcattcagattggcatcca

SEQ ID NO: 105830 - DNA, 25 bp, Rattus norvegicus
agaagggcattctgattggcatcca

SEQ ID NO: 105831 - DNA, 25 bp, Rattus norvegicus
agaagggcattgaggctactggcat

SEQ ID NO: 105832 - DNA, 25 bp, Rattus norvegicus
agaagggcattgtggctactggcat

SEQ ID NO: 105833 - DNA, 25 bp, Rattus norvegicus
agaagggccaggatctctgagcaaa

SEQ ID NO: 105834 - DNA, 25 bp, Rattus norvegicus
agaagggccaggttctctgagcaaa

SEQ ID NO: 105835 - DNA, 25 bp, Rattus norvegicus
agaagggcccctctctttgatgcag

SEQ ID NO: 105836 - DNA, 25 bp, Rattus norvegicus
agaagggcccctgtctttgatgcag

SEQ ID NO: 105837 - DNA, 25 bp, Rattus norvegicus
agaagggccctgaagagctccaggc

SEQ ID NO: 105838 - DNA, 25 bp, Rattus norvegicus
agaagggccctgactctaagaatgg

SEQ ID NO: 105839 - DNA, 25 bp, Rattus norvegicus
agaagggccctgtagagctccaggc

SEQ ID NO: 105840 - DNA, 25 bp, Rattus norvegicus
agaagggccctgtctctaagaatgg

SEQ ID NO: 105841 - DNA, 25 bp, Rattus norvegicus
agaagggccgagatgtcaccccgcg

SEQ ID NO: 105842 - DNA, 25 bp, Rattus norvegicus
agaagggccgagttgtcaccccgcg

SEQ ID NO: 105843 - DNA, 25 bp, Rattus norvegicus
agaagggccggcacctagcagagca

SEQ ID NO: 105844 - DNA, 25 bp, Rattus norvegicus
agaagggccggctcctagcagagca

SEQ ID NO: 105845 - DNA, 25 bp, Rattus norvegicus
agaagggcggatccactttgtgtcc

SEQ ID NO: 105846 - DNA, 25 bp, Rattus norvegicus
agaagggcggatgcactttgtgtcc

SEQ ID NO: 105847 - DNA, 25 bp, Rattus norvegicus
agaagggctactacgcagtgactga

SEQ ID NO: 105848 - DNA, 25 bp, Rattus norvegicus
agaagggctacttcgcagtgactga

SEQ ID NO: 105849 - DNA, 25 bp, Rattus norvegicus
agaagggctagacctgccagcacgc

SEQ ID NO: 105850 - DNA, 25 bp, Rattus norvegicus
agaagggctagagctgccagcacgc

SEQ ID NO: 105851 - DNA, 25 bp, Rattus norvegicus
agaagggctaggatcctctctcaag

SEQ ID NO: 105852 - DNA, 25 bp, Rattus norvegicus
agaagggctaggttcctctctcaag

SEQ ID NO: 105853 - DNA, 25 bp, Rattus norvegicus
agaagggctctgacagcatggacct

SEQ ID NO: 105854 - DNA, 25 bp, Rattus norvegicus
agaagggctctgtcagcatggacct

SEQ ID NO: 105855 - DNA, 25 bp, Rattus norvegicus
agaagggctgccacttgatgcacgt

SEQ ID NO: 105856 - DNA, 25 bp, Rattus norvegicus
agaagggctgcctcttgatgcacgt

SEQ ID NO: 105857 - DNA, 25 bp, Rattus norvegicus
agaagggctgtaccggaacctctca

SEQ ID NO: 105858 - DNA, 25 bp, Rattus norvegicus
agaagggctgtagcggaacctctca

SEQ ID NO: 105859 - DNA, 25 bp, Rattus norvegicus
agaagggctgttccaccctaacatt

SEQ ID NO: 105860 - DNA, 25 bp, Rattus norvegicus
agaagggctgttgcaccctaacatt

SEQ ID NO: 105861 - DNA, 25 bp, Rattus norvegicus
agaagggcttttagagcggcgagat

SEQ ID NO: 105862 - DNA, 25 bp, Rattus norvegicus
agaagggctttttgagcggcgagat

SEQ ID NO: 105863 - DNA, 25 bp, Rattus norvegicus
agaagggtcaagatcatcaatatga

SEQ ID NO: 105864 - DNA, 25 bp, Rattus norvegicus
agaagggtcaagttcatcaatatga

SEQ ID NO: 105865 - DNA, 25 bp, Rattus norvegicus
agaagggtcatcacgcacagcacag

SEQ ID NO: 105866 - DNA, 25 bp, Rattus norvegicus
agaagggtcatctcgcacagcacag

SEQ ID NO: 105867 - DNA, 25 bp, Rattus norvegicus
agaagggtcattcccagccttgtct

SEQ ID NO: 105868 - DNA, 25 bp, Rattus norvegicus
agaagggtcattgccagccttgtct

SEQ ID NO: 105869 - DNA, 25 bp, Rattus norvegicus
agaagggtccttcccttagatcaat

SEQ ID NO: 105870 - DNA, 25 bp, Rattus norvegicus
agaagggtccttgccttagatcaat

SEQ ID NO: 105871 - DNA, 25 bp, Rattus norvegicus
agaagggtgatgctagctccgtacc

SEQ ID NO: 105872 - DNA, 25 bp, Rattus norvegicus
agaagggtgatggtagctccgtacc

SEQ ID NO: 105873 - DNA, 25 bp, Rattus norvegicus
agaagggtgttcaagcctgtgctcc

SEQ ID NO: 105874 - DNA, 25 bp, Rattus norvegicus
agaagggtgttctagcctgtgctcc

SEQ ID NO: 105875 - DNA, 25 bp, Rattus norvegicus
agaagggtttgtacccaggtgtgct

SEQ ID NO: 105876 - DNA, 25 bp, Rattus norvegicus
agaagggtttgttcccaggtgtgct

SEQ ID NO: 105877 - DNA, 25 bp, Rattus norvegicus
agaaggtacgtcaggctccgtatct

SEQ ID NO: 105878 - DNA, 25 bp, Rattus norvegicus
agaaggtacgtctggctccgtatct

SEQ ID NO: 105879 - DNA, 25 bp, Rattus norvegicus
agaaggtagacaccctggcagccca

SEQ ID NO: 105880 - DNA, 25 bp, Rattus norvegicus
agaaggtagacagcctggcagccca

SEQ ID NO: 105881 - DNA, 25 bp, Rattus norvegicus
agaaggtagctactgatcactggca

SEQ ID NO: 105882 - DNA, 25 bp, Rattus norvegicus
agaaggtagctagtgatcactggca

SEQ ID NO: 105883 - DNA, 25 bp, Rattus norvegicus
agaaggtagtttcccctcttcatgt

SEQ ID NO: 105884 - DNA, 25 bp, Rattus norvegicus
agaaggtagtttgccctcttcatgt

SEQ ID NO: 105885 - DNA, 25 bp, Rattus norvegicus
agaaggtatcatagagtccagccaa

SEQ ID NO: 105886 - DNA, 25 bp, Rattus norvegicus
agaaggtatcattgagtccagccaa

SEQ ID NO: 105887 - DNA, 25 bp, Rattus norvegicus
agaaggtattctccacattctgcct

SEQ ID NO: 105888 - DNA, 25 bp, Rattus norvegicus
agaaggtattctgcacattctgcct

SEQ ID NO: 105889 - DNA, 25 bp, Rattus norvegicus
agaaggtcactgcagctcacgaatt

SEQ ID NO: 105890 - DNA, 25 bp, Rattus norvegicus
agaaggtcactggagctcacgaatt

SEQ ID NO: 105891 - DNA, 25 bp, Rattus norvegicus
agaaggtcatcaactgccatcgagg

SEQ ID NO: 105892 - DNA, 25 bp, Rattus norvegicus
agaaggtcatcatctgccatcgagg

SEQ ID NO: 105893 - DNA, 25 bp, Rattus norvegicus
agaaggtcatctaccgactgcatga

SEQ ID NO: 105894 - DNA, 25 bp, Rattus norvegicus
agaaggtcatcttccgactgcatga

SEQ ID NO: 105895 - DNA, 25 bp, Rattus norvegicus
agaaggtcatgacccacgtcagcaa

SEQ ID NO: 105896 - DNA, 25 bp, Rattus norvegicus
agaaggtcatgagccacgtcagcaa

SEQ ID NO: 105897 - DNA, 25 bp, Rattus norvegicus
agaaggtcatttcccctttgcagag

SEQ ID NO: 105898 - DNA, 25 bp, Rattus norvegicus
agaaggtcatttcctctgctaaccg

SEQ ID NO: 105899 - DNA, 25 bp, Rattus norvegicus
agaaggtcatttcctttgccaacaa

SEQ ID NO: 105900 - DNA, 25 bp, Rattus norvegicus
agaaggtcatttgccctttgcagag

SEQ ID NO: 105901 - DNA, 25 bp, Rattus norvegicus
agaaggtcatttgctctgctaaccg

SEQ ID NO: 105902 - DNA, 25 bp, Rattus norvegicus
agaaggtcatttgctttgccaacaa

SEQ ID NO: 105903 - DNA, 25 bp, Rattus norvegicus
agaaggtcgtagaccatcagccctt

SEQ ID NO: 105904 - DNA, 25 bp, Rattus norvegicus
agaaggtcgtagtccatcagccctt

SEQ ID NO: 105905 - DNA, 25 bp, Rattus norvegicus
agaaggtctcagctctcggaccgtc

SEQ ID NO: 105906 - DNA, 25 bp, Rattus norvegicus
agaaggtctcaggtctcggaccgtc

SEQ ID NO: 105907 - DNA, 25 bp, Rattus norvegicus
agaaggtctcgcaatggtggtgcaa

SEQ ID NO: 105908 - DNA, 25 bp, Rattus norvegicus
agaaggtctcgctatggtggtgcaa

SEQ ID NO: 105909 - DNA, 25 bp, Rattus norvegicus
agaaggtctctgagactgcttgcat

SEQ ID NO: 105910 - DNA, 25 bp, Rattus norvegicus
agaaggtctctgtgactgcttgcat

SEQ ID NO: 105911 - DNA, 25 bp, Rattus norvegicus
agaaggtctcttatacttttataga

SEQ ID NO: 105912 - DNA, 25 bp, Rattus norvegicus
agaaggtctcttttacttttataga

SEQ ID NO: 105913 - DNA, 25 bp, Rattus norvegicus
agaaggtctgggacctgcaagctca

SEQ ID NO: 105914 - DNA, 25 bp, Rattus norvegicus
agaaggtctgggtcctgcaagctca

SEQ ID NO: 105915 - DNA, 25 bp, Rattus norvegicus
agaaggtgacatcccctcagaaaaa

SEQ ID NO: 105916 - DNA, 25 bp, Rattus norvegicus
agaaggtgacatgccctcagaaaaa

SEQ ID NO: 105917 - DNA, 25 bp, Rattus norvegicus
agaaggtgaccaacaccccattgat

SEQ ID NO: 105918 - DNA, 25 bp, Rattus norvegicus
agaaggtgaccatcaccccattgat

SEQ ID NO: 105919 - DNA, 25 bp, Rattus norvegicus
agaaggtgagctatgcaatctgcaa

SEQ ID NO: 105920 - DNA, 25 bp, Rattus norvegicus
agaaggtgagctttgcaatctgcaa

SEQ ID NO: 105921 - DNA, 25 bp, Rattus norvegicus
agaaggtgccagcttaccccataac

SEQ ID NO: 105922 - DNA, 25 bp, Rattus norvegicus
agaaggtgccaggttaccccataac

SEQ ID NO: 105923 - DNA, 25 bp, Rattus norvegicus
agaaggtgccttacagtgctgtgct

SEQ ID NO: 105924 - DNA, 25 bp, Rattus norvegicus
agaaggtgcctttcagtgctgtgct

SEQ ID NO: 105925 - DNA, 25 bp, Rattus norvegicus
agaaggtgcgttctatcccctttcg

SEQ ID NO: 105926 - DNA, 25 bp, Rattus norvegicus
agaaggtgcgttgtatcccctttcg

SEQ ID NO: 105927 - DNA, 25 bp, Rattus norvegicus
agaaggtgctgccattgcactgtct

SEQ ID NO: 105928 - DNA, 25 bp, Rattus norvegicus
agaaggtgctgcgattgcactgtct

SEQ ID NO: 105929 - DNA, 25 bp, Rattus norvegicus
agaaggtggcccaggatctggaccc

SEQ ID NO: 105930 - DNA, 25 bp, Rattus norvegicus
agaaggtggccctggatctggaccc

SEQ ID NO: 105931 - DNA, 25 bp, Rattus norvegicus
agaaggtggcctagtaccggctcca

SEQ ID NO: 105932 - DNA, 25 bp, Rattus norvegicus
agaaggtggccttgtaccggctcca

SEQ ID NO: 105933 - DNA, 25 bp, Rattus norvegicus
agaaggtggttcagcaactccggct

SEQ ID NO: 105934 - DNA, 25 bp, Rattus norvegicus
agaaggtggttctgcaactccggct

SEQ ID NO: 105935 - DNA, 25 bp, Rattus norvegicus
agaaggtgtacgacctggtgcgctc

SEQ ID NO: 105936 - DNA, 25 bp, Rattus norvegicus
agaaggtgtacgtcctggtgcgctc

SEQ ID NO: 105937 - DNA, 25 bp, Rattus norvegicus
agaaggtgtgcgaaacgttgccgaa

SEQ ID NO: 105938 - DNA, 25 bp, Rattus norvegicus
agaaggtgtgcgtaacgttgccgaa

SEQ ID NO: 105939 - DNA, 25 bp, Rattus norvegicus
agaaggtgtggactgctttcctctg

SEQ ID NO: 105940 - DNA, 25 bp, Rattus norvegicus
agaaggtgtggagtgctttcctctg

SEQ ID NO: 105941 - DNA, 25 bp, Rattus norvegicus
agaaggtgtttcaccctgagtacta

SEQ ID NO: 105942 - DNA, 25 bp, Rattus norvegicus
agaaggtgtttctccctgagtacta

SEQ ID NO: 105943 - DNA, 25 bp, Rattus norvegicus
agaaggttatcgcttaccagcaccc

SEQ ID NO: 105944 - DNA, 25 bp, Rattus norvegicus
agaaggttatcggttaccagcaccc

SEQ ID NO: 105945 - DNA, 25 bp, Rattus norvegicus
agaaggttgccacatctctgacaga

SEQ ID NO: 105946 - DNA, 25 bp, Rattus norvegicus
agaaggttgccagatctctgacaga

SEQ ID NO: 105947 - DNA, 25 bp, Rattus norvegicus
agaaggttggccagactcagcttac

SEQ ID NO: 105948 - DNA, 25 bp, Rattus norvegicus
agaaggttggcctgactcagcttac

SEQ ID NO: 105949 - DNA, 25 bp, Rattus norvegicus
agaaggtttattactctcctcgcgg

SEQ ID NO: 105950 - DNA, 25 bp, Rattus norvegicus
agaaggtttatttctctcctcgcgg

SEQ ID NO: 105951 - DNA, 25 bp, Rattus norvegicus
agaaggtttgcactgatccgactct

SEQ ID NO: 105952 - DNA, 25 bp, Rattus norvegicus
agaaggtttgcagtgatccgactct

SEQ ID NO: 105953 - DNA, 25 bp, Rattus norvegicus
agaaggtttgcccttgctttgagca

SEQ ID NO: 105954 - DNA, 25 bp, Rattus norvegicus
agaaggtttgccgttgctttgagca

SEQ ID NO: 105955 - DNA, 25 bp, Rattus norvegicus
agaagtaagcctcacgtgcacccgt

SEQ ID NO: 105956 - DNA, 25 bp, Rattus norvegicus
agaagtaagcctgacgtgcacccgt

SEQ ID NO: 105957 - DNA, 25 bp, Rattus norvegicus
agaagtaattgactaccacacgcat

SEQ ID NO: 105958 - DNA, 25 bp, Rattus norvegicus
agaagtaattgagtaccacacgcat

SEQ ID NO: 105959 - DNA, 25 bp, Rattus norvegicus
agaagtacagtccttcttggccctt

SEQ ID NO: 105960 - DNA, 25 bp, Rattus norvegicus
agaagtacagtcgttcttggccctt

SEQ ID NO: 105961 - DNA, 25 bp, Rattus norvegicus
agaagtacatggctctccggaagaa

SEQ ID NO: 105962 - DNA, 25 bp, Rattus norvegicus
agaagtacatgggtctccggaagaa

SEQ ID NO: 105963 - DNA, 25 bp, Rattus norvegicus
agaagtaccacactccaatgccggg

SEQ ID NO: 105964 - DNA, 25 bp, Rattus norvegicus
agaagtaccacagtccaatgccggg

SEQ ID NO: 105965 - DNA, 25 bp, Rattus norvegicus
agaagtacccacagaagccacacgg

SEQ ID NO: 105966 - DNA, 25 bp, Rattus norvegicus
agaagtacccactgaagccacacgg

SEQ ID NO: 105967 - DNA, 25 bp, Rattus norvegicus
agaagtacctgaccgctgtggtgaa

SEQ ID NO: 105968 - DNA, 25 bp, Rattus norvegicus
agaagtacctgagcgctgtggtgaa

SEQ ID NO: 105969 - DNA, 25 bp, Rattus norvegicus
agaagtaccttgaggctccattgac

SEQ ID NO: 105970 - DNA, 25 bp, Rattus norvegicus
agaagtaccttgtggctccattgac

SEQ ID NO: 105971 - DNA, 25 bp, Rattus norvegicus
agaagtacgacccaaccatcgaaga

SEQ ID NO: 105972 - DNA, 25 bp, Rattus norvegicus
agaagtacgaccgaaccatcgaaga

SEQ ID NO: 105973 - DNA, 25 bp, Rattus norvegicus
agaagtacgagcaggatgctcagct

SEQ ID NO: 105974 - DNA, 25 bp, Rattus norvegicus
agaagtacgagctggatgctcagct

SEQ ID NO: 105975 - DNA, 25 bp, Rattus norvegicus
agaagtacgggcagaggctcattcc

SEQ ID NO: 105976 - DNA, 25 bp, Rattus norvegicus
agaagtacgggctgaggctcattcc

SEQ ID NO: 105977 - DNA, 25 bp, Rattus norvegicus
agaagtacgtgaacccgaggacgcg

SEQ ID NO: 105978 - DNA, 25 bp, Rattus norvegicus
agaagtacgtgatcccgaggacgcg

SEQ ID NO: 105979 - DNA, 25 bp, Rattus norvegicus
agaagtacgttactgttgagatgaa

SEQ ID NO: 105980 - DNA, 25 bp, Rattus norvegicus
agaagtacgttagtgttgagatgaa

SEQ ID NO: 105981 - DNA, 25 bp, Rattus norvegicus
agaagtactcagaggcgtgccagga

SEQ ID NO: 105982 - DNA, 25 bp, Rattus norvegicus
agaagtactcagtggcgtgccagga

SEQ ID NO: 105983 - DNA, 25 bp, Rattus norvegicus
agaagtactgtacatccccaggttg

SEQ ID NO: 105984 - DNA, 25 bp, Rattus norvegicus
agaagtactgtagatccccaggttg

SEQ ID NO: 105985 - DNA, 25 bp, Rattus norvegicus
agaagtactgtcagcgcgtgcccta

SEQ ID NO: 105986 - DNA, 25 bp, Rattus norvegicus
agaagtactgtctgcgcgtgcccta

SEQ ID NO: 105987 - DNA, 25 bp, Rattus norvegicus
agaagtacttgtcctgtctcagcag

SEQ ID NO: 105988 - DNA, 25 bp, Rattus norvegicus
agaagtacttgtgctgtctcagcag

SEQ ID NO: 105989 - DNA, 25 bp, Rattus norvegicus
agaagtactttcctgtcacatagca

SEQ ID NO: 105990 - DNA, 25 bp, Rattus norvegicus
agaagtactttcgtgtcacatagca

SEQ ID NO: 105991 - DNA, 25 bp, Rattus norvegicus
agaagtagcagtagtcaccgcctgt

SEQ ID NO: 105992 - DNA, 25 bp, Rattus norvegicus
agaagtagcagttgtcaccgcctgt

SEQ ID NO: 105993 - DNA, 25 bp, Rattus norvegicus
agaagtagcccaagggtggccccag

SEQ ID NO: 105994 - DNA, 25 bp, Rattus norvegicus
agaagtagcccatgggtggccccag

SEQ ID NO: 105995 - DNA, 25 bp, Rattus norvegicus
agaagtagctccctgctgctgtagc

SEQ ID NO: 105996 - DNA, 25 bp, Rattus norvegicus
agaagtagctccgtgctgctgtagc

SEQ ID NO: 105997 - DNA, 25 bp, Rattus norvegicus
agaagtaggcctaaggccacgcctc

SEQ ID NO: 105998 - DNA, 25 bp, Rattus norvegicus
agaagtaggccttaggccacgcctc

SEQ ID NO: 105999 - DNA, 25 bp, Rattus norvegicus
agaagtagtcacatcaccttcctgc

SEQ ID NO: 106000 - DNA, 25 bp, Rattus norvegicus
agaagtagtcacttcaccttcctgc

SEQ ID NO: 106001 - DNA, 25 bp, Rattus norvegicus
agaagtagtcagagggcagacctct

SEQ ID NO: 106002 - DNA, 25 bp, Rattus norvegicus
agaagtagtcagtgggcagacctct

SEQ ID NO: 106003 - DNA, 25 bp, Rattus norvegicus
agaagtagtgtaaccccagcacatg

SEQ ID NO: 106004 - DNA, 25 bp, Rattus norvegicus
agaagtagtgtatccccagcacatg

SEQ ID NO: 106005 - DNA, 25 bp, Rattus norvegicus
agaagtagtttcatcctggtttgtc

SEQ ID NO: 106006 - DNA, 25 bp, Rattus norvegicus
agaagtagtttcttcctggtttgtc

SEQ ID NO: 106007 - DNA, 25 bp, Rattus norvegicus
agaagtatcagaagaccagtctcaa

SEQ ID NO: 106008 - DNA, 25 bp, Rattus norvegicus
agaagtatcagatgaccagtctcaa

SEQ ID NO: 106009 - DNA, 25 bp, Rattus norvegicus
agaagtatcattccggttactacca

SEQ ID NO: 106010 - DNA, 25 bp, Rattus norvegicus
agaagtatcattgcggttactacca

SEQ ID NO: 106011 - DNA, 25 bp, Rattus norvegicus
agaagtatctagctgtaccccacta

SEQ ID NO: 106012 - DNA, 25 bp, Rattus norvegicus
agaagtatctaggtgtaccccacta

SEQ ID NO: 106013 - DNA, 25 bp, Rattus norvegicus
agaagtatggtaaccctgagccacc

SEQ ID NO: 106014 - DNA, 25 bp, Rattus norvegicus
agaagtatggtatccctgagccacc

SEQ ID NO: 106015 - DNA, 25 bp, Rattus norvegicus
agaagtatgtttccctatgacccca

SEQ ID NO: 106016 - DNA, 25 bp, Rattus norvegicus
agaagtatgtttgcctatgacccca

SEQ ID NO: 106017 - DNA, 25 bp, Rattus norvegicus
agaagtcaacgtctgctcactaagt

SEQ ID NO: 106018 - DNA, 25 bp, Rattus norvegicus
agaagtcaacgtgtgctcactaagt

SEQ ID NO: 106019 - DNA, 25 bp, Rattus norvegicus
agaagtcaaggacccacagagtctc

SEQ ID NO: 106020 - DNA, 25 bp, Rattus norvegicus
agaagtcaaggagccacagagtctc

SEQ ID NO: 106021 - DNA, 25 bp, Rattus norvegicus
agaagtcacactagtcctagacagc

SEQ ID NO: 106022 - DNA, 25 bp, Rattus norvegicus
agaagtcacacttgtcctagacagc

SEQ ID NO: 106023 - DNA, 25 bp, Rattus norvegicus
agaagtcaccccagcgtgtgaagaa

SEQ ID NO: 106024 - DNA, 25 bp, Rattus norvegicus
agaagtcacccctgcgtgtgaagaa

SEQ ID NO: 106025 - DNA, 25 bp, Rattus norvegicus
agaagtcacctgagatccagtcttc

SEQ ID NO: 106026 - DNA, 25 bp, Rattus norvegicus
agaagtcacctgtgatccagtcttc

SEQ ID NO: 106027 - DNA, 25 bp, Rattus norvegicus
agaagtcactcactgaagtcactta

SEQ ID NO: 106028 - DNA, 25 bp, Rattus norvegicus
agaagtcactcagtgaagtcactta

SEQ ID NO: 106029 - DNA, 25 bp, Rattus norvegicus
agaagtcagagcagttcccatgcca

SEQ ID NO: 106030 - DNA, 25 bp, Rattus norvegicus
agaagtcagagctgttcccatgcca

SEQ ID NO: 106031 - DNA, 25 bp, Rattus norvegicus
agaagtcagagtccgaagccccacc

SEQ ID NO: 106032 - DNA, 25 bp, Rattus norvegicus
agaagtcagagtgcgaagccccacc

SEQ ID NO: 106033 - DNA, 25 bp, Rattus norvegicus
agaagtcagatcaacagcacgtgaa

SEQ ID NO: 106034 - DNA, 25 bp, Rattus norvegicus
agaagtcagatctacagcacgtgaa

SEQ ID NO: 106035 - DNA, 25 bp, Rattus norvegicus
agaagtcagcataccggcagtggca

SEQ ID NO: 106036 - DNA, 25 bp, Rattus norvegicus
agaagtcagcattccggcagtggca

SEQ ID NO: 106037 - DNA, 25 bp, Rattus norvegicus
agaagtcagcccagtggcgaacagt

SEQ ID NO: 106038 - DNA, 25 bp, Rattus norvegicus
agaagtcagccctgtggcgaacagt

SEQ ID NO: 106039 - DNA, 25 bp, Rattus norvegicus
agaagtcagcctcatagatccctgg

SEQ ID NO: 106040 - DNA, 25 bp, Rattus norvegicus
agaagtcagcctgatagatccctgg

SEQ ID NO: 106041 - DNA, 25 bp, Rattus norvegicus
agaagtcagcgcacactttttgtat

SEQ ID NO: 106042 - DNA, 25 bp, Rattus norvegicus
agaagtcagcgctcactttttgtat

SEQ ID NO: 106043 - DNA, 25 bp, Rattus norvegicus
agaagtcaggacaggcttccatcct

SEQ ID NO: 106044 - DNA, 25 bp, Rattus norvegicus
agaagtcaggactggcttccatcct

SEQ ID NO: 106045 - DNA, 25 bp, Rattus norvegicus
agaagtcagtcaaccccaggccgtg

SEQ ID NO: 106046 - DNA, 25 bp, Rattus norvegicus
agaagtcagtcatccccaggccgtg

SEQ ID NO: 106047 - DNA, 25 bp, Rattus norvegicus
agaagtcagtgcacagaccctggct

SEQ ID NO: 106048 - DNA, 25 bp, Rattus norvegicus
agaagtcagtgctcagaccctggct

SEQ ID NO: 106049 - DNA, 25 bp, Rattus norvegicus
agaagtcatcctaagtgcccataac

SEQ ID NO: 106050 - DNA, 25 bp, Rattus norvegicus
agaagtcatccttagtgcccataac

SEQ ID NO: 106051 - DNA, 25 bp, Rattus norvegicus
agaagtcatgttactgactgtgacc

SEQ ID NO: 106052 - DNA, 25 bp, Rattus norvegicus
agaagtcatgtttctgactgtgacc

SEQ ID NO: 106053 - DNA, 25 bp, Rattus norvegicus
agaagtcattccaccgcagagcttg

SEQ ID NO: 106054 - DNA, 25 bp, Rattus norvegicus
agaagtcattcctccgcagagcttg

SEQ ID NO: 106055 - DNA, 25 bp, Rattus norvegicus
agaagtccaaagaccaccctataat

SEQ ID NO: 106056 - DNA, 25 bp, Rattus norvegicus
agaagtccaaagtccaccctataat

SEQ ID NO: 106057 - DNA, 25 bp, Rattus norvegicus
agaagtccacatccacagggtttat

SEQ ID NO: 106058 - DNA, 25 bp, Rattus norvegicus
agaagtccacatgcacagggtttat

SEQ ID NO: 106059 - DNA, 25 bp, Rattus norvegicus
agaagtccacgcagcacgatcacct

SEQ ID NO: 106060 - DNA, 25 bp, Rattus norvegicus
agaagtccacgctgcacgatcacct

SEQ ID NO: 106061 - DNA, 25 bp, Rattus norvegicus
agaagtccactgacagtttcctctt

SEQ ID NO: 106062 - DNA, 25 bp, Rattus norvegicus
agaagtccactgtcagtttcctctt

SEQ ID NO: 106063 - DNA, 25 bp, Rattus norvegicus
agaagtccagagatgtagccctcca

SEQ ID NO: 106064 - DNA, 25 bp, Rattus norvegicus
agaagtccagagttgtagccctcca

SEQ ID NO: 106065 - DNA, 25 bp, Rattus norvegicus
agaagtccagccctatgagtcacag

SEQ ID NO: 106066 - DNA, 25 bp, Rattus norvegicus
agaagtccagccgtatgagtcacag

SEQ ID NO: 106067 - DNA, 25 bp, Rattus norvegicus
agaagtccaggaaccacctagcagg

SEQ ID NO: 106068 - DNA, 25 bp, Rattus norvegicus
agaagtccaggatccacctagcagg

SEQ ID NO: 106069 - DNA, 25 bp, Rattus norvegicus
agaagtccatcacctggtccaaatc

SEQ ID NO: 106070 - DNA, 25 bp, Rattus norvegicus
agaagtccatcagctggtccaaatc

SEQ ID NO: 106071 - DNA, 25 bp, Rattus norvegicus
agaagtccatgcacccgctggcagg

SEQ ID NO: 106072 - DNA, 25 bp, Rattus norvegicus
agaagtccatgctcccgctggcagg

SEQ ID NO: 106073 - DNA, 25 bp, Rattus norvegicus
agaagtccatggacatctacaaggg

SEQ ID NO: 106074 - DNA, 25 bp, Rattus norvegicus
agaagtccatggtcatctacaaggg

SEQ ID NO: 106075 - DNA, 25 bp, Rattus norvegicus
agaagtcccaaccagccagtggaga

SEQ ID NO: 106076 - DNA, 25 bp, Rattus norvegicus
agaagtcccaacgagccagtggaga

SEQ ID NO: 106077 - DNA, 25 bp, Rattus norvegicus
agaagtcccagcaccataccaggat

SEQ ID NO: 106078 - DNA, 25 bp, Rattus norvegicus
agaagtcccagctccataccaggat

SEQ ID NO: 106079 - DNA, 25 bp, Rattus norvegicus
agaagtcccatccaatgcagcaagt

SEQ ID NO: 106080 - DNA, 25 bp, Rattus norvegicus
agaagtcccatcgaatgcagcaagt

SEQ ID NO: 106081 - DNA, 25 bp, Rattus norvegicus
agaagtccccttatgactgtttcat

SEQ ID NO: 106082 - DNA, 25 bp, Rattus norvegicus
agaagtccccttttgactgtttcat

SEQ ID NO: 106083 - DNA, 25 bp, Rattus norvegicus
agaagtcccgtgacctgtgtctagg

SEQ ID NO: 106084 - DNA, 25 bp, Rattus norvegicus
agaagtcccgtgtcctgtgtctagg

SEQ ID NO: 106085 - DNA, 25 bp, Rattus norvegicus
agaagtccctaactgtggcttcctc

SEQ ID NO: 106086 - DNA, 25 bp, Rattus norvegicus
agaagtccctaagtgtggcttcctc

SEQ ID NO: 106087 - DNA, 25 bp, Rattus norvegicus
agaagtccgccacaaggctctgaca

SEQ ID NO: 106088 - DNA, 25 bp, Rattus norvegicus
agaagtccgccagaaggctctgaca

SEQ ID NO: 106089 - DNA, 25 bp, Rattus norvegicus
agaagtccgtctacgctcattcact

SEQ ID NO: 106090 - DNA, 25 bp, Rattus norvegicus
agaagtccgtcttcgctcattcact

SEQ ID NO: 106091 - DNA, 25 bp, Rattus norvegicus
agaagtcctcaacagtcctagcaga

SEQ ID NO: 106092 - DNA, 25 bp, Rattus norvegicus
agaagtcctcaagagtcctagcaga

SEQ ID NO: 106093 - DNA, 25 bp, Rattus norvegicus
agaagtcctgaaactcctgactgca

SEQ ID NO: 106094 - DNA, 25 bp, Rattus norvegicus
agaagtcctgaatctcctgactgca

SEQ ID NO: 106095 - DNA, 25 bp, Rattus norvegicus
agaagtccttagaccagctcgctgg

SEQ ID NO: 106096 - DNA, 25 bp, Rattus norvegicus
agaagtccttagtccagctcgctgg

SEQ ID NO: 106097 - DNA, 25 bp, Rattus norvegicus
agaagtccttcaaacagtcctcaca

SEQ ID NO: 106098 - DNA, 25 bp, Rattus norvegicus
agaagtccttcatacagtcctcaca

SEQ ID NO: 106099 - DNA, 25 bp, Rattus norvegicus
agaagtcgcattcaacaacctcctg

SEQ ID NO: 106100 - DNA, 25 bp, Rattus norvegicus
agaagtcgcattgaacaacctcctg

SEQ ID NO: 106101 - DNA, 25 bp, Rattus norvegicus
agaagtcgcccgacagtcagaatct

SEQ ID NO: 106102 - DNA, 25 bp, Rattus norvegicus
agaagtcgcccgtcagtcagaatct

SEQ ID NO: 106103 - DNA, 25 bp, Rattus norvegicus
agaagtcgctctcattgctgtgctg

SEQ ID NO: 106104 - DNA, 25 bp, Rattus norvegicus
agaagtcgctctgattgctgtgctg

SEQ ID NO: 106105 - DNA, 25 bp, Rattus norvegicus
agaagtcggtttctttgctgcaaga

SEQ ID NO: 106106 - DNA, 25 bp, Rattus norvegicus
agaagtcggtttgtttgctgcaaga

SEQ ID NO: 106107 - DNA, 25 bp, Rattus norvegicus
agaagtcgtcagacactctccggga

SEQ ID NO: 106108 - DNA, 25 bp, Rattus norvegicus
agaagtcgtcagtcactctccggga

SEQ ID NO: 106109 - DNA, 25 bp, Rattus norvegicus
agaagtctacttatctgaggcagta

SEQ ID NO: 106110 - DNA, 25 bp, Rattus norvegicus
agaagtctacttttctgaggcagta

SEQ ID NO: 106111 - DNA, 25 bp, Rattus norvegicus
agaagtctcaacactggtcagcaaa

SEQ ID NO: 106112 - DNA, 25 bp, Rattus norvegicus
agaagtctcaactctggtcagcaaa

SEQ ID NO: 106113 - DNA, 25 bp, Rattus norvegicus
agaagtctcagtctaatgtgggaac

SEQ ID NO: 106114 - DNA, 25 bp, Rattus norvegicus
agaagtctcagtgtaatgtgggaac

SEQ ID NO: 106115 - DNA, 25 bp, Rattus norvegicus
agaagtctcatcagtctcttcagtg

SEQ ID NO: 106116 - DNA, 25 bp, Rattus norvegicus
agaagtctcatctgtctcttcagtg

SEQ ID NO: 106117 - DNA, 25 bp, Rattus norvegicus
agaagtctcccaattctgtgctggc

SEQ ID NO: 106118 - DNA, 25 bp, Rattus norvegicus
agaagtctcccatttctgtgctggc

SEQ ID NO: 106119 - DNA, 25 bp, Rattus norvegicus
agaagtctcgtaaccaggccatgaa

SEQ ID NO: 106120 - DNA, 25 bp, Rattus norvegicus
agaagtctcgtatccaggccatgaa

SEQ ID NO: 106121 - DNA, 25 bp, Rattus norvegicus
agaagtctctagaccctggctttga

SEQ ID NO: 106122 - DNA, 25 bp, Rattus norvegicus
agaagtctctagtccctggctttga

SEQ ID NO: 106123 - DNA, 25 bp, Rattus norvegicus
agaagtctctttactttgcatccct

SEQ ID NO: 106124 - DNA, 25 bp, Rattus norvegicus
agaagtctcttttctttgcatccct

SEQ ID NO: 106125 - DNA, 25 bp, Rattus norvegicus
agaagtctgaccagcgggagctcta

SEQ ID NO: 106126 - DNA, 25 bp, Rattus norvegicus
agaagtctgacctgcgggagctcta

SEQ ID NO: 106127 - DNA, 25 bp, Rattus norvegicus
agaagtctgactcacaccttccatt

SEQ ID NO: 106128 - DNA, 25 bp, Rattus norvegicus
agaagtctgactgacaccttccatt

SEQ ID NO: 106129 - DNA, 25 bp, Rattus norvegicus
agaagtctgatcaggtgctagggat

SEQ ID NO: 106130 - DNA, 25 bp, Rattus norvegicus
agaagtctgatctggtgctagggat

SEQ ID NO: 106131 - DNA, 25 bp, Rattus norvegicus
agaagtctgattcctacagctaggc

SEQ ID NO: 106132 - DNA, 25 bp, Rattus norvegicus
agaagtctgattgctacagctaggc

SEQ ID NO: 106133 - DNA, 25 bp, Rattus norvegicus
agaagtctgcagatggaagcccaaa

SEQ ID NO: 106134 - DNA, 25 bp, Rattus norvegicus
agaagtctgcagttggaagcccaaa

SEQ ID NO: 106135 - DNA, 25 bp, Rattus norvegicus
agaagtctgctcatgagatctgcaa

SEQ ID NO: 106136 - DNA, 25 bp, Rattus norvegicus
agaagtctgctcttgagatctgcaa

SEQ ID NO: 106137 - DNA, 25 bp, Rattus norvegicus
agaagtctggagagccctgtcttcc

SEQ ID NO: 106138 - DNA, 25 bp, Rattus norvegicus
agaagtctggagtgccctgtcttcc

SEQ ID NO: 106139 - DNA, 25 bp, Rattus norvegicus
agaagtctggctatcatactgctga

SEQ ID NO: 106140 - DNA, 25 bp, Rattus norvegicus
agaagtctggctttcatactgctga

SEQ ID NO: 106141 - DNA, 25 bp, Rattus norvegicus
agaagtctgggcctcgaagtcgaaa

SEQ ID NO: 106142 - DNA, 25 bp, Rattus norvegicus
agaagtctgggcgtcgaagtcgaaa

SEQ ID NO: 106143 - DNA, 25 bp, Rattus norvegicus
agaagtctgtcactgtgccggtcac

SEQ ID NO: 106144 - DNA, 25 bp, Rattus norvegicus
agaagtctgtcagtgtgccggtcac

SEQ ID NO: 106145 - DNA, 25 bp, Rattus norvegicus
agaagtctgtccatctgcaagcgct

SEQ ID NO: 106146 - DNA, 25 bp, Rattus norvegicus
agaagtctgtccttctgcaagcgct

SEQ ID NO: 106147 - DNA, 25 bp, Rattus norvegicus
agaagtcttctaatagcacctcctg

SEQ ID NO: 106148 - DNA, 25 bp, Rattus norvegicus
agaagtcttctattagcacctcctg

SEQ ID NO: 106149 - DNA, 25 bp, Rattus norvegicus
agaagtcttctgcttgagaatacag

SEQ ID NO: 106150 - DNA, 25 bp, Rattus norvegicus
agaagtcttctggttgagaatacag

SEQ ID NO: 106151 - DNA, 25 bp, Rattus norvegicus
agaagtctttgccagtatgcccatc

SEQ ID NO: 106152 - DNA, 25 bp, Rattus norvegicus
agaagtctttgcgagtatgcccatc

SEQ ID NO: 106153 - DNA, 25 bp, Rattus norvegicus
agaagtgaacctagcgtcccaaaat

SEQ ID NO: 106154 - DNA, 25 bp, Rattus norvegicus
agaagtgaaccttgcgtcccaaaat

SEQ ID NO: 106155 - DNA, 25 bp, Rattus norvegicus
agaagtgaagtcagtgtcccgcatc

SEQ ID NO: 106156 - DNA, 25 bp, Rattus norvegicus
agaagtgaagtctgtgtcccgcatc

SEQ ID NO: 106157 - DNA, 25 bp, Rattus norvegicus
agaagtgaattcaccgtgccttaga

SEQ ID NO: 106158 - DNA, 25 bp, Rattus norvegicus
agaagtgaattctccgtgccttaga

SEQ ID NO: 106159 - DNA, 25 bp, Rattus norvegicus
agaagtgaatttaccccactggcaa

SEQ ID NO: 106160 - DNA, 25 bp, Rattus norvegicus
agaagtgaattttccccactggcaa

SEQ ID NO: 106161 - DNA, 25 bp, Rattus norvegicus
agaagtgacaagctctctgcctcca

SEQ ID NO: 106162 - DNA, 25 bp, Rattus norvegicus
agaagtgacaaggtctctgcctcca

SEQ ID NO: 106163 - DNA, 25 bp, Rattus norvegicus
agaagtgaccataaatccagacact

SEQ ID NO: 106164 - DNA, 25 bp, Rattus norvegicus
agaagtgaccatcagtcctgccgtg

SEQ ID NO: 106165 - DNA, 25 bp, Rattus norvegicus
agaagtgaccatgagtcctgccgtg

SEQ ID NO: 106166 - DNA, 25 bp, Rattus norvegicus
agaagtgaccattaatccagacact

SEQ ID NO: 106167 - DNA, 25 bp, Rattus norvegicus
agaagtgacccacgccctgagagaa

SEQ ID NO: 106168 - DNA, 25 bp, Rattus norvegicus
agaagtgacccaggccctgagagaa

SEQ ID NO: 106169 - DNA, 25 bp, Rattus norvegicus
agaagtgacctcaagctcagctact

SEQ ID NO: 106170 - DNA, 25 bp, Rattus norvegicus
agaagtgacctctagctcagctact

SEQ ID NO: 106171 - DNA, 25 bp, Rattus norvegicus
agaagtgactgcaacagacctgagt

SEQ ID NO: 106172 - DNA, 25 bp, Rattus norvegicus
agaagtgactgctacagacctgagt

SEQ ID NO: 106173 - DNA, 25 bp, Rattus norvegicus
agaagtgagaatcaggtaccttttt

SEQ ID NO: 106174 - DNA, 25 bp, Rattus norvegicus
agaagtgagaatgaggtaccttttt

SEQ ID NO: 106175 - DNA, 25 bp, Rattus norvegicus
agaagtgagagccaggcagccctct

SEQ ID NO: 106176 - DNA, 25 bp, Rattus norvegicus
agaagtgagagcgaggcagccctct

SEQ ID NO: 106177 - DNA, 25 bp, Rattus norvegicus
agaagtgaggacacagtgccgagat

SEQ ID NO: 106178 - DNA, 25 bp, Rattus norvegicus
agaagtgaggactcagtgccgagat

SEQ ID NO: 106179 - DNA, 25 bp, Rattus norvegicus
agaagtgaggcgctcactgctcatg

SEQ ID NO: 106180 - DNA, 25 bp, Rattus norvegicus
agaagtgaggcggtcactgctcatg

SEQ ID NO: 106181 - DNA, 25 bp, Rattus norvegicus
agaagtgaggtcctttcatgcgctc

SEQ ID NO: 106182 - DNA, 25 bp, Rattus norvegicus
agaagtgaggtcgtttcatgcgctc

SEQ ID NO: 106183 - DNA, 25 bp, Rattus norvegicus
agaagtgagtttagctggtcccaga

SEQ ID NO: 106184 - DNA, 25 bp, Rattus norvegicus
agaagtgagttttgctggtcccaga

SEQ ID NO: 106185 - DNA, 25 bp, Rattus norvegicus
agaagtgatgctcccctatgtgtgc

SEQ ID NO: 106186 - DNA, 25 bp, Rattus norvegicus
agaagtgatgctgccctatgtgtgc

SEQ ID NO: 106187 - DNA, 25 bp, Rattus norvegicus
agaagtgatggtcccgtgtcttcac

SEQ ID NO: 106188 - DNA, 25 bp, Rattus norvegicus
agaagtgatggtcctctgtgtcctc

SEQ ID NO: 106189 - DNA, 25 bp, Rattus norvegicus
agaagtgatggtgccgtgtcttcac

SEQ ID NO: 106190 - DNA, 25 bp, Rattus norvegicus
agaagtgatggtgctctgtgtcctc

SEQ ID NO: 106191 - DNA, 25 bp, Rattus norvegicus
agaagtgatgttccttgtcctggtg

SEQ ID NO: 106192 - DNA, 25 bp, Rattus norvegicus
agaagtgatgttgcttgtcctggtg

SEQ ID NO: 106193 - DNA, 25 bp, Rattus norvegicus
agaagtgattcacagctgctccagt

SEQ ID NO: 106194 - DNA, 25 bp, Rattus norvegicus
agaagtgattcagagctgctccagt

SEQ ID NO: 106195 - DNA, 25 bp, Rattus norvegicus
agaagtgcacaaagcaccgagccct

SEQ ID NO: 106196 - DNA, 25 bp, Rattus norvegicus
agaagtgcacaatgcaccgagccct

SEQ ID NO: 106197 - DNA, 25 bp, Rattus norvegicus
agaagtgcacagctttagcagccaa

SEQ ID NO: 106198 - DNA, 25 bp, Rattus norvegicus
agaagtgcacaggtttagcagccaa

SEQ ID NO: 106199 - DNA, 25 bp, Rattus norvegicus
agaagtgcacatatgaccctgctgc

SEQ ID NO: 106200 - DNA, 25 bp, Rattus norvegicus
agaagtgcacatttgaccctgctgc

SEQ ID NO: 106201 - DNA, 25 bp, Rattus norvegicus
agaagtgcatagactcccttctggg

SEQ ID NO: 106202 - DNA, 25 bp, Rattus norvegicus
agaagtgcatagtctcccttctggg

SEQ ID NO: 106203 - DNA, 25 bp, Rattus norvegicus
agaagtgcatgcaccctttaagccc

SEQ ID NO: 106204 - DNA, 25 bp, Rattus norvegicus
agaagtgcatgctccctttaagccc

SEQ ID NO: 106205 - DNA, 25 bp, Rattus norvegicus
agaagtgccaagacatgtccgaaga

SEQ ID NO: 106206 - DNA, 25 bp, Rattus norvegicus
agaagtgccaagtcatgtccgaaga

SEQ ID NO: 106207 - DNA, 25 bp, Rattus norvegicus
agaagtgccacacaacccagtctca

SEQ ID NO: 106208 - DNA, 25 bp, Rattus norvegicus
agaagtgccacagaacccagtctca

SEQ ID NO: 106209 - DNA, 25 bp, Rattus norvegicus
agaagtgccaccaatcctggctggt

SEQ ID NO: 106210 - DNA, 25 bp, Rattus norvegicus
agaagtgccacctatcctggctggt

SEQ ID NO: 106211 - DNA, 25 bp, Rattus norvegicus
agaagtgccatgctcatcggtttcc

SEQ ID NO: 106212 - DNA, 25 bp, Rattus norvegicus
agaagtgccatggtcatcggtttcc

SEQ ID NO: 106213 - DNA, 25 bp, Rattus norvegicus
agaagtgccattatcctcacctgga

SEQ ID NO: 106214 - DNA, 25 bp, Rattus norvegicus
agaagtgccattttcctcacctgga

SEQ ID NO: 106215 - DNA, 25 bp, Rattus norvegicus
agaagtgcccaccatgcggaaagtc

SEQ ID NO: 106216 - DNA, 25 bp, Rattus norvegicus
agaagtgcccacgatgcggaaagtc

SEQ ID NO: 106217 - DNA, 25 bp, Rattus norvegicus
agaagtgccgccaggtgctgtgcaa

SEQ ID NO: 106218 - DNA, 25 bp, Rattus norvegicus
agaagtgccgcctggtgctgtgcaa

SEQ ID NO: 106219 - DNA, 25 bp, Rattus norvegicus
agaagtgccttgaactgcctgagta

SEQ ID NO: 106220 - DNA, 25 bp, Rattus norvegicus
agaagtgccttgtactgcctgagta

SEQ ID NO: 106221 - DNA, 25 bp, Rattus norvegicus
agaagtgcgttcacagacggtttta

SEQ ID NO: 106222 - DNA, 25 bp, Rattus norvegicus
agaagtgcgttctcagacggtttta

SEQ ID NO: 106223 - DNA, 25 bp, Rattus norvegicus
agaagtgctagcaagtcccatgtct

SEQ ID NO: 106224 - DNA, 25 bp, Rattus norvegicus
agaagtgctagctagtcccatgtct

SEQ ID NO: 106225 - DNA, 25 bp, Rattus norvegicus
agaagtgctctgaacagctggttcc

SEQ ID NO: 106226 - DNA, 25 bp, Rattus norvegicus
agaagtgctctgcagccgaaaggat

SEQ ID NO: 106227 - DNA, 25 bp, Rattus norvegicus
agaagtgctctggagccgaaaggat

SEQ ID NO: 106228 - DNA, 25 bp, Rattus norvegicus
agaagtgctctgtacagctggttcc

SEQ ID NO: 106229 - DNA, 25 bp, Rattus norvegicus
agaagtgctcttcccctggaggatg

SEQ ID NO: 106230 - DNA, 25 bp, Rattus norvegicus
agaagtgctcttgccctggaggatg

SEQ ID NO: 106231 - DNA, 25 bp, Rattus norvegicus
agaagtgctgtcacagtgctgtttc

SEQ ID NO: 106232 - DNA, 25 bp, Rattus norvegicus
agaagtgctgtctcagtgctgtttc

SEQ ID NO: 106233 - DNA, 25 bp, Rattus norvegicus
agaagtgctgtgcatgtcccttggt

SEQ ID NO: 106234 - DNA, 25 bp, Rattus norvegicus
agaagtgctgtgctgtagccctagt

SEQ ID NO: 106235 - DNA, 25 bp, Rattus norvegicus
agaagtgctgtggatgtcccttggt

SEQ ID NO: 106236 - DNA, 25 bp, Rattus norvegicus
agaagtgctgtggtgtagccctagt

SEQ ID NO: 106237 - DNA, 25 bp, Rattus norvegicus
agaagtgcttaaagggttcctttat

SEQ ID NO: 106238 - DNA, 25 bp, Rattus norvegicus
agaagtgcttaatgggttcctttat

SEQ ID NO: 106239 - DNA, 25 bp, Rattus norvegicus
agaagtgcttctaccactacagtga

SEQ ID NO: 106240 - DNA, 25 bp, Rattus norvegicus
agaagtgcttcttccactacagtga

SEQ ID NO: 106241 - DNA, 25 bp, Rattus norvegicus
agaagtggaggcacacctgggttca

SEQ ID NO: 106242 - DNA, 25 bp, Rattus norvegicus
agaagtggaggctcacctgggttca

SEQ ID NO: 106243 - DNA, 25 bp, Rattus norvegicus
agaagtggcaaactgcccagcccac

SEQ ID NO: 106244 - DNA, 25 bp, Rattus norvegicus
agaagtggcaaagtgcccagcccac

SEQ ID NO: 106245 - DNA, 25 bp, Rattus norvegicus
agaagtggcacaagcgcggctgctt

SEQ ID NO: 106246 - DNA, 25 bp, Rattus norvegicus
agaagtggcacatgcgcggctgctt

SEQ ID NO: 106247 - DNA, 25 bp, Rattus norvegicus
agaagtggcattacagactgttgtc

SEQ ID NO: 106248 - DNA, 25 bp, Rattus norvegicus
agaagtggcatttcagactgttgtc

SEQ ID NO: 106249 - DNA, 25 bp, Rattus norvegicus
agaagtggccaaattcatccccatc

SEQ ID NO: 106250 - DNA, 25 bp, Rattus norvegicus
agaagtggccaatttcatccccatc

SEQ ID NO: 106251 - DNA, 25 bp, Rattus norvegicus
agaagtggccttactcttcctgaga

SEQ ID NO: 106252 - DNA, 25 bp, Rattus norvegicus
agaagtggcctttctcttcctgaga

SEQ ID NO: 106253 - DNA, 25 bp, Rattus norvegicus
agaagtggcgctacagcataccctt

SEQ ID NO: 106254 - DNA, 25 bp, Rattus norvegicus
agaagtggcgcttcagcataccctt

SEQ ID NO: 106255 - DNA, 25 bp, Rattus norvegicus
agaagtggctaaaacctctgccttc

SEQ ID NO: 106256 - DNA, 25 bp, Rattus norvegicus
agaagtggctaatacctctgccttc

SEQ ID NO: 106257 - DNA, 25 bp, Rattus norvegicus
agaagtggctcaccctacactgagg

SEQ ID NO: 106258 - DNA, 25 bp, Rattus norvegicus
agaagtggctcagcctacactgagg

SEQ ID NO: 106259 - DNA, 25 bp, Rattus norvegicus
agaagtggctggcaagatccccaaa

SEQ ID NO: 106260 - DNA, 25 bp, Rattus norvegicus
agaagtggctgggaagatccccaaa

SEQ ID NO: 106261 - DNA, 25 bp, Rattus norvegicus
agaagtgggtctcggctgcttttca

SEQ ID NO: 106262 - DNA, 25 bp, Rattus norvegicus
agaagtgggtctgggctgcttttca

SEQ ID NO: 106263 - DNA, 25 bp, Rattus norvegicus
agaagtggtcacagggccaccatac

SEQ ID NO: 106264 - DNA, 25 bp, Rattus norvegicus
agaagtggtcacagtggttagtcac

SEQ ID NO: 106265 - DNA, 25 bp, Rattus norvegicus
agaagtggtcactgggccaccatac

SEQ ID NO: 106266 - DNA, 25 bp, Rattus norvegicus
agaagtggtcactgtggttagtcac

SEQ ID NO: 106267 - DNA, 25 bp, Rattus norvegicus
agaagtggtcatagctgtcacaccc

SEQ ID NO: 106268 - DNA, 25 bp, Rattus norvegicus
agaagtggtcatcacgtcctaccag

SEQ ID NO: 106269 - DNA, 25 bp, Rattus norvegicus
agaagtggtcatgacgtcctaccag

SEQ ID NO: 106270 - DNA, 25 bp, Rattus norvegicus
agaagtggtcattgctgtcacaccc

SEQ ID NO: 106271 - DNA, 25 bp, Rattus norvegicus
agaagtggtgcaccctgtttaccca

SEQ ID NO: 106272 - DNA, 25 bp, Rattus norvegicus
agaagtggtgcagcctgtttaccca

SEQ ID NO: 106273 - DNA, 25 bp, Rattus norvegicus
agaagtgtacttactgtctctccat

SEQ ID NO: 106274 - DNA, 25 bp, Rattus norvegicus
agaagtgtactttctgtctctccat

SEQ ID NO: 106275 - DNA, 25 bp, Rattus norvegicus
agaagtgtatgacccaccgcaaccg

SEQ ID NO: 106276 - DNA, 25 bp, Rattus norvegicus
agaagtgtatgagccaccgcaaccg

SEQ ID NO: 106277 - DNA, 25 bp, Rattus norvegicus
agaagtgtcacacgcgcaccgtgta

SEQ ID NO: 106278 - DNA, 25 bp, Rattus norvegicus
agaagtgtcacaggcgcaccgtgta

SEQ ID NO: 106279 - DNA, 25 bp, Rattus norvegicus
agaagtgtcaccagcacagcccaaa

SEQ ID NO: 106280 - DNA, 25 bp, Rattus norvegicus
agaagtgtcacctgcacagcccaaa

SEQ ID NO: 106281 - DNA, 25 bp, Rattus norvegicus
agaagtgtcactccaaggaatcaac

SEQ ID NO: 106282 - DNA, 25 bp, Rattus norvegicus
agaagtgtcactgcaaggaatcaac

SEQ ID NO: 106283 - DNA, 25 bp, Rattus norvegicus
agaagtgtccaccaaagagcaagtg

SEQ ID NO: 106284 - DNA, 25 bp, Rattus norvegicus
agaagtgtccacgaaagagcaagtg

SEQ ID NO: 106285 - DNA, 25 bp, Rattus norvegicus
agaagtgtccagatgcattgcccat

SEQ ID NO: 106286 - DNA, 25 bp, Rattus norvegicus
agaagtgtccagttgcattgcccat

SEQ ID NO: 106287 - DNA, 25 bp, Rattus norvegicus
agaagtgtccctcggctgactgtgc

SEQ ID NO: 106288 - DNA, 25 bp, Rattus norvegicus
agaagtgtccctgggctgactgtgc

SEQ ID NO: 106289 - DNA, 25 bp, Rattus norvegicus
agaagtgtcctgcattgtggcttta

SEQ ID NO: 106290 - DNA, 25 bp, Rattus norvegicus
agaagtgtcctggattgtggcttta

SEQ ID NO: 106291 - DNA, 25 bp, Rattus norvegicus
agaagtgtcgtccatgaagctgcag

SEQ ID NO: 106292 - DNA, 25 bp, Rattus norvegicus
agaagtgtcgtcgatgaagctgcag

SEQ ID NO: 106293 - DNA, 25 bp, Rattus norvegicus
agaagtgtctagaggcctcagcagc

SEQ ID NO: 106294 - DNA, 25 bp, Rattus norvegicus
agaagtgtctagtggcctcagcagc

SEQ ID NO: 106295 - DNA, 25 bp, Rattus norvegicus
agaagtgtctgaatcctgctggctt

SEQ ID NO: 106296 - DNA, 25 bp, Rattus norvegicus
agaagtgtctgattcctgctggctt

SEQ ID NO: 106297 - DNA, 25 bp, Rattus norvegicus
agaagtgtctggatgctcgttccca

SEQ ID NO: 106298 - DNA, 25 bp, Rattus norvegicus
agaagtgtctggttgctcgttccca

SEQ ID NO: 106299 - DNA, 25 bp, Rattus norvegicus
agaagtgtcttgagtagcctggtac

SEQ ID NO: 106300 - DNA, 25 bp, Rattus norvegicus
agaagtgtcttgctggtttgtccac

SEQ ID NO: 106301 - DNA, 25 bp, Rattus norvegicus
agaagtgtcttggtggtttgtccac

SEQ ID NO: 106302 - DNA, 25 bp, Rattus norvegicus
agaagtgtcttgtgtagcctggtac

SEQ ID NO: 106303 - DNA, 25 bp, Rattus norvegicus
agaagtgtctttcccagtcactctc

SEQ ID NO: 106304 - DNA, 25 bp, Rattus norvegicus
agaagtgtctttgccagtcactctc

SEQ ID NO: 106305 - DNA, 25 bp, Rattus norvegicus
agaagtgtgcaacccggtatcctct

SEQ ID NO: 106306 - DNA, 25 bp, Rattus norvegicus
agaagtgtgcaagccggtatcctct

SEQ ID NO: 106307 - DNA, 25 bp, Rattus norvegicus
agaagtgtgctcatgcagcagctat

SEQ ID NO: 106308 - DNA, 25 bp, Rattus norvegicus
agaagtgtgctcttgcagcagctat

SEQ ID NO: 106309 - DNA, 25 bp, Rattus norvegicus
agaagtgtggcccaggctagccctc

SEQ ID NO: 106310 - DNA, 25 bp, Rattus norvegicus
agaagtgtggccgaggctagccctc

SEQ ID NO: 106311 - DNA, 25 bp, Rattus norvegicus
agaagtgtgggcaggctcttacttc

SEQ ID NO: 106312 - DNA, 25 bp, Rattus norvegicus
agaagtgtgggctggctcttacttc

SEQ ID NO: 106313 - DNA, 25 bp, Rattus norvegicus
agaagtgtgtttcagggcttgcctc

SEQ ID NO: 106314 - DNA, 25 bp, Rattus norvegicus
agaagtgtgtttgagggcttgcctc

SEQ ID NO: 106315 - DNA, 25 bp, Rattus norvegicus
agaagtgttactatcggcttgaata

SEQ ID NO: 106316 - DNA, 25 bp, Rattus norvegicus
agaagtgttactctccatatcccac

SEQ ID NO: 106317 - DNA, 25 bp, Rattus norvegicus
agaagtgttactgtccatatcccac

SEQ ID NO: 106318 - DNA, 25 bp, Rattus norvegicus
agaagtgttactttcggcttgaata

SEQ ID NO: 106319 - DNA, 25 bp, Rattus norvegicus
agaagtgttgacagccaaagcagca

SEQ ID NO: 106320 - DNA, 25 bp, Rattus norvegicus
agaagtgttgactgccaaagcagca

SEQ ID NO: 106321 - DNA, 25 bp, Rattus norvegicus
agaagtgttgatagagtcccgcctc

SEQ ID NO: 106322 - DNA, 25 bp, Rattus norvegicus
agaagtgttgattgagtcccgcctc

SEQ ID NO: 106323 - DNA, 25 bp, Rattus norvegicus
agaagttaaggcctcctactctgaa

SEQ ID NO: 106324 - DNA, 25 bp, Rattus norvegicus
agaagttaaggcgtcctactctgaa

SEQ ID NO: 106325 - DNA, 25 bp, Rattus norvegicus
agaagttaccacagtgctgctccat

SEQ ID NO: 106326 - DNA, 25 bp, Rattus norvegicus
agaagttaccactgtgctgctccat

SEQ ID NO: 106327 - DNA, 25 bp, Rattus norvegicus
agaagttagccgcacatctcttgtt

SEQ ID NO: 106328 - DNA, 25 bp, Rattus norvegicus
agaagttagccggacatctcttgtt

SEQ ID NO: 106329 - DNA, 25 bp, Rattus norvegicus
agaagttaggccagcaaccacgtgt

SEQ ID NO: 106330 - DNA, 25 bp, Rattus norvegicus
agaagttaggcctgcaaccacgtgt

SEQ ID NO: 106331 - DNA, 25 bp, Rattus norvegicus
agaagttagtgtcctctctgtaata

SEQ ID NO: 106332 - DNA, 25 bp, Rattus norvegicus
agaagttagtgtgctctctgtaata

SEQ ID NO: 106333 - DNA, 25 bp, Rattus norvegicus
agaagttatctgctgtttctttact

SEQ ID NO: 106334 - DNA, 25 bp, Rattus norvegicus
agaagttatctggtgtttctttact

SEQ ID NO: 106335 - DNA, 25 bp, Rattus norvegicus
agaagttcaaacaatgcctgcctct

SEQ ID NO: 106336 - DNA, 25 bp, Rattus norvegicus
agaagttcaaactatgcctgcctct

SEQ ID NO: 106337 - DNA, 25 bp, Rattus norvegicus
agaagttcaccgagcattcactact

SEQ ID NO: 106338 - DNA, 25 bp, Rattus norvegicus
agaagttcaccgtgcattcactact

SEQ ID NO: 106339 - DNA, 25 bp, Rattus norvegicus
agaagttcacttcggttatcccagg

SEQ ID NO: 106340 - DNA, 25 bp, Rattus norvegicus
agaagttcacttgggttatcccagg

SEQ ID NO: 106341 - DNA, 25 bp, Rattus norvegicus
agaagttcagttctctgctctttgg

SEQ ID NO: 106342 - DNA, 25 bp, Rattus norvegicus
agaagttcagttgtctgctctttgg

SEQ ID NO: 106343 - DNA, 25 bp, Rattus norvegicus
agaagttcatcaccgactacctctg

SEQ ID NO: 106344 - DNA, 25 bp, Rattus norvegicus
agaagttcatcagcgactacctctg

SEQ ID NO: 106345 - DNA, 25 bp, Rattus norvegicus
agaagttccacacccagcaacacgg

SEQ ID NO: 106346 - DNA, 25 bp, Rattus norvegicus
agaagttccacagccagcaacacgg

SEQ ID NO: 106347 - DNA, 25 bp, Rattus norvegicus
agaagttccagactgacgccagaga

SEQ ID NO: 106348 - DNA, 25 bp, Rattus norvegicus
agaagttccagagtgacgccagaga

SEQ ID NO: 106349 - DNA, 25 bp, Rattus norvegicus
agaagttccagtactgtgccccaat

SEQ ID NO: 106350 - DNA, 25 bp, Rattus norvegicus
agaagttccagttctgtgccccaat

SEQ ID NO: 106351 - DNA, 25 bp, Rattus norvegicus
agaagttccgcacccaggcttctac

SEQ ID NO: 106352 - DNA, 25 bp, Rattus norvegicus
agaagttccgcagccaggcttctac

SEQ ID NO: 106353 - DNA, 25 bp, Rattus norvegicus
agaagttcctagagtgtgctcagca

SEQ ID NO: 106354 - DNA, 25 bp, Rattus norvegicus
agaagttcctagtgtgtgctcagca

SEQ ID NO: 106355 - DNA, 25 bp, Rattus norvegicus
agaagttcctccagaaggttccact

SEQ ID NO: 106356 - DNA, 25 bp, Rattus norvegicus
agaagttcctcctgaaggttccact

SEQ ID NO: 106357 - DNA, 25 bp, Rattus norvegicus
agaagttcctctcacacaaattcac

SEQ ID NO: 106358 - DNA, 25 bp, Rattus norvegicus
agaagttcctctgacacaaattcac

SEQ ID NO: 106359 - DNA, 25 bp, Rattus norvegicus
agaagttcctgtctcttatttaaat

SEQ ID NO: 106360 - DNA, 25 bp, Rattus norvegicus
agaagttcctgtgtcttatttaaat

SEQ ID NO: 106361 - DNA, 25 bp, Rattus norvegicus
agaagttctaatacagggtccctga

SEQ ID NO: 106362 - DNA, 25 bp, Rattus norvegicus
agaagttctaattcagggtccctga

SEQ ID NO: 106363 - DNA, 25 bp, Rattus norvegicus
agaagttctagcacaccccgaggga

SEQ ID NO: 106364 - DNA, 25 bp, Rattus norvegicus
agaagttctagctcaccccgaggga

SEQ ID NO: 106365 - DNA, 25 bp, Rattus norvegicus
agaagttctcatacctgcaaggcaa

SEQ ID NO: 106366 - DNA, 25 bp, Rattus norvegicus
agaagttctcattcctgcaaggcaa

SEQ ID NO: 106367 - DNA, 25 bp, Rattus norvegicus
agaagttctcccacagtaggatctc

SEQ ID NO: 106368 - DNA, 25 bp, Rattus norvegicus
agaagttctccctcagtaggatctc

SEQ ID NO: 106369 - DNA, 25 bp, Rattus norvegicus
agaagttctctgaatggcctgctag

SEQ ID NO: 106370 - DNA, 25 bp, Rattus norvegicus
agaagttctctgagagggccagcaa

SEQ ID NO: 106371 - DNA, 25 bp, Rattus norvegicus
agaagttctctgtatggcctgctag

SEQ ID NO: 106372 - DNA, 25 bp, Rattus norvegicus
agaagttctctgtgagggccagcaa

SEQ ID NO: 106373 - DNA, 25 bp, Rattus norvegicus
agaagttctgatacccctccatagt

SEQ ID NO: 106374 - DNA, 25 bp, Rattus norvegicus
agaagttctgattcccctccatagt

SEQ ID NO: 106375 - DNA, 25 bp, Rattus norvegicus
agaagttctgcaccaaagtcctccc

SEQ ID NO: 106376 - DNA, 25 bp, Rattus norvegicus
agaagttctgcagcaaagtcctccc

SEQ ID NO: 106377 - DNA, 25 bp, Rattus norvegicus
agaagttcttctccaaacggccgag

SEQ ID NO: 106378 - DNA, 25 bp, Rattus norvegicus
agaagttcttctgcaaacggccgag

SEQ ID NO: 106379 - DNA, 25 bp, Rattus norvegicus
agaagttgactgcataggcgcgcca

SEQ ID NO: 106380 - DNA, 25 bp, Rattus norvegicus
agaagttgactggataggcgcgcca

SEQ ID NO: 106381 - DNA, 25 bp, Rattus norvegicus
agaagttgaggtacgctttccgtat

SEQ ID NO: 106382 - DNA, 25 bp, Rattus norvegicus
agaagttgaggttcgctttccgtat

SEQ ID NO: 106383 - DNA, 25 bp, Rattus norvegicus
agaagttgattcctctgggctttgt

SEQ ID NO: 106384 - DNA, 25 bp, Rattus norvegicus
agaagttgattcgtctgggctttgt

SEQ ID NO: 106385 - DNA, 25 bp, Rattus norvegicus
agaagttgcagtatgcccttggcga

SEQ ID NO: 106386 - DNA, 25 bp, Rattus norvegicus
agaagttgcagtttgcccttggcga

SEQ ID NO: 106387 - DNA, 25 bp, Rattus norvegicus
agaagttgccaaacaccaaacccta

SEQ ID NO: 106388 - DNA, 25 bp, Rattus norvegicus
agaagttgccaatcaccaaacccta

SEQ ID NO: 106389 - DNA, 25 bp, Rattus norvegicus
agaagttgccatagggctgctgttc

SEQ ID NO: 106390 - DNA, 25 bp, Rattus norvegicus
agaagttgccatcgactccatcgtc

SEQ ID NO: 106391 - DNA, 25 bp, Rattus norvegicus
agaagttgccatggactccatcgtc

SEQ ID NO: 106392 - DNA, 25 bp, Rattus norvegicus
agaagttgccattgggctgctgttc

SEQ ID NO: 106393 - DNA, 25 bp, Rattus norvegicus
agaagttgcccaagatcggccgtac

SEQ ID NO: 106394 - DNA, 25 bp, Rattus norvegicus
agaagttgcccatgatcggccgtac

SEQ ID NO: 106395 - DNA, 25 bp, Rattus norvegicus
agaagttgcgttcgtatttcaagct

SEQ ID NO: 106396 - DNA, 25 bp, Rattus norvegicus
agaagttgcgttggtatttcaagct

SEQ ID NO: 106397 - DNA, 25 bp, Rattus norvegicus
agaagttgctacagactcctttggc

SEQ ID NO: 106398 - DNA, 25 bp, Rattus norvegicus
agaagttgctactgactcctttggc

SEQ ID NO: 106399 - DNA, 25 bp, Rattus norvegicus
agaagttgctagcactgctgtctcc

SEQ ID NO: 106400 - DNA, 25 bp, Rattus norvegicus
agaagttgctaggactgctgtctcc

SEQ ID NO: 106401 - DNA, 25 bp, Rattus norvegicus
agaagttgctgcaggcctggactga

SEQ ID NO: 106402 - DNA, 25 bp, Rattus norvegicus
agaagttgctgctggcctggactga

SEQ ID NO: 106403 - DNA, 25 bp, Rattus norvegicus
agaagttgctggatccttagagtct

SEQ ID NO: 106404 - DNA, 25 bp, Rattus norvegicus
agaagttgctggttccttagagtct

SEQ ID NO: 106405 - DNA, 25 bp, Rattus norvegicus
agaagttggagcatcagagcctgca

SEQ ID NO: 106406 - DNA, 25 bp, Rattus norvegicus
agaagttggagcttcagagcctgca

SEQ ID NO: 106407 - DNA, 25 bp, Rattus norvegicus
agaagttgttcaagcgccgcagggt

SEQ ID NO: 106408 - DNA, 25 bp, Rattus norvegicus
agaagttgttcatgcgccgcagggt

SEQ ID NO: 106409 - DNA, 25 bp, Rattus norvegicus
agaagttgtttgacctgcctaagcc

SEQ ID NO: 106410 - DNA, 25 bp, Rattus norvegicus
agaagttgtttgtcctgcctaagcc

SEQ ID NO: 106411 - DNA, 25 bp, Rattus norvegicus
agaagtttacgtcgtggctgctcac

SEQ ID NO: 106412 - DNA, 25 bp, Rattus norvegicus
agaagtttacgtggtggctgctcac

SEQ ID NO: 106413 - DNA, 25 bp, Rattus norvegicus
agaagtttcagaactcagcccaggg

SEQ ID NO: 106414 - DNA, 25 bp, Rattus norvegicus
agaagtttcagatctcagcccaggg

SEQ ID NO: 106415 - DNA, 25 bp, Rattus norvegicus
agaagtttcaggacacagccctcaa

SEQ ID NO: 106416 - DNA, 25 bp, Rattus norvegicus
agaagtttcaggcatctctgtctcc

SEQ ID NO: 106417 - DNA, 25 bp, Rattus norvegicus
agaagtttcagggatctctgtctcc

SEQ ID NO: 106418 - DNA, 25 bp, Rattus norvegicus
agaagtttcaggtcacagccctcaa

SEQ ID NO: 106419 - DNA, 25 bp, Rattus norvegicus
agaagtttccctagctgtgtgaaga

SEQ ID NO: 106420 - DNA, 25 bp, Rattus norvegicus
agaagtttcccttgctgtgtgaaga

SEQ ID NO: 106421 - DNA, 25 bp, Rattus norvegicus
agaagtttctgaagccgagggccat

SEQ ID NO: 106422 - DNA, 25 bp, Rattus norvegicus
agaagtttctgatgccgagggccat

SEQ ID NO: 106423 - DNA, 25 bp, Rattus norvegicus
agaagtttctgcagactctgagtcc

SEQ ID NO: 106424 - DNA, 25 bp, Rattus norvegicus
agaagtttctgctgactctgagtcc

SEQ ID NO: 106425 - DNA, 25 bp, Rattus norvegicus
agaagtttgagtctctgaccctgca

SEQ ID NO: 106426 - DNA, 25 bp, Rattus norvegicus
agaagtttgagtgtctgaccctgca

SEQ ID NO: 106427 - DNA, 25 bp, Rattus norvegicus
agaagtttgctcacaggcttccgaa

SEQ ID NO: 106428 - DNA, 25 bp, Rattus norvegicus
agaagtttgctctcaggcttccgaa

SEQ ID NO: 106429 - DNA, 25 bp, Rattus norvegicus
agaagtttggtcctccatgactttt

SEQ ID NO: 106430 - DNA, 25 bp, Rattus norvegicus
agaagtttggtcgtccatgactttt

SEQ ID NO: 106431 - DNA, 25 bp, Rattus norvegicus
agaagtttgtaactgcctgcaaggg

SEQ ID NO: 106432 - DNA, 25 bp, Rattus norvegicus
agaagtttgtaagtgcctgcaaggg

SEQ ID NO: 106433 - DNA, 25 bp, Rattus norvegicus
agaagtttgtgaccctgacccacca

SEQ ID NO: 106434 - DNA, 25 bp, Rattus norvegicus
agaagtttgtgagcctgacccacca

SEQ ID NO: 106435 - DNA, 25 bp, Rattus norvegicus
agaagttttatcactgcacagtcag

SEQ ID NO: 106436 - DNA, 25 bp, Rattus norvegicus
agaagttttatctctgcacagtcag

SEQ ID NO: 106437 - DNA, 25 bp, Rattus norvegicus
agaataaagattcctcaggcctgcc

SEQ ID NO: 106438 - DNA, 25 bp, Rattus norvegicus
agaataaagattgctcaggcctgcc

SEQ ID NO: 106439 - DNA, 25 bp, Rattus norvegicus
agaataaatgcgacctcttcagagg

SEQ ID NO: 106440 - DNA, 25 bp, Rattus norvegicus
agaataaatgcgtcctcttcagagg

SEQ ID NO: 106441 - DNA, 25 bp, Rattus norvegicus
agaataaattgtcgcttccccggtg

SEQ ID NO: 106442 - DNA, 25 bp, Rattus norvegicus
agaataaattgtggcttccccggtg

SEQ ID NO: 106443 - DNA, 25 bp, Rattus norvegicus
agaataacctgcagtgttccatctg

SEQ ID NO: 106444 - DNA, 25 bp, Rattus norvegicus
agaataacctgctgtgttccatctg

SEQ ID NO: 106445 - DNA, 25 bp, Rattus norvegicus
agaataactaccactgccgctgcag

SEQ ID NO: 106446 - DNA, 25 bp, Rattus norvegicus
agaataactacctctgccgctgcag

SEQ ID NO: 106447 - DNA, 25 bp, Rattus norvegicus
agaataagatctcggcatttgctgc

SEQ ID NO: 106448 - DNA, 25 bp, Rattus norvegicus
agaataagatctgggcatttgctgc

SEQ ID NO: 106449 - DNA, 25 bp, Rattus norvegicus
agaataagcttcagagtactcagat

SEQ ID NO: 106450 - DNA, 25 bp, Rattus norvegicus
agaataagcttctgagtactcagat

SEQ ID NO: 106451 - DNA, 25 bp, Rattus norvegicus
agaataatcacacattcccgactct

SEQ ID NO: 106452 - DNA, 25 bp, Rattus norvegicus
agaataatcacagattcccgactct

SEQ ID NO: 106453 - DNA, 25 bp, Rattus norvegicus
agaatacacatcatagggccaccac

SEQ ID NO: 106454 - DNA, 25 bp, Rattus norvegicus
agaatacacatcttagggccaccac

SEQ ID NO: 106455 - DNA, 25 bp, Rattus norvegicus
agaatacaccgtcgcctgaggcaga

SEQ ID NO: 106456 - DNA, 25 bp, Rattus norvegicus
agaatacaccgtggcctgaggcaga

SEQ ID NO: 106457 - DNA, 25 bp, Rattus norvegicus
agaatacaccttcactgctagcctg

SEQ ID NO: 106458 - DNA, 25 bp, Rattus norvegicus
agaatacaccttgactgctagcctg

SEQ ID NO: 106459 - DNA, 25 bp, Rattus norvegicus
agaatacacgcgagtacccaggcgt

SEQ ID NO: 106460 - DNA, 25 bp, Rattus norvegicus
agaatacacgcgtgtacccaggcgt

SEQ ID NO: 106461 - DNA, 25 bp, Rattus norvegicus
agaatacagtagagcatccccacag

SEQ ID NO: 106462 - DNA, 25 bp, Rattus norvegicus
agaatacagtagtgcatccccacag

SEQ ID NO: 106463 - DNA, 25 bp, Rattus norvegicus
agaatacagttcaattcccacaccc

SEQ ID NO: 106464 - DNA, 25 bp, Rattus norvegicus
agaatacagttctattcccacaccc

SEQ ID NO: 106465 - DNA, 25 bp, Rattus norvegicus
agaatacattgcacaccaggaaccc

SEQ ID NO: 106466 - DNA, 25 bp, Rattus norvegicus
agaatacattgctcaccaggaaccc

SEQ ID NO: 106467 - DNA, 25 bp, Rattus norvegicus
agaataccaggcactctcattggca

SEQ ID NO: 106468 - DNA, 25 bp, Rattus norvegicus
agaataccaggctctctcattggca

SEQ ID NO: 106469 - DNA, 25 bp, Rattus norvegicus
agaatacccattaccaggcagctag

SEQ ID NO: 106470 - DNA, 25 bp, Rattus norvegicus
agaatacccatttccaggcagctag

SEQ ID NO: 106471 - DNA, 25 bp, Rattus norvegicus
agaatacccgcaatggcactttatc

SEQ ID NO: 106472 - DNA, 25 bp, Rattus norvegicus
agaatacccgcattggcactttatc

SEQ ID NO: 106473 - DNA, 25 bp, Rattus norvegicus
agaatacctgacacctgtactacag

SEQ ID NO: 106474 - DNA, 25 bp, Rattus norvegicus
agaatacctgactcctgtactacag

SEQ ID NO: 106475 - DNA, 25 bp, Rattus norvegicus
agaatacctttcaatggcttcctgt

SEQ ID NO: 106476 - DNA, 25 bp, Rattus norvegicus
agaatacctttctatggcttcctgt

SEQ ID NO: 106477 - DNA, 25 bp, Rattus norvegicus
agaatacgaattcctgaccttggcc

SEQ ID NO: 106478 - DNA, 25 bp, Rattus norvegicus
agaatacgaattgctgaccttggcc

SEQ ID NO: 106479 - DNA, 25 bp, Rattus norvegicus
agaatacgtggacccagcttcaccg

SEQ ID NO: 106480 - DNA, 25 bp, Rattus norvegicus
agaatacgtggagccagcttcaccg

SEQ ID NO: 106481 - DNA, 25 bp, Rattus norvegicus
agaatactgaatcgctgagactaaa

SEQ ID NO: 106482 - DNA, 25 bp, Rattus norvegicus
agaatactgaatggctgagactaaa

SEQ ID NO: 106483 - DNA, 25 bp, Rattus norvegicus
agaatactgactccggatgctacct

SEQ ID NO: 106484 - DNA, 25 bp, Rattus norvegicus
agaatactgactgcggatgctacct

SEQ ID NO: 106485 - DNA, 25 bp, Rattus norvegicus
agaatactggcaccttctccgagtc

SEQ ID NO: 106486 - DNA, 25 bp, Rattus norvegicus
agaatactggcagcttctccgagtc

SEQ ID NO: 106487 - DNA, 25 bp, Rattus norvegicus
agaatacttccgcacgtcatctaac

SEQ ID NO: 106488 - DNA, 25 bp, Rattus norvegicus
agaatacttccggacgtcatctaac

SEQ ID NO: 106489 - DNA, 25 bp, Rattus norvegicus
agaatacttcctaccttggtctcat

SEQ ID NO: 106490 - DNA, 25 bp, Rattus norvegicus
agaatacttccttccttggtctcat

SEQ ID NO: 106491 - DNA, 25 bp, Rattus norvegicus
agaatacttctgatccctttaagag

SEQ ID NO: 106492 - DNA, 25 bp, Rattus norvegicus
agaatacttctgttccctttaagag

SEQ ID NO: 106493 - DNA, 25 bp, Rattus norvegicus
agaatagaaagaacagggcccggag

SEQ ID NO: 106494 - DNA, 25 bp, Rattus norvegicus
agaatagaaagatcagggcccggag

SEQ ID NO: 106495 - DNA, 25 bp, Rattus norvegicus
agaatagaagcaccttcctgccagg

SEQ ID NO: 106496 - DNA, 25 bp, Rattus norvegicus
agaatagaagcagcttcctgccagg

SEQ ID NO: 106497 - DNA, 25 bp, Rattus norvegicus
agaatagcaagcacaaccctttgcc

SEQ ID NO: 106498 - DNA, 25 bp, Rattus norvegicus
agaatagcaagctcaaccctttgcc

SEQ ID NO: 106499 - DNA, 25 bp, Rattus norvegicus
agaatagcacctcgtctgctgctgc

SEQ ID NO: 106500 - DNA, 25 bp, Rattus norvegicus
agaatagcacctggtctgctgctgc

SEQ ID NO: 106501 - DNA, 25 bp, Rattus norvegicus
agaatagcagccaccagtgatacca

SEQ ID NO: 106502 - DNA, 25 bp, Rattus norvegicus
agaatagcagcctccagtgatacca

SEQ ID NO: 106503 - DNA, 25 bp, Rattus norvegicus
agaatagcatctagcccaatcagcc

SEQ ID NO: 106504 - DNA, 25 bp, Rattus norvegicus
agaatagcatcttgcccaatcagcc

SEQ ID NO: 106505 - DNA, 25 bp, Rattus norvegicus
agaatagccagccatggtctccgag

SEQ ID NO: 106506 - DNA, 25 bp, Rattus norvegicus
agaatagccagcgatggtctccgag

SEQ ID NO: 106507 - DNA, 25 bp, Rattus norvegicus
agaatagctgcaaggcactgaccct

SEQ ID NO: 106508 - DNA, 25 bp, Rattus norvegicus
agaatagctgcatggcactgaccct

SEQ ID NO: 106509 - DNA, 25 bp, Rattus norvegicus
agaatagcttccatgaaactcccct

SEQ ID NO: 106510 - DNA, 25 bp, Rattus norvegicus
agaatagcttccttgaaactcccct

SEQ ID NO: 106511 - DNA, 25 bp, Rattus norvegicus
agaatagtgaggattctctcccaga

SEQ ID NO: 106512 - DNA, 25 bp, Rattus norvegicus
agaatagtgaggtttctctcccaga

SEQ ID NO: 106513 - DNA, 25 bp, Rattus norvegicus
agaatagtgctcatgttttcattta

SEQ ID NO: 106514 - DNA, 25 bp, Rattus norvegicus
agaatagtgctcttgttttcattta

SEQ ID NO: 106515 - DNA, 25 bp, Rattus norvegicus
agaatagtgctgatcacctaggagg

SEQ ID NO: 106516 - DNA, 25 bp, Rattus norvegicus
agaatagtgctgttcacctaggagg

SEQ ID NO: 106517 - DNA, 25 bp, Rattus norvegicus
agaatagttctcactcaagtgaatg

SEQ ID NO: 106518 - DNA, 25 bp, Rattus norvegicus
agaatagttctctctcaagtgaatg

SEQ ID NO: 106519 - DNA, 25 bp, Rattus norvegicus
agaatatactcacccaatcttgaca

SEQ ID NO: 106520 - DNA, 25 bp, Rattus norvegicus
agaatatactcagccaatcttgaca

SEQ ID NO: 106521 - DNA, 25 bp, Rattus norvegicus
agaatatattctctcttgctaatta

SEQ ID NO: 106522 - DNA, 25 bp, Rattus norvegicus
agaatatattctgtcttgctaatta

SEQ ID NO: 106523 - DNA, 25 bp, Rattus norvegicus
agaatatcaagcaccctcatgcggg

SEQ ID NO: 106524 - DNA, 25 bp, Rattus norvegicus
agaatatcaagcaggccgcttcgct

SEQ ID NO: 106525 - DNA, 25 bp, Rattus norvegicus
agaatatcaagctccctcatgcggg

SEQ ID NO: 106526 - DNA, 25 bp, Rattus norvegicus
agaatatcaagctggccgcttcgct

SEQ ID NO: 106527 - DNA, 25 bp, Rattus norvegicus
agaatatcagtgctttccctcagga

SEQ ID NO: 106528 - DNA, 25 bp, Rattus norvegicus
agaatatcagtggtttccctcagga

SEQ ID NO: 106529 - DNA, 25 bp, Rattus norvegicus
agaatatcatctcggctaacctgcg

SEQ ID NO: 106530 - DNA, 25 bp, Rattus norvegicus
agaatatcatctgggctaacctgcg

SEQ ID NO: 106531 - DNA, 25 bp, Rattus norvegicus
agaatatccagaagcccaaacccct

SEQ ID NO: 106532 - DNA, 25 bp, Rattus norvegicus
agaatatccagatgcccaaacccct

SEQ ID NO: 106533 - DNA, 25 bp, Rattus norvegicus
agaatatccgccattgtggccaaag

SEQ ID NO: 106534 - DNA, 25 bp, Rattus norvegicus
agaatatccgcctttgtggccaaag

SEQ ID NO: 106535 - DNA, 25 bp, Rattus norvegicus
agaatatcctacactgtcgtagtta

SEQ ID NO: 106536 - DNA, 25 bp, Rattus norvegicus
agaatatcctactctgtcgtagtta

SEQ ID NO: 106537 - DNA, 25 bp, Rattus norvegicus
agaatatgatccctcgcctggaggt

SEQ ID NO: 106538 - DNA, 25 bp, Rattus norvegicus
agaatatgatccgtcgcctggaggt

SEQ ID NO: 106539 - DNA, 25 bp, Rattus norvegicus
agaatatgatcgaccccttgggaac

SEQ ID NO: 106540 - DNA, 25 bp, Rattus norvegicus
agaatatgatcgtccccttgggaac

SEQ ID NO: 106541 - DNA, 25 bp, Rattus norvegicus
agaatatgcagtccgcatgtcccgt

SEQ ID NO: 106542 - DNA, 25 bp, Rattus norvegicus
agaatatgcagtgcgcatgtcccgt

SEQ ID NO: 106543 - DNA, 25 bp, Rattus norvegicus
agaatatgctccattatggtacccc

SEQ ID NO: 106544 - DNA, 25 bp, Rattus norvegicus
agaatatgctcctttatggtacccc

SEQ ID NO: 106545 - DNA, 25 bp, Rattus norvegicus
agaatatgtcatattaccacggctg

SEQ ID NO: 106546 - DNA, 25 bp, Rattus norvegicus
agaatatgtcattttaccacggctg

SEQ ID NO: 106547 - DNA, 25 bp, Rattus norvegicus
agaatatgtcttcctgcgattgccg

SEQ ID NO: 106548 - DNA, 25 bp, Rattus norvegicus
agaatatgtcttgctgcgattgccg

SEQ ID NO: 106549 - DNA, 25 bp, Rattus norvegicus
agaatattcactatcatcgttcggg

SEQ ID NO: 106550 - DNA, 25 bp, Rattus norvegicus
agaatattcactttcatcgttcggg

SEQ ID NO: 106551 - DNA, 25 bp, Rattus norvegicus
agaatattcgtgctccgaggccttg

SEQ ID NO: 106552 - DNA, 25 bp, Rattus norvegicus
agaatattcgtggtccgaggccttg

SEQ ID NO: 106553 - DNA, 25 bp, Rattus norvegicus
agaatattctgccatgtctagttat

SEQ ID NO: 106554 - DNA, 25 bp, Rattus norvegicus
agaatattctgcgatgtctagttat

SEQ ID NO: 106555 - DNA, 25 bp, Rattus norvegicus
agaatatttggtaccatccctggac

SEQ ID NO: 106556 - DNA, 25 bp, Rattus norvegicus
agaatatttggttccatccctggac

SEQ ID NO: 106557 - DNA, 25 bp, Rattus norvegicus
agaatattttcacggcttgcgtggg

SEQ ID NO: 106558 - DNA, 25 bp, Rattus norvegicus
agaatattttcagggcttgcgtggg

SEQ ID NO: 106559 - DNA, 25 bp, Rattus norvegicus
agaatatttttacagcactccaagg

SEQ ID NO: 106560 - DNA, 25 bp, Rattus norvegicus
agaatatttttagagcactccaagg

SEQ ID NO: 106561 - DNA, 25 bp, Rattus norvegicus
agaatcaaacgaactatccctcacc

SEQ ID NO: 106562 - DNA, 25 bp, Rattus norvegicus
agaatcaaacgatctatccctcacc

SEQ ID NO: 106563 - DNA, 25 bp, Rattus norvegicus
agaatcaagactccctgagataaaa

SEQ ID NO: 106564 - DNA, 25 bp, Rattus norvegicus
agaatcaagactgcctgagataaaa

SEQ ID NO: 106565 - DNA, 25 bp, Rattus norvegicus
agaatcaaggccaacgtgcgtgcga

SEQ ID NO: 106566 - DNA, 25 bp, Rattus norvegicus
agaatcaaggcctacgtgcgtgcga

SEQ ID NO: 106567 - DNA, 25 bp, Rattus norvegicus
agaatcaatctgaaccctaggtagt

SEQ ID NO: 106568 - DNA, 25 bp, Rattus norvegicus
agaatcaatctgtaccctaggtagt

SEQ ID NO: 106569 - DNA, 25 bp, Rattus norvegicus
agaatcacagcaactgggaccttca

SEQ ID NO: 106570 - DNA, 25 bp, Rattus norvegicus
agaatcacagcatctgggaccttca

SEQ ID NO: 106571 - DNA, 25 bp, Rattus norvegicus
agaatcacatgaacgaagcagactg

SEQ ID NO: 106572 - DNA, 25 bp, Rattus norvegicus
agaatcacatgatcgaagcagactg

SEQ ID NO: 106573 - DNA, 25 bp, Rattus norvegicus
agaatcaccacaactgctcgagctt

SEQ ID NO: 106574 - DNA, 25 bp, Rattus norvegicus
agaatcaccacatctgctcgagctt

SEQ ID NO: 106575 - DNA, 25 bp, Rattus norvegicus
agaatcaccatcaggagcctgagga

SEQ ID NO: 106576 - DNA, 25 bp, Rattus norvegicus
agaatcaccatctggagcctgagga

SEQ ID NO: 106577 - DNA, 25 bp, Rattus norvegicus
agaatcacccagaaagagtcttagt

SEQ ID NO: 106578 - DNA, 25 bp, Rattus norvegicus
agaatcacccagtaagagtcttagt

SEQ ID NO: 106579 - DNA, 25 bp, Rattus norvegicus
agaatcaccccaactctgggctgtg

SEQ ID NO: 106580 - DNA, 25 bp, Rattus norvegicus
agaatcaccccatctctgggctgtg

SEQ ID NO: 106581 - DNA, 25 bp, Rattus norvegicus
agaatcacctatctctttgccttca

SEQ ID NO: 106582 - DNA, 25 bp, Rattus norvegicus
agaatcacctatgtctttgccttca

SEQ ID NO: 106583 - DNA, 25 bp, Rattus norvegicus
agaatcagaggtctccagccttcct

SEQ ID NO: 106584 - DNA, 25 bp, Rattus norvegicus
agaatcagaggtgtccagccttcct

SEQ ID NO: 106585 - DNA, 25 bp, Rattus norvegicus
agaatcagcaacacatcgacaggaa

SEQ ID NO: 106586 - DNA, 25 bp, Rattus norvegicus
agaatcagcaactcatcgacaggaa

SEQ ID NO: 106587 - DNA, 25 bp, Rattus norvegicus
agaatcagcccaaactcattgagtt

SEQ ID NO: 106588 - DNA, 25 bp, Rattus norvegicus
agaatcagcccatactcattgagtt

SEQ ID NO: 106589 - DNA, 25 bp, Rattus norvegicus
agaatcaggtccacgggatgctcag

SEQ ID NO: 106590 - DNA, 25 bp, Rattus norvegicus
agaatcaggtccattgcacgcctgg

SEQ ID NO: 106591 - DNA, 25 bp, Rattus norvegicus
agaatcaggtcctcgggatgctcag

SEQ ID NO: 106592 - DNA, 25 bp, Rattus norvegicus
agaatcaggtcctttgcacgcctgg

SEQ ID NO: 106593 - DNA, 25 bp, Rattus norvegicus
agaatcaggtgtagtctcatcctct

SEQ ID NO: 106594 - DNA, 25 bp, Rattus norvegicus
agaatcaggtgttgtctcatcctct

SEQ ID NO: 106595 - DNA, 25 bp, Rattus norvegicus
agaatcataggtaccactggacagc

SEQ ID NO: 106596 - DNA, 25 bp, Rattus norvegicus
agaatcataggttccactggacagc

SEQ ID NO: 106597 - DNA, 25 bp, Rattus norvegicus
agaatcatgccacgtcccatggagt

SEQ ID NO: 106598 - DNA, 25 bp, Rattus norvegicus
agaatcatgccaggtcccatggagt

SEQ ID NO: 106599 - DNA, 25 bp, Rattus norvegicus
agaatcatgctgacccgcagtgagc

SEQ ID NO: 106600 - DNA, 25 bp, Rattus norvegicus
agaatcatgctgtcccgcagtgagc

SEQ ID NO: 106601 - DNA, 25 bp, Rattus norvegicus
agaatcatggtcactcgcagtgaag

SEQ ID NO: 106602 - DNA, 25 bp, Rattus norvegicus
agaatcatggtctctcgcagtgaag

SEQ ID NO: 106603 - DNA, 25 bp, Rattus norvegicus
agaatcattgaaaccctctcatctg

SEQ ID NO: 106604 - DNA, 25 bp, Rattus norvegicus
agaatcattgaatccctctcatctg

SEQ ID NO: 106605 - DNA, 25 bp, Rattus norvegicus
agaatcattggtaatgagcgccgga

SEQ ID NO: 106606 - DNA, 25 bp, Rattus norvegicus
agaatcattggttatgagcgccgga

SEQ ID NO: 106607 - DNA, 25 bp, Rattus norvegicus
agaatcatttttccagtcaggcagt

SEQ ID NO: 106608 - DNA, 25 bp, Rattus norvegicus
agaatcatttttgcagtcaggcagt

SEQ ID NO: 106609 - DNA, 25 bp, Rattus norvegicus
agaatccaaagaccccgcggacgag

SEQ ID NO: 106610 - DNA, 25 bp, Rattus norvegicus
agaatccaaagagcccgcggacgag

SEQ ID NO: 106611 - DNA, 25 bp, Rattus norvegicus
agaatccaattactgctccataaaa

SEQ ID NO: 106612 - DNA, 25 bp, Rattus norvegicus
agaatccaattagtgctccataaaa

SEQ ID NO: 106613 - DNA, 25 bp, Rattus norvegicus
agaatccacattcccttcttgattt

SEQ ID NO: 106614 - DNA, 25 bp, Rattus norvegicus
agaatccacattgccttcttgattt

SEQ ID NO: 106615 - DNA, 25 bp, Rattus norvegicus
agaatccacccactgctggtttttc

SEQ ID NO: 106616 - DNA, 25 bp, Rattus norvegicus
agaatccacccagtgctggtttttc

SEQ ID NO: 106617 - DNA, 25 bp, Rattus norvegicus
agaatccacgtcaggtgtctcacag

SEQ ID NO: 106618 - DNA, 25 bp, Rattus norvegicus
agaatccacgtctggtgtctcacag

SEQ ID NO: 106619 - DNA, 25 bp, Rattus norvegicus
agaatccactctacctcagcagctt

SEQ ID NO: 106620 - DNA, 25 bp, Rattus norvegicus
agaatccactcttcctcagcagctt

SEQ ID NO: 106621 - DNA, 25 bp, Rattus norvegicus
agaatccagcgaactttctcacttt

SEQ ID NO: 106622 - DNA, 25 bp, Rattus norvegicus
agaatccagcgatctttctcacttt

SEQ ID NO: 106623 - DNA, 25 bp, Rattus norvegicus
agaatccaggcaacagggcagtcct

SEQ ID NO: 106624 - DNA, 25 bp, Rattus norvegicus
agaatccaggcatcagggcagtcct

SEQ ID NO: 106625 - DNA, 25 bp, Rattus norvegicus
agaatccaggccaggcttgactcct

SEQ ID NO: 106626 - DNA, 25 bp, Rattus norvegicus
agaatccaggcctggcttgactcct

SEQ ID NO: 106627 - DNA, 25 bp, Rattus norvegicus
agaatccaggctcactcacggagtg

SEQ ID NO: 106628 - DNA, 25 bp, Rattus norvegicus
agaatccaggctgactcacggagtg

SEQ ID NO: 106629 - DNA, 25 bp, Rattus norvegicus
agaatccagttcacctacaggtgta

SEQ ID NO: 106630 - DNA, 25 bp, Rattus norvegicus
agaatccagttctcctacaggtgta

SEQ ID NO: 106631 - DNA, 25 bp, Rattus norvegicus
agaatccatccaaagcattcaggga

SEQ ID NO: 106632 - DNA, 25 bp, Rattus norvegicus
agaatccatccacgcctgtaaactg

SEQ ID NO: 106633 - DNA, 25 bp, Rattus norvegicus
agaatccatccaggcctgtaaactg

SEQ ID NO: 106634 - DNA, 25 bp, Rattus norvegicus
agaatccatccatagcattcaggga

SEQ ID NO: 106635 - DNA, 25 bp, Rattus norvegicus
agaatcccaaagagtgagccccaga

SEQ ID NO: 106636 - DNA, 25 bp, Rattus norvegicus
agaatcccaaagtgtgagccccaga

SEQ ID NO: 106637 - DNA, 25 bp, Rattus norvegicus
agaatcccacaacctccaataaaac

SEQ ID NO: 106638 - DNA, 25 bp, Rattus norvegicus
agaatcccacaagctccaataaaac

SEQ ID NO: 106639 - DNA, 25 bp, Rattus norvegicus
agaatcccacggaactggagctaca

SEQ ID NO: 106640 - DNA, 25 bp, Rattus norvegicus
agaatcccacggtactggagctaca

SEQ ID NO: 106641 - DNA, 25 bp, Rattus norvegicus
agaatcccaggccaaatccttcgga

SEQ ID NO: 106642 - DNA, 25 bp, Rattus norvegicus
agaatcccaggcgaaatccttcgga

SEQ ID NO: 106643 - DNA, 25 bp, Rattus norvegicus
agaatcccatctcgttggtcactgt

SEQ ID NO: 106644 - DNA, 25 bp, Rattus norvegicus
agaatcccatctggttggtcactgt

SEQ ID NO: 106645 - DNA, 25 bp, Rattus norvegicus
agaatcccatgtagctaagtccaca

SEQ ID NO: 106646 - DNA, 25 bp, Rattus norvegicus
agaatcccatgttgctaagtccaca

SEQ ID NO: 106647 - DNA, 25 bp, Rattus norvegicus
agaatcccctttctgggctgcagtg

SEQ ID NO: 106648 - DNA, 25 bp, Rattus norvegicus
agaatcccctttgtgggctgcagtg

SEQ ID NO: 106649 - DNA, 25 bp, Rattus norvegicus
agaatccctagaatttcgcatctcc

SEQ ID NO: 106650 - DNA, 25 bp, Rattus norvegicus
agaatccctagattttcgcatctcc

SEQ ID NO: 106651 - DNA, 25 bp, Rattus norvegicus
agaatccctcaactcttaccaagct

SEQ ID NO: 106652 - DNA, 25 bp, Rattus norvegicus
agaatccctcaagtcttaccaagct

SEQ ID NO: 106653 - DNA, 25 bp, Rattus norvegicus
agaatccctgctctaaatgtcctcc

SEQ ID NO: 106654 - DNA, 25 bp, Rattus norvegicus
agaatccctgctgtaaatgtcctcc

SEQ ID NO: 106655 - DNA, 25 bp, Rattus norvegicus
agaatccctggacaacgtgcgccac

SEQ ID NO: 106656 - DNA, 25 bp, Rattus norvegicus
agaatccctggagaacgtgcgccac

SEQ ID NO: 106657 - DNA, 25 bp, Rattus norvegicus
agaatccgaggtcccagacagacag

SEQ ID NO: 106658 - DNA, 25 bp, Rattus norvegicus
agaatccgaggtgccagacagacag

SEQ ID NO: 106659 - DNA, 25 bp, Rattus norvegicus
agaatccggaagatccctggtgtcc

SEQ ID NO: 106660 - DNA, 25 bp, Rattus norvegicus
agaatccggaagttccctggtgtcc

SEQ ID NO: 106661 - DNA, 25 bp, Rattus norvegicus
agaatccggcccagaagtgcctgag

SEQ ID NO: 106662 - DNA, 25 bp, Rattus norvegicus
agaatccggccctgaagtgcctgag

SEQ ID NO: 106663 - DNA, 25 bp, Rattus norvegicus
agaatccggttcctatgttctgcgg

SEQ ID NO: 106664 - DNA, 25 bp, Rattus norvegicus
agaatccggttcgtatgttctgcgg

SEQ ID NO: 106665 - DNA, 25 bp, Rattus norvegicus
agaatccgttgtccatgttgctcct

SEQ ID NO: 106666 - DNA, 25 bp, Rattus norvegicus
agaatccgttgtgcatgttgctcct

SEQ ID NO: 106667 - DNA, 25 bp, Rattus norvegicus
agaatcctaagacacgctggcttgg

SEQ ID NO: 106668 - DNA, 25 bp, Rattus norvegicus
agaatcctaagagacgctggcttgg

SEQ ID NO: 106669 - DNA, 25 bp, Rattus norvegicus
agaatcctacttaccatgttttatt

SEQ ID NO: 106670 - DNA, 25 bp, Rattus norvegicus
agaatcctactttccatgttttatt

SEQ ID NO: 106671 - DNA, 25 bp, Rattus norvegicus
agaatcctaggaaacaactctctgg

SEQ ID NO: 106672 - DNA, 25 bp, Rattus norvegicus
agaatcctaggatacaactctctgg

SEQ ID NO: 106673 - DNA, 25 bp, Rattus norvegicus
agaatcctccaccaccgagtctgga

SEQ ID NO: 106674 - DNA, 25 bp, Rattus norvegicus
agaatcctccacgaccgagtctgga

SEQ ID NO: 106675 - DNA, 25 bp, Rattus norvegicus
agaatcctctccaggtggtgggctc

SEQ ID NO: 106676 - DNA, 25 bp, Rattus norvegicus
agaatcctctcctggtggtgggctc

SEQ ID NO: 106677 - DNA, 25 bp, Rattus norvegicus
agaatcctgaaccagactctgatga

SEQ ID NO: 106678 - DNA, 25 bp, Rattus norvegicus
agaatcctgaacgagactctgatga

SEQ ID NO: 106679 - DNA, 25 bp, Rattus norvegicus
agaatcctgaatccctgctttgaaa

SEQ ID NO: 106680 - DNA, 25 bp, Rattus norvegicus
agaatcctgaatgcctgctttgaaa

SEQ ID NO: 106681 - DNA, 25 bp, Rattus norvegicus
agaatcctgagacccgcttctttgg

SEQ ID NO: 106682 - DNA, 25 bp, Rattus norvegicus
agaatcctgagagccgcttctttgg

SEQ ID NO: 106683 - DNA, 25 bp, Rattus norvegicus
agaatcctgccaccatctaagtgag

SEQ ID NO: 106684 - DNA, 25 bp, Rattus norvegicus
agaatcctgccagcatctaagtgag

SEQ ID NO: 106685 - DNA, 25 bp, Rattus norvegicus
agaatcctgctgactcaaccaaagg

SEQ ID NO: 106686 - DNA, 25 bp, Rattus norvegicus
agaatcctgctgtctcaaccaaagg

SEQ ID NO: 106687 - DNA, 25 bp, Rattus norvegicus
agaatccttaaactgcctcatggca

SEQ ID NO: 106688 - DNA, 25 bp, Rattus norvegicus
agaatccttaaagtgcctcatggca

SEQ ID NO: 106689 - DNA, 25 bp, Rattus norvegicus
agaatccttaatccttatttcctct

SEQ ID NO: 106690 - DNA, 25 bp, Rattus norvegicus
agaatccttaatgcttatttcctct

SEQ ID NO: 106691 - DNA, 25 bp, Rattus norvegicus
agaatccttgggagcagatcatgct

SEQ ID NO: 106692 - DNA, 25 bp, Rattus norvegicus
agaatccttgggtgcagatcatgct

SEQ ID NO: 106693 - DNA, 25 bp, Rattus norvegicus
agaatcctttcactgagcctcaggc

SEQ ID NO: 106694 - DNA, 25 bp, Rattus norvegicus
agaatcctttcagtgagcctcaggc

SEQ ID NO: 106695 - DNA, 25 bp, Rattus norvegicus
agaatccttttactcttgctgtcac

SEQ ID NO: 106696 - DNA, 25 bp, Rattus norvegicus
agaatccttttagtcttgctgtcac

SEQ ID NO: 106697 - DNA, 25 bp, Rattus norvegicus
agaatcgaaactatccatcagccct

SEQ ID NO: 106698 - DNA, 25 bp, Rattus norvegicus
agaatcgaaactcttctgcctcaaa

SEQ ID NO: 106699 - DNA, 25 bp, Rattus norvegicus
agaatcgaaactgttctgcctcaaa

SEQ ID NO: 106700 - DNA, 25 bp, Rattus norvegicus
agaatcgaaactttccatcagccct

SEQ ID NO: 106701 - DNA, 25 bp, Rattus norvegicus
agaatcgaggagagcgtgcctatat

SEQ ID NO: 106702 - DNA, 25 bp, Rattus norvegicus
agaatcgaggagtgcgtgcctatat

SEQ ID NO: 106703 - DNA, 25 bp, Rattus norvegicus
agaatcgagggcatcactcagcgca

SEQ ID NO: 106704 - DNA, 25 bp, Rattus norvegicus
agaatcgagggcttcactcagcgca

SEQ ID NO: 106705 - DNA, 25 bp, Rattus norvegicus
agaatcgataacatgagctcattgt

SEQ ID NO: 106706 - DNA, 25 bp, Rattus norvegicus
agaatcgataacttgagctcattgt

SEQ ID NO: 106707 - DNA, 25 bp, Rattus norvegicus
agaatcgcacaacccttggagggta

SEQ ID NO: 106708 - DNA, 25 bp, Rattus norvegicus
agaatcgcacaagccttggagggta

SEQ ID NO: 106709 - DNA, 25 bp, Rattus norvegicus
agaatcgcctctctgttccgggaaa

SEQ ID NO: 106710 - DNA, 25 bp, Rattus norvegicus
agaatcgcctctgtgttccgggaaa

SEQ ID NO: 106711 - DNA, 25 bp, Rattus norvegicus
agaatcgctcagatttgggtctccc

SEQ ID NO: 106712 - DNA, 25 bp, Rattus norvegicus
agaatcgctcagttttgggtctccc

SEQ ID NO: 106713 - DNA, 25 bp, Rattus norvegicus
agaatcgcttcgagtttgttatagt

SEQ ID NO: 106714 - DNA, 25 bp, Rattus norvegicus
agaatcgcttcgtgtttgttatagt

SEQ ID NO: 106715 - DNA, 25 bp, Rattus norvegicus
agaatcggctctctatcctagcaga

SEQ ID NO: 106716 - DNA, 25 bp, Rattus norvegicus
agaatcggctctgtatcctagcaga

SEQ ID NO: 106717 - DNA, 25 bp, Rattus norvegicus
agaatcgggagcagtctgatctctg

SEQ ID NO: 106718 - DNA, 25 bp, Rattus norvegicus
agaatcgggagctgtctgatctctg

SEQ ID NO: 106719 - DNA, 25 bp, Rattus norvegicus
agaatcgggctcatagctgcagctg

SEQ ID NO: 106720 - DNA, 25 bp, Rattus norvegicus
agaatcgggctcttagctgcagctg

SEQ ID NO: 106721 - DNA, 25 bp, Rattus norvegicus
agaatcggtgacatcattgatgtga

SEQ ID NO: 106722 - DNA, 25 bp, Rattus norvegicus
agaatcggtgacttcattgatgtga

SEQ ID NO: 106723 - DNA, 25 bp, Rattus norvegicus
agaatcgtaaacacttcgacctcct

SEQ ID NO: 106724 - DNA, 25 bp, Rattus norvegicus
agaatcgtaaactcttcgacctcct

SEQ ID NO: 106725 - DNA, 25 bp, Rattus norvegicus
agaatcgtgggcagctggttcctga

SEQ ID NO: 106726 - DNA, 25 bp, Rattus norvegicus
agaatcgtgggctgctggttcctga

SEQ ID NO: 106727 - DNA, 25 bp, Rattus norvegicus
agaatctaacttatctccatgtgtg

SEQ ID NO: 106728 - DNA, 25 bp, Rattus norvegicus
agaatctaacttttctccatgtgtg

SEQ ID NO: 106729 - DNA, 25 bp, Rattus norvegicus
agaatctaagaaacccatcctgcac

SEQ ID NO: 106730 - DNA, 25 bp, Rattus norvegicus
agaatctaagaatcccatcctgcac

SEQ ID NO: 106731 - DNA, 25 bp, Rattus norvegicus
agaatctaatgtccatctgtccccg

SEQ ID NO: 106732 - DNA, 25 bp, Rattus norvegicus
agaatctaatgtgcatctgtccccg

SEQ ID NO: 106733 - DNA, 25 bp, Rattus norvegicus
agaatctacagcagctggtcctggg

SEQ ID NO: 106734 - DNA, 25 bp, Rattus norvegicus
agaatctacagctgctggtcctggg

SEQ ID NO: 106735 - DNA, 25 bp, Rattus norvegicus
agaatctactcacggcagttaaaat

SEQ ID NO: 106736 - DNA, 25 bp, Rattus norvegicus
agaatctactcagggcagttaaaat

SEQ ID NO: 106737 - DNA, 25 bp, Rattus norvegicus
agaatctactccacagacagcgacg

SEQ ID NO: 106738 - DNA, 25 bp, Rattus norvegicus
agaatctactcctcagacagcgacg

SEQ ID NO: 106739 - DNA, 25 bp, Rattus norvegicus
agaatctattacagctccgtgcacc

SEQ ID NO: 106740 - DNA, 25 bp, Rattus norvegicus
agaatctattactgctccgtgcacc

SEQ ID NO: 106741 - DNA, 25 bp, Rattus norvegicus
agaatctattagcttccctgtggac

SEQ ID NO: 106742 - DNA, 25 bp, Rattus norvegicus
agaatctattaggttccctgtggac

SEQ ID NO: 106743 - DNA, 25 bp, Rattus norvegicus
agaatctcaacacctgtttgcagca

SEQ ID NO: 106744 - DNA, 25 bp, Rattus norvegicus
agaatctcaacagctgtttgcagca

SEQ ID NO: 106745 - DNA, 25 bp, Rattus norvegicus
agaatctcataaagtagccctggct

SEQ ID NO: 106746 - DNA, 25 bp, Rattus norvegicus
agaatctcataatgtagccctggct

SEQ ID NO: 106747 - DNA, 25 bp, Rattus norvegicus
agaatctcccgcctggaaaggcatg

SEQ ID NO: 106748 - DNA, 25 bp, Rattus norvegicus
agaatctcccgcgtggaaaggcatg

SEQ ID NO: 106749 - DNA, 25 bp, Rattus norvegicus
agaatctcctctcagggtgaatcca

SEQ ID NO: 106750 - DNA, 25 bp, Rattus norvegicus
agaatctcctctgagggtgaatcca

SEQ ID NO: 106751 - DNA, 25 bp, Rattus norvegicus
agaatctcctggagtgaaggccctc

SEQ ID NO: 106752 - DNA, 25 bp, Rattus norvegicus
agaatctcctggtgtgaaggccctc

SEQ ID NO: 106753 - DNA, 25 bp, Rattus norvegicus
agaatctcgtaactcacggtctgcc

SEQ ID NO: 106754 - DNA, 25 bp, Rattus norvegicus
agaatctcgtaagtcacggtctgcc

SEQ ID NO: 106755 - DNA, 25 bp, Rattus norvegicus
agaatctcgtatcccattttccact

SEQ ID NO: 106756 - DNA, 25 bp, Rattus norvegicus
agaatctcgtatgccattttccact

SEQ ID NO: 106757 - DNA, 25 bp, Rattus norvegicus
agaatctcgtgtcttcatccctgga

SEQ ID NO: 106758 - DNA, 25 bp, Rattus norvegicus
agaatctcgtgtgttcatccctgga

SEQ ID NO: 106759 - DNA, 25 bp, Rattus norvegicus
agaatctctctcctctacttgggag

SEQ ID NO: 106760 - DNA, 25 bp, Rattus norvegicus
agaatctctctcgtctacttgggag

SEQ ID NO: 106761 - DNA, 25 bp, Rattus norvegicus
agaatctctgtgagggagggcccat

SEQ ID NO: 106762 - DNA, 25 bp, Rattus norvegicus
agaatctctgtgtgggagggcccat

SEQ ID NO: 106763 - DNA, 25 bp, Rattus norvegicus
agaatctcttttcagtctcctgtca

SEQ ID NO: 106764 - DNA, 25 bp, Rattus norvegicus
agaatctcttttgagtctcctgtca

SEQ ID NO: 106765 - DNA, 25 bp, Rattus norvegicus
agaatctgaattctctaccccattc

SEQ ID NO: 106766 - DNA, 25 bp, Rattus norvegicus
agaatctgaattgtctaccccattc

SEQ ID NO: 106767 - DNA, 25 bp, Rattus norvegicus
agaatctgagttctcttccagtcct

SEQ ID NO: 106768 - DNA, 25 bp, Rattus norvegicus
agaatctgagttgtcttccagtcct

SEQ ID NO: 106769 - DNA, 25 bp, Rattus norvegicus
agaatctgatcaccatgtctgccta

SEQ ID NO: 106770 - DNA, 25 bp, Rattus norvegicus
agaatctgatcagcatgtctgccta

SEQ ID NO: 106771 - DNA, 25 bp, Rattus norvegicus
agaatctgatgcagtgcgcactgca

SEQ ID NO: 106772 - DNA, 25 bp, Rattus norvegicus
agaatctgatgctgtgcgcactgca

SEQ ID NO: 106773 - DNA, 25 bp, Rattus norvegicus
agaatctgcagcagcacctgctgtg

SEQ ID NO: 106774 - DNA, 25 bp, Rattus norvegicus
agaatctgcagctgcacctgctgtg

SEQ ID NO: 106775 - DNA, 25 bp, Rattus norvegicus
agaatctgcccaacacggtgggtgg

SEQ ID NO: 106776 - DNA, 25 bp, Rattus norvegicus
agaatctgcccatcacggtgggtgg

SEQ ID NO: 106777 - DNA, 25 bp, Rattus norvegicus
agaatctgctgaaattccgggcctg

SEQ ID NO: 106778 - DNA, 25 bp, Rattus norvegicus
agaatctgctgatattccgggcctg

SEQ ID NO: 106779 - DNA, 25 bp, Rattus norvegicus
agaatctgcttgatggccccaaaaa

SEQ ID NO: 106780 - DNA, 25 bp, Rattus norvegicus
agaatctgcttgttggccccaaaaa

SEQ ID NO: 106781 - DNA, 25 bp, Rattus norvegicus
agaatctggcctacatcgacgagtc

SEQ ID NO: 106782 - DNA, 25 bp, Rattus norvegicus
agaatctggccttcatcgacgagtc

SEQ ID NO: 106783 - DNA, 25 bp, Rattus norvegicus
agaatctgggacagggcaaatgttt

SEQ ID NO: 106784 - DNA, 25 bp, Rattus norvegicus
agaatctgggactgggcaaatgttt

SEQ ID NO: 106785 - DNA, 25 bp, Rattus norvegicus
agaatctggtcactgcgacctgcaa

SEQ ID NO: 106786 - DNA, 25 bp, Rattus norvegicus
agaatctggtcagtgcgacctgcaa

SEQ ID NO: 106787 - DNA, 25 bp, Rattus norvegicus
agaatctgtaggctgcttgtgtcca

SEQ ID NO: 106788 - DNA, 25 bp, Rattus norvegicus
agaatctgtagggtgcttgtgtcca

SEQ ID NO: 106789 - DNA, 25 bp, Rattus norvegicus
agaatctgtgttccttgcagctgac

SEQ ID NO: 106790 - DNA, 25 bp, Rattus norvegicus
agaatctgtgttgcttgcagctgac

SEQ ID NO: 106791 - DNA, 25 bp, Rattus norvegicus
agaatcttactcatccacatggcac

SEQ ID NO: 106792 - DNA, 25 bp, Rattus norvegicus
agaatcttactcttccacatggcac

SEQ ID NO: 106793 - DNA, 25 bp, Rattus norvegicus
agaatcttcatccatggcctttaag

SEQ ID NO: 106794 - DNA, 25 bp, Rattus norvegicus
agaatcttcatcgatggcctttaag

SEQ ID NO: 106795 - DNA, 25 bp, Rattus norvegicus
agaatcttctctccgtttcagggag

SEQ ID NO: 106796 - DNA, 25 bp, Rattus norvegicus
agaatcttctctgcgtttcagggag

SEQ ID NO: 106797 - DNA, 25 bp, Rattus norvegicus
agaatcttgctcctgcacgtagtat

SEQ ID NO: 106798 - DNA, 25 bp, Rattus norvegicus
agaatcttgctcgtgcacgtagtat

SEQ ID NO: 106799 - DNA, 25 bp, Rattus norvegicus
agaatcttggtcactcctgtttgtt

SEQ ID NO: 106800 - DNA, 25 bp, Rattus norvegicus
agaatcttggtctctcctgtttgtt

SEQ ID NO: 106801 - DNA, 25 bp, Rattus norvegicus
agaatcttggtgcacacgcacctgt

SEQ ID NO: 106802 - DNA, 25 bp, Rattus norvegicus
agaatcttggtggacacgcacctgt

SEQ ID NO: 106803 - DNA, 25 bp, Rattus norvegicus
agaatcttttctacctttgaccata

SEQ ID NO: 106804 - DNA, 25 bp, Rattus norvegicus
agaatcttttctcggctggtttgta

SEQ ID NO: 106805 - DNA, 25 bp, Rattus norvegicus
agaatcttttctgggctggtttgta

SEQ ID NO: 106806 - DNA, 25 bp, Rattus norvegicus
agaatcttttcttcctttgaccata

SEQ ID NO: 106807 - DNA, 25 bp, Rattus norvegicus
agaatcttttgtactcatgagcctt

SEQ ID NO: 106808 - DNA, 25 bp, Rattus norvegicus
agaatcttttgttctcatgagcctt

SEQ ID NO: 106809 - DNA, 25 bp, Rattus norvegicus
agaatctttttcagagactcccatc

SEQ ID NO: 106810 - DNA, 25 bp, Rattus norvegicus
agaatctttttctgagactcccatc

SEQ ID NO: 106811 - DNA, 25 bp, Rattus norvegicus
agaatgaaaaccacctagccagctg

SEQ ID NO: 106812 - DNA, 25 bp, Rattus norvegicus
agaatgaaaacctcctagccagctg

SEQ ID NO: 106813 - DNA, 25 bp, Rattus norvegicus
agaatgaaagtcatctacttcagag

SEQ ID NO: 106814 - DNA, 25 bp, Rattus norvegicus
agaatgaaagtcttctacttcagag

SEQ ID NO: 106815 - DNA, 25 bp, Rattus norvegicus
agaatgaacgtgcacaggccttccg

SEQ ID NO: 106816 - DNA, 25 bp, Rattus norvegicus
agaatgaacgtggacaggccttccg

SEQ ID NO: 106817 - DNA, 25 bp, Rattus norvegicus
agaatgaactctatggcctttgata

SEQ ID NO: 106818 - DNA, 25 bp, Rattus norvegicus
agaatgaactctttggcctttgata

SEQ ID NO: 106819 - DNA, 25 bp, Rattus norvegicus
agaatgaatcaaacccctgaagcct

SEQ ID NO: 106820 - DNA, 25 bp, Rattus norvegicus
agaatgaatcaatcccctgaagcct

SEQ ID NO: 106821 - DNA, 25 bp, Rattus norvegicus
agaatgacacctactcaggtcacct

SEQ ID NO: 106822 - DNA, 25 bp, Rattus norvegicus
agaatgacaccttctcaggtcacct

SEQ ID NO: 106823 - DNA, 25 bp, Rattus norvegicus
agaatgacagctccctacatctgaa

SEQ ID NO: 106824 - DNA, 25 bp, Rattus norvegicus
agaatgacagctgcctacatctgaa

SEQ ID NO: 106825 - DNA, 25 bp, Rattus norvegicus
agaatgacaggtccacttggccctc

SEQ ID NO: 106826 - DNA, 25 bp, Rattus norvegicus
agaatgacaggtgcacttggccctc

SEQ ID NO: 106827 - DNA, 25 bp, Rattus norvegicus
agaatgacccagactcctagaggag

SEQ ID NO: 106828 - DNA, 25 bp, Rattus norvegicus
agaatgacccagtctcctagaggag

SEQ ID NO: 106829 - DNA, 25 bp, Rattus norvegicus
agaatgaccccaatgagggcctgga

SEQ ID NO: 106830 - DNA, 25 bp, Rattus norvegicus
agaatgaccccattgagggcctgga

SEQ ID NO: 106831 - DNA, 25 bp, Rattus norvegicus
agaatgaccctcctttcatcggaaa

SEQ ID NO: 106832 - DNA, 25 bp, Rattus norvegicus
agaatgaccctcgtttcatcggaaa

SEQ ID NO: 106833 - DNA, 25 bp, Rattus norvegicus
agaatgaccctgatgtcactcctgg

SEQ ID NO: 106834 - DNA, 25 bp, Rattus norvegicus
agaatgaccctgttgtcactcctgg

SEQ ID NO: 106835 - DNA, 25 bp, Rattus norvegicus
agaatgacctaaccttccttcgaat

SEQ ID NO: 106836 - DNA, 25 bp, Rattus norvegicus
agaatgacctaagcttccttcgaat

SEQ ID NO: 106837 - DNA, 25 bp, Rattus norvegicus
agaatgacctggctcctgtggccca

SEQ ID NO: 106838 - DNA, 25 bp, Rattus norvegicus
agaatgacctgggtcctgtggccca

SEQ ID NO: 106839 - DNA, 25 bp, Rattus norvegicus
agaatgactagtcccaagtccttcc

SEQ ID NO: 106840 - DNA, 25 bp, Rattus norvegicus
agaatgactagtgccaagtccttcc

SEQ ID NO: 106841 - DNA, 25 bp, Rattus norvegicus
agaatgactccactttaggcagcca

SEQ ID NO: 106842 - DNA, 25 bp, Rattus norvegicus
agaatgactccagtttaggcagcca

SEQ ID NO: 106843 - DNA, 25 bp, Rattus norvegicus
agaatgactcgcctctgtctgtggg

SEQ ID NO: 106844 - DNA, 25 bp, Rattus norvegicus
agaatgactcgcgtctgtctgtggg

SEQ ID NO: 106845 - DNA, 25 bp, Rattus norvegicus
agaatgactctgagccttcactgat

SEQ ID NO: 106846 - DNA, 25 bp, Rattus norvegicus
agaatgactctgtgccttcactgat

SEQ ID NO: 106847 - DNA, 25 bp, Rattus norvegicus
agaatgactgaaaggtcaagcccct

SEQ ID NO: 106848 - DNA, 25 bp, Rattus norvegicus
agaatgactgaatggtcaagcccct

SEQ ID NO: 106849 - DNA, 25 bp, Rattus norvegicus
agaatgactgtcagtgccgagttaa

SEQ ID NO: 106850 - DNA, 25 bp, Rattus norvegicus
agaatgactgtctgtgccgagttaa

SEQ ID NO: 106851 - DNA, 25 bp, Rattus norvegicus
agaatgagactgaggcccctcgaga

SEQ ID NO: 106852 - DNA, 25 bp, Rattus norvegicus
agaatgagactgtggcccctcgaga

SEQ ID NO: 106853 - DNA, 25 bp, Rattus norvegicus
agaatgagatctccatcccagaccc

SEQ ID NO: 106854 - DNA, 25 bp, Rattus norvegicus
agaatgagatctgcatcccagaccc

SEQ ID NO: 106855 - DNA, 25 bp, Rattus norvegicus
agaatgagccagctagccccattgc

SEQ ID NO: 106856 - DNA, 25 bp, Rattus norvegicus
agaatgagccaggtagccccattgc

SEQ ID NO: 106857 - DNA, 25 bp, Rattus norvegicus
agaatgagccccagaggcttggcat

SEQ ID NO: 106858 - DNA, 25 bp, Rattus norvegicus
agaatgagcccctgaggcttggcat

SEQ ID NO: 106859 - DNA, 25 bp, Rattus norvegicus
agaatgaggcagcattccctttccc

SEQ ID NO: 106860 - DNA, 25 bp, Rattus norvegicus
agaatgaggcaggattccctttccc

SEQ ID NO: 106861 - DNA, 25 bp, Rattus norvegicus
agaatgaggcgtatcagactgagaa

SEQ ID NO: 106862 - DNA, 25 bp, Rattus norvegicus
agaatgaggcgtttcagactgagaa

SEQ ID NO: 106863 - DNA, 25 bp, Rattus norvegicus
agaatgatactaatcccaccctggg

SEQ ID NO: 106864 - DNA, 25 bp, Rattus norvegicus
agaatgatactattcccaccctggg

SEQ ID NO: 106865 - DNA, 25 bp, Rattus norvegicus
agaatgatccgcatctattcctctg

SEQ ID NO: 106866 - DNA, 25 bp, Rattus norvegicus
agaatgatccgcttctattcctctg

SEQ ID NO: 106867 - DNA, 25 bp, Rattus norvegicus
agaatgatcgttatccagccaacat

SEQ ID NO: 106868 - DNA, 25 bp, Rattus norvegicus
agaatgatcgttttccagccaacat

SEQ ID NO: 106869 - DNA, 25 bp, Rattus norvegicus
agaatgatcttcatggacatcccaa

SEQ ID NO: 106870 - DNA, 25 bp, Rattus norvegicus
agaatgatcttcttggacatcccaa

SEQ ID NO: 106871 - DNA, 25 bp, Rattus norvegicus
agaatgatgagcagtgaccccgcgc

SEQ ID NO: 106872 - DNA, 25 bp, Rattus norvegicus
agaatgatgagctgtgaccccgcgc

SEQ ID NO: 106873 - DNA, 25 bp, Rattus norvegicus
agaatgatgataccctgcactggaa

SEQ ID NO: 106874 - DNA, 25 bp, Rattus norvegicus
agaatgatgatagcctgcactggaa

SEQ ID NO: 106875 - DNA, 25 bp, Rattus norvegicus
agaatgatgcctagtgttctgtgaa

SEQ ID NO: 106876 - DNA, 25 bp, Rattus norvegicus
agaatgatgccttgtgttctgtgaa

SEQ ID NO: 106877 - DNA, 25 bp, Rattus norvegicus
agaatgatgctcacttttttaagat

SEQ ID NO: 106878 - DNA, 25 bp, Rattus norvegicus
agaatgatgctctcttttttaagat

SEQ ID NO: 106879 - DNA, 25 bp, Rattus norvegicus
agaatgatttggcttcctccattgg

SEQ ID NO: 106880 - DNA, 25 bp, Rattus norvegicus
agaatgatttgggttcctccattgg

SEQ ID NO: 106881 - DNA, 25 bp, Rattus norvegicus
agaatgcacaggctcgagtatttcc

SEQ ID NO: 106882 - DNA, 25 bp, Rattus norvegicus
agaatgcacagggtcgagtatttcc

SEQ ID NO: 106883 - DNA, 25 bp, Rattus norvegicus
agaatgcacagtactttctccctta

SEQ ID NO: 106884 - DNA, 25 bp, Rattus norvegicus
agaatgcacagttctttctccctta

SEQ ID NO: 106885 - DNA, 25 bp, Rattus norvegicus
agaatgcagaagcttcaaccccatc

SEQ ID NO: 106886 - DNA, 25 bp, Rattus norvegicus
agaatgcagaaggttcaaccccatc

SEQ ID NO: 106887 - DNA, 25 bp, Rattus norvegicus
agaatgcagaatcggctttttcacc

SEQ ID NO: 106888 - DNA, 25 bp, Rattus norvegicus
agaatgcagaatgggctttttcacc

SEQ ID NO: 106889 - DNA, 25 bp, Rattus norvegicus
agaatgcagacacgccttgttcggg

SEQ ID NO: 106890 - DNA, 25 bp, Rattus norvegicus
agaatgcagacaggccttgttcggg

SEQ ID NO: 106891 - DNA, 25 bp, Rattus norvegicus
agaatgcagttgctctctctcctag

SEQ ID NO: 106892 - DNA, 25 bp, Rattus norvegicus
agaatgcagttggtctctctcctag

SEQ ID NO: 106893 - DNA, 25 bp, Rattus norvegicus
agaatgccagaaatacttccctccc

SEQ ID NO: 106894 - DNA, 25 bp, Rattus norvegicus
agaatgccagaattacttccctccc

SEQ ID NO: 106895 - DNA, 25 bp, Rattus norvegicus
agaatgccagctcttcctcgaagag

SEQ ID NO: 106896 - DNA, 25 bp, Rattus norvegicus
agaatgccagctgttcctcgaagag

SEQ ID NO: 106897 - DNA, 25 bp, Rattus norvegicus
agaatgcccaagacagacagagtag

SEQ ID NO: 106898 - DNA, 25 bp, Rattus norvegicus
agaatgcccaagtcagacagagtag

SEQ ID NO: 106899 - DNA, 25 bp, Rattus norvegicus
agaatgcccagcagtagccagagcc

SEQ ID NO: 106900 - DNA, 25 bp, Rattus norvegicus
agaatgcccagctgtagccagagcc

SEQ ID NO: 106901 - DNA, 25 bp, Rattus norvegicus
agaatgcccgacactagcattggaa

SEQ ID NO: 106902 - DNA, 25 bp, Rattus norvegicus
agaatgcccgactctagcattggaa

SEQ ID NO: 106903 - DNA, 25 bp, Rattus norvegicus
agaatgcccgtcacttcatatttga

SEQ ID NO: 106904 - DNA, 25 bp, Rattus norvegicus
agaatgcccgtctcttcatatttga

SEQ ID NO: 106905 - DNA, 25 bp, Rattus norvegicus
agaatgccctctccccaaagagatg

SEQ ID NO: 106906 - DNA, 25 bp, Rattus norvegicus
agaatgccctctgcccaaagagatg

SEQ ID NO: 106907 - DNA, 25 bp, Rattus norvegicus
agaatgcctaggagatcagtgaagc

SEQ ID NO: 106908 - DNA, 25 bp, Rattus norvegicus
agaatgcctaggtgatcagtgaagc

SEQ ID NO: 106909 - DNA, 25 bp, Rattus norvegicus
agaatgcctggcaccttttgatccg

SEQ ID NO: 106910 - DNA, 25 bp, Rattus norvegicus
agaatgcctggctccttttgatccg

SEQ ID NO: 106911 - DNA, 25 bp, Rattus norvegicus
agaatgcctttgctctgtgggtcca

SEQ ID NO: 106912 - DNA, 25 bp, Rattus norvegicus
agaatgcctttggtctgtgggtcca

SEQ ID NO: 106913 - DNA, 25 bp, Rattus norvegicus
agaatgcggttgagattctccgcta

SEQ ID NO: 106914 - DNA, 25 bp, Rattus norvegicus
agaatgcggttgctgcagcctcctg

SEQ ID NO: 106915 - DNA, 25 bp, Rattus norvegicus
agaatgcggttggtgcagcctcctg

SEQ ID NO: 106916 - DNA, 25 bp, Rattus norvegicus
agaatgcggttgtgattctccgcta

SEQ ID NO: 106917 - DNA, 25 bp, Rattus norvegicus
agaatgcgtatcacaatctgactgc

SEQ ID NO: 106918 - DNA, 25 bp, Rattus norvegicus
agaatgcgtatctcaatctgactgc

SEQ ID NO: 106919 - DNA, 25 bp, Rattus norvegicus
agaatgcgtgaacccacctcttgaa

SEQ ID NO: 106920 - DNA, 25 bp, Rattus norvegicus
agaatgcgtgaagccacctcttgaa

SEQ ID NO: 106921 - DNA, 25 bp, Rattus norvegicus
agaatgctaacacttgcccaacttg

SEQ ID NO: 106922 - DNA, 25 bp, Rattus norvegicus
agaatgctaacagttgcccaacttg

SEQ ID NO: 106923 - DNA, 25 bp, Rattus norvegicus
agaatgctacagacacattgtgttg

SEQ ID NO: 106924 - DNA, 25 bp, Rattus norvegicus
agaatgctacagtcacattgtgttg

SEQ ID NO: 106925 - DNA, 25 bp, Rattus norvegicus
agaatgctattgctctgctgtctgc

SEQ ID NO: 106926 - DNA, 25 bp, Rattus norvegicus
agaatgctattggtctgctgtctgc

SEQ ID NO: 106927 - DNA, 25 bp, Rattus norvegicus
agaatgctcacaatacctcttccaa

SEQ ID NO: 106928 - DNA, 25 bp, Rattus norvegicus
agaatgctcacattacctcttccaa

SEQ ID NO: 106929 - DNA, 25 bp, Rattus norvegicus
agaatgctccggaaggatgcttgga

SEQ ID NO: 106930 - DNA, 25 bp, Rattus norvegicus
agaatgctccggtaggatgcttgga

SEQ ID NO: 106931 - DNA, 25 bp, Rattus norvegicus
agaatgctcgctcagtctgcactag

SEQ ID NO: 106932 - DNA, 25 bp, Rattus norvegicus
agaatgctcgctgagtctgcactag

SEQ ID NO: 106933 - DNA, 25 bp, Rattus norvegicus
agaatgctctgaaggtgagtccagg

SEQ ID NO: 106934 - DNA, 25 bp, Rattus norvegicus
agaatgctctgatggtgagtccagg

SEQ ID NO: 106935 - DNA, 25 bp, Rattus norvegicus
agaatgctctttcgtcgtctttatt

SEQ ID NO: 106936 - DNA, 25 bp, Rattus norvegicus
agaatgctctttggtcgtctttatt

SEQ ID NO: 106937 - DNA, 25 bp, Rattus norvegicus
agaatgctgaaacggaactacggtt

SEQ ID NO: 106938 - DNA, 25 bp, Rattus norvegicus
agaatgctgaaagggaactacggtt

SEQ ID NO: 106939 - DNA, 25 bp, Rattus norvegicus
agaatgctgcagatcaggctgtcaa

SEQ ID NO: 106940 - DNA, 25 bp, Rattus norvegicus
agaatgctgcagttcaggctgtcaa

SEQ ID NO: 106941 - DNA, 25 bp, Rattus norvegicus
agaatgctggtacctgtgtgccgcc

SEQ ID NO: 106942 - DNA, 25 bp, Rattus norvegicus
agaatgctggtagctgtgtgccgcc

SEQ ID NO: 106943 - DNA, 25 bp, Rattus norvegicus
agaatgctggttatactccccagga

SEQ ID NO: 106944 - DNA, 25 bp, Rattus norvegicus
agaatgctggttttactccccagga

SEQ ID NO: 106945 - DNA, 25 bp, Rattus norvegicus
agaatgctgtctactgtgcagtcat

SEQ ID NO: 106946 - DNA, 25 bp, Rattus norvegicus
agaatgctgtcttctgtgcagtcat

SEQ ID NO: 106947 - DNA, 25 bp, Rattus norvegicus
agaatgctgtgtacctgccgcgtca

SEQ ID NO: 106948 - DNA, 25 bp, Rattus norvegicus
agaatgctgtgttcctgccgcgtca

SEQ ID NO: 106949 - DNA, 25 bp, Rattus norvegicus
agaatgctgtttatactgtagttta

SEQ ID NO: 106950 - DNA, 25 bp, Rattus norvegicus
agaatgctgtttttactgtagttta

SEQ ID NO: 106951 - DNA, 25 bp, Rattus norvegicus
agaatgcttactctgcgtcgggcgc

SEQ ID NO: 106952 - DNA, 25 bp, Rattus norvegicus
agaatgcttactgtgcgtcgggcgc

SEQ ID NO: 106953 - DNA, 25 bp, Rattus norvegicus
agaatgcttctcaatctctggcagg

SEQ ID NO: 106954 - DNA, 25 bp, Rattus norvegicus
agaatgcttctctatctctggcagg

SEQ ID NO: 106955 - DNA, 25 bp, Rattus norvegicus
agaatgcttgcccagtacacgagca

SEQ ID NO: 106956 - DNA, 25 bp, Rattus norvegicus
agaatgcttgccgagtacacgagca

SEQ ID NO: 106957 - DNA, 25 bp, Rattus norvegicus
agaatgctttctacggttcaaaacg

SEQ ID NO: 106958 - DNA, 25 bp, Rattus norvegicus
agaatgctttcttcggttcaaaacg

SEQ ID NO: 106959 - DNA, 25 bp, Rattus norvegicus
agaatgcttttcctcatgcagtagt

SEQ ID NO: 106960 - DNA, 25 bp, Rattus norvegicus
agaatgcttttcgtcatgcagtagt

SEQ ID NO: 106961 - DNA, 25 bp, Rattus norvegicus
agaatggaacatccttcttcccttc

SEQ ID NO: 106962 - DNA, 25 bp, Rattus norvegicus
agaatggaacatgcttcttcccttc

SEQ ID NO: 106963 - DNA, 25 bp, Rattus norvegicus
agaatggagtccctcagctgcaaac

SEQ ID NO: 106964 - DNA, 25 bp, Rattus norvegicus
agaatggagtccgtcagctgcaaac

SEQ ID NO: 106965 - DNA, 25 bp, Rattus norvegicus
agaatggattacacaggcttactga

SEQ ID NO: 106966 - DNA, 25 bp, Rattus norvegicus
agaatggattactcaggcttactga

SEQ ID NO: 106967 - DNA, 25 bp, Rattus norvegicus
agaatggcacttactttgcatccag

SEQ ID NO: 106968 - DNA, 25 bp, Rattus norvegicus
agaatggcactttctttgcatccag

SEQ ID NO: 106969 - DNA, 25 bp, Rattus norvegicus
agaatggcagacatggactcctcgg

SEQ ID NO: 106970 - DNA, 25 bp, Rattus norvegicus
agaatggcagacttggactcctcgg

SEQ ID NO: 106971 - DNA, 25 bp, Rattus norvegicus
agaatggcagatcctccaggcacga

SEQ ID NO: 106972 - DNA, 25 bp, Rattus norvegicus
agaatggcagatgctccaggcacga

SEQ ID NO: 106973 - DNA, 25 bp, Rattus norvegicus
agaatggcagtgctgctacgtcccg

SEQ ID NO: 106974 - DNA, 25 bp, Rattus norvegicus
agaatggcagtggtgctacgtcccg

SEQ ID NO: 106975 - DNA, 25 bp, Rattus norvegicus
agaatggcatggatacctcctgagc

SEQ ID NO: 106976 - DNA, 25 bp, Rattus norvegicus
agaatggcatggttacctcctgagc

SEQ ID NO: 106977 - DNA, 25 bp, Rattus norvegicus
agaatggcatgtccaaacttcttgg

SEQ ID NO: 106978 - DNA, 25 bp, Rattus norvegicus
agaatggcatgtgcaaacttcttgg

SEQ ID NO: 106979 - DNA, 25 bp, Rattus norvegicus
agaatggcattgcaacagctgagct

SEQ ID NO: 106980 - DNA, 25 bp, Rattus norvegicus
agaatggcattggaacagctgagct

SEQ ID NO: 106981 - DNA, 25 bp, Rattus norvegicus
agaatggcccagaagcccctggaac

SEQ ID NO: 106982 - DNA, 25 bp, Rattus norvegicus
agaatggcccagtagcccctggaac

SEQ ID NO: 106983 - DNA, 25 bp, Rattus norvegicus
agaatggccttcagagttcacactc

SEQ ID NO: 106984 - DNA, 25 bp, Rattus norvegicus
agaatggccttctgagttcacactc

SEQ ID NO: 106985 - DNA, 25 bp, Rattus norvegicus
agaatggccttgacttcatttttca

SEQ ID NO: 106986 - DNA, 25 bp, Rattus norvegicus
agaatggccttgtcttcatttttca

SEQ ID NO: 106987 - DNA, 25 bp, Rattus norvegicus
agaatggcggccactgccttgacct

SEQ ID NO: 106988 - DNA, 25 bp, Rattus norvegicus
agaatggcggcctctgccttgacct

SEQ ID NO: 106989 - DNA, 25 bp, Rattus norvegicus
agaatggcgtagctgcttcaggtct

SEQ ID NO: 106990 - DNA, 25 bp, Rattus norvegicus
agaatggcgtaggtgcttcaggtct

SEQ ID NO: 106991 - DNA, 25 bp, Rattus norvegicus
agaatggctagacctggcccataac

SEQ ID NO: 106992 - DNA, 25 bp, Rattus norvegicus
agaatggctagagctggcccataac

SEQ ID NO: 106993 - DNA, 25 bp, Rattus norvegicus
agaatggctcaacctccgattcttc

SEQ ID NO: 106994 - DNA, 25 bp, Rattus norvegicus
agaatggctcaagctccgattcttc

SEQ ID NO: 106995 - DNA, 25 bp, Rattus norvegicus
agaatggctgttccagtcggcgtca

SEQ ID NO: 106996 - DNA, 25 bp, Rattus norvegicus
agaatggctgttgcagtcggcgtca

SEQ ID NO: 106997 - DNA, 25 bp, Rattus norvegicus
agaatggcttccaccaatatggctc

SEQ ID NO: 106998 - DNA, 25 bp, Rattus norvegicus
agaatggcttcctccaatatggctc

SEQ ID NO: 106999 - DNA, 25 bp, Rattus norvegicus
agaatggctttgacctctttatttc

SEQ ID NO: 107000 - DNA, 25 bp, Rattus norvegicus
agaatggctttgtcctctttatttc

SEQ ID NO: 107001 - DNA, 25 bp, Rattus norvegicus
agaatgggaacaatgcagacctttt

SEQ ID NO: 107002 - DNA, 25 bp, Rattus norvegicus
agaatgggaacattgcagacctttt

SEQ ID NO: 107003 - DNA, 25 bp, Rattus norvegicus
agaatgggaagtccctgcatcgcag

SEQ ID NO: 107004 - DNA, 25 bp, Rattus norvegicus
agaatgggaagtgcctgcatcgcag

SEQ ID NO: 107005 - DNA, 25 bp, Rattus norvegicus
agaatgggcacacaagggctccctc

SEQ ID NO: 107006 - DNA, 25 bp, Rattus norvegicus
agaatgggcacagaagggctccctc

SEQ ID NO: 107007 - DNA, 25 bp, Rattus norvegicus
agaatgggcccaattatgccagggt

SEQ ID NO: 107008 - DNA, 25 bp, Rattus norvegicus
agaatgggcccatttatgccagggt

SEQ ID NO: 107009 - DNA, 25 bp, Rattus norvegicus
agaatgggctttcggaggcccctca

SEQ ID NO: 107010 - DNA, 25 bp, Rattus norvegicus
agaatgggctttgggaggcccctca

SEQ ID NO: 107011 - DNA, 25 bp, Rattus norvegicus
agaatgggtgatccagtgcctcatt

SEQ ID NO: 107012 - DNA, 25 bp, Rattus norvegicus
agaatgggtgatgcagtgcctcatt

SEQ ID NO: 107013 - DNA, 25 bp, Rattus norvegicus
agaatgggttcacctcagactggct

SEQ ID NO: 107014 - DNA, 25 bp, Rattus norvegicus
agaatgggttcagctcagactggct

SEQ ID NO: 107015 - DNA, 25 bp, Rattus norvegicus
agaatgggttcgcactatcctgtca

SEQ ID NO: 107016 - DNA, 25 bp, Rattus norvegicus
agaatgggttcggactatcctgtca

SEQ ID NO: 107017 - DNA, 25 bp, Rattus norvegicus
agaatggtcactctgaagccctgga

SEQ ID NO: 107018 - DNA, 25 bp, Rattus norvegicus
agaatggtcactgtgaagccctgga

SEQ ID NO: 107019 - DNA, 25 bp, Rattus norvegicus
agaatggtccagatcccgtgtaaag

SEQ ID NO: 107020 - DNA, 25 bp, Rattus norvegicus
agaatggtccagttcccgtgtaaag

SEQ ID NO: 107021 - DNA, 25 bp, Rattus norvegicus
agaatggtctcacagtttcgtctcc

SEQ ID NO: 107022 - DNA, 25 bp, Rattus norvegicus
agaatggtctcagagtttcgtctcc

SEQ ID NO: 107023 - DNA, 25 bp, Rattus norvegicus
agaatggtctctctgatgctgtcgt

SEQ ID NO: 107024 - DNA, 25 bp, Rattus norvegicus
agaatggtctctgtgatgctgtcgt

SEQ ID NO: 107025 - DNA, 25 bp, Rattus norvegicus
agaatggtttctcagtacctctctg

SEQ ID NO: 107026 - DNA, 25 bp, Rattus norvegicus
agaatggtttctgagtacctctctg

SEQ ID NO: 107027 - DNA, 25 bp, Rattus norvegicus
agaatgtacacaacgctagccgccc

SEQ ID NO: 107028 - DNA, 25 bp, Rattus norvegicus
agaatgtacacatcgctagccgccc

SEQ ID NO: 107029 - DNA, 25 bp, Rattus norvegicus
agaatgtactaaacgcagcctttta

SEQ ID NO: 107030 - DNA, 25 bp, Rattus norvegicus
agaatgtactaatcgcagcctttta

SEQ ID NO: 107031 - DNA, 25 bp, Rattus norvegicus
agaatgtactgtccggtgtggcctt

SEQ ID NO: 107032 - DNA, 25 bp, Rattus norvegicus
agaatgtactgtgcggtgtggcctt

SEQ ID NO: 107033 - DNA, 25 bp, Rattus norvegicus
agaatgtagcagcatcttttgatga

SEQ ID NO: 107034 - DNA, 25 bp, Rattus norvegicus
agaatgtagcaggatcttttgatga

SEQ ID NO: 107035 - DNA, 25 bp, Rattus norvegicus
agaatgtagctcataaacacagagc

SEQ ID NO: 107036 - DNA, 25 bp, Rattus norvegicus
agaatgtagctcttaaacacagagc

SEQ ID NO: 107037 - DNA, 25 bp, Rattus norvegicus
agaatgtatgtcagcctttcttgtc

SEQ ID NO: 107038 - DNA, 25 bp, Rattus norvegicus
agaatgtatgtctgcctttcttgtc

SEQ ID NO: 107039 - DNA, 25 bp, Rattus norvegicus
agaatgtcaaaccactggctctgcc

SEQ ID NO: 107040 - DNA, 25 bp, Rattus norvegicus
agaatgtcaaacgactggctctgcc

SEQ ID NO: 107041 - DNA, 25 bp, Rattus norvegicus
agaatgtcaaggctgttcctccctg

SEQ ID NO: 107042 - DNA, 25 bp, Rattus norvegicus
agaatgtcaagggtgttcctccctg

SEQ ID NO: 107043 - DNA, 25 bp, Rattus norvegicus
agaatgtcaccaccattgtttttcc

SEQ ID NO: 107044 - DNA, 25 bp, Rattus norvegicus
agaatgtcaccagcattgtttttcc

SEQ ID NO: 107045 - DNA, 25 bp, Rattus norvegicus
agaatgtcatttctgttctcagtgt

SEQ ID NO: 107046 - DNA, 25 bp, Rattus norvegicus
agaatgtcatttgtgttctcagtgt

SEQ ID NO: 107047 - DNA, 25 bp, Rattus norvegicus
agaatgtccattaccactgctcggg

SEQ ID NO: 107048 - DNA, 25 bp, Rattus norvegicus
agaatgtccatttccactgctcggg

SEQ ID NO: 107049 - DNA, 25 bp, Rattus norvegicus
agaatgtcgattcggccctatcaca

SEQ ID NO: 107050 - DNA, 25 bp, Rattus norvegicus
agaatgtcgattgggccctatcaca

SEQ ID NO: 107051 - DNA, 25 bp, Rattus norvegicus
agaatgtctacgaggctatcccgga

SEQ ID NO: 107052 - DNA, 25 bp, Rattus norvegicus
agaatgtctacgtggctatcccgga

SEQ ID NO: 107053 - DNA, 25 bp, Rattus norvegicus
agaatgtgacatcaccccttcatct

SEQ ID NO: 107054 - DNA, 25 bp, Rattus norvegicus
agaatgtgacatgaccccttcatct

SEQ ID NO: 107055 - DNA, 25 bp, Rattus norvegicus
agaatgtgacttaccgagtcgggta

SEQ ID NO: 107056 - DNA, 25 bp, Rattus norvegicus
agaatgtgactttccgagtcgggta

SEQ ID NO: 107057 - DNA, 25 bp, Rattus norvegicus
agaatgtgagcaccacctcgagttg

SEQ ID NO: 107058 - DNA, 25 bp, Rattus norvegicus
agaatgtgagcagcacctcgagttg

SEQ ID NO: 107059 - DNA, 25 bp, Rattus norvegicus
agaatgtgagccaacctgtcttatc

SEQ ID NO: 107060 - DNA, 25 bp, Rattus norvegicus
agaatgtgagcctacctgtcttatc

SEQ ID NO: 107061 - DNA, 25 bp, Rattus norvegicus
agaatgtgattcagcgtctctcggg

SEQ ID NO: 107062 - DNA, 25 bp, Rattus norvegicus
agaatgtgattctgcgtctctcggg

SEQ ID NO: 107063 - DNA, 25 bp, Rattus norvegicus
agaatgtgccttccttacacgactc

SEQ ID NO: 107064 - DNA, 25 bp, Rattus norvegicus
agaatgtgccttgcttacacgactc

SEQ ID NO: 107065 - DNA, 25 bp, Rattus norvegicus
agaatgtgcttcagagtagtcctca

SEQ ID NO: 107066 - DNA, 25 bp, Rattus norvegicus
agaatgtgcttctgagtagtcctca

SEQ ID NO: 107067 - DNA, 25 bp, Rattus norvegicus
agaatgtggcatctggccctgcctc

SEQ ID NO: 107068 - DNA, 25 bp, Rattus norvegicus
agaatgtggcatgtggccctgcctc

SEQ ID NO: 107069 - DNA, 25 bp, Rattus norvegicus
agaatgtggccacgtcttctgtagc

SEQ ID NO: 107070 - DNA, 25 bp, Rattus norvegicus
agaatgtggccaggtcttctgtagc

SEQ ID NO: 107071 - DNA, 25 bp, Rattus norvegicus
agaatgtggcctatgtgcagccagt

SEQ ID NO: 107072 - DNA, 25 bp, Rattus norvegicus
agaatgtggcctttgtgcagccagt

SEQ ID NO: 107073 - DNA, 25 bp, Rattus norvegicus
agaatgtgtcatcgaacccgggtgt

SEQ ID NO: 107074 - DNA, 25 bp, Rattus norvegicus
agaatgtgtcatggaacccgggtgt

SEQ ID NO: 107075 - DNA, 25 bp, Rattus norvegicus
agaatgtgtggccttttgttagaaa

SEQ ID NO: 107076 - DNA, 25 bp, Rattus norvegicus
agaatgtgtggcgttttgttagaaa

SEQ ID NO: 107077 - DNA, 25 bp, Rattus norvegicus
agaatgttaccaacagagccatccc

SEQ ID NO: 107078 - DNA, 25 bp, Rattus norvegicus
agaatgttaccatcagagccatccc

SEQ ID NO: 107079 - DNA, 25 bp, Rattus norvegicus
agaatgttatcactgttggcacaca

SEQ ID NO: 107080 - DNA, 25 bp, Rattus norvegicus
agaatgttatcagtgttggcacaca

SEQ ID NO: 107081 - DNA, 25 bp, Rattus norvegicus
agaatgttctagacctactgccact

SEQ ID NO: 107082 - DNA, 25 bp, Rattus norvegicus
agaatgttctagtcctactgccact

SEQ ID NO: 107083 - DNA, 25 bp, Rattus norvegicus
agaatgttctccaaggctgcagtag

SEQ ID NO: 107084 - DNA, 25 bp, Rattus norvegicus
agaatgttctcctaggctgcagtag

SEQ ID NO: 107085 - DNA, 25 bp, Rattus norvegicus
agaatgttcttcctagacgccaaag

SEQ ID NO: 107086 - DNA, 25 bp, Rattus norvegicus
agaatgttcttcgtagacgccaaag

SEQ ID NO: 107087 - DNA, 25 bp, Rattus norvegicus
agaatgttgcgtcatgtgaagagac

SEQ ID NO: 107088 - DNA, 25 bp, Rattus norvegicus
agaatgttgcgtgatgtgaagagac

SEQ ID NO: 107089 - DNA, 25 bp, Rattus norvegicus
agaatgttggcaaggtcttcctctt

SEQ ID NO: 107090 - DNA, 25 bp, Rattus norvegicus
agaatgttggcatggtcttcctctt

SEQ ID NO: 107091 - DNA, 25 bp, Rattus norvegicus
agaatgttgtatccttgacctcctc

SEQ ID NO: 107092 - DNA, 25 bp, Rattus norvegicus
agaatgttgtatgcttgacctcctc

SEQ ID NO: 107093 - DNA, 25 bp, Rattus norvegicus
agaatgttgtgcagtttgagtttag

SEQ ID NO: 107094 - DNA, 25 bp, Rattus norvegicus
agaatgttgtgctgtttgagtttag

SEQ ID NO: 107095 - DNA, 25 bp, Rattus norvegicus
agaatgtttaatccccatgtggtaa

SEQ ID NO: 107096 - DNA, 25 bp, Rattus norvegicus
agaatgtttaatgcccatgtggtaa

SEQ ID NO: 107097 - DNA, 25 bp, Rattus norvegicus
agaatgtttcccaagtcatctcagt

SEQ ID NO: 107098 - DNA, 25 bp, Rattus norvegicus
agaatgtttccctagtcatctcagt

SEQ ID NO: 107099 - DNA, 25 bp, Rattus norvegicus
agaatgtttcctctctggcagggac

SEQ ID NO: 107100 - DNA, 25 bp, Rattus norvegicus
agaatgtttcctgtctggcagggac

SEQ ID NO: 107101 - DNA, 25 bp, Rattus norvegicus
agaattaaaagcctcccgtcagtca

SEQ ID NO: 107102 - DNA, 25 bp, Rattus norvegicus
agaattaaaagcgtcccgtcagtca

SEQ ID NO: 107103 - DNA, 25 bp, Rattus norvegicus
agaattaaaaggcagacattgggct

SEQ ID NO: 107104 - DNA, 25 bp, Rattus norvegicus
agaattaaaagggagacattgggct

SEQ ID NO: 107105 - DNA, 25 bp, Rattus norvegicus
agaattaacctcagttcccatgggc

SEQ ID NO: 107106 - DNA, 25 bp, Rattus norvegicus
agaattaacctctgttcccatgggc

SEQ ID NO: 107107 - DNA, 25 bp, Rattus norvegicus
agaattaactctcgatctcgggcca

SEQ ID NO: 107108 - DNA, 25 bp, Rattus norvegicus
agaattaactctggatctcgggcca

SEQ ID NO: 107109 - DNA, 25 bp, Rattus norvegicus
agaattacagctacacaggcgttga

SEQ ID NO: 107110 - DNA, 25 bp, Rattus norvegicus
agaattacagcttcacaggcgttga

SEQ ID NO: 107111 - DNA, 25 bp, Rattus norvegicus
agaattacattcacccctaagggca

SEQ ID NO: 107112 - DNA, 25 bp, Rattus norvegicus
agaattacattctcccctaagggca

SEQ ID NO: 107113 - DNA, 25 bp, Rattus norvegicus
agaattaccactccacttacagtct

SEQ ID NO: 107114 - DNA, 25 bp, Rattus norvegicus
agaattaccactgcacttacagtct

SEQ ID NO: 107115 - DNA, 25 bp, Rattus norvegicus
agaattaccatgacctccttttgac

SEQ ID NO: 107116 - DNA, 25 bp, Rattus norvegicus
agaattaccatgtcctccttttgac

SEQ ID NO: 107117 - DNA, 25 bp, Rattus norvegicus
agaattacccctaacttggatgcct

SEQ ID NO: 107118 - DNA, 25 bp, Rattus norvegicus
agaattaccccttacttggatgcct

SEQ ID NO: 107119 - DNA, 25 bp, Rattus norvegicus
agaattacctcaacagattggcctg

SEQ ID NO: 107120 - DNA, 25 bp, Rattus norvegicus
agaattacctcatcagattggcctg

SEQ ID NO: 107121 - DNA, 25 bp, Rattus norvegicus
agaattacctgaatgaccgtgttgg

SEQ ID NO: 107122 - DNA, 25 bp, Rattus norvegicus
agaattacctgattgaccgtgttgg

SEQ ID NO: 107123 - DNA, 25 bp, Rattus norvegicus
agaattaccttaacactgcacaatg

SEQ ID NO: 107124 - DNA, 25 bp, Rattus norvegicus
agaattaccttatcactgcacaatg

SEQ ID NO: 107125 - DNA, 25 bp, Rattus norvegicus
agaattacgacaacgctgctgctct

SEQ ID NO: 107126 - DNA, 25 bp, Rattus norvegicus
agaattacgacatcgctgctgctct

SEQ ID NO: 107127 - DNA, 25 bp, Rattus norvegicus
agaattagccaccactgcggtcgag

SEQ ID NO: 107128 - DNA, 25 bp, Rattus norvegicus
agaattagccacgactgcggtcgag

SEQ ID NO: 107129 - DNA, 25 bp, Rattus norvegicus
agaattaggcacactgctctgggca

SEQ ID NO: 107130 - DNA, 25 bp, Rattus norvegicus
agaattaggcactctgctctgggca

SEQ ID NO: 107131 - DNA, 25 bp, Rattus norvegicus
agaattatctcgctttatactccaa

SEQ ID NO: 107132 - DNA, 25 bp, Rattus norvegicus
agaattatctcggtttatactccaa

SEQ ID NO: 107133 - DNA, 25 bp, Rattus norvegicus
agaattatgcagatccactcacgga

SEQ ID NO: 107134 - DNA, 25 bp, Rattus norvegicus
agaattatgcagttccactcacgga

SEQ ID NO: 107135 - DNA, 25 bp, Rattus norvegicus
agaattatgggcatcctgcttcctt

SEQ ID NO: 107136 - DNA, 25 bp, Rattus norvegicus
agaattatgggcttcctgcttcctt

SEQ ID NO: 107137 - DNA, 25 bp, Rattus norvegicus
agaattcactctagcccaggttagc

SEQ ID NO: 107138 - DNA, 25 bp, Rattus norvegicus
agaattcactcttgcccaggttagc

SEQ ID NO: 107139 - DNA, 25 bp, Rattus norvegicus
agaattcactgaccgcgagcaggga

SEQ ID NO: 107140 - DNA, 25 bp, Rattus norvegicus
agaattcactgagcgcgagcaggga

SEQ ID NO: 107141 - DNA, 25 bp, Rattus norvegicus
agaattcagattccctgcagctgct

SEQ ID NO: 107142 - DNA, 25 bp, Rattus norvegicus
agaattcagattgcctgcagctgct

SEQ ID NO: 107143 - DNA, 25 bp, Rattus norvegicus
agaattcaggtcactgttgagcatc

SEQ ID NO: 107144 - DNA, 25 bp, Rattus norvegicus
agaattcaggtctctgttgagcatc

SEQ ID NO: 107145 - DNA, 25 bp, Rattus norvegicus
agaattcagtatataccgacggtat

SEQ ID NO: 107146 - DNA, 25 bp, Rattus norvegicus
agaattcagtatttaccgacggtat

SEQ ID NO: 107147 - DNA, 25 bp, Rattus norvegicus
agaattcagtctcgtccttgggtcc

SEQ ID NO: 107148 - DNA, 25 bp, Rattus norvegicus
agaattcagtctggtccttgggtcc

SEQ ID NO: 107149 - DNA, 25 bp, Rattus norvegicus
agaattcatacccaagtgtccacac

SEQ ID NO: 107150 - DNA, 25 bp, Rattus norvegicus
agaattcataccgaagtgtccacac

SEQ ID NO: 107151 - DNA, 25 bp, Rattus norvegicus
agaattcattatattcctgacctat

SEQ ID NO: 107152 - DNA, 25 bp, Rattus norvegicus
agaattcattattttcctgacctat

SEQ ID NO: 107153 - DNA, 25 bp, Rattus norvegicus
agaattccaaggctgtctgtattac

SEQ ID NO: 107154 - DNA, 25 bp, Rattus norvegicus
agaattccaagggtgtctgtattac

SEQ ID NO: 107155 - DNA, 25 bp, Rattus norvegicus
agaattccagaacatcgccatggcc

SEQ ID NO: 107156 - DNA, 25 bp, Rattus norvegicus
agaattccagaagatcgccatggcc

SEQ ID NO: 107157 - DNA, 25 bp, Rattus norvegicus
agaattccagtacccctcgctgagc

SEQ ID NO: 107158 - DNA, 25 bp, Rattus norvegicus
agaattccagtagccctcgctgagc

SEQ ID NO: 107159 - DNA, 25 bp, Rattus norvegicus
agaattccatctccaggtcaaccac

SEQ ID NO: 107160 - DNA, 25 bp, Rattus norvegicus
agaattccatctgcaggtcaaccac

SEQ ID NO: 107161 - DNA, 25 bp, Rattus norvegicus
agaattcccagccagactaagactc

SEQ ID NO: 107162 - DNA, 25 bp, Rattus norvegicus
agaattcccagcgagactaagactc

SEQ ID NO: 107163 - DNA, 25 bp, Rattus norvegicus
agaattcccataaaacctccattta

SEQ ID NO: 107164 - DNA, 25 bp, Rattus norvegicus
agaattcccatataacctccattta

SEQ ID NO: 107165 - DNA, 25 bp, Rattus norvegicus
agaattcccatcactgcccagaagt

SEQ ID NO: 107166 - DNA, 25 bp, Rattus norvegicus
agaattcccatctctgcccagaagt

SEQ ID NO: 107167 - DNA, 25 bp, Rattus norvegicus
agaattcccctacctctgaagagat

SEQ ID NO: 107168 - DNA, 25 bp, Rattus norvegicus
agaattcccctagctctgaagagat

SEQ ID NO: 107169 - DNA, 25 bp, Rattus norvegicus
agaattccctttcctgccaattggg

SEQ ID NO: 107170 - DNA, 25 bp, Rattus norvegicus
agaattccctttgctgccaattggg

SEQ ID NO: 107171 - DNA, 25 bp, Rattus norvegicus
agaattcctaacactcaggctctgc

SEQ ID NO: 107172 - DNA, 25 bp, Rattus norvegicus
agaattcctaacatctagccgtcaa

SEQ ID NO: 107173 - DNA, 25 bp, Rattus norvegicus
agaattcctaactctcaggctctgc

SEQ ID NO: 107174 - DNA, 25 bp, Rattus norvegicus
agaattcctaacttctagccgtcaa

SEQ ID NO: 107175 - DNA, 25 bp, Rattus norvegicus
agaattcctgacagaggccggccta

SEQ ID NO: 107176 - DNA, 25 bp, Rattus norvegicus
agaattcctgacataagcactttat

SEQ ID NO: 107177 - DNA, 25 bp, Rattus norvegicus
agaattcctgactgaggccggccta

SEQ ID NO: 107178 - DNA, 25 bp, Rattus norvegicus
agaattcctgacttaagcactttat

SEQ ID NO: 107179 - DNA, 25 bp, Rattus norvegicus
agaattcctggtccagcgacgctgg

SEQ ID NO: 107180 - DNA, 25 bp, Rattus norvegicus
agaattcctggtgcagcgacgctgg

SEQ ID NO: 107181 - DNA, 25 bp, Rattus norvegicus
agaattcctgtcacaggctctctaa

SEQ ID NO: 107182 - DNA, 25 bp, Rattus norvegicus
agaattcctgtctcaggctctctaa

SEQ ID NO: 107183 - DNA, 25 bp, Rattus norvegicus
agaattccttatcagttactgttgt

SEQ ID NO: 107184 - DNA, 25 bp, Rattus norvegicus
agaattccttatctaatccatcctc

SEQ ID NO: 107185 - DNA, 25 bp, Rattus norvegicus
agaattccttatgagttactgttgt

SEQ ID NO: 107186 - DNA, 25 bp, Rattus norvegicus
agaattccttatgtaatccatcctc

SEQ ID NO: 107187 - DNA, 25 bp, Rattus norvegicus
agaattcctttcatgccagattgca

SEQ ID NO: 107188 - DNA, 25 bp, Rattus norvegicus
agaattcctttcttgccagattgca

SEQ ID NO: 107189 - DNA, 25 bp, Rattus norvegicus
agaattcgaggcctggtccctgacc

SEQ ID NO: 107190 - DNA, 25 bp, Rattus norvegicus
agaattcgaggcgtggtccctgacc

SEQ ID NO: 107191 - DNA, 25 bp, Rattus norvegicus
agaattcgcgatcaactctgcaaaa

SEQ ID NO: 107192 - DNA, 25 bp, Rattus norvegicus
agaattcgcgatgaactctgcaaaa

SEQ ID NO: 107193 - DNA, 25 bp, Rattus norvegicus
agaattcggctgaggcatcgtgctc

SEQ ID NO: 107194 - DNA, 25 bp, Rattus norvegicus
agaattcggctgtggcatcgtgctc

SEQ ID NO: 107195 - DNA, 25 bp, Rattus norvegicus
agaattctacgtatcccctgaagac

SEQ ID NO: 107196 - DNA, 25 bp, Rattus norvegicus
agaattctacgtttcccctgaagac

SEQ ID NO: 107197 - DNA, 25 bp, Rattus norvegicus
agaattctcattcaccttttccttg

SEQ ID NO: 107198 - DNA, 25 bp, Rattus norvegicus
agaattctcattgaccttttccttg

SEQ ID NO: 107199 - DNA, 25 bp, Rattus norvegicus
agaattctccaaattacatctcccg

SEQ ID NO: 107200 - DNA, 25 bp, Rattus norvegicus
agaattctccaatttacatctcccg

SEQ ID NO: 107201 - DNA, 25 bp, Rattus norvegicus
agaattctcgttccagtgctggtga

SEQ ID NO: 107202 - DNA, 25 bp, Rattus norvegicus
agaattctcgttgcagtgctggtga

SEQ ID NO: 107203 - DNA, 25 bp, Rattus norvegicus
agaattctctccagtgaaagacggg

SEQ ID NO: 107204 - DNA, 25 bp, Rattus norvegicus
agaattctctcctgtgaaagacggg

SEQ ID NO: 107205 - DNA, 25 bp, Rattus norvegicus
agaattctcttccaccagggttcat

SEQ ID NO: 107206 - DNA, 25 bp, Rattus norvegicus
agaattctcttcgaccagggttcat

SEQ ID NO: 107207 - DNA, 25 bp, Rattus norvegicus
agaattctgaagacttccccttgtg

SEQ ID NO: 107208 - DNA, 25 bp, Rattus norvegicus
agaattctgaagtcttccccttgtg

SEQ ID NO: 107209 - DNA, 25 bp, Rattus norvegicus
agaattctgaccaccacaacttggt

SEQ ID NO: 107210 - DNA, 25 bp, Rattus norvegicus
agaattctgacctccacaacttggt

SEQ ID NO: 107211 - DNA, 25 bp, Rattus norvegicus
agaattctgattcccactcagtctt

SEQ ID NO: 107212 - DNA, 25 bp, Rattus norvegicus
agaattctgattgccactcagtctt

SEQ ID NO: 107213 - DNA, 25 bp, Rattus norvegicus
agaattctgggtaacgctggttgca

SEQ ID NO: 107214 - DNA, 25 bp, Rattus norvegicus
agaattctgggttacgctggttgca

SEQ ID NO: 107215 - DNA, 25 bp, Rattus norvegicus
agaattctgtacacagagctgtttc

SEQ ID NO: 107216 - DNA, 25 bp, Rattus norvegicus
agaattctgtactcagagctgtttc

SEQ ID NO: 107217 - DNA, 25 bp, Rattus norvegicus
agaattctgtggctcagcatccggg

SEQ ID NO: 107218 - DNA, 25 bp, Rattus norvegicus
agaattctgtgggtcagcatccggg

SEQ ID NO: 107219 - DNA, 25 bp, Rattus norvegicus
agaattcttactcatcacctgctgc

SEQ ID NO: 107220 - DNA, 25 bp, Rattus norvegicus
agaattcttactgatcacctgctgc

SEQ ID NO: 107221 - DNA, 25 bp, Rattus norvegicus
agaattcttagcacgtgtctgcacg

SEQ ID NO: 107222 - DNA, 25 bp, Rattus norvegicus
agaattcttagctcgtgtctgcacg

SEQ ID NO: 107223 - DNA, 25 bp, Rattus norvegicus
agaattctttcaatgttacaaaact

SEQ ID NO: 107224 - DNA, 25 bp, Rattus norvegicus
agaattctttcattgttacaaaact

SEQ ID NO: 107225 - DNA, 25 bp, Rattus norvegicus
agaattctttctccatgtgcagctg

SEQ ID NO: 107226 - DNA, 25 bp, Rattus norvegicus
agaattctttctgcatgtgcagctg

SEQ ID NO: 107227 - DNA, 25 bp, Rattus norvegicus
agaattgaccaactctggctgaatt

SEQ ID NO: 107228 - DNA, 25 bp, Rattus norvegicus
agaattgaccaagtctggctgaatt

SEQ ID NO: 107229 - DNA, 25 bp, Rattus norvegicus
agaattgaccatattgtgttgtaaa

SEQ ID NO: 107230 - DNA, 25 bp, Rattus norvegicus
agaattgaccattttgtgttgtaaa

SEQ ID NO: 107231 - DNA, 25 bp, Rattus norvegicus
agaattgagtctcctcattctctgc

SEQ ID NO: 107232 - DNA, 25 bp, Rattus norvegicus
agaattgagtctgctcattctctgc

SEQ ID NO: 107233 - DNA, 25 bp, Rattus norvegicus
agaattgatctgaccaagtctcttg

SEQ ID NO: 107234 - DNA, 25 bp, Rattus norvegicus
agaattgatctgtccaagtctcttg

SEQ ID NO: 107235 - DNA, 25 bp, Rattus norvegicus
agaattgattctcctcccttgacca

SEQ ID NO: 107236 - DNA, 25 bp, Rattus norvegicus
agaattgattctgctcccttgacca

SEQ ID NO: 107237 - DNA, 25 bp, Rattus norvegicus
agaattgcactaagcgctccatgat

SEQ ID NO: 107238 - DNA, 25 bp, Rattus norvegicus
agaattgcactaccctgtacaccta

SEQ ID NO: 107239 - DNA, 25 bp, Rattus norvegicus
agaattgcactagcctgtacaccta

SEQ ID NO: 107240 - DNA, 25 bp, Rattus norvegicus
agaattgcactatgcgctccatgat

SEQ ID NO: 107241 - DNA, 25 bp, Rattus norvegicus
agaattgccccgagctggaacagga

SEQ ID NO: 107242 - DNA, 25 bp, Rattus norvegicus
agaattgccccgtgctggaacagga

SEQ ID NO: 107243 - DNA, 25 bp, Rattus norvegicus
agaattgcctgtatttgtcgtctgc

SEQ ID NO: 107244 - DNA, 25 bp, Rattus norvegicus
agaattgcctgtttttgtcgtctgc

SEQ ID NO: 107245 - DNA, 25 bp, Rattus norvegicus
agaattgctagaagccgaggcccct

SEQ ID NO: 107246 - DNA, 25 bp, Rattus norvegicus
agaattgctagatgccgaggcccct

SEQ ID NO: 107247 - DNA, 25 bp, Rattus norvegicus
agaattgctctcagatgttgccaga

SEQ ID NO: 107248 - DNA, 25 bp, Rattus norvegicus
agaattgctctctgatgttgccaga

SEQ ID NO: 107249 - DNA, 25 bp, Rattus norvegicus
agaattgctgaaatgaagactcaaa

SEQ ID NO: 107250 - DNA, 25 bp, Rattus norvegicus
agaattgctgaattgaagactcaaa

SEQ ID NO: 107251 - DNA, 25 bp, Rattus norvegicus
agaattgctgataagagagaccctg

SEQ ID NO: 107252 - DNA, 25 bp, Rattus norvegicus
agaattgctgattagagagaccctg

SEQ ID NO: 107253 - DNA, 25 bp, Rattus norvegicus
agaattgctgggacctttaaccttg

SEQ ID NO: 107254 - DNA, 25 bp, Rattus norvegicus
agaattgctgggtcctttaaccttg

SEQ ID NO: 107255 - DNA, 25 bp, Rattus norvegicus
agaattgcttatctcccttcatggt

SEQ ID NO: 107256 - DNA, 25 bp, Rattus norvegicus
agaattgcttatgtcccttcatggt

SEQ ID NO: 107257 - DNA, 25 bp, Rattus norvegicus
agaattgcttctctgaaccccatcc

SEQ ID NO: 107258 - DNA, 25 bp, Rattus norvegicus
agaattgcttctgtgaaccccatcc

SEQ ID NO: 107259 - DNA, 25 bp, Rattus norvegicus
agaattggcaacatgttcgtttggg

SEQ ID NO: 107260 - DNA, 25 bp, Rattus norvegicus
agaattggcaacttgttcgtttggg

SEQ ID NO: 107261 - DNA, 25 bp, Rattus norvegicus
agaattggccgcatgtgctttccct

SEQ ID NO: 107262 - DNA, 25 bp, Rattus norvegicus
agaattggccgcttgtgctttccct

SEQ ID NO: 107263 - DNA, 25 bp, Rattus norvegicus
agaattggttccaagcaagcaagct

SEQ ID NO: 107264 - DNA, 25 bp, Rattus norvegicus
agaattggttcctagcaagcaagct

SEQ ID NO: 107265 - DNA, 25 bp, Rattus norvegicus
agaattgtaattcttcccacaccga

SEQ ID NO: 107266 - DNA, 25 bp, Rattus norvegicus
agaattgtaattgttcccacaccga

SEQ ID NO: 107267 - DNA, 25 bp, Rattus norvegicus
agaattgtccttcagcttgtgccta

SEQ ID NO: 107268 - DNA, 25 bp, Rattus norvegicus
agaattgtccttgagcttgtgccta

SEQ ID NO: 107269 - DNA, 25 bp, Rattus norvegicus
agaattgtgattcgcctctttggaa

SEQ ID NO: 107270 - DNA, 25 bp, Rattus norvegicus
agaattgtgattggcctctttggaa

SEQ ID NO: 107271 - DNA, 25 bp, Rattus norvegicus
agaattgtgcccatgttttcaacag

SEQ ID NO: 107272 - DNA, 25 bp, Rattus norvegicus
agaattgtgcccttgttttcaacag

SEQ ID NO: 107273 - DNA, 25 bp, Rattus norvegicus
agaattgtgcctcatgattaaccca

SEQ ID NO: 107274 - DNA, 25 bp, Rattus norvegicus
agaattgtgcctctcttaagtccag

SEQ ID NO: 107275 - DNA, 25 bp, Rattus norvegicus
agaattgtgcctgatgattaaccca

SEQ ID NO: 107276 - DNA, 25 bp, Rattus norvegicus
agaattgtgcctgtcttaagtccag

SEQ ID NO: 107277 - DNA, 25 bp, Rattus norvegicus
agaattgtgcttccttgctatcctc

SEQ ID NO: 107278 - DNA, 25 bp, Rattus norvegicus
agaattgtgcttgcttgctatcctc

SEQ ID NO: 107279 - DNA, 25 bp, Rattus norvegicus
agaattgtgtcaaatctgatactaa

SEQ ID NO: 107280 - DNA, 25 bp, Rattus norvegicus
agaattgtgtcatatctgatactaa

SEQ ID NO: 107281 - DNA, 25 bp, Rattus norvegicus
agaattgtgtgtaaaccggctttat

SEQ ID NO: 107282 - DNA, 25 bp, Rattus norvegicus
agaattgtgtgttaaccggctttat

SEQ ID NO: 107283 - DNA, 25 bp, Rattus norvegicus
agaattgttcctcggcacaaggact

SEQ ID NO: 107284 - DNA, 25 bp, Rattus norvegicus
agaattgttcctgggcacaaggact

SEQ ID NO: 107285 - DNA, 25 bp, Rattus norvegicus
agaattgttggtaatcctgccctga

SEQ ID NO: 107286 - DNA, 25 bp, Rattus norvegicus
agaattgttggttatcctgccctga

SEQ ID NO: 107287 - DNA, 25 bp, Rattus norvegicus
agaattgtttagatctcccactcag

SEQ ID NO: 107288 - DNA, 25 bp, Rattus norvegicus
agaattgtttagttctcccactcag

SEQ ID NO: 107289 - DNA, 25 bp, Rattus norvegicus
agaattgtttctctgccacttctga

SEQ ID NO: 107290 - DNA, 25 bp, Rattus norvegicus
agaattgtttctgtgccacttctga

SEQ ID NO: 107291 - DNA, 25 bp, Rattus norvegicus
agaattgtttgcactaactcccact

SEQ ID NO: 107292 - DNA, 25 bp, Rattus norvegicus
agaattgtttgctctaactcccact

SEQ ID NO: 107293 - DNA, 25 bp, Rattus norvegicus
agaatttaactcaacctctgcgatt

SEQ ID NO: 107294 - DNA, 25 bp, Rattus norvegicus
agaatttaactctacctctgcgatt

SEQ ID NO: 107295 - DNA, 25 bp, Rattus norvegicus
agaatttacataagccacccggaag

SEQ ID NO: 107296 - DNA, 25 bp, Rattus norvegicus
agaatttacatatgccacccggaag

SEQ ID NO: 107297 - DNA, 25 bp, Rattus norvegicus
agaatttacggaactgctggctcag

SEQ ID NO: 107298 - DNA, 25 bp, Rattus norvegicus
agaatttacggatctgctggctcag

SEQ ID NO: 107299 - DNA, 25 bp, Rattus norvegicus
agaatttagcatccccgtgtttcct

SEQ ID NO: 107300 - DNA, 25 bp, Rattus norvegicus
agaatttagcatgcccgtgtttcct

SEQ ID NO: 107301 - DNA, 25 bp, Rattus norvegicus
agaatttagcctaatgtggtgacac

SEQ ID NO: 107302 - DNA, 25 bp, Rattus norvegicus
agaatttagcctcggacacttccac

SEQ ID NO: 107303 - DNA, 25 bp, Rattus norvegicus
agaatttagcctgggacacttccac

SEQ ID NO: 107304 - DNA, 25 bp, Rattus norvegicus
agaatttagccttatgtggtgacac

SEQ ID NO: 107305 - DNA, 25 bp, Rattus norvegicus
agaatttaggttacatctcccacca

SEQ ID NO: 107306 - DNA, 25 bp, Rattus norvegicus
agaatttaggtttcatctcccacca

SEQ ID NO: 107307 - DNA, 25 bp, Rattus norvegicus
agaatttagtccaccagtcagtctc

SEQ ID NO: 107308 - DNA, 25 bp, Rattus norvegicus
agaatttagtcctccagtcagtctc

SEQ ID NO: 107309 - DNA, 25 bp, Rattus norvegicus
agaatttattgtcgctctgattatg

SEQ ID NO: 107310 - DNA, 25 bp, Rattus norvegicus
agaatttattgtggctctgattatg

SEQ ID NO: 107311 - DNA, 25 bp, Rattus norvegicus
agaatttcaactaccttgctttaat

SEQ ID NO: 107312 - DNA, 25 bp, Rattus norvegicus
agaatttcaacttccttgctttaat

SEQ ID NO: 107313 - DNA, 25 bp, Rattus norvegicus
agaatttcacatacaaccagctcca

SEQ ID NO: 107314 - DNA, 25 bp, Rattus norvegicus
agaatttcacatacaggacaatggt

SEQ ID NO: 107315 - DNA, 25 bp, Rattus norvegicus
agaatttcacattcaaccagctcca

SEQ ID NO: 107316 - DNA, 25 bp, Rattus norvegicus
agaatttcacattcaggacaatggt

SEQ ID NO: 107317 - DNA, 25 bp, Rattus norvegicus
agaatttcactacaatcgctacctg

SEQ ID NO: 107318 - DNA, 25 bp, Rattus norvegicus
agaatttcactagaatcgctacctg

SEQ ID NO: 107319 - DNA, 25 bp, Rattus norvegicus
agaatttcatctaagggtccgacga

SEQ ID NO: 107320 - DNA, 25 bp, Rattus norvegicus
agaatttcatcttagggtccgacga

SEQ ID NO: 107321 - DNA, 25 bp, Rattus norvegicus
agaatttccattctgtccttaagaa

SEQ ID NO: 107322 - DNA, 25 bp, Rattus norvegicus
agaatttccattgtgtccttaagaa

SEQ ID NO: 107323 - DNA, 25 bp, Rattus norvegicus
agaatttcccatatttaccattgta

SEQ ID NO: 107324 - DNA, 25 bp, Rattus norvegicus
agaatttcccatttttaccattgta

SEQ ID NO: 107325 - DNA, 25 bp, Rattus norvegicus
agaatttccgtgaacgactgaccct

SEQ ID NO: 107326 - DNA, 25 bp, Rattus norvegicus
agaatttccgtgtacgactgaccct

SEQ ID NO: 107327 - DNA, 25 bp, Rattus norvegicus
agaatttcctaacaaccaccttgct

SEQ ID NO: 107328 - DNA, 25 bp, Rattus norvegicus
agaatttcctaagaaccaccttgct

SEQ ID NO: 107329 - DNA, 25 bp, Rattus norvegicus
agaatttcctggatttgatctcatc

SEQ ID NO: 107330 - DNA, 25 bp, Rattus norvegicus
agaatttcctggttttgatctcatc

SEQ ID NO: 107331 - DNA, 25 bp, Rattus norvegicus
agaatttcctttcttcataccctca

SEQ ID NO: 107332 - DNA, 25 bp, Rattus norvegicus
agaatttcctttgttcataccctca

SEQ ID NO: 107333 - DNA, 25 bp, Rattus norvegicus
agaatttctaatcctcctttaggtt

SEQ ID NO: 107334 - DNA, 25 bp, Rattus norvegicus
agaatttctaatgctcctttaggtt

SEQ ID NO: 107335 - DNA, 25 bp, Rattus norvegicus
agaatttctgccacatctaatcgtg

SEQ ID NO: 107336 - DNA, 25 bp, Rattus norvegicus
agaatttctgcctcatctaatcgtg

SEQ ID NO: 107337 - DNA, 25 bp, Rattus norvegicus
agaatttcttggattatgcctgatt

SEQ ID NO: 107338 - DNA, 25 bp, Rattus norvegicus
agaatttcttggtttatgcctgatt

SEQ ID NO: 107339 - DNA, 25 bp, Rattus norvegicus
agaatttgacctcttcatgcgcatg

SEQ ID NO: 107340 - DNA, 25 bp, Rattus norvegicus
agaatttgacctgttcatgcgcatg

SEQ ID NO: 107341 - DNA, 25 bp, Rattus norvegicus
agaatttgcccacttacttaatgaa

SEQ ID NO: 107342 - DNA, 25 bp, Rattus norvegicus
agaatttgcccagttacttaatgaa

SEQ ID NO: 107343 - DNA, 25 bp, Rattus norvegicus
agaatttgcctgcttcctctttgtt

SEQ ID NO: 107344 - DNA, 25 bp, Rattus norvegicus
agaatttgcctggttcctctttgtt

SEQ ID NO: 107345 - DNA, 25 bp, Rattus norvegicus
agaatttgctgcatcccacctttcc

SEQ ID NO: 107346 - DNA, 25 bp, Rattus norvegicus
agaatttgctgcttcccacctttcc

SEQ ID NO: 107347 - DNA, 25 bp, Rattus norvegicus
agaatttgctgtccttgggaaaccc

SEQ ID NO: 107348 - DNA, 25 bp, Rattus norvegicus
agaatttgctgtgcttgggaaaccc

SEQ ID NO: 107349 - DNA, 25 bp, Rattus norvegicus
agaatttgctttactactgggcgca

SEQ ID NO: 107350 - DNA, 25 bp, Rattus norvegicus
agaatttgcttttctactgggcgca

SEQ ID NO: 107351 - DNA, 25 bp, Rattus norvegicus
agaatttggcagaaagacctctgat

SEQ ID NO: 107352 - DNA, 25 bp, Rattus norvegicus
agaatttggcagtaagacctctgat

SEQ ID NO: 107353 - DNA, 25 bp, Rattus norvegicus
agaatttggtcacccgggcactgga

SEQ ID NO: 107354 - DNA, 25 bp, Rattus norvegicus
agaatttggtcagccgggcactgga

SEQ ID NO: 107355 - DNA, 25 bp, Rattus norvegicus
agaatttgtacaaggacacccctcg

SEQ ID NO: 107356 - DNA, 25 bp, Rattus norvegicus
agaatttgtacatggacacccctcg

SEQ ID NO: 107357 - DNA, 25 bp, Rattus norvegicus
agaatttgtttcatccctagctgtg

SEQ ID NO: 107358 - DNA, 25 bp, Rattus norvegicus
agaatttgtttcttccctagctgtg

SEQ ID NO: 107359 - DNA, 25 bp, Rattus norvegicus
agaattttaaagcaccacggtcaga

SEQ ID NO: 107360 - DNA, 25 bp, Rattus norvegicus
agaattttaaaggaccacggtcaga

SEQ ID NO: 107361 - DNA, 25 bp, Rattus norvegicus
agaattttacctccctgttgacatc

SEQ ID NO: 107362 - DNA, 25 bp, Rattus norvegicus
agaattttacctgcctgttgacatc

SEQ ID NO: 107363 - DNA, 25 bp, Rattus norvegicus
agaattttatgtactgcccagacac

SEQ ID NO: 107364 - DNA, 25 bp, Rattus norvegicus
agaattttatgttctgcccagacac

SEQ ID NO: 107365 - DNA, 25 bp, Rattus norvegicus
agaattttatttcgccttagcatac

SEQ ID NO: 107366 - DNA, 25 bp, Rattus norvegicus
agaattttatttggccttagcatac

SEQ ID NO: 107367 - DNA, 25 bp, Rattus norvegicus
agaattttcctaatcctgacctgga

SEQ ID NO: 107368 - DNA, 25 bp, Rattus norvegicus
agaattttcctattcctgacctgga

SEQ ID NO: 107369 - DNA, 25 bp, Rattus norvegicus
agaattttctgacgccagggaggac

SEQ ID NO: 107370 - DNA, 25 bp, Rattus norvegicus
agaattttctgaggccagggaggac

SEQ ID NO: 107371 - DNA, 25 bp, Rattus norvegicus
agaattttctggactaccaccggtg

SEQ ID NO: 107372 - DNA, 25 bp, Rattus norvegicus
agaattttctggtctaccaccggtg

SEQ ID NO: 107373 - DNA, 25 bp, Rattus norvegicus
agaattttgattcctaggtggccag

SEQ ID NO: 107374 - DNA, 25 bp, Rattus norvegicus
agaattttgattgctaggtggccag

SEQ ID NO: 107375 - DNA, 25 bp, Rattus norvegicus
agaattttgtgacccagacttgtat

SEQ ID NO: 107376 - DNA, 25 bp, Rattus norvegicus
agaattttgtgagccagacttgtat

SEQ ID NO: 107377 - DNA, 25 bp, Rattus norvegicus
agaattttgtttagtgactgcacat

SEQ ID NO: 107378 - DNA, 25 bp, Rattus norvegicus
agaattttgttttgtgactgcacat

SEQ ID NO: 107379 - DNA, 25 bp, Rattus norvegicus
agaatttttacaaccctctgctgcc

SEQ ID NO: 107380 - DNA, 25 bp, Rattus norvegicus
agaatttttacatccctctgctgcc

SEQ ID NO: 107381 - DNA, 25 bp, Rattus norvegicus
agaatttttgtcctgctttatctag

SEQ ID NO: 107382 - DNA, 25 bp, Rattus norvegicus
agaatttttgtcgtgctttatctag

SEQ ID NO: 107383 - DNA, 25 bp, Rattus norvegicus
agacaaaaaggtactctcccactcg

SEQ ID NO: 107384 - DNA, 25 bp, Rattus norvegicus
agacaaaaaggttctctcccactcg

SEQ ID NO: 107385 - DNA, 25 bp, Rattus norvegicus
agacaaaagactcatgccgactccc

SEQ ID NO: 107386 - DNA, 25 bp, Rattus norvegicus
agacaaaagactgatgccgactccc

SEQ ID NO: 107387 - DNA, 25 bp, Rattus norvegicus
agacaaaagagacagccccggccag

SEQ ID NO: 107388 - DNA, 25 bp, Rattus norvegicus
agacaaaagagagagccccggccag

SEQ ID NO: 107389 - DNA, 25 bp, Rattus norvegicus
agacaaaagggcctcactcctctgc

SEQ ID NO: 107390 - DNA, 25 bp, Rattus norvegicus
agacaaaagggcgtcactcctctgc

SEQ ID NO: 107391 - DNA, 25 bp, Rattus norvegicus
agacaaaatgcacaccttccacttc

SEQ ID NO: 107392 - DNA, 25 bp, Rattus norvegicus
agacaaaatgcagaccttccacttc

SEQ ID NO: 107393 - DNA, 25 bp, Rattus norvegicus
agacaaaccgctctgcaagaagcac

SEQ ID NO: 107394 - DNA, 25 bp, Rattus norvegicus
agacaaaccgctgtgcaagaagcac

SEQ ID NO: 107395 - DNA, 25 bp, Rattus norvegicus
agacaaacgactaccaatctgggcc

SEQ ID NO: 107396 - DNA, 25 bp, Rattus norvegicus
agacaaacgacttccaatctgggcc

SEQ ID NO: 107397 - DNA, 25 bp, Rattus norvegicus
agacaaacgcatcctcggactggaa

SEQ ID NO: 107398 - DNA, 25 bp, Rattus norvegicus
agacaaacgcatgctcggactggaa

SEQ ID NO: 107399 - DNA, 25 bp, Rattus norvegicus
agacaaacgctgctgggcccttcta

SEQ ID NO: 107400 - DNA, 25 bp, Rattus norvegicus
agacaaacgctggtgggcccttcta

SEQ ID NO: 107401 - DNA, 25 bp, Rattus norvegicus
agacaaactattcctgaggctgaaa

SEQ ID NO: 107402 - DNA, 25 bp, Rattus norvegicus
agacaaactattgctgaggctgaaa

SEQ ID NO: 107403 - DNA, 25 bp, Rattus norvegicus
agacaaactcagctctcctgggaag

SEQ ID NO: 107404 - DNA, 25 bp, Rattus norvegicus
agacaaactcaggtctcctgggaag

SEQ ID NO: 107405 - DNA, 25 bp, Rattus norvegicus
agacaaagacgtcgcctccgctaaa

SEQ ID NO: 107406 - DNA, 25 bp, Rattus norvegicus
agacaaagacgtggcctccgctaaa

SEQ ID NO: 107407 - DNA, 25 bp, Rattus norvegicus
agacaaagctgacggaactcttagg

SEQ ID NO: 107408 - DNA, 25 bp, Rattus norvegicus
agacaaagctgagggaactcttagg

SEQ ID NO: 107409 - DNA, 25 bp, Rattus norvegicus
agacaaagggacacagctgtcgggc

SEQ ID NO: 107410 - DNA, 25 bp, Rattus norvegicus
agacaaagggactcagctgtcgggc

SEQ ID NO: 107411 - DNA, 25 bp, Rattus norvegicus
agacaaagggtcatcccacgttctg

SEQ ID NO: 107412 - DNA, 25 bp, Rattus norvegicus
agacaaagggtcttcccacgttctg

SEQ ID NO: 107413 - DNA, 25 bp, Rattus norvegicus
agacaaaggtagctcgcaggtccag

SEQ ID NO: 107414 - DNA, 25 bp, Rattus norvegicus
agacaaaggtaggtcgcaggtccag

SEQ ID NO: 107415 - DNA, 25 bp, Rattus norvegicus
agacaaagtcttaaactcctgtgta

SEQ ID NO: 107416 - DNA, 25 bp, Rattus norvegicus
agacaaagtctttaactcctgtgta

SEQ ID NO: 107417 - DNA, 25 bp, Rattus norvegicus
agacaaagttctagggtcctccatc

SEQ ID NO: 107418 - DNA, 25 bp, Rattus norvegicus
agacaaagttcttgggtcctccatc

SEQ ID NO: 107419 - DNA, 25 bp, Rattus norvegicus
agacaaatacaacaccctgcgccag

SEQ ID NO: 107420 - DNA, 25 bp, Rattus norvegicus
agacaaatacaagaccctgcgccag

SEQ ID NO: 107421 - DNA, 25 bp, Rattus norvegicus
agacaaatactactaccgctatccc

SEQ ID NO: 107422 - DNA, 25 bp, Rattus norvegicus
agacaaatactagtaccgctatccc

SEQ ID NO: 107423 - DNA, 25 bp, Rattus norvegicus
agacaaatatgcattgtggctgtgc

SEQ ID NO: 107424 - DNA, 25 bp, Rattus norvegicus
agacaaatatgctttgtggctgtgc

SEQ ID NO: 107425 - DNA, 25 bp, Rattus norvegicus
agacaaatcataaattgaccgagat

SEQ ID NO: 107426 - DNA, 25 bp, Rattus norvegicus
agacaaatcatatattgaccgagat

SEQ ID NO: 107427 - DNA, 25 bp, Rattus norvegicus
agacaaatcccactcctactgtgtg

SEQ ID NO: 107428 - DNA, 25 bp, Rattus norvegicus
agacaaatcccagtcctactgtgtg

SEQ ID NO: 107429 - DNA, 25 bp, Rattus norvegicus
agacaaatgcctactcacagcgtga

SEQ ID NO: 107430 - DNA, 25 bp, Rattus norvegicus
agacaaatgccttctcacagcgtga

SEQ ID NO: 107431 - DNA, 25 bp, Rattus norvegicus
agacaaattccactccgtttgcacg

SEQ ID NO: 107432 - DNA, 25 bp, Rattus norvegicus
agacaaattccagtccgtttgcacg

SEQ ID NO: 107433 - DNA, 25 bp, Rattus norvegicus
agacaacacaggatgggcccaggct

SEQ ID NO: 107434 - DNA, 25 bp, Rattus norvegicus
agacaacacaggttgggcccaggct

SEQ ID NO: 107435 - DNA, 25 bp, Rattus norvegicus
agacaacacgttattcacacagggt

SEQ ID NO: 107436 - DNA, 25 bp, Rattus norvegicus
agacaacacgtttttcacacagggt

SEQ ID NO: 107437 - DNA, 25 bp, Rattus norvegicus
agacaacactggatctgtgccttct

SEQ ID NO: 107438 - DNA, 25 bp, Rattus norvegicus
agacaacactggttctgtgccttct

SEQ ID NO: 107439 - DNA, 25 bp, Rattus norvegicus
agacaacagattcagcctagccatg

SEQ ID NO: 107440 - DNA, 25 bp, Rattus norvegicus
agacaacagattgagcctagccatg

SEQ ID NO: 107441 - DNA, 25 bp, Rattus norvegicus
agacaacatggcacagaatatcagt

SEQ ID NO: 107442 - DNA, 25 bp, Rattus norvegicus
agacaacatggctcagaatatcagt

SEQ ID NO: 107443 - DNA, 25 bp, Rattus norvegicus
agacaaccagagacttgcaacctgc

SEQ ID NO: 107444 - DNA, 25 bp, Rattus norvegicus
agacaaccagagtcttgcaacctgc

SEQ ID NO: 107445 - DNA, 25 bp, Rattus norvegicus
agacaacccggaagaacctcagagc

SEQ ID NO: 107446 - DNA, 25 bp, Rattus norvegicus
agacaacccggatgaacctcagagc

SEQ ID NO: 107447 - DNA, 25 bp, Rattus norvegicus
agacaaccctagcaacggcttctat

SEQ ID NO: 107448 - DNA, 25 bp, Rattus norvegicus
agacaaccctaggaacggcttctat

SEQ ID NO: 107449 - DNA, 25 bp, Rattus norvegicus
agacaaccggcaaataacccactag

SEQ ID NO: 107450 - DNA, 25 bp, Rattus norvegicus
agacaaccggcatataacccactag

SEQ ID NO: 107451 - DNA, 25 bp, Rattus norvegicus
agacaacctagtccttcctgacctt

SEQ ID NO: 107452 - DNA, 25 bp, Rattus norvegicus
agacaacctagtgcttcctgacctt

SEQ ID NO: 107453 - DNA, 25 bp, Rattus norvegicus
agacaacctccaataacttcacata

SEQ ID NO: 107454 - DNA, 25 bp, Rattus norvegicus
agacaacctccattaacttcacata

SEQ ID NO: 107455 - DNA, 25 bp, Rattus norvegicus
agacaacctcttatatatttctcga

SEQ ID NO: 107456 - DNA, 25 bp, Rattus norvegicus
agacaacctcttttatatttctcga

SEQ ID NO: 107457 - DNA, 25 bp, Rattus norvegicus
agacaacctgtgattggctgcttct

SEQ ID NO: 107458 - DNA, 25 bp, Rattus norvegicus
agacaacctgtgtttggctgcttct

SEQ ID NO: 107459 - DNA, 25 bp, Rattus norvegicus
agacaaccttttccaatgaccattc

SEQ ID NO: 107460 - DNA, 25 bp, Rattus norvegicus
agacaaccttttgcaatgaccattc

SEQ ID NO: 107461 - DNA, 25 bp, Rattus norvegicus
agacaacgtgggagactggcttcgc

SEQ ID NO: 107462 - DNA, 25 bp, Rattus norvegicus
agacaacgtgggtgactggcttcgc

SEQ ID NO: 107463 - DNA, 25 bp, Rattus norvegicus
agacaacgtgtgcatgctttactca

SEQ ID NO: 107464 - DNA, 25 bp, Rattus norvegicus
agacaacgtgtggatgctttactca

SEQ ID NO: 107465 - DNA, 25 bp, Rattus norvegicus
agacaactcctcacagaaggctctg

SEQ ID NO: 107466 - DNA, 25 bp, Rattus norvegicus
agacaactcctctcagaaggctctg

SEQ ID NO: 107467 - DNA, 25 bp, Rattus norvegicus
agacaactctcacgctggtgactct

SEQ ID NO: 107468 - DNA, 25 bp, Rattus norvegicus
agacaactctcaggctggtgactct

SEQ ID NO: 107469 - DNA, 25 bp, Rattus norvegicus
agacaactctgaccgcccacagttg

SEQ ID NO: 107470 - DNA, 25 bp, Rattus norvegicus
agacaactctgagcgcccacagttg

SEQ ID NO: 107471 - DNA, 25 bp, Rattus norvegicus
agacaactgaacacaagaccctcct

SEQ ID NO: 107472 - DNA, 25 bp, Rattus norvegicus
agacaactgaactcaagaccctcct

SEQ ID NO: 107473 - DNA, 25 bp, Rattus norvegicus
agacaactgatcagtcagctttccc

SEQ ID NO: 107474 - DNA, 25 bp, Rattus norvegicus
agacaactgatctgtcagctttccc

SEQ ID NO: 107475 - DNA, 25 bp, Rattus norvegicus
agacaactgtgccacgggactgagc

SEQ ID NO: 107476 - DNA, 25 bp, Rattus norvegicus
agacaactgtgcgacgggactgagc

SEQ ID NO: 107477 - DNA, 25 bp, Rattus norvegicus
agacaactgttgagcctgatggctg

SEQ ID NO: 107478 - DNA, 25 bp, Rattus norvegicus
agacaactgttgtgcctgatggctg

SEQ ID NO: 107479 - DNA, 25 bp, Rattus norvegicus
agacaacttcatctttgtccgactc

SEQ ID NO: 107480 - DNA, 25 bp, Rattus norvegicus
agacaacttcatgtttgtccgactc

SEQ ID NO: 107481 - DNA, 25 bp, Rattus norvegicus
agacaacttggcaggcatcatggat

SEQ ID NO: 107482 - DNA, 25 bp, Rattus norvegicus
agacaacttggctggcatcatggat

SEQ ID NO: 107483 - DNA, 25 bp, Rattus norvegicus
agacaagaaagaagcctcctaggct

SEQ ID NO: 107484 - DNA, 25 bp, Rattus norvegicus
agacaagaaagatgcctcctaggct

SEQ ID NO: 107485 - DNA, 25 bp, Rattus norvegicus
agacaagaaatcctacgaaccccag

SEQ ID NO: 107486 - DNA, 25 bp, Rattus norvegicus
agacaagaaatcgtacgaaccccag

SEQ ID NO: 107487 - DNA, 25 bp, Rattus norvegicus
agacaagaactgacgcctggcttat

SEQ ID NO: 107488 - DNA, 25 bp, Rattus norvegicus
agacaagaactgtcgcctggcttat

SEQ ID NO: 107489 - DNA, 25 bp, Rattus norvegicus
agacaagacctaaaagtgtgatgag

SEQ ID NO: 107490 - DNA, 25 bp, Rattus norvegicus
agacaagacctataagtgtgatgag

SEQ ID NO: 107491 - DNA, 25 bp, Rattus norvegicus
agacaagacttcactctgtagcgca

SEQ ID NO: 107492 - DNA, 25 bp, Rattus norvegicus
agacaagacttctctctgtagcgca

SEQ ID NO: 107493 - DNA, 25 bp, Rattus norvegicus
agacaagagcccatctgactggatc

SEQ ID NO: 107494 - DNA, 25 bp, Rattus norvegicus
agacaagagcccttctgactggatc

SEQ ID NO: 107495 - DNA, 25 bp, Rattus norvegicus
agacaagagtatcctggtcagcccc

SEQ ID NO: 107496 - DNA, 25 bp, Rattus norvegicus
agacaagagtatgctggtcagcccc

SEQ ID NO: 107497 - DNA, 25 bp, Rattus norvegicus
agacaagatggcagctctgaggaag

SEQ ID NO: 107498 - DNA, 25 bp, Rattus norvegicus
agacaagatggctgctctgaggaag

SEQ ID NO: 107499 - DNA, 25 bp, Rattus norvegicus
agacaagcatgtcacctcgtcttgc

SEQ ID NO: 107500 - DNA, 25 bp, Rattus norvegicus
agacaagcatgtgacctcgtcttgc

SEQ ID NO: 107501 - DNA, 25 bp, Rattus norvegicus
agacaagccctccttgagttggaga

SEQ ID NO: 107502 - DNA, 25 bp, Rattus norvegicus
agacaagccctcgttgagttggaga

SEQ ID NO: 107503 - DNA, 25 bp, Rattus norvegicus
agacaagccttacccaattctctta

SEQ ID NO: 107504 - DNA, 25 bp, Rattus norvegicus
agacaagccttagccaattctctta

SEQ ID NO: 107505 - DNA, 25 bp, Rattus norvegicus
agacaagccttcaagagtcccggac

SEQ ID NO: 107506 - DNA, 25 bp, Rattus norvegicus
agacaagccttctagagtcccggac

SEQ ID NO: 107507 - DNA, 25 bp, Rattus norvegicus
agacaagccttgctaagagccctgc

SEQ ID NO: 107508 - DNA, 25 bp, Rattus norvegicus
agacaagccttggtaagagccctgc

SEQ ID NO: 107509 - DNA, 25 bp, Rattus norvegicus
agacaagcgtgccatttgaccatct

SEQ ID NO: 107510 - DNA, 25 bp, Rattus norvegicus
agacaagcgtgcgatttgaccatct

SEQ ID NO: 107511 - DNA, 25 bp, Rattus norvegicus
agacaagctaagcttctccgtctcc

SEQ ID NO: 107512 - DNA, 25 bp, Rattus norvegicus
agacaagctaaggttctccgtctcc

SEQ ID NO: 107513 - DNA, 25 bp, Rattus norvegicus
agacaagctgtgctactgctctcct

SEQ ID NO: 107514 - DNA, 25 bp, Rattus norvegicus
agacaagctgtggtactgctctcct

SEQ ID NO: 107515 - DNA, 25 bp, Rattus norvegicus
agacaaggagacaagcctgttgccg

SEQ ID NO: 107516 - DNA, 25 bp, Rattus norvegicus
agacaaggagactagcctgttgccg

SEQ ID NO: 107517 - DNA, 25 bp, Rattus norvegicus
agacaaggatcaagcaaccagtttg

SEQ ID NO: 107518 - DNA, 25 bp, Rattus norvegicus
agacaaggatcatgcaaccagtttg

SEQ ID NO: 107519 - DNA, 25 bp, Rattus norvegicus
agacaaggccttccagtgtggacgc

SEQ ID NO: 107520 - DNA, 25 bp, Rattus norvegicus
agacaaggccttgcagtgtggacgc

SEQ ID NO: 107521 - DNA, 25 bp, Rattus norvegicus
agacaaggcttccagtgagtcactc

SEQ ID NO: 107522 - DNA, 25 bp, Rattus norvegicus
agacaaggcttcgagtgagtcactc

SEQ ID NO: 107523 - DNA, 25 bp, Rattus norvegicus
agacaagggatgcacggtcctcaca

SEQ ID NO: 107524 - DNA, 25 bp, Rattus norvegicus
agacaagggatggacggtcctcaca

SEQ ID NO: 107525 - DNA, 25 bp, Rattus norvegicus
agacaagggcggactcactcagggc

SEQ ID NO: 107526 - DNA, 25 bp, Rattus norvegicus
agacaagggcggtctcactcagggc

SEQ ID NO: 107527 - DNA, 25 bp, Rattus norvegicus
agacaaggtcagagtttccctgcca

SEQ ID NO: 107528 - DNA, 25 bp, Rattus norvegicus
agacaaggtcagtgtttccctgcca

SEQ ID NO: 107529 - DNA, 25 bp, Rattus norvegicus
agacaaggtctcactagctttcctg

SEQ ID NO: 107530 - DNA, 25 bp, Rattus norvegicus
agacaaggtctctctagctttcctg

SEQ ID NO: 107531 - DNA, 25 bp, Rattus norvegicus
agacaaggtcttaactgggcgtatt

SEQ ID NO: 107532 - DNA, 25 bp, Rattus norvegicus
agacaaggtcttaattgctggcaat

SEQ ID NO: 107533 - DNA, 25 bp, Rattus norvegicus
agacaaggtctttactgggcgtatt

SEQ ID NO: 107534 - DNA, 25 bp, Rattus norvegicus
agacaaggtctttattgctggcaat

SEQ ID NO: 107535 - DNA, 25 bp, Rattus norvegicus
agacaagtagtgatccgctttcacc

SEQ ID NO: 107536 - DNA, 25 bp, Rattus norvegicus
agacaagtagtgttccgctttcacc

SEQ ID NO: 107537 - DNA, 25 bp, Rattus norvegicus
agacaagtatatacctgttctttag

SEQ ID NO: 107538 - DNA, 25 bp, Rattus norvegicus
agacaagtatattcctgttctttag

SEQ ID NO: 107539 - DNA, 25 bp, Rattus norvegicus
agacaagtctctacatctatgtgaa

SEQ ID NO: 107540 - DNA, 25 bp, Rattus norvegicus
agacaagtctcttcatctatgtgaa

SEQ ID NO: 107541 - DNA, 25 bp, Rattus norvegicus
agacaagtgcctcgctgtgactgaa

SEQ ID NO: 107542 - DNA, 25 bp, Rattus norvegicus
agacaagtgcctggctgtgactgaa

SEQ ID NO: 107543 - DNA, 25 bp, Rattus norvegicus
agacaagtgcggctccgtcagaagc

SEQ ID NO: 107544 - DNA, 25 bp, Rattus norvegicus
agacaagtgcgggtccgtcagaagc

SEQ ID NO: 107545 - DNA, 25 bp, Rattus norvegicus
agacaagtgctcatagagcccaggc

SEQ ID NO: 107546 - DNA, 25 bp, Rattus norvegicus
agacaagtgctcttagagcccaggc

SEQ ID NO: 107547 - DNA, 25 bp, Rattus norvegicus
agacaagtgcttctgtgcaaacctt

SEQ ID NO: 107548 - DNA, 25 bp, Rattus norvegicus
agacaagtgcttgtgtgcaaacctt

SEQ ID NO: 107549 - DNA, 25 bp, Rattus norvegicus
agacaagttccaagttctcctggca

SEQ ID NO: 107550 - DNA, 25 bp, Rattus norvegicus
agacaagttccatgttctcctggca

SEQ ID NO: 107551 - DNA, 25 bp, Rattus norvegicus
agacaatacccgcagcctggttggt

SEQ ID NO: 107552 - DNA, 25 bp, Rattus norvegicus
agacaatacccggagcctggttggt

SEQ ID NO: 107553 - DNA, 25 bp, Rattus norvegicus
agacaatagctaccgtttgccgaac

SEQ ID NO: 107554 - DNA, 25 bp, Rattus norvegicus
agacaatagctagcgtttgccgaac

SEQ ID NO: 107555 - DNA, 25 bp, Rattus norvegicus
agacaatcaacaaggcagcagctag

SEQ ID NO: 107556 - DNA, 25 bp, Rattus norvegicus
agacaatcaacatggcagcagctag

SEQ ID NO: 107557 - DNA, 25 bp, Rattus norvegicus
agacaatcagacacccacgctggaa

SEQ ID NO: 107558 - DNA, 25 bp, Rattus norvegicus
agacaatcagactcccacgctggaa

SEQ ID NO: 107559 - DNA, 25 bp, Rattus norvegicus
agacaatcattcactgtctccttta

SEQ ID NO: 107560 - DNA, 25 bp, Rattus norvegicus
agacaatcattctctgtctccttta

SEQ ID NO: 107561 - DNA, 25 bp, Rattus norvegicus
agacaatccatcatcctgaaagcac

SEQ ID NO: 107562 - DNA, 25 bp, Rattus norvegicus
agacaatccatcttcctgaaagcac

SEQ ID NO: 107563 - DNA, 25 bp, Rattus norvegicus
agacaatcgtccacttatagcggcc

SEQ ID NO: 107564 - DNA, 25 bp, Rattus norvegicus
agacaatcgtcctcttatagcggcc

SEQ ID NO: 107565 - DNA, 25 bp, Rattus norvegicus
agacaatctaaacctgctctcccta

SEQ ID NO: 107566 - DNA, 25 bp, Rattus norvegicus
agacaatctaaagctgctctcccta

SEQ ID NO: 107567 - DNA, 25 bp, Rattus norvegicus
agacaatctgctcagagctgaccag

SEQ ID NO: 107568 - DNA, 25 bp, Rattus norvegicus
agacaatctgctgagagctgaccag

SEQ ID NO: 107569 - DNA, 25 bp, Rattus norvegicus
agacaatctggcagatgaggcgatt

SEQ ID NO: 107570 - DNA, 25 bp, Rattus norvegicus
agacaatctggctgatgaggcgatt

SEQ ID NO: 107571 - DNA, 25 bp, Rattus norvegicus
agacaatctttaatctccccatttt

SEQ ID NO: 107572 - DNA, 25 bp, Rattus norvegicus
agacaatctttattctccccatttt

SEQ ID NO: 107573 - DNA, 25 bp, Rattus norvegicus
agacaatgaattaagcactcgatgc

SEQ ID NO: 107574 - DNA, 25 bp, Rattus norvegicus
agacaatgaatttagcactcgatgc

SEQ ID NO: 107575 - DNA, 25 bp, Rattus norvegicus
agacaatgccccagaggagcgagct

SEQ ID NO: 107576 - DNA, 25 bp, Rattus norvegicus
agacaatgcccctgaggagcgagct

SEQ ID NO: 107577 - DNA, 25 bp, Rattus norvegicus
agacaatgcctgacactgcagcctc

SEQ ID NO: 107578 - DNA, 25 bp, Rattus norvegicus
agacaatgcctgtcactgcagcctc

SEQ ID NO: 107579 - DNA, 25 bp, Rattus norvegicus
agacaatgctgaccgtgacctgtga

SEQ ID NO: 107580 - DNA, 25 bp, Rattus norvegicus
agacaatgctgagcgtgacctgtga

SEQ ID NO: 107581 - DNA, 25 bp, Rattus norvegicus
agacaatggccccattcagcgcagg

SEQ ID NO: 107582 - DNA, 25 bp, Rattus norvegicus
agacaatggcccgattcagcgcagg

SEQ ID NO: 107583 - DNA, 25 bp, Rattus norvegicus
agacaatgggctaagagcacctcct

SEQ ID NO: 107584 - DNA, 25 bp, Rattus norvegicus
agacaatgggcttagagcacctcct

SEQ ID NO: 107585 - DNA, 25 bp, Rattus norvegicus
agacaatgggtccacgtcctgcagc

SEQ ID NO: 107586 - DNA, 25 bp, Rattus norvegicus
agacaatgggtcgacgtcctgcagc

SEQ ID NO: 107587 - DNA, 25 bp, Rattus norvegicus
agacaatgtcagatgaacctttttt

SEQ ID NO: 107588 - DNA, 25 bp, Rattus norvegicus
agacaatgtcagttgaacctttttt

SEQ ID NO: 107589 - DNA, 25 bp, Rattus norvegicus
agacaatgttccaggctgtcgtgct

SEQ ID NO: 107590 - DNA, 25 bp, Rattus norvegicus
agacaatgttcctggctgtcgtgct

SEQ ID NO: 107591 - DNA, 25 bp, Rattus norvegicus
agacaattactcacctctgttcata

SEQ ID NO: 107592 - DNA, 25 bp, Rattus norvegicus
agacaattactctcctctgttcata

SEQ ID NO: 107593 - DNA, 25 bp, Rattus norvegicus
agacaattctgtccgaactcctgaa

SEQ ID NO: 107594 - DNA, 25 bp, Rattus norvegicus
agacaattctgtgcgaactcctgaa

SEQ ID NO: 107595 - DNA, 25 bp, Rattus norvegicus
agacaatttcaaactccgagaggag

SEQ ID NO: 107596 - DNA, 25 bp, Rattus norvegicus
agacaatttcaatctccgagaggag

SEQ ID NO: 107597 - DNA, 25 bp, Rattus norvegicus
agacaatttcagctagccacatatt

SEQ ID NO: 107598 - DNA, 25 bp, Rattus norvegicus
agacaatttcaggtagccacatatt

SEQ ID NO: 107599 - DNA, 25 bp, Rattus norvegicus
agacaattttaacactagcagccgc

SEQ ID NO: 107600 - DNA, 25 bp, Rattus norvegicus
agacaattttaagactagcagccgc

SEQ ID NO: 107601 - DNA, 25 bp, Rattus norvegicus
agacacaaccatcctcgacttttta

SEQ ID NO: 107602 - DNA, 25 bp, Rattus norvegicus
agacacaaccatgctcgacttttta

SEQ ID NO: 107603 - DNA, 25 bp, Rattus norvegicus
agacacaatgaacagccccagaggc

SEQ ID NO: 107604 - DNA, 25 bp, Rattus norvegicus
agacacaatgaagagccccagaggc

SEQ ID NO: 107605 - DNA, 25 bp, Rattus norvegicus
agacacaattgtaaacgccgttggg

SEQ ID NO: 107606 - DNA, 25 bp, Rattus norvegicus
agacacaattgttaacgccgttggg

SEQ ID NO: 107607 - DNA, 25 bp, Rattus norvegicus
agacacacaatgactgcgcatcggc

SEQ ID NO: 107608 - DNA, 25 bp, Rattus norvegicus
agacacacaatgtctgcgcatcggc

SEQ ID NO: 107609 - DNA, 25 bp, Rattus norvegicus
agacacacaggacgacaagcacatt

SEQ ID NO: 107610 - DNA, 25 bp, Rattus norvegicus
agacacacaggaggacaagcacatt

SEQ ID NO: 107611 - DNA, 25 bp, Rattus norvegicus
agacacacaggtcatgtacagatgt

SEQ ID NO: 107612 - DNA, 25 bp, Rattus norvegicus
agacacacaggtctccttgccagga

SEQ ID NO: 107613 - DNA, 25 bp, Rattus norvegicus
agacacacaggtgatgtacagatgt

SEQ ID NO: 107614 - DNA, 25 bp, Rattus norvegicus
agacacacaggtgtccttgccagga

SEQ ID NO: 107615 - DNA, 25 bp, Rattus norvegicus
agacacacatctatgaaaccacagg

SEQ ID NO: 107616 - DNA, 25 bp, Rattus norvegicus
agacacacatctttgaaaccacagg

SEQ ID NO: 107617 - DNA, 25 bp, Rattus norvegicus
agacacacatggcttcaggatggaa

SEQ ID NO: 107618 - DNA, 25 bp, Rattus norvegicus
agacacacatgggttcaggatggaa

SEQ ID NO: 107619 - DNA, 25 bp, Rattus norvegicus
agacacacatgtctagctgggttgg

SEQ ID NO: 107620 - DNA, 25 bp, Rattus norvegicus
agacacacatgtgtagctgggttgg

SEQ ID NO: 107621 - DNA, 25 bp, Rattus norvegicus
agacacacccgacctcattacagat

SEQ ID NO: 107622 - DNA, 25 bp, Rattus norvegicus
agacacacccgagctcattacagat

SEQ ID NO: 107623 - DNA, 25 bp, Rattus norvegicus
agacacaccctgctgcatgaagttg

SEQ ID NO: 107624 - DNA, 25 bp, Rattus norvegicus
agacacaccctggtgcatgaagttg

SEQ ID NO: 107625 - DNA, 25 bp, Rattus norvegicus
agacacaccggtatcagttcttctg

SEQ ID NO: 107626 - DNA, 25 bp, Rattus norvegicus
agacacaccggtttcagttcttctg

SEQ ID NO: 107627 - DNA, 25 bp, Rattus norvegicus
agacacactcaaaactcactttacc

SEQ ID NO: 107628 - DNA, 25 bp, Rattus norvegicus
agacacactcaatactcactttacc

SEQ ID NO: 107629 - DNA, 25 bp, Rattus norvegicus
agacacactggtatcctacaaggga

SEQ ID NO: 107630 - DNA, 25 bp, Rattus norvegicus
agacacactggtttcctacaaggga

SEQ ID NO: 107631 - DNA, 25 bp, Rattus norvegicus
agacacacttagctttcctctggag

SEQ ID NO: 107632 - DNA, 25 bp, Rattus norvegicus
agacacacttaggtttcctctggag

SEQ ID NO: 107633 - DNA, 25 bp, Rattus norvegicus
agacacacttccagtgaaaccacgg

SEQ ID NO: 107634 - DNA, 25 bp, Rattus norvegicus
agacacacttcctgtgaaaccacgg

SEQ ID NO: 107635 - DNA, 25 bp, Rattus norvegicus
agacacacttcgacgcagcgacaga

SEQ ID NO: 107636 - DNA, 25 bp, Rattus norvegicus
agacacacttcgtcgcagcgacaga

SEQ ID NO: 107637 - DNA, 25 bp, Rattus norvegicus
agacacagagcaccctggtcacagg

SEQ ID NO: 107638 - DNA, 25 bp, Rattus norvegicus
agacacagagcagcctggtcacagg

SEQ ID NO: 107639 - DNA, 25 bp, Rattus norvegicus
agacacagagccatactaggtagcc

SEQ ID NO: 107640 - DNA, 25 bp, Rattus norvegicus
agacacagagccttactaggtagcc

SEQ ID NO: 107641 - DNA, 25 bp, Rattus norvegicus
agacacagcataattcctaattgca

SEQ ID NO: 107642 - DNA, 25 bp, Rattus norvegicus
agacacagcatatttcctaattgca

SEQ ID NO: 107643 - DNA, 25 bp, Rattus norvegicus
agacacagcggacctgcctgggctt

SEQ ID NO: 107644 - DNA, 25 bp, Rattus norvegicus
agacacagcggagctgcctgggctt

SEQ ID NO: 107645 - DNA, 25 bp, Rattus norvegicus
agacacagcgggacatggccaacgt

SEQ ID NO: 107646 - DNA, 25 bp, Rattus norvegicus
agacacagcgggtcatggccaacgt

SEQ ID NO: 107647 - DNA, 25 bp, Rattus norvegicus
agacacagcgtcatgtagtccaggc

SEQ ID NO: 107648 - DNA, 25 bp, Rattus norvegicus
agacacagcgtcttgtagtccaggc

SEQ ID NO: 107649 - DNA, 25 bp, Rattus norvegicus
agacacagctccctctctcggtctc

SEQ ID NO: 107650 - DNA, 25 bp, Rattus norvegicus
agacacagctccgtctctcggtctc

SEQ ID NO: 107651 - DNA, 25 bp, Rattus norvegicus
agacacagctgccatcaatgactcc

SEQ ID NO: 107652 - DNA, 25 bp, Rattus norvegicus
agacacagctgcgatcaatgactcc

SEQ ID NO: 107653 - DNA, 25 bp, Rattus norvegicus
agacacaggagcctttacccgctgg

SEQ ID NO: 107654 - DNA, 25 bp, Rattus norvegicus
agacacaggagcgtttacccgctgg

SEQ ID NO: 107655 - DNA, 25 bp, Rattus norvegicus
agacacaggaggaagcgctgaccgc

SEQ ID NO: 107656 - DNA, 25 bp, Rattus norvegicus
agacacaggaggtagcgctgaccgc

SEQ ID NO: 107657 - DNA, 25 bp, Rattus norvegicus
agacacaggattatccacttctcag

SEQ ID NO: 107658 - DNA, 25 bp, Rattus norvegicus
agacacaggattttccacttctcag

SEQ ID NO: 107659 - DNA, 25 bp, Rattus norvegicus
agacacaggcgcctactgacttggc

SEQ ID NO: 107660 - DNA, 25 bp, Rattus norvegicus
agacacaggcgcgtactgacttggc

SEQ ID NO: 107661 - DNA, 25 bp, Rattus norvegicus
agacacaggcggacacgaagccggt

SEQ ID NO: 107662 - DNA, 25 bp, Rattus norvegicus
agacacaggcggctagccagaaact

SEQ ID NO: 107663 - DNA, 25 bp, Rattus norvegicus
agacacaggcgggtagccagaaact

SEQ ID NO: 107664 - DNA, 25 bp, Rattus norvegicus
agacacaggcggtcacgaagccggt

SEQ ID NO: 107665 - DNA, 25 bp, Rattus norvegicus
agacacagggcaagtctctccttgt

SEQ ID NO: 107666 - DNA, 25 bp, Rattus norvegicus
agacacagggcatgtctctccttgt

SEQ ID NO: 107667 - DNA, 25 bp, Rattus norvegicus
agacacagggcccagctggtttatt

SEQ ID NO: 107668 - DNA, 25 bp, Rattus norvegicus
agacacagggccgagctggtttatt

SEQ ID NO: 107669 - DNA, 25 bp, Rattus norvegicus
agacacagggctacttctgagtgga

SEQ ID NO: 107670 - DNA, 25 bp, Rattus norvegicus
agacacagggcttcttctgagtgga

SEQ ID NO: 107671 - DNA, 25 bp, Rattus norvegicus
agacacaggtccaaggagctgcctt

SEQ ID NO: 107672 - DNA, 25 bp, Rattus norvegicus
agacacaggtcctaggagctgcctt

SEQ ID NO: 107673 - DNA, 25 bp, Rattus norvegicus
agacacagtgtcaatcttctgctgc

SEQ ID NO: 107674 - DNA, 25 bp, Rattus norvegicus
agacacagtgtccaagatgccacca

SEQ ID NO: 107675 - DNA, 25 bp, Rattus norvegicus
agacacagtgtcgaagatgccacca

SEQ ID NO: 107676 - DNA, 25 bp, Rattus norvegicus
agacacagtgtctatcttctgctgc

SEQ ID NO: 107677 - DNA, 25 bp, Rattus norvegicus
agacacagttctacgagcagcaacc

SEQ ID NO: 107678 - DNA, 25 bp, Rattus norvegicus
agacacagttcttcgagcagcaacc

SEQ ID NO: 107679 - DNA, 25 bp, Rattus norvegicus
agacacatccggagttcggccatat

SEQ ID NO: 107680 - DNA, 25 bp, Rattus norvegicus
agacacatccggtgttcggccatat

SEQ ID NO: 107681 - DNA, 25 bp, Rattus norvegicus
agacacatctgcacataactcacac

SEQ ID NO: 107682 - DNA, 25 bp, Rattus norvegicus
agacacatctgcatcgggccttgga

SEQ ID NO: 107683 - DNA, 25 bp, Rattus norvegicus
agacacatctgctcataactcacac

SEQ ID NO: 107684 - DNA, 25 bp, Rattus norvegicus
agacacatctgcttcgggccttgga

SEQ ID NO: 107685 - DNA, 25 bp, Rattus norvegicus
agacacatgctgagaggactccaca

SEQ ID NO: 107686 - DNA, 25 bp, Rattus norvegicus
agacacatgctgcttcaaggactgc

SEQ ID NO: 107687 - DNA, 25 bp, Rattus norvegicus
agacacatgctggttcaaggactgc

SEQ ID NO: 107688 - DNA, 25 bp, Rattus norvegicus
agacacatgctgtgaggactccaca

SEQ ID NO: 107689 - DNA, 25 bp, Rattus norvegicus
agacacatggaaccttccctccagg

SEQ ID NO: 107690 - DNA, 25 bp, Rattus norvegicus
agacacatggaagcttccctccagg

SEQ ID NO: 107691 - DNA, 25 bp, Rattus norvegicus
agacacatggcactcacccttgaat

SEQ ID NO: 107692 - DNA, 25 bp, Rattus norvegicus
agacacatggcagtcacccttgaat

SEQ ID NO: 107693 - DNA, 25 bp, Rattus norvegicus
agacacatgggcatggacccctgtc

SEQ ID NO: 107694 - DNA, 25 bp, Rattus norvegicus
agacacatgggcttggacccctgtc

SEQ ID NO: 107695 - DNA, 25 bp, Rattus norvegicus
agacacatgtctcttctcgtgatgg

SEQ ID NO: 107696 - DNA, 25 bp, Rattus norvegicus
agacacatgtctgttctcgtgatgg

SEQ ID NO: 107697 - DNA, 25 bp, Rattus norvegicus
agacacattcagagatcccctttaa

SEQ ID NO: 107698 - DNA, 25 bp, Rattus norvegicus
agacacattcagatttcaagcccat

SEQ ID NO: 107699 - DNA, 25 bp, Rattus norvegicus
agacacattcagtgatcccctttaa

SEQ ID NO: 107700 - DNA, 25 bp, Rattus norvegicus
agacacattcagttttcaagcccat

SEQ ID NO: 107701 - DNA, 25 bp, Rattus norvegicus
agacacatttacatggagcgccttg

SEQ ID NO: 107702 - DNA, 25 bp, Rattus norvegicus
agacacatttacttggagcgccttg

SEQ ID NO: 107703 - DNA, 25 bp, Rattus norvegicus
agacacatttcccaaatcctggagt

SEQ ID NO: 107704 - DNA, 25 bp, Rattus norvegicus
agacacatttccgaaatcctggagt

SEQ ID NO: 107705 - DNA, 25 bp, Rattus norvegicus
agacaccaaaatcctttgccttgtg

SEQ ID NO: 107706 - DNA, 25 bp, Rattus norvegicus
agacaccaaaatgctttgccttgtg

SEQ ID NO: 107707 - DNA, 25 bp, Rattus norvegicus
agacaccaaagtagcccgacgctat

SEQ ID NO: 107708 - DNA, 25 bp, Rattus norvegicus
agacaccaaagttgcccgacgctat

SEQ ID NO: 107709 - DNA, 25 bp, Rattus norvegicus
agacaccaactgaccagagtgcttt

SEQ ID NO: 107710 - DNA, 25 bp, Rattus norvegicus
agacaccaactgtccagagtgcttt

SEQ ID NO: 107711 - DNA, 25 bp, Rattus norvegicus
agacaccaatgcaagaggctcttcc

SEQ ID NO: 107712 - DNA, 25 bp, Rattus norvegicus
agacaccaatgctagaggctcttcc

SEQ ID NO: 107713 - DNA, 25 bp, Rattus norvegicus
agacaccaatttatatcacaagtag

SEQ ID NO: 107714 - DNA, 25 bp, Rattus norvegicus
agacaccaatttttatcacaagtag

SEQ ID NO: 107715 - DNA, 25 bp, Rattus norvegicus
agacaccacaatcagtttacttaca

SEQ ID NO: 107716 - DNA, 25 bp, Rattus norvegicus
agacaccacaatgagtttacttaca

SEQ ID NO: 107717 - DNA, 25 bp, Rattus norvegicus
agacaccacgagcactgaagtagac

SEQ ID NO: 107718 - DNA, 25 bp, Rattus norvegicus
agacaccacgaggactgaagtagac

SEQ ID NO: 107719 - DNA, 25 bp, Rattus norvegicus
agacaccagcttcctctggaagatt

SEQ ID NO: 107720 - DNA, 25 bp, Rattus norvegicus
agacaccagcttgctctggaagatt

SEQ ID NO: 107721 - DNA, 25 bp, Rattus norvegicus
agacaccaggcgaggcctctgttga

SEQ ID NO: 107722 - DNA, 25 bp, Rattus norvegicus
agacaccaggcgtggcctctgttga

SEQ ID NO: 107723 - DNA, 25 bp, Rattus norvegicus
agacaccatattctggccaggttgt

SEQ ID NO: 107724 - DNA, 25 bp, Rattus norvegicus
agacaccatattgtggccaggttgt

SEQ ID NO: 107725 - DNA, 25 bp, Rattus norvegicus
agacaccatgagattgcacacggcg

SEQ ID NO: 107726 - DNA, 25 bp, Rattus norvegicus
agacaccatgagtttgcacacggcg

SEQ ID NO: 107727 - DNA, 25 bp, Rattus norvegicus
agacaccatgatcgcatagctacaa

SEQ ID NO: 107728 - DNA, 25 bp, Rattus norvegicus
agacaccatgatggcatagctacaa

SEQ ID NO: 107729 - DNA, 25 bp, Rattus norvegicus
agacaccatggtccacctaactgat

SEQ ID NO: 107730 - DNA, 25 bp, Rattus norvegicus
agacaccatggtcgcgtactggcga

SEQ ID NO: 107731 - DNA, 25 bp, Rattus norvegicus
agacaccatggtgcacctaactgat

SEQ ID NO: 107732 - DNA, 25 bp, Rattus norvegicus
agacaccatggtggcgtactggcga

SEQ ID NO: 107733 - DNA, 25 bp, Rattus norvegicus
agacacccagagatccaagtcggaa

SEQ ID NO: 107734 - DNA, 25 bp, Rattus norvegicus
agacacccagagttccaagtcggaa

SEQ ID NO: 107735 - DNA, 25 bp, Rattus norvegicus
agacacccaggcagttgtgaatgca

SEQ ID NO: 107736 - DNA, 25 bp, Rattus norvegicus
agacacccaggctgttgtgaatgca

SEQ ID NO: 107737 - DNA, 25 bp, Rattus norvegicus
agacacccatgcagttatccatgaa

SEQ ID NO: 107738 - DNA, 25 bp, Rattus norvegicus
agacacccatgctgttatccatgaa

SEQ ID NO: 107739 - DNA, 25 bp, Rattus norvegicus
agacaccccaaaacagatccggaat

SEQ ID NO: 107740 - DNA, 25 bp, Rattus norvegicus
agacaccccaaatcagatccggaat

SEQ ID NO: 107741 - DNA, 25 bp, Rattus norvegicus
agacacccctacaggctgaagagca

SEQ ID NO: 107742 - DNA, 25 bp, Rattus norvegicus
agacacccctactggctgaagagca

SEQ ID NO: 107743 - DNA, 25 bp, Rattus norvegicus
agacacccgttcagatgttggtcag

SEQ ID NO: 107744 - DNA, 25 bp, Rattus norvegicus
agacacccgttctgatgttggtcag

SEQ ID NO: 107745 - DNA, 25 bp, Rattus norvegicus
agacaccctcatctcatttatcttt

SEQ ID NO: 107746 - DNA, 25 bp, Rattus norvegicus
agacaccctcatgtcatttatcttt

SEQ ID NO: 107747 - DNA, 25 bp, Rattus norvegicus
agacaccctctgagaaggagcctgg

SEQ ID NO: 107748 - DNA, 25 bp, Rattus norvegicus
agacaccctctgtgaaggagcctgg

SEQ ID NO: 107749 - DNA, 25 bp, Rattus norvegicus
agacaccctgtgaatttctatcaag

SEQ ID NO: 107750 - DNA, 25 bp, Rattus norvegicus
agacaccctgtgtatttctatcaag

SEQ ID NO: 107751 - DNA, 25 bp, Rattus norvegicus
agacacccttttcactgaggcctag

SEQ ID NO: 107752 - DNA, 25 bp, Rattus norvegicus
agacacccttttgactgaggcctag

SEQ ID NO: 107753 - DNA, 25 bp, Rattus norvegicus
agacaccgcttgacaggagtgacca

SEQ ID NO: 107754 - DNA, 25 bp, Rattus norvegicus
agacaccgcttgtcaggagtgacca

SEQ ID NO: 107755 - DNA, 25 bp, Rattus norvegicus
agacaccggcagcagtcaggctgca

SEQ ID NO: 107756 - DNA, 25 bp, Rattus norvegicus
agacaccggcaggagtcaggctgca

SEQ ID NO: 107757 - DNA, 25 bp, Rattus norvegicus
agacacctacacattcttgctctgt

SEQ ID NO: 107758 - DNA, 25 bp, Rattus norvegicus
agacacctacactttcttgctctgt

SEQ ID NO: 107759 - DNA, 25 bp, Rattus norvegicus
agacacctctgaactcaacgactat

SEQ ID NO: 107760 - DNA, 25 bp, Rattus norvegicus
agacacctctgatctcaacgactat

SEQ ID NO: 107761 - DNA, 25 bp, Rattus norvegicus
agacacctctgcagaagctatggaa

SEQ ID NO: 107762 - DNA, 25 bp, Rattus norvegicus
agacacctctgctgaagctatggaa

SEQ ID NO: 107763 - DNA, 25 bp, Rattus norvegicus
agacacctcttcaataatggaccct

SEQ ID NO: 107764 - DNA, 25 bp, Rattus norvegicus
agacacctcttctataatggaccct

SEQ ID NO: 107765 - DNA, 25 bp, Rattus norvegicus
agacacctgaataaacctctggcct

SEQ ID NO: 107766 - DNA, 25 bp, Rattus norvegicus
agacacctgaatctccttcttggtt

SEQ ID NO: 107767 - DNA, 25 bp, Rattus norvegicus
agacacctgaatgtccttcttggtt

SEQ ID NO: 107768 - DNA, 25 bp, Rattus norvegicus
agacacctgaattaacctctggcct

SEQ ID NO: 107769 - DNA, 25 bp, Rattus norvegicus
agacacctgagcacatcgttggatg

SEQ ID NO: 107770 - DNA, 25 bp, Rattus norvegicus
agacacctgagcatctgtgaacagt

SEQ ID NO: 107771 - DNA, 25 bp, Rattus norvegicus
agacacctgagctcatcgttggatg

SEQ ID NO: 107772 - DNA, 25 bp, Rattus norvegicus
agacacctgagcttctgtgaacagt

SEQ ID NO: 107773 - DNA, 25 bp, Rattus norvegicus
agacacctgaggctgatgctcttca

SEQ ID NO: 107774 - DNA, 25 bp, Rattus norvegicus
agacacctgagggtgatgctcttca

SEQ ID NO: 107775 - DNA, 25 bp, Rattus norvegicus
agacacctgctcactttaaagaatc

SEQ ID NO: 107776 - DNA, 25 bp, Rattus norvegicus
agacacctgctctctttaaagaatc

SEQ ID NO: 107777 - DNA, 25 bp, Rattus norvegicus
agacacctggtcatgaccgtactaa

SEQ ID NO: 107778 - DNA, 25 bp, Rattus norvegicus
agacacctggtcttgaccgtactaa

SEQ ID NO: 107779 - DNA, 25 bp, Rattus norvegicus
agacacctggtgattcacatagatt

SEQ ID NO: 107780 - DNA, 25 bp, Rattus norvegicus
agacacctggtgtttcacatagatt

SEQ ID NO: 107781 - DNA, 25 bp, Rattus norvegicus
agacacctgtatcagcaagcctttc

SEQ ID NO: 107782 - DNA, 25 bp, Rattus norvegicus
agacacctgtatgagcaagcctttc

SEQ ID NO: 107783 - DNA, 25 bp, Rattus norvegicus
agacacctgtggcagtggcttccag

SEQ ID NO: 107784 - DNA, 25 bp, Rattus norvegicus
agacacctgtgggagtggcttccag

SEQ ID NO: 107785 - DNA, 25 bp, Rattus norvegicus
agacaccttagacagataccgactt

SEQ ID NO: 107786 - DNA, 25 bp, Rattus norvegicus
agacaccttagagagataccgactt

SEQ ID NO: 107787 - DNA, 25 bp, Rattus norvegicus
agacaccttatgagggtagcagcca

SEQ ID NO: 107788 - DNA, 25 bp, Rattus norvegicus
agacaccttatgtgggtagcagcca

SEQ ID NO: 107789 - DNA, 25 bp, Rattus norvegicus
agacaccttcttactgggctcaaat

SEQ ID NO: 107790 - DNA, 25 bp, Rattus norvegicus
agacaccttctttctgggctcaaat

SEQ ID NO: 107791 - DNA, 25 bp, Rattus norvegicus
agacacctttctcccttattctgga

SEQ ID NO: 107792 - DNA, 25 bp, Rattus norvegicus
agacacctttctgccttattctgga

SEQ ID NO: 107793 - DNA, 25 bp, Rattus norvegicus
agacacgaaaaactgctgacccaca

SEQ ID NO: 107794 - DNA, 25 bp, Rattus norvegicus
agacacgaaaaagtgctgacccaca

SEQ ID NO: 107795 - DNA, 25 bp, Rattus norvegicus
agacacgaagcccttcatgttctgc

SEQ ID NO: 107796 - DNA, 25 bp, Rattus norvegicus
agacacgaagccgttcatgttctgc

SEQ ID NO: 107797 - DNA, 25 bp, Rattus norvegicus
agacacgagcccagttgtattcttt

SEQ ID NO: 107798 - DNA, 25 bp, Rattus norvegicus
agacacgagccctgttgtattcttt

SEQ ID NO: 107799 - DNA, 25 bp, Rattus norvegicus
agacacgaggtgagctttcacttct

SEQ ID NO: 107800 - DNA, 25 bp, Rattus norvegicus
agacacgaggtgtgctttcacttct

SEQ ID NO: 107801 - DNA, 25 bp, Rattus norvegicus
agacacgatatccagatctgaaggg

SEQ ID NO: 107802 - DNA, 25 bp, Rattus norvegicus
agacacgatatcgagatctgaaggg

SEQ ID NO: 107803 - DNA, 25 bp, Rattus norvegicus
agacacgatgacatcgctcggagac

SEQ ID NO: 107804 - DNA, 25 bp, Rattus norvegicus
agacacgatgacttcgctcggagac

SEQ ID NO: 107805 - DNA, 25 bp, Rattus norvegicus
agacacgatgctcttccaggtcttc

SEQ ID NO: 107806 - DNA, 25 bp, Rattus norvegicus
agacacgatgctgttccaggtcttc

SEQ ID NO: 107807 - DNA, 25 bp, Rattus norvegicus
agacacgcagcactagctagcccag

SEQ ID NO: 107808 - DNA, 25 bp, Rattus norvegicus
agacacgcagcagtagctagcccag

SEQ ID NO: 107809 - DNA, 25 bp, Rattus norvegicus
agacacgcatgcagatccttgaaga

SEQ ID NO: 107810 - DNA, 25 bp, Rattus norvegicus
agacacgcatgctgatccttgaaga

SEQ ID NO: 107811 - DNA, 25 bp, Rattus norvegicus
agacacgcccaaatctgaaagatat

SEQ ID NO: 107812 - DNA, 25 bp, Rattus norvegicus
agacacgcccaattctgaaagatat

SEQ ID NO: 107813 - DNA, 25 bp, Rattus norvegicus
agacacgccgaacccagagtagcac

SEQ ID NO: 107814 - DNA, 25 bp, Rattus norvegicus
agacacgccgaagccagagtagcac

SEQ ID NO: 107815 - DNA, 25 bp, Rattus norvegicus
agacacgctggtcctccacggcaag

SEQ ID NO: 107816 - DNA, 25 bp, Rattus norvegicus
agacacgctggtgctccacggcaag

SEQ ID NO: 107817 - DNA, 25 bp, Rattus norvegicus
agacacgggaatcgctgaggctttc

SEQ ID NO: 107818 - DNA, 25 bp, Rattus norvegicus
agacacgggaatggctgaggctttc

SEQ ID NO: 107819 - DNA, 25 bp, Rattus norvegicus
agacacggtgtgctccatgcaagaa

SEQ ID NO: 107820 - DNA, 25 bp, Rattus norvegicus
agacacggtgtggtccatgcaagaa

SEQ ID NO: 107821 - DNA, 25 bp, Rattus norvegicus
agacacgtacgtccccagttcagac

SEQ ID NO: 107822 - DNA, 25 bp, Rattus norvegicus
agacacgtacgtgcccagttcagac

SEQ ID NO: 107823 - DNA, 25 bp, Rattus norvegicus
agacacgtatctcgccttgttgaac

SEQ ID NO: 107824 - DNA, 25 bp, Rattus norvegicus
agacacgtatctggccttgttgaac

SEQ ID NO: 107825 - DNA, 25 bp, Rattus norvegicus
agacacgtgacaaccatactgggct

SEQ ID NO: 107826 - DNA, 25 bp, Rattus norvegicus
agacacgtgacatccatactgggct

SEQ ID NO: 107827 - DNA, 25 bp, Rattus norvegicus
agacacgtgcaccttactgatgagc

SEQ ID NO: 107828 - DNA, 25 bp, Rattus norvegicus
agacacgtgcacgttactgatgagc

SEQ ID NO: 107829 - DNA, 25 bp, Rattus norvegicus
agacacgttcaaactgcactgcttc

SEQ ID NO: 107830 - DNA, 25 bp, Rattus norvegicus
agacacgttcaatctgcactgcttc

SEQ ID NO: 107831 - DNA, 25 bp, Rattus norvegicus
agacactaacgaccccatttatgtg

SEQ ID NO: 107832 - DNA, 25 bp, Rattus norvegicus
agacactaacgagcccatttatgtg

SEQ ID NO: 107833 - DNA, 25 bp, Rattus norvegicus
agacactacattatgctctggcaac

SEQ ID NO: 107834 - DNA, 25 bp, Rattus norvegicus
agacactacattttgctctggcaac

SEQ ID NO: 107835 - DNA, 25 bp, Rattus norvegicus
agacactacgatattggttcccaat

SEQ ID NO: 107836 - DNA, 25 bp, Rattus norvegicus
agacactacgattttggttcccaat

SEQ ID NO: 107837 - DNA, 25 bp, Rattus norvegicus
agacactagaatacagacctctgca

SEQ ID NO: 107838 - DNA, 25 bp, Rattus norvegicus
agacactagaattcagacctctgca

SEQ ID NO: 107839 - DNA, 25 bp, Rattus norvegicus
agacactagctcactgttttcacat

SEQ ID NO: 107840 - DNA, 25 bp, Rattus norvegicus
agacactagctctctgttttcacat

SEQ ID NO: 107841 - DNA, 25 bp, Rattus norvegicus
agacactaggcaaggccatggcttc

SEQ ID NO: 107842 - DNA, 25 bp, Rattus norvegicus
agacactaggcatggccatggcttc

SEQ ID NO: 107843 - DNA, 25 bp, Rattus norvegicus
agacactaggtcaggtttcctttgg

SEQ ID NO: 107844 - DNA, 25 bp, Rattus norvegicus
agacactaggtctggtttcctttgg

SEQ ID NO: 107845 - DNA, 25 bp, Rattus norvegicus
agacactagtggcttctccgggtga

SEQ ID NO: 107846 - DNA, 25 bp, Rattus norvegicus
agacactagtgggttctccgggtga

SEQ ID NO: 107847 - DNA, 25 bp, Rattus norvegicus
agacactatatactccttgttggac

SEQ ID NO: 107848 - DNA, 25 bp, Rattus norvegicus
agacactatatagtccttgttggac

SEQ ID NO: 107849 - DNA, 25 bp, Rattus norvegicus
agacactatctcaaacagtagcaac

SEQ ID NO: 107850 - DNA, 25 bp, Rattus norvegicus
agacactatctctaacagtagcaac

SEQ ID NO: 107851 - DNA, 25 bp, Rattus norvegicus
agacactatcttataccttggagaa

SEQ ID NO: 107852 - DNA, 25 bp, Rattus norvegicus
agacactatcttttaccttggagaa

SEQ ID NO: 107853 - DNA, 25 bp, Rattus norvegicus
agacactatgtgaagccgcaagaaa

SEQ ID NO: 107854 - DNA, 25 bp, Rattus norvegicus
agacactatgtgtagccgcaagaaa

SEQ ID NO: 107855 - DNA, 25 bp, Rattus norvegicus
agacactcagagaccctgggtgcta

SEQ ID NO: 107856 - DNA, 25 bp, Rattus norvegicus
agacactcagagtccctgggtgcta

SEQ ID NO: 107857 - DNA, 25 bp, Rattus norvegicus
agacactcagccctgagctgtgaga

SEQ ID NO: 107858 - DNA, 25 bp, Rattus norvegicus
agacactcagccgtgagctgtgaga

SEQ ID NO: 107859 - DNA, 25 bp, Rattus norvegicus
agacactccactcaagccattctgt

SEQ ID NO: 107860 - DNA, 25 bp, Rattus norvegicus
agacactccactgaagccattctgt

SEQ ID NO: 107861 - DNA, 25 bp, Rattus norvegicus
agacactccagacagacacggtgcc

SEQ ID NO: 107862 - DNA, 25 bp, Rattus norvegicus
agacactccagagagacacggtgcc

SEQ ID NO: 107863 - DNA, 25 bp, Rattus norvegicus
agacactccatcaaaccatggcact

SEQ ID NO: 107864 - DNA, 25 bp, Rattus norvegicus
agacactccatctaaccatggcact

SEQ ID NO: 107865 - DNA, 25 bp, Rattus norvegicus
agacactccattcttcagagtcggt

SEQ ID NO: 107866 - DNA, 25 bp, Rattus norvegicus
agacactccattgttcagagtcggt

SEQ ID NO: 107867 - DNA, 25 bp, Rattus norvegicus
agacactccgttcaggccgatggaa

SEQ ID NO: 107868 - DNA, 25 bp, Rattus norvegicus
agacactccgttgaggccgatggaa

SEQ ID NO: 107869 - DNA, 25 bp, Rattus norvegicus
agacactcctctcctgcagtttgag

SEQ ID NO: 107870 - DNA, 25 bp, Rattus norvegicus
agacactcctctgctgcagtttgag

SEQ ID NO: 107871 - DNA, 25 bp, Rattus norvegicus
agacactcctggcaaacctagagtt

SEQ ID NO: 107872 - DNA, 25 bp, Rattus norvegicus
agacactcctgggaaacctagagtt

SEQ ID NO: 107873 - DNA, 25 bp, Rattus norvegicus
agacactcctgtacttaacactaac

SEQ ID NO: 107874 - DNA, 25 bp, Rattus norvegicus
agacactcctgttcttaacactaac

SEQ ID NO: 107875 - DNA, 25 bp, Rattus norvegicus
agacactccttcaggtctcgaagaa

SEQ ID NO: 107876 - DNA, 25 bp, Rattus norvegicus
agacactccttctggtctcgaagaa

SEQ ID NO: 107877 - DNA, 25 bp, Rattus norvegicus
agacactcctttaagcccgagatag

SEQ ID NO: 107878 - DNA, 25 bp, Rattus norvegicus
agacactccttttagcccgagatag

SEQ ID NO: 107879 - DNA, 25 bp, Rattus norvegicus
agacactcgcgtaacctcaggcttt

SEQ ID NO: 107880 - DNA, 25 bp, Rattus norvegicus
agacactcgcgttacctcaggcttt

SEQ ID NO: 107881 - DNA, 25 bp, Rattus norvegicus
agacactcggatatggtggccacgt

SEQ ID NO: 107882 - DNA, 25 bp, Rattus norvegicus
agacactcggatttggtggccacgt

SEQ ID NO: 107883 - DNA, 25 bp, Rattus norvegicus
agacactctgacaagctgaccaaag

SEQ ID NO: 107884 - DNA, 25 bp, Rattus norvegicus
agacactctgactagctgaccaaag

SEQ ID NO: 107885 - DNA, 25 bp, Rattus norvegicus
agacactctgtgacggcttagccag

SEQ ID NO: 107886 - DNA, 25 bp, Rattus norvegicus
agacactctgtgtcggcttagccag

SEQ ID NO: 107887 - DNA, 25 bp, Rattus norvegicus
agacactgaatcagtgtgcctagaa

SEQ ID NO: 107888 - DNA, 25 bp, Rattus norvegicus
agacactgaatctgtgtgcctagaa

SEQ ID NO: 107889 - DNA, 25 bp, Rattus norvegicus
agacactgaccgagtgctgggacca

SEQ ID NO: 107890 - DNA, 25 bp, Rattus norvegicus
agacactgaccgtgtgctgggacca

SEQ ID NO: 107891 - DNA, 25 bp, Rattus norvegicus
agacactgacgtcctctacatgact

SEQ ID NO: 107892 - DNA, 25 bp, Rattus norvegicus
agacactgacgtgctctacatgact

SEQ ID NO: 107893 - DNA, 25 bp, Rattus norvegicus
agacactgatgtcacggctggcaga

SEQ ID NO: 107894 - DNA, 25 bp, Rattus norvegicus
agacactgatgtgacggctggcaga

SEQ ID NO: 107895 - DNA, 25 bp, Rattus norvegicus
agacactgatttcatgtgcactccc

SEQ ID NO: 107896 - DNA, 25 bp, Rattus norvegicus
agacactgatttgatgtgcactccc

SEQ ID NO: 107897 - DNA, 25 bp, Rattus norvegicus
agacactgcatgatcatggcccagt

SEQ ID NO: 107898 - DNA, 25 bp, Rattus norvegicus
agacactgcatgttcatggcccagt

SEQ ID NO: 107899 - DNA, 25 bp, Rattus norvegicus
agacactgccagacactgagagacc

SEQ ID NO: 107900 - DNA, 25 bp, Rattus norvegicus
agacactgccagtcactgagagacc

SEQ ID NO: 107901 - DNA, 25 bp, Rattus norvegicus
agacactgctctcccaaaggatggg

SEQ ID NO: 107902 - DNA, 25 bp, Rattus norvegicus
agacactgctctgccaaaggatggg

SEQ ID NO: 107903 - DNA, 25 bp, Rattus norvegicus
agacactggatacttgccacactgg

SEQ ID NO: 107904 - DNA, 25 bp, Rattus norvegicus
agacactggatagttgccacactgg

SEQ ID NO: 107905 - DNA, 25 bp, Rattus norvegicus
agacactggcagactgtgcacagat

SEQ ID NO: 107906 - DNA, 25 bp, Rattus norvegicus
agacactggcagtctgtgcacagat

SEQ ID NO: 107907 - DNA, 25 bp, Rattus norvegicus
agacactggcctctaggttcctaga

SEQ ID NO: 107908 - DNA, 25 bp, Rattus norvegicus
agacactggcctgtaggttcctaga

SEQ ID NO: 107909 - DNA, 25 bp, Rattus norvegicus
agacactggcttagctcttcaacat

SEQ ID NO: 107910 - DNA, 25 bp, Rattus norvegicus
agacactggctttgctcttcaacat

SEQ ID NO: 107911 - DNA, 25 bp, Rattus norvegicus
agacactgggatcgtcctcgtgaac

SEQ ID NO: 107912 - DNA, 25 bp, Rattus norvegicus
agacactgggatggtcctcgtgaac

SEQ ID NO: 107913 - DNA, 25 bp, Rattus norvegicus
agacactgggtgagctatggttccc

SEQ ID NO: 107914 - DNA, 25 bp, Rattus norvegicus
agacactgggtgaggatcggccacc

SEQ ID NO: 107915 - DNA, 25 bp, Rattus norvegicus
agacactgggtgtgctatggttccc

SEQ ID NO: 107916 - DNA, 25 bp, Rattus norvegicus
agacactgggtgtggatcggccacc

SEQ ID NO: 107917 - DNA, 25 bp, Rattus norvegicus
agacactggtgtctgcaagagctgc

SEQ ID NO: 107918 - DNA, 25 bp, Rattus norvegicus
agacactggtgtgtgcaagagctgc

SEQ ID NO: 107919 - DNA, 25 bp, Rattus norvegicus
agacactggtttccctggactatgc

SEQ ID NO: 107920 - DNA, 25 bp, Rattus norvegicus
agacactggtttgcctggactatgc

SEQ ID NO: 107921 - DNA, 25 bp, Rattus norvegicus
agacactgtactcaggccagggcca

SEQ ID NO: 107922 - DNA, 25 bp, Rattus norvegicus
agacactgtactgaggccagggcca

SEQ ID NO: 107923 - DNA, 25 bp, Rattus norvegicus
agacactgtcagactgtggccatgc

SEQ ID NO: 107924 - DNA, 25 bp, Rattus norvegicus
agacactgtcagtctgtggccatgc

SEQ ID NO: 107925 - DNA, 25 bp, Rattus norvegicus
agacactgtggacttggtttccttg

SEQ ID NO: 107926 - DNA, 25 bp, Rattus norvegicus
agacactgtggagttggtttccttg

SEQ ID NO: 107927 - DNA, 25 bp, Rattus norvegicus
agacactgtttcaggtcctgttttt

SEQ ID NO: 107928 - DNA, 25 bp, Rattus norvegicus
agacactgtttctggtcctgttttt

SEQ ID NO: 107929 - DNA, 25 bp, Rattus norvegicus
agacacttagtacgcatgacctggg

SEQ ID NO: 107930 - DNA, 25 bp, Rattus norvegicus
agacacttagtaggcatgacctggg

SEQ ID NO: 107931 - DNA, 25 bp, Rattus norvegicus
agacacttcaatcattctcttcctt

SEQ ID NO: 107932 - DNA, 25 bp, Rattus norvegicus
agacacttcaatgattctcttcctt

SEQ ID NO: 107933 - DNA, 25 bp, Rattus norvegicus
agacacttcaggatctggtccatca

SEQ ID NO: 107934 - DNA, 25 bp, Rattus norvegicus
agacacttcaggttctggtccatca

SEQ ID NO: 107935 - DNA, 25 bp, Rattus norvegicus
agacacttcagtatctcgcagatat

SEQ ID NO: 107936 - DNA, 25 bp, Rattus norvegicus
agacacttcagtttctcgcagatat

SEQ ID NO: 107937 - DNA, 25 bp, Rattus norvegicus
agacacttccccagaggttggattc

SEQ ID NO: 107938 - DNA, 25 bp, Rattus norvegicus
agacacttcccctgaggttggattc

SEQ ID NO: 107939 - DNA, 25 bp, Rattus norvegicus
agacacttcctgagtatgtacactg

SEQ ID NO: 107940 - DNA, 25 bp, Rattus norvegicus
agacacttcctgtgtatgtacactg

SEQ ID NO: 107941 - DNA, 25 bp, Rattus norvegicus
agacacttcgttattcctgacccat

SEQ ID NO: 107942 - DNA, 25 bp, Rattus norvegicus
agacacttcgtttttcctgacccat

SEQ ID NO: 107943 - DNA, 25 bp, Rattus norvegicus
agacacttctagctgggcacttcgg

SEQ ID NO: 107944 - DNA, 25 bp, Rattus norvegicus
agacacttctaggtgggcacttcgg

SEQ ID NO: 107945 - DNA, 25 bp, Rattus norvegicus
agacacttctggctacctgcacgtg

SEQ ID NO: 107946 - DNA, 25 bp, Rattus norvegicus
agacacttctgggtacctgcacgtg

SEQ ID NO: 107947 - DNA, 25 bp, Rattus norvegicus
agacacttgaagactcgcaccacaa

SEQ ID NO: 107948 - DNA, 25 bp, Rattus norvegicus
agacacttgaagtctcgcaccacaa

SEQ ID NO: 107949 - DNA, 25 bp, Rattus norvegicus
agacacttgcatcgctagtcatcag

SEQ ID NO: 107950 - DNA, 25 bp, Rattus norvegicus
agacacttgcatggctagtcatcag

SEQ ID NO: 107951 - DNA, 25 bp, Rattus norvegicus
agacacttgcctatgagtgctgacc

SEQ ID NO: 107952 - DNA, 25 bp, Rattus norvegicus
agacacttgcctttgagtgctgacc

SEQ ID NO: 107953 - DNA, 25 bp, Rattus norvegicus
agacacttgctcacaagcctaaaga

SEQ ID NO: 107954 - DNA, 25 bp, Rattus norvegicus
agacacttgctctcaagcctaaaga

SEQ ID NO: 107955 - DNA, 25 bp, Rattus norvegicus
agacacttgtgtaccattgattgta

SEQ ID NO: 107956 - DNA, 25 bp, Rattus norvegicus
agacacttgtgttccattgattgta

SEQ ID NO: 107957 - DNA, 25 bp, Rattus norvegicus
agacactttactctagggcaaacct

SEQ ID NO: 107958 - DNA, 25 bp, Rattus norvegicus
agacactttactgtagggcaaacct

SEQ ID NO: 107959 - DNA, 25 bp, Rattus norvegicus
agacactttctcattatatgttaaa

SEQ ID NO: 107960 - DNA, 25 bp, Rattus norvegicus
agacactttctctttatatgttaaa

SEQ ID NO: 107961 - DNA, 25 bp, Rattus norvegicus
agacactttctgattctttggcctc

SEQ ID NO: 107962 - DNA, 25 bp, Rattus norvegicus
agacactttctgtttctttggcctc

SEQ ID NO: 107963 - DNA, 25 bp, Rattus norvegicus
agacactttcttctcagctggtggg

SEQ ID NO: 107964 - DNA, 25 bp, Rattus norvegicus
agacactttcttgtcagctggtggg

SEQ ID NO: 107965 - DNA, 25 bp, Rattus norvegicus
agacactttgagatctgctgcgcta

SEQ ID NO: 107966 - DNA, 25 bp, Rattus norvegicus
agacactttgagttctgctgcgcta

SEQ ID NO: 107967 - DNA, 25 bp, Rattus norvegicus
agacactttgtgagatcgatccaga

SEQ ID NO: 107968 - DNA, 25 bp, Rattus norvegicus
agacactttgtgtgatcgatccaga

SEQ ID NO: 107969 - DNA, 25 bp, Rattus norvegicus
agacacttttcaagttcctgctggc

SEQ ID NO: 107970 - DNA, 25 bp, Rattus norvegicus
agacacttttcatgttcctgctggc

SEQ ID NO: 107971 - DNA, 25 bp, Rattus norvegicus
agacacttttctctgtttccattcc

SEQ ID NO: 107972 - DNA, 25 bp, Rattus norvegicus
agacacttttctgtgtttccattcc

SEQ ID NO: 107973 - DNA, 25 bp, Rattus norvegicus
agacagaaaattctcctcctatgcc

SEQ ID NO: 107974 - DNA, 25 bp, Rattus norvegicus
agacagaaaattctctctgccctgc

SEQ ID NO: 107975 - DNA, 25 bp, Rattus norvegicus
agacagaaaattgtcctcctatgcc

SEQ ID NO: 107976 - DNA, 25 bp, Rattus norvegicus
agacagaaaattgtctctgccctgc

SEQ ID NO: 107977 - DNA, 25 bp, Rattus norvegicus
agacagaaacttcctgacttccagt

SEQ ID NO: 107978 - DNA, 25 bp, Rattus norvegicus
agacagaaacttgctgacttccagt

SEQ ID NO: 107979 - DNA, 25 bp, Rattus norvegicus
agacagaaatgtagcctcagcccta

SEQ ID NO: 107980 - DNA, 25 bp, Rattus norvegicus
agacagaaatgttgcctcagcccta

SEQ ID NO: 107981 - DNA, 25 bp, Rattus norvegicus
agacagaacactcacgcatgggacc

SEQ ID NO: 107982 - DNA, 25 bp, Rattus norvegicus
agacagaacactgacgcatgggacc

SEQ ID NO: 107983 - DNA, 25 bp, Rattus norvegicus
agacagaactggcatctttctgtgc

SEQ ID NO: 107984 - DNA, 25 bp, Rattus norvegicus
agacagaactgggatctttctgtgc

SEQ ID NO: 107985 - DNA, 25 bp, Rattus norvegicus
agacagaagaccacgactccagctt

SEQ ID NO: 107986 - DNA, 25 bp, Rattus norvegicus
agacagaagacctcgactccagctt

SEQ ID NO: 107987 - DNA, 25 bp, Rattus norvegicus
agacagaaggtcatcttcctctgac

SEQ ID NO: 107988 - DNA, 25 bp, Rattus norvegicus
agacagaaggtcttcttcctctgac

SEQ ID NO: 107989 - DNA, 25 bp, Rattus norvegicus
agacagaatggccactgactctcag

SEQ ID NO: 107990 - DNA, 25 bp, Rattus norvegicus
agacagaatggcgactgactctcag

SEQ ID NO: 107991 - DNA, 25 bp, Rattus norvegicus
agacagaattcaaggtcccgaccct

SEQ ID NO: 107992 - DNA, 25 bp, Rattus norvegicus
agacagaattcatggtcccgaccct

SEQ ID NO: 107993 - DNA, 25 bp, Rattus norvegicus
agacagacaagaccccgaaactgta

SEQ ID NO: 107994 - DNA, 25 bp, Rattus norvegicus
agacagacaagagcccgaaactgta

SEQ ID NO: 107995 - DNA, 25 bp, Rattus norvegicus
agacagacagatcccctttgaagcg

SEQ ID NO: 107996 - DNA, 25 bp, Rattus norvegicus
agacagacagatgccctttgaagcg

SEQ ID NO: 107997 - DNA, 25 bp, Rattus norvegicus
agacagacatctcggctattggtgt

SEQ ID NO: 107998 - DNA, 25 bp, Rattus norvegicus
agacagacatctgggctattggtgt

SEQ ID NO: 107999 - DNA, 25 bp, Rattus norvegicus
agacagaccgctactcggtaaggac

SEQ ID NO: 108000 - DNA, 25 bp, Rattus norvegicus
agacagaccgcttctcggtaaggac

SEQ ID NO: 108001 - DNA, 25 bp, Rattus norvegicus
agacagacgggcatctaggtgcagt

SEQ ID NO: 108002 - DNA, 25 bp, Rattus norvegicus
agacagacgggcttctaggtgcagt

SEQ ID NO: 108003 - DNA, 25 bp, Rattus norvegicus
agacagactggtacctcatatgcct

SEQ ID NO: 108004 - DNA, 25 bp, Rattus norvegicus
agacagactggttcctcatatgcct

SEQ ID NO: 108005 - DNA, 25 bp, Rattus norvegicus
agacagactgtacacgacttcggtg

SEQ ID NO: 108006 - DNA, 25 bp, Rattus norvegicus
agacagactgtagacgacttcggtg

SEQ ID NO: 108007 - DNA, 25 bp, Rattus norvegicus
agacagacttccaactatcaccggt

SEQ ID NO: 108008 - DNA, 25 bp, Rattus norvegicus
agacagacttcctactatcaccggt

SEQ ID NO: 108009 - DNA, 25 bp, Rattus norvegicus
agacagagacatattacccctcggc

SEQ ID NO: 108010 - DNA, 25 bp, Rattus norvegicus
agacagagacattttacccctcggc

SEQ ID NO: 108011 - DNA, 25 bp, Rattus norvegicus
agacagagacctctagtccacacca

SEQ ID NO: 108012 - DNA, 25 bp, Rattus norvegicus
agacagagacctgtagtccacacca

SEQ ID NO: 108013 - DNA, 25 bp, Rattus norvegicus
agacagagagccagcgggcagacac

SEQ ID NO: 108014 - DNA, 25 bp, Rattus norvegicus
agacagagagcctgcgggcagacac

SEQ ID NO: 108015 - DNA, 25 bp, Rattus norvegicus
agacagagcccgctgtgatggcaaa

SEQ ID NO: 108016 - DNA, 25 bp, Rattus norvegicus
agacagagcccggtgtgatggcaaa

SEQ ID NO: 108017 - DNA, 25 bp, Rattus norvegicus
agacagagccggacctgcagtatta

SEQ ID NO: 108018 - DNA, 25 bp, Rattus norvegicus
agacagagccggtcctgcagtatta

SEQ ID NO: 108019 - DNA, 25 bp, Rattus norvegicus
agacagagcctaccttgggccttgg

SEQ ID NO: 108020 - DNA, 25 bp, Rattus norvegicus
agacagagcctagcttgggccttgg

SEQ ID NO: 108021 - DNA, 25 bp, Rattus norvegicus
agacagagccttcaagcaaccgatc

SEQ ID NO: 108022 - DNA, 25 bp, Rattus norvegicus
agacagagccttgaagcaaccgatc

SEQ ID NO: 108023 - DNA, 25 bp, Rattus norvegicus
agacagagctagctgatttcttcaa

SEQ ID NO: 108024 - DNA, 25 bp, Rattus norvegicus
agacagagctaggtgatttcttcaa

SEQ ID NO: 108025 - DNA, 25 bp, Rattus norvegicus
agacagagctccctgagcagcagtt

SEQ ID NO: 108026 - DNA, 25 bp, Rattus norvegicus
agacagagctccgtgagcagcagtt

SEQ ID NO: 108027 - DNA, 25 bp, Rattus norvegicus
agacagagctctcggaccttggctt

SEQ ID NO: 108028 - DNA, 25 bp, Rattus norvegicus
agacagagctctgggaccttggctt

SEQ ID NO: 108029 - DNA, 25 bp, Rattus norvegicus
agacagaggagtagaccccgagccc

SEQ ID NO: 108030 - DNA, 25 bp, Rattus norvegicus
agacagaggagttgaccccgagccc

SEQ ID NO: 108031 - DNA, 25 bp, Rattus norvegicus
agacagaggcatatcttgggatcgt

SEQ ID NO: 108032 - DNA, 25 bp, Rattus norvegicus
agacagaggcatttcttgggatcgt

SEQ ID NO: 108033 - DNA, 25 bp, Rattus norvegicus
agacagagggcacctaccggcccag

SEQ ID NO: 108034 - DNA, 25 bp, Rattus norvegicus
agacagagggcagctaccggcccag

SEQ ID NO: 108035 - DNA, 25 bp, Rattus norvegicus
agacagagtcaacgagctgagcccc

SEQ ID NO: 108036 - DNA, 25 bp, Rattus norvegicus
agacagagtcaaggagctgagcccc

SEQ ID NO: 108037 - DNA, 25 bp, Rattus norvegicus
agacagagtctcagagtggccccaa

SEQ ID NO: 108038 - DNA, 25 bp, Rattus norvegicus
agacagagtctctgagtggccccaa

SEQ ID NO: 108039 - DNA, 25 bp, Rattus norvegicus
agacagagtctgagcctggtccttt

SEQ ID NO: 108040 - DNA, 25 bp, Rattus norvegicus
agacagagtctgatctttcctttcc

SEQ ID NO: 108041 - DNA, 25 bp, Rattus norvegicus
agacagagtctgtgcctggtccttt

SEQ ID NO: 108042 - DNA, 25 bp, Rattus norvegicus
agacagagtctgttctttcctttcc

SEQ ID NO: 108043 - DNA, 25 bp, Rattus norvegicus
agacagatacggctctgcccagttg

SEQ ID NO: 108044 - DNA, 25 bp, Rattus norvegicus
agacagatacgggtctgcccagttg

SEQ ID NO: 108045 - DNA, 25 bp, Rattus norvegicus
agacagatagcaaatccccttcagc

SEQ ID NO: 108046 - DNA, 25 bp, Rattus norvegicus
agacagatagcatatccccttcagc

SEQ ID NO: 108047 - DNA, 25 bp, Rattus norvegicus
agacagatgctgatccaagtcctgc

SEQ ID NO: 108048 - DNA, 25 bp, Rattus norvegicus
agacagatgctgttccaagtcctgc

SEQ ID NO: 108049 - DNA, 25 bp, Rattus norvegicus
agacagatgtccacgggagccattc

SEQ ID NO: 108050 - DNA, 25 bp, Rattus norvegicus
agacagatgtcctcgggagccattc

SEQ ID NO: 108051 - DNA, 25 bp, Rattus norvegicus
agacagattaccagtgtgtcctctg

SEQ ID NO: 108052 - DNA, 25 bp, Rattus norvegicus
agacagattacctgtgtgtcctctg

SEQ ID NO: 108053 - DNA, 25 bp, Rattus norvegicus
agacagattattagctctctctccc

SEQ ID NO: 108054 - DNA, 25 bp, Rattus norvegicus
agacagattatttgctctctctccc

SEQ ID NO: 108055 - DNA, 25 bp, Rattus norvegicus
agacagattctgcactcgacttggg

SEQ ID NO: 108056 - DNA, 25 bp, Rattus norvegicus
agacagattctggactcgacttggg

SEQ ID NO: 108057 - DNA, 25 bp, Rattus norvegicus
agacagattgtcacggcatggcggt

SEQ ID NO: 108058 - DNA, 25 bp, Rattus norvegicus
agacagattgtctcggcatggcggt

SEQ ID NO: 108059 - DNA, 25 bp, Rattus norvegicus
agacagcaaactacagggcttttga

SEQ ID NO: 108060 - DNA, 25 bp, Rattus norvegicus
agacagcaaacttcagggcttttga

SEQ ID NO: 108061 - DNA, 25 bp, Rattus norvegicus
agacagcaagtcaccgtctcgcagt

SEQ ID NO: 108062 - DNA, 25 bp, Rattus norvegicus
agacagcaagtccttgcctcaaaca

SEQ ID NO: 108063 - DNA, 25 bp, Rattus norvegicus
agacagcaagtcgttgcctcaaaca

SEQ ID NO: 108064 - DNA, 25 bp, Rattus norvegicus
agacagcaagtctccgtctcgcagt

SEQ ID NO: 108065 - DNA, 25 bp, Rattus norvegicus
agacagcaatgtcgatttcaggccc

SEQ ID NO: 108066 - DNA, 25 bp, Rattus norvegicus
agacagcaatgtggatttcaggccc

SEQ ID NO: 108067 - DNA, 25 bp, Rattus norvegicus
agacagcacaggctgtgcttcctct

SEQ ID NO: 108068 - DNA, 25 bp, Rattus norvegicus
agacagcacagggtgtgcttcctct

SEQ ID NO: 108069 - DNA, 25 bp, Rattus norvegicus
agacagcacctcaggaacttttgcc

SEQ ID NO: 108070 - DNA, 25 bp, Rattus norvegicus
agacagcacctctggaacttttgcc

SEQ ID NO: 108071 - DNA, 25 bp, Rattus norvegicus
agacagcaccttcctgttggaccat

SEQ ID NO: 108072 - DNA, 25 bp, Rattus norvegicus
agacagcaccttgctgttggaccat

SEQ ID NO: 108073 - DNA, 25 bp, Rattus norvegicus
agacagcactgccttggatgattaa

SEQ ID NO: 108074 - DNA, 25 bp, Rattus norvegicus
agacagcactgcgttggatgattaa

SEQ ID NO: 108075 - DNA, 25 bp, Rattus norvegicus
agacagcagataaaggtccttagga

SEQ ID NO: 108076 - DNA, 25 bp, Rattus norvegicus
agacagcagatataggtccttagga

SEQ ID NO: 108077 - DNA, 25 bp, Rattus norvegicus
agacagcagattacagcaccctgga

SEQ ID NO: 108078 - DNA, 25 bp, Rattus norvegicus
agacagcagatttcagcaccctgga

SEQ ID NO: 108079 - DNA, 25 bp, Rattus norvegicus
agacagcagcttctactatccacac

SEQ ID NO: 108080 - DNA, 25 bp, Rattus norvegicus
agacagcagcttgtactatccacac

SEQ ID NO: 108081 - DNA, 25 bp, Rattus norvegicus
agacagcaggcaacatttttatcat

SEQ ID NO: 108082 - DNA, 25 bp, Rattus norvegicus
agacagcaggcatcatttttatcat

SEQ ID NO: 108083 - DNA, 25 bp, Rattus norvegicus
agacagcaggtaagttccggccttt

SEQ ID NO: 108084 - DNA, 25 bp, Rattus norvegicus
agacagcaggtatgttccggccttt

SEQ ID NO: 108085 - DNA, 25 bp, Rattus norvegicus
agacagcagtagcaagcgcctccct

SEQ ID NO: 108086 - DNA, 25 bp, Rattus norvegicus
agacagcagtaggaagcgcctccct

SEQ ID NO: 108087 - DNA, 25 bp, Rattus norvegicus
agacagcagtgcactcttttgatgc

SEQ ID NO: 108088 - DNA, 25 bp, Rattus norvegicus
agacagcagtgctctcttttgatgc

SEQ ID NO: 108089 - DNA, 25 bp, Rattus norvegicus
agacagcagtggatgggcctctctg

SEQ ID NO: 108090 - DNA, 25 bp, Rattus norvegicus
agacagcagtggttgggcctctctg

SEQ ID NO: 108091 - DNA, 25 bp, Rattus norvegicus
agacagcagtttctcagaaccggcc

SEQ ID NO: 108092 - DNA, 25 bp, Rattus norvegicus
agacagcagtttgtcagaaccggcc

SEQ ID NO: 108093 - DNA, 25 bp, Rattus norvegicus
agacagcatgcaccccagtttagga

SEQ ID NO: 108094 - DNA, 25 bp, Rattus norvegicus
agacagcatgcagcccagtttagga

SEQ ID NO: 108095 - DNA, 25 bp, Rattus norvegicus
agacagccactgagaactaggatta

SEQ ID NO: 108096 - DNA, 25 bp, Rattus norvegicus
agacagccactgtgaactaggatta

SEQ ID NO: 108097 - DNA, 25 bp, Rattus norvegicus
agacagccagacaatccgaattagt

SEQ ID NO: 108098 - DNA, 25 bp, Rattus norvegicus
agacagccagactatccgaattagt

SEQ ID NO: 108099 - DNA, 25 bp, Rattus norvegicus
agacagccatagcagcagacccgct

SEQ ID NO: 108100 - DNA, 25 bp, Rattus norvegicus
agacagccataggagcagacccgct

SEQ ID NO: 108101 - DNA, 25 bp, Rattus norvegicus
agacagccctccactacaacatgaa

SEQ ID NO: 108102 - DNA, 25 bp, Rattus norvegicus
agacagccctcctctacaacatgaa

SEQ ID NO: 108103 - DNA, 25 bp, Rattus norvegicus
agacagccctctagtggaatctgga

SEQ ID NO: 108104 - DNA, 25 bp, Rattus norvegicus
agacagccctcttgtggaatctgga

SEQ ID NO: 108105 - DNA, 25 bp, Rattus norvegicus
agacagccctggactgtgagcgccg

SEQ ID NO: 108106 - DNA, 25 bp, Rattus norvegicus
agacagccctggtctgtgagcgccg

SEQ ID NO: 108107 - DNA, 25 bp, Rattus norvegicus
agacagccctgtagcactttgtgtt

SEQ ID NO: 108108 - DNA, 25 bp, Rattus norvegicus
agacagccctgttgcactttgtgtt

SEQ ID NO: 108109 - DNA, 25 bp, Rattus norvegicus
agacagcccttgaacctatgatccc

SEQ ID NO: 108110 - DNA, 25 bp, Rattus norvegicus
agacagcccttgtacctatgatccc

SEQ ID NO: 108111 - DNA, 25 bp, Rattus norvegicus
agacagcctattctctctttagatc

SEQ ID NO: 108112 - DNA, 25 bp, Rattus norvegicus
agacagcctattgtctctttagatc

SEQ ID NO: 108113 - DNA, 25 bp, Rattus norvegicus
agacagcctcaaagacactggctca

SEQ ID NO: 108114 - DNA, 25 bp, Rattus norvegicus
agacagcctcaatgacactggctca

SEQ ID NO: 108115 - DNA, 25 bp, Rattus norvegicus
agacagccttccaaattgtgagcat

SEQ ID NO: 108116 - DNA, 25 bp, Rattus norvegicus
agacagccttccagagaggtggctt

SEQ ID NO: 108117 - DNA, 25 bp, Rattus norvegicus
agacagccttcctaattgtgagcat

SEQ ID NO: 108118 - DNA, 25 bp, Rattus norvegicus
agacagccttcctgagaggtggctt

SEQ ID NO: 108119 - DNA, 25 bp, Rattus norvegicus
agacagccttgtaagtcccatcagg

SEQ ID NO: 108120 - DNA, 25 bp, Rattus norvegicus
agacagccttgttagtcccatcagg

SEQ ID NO: 108121 - DNA, 25 bp, Rattus norvegicus
agacagcgactaatcatatacataa

SEQ ID NO: 108122 - DNA, 25 bp, Rattus norvegicus
agacagcgactattcatatacataa

SEQ ID NO: 108123 - DNA, 25 bp, Rattus norvegicus
agacagcgaggcaactcacagggct

SEQ ID NO: 108124 - DNA, 25 bp, Rattus norvegicus
agacagcgaggctactcacagggct

SEQ ID NO: 108125 - DNA, 25 bp, Rattus norvegicus
agacagcgagttactgtggctccaa

SEQ ID NO: 108126 - DNA, 25 bp, Rattus norvegicus
agacagcgagtttctgtggctccaa

SEQ ID NO: 108127 - DNA, 25 bp, Rattus norvegicus
agacagcgccagaaaataacgtgac

SEQ ID NO: 108128 - DNA, 25 bp, Rattus norvegicus
agacagcgccagtaaataacgtgac

SEQ ID NO: 108129 - DNA, 25 bp, Rattus norvegicus
agacagcgcttcattatgctgctgc

SEQ ID NO: 108130 - DNA, 25 bp, Rattus norvegicus
agacagcgcttctttatgctgctgc

SEQ ID NO: 108131 - DNA, 25 bp, Rattus norvegicus
agacagcggcgtctcactgcagact

SEQ ID NO: 108132 - DNA, 25 bp, Rattus norvegicus
agacagcggcgtgtcactgcagact

SEQ ID NO: 108133 - DNA, 25 bp, Rattus norvegicus
agacagcgggctcctgggtctattc

SEQ ID NO: 108134 - DNA, 25 bp, Rattus norvegicus
agacagcgggctctttggacagtac

SEQ ID NO: 108135 - DNA, 25 bp, Rattus norvegicus
agacagcgggctgctgggtctattc

SEQ ID NO: 108136 - DNA, 25 bp, Rattus norvegicus
agacagcgggctgtttggacagtac

SEQ ID NO: 108137 - DNA, 25 bp, Rattus norvegicus
agacagcgggtgattgctctgcctg

SEQ ID NO: 108138 - DNA, 25 bp, Rattus norvegicus
agacagcgggtgtttgctctgcctg

SEQ ID NO: 108139 - DNA, 25 bp, Rattus norvegicus
agacagcggtaacttcccacaagaa

SEQ ID NO: 108140 - DNA, 25 bp, Rattus norvegicus
agacagcggtaagttcccacaagaa

SEQ ID NO: 108141 - DNA, 25 bp, Rattus norvegicus
agacagcgtccaagcatagaacact

SEQ ID NO: 108142 - DNA, 25 bp, Rattus norvegicus
agacagcgtccatgcatagaacact

SEQ ID NO: 108143 - DNA, 25 bp, Rattus norvegicus
agacagctaatgacctgcgcagaca

SEQ ID NO: 108144 - DNA, 25 bp, Rattus norvegicus
agacagctaatgtcctgcgcagaca

SEQ ID NO: 108145 - DNA, 25 bp, Rattus norvegicus
agacagctagacagacccattctca

SEQ ID NO: 108146 - DNA, 25 bp, Rattus norvegicus
agacagctagactgacccattctca

SEQ ID NO: 108147 - DNA, 25 bp, Rattus norvegicus
agacagctagcaacggacatttttt

SEQ ID NO: 108148 - DNA, 25 bp, Rattus norvegicus
agacagctagcatcggacatttttt

SEQ ID NO: 108149 - DNA, 25 bp, Rattus norvegicus
agacagctagccctcaccagatatt

SEQ ID NO: 108150 - DNA, 25 bp, Rattus norvegicus
agacagctagccgtcaccagatatt

SEQ ID NO: 108151 - DNA, 25 bp, Rattus norvegicus
agacagctcgaacccggaatgctca

SEQ ID NO: 108152 - DNA, 25 bp, Rattus norvegicus
agacagctcgaagccggaatgctca

SEQ ID NO: 108153 - DNA, 25 bp, Rattus norvegicus
agacagctctgtcagtcaggatgtg

SEQ ID NO: 108154 - DNA, 25 bp, Rattus norvegicus
agacagctctgtgagtcaggatgtg

SEQ ID NO: 108155 - DNA, 25 bp, Rattus norvegicus
agacagctcttaccgtggctatcgt

SEQ ID NO: 108156 - DNA, 25 bp, Rattus norvegicus
agacagctcttagcgtggctatcgt

SEQ ID NO: 108157 - DNA, 25 bp, Rattus norvegicus
agacagctgactcgatccctcttct

SEQ ID NO: 108158 - DNA, 25 bp, Rattus norvegicus
agacagctgactggatccctcttct

SEQ ID NO: 108159 - DNA, 25 bp, Rattus norvegicus
agacagctgagaaggctcaccctgt

SEQ ID NO: 108160 - DNA, 25 bp, Rattus norvegicus
agacagctgagatggctcaccctgt

SEQ ID NO: 108161 - DNA, 25 bp, Rattus norvegicus
agacagctgagcacactccggaact

SEQ ID NO: 108162 - DNA, 25 bp, Rattus norvegicus
agacagctgagctcactccggaact

SEQ ID NO: 108163 - DNA, 25 bp, Rattus norvegicus
agacagctgctcctggtaggctttc

SEQ ID NO: 108164 - DNA, 25 bp, Rattus norvegicus
agacagctgctcgtggtaggctttc

SEQ ID NO: 108165 - DNA, 25 bp, Rattus norvegicus
agacagctggctccttacctcttga

SEQ ID NO: 108166 - DNA, 25 bp, Rattus norvegicus
agacagctggctgcttacctcttga

SEQ ID NO: 108167 - DNA, 25 bp, Rattus norvegicus
agacagctggtactctcggttccac

SEQ ID NO: 108168 - DNA, 25 bp, Rattus norvegicus
agacagctggtagtctcggttccac

SEQ ID NO: 108169 - DNA, 25 bp, Rattus norvegicus
agacagctgtccctaatgttggctt

SEQ ID NO: 108170 - DNA, 25 bp, Rattus norvegicus
agacagctgtccgtaatgttggctt

SEQ ID NO: 108171 - DNA, 25 bp, Rattus norvegicus
agacagctgtcgctaagcctgagga

SEQ ID NO: 108172 - DNA, 25 bp, Rattus norvegicus
agacagctgtcggtaagcctgagga

SEQ ID NO: 108173 - DNA, 25 bp, Rattus norvegicus
agacagcttactcaggtcctcactt

SEQ ID NO: 108174 - DNA, 25 bp, Rattus norvegicus
agacagcttactgaggtcctcactt

SEQ ID NO: 108175 - DNA, 25 bp, Rattus norvegicus
agacagcttcgcagtgctcacaaag

SEQ ID NO: 108176 - DNA, 25 bp, Rattus norvegicus
agacagcttcgctgtgctcacaaag

SEQ ID NO: 108177 - DNA, 25 bp, Rattus norvegicus
agacagctttcacagtttgcgggac

SEQ ID NO: 108178 - DNA, 25 bp, Rattus norvegicus
agacagctttcagagtttgcgggac

SEQ ID NO: 108179 - DNA, 25 bp, Rattus norvegicus
agacagctttgtatgaaattgcaca

SEQ ID NO: 108180 - DNA, 25 bp, Rattus norvegicus
agacagctttgtttgaaattgcaca

SEQ ID NO: 108181 - DNA, 25 bp, Rattus norvegicus
agacaggaagctccacgtgggctta

SEQ ID NO: 108182 - DNA, 25 bp, Rattus norvegicus
agacaggaagctgcacgtgggctta

SEQ ID NO: 108183 - DNA, 25 bp, Rattus norvegicus
agacaggaatctcaccaaggcccct

SEQ ID NO: 108184 - DNA, 25 bp, Rattus norvegicus
agacaggaatctgaccaaggcccct

SEQ ID NO: 108185 - DNA, 25 bp, Rattus norvegicus
agacaggaatgtcgtgccagctgcc

SEQ ID NO: 108186 - DNA, 25 bp, Rattus norvegicus
agacaggaatgtggtgccagctgcc

SEQ ID NO: 108187 - DNA, 25 bp, Rattus norvegicus
agacaggacagtatgatttcgctca

SEQ ID NO: 108188 - DNA, 25 bp, Rattus norvegicus
agacaggacagtttgatttcgctca

SEQ ID NO: 108189 - DNA, 25 bp, Rattus norvegicus
agacaggaccacagattggctgcca

SEQ ID NO: 108190 - DNA, 25 bp, Rattus norvegicus
agacaggaccactgattggctgcca

SEQ ID NO: 108191 - DNA, 25 bp, Rattus norvegicus
agacaggacctgcacttttttaact

SEQ ID NO: 108192 - DNA, 25 bp, Rattus norvegicus
agacaggacctggacttttttaact

SEQ ID NO: 108193 - DNA, 25 bp, Rattus norvegicus
agacaggaccttctcaacagcaaga

SEQ ID NO: 108194 - DNA, 25 bp, Rattus norvegicus
agacaggaccttgtcaacagcaaga

SEQ ID NO: 108195 - DNA, 25 bp, Rattus norvegicus
agacaggactgcctttagccacagc

SEQ ID NO: 108196 - DNA, 25 bp, Rattus norvegicus
agacaggactgcgtttagccacagc

SEQ ID NO: 108197 - DNA, 25 bp, Rattus norvegicus
agacaggagccgatacagagaccat

SEQ ID NO: 108198 - DNA, 25 bp, Rattus norvegicus
agacaggagccgttacagagaccat

SEQ ID NO: 108199 - DNA, 25 bp, Rattus norvegicus
agacaggaggtcactacagctgcct

SEQ ID NO: 108200 - DNA, 25 bp, Rattus norvegicus
agacaggaggtctctacagctgcct

SEQ ID NO: 108201 - DNA, 25 bp, Rattus norvegicus
agacaggatgccaagccttgttcat

SEQ ID NO: 108202 - DNA, 25 bp, Rattus norvegicus
agacaggatgcctagccttgttcat

SEQ ID NO: 108203 - DNA, 25 bp, Rattus norvegicus
agacaggattgcaggcgcgtacctt

SEQ ID NO: 108204 - DNA, 25 bp, Rattus norvegicus
agacaggattgctggcgcgtacctt

SEQ ID NO: 108205 - DNA, 25 bp, Rattus norvegicus
agacaggattttccagatccctccc

SEQ ID NO: 108206 - DNA, 25 bp, Rattus norvegicus
agacaggattttgcagatccctccc

SEQ ID NO: 108207 - DNA, 25 bp, Rattus norvegicus
agacaggcaaagagcaccggaccct

SEQ ID NO: 108208 - DNA, 25 bp, Rattus norvegicus
agacaggcaaagtgcaccggaccct

SEQ ID NO: 108209 - DNA, 25 bp, Rattus norvegicus
agacaggcagagacagagaccgcaa

SEQ ID NO: 108210 - DNA, 25 bp, Rattus norvegicus
agacaggcagagtcagagaccgcaa

SEQ ID NO: 108211 - DNA, 25 bp, Rattus norvegicus
agacaggcagccatgtggacctcac

SEQ ID NO: 108212 - DNA, 25 bp, Rattus norvegicus
agacaggcagccttgtggacctcac

SEQ ID NO: 108213 - DNA, 25 bp, Rattus norvegicus
agacaggcatcacttgccgggtctt

SEQ ID NO: 108214 - DNA, 25 bp, Rattus norvegicus
agacaggcatcagttgccgggtctt

SEQ ID NO: 108215 - DNA, 25 bp, Rattus norvegicus
agacaggcatctcgttcccttgaac

SEQ ID NO: 108216 - DNA, 25 bp, Rattus norvegicus
agacaggcatctggttcccttgaac

SEQ ID NO: 108217 - DNA, 25 bp, Rattus norvegicus
agacaggcattgatacatggaaaat

SEQ ID NO: 108218 - DNA, 25 bp, Rattus norvegicus
agacaggcattgatagtgtcaacaa

SEQ ID NO: 108219 - DNA, 25 bp, Rattus norvegicus
agacaggcattgttacatggaaaat

SEQ ID NO: 108220 - DNA, 25 bp, Rattus norvegicus
agacaggcattgttagtgtcaacaa

SEQ ID NO: 108221 - DNA, 25 bp, Rattus norvegicus
agacaggccatgagtatacctttgc

SEQ ID NO: 108222 - DNA, 25 bp, Rattus norvegicus
agacaggccatgtgtatacctttgc

SEQ ID NO: 108223 - DNA, 25 bp, Rattus norvegicus
agacaggcccacctagtccagaaga

SEQ ID NO: 108224 - DNA, 25 bp, Rattus norvegicus
agacaggcccacgtagtccagaaga

SEQ ID NO: 108225 - DNA, 25 bp, Rattus norvegicus
agacaggccctgagattagcatata

SEQ ID NO: 108226 - DNA, 25 bp, Rattus norvegicus
agacaggccctgtgattagcatata

SEQ ID NO: 108227 - DNA, 25 bp, Rattus norvegicus
agacaggccggcacagcatgcttga

SEQ ID NO: 108228 - DNA, 25 bp, Rattus norvegicus
agacaggccggctcagcatgcttga

SEQ ID NO: 108229 - DNA, 25 bp, Rattus norvegicus
agacaggccgtactgaaacccgtgc

SEQ ID NO: 108230 - DNA, 25 bp, Rattus norvegicus
agacaggccgtagtgaaacccgtgc

SEQ ID NO: 108231 - DNA, 25 bp, Rattus norvegicus
agacaggcgatcagtggcctccagt

SEQ ID NO: 108232 - DNA, 25 bp, Rattus norvegicus
agacaggcgatctgtggcctccagt

SEQ ID NO: 108233 - DNA, 25 bp, Rattus norvegicus
agacaggcgattcaccttctgtacc

SEQ ID NO: 108234 - DNA, 25 bp, Rattus norvegicus
agacaggcgattgaccttctgtacc

SEQ ID NO: 108235 - DNA, 25 bp, Rattus norvegicus
agacaggcgtggagaagcagtcctc

SEQ ID NO: 108236 - DNA, 25 bp, Rattus norvegicus
agacaggcgtggtgaagcagtcctc

SEQ ID NO: 108237 - DNA, 25 bp, Rattus norvegicus
agacaggcgttaaagccctttcctt

SEQ ID NO: 108238 - DNA, 25 bp, Rattus norvegicus
agacaggcgttatagccctttcctt

SEQ ID NO: 108239 - DNA, 25 bp, Rattus norvegicus
agacaggctgtcaaagtcccaccag

SEQ ID NO: 108240 - DNA, 25 bp, Rattus norvegicus
agacaggctgtctaagtcccaccag

SEQ ID NO: 108241 - DNA, 25 bp, Rattus norvegicus
agacaggctgttacttttgacacaa

SEQ ID NO: 108242 - DNA, 25 bp, Rattus norvegicus
agacaggctgtttcttttgacacaa

SEQ ID NO: 108243 - DNA, 25 bp, Rattus norvegicus
agacaggcttggactttggaaagct

SEQ ID NO: 108244 - DNA, 25 bp, Rattus norvegicus
agacaggcttggtctttggaaagct

SEQ ID NO: 108245 - DNA, 25 bp, Rattus norvegicus
agacaggcttttaatacaccagggt

SEQ ID NO: 108246 - DNA, 25 bp, Rattus norvegicus
agacaggcttttctggtgagcgttt

SEQ ID NO: 108247 - DNA, 25 bp, Rattus norvegicus
agacaggcttttgtggtgagcgttt

SEQ ID NO: 108248 - DNA, 25 bp, Rattus norvegicus
agacaggctttttatacaccagggt

SEQ ID NO: 108249 - DNA, 25 bp, Rattus norvegicus
agacagggaccactgagctcccaat

SEQ ID NO: 108250 - DNA, 25 bp, Rattus norvegicus
agacagggaccagtgagctcccaat

SEQ ID NO: 108251 - DNA, 25 bp, Rattus norvegicus
agacagggcaagctgatagctaagc

SEQ ID NO: 108252 - DNA, 25 bp, Rattus norvegicus
agacagggcaaggtgatagctaagc

SEQ ID NO: 108253 - DNA, 25 bp, Rattus norvegicus
agacagggcacactctccttgagga

SEQ ID NO: 108254 - DNA, 25 bp, Rattus norvegicus
agacagggcacagtctccttgagga

SEQ ID NO: 108255 - DNA, 25 bp, Rattus norvegicus
agacagggcagtcagtgggcacaca

SEQ ID NO: 108256 - DNA, 25 bp, Rattus norvegicus
agacagggcagtccacagctgctgt

SEQ ID NO: 108257 - DNA, 25 bp, Rattus norvegicus
agacagggcagtgagtgggcacaca

SEQ ID NO: 108258 - DNA, 25 bp, Rattus norvegicus
agacagggcagtgcacagctgctgt

SEQ ID NO: 108259 - DNA, 25 bp, Rattus norvegicus
agacagggccttcccgtgacacgtt

SEQ ID NO: 108260 - DNA, 25 bp, Rattus norvegicus
agacagggccttgccgtgacacgtt

SEQ ID NO: 108261 - DNA, 25 bp, Rattus norvegicus
agacaggggacgaatgcatctccat

SEQ ID NO: 108262 - DNA, 25 bp, Rattus norvegicus
agacaggggacgtatgcatctccat

SEQ ID NO: 108263 - DNA, 25 bp, Rattus norvegicus
agacagggtcccactttgaatcgct

SEQ ID NO: 108264 - DNA, 25 bp, Rattus norvegicus
agacagggtccctctttgaatcgct

SEQ ID NO: 108265 - DNA, 25 bp, Rattus norvegicus
agacaggtaatacccctggcacaac

SEQ ID NO: 108266 - DNA, 25 bp, Rattus norvegicus
agacaggtaatagccctggcacaac

SEQ ID NO: 108267 - DNA, 25 bp, Rattus norvegicus
agacaggtcacaatctcttcgtaca

SEQ ID NO: 108268 - DNA, 25 bp, Rattus norvegicus
agacaggtcacattctcttcgtaca

SEQ ID NO: 108269 - DNA, 25 bp, Rattus norvegicus
agacaggtcgttagcgagtggcgtc

SEQ ID NO: 108270 - DNA, 25 bp, Rattus norvegicus
agacaggtcgtttgcgagtggcgtc

SEQ ID NO: 108271 - DNA, 25 bp, Rattus norvegicus
agacaggtgaccctgggtgccaccc

SEQ ID NO: 108272 - DNA, 25 bp, Rattus norvegicus
agacaggtgaccgtgggtgccaccc

SEQ ID NO: 108273 - DNA, 25 bp, Rattus norvegicus
agacaggtgactccccatgtcaagg

SEQ ID NO: 108274 - DNA, 25 bp, Rattus norvegicus
agacaggtgactgcccatgtcaagg

SEQ ID NO: 108275 - DNA, 25 bp, Rattus norvegicus
agacaggtggctatgaggctcttcc

SEQ ID NO: 108276 - DNA, 25 bp, Rattus norvegicus
agacaggtggctttgaggctcttcc

SEQ ID NO: 108277 - DNA, 25 bp, Rattus norvegicus
agacaggtgggtacccagagctcac

SEQ ID NO: 108278 - DNA, 25 bp, Rattus norvegicus
agacaggtgggttcccagagctcac

SEQ ID NO: 108279 - DNA, 25 bp, Rattus norvegicus
agacaggtgtgtaaagccctcagga

SEQ ID NO: 108280 - DNA, 25 bp, Rattus norvegicus
agacaggtgtgttaagccctcagga

SEQ ID NO: 108281 - DNA, 25 bp, Rattus norvegicus
agacaggtttctcctggcacgggct

SEQ ID NO: 108282 - DNA, 25 bp, Rattus norvegicus
agacaggtttctgctggcacgggct

SEQ ID NO: 108283 - DNA, 25 bp, Rattus norvegicus
agacagtaaacaagaccctccgtgg

SEQ ID NO: 108284 - DNA, 25 bp, Rattus norvegicus
agacagtaaacatgaccctccgtgg

SEQ ID NO: 108285 - DNA, 25 bp, Rattus norvegicus
agacagtaactcagcgtcctggagc

SEQ ID NO: 108286 - DNA, 25 bp, Rattus norvegicus
agacagtaactctgcgtcctggagc

SEQ ID NO: 108287 - DNA, 25 bp, Rattus norvegicus
agacagtaccccagacttgtaacaa

SEQ ID NO: 108288 - DNA, 25 bp, Rattus norvegicus
agacagtacccctgacttgtaacaa

SEQ ID NO: 108289 - DNA, 25 bp, Rattus norvegicus
agacagtactgaccccttcagcaat

SEQ ID NO: 108290 - DNA, 25 bp, Rattus norvegicus
agacagtactgagcccttcagcaat

SEQ ID NO: 108291 - DNA, 25 bp, Rattus norvegicus
agacagtagcaaacatctcctctta

SEQ ID NO: 108292 - DNA, 25 bp, Rattus norvegicus
agacagtagcaatcatctcctctta

SEQ ID NO: 108293 - DNA, 25 bp, Rattus norvegicus
agacagtagctgagcatccattccc

SEQ ID NO: 108294 - DNA, 25 bp, Rattus norvegicus
agacagtagctgtgcatccattccc

SEQ ID NO: 108295 - DNA, 25 bp, Rattus norvegicus
agacagtagtgaacaacttcttggt

SEQ ID NO: 108296 - DNA, 25 bp, Rattus norvegicus
agacagtagtgatcaacttcttggt

SEQ ID NO: 108297 - DNA, 25 bp, Rattus norvegicus
agacagtattatctcttcagtaagt

SEQ ID NO: 108298 - DNA, 25 bp, Rattus norvegicus
agacagtattatgtcttcagtaagt

SEQ ID NO: 108299 - DNA, 25 bp, Rattus norvegicus
agacagtatttgattccagtggact

SEQ ID NO: 108300 - DNA, 25 bp, Rattus norvegicus
agacagtatttgtttccagtggact

SEQ ID NO: 108301 - DNA, 25 bp, Rattus norvegicus
agacagtcacaaacgctgatgttgc

SEQ ID NO: 108302 - DNA, 25 bp, Rattus norvegicus
agacagtcacaatcgctgatgttgc

SEQ ID NO: 108303 - DNA, 25 bp, Rattus norvegicus
agacagtcaccaacgtactgggtgt

SEQ ID NO: 108304 - DNA, 25 bp, Rattus norvegicus
agacagtcaccatcgtactgggtgt

SEQ ID NO: 108305 - DNA, 25 bp, Rattus norvegicus
agacagtcacctctatccccaattg

SEQ ID NO: 108306 - DNA, 25 bp, Rattus norvegicus
agacagtcacctgtatccccaattg

SEQ ID NO: 108307 - DNA, 25 bp, Rattus norvegicus
agacagtcacgcaaagcggagcccc

SEQ ID NO: 108308 - DNA, 25 bp, Rattus norvegicus
agacagtcacgctaagcggagcccc

SEQ ID NO: 108309 - DNA, 25 bp, Rattus norvegicus
agacagtcagtcagcactcaggaga

SEQ ID NO: 108310 - DNA, 25 bp, Rattus norvegicus
agacagtcagtctgcactcaggaga

SEQ ID NO: 108311 - DNA, 25 bp, Rattus norvegicus
agacagtccagtacagtgtctcttc

SEQ ID NO: 108312 - DNA, 25 bp, Rattus norvegicus
agacagtccagttcagtgtctcttc

SEQ ID NO: 108313 - DNA, 25 bp, Rattus norvegicus
agacagtccatgatgtgattcccct

SEQ ID NO: 108314 - DNA, 25 bp, Rattus norvegicus
agacagtccatgttgtgattcccct

SEQ ID NO: 108315 - DNA, 25 bp, Rattus norvegicus
agacagtcctagataggccctgact

SEQ ID NO: 108316 - DNA, 25 bp, Rattus norvegicus
agacagtcctagttaggccctgact

SEQ ID NO: 108317 - DNA, 25 bp, Rattus norvegicus
agacagtcctgcagctctagcagca

SEQ ID NO: 108318 - DNA, 25 bp, Rattus norvegicus
agacagtcctgctgctctagcagca

SEQ ID NO: 108319 - DNA, 25 bp, Rattus norvegicus
agacagtcctttacactactatggg

SEQ ID NO: 108320 - DNA, 25 bp, Rattus norvegicus
agacagtcctttcccatcggaggct

SEQ ID NO: 108321 - DNA, 25 bp, Rattus norvegicus
agacagtcctttgccatcggaggct

SEQ ID NO: 108322 - DNA, 25 bp, Rattus norvegicus
agacagtccttttcactactatggg

SEQ ID NO: 108323 - DNA, 25 bp, Rattus norvegicus
agacagtcgcttactggatgcctga

SEQ ID NO: 108324 - DNA, 25 bp, Rattus norvegicus
agacagtcgctttctggatgcctga

SEQ ID NO: 108325 - DNA, 25 bp, Rattus norvegicus
agacagtcgggtccaggctcagaac

SEQ ID NO: 108326 - DNA, 25 bp, Rattus norvegicus
agacagtcgggtgcaggctcagaac

SEQ ID NO: 108327 - DNA, 25 bp, Rattus norvegicus
agacagtcggtcatttttcacaagc

SEQ ID NO: 108328 - DNA, 25 bp, Rattus norvegicus
agacagtcggtcttttttcacaagc

SEQ ID NO: 108329 - DNA, 25 bp, Rattus norvegicus
agacagtctaaacccagtggttctc

SEQ ID NO: 108330 - DNA, 25 bp, Rattus norvegicus
agacagtctaaagccagtggttctc

SEQ ID NO: 108331 - DNA, 25 bp, Rattus norvegicus
agacagtctgagaagctcctggctt

SEQ ID NO: 108332 - DNA, 25 bp, Rattus norvegicus
agacagtctgagtagctcctggctt

SEQ ID NO: 108333 - DNA, 25 bp, Rattus norvegicus
agacagtcttgactctcccatcgtg

SEQ ID NO: 108334 - DNA, 25 bp, Rattus norvegicus
agacagtcttgagtctcccatcgtg

SEQ ID NO: 108335 - DNA, 25 bp, Rattus norvegicus
agacagtcttgcaacctgtgcgacc

SEQ ID NO: 108336 - DNA, 25 bp, Rattus norvegicus
agacagtcttgctacctgtgcgacc

SEQ ID NO: 108337 - DNA, 25 bp, Rattus norvegicus
agacagtcttggatcacattccagt

SEQ ID NO: 108338 - DNA, 25 bp, Rattus norvegicus
agacagtcttggttcacattccagt

SEQ ID NO: 108339 - DNA, 25 bp, Rattus norvegicus
agacagtctttactgcccaacctag

SEQ ID NO: 108340 - DNA, 25 bp, Rattus norvegicus
agacagtctttagtgcccaacctag

SEQ ID NO: 108341 - DNA, 25 bp, Rattus norvegicus
agacagtgaacaaagcctgcccgtg

SEQ ID NO: 108342 - DNA, 25 bp, Rattus norvegicus
agacagtgaacatagcctgcccgtg

SEQ ID NO: 108343 - DNA, 25 bp, Rattus norvegicus
agacagtgacttatatccagagatc

SEQ ID NO: 108344 - DNA, 25 bp, Rattus norvegicus
agacagtgacttttatccagagatc

SEQ ID NO: 108345 - DNA, 25 bp, Rattus norvegicus
agacagtgagtcaccttgtgacctg

SEQ ID NO: 108346 - DNA, 25 bp, Rattus norvegicus
agacagtgagtctccttgtgacctg

SEQ ID NO: 108347 - DNA, 25 bp, Rattus norvegicus
agacagtgagtgctggacacctctg

SEQ ID NO: 108348 - DNA, 25 bp, Rattus norvegicus
agacagtgagtggtggacacctctg

SEQ ID NO: 108349 - DNA, 25 bp, Rattus norvegicus
agacagtgatgcatcgtcagagctt

SEQ ID NO: 108350 - DNA, 25 bp, Rattus norvegicus
agacagtgatgcttcgtcagagctt

SEQ ID NO: 108351 - DNA, 25 bp, Rattus norvegicus
agacagtgcgttacaaattgccaat

SEQ ID NO: 108352 - DNA, 25 bp, Rattus norvegicus
agacagtgcgtttcaaattgccaat

SEQ ID NO: 108353 - DNA, 25 bp, Rattus norvegicus
agacagtgctggctgtcatttctca

SEQ ID NO: 108354 - DNA, 25 bp, Rattus norvegicus
agacagtgctgggtgtcatttctca

SEQ ID NO: 108355 - DNA, 25 bp, Rattus norvegicus
agacagtgcttcaccaacatgacag

SEQ ID NO: 108356 - DNA, 25 bp, Rattus norvegicus
agacagtgcttctccaacatgacag

SEQ ID NO: 108357 - DNA, 25 bp, Rattus norvegicus
agacagtggaatctctctctcaact

SEQ ID NO: 108358 - DNA, 25 bp, Rattus norvegicus
agacagtggaatgtctctctcaact

SEQ ID NO: 108359 - DNA, 25 bp, Rattus norvegicus
agacagtggaccaagcggtacgcca

SEQ ID NO: 108360 - DNA, 25 bp, Rattus norvegicus
agacagtggacctagcggtacgcca

SEQ ID NO: 108361 - DNA, 25 bp, Rattus norvegicus
agacagtggactacctagctcaggg

SEQ ID NO: 108362 - DNA, 25 bp, Rattus norvegicus
agacagtggacttcctagctcaggg

SEQ ID NO: 108363 - DNA, 25 bp, Rattus norvegicus
agacagtggcccaaaatacatccca

SEQ ID NO: 108364 - DNA, 25 bp, Rattus norvegicus
agacagtggcccagttggtggatct

SEQ ID NO: 108365 - DNA, 25 bp, Rattus norvegicus
agacagtggccctaaatacatccca

SEQ ID NO: 108366 - DNA, 25 bp, Rattus norvegicus
agacagtggccctgttggtggatct

SEQ ID NO: 108367 - DNA, 25 bp, Rattus norvegicus
agacagtggcgtcactttggtgctc

SEQ ID NO: 108368 - DNA, 25 bp, Rattus norvegicus
agacagtggcgtgactttggtgctc

SEQ ID NO: 108369 - DNA, 25 bp, Rattus norvegicus
agacagtggctcatacagtgtgcgc

SEQ ID NO: 108370 - DNA, 25 bp, Rattus norvegicus
agacagtggctcctgttgtcgtcag

SEQ ID NO: 108371 - DNA, 25 bp, Rattus norvegicus
agacagtggctcgtgttgtcgtcag

SEQ ID NO: 108372 - DNA, 25 bp, Rattus norvegicus
agacagtggctcttacagtgtgcgc

SEQ ID NO: 108373 - DNA, 25 bp, Rattus norvegicus
agacagtgggatctacctgtggcct

SEQ ID NO: 108374 - DNA, 25 bp, Rattus norvegicus
agacagtgggatgtacctgtggcct

SEQ ID NO: 108375 - DNA, 25 bp, Rattus norvegicus
agacagtggtgcacacacgtgaacc

SEQ ID NO: 108376 - DNA, 25 bp, Rattus norvegicus
agacagtggtgctcacacgtgaacc

SEQ ID NO: 108377 - DNA, 25 bp, Rattus norvegicus
agacagtgtagtctcggtcctgcta

SEQ ID NO: 108378 - DNA, 25 bp, Rattus norvegicus
agacagtgtagtgtcggtcctgcta

SEQ ID NO: 108379 - DNA, 25 bp, Rattus norvegicus
agacagtgtcagagccggttctggt

SEQ ID NO: 108380 - DNA, 25 bp, Rattus norvegicus
agacagtgtcagtgccggttctggt

SEQ ID NO: 108381 - DNA, 25 bp, Rattus norvegicus
agacagtgtcttacttacaggccat

SEQ ID NO: 108382 - DNA, 25 bp, Rattus norvegicus
agacagtgtctttcttacaggccat

SEQ ID NO: 108383 - DNA, 25 bp, Rattus norvegicus
agacagtgtgaacatttttctagcc

SEQ ID NO: 108384 - DNA, 25 bp, Rattus norvegicus
agacagtgtgaagatttttctagcc

SEQ ID NO: 108385 - DNA, 25 bp, Rattus norvegicus
agacagtgtgagctgccacctctgc

SEQ ID NO: 108386 - DNA, 25 bp, Rattus norvegicus
agacagtgtgaggtgccacctctgc

SEQ ID NO: 108387 - DNA, 25 bp, Rattus norvegicus
agacagttacagatatctcgcctcc

SEQ ID NO: 108388 - DNA, 25 bp, Rattus norvegicus
agacagttacagttatctcgcctcc

SEQ ID NO: 108389 - DNA, 25 bp, Rattus norvegicus
agacagttactgagagactaggaca

SEQ ID NO: 108390 - DNA, 25 bp, Rattus norvegicus
agacagttactgtgagactaggaca

SEQ ID NO: 108391 - DNA, 25 bp, Rattus norvegicus
agacagttatctaggccctgggtga

SEQ ID NO: 108392 - DNA, 25 bp, Rattus norvegicus
agacagttatcttggccctgggtga

SEQ ID NO: 108393 - DNA, 25 bp, Rattus norvegicus
agacagttcaacacagagccctcaa

SEQ ID NO: 108394 - DNA, 25 bp, Rattus norvegicus
agacagttcaactcagagccctcaa

SEQ ID NO: 108395 - DNA, 25 bp, Rattus norvegicus
agacagttcctaacgttctattccc

SEQ ID NO: 108396 - DNA, 25 bp, Rattus norvegicus
agacagttcctatcgttctattccc

SEQ ID NO: 108397 - DNA, 25 bp, Rattus norvegicus
agacagttcgtcaggttattcccgt

SEQ ID NO: 108398 - DNA, 25 bp, Rattus norvegicus
agacagttcgtctggttattcccgt

SEQ ID NO: 108399 - DNA, 25 bp, Rattus norvegicus
agacagttctatagctagttccttt

SEQ ID NO: 108400 - DNA, 25 bp, Rattus norvegicus
agacagttctattgctagttccttt

SEQ ID NO: 108401 - DNA, 25 bp, Rattus norvegicus
agacagttctgcattcttttgccgt

SEQ ID NO: 108402 - DNA, 25 bp, Rattus norvegicus
agacagttctgctttcttttgccgt

SEQ ID NO: 108403 - DNA, 25 bp, Rattus norvegicus
agacagttgcaacctgctatgtggt

SEQ ID NO: 108404 - DNA, 25 bp, Rattus norvegicus
agacagttgcaagctgctatgtggt

SEQ ID NO: 108405 - DNA, 25 bp, Rattus norvegicus
agacagttgcacaacacaaaccctt

SEQ ID NO: 108406 - DNA, 25 bp, Rattus norvegicus
agacagttgcactacacaaaccctt

SEQ ID NO: 108407 - DNA, 25 bp, Rattus norvegicus
agacagttgctcatctccatgagag

SEQ ID NO: 108408 - DNA, 25 bp, Rattus norvegicus
agacagttgctcttctccatgagag

SEQ ID NO: 108409 - DNA, 25 bp, Rattus norvegicus
agacagttggcaaaggactccttag

SEQ ID NO: 108410 - DNA, 25 bp, Rattus norvegicus
agacagttggcataggactccttag

SEQ ID NO: 108411 - DNA, 25 bp, Rattus norvegicus
agacagttgtaaatgcccacccaag

SEQ ID NO: 108412 - DNA, 25 bp, Rattus norvegicus
agacagttgtaattgcccacccaag

SEQ ID NO: 108413 - DNA, 25 bp, Rattus norvegicus
agacagttgtcgatcacaatgcccc

SEQ ID NO: 108414 - DNA, 25 bp, Rattus norvegicus
agacagttgtcgttcacaatgcccc

SEQ ID NO: 108415 - DNA, 25 bp, Rattus norvegicus
agacagttgtgtccatcgtgggcca

SEQ ID NO: 108416 - DNA, 25 bp, Rattus norvegicus
agacagttgtgtgcatcgtgggcca

SEQ ID NO: 108417 - DNA, 25 bp, Rattus norvegicus
agacagtttctcattgtgtagctct

SEQ ID NO: 108418 - DNA, 25 bp, Rattus norvegicus
agacagtttctctttgtgtagctct

SEQ ID NO: 108419 - DNA, 25 bp, Rattus norvegicus
agacataaacgtatttgctgttggt

SEQ ID NO: 108420 - DNA, 25 bp, Rattus norvegicus
agacataaacgtttttgctgttggt

SEQ ID NO: 108421 - DNA, 25 bp, Rattus norvegicus
agacataacagcagcctgggttctc

SEQ ID NO: 108422 - DNA, 25 bp, Rattus norvegicus
agacataacagctgcctgggttctc

SEQ ID NO: 108423 - DNA, 25 bp, Rattus norvegicus
agacataaccttagctactttgaat

SEQ ID NO: 108424 - DNA, 25 bp, Rattus norvegicus
agacataacctttgctactttgaat

SEQ ID NO: 108425 - DNA, 25 bp, Rattus norvegicus
agacataagcaccatcttcccgagg

SEQ ID NO: 108426 - DNA, 25 bp, Rattus norvegicus
agacataagcacgatcttcccgagg

SEQ ID NO: 108427 - DNA, 25 bp, Rattus norvegicus
agacataaggctccttcggcgagga

SEQ ID NO: 108428 - DNA, 25 bp, Rattus norvegicus
agacataaggctgcttcggcgagga

SEQ ID NO: 108429 - DNA, 25 bp, Rattus norvegicus
agacataagtctcccaacatcaacg

SEQ ID NO: 108430 - DNA, 25 bp, Rattus norvegicus
agacataagtctcccgtctccttat

SEQ ID NO: 108431 - DNA, 25 bp, Rattus norvegicus
agacataagtctgccaacatcaacg

SEQ ID NO: 108432 - DNA, 25 bp, Rattus norvegicus
agacataagtctgccgtctccttat

SEQ ID NO: 108433 - DNA, 25 bp, Rattus norvegicus
agacatacagtcactctgggaaggg

SEQ ID NO: 108434 - DNA, 25 bp, Rattus norvegicus
agacatacagtctctctgggaaggg

SEQ ID NO: 108435 - DNA, 25 bp, Rattus norvegicus
agacatacatatcctccctgggatg

SEQ ID NO: 108436 - DNA, 25 bp, Rattus norvegicus
agacatacatatgctccctgggatg

SEQ ID NO: 108437 - DNA, 25 bp, Rattus norvegicus
agacatacattgatctctggcctcc

SEQ ID NO: 108438 - DNA, 25 bp, Rattus norvegicus
agacatacattgttctctggcctcc

SEQ ID NO: 108439 - DNA, 25 bp, Rattus norvegicus
agacatacccaaacgaccaagctac

SEQ ID NO: 108440 - DNA, 25 bp, Rattus norvegicus
agacatacccaatcgaccaagctac

SEQ ID NO: 108441 - DNA, 25 bp, Rattus norvegicus
agacataccgggaacagctcttcgc

SEQ ID NO: 108442 - DNA, 25 bp, Rattus norvegicus
agacataccgggtacagctcttcgc

SEQ ID NO: 108443 - DNA, 25 bp, Rattus norvegicus
agacatacctggagtggcccttgga

SEQ ID NO: 108444 - DNA, 25 bp, Rattus norvegicus
agacatacctggtgtggcccttgga

SEQ ID NO: 108445 - DNA, 25 bp, Rattus norvegicus
agacatactcccagcccagagaatg

SEQ ID NO: 108446 - DNA, 25 bp, Rattus norvegicus
agacatactccctgcccagagaatg

SEQ ID NO: 108447 - DNA, 25 bp, Rattus norvegicus
agacatagacttatgaggcataaac

SEQ ID NO: 108448 - DNA, 25 bp, Rattus norvegicus
agacatagacttcaggcaggagagc

SEQ ID NO: 108449 - DNA, 25 bp, Rattus norvegicus
agacatagacttgaggcaggagagc

SEQ ID NO: 108450 - DNA, 25 bp, Rattus norvegicus
agacatagacttttgaggcataaac

SEQ ID NO: 108451 - DNA, 25 bp, Rattus norvegicus
agacatagccatattttattatctt

SEQ ID NO: 108452 - DNA, 25 bp, Rattus norvegicus
agacatagccattttttattatctt

SEQ ID NO: 108453 - DNA, 25 bp, Rattus norvegicus
agacatagcctcaccttcaagactg

SEQ ID NO: 108454 - DNA, 25 bp, Rattus norvegicus
agacatagcctctccttcaagactg

SEQ ID NO: 108455 - DNA, 25 bp, Rattus norvegicus
agacatagcctgaactactgaaaag

SEQ ID NO: 108456 - DNA, 25 bp, Rattus norvegicus
agacatagcctgtactactgaaaag

SEQ ID NO: 108457 - DNA, 25 bp, Rattus norvegicus
agacatatcccaatccgaaagccat

SEQ ID NO: 108458 - DNA, 25 bp, Rattus norvegicus
agacatatcccattccgaaagccat

SEQ ID NO: 108459 - DNA, 25 bp, Rattus norvegicus
agacatatcttcctggtgacacata

SEQ ID NO: 108460 - DNA, 25 bp, Rattus norvegicus
agacatatcttcgtggtgacacata

SEQ ID NO: 108461 - DNA, 25 bp, Rattus norvegicus
agacatatcttgatctcgctcatgc

SEQ ID NO: 108462 - DNA, 25 bp, Rattus norvegicus
agacatatcttgttctcgctcatgc

SEQ ID NO: 108463 - DNA, 25 bp, Rattus norvegicus
agacatattgagagacggcggtcca

SEQ ID NO: 108464 - DNA, 25 bp, Rattus norvegicus
agacatattgagtgacggcggtcca

SEQ ID NO: 108465 - DNA, 25 bp, Rattus norvegicus
agacatcaaccccaggctcatttgt

SEQ ID NO: 108466 - DNA, 25 bp, Rattus norvegicus
agacatcaacccgaggctcatttgt

SEQ ID NO: 108467 - DNA, 25 bp, Rattus norvegicus
agacatcacatacttcagcacttct

SEQ ID NO: 108468 - DNA, 25 bp, Rattus norvegicus
agacatcacatagttcagcacttct

SEQ ID NO: 108469 - DNA, 25 bp, Rattus norvegicus
agacatcactcaaggagagctcagg

SEQ ID NO: 108470 - DNA, 25 bp, Rattus norvegicus
agacatcactcatggagagctcagg

SEQ ID NO: 108471 - DNA, 25 bp, Rattus norvegicus
agacatcactctcaagtggcccaca

SEQ ID NO: 108472 - DNA, 25 bp, Rattus norvegicus
agacatcactctgaagtggcccaca

SEQ ID NO: 108473 - DNA, 25 bp, Rattus norvegicus
agacatcactttcccaatgagcagg

SEQ ID NO: 108474 - DNA, 25 bp, Rattus norvegicus
agacatcactttgccaatgagcagg

SEQ ID NO: 108475 - DNA, 25 bp, Rattus norvegicus
agacatcagcagatccaggagcaca

SEQ ID NO: 108476 - DNA, 25 bp, Rattus norvegicus
agacatcagcagttccaggagcaca

SEQ ID NO: 108477 - DNA, 25 bp, Rattus norvegicus
agacatcagtatcatccagctcaac

SEQ ID NO: 108478 - DNA, 25 bp, Rattus norvegicus
agacatcagtatgatccagctcaac

SEQ ID NO: 108479 - DNA, 25 bp, Rattus norvegicus
agacatcatcagaagcaaggtcttt

SEQ ID NO: 108480 - DNA, 25 bp, Rattus norvegicus
agacatcatcagtagcaaggtcttt

SEQ ID NO: 108481 - DNA, 25 bp, Rattus norvegicus
agacatcatctacagtccacttgtt

SEQ ID NO: 108482 - DNA, 25 bp, Rattus norvegicus
agacatcatctagagtccacttgtt

SEQ ID NO: 108483 - DNA, 25 bp, Rattus norvegicus
agacatccacttaattcatcacaac

SEQ ID NO: 108484 - DNA, 25 bp, Rattus norvegicus
agacatccactttattcatcacaac

SEQ ID NO: 108485 - DNA, 25 bp, Rattus norvegicus
agacatccagatcaggcccacagaa

SEQ ID NO: 108486 - DNA, 25 bp, Rattus norvegicus
agacatccagatgaggcccacagaa

SEQ ID NO: 108487 - DNA, 25 bp, Rattus norvegicus
agacatccagctacagctttctgaa

SEQ ID NO: 108488 - DNA, 25 bp, Rattus norvegicus
agacatccagcttcagctttctgaa

SEQ ID NO: 108489 - DNA, 25 bp, Rattus norvegicus
agacatccccagatagcattagcca

SEQ ID NO: 108490 - DNA, 25 bp, Rattus norvegicus
agacatccccagttagcattagcca

SEQ ID NO: 108491 - DNA, 25 bp, Rattus norvegicus
agacatccctctacagtgtccttga

SEQ ID NO: 108492 - DNA, 25 bp, Rattus norvegicus
agacatccctcttcagtgtccttga

SEQ ID NO: 108493 - DNA, 25 bp, Rattus norvegicus
agacatccttacatctcagttatga

SEQ ID NO: 108494 - DNA, 25 bp, Rattus norvegicus
agacatccttacttctcagttatga

SEQ ID NO: 108495 - DNA, 25 bp, Rattus norvegicus
agacatccttatctctcttgagcta

SEQ ID NO: 108496 - DNA, 25 bp, Rattus norvegicus
agacatccttatgtctcttgagcta

SEQ ID NO: 108497 - DNA, 25 bp, Rattus norvegicus
agacatcgactcagggtgtccctgg

SEQ ID NO: 108498 - DNA, 25 bp, Rattus norvegicus
agacatcgactctgggtgtccctgg

SEQ ID NO: 108499 - DNA, 25 bp, Rattus norvegicus
agacatcgagaaccctagctcccat

SEQ ID NO: 108500 - DNA, 25 bp, Rattus norvegicus
agacatcgagaagcctagctcccat

SEQ ID NO: 108501 - DNA, 25 bp, Rattus norvegicus
agacatcggtggactctgcagtggc

SEQ ID NO: 108502 - DNA, 25 bp, Rattus norvegicus
agacatcggtggtctctgcagtggc

SEQ ID NO: 108503 - DNA, 25 bp, Rattus norvegicus
agacatcggttaattgggccactcc

SEQ ID NO: 108504 - DNA, 25 bp, Rattus norvegicus
agacatcggttatttgggccactcc

SEQ ID NO: 108505 - DNA, 25 bp, Rattus norvegicus
agacatctaccgatgctaaggcagt

SEQ ID NO: 108506 - DNA, 25 bp, Rattus norvegicus
agacatctaccgttgctaaggcagt

SEQ ID NO: 108507 - DNA, 25 bp, Rattus norvegicus
agacatctactgactatgatgttcc

SEQ ID NO: 108508 - DNA, 25 bp, Rattus norvegicus
agacatctactgtctatgatgttcc

SEQ ID NO: 108509 - DNA, 25 bp, Rattus norvegicus
agacatctagaactctatgcatcaa

SEQ ID NO: 108510 - DNA, 25 bp, Rattus norvegicus
agacatctagaagtctatgcatcaa

SEQ ID NO: 108511 - DNA, 25 bp, Rattus norvegicus
agacatctatctcaaggaccccaaa

SEQ ID NO: 108512 - DNA, 25 bp, Rattus norvegicus
agacatctatctgaaggaccccaaa

SEQ ID NO: 108513 - DNA, 25 bp, Rattus norvegicus
agacatctattcagcttcccaactg

SEQ ID NO: 108514 - DNA, 25 bp, Rattus norvegicus
agacatctattctgcttcccaactg

SEQ ID NO: 108515 - DNA, 25 bp, Rattus norvegicus
agacatctcaccagttccaggtcgg

SEQ ID NO: 108516 - DNA, 25 bp, Rattus norvegicus
agacatctcacctgttccaggtcgg

SEQ ID NO: 108517 - DNA, 25 bp, Rattus norvegicus
agacatctcagacgtctgccatgct

SEQ ID NO: 108518 - DNA, 25 bp, Rattus norvegicus
agacatctcagaggtctgccatgct

SEQ ID NO: 108519 - DNA, 25 bp, Rattus norvegicus
agacatctcaggaccaggagccaga

SEQ ID NO: 108520 - DNA, 25 bp, Rattus norvegicus
agacatctcaggtccaggagccaga

SEQ ID NO: 108521 - DNA, 25 bp, Rattus norvegicus
agacatctcagtcgctctgccaaat

SEQ ID NO: 108522 - DNA, 25 bp, Rattus norvegicus
agacatctcagtggctctgccaaat

SEQ ID NO: 108523 - DNA, 25 bp, Rattus norvegicus
agacatctccttccaacttgatcaa

SEQ ID NO: 108524 - DNA, 25 bp, Rattus norvegicus
agacatctccttgcaacttgatcaa

SEQ ID NO: 108525 - DNA, 25 bp, Rattus norvegicus
agacatctcggtaccgtgtatcaca

SEQ ID NO: 108526 - DNA, 25 bp, Rattus norvegicus
agacatctcggtagctccatgggaa

SEQ ID NO: 108527 - DNA, 25 bp, Rattus norvegicus
agacatctcggttccgtgtatcaca

SEQ ID NO: 108528 - DNA, 25 bp, Rattus norvegicus
agacatctcggttgctccatgggaa

SEQ ID NO: 108529 - DNA, 25 bp, Rattus norvegicus
agacatctctctctgacactgacat

SEQ ID NO: 108530 - DNA, 25 bp, Rattus norvegicus
agacatctctctgtgacactgacat

SEQ ID NO: 108531 - DNA, 25 bp, Rattus norvegicus
agacatctgataacacccaggcccg

SEQ ID NO: 108532 - DNA, 25 bp, Rattus norvegicus
agacatctgatatcacccaggcccg

SEQ ID NO: 108533 - DNA, 25 bp, Rattus norvegicus
agacatctgcggcttccagggaaac

SEQ ID NO: 108534 - DNA, 25 bp, Rattus norvegicus
agacatctgcgggttccagggaaac

SEQ ID NO: 108535 - DNA, 25 bp, Rattus norvegicus
agacatctggctcatctccactttt

SEQ ID NO: 108536 - DNA, 25 bp, Rattus norvegicus
agacatctggctgatctccactttt

SEQ ID NO: 108537 - DNA, 25 bp, Rattus norvegicus
agacatctgttgctccaggaagcat

SEQ ID NO: 108538 - DNA, 25 bp, Rattus norvegicus
agacatctgttggtccaggaagcat

SEQ ID NO: 108539 - DNA, 25 bp, Rattus norvegicus
agacatcttagaagaccaccatgtt

SEQ ID NO: 108540 - DNA, 25 bp, Rattus norvegicus
agacatcttagaccttcccagtata

SEQ ID NO: 108541 - DNA, 25 bp, Rattus norvegicus
agacatcttagagcttcccagtata

SEQ ID NO: 108542 - DNA, 25 bp, Rattus norvegicus
agacatcttagatgaccaccatgtt

SEQ ID NO: 108543 - DNA, 25 bp, Rattus norvegicus
agacatctttccaacaccttggcta

SEQ ID NO: 108544 - DNA, 25 bp, Rattus norvegicus
agacatctttcctacaccttggcta

SEQ ID NO: 108545 - DNA, 25 bp, Rattus norvegicus
agacatctttgtacagtggcttcag

SEQ ID NO: 108546 - DNA, 25 bp, Rattus norvegicus
agacatctttgttcagtggcttcag

SEQ ID NO: 108547 - DNA, 25 bp, Rattus norvegicus
agacatcttttactcatcggctgac

SEQ ID NO: 108548 - DNA, 25 bp, Rattus norvegicus
agacatcttttagtcatcggctgac

SEQ ID NO: 108549 - DNA, 25 bp, Rattus norvegicus
agacatcttttccttcagcaggcta

SEQ ID NO: 108550 - DNA, 25 bp, Rattus norvegicus
agacatcttttcgttcagcaggcta

SEQ ID NO: 108551 - DNA, 25 bp, Rattus norvegicus
agacatgaactgacaccaccactta

SEQ ID NO: 108552 - DNA, 25 bp, Rattus norvegicus
agacatgaactgtcaccaccactta

SEQ ID NO: 108553 - DNA, 25 bp, Rattus norvegicus
agacatgaatccattcttggctccc

SEQ ID NO: 108554 - DNA, 25 bp, Rattus norvegicus
agacatgaatcctttcttggctccc

SEQ ID NO: 108555 - DNA, 25 bp, Rattus norvegicus
agacatgacgaccttccgaagctcg

SEQ ID NO: 108556 - DNA, 25 bp, Rattus norvegicus
agacatgacgacgttccgaagctcg

SEQ ID NO: 108557 - DNA, 25 bp, Rattus norvegicus
agacatgaggtgcatctccaggctg

SEQ ID NO: 108558 - DNA, 25 bp, Rattus norvegicus
agacatgaggtggatctccaggctg

SEQ ID NO: 108559 - DNA, 25 bp, Rattus norvegicus
agacatgatgctcctagattagact

SEQ ID NO: 108560 - DNA, 25 bp, Rattus norvegicus
agacatgatgctgctagattagact

SEQ ID NO: 108561 - DNA, 25 bp, Rattus norvegicus
agacatgatgtcatgcttcctgact

SEQ ID NO: 108562 - DNA, 25 bp, Rattus norvegicus
agacatgatgtcttgcttcctgact

SEQ ID NO: 108563 - DNA, 25 bp, Rattus norvegicus
agacatgattccagaggagcagctg

SEQ ID NO: 108564 - DNA, 25 bp, Rattus norvegicus
agacatgattcctgaggagcagctg

SEQ ID NO: 108565 - DNA, 25 bp, Rattus norvegicus
agacatgcagtcaggaatcagaaga

SEQ ID NO: 108566 - DNA, 25 bp, Rattus norvegicus
agacatgcagtctggaatcagaaga

SEQ ID NO: 108567 - DNA, 25 bp, Rattus norvegicus
agacatgcatgcaggcaaggcgcct

SEQ ID NO: 108568 - DNA, 25 bp, Rattus norvegicus
agacatgcatgctggcaaggcgcct

SEQ ID NO: 108569 - DNA, 25 bp, Rattus norvegicus
agacatgccttacgtaactaccaat

SEQ ID NO: 108570 - DNA, 25 bp, Rattus norvegicus
agacatgccttaggtaactaccaat

SEQ ID NO: 108571 - DNA, 25 bp, Rattus norvegicus
agacatgcggttcgctttccttgtg

SEQ ID NO: 108572 - DNA, 25 bp, Rattus norvegicus
agacatgcggttggctttccttgtg

SEQ ID NO: 108573 - DNA, 25 bp, Rattus norvegicus
agacatgctaccacattcgatggtg

SEQ ID NO: 108574 - DNA, 25 bp, Rattus norvegicus
agacatgctacctcattcgatggtg

SEQ ID NO: 108575 - DNA, 25 bp, Rattus norvegicus
agacatgctctgagccggctttgta

SEQ ID NO: 108576 - DNA, 25 bp, Rattus norvegicus
agacatgctctgtgccggctttgta

SEQ ID NO: 108577 - DNA, 25 bp, Rattus norvegicus
agacatggacctctagctcctgagt

SEQ ID NO: 108578 - DNA, 25 bp, Rattus norvegicus
agacatggacctgtagctcctgagt

SEQ ID NO: 108579 - DNA, 25 bp, Rattus norvegicus
agacatggatctcttactacttaga

SEQ ID NO: 108580 - DNA, 25 bp, Rattus norvegicus
agacatggatctgttactacttaga

SEQ ID NO: 108581 - DNA, 25 bp, Rattus norvegicus
agacatggatggaaggctcctgact

SEQ ID NO: 108582 - DNA, 25 bp, Rattus norvegicus
agacatggatggtaggctcctgact

SEQ ID NO: 108583 - DNA, 25 bp, Rattus norvegicus
agacatggccatatcacaattaccc

SEQ ID NO: 108584 - DNA, 25 bp, Rattus norvegicus
agacatggccatttcacaattaccc

SEQ ID NO: 108585 - DNA, 25 bp, Rattus norvegicus
agacatggcccacctagagacttgt

SEQ ID NO: 108586 - DNA, 25 bp, Rattus norvegicus
agacatggcccagctagagacttgt

SEQ ID NO: 108587 - DNA, 25 bp, Rattus norvegicus
agacatggcgcgaagacacacgtga

SEQ ID NO: 108588 - DNA, 25 bp, Rattus norvegicus
agacatggcgcgtagacacacgtga

SEQ ID NO: 108589 - DNA, 25 bp, Rattus norvegicus
agacatggctttctttgggtgctct

SEQ ID NO: 108590 - DNA, 25 bp, Rattus norvegicus
agacatggctttgtttgggtgctct

SEQ ID NO: 108591 - DNA, 25 bp, Rattus norvegicus
agacatgggaatcgccatccgggtt

SEQ ID NO: 108592 - DNA, 25 bp, Rattus norvegicus
agacatgggaatggccatccgggtt

SEQ ID NO: 108593 - DNA, 25 bp, Rattus norvegicus
agacatgggattccatgccgcacta

SEQ ID NO: 108594 - DNA, 25 bp, Rattus norvegicus
agacatgggattgcatgccgcacta

SEQ ID NO: 108595 - DNA, 25 bp, Rattus norvegicus
agacatgggcctagttgatctcttc

SEQ ID NO: 108596 - DNA, 25 bp, Rattus norvegicus
agacatgggccttgttgatctcttc

SEQ ID NO: 108597 - DNA, 25 bp, Rattus norvegicus
agacatgggctacaactggttgcta

SEQ ID NO: 108598 - DNA, 25 bp, Rattus norvegicus
agacatgggctagaactggttgcta

SEQ ID NO: 108599 - DNA, 25 bp, Rattus norvegicus
agacatggtctcatcgccgttgctc

SEQ ID NO: 108600 - DNA, 25 bp, Rattus norvegicus
agacatggtctcttcgccgttgctc

SEQ ID NO: 108601 - DNA, 25 bp, Rattus norvegicus
agacatggtggtctaccccttcgat

SEQ ID NO: 108602 - DNA, 25 bp, Rattus norvegicus
agacatggtggtgtaccccttcgat

SEQ ID NO: 108603 - DNA, 25 bp, Rattus norvegicus
agacatgtacataccacagtgctgt

SEQ ID NO: 108604 - DNA, 25 bp, Rattus norvegicus
agacatgtacattccacagtgctgt

SEQ ID NO: 108605 - DNA, 25 bp, Rattus norvegicus
agacatgtacggacaaacacaatga

SEQ ID NO: 108606 - DNA, 25 bp, Rattus norvegicus
agacatgtacggtcaaacacaatga

SEQ ID NO: 108607 - DNA, 25 bp, Rattus norvegicus
agacatgtacttagacagtcctaaa

SEQ ID NO: 108608 - DNA, 25 bp, Rattus norvegicus
agacatgtactttgacagtcctaaa

SEQ ID NO: 108609 - DNA, 25 bp, Rattus norvegicus
agacatgtatttacttcatcgtaat

SEQ ID NO: 108610 - DNA, 25 bp, Rattus norvegicus
agacatgtattttcttcatcgtaat

SEQ ID NO: 108611 - DNA, 25 bp, Rattus norvegicus
agacatgtcagcatctgggacgctc

SEQ ID NO: 108612 - DNA, 25 bp, Rattus norvegicus
agacatgtcagcttctgggacgctc

SEQ ID NO: 108613 - DNA, 25 bp, Rattus norvegicus
agacatgtcccacgcaaggacggtt

SEQ ID NO: 108614 - DNA, 25 bp, Rattus norvegicus
agacatgtcccaggcaaggacggtt

SEQ ID NO: 108615 - DNA, 25 bp, Rattus norvegicus
agacatgtccggattgcgcaggcga

SEQ ID NO: 108616 - DNA, 25 bp, Rattus norvegicus
agacatgtccggtttgcgcaggcga

SEQ ID NO: 108617 - DNA, 25 bp, Rattus norvegicus
agacatgtcctaccaggtcaccagg

SEQ ID NO: 108618 - DNA, 25 bp, Rattus norvegicus
agacatgtcctagcaggtcaccagg

SEQ ID NO: 108619 - DNA, 25 bp, Rattus norvegicus
agacatgtcctcacaggcagtgtaa

SEQ ID NO: 108620 - DNA, 25 bp, Rattus norvegicus
agacatgtcctctcaggcagtgtaa

SEQ ID NO: 108621 - DNA, 25 bp, Rattus norvegicus
agacatgtctgcaatgccgagctct

SEQ ID NO: 108622 - DNA, 25 bp, Rattus norvegicus
agacatgtctgctatgccgagctct

SEQ ID NO: 108623 - DNA, 25 bp, Rattus norvegicus
agacatgtcttgacctcgtcctgga

SEQ ID NO: 108624 - DNA, 25 bp, Rattus norvegicus
agacatgtcttgtcctcgtcctgga

SEQ ID NO: 108625 - DNA, 25 bp, Rattus norvegicus
agacatgtgctgagcatggactgaa

SEQ ID NO: 108626 - DNA, 25 bp, Rattus norvegicus
agacatgtgctgtgcatggactgaa

SEQ ID NO: 108627 - DNA, 25 bp, Rattus norvegicus
agacatgttcatcggtttattctct

SEQ ID NO: 108628 - DNA, 25 bp, Rattus norvegicus
agacatgttcatgggtttattctct

SEQ ID NO: 108629 - DNA, 25 bp, Rattus norvegicus
agacatgttcttcaccaaggcaaat

SEQ ID NO: 108630 - DNA, 25 bp, Rattus norvegicus
agacatgttcttgaccaaggcaaat

SEQ ID NO: 108631 - DNA, 25 bp, Rattus norvegicus
agacatgttgacacaggcctgttat

SEQ ID NO: 108632 - DNA, 25 bp, Rattus norvegicus
agacatgttgacactgggttgcagt

SEQ ID NO: 108633 - DNA, 25 bp, Rattus norvegicus
agacatgttgactcaggcctgttat

SEQ ID NO: 108634 - DNA, 25 bp, Rattus norvegicus
agacatgttgactctgggttgcagt

SEQ ID NO: 108635 - DNA, 25 bp, Rattus norvegicus
agacatgttggcacaatctcttctc

SEQ ID NO: 108636 - DNA, 25 bp, Rattus norvegicus
agacatgttggctcaatctcttctc

SEQ ID NO: 108637 - DNA, 25 bp, Rattus norvegicus
agacatgttttgacctgacagcctt

SEQ ID NO: 108638 - DNA, 25 bp, Rattus norvegicus
agacatgttttgtcctgacagcctt

SEQ ID NO: 108639 - DNA, 25 bp, Rattus norvegicus
agacattacacccagcattaccaga

SEQ ID NO: 108640 - DNA, 25 bp, Rattus norvegicus
agacattacaccgagcattaccaga

SEQ ID NO: 108641 - DNA, 25 bp, Rattus norvegicus
agacattacatccagtgcacagttt

SEQ ID NO: 108642 - DNA, 25 bp, Rattus norvegicus
agacattacatcgagtgcacagttt

SEQ ID NO: 108643 - DNA, 25 bp, Rattus norvegicus
agacattaccatatgtaccgttggt

SEQ ID NO: 108644 - DNA, 25 bp, Rattus norvegicus
agacattaccatttgtaccgttggt

SEQ ID NO: 108645 - DNA, 25 bp, Rattus norvegicus
agacattactacaccatcactatta

SEQ ID NO: 108646 - DNA, 25 bp, Rattus norvegicus
agacattactactccatcactatta

SEQ ID NO: 108647 - DNA, 25 bp, Rattus norvegicus
agacattagcatccccaaatgcctg

SEQ ID NO: 108648 - DNA, 25 bp, Rattus norvegicus
agacattagcatgcccaaatgcctg

SEQ ID NO: 108649 - DNA, 25 bp, Rattus norvegicus
agacattattctattactcagccaa

SEQ ID NO: 108650 - DNA, 25 bp, Rattus norvegicus
agacattattcttttactcagccaa

SEQ ID NO: 108651 - DNA, 25 bp, Rattus norvegicus
agacattcaaccatgcaagcctcag

SEQ ID NO: 108652 - DNA, 25 bp, Rattus norvegicus
agacattcaaccttgcaagcctcag

SEQ ID NO: 108653 - DNA, 25 bp, Rattus norvegicus
agacattcagacagctaccaggctg

SEQ ID NO: 108654 - DNA, 25 bp, Rattus norvegicus
agacattcagactgctaccaggctg

SEQ ID NO: 108655 - DNA, 25 bp, Rattus norvegicus
agacattccagaacaggcctgccat

SEQ ID NO: 108656 - DNA, 25 bp, Rattus norvegicus
agacattccagatcaggcctgccat

SEQ ID NO: 108657 - DNA, 25 bp, Rattus norvegicus
agacattccaggagtgccaggacca

SEQ ID NO: 108658 - DNA, 25 bp, Rattus norvegicus
agacattccaggtgtgccaggacca

SEQ ID NO: 108659 - DNA, 25 bp, Rattus norvegicus
agacattccgtgctgcagggacaaa

SEQ ID NO: 108660 - DNA, 25 bp, Rattus norvegicus
agacattccgtggtgcagggacaaa

SEQ ID NO: 108661 - DNA, 25 bp, Rattus norvegicus
agacattcctgacttctgaccccga

SEQ ID NO: 108662 - DNA, 25 bp, Rattus norvegicus
agacattcctgagttctgaccccga

SEQ ID NO: 108663 - DNA, 25 bp, Rattus norvegicus
agacattcctgcagtcattgcagga

SEQ ID NO: 108664 - DNA, 25 bp, Rattus norvegicus
agacattcctgctgtcattgcagga

SEQ ID NO: 108665 - DNA, 25 bp, Rattus norvegicus
agacattcctgtcgaccagagccat

SEQ ID NO: 108666 - DNA, 25 bp, Rattus norvegicus
agacattcctgtggaccagagccat

SEQ ID NO: 108667 - DNA, 25 bp, Rattus norvegicus
agacattctcccacttggtgtgcct

SEQ ID NO: 108668 - DNA, 25 bp, Rattus norvegicus
agacattctccctcttggtgtgcct

SEQ ID NO: 108669 - DNA, 25 bp, Rattus norvegicus
agacattctgtccatatggcatagt

SEQ ID NO: 108670 - DNA, 25 bp, Rattus norvegicus
agacattctgtccatgccagcaaat

SEQ ID NO: 108671 - DNA, 25 bp, Rattus norvegicus
agacattctgtcgatatggcatagt

SEQ ID NO: 108672 - DNA, 25 bp, Rattus norvegicus
agacattctgtcgatgccagcaaat

SEQ ID NO: 108673 - DNA, 25 bp, Rattus norvegicus
agacattcttggagagtgaccctga

SEQ ID NO: 108674 - DNA, 25 bp, Rattus norvegicus
agacattcttggtgagtgaccctga

SEQ ID NO: 108675 - DNA, 25 bp, Rattus norvegicus
agacattgacctcgagctggtggat

SEQ ID NO: 108676 - DNA, 25 bp, Rattus norvegicus
agacattgacctggagctggtggat

SEQ ID NO: 108677 - DNA, 25 bp, Rattus norvegicus
agacattgacgcctctagccaagcc

SEQ ID NO: 108678 - DNA, 25 bp, Rattus norvegicus
agacattgacgcgtctagccaagcc

SEQ ID NO: 108679 - DNA, 25 bp, Rattus norvegicus
agacattgatatcttctgtaaaaat

SEQ ID NO: 108680 - DNA, 25 bp, Rattus norvegicus
agacattgatatgttctgtaaaaat

SEQ ID NO: 108681 - DNA, 25 bp, Rattus norvegicus
agacattgcacaatctccttgctgt

SEQ ID NO: 108682 - DNA, 25 bp, Rattus norvegicus
agacattgcacattctccttgctgt

SEQ ID NO: 108683 - DNA, 25 bp, Rattus norvegicus
agacattgccctcatttggacagac

SEQ ID NO: 108684 - DNA, 25 bp, Rattus norvegicus
agacattgccctgatttggacagac

SEQ ID NO: 108685 - DNA, 25 bp, Rattus norvegicus
agacattgccggaaggaactcttgg

SEQ ID NO: 108686 - DNA, 25 bp, Rattus norvegicus
agacattgccggatcatgcgccttt

SEQ ID NO: 108687 - DNA, 25 bp, Rattus norvegicus
agacattgccggtaggaactcttgg

SEQ ID NO: 108688 - DNA, 25 bp, Rattus norvegicus
agacattgccggttcatgcgccttt

SEQ ID NO: 108689 - DNA, 25 bp, Rattus norvegicus
agacattgctatactgttttttata

SEQ ID NO: 108690 - DNA, 25 bp, Rattus norvegicus
agacattgctattctgttttttata

SEQ ID NO: 108691 - DNA, 25 bp, Rattus norvegicus
agacattgctttaccctcctgcttt

SEQ ID NO: 108692 - DNA, 25 bp, Rattus norvegicus
agacattgcttttccctcctgcttt

SEQ ID NO: 108693 - DNA, 25 bp, Rattus norvegicus
agacattggcatccttacctctgac

SEQ ID NO: 108694 - DNA, 25 bp, Rattus norvegicus
agacattggcatgcttacctctgac

SEQ ID NO: 108695 - DNA, 25 bp, Rattus norvegicus
agacattgtcccacttgggcacaag

SEQ ID NO: 108696 - DNA, 25 bp, Rattus norvegicus
agacattgtccctcttgggcacaag

SEQ ID NO: 108697 - DNA, 25 bp, Rattus norvegicus
agacatttcaaccttgaggcctgaa

SEQ ID NO: 108698 - DNA, 25 bp, Rattus norvegicus
agacatttcaacgttgaggcctgaa

SEQ ID NO: 108699 - DNA, 25 bp, Rattus norvegicus
agacatttcagtagcttacctccag

SEQ ID NO: 108700 - DNA, 25 bp, Rattus norvegicus
agacatttcagttgcttacctccag

SEQ ID NO: 108701 - DNA, 25 bp, Rattus norvegicus
agacatttcccacccctataatttt

SEQ ID NO: 108702 - DNA, 25 bp, Rattus norvegicus
agacatttcccagccctataatttt

SEQ ID NO: 108703 - DNA, 25 bp, Rattus norvegicus
agacatttctacaggtacctcacga

SEQ ID NO: 108704 - DNA, 25 bp, Rattus norvegicus
agacatttctactggtacctcacga

SEQ ID NO: 108705 - DNA, 25 bp, Rattus norvegicus
agacatttctccaaggtgcttggcc

SEQ ID NO: 108706 - DNA, 25 bp, Rattus norvegicus
agacatttctcctaggtgcttggcc

SEQ ID NO: 108707 - DNA, 25 bp, Rattus norvegicus
agacatttgaaacttcctcccaggt

SEQ ID NO: 108708 - DNA, 25 bp, Rattus norvegicus
agacatttgaaagttcctcccaggt

SEQ ID NO: 108709 - DNA, 25 bp, Rattus norvegicus
agacatttgggtcagttctgtgcat

SEQ ID NO: 108710 - DNA, 25 bp, Rattus norvegicus
agacatttgggtgagttctgtgcat

SEQ ID NO: 108711 - DNA, 25 bp, Rattus norvegicus
agacatttggtcaccttttcatttg

SEQ ID NO: 108712 - DNA, 25 bp, Rattus norvegicus
agacatttggtctccttttcatttg

SEQ ID NO: 108713 - DNA, 25 bp, Rattus norvegicus
agacattttaaactccgggcctgtg

SEQ ID NO: 108714 - DNA, 25 bp, Rattus norvegicus
agacattttaaagtccgggcctgtg

SEQ ID NO: 108715 - DNA, 25 bp, Rattus norvegicus
agacattttcagagcattttttccc

SEQ ID NO: 108716 - DNA, 25 bp, Rattus norvegicus
agacattttcagtgcattttttccc

SEQ ID NO: 108717 - DNA, 25 bp, Rattus norvegicus
agacattttcccaaaattggctaat

SEQ ID NO: 108718 - DNA, 25 bp, Rattus norvegicus
agacattttccctaaattggctaat

SEQ ID NO: 108719 - DNA, 25 bp, Rattus norvegicus
agacattttctcataagcccaagcc

SEQ ID NO: 108720 - DNA, 25 bp, Rattus norvegicus
agacattttctcattatcagcactg

SEQ ID NO: 108721 - DNA, 25 bp, Rattus norvegicus
agacattttctcttaagcccaagcc

SEQ ID NO: 108722 - DNA, 25 bp, Rattus norvegicus
agacattttctctttatcagcactg

SEQ ID NO: 108723 - DNA, 25 bp, Rattus norvegicus
agacattttctgcatctctgtcctc

SEQ ID NO: 108724 - DNA, 25 bp, Rattus norvegicus
agacattttctggatctctgtcctc

SEQ ID NO: 108725 - DNA, 25 bp, Rattus norvegicus
agacattttgctctccttgggcaga

SEQ ID NO: 108726 - DNA, 25 bp, Rattus norvegicus
agacattttgctgtccttgggcaga

SEQ ID NO: 108727 - DNA, 25 bp, Rattus norvegicus
agacattttgtaatgctgacacgag

SEQ ID NO: 108728 - DNA, 25 bp, Rattus norvegicus
agacattttgtattgctgacacgag

SEQ ID NO: 108729 - DNA, 25 bp, Rattus norvegicus
agacatttttccatggctaagccag

SEQ ID NO: 108730 - DNA, 25 bp, Rattus norvegicus
agacatttttccttggctaagccag

SEQ ID NO: 108731 - DNA, 25 bp, Rattus norvegicus
agaccaaacataagccagaatggct

SEQ ID NO: 108732 - DNA, 25 bp, Rattus norvegicus
agaccaaacatatgccagaatggct

SEQ ID NO: 108733 - DNA, 25 bp, Rattus norvegicus
agaccaaaggctaccagtctcaggg

SEQ ID NO: 108734 - DNA, 25 bp, Rattus norvegicus
agaccaaaggcttccagtctcaggg

SEQ ID NO: 108735 - DNA, 25 bp, Rattus norvegicus
agaccaaagtcaatgcaagcatgtt

SEQ ID NO: 108736 - DNA, 25 bp, Rattus norvegicus
agaccaaagtcattgcaagcatgtt

SEQ ID NO: 108737 - DNA, 25 bp, Rattus norvegicus
agaccaaagtctcttatccactagc

SEQ ID NO: 108738 - DNA, 25 bp, Rattus norvegicus
agaccaaagtctgttatccactagc

SEQ ID NO: 108739 - DNA, 25 bp, Rattus norvegicus
agaccaaatcacaccatctgtgacg

SEQ ID NO: 108740 - DNA, 25 bp, Rattus norvegicus
agaccaaatcactccatctgtgacg

SEQ ID NO: 108741 - DNA, 25 bp, Rattus norvegicus
agaccaaatcccatcttcttagagg

SEQ ID NO: 108742 - DNA, 25 bp, Rattus norvegicus
agaccaaatcccttcttcttagagg

SEQ ID NO: 108743 - DNA, 25 bp, Rattus norvegicus
agaccaaatggtccgctgagcattt

SEQ ID NO: 108744 - DNA, 25 bp, Rattus norvegicus
agaccaaatggtgcgctgagcattt

SEQ ID NO: 108745 - DNA, 25 bp, Rattus norvegicus
agaccaacaggactcaacaaacttg

SEQ ID NO: 108746 - DNA, 25 bp, Rattus norvegicus
agaccaacaggagtcaacaaacttg

SEQ ID NO: 108747 - DNA, 25 bp, Rattus norvegicus
agaccaacatcaataccatcgtttg

SEQ ID NO: 108748 - DNA, 25 bp, Rattus norvegicus
agaccaacatcattaccatcgtttg

SEQ ID NO: 108749 - DNA, 25 bp, Rattus norvegicus
agaccaacatctcaggttgtcctct

SEQ ID NO: 108750 - DNA, 25 bp, Rattus norvegicus
agaccaacatctgaggttgtcctct

SEQ ID NO: 108751 - DNA, 25 bp, Rattus norvegicus
agaccaaccagaccggaaattccag

SEQ ID NO: 108752 - DNA, 25 bp, Rattus norvegicus
agaccaaccagagcggaaattccag

SEQ ID NO: 108753 - DNA, 25 bp, Rattus norvegicus
agaccaacccacaatatacatatgt

SEQ ID NO: 108754 - DNA, 25 bp, Rattus norvegicus
agaccaacccactatatacatatgt

SEQ ID NO: 108755 - DNA, 25 bp, Rattus norvegicus
agaccaacctgcaagtgccattgtc

SEQ ID NO: 108756 - DNA, 25 bp, Rattus norvegicus
agaccaacctgctagtgccattgtc

SEQ ID NO: 108757 - DNA, 25 bp, Rattus norvegicus
agaccaacttccatcaggctattaa

SEQ ID NO: 108758 - DNA, 25 bp, Rattus norvegicus
agaccaacttccttcaggctattaa

SEQ ID NO: 108759 - DNA, 25 bp, Rattus norvegicus
agaccaagacttctaaagccaagaa

SEQ ID NO: 108760 - DNA, 25 bp, Rattus norvegicus
agaccaagacttctgaggccatacc

SEQ ID NO: 108761 - DNA, 25 bp, Rattus norvegicus
agaccaagacttgtaaagccaagaa

SEQ ID NO: 108762 - DNA, 25 bp, Rattus norvegicus
agaccaagacttgtgaggccatacc

SEQ ID NO: 108763 - DNA, 25 bp, Rattus norvegicus
agaccaagagtgaggatgccctgaa

SEQ ID NO: 108764 - DNA, 25 bp, Rattus norvegicus
agaccaagagtgtggatgccctgaa

SEQ ID NO: 108765 - DNA, 25 bp, Rattus norvegicus
agaccaagcaccagctgcgttacta

SEQ ID NO: 108766 - DNA, 25 bp, Rattus norvegicus
agaccaagcacctgctgcgttacta

SEQ ID NO: 108767 - DNA, 25 bp, Rattus norvegicus
agaccaagccaaccatattagccat

SEQ ID NO: 108768 - DNA, 25 bp, Rattus norvegicus
agaccaagccaagcatattagccat

SEQ ID NO: 108769 - DNA, 25 bp, Rattus norvegicus
agaccaagccacaggaatttgccac

SEQ ID NO: 108770 - DNA, 25 bp, Rattus norvegicus
agaccaagccactggaatttgccac

SEQ ID NO: 108771 - DNA, 25 bp, Rattus norvegicus
agaccaagctagcaaggtgctggaa

SEQ ID NO: 108772 - DNA, 25 bp, Rattus norvegicus
agaccaagctaggaaggtgctggaa

SEQ ID NO: 108773 - DNA, 25 bp, Rattus norvegicus
agaccaagctggaaagcccaccagg

SEQ ID NO: 108774 - DNA, 25 bp, Rattus norvegicus
agaccaagctggtaagcccaccagg

SEQ ID NO: 108775 - DNA, 25 bp, Rattus norvegicus
agaccaaggatcagaattcccagat

SEQ ID NO: 108776 - DNA, 25 bp, Rattus norvegicus
agaccaaggatctgaattcccagat

SEQ ID NO: 108777 - DNA, 25 bp, Rattus norvegicus
agaccaaggctaagcgttctcagtc

SEQ ID NO: 108778 - DNA, 25 bp, Rattus norvegicus
agaccaaggctatgcgttctcagtc

SEQ ID NO: 108779 - DNA, 25 bp, Rattus norvegicus
agaccaagggtgacacacacagtta

SEQ ID NO: 108780 - DNA, 25 bp, Rattus norvegicus
agaccaagggtgaggctttgcctga

SEQ ID NO: 108781 - DNA, 25 bp, Rattus norvegicus
agaccaagggtgtcacacacagtta

SEQ ID NO: 108782 - DNA, 25 bp, Rattus norvegicus
agaccaagggtgtggctttgcctga

SEQ ID NO: 108783 - DNA, 25 bp, Rattus norvegicus
agaccaagtgtcatgagtcagccat

SEQ ID NO: 108784 - DNA, 25 bp, Rattus norvegicus
agaccaagtgtcttgagtcagccat

SEQ ID NO: 108785 - DNA, 25 bp, Rattus norvegicus
agaccaataagtactgcattccttt

SEQ ID NO: 108786 - DNA, 25 bp, Rattus norvegicus
agaccaataagttctgcattccttt

SEQ ID NO: 108787 - DNA, 25 bp, Rattus norvegicus
agaccaatccttcatgtcccctgaa

SEQ ID NO: 108788 - DNA, 25 bp, Rattus norvegicus
agaccaatccttgatgtcccctgaa

SEQ ID NO: 108789 - DNA, 25 bp, Rattus norvegicus
agaccaatctccaactcctagttat

SEQ ID NO: 108790 - DNA, 25 bp, Rattus norvegicus
agaccaatctcctactcctagttat

SEQ ID NO: 108791 - DNA, 25 bp, Rattus norvegicus
agaccaatgatgaccctgcaggagc

SEQ ID NO: 108792 - DNA, 25 bp, Rattus norvegicus
agaccaatgatgtccctgcaggagc

SEQ ID NO: 108793 - DNA, 25 bp, Rattus norvegicus
agaccaatggctcctgacagtcatg

SEQ ID NO: 108794 - DNA, 25 bp, Rattus norvegicus
agaccaatggctgctgacagtcatg

SEQ ID NO: 108795 - DNA, 25 bp, Rattus norvegicus
agaccaatggttactcggcccagga

SEQ ID NO: 108796 - DNA, 25 bp, Rattus norvegicus
agaccaatggtttctcggcccagga

SEQ ID NO: 108797 - DNA, 25 bp, Rattus norvegicus
agaccaattactcgcttgcctggta

SEQ ID NO: 108798 - DNA, 25 bp, Rattus norvegicus
agaccaattactggcttgcctggta

SEQ ID NO: 108799 - DNA, 25 bp, Rattus norvegicus
agaccaattatcatcctctttgcag

SEQ ID NO: 108800 - DNA, 25 bp, Rattus norvegicus
agaccaattatcttcctctttgcag

SEQ ID NO: 108801 - DNA, 25 bp, Rattus norvegicus
agaccaatttgcatttatgcctgtg

SEQ ID NO: 108802 - DNA, 25 bp, Rattus norvegicus
agaccaatttgcttttatgcctgtg

SEQ ID NO: 108803 - DNA, 25 bp, Rattus norvegicus
agaccacaaaccacagagccatgga

SEQ ID NO: 108804 - DNA, 25 bp, Rattus norvegicus
agaccacaaacctcagagccatgga

SEQ ID NO: 108805 - DNA, 25 bp, Rattus norvegicus
agaccacaagtgctgttgcctgtag

SEQ ID NO: 108806 - DNA, 25 bp, Rattus norvegicus
agaccacaagtggtgttgcctgtag

SEQ ID NO: 108807 - DNA, 25 bp, Rattus norvegicus
agaccacacaccagaaacctgtatt

SEQ ID NO: 108808 - DNA, 25 bp, Rattus norvegicus
agaccacacacctgaaacctgtatt

SEQ ID NO: 108809 - DNA, 25 bp, Rattus norvegicus
agaccacaccccaatggagattgtg

SEQ ID NO: 108810 - DNA, 25 bp, Rattus norvegicus
agaccacacccctatggagattgtg

SEQ ID NO: 108811 - DNA, 25 bp, Rattus norvegicus
agaccacaccttcgaatctgcatga

SEQ ID NO: 108812 - DNA, 25 bp, Rattus norvegicus
agaccacaccttggaatctgcatga

SEQ ID NO: 108813 - DNA, 25 bp, Rattus norvegicus
agaccacagaacatgaacccaggct

SEQ ID NO: 108814 - DNA, 25 bp, Rattus norvegicus
agaccacagaacttgaacccaggct

SEQ ID NO: 108815 - DNA, 25 bp, Rattus norvegicus
agaccacaggagctttacagccccg

SEQ ID NO: 108816 - DNA, 25 bp, Rattus norvegicus
agaccacaggaggtttacagccccg

SEQ ID NO: 108817 - DNA, 25 bp, Rattus norvegicus
agaccacagggcagtgttccaggaa

SEQ ID NO: 108818 - DNA, 25 bp, Rattus norvegicus
agaccacagggctgtgttccaggaa

SEQ ID NO: 108819 - DNA, 25 bp, Rattus norvegicus
agaccacaggttcattccgaggcca

SEQ ID NO: 108820 - DNA, 25 bp, Rattus norvegicus
agaccacaggttgattccgaggcca

SEQ ID NO: 108821 - DNA, 25 bp, Rattus norvegicus
agaccacagtctctttgcttttatt

SEQ ID NO: 108822 - DNA, 25 bp, Rattus norvegicus
agaccacagtctgtttgcttttatt

SEQ ID NO: 108823 - DNA, 25 bp, Rattus norvegicus
agaccacatactactctctggagag

SEQ ID NO: 108824 - DNA, 25 bp, Rattus norvegicus
agaccacatacttctctctggagag

SEQ ID NO: 108825 - DNA, 25 bp, Rattus norvegicus
agaccaccacccagcataaaataaa

SEQ ID NO: 108826 - DNA, 25 bp, Rattus norvegicus
agaccaccaccctgcataaaataaa

SEQ ID NO: 108827 - DNA, 25 bp, Rattus norvegicus
agaccaccagctcagcggatgtgaa

SEQ ID NO: 108828 - DNA, 25 bp, Rattus norvegicus
agaccaccagctgagcggatgtgaa

SEQ ID NO: 108829 - DNA, 25 bp, Rattus norvegicus
agaccaccagggactggagcagcct

SEQ ID NO: 108830 - DNA, 25 bp, Rattus norvegicus
agaccaccagggatggcttccagaa

SEQ ID NO: 108831 - DNA, 25 bp, Rattus norvegicus
agaccaccagggtctggagcagcct

SEQ ID NO: 108832 - DNA, 25 bp, Rattus norvegicus
agaccaccagggttggcttccagaa

SEQ ID NO: 108833 - DNA, 25 bp, Rattus norvegicus
agaccacccaccaaggaacgtacag

SEQ ID NO: 108834 - DNA, 25 bp, Rattus norvegicus
agaccacccaccagatcaataaaag

SEQ ID NO: 108835 - DNA, 25 bp, Rattus norvegicus
agaccacccacctaggaacgtacag

SEQ ID NO: 108836 - DNA, 25 bp, Rattus norvegicus
agaccacccacctgatcaataaaag

SEQ ID NO: 108837 - DNA, 25 bp, Rattus norvegicus
agaccacccgttcagtgactttcat

SEQ ID NO: 108838 - DNA, 25 bp, Rattus norvegicus
agaccacccgttgagtgactttcat

SEQ ID NO: 108839 - DNA, 25 bp, Rattus norvegicus
agaccaccctacacaagatggcaga

SEQ ID NO: 108840 - DNA, 25 bp, Rattus norvegicus
agaccaccctactcaagatggcaga

SEQ ID NO: 108841 - DNA, 25 bp, Rattus norvegicus
agaccaccctctctcttgttaagtg

SEQ ID NO: 108842 - DNA, 25 bp, Rattus norvegicus
agaccaccctctgtcttgttaagtg

SEQ ID NO: 108843 - DNA, 25 bp, Rattus norvegicus
agaccaccggccaggaatgcagtgt

SEQ ID NO: 108844 - DNA, 25 bp, Rattus norvegicus
agaccaccggcctggaatgcagtgt

SEQ ID NO: 108845 - DNA, 25 bp, Rattus norvegicus
agaccaccgggactccgctgcttgt

SEQ ID NO: 108846 - DNA, 25 bp, Rattus norvegicus
agaccaccgggagtccgctgcttgt

SEQ ID NO: 108847 - DNA, 25 bp, Rattus norvegicus
agaccaccgtttctgtactacattt

SEQ ID NO: 108848 - DNA, 25 bp, Rattus norvegicus
agaccaccgtttgtgtactacattt

SEQ ID NO: 108849 - DNA, 25 bp, Rattus norvegicus
agaccaccttagcatcatactgatc

SEQ ID NO: 108850 - DNA, 25 bp, Rattus norvegicus
agaccaccttaggatcatactgatc

SEQ ID NO: 108851 - DNA, 25 bp, Rattus norvegicus
agaccacctttaatatacccacctg

SEQ ID NO: 108852 - DNA, 25 bp, Rattus norvegicus
agaccacctttattatacccacctg

SEQ ID NO: 108853 - DNA, 25 bp, Rattus norvegicus
agaccacgcggcagctgagcttagc

SEQ ID NO: 108854 - DNA, 25 bp, Rattus norvegicus
agaccacgcggctgctgagcttagc

SEQ ID NO: 108855 - DNA, 25 bp, Rattus norvegicus
agaccacggagcacaggaactactg

SEQ ID NO: 108856 - DNA, 25 bp, Rattus norvegicus
agaccacggagctcaggaactactg

SEQ ID NO: 108857 - DNA, 25 bp, Rattus norvegicus
agaccacggcttagtgactgagcgc

SEQ ID NO: 108858 - DNA, 25 bp, Rattus norvegicus
agaccacggctttgtgactgagcgc

SEQ ID NO: 108859 - DNA, 25 bp, Rattus norvegicus
agaccacgtcttatggatcagccaa

SEQ ID NO: 108860 - DNA, 25 bp, Rattus norvegicus
agaccacgtcttttggatcagccaa

SEQ ID NO: 108861 - DNA, 25 bp, Rattus norvegicus
agaccacgtttcaaaggacttactg

SEQ ID NO: 108862 - DNA, 25 bp, Rattus norvegicus
agaccacgtttcatctgtgcattta

SEQ ID NO: 108863 - DNA, 25 bp, Rattus norvegicus
agaccacgtttctaaggacttactg

SEQ ID NO: 108864 - DNA, 25 bp, Rattus norvegicus
agaccacgtttcttctgtgcattta

SEQ ID NO: 108865 - DNA, 25 bp, Rattus norvegicus
agaccactctaactccttcatttga

SEQ ID NO: 108866 - DNA, 25 bp, Rattus norvegicus
agaccactctaagtccttcatttga

SEQ ID NO: 108867 - DNA, 25 bp, Rattus norvegicus
agaccactctggaaagaagcagggt

SEQ ID NO: 108868 - DNA, 25 bp, Rattus norvegicus
agaccactctggtaagaagcagggt

SEQ ID NO: 108869 - DNA, 25 bp, Rattus norvegicus
agaccactctgtatgcaaaagccca

SEQ ID NO: 108870 - DNA, 25 bp, Rattus norvegicus
agaccactctgtttgcaaaagccca

SEQ ID NO: 108871 - DNA, 25 bp, Rattus norvegicus
agaccactgaatctcagggtgccgt

SEQ ID NO: 108872 - DNA, 25 bp, Rattus norvegicus
agaccactgaatgtcagggtgccgt

SEQ ID NO: 108873 - DNA, 25 bp, Rattus norvegicus
agaccactgcagagtcatttgcaca

SEQ ID NO: 108874 - DNA, 25 bp, Rattus norvegicus
agaccactgcagtgtcatttgcaca

SEQ ID NO: 108875 - DNA, 25 bp, Rattus norvegicus
agaccactgcttcgaaattttgcca

SEQ ID NO: 108876 - DNA, 25 bp, Rattus norvegicus
agaccactgcttggaaattttgcca

SEQ ID NO: 108877 - DNA, 25 bp, Rattus norvegicus
agaccactggtgcagtgatctcttc

SEQ ID NO: 108878 - DNA, 25 bp, Rattus norvegicus
agaccactggtggagtgatctcttc

SEQ ID NO: 108879 - DNA, 25 bp, Rattus norvegicus
agaccactgtacatagatctgccct

SEQ ID NO: 108880 - DNA, 25 bp, Rattus norvegicus
agaccactgtacttagatctgccct

SEQ ID NO: 108881 - DNA, 25 bp, Rattus norvegicus
agaccactgttaatcttacgctgga

SEQ ID NO: 108882 - DNA, 25 bp, Rattus norvegicus
agaccactgttattcttacgctgga

SEQ ID NO: 108883 - DNA, 25 bp, Rattus norvegicus
agaccactgttcaacccagagaaga

SEQ ID NO: 108884 - DNA, 25 bp, Rattus norvegicus
agaccactgttctacccagagaaga

SEQ ID NO: 108885 - DNA, 25 bp, Rattus norvegicus
agaccactgtttctgttaattcaca

SEQ ID NO: 108886 - DNA, 25 bp, Rattus norvegicus
agaccactgtttgtgttaattcaca

SEQ ID NO: 108887 - DNA, 25 bp, Rattus norvegicus
agaccacttccgcaacagggatagt

SEQ ID NO: 108888 - DNA, 25 bp, Rattus norvegicus
agaccacttccggaacagggatagt

SEQ ID NO: 108889 - DNA, 25 bp, Rattus norvegicus
agaccacttctgagctgactttaga

SEQ ID NO: 108890 - DNA, 25 bp, Rattus norvegicus
agaccacttctgtgctgactttaga

SEQ ID NO: 108891 - DNA, 25 bp, Rattus norvegicus
agaccactttaaactgtggacattt

SEQ ID NO: 108892 - DNA, 25 bp, Rattus norvegicus
agaccactttaatctgtggacattt

SEQ ID NO: 108893 - DNA, 25 bp, Rattus norvegicus
agaccagaagacacaactaacccag

SEQ ID NO: 108894 - DNA, 25 bp, Rattus norvegicus
agaccagaagactcaactaacccag

SEQ ID NO: 108895 - DNA, 25 bp, Rattus norvegicus
agaccagaagccagactgctagtat

SEQ ID NO: 108896 - DNA, 25 bp, Rattus norvegicus
agaccagaagccagcgagtcctaca

SEQ ID NO: 108897 - DNA, 25 bp, Rattus norvegicus
agaccagaagcctgactgctagtat

SEQ ID NO: 108898 - DNA, 25 bp, Rattus norvegicus
agaccagaagcctgcgagtcctaca

SEQ ID NO: 108899 - DNA, 25 bp, Rattus norvegicus
agaccagaattgcttcctcagaagg

SEQ ID NO: 108900 - DNA, 25 bp, Rattus norvegicus
agaccagaattggttcctcagaagg

SEQ ID NO: 108901 - DNA, 25 bp, Rattus norvegicus
agaccagacattaccatactttgag

SEQ ID NO: 108902 - DNA, 25 bp, Rattus norvegicus
agaccagacatttccatactttgag

SEQ ID NO: 108903 - DNA, 25 bp, Rattus norvegicus
agaccagaccctctcattcatgaag

SEQ ID NO: 108904 - DNA, 25 bp, Rattus norvegicus
agaccagaccctgtcattcatgaag

SEQ ID NO: 108905 - DNA, 25 bp, Rattus norvegicus
agaccagacctcaacgacgtgtttg

SEQ ID NO: 108906 - DNA, 25 bp, Rattus norvegicus
agaccagacctctacgacgtgtttg

SEQ ID NO: 108907 - DNA, 25 bp, Rattus norvegicus
agaccagaggctcggctgcaccaga

SEQ ID NO: 108908 - DNA, 25 bp, Rattus norvegicus
agaccagaggctgggctgcaccaga

SEQ ID NO: 108909 - DNA, 25 bp, Rattus norvegicus
agaccagagtttcttccacaagggc

SEQ ID NO: 108910 - DNA, 25 bp, Rattus norvegicus
agaccagagtttgttccacaagggc

SEQ ID NO: 108911 - DNA, 25 bp, Rattus norvegicus
agaccagatacgacagggcattcag

SEQ ID NO: 108912 - DNA, 25 bp, Rattus norvegicus
agaccagatacgtcagggcattcag

SEQ ID NO: 108913 - DNA, 25 bp, Rattus norvegicus
agaccagatcagaattttcttgata

SEQ ID NO: 108914 - DNA, 25 bp, Rattus norvegicus
agaccagatcagtattttcttgata

SEQ ID NO: 108915 - DNA, 25 bp, Rattus norvegicus
agaccagatctcaagctctgtagcc

SEQ ID NO: 108916 - DNA, 25 bp, Rattus norvegicus
agaccagatctctagctctgtagcc

SEQ ID NO: 108917 - DNA, 25 bp, Rattus norvegicus
agaccagatgttacttggcaggctc

SEQ ID NO: 108918 - DNA, 25 bp, Rattus norvegicus
agaccagatgtttcttggcaggctc

SEQ ID NO: 108919 - DNA, 25 bp, Rattus norvegicus
agaccagattatcggcttactgaat

SEQ ID NO: 108920 - DNA, 25 bp, Rattus norvegicus
agaccagattatgggcttactgaat

SEQ ID NO: 108921 - DNA, 25 bp, Rattus norvegicus
agaccagcagctacatctaatccag

SEQ ID NO: 108922 - DNA, 25 bp, Rattus norvegicus
agaccagcagctattcctatttaaa

SEQ ID NO: 108923 - DNA, 25 bp, Rattus norvegicus
agaccagcagcttcatctaatccag

SEQ ID NO: 108924 - DNA, 25 bp, Rattus norvegicus
agaccagcagcttttcctatttaaa

SEQ ID NO: 108925 - DNA, 25 bp, Rattus norvegicus
agaccagcagggagccgtcttcacg

SEQ ID NO: 108926 - DNA, 25 bp, Rattus norvegicus
agaccagcagggtgccgtcttcacg

SEQ ID NO: 108927 - DNA, 25 bp, Rattus norvegicus
agaccagcatctacatcatggatga

SEQ ID NO: 108928 - DNA, 25 bp, Rattus norvegicus
agaccagcatcttcatcatggatga

SEQ ID NO: 108929 - DNA, 25 bp, Rattus norvegicus
agaccagcattaccaagagacccaa

SEQ ID NO: 108930 - DNA, 25 bp, Rattus norvegicus
agaccagcattagcaagagacccaa

SEQ ID NO: 108931 - DNA, 25 bp, Rattus norvegicus
agaccagccatacccagttaatctt

SEQ ID NO: 108932 - DNA, 25 bp, Rattus norvegicus
agaccagccatagccagttaatctt

SEQ ID NO: 108933 - DNA, 25 bp, Rattus norvegicus
agaccagccctcattggagtctgaa

SEQ ID NO: 108934 - DNA, 25 bp, Rattus norvegicus
agaccagccctctttggagtctgaa

SEQ ID NO: 108935 - DNA, 25 bp, Rattus norvegicus
agaccagcctataaggtgtttttat

SEQ ID NO: 108936 - DNA, 25 bp, Rattus norvegicus
agaccagcctattaggtgtttttat

SEQ ID NO: 108937 - DNA, 25 bp, Rattus norvegicus
agaccagcctcacacttgctgtgca

SEQ ID NO: 108938 - DNA, 25 bp, Rattus norvegicus
agaccagcctcagacttgctgtgca

SEQ ID NO: 108939 - DNA, 25 bp, Rattus norvegicus
agaccagcctttattagctctgctt

SEQ ID NO: 108940 - DNA, 25 bp, Rattus norvegicus
agaccagccttttttagctctgctt

SEQ ID NO: 108941 - DNA, 25 bp, Rattus norvegicus
agaccagcgagaccagcgttatcca

SEQ ID NO: 108942 - DNA, 25 bp, Rattus norvegicus
agaccagcgagagcagcgttatcca

SEQ ID NO: 108943 - DNA, 25 bp, Rattus norvegicus
agaccagcgctcacacgggtgaaaa

SEQ ID NO: 108944 - DNA, 25 bp, Rattus norvegicus
agaccagcgctctcacgggtgaaaa

SEQ ID NO: 108945 - DNA, 25 bp, Rattus norvegicus
agaccagcggtcagctctgctgtga

SEQ ID NO: 108946 - DNA, 25 bp, Rattus norvegicus
agaccagcggtctgctctgctgtga

SEQ ID NO: 108947 - DNA, 25 bp, Rattus norvegicus
agaccagctctcaggctactatgaa

SEQ ID NO: 108948 - DNA, 25 bp, Rattus norvegicus
agaccagctctctggctactatgaa

SEQ ID NO: 108949 - DNA, 25 bp, Rattus norvegicus
agaccagctgcgcacatgcttagca

SEQ ID NO: 108950 - DNA, 25 bp, Rattus norvegicus
agaccagctgcggacatgcttagca

SEQ ID NO: 108951 - DNA, 25 bp, Rattus norvegicus
agaccagctgtgcatcggcactaaa

SEQ ID NO: 108952 - DNA, 25 bp, Rattus norvegicus
agaccagctgtggatcggcactaaa

SEQ ID NO: 108953 - DNA, 25 bp, Rattus norvegicus
agaccagcttaaccctgaactcata

SEQ ID NO: 108954 - DNA, 25 bp, Rattus norvegicus
agaccagcttaagcctgaactcata

SEQ ID NO: 108955 - DNA, 25 bp, Rattus norvegicus
agaccagcttcacctacgacgagag

SEQ ID NO: 108956 - DNA, 25 bp, Rattus norvegicus
agaccagcttcagctacgacgagag

SEQ ID NO: 108957 - DNA, 25 bp, Rattus norvegicus
agaccaggacttcctctaaggccag

SEQ ID NO: 108958 - DNA, 25 bp, Rattus norvegicus
agaccaggacttgctctaaggccag

SEQ ID NO: 108959 - DNA, 25 bp, Rattus norvegicus
agaccaggatagctttgaatacaga

SEQ ID NO: 108960 - DNA, 25 bp, Rattus norvegicus
agaccaggataggtttgaatacaga

SEQ ID NO: 108961 - DNA, 25 bp, Rattus norvegicus
agaccaggccatactttcggaggag

SEQ ID NO: 108962 - DNA, 25 bp, Rattus norvegicus
agaccaggccattctttcggaggag

SEQ ID NO: 108963 - DNA, 25 bp, Rattus norvegicus
agaccaggcctgaaggagggtactt

SEQ ID NO: 108964 - DNA, 25 bp, Rattus norvegicus
agaccaggcctgtaggagggtactt

SEQ ID NO: 108965 - DNA, 25 bp, Rattus norvegicus
agaccaggctggctgaataccaaga

SEQ ID NO: 108966 - DNA, 25 bp, Rattus norvegicus
agaccaggctgggtgaataccaaga

SEQ ID NO: 108967 - DNA, 25 bp, Rattus norvegicus
agaccaggctgtaattgaactttca

SEQ ID NO: 108968 - DNA, 25 bp, Rattus norvegicus
agaccaggctgttattgaactttca

SEQ ID NO: 108969 - DNA, 25 bp, Rattus norvegicus
agaccaggcttgagtggctccggca

SEQ ID NO: 108970 - DNA, 25 bp, Rattus norvegicus
agaccaggcttgtgtggctccggca

SEQ ID NO: 108971 - DNA, 25 bp, Rattus norvegicus
agaccagggtaaccactgtggaatt

SEQ ID NO: 108972 - DNA, 25 bp, Rattus norvegicus
agaccagggtaagcactgtggaatt

SEQ ID NO: 108973 - DNA, 25 bp, Rattus norvegicus
agaccagggtgtcgtgcttcccatt

SEQ ID NO: 108974 - DNA, 25 bp, Rattus norvegicus
agaccagggtgtggtgcttcccatt

SEQ ID NO: 108975 - DNA, 25 bp, Rattus norvegicus
agaccaggtatcctcaaggccgctg

SEQ ID NO: 108976 - DNA, 25 bp, Rattus norvegicus
agaccaggtatcgtcaaggccgctg

SEQ ID NO: 108977 - DNA, 25 bp, Rattus norvegicus
agaccaggtctacgcaatcagttcc

SEQ ID NO: 108978 - DNA, 25 bp, Rattus norvegicus
agaccaggtctaggcaatcagttcc

SEQ ID NO: 108979 - DNA, 25 bp, Rattus norvegicus
agaccaggtcttacaggcagcaaac

SEQ ID NO: 108980 - DNA, 25 bp, Rattus norvegicus
agaccaggtctttcaggcagcaaac

SEQ ID NO: 108981 - DNA, 25 bp, Rattus norvegicus
agaccaggttctcagcagccgctgt

SEQ ID NO: 108982 - DNA, 25 bp, Rattus norvegicus
agaccaggttctgagcagccgctgt

SEQ ID NO: 108983 - DNA, 25 bp, Rattus norvegicus
agaccagtatttcttcctctgggct

SEQ ID NO: 108984 - DNA, 25 bp, Rattus norvegicus
agaccagtatttgttcctctgggct

SEQ ID NO: 108985 - DNA, 25 bp, Rattus norvegicus
agaccagtcaccatccagacatgaa

SEQ ID NO: 108986 - DNA, 25 bp, Rattus norvegicus
agaccagtcaccttccagacatgaa

SEQ ID NO: 108987 - DNA, 25 bp, Rattus norvegicus
agaccagtcctcaccatgggacggg

SEQ ID NO: 108988 - DNA, 25 bp, Rattus norvegicus
agaccagtcctctccatgggacggg

SEQ ID NO: 108989 - DNA, 25 bp, Rattus norvegicus
agaccagtcggcatatacttagaag

SEQ ID NO: 108990 - DNA, 25 bp, Rattus norvegicus
agaccagtcggcttatacttagaag

SEQ ID NO: 108991 - DNA, 25 bp, Rattus norvegicus
agaccagtgctaactctgcagagaa

SEQ ID NO: 108992 - DNA, 25 bp, Rattus norvegicus
agaccagtgctatctctgcagagaa

SEQ ID NO: 108993 - DNA, 25 bp, Rattus norvegicus
agaccagtgcttcttcaccagtaaa

SEQ ID NO: 108994 - DNA, 25 bp, Rattus norvegicus
agaccagtgcttgttcaccagtaaa

SEQ ID NO: 108995 - DNA, 25 bp, Rattus norvegicus
agaccagtggccagttcgggcaaga

SEQ ID NO: 108996 - DNA, 25 bp, Rattus norvegicus
agaccagtggccctgtggacgataa

SEQ ID NO: 108997 - DNA, 25 bp, Rattus norvegicus
agaccagtggccgtgtggacgataa

SEQ ID NO: 108998 - DNA, 25 bp, Rattus norvegicus
agaccagtggcctgttcgggcaaga

SEQ ID NO: 108999 - DNA, 25 bp, Rattus norvegicus
agaccagtgggcaaccggacaagtc

SEQ ID NO: 109000 - DNA, 25 bp, Rattus norvegicus
agaccagtgggctaccggacaagtc

SEQ ID NO: 109001 - DNA, 25 bp, Rattus norvegicus
agaccagtggtacctttgtggccct

SEQ ID NO: 109002 - DNA, 25 bp, Rattus norvegicus
agaccagtggtagctttgtggccct

SEQ ID NO: 109003 - DNA, 25 bp, Rattus norvegicus
agaccagtggtcaaccaggtggagt

SEQ ID NO: 109004 - DNA, 25 bp, Rattus norvegicus
agaccagtggtctaccaggtggagt

SEQ ID NO: 109005 - DNA, 25 bp, Rattus norvegicus
agaccagtggttatcctttccaatg

SEQ ID NO: 109006 - DNA, 25 bp, Rattus norvegicus
agaccagtggttttcctttccaatg

SEQ ID NO: 109007 - DNA, 25 bp, Rattus norvegicus
agaccagtgtagagatctactccaa

SEQ ID NO: 109008 - DNA, 25 bp, Rattus norvegicus
agaccagtgtagtgatctactccaa

SEQ ID NO: 109009 - DNA, 25 bp, Rattus norvegicus
agaccagtgttaattcccgggacat

SEQ ID NO: 109010 - DNA, 25 bp, Rattus norvegicus
agaccagtgttatttcccgggacat

SEQ ID NO: 109011 - DNA, 25 bp, Rattus norvegicus
agaccagttacgaacggcattcccg

SEQ ID NO: 109012 - DNA, 25 bp, Rattus norvegicus
agaccagttacgtacggcattcccg

SEQ ID NO: 109013 - DNA, 25 bp, Rattus norvegicus
agaccagtttaaagaccttgttatc

SEQ ID NO: 109014 - DNA, 25 bp, Rattus norvegicus
agaccagtttaatgaccttgttatc

SEQ ID NO: 109015 - DNA, 25 bp, Rattus norvegicus
agaccagttttgaatgacctttgag

SEQ ID NO: 109016 - DNA, 25 bp, Rattus norvegicus
agaccagttttgtatgacctttgag

SEQ ID NO: 109017 - DNA, 25 bp, Rattus norvegicus
agaccataccttctctgtgttaagt

SEQ ID NO: 109018 - DNA, 25 bp, Rattus norvegicus
agaccataccttgtctgtgttaagt

SEQ ID NO: 109019 - DNA, 25 bp, Rattus norvegicus
agaccatagcttatatttccttagt

SEQ ID NO: 109020 - DNA, 25 bp, Rattus norvegicus
agaccatagcttttatttccttagt

SEQ ID NO: 109021 - DNA, 25 bp, Rattus norvegicus
agaccatcaacaacgagcctgacat

SEQ ID NO: 109022 - DNA, 25 bp, Rattus norvegicus
agaccatcaacatcgagcctgacat

SEQ ID NO: 109023 - DNA, 25 bp, Rattus norvegicus
agaccatcaaccatacacatcaaga

SEQ ID NO: 109024 - DNA, 25 bp, Rattus norvegicus
agaccatcaaccttacacatcaaga

SEQ ID NO: 109025 - DNA, 25 bp, Rattus norvegicus
agaccatcacatctctggagctgag

SEQ ID NO: 109026 - DNA, 25 bp, Rattus norvegicus
agaccatcacatgtctggagctgag

SEQ ID NO: 109027 - DNA, 25 bp, Rattus norvegicus
agaccatcacgcacgaggttgaacc

SEQ ID NO: 109028 - DNA, 25 bp, Rattus norvegicus
agaccatcacgctcgaggttgaacc

SEQ ID NO: 109029 - DNA, 25 bp, Rattus norvegicus
agaccatcagttacttctcagcaga

SEQ ID NO: 109030 - DNA, 25 bp, Rattus norvegicus
agaccatcagtttcttctcagcaga

SEQ ID NO: 109031 - DNA, 25 bp, Rattus norvegicus
agaccatccaggaggccggtgactg

SEQ ID NO: 109032 - DNA, 25 bp, Rattus norvegicus
agaccatccaggtggccggtgactg

SEQ ID NO: 109033 - DNA, 25 bp, Rattus norvegicus
agaccatcctacctaccatatttga

SEQ ID NO: 109034 - DNA, 25 bp, Rattus norvegicus
agaccatcctacgtaccatatttga

SEQ ID NO: 109035 - DNA, 25 bp, Rattus norvegicus
agaccatcgaccctctgtcgggtaa

SEQ ID NO: 109036 - DNA, 25 bp, Rattus norvegicus
agaccatcgaccgtctgtcgggtaa

SEQ ID NO: 109037 - DNA, 25 bp, Rattus norvegicus
agaccatcgagaccttaactggaag

SEQ ID NO: 109038 - DNA, 25 bp, Rattus norvegicus
agaccatcgagagcttaactggaag

SEQ ID NO: 109039 - DNA, 25 bp, Rattus norvegicus
agaccatcgggtagaaccttctgtt

SEQ ID NO: 109040 - DNA, 25 bp, Rattus norvegicus
agaccatcgggttgaaccttctgtt

SEQ ID NO: 109041 - DNA, 25 bp, Rattus norvegicus
agaccatctggtaggagctgccaca

SEQ ID NO: 109042 - DNA, 25 bp, Rattus norvegicus
agaccatctggttggagctgccaca

SEQ ID NO: 109043 - DNA, 25 bp, Rattus norvegicus
agaccatctgtactgtcactttggg

SEQ ID NO: 109044 - DNA, 25 bp, Rattus norvegicus
agaccatctgtagtgtcactttggg

SEQ ID NO: 109045 - DNA, 25 bp, Rattus norvegicus
agaccatcttaacgctcagcttctc

SEQ ID NO: 109046 - DNA, 25 bp, Rattus norvegicus
agaccatcttaaggctcagcttctc

SEQ ID NO: 109047 - DNA, 25 bp, Rattus norvegicus
agaccatcttcacacccgtgttctg

SEQ ID NO: 109048 - DNA, 25 bp, Rattus norvegicus
agaccatcttcagacccgtgttctg

SEQ ID NO: 109049 - DNA, 25 bp, Rattus norvegicus
agaccatcttggcttacagtgtgag

SEQ ID NO: 109050 - DNA, 25 bp, Rattus norvegicus
agaccatcttgggttacagtgtgag

SEQ ID NO: 109051 - DNA, 25 bp, Rattus norvegicus
agaccatcttgtccttctgagagta

SEQ ID NO: 109052 - DNA, 25 bp, Rattus norvegicus
agaccatcttgtgcttctgagagta

SEQ ID NO: 109053 - DNA, 25 bp, Rattus norvegicus
agaccatcttttactcttcggagga

SEQ ID NO: 109054 - DNA, 25 bp, Rattus norvegicus
agaccatctttttctcttcggagga

SEQ ID NO: 109055 - DNA, 25 bp, Rattus norvegicus
agaccatgaaggcacctgcctcggt

SEQ ID NO: 109056 - DNA, 25 bp, Rattus norvegicus
agaccatgaagggacctgcctcggt

SEQ ID NO: 109057 - DNA, 25 bp, Rattus norvegicus
agaccatgacttccttctggtggca

SEQ ID NO: 109058 - DNA, 25 bp, Rattus norvegicus
agaccatgacttgcttctggtggca

SEQ ID NO: 109059 - DNA, 25 bp, Rattus norvegicus
agaccatgagaacctcctctgaggt

SEQ ID NO: 109060 - DNA, 25 bp, Rattus norvegicus
agaccatgagaagctcctctgaggt

SEQ ID NO: 109061 - DNA, 25 bp, Rattus norvegicus
agaccatgagtaatgaattcccaga

SEQ ID NO: 109062 - DNA, 25 bp, Rattus norvegicus
agaccatgagtattgaattcccaga

SEQ ID NO: 109063 - DNA, 25 bp, Rattus norvegicus
agaccatgagttctggcttcgagcc

SEQ ID NO: 109064 - DNA, 25 bp, Rattus norvegicus
agaccatgagttgtggcttcgagcc

SEQ ID NO: 109065 - DNA, 25 bp, Rattus norvegicus
agaccatgatcgaaagagtgtgtca

SEQ ID NO: 109066 - DNA, 25 bp, Rattus norvegicus
agaccatgatcgtaagagtgtgtca

SEQ ID NO: 109067 - DNA, 25 bp, Rattus norvegicus
agaccatgccccaggactgagtaaa

SEQ ID NO: 109068 - DNA, 25 bp, Rattus norvegicus
agaccatgcccctggactgagtaaa

SEQ ID NO: 109069 - DNA, 25 bp, Rattus norvegicus
agaccatggcatacctgtgtgtgct

SEQ ID NO: 109070 - DNA, 25 bp, Rattus norvegicus
agaccatggcattcctgtgtgtgct

SEQ ID NO: 109071 - DNA, 25 bp, Rattus norvegicus
agaccatggccaagttcatccgtaa

SEQ ID NO: 109072 - DNA, 25 bp, Rattus norvegicus
agaccatggccatgttcatccgtaa

SEQ ID NO: 109073 - DNA, 25 bp, Rattus norvegicus
agaccatggctgctcactggctgtc

SEQ ID NO: 109074 - DNA, 25 bp, Rattus norvegicus
agaccatggctggtcactggctgtc

SEQ ID NO: 109075 - DNA, 25 bp, Rattus norvegicus
agaccatgggcaagagggactgatc

SEQ ID NO: 109076 - DNA, 25 bp, Rattus norvegicus
agaccatgggcatgagggactgatc

SEQ ID NO: 109077 - DNA, 25 bp, Rattus norvegicus
agaccatggttcatctacctcagca

SEQ ID NO: 109078 - DNA, 25 bp, Rattus norvegicus
agaccatggttcttctacctcagca

SEQ ID NO: 109079 - DNA, 25 bp, Rattus norvegicus
agaccatgtcttcatttcctgagcc

SEQ ID NO: 109080 - DNA, 25 bp, Rattus norvegicus
agaccatgtcttgatttcctgagcc

SEQ ID NO: 109081 - DNA, 25 bp, Rattus norvegicus
agaccatgttaactctgacccagct

SEQ ID NO: 109082 - DNA, 25 bp, Rattus norvegicus
agaccatgttaagtctgacccagct

SEQ ID NO: 109083 - DNA, 25 bp, Rattus norvegicus
agaccattaccaattttgcctctaa

SEQ ID NO: 109084 - DNA, 25 bp, Rattus norvegicus
agaccattaccatttttgcctctaa

SEQ ID NO: 109085 - DNA, 25 bp, Rattus norvegicus
agaccattatctagatccaccagtg

SEQ ID NO: 109086 - DNA, 25 bp, Rattus norvegicus
agaccattatcttgatccaccagtg

SEQ ID NO: 109087 - DNA, 25 bp, Rattus norvegicus
agaccattctcaacgccttcaaggt

SEQ ID NO: 109088 - DNA, 25 bp, Rattus norvegicus
agaccattctcatcgccttcaaggt

SEQ ID NO: 109089 - DNA, 25 bp, Rattus norvegicus
agaccattctccaggactctttttt

SEQ ID NO: 109090 - DNA, 25 bp, Rattus norvegicus
agaccattctcctggactctttttt

SEQ ID NO: 109091 - DNA, 25 bp, Rattus norvegicus
agaccattgaggacacgggcactat

SEQ ID NO: 109092 - DNA, 25 bp, Rattus norvegicus
agaccattgaggtcacgggcactat

SEQ ID NO: 109093 - DNA, 25 bp, Rattus norvegicus
agaccattgctaattcagcctgttc

SEQ ID NO: 109094 - DNA, 25 bp, Rattus norvegicus
agaccattgctatttcagcctgttc

SEQ ID NO: 109095 - DNA, 25 bp, Rattus norvegicus
agaccattggttatctagcctgcct

SEQ ID NO: 109096 - DNA, 25 bp, Rattus norvegicus
agaccattggttttctagcctgcct

SEQ ID NO: 109097 - DNA, 25 bp, Rattus norvegicus
agaccattgtcaagggtgcttcctt

SEQ ID NO: 109098 - DNA, 25 bp, Rattus norvegicus
agaccattgtcatgggtgcttcctt

SEQ ID NO: 109099 - DNA, 25 bp, Rattus norvegicus
agaccatttaatcctgaatttactt

SEQ ID NO: 109100 - DNA, 25 bp, Rattus norvegicus
agaccatttaatgctgaatttactt

SEQ ID NO: 109101 - DNA, 25 bp, Rattus norvegicus
agaccatttctcagcagtcagactg

SEQ ID NO: 109102 - DNA, 25 bp, Rattus norvegicus
agaccatttctcaggccatgctgaa

SEQ ID NO: 109103 - DNA, 25 bp, Rattus norvegicus
agaccatttctctgcagtcagactg

SEQ ID NO: 109104 - DNA, 25 bp, Rattus norvegicus
agaccatttctctggccatgctgaa

SEQ ID NO: 109105 - DNA, 25 bp, Rattus norvegicus
agaccattttatagcctagttgaca

SEQ ID NO: 109106 - DNA, 25 bp, Rattus norvegicus
agaccattttattgcctagttgaca

SEQ ID NO: 109107 - DNA, 25 bp, Rattus norvegicus
agacccaaacaaatgaggaagccga

SEQ ID NO: 109108 - DNA, 25 bp, Rattus norvegicus
agacccaaacaattgaggaagccga

SEQ ID NO: 109109 - DNA, 25 bp, Rattus norvegicus
agacccaaagggacatgcatggtat

SEQ ID NO: 109110 - DNA, 25 bp, Rattus norvegicus
agacccaaagggtcatgcatggtat

SEQ ID NO: 109111 - DNA, 25 bp, Rattus norvegicus
agacccaagagtatgagcatcctga

SEQ ID NO: 109112 - DNA, 25 bp, Rattus norvegicus
agacccaagagtttgagcatcctga

SEQ ID NO: 109113 - DNA, 25 bp, Rattus norvegicus
agacccaaggccaggtttgaccaga

SEQ ID NO: 109114 - DNA, 25 bp, Rattus norvegicus
agacccaaggcctggtttgaccaga

SEQ ID NO: 109115 - DNA, 25 bp, Rattus norvegicus
agacccaaggtcatgatctaaacat

SEQ ID NO: 109116 - DNA, 25 bp, Rattus norvegicus
agacccaaggtcttgatctaaacat

SEQ ID NO: 109117 - DNA, 25 bp, Rattus norvegicus
agacccaagtccagagtgtgatcga

SEQ ID NO: 109118 - DNA, 25 bp, Rattus norvegicus
agacccaagtcctgagtgtgatcga

SEQ ID NO: 109119 - DNA, 25 bp, Rattus norvegicus
agacccaatgtcatcgcatgtatct

SEQ ID NO: 109120 - DNA, 25 bp, Rattus norvegicus
agacccaatgtcttcgcatgtatct

SEQ ID NO: 109121 - DNA, 25 bp, Rattus norvegicus
agacccaatttgagtgccttttctg

SEQ ID NO: 109122 - DNA, 25 bp, Rattus norvegicus
agacccaatttgtgtgccttttctg

SEQ ID NO: 109123 - DNA, 25 bp, Rattus norvegicus
agacccacagagatgtccacatgca

SEQ ID NO: 109124 - DNA, 25 bp, Rattus norvegicus
agacccacagagttgtccacatgca

SEQ ID NO: 109125 - DNA, 25 bp, Rattus norvegicus
agacccacagtacgtatatcctgca

SEQ ID NO: 109126 - DNA, 25 bp, Rattus norvegicus
agacccacagtaggtatatcctgca

SEQ ID NO: 109127 - DNA, 25 bp, Rattus norvegicus
agacccacccgtcagtcaagaaagt

SEQ ID NO: 109128 - DNA, 25 bp, Rattus norvegicus
agacccacccgtgagtcaagaaagt

SEQ ID NO: 109129 - DNA, 25 bp, Rattus norvegicus
agacccaccttgacaagctgtgtat

SEQ ID NO: 109130 - DNA, 25 bp, Rattus norvegicus
agacccaccttgtcaagctgtgtat

SEQ ID NO: 109131 - DNA, 25 bp, Rattus norvegicus
agacccacgagacgcatcatcttgt

SEQ ID NO: 109132 - DNA, 25 bp, Rattus norvegicus
agacccacgagaggcatcatcttgt

SEQ ID NO: 109133 - DNA, 25 bp, Rattus norvegicus
agacccactatccagacgcttttat

SEQ ID NO: 109134 - DNA, 25 bp, Rattus norvegicus
agacccactatcgagacgcttttat

SEQ ID NO: 109135 - DNA, 25 bp, Rattus norvegicus
agacccactcagacctgcttaggct

SEQ ID NO: 109136 - DNA, 25 bp, Rattus norvegicus
agacccactcagtcctgcttaggct

SEQ ID NO: 109137 - DNA, 25 bp, Rattus norvegicus
agacccacttcccaggatttggcgg

SEQ ID NO: 109138 - DNA, 25 bp, Rattus norvegicus
agacccacttccgaggatttggcgg

SEQ ID NO: 109139 - DNA, 25 bp, Rattus norvegicus
agacccacttctaactgtgctgtca

SEQ ID NO: 109140 - DNA, 25 bp, Rattus norvegicus
agacccacttcttactgtgctgtca

SEQ ID NO: 109141 - DNA, 25 bp, Rattus norvegicus
agacccacttttcttggcccagcaa

SEQ ID NO: 109142 - DNA, 25 bp, Rattus norvegicus
agacccacttttgttggcccagcaa

SEQ ID NO: 109143 - DNA, 25 bp, Rattus norvegicus
agacccagactaaataacctccatt

SEQ ID NO: 109144 - DNA, 25 bp, Rattus norvegicus
agacccagactatataacctccatt

SEQ ID NO: 109145 - DNA, 25 bp, Rattus norvegicus
agacccagacttacctagtgctctt

SEQ ID NO: 109146 - DNA, 25 bp, Rattus norvegicus
agacccagactttcctagtgctctt

SEQ ID NO: 109147 - DNA, 25 bp, Rattus norvegicus
agacccagagatacaggccgccaag

SEQ ID NO: 109148 - DNA, 25 bp, Rattus norvegicus
agacccagagattcaggccgccaag

SEQ ID NO: 109149 - DNA, 25 bp, Rattus norvegicus
agacccagagctcagcgtactcatt

SEQ ID NO: 109150 - DNA, 25 bp, Rattus norvegicus
agacccagagctgagcgtactcatt

SEQ ID NO: 109151 - DNA, 25 bp, Rattus norvegicus
agacccagagtgatgatccacctct

SEQ ID NO: 109152 - DNA, 25 bp, Rattus norvegicus
agacccagagtgttgatccacctct

SEQ ID NO: 109153 - DNA, 25 bp, Rattus norvegicus
agacccagatgtccctcagactgag

SEQ ID NO: 109154 - DNA, 25 bp, Rattus norvegicus
agacccagatgtgcctcagactgag

SEQ ID NO: 109155 - DNA, 25 bp, Rattus norvegicus
agacccagcatcctgggagtggcca

SEQ ID NO: 109156 - DNA, 25 bp, Rattus norvegicus
agacccagcatcgtgggagtggcca

SEQ ID NO: 109157 - DNA, 25 bp, Rattus norvegicus
agacccagccagcatggagagtgca

SEQ ID NO: 109158 - DNA, 25 bp, Rattus norvegicus
agacccagccaggatggagagtgca

SEQ ID NO: 109159 - DNA, 25 bp, Rattus norvegicus
agacccagcctacagttgagggcaa

SEQ ID NO: 109160 - DNA, 25 bp, Rattus norvegicus
agacccagcctagagttgagggcaa

SEQ ID NO: 109161 - DNA, 25 bp, Rattus norvegicus
agacccagggacagcctgccaagca

SEQ ID NO: 109162 - DNA, 25 bp, Rattus norvegicus
agacccagggactgcctgccaagca

SEQ ID NO: 109163 - DNA, 25 bp, Rattus norvegicus
agacccagggcaattgcttttcagg

SEQ ID NO: 109164 - DNA, 25 bp, Rattus norvegicus
agacccagggcatttgcttttcagg

SEQ ID NO: 109165 - DNA, 25 bp, Rattus norvegicus
agacccagggccagaatattaggca

SEQ ID NO: 109166 - DNA, 25 bp, Rattus norvegicus
agacccagggcctgaatattaggca

SEQ ID NO: 109167 - DNA, 25 bp, Rattus norvegicus
agacccagggctctgatactgtctt

SEQ ID NO: 109168 - DNA, 25 bp, Rattus norvegicus
agacccagggctgtgatactgtctt

SEQ ID NO: 109169 - DNA, 25 bp, Rattus norvegicus
agacccagggtcactttggagagac

SEQ ID NO: 109170 - DNA, 25 bp, Rattus norvegicus
agacccagggtcctgaggcacagca

SEQ ID NO: 109171 - DNA, 25 bp, Rattus norvegicus
agacccagggtcgtgaggcacagca

SEQ ID NO: 109172 - DNA, 25 bp, Rattus norvegicus
agacccagggtctctttggagagac

SEQ ID NO: 109173 - DNA, 25 bp, Rattus norvegicus
agacccaggtagatataggcactta

SEQ ID NO: 109174 - DNA, 25 bp, Rattus norvegicus
agacccaggtagttataggcactta

SEQ ID NO: 109175 - DNA, 25 bp, Rattus norvegicus
agacccagtgcccatgtcagaagac

SEQ ID NO: 109176 - DNA, 25 bp, Rattus norvegicus
agacccagtgccgatgtcagaagac

SEQ ID NO: 109177 - DNA, 25 bp, Rattus norvegicus
agacccatatagaagcatgccctct

SEQ ID NO: 109178 - DNA, 25 bp, Rattus norvegicus
agacccatatagtagcatgccctct

SEQ ID NO: 109179 - DNA, 25 bp, Rattus norvegicus
agacccatctaaagttcctcaaagc

SEQ ID NO: 109180 - DNA, 25 bp, Rattus norvegicus
agacccatctaatgttcctcaaagc

SEQ ID NO: 109181 - DNA, 25 bp, Rattus norvegicus
agacccatctctatgagaaccactt

SEQ ID NO: 109182 - DNA, 25 bp, Rattus norvegicus
agacccatctctttgagaaccactt

SEQ ID NO: 109183 - DNA, 25 bp, Rattus norvegicus
agacccatctgcacaaacacagaca

SEQ ID NO: 109184 - DNA, 25 bp, Rattus norvegicus
agacccatctgctcaaacacagaca

SEQ ID NO: 109185 - DNA, 25 bp, Rattus norvegicus
agacccatgactctgtgtgcactta

SEQ ID NO: 109186 - DNA, 25 bp, Rattus norvegicus
agacccatgactgtgtgtgcactta

SEQ ID NO: 109187 - DNA, 25 bp, Rattus norvegicus
agacccatgggtatcattcaggaac

SEQ ID NO: 109188 - DNA, 25 bp, Rattus norvegicus
agacccatgggtttcattcaggaac

SEQ ID NO: 109189 - DNA, 25 bp, Rattus norvegicus
agacccattctacggcccctggtat

SEQ ID NO: 109190 - DNA, 25 bp, Rattus norvegicus
agacccattctagggcccctggtat

SEQ ID NO: 109191 - DNA, 25 bp, Rattus norvegicus
agacccatttccagtccagtgttag

SEQ ID NO: 109192 - DNA, 25 bp, Rattus norvegicus
agacccatttcctgtccagtgttag

SEQ ID NO: 109193 - DNA, 25 bp, Rattus norvegicus
agaccccaacatccttggcaggact

SEQ ID NO: 109194 - DNA, 25 bp, Rattus norvegicus
agaccccaacatgcttggcaggact

SEQ ID NO: 109195 - DNA, 25 bp, Rattus norvegicus
agaccccaactcatatcctgtatgg

SEQ ID NO: 109196 - DNA, 25 bp, Rattus norvegicus
agaccccaactcttatcctgtatgg

SEQ ID NO: 109197 - DNA, 25 bp, Rattus norvegicus
agaccccaatatcctgagcctgagt

SEQ ID NO: 109198 - DNA, 25 bp, Rattus norvegicus
agaccccaatatgctgagcctgagt

SEQ ID NO: 109199 - DNA, 25 bp, Rattus norvegicus
agaccccaatgtactgtattccaga

SEQ ID NO: 109200 - DNA, 25 bp, Rattus norvegicus
agaccccaatgtcaatgtggcctcc

SEQ ID NO: 109201 - DNA, 25 bp, Rattus norvegicus
agaccccaatgtgaatgtggcctcc

SEQ ID NO: 109202 - DNA, 25 bp, Rattus norvegicus
agaccccaatgttctgtattccaga

SEQ ID NO: 109203 - DNA, 25 bp, Rattus norvegicus
agaccccacaagacccttatagagg

SEQ ID NO: 109204 - DNA, 25 bp, Rattus norvegicus
agaccccacaagtcccttatagagg

SEQ ID NO: 109205 - DNA, 25 bp, Rattus norvegicus
agaccccacacaccattgagtgtct

SEQ ID NO: 109206 - DNA, 25 bp, Rattus norvegicus
agaccccacacagcattgagtgtct

SEQ ID NO: 109207 - DNA, 25 bp, Rattus norvegicus
agaccccacaggaaacagttgaatt

SEQ ID NO: 109208 - DNA, 25 bp, Rattus norvegicus
agaccccacaggtaacagttgaatt

SEQ ID NO: 109209 - DNA, 25 bp, Rattus norvegicus
agaccccagcaactaccaggacgaa

SEQ ID NO: 109210 - DNA, 25 bp, Rattus norvegicus
agaccccagcaagtaccaggacgaa

SEQ ID NO: 109211 - DNA, 25 bp, Rattus norvegicus
agaccccaggttattaaatgccatg

SEQ ID NO: 109212 - DNA, 25 bp, Rattus norvegicus
agaccccaggtttttaaatgccatg

SEQ ID NO: 109213 - DNA, 25 bp, Rattus norvegicus
agaccccagtgaagagagccccaga

SEQ ID NO: 109214 - DNA, 25 bp, Rattus norvegicus
agaccccagtgatgagagccccaga

SEQ ID NO: 109215 - DNA, 25 bp, Rattus norvegicus
agacccccttctattgcagaatgtg

SEQ ID NO: 109216 - DNA, 25 bp, Rattus norvegicus
agacccccttcttttgcagaatgtg

SEQ ID NO: 109217 - DNA, 25 bp, Rattus norvegicus
agaccccgagtcagcccaaaagaag

SEQ ID NO: 109218 - DNA, 25 bp, Rattus norvegicus
agaccccgagtctgcccaaaagaag

SEQ ID NO: 109219 - DNA, 25 bp, Rattus norvegicus
agaccccgccacactgtagtggtaa

SEQ ID NO: 109220 - DNA, 25 bp, Rattus norvegicus
agaccccgccactctgtagtggtaa

SEQ ID NO: 109221 - DNA, 25 bp, Rattus norvegicus
agaccccgcttcaataatgttcaac

SEQ ID NO: 109222 - DNA, 25 bp, Rattus norvegicus
agaccccgcttctataatgttcaac

SEQ ID NO: 109223 - DNA, 25 bp, Rattus norvegicus
agacccctactaagagctgcctgaa

SEQ ID NO: 109224 - DNA, 25 bp, Rattus norvegicus
agacccctactatgagctgcctgaa

SEQ ID NO: 109225 - DNA, 25 bp, Rattus norvegicus
agacccctatgtctcagtgttgctg

SEQ ID NO: 109226 - DNA, 25 bp, Rattus norvegicus
agacccctatgtgtcagtgttgctg

SEQ ID NO: 109227 - DNA, 25 bp, Rattus norvegicus
agacccctctctcctattaaaatta

SEQ ID NO: 109228 - DNA, 25 bp, Rattus norvegicus
agacccctctctgctattaaaatta

SEQ ID NO: 109229 - DNA, 25 bp, Rattus norvegicus
agacccctctgacctgacataaggt

SEQ ID NO: 109230 - DNA, 25 bp, Rattus norvegicus
agacccctctgagctgacataaggt

SEQ ID NO: 109231 - DNA, 25 bp, Rattus norvegicus
agacccctctgcaagtttaagctct

SEQ ID NO: 109232 - DNA, 25 bp, Rattus norvegicus
agacccctctgctagtttaagctct

SEQ ID NO: 109233 - DNA, 25 bp, Rattus norvegicus
agacccctgacgaggtgtttgcaag

SEQ ID NO: 109234 - DNA, 25 bp, Rattus norvegicus
agacccctgacgtggtgtttgcaag

SEQ ID NO: 109235 - DNA, 25 bp, Rattus norvegicus
agacccctgcaaatctgtacacata

SEQ ID NO: 109236 - DNA, 25 bp, Rattus norvegicus
agacccctgcaattctgtacacata

SEQ ID NO: 109237 - DNA, 25 bp, Rattus norvegicus
agacccctgcatcagtaccacatat

SEQ ID NO: 109238 - DNA, 25 bp, Rattus norvegicus
agacccctgcatgagtaccacatat

SEQ ID NO: 109239 - DNA, 25 bp, Rattus norvegicus
agacccctgcccagtggagagagaa

SEQ ID NO: 109240 - DNA, 25 bp, Rattus norvegicus
agacccctgccctgtggagagagaa

SEQ ID NO: 109241 - DNA, 25 bp, Rattus norvegicus
agacccctgcggaagtctcgcgagg

SEQ ID NO: 109242 - DNA, 25 bp, Rattus norvegicus
agacccctgcggtagtctcgcgagg

SEQ ID NO: 109243 - DNA, 25 bp, Rattus norvegicus
agacccctgggccacagaatgtatt

SEQ ID NO: 109244 - DNA, 25 bp, Rattus norvegicus
agacccctgggcgacagaatgtatt

SEQ ID NO: 109245 - DNA, 25 bp, Rattus norvegicus
agaccccttaggagagaatcctggt

SEQ ID NO: 109246 - DNA, 25 bp, Rattus norvegicus
agaccccttaggtgagaatcctggt

SEQ ID NO: 109247 - DNA, 25 bp, Rattus norvegicus
agaccccttcagacactgagggagt

SEQ ID NO: 109248 - DNA, 25 bp, Rattus norvegicus
agaccccttcagtcactgagggagt

SEQ ID NO: 109249 - DNA, 25 bp, Rattus norvegicus
agaccccttctgacactgtatatgt

SEQ ID NO: 109250 - DNA, 25 bp, Rattus norvegicus
agaccccttctgtcactgtatatgt

SEQ ID NO: 109251 - DNA, 25 bp, Rattus norvegicus
agaccccttggacatactggctaca

SEQ ID NO: 109252 - DNA, 25 bp, Rattus norvegicus
agaccccttggagatactggctaca

SEQ ID NO: 109253 - DNA, 25 bp, Rattus norvegicus
agacccctttgtattgtaatgatga

SEQ ID NO: 109254 - DNA, 25 bp, Rattus norvegicus
agacccctttgttttgtaatgatga

SEQ ID NO: 109255 - DNA, 25 bp, Rattus norvegicus
agacccgagagcacttactgctagc

SEQ ID NO: 109256 - DNA, 25 bp, Rattus norvegicus
agacccgagagctcttactgctagc

SEQ ID NO: 109257 - DNA, 25 bp, Rattus norvegicus
agacccgaggcaactttgagaccaa

SEQ ID NO: 109258 - DNA, 25 bp, Rattus norvegicus
agacccgaggcatctttgagaccaa

SEQ ID NO: 109259 - DNA, 25 bp, Rattus norvegicus
agacccgaggcgagtactgactgac

SEQ ID NO: 109260 - DNA, 25 bp, Rattus norvegicus
agacccgaggcgtgtactgactgac

SEQ ID NO: 109261 - DNA, 25 bp, Rattus norvegicus
agacccgcattactgtgctttcttt

SEQ ID NO: 109262 - DNA, 25 bp, Rattus norvegicus
agacccgcattagtgtgctttcttt

SEQ ID NO: 109263 - DNA, 25 bp, Rattus norvegicus
agacccgccagcagacagactgttg

SEQ ID NO: 109264 - DNA, 25 bp, Rattus norvegicus
agacccgccagctgacagactgttg

SEQ ID NO: 109265 - DNA, 25 bp, Rattus norvegicus
agacccgcccttagattggaaatca

SEQ ID NO: 109266 - DNA, 25 bp, Rattus norvegicus
agacccgccctttgattggaaatca

SEQ ID NO: 109267 - DNA, 25 bp, Rattus norvegicus
agacccgcctgaagctatacaagca

SEQ ID NO: 109268 - DNA, 25 bp, Rattus norvegicus
agacccgcctgatgctatacaagca

SEQ ID NO: 109269 - DNA, 25 bp, Rattus norvegicus
agacccgcgagcactcggtgcagtg

SEQ ID NO: 109270 - DNA, 25 bp, Rattus norvegicus
agacccgcgagctctcggtgcagtg

SEQ ID NO: 109271 - DNA, 25 bp, Rattus norvegicus
agacccgctgctcagtagagcctgt

SEQ ID NO: 109272 - DNA, 25 bp, Rattus norvegicus
agacccgctgctgagtagagcctgt

SEQ ID NO: 109273 - DNA, 25 bp, Rattus norvegicus
agacccgctttaattaagcttatca

SEQ ID NO: 109274 - DNA, 25 bp, Rattus norvegicus
agacccgctttatttaagcttatca

SEQ ID NO: 109275 - DNA, 25 bp, Rattus norvegicus
agacccggaacgagctcatcagatg

SEQ ID NO: 109276 - DNA, 25 bp, Rattus norvegicus
agacccggaacgtgctcatcagatg

SEQ ID NO: 109277 - DNA, 25 bp, Rattus norvegicus
agacccggaatgacacagagcctca

SEQ ID NO: 109278 - DNA, 25 bp, Rattus norvegicus
agacccggaatgtcacagagcctca

SEQ ID NO: 109279 - DNA, 25 bp, Rattus norvegicus
agacccggctctcataaaggagata

SEQ ID NO: 109280 - DNA, 25 bp, Rattus norvegicus
agacccggctctgataaaggagata

SEQ ID NO: 109281 - DNA, 25 bp, Rattus norvegicus
agacccgggaaaccgtcagcattga

SEQ ID NO: 109282 - DNA, 25 bp, Rattus norvegicus
agacccgggaaagcgtcagcattga

SEQ ID NO: 109283 - DNA, 25 bp, Rattus norvegicus
agacccgggaacacaagctcaagta

SEQ ID NO: 109284 - DNA, 25 bp, Rattus norvegicus
agacccgggaactcaagctcaagta

SEQ ID NO: 109285 - DNA, 25 bp, Rattus norvegicus
agacccggtggccactctgtgagaa

SEQ ID NO: 109286 - DNA, 25 bp, Rattus norvegicus
agacccggtggcgactctgtgagaa

SEQ ID NO: 109287 - DNA, 25 bp, Rattus norvegicus
agacccggtggtcccgagctacgca

SEQ ID NO: 109288 - DNA, 25 bp, Rattus norvegicus
agacccggtggtgccgagctacgca

SEQ ID NO: 109289 - DNA, 25 bp, Rattus norvegicus
agacccgtcagcaagcaaggccaag

SEQ ID NO: 109290 - DNA, 25 bp, Rattus norvegicus
agacccgtcagctagcaaggccaag

SEQ ID NO: 109291 - DNA, 25 bp, Rattus norvegicus
agacccgtgactccgagttcggacg

SEQ ID NO: 109292 - DNA, 25 bp, Rattus norvegicus
agacccgtgactgcgagttcggacg

SEQ ID NO: 109293 - DNA, 25 bp, Rattus norvegicus
agacccgtgaggctcgacatgacag

SEQ ID NO: 109294 - DNA, 25 bp, Rattus norvegicus
agacccgtgagggtcgacatgacag

SEQ ID NO: 109295 - DNA, 25 bp, Rattus norvegicus
agacccgtgccaaactgtaaaggac

SEQ ID NO: 109296 - DNA, 25 bp, Rattus norvegicus
agacccgtgccatactgtaaaggac

SEQ ID NO: 109297 - DNA, 25 bp, Rattus norvegicus
agacccgttctacgagatgcttgca

SEQ ID NO: 109298 - DNA, 25 bp, Rattus norvegicus
agacccgttctaggagatgcttgca

SEQ ID NO: 109299 - DNA, 25 bp, Rattus norvegicus
agacccgtttgacctatttcttgca

SEQ ID NO: 109300 - DNA, 25 bp, Rattus norvegicus
agacccgtttgagctatttcttgca

SEQ ID NO: 109301 - DNA, 25 bp, Rattus norvegicus
agaccctaatctatcattcacagca

SEQ ID NO: 109302 - DNA, 25 bp, Rattus norvegicus
agaccctaatctttcattcacagca

SEQ ID NO: 109303 - DNA, 25 bp, Rattus norvegicus
agaccctacgggagaggcggcagac

SEQ ID NO: 109304 - DNA, 25 bp, Rattus norvegicus
agaccctacgggtgaggcggcagac

SEQ ID NO: 109305 - DNA, 25 bp, Rattus norvegicus
agaccctagggactggctgcattgc

SEQ ID NO: 109306 - DNA, 25 bp, Rattus norvegicus
agaccctagggagtggctgcattgc

SEQ ID NO: 109307 - DNA, 25 bp, Rattus norvegicus
agaccctagtgaatttacagctgta

SEQ ID NO: 109308 - DNA, 25 bp, Rattus norvegicus
agaccctagtgattttacagctgta

SEQ ID NO: 109309 - DNA, 25 bp, Rattus norvegicus
agaccctagtgtatactttctccag

SEQ ID NO: 109310 - DNA, 25 bp, Rattus norvegicus
agaccctagtgtttactttctccag

SEQ ID NO: 109311 - DNA, 25 bp, Rattus norvegicus
agaccctcagctacagggaggctgt

SEQ ID NO: 109312 - DNA, 25 bp, Rattus norvegicus
agaccctcagcttcagggaggctgt

SEQ ID NO: 109313 - DNA, 25 bp, Rattus norvegicus
agaccctcagtcattaactctacga

SEQ ID NO: 109314 - DNA, 25 bp, Rattus norvegicus
agaccctcagtctttaactctacga

SEQ ID NO: 109315 - DNA, 25 bp, Rattus norvegicus
agaccctcagtgattctaacgtgct

SEQ ID NO: 109316 - DNA, 25 bp, Rattus norvegicus
agaccctcagtgtttctaacgtgct

SEQ ID NO: 109317 - DNA, 25 bp, Rattus norvegicus
agaccctcattcactgggcatctgt

SEQ ID NO: 109318 - DNA, 25 bp, Rattus norvegicus
agaccctcattctctgggcatctgt

SEQ ID NO: 109319 - DNA, 25 bp, Rattus norvegicus
agaccctccaaaatgttaagtgcca

SEQ ID NO: 109320 - DNA, 25 bp, Rattus norvegicus
agaccctccaaattgttaagtgcca

SEQ ID NO: 109321 - DNA, 25 bp, Rattus norvegicus
agaccctccatcaaagtgtccaaag

SEQ ID NO: 109322 - DNA, 25 bp, Rattus norvegicus
agaccctccatctaagtgtccaaag

SEQ ID NO: 109323 - DNA, 25 bp, Rattus norvegicus
agaccctccgcaactgtgtggtcag

SEQ ID NO: 109324 - DNA, 25 bp, Rattus norvegicus
agaccctccgcatctgtgtggtcag

SEQ ID NO: 109325 - DNA, 25 bp, Rattus norvegicus
agaccctccttcagaagaacttcaa

SEQ ID NO: 109326 - DNA, 25 bp, Rattus norvegicus
agaccctccttctgaagaacttcaa

SEQ ID NO: 109327 - DNA, 25 bp, Rattus norvegicus
agaccctcggttactgttcagactt

SEQ ID NO: 109328 - DNA, 25 bp, Rattus norvegicus
agaccctcggtttctgttcagactt

SEQ ID NO: 109329 - DNA, 25 bp, Rattus norvegicus
agaccctcttgaaatcagtgtgccc

SEQ ID NO: 109330 - DNA, 25 bp, Rattus norvegicus
agaccctcttgaagcggagactcag

SEQ ID NO: 109331 - DNA, 25 bp, Rattus norvegicus
agaccctcttgacccaaagtatggt

SEQ ID NO: 109332 - DNA, 25 bp, Rattus norvegicus
agaccctcttgagccaaagtatggt

SEQ ID NO: 109333 - DNA, 25 bp, Rattus norvegicus
agaccctcttgatatcagtgtgccc

SEQ ID NO: 109334 - DNA, 25 bp, Rattus norvegicus
agaccctcttgatgcggagactcag

SEQ ID NO: 109335 - DNA, 25 bp, Rattus norvegicus
agaccctgaagacatctgtttccca

SEQ ID NO: 109336 - DNA, 25 bp, Rattus norvegicus
agaccctgaagagatctgtttccca

SEQ ID NO: 109337 - DNA, 25 bp, Rattus norvegicus
agaccctgaagcctgagcaaagcca

SEQ ID NO: 109338 - DNA, 25 bp, Rattus norvegicus
agaccctgaagcgtgagcaaagcca

SEQ ID NO: 109339 - DNA, 25 bp, Rattus norvegicus
agaccctgaaggaggctcactttca

SEQ ID NO: 109340 - DNA, 25 bp, Rattus norvegicus
agaccctgaaggtggctcactttca

SEQ ID NO: 109341 - DNA, 25 bp, Rattus norvegicus
agaccctgacctacaatgccaagaa

SEQ ID NO: 109342 - DNA, 25 bp, Rattus norvegicus
agaccctgaccttcaatgccaagaa

SEQ ID NO: 109343 - DNA, 25 bp, Rattus norvegicus
agaccctgagagcagctagacttct

SEQ ID NO: 109344 - DNA, 25 bp, Rattus norvegicus
agaccctgagaggagctagacttct

SEQ ID NO: 109345 - DNA, 25 bp, Rattus norvegicus
agaccctgaggccttattccagaag

SEQ ID NO: 109346 - DNA, 25 bp, Rattus norvegicus
agaccctgaggcgttattccagaag

SEQ ID NO: 109347 - DNA, 25 bp, Rattus norvegicus
agaccctgagttctttctactcatc

SEQ ID NO: 109348 - DNA, 25 bp, Rattus norvegicus
agaccctgagttgtttctactcatc

SEQ ID NO: 109349 - DNA, 25 bp, Rattus norvegicus
agaccctgatacagaagctgctttg

SEQ ID NO: 109350 - DNA, 25 bp, Rattus norvegicus
agaccctgatactgaagctgctttg

SEQ ID NO: 109351 - DNA, 25 bp, Rattus norvegicus
agaccctgatatcatgctgcttctc

SEQ ID NO: 109352 - DNA, 25 bp, Rattus norvegicus
agaccctgatatgatgctgcttctc

SEQ ID NO: 109353 - DNA, 25 bp, Rattus norvegicus
agaccctgcctaagtctctgaagac

SEQ ID NO: 109354 - DNA, 25 bp, Rattus norvegicus
agaccctgcctatgtctctgaagac

SEQ ID NO: 109355 - DNA, 25 bp, Rattus norvegicus
agaccctgcctcagagttgggaaac

SEQ ID NO: 109356 - DNA, 25 bp, Rattus norvegicus
agaccctgcctctgagttgggaaac

SEQ ID NO: 109357 - DNA, 25 bp, Rattus norvegicus
agaccctgcggtagcttgaataaga

SEQ ID NO: 109358 - DNA, 25 bp, Rattus norvegicus
agaccctgcggttgcttgaataaga

SEQ ID NO: 109359 - DNA, 25 bp, Rattus norvegicus
agaccctgcgttatatcatggccat

SEQ ID NO: 109360 - DNA, 25 bp, Rattus norvegicus
agaccctgcgttttatcatggccat

SEQ ID NO: 109361 - DNA, 25 bp, Rattus norvegicus
agaccctgctaactcctgaggaatt

SEQ ID NO: 109362 - DNA, 25 bp, Rattus norvegicus
agaccctgctaagtcctgaggaatt

SEQ ID NO: 109363 - DNA, 25 bp, Rattus norvegicus
agaccctgctctcttgtgttgagaa

SEQ ID NO: 109364 - DNA, 25 bp, Rattus norvegicus
agaccctgctctgttgtgttgagaa

SEQ ID NO: 109365 - DNA, 25 bp, Rattus norvegicus
agaccctgctggactgagaaaccca

SEQ ID NO: 109366 - DNA, 25 bp, Rattus norvegicus
agaccctgctggtctgagaaaccca

SEQ ID NO: 109367 - DNA, 25 bp, Rattus norvegicus
agaccctggactccatcataaagac

SEQ ID NO: 109368 - DNA, 25 bp, Rattus norvegicus
agaccctggactgcatcataaagac

SEQ ID NO: 109369 - DNA, 25 bp, Rattus norvegicus
agaccctggagcagaggccacgatg

SEQ ID NO: 109370 - DNA, 25 bp, Rattus norvegicus
agaccctggagctgaggccacgatg

SEQ ID NO: 109371 - DNA, 25 bp, Rattus norvegicus
agaccctggaggatgccttcaaaaa

SEQ ID NO: 109372 - DNA, 25 bp, Rattus norvegicus
agaccctggaggttgccttcaaaaa

SEQ ID NO: 109373 - DNA, 25 bp, Rattus norvegicus
agaccctggcacaccatttggagag

SEQ ID NO: 109374 - DNA, 25 bp, Rattus norvegicus
agaccctggcactccatttggagag

SEQ ID NO: 109375 - DNA, 25 bp, Rattus norvegicus
agaccctggctgcagctgacttttt

SEQ ID NO: 109376 - DNA, 25 bp, Rattus norvegicus
agaccctggctggagctgacttttt

SEQ ID NO: 109377 - DNA, 25 bp, Rattus norvegicus
agaccctgggagactctgatctact

SEQ ID NO: 109378 - DNA, 25 bp, Rattus norvegicus
agaccctgggagtctctgatctact

SEQ ID NO: 109379 - DNA, 25 bp, Rattus norvegicus
agaccctgggtcaagtccccagtgg

SEQ ID NO: 109380 - DNA, 25 bp, Rattus norvegicus
agaccctgggtctagtccccagtgg

SEQ ID NO: 109381 - DNA, 25 bp, Rattus norvegicus
agaccctggtatacctaagacctgg

SEQ ID NO: 109382 - DNA, 25 bp, Rattus norvegicus
agaccctggtattcctaagacctgg

SEQ ID NO: 109383 - DNA, 25 bp, Rattus norvegicus
agaccctggtgaagaactgcattgt

SEQ ID NO: 109384 - DNA, 25 bp, Rattus norvegicus
agaccctggtgatgaactgcattgt

SEQ ID NO: 109385 - DNA, 25 bp, Rattus norvegicus
agaccctgtagcagatctgctggac

SEQ ID NO: 109386 - DNA, 25 bp, Rattus norvegicus
agaccctgtagctgatctgctggac

SEQ ID NO: 109387 - DNA, 25 bp, Rattus norvegicus
agaccctgtatcctccgtggaacgg

SEQ ID NO: 109388 - DNA, 25 bp, Rattus norvegicus
agaccctgtatcgtccgtggaacgg

SEQ ID NO: 109389 - DNA, 25 bp, Rattus norvegicus
agaccctgtatgaataggtgagcac

SEQ ID NO: 109390 - DNA, 25 bp, Rattus norvegicus
agaccctgtatgtataggtgagcac

SEQ ID NO: 109391 - DNA, 25 bp, Rattus norvegicus
agaccctgtcacattcgctcaagat

SEQ ID NO: 109392 - DNA, 25 bp, Rattus norvegicus
agaccctgtcaccaagagcacttta

SEQ ID NO: 109393 - DNA, 25 bp, Rattus norvegicus
agaccctgtcacgaagagcacttta

SEQ ID NO: 109394 - DNA, 25 bp, Rattus norvegicus
agaccctgtcactttcgctcaagat

SEQ ID NO: 109395 - DNA, 25 bp, Rattus norvegicus
agaccctgtcccctaagaaggtgat

SEQ ID NO: 109396 - DNA, 25 bp, Rattus norvegicus
agaccctgtcccgtaagaaggtgat

SEQ ID NO: 109397 - DNA, 25 bp, Rattus norvegicus
agaccctgtgctattctcaggtgcg

SEQ ID NO: 109398 - DNA, 25 bp, Rattus norvegicus
agaccctgtgcttttctcaggtgcg

SEQ ID NO: 109399 - DNA, 25 bp, Rattus norvegicus
agaccctgtggacgaaaccttggct

SEQ ID NO: 109400 - DNA, 25 bp, Rattus norvegicus
agaccctgtggaggaaaccttggct

SEQ ID NO: 109401 - DNA, 25 bp, Rattus norvegicus
agaccctgtggcattgggttgcagc

SEQ ID NO: 109402 - DNA, 25 bp, Rattus norvegicus
agaccctgtggctttgggttgcagc

SEQ ID NO: 109403 - DNA, 25 bp, Rattus norvegicus
agaccctgtgggattgtgcagactg

SEQ ID NO: 109404 - DNA, 25 bp, Rattus norvegicus
agaccctgtgggtttgtgcagactg

SEQ ID NO: 109405 - DNA, 25 bp, Rattus norvegicus
agaccctgtggtaaattctgtgccc

SEQ ID NO: 109406 - DNA, 25 bp, Rattus norvegicus
agaccctgtggttaattctgtgccc

SEQ ID NO: 109407 - DNA, 25 bp, Rattus norvegicus
agaccctgtgtaatctgtgttctca

SEQ ID NO: 109408 - DNA, 25 bp, Rattus norvegicus
agaccctgtgtattctgtgttctca

SEQ ID NO: 109409 - DNA, 25 bp, Rattus norvegicus
agaccctgttccagcgcttgcgagc

SEQ ID NO: 109410 - DNA, 25 bp, Rattus norvegicus
agaccctgttcctgcgcttgcgagc

SEQ ID NO: 109411 - DNA, 25 bp, Rattus norvegicus
agaccctgttggaattacggtattg

SEQ ID NO: 109412 - DNA, 25 bp, Rattus norvegicus
agaccctgttggtattacggtattg

SEQ ID NO: 109413 - DNA, 25 bp, Rattus norvegicus
agaccctgtttcatctcttgattat

SEQ ID NO: 109414 - DNA, 25 bp, Rattus norvegicus
agaccctgtttcttctcttgattat

SEQ ID NO: 109415 - DNA, 25 bp, Rattus norvegicus
agacccttagctcattaatgggcag

SEQ ID NO: 109416 - DNA, 25 bp, Rattus norvegicus
agacccttagctctggaaccattaa

SEQ ID NO: 109417 - DNA, 25 bp, Rattus norvegicus
agacccttagctgattaatgggcag

SEQ ID NO: 109418 - DNA, 25 bp, Rattus norvegicus
agacccttagctgtggaaccattaa

SEQ ID NO: 109419 - DNA, 25 bp, Rattus norvegicus
agacccttatgcaagcttcttagat

SEQ ID NO: 109420 - DNA, 25 bp, Rattus norvegicus
agacccttatgctagcttcttagat

SEQ ID NO: 109421 - DNA, 25 bp, Rattus norvegicus
agacccttcatcaatccttggagta

SEQ ID NO: 109422 - DNA, 25 bp, Rattus norvegicus
agacccttcatctatccttggagta

SEQ ID NO: 109423 - DNA, 25 bp, Rattus norvegicus
agacccttcgtgcaggaggctaagc

SEQ ID NO: 109424 - DNA, 25 bp, Rattus norvegicus
agacccttcgtggaggaggctaagc

SEQ ID NO: 109425 - DNA, 25 bp, Rattus norvegicus
agacccttctaaacatgtgctgact

SEQ ID NO: 109426 - DNA, 25 bp, Rattus norvegicus
agacccttctaatcatgtgctgact

SEQ ID NO: 109427 - DNA, 25 bp, Rattus norvegicus
agacccttgatacatttcctgcaca

SEQ ID NO: 109428 - DNA, 25 bp, Rattus norvegicus
agacccttgatagatttcctgcaca

SEQ ID NO: 109429 - DNA, 25 bp, Rattus norvegicus
agacccttgattaggcttgaattgg

SEQ ID NO: 109430 - DNA, 25 bp, Rattus norvegicus
agacccttgatttggcttgaattgg

SEQ ID NO: 109431 - DNA, 25 bp, Rattus norvegicus
agacccttggcaatgggctccagtt

SEQ ID NO: 109432 - DNA, 25 bp, Rattus norvegicus
agacccttggcattgggctccagtt

SEQ ID NO: 109433 - DNA, 25 bp, Rattus norvegicus
agacccttggttcgcatgtatcaga

SEQ ID NO: 109434 - DNA, 25 bp, Rattus norvegicus
agacccttggttggcatgtatcaga

SEQ ID NO: 109435 - DNA, 25 bp, Rattus norvegicus
agaccctttcgtctgagagcttatc

SEQ ID NO: 109436 - DNA, 25 bp, Rattus norvegicus
agaccctttcgtgtgagagcttatc

SEQ ID NO: 109437 - DNA, 25 bp, Rattus norvegicus
agaccctttctcacggatatccaga

SEQ ID NO: 109438 - DNA, 25 bp, Rattus norvegicus
agaccctttctctcggatatccaga

SEQ ID NO: 109439 - DNA, 25 bp, Rattus norvegicus
agacccttttctacctggaatgctt

SEQ ID NO: 109440 - DNA, 25 bp, Rattus norvegicus
agacccttttcttcctggaatgctt

SEQ ID NO: 109441 - DNA, 25 bp, Rattus norvegicus
agaccgaactccatagcacgatgac

SEQ ID NO: 109442 - DNA, 25 bp, Rattus norvegicus
agaccgaactccttagcacgatgac

SEQ ID NO: 109443 - DNA, 25 bp, Rattus norvegicus
agaccgaagctgcaactcactgcag

SEQ ID NO: 109444 - DNA, 25 bp, Rattus norvegicus
agaccgaagctggaactcactgcag

SEQ ID NO: 109445 - DNA, 25 bp, Rattus norvegicus
agaccgaagggaactcaatgtagat

SEQ ID NO: 109446 - DNA, 25 bp, Rattus norvegicus
agaccgaagggatctcaatgtagat

SEQ ID NO: 109447 - DNA, 25 bp, Rattus norvegicus
agaccgaatctcacgttatctcagg

SEQ ID NO: 109448 - DNA, 25 bp, Rattus norvegicus
agaccgaatctctcgttatctcagg

SEQ ID NO: 109449 - DNA, 25 bp, Rattus norvegicus
agaccgaatggacctccaagacctc

SEQ ID NO: 109450 - DNA, 25 bp, Rattus norvegicus
agaccgaatggagctccaagacctc

SEQ ID NO: 109451 - DNA, 25 bp, Rattus norvegicus
agaccgacagccatgtgattcagac

SEQ ID NO: 109452 - DNA, 25 bp, Rattus norvegicus
agaccgacagccttgtgattcagac

SEQ ID NO: 109453 - DNA, 25 bp, Rattus norvegicus
agaccgacccgccatatgcaggatg

SEQ ID NO: 109454 - DNA, 25 bp, Rattus norvegicus
agaccgacccgcgatatgcaggatg

SEQ ID NO: 109455 - DNA, 25 bp, Rattus norvegicus
agaccgacctcaatttcttctggga

SEQ ID NO: 109456 - DNA, 25 bp, Rattus norvegicus
agaccgacctcattttcttctggga

SEQ ID NO: 109457 - DNA, 25 bp, Rattus norvegicus
agaccgactccgagcctgagccgga

SEQ ID NO: 109458 - DNA, 25 bp, Rattus norvegicus
agaccgactccgtgcctgagccgga

SEQ ID NO: 109459 - DNA, 25 bp, Rattus norvegicus
agaccgagcaccagggagcgcttct

SEQ ID NO: 109460 - DNA, 25 bp, Rattus norvegicus
agaccgagcacctgggagcgcttct

SEQ ID NO: 109461 - DNA, 25 bp, Rattus norvegicus
agaccgagccctcagatgaccagat

SEQ ID NO: 109462 - DNA, 25 bp, Rattus norvegicus
agaccgagccctgagatgaccagat

SEQ ID NO: 109463 - DNA, 25 bp, Rattus norvegicus
agaccgaggaacatgcttcatctcc

SEQ ID NO: 109464 - DNA, 25 bp, Rattus norvegicus
agaccgaggaacttgcttcatctcc

SEQ ID NO: 109465 - DNA, 25 bp, Rattus norvegicus
agaccgagggcccagtgtacactaa

SEQ ID NO: 109466 - DNA, 25 bp, Rattus norvegicus
agaccgagggccgagtgtacactaa

SEQ ID NO: 109467 - DNA, 25 bp, Rattus norvegicus
agaccgaggtcaagaagaacaccct

SEQ ID NO: 109468 - DNA, 25 bp, Rattus norvegicus
agaccgaggtcatgaagaacaccct

SEQ ID NO: 109469 - DNA, 25 bp, Rattus norvegicus
agaccgatatgacagcctgggctcg

SEQ ID NO: 109470 - DNA, 25 bp, Rattus norvegicus
agaccgatatgagagcctgggctcg

SEQ ID NO: 109471 - DNA, 25 bp, Rattus norvegicus
agaccgcaactgcatgccttgtcga

SEQ ID NO: 109472 - DNA, 25 bp, Rattus norvegicus
agaccgcaactggatgccttgtcga

SEQ ID NO: 109473 - DNA, 25 bp, Rattus norvegicus
agaccgcaccggagtgactgctgca

SEQ ID NO: 109474 - DNA, 25 bp, Rattus norvegicus
agaccgcaccggtgtgactgctgca

SEQ ID NO: 109475 - DNA, 25 bp, Rattus norvegicus
agaccgcagcctctttgtccaggag

SEQ ID NO: 109476 - DNA, 25 bp, Rattus norvegicus
agaccgcagcctgtttgtccaggag

SEQ ID NO: 109477 - DNA, 25 bp, Rattus norvegicus
agaccgccactaacaaaactgctta

SEQ ID NO: 109478 - DNA, 25 bp, Rattus norvegicus
agaccgccactatcaaaactgctta

SEQ ID NO: 109479 - DNA, 25 bp, Rattus norvegicus
agaccgccatgccttgctaggagca

SEQ ID NO: 109480 - DNA, 25 bp, Rattus norvegicus
agaccgccatgcgttgctaggagca

SEQ ID NO: 109481 - DNA, 25 bp, Rattus norvegicus
agaccgcctggccaacgaaattgtg

SEQ ID NO: 109482 - DNA, 25 bp, Rattus norvegicus
agaccgcctggcgaacgaaattgtg

SEQ ID NO: 109483 - DNA, 25 bp, Rattus norvegicus
agaccgcctgggaataccgggtgct

SEQ ID NO: 109484 - DNA, 25 bp, Rattus norvegicus
agaccgcctgggtataccgggtgct

SEQ ID NO: 109485 - DNA, 25 bp, Rattus norvegicus
agaccgccttggcaaaagacaggac

SEQ ID NO: 109486 - DNA, 25 bp, Rattus norvegicus
agaccgccttgggaaaagacaggac

SEQ ID NO: 109487 - DNA, 25 bp, Rattus norvegicus
agaccgcgaagaagcgtcgacaaac

SEQ ID NO: 109488 - DNA, 25 bp, Rattus norvegicus
agaccgcgaagatgcgtcgacaaac

SEQ ID NO: 109489 - DNA, 25 bp, Rattus norvegicus
agaccgctaaggaatctgtccagct

SEQ ID NO: 109490 - DNA, 25 bp, Rattus norvegicus
agaccgctaaggtatctgtccagct

SEQ ID NO: 109491 - DNA, 25 bp, Rattus norvegicus
agaccgctaggaagtccaccggagg

SEQ ID NO: 109492 - DNA, 25 bp, Rattus norvegicus
agaccgctaggatgtccaccggagg

SEQ ID NO: 109493 - DNA, 25 bp, Rattus norvegicus
agaccggaacagacccatgacatgt

SEQ ID NO: 109494 - DNA, 25 bp, Rattus norvegicus
agaccggaacagtcccatgacatgt

SEQ ID NO: 109495 - DNA, 25 bp, Rattus norvegicus
agaccggaaggtatgcatctgcaga

SEQ ID NO: 109496 - DNA, 25 bp, Rattus norvegicus
agaccggaaggtttgcatctgcaga

SEQ ID NO: 109497 - DNA, 25 bp, Rattus norvegicus
agaccggatctgcttctttccacag

SEQ ID NO: 109498 - DNA, 25 bp, Rattus norvegicus
agaccggatctggttctttccacag

SEQ ID NO: 109499 - DNA, 25 bp, Rattus norvegicus
agaccggcatctctacaagctggaa

SEQ ID NO: 109500 - DNA, 25 bp, Rattus norvegicus
agaccggcatctgtacaagctggaa

SEQ ID NO: 109501 - DNA, 25 bp, Rattus norvegicus
agaccggctaccctagcatatacag

SEQ ID NO: 109502 - DNA, 25 bp, Rattus norvegicus
agaccggctaccgtagcatatacag

SEQ ID NO: 109503 - DNA, 25 bp, Rattus norvegicus
agaccggcttttcttacatggcttc

SEQ ID NO: 109504 - DNA, 25 bp, Rattus norvegicus
agaccggcttttgttacatggcttc

SEQ ID NO: 109505 - DNA, 25 bp, Rattus norvegicus
agaccgggagacataagatgttaca

SEQ ID NO: 109506 - DNA, 25 bp, Rattus norvegicus
agaccgggagacttaagatgttaca

SEQ ID NO: 109507 - DNA, 25 bp, Rattus norvegicus
agaccggtgccgacagaacagatga

SEQ ID NO: 109508 - DNA, 25 bp, Rattus norvegicus
agaccggtgccgtcagaacagatga

SEQ ID NO: 109509 - DNA, 25 bp, Rattus norvegicus
agaccggtggcccacagaccattgc

SEQ ID NO: 109510 - DNA, 25 bp, Rattus norvegicus
agaccggtggccgacagaccattgc

SEQ ID NO: 109511 - DNA, 25 bp, Rattus norvegicus
agaccgtagagcagcggaccgcccg

SEQ ID NO: 109512 - DNA, 25 bp, Rattus norvegicus
agaccgtagagctgcggaccgcccg

SEQ ID NO: 109513 - DNA, 25 bp, Rattus norvegicus
agaccgtaggcccaatttcagtttg

SEQ ID NO: 109514 - DNA, 25 bp, Rattus norvegicus
agaccgtaggccgaatttcagtttg

SEQ ID NO: 109515 - DNA, 25 bp, Rattus norvegicus
agaccgtattaccagtgatcatagt

SEQ ID NO: 109516 - DNA, 25 bp, Rattus norvegicus
agaccgtattacgagtgatcatagt

SEQ ID NO: 109517 - DNA, 25 bp, Rattus norvegicus
agaccgtcaagtatttcgccaacaa

SEQ ID NO: 109518 - DNA, 25 bp, Rattus norvegicus
agaccgtcaagtttttcgccaacaa

SEQ ID NO: 109519 - DNA, 25 bp, Rattus norvegicus
agaccgtcaatcacgaagctggctt

SEQ ID NO: 109520 - DNA, 25 bp, Rattus norvegicus
agaccgtcaatctcgaagctggctt

SEQ ID NO: 109521 - DNA, 25 bp, Rattus norvegicus
agaccgtcagctatggtgctcagtg

SEQ ID NO: 109522 - DNA, 25 bp, Rattus norvegicus
agaccgtcagctttggtgctcagtg

SEQ ID NO: 109523 - DNA, 25 bp, Rattus norvegicus
agaccgtccgcaatgtggctctgga

SEQ ID NO: 109524 - DNA, 25 bp, Rattus norvegicus
agaccgtccgcattgtggctctgga

SEQ ID NO: 109525 - DNA, 25 bp, Rattus norvegicus
agaccgtcctggaattggcgcttag

SEQ ID NO: 109526 - DNA, 25 bp, Rattus norvegicus
agaccgtcctggtattggcgcttag

SEQ ID NO: 109527 - DNA, 25 bp, Rattus norvegicus
agaccgtctactcacaagagctctc

SEQ ID NO: 109528 - DNA, 25 bp, Rattus norvegicus
agaccgtctactgacaagagctctc

SEQ ID NO: 109529 - DNA, 25 bp, Rattus norvegicus
agaccgtctctaatttcagatcggg

SEQ ID NO: 109530 - DNA, 25 bp, Rattus norvegicus
agaccgtctctattttcagatcggg

SEQ ID NO: 109531 - DNA, 25 bp, Rattus norvegicus
agaccgtctcttatcttttgtcagg

SEQ ID NO: 109532 - DNA, 25 bp, Rattus norvegicus
agaccgtctcttttcttttgtcagg

SEQ ID NO: 109533 - DNA, 25 bp, Rattus norvegicus
agaccgtgacatcagccttttagca

SEQ ID NO: 109534 - DNA, 25 bp, Rattus norvegicus
agaccgtgacatgagccttttagca

SEQ ID NO: 109535 - DNA, 25 bp, Rattus norvegicus
agaccgtgccggacgtgccgagctt

SEQ ID NO: 109536 - DNA, 25 bp, Rattus norvegicus
agaccgtgccggtcgtgccgagctt

SEQ ID NO: 109537 - DNA, 25 bp, Rattus norvegicus
agaccgtggatgactgtgttcccag

SEQ ID NO: 109538 - DNA, 25 bp, Rattus norvegicus
agaccgtggatgtctgtgttcccag

SEQ ID NO: 109539 - DNA, 25 bp, Rattus norvegicus
agaccgtgggcgatctggctgtaaa

SEQ ID NO: 109540 - DNA, 25 bp, Rattus norvegicus
agaccgtgggcgttctggctgtaaa

SEQ ID NO: 109541 - DNA, 25 bp, Rattus norvegicus
agaccgtggtgacctgccgtattag

SEQ ID NO: 109542 - DNA, 25 bp, Rattus norvegicus
agaccgtggtgagctgccgtattag

SEQ ID NO: 109543 - DNA, 25 bp, Rattus norvegicus
agaccgtgtacaagagcctccagat

SEQ ID NO: 109544 - DNA, 25 bp, Rattus norvegicus
agaccgtgtacatgagcctccagat

SEQ ID NO: 109545 - DNA, 25 bp, Rattus norvegicus
agaccgtgtgccctgggatgaacca

SEQ ID NO: 109546 - DNA, 25 bp, Rattus norvegicus
agaccgtgtgccgtgggatgaacca

SEQ ID NO: 109547 - DNA, 25 bp, Rattus norvegicus
agaccgtgtttacaaccacatcgcc

SEQ ID NO: 109548 - DNA, 25 bp, Rattus norvegicus
agaccgtgtttagaaccacatcgcc

SEQ ID NO: 109549 - DNA, 25 bp, Rattus norvegicus
agaccgttcttgcaggtctctggat

SEQ ID NO: 109550 - DNA, 25 bp, Rattus norvegicus
agaccgttcttggaggtctctggat

SEQ ID NO: 109551 - DNA, 25 bp, Rattus norvegicus
agaccgtttctgcagcgatgcttgg

SEQ ID NO: 109552 - DNA, 25 bp, Rattus norvegicus
agaccgtttctggagcgatgcttgg

SEQ ID NO: 109553 - DNA, 25 bp, Rattus norvegicus
agaccgttttcacggacgctttgat

SEQ ID NO: 109554 - DNA, 25 bp, Rattus norvegicus
agaccgttttcagggacgctttgat

SEQ ID NO: 109555 - DNA, 25 bp, Rattus norvegicus
agacctaaagcccttgctgtacctg

SEQ ID NO: 109556 - DNA, 25 bp, Rattus norvegicus
agacctaaagccgttgctgtacctg

SEQ ID NO: 109557 - DNA, 25 bp, Rattus norvegicus
agacctaaagtgcaccaaccccttg

SEQ ID NO: 109558 - DNA, 25 bp, Rattus norvegicus
agacctaaagtggaccaaccccttg

SEQ ID NO: 109559 - DNA, 25 bp, Rattus norvegicus
agacctaaggacactggcctgtggt

SEQ ID NO: 109560 - DNA, 25 bp, Rattus norvegicus
agacctaaggactctggcctgtggt

SEQ ID NO: 109561 - DNA, 25 bp, Rattus norvegicus
agacctaattgcactcacttgatgt

SEQ ID NO: 109562 - DNA, 25 bp, Rattus norvegicus
agacctaattgctctcacttgatgt

SEQ ID NO: 109563 - DNA, 25 bp, Rattus norvegicus
agacctacaccaacgggctgcggtt

SEQ ID NO: 109564 - DNA, 25 bp, Rattus norvegicus
agacctacaccatcgggctgcggtt

SEQ ID NO: 109565 - DNA, 25 bp, Rattus norvegicus
agacctacaggaaccgcttctggaa

SEQ ID NO: 109566 - DNA, 25 bp, Rattus norvegicus
agacctacaggatccgcttctggaa

SEQ ID NO: 109567 - DNA, 25 bp, Rattus norvegicus
agacctaccaacctgctgtgcaaag

SEQ ID NO: 109568 - DNA, 25 bp, Rattus norvegicus
agacctaccaacgtgctgtgcaaag

SEQ ID NO: 109569 - DNA, 25 bp, Rattus norvegicus
agacctacccagaggagtattccat

SEQ ID NO: 109570 - DNA, 25 bp, Rattus norvegicus
agacctacccagtggagtattccat

SEQ ID NO: 109571 - DNA, 25 bp, Rattus norvegicus
agacctacctcgatgtgctattgca

SEQ ID NO: 109572 - DNA, 25 bp, Rattus norvegicus
agacctacctcgttgtgctattgca

SEQ ID NO: 109573 - DNA, 25 bp, Rattus norvegicus
agacctacctgccatcatcaaatgg

SEQ ID NO: 109574 - DNA, 25 bp, Rattus norvegicus
agacctacctgcgatcatcaaatgg

SEQ ID NO: 109575 - DNA, 25 bp, Rattus norvegicus
agacctacctgtcagttgctccagt

SEQ ID NO: 109576 - DNA, 25 bp, Rattus norvegicus
agacctacctgtgagttgctccagt

SEQ ID NO: 109577 - DNA, 25 bp, Rattus norvegicus
agacctacgagcagatgcgatgcct

SEQ ID NO: 109578 - DNA, 25 bp, Rattus norvegicus
agacctacgagctgatgcgatgcct

SEQ ID NO: 109579 - DNA, 25 bp, Rattus norvegicus
agacctacttgtctgcttgggcaga

SEQ ID NO: 109580 - DNA, 25 bp, Rattus norvegicus
agacctacttgtgtgcttgggcaga

SEQ ID NO: 109581 - DNA, 25 bp, Rattus norvegicus
agacctagaagtcgctctgaccgaa

SEQ ID NO: 109582 - DNA, 25 bp, Rattus norvegicus
agacctagaagtggctctgaccgaa

SEQ ID NO: 109583 - DNA, 25 bp, Rattus norvegicus
agacctagacctatctgctattgac

SEQ ID NO: 109584 - DNA, 25 bp, Rattus norvegicus
agacctagacctttctgctattgac

SEQ ID NO: 109585 - DNA, 25 bp, Rattus norvegicus
agacctagagcactcctgagaccac

SEQ ID NO: 109586 - DNA, 25 bp, Rattus norvegicus
agacctagagcagtcctgagaccac

SEQ ID NO: 109587 - DNA, 25 bp, Rattus norvegicus
agacctagcctgaggattaaccaaa

SEQ ID NO: 109588 - DNA, 25 bp, Rattus norvegicus
agacctagcctgtggattaaccaaa

SEQ ID NO: 109589 - DNA, 25 bp, Rattus norvegicus
agacctaggctaaggcagagactga

SEQ ID NO: 109590 - DNA, 25 bp, Rattus norvegicus
agacctaggctatggcagagactga

SEQ ID NO: 109591 - DNA, 25 bp, Rattus norvegicus
agacctaggttacctgtgcaggctc

SEQ ID NO: 109592 - DNA, 25 bp, Rattus norvegicus
agacctaggttagctgtgcaggctc

SEQ ID NO: 109593 - DNA, 25 bp, Rattus norvegicus
agacctagtaccctcagaactgttt

SEQ ID NO: 109594 - DNA, 25 bp, Rattus norvegicus
agacctagtaccgtcagaactgttt

SEQ ID NO: 109595 - DNA, 25 bp, Rattus norvegicus
agacctagtcagaggtgtctgggtt

SEQ ID NO: 109596 - DNA, 25 bp, Rattus norvegicus
agacctagtcagtggtgtctgggtt

SEQ ID NO: 109597 - DNA, 25 bp, Rattus norvegicus
agacctagtggaagctctgtcttaa

SEQ ID NO: 109598 - DNA, 25 bp, Rattus norvegicus
agacctagtggatgctctgtcttaa

SEQ ID NO: 109599 - DNA, 25 bp, Rattus norvegicus
agacctataacccttgagcatgctc

SEQ ID NO: 109600 - DNA, 25 bp, Rattus norvegicus
agacctataaccgttgagcatgctc

SEQ ID NO: 109601 - DNA, 25 bp, Rattus norvegicus
agacctatatatcctggaccagttc

SEQ ID NO: 109602 - DNA, 25 bp, Rattus norvegicus
agacctatatatgctggaccagttc

SEQ ID NO: 109603 - DNA, 25 bp, Rattus norvegicus
agacctatcctcacacagaatgctg

SEQ ID NO: 109604 - DNA, 25 bp, Rattus norvegicus
agacctatcctctcacagaatgctg

SEQ ID NO: 109605 - DNA, 25 bp, Rattus norvegicus
agacctatcggtcagaggcatctgc

SEQ ID NO: 109606 - DNA, 25 bp, Rattus norvegicus
agacctatcggtgagaggcatctgc

SEQ ID NO: 109607 - DNA, 25 bp, Rattus norvegicus
agacctatctgtatgtttccttcct

SEQ ID NO: 109608 - DNA, 25 bp, Rattus norvegicus
agacctatctgtttgtttccttcct

SEQ ID NO: 109609 - DNA, 25 bp, Rattus norvegicus
agacctatgaatctatacccactta

SEQ ID NO: 109610 - DNA, 25 bp, Rattus norvegicus
agacctatgaatgtatacccactta

SEQ ID NO: 109611 - DNA, 25 bp, Rattus norvegicus
agacctatggcaactgactgcccca

SEQ ID NO: 109612 - DNA, 25 bp, Rattus norvegicus
agacctatggcatctgactgcccca

SEQ ID NO: 109613 - DNA, 25 bp, Rattus norvegicus
agacctatggctacagtcaatatgt

SEQ ID NO: 109614 - DNA, 25 bp, Rattus norvegicus
agacctatggcttcagtcaatatgt

SEQ ID NO: 109615 - DNA, 25 bp, Rattus norvegicus
agacctatgggtcactttgtgtgag

SEQ ID NO: 109616 - DNA, 25 bp, Rattus norvegicus
agacctatgggtgactttgtgtgag

SEQ ID NO: 109617 - DNA, 25 bp, Rattus norvegicus
agacctatgtgcaagaccttctgag

SEQ ID NO: 109618 - DNA, 25 bp, Rattus norvegicus
agacctatgtgctagaccttctgag

SEQ ID NO: 109619 - DNA, 25 bp, Rattus norvegicus
agacctattcttctgggtccgccaa

SEQ ID NO: 109620 - DNA, 25 bp, Rattus norvegicus
agacctattcttgtgggtccgccaa

SEQ ID NO: 109621 - DNA, 25 bp, Rattus norvegicus
agacctattgacagcttagctcaca

SEQ ID NO: 109622 - DNA, 25 bp, Rattus norvegicus
agacctattgactgcttagctcaca

SEQ ID NO: 109623 - DNA, 25 bp, Rattus norvegicus
agacctattggtccttcttggctgt

SEQ ID NO: 109624 - DNA, 25 bp, Rattus norvegicus
agacctattggtgcttcttggctgt

SEQ ID NO: 109625 - DNA, 25 bp, Rattus norvegicus
agacctatttctcgcagccttagaa

SEQ ID NO: 109626 - DNA, 25 bp, Rattus norvegicus
agacctatttctggcagccttagaa

SEQ ID NO: 109627 - DNA, 25 bp, Rattus norvegicus
agacctcaactccttgtgtgtgtgt

SEQ ID NO: 109628 - DNA, 25 bp, Rattus norvegicus
agacctcaactcgttgtgtgtgtgt

SEQ ID NO: 109629 - DNA, 25 bp, Rattus norvegicus
agacctcaagaaagttttctctatg

SEQ ID NO: 109630 - DNA, 25 bp, Rattus norvegicus
agacctcaagaatgttttctctatg

SEQ ID NO: 109631 - DNA, 25 bp, Rattus norvegicus
agacctcaatcgatcagtggcagac

SEQ ID NO: 109632 - DNA, 25 bp, Rattus norvegicus
agacctcaatcgttcagtggcagac

SEQ ID NO: 109633 - DNA, 25 bp, Rattus norvegicus
agacctcacactaccgattaacagt

SEQ ID NO: 109634 - DNA, 25 bp, Rattus norvegicus
agacctcacacttccgattaacagt

SEQ ID NO: 109635 - DNA, 25 bp, Rattus norvegicus
agacctcaccgacccttattgcttc

SEQ ID NO: 109636 - DNA, 25 bp, Rattus norvegicus
agacctcaccgagccttattgcttc

SEQ ID NO: 109637 - DNA, 25 bp, Rattus norvegicus
agacctcactaactactggaacctg

SEQ ID NO: 109638 - DNA, 25 bp, Rattus norvegicus
agacctcactaagtactggaacctg

SEQ ID NO: 109639 - DNA, 25 bp, Rattus norvegicus
agacctcactctatagtccaaacga

SEQ ID NO: 109640 - DNA, 25 bp, Rattus norvegicus
agacctcactctctgatggtttcag

SEQ ID NO: 109641 - DNA, 25 bp, Rattus norvegicus
agacctcactctgtgatggtttcag

SEQ ID NO: 109642 - DNA, 25 bp, Rattus norvegicus
agacctcactctttagtccaaacga

SEQ ID NO: 109643 - DNA, 25 bp, Rattus norvegicus
agacctcagcacctatcaacagtgg

SEQ ID NO: 109644 - DNA, 25 bp, Rattus norvegicus
agacctcagcacgtatcaacagtgg

SEQ ID NO: 109645 - DNA, 25 bp, Rattus norvegicus
agacctcagccaagactacagccat

SEQ ID NO: 109646 - DNA, 25 bp, Rattus norvegicus
agacctcagccatgactacagccat

SEQ ID NO: 109647 - DNA, 25 bp, Rattus norvegicus
agacctcaggctcatcccaaaggga

SEQ ID NO: 109648 - DNA, 25 bp, Rattus norvegicus
agacctcaggctgatcccaaaggga

SEQ ID NO: 109649 - DNA, 25 bp, Rattus norvegicus
agacctcagggcaatcttgggaccc

SEQ ID NO: 109650 - DNA, 25 bp, Rattus norvegicus
agacctcagggctatcttgggaccc

SEQ ID NO: 109651 - DNA, 25 bp, Rattus norvegicus
agacctcagggtatgggcacctgga

SEQ ID NO: 109652 - DNA, 25 bp, Rattus norvegicus
agacctcagggtttgggcacctgga

SEQ ID NO: 109653 - DNA, 25 bp, Rattus norvegicus
agacctcaggtaccagcaggctgtg

SEQ ID NO: 109654 - DNA, 25 bp, Rattus norvegicus
agacctcaggtacgcagggctgcat

SEQ ID NO: 109655 - DNA, 25 bp, Rattus norvegicus
agacctcaggtagcagcaggctgtg

SEQ ID NO: 109656 - DNA, 25 bp, Rattus norvegicus
agacctcaggtaggcagggctgcat

SEQ ID NO: 109657 - DNA, 25 bp, Rattus norvegicus
agacctcagttgcatgcacccacat

SEQ ID NO: 109658 - DNA, 25 bp, Rattus norvegicus
agacctcagttggatgcacccacat

SEQ ID NO: 109659 - DNA, 25 bp, Rattus norvegicus
agacctcatagaaagcttcccagct

SEQ ID NO: 109660 - DNA, 25 bp, Rattus norvegicus
agacctcatagatagcttcccagct

SEQ ID NO: 109661 - DNA, 25 bp, Rattus norvegicus
agacctcatcttcactgtagacttt

SEQ ID NO: 109662 - DNA, 25 bp, Rattus norvegicus
agacctcatcttgactgtagacttt

SEQ ID NO: 109663 - DNA, 25 bp, Rattus norvegicus
agacctcatgacaaaactatccctg

SEQ ID NO: 109664 - DNA, 25 bp, Rattus norvegicus
agacctcatgactaaactatccctg

SEQ ID NO: 109665 - DNA, 25 bp, Rattus norvegicus
agacctcattgtcccatgttgctaa

SEQ ID NO: 109666 - DNA, 25 bp, Rattus norvegicus
agacctcattgtgccatgttgctaa

SEQ ID NO: 109667 - DNA, 25 bp, Rattus norvegicus
agacctcatttcagccagatctgtg

SEQ ID NO: 109668 - DNA, 25 bp, Rattus norvegicus
agacctcatttctgccagatctgtg

SEQ ID NO: 109669 - DNA, 25 bp, Rattus norvegicus
agacctccacaccttaatgtgttat

SEQ ID NO: 109670 - DNA, 25 bp, Rattus norvegicus
agacctccacacgttaatgtgttat

SEQ ID NO: 109671 - DNA, 25 bp, Rattus norvegicus
agacctccaggaaggtacctcagga

SEQ ID NO: 109672 - DNA, 25 bp, Rattus norvegicus
agacctccaggatggtacctcagga

SEQ ID NO: 109673 - DNA, 25 bp, Rattus norvegicus
agacctccatggagcatgagctcaa

SEQ ID NO: 109674 - DNA, 25 bp, Rattus norvegicus
agacctccatggtgcatgagctcaa

SEQ ID NO: 109675 - DNA, 25 bp, Rattus norvegicus
agacctcccactatgtgcctttagt

SEQ ID NO: 109676 - DNA, 25 bp, Rattus norvegicus
agacctcccactttgtgcctttagt

SEQ ID NO: 109677 - DNA, 25 bp, Rattus norvegicus
agacctccccagaaggtctcagaga

SEQ ID NO: 109678 - DNA, 25 bp, Rattus norvegicus
agacctccccagtaggtctcagaga

SEQ ID NO: 109679 - DNA, 25 bp, Rattus norvegicus
agacctcccgtactaacagcaggtg

SEQ ID NO: 109680 - DNA, 25 bp, Rattus norvegicus
agacctcccgtagtaacagcaggtg

SEQ ID NO: 109681 - DNA, 25 bp, Rattus norvegicus
agacctccctccatggatggctatt

SEQ ID NO: 109682 - DNA, 25 bp, Rattus norvegicus
agacctccctccttggatggctatt

SEQ ID NO: 109683 - DNA, 25 bp, Rattus norvegicus
agacctccgccaaggctggaaggca

SEQ ID NO: 109684 - DNA, 25 bp, Rattus norvegicus
agacctccgccatggctggaaggca

SEQ ID NO: 109685 - DNA, 25 bp, Rattus norvegicus
agacctcctagaagtgtctctggat

SEQ ID NO: 109686 - DNA, 25 bp, Rattus norvegicus
agacctcctagatgtgtctctggat

SEQ ID NO: 109687 - DNA, 25 bp, Rattus norvegicus
agacctcctcctagcactgaaaatg

SEQ ID NO: 109688 - DNA, 25 bp, Rattus norvegicus
agacctcctccttgcactgaaaatg

SEQ ID NO: 109689 - DNA, 25 bp, Rattus norvegicus
agacctcctgtgatgtgcttagact

SEQ ID NO: 109690 - DNA, 25 bp, Rattus norvegicus
agacctcctgtgttgtgcttagact

SEQ ID NO: 109691 - DNA, 25 bp, Rattus norvegicus
agacctcctgttagctctaggtata

SEQ ID NO: 109692 - DNA, 25 bp, Rattus norvegicus
agacctcctgttagtttggcctgca

SEQ ID NO: 109693 - DNA, 25 bp, Rattus norvegicus
agacctcctgtttgctctaggtata

SEQ ID NO: 109694 - DNA, 25 bp, Rattus norvegicus
agacctcctgtttgtttggcctgca

SEQ ID NO: 109695 - DNA, 25 bp, Rattus norvegicus
agacctcctttgacttttggaacag

SEQ ID NO: 109696 - DNA, 25 bp, Rattus norvegicus
agacctcctttgtcttttggaacag

SEQ ID NO: 109697 - DNA, 25 bp, Rattus norvegicus
agacctcgagtgcttattacttcgg

SEQ ID NO: 109698 - DNA, 25 bp, Rattus norvegicus
agacctcgagtggttattacttcgg

SEQ ID NO: 109699 - DNA, 25 bp, Rattus norvegicus
agacctcgcaaacctcttcggaaga

SEQ ID NO: 109700 - DNA, 25 bp, Rattus norvegicus
agacctcgcaaagctcttcggaaga

SEQ ID NO: 109701 - DNA, 25 bp, Rattus norvegicus
agacctcgcagtactagatgcctgg

SEQ ID NO: 109702 - DNA, 25 bp, Rattus norvegicus
agacctcgcagttctagatgcctgg

SEQ ID NO: 109703 - DNA, 25 bp, Rattus norvegicus
agacctcgctgaactcgttgtataa

SEQ ID NO: 109704 - DNA, 25 bp, Rattus norvegicus
agacctcgctgatctcgttgtataa

SEQ ID NO: 109705 - DNA, 25 bp, Rattus norvegicus
agacctcgctgtcacctgaacttgt

SEQ ID NO: 109706 - DNA, 25 bp, Rattus norvegicus
agacctcgctgtgacctgaacttgt

SEQ ID NO: 109707 - DNA, 25 bp, Rattus norvegicus
agacctcggagcatctctcctggct

SEQ ID NO: 109708 - DNA, 25 bp, Rattus norvegicus
agacctcggagcttctctcctggct

SEQ ID NO: 109709 - DNA, 25 bp, Rattus norvegicus
agacctcggtgtaccagatgggcgc

SEQ ID NO: 109710 - DNA, 25 bp, Rattus norvegicus
agacctcggtgttccagatgggcgc

SEQ ID NO: 109711 - DNA, 25 bp, Rattus norvegicus
agacctctcagacacccactttatt

SEQ ID NO: 109712 - DNA, 25 bp, Rattus norvegicus
agacctctcagagacccactttatt

SEQ ID NO: 109713 - DNA, 25 bp, Rattus norvegicus
agacctctcagcatcttaggactgt

SEQ ID NO: 109714 - DNA, 25 bp, Rattus norvegicus
agacctctcagcttcttaggactgt

SEQ ID NO: 109715 - DNA, 25 bp, Rattus norvegicus
agacctctccccattgtgtttgtct

SEQ ID NO: 109716 - DNA, 25 bp, Rattus norvegicus
agacctctcccctttgtgtttgtct

SEQ ID NO: 109717 - DNA, 25 bp, Rattus norvegicus
agacctctcctcactaaaagatctg

SEQ ID NO: 109718 - DNA, 25 bp, Rattus norvegicus
agacctctcctctctaaaagatctg

SEQ ID NO: 109719 - DNA, 25 bp, Rattus norvegicus
agacctctctctcacattactggga

SEQ ID NO: 109720 - DNA, 25 bp, Rattus norvegicus
agacctctctctgacattactggga

SEQ ID NO: 109721 - DNA, 25 bp, Rattus norvegicus
agacctctctgcatttggaactaca

SEQ ID NO: 109722 - DNA, 25 bp, Rattus norvegicus
agacctctctgcttttggaactaca

SEQ ID NO: 109723 - DNA, 25 bp, Rattus norvegicus
agacctctgaccatagtggcaacat

SEQ ID NO: 109724 - DNA, 25 bp, Rattus norvegicus
agacctctgaccttagtggcaacat

SEQ ID NO: 109725 - DNA, 25 bp, Rattus norvegicus
agacctctgattctgacatcttcac

SEQ ID NO: 109726 - DNA, 25 bp, Rattus norvegicus
agacctctgattgtgacatcttcac

SEQ ID NO: 109727 - DNA, 25 bp, Rattus norvegicus
agacctctgcagatatccctagaag

SEQ ID NO: 109728 - DNA, 25 bp, Rattus norvegicus
agacctctgcagcttttaggcacct

SEQ ID NO: 109729 - DNA, 25 bp, Rattus norvegicus
agacctctgcaggttttaggcacct

SEQ ID NO: 109730 - DNA, 25 bp, Rattus norvegicus
agacctctgcagttatccctagaag

SEQ ID NO: 109731 - DNA, 25 bp, Rattus norvegicus
agacctctgccccttgtgagctgtt

SEQ ID NO: 109732 - DNA, 25 bp, Rattus norvegicus
agacctctgcccgttgtgagctgtt

SEQ ID NO: 109733 - DNA, 25 bp, Rattus norvegicus
agacctctgcttcatgaacccattc

SEQ ID NO: 109734 - DNA, 25 bp, Rattus norvegicus
agacctctgcttgatgaacccattc

SEQ ID NO: 109735 - DNA, 25 bp, Rattus norvegicus
agacctctggagactgcccaggaga

SEQ ID NO: 109736 - DNA, 25 bp, Rattus norvegicus
agacctctggagtctgcccaggaga

SEQ ID NO: 109737 - DNA, 25 bp, Rattus norvegicus
agacctctgggtccccgaggagtca

SEQ ID NO: 109738 - DNA, 25 bp, Rattus norvegicus
agacctctgggtgcccgaggagtca

SEQ ID NO: 109739 - DNA, 25 bp, Rattus norvegicus
agacctctggtaacgaggaaactga

SEQ ID NO: 109740 - DNA, 25 bp, Rattus norvegicus
agacctctggtatcgaggaaactga

SEQ ID NO: 109741 - DNA, 25 bp, Rattus norvegicus
agacctctgtgcatgtggtatccat

SEQ ID NO: 109742 - DNA, 25 bp, Rattus norvegicus
agacctctgtgcttgtggtatccat

SEQ ID NO: 109743 - DNA, 25 bp, Rattus norvegicus
agacctctgtgtcctttgccagaag

SEQ ID NO: 109744 - DNA, 25 bp, Rattus norvegicus
agacctctgtgtgctttgccagaag

SEQ ID NO: 109745 - DNA, 25 bp, Rattus norvegicus
agacctcttagaccaggctgcctga

SEQ ID NO: 109746 - DNA, 25 bp, Rattus norvegicus
agacctcttagagcaggctgcctga

SEQ ID NO: 109747 - DNA, 25 bp, Rattus norvegicus
agacctcttcctaggttgatctggg

SEQ ID NO: 109748 - DNA, 25 bp, Rattus norvegicus
agacctcttccttggttgatctggg

SEQ ID NO: 109749 - DNA, 25 bp, Rattus norvegicus
agacctcttcggcagcagtaagcac

SEQ ID NO: 109750 - DNA, 25 bp, Rattus norvegicus
agacctcttcgggagcagtaagcac

SEQ ID NO: 109751 - DNA, 25 bp, Rattus norvegicus
agacctcttgaacatgtcgaagcag

SEQ ID NO: 109752 - DNA, 25 bp, Rattus norvegicus
agacctcttgaagatgtcgaagcag

SEQ ID NO: 109753 - DNA, 25 bp, Rattus norvegicus
agacctcttgatagcctttctttga

SEQ ID NO: 109754 - DNA, 25 bp, Rattus norvegicus
agacctcttgattgcctttctttga

SEQ ID NO: 109755 - DNA, 25 bp, Rattus norvegicus
agacctctttcacctattttaataa

SEQ ID NO: 109756 - DNA, 25 bp, Rattus norvegicus
agacctctttcagctattttaataa

SEQ ID NO: 109757 - DNA, 25 bp, Rattus norvegicus
agacctgaaaataagctctccttta

SEQ ID NO: 109758 - DNA, 25 bp, Rattus norvegicus
agacctgaaaattagctctccttta

SEQ ID NO: 109759 - DNA, 25 bp, Rattus norvegicus
agacctgaaatccagctccgggaag

SEQ ID NO: 109760 - DNA, 25 bp, Rattus norvegicus
agacctgaaatcgagctccgggaag

SEQ ID NO: 109761 - DNA, 25 bp, Rattus norvegicus
agacctgaacaacagtgcttactgt

SEQ ID NO: 109762 - DNA, 25 bp, Rattus norvegicus
agacctgaacaagagtgcttactgt

SEQ ID NO: 109763 - DNA, 25 bp, Rattus norvegicus
agacctgaacatcaacatgacctcc

SEQ ID NO: 109764 - DNA, 25 bp, Rattus norvegicus
agacctgaacatgaacatgacctcc

SEQ ID NO: 109765 - DNA, 25 bp, Rattus norvegicus
agacctgaacgacttccccactgtt

SEQ ID NO: 109766 - DNA, 25 bp, Rattus norvegicus
agacctgaacgagttccccactgtt

SEQ ID NO: 109767 - DNA, 25 bp, Rattus norvegicus
agacctgaatccagatgggcgtggt

SEQ ID NO: 109768 - DNA, 25 bp, Rattus norvegicus
agacctgaatcctgatgggcgtggt

SEQ ID NO: 109769 - DNA, 25 bp, Rattus norvegicus
agacctgacactatatgctcctact

SEQ ID NO: 109770 - DNA, 25 bp, Rattus norvegicus
agacctgacactttatgctcctact

SEQ ID NO: 109771 - DNA, 25 bp, Rattus norvegicus
agacctgacatgctggcagtgcgct

SEQ ID NO: 109772 - DNA, 25 bp, Rattus norvegicus
agacctgacatggtggcagtgcgct

SEQ ID NO: 109773 - DNA, 25 bp, Rattus norvegicus
agacctgaccgacaaattctacctt

SEQ ID NO: 109774 - DNA, 25 bp, Rattus norvegicus
agacctgaccgagaaattctacctt

SEQ ID NO: 109775 - DNA, 25 bp, Rattus norvegicus
agacctgactgactaggcctgccat

SEQ ID NO: 109776 - DNA, 25 bp, Rattus norvegicus
agacctgactgagtaggcctgccat

SEQ ID NO: 109777 - DNA, 25 bp, Rattus norvegicus
agacctgacttgaagctcctgagtg

SEQ ID NO: 109778 - DNA, 25 bp, Rattus norvegicus
agacctgacttgtagctcctgagtg

SEQ ID NO: 109779 - DNA, 25 bp, Rattus norvegicus
agacctgagacaagatctggccaca

SEQ ID NO: 109780 - DNA, 25 bp, Rattus norvegicus
agacctgagacatgatctggccaca

SEQ ID NO: 109781 - DNA, 25 bp, Rattus norvegicus
agacctgagacgcaggccagcctgc

SEQ ID NO: 109782 - DNA, 25 bp, Rattus norvegicus
agacctgagacggaggccagcctgc

SEQ ID NO: 109783 - DNA, 25 bp, Rattus norvegicus
agacctgagccaccaatcgccaaag

SEQ ID NO: 109784 - DNA, 25 bp, Rattus norvegicus
agacctgagccagcaatcgccaaag

SEQ ID NO: 109785 - DNA, 25 bp, Rattus norvegicus
agacctgagcttccatccgtaagaa

SEQ ID NO: 109786 - DNA, 25 bp, Rattus norvegicus
agacctgagcttgcatccgtaagaa

SEQ ID NO: 109787 - DNA, 25 bp, Rattus norvegicus
agacctgaggctcggttcacaatat

SEQ ID NO: 109788 - DNA, 25 bp, Rattus norvegicus
agacctgaggctgggttcacaatat

SEQ ID NO: 109789 - DNA, 25 bp, Rattus norvegicus
agacctgagtctaggcctgattggc

SEQ ID NO: 109790 - DNA, 25 bp, Rattus norvegicus
agacctgagtcttggcctgattggc

SEQ ID NO: 109791 - DNA, 25 bp, Rattus norvegicus
agacctgagtgcaaagccatcccct

SEQ ID NO: 109792 - DNA, 25 bp, Rattus norvegicus
agacctgagtgctaagccatcccct

SEQ ID NO: 109793 - DNA, 25 bp, Rattus norvegicus
agacctgagtggcttccctgcacgt

SEQ ID NO: 109794 - DNA, 25 bp, Rattus norvegicus
agacctgagtgggttccctgcacgt

SEQ ID NO: 109795 - DNA, 25 bp, Rattus norvegicus
agacctgatcttctgcctgatgcag

SEQ ID NO: 109796 - DNA, 25 bp, Rattus norvegicus
agacctgatcttgtgcctgatgcag

SEQ ID NO: 109797 - DNA, 25 bp, Rattus norvegicus
agacctgatgccagaaacctgccaa

SEQ ID NO: 109798 - DNA, 25 bp, Rattus norvegicus
agacctgatgcctgaaacctgccaa

SEQ ID NO: 109799 - DNA, 25 bp, Rattus norvegicus
agacctgatgttacaagatcttaga

SEQ ID NO: 109800 - DNA, 25 bp, Rattus norvegicus
agacctgatgtttcaagatcttaga

SEQ ID NO: 109801 - DNA, 25 bp, Rattus norvegicus
agacctgattcacttctccagatta

SEQ ID NO: 109802 - DNA, 25 bp, Rattus norvegicus
agacctgattcagttctccagatta

SEQ ID NO: 109803 - DNA, 25 bp, Rattus norvegicus
agacctgatttaaatgctattgcca

SEQ ID NO: 109804 - DNA, 25 bp, Rattus norvegicus
agacctgatttatatgctattgcca

SEQ ID NO: 109805 - DNA, 25 bp, Rattus norvegicus
agacctgcacaaacagaccggaagt

SEQ ID NO: 109806 - DNA, 25 bp, Rattus norvegicus
agacctgcacaatcagaccggaagt

SEQ ID NO: 109807 - DNA, 25 bp, Rattus norvegicus
agacctgcacacagtacacttccac

SEQ ID NO: 109808 - DNA, 25 bp, Rattus norvegicus
agacctgcacactgtacacttccac

SEQ ID NO: 109809 - DNA, 25 bp, Rattus norvegicus
agacctgcagagagataagaccatt

SEQ ID NO: 109810 - DNA, 25 bp, Rattus norvegicus
agacctgcagagcaacactgactaa

SEQ ID NO: 109811 - DNA, 25 bp, Rattus norvegicus
agacctgcagaggaacactgactaa

SEQ ID NO: 109812 - DNA, 25 bp, Rattus norvegicus
agacctgcagagtgataagaccatt

SEQ ID NO: 109813 - DNA, 25 bp, Rattus norvegicus
agacctgcaggcacactgaaggatt

SEQ ID NO: 109814 - DNA, 25 bp, Rattus norvegicus
agacctgcaggctcactgaaggatt

SEQ ID NO: 109815 - DNA, 25 bp, Rattus norvegicus
agacctgccaaaagcccttgctgtt

SEQ ID NO: 109816 - DNA, 25 bp, Rattus norvegicus
agacctgccaaatgcccttgctgtt

SEQ ID NO: 109817 - DNA, 25 bp, Rattus norvegicus
agacctgccagaagtcacagtgatt

SEQ ID NO: 109818 - DNA, 25 bp, Rattus norvegicus
agacctgccagatgtcacagtgatt

SEQ ID NO: 109819 - DNA, 25 bp, Rattus norvegicus
agacctgcctctcgtgacgaagatg

SEQ ID NO: 109820 - DNA, 25 bp, Rattus norvegicus
agacctgcctctggtgacgaagatg

SEQ ID NO: 109821 - DNA, 25 bp, Rattus norvegicus
agacctgcctgaactacatactgag

SEQ ID NO: 109822 - DNA, 25 bp, Rattus norvegicus
agacctgcctgatctacatactgag

SEQ ID NO: 109823 - DNA, 25 bp, Rattus norvegicus
agacctgcgtggaacactacacggg

SEQ ID NO: 109824 - DNA, 25 bp, Rattus norvegicus
agacctgcgtggtacactacacggg

SEQ ID NO: 109825 - DNA, 25 bp, Rattus norvegicus
agacctgctcccattttataggtgg

SEQ ID NO: 109826 - DNA, 25 bp, Rattus norvegicus
agacctgctccctttttataggtgg

SEQ ID NO: 109827 - DNA, 25 bp, Rattus norvegicus
agacctgctcgaacactgaaacaaa

SEQ ID NO: 109828 - DNA, 25 bp, Rattus norvegicus
agacctgctcgatcactgaaacaaa

SEQ ID NO: 109829 - DNA, 25 bp, Rattus norvegicus
agacctgctctcctgtggtacagaa

SEQ ID NO: 109830 - DNA, 25 bp, Rattus norvegicus
agacctgctctcgtgtggtacagaa

SEQ ID NO: 109831 - DNA, 25 bp, Rattus norvegicus
agacctgctggaccttggcatgcat

SEQ ID NO: 109832 - DNA, 25 bp, Rattus norvegicus
agacctgctggagcttggcatgcat

SEQ ID NO: 109833 - DNA, 25 bp, Rattus norvegicus
agacctgcttggagccctgtccact

SEQ ID NO: 109834 - DNA, 25 bp, Rattus norvegicus
agacctgcttggtgccctgtccact

SEQ ID NO: 109835 - DNA, 25 bp, Rattus norvegicus
agacctgcttttaatgccccggcag

SEQ ID NO: 109836 - DNA, 25 bp, Rattus norvegicus
agacctgctttttatgccccggcag

SEQ ID NO: 109837 - DNA, 25 bp, Rattus norvegicus
agacctggaatgacagactagcctg

SEQ ID NO: 109838 - DNA, 25 bp, Rattus norvegicus
agacctggaatgtcagactagcctg

SEQ ID NO: 109839 - DNA, 25 bp, Rattus norvegicus
agacctggacagaagcagccagccc

SEQ ID NO: 109840 - DNA, 25 bp, Rattus norvegicus
agacctggacagtagcagccagccc

SEQ ID NO: 109841 - DNA, 25 bp, Rattus norvegicus
agacctggaccactgccgagatgga

SEQ ID NO: 109842 - DNA, 25 bp, Rattus norvegicus
agacctggaccacttgatgagttca

SEQ ID NO: 109843 - DNA, 25 bp, Rattus norvegicus
agacctggaccagtgccgagatgga

SEQ ID NO: 109844 - DNA, 25 bp, Rattus norvegicus
agacctggaccagttgatgagttca

SEQ ID NO: 109845 - DNA, 25 bp, Rattus norvegicus
agacctggacttatgaagagaccgt

SEQ ID NO: 109846 - DNA, 25 bp, Rattus norvegicus
agacctggacttttgaagagaccgt

SEQ ID NO: 109847 - DNA, 25 bp, Rattus norvegicus
agacctggaggcacacctgaactgg

SEQ ID NO: 109848 - DNA, 25 bp, Rattus norvegicus
agacctggaggctcacctgaactgg

SEQ ID NO: 109849 - DNA, 25 bp, Rattus norvegicus
agacctggaggtacctctttctagg

SEQ ID NO: 109850 - DNA, 25 bp, Rattus norvegicus
agacctggaggttcctctttctagg

SEQ ID NO: 109851 - DNA, 25 bp, Rattus norvegicus
agacctggagtcatggtctcggctt

SEQ ID NO: 109852 - DNA, 25 bp, Rattus norvegicus
agacctggagtcttggtctcggctt

SEQ ID NO: 109853 - DNA, 25 bp, Rattus norvegicus
agacctggccttccctatggcagac

SEQ ID NO: 109854 - DNA, 25 bp, Rattus norvegicus
agacctggccttgcctatggcagac

SEQ ID NO: 109855 - DNA, 25 bp, Rattus norvegicus
agacctggctgtatattactgtgag

SEQ ID NO: 109856 - DNA, 25 bp, Rattus norvegicus
agacctggctgtttattactgtgag

SEQ ID NO: 109857 - DNA, 25 bp, Rattus norvegicus
agacctggctttctggttcatgtaa

SEQ ID NO: 109858 - DNA, 25 bp, Rattus norvegicus
agacctggctttgtggttcatgtaa

SEQ ID NO: 109859 - DNA, 25 bp, Rattus norvegicus
agacctgggagcacctttacagaaa

SEQ ID NO: 109860 - DNA, 25 bp, Rattus norvegicus
agacctgggagcatgcagcccttca

SEQ ID NO: 109861 - DNA, 25 bp, Rattus norvegicus
agacctgggagctcctttacagaaa

SEQ ID NO: 109862 - DNA, 25 bp, Rattus norvegicus
agacctgggagcttgcagcccttca

SEQ ID NO: 109863 - DNA, 25 bp, Rattus norvegicus
agacctgggataaatgtacttttac

SEQ ID NO: 109864 - DNA, 25 bp, Rattus norvegicus
agacctgggatatatgtacttttac

SEQ ID NO: 109865 - DNA, 25 bp, Rattus norvegicus
agacctgggatgagcccatgctgtg

SEQ ID NO: 109866 - DNA, 25 bp, Rattus norvegicus
agacctgggatgtgcccatgctgtg

SEQ ID NO: 109867 - DNA, 25 bp, Rattus norvegicus
agacctgggcatatagtgtcctatt

SEQ ID NO: 109868 - DNA, 25 bp, Rattus norvegicus
agacctgggcatttagtgtcctatt

SEQ ID NO: 109869 - DNA, 25 bp, Rattus norvegicus
agacctgggctcaggcatcaacgag

SEQ ID NO: 109870 - DNA, 25 bp, Rattus norvegicus
agacctgggctcatttggccacaga

SEQ ID NO: 109871 - DNA, 25 bp, Rattus norvegicus
agacctgggctctggcatcaacgag

SEQ ID NO: 109872 - DNA, 25 bp, Rattus norvegicus
agacctgggctcttttggccacaga

SEQ ID NO: 109873 - DNA, 25 bp, Rattus norvegicus
agacctgggcttagcttttgtgtgg

SEQ ID NO: 109874 - DNA, 25 bp, Rattus norvegicus
agacctgggctttgcttttgtgtgg

SEQ ID NO: 109875 - DNA, 25 bp, Rattus norvegicus
agacctgggtacaaaaagctggaag

SEQ ID NO: 109876 - DNA, 25 bp, Rattus norvegicus
agacctgggtactaaaagctggaag

SEQ ID NO: 109877 - DNA, 25 bp, Rattus norvegicus
agacctgggtgtcgacctgacctcc

SEQ ID NO: 109878 - DNA, 25 bp, Rattus norvegicus
agacctgggtgtggacctgacctcc

SEQ ID NO: 109879 - DNA, 25 bp, Rattus norvegicus
agacctggtaccacaaagggcaagt

SEQ ID NO: 109880 - DNA, 25 bp, Rattus norvegicus
agacctggtacctcaaagggcaagt

SEQ ID NO: 109881 - DNA, 25 bp, Rattus norvegicus
agacctggtctcactgacagcaaac

SEQ ID NO: 109882 - DNA, 25 bp, Rattus norvegicus
agacctggtctctctgacagcaaac

SEQ ID NO: 109883 - DNA, 25 bp, Rattus norvegicus
agacctggtggtcaattctagccac

SEQ ID NO: 109884 - DNA, 25 bp, Rattus norvegicus
agacctggtggtgaattctagccac

SEQ ID NO: 109885 - DNA, 25 bp, Rattus norvegicus
agacctgtacaaactgtacctagaa

SEQ ID NO: 109886 - DNA, 25 bp, Rattus norvegicus
agacctgtacaatctgtacctagaa

SEQ ID NO: 109887 - DNA, 25 bp, Rattus norvegicus
agacctgtacagacacatccgcaag

SEQ ID NO: 109888 - DNA, 25 bp, Rattus norvegicus
agacctgtacagtcacatccgcaag

SEQ ID NO: 109889 - DNA, 25 bp, Rattus norvegicus
agacctgtaccaataattaacaaat

SEQ ID NO: 109890 - DNA, 25 bp, Rattus norvegicus
agacctgtaccattaattaacaaat

SEQ ID NO: 109891 - DNA, 25 bp, Rattus norvegicus
agacctgtactacctcacttttgaa

SEQ ID NO: 109892 - DNA, 25 bp, Rattus norvegicus
agacctgtactagctcacttttgaa

SEQ ID NO: 109893 - DNA, 25 bp, Rattus norvegicus
agacctgtaggcatatccgtgtggc

SEQ ID NO: 109894 - DNA, 25 bp, Rattus norvegicus
agacctgtaggcttatccgtgtggc

SEQ ID NO: 109895 - DNA, 25 bp, Rattus norvegicus
agacctgtagtgaaggtggtaccat

SEQ ID NO: 109896 - DNA, 25 bp, Rattus norvegicus
agacctgtagtgtaggtggtaccat

SEQ ID NO: 109897 - DNA, 25 bp, Rattus norvegicus
agacctgtatgtagtcctggctggc

SEQ ID NO: 109898 - DNA, 25 bp, Rattus norvegicus
agacctgtatgttgtcctggctggc

SEQ ID NO: 109899 - DNA, 25 bp, Rattus norvegicus
agacctgtcaccaaactgagttcat

SEQ ID NO: 109900 - DNA, 25 bp, Rattus norvegicus
agacctgtcaccatctggcctcagg

SEQ ID NO: 109901 - DNA, 25 bp, Rattus norvegicus
agacctgtcacctaactgagttcat

SEQ ID NO: 109902 - DNA, 25 bp, Rattus norvegicus
agacctgtcaccttctggcctcagg

SEQ ID NO: 109903 - DNA, 25 bp, Rattus norvegicus
agacctgtccttctgatcttaagag

SEQ ID NO: 109904 - DNA, 25 bp, Rattus norvegicus
agacctgtccttgtgatcttaagag

SEQ ID NO: 109905 - DNA, 25 bp, Rattus norvegicus
agacctgtcgtcaggaatgttcctt

SEQ ID NO: 109906 - DNA, 25 bp, Rattus norvegicus
agacctgtcgtctggaatgttcctt

SEQ ID NO: 109907 - DNA, 25 bp, Rattus norvegicus
agacctgtctgacatgccagcgaag

SEQ ID NO: 109908 - DNA, 25 bp, Rattus norvegicus
agacctgtctgagatgccagcgaag

SEQ ID NO: 109909 - DNA, 25 bp, Rattus norvegicus
agacctgtctgcctttgaggaacta

SEQ ID NO: 109910 - DNA, 25 bp, Rattus norvegicus
agacctgtctgcgtttgaggaacta

SEQ ID NO: 109911 - DNA, 25 bp, Rattus norvegicus
agacctgtgatgctctgtgtgtatt

SEQ ID NO: 109912 - DNA, 25 bp, Rattus norvegicus
agacctgtgatggtctgtgtgtatt

SEQ ID NO: 109913 - DNA, 25 bp, Rattus norvegicus
agacctgtgcatatctgtaccaaat

SEQ ID NO: 109914 - DNA, 25 bp, Rattus norvegicus
agacctgtgcatttctgtaccaaat

SEQ ID NO: 109915 - DNA, 25 bp, Rattus norvegicus
agacctgtgctcacacatacaatgt

SEQ ID NO: 109916 - DNA, 25 bp, Rattus norvegicus
agacctgtgctctcacatacaatgt

SEQ ID NO: 109917 - DNA, 25 bp, Rattus norvegicus
agacctgtggtacccagatcactca

SEQ ID NO: 109918 - DNA, 25 bp, Rattus norvegicus
agacctgtggtagccagatcactca

SEQ ID NO: 109919 - DNA, 25 bp, Rattus norvegicus
agacctgtggtcattcttcgatgtt

SEQ ID NO: 109920 - DNA, 25 bp, Rattus norvegicus
agacctgtggtctttcttcgatgtt

SEQ ID NO: 109921 - DNA, 25 bp, Rattus norvegicus
agacctgttaccagacttagtacca

SEQ ID NO: 109922 - DNA, 25 bp, Rattus norvegicus
agacctgttacctgacttagtacca

SEQ ID NO: 109923 - DNA, 25 bp, Rattus norvegicus
agacctgttctacattgttcaacta

SEQ ID NO: 109924 - DNA, 25 bp, Rattus norvegicus
agacctgttctagattgttcaacta

SEQ ID NO: 109925 - DNA, 25 bp, Rattus norvegicus
agacctgttttcctgtatctgaagt

SEQ ID NO: 109926 - DNA, 25 bp, Rattus norvegicus
agacctgttttcgtgtatctgaagt

SEQ ID NO: 109927 - DNA, 25 bp, Rattus norvegicus
agaccttaaagccagtagccaaatg

SEQ ID NO: 109928 - DNA, 25 bp, Rattus norvegicus
agaccttaaagcgagtagccaaatg

SEQ ID NO: 109929 - DNA, 25 bp, Rattus norvegicus
agaccttacagcctcaccattggaa

SEQ ID NO: 109930 - DNA, 25 bp, Rattus norvegicus
agaccttacagcgtcaccattggaa

SEQ ID NO: 109931 - DNA, 25 bp, Rattus norvegicus
agaccttactgcagggtcatcggca

SEQ ID NO: 109932 - DNA, 25 bp, Rattus norvegicus
agaccttactgctgggtcatcggca

SEQ ID NO: 109933 - DNA, 25 bp, Rattus norvegicus
agaccttactttccagaacagccca

SEQ ID NO: 109934 - DNA, 25 bp, Rattus norvegicus
agaccttactttgcagaacagccca

SEQ ID NO: 109935 - DNA, 25 bp, Rattus norvegicus
agaccttagcaacctcttacctaga

SEQ ID NO: 109936 - DNA, 25 bp, Rattus norvegicus
agaccttagcaagctcttacctaga

SEQ ID NO: 109937 - DNA, 25 bp, Rattus norvegicus
agaccttagcagaacaccagcagtt

SEQ ID NO: 109938 - DNA, 25 bp, Rattus norvegicus
agaccttagcagtacaccagcagtt

SEQ ID NO: 109939 - DNA, 25 bp, Rattus norvegicus
agaccttatgttcaactttggctta

SEQ ID NO: 109940 - DNA, 25 bp, Rattus norvegicus
agaccttatgttgaactttggctta

SEQ ID NO: 109941 - DNA, 25 bp, Rattus norvegicus
agaccttcaccaacagaacagccag

SEQ ID NO: 109942 - DNA, 25 bp, Rattus norvegicus
agaccttcaccatcagaacagccag

SEQ ID NO: 109943 - DNA, 25 bp, Rattus norvegicus
agaccttcacgccaatgaatcctat

SEQ ID NO: 109944 - DNA, 25 bp, Rattus norvegicus
agaccttcacgcgaatgaatcctat

SEQ ID NO: 109945 - DNA, 25 bp, Rattus norvegicus
agaccttcacttaatcactgtgtgg

SEQ ID NO: 109946 - DNA, 25 bp, Rattus norvegicus
agaccttcactttatcactgtgtgg

SEQ ID NO: 109947 - DNA, 25 bp, Rattus norvegicus
agaccttcagtcagaggcatcacct

SEQ ID NO: 109948 - DNA, 25 bp, Rattus norvegicus
agaccttcagtctgaggcatcacct

SEQ ID NO: 109949 - DNA, 25 bp, Rattus norvegicus
agaccttcagttattccactttcat

SEQ ID NO: 109950 - DNA, 25 bp, Rattus norvegicus
agaccttcagtttttccactttcat

SEQ ID NO: 109951 - DNA, 25 bp, Rattus norvegicus
agaccttcatctatccaggacacag

SEQ ID NO: 109952 - DNA, 25 bp, Rattus norvegicus
agaccttcatctttccaggacacag

SEQ ID NO: 109953 - DNA, 25 bp, Rattus norvegicus
agaccttccagacctgccgtttcaa

SEQ ID NO: 109954 - DNA, 25 bp, Rattus norvegicus
agaccttccagagctgccgtttcaa

SEQ ID NO: 109955 - DNA, 25 bp, Rattus norvegicus
agaccttccatgaggcgagcgagga

SEQ ID NO: 109956 - DNA, 25 bp, Rattus norvegicus
agaccttccatgtggcgagcgagga

SEQ ID NO: 109957 - DNA, 25 bp, Rattus norvegicus
agaccttccctgaagagtgtaaaca

SEQ ID NO: 109958 - DNA, 25 bp, Rattus norvegicus
agaccttccctgtagagtgtaaaca

SEQ ID NO: 109959 - DNA, 25 bp, Rattus norvegicus
agaccttcctctaagctacttgtaa

SEQ ID NO: 109960 - DNA, 25 bp, Rattus norvegicus
agaccttcctcttagctacttgtaa

SEQ ID NO: 109961 - DNA, 25 bp, Rattus norvegicus
agaccttctcgtaaatactctgcaa

SEQ ID NO: 109962 - DNA, 25 bp, Rattus norvegicus
agaccttctcgttaatactctgcaa

SEQ ID NO: 109963 - DNA, 25 bp, Rattus norvegicus
agaccttctgagcaggccgggcaca

SEQ ID NO: 109964 - DNA, 25 bp, Rattus norvegicus
agaccttctgaggaggccgggcaca

SEQ ID NO: 109965 - DNA, 25 bp, Rattus norvegicus
agaccttctgctaaaggctctgctt

SEQ ID NO: 109966 - DNA, 25 bp, Rattus norvegicus
agaccttctgcttaaggctctgctt

SEQ ID NO: 109967 - DNA, 25 bp, Rattus norvegicus
agaccttctggcaatcgattacaac

SEQ ID NO: 109968 - DNA, 25 bp, Rattus norvegicus
agaccttctggctatcgattacaac

SEQ ID NO: 109969 - DNA, 25 bp, Rattus norvegicus
agaccttctggtatctctaccataa

SEQ ID NO: 109970 - DNA, 25 bp, Rattus norvegicus
agaccttctggtttctctaccataa

SEQ ID NO: 109971 - DNA, 25 bp, Rattus norvegicus
agaccttcttcccaagtgattctag

SEQ ID NO: 109972 - DNA, 25 bp, Rattus norvegicus
agaccttcttccgaagtgattctag

SEQ ID NO: 109973 - DNA, 25 bp, Rattus norvegicus
agaccttgaattcttctgtcagaga

SEQ ID NO: 109974 - DNA, 25 bp, Rattus norvegicus
agaccttgaattgttctgtcagaga

SEQ ID NO: 109975 - DNA, 25 bp, Rattus norvegicus
agaccttgacttagagggcaagcga

SEQ ID NO: 109976 - DNA, 25 bp, Rattus norvegicus
agaccttgactttgagggcaagcga

SEQ ID NO: 109977 - DNA, 25 bp, Rattus norvegicus
agaccttgatgcctctgcgcaccgg

SEQ ID NO: 109978 - DNA, 25 bp, Rattus norvegicus
agaccttgatgcgtctgcgcaccgg

SEQ ID NO: 109979 - DNA, 25 bp, Rattus norvegicus
agaccttgcaaccagcagggcttat

SEQ ID NO: 109980 - DNA, 25 bp, Rattus norvegicus
agaccttgcaacgagcagggcttat

SEQ ID NO: 109981 - DNA, 25 bp, Rattus norvegicus
agaccttgcaagcatttgtcccgct

SEQ ID NO: 109982 - DNA, 25 bp, Rattus norvegicus
agaccttgcaaggatttgtcccgct

SEQ ID NO: 109983 - DNA, 25 bp, Rattus norvegicus
agaccttgcagtcacgggtgccaag

SEQ ID NO: 109984 - DNA, 25 bp, Rattus norvegicus
agaccttgcagtgacgggtgccaag

SEQ ID NO: 109985 - DNA, 25 bp, Rattus norvegicus
agaccttggatgaacataccttgga

SEQ ID NO: 109986 - DNA, 25 bp, Rattus norvegicus
agaccttggatgtacataccttgga

SEQ ID NO: 109987 - DNA, 25 bp, Rattus norvegicus
agaccttggattcggactctgactc

SEQ ID NO: 109988 - DNA, 25 bp, Rattus norvegicus
agaccttggattgggactctgactc

SEQ ID NO: 109989 - DNA, 25 bp, Rattus norvegicus
agaccttggcatctttgatacgagc

SEQ ID NO: 109990 - DNA, 25 bp, Rattus norvegicus
agaccttggcatgtttgatacgagc

SEQ ID NO: 109991 - DNA, 25 bp, Rattus norvegicus
agaccttggcttctgacatctaaga

SEQ ID NO: 109992 - DNA, 25 bp, Rattus norvegicus
agaccttggcttgtgacatctaaga

SEQ ID NO: 109993 - DNA, 25 bp, Rattus norvegicus
agaccttgggcacatgctggcctgt

SEQ ID NO: 109994 - DNA, 25 bp, Rattus norvegicus
agaccttgggcagatgctggcctgt

SEQ ID NO: 109995 - DNA, 25 bp, Rattus norvegicus
agaccttgtagcatctctgaagcca

SEQ ID NO: 109996 - DNA, 25 bp, Rattus norvegicus
agaccttgtagcttctctgaagcca

SEQ ID NO: 109997 - DNA, 25 bp, Rattus norvegicus
agaccttgtctgctttagtcctaca

SEQ ID NO: 109998 - DNA, 25 bp, Rattus norvegicus
agaccttgtctggtttagtcctaca

SEQ ID NO: 109999 - DNA, 25 bp, Rattus norvegicus
agaccttgtggcacttgcatagggc

SEQ ID NO: 110000 - DNA, 25 bp, Rattus norvegicus
agaccttgtggctcttgcatagggc

SEQ ID NO: 110001 - DNA, 25 bp, Rattus norvegicus
agaccttgtggtaggttctcctaag

SEQ ID NO: 110002 - DNA, 25 bp, Rattus norvegicus
agaccttgtggttggttctcctaag

SEQ ID NO: 110003 - DNA, 25 bp, Rattus norvegicus
agaccttgtgtacttccttttgcaa

SEQ ID NO: 110004 - DNA, 25 bp, Rattus norvegicus
agaccttgtgtagttccttttgcaa

SEQ ID NO: 110005 - DNA, 25 bp, Rattus norvegicus
agaccttgtgtcagacaggcagaca

SEQ ID NO: 110006 - DNA, 25 bp, Rattus norvegicus
agaccttgtgtctgacaggcagaca

SEQ ID NO: 110007 - DNA, 25 bp, Rattus norvegicus
agacctttaaggacttccctcagat

SEQ ID NO: 110008 - DNA, 25 bp, Rattus norvegicus
agacctttaaggtcttccctcagat

SEQ ID NO: 110009 - DNA, 25 bp, Rattus norvegicus
agacctttaattaggacacgtggag

SEQ ID NO: 110010 - DNA, 25 bp, Rattus norvegicus
agacctttaatttggacacgtggag

SEQ ID NO: 110011 - DNA, 25 bp, Rattus norvegicus
agacctttactcaacagacattcct

SEQ ID NO: 110012 - DNA, 25 bp, Rattus norvegicus
agacctttactctacagacattcct

SEQ ID NO: 110013 - DNA, 25 bp, Rattus norvegicus
agacctttctctaccagtctaggag

SEQ ID NO: 110014 - DNA, 25 bp, Rattus norvegicus
agacctttctcttccagtctaggag

SEQ ID NO: 110015 - DNA, 25 bp, Rattus norvegicus
agacctttctgcaattgacgacaaa

SEQ ID NO: 110016 - DNA, 25 bp, Rattus norvegicus
agacctttctgctattgacgacaaa

SEQ ID NO: 110017 - DNA, 25 bp, Rattus norvegicus
agacctttctgtatgccaattgcct

SEQ ID NO: 110018 - DNA, 25 bp, Rattus norvegicus
agacctttctgtttgccaattgcct

SEQ ID NO: 110019 - DNA, 25 bp, Rattus norvegicus
agacctttctttagaacttatcaag

SEQ ID NO: 110020 - DNA, 25 bp, Rattus norvegicus
agacctttcttttgaacttatcaag

SEQ ID NO: 110021 - DNA, 25 bp, Rattus norvegicus
agacctttgaacagtccctggagct

SEQ ID NO: 110022 - DNA, 25 bp, Rattus norvegicus
agacctttgaactgtccctggagct

SEQ ID NO: 110023 - DNA, 25 bp, Rattus norvegicus
agacctttgccaaatgaagctcgga

SEQ ID NO: 110024 - DNA, 25 bp, Rattus norvegicus
agacctttgccatatgaagctcgga

SEQ ID NO: 110025 - DNA, 25 bp, Rattus norvegicus
agacctttgctgactgtgtgtcccc

SEQ ID NO: 110026 - DNA, 25 bp, Rattus norvegicus
agacctttgctgtctgtgtgtcccc

SEQ ID NO: 110027 - DNA, 25 bp, Rattus norvegicus
agacctttgcttaagagtccgacct

SEQ ID NO: 110028 - DNA, 25 bp, Rattus norvegicus
agacctttgctttagagtccgacct

SEQ ID NO: 110029 - DNA, 25 bp, Rattus norvegicus
agacctttggctatggtgcacgctt

SEQ ID NO: 110030 - DNA, 25 bp, Rattus norvegicus
agacctttggctttggtgcacgctt

SEQ ID NO: 110031 - DNA, 25 bp, Rattus norvegicus
agacctttggttccttcagtctgag

SEQ ID NO: 110032 - DNA, 25 bp, Rattus norvegicus
agacctttggttgcttcagtctgag

SEQ ID NO: 110033 - DNA, 25 bp, Rattus norvegicus
agacctttgtctcatgagtttcatc

SEQ ID NO: 110034 - DNA, 25 bp, Rattus norvegicus
agacctttgtctgatgagtttcatc

SEQ ID NO: 110035 - DNA, 25 bp, Rattus norvegicus
agacctttgttcagacatatgcatg

SEQ ID NO: 110036 - DNA, 25 bp, Rattus norvegicus
agacctttgttctgacatatgcatg

SEQ ID NO: 110037 - DNA, 25 bp, Rattus norvegicus
agaccttttaccagtgatctctcca

SEQ ID NO: 110038 - DNA, 25 bp, Rattus norvegicus
agaccttttacctgtgatctctcca

SEQ ID NO: 110039 - DNA, 25 bp, Rattus norvegicus
agaccttttcatccctgtgtgtcct

SEQ ID NO: 110040 - DNA, 25 bp, Rattus norvegicus
agaccttttcatgcctgtgtgtcct

SEQ ID NO: 110041 - DNA, 25 bp, Rattus norvegicus
agaccttttccaactgttaactctt

SEQ ID NO: 110042 - DNA, 25 bp, Rattus norvegicus
agaccttttccatctgttaactctt

SEQ ID NO: 110043 - DNA, 25 bp, Rattus norvegicus
agaccttttcttaagcactttgatg

SEQ ID NO: 110044 - DNA, 25 bp, Rattus norvegicus
agaccttttctttagcactttgatg

SEQ ID NO: 110045 - DNA, 25 bp, Rattus norvegicus
agacgaaatgtcaatggtagggaat

SEQ ID NO: 110046 - DNA, 25 bp, Rattus norvegicus
agacgaaatgtctatggtagggaat

SEQ ID NO: 110047 - DNA, 25 bp, Rattus norvegicus
agacgaacatacagccttgctctat

SEQ ID NO: 110048 - DNA, 25 bp, Rattus norvegicus
agacgaacatactgccttgctctat

SEQ ID NO: 110049 - DNA, 25 bp, Rattus norvegicus
agacgaactcttagggctcccagaa

SEQ ID NO: 110050 - DNA, 25 bp, Rattus norvegicus
agacgaactctttgggctcccagaa

SEQ ID NO: 110051 - DNA, 25 bp, Rattus norvegicus
agacgaagacataagcctccacctg

SEQ ID NO: 110052 - DNA, 25 bp, Rattus norvegicus
agacgaagacattagcctccacctg

SEQ ID NO: 110053 - DNA, 25 bp, Rattus norvegicus
agacgaagacttcttggacctccaa

SEQ ID NO: 110054 - DNA, 25 bp, Rattus norvegicus
agacgaagacttgttggacctccaa

SEQ ID NO: 110055 - DNA, 25 bp, Rattus norvegicus
agacgaagcttgacacctatatccc

SEQ ID NO: 110056 - DNA, 25 bp, Rattus norvegicus
agacgaagcttgtcacctatatccc

SEQ ID NO: 110057 - DNA, 25 bp, Rattus norvegicus
agacgaaggtcgagcctgagtccag

SEQ ID NO: 110058 - DNA, 25 bp, Rattus norvegicus
agacgaaggtcgtgcctgagtccag

SEQ ID NO: 110059 - DNA, 25 bp, Rattus norvegicus
agacgaataaatcccacagcccttc

SEQ ID NO: 110060 - DNA, 25 bp, Rattus norvegicus
agacgaataaatgccacagcccttc

SEQ ID NO: 110061 - DNA, 25 bp, Rattus norvegicus
agacgaatccaaagccgacgaacca

SEQ ID NO: 110062 - DNA, 25 bp, Rattus norvegicus
agacgaatccaatgccgacgaacca

SEQ ID NO: 110063 - DNA, 25 bp, Rattus norvegicus
agacgacaccacatttgatgagata

SEQ ID NO: 110064 - DNA, 25 bp, Rattus norvegicus
agacgacaccacttttgatgagata

SEQ ID NO: 110065 - DNA, 25 bp, Rattus norvegicus
agacgacacttcaagaggctgcttc

SEQ ID NO: 110066 - DNA, 25 bp, Rattus norvegicus
agacgacacttctagaggctgcttc

SEQ ID NO: 110067 - DNA, 25 bp, Rattus norvegicus
agacgacagctgagcaccataccca

SEQ ID NO: 110068 - DNA, 25 bp, Rattus norvegicus
agacgacagctgtgcaccataccca

SEQ ID NO: 110069 - DNA, 25 bp, Rattus norvegicus
agacgacaggcaccttacaaggaca

SEQ ID NO: 110070 - DNA, 25 bp, Rattus norvegicus
agacgacaggcagcttacaaggaca

SEQ ID NO: 110071 - DNA, 25 bp, Rattus norvegicus
agacgacaggctcctggtcagagaa

SEQ ID NO: 110072 - DNA, 25 bp, Rattus norvegicus
agacgacaggctgctggtcagagaa

SEQ ID NO: 110073 - DNA, 25 bp, Rattus norvegicus
agacgacatacaattttagaagcaa

SEQ ID NO: 110074 - DNA, 25 bp, Rattus norvegicus
agacgacatacatttttagaagcaa

SEQ ID NO: 110075 - DNA, 25 bp, Rattus norvegicus
agacgaccagaacgcagggaccaca

SEQ ID NO: 110076 - DNA, 25 bp, Rattus norvegicus
agacgaccagaaggcagggaccaca

SEQ ID NO: 110077 - DNA, 25 bp, Rattus norvegicus
agacgacccattaacagccaagttg

SEQ ID NO: 110078 - DNA, 25 bp, Rattus norvegicus
agacgacccatttacagccaagttg

SEQ ID NO: 110079 - DNA, 25 bp, Rattus norvegicus
agacgacccgtgaagtagtcattgt

SEQ ID NO: 110080 - DNA, 25 bp, Rattus norvegicus
agacgacccgtgtagtagtcattgt

SEQ ID NO: 110081 - DNA, 25 bp, Rattus norvegicus
agacgaccctgtcctgtgttgtcct

SEQ ID NO: 110082 - DNA, 25 bp, Rattus norvegicus
agacgaccctgtgctgtgttgtcct

SEQ ID NO: 110083 - DNA, 25 bp, Rattus norvegicus
agacgacctgctagagctcatacaa

SEQ ID NO: 110084 - DNA, 25 bp, Rattus norvegicus
agacgacctgcttgagctcatacaa

SEQ ID NO: 110085 - DNA, 25 bp, Rattus norvegicus
agacgacctggacttgtattacaag

SEQ ID NO: 110086 - DNA, 25 bp, Rattus norvegicus
agacgacctggagttgtattacaag

SEQ ID NO: 110087 - DNA, 25 bp, Rattus norvegicus
agacgaccttctcgctgacaggcaa

SEQ ID NO: 110088 - DNA, 25 bp, Rattus norvegicus
agacgaccttctggctgacaggcaa

SEQ ID NO: 110089 - DNA, 25 bp, Rattus norvegicus
agacgactgcacagagtagacctcc

SEQ ID NO: 110090 - DNA, 25 bp, Rattus norvegicus
agacgactgcactgagtagacctcc

SEQ ID NO: 110091 - DNA, 25 bp, Rattus norvegicus
agacgacttggaatatctcagcccc

SEQ ID NO: 110092 - DNA, 25 bp, Rattus norvegicus
agacgacttggattatctcagcccc

SEQ ID NO: 110093 - DNA, 25 bp, Rattus norvegicus
agacgactttgtcagcctttaggat

SEQ ID NO: 110094 - DNA, 25 bp, Rattus norvegicus
agacgactttgtgagcctttaggat

SEQ ID NO: 110095 - DNA, 25 bp, Rattus norvegicus
agacgagaagtacctgcccgtagca

SEQ ID NO: 110096 - DNA, 25 bp, Rattus norvegicus
agacgagaagtagctgcccgtagca

SEQ ID NO: 110097 - DNA, 25 bp, Rattus norvegicus
agacgagaatccacatcccgtgttt

SEQ ID NO: 110098 - DNA, 25 bp, Rattus norvegicus
agacgagaatcctcatcccgtgttt

SEQ ID NO: 110099 - DNA, 25 bp, Rattus norvegicus
agacgagatacacagggttccttaa

SEQ ID NO: 110100 - DNA, 25 bp, Rattus norvegicus
agacgagatacagagggttccttaa

SEQ ID NO: 110101 - DNA, 25 bp, Rattus norvegicus
agacgagatgtacaaggcgctgctt

SEQ ID NO: 110102 - DNA, 25 bp, Rattus norvegicus
agacgagatgtagaaggcgctgctt

SEQ ID NO: 110103 - DNA, 25 bp, Rattus norvegicus
agacgagcagatctccaaggaccca

SEQ ID NO: 110104 - DNA, 25 bp, Rattus norvegicus
agacgagcagatgtccaaggaccca

SEQ ID NO: 110105 - DNA, 25 bp, Rattus norvegicus
agacgagctgttccctgacactgtg

SEQ ID NO: 110106 - DNA, 25 bp, Rattus norvegicus
agacgagctgttgcctgacactgtg

SEQ ID NO: 110107 - DNA, 25 bp, Rattus norvegicus
agacgaggattcacatgtccctaac

SEQ ID NO: 110108 - DNA, 25 bp, Rattus norvegicus
agacgaggattctcatgtccctaac

SEQ ID NO: 110109 - DNA, 25 bp, Rattus norvegicus
agacgagggtctcccaaggagcttt

SEQ ID NO: 110110 - DNA, 25 bp, Rattus norvegicus
agacgagggtctgccaaggagcttt

SEQ ID NO: 110111 - DNA, 25 bp, Rattus norvegicus
agacgagtgagaagtcccctgccaa

SEQ ID NO: 110112 - DNA, 25 bp, Rattus norvegicus
agacgagtgagatgtcccctgccaa

SEQ ID NO: 110113 - DNA, 25 bp, Rattus norvegicus
agacgagtgcctagagcctgagcaa

SEQ ID NO: 110114 - DNA, 25 bp, Rattus norvegicus
agacgagtgccttgagcctgagcaa

SEQ ID NO: 110115 - DNA, 25 bp, Rattus norvegicus
agacgatcctccctgtggcagctcg

SEQ ID NO: 110116 - DNA, 25 bp, Rattus norvegicus
agacgatcctccgtgtggcagctcg

SEQ ID NO: 110117 - DNA, 25 bp, Rattus norvegicus
agacgatctattaggaagtgctccc

SEQ ID NO: 110118 - DNA, 25 bp, Rattus norvegicus
agacgatctatttggaagtgctccc

SEQ ID NO: 110119 - DNA, 25 bp, Rattus norvegicus
agacgatctcagctgtttacgatgc

SEQ ID NO: 110120 - DNA, 25 bp, Rattus norvegicus
agacgatctcaggtgtttacgatgc

SEQ ID NO: 110121 - DNA, 25 bp, Rattus norvegicus
agacgatgaaaccaacctaccacag

SEQ ID NO: 110122 - DNA, 25 bp, Rattus norvegicus
agacgatgaaacgaacctaccacag

SEQ ID NO: 110123 - DNA, 25 bp, Rattus norvegicus
agacgatgacgtccctccagaacag

SEQ ID NO: 110124 - DNA, 25 bp, Rattus norvegicus
agacgatgacgtgcctccagaacag

SEQ ID NO: 110125 - DNA, 25 bp, Rattus norvegicus
agacgatgcctaagactttaccaca

SEQ ID NO: 110126 - DNA, 25 bp, Rattus norvegicus
agacgatgcctatgactttaccaca

SEQ ID NO: 110127 - DNA, 25 bp, Rattus norvegicus
agacgatggacaacctcacgctgga

SEQ ID NO: 110128 - DNA, 25 bp, Rattus norvegicus
agacgatggacatcctcacgctgga

SEQ ID NO: 110129 - DNA, 25 bp, Rattus norvegicus
agacgatggcatctcccagcagcga

SEQ ID NO: 110130 - DNA, 25 bp, Rattus norvegicus
agacgatggcatgtcccagcagcga

SEQ ID NO: 110131 - DNA, 25 bp, Rattus norvegicus
agacgatggctgaagtgtttgaaaa

SEQ ID NO: 110132 - DNA, 25 bp, Rattus norvegicus
agacgatggctgtagtgtttgaaaa

SEQ ID NO: 110133 - DNA, 25 bp, Rattus norvegicus
agacgatgtctgagagtctcactca

SEQ ID NO: 110134 - DNA, 25 bp, Rattus norvegicus
agacgatgtctgtgagtctcactca

SEQ ID NO: 110135 - DNA, 25 bp, Rattus norvegicus
agacgatgtgctaatctgggccagg

SEQ ID NO: 110136 - DNA, 25 bp, Rattus norvegicus
agacgatgtgcttatctgggccagg

SEQ ID NO: 110137 - DNA, 25 bp, Rattus norvegicus
agacgatgtgggacgccaatcttcc

SEQ ID NO: 110138 - DNA, 25 bp, Rattus norvegicus
agacgatgtgggtcgccaatcttcc

SEQ ID NO: 110139 - DNA, 25 bp, Rattus norvegicus
agacgattacaaccggaggcgctgc

SEQ ID NO: 110140 - DNA, 25 bp, Rattus norvegicus
agacgattacaagcggaggcgctgc

SEQ ID NO: 110141 - DNA, 25 bp, Rattus norvegicus
agacgattacaccactcactagtta

SEQ ID NO: 110142 - DNA, 25 bp, Rattus norvegicus
agacgattacacgactcactagtta

SEQ ID NO: 110143 - DNA, 25 bp, Rattus norvegicus
agacgattttgaccgcagtatgcac

SEQ ID NO: 110144 - DNA, 25 bp, Rattus norvegicus
agacgattttgagcgcagtatgcac

SEQ ID NO: 110145 - DNA, 25 bp, Rattus norvegicus
agacgcaagacgatcttccacccta

SEQ ID NO: 110146 - DNA, 25 bp, Rattus norvegicus
agacgcaagacgttcttccacccta

SEQ ID NO: 110147 - DNA, 25 bp, Rattus norvegicus
agacgcaccttcaagaaatacctcc

SEQ ID NO: 110148 - DNA, 25 bp, Rattus norvegicus
agacgcaccttctagaaatacctcc

SEQ ID NO: 110149 - DNA, 25 bp, Rattus norvegicus
agacgcacggtcagatcggcaagga

SEQ ID NO: 110150 - DNA, 25 bp, Rattus norvegicus
agacgcacggtctgatcggcaagga

SEQ ID NO: 110151 - DNA, 25 bp, Rattus norvegicus
agacgcaggagcaggcctccaagcg

SEQ ID NO: 110152 - DNA, 25 bp, Rattus norvegicus
agacgcaggagctggcctccaagcg

SEQ ID NO: 110153 - DNA, 25 bp, Rattus norvegicus
agacgcaggcacctaccgaacagtt

SEQ ID NO: 110154 - DNA, 25 bp, Rattus norvegicus
agacgcaggcacgtaccgaacagtt

SEQ ID NO: 110155 - DNA, 25 bp, Rattus norvegicus
agacgcaggcgtctttctgcttcag

SEQ ID NO: 110156 - DNA, 25 bp, Rattus norvegicus
agacgcaggcgtgtttctgcttcag

SEQ ID NO: 110157 - DNA, 25 bp, Rattus norvegicus
agacgcagggttctctccttgcttt

SEQ ID NO: 110158 - DNA, 25 bp, Rattus norvegicus
agacgcagggttgtctccttgcttt

SEQ ID NO: 110159 - DNA, 25 bp, Rattus norvegicus
agacgcatacttatgtgtcgaccaa

SEQ ID NO: 110160 - DNA, 25 bp, Rattus norvegicus
agacgcatacttttgtgtcgaccaa

SEQ ID NO: 110161 - DNA, 25 bp, Rattus norvegicus
agacgcatcaccaagacactggctg

SEQ ID NO: 110162 - DNA, 25 bp, Rattus norvegicus
agacgcatcacctagacactggctg

SEQ ID NO: 110163 - DNA, 25 bp, Rattus norvegicus
agacgcatctctctagcttcagcta

SEQ ID NO: 110164 - DNA, 25 bp, Rattus norvegicus
agacgcatctctgtagcttcagcta

SEQ ID NO: 110165 - DNA, 25 bp, Rattus norvegicus
agacgcatgggtacagaccggccag

SEQ ID NO: 110166 - DNA, 25 bp, Rattus norvegicus
agacgcatgggttcagaccggccag

SEQ ID NO: 110167 - DNA, 25 bp, Rattus norvegicus
agacgcattgtcaggagtttcaata

SEQ ID NO: 110168 - DNA, 25 bp, Rattus norvegicus
agacgcattgtctggagtttcaata

SEQ ID NO: 110169 - DNA, 25 bp, Rattus norvegicus
agacgccacagtcggtgttcacagg

SEQ ID NO: 110170 - DNA, 25 bp, Rattus norvegicus
agacgccacagtgggtgttcacagg

SEQ ID NO: 110171 - DNA, 25 bp, Rattus norvegicus
agacgccacggcaccagggtttctg

SEQ ID NO: 110172 - DNA, 25 bp, Rattus norvegicus
agacgccacggctccagggtttctg

SEQ ID NO: 110173 - DNA, 25 bp, Rattus norvegicus
agacgccactttcgagagggcaaga

SEQ ID NO: 110174 - DNA, 25 bp, Rattus norvegicus
agacgccactttggagagggcaaga

SEQ ID NO: 110175 - DNA, 25 bp, Rattus norvegicus
agacgccagagacagacgagtccgt

SEQ ID NO: 110176 - DNA, 25 bp, Rattus norvegicus
agacgccagagagagacgagtccgt

SEQ ID NO: 110177 - DNA, 25 bp, Rattus norvegicus
agacgccagcagacctaagaagaag

SEQ ID NO: 110178 - DNA, 25 bp, Rattus norvegicus
agacgccagcagtcctaagaagaag

SEQ ID NO: 110179 - DNA, 25 bp, Rattus norvegicus
agacgccatcgtacccagaggattg

SEQ ID NO: 110180 - DNA, 25 bp, Rattus norvegicus
agacgccatcgttcccagaggattg

SEQ ID NO: 110181 - DNA, 25 bp, Rattus norvegicus
agacgcccaagactatgaccgaagg

SEQ ID NO: 110182 - DNA, 25 bp, Rattus norvegicus
agacgcccaagagtatgaccgaagg

SEQ ID NO: 110183 - DNA, 25 bp, Rattus norvegicus
agacgccgagcgcagggtctcttct

SEQ ID NO: 110184 - DNA, 25 bp, Rattus norvegicus
agacgccgagcggagggtctcttct

SEQ ID NO: 110185 - DNA, 25 bp, Rattus norvegicus
agacgccgaggcatcggacgccgaa

SEQ ID NO: 110186 - DNA, 25 bp, Rattus norvegicus
agacgccgaggcttcggacgccgaa

SEQ ID NO: 110187 - DNA, 25 bp, Rattus norvegicus
agacgcctcgggacatggaagcgcc

SEQ ID NO: 110188 - DNA, 25 bp, Rattus norvegicus
agacgcctcgggtcatggaagcgcc

SEQ ID NO: 110189 - DNA, 25 bp, Rattus norvegicus
agacgcctgaggctgactccagcac

SEQ ID NO: 110190 - DNA, 25 bp, Rattus norvegicus
agacgcctgagggtgactccagcac

SEQ ID NO: 110191 - DNA, 25 bp, Rattus norvegicus
agacgcctggagacaactgactttc

SEQ ID NO: 110192 - DNA, 25 bp, Rattus norvegicus
agacgcctggagtcaactgactttc

SEQ ID NO: 110193 - DNA, 25 bp, Rattus norvegicus
agacgcctggccaccgaggatgagc

SEQ ID NO: 110194 - DNA, 25 bp, Rattus norvegicus
agacgcctggcctccgaggatgagc

SEQ ID NO: 110195 - DNA, 25 bp, Rattus norvegicus
agacgcgagagacgtgcttccgaag

SEQ ID NO: 110196 - DNA, 25 bp, Rattus norvegicus
agacgcgagagaggtgcttccgaag

SEQ ID NO: 110197 - DNA, 25 bp, Rattus norvegicus
agacgcgcacgacttggtcacaact

SEQ ID NO: 110198 - DNA, 25 bp, Rattus norvegicus
agacgcgcacgagttggtcacaact

SEQ ID NO: 110199 - DNA, 25 bp, Rattus norvegicus
agacgcgcaggcatactgtccctta

SEQ ID NO: 110200 - DNA, 25 bp, Rattus norvegicus
agacgcgcaggcttactgtccctta

SEQ ID NO: 110201 - DNA, 25 bp, Rattus norvegicus
agacgcgcccacagaagatgacatg

SEQ ID NO: 110202 - DNA, 25 bp, Rattus norvegicus
agacgcgcccactgaagatgacatg

SEQ ID NO: 110203 - DNA, 25 bp, Rattus norvegicus
agacgcgcctggaccacgacgtagc

SEQ ID NO: 110204 - DNA, 25 bp, Rattus norvegicus
agacgcgcctggtccacgacgtagc

SEQ ID NO: 110205 - DNA, 25 bp, Rattus norvegicus
agacgcgggtgcatcctgttgcctt

SEQ ID NO: 110206 - DNA, 25 bp, Rattus norvegicus
agacgcgggtgcttcctgttgcctt

SEQ ID NO: 110207 - DNA, 25 bp, Rattus norvegicus
agacgcggtctacgattacatcaac

SEQ ID NO: 110208 - DNA, 25 bp, Rattus norvegicus
agacgcggtctaggattacatcaac

SEQ ID NO: 110209 - DNA, 25 bp, Rattus norvegicus
agacgcgtaaccagagtttctccaa

SEQ ID NO: 110210 - DNA, 25 bp, Rattus norvegicus
agacgcgtaacctgagtttctccaa

SEQ ID NO: 110211 - DNA, 25 bp, Rattus norvegicus
agacgcgtatgccaaactgtgactc

SEQ ID NO: 110212 - DNA, 25 bp, Rattus norvegicus
agacgcgtatgcgaaactgtgactc

SEQ ID NO: 110213 - DNA, 25 bp, Rattus norvegicus
agacgcgtatgtaactccagtgatg

SEQ ID NO: 110214 - DNA, 25 bp, Rattus norvegicus
agacgcgtatgttactccagtgatg

SEQ ID NO: 110215 - DNA, 25 bp, Rattus norvegicus
agacgcgtcggaatgccaagtggct

SEQ ID NO: 110216 - DNA, 25 bp, Rattus norvegicus
agacgcgtcggattgccaagtggct

SEQ ID NO: 110217 - DNA, 25 bp, Rattus norvegicus
agacgcgtctacaagcccagagcag

SEQ ID NO: 110218 - DNA, 25 bp, Rattus norvegicus
agacgcgtctactagcccagagcag

SEQ ID NO: 110219 - DNA, 25 bp, Rattus norvegicus
agacgcgtggttattgcagttgctt

SEQ ID NO: 110220 - DNA, 25 bp, Rattus norvegicus
agacgcgtggtttttgcagttgctt

SEQ ID NO: 110221 - DNA, 25 bp, Rattus norvegicus
agacgctaatctcaccccagtggtc

SEQ ID NO: 110222 - DNA, 25 bp, Rattus norvegicus
agacgctaatctgaccccagtggtc

SEQ ID NO: 110223 - DNA, 25 bp, Rattus norvegicus
agacgctacaaccacgagacagagt

SEQ ID NO: 110224 - DNA, 25 bp, Rattus norvegicus
agacgctacaacgacgagacagagt

SEQ ID NO: 110225 - DNA, 25 bp, Rattus norvegicus
agacgctagaccagcattgcagcac

SEQ ID NO: 110226 - DNA, 25 bp, Rattus norvegicus
agacgctagacctgcattgcagcac

SEQ ID NO: 110227 - DNA, 25 bp, Rattus norvegicus
agacgctagggtctcatgggtccct

SEQ ID NO: 110228 - DNA, 25 bp, Rattus norvegicus
agacgctagggtgtcatgggtccct

SEQ ID NO: 110229 - DNA, 25 bp, Rattus norvegicus
agacgctatgtcagcagtctccagg

SEQ ID NO: 110230 - DNA, 25 bp, Rattus norvegicus
agacgctatgtctgcagtctccagg

SEQ ID NO: 110231 - DNA, 25 bp, Rattus norvegicus
agacgctattggcttttctcactgt

SEQ ID NO: 110232 - DNA, 25 bp, Rattus norvegicus
agacgctattgggttttctcactgt

SEQ ID NO: 110233 - DNA, 25 bp, Rattus norvegicus
agacgctcctctagtgccagtgtga

SEQ ID NO: 110234 - DNA, 25 bp, Rattus norvegicus
agacgctcctcttgtgccagtgtga

SEQ ID NO: 110235 - DNA, 25 bp, Rattus norvegicus
agacgctcgtgcagttagtggacat

SEQ ID NO: 110236 - DNA, 25 bp, Rattus norvegicus
agacgctcgtgctgttagtggacat

SEQ ID NO: 110237 - DNA, 25 bp, Rattus norvegicus
agacgctctctgcaatcaaattttt

SEQ ID NO: 110238 - DNA, 25 bp, Rattus norvegicus
agacgctctctggaatcaaattttt

SEQ ID NO: 110239 - DNA, 25 bp, Rattus norvegicus
agacgctgagcccttggagatcatc

SEQ ID NO: 110240 - DNA, 25 bp, Rattus norvegicus
agacgctgagccgttggagatcatc

SEQ ID NO: 110241 - DNA, 25 bp, Rattus norvegicus
agacgctgatgaagagccggcctgt

SEQ ID NO: 110242 - DNA, 25 bp, Rattus norvegicus
agacgctgatgatgagccggcctgt

SEQ ID NO: 110243 - DNA, 25 bp, Rattus norvegicus
agacgctgccttcccaggaaaatgt

SEQ ID NO: 110244 - DNA, 25 bp, Rattus norvegicus
agacgctgccttgccaggaaaatgt

SEQ ID NO: 110245 - DNA, 25 bp, Rattus norvegicus
agacgctgcttcactttggtcagat

SEQ ID NO: 110246 - DNA, 25 bp, Rattus norvegicus
agacgctgcttctctttggtcagat

SEQ ID NO: 110247 - DNA, 25 bp, Rattus norvegicus
agacgctggagcagcagaatctgat

SEQ ID NO: 110248 - DNA, 25 bp, Rattus norvegicus
agacgctggagctgcagaatctgat

SEQ ID NO: 110249 - DNA, 25 bp, Rattus norvegicus
agacgctggattagattgttgtgat

SEQ ID NO: 110250 - DNA, 25 bp, Rattus norvegicus
agacgctggatttgattgttgtgat

SEQ ID NO: 110251 - DNA, 25 bp, Rattus norvegicus
agacgctggcccatgtgctgacagt

SEQ ID NO: 110252 - DNA, 25 bp, Rattus norvegicus
agacgctggcccttgtgctgacagt

SEQ ID NO: 110253 - DNA, 25 bp, Rattus norvegicus
agacgctggctcctgatgagtcccg

SEQ ID NO: 110254 - DNA, 25 bp, Rattus norvegicus
agacgctggctcgtgatgagtcccg

SEQ ID NO: 110255 - DNA, 25 bp, Rattus norvegicus
agacgctggtgtcgtgtctgcacaa

SEQ ID NO: 110256 - DNA, 25 bp, Rattus norvegicus
agacgctggtgtggtgtctgcacaa

SEQ ID NO: 110257 - DNA, 25 bp, Rattus norvegicus
agacgctgtctacctgaaatacctg

SEQ ID NO: 110258 - DNA, 25 bp, Rattus norvegicus
agacgctgtctagctgaaatacctg

SEQ ID NO: 110259 - DNA, 25 bp, Rattus norvegicus
agacgctgtgacaatcaaggactca

SEQ ID NO: 110260 - DNA, 25 bp, Rattus norvegicus
agacgctgtgactatcaaggactca

SEQ ID NO: 110261 - DNA, 25 bp, Rattus norvegicus
agacgctgtgcgcatgcccattggt

SEQ ID NO: 110262 - DNA, 25 bp, Rattus norvegicus
agacgctgtgcggatgcccattggt

SEQ ID NO: 110263 - DNA, 25 bp, Rattus norvegicus
agacgctgttagcacgctggcagaa

SEQ ID NO: 110264 - DNA, 25 bp, Rattus norvegicus
agacgctgttaggacgctggcagaa

SEQ ID NO: 110265 - DNA, 25 bp, Rattus norvegicus
agacgcttgtaacttttattgtgac

SEQ ID NO: 110266 - DNA, 25 bp, Rattus norvegicus
agacgcttgtaagttttattgtgac

SEQ ID NO: 110267 - DNA, 25 bp, Rattus norvegicus
agacggaaaggtcaagcccagcttc

SEQ ID NO: 110268 - DNA, 25 bp, Rattus norvegicus
agacggaaaggtgaagcccagcttc

SEQ ID NO: 110269 - DNA, 25 bp, Rattus norvegicus
agacggaatgttagaccccactcat

SEQ ID NO: 110270 - DNA, 25 bp, Rattus norvegicus
agacggaatgtttgaccccactcat

SEQ ID NO: 110271 - DNA, 25 bp, Rattus norvegicus
agacggacagaaagaccagccaccc

SEQ ID NO: 110272 - DNA, 25 bp, Rattus norvegicus
agacggacagaatgaccagccaccc

SEQ ID NO: 110273 - DNA, 25 bp, Rattus norvegicus
agacggacagcaaagagcaatctct

SEQ ID NO: 110274 - DNA, 25 bp, Rattus norvegicus
agacggacagcatagagcaatctct

SEQ ID NO: 110275 - DNA, 25 bp, Rattus norvegicus
agacggacaggaagcatatcttcaa

SEQ ID NO: 110276 - DNA, 25 bp, Rattus norvegicus
agacggacaggatgcatatcttcaa

SEQ ID NO: 110277 - DNA, 25 bp, Rattus norvegicus
agacggacctctccggacagttgtg

SEQ ID NO: 110278 - DNA, 25 bp, Rattus norvegicus
agacggacctctgcggacagttgtg

SEQ ID NO: 110279 - DNA, 25 bp, Rattus norvegicus
agacggacgcgtcggcaccaactgt

SEQ ID NO: 110280 - DNA, 25 bp, Rattus norvegicus
agacggacgcgtgggcaccaactgt

SEQ ID NO: 110281 - DNA, 25 bp, Rattus norvegicus
agacggactctaagaccctcaagtg

SEQ ID NO: 110282 - DNA, 25 bp, Rattus norvegicus
agacggactctatgaccctcaagtg

SEQ ID NO: 110283 - DNA, 25 bp, Rattus norvegicus
agacggactgcacgtgtcgtttcgc

SEQ ID NO: 110284 - DNA, 25 bp, Rattus norvegicus
agacggactgcaggtgtcgtttcgc

SEQ ID NO: 110285 - DNA, 25 bp, Rattus norvegicus
agacggacttgaatgactttttaat

SEQ ID NO: 110286 - DNA, 25 bp, Rattus norvegicus
agacggacttgattgactttttaat

SEQ ID NO: 110287 - DNA, 25 bp, Rattus norvegicus
agacggagaacaccgcgctgcagct

SEQ ID NO: 110288 - DNA, 25 bp, Rattus norvegicus
agacggagaacagcgcgctgcagct

SEQ ID NO: 110289 - DNA, 25 bp, Rattus norvegicus
agacggagaagcaccagtcgccaga

SEQ ID NO: 110290 - DNA, 25 bp, Rattus norvegicus
agacggagaagctccagtcgccaga

SEQ ID NO: 110291 - DNA, 25 bp, Rattus norvegicus
agacggagactccttagctctctgc

SEQ ID NO: 110292 - DNA, 25 bp, Rattus norvegicus
agacggagactcgttagctctctgc

SEQ ID NO: 110293 - DNA, 25 bp, Rattus norvegicus
agacggagagatcacctcaggagat

SEQ ID NO: 110294 - DNA, 25 bp, Rattus norvegicus
agacggagagatgacctcaggagat

SEQ ID NO: 110295 - DNA, 25 bp, Rattus norvegicus
agacggaggctgagcttgaccatcg

SEQ ID NO: 110296 - DNA, 25 bp, Rattus norvegicus
agacggaggctgtgcttgaccatcg

SEQ ID NO: 110297 - DNA, 25 bp, Rattus norvegicus
agacggaggcttaccttatgaagac

SEQ ID NO: 110298 - DNA, 25 bp, Rattus norvegicus
agacggaggctttccttatgaagac

SEQ ID NO: 110299 - DNA, 25 bp, Rattus norvegicus
agacggagtctcacttttgacctat

SEQ ID NO: 110300 - DNA, 25 bp, Rattus norvegicus
agacggagtctctcttttgacctat

SEQ ID NO: 110301 - DNA, 25 bp, Rattus norvegicus
agacggatagccacattcagacgac

SEQ ID NO: 110302 - DNA, 25 bp, Rattus norvegicus
agacggatagcctcattcagacgac

SEQ ID NO: 110303 - DNA, 25 bp, Rattus norvegicus
agacggatgtctactccatggctct

SEQ ID NO: 110304 - DNA, 25 bp, Rattus norvegicus
agacggatgtcttctccatggctct

SEQ ID NO: 110305 - DNA, 25 bp, Rattus norvegicus
agacggcaagatccactgggccaga

SEQ ID NO: 110306 - DNA, 25 bp, Rattus norvegicus
agacggcaagatgcactgggccaga

SEQ ID NO: 110307 - DNA, 25 bp, Rattus norvegicus
agacggcacaatcgagtccgggata

SEQ ID NO: 110308 - DNA, 25 bp, Rattus norvegicus
agacggcacaatggagtccgggata

SEQ ID NO: 110309 - DNA, 25 bp, Rattus norvegicus
agacggcactgcaggctgagtaaat

SEQ ID NO: 110310 - DNA, 25 bp, Rattus norvegicus
agacggcactgctggctgagtaaat

SEQ ID NO: 110311 - DNA, 25 bp, Rattus norvegicus
agacggcaggacaccagcatgcgct

SEQ ID NO: 110312 - DNA, 25 bp, Rattus norvegicus
agacggcaggactccagcatgcgct

SEQ ID NO: 110313 - DNA, 25 bp, Rattus norvegicus
agacggccaactccgcagcaagagg

SEQ ID NO: 110314 - DNA, 25 bp, Rattus norvegicus
agacggccaactgcgcagcaagagg

SEQ ID NO: 110315 - DNA, 25 bp, Rattus norvegicus
agacggccaagtacctggtcgcgct

SEQ ID NO: 110316 - DNA, 25 bp, Rattus norvegicus
agacggccaagttcctggtcgcgct

SEQ ID NO: 110317 - DNA, 25 bp, Rattus norvegicus
agacggccaattacttctctcaatg

SEQ ID NO: 110318 - DNA, 25 bp, Rattus norvegicus
agacggccaatttcttctctcaatg

SEQ ID NO: 110319 - DNA, 25 bp, Rattus norvegicus
agacggccacctcaagaatgagttt

SEQ ID NO: 110320 - DNA, 25 bp, Rattus norvegicus
agacggccacctgaagaatgagttt

SEQ ID NO: 110321 - DNA, 25 bp, Rattus norvegicus
agacggccagccacttggatgtgat

SEQ ID NO: 110322 - DNA, 25 bp, Rattus norvegicus
agacggccagcctcttggatgtgat

SEQ ID NO: 110323 - DNA, 25 bp, Rattus norvegicus
agacggccatgacatcatcctgcag

SEQ ID NO: 110324 - DNA, 25 bp, Rattus norvegicus
agacggccatgagatcatcctgcag

SEQ ID NO: 110325 - DNA, 25 bp, Rattus norvegicus
agacggcgccgtatgcggtctcatg

SEQ ID NO: 110326 - DNA, 25 bp, Rattus norvegicus
agacggcgccgtttgcggtctcatg

SEQ ID NO: 110327 - DNA, 25 bp, Rattus norvegicus
agacggcggcctacattgagcggct

SEQ ID NO: 110328 - DNA, 25 bp, Rattus norvegicus
agacggcggccttcattgagcggct

SEQ ID NO: 110329 - DNA, 25 bp, Rattus norvegicus
agacggctccgtcaggaagagtacc

SEQ ID NO: 110330 - DNA, 25 bp, Rattus norvegicus
agacggctccgtgaggaagagtacc

SEQ ID NO: 110331 - DNA, 25 bp, Rattus norvegicus
agacggctgccgagcagatgcccac

SEQ ID NO: 110332 - DNA, 25 bp, Rattus norvegicus
agacggctgccgtgcagatgcccac

SEQ ID NO: 110333 - DNA, 25 bp, Rattus norvegicus
agacggctggtcaactgcattcggt

SEQ ID NO: 110334 - DNA, 25 bp, Rattus norvegicus
agacggctggtctactgcattcggt

SEQ ID NO: 110335 - DNA, 25 bp, Rattus norvegicus
agacggcttaatctctactccagtg

SEQ ID NO: 110336 - DNA, 25 bp, Rattus norvegicus
agacggcttaatgtctactccagtg

SEQ ID NO: 110337 - DNA, 25 bp, Rattus norvegicus
agacgggacacacctgttggacaca

SEQ ID NO: 110338 - DNA, 25 bp, Rattus norvegicus
agacgggacacagctgttggacaca

SEQ ID NO: 110339 - DNA, 25 bp, Rattus norvegicus
agacgggacccgcaaacagcacatg

SEQ ID NO: 110340 - DNA, 25 bp, Rattus norvegicus
agacgggacccggaaacagcacatg

SEQ ID NO: 110341 - DNA, 25 bp, Rattus norvegicus
agacgggagtctacacctgcgaagt

SEQ ID NO: 110342 - DNA, 25 bp, Rattus norvegicus
agacgggagtcttcacctgcgaagt

SEQ ID NO: 110343 - DNA, 25 bp, Rattus norvegicus
agacgggcagtcaataccacatggg

SEQ ID NO: 110344 - DNA, 25 bp, Rattus norvegicus
agacgggcagtctataccacatggg

SEQ ID NO: 110345 - DNA, 25 bp, Rattus norvegicus
agacgggcattcaaactctgtttct

SEQ ID NO: 110346 - DNA, 25 bp, Rattus norvegicus
agacgggcattctaactctgtttct

SEQ ID NO: 110347 - DNA, 25 bp, Rattus norvegicus
agacgggcccggacatgctgcagat

SEQ ID NO: 110348 - DNA, 25 bp, Rattus norvegicus
agacgggcccggtcatgctgcagat

SEQ ID NO: 110349 - DNA, 25 bp, Rattus norvegicus
agacgggctctcactttgaagctga

SEQ ID NO: 110350 - DNA, 25 bp, Rattus norvegicus
agacgggctctctctttgaagctga

SEQ ID NO: 110351 - DNA, 25 bp, Rattus norvegicus
agacgggctttcacagaggctgaca

SEQ ID NO: 110352 - DNA, 25 bp, Rattus norvegicus
agacgggctttctcagaggctgaca

SEQ ID NO: 110353 - DNA, 25 bp, Rattus norvegicus
agacgggtcaggagctaacggaatt

SEQ ID NO: 110354 - DNA, 25 bp, Rattus norvegicus
agacgggtcaggtgctaacggaatt

SEQ ID NO: 110355 - DNA, 25 bp, Rattus norvegicus
agacgggtctagaagccagcatgat

SEQ ID NO: 110356 - DNA, 25 bp, Rattus norvegicus
agacgggtctagtagccagcatgat

SEQ ID NO: 110357 - DNA, 25 bp, Rattus norvegicus
agacgggtcttgcagttctgttcca

SEQ ID NO: 110358 - DNA, 25 bp, Rattus norvegicus
agacgggtcttggagttctgttcca

SEQ ID NO: 110359 - DNA, 25 bp, Rattus norvegicus
agacgggtgattatgcctcgagcaa

SEQ ID NO: 110360 - DNA, 25 bp, Rattus norvegicus
agacgggtgattttgcctcgagcaa

SEQ ID NO: 110361 - DNA, 25 bp, Rattus norvegicus
agacgggtgcttcctgaacactgac

SEQ ID NO: 110362 - DNA, 25 bp, Rattus norvegicus
agacgggtgcttgctgaacactgac

SEQ ID NO: 110363 - DNA, 25 bp, Rattus norvegicus
agacggtaagatctgaacctattta

SEQ ID NO: 110364 - DNA, 25 bp, Rattus norvegicus
agacggtaagatgtgaacctattta

SEQ ID NO: 110365 - DNA, 25 bp, Rattus norvegicus
agacggtcacctcttggagcattgc

SEQ ID NO: 110366 - DNA, 25 bp, Rattus norvegicus
agacggtcacctgttggagcattgc

SEQ ID NO: 110367 - DNA, 25 bp, Rattus norvegicus
agacggtcactaactgcgcccagga

SEQ ID NO: 110368 - DNA, 25 bp, Rattus norvegicus
agacggtcactatctgcgcccagga

SEQ ID NO: 110369 - DNA, 25 bp, Rattus norvegicus
agacggtcactcatggaatccacta

SEQ ID NO: 110370 - DNA, 25 bp, Rattus norvegicus
agacggtcactcttggaatccacta

SEQ ID NO: 110371 - DNA, 25 bp, Rattus norvegicus
agacggtcagacaactaggtatgga

SEQ ID NO: 110372 - DNA, 25 bp, Rattus norvegicus
agacggtcagactactaggtatgga

SEQ ID NO: 110373 - DNA, 25 bp, Rattus norvegicus
agacggtcagcaacagcacgggtga

SEQ ID NO: 110374 - DNA, 25 bp, Rattus norvegicus
agacggtcagcactgaggccctcat

SEQ ID NO: 110375 - DNA, 25 bp, Rattus norvegicus
agacggtcagcagtgaggccctcat

SEQ ID NO: 110376 - DNA, 25 bp, Rattus norvegicus
agacggtcagcatcagcacgggtga

SEQ ID NO: 110377 - DNA, 25 bp, Rattus norvegicus
agacggtcctctctggagccttggt

SEQ ID NO: 110378 - DNA, 25 bp, Rattus norvegicus
agacggtcctctgtggagccttggt

SEQ ID NO: 110379 - DNA, 25 bp, Rattus norvegicus
agacggtgaggcagttcacagccct

SEQ ID NO: 110380 - DNA, 25 bp, Rattus norvegicus
agacggtgaggccatcttctatgag

SEQ ID NO: 110381 - DNA, 25 bp, Rattus norvegicus
agacggtgaggcgatcttctatgag

SEQ ID NO: 110382 - DNA, 25 bp, Rattus norvegicus
agacggtgaggctgttcacagccct

SEQ ID NO: 110383 - DNA, 25 bp, Rattus norvegicus
agacggtgctgcatctcggcttgag

SEQ ID NO: 110384 - DNA, 25 bp, Rattus norvegicus
agacggtgctgcttctcggcttgag

SEQ ID NO: 110385 - DNA, 25 bp, Rattus norvegicus
agacggtggctcaggcccacttgtg

SEQ ID NO: 110386 - DNA, 25 bp, Rattus norvegicus
agacggtggctctggcccacttgtg

SEQ ID NO: 110387 - DNA, 25 bp, Rattus norvegicus
agacggtggtaaagctatcccttgt

SEQ ID NO: 110388 - DNA, 25 bp, Rattus norvegicus
agacggtggtaatgctatcccttgt

SEQ ID NO: 110389 - DNA, 25 bp, Rattus norvegicus
agacggtgttccagtgcgcagatac

SEQ ID NO: 110390 - DNA, 25 bp, Rattus norvegicus
agacggtgttcctgtgcgcagatac

SEQ ID NO: 110391 - DNA, 25 bp, Rattus norvegicus
agacggtgtttgctttgcctgcata

SEQ ID NO: 110392 - DNA, 25 bp, Rattus norvegicus
agacggtgtttggtttgcctgcata

SEQ ID NO: 110393 - DNA, 25 bp, Rattus norvegicus
agacggttaattacacaggtgcttt

SEQ ID NO: 110394 - DNA, 25 bp, Rattus norvegicus
agacggttaatttcacaggtgcttt

SEQ ID NO: 110395 - DNA, 25 bp, Rattus norvegicus
agacggttactgcatgttccacact

SEQ ID NO: 110396 - DNA, 25 bp, Rattus norvegicus
agacggttactggatgttccacact

SEQ ID NO: 110397 - DNA, 25 bp, Rattus norvegicus
agacggttcaaaagctgctcctctg

SEQ ID NO: 110398 - DNA, 25 bp, Rattus norvegicus
agacggttcaaatgctgctcctctg

SEQ ID NO: 110399 - DNA, 25 bp, Rattus norvegicus
agacggttccatagtgtacggcggt

SEQ ID NO: 110400 - DNA, 25 bp, Rattus norvegicus
agacggttccattgtgtacggcggt

SEQ ID NO: 110401 - DNA, 25 bp, Rattus norvegicus
agacggttgcaaactgttgttgttt

SEQ ID NO: 110402 - DNA, 25 bp, Rattus norvegicus
agacggttgcaatctgttgttgttt

SEQ ID NO: 110403 - DNA, 25 bp, Rattus norvegicus
agacgtaagagacctcactcccaca

SEQ ID NO: 110404 - DNA, 25 bp, Rattus norvegicus
agacgtaagagagctcactcccaca

SEQ ID NO: 110405 - DNA, 25 bp, Rattus norvegicus
agacgtacagcacggagcccaataa

SEQ ID NO: 110406 - DNA, 25 bp, Rattus norvegicus
agacgtacagcagggagcccaataa

SEQ ID NO: 110407 - DNA, 25 bp, Rattus norvegicus
agacgtagcgtgctccgcttagctg

SEQ ID NO: 110408 - DNA, 25 bp, Rattus norvegicus
agacgtagcgtggtccgcttagctg

SEQ ID NO: 110409 - DNA, 25 bp, Rattus norvegicus
agacgtagctcaagactgaccgcca

SEQ ID NO: 110410 - DNA, 25 bp, Rattus norvegicus
agacgtagctcatgactgaccgcca

SEQ ID NO: 110411 - DNA, 25 bp, Rattus norvegicus
agacgtatccgtcgtctgctgagga

SEQ ID NO: 110412 - DNA, 25 bp, Rattus norvegicus
agacgtatccgtggtctgctgagga

SEQ ID NO: 110413 - DNA, 25 bp, Rattus norvegicus
agacgtatgagcagtgctgcgacat

SEQ ID NO: 110414 - DNA, 25 bp, Rattus norvegicus
agacgtatgagctgtgctgcgacat

SEQ ID NO: 110415 - DNA, 25 bp, Rattus norvegicus
agacgtatggaaactcttcctcgtt

SEQ ID NO: 110416 - DNA, 25 bp, Rattus norvegicus
agacgtatggaatctcttcctcgtt

SEQ ID NO: 110417 - DNA, 25 bp, Rattus norvegicus
agacgtcaactactaaggcgaaaga

SEQ ID NO: 110418 - DNA, 25 bp, Rattus norvegicus
agacgtcaactagtaaggcgaaaga

SEQ ID NO: 110419 - DNA, 25 bp, Rattus norvegicus
agacgtcaagttagcctctgaagct

SEQ ID NO: 110420 - DNA, 25 bp, Rattus norvegicus
agacgtcaagtttgcctctgaagct

SEQ ID NO: 110421 - DNA, 25 bp, Rattus norvegicus
agacgtcactgcaatagattcccat

SEQ ID NO: 110422 - DNA, 25 bp, Rattus norvegicus
agacgtcactgctatagattcccat

SEQ ID NO: 110423 - DNA, 25 bp, Rattus norvegicus
agacgtcagaacagcctctctagag

SEQ ID NO: 110424 - DNA, 25 bp, Rattus norvegicus
agacgtcagaactgcctctctagag

SEQ ID NO: 110425 - DNA, 25 bp, Rattus norvegicus
agacgtcaggcgatacaggacttga

SEQ ID NO: 110426 - DNA, 25 bp, Rattus norvegicus
agacgtcaggcgttacaggacttga

SEQ ID NO: 110427 - DNA, 25 bp, Rattus norvegicus
agacgtccactgaactttatcctca

SEQ ID NO: 110428 - DNA, 25 bp, Rattus norvegicus
agacgtccactgtactttatcctca

SEQ ID NO: 110429 - DNA, 25 bp, Rattus norvegicus
agacgtccaggtcgtactgtttcct

SEQ ID NO: 110430 - DNA, 25 bp, Rattus norvegicus
agacgtccaggtggtactgtttcct

SEQ ID NO: 110431 - DNA, 25 bp, Rattus norvegicus
agacgtcccctaatgactgtggaga

SEQ ID NO: 110432 - DNA, 25 bp, Rattus norvegicus
agacgtcccctattgactgtggaga

SEQ ID NO: 110433 - DNA, 25 bp, Rattus norvegicus
agacgtcctcgcatgctgtgtcgtg

SEQ ID NO: 110434 - DNA, 25 bp, Rattus norvegicus
agacgtcctcgcttgctgtgtcgtg

SEQ ID NO: 110435 - DNA, 25 bp, Rattus norvegicus
agacgtcctgccagtgaataaacct

SEQ ID NO: 110436 - DNA, 25 bp, Rattus norvegicus
agacgtcctgcctgtgaataaacct

SEQ ID NO: 110437 - DNA, 25 bp, Rattus norvegicus
agacgtctacctagagtgtttccag

SEQ ID NO: 110438 - DNA, 25 bp, Rattus norvegicus
agacgtctaccttgagtgtttccag

SEQ ID NO: 110439 - DNA, 25 bp, Rattus norvegicus
agacgtctatcccagagtgaggcct

SEQ ID NO: 110440 - DNA, 25 bp, Rattus norvegicus
agacgtctatccgagagtgaggcct

SEQ ID NO: 110441 - DNA, 25 bp, Rattus norvegicus
agacgtctccaacatgagccgcttg

SEQ ID NO: 110442 - DNA, 25 bp, Rattus norvegicus
agacgtctccaagatgagccgcttg

SEQ ID NO: 110443 - DNA, 25 bp, Rattus norvegicus
agacgtctccacagttttctgtgtg

SEQ ID NO: 110444 - DNA, 25 bp, Rattus norvegicus
agacgtctccactgttttctgtgtg

SEQ ID NO: 110445 - DNA, 25 bp, Rattus norvegicus
agacgtctgctaaaacgcgcgccaa

SEQ ID NO: 110446 - DNA, 25 bp, Rattus norvegicus
agacgtctgctataacgcgcgccaa

SEQ ID NO: 110447 - DNA, 25 bp, Rattus norvegicus
agacgtctggcacaatctctactga

SEQ ID NO: 110448 - DNA, 25 bp, Rattus norvegicus
agacgtctggcagaatctctactga

SEQ ID NO: 110449 - DNA, 25 bp, Rattus norvegicus
agacgtcttttccagttcatcaaca

SEQ ID NO: 110450 - DNA, 25 bp, Rattus norvegicus
agacgtcttttcgagttcatcaaca

SEQ ID NO: 110451 - DNA, 25 bp, Rattus norvegicus
agacgtgaagcacgctgggactcct

SEQ ID NO: 110452 - DNA, 25 bp, Rattus norvegicus
agacgtgaagcaggctgggactcct

SEQ ID NO: 110453 - DNA, 25 bp, Rattus norvegicus
agacgtgacagcacctgttcacaga

SEQ ID NO: 110454 - DNA, 25 bp, Rattus norvegicus
agacgtgacagctcctgttcacaga

SEQ ID NO: 110455 - DNA, 25 bp, Rattus norvegicus
agacgtgactatcggacctgccgac

SEQ ID NO: 110456 - DNA, 25 bp, Rattus norvegicus
agacgtgactatgggacctgccgac

SEQ ID NO: 110457 - DNA, 25 bp, Rattus norvegicus
agacgtgactctcacctgggtggat

SEQ ID NO: 110458 - DNA, 25 bp, Rattus norvegicus
agacgtgactctgacctgggtggat

SEQ ID NO: 110459 - DNA, 25 bp, Rattus norvegicus
agacgtgagagtaccctggtccagg

SEQ ID NO: 110460 - DNA, 25 bp, Rattus norvegicus
agacgtgagagttccctggtccagg

SEQ ID NO: 110461 - DNA, 25 bp, Rattus norvegicus
agacgtgagtctatcctctgaggac

SEQ ID NO: 110462 - DNA, 25 bp, Rattus norvegicus
agacgtgagtctttcctctgaggac

SEQ ID NO: 110463 - DNA, 25 bp, Rattus norvegicus
agacgtgatgatcgcatgaactgct

SEQ ID NO: 110464 - DNA, 25 bp, Rattus norvegicus
agacgtgatgatggcatgaactgct

SEQ ID NO: 110465 - DNA, 25 bp, Rattus norvegicus
agacgtgattcaccaacttctcgga

SEQ ID NO: 110466 - DNA, 25 bp, Rattus norvegicus
agacgtgattcagcaacttctcgga

SEQ ID NO: 110467 - DNA, 25 bp, Rattus norvegicus
agacgtgcactccattttaaacctt

SEQ ID NO: 110468 - DNA, 25 bp, Rattus norvegicus
agacgtgcactcgattttaaacctt

SEQ ID NO: 110469 - DNA, 25 bp, Rattus norvegicus
agacgtgcactgaccgtgaccgtga

SEQ ID NO: 110470 - DNA, 25 bp, Rattus norvegicus
agacgtgcactgtccgtgaccgtga

SEQ ID NO: 110471 - DNA, 25 bp, Rattus norvegicus
agacgtgcagttcggatcatcaaaa

SEQ ID NO: 110472 - DNA, 25 bp, Rattus norvegicus
agacgtgcagttgggatcatcaaaa

SEQ ID NO: 110473 - DNA, 25 bp, Rattus norvegicus
agacgtgccaccagctaagagcttc

SEQ ID NO: 110474 - DNA, 25 bp, Rattus norvegicus
agacgtgccacctgctaagagcttc

SEQ ID NO: 110475 - DNA, 25 bp, Rattus norvegicus
agacgtgccagtcttgtgtggtcat

SEQ ID NO: 110476 - DNA, 25 bp, Rattus norvegicus
agacgtgccagtgttgtgtggtcat

SEQ ID NO: 110477 - DNA, 25 bp, Rattus norvegicus
agacgtgccatcagtgtggacacaa

SEQ ID NO: 110478 - DNA, 25 bp, Rattus norvegicus
agacgtgccatctgtgtggacacaa

SEQ ID NO: 110479 - DNA, 25 bp, Rattus norvegicus
agacgtgcctcgcaagctgctgagc

SEQ ID NO: 110480 - DNA, 25 bp, Rattus norvegicus
agacgtgcctcggaagctgctgagc

SEQ ID NO: 110481 - DNA, 25 bp, Rattus norvegicus
agacgtgccttaccctttgctagaa

SEQ ID NO: 110482 - DNA, 25 bp, Rattus norvegicus
agacgtgccttagcctttgctagaa

SEQ ID NO: 110483 - DNA, 25 bp, Rattus norvegicus
agacgtgcttgcagtagctgtcata

SEQ ID NO: 110484 - DNA, 25 bp, Rattus norvegicus
agacgtgcttgctgtagctgtcata

SEQ ID NO: 110485 - DNA, 25 bp, Rattus norvegicus
agacgtggacacactcaatatatgt

SEQ ID NO: 110486 - DNA, 25 bp, Rattus norvegicus
agacgtggacactctcaatatatgt

SEQ ID NO: 110487 - DNA, 25 bp, Rattus norvegicus
agacgtggagaactgttgagtccca

SEQ ID NO: 110488 - DNA, 25 bp, Rattus norvegicus
agacgtggagaagtgttgagtccca

SEQ ID NO: 110489 - DNA, 25 bp, Rattus norvegicus
agacgtggagttcagtgtttcccta

SEQ ID NO: 110490 - DNA, 25 bp, Rattus norvegicus
agacgtggagttgagtgtttcccta

SEQ ID NO: 110491 - DNA, 25 bp, Rattus norvegicus
agacgtggcactcgctcatgacagt

SEQ ID NO: 110492 - DNA, 25 bp, Rattus norvegicus
agacgtggcactggctcatgacagt

SEQ ID NO: 110493 - DNA, 25 bp, Rattus norvegicus
agacgtgggcttagatgctgtatct

SEQ ID NO: 110494 - DNA, 25 bp, Rattus norvegicus
agacgtgggctttgatgctgtatct

SEQ ID NO: 110495 - DNA, 25 bp, Rattus norvegicus
agacgtggtactcaagtggttcaca

SEQ ID NO: 110496 - DNA, 25 bp, Rattus norvegicus
agacgtggtactgaagtggttcaca

SEQ ID NO: 110497 - DNA, 25 bp, Rattus norvegicus
agacgtggtccaacaaggcatcctg

SEQ ID NO: 110498 - DNA, 25 bp, Rattus norvegicus
agacgtggtccatcaaggcatcctg

SEQ ID NO: 110499 - DNA, 25 bp, Rattus norvegicus
agacgtggtcggctgcggacttggc

SEQ ID NO: 110500 - DNA, 25 bp, Rattus norvegicus
agacgtggtcgggtgcggacttggc

SEQ ID NO: 110501 - DNA, 25 bp, Rattus norvegicus
agacgtgtaaatcttcctgcaaaaa

SEQ ID NO: 110502 - DNA, 25 bp, Rattus norvegicus
agacgtgtaaatgttcctgcaaaaa

SEQ ID NO: 110503 - DNA, 25 bp, Rattus norvegicus
agacgtgtatttatgtttgccgaat

SEQ ID NO: 110504 - DNA, 25 bp, Rattus norvegicus
agacgtgtatttttgtttgccgaat

SEQ ID NO: 110505 - DNA, 25 bp, Rattus norvegicus
agacgtgtcacacctctaacagaaa

SEQ ID NO: 110506 - DNA, 25 bp, Rattus norvegicus
agacgtgtcacagctctaacagaaa

SEQ ID NO: 110507 - DNA, 25 bp, Rattus norvegicus
agacgtgtcccgagagcatcgtcag

SEQ ID NO: 110508 - DNA, 25 bp, Rattus norvegicus
agacgtgtcccgtgagcatcgtcag

SEQ ID NO: 110509 - DNA, 25 bp, Rattus norvegicus
agacgtgtccggcaacgctataaag

SEQ ID NO: 110510 - DNA, 25 bp, Rattus norvegicus
agacgtgtccgggaacgctataaag

SEQ ID NO: 110511 - DNA, 25 bp, Rattus norvegicus
agacgtgtcgtcactgagccagccg

SEQ ID NO: 110512 - DNA, 25 bp, Rattus norvegicus
agacgtgtcgtctctgagccagccg

SEQ ID NO: 110513 - DNA, 25 bp, Rattus norvegicus
agacgtgtcttaatccatgtggtaa

SEQ ID NO: 110514 - DNA, 25 bp, Rattus norvegicus
agacgtgtcttattccatgtggtaa

SEQ ID NO: 110515 - DNA, 25 bp, Rattus norvegicus
agacgtgtcttcaacttttgtgctt

SEQ ID NO: 110516 - DNA, 25 bp, Rattus norvegicus
agacgtgtcttctacttttgtgctt

SEQ ID NO: 110517 - DNA, 25 bp, Rattus norvegicus
agacgtgtgccgcagatgccatgca

SEQ ID NO: 110518 - DNA, 25 bp, Rattus norvegicus
agacgtgtgccggagatgccatgca

SEQ ID NO: 110519 - DNA, 25 bp, Rattus norvegicus
agacgtgtgctaacatgcccggttt

SEQ ID NO: 110520 - DNA, 25 bp, Rattus norvegicus
agacgtgtgctatcatgcccggttt

SEQ ID NO: 110521 - DNA, 25 bp, Rattus norvegicus
agacgtgtgtagagtgaatcatatc

SEQ ID NO: 110522 - DNA, 25 bp, Rattus norvegicus
agacgtgtgtagtgtgaatcatatc

SEQ ID NO: 110523 - DNA, 25 bp, Rattus norvegicus
agacgttaaaccctgctcataagca

SEQ ID NO: 110524 - DNA, 25 bp, Rattus norvegicus
agacgttaaaccgtgctcataagca

SEQ ID NO: 110525 - DNA, 25 bp, Rattus norvegicus
agacgttcaagtccagggctccaaa

SEQ ID NO: 110526 - DNA, 25 bp, Rattus norvegicus
agacgttcaagtgcagggctccaaa

SEQ ID NO: 110527 - DNA, 25 bp, Rattus norvegicus
agacgttcagctacttgggctttga

SEQ ID NO: 110528 - DNA, 25 bp, Rattus norvegicus
agacgttcagcttcttgggctttga

SEQ ID NO: 110529 - DNA, 25 bp, Rattus norvegicus
agacgttcgtaaagggttcctgtat

SEQ ID NO: 110530 - DNA, 25 bp, Rattus norvegicus
agacgttcgtaatgggttcctgtat

SEQ ID NO: 110531 - DNA, 25 bp, Rattus norvegicus
agacgttctcctacaatgctagtga

SEQ ID NO: 110532 - DNA, 25 bp, Rattus norvegicus
agacgttctccttcaatgctagtga

SEQ ID NO: 110533 - DNA, 25 bp, Rattus norvegicus
agacgttctgccaagttcagactgg

SEQ ID NO: 110534 - DNA, 25 bp, Rattus norvegicus
agacgttctgcctagttcagactgg

SEQ ID NO: 110535 - DNA, 25 bp, Rattus norvegicus
agacgttctgctagcctgactctca

SEQ ID NO: 110536 - DNA, 25 bp, Rattus norvegicus
agacgttctgcttgcctgactctca

SEQ ID NO: 110537 - DNA, 25 bp, Rattus norvegicus
agacgttgagggatagactttatgt

SEQ ID NO: 110538 - DNA, 25 bp, Rattus norvegicus
agacgttgagggttagactttatgt

SEQ ID NO: 110539 - DNA, 25 bp, Rattus norvegicus
agacgttgcgttaatttgtgagacc

SEQ ID NO: 110540 - DNA, 25 bp, Rattus norvegicus
agacgttgcgtttatttgtgagacc

SEQ ID NO: 110541 - DNA, 25 bp, Rattus norvegicus
agacgttgtcatacaggtggccttg

SEQ ID NO: 110542 - DNA, 25 bp, Rattus norvegicus
agacgttgtcattcaggtggccttg

SEQ ID NO: 110543 - DNA, 25 bp, Rattus norvegicus
agacgtttgactactgactcagatg

SEQ ID NO: 110544 - DNA, 25 bp, Rattus norvegicus
agacgtttgacttctgactcagatg

SEQ ID NO: 110545 - DNA, 25 bp, Rattus norvegicus
agacgtttgcctaggaaatgtggaa

SEQ ID NO: 110546 - DNA, 25 bp, Rattus norvegicus
agacgtttgccttggaaatgtggaa

SEQ ID NO: 110547 - DNA, 25 bp, Rattus norvegicus
agacgtttgcgtcaccaagaagttt

SEQ ID NO: 110548 - DNA, 25 bp, Rattus norvegicus
agacgtttgcgtgaccaagaagttt

SEQ ID NO: 110549 - DNA, 25 bp, Rattus norvegicus
agacgtttgtgcctattgttcttgt

SEQ ID NO: 110550 - DNA, 25 bp, Rattus norvegicus
agacgtttgtgcgtattgttcttgt

SEQ ID NO: 110551 - DNA, 25 bp, Rattus norvegicus
agacgtttgttgattgatttcccat

SEQ ID NO: 110552 - DNA, 25 bp, Rattus norvegicus
agacgtttgttgtttgatttcccat

SEQ ID NO: 110553 - DNA, 25 bp, Rattus norvegicus
agactaaaattaaacctcagatgga

SEQ ID NO: 110554 - DNA, 25 bp, Rattus norvegicus
agactaaaattatacctcagatgga

SEQ ID NO: 110555 - DNA, 25 bp, Rattus norvegicus
agactaaaggtcaggtctggctccc

SEQ ID NO: 110556 - DNA, 25 bp, Rattus norvegicus
agactaaaggtctggtctggctccc

SEQ ID NO: 110557 - DNA, 25 bp, Rattus norvegicus
agactaaagtttagctggctccaca

SEQ ID NO: 110558 - DNA, 25 bp, Rattus norvegicus
agactaaagttttgctggctccaca

SEQ ID NO: 110559 - DNA, 25 bp, Rattus norvegicus
agactaaatacacacatcctgccag

SEQ ID NO: 110560 - DNA, 25 bp, Rattus norvegicus
agactaaatacagacatcctgccag

SEQ ID NO: 110561 - DNA, 25 bp, Rattus norvegicus
agactaaatcaacccagcgtctctc

SEQ ID NO: 110562 - DNA, 25 bp, Rattus norvegicus
agactaaatcaagccagcgtctctc

SEQ ID NO: 110563 - DNA, 25 bp, Rattus norvegicus
agactaaattctcattggcagcaag

SEQ ID NO: 110564 - DNA, 25 bp, Rattus norvegicus
agactaaattctgattggcagcaag

SEQ ID NO: 110565 - DNA, 25 bp, Rattus norvegicus
agactaacacctccatgatcattgt

SEQ ID NO: 110566 - DNA, 25 bp, Rattus norvegicus
agactaacacctgcatgatcattgt

SEQ ID NO: 110567 - DNA, 25 bp, Rattus norvegicus
agactaacgttgattaactcaccca

SEQ ID NO: 110568 - DNA, 25 bp, Rattus norvegicus
agactaacgttgtttaactcaccca

SEQ ID NO: 110569 - DNA, 25 bp, Rattus norvegicus
agactaactaggaccctctccagag

SEQ ID NO: 110570 - DNA, 25 bp, Rattus norvegicus
agactaactaggtccctctccagag

SEQ ID NO: 110571 - DNA, 25 bp, Rattus norvegicus
agactaagacaaaggcacatccggg

SEQ ID NO: 110572 - DNA, 25 bp, Rattus norvegicus
agactaagacaatggcacatccggg

SEQ ID NO: 110573 - DNA, 25 bp, Rattus norvegicus
agactaagaccacaggacagaggaa

SEQ ID NO: 110574 - DNA, 25 bp, Rattus norvegicus
agactaagaccagaggacagaggaa

SEQ ID NO: 110575 - DNA, 25 bp, Rattus norvegicus
agactaagaccccaaggctcttgac

SEQ ID NO: 110576 - DNA, 25 bp, Rattus norvegicus
agactaagacccgaaggctcttgac

SEQ ID NO: 110577 - DNA, 25 bp, Rattus norvegicus
agactaagactccacctctgggagt

SEQ ID NO: 110578 - DNA, 25 bp, Rattus norvegicus
agactaagactcgacctctgggagt

SEQ ID NO: 110579 - DNA, 25 bp, Rattus norvegicus
agactaataagacaccccactccgt

SEQ ID NO: 110580 - DNA, 25 bp, Rattus norvegicus
agactaataagagaccccactccgt

SEQ ID NO: 110581 - DNA, 25 bp, Rattus norvegicus
agactaatattcctgtgaccttcca

SEQ ID NO: 110582 - DNA, 25 bp, Rattus norvegicus
agactaatattcgtgtgaccttcca

SEQ ID NO: 110583 - DNA, 25 bp, Rattus norvegicus
agactaatcatgacggaaggactcc

SEQ ID NO: 110584 - DNA, 25 bp, Rattus norvegicus
agactaatcatgtcggaaggactcc

SEQ ID NO: 110585 - DNA, 25 bp, Rattus norvegicus
agactaatgcttactgtggactcct

SEQ ID NO: 110586 - DNA, 25 bp, Rattus norvegicus
agactaatgctttctgtggactcct

SEQ ID NO: 110587 - DNA, 25 bp, Rattus norvegicus
agactaatgtcacgacccgcacagg

SEQ ID NO: 110588 - DNA, 25 bp, Rattus norvegicus
agactaatgtcaggacccgcacagg

SEQ ID NO: 110589 - DNA, 25 bp, Rattus norvegicus
agactaattcaccatctgcctgagc

SEQ ID NO: 110590 - DNA, 25 bp, Rattus norvegicus
agactaattcacgatctgcctgagc

SEQ ID NO: 110591 - DNA, 25 bp, Rattus norvegicus
agactacaacatacgtgcacaagag

SEQ ID NO: 110592 - DNA, 25 bp, Rattus norvegicus
agactacaacattcgtgcacaagag

SEQ ID NO: 110593 - DNA, 25 bp, Rattus norvegicus
agactacaaggaatcacccaccaca

SEQ ID NO: 110594 - DNA, 25 bp, Rattus norvegicus
agactacaaggattcacccaccaca

SEQ ID NO: 110595 - DNA, 25 bp, Rattus norvegicus
agactacacgacatctgaccacaga

SEQ ID NO: 110596 - DNA, 25 bp, Rattus norvegicus
agactacacgacttctgaccacaga

SEQ ID NO: 110597 - DNA, 25 bp, Rattus norvegicus
agactacagaccattgcttgcttcc

SEQ ID NO: 110598 - DNA, 25 bp, Rattus norvegicus
agactacagacctttgcttgcttcc

SEQ ID NO: 110599 - DNA, 25 bp, Rattus norvegicus
agactacaggaacccgggaccactt

SEQ ID NO: 110600 - DNA, 25 bp, Rattus norvegicus
agactacaggaagccgggaccactt

SEQ ID NO: 110601 - DNA, 25 bp, Rattus norvegicus
agactacatacacagaccctatttc

SEQ ID NO: 110602 - DNA, 25 bp, Rattus norvegicus
agactacatacagagaccctatttc

SEQ ID NO: 110603 - DNA, 25 bp, Rattus norvegicus
agactacatgcgctacctgatggag

SEQ ID NO: 110604 - DNA, 25 bp, Rattus norvegicus
agactacatgcggtacctgatggag

SEQ ID NO: 110605 - DNA, 25 bp, Rattus norvegicus
agactaccacctcctggtcatagga

SEQ ID NO: 110606 - DNA, 25 bp, Rattus norvegicus
agactaccacctgctggtcatagga

SEQ ID NO: 110607 - DNA, 25 bp, Rattus norvegicus
agactaccagttcccttactatgat

SEQ ID NO: 110608 - DNA, 25 bp, Rattus norvegicus
agactaccagttgccttactatgat

SEQ ID NO: 110609 - DNA, 25 bp, Rattus norvegicus
agactaccatcacagcattttgcat

SEQ ID NO: 110610 - DNA, 25 bp, Rattus norvegicus
agactaccatcagagcattttgcat

SEQ ID NO: 110611 - DNA, 25 bp, Rattus norvegicus
agactaccattcaagcctaagcctc

SEQ ID NO: 110612 - DNA, 25 bp, Rattus norvegicus
agactaccattctagcctaagcctc

SEQ ID NO: 110613 - DNA, 25 bp, Rattus norvegicus
agactacccacccagctttgtaagt

SEQ ID NO: 110614 - DNA, 25 bp, Rattus norvegicus
agactacccaccgagctttgtaagt

SEQ ID NO: 110615 - DNA, 25 bp, Rattus norvegicus
agactacccagcctttcaaacagaa

SEQ ID NO: 110616 - DNA, 25 bp, Rattus norvegicus
agactacccagcgtttcaaacagaa

SEQ ID NO: 110617 - DNA, 25 bp, Rattus norvegicus
agactacccataagtcctgtgactc

SEQ ID NO: 110618 - DNA, 25 bp, Rattus norvegicus
agactacccatatgtcctgtgactc

SEQ ID NO: 110619 - DNA, 25 bp, Rattus norvegicus
agactacccattatacacttgcttt

SEQ ID NO: 110620 - DNA, 25 bp, Rattus norvegicus
agactacccattttacacttgcttt

SEQ ID NO: 110621 - DNA, 25 bp, Rattus norvegicus
agactacctaccacattcggaatta

SEQ ID NO: 110622 - DNA, 25 bp, Rattus norvegicus
agactacctacctcattcggaatta

SEQ ID NO: 110623 - DNA, 25 bp, Rattus norvegicus
agactacctcagatcgatgatgatg

SEQ ID NO: 110624 - DNA, 25 bp, Rattus norvegicus
agactacctcagttcgatgatgatg

SEQ ID NO: 110625 - DNA, 25 bp, Rattus norvegicus
agactacctcatcaagatcctgacc

SEQ ID NO: 110626 - DNA, 25 bp, Rattus norvegicus
agactacctcatgaagatcctgacc

SEQ ID NO: 110627 - DNA, 25 bp, Rattus norvegicus
agactacctggtcatgcaatttttt

SEQ ID NO: 110628 - DNA, 25 bp, Rattus norvegicus
agactacctggtgatgcaatttttt

SEQ ID NO: 110629 - DNA, 25 bp, Rattus norvegicus
agactacgacccacacatgcttttg

SEQ ID NO: 110630 - DNA, 25 bp, Rattus norvegicus
agactacgaccctcacatgcttttg

SEQ ID NO: 110631 - DNA, 25 bp, Rattus norvegicus
agactacgttcacggtatctagtat

SEQ ID NO: 110632 - DNA, 25 bp, Rattus norvegicus
agactacgttcagggtatctagtat

SEQ ID NO: 110633 - DNA, 25 bp, Rattus norvegicus
agactactaagacacgtggcccacg

SEQ ID NO: 110634 - DNA, 25 bp, Rattus norvegicus
agactactaagagacgtggcccacg

SEQ ID NO: 110635 - DNA, 25 bp, Rattus norvegicus
agactactactgcatgaccggctac

SEQ ID NO: 110636 - DNA, 25 bp, Rattus norvegicus
agactactactggatgaccggctac

SEQ ID NO: 110637 - DNA, 25 bp, Rattus norvegicus
agactactagaactggctccaactg

SEQ ID NO: 110638 - DNA, 25 bp, Rattus norvegicus
agactactagaagtggctccaactg

SEQ ID NO: 110639 - DNA, 25 bp, Rattus norvegicus
agactactagtcaccagttactctg

SEQ ID NO: 110640 - DNA, 25 bp, Rattus norvegicus
agactactagtctccagttactctg

SEQ ID NO: 110641 - DNA, 25 bp, Rattus norvegicus
agactactgggactgctttgatgcc

SEQ ID NO: 110642 - DNA, 25 bp, Rattus norvegicus
agactactgggagtgctttgatgcc

SEQ ID NO: 110643 - DNA, 25 bp, Rattus norvegicus
agactacttactctctgtcttaagt

SEQ ID NO: 110644 - DNA, 25 bp, Rattus norvegicus
agactacttactgtctgtcttaagt

SEQ ID NO: 110645 - DNA, 25 bp, Rattus norvegicus
agactacttcaacccatttgttcta

SEQ ID NO: 110646 - DNA, 25 bp, Rattus norvegicus
agactacttcaagccatttgttcta

SEQ ID NO: 110647 - DNA, 25 bp, Rattus norvegicus
agactacttcggagcctgtgtgaaa

SEQ ID NO: 110648 - DNA, 25 bp, Rattus norvegicus
agactacttcggtgcctgtgtgaaa

SEQ ID NO: 110649 - DNA, 25 bp, Rattus norvegicus
agactactttgcagtattgcccgag

SEQ ID NO: 110650 - DNA, 25 bp, Rattus norvegicus
agactactttgctgtattgcccgag

SEQ ID NO: 110651 - DNA, 25 bp, Rattus norvegicus
agactagactccacaaagccagtat

SEQ ID NO: 110652 - DNA, 25 bp, Rattus norvegicus
agactagactcctcaaagccagtat

SEQ ID NO: 110653 - DNA, 25 bp, Rattus norvegicus
agactagagacaacggtatacccaa

SEQ ID NO: 110654 - DNA, 25 bp, Rattus norvegicus
agactagagacatcggtatacccaa

SEQ ID NO: 110655 - DNA, 25 bp, Rattus norvegicus
agactagagcccacagtttcctgct

SEQ ID NO: 110656 - DNA, 25 bp, Rattus norvegicus
agactagagccctcagtttcctgct

SEQ ID NO: 110657 - DNA, 25 bp, Rattus norvegicus
agactagatgccagctgttagctat

SEQ ID NO: 110658 - DNA, 25 bp, Rattus norvegicus
agactagatgcctgctgttagctat

SEQ ID NO: 110659 - DNA, 25 bp, Rattus norvegicus
agactagatttcacaggccttaagg

SEQ ID NO: 110660 - DNA, 25 bp, Rattus norvegicus
agactagatttctcaggccttaagg

SEQ ID NO: 110661 - DNA, 25 bp, Rattus norvegicus
agactagcacaaatgactcctccta

SEQ ID NO: 110662 - DNA, 25 bp, Rattus norvegicus
agactagcacaattgactcctccta

SEQ ID NO: 110663 - DNA, 25 bp, Rattus norvegicus
agactagccagacttatctaacaag

SEQ ID NO: 110664 - DNA, 25 bp, Rattus norvegicus
agactagccagagttatctaacaag

SEQ ID NO: 110665 - DNA, 25 bp, Rattus norvegicus
agactagcccaaacaggcctgagat

SEQ ID NO: 110666 - DNA, 25 bp, Rattus norvegicus
agactagcccaatcaggcctgagat

SEQ ID NO: 110667 - DNA, 25 bp, Rattus norvegicus
agactagcccagacgcatcaattag

SEQ ID NO: 110668 - DNA, 25 bp, Rattus norvegicus
agactagcccagtcgcatcaattag

SEQ ID NO: 110669 - DNA, 25 bp, Rattus norvegicus
agactagctaggcactcatcggcgc

SEQ ID NO: 110670 - DNA, 25 bp, Rattus norvegicus
agactagctagggactcatcggcgc

SEQ ID NO: 110671 - DNA, 25 bp, Rattus norvegicus
agactagctcagatgcatgactcaa

SEQ ID NO: 110672 - DNA, 25 bp, Rattus norvegicus
agactagctcagttgcatgactcaa

SEQ ID NO: 110673 - DNA, 25 bp, Rattus norvegicus
agactagctgatccctccaagaaac

SEQ ID NO: 110674 - DNA, 25 bp, Rattus norvegicus
agactagctgatgcctccaagaaac

SEQ ID NO: 110675 - DNA, 25 bp, Rattus norvegicus
agactagctttgcagccgtttttct

SEQ ID NO: 110676 - DNA, 25 bp, Rattus norvegicus
agactagctttggagccgtttttct

SEQ ID NO: 110677 - DNA, 25 bp, Rattus norvegicus
agactaggtctaagccagtggcttt

SEQ ID NO: 110678 - DNA, 25 bp, Rattus norvegicus
agactaggtctatgccagtggcttt

SEQ ID NO: 110679 - DNA, 25 bp, Rattus norvegicus
agactaggtgtcagccatcagccag

SEQ ID NO: 110680 - DNA, 25 bp, Rattus norvegicus
agactaggtgtctgccatcagccag

SEQ ID NO: 110681 - DNA, 25 bp, Rattus norvegicus
agactagtcataaatctgtgtatgt

SEQ ID NO: 110682 - DNA, 25 bp, Rattus norvegicus
agactagtcatatatctgtgtatgt

SEQ ID NO: 110683 - DNA, 25 bp, Rattus norvegicus
agactagtgctgagtgtagcgcctg

SEQ ID NO: 110684 - DNA, 25 bp, Rattus norvegicus
agactagtgctgtgtgtagcgcctg

SEQ ID NO: 110685 - DNA, 25 bp, Rattus norvegicus
agactagtggatcccctaacttaga

SEQ ID NO: 110686 - DNA, 25 bp, Rattus norvegicus
agactagtggatgccctaacttaga

SEQ ID NO: 110687 - DNA, 25 bp, Rattus norvegicus
agactagttcaccaacaacaggatg

SEQ ID NO: 110688 - DNA, 25 bp, Rattus norvegicus
agactagttcacgaacaacaggatg

SEQ ID NO: 110689 - DNA, 25 bp, Rattus norvegicus
agactagttctgctgttgtaattta

SEQ ID NO: 110690 - DNA, 25 bp, Rattus norvegicus
agactagttctggtgttgtaattta

SEQ ID NO: 110691 - DNA, 25 bp, Rattus norvegicus
agactataagaacgccctgctgctc

SEQ ID NO: 110692 - DNA, 25 bp, Rattus norvegicus
agactataagaaggccctgctgctc

SEQ ID NO: 110693 - DNA, 25 bp, Rattus norvegicus
agactataagccctacccaatgtac

SEQ ID NO: 110694 - DNA, 25 bp, Rattus norvegicus
agactataagccgtacccaatgtac

SEQ ID NO: 110695 - DNA, 25 bp, Rattus norvegicus
agactatagaatcgcccttctctgg

SEQ ID NO: 110696 - DNA, 25 bp, Rattus norvegicus
agactatagaatggcccttctctgg

SEQ ID NO: 110697 - DNA, 25 bp, Rattus norvegicus
agactatcagtgaccagtgcacagg

SEQ ID NO: 110698 - DNA, 25 bp, Rattus norvegicus
agactatcagtgtccagtgcacagg

SEQ ID NO: 110699 - DNA, 25 bp, Rattus norvegicus
agactatcatcaatgcttggtggcc

SEQ ID NO: 110700 - DNA, 25 bp, Rattus norvegicus
agactatcatcattgcttggtggcc

SEQ ID NO: 110701 - DNA, 25 bp, Rattus norvegicus
agactatcatgtagtctcctcatct

SEQ ID NO: 110702 - DNA, 25 bp, Rattus norvegicus
agactatcatgttgtctcctcatct

SEQ ID NO: 110703 - DNA, 25 bp, Rattus norvegicus
agactatcttcaatcaaactacccg

SEQ ID NO: 110704 - DNA, 25 bp, Rattus norvegicus
agactatcttcattcaaactacccg

SEQ ID NO: 110705 - DNA, 25 bp, Rattus norvegicus
agactatcttgaatctcacttccag

SEQ ID NO: 110706 - DNA, 25 bp, Rattus norvegicus
agactatcttgattctcacttccag

SEQ ID NO: 110707 - DNA, 25 bp, Rattus norvegicus
agactatgactccttctcgctagac

SEQ ID NO: 110708 - DNA, 25 bp, Rattus norvegicus
agactatgactcgttctcgctagac

SEQ ID NO: 110709 - DNA, 25 bp, Rattus norvegicus
agactatgacttcctgacctattgt

SEQ ID NO: 110710 - DNA, 25 bp, Rattus norvegicus
agactatgacttgctgacctattgt

SEQ ID NO: 110711 - DNA, 25 bp, Rattus norvegicus
agactatgccagctacacacaagag

SEQ ID NO: 110712 - DNA, 25 bp, Rattus norvegicus
agactatgccaggtacacacaagag

SEQ ID NO: 110713 - DNA, 25 bp, Rattus norvegicus
agactatgcctaaggagccaccggg

SEQ ID NO: 110714 - DNA, 25 bp, Rattus norvegicus
agactatgcctatggagccaccggg

SEQ ID NO: 110715 - DNA, 25 bp, Rattus norvegicus
agactatgcctcataacctctggga

SEQ ID NO: 110716 - DNA, 25 bp, Rattus norvegicus
agactatgcctcttaacctctggga

SEQ ID NO: 110717 - DNA, 25 bp, Rattus norvegicus
agactatggactctgagccttctct

SEQ ID NO: 110718 - DNA, 25 bp, Rattus norvegicus
agactatggactgtgagccttctct

SEQ ID NO: 110719 - DNA, 25 bp, Rattus norvegicus
agactatggctgcacaccttgcgtt

SEQ ID NO: 110720 - DNA, 25 bp, Rattus norvegicus
agactatggctggacaccttgcgtt

SEQ ID NO: 110721 - DNA, 25 bp, Rattus norvegicus
agactatgggtcacgaaggcaaagt

SEQ ID NO: 110722 - DNA, 25 bp, Rattus norvegicus
agactatgggtctcgaaggcaaagt

SEQ ID NO: 110723 - DNA, 25 bp, Rattus norvegicus
agactatgtctacaggtaatcccaa

SEQ ID NO: 110724 - DNA, 25 bp, Rattus norvegicus
agactatgtctagaggtaatcccaa

SEQ ID NO: 110725 - DNA, 25 bp, Rattus norvegicus
agactatgtgccctttttcaaccag

SEQ ID NO: 110726 - DNA, 25 bp, Rattus norvegicus
agactatgtgccgtttttcaaccag

SEQ ID NO: 110727 - DNA, 25 bp, Rattus norvegicus
agactatgttctatctatggttata

SEQ ID NO: 110728 - DNA, 25 bp, Rattus norvegicus
agactatgttctttctatggttata

SEQ ID NO: 110729 - DNA, 25 bp, Rattus norvegicus
agactattataaaccacctgatcac

SEQ ID NO: 110730 - DNA, 25 bp, Rattus norvegicus
agactattataatccacctgatcac

SEQ ID NO: 110731 - DNA, 25 bp, Rattus norvegicus
agactattatcccaaccatacacaa

SEQ ID NO: 110732 - DNA, 25 bp, Rattus norvegicus
agactattatccgaaccatacacaa

SEQ ID NO: 110733 - DNA, 25 bp, Rattus norvegicus
agactattctgcatccgtaggctaa

SEQ ID NO: 110734 - DNA, 25 bp, Rattus norvegicus
agactattctgcttccgtaggctaa

SEQ ID NO: 110735 - DNA, 25 bp, Rattus norvegicus
agactattgacacgagtttctacct

SEQ ID NO: 110736 - DNA, 25 bp, Rattus norvegicus
agactattgacaggagtttctacct

SEQ ID NO: 110737 - DNA, 25 bp, Rattus norvegicus
agactatttttccactagtgtgaag

SEQ ID NO: 110738 - DNA, 25 bp, Rattus norvegicus
agactatttttcgactagtgtgaag

SEQ ID NO: 110739 - DNA, 25 bp, Rattus norvegicus
agactcaacagcattcatcgcttct

SEQ ID NO: 110740 - DNA, 25 bp, Rattus norvegicus
agactcaacagctttcatcgcttct

SEQ ID NO: 110741 - DNA, 25 bp, Rattus norvegicus
agactcaaccagcacggcattcaat

SEQ ID NO: 110742 - DNA, 25 bp, Rattus norvegicus
agactcaaccaggacggcattcaat

SEQ ID NO: 110743 - DNA, 25 bp, Rattus norvegicus
agactcaaccttcgctaacactgtt

SEQ ID NO: 110744 - DNA, 25 bp, Rattus norvegicus
agactcaaccttggctaacactgtt

SEQ ID NO: 110745 - DNA, 25 bp, Rattus norvegicus
agactcaagagacaactcctgcacc

SEQ ID NO: 110746 - DNA, 25 bp, Rattus norvegicus
agactcaagagagaactcctgcacc

SEQ ID NO: 110747 - DNA, 25 bp, Rattus norvegicus
agactcaagctacccacagatctgt

SEQ ID NO: 110748 - DNA, 25 bp, Rattus norvegicus
agactcaagctagccacagatctgt

SEQ ID NO: 110749 - DNA, 25 bp, Rattus norvegicus
agactcaaggctctattcctatcag

SEQ ID NO: 110750 - DNA, 25 bp, Rattus norvegicus
agactcaaggctgtattcctatcag

SEQ ID NO: 110751 - DNA, 25 bp, Rattus norvegicus
agactcaagtgtaacaggtacagaa

SEQ ID NO: 110752 - DNA, 25 bp, Rattus norvegicus
agactcaagtgttacaggtacagaa

SEQ ID NO: 110753 - DNA, 25 bp, Rattus norvegicus
agactcacacaaagtttgggccctt

SEQ ID NO: 110754 - DNA, 25 bp, Rattus norvegicus
agactcacacaatgtttgggccctt

SEQ ID NO: 110755 - DNA, 25 bp, Rattus norvegicus
agactcacacggctgctattgatga

SEQ ID NO: 110756 - DNA, 25 bp, Rattus norvegicus
agactcacacgggtgctattgatga

SEQ ID NO: 110757 - DNA, 25 bp, Rattus norvegicus
agactcacagacatccctggaggac

SEQ ID NO: 110758 - DNA, 25 bp, Rattus norvegicus
agactcacagacttccctggaggac

SEQ ID NO: 110759 - DNA, 25 bp, Rattus norvegicus
agactcacataactcttccatcagt

SEQ ID NO: 110760 - DNA, 25 bp, Rattus norvegicus
agactcacataagtcttccatcagt

SEQ ID NO: 110761 - DNA, 25 bp, Rattus norvegicus
agactcacatatactcctggttttg

SEQ ID NO: 110762 - DNA, 25 bp, Rattus norvegicus
agactcacatattctcctggttttg

SEQ ID NO: 110763 - DNA, 25 bp, Rattus norvegicus
agactcacatccagttttctgtacg

SEQ ID NO: 110764 - DNA, 25 bp, Rattus norvegicus
agactcacatcctgttttctgtacg

SEQ ID NO: 110765 - DNA, 25 bp, Rattus norvegicus
agactcacctcacatgacttctatg

SEQ ID NO: 110766 - DNA, 25 bp, Rattus norvegicus
agactcacctcagatgacttctatg

SEQ ID NO: 110767 - DNA, 25 bp, Rattus norvegicus
agactcactcctagaagactcatgc

SEQ ID NO: 110768 - DNA, 25 bp, Rattus norvegicus
agactcactcctctttgtgtgttgt

SEQ ID NO: 110769 - DNA, 25 bp, Rattus norvegicus
agactcactcctgtttgtgtgttgt

SEQ ID NO: 110770 - DNA, 25 bp, Rattus norvegicus
agactcactccttgaagactcatgc

SEQ ID NO: 110771 - DNA, 25 bp, Rattus norvegicus
agactcacttccagaacatggcaat

SEQ ID NO: 110772 - DNA, 25 bp, Rattus norvegicus
agactcacttcctgaacatggcaat

SEQ ID NO: 110773 - DNA, 25 bp, Rattus norvegicus
agactcactttccattgctgctagc

SEQ ID NO: 110774 - DNA, 25 bp, Rattus norvegicus
agactcactttcgattgctgctagc

SEQ ID NO: 110775 - DNA, 25 bp, Rattus norvegicus
agactcactttgacttctgtgctag

SEQ ID NO: 110776 - DNA, 25 bp, Rattus norvegicus
agactcactttgtcttctgtgctag

SEQ ID NO: 110777 - DNA, 25 bp, Rattus norvegicus
agactcagaagacgatatgtgattt

SEQ ID NO: 110778 - DNA, 25 bp, Rattus norvegicus
agactcagaagaggatatgtgattt

SEQ ID NO: 110779 - DNA, 25 bp, Rattus norvegicus
agactcagacgcaggtcgagttgcc

SEQ ID NO: 110780 - DNA, 25 bp, Rattus norvegicus
agactcagacgctggtcgagttgcc

SEQ ID NO: 110781 - DNA, 25 bp, Rattus norvegicus
agactcagactgatgcctcctggag

SEQ ID NO: 110782 - DNA, 25 bp, Rattus norvegicus
agactcagactgttgcctcctggag

SEQ ID NO: 110783 - DNA, 25 bp, Rattus norvegicus
agactcagccgtagcatcgtcacag

SEQ ID NO: 110784 - DNA, 25 bp, Rattus norvegicus
agactcagccgttgcatcgtcacag

SEQ ID NO: 110785 - DNA, 25 bp, Rattus norvegicus
agactcagcctcatttggttttcag

SEQ ID NO: 110786 - DNA, 25 bp, Rattus norvegicus
agactcagcctcttttggttttcag

SEQ ID NO: 110787 - DNA, 25 bp, Rattus norvegicus
agactcaggcgaagtgctttatggc

SEQ ID NO: 110788 - DNA, 25 bp, Rattus norvegicus
agactcaggcgatgtgctttatggc

SEQ ID NO: 110789 - DNA, 25 bp, Rattus norvegicus
agactcaggcggagggttcatctcg

SEQ ID NO: 110790 - DNA, 25 bp, Rattus norvegicus
agactcaggcggtgggttcatctcg

SEQ ID NO: 110791 - DNA, 25 bp, Rattus norvegicus
agactcagtagtaattgttggaaaa

SEQ ID NO: 110792 - DNA, 25 bp, Rattus norvegicus
agactcagtagttattgttggaaaa

SEQ ID NO: 110793 - DNA, 25 bp, Rattus norvegicus
agactcagtcacaggaaccactatg

SEQ ID NO: 110794 - DNA, 25 bp, Rattus norvegicus
agactcagtcactggaaccactatg

SEQ ID NO: 110795 - DNA, 25 bp, Rattus norvegicus
agactcagtcccatgtgaccattat

SEQ ID NO: 110796 - DNA, 25 bp, Rattus norvegicus
agactcagtcccttgtgaccattat

SEQ ID NO: 110797 - DNA, 25 bp, Rattus norvegicus
agactcagtgatcgccacctacagc

SEQ ID NO: 110798 - DNA, 25 bp, Rattus norvegicus
agactcagtgatggccacctacagc

SEQ ID NO: 110799 - DNA, 25 bp, Rattus norvegicus
agactcatacaaaactcaatagaag

SEQ ID NO: 110800 - DNA, 25 bp, Rattus norvegicus
agactcatacaatactcaatagaag

SEQ ID NO: 110801 - DNA, 25 bp, Rattus norvegicus
agactcatattcaggcaactgtgcc

SEQ ID NO: 110802 - DNA, 25 bp, Rattus norvegicus
agactcatattctggcaactgtgcc

SEQ ID NO: 110803 - DNA, 25 bp, Rattus norvegicus
agactcatcagtccggagaagtgca

SEQ ID NO: 110804 - DNA, 25 bp, Rattus norvegicus
agactcatcagtgcggagaagtgca

SEQ ID NO: 110805 - DNA, 25 bp, Rattus norvegicus
agactcatccgcatgaatgcttgaa

SEQ ID NO: 110806 - DNA, 25 bp, Rattus norvegicus
agactcatccgcttgaatgcttgaa

SEQ ID NO: 110807 - DNA, 25 bp, Rattus norvegicus
agactcatctctctgcctttgacta

SEQ ID NO: 110808 - DNA, 25 bp, Rattus norvegicus
agactcatctctgtgcctttgacta

SEQ ID NO: 110809 - DNA, 25 bp, Rattus norvegicus
agactcatgcagatcagctctttta

SEQ ID NO: 110810 - DNA, 25 bp, Rattus norvegicus
agactcatgcagttcagctctttta

SEQ ID NO: 110811 - DNA, 25 bp, Rattus norvegicus
agactcatgcctctttgtgcacaca

SEQ ID NO: 110812 - DNA, 25 bp, Rattus norvegicus
agactcatgcctgtttgtgcacaca

SEQ ID NO: 110813 - DNA, 25 bp, Rattus norvegicus
agactcatgctactgtactgcaggt

SEQ ID NO: 110814 - DNA, 25 bp, Rattus norvegicus
agactcatgctagtgtactgcaggt

SEQ ID NO: 110815 - DNA, 25 bp, Rattus norvegicus
agactcatgcttaccgtttgctgaa

SEQ ID NO: 110816 - DNA, 25 bp, Rattus norvegicus
agactcatgctttccgtttgctgaa

SEQ ID NO: 110817 - DNA, 25 bp, Rattus norvegicus
agactcatgggtcgtgttcgacccc

SEQ ID NO: 110818 - DNA, 25 bp, Rattus norvegicus
agactcatgggtggtgttcgacccc

SEQ ID NO: 110819 - DNA, 25 bp, Rattus norvegicus
agactcatggtccacacacctggag

SEQ ID NO: 110820 - DNA, 25 bp, Rattus norvegicus
agactcatggtcgacacacctggag

SEQ ID NO: 110821 - DNA, 25 bp, Rattus norvegicus
agactcatgtctatttgcagccttc

SEQ ID NO: 110822 - DNA, 25 bp, Rattus norvegicus
agactcatgtctttttgcagccttc

SEQ ID NO: 110823 - DNA, 25 bp, Rattus norvegicus
agactcatgttaaaacggcctccct

SEQ ID NO: 110824 - DNA, 25 bp, Rattus norvegicus
agactcatgttataacggcctccct

SEQ ID NO: 110825 - DNA, 25 bp, Rattus norvegicus
agactccaaaagactggtcctgcca

SEQ ID NO: 110826 - DNA, 25 bp, Rattus norvegicus
agactccaaaagtctggtcctgcca

SEQ ID NO: 110827 - DNA, 25 bp, Rattus norvegicus
agactccaaagaccccttgtagcct

SEQ ID NO: 110828 - DNA, 25 bp, Rattus norvegicus
agactccaaagagcccttgtagcct

SEQ ID NO: 110829 - DNA, 25 bp, Rattus norvegicus
agactccaaataatattaccgtaag

SEQ ID NO: 110830 - DNA, 25 bp, Rattus norvegicus
agactccaaatattattaccgtaag

SEQ ID NO: 110831 - DNA, 25 bp, Rattus norvegicus
agactccaaccgcacagatggcttt

SEQ ID NO: 110832 - DNA, 25 bp, Rattus norvegicus
agactccaaccggacagatggcttt

SEQ ID NO: 110833 - DNA, 25 bp, Rattus norvegicus
agactccaagaactgctgttctcta

SEQ ID NO: 110834 - DNA, 25 bp, Rattus norvegicus
agactccaagaagtgctgttctcta

SEQ ID NO: 110835 - DNA, 25 bp, Rattus norvegicus
agactccaataacttgtcctctgtc

SEQ ID NO: 110836 - DNA, 25 bp, Rattus norvegicus
agactccaataagttgtcctctgtc

SEQ ID NO: 110837 - DNA, 25 bp, Rattus norvegicus
agactccaccacatatgcacatttt

SEQ ID NO: 110838 - DNA, 25 bp, Rattus norvegicus
agactccaccacttatgcacatttt

SEQ ID NO: 110839 - DNA, 25 bp, Rattus norvegicus
agactccaccttatgtgcttttttg

SEQ ID NO: 110840 - DNA, 25 bp, Rattus norvegicus
agactccaccttttgtgcttttttg

SEQ ID NO: 110841 - DNA, 25 bp, Rattus norvegicus
agactccacgttaaacatcttcctg

SEQ ID NO: 110842 - DNA, 25 bp, Rattus norvegicus
agactccacgttacctgttaccagg

SEQ ID NO: 110843 - DNA, 25 bp, Rattus norvegicus
agactccacgtttaacatcttcctg

SEQ ID NO: 110844 - DNA, 25 bp, Rattus norvegicus
agactccacgtttcctgttaccagg

SEQ ID NO: 110845 - DNA, 25 bp, Rattus norvegicus
agactccactctcatgggcttgacg

SEQ ID NO: 110846 - DNA, 25 bp, Rattus norvegicus
agactccactctgatgggcttgacg

SEQ ID NO: 110847 - DNA, 25 bp, Rattus norvegicus
agactccagctcataggtccatcag

SEQ ID NO: 110848 - DNA, 25 bp, Rattus norvegicus
agactccagctcttaggtccatcag

SEQ ID NO: 110849 - DNA, 25 bp, Rattus norvegicus
agactccaggaaacttctgttgtcc

SEQ ID NO: 110850 - DNA, 25 bp, Rattus norvegicus
agactccaggaaagttgccatctct

SEQ ID NO: 110851 - DNA, 25 bp, Rattus norvegicus
agactccaggaatcttctgttgtcc

SEQ ID NO: 110852 - DNA, 25 bp, Rattus norvegicus
agactccaggaatgttgccatctct

SEQ ID NO: 110853 - DNA, 25 bp, Rattus norvegicus
agactccagggcacatgcgactaaa

SEQ ID NO: 110854 - DNA, 25 bp, Rattus norvegicus
agactccagggcacctgtgcattag

SEQ ID NO: 110855 - DNA, 25 bp, Rattus norvegicus
agactccagggctcatgcgactaaa

SEQ ID NO: 110856 - DNA, 25 bp, Rattus norvegicus
agactccagggctcctgtgcattag

SEQ ID NO: 110857 - DNA, 25 bp, Rattus norvegicus
agactccaggtcaggagaactggca

SEQ ID NO: 110858 - DNA, 25 bp, Rattus norvegicus
agactccaggtctggagaactggca

SEQ ID NO: 110859 - DNA, 25 bp, Rattus norvegicus
agactccagtctctgtaacctaaca

SEQ ID NO: 110860 - DNA, 25 bp, Rattus norvegicus
agactccagtctgtgtaacctaaca

SEQ ID NO: 110861 - DNA, 25 bp, Rattus norvegicus
agactccagtgacacgctgttttca

SEQ ID NO: 110862 - DNA, 25 bp, Rattus norvegicus
agactccagtgagacgctgttttca

SEQ ID NO: 110863 - DNA, 25 bp, Rattus norvegicus
agactccatattacccagttcatag

SEQ ID NO: 110864 - DNA, 25 bp, Rattus norvegicus
agactccatatttcccagttcatag

SEQ ID NO: 110865 - DNA, 25 bp, Rattus norvegicus
agactccatcacaaggcgaatctgt

SEQ ID NO: 110866 - DNA, 25 bp, Rattus norvegicus
agactccatcactaggcgaatctgt

SEQ ID NO: 110867 - DNA, 25 bp, Rattus norvegicus
agactccatcccacttgttgatgac

SEQ ID NO: 110868 - DNA, 25 bp, Rattus norvegicus
agactccatcccagtttgtgcgtgg

SEQ ID NO: 110869 - DNA, 25 bp, Rattus norvegicus
agactccatccctcttgttgatgac

SEQ ID NO: 110870 - DNA, 25 bp, Rattus norvegicus
agactccatccctgtttgtgcgtgg

SEQ ID NO: 110871 - DNA, 25 bp, Rattus norvegicus
agactccatcttcagtgggaccgtg

SEQ ID NO: 110872 - DNA, 25 bp, Rattus norvegicus
agactccatcttcatggccaactaa

SEQ ID NO: 110873 - DNA, 25 bp, Rattus norvegicus
agactccatcttgagtgggaccgtg

SEQ ID NO: 110874 - DNA, 25 bp, Rattus norvegicus
agactccatcttgatggccaactaa

SEQ ID NO: 110875 - DNA, 25 bp, Rattus norvegicus
agactccatgagatatctgtcgatg

SEQ ID NO: 110876 - DNA, 25 bp, Rattus norvegicus
agactccatgagttatctgtcgatg

SEQ ID NO: 110877 - DNA, 25 bp, Rattus norvegicus
agactccatgtgaccctcaggatga

SEQ ID NO: 110878 - DNA, 25 bp, Rattus norvegicus
agactccatgtgtccctcaggatga

SEQ ID NO: 110879 - DNA, 25 bp, Rattus norvegicus
agactcccaaagagtgcccatgcaa

SEQ ID NO: 110880 - DNA, 25 bp, Rattus norvegicus
agactcccaaagtgtgcccatgcaa

SEQ ID NO: 110881 - DNA, 25 bp, Rattus norvegicus
agactcccaactagactagaacctg

SEQ ID NO: 110882 - DNA, 25 bp, Rattus norvegicus
agactcccaacttgactagaacctg

SEQ ID NO: 110883 - DNA, 25 bp, Rattus norvegicus
agactcccatttcaaagctcacgtg

SEQ ID NO: 110884 - DNA, 25 bp, Rattus norvegicus
agactcccatttgaaagctcacgtg

SEQ ID NO: 110885 - DNA, 25 bp, Rattus norvegicus
agactccccagtcctgtagagcgaa

SEQ ID NO: 110886 - DNA, 25 bp, Rattus norvegicus
agactccccagtgctgtagagcgaa

SEQ ID NO: 110887 - DNA, 25 bp, Rattus norvegicus
agactccctctacacatatccagta

SEQ ID NO: 110888 - DNA, 25 bp, Rattus norvegicus
agactccctctagacatatccagta

SEQ ID NO: 110889 - DNA, 25 bp, Rattus norvegicus
agactccctgaaagaaccgtcctgt

SEQ ID NO: 110890 - DNA, 25 bp, Rattus norvegicus
agactccctgaatgaaccgtcctgt

SEQ ID NO: 110891 - DNA, 25 bp, Rattus norvegicus
agactccctgctcttgactattcaa

SEQ ID NO: 110892 - DNA, 25 bp, Rattus norvegicus
agactccctgctgttgactattcaa

SEQ ID NO: 110893 - DNA, 25 bp, Rattus norvegicus
agactccctggaaccattcatgtga

SEQ ID NO: 110894 - DNA, 25 bp, Rattus norvegicus
agactccctggactgggccttgtat

SEQ ID NO: 110895 - DNA, 25 bp, Rattus norvegicus
agactccctggagtgggccttgtat

SEQ ID NO: 110896 - DNA, 25 bp, Rattus norvegicus
agactccctggatccattcatgtga

SEQ ID NO: 110897 - DNA, 25 bp, Rattus norvegicus
agactccctttgaatgtgatcccga

SEQ ID NO: 110898 - DNA, 25 bp, Rattus norvegicus
agactccctttgtatgtgatcccga

SEQ ID NO: 110899 - DNA, 25 bp, Rattus norvegicus
agactccgcagtaggctttgggcta

SEQ ID NO: 110900 - DNA, 25 bp, Rattus norvegicus
agactccgcagttggctttgggcta

SEQ ID NO: 110901 - DNA, 25 bp, Rattus norvegicus
agactccgcttacagatcttaaaag

SEQ ID NO: 110902 - DNA, 25 bp, Rattus norvegicus
agactccgcttagagatcttaaaag

SEQ ID NO: 110903 - DNA, 25 bp, Rattus norvegicus
agactccgggccatcagttagcatt

SEQ ID NO: 110904 - DNA, 25 bp, Rattus norvegicus
agactccgggccttcagttagcatt

SEQ ID NO: 110905 - DNA, 25 bp, Rattus norvegicus
agactccgtcagattctgcagaagt

SEQ ID NO: 110906 - DNA, 25 bp, Rattus norvegicus
agactccgtcagtttctgcagaagt

SEQ ID NO: 110907 - DNA, 25 bp, Rattus norvegicus
agactccgtcctctggtgatcaaga

SEQ ID NO: 110908 - DNA, 25 bp, Rattus norvegicus
agactccgtcctgtggtgatcaaga

SEQ ID NO: 110909 - DNA, 25 bp, Rattus norvegicus
agactccgtttacacagatctgcac

SEQ ID NO: 110910 - DNA, 25 bp, Rattus norvegicus
agactccgtttagacagatctgcac

SEQ ID NO: 110911 - DNA, 25 bp, Rattus norvegicus
agactccgttttcctagttgagcct

SEQ ID NO: 110912 - DNA, 25 bp, Rattus norvegicus
agactccgttttgctagttgagcct

SEQ ID NO: 110913 - DNA, 25 bp, Rattus norvegicus
agactcctactgacctgcatcatga

SEQ ID NO: 110914 - DNA, 25 bp, Rattus norvegicus
agactcctactgtcctgcatcatga

SEQ ID NO: 110915 - DNA, 25 bp, Rattus norvegicus
agactcctcccaagcaggagtggaa

SEQ ID NO: 110916 - DNA, 25 bp, Rattus norvegicus
agactcctcccactgtttgagttgc

SEQ ID NO: 110917 - DNA, 25 bp, Rattus norvegicus
agactcctcccagtgtttgagttgc

SEQ ID NO: 110918 - DNA, 25 bp, Rattus norvegicus
agactcctcccatgcaggagtggaa

SEQ ID NO: 110919 - DNA, 25 bp, Rattus norvegicus
agactcctcgtcctcggaggatgag

SEQ ID NO: 110920 - DNA, 25 bp, Rattus norvegicus
agactcctcgtcgtcggaggatgag

SEQ ID NO: 110921 - DNA, 25 bp, Rattus norvegicus
agactcctctaccttgtgattgcta

SEQ ID NO: 110922 - DNA, 25 bp, Rattus norvegicus
agactcctctacgttgtgattgcta

SEQ ID NO: 110923 - DNA, 25 bp, Rattus norvegicus
agactcctgacaacaactcttagca

SEQ ID NO: 110924 - DNA, 25 bp, Rattus norvegicus
agactcctgacatcaactcttagca

SEQ ID NO: 110925 - DNA, 25 bp, Rattus norvegicus
agactcctggtcaaagttaccgaga

SEQ ID NO: 110926 - DNA, 25 bp, Rattus norvegicus
agactcctggtctaagttaccgaga

SEQ ID NO: 110927 - DNA, 25 bp, Rattus norvegicus
agactcctgtgaactagccgtgtgt

SEQ ID NO: 110928 - DNA, 25 bp, Rattus norvegicus
agactcctgtgatctagccgtgtgt

SEQ ID NO: 110929 - DNA, 25 bp, Rattus norvegicus
agactcctgtggcaagcatctctca

SEQ ID NO: 110930 - DNA, 25 bp, Rattus norvegicus
agactcctgtgggaagcatctctca

SEQ ID NO: 110931 - DNA, 25 bp, Rattus norvegicus
agactcctgttcaagggatcgctgt

SEQ ID NO: 110932 - DNA, 25 bp, Rattus norvegicus
agactcctgttctagggatcgctgt

SEQ ID NO: 110933 - DNA, 25 bp, Rattus norvegicus
agactccttaacagcaaactattaa

SEQ ID NO: 110934 - DNA, 25 bp, Rattus norvegicus
agactccttaactgcaaactattaa

SEQ ID NO: 110935 - DNA, 25 bp, Rattus norvegicus
agactccttcatcaagccggatgtc

SEQ ID NO: 110936 - DNA, 25 bp, Rattus norvegicus
agactccttcatgaagccggatgtc

SEQ ID NO: 110937 - DNA, 25 bp, Rattus norvegicus
agactccttcgtctgtctggtctgt

SEQ ID NO: 110938 - DNA, 25 bp, Rattus norvegicus
agactccttcgtgtgtctggtctgt

SEQ ID NO: 110939 - DNA, 25 bp, Rattus norvegicus
agactccttgccagcggactatcag

SEQ ID NO: 110940 - DNA, 25 bp, Rattus norvegicus
agactccttgcctgcggactatcag

SEQ ID NO: 110941 - DNA, 25 bp, Rattus norvegicus
agactcctttcaattctctgtggtg

SEQ ID NO: 110942 - DNA, 25 bp, Rattus norvegicus
agactcctttcatttctctgtggtg

SEQ ID NO: 110943 - DNA, 25 bp, Rattus norvegicus
agactcctttttcggtactctgagt

SEQ ID NO: 110944 - DNA, 25 bp, Rattus norvegicus
agactcctttttgggtactctgagt

SEQ ID NO: 110945 - DNA, 25 bp, Rattus norvegicus
agactcgaacgtcttggcagcgttt

SEQ ID NO: 110946 - DNA, 25 bp, Rattus norvegicus
agactcgaacgtgttggcagcgttt

SEQ ID NO: 110947 - DNA, 25 bp, Rattus norvegicus
agactcgacccgcaggtctcagaac

SEQ ID NO: 110948 - DNA, 25 bp, Rattus norvegicus
agactcgacccggaggtctcagaac

SEQ ID NO: 110949 - DNA, 25 bp, Rattus norvegicus
agactcgagtatcccagatgtgcaa

SEQ ID NO: 110950 - DNA, 25 bp, Rattus norvegicus
agactcgagtatgccagatgtgcaa

SEQ ID NO: 110951 - DNA, 25 bp, Rattus norvegicus
agactcgagtgtcatccctgcaata

SEQ ID NO: 110952 - DNA, 25 bp, Rattus norvegicus
agactcgagtgtgatccctgcaata

SEQ ID NO: 110953 - DNA, 25 bp, Rattus norvegicus
agactcgatagtcctcggcctcatt

SEQ ID NO: 110954 - DNA, 25 bp, Rattus norvegicus
agactcgatagtgctcggcctcatt

SEQ ID NO: 110955 - DNA, 25 bp, Rattus norvegicus
agactcgatatactagataccgccg

SEQ ID NO: 110956 - DNA, 25 bp, Rattus norvegicus
agactcgatatagtagataccgccg

SEQ ID NO: 110957 - DNA, 25 bp, Rattus norvegicus
agactcgcacagatctcggaaccaa

SEQ ID NO: 110958 - DNA, 25 bp, Rattus norvegicus
agactcgcacagttctcggaaccaa

SEQ ID NO: 110959 - DNA, 25 bp, Rattus norvegicus
agactcgccatcaggcagctagcta

SEQ ID NO: 110960 - DNA, 25 bp, Rattus norvegicus
agactcgccatctggcagctagcta

SEQ ID NO: 110961 - DNA, 25 bp, Rattus norvegicus
agactcgctctgaaatccggaaggc

SEQ ID NO: 110962 - DNA, 25 bp, Rattus norvegicus
agactcgctctgtaatccggaaggc

SEQ ID NO: 110963 - DNA, 25 bp, Rattus norvegicus
agactcggaactcttcagtgctcgc

SEQ ID NO: 110964 - DNA, 25 bp, Rattus norvegicus
agactcggaactgttcagtgctcgc

SEQ ID NO: 110965 - DNA, 25 bp, Rattus norvegicus
agactcggacttactactgtttcct

SEQ ID NO: 110966 - DNA, 25 bp, Rattus norvegicus
agactcggactttctactgtttcct

SEQ ID NO: 110967 - DNA, 25 bp, Rattus norvegicus
agactcggcacgcactttctcaaag

SEQ ID NO: 110968 - DNA, 25 bp, Rattus norvegicus
agactcggcacggactttctcaaag

SEQ ID NO: 110969 - DNA, 25 bp, Rattus norvegicus
agactcggtcccagggaaggcctgt

SEQ ID NO: 110970 - DNA, 25 bp, Rattus norvegicus
agactcggtccctgggaaggcctgt

SEQ ID NO: 110971 - DNA, 25 bp, Rattus norvegicus
agactcggtggtcgcgcactccaga

SEQ ID NO: 110972 - DNA, 25 bp, Rattus norvegicus
agactcggtggtggcgcactccaga

SEQ ID NO: 110973 - DNA, 25 bp, Rattus norvegicus
agactcgtcaaacggtcatctccag

SEQ ID NO: 110974 - DNA, 25 bp, Rattus norvegicus
agactcgtcaaagggtcatctccag

SEQ ID NO: 110975 - DNA, 25 bp, Rattus norvegicus
agactcgtccgccatttatcaatgt

SEQ ID NO: 110976 - DNA, 25 bp, Rattus norvegicus
agactcgtccgcgatttatcaatgt

SEQ ID NO: 110977 - DNA, 25 bp, Rattus norvegicus
agactcgtcgttcatgaatctcaga

SEQ ID NO: 110978 - DNA, 25 bp, Rattus norvegicus
agactcgtcgttgatgaatctcaga

SEQ ID NO: 110979 - DNA, 25 bp, Rattus norvegicus
agactcgtctacagcaaggtggttc

SEQ ID NO: 110980 - DNA, 25 bp, Rattus norvegicus
agactcgtctactgcaaggtggttc

SEQ ID NO: 110981 - DNA, 25 bp, Rattus norvegicus
agactcgtgtgccagggtttccaag

SEQ ID NO: 110982 - DNA, 25 bp, Rattus norvegicus
agactcgtgtgcgagggtttccaag

SEQ ID NO: 110983 - DNA, 25 bp, Rattus norvegicus
agactcgtgttcagcgtggctagca

SEQ ID NO: 110984 - DNA, 25 bp, Rattus norvegicus
agactcgtgttctgcgtggctagca

SEQ ID NO: 110985 - DNA, 25 bp, Rattus norvegicus
agactcgttgcacactgctgagaaa

SEQ ID NO: 110986 - DNA, 25 bp, Rattus norvegicus
agactcgttgcagactgctgagaaa

SEQ ID NO: 110987 - DNA, 25 bp, Rattus norvegicus
agactctaaggactggacacacgtt

SEQ ID NO: 110988 - DNA, 25 bp, Rattus norvegicus
agactctaaggagtggacacacgtt

SEQ ID NO: 110989 - DNA, 25 bp, Rattus norvegicus
agactctaccatctgctgtgtttga

SEQ ID NO: 110990 - DNA, 25 bp, Rattus norvegicus
agactctaccatgtgctgtgtttga

SEQ ID NO: 110991 - DNA, 25 bp, Rattus norvegicus
agactctagagtacagggcatacct

SEQ ID NO: 110992 - DNA, 25 bp, Rattus norvegicus
agactctagagttcagggcatacct

SEQ ID NO: 110993 - DNA, 25 bp, Rattus norvegicus
agactctaggttagcatccttgcag

SEQ ID NO: 110994 - DNA, 25 bp, Rattus norvegicus
agactctaggtttgcatccttgcag

SEQ ID NO: 110995 - DNA, 25 bp, Rattus norvegicus
agactctagtaactgctccagcagg

SEQ ID NO: 110996 - DNA, 25 bp, Rattus norvegicus
agactctagtaagtgctccagcagg

SEQ ID NO: 110997 - DNA, 25 bp, Rattus norvegicus
agactctatctgatgtaagctctca

SEQ ID NO: 110998 - DNA, 25 bp, Rattus norvegicus
agactctatctgttgtaagctctca

SEQ ID NO: 110999 - DNA, 25 bp, Rattus norvegicus
agactctatttaccaggagctgagc

SEQ ID NO: 111000 - DNA, 25 bp, Rattus norvegicus
agactctatttagcaggagctgagc

SEQ ID NO: 111001 - DNA, 25 bp, Rattus norvegicus
agactctattttagtacatacacgg

SEQ ID NO: 111002 - DNA, 25 bp, Rattus norvegicus
agactctatttttgtacatacacgg

SEQ ID NO: 111003 - DNA, 25 bp, Rattus norvegicus
agactctcaaggatttgccatggta

SEQ ID NO: 111004 - DNA, 25 bp, Rattus norvegicus
agactctcaaggttttgccatggta

SEQ ID NO: 111005 - DNA, 25 bp, Rattus norvegicus
agactctcaagtccctttgggctca

SEQ ID NO: 111006 - DNA, 25 bp, Rattus norvegicus
agactctcaagtgcctttgggctca

SEQ ID NO: 111007 - DNA, 25 bp, Rattus norvegicus
agactctcactaaatagccctgact

SEQ ID NO: 111008 - DNA, 25 bp, Rattus norvegicus
agactctcactatatagccctgact

SEQ ID NO: 111009 - DNA, 25 bp, Rattus norvegicus
agactctccactagatgcagcagtt

SEQ ID NO: 111010 - DNA, 25 bp, Rattus norvegicus
agactctccacttgatgcagcagtt

SEQ ID NO: 111011 - DNA, 25 bp, Rattus norvegicus
agactctccagaacatattccttat

SEQ ID NO: 111012 - DNA, 25 bp, Rattus norvegicus
agactctccagacggttcggactca

SEQ ID NO: 111013 - DNA, 25 bp, Rattus norvegicus
agactctccagagggttcggactca

SEQ ID NO: 111014 - DNA, 25 bp, Rattus norvegicus
agactctccagatcatattccttat

SEQ ID NO: 111015 - DNA, 25 bp, Rattus norvegicus
agactctccataactgttttataaa

SEQ ID NO: 111016 - DNA, 25 bp, Rattus norvegicus
agactctccatatctgttttataaa

SEQ ID NO: 111017 - DNA, 25 bp, Rattus norvegicus
agactctctgctctttacttgggaa

SEQ ID NO: 111018 - DNA, 25 bp, Rattus norvegicus
agactctctgctgtttacttgggaa

SEQ ID NO: 111019 - DNA, 25 bp, Rattus norvegicus
agactctctttacagacctctttag

SEQ ID NO: 111020 - DNA, 25 bp, Rattus norvegicus
agactctctttagagacctctttag

SEQ ID NO: 111021 - DNA, 25 bp, Rattus norvegicus
agactctgactaaccttgtgggctc

SEQ ID NO: 111022 - DNA, 25 bp, Rattus norvegicus
agactctgactatccttgtgggctc

SEQ ID NO: 111023 - DNA, 25 bp, Rattus norvegicus
agactctgactcctgactcagtaga

SEQ ID NO: 111024 - DNA, 25 bp, Rattus norvegicus
agactctgactcgtgactcagtaga

SEQ ID NO: 111025 - DNA, 25 bp, Rattus norvegicus
agactctgatgaagtttgtcaccat

SEQ ID NO: 111026 - DNA, 25 bp, Rattus norvegicus
agactctgatgatgtttgtcaccat

SEQ ID NO: 111027 - DNA, 25 bp, Rattus norvegicus
agactctgattaccagtccctgcat

SEQ ID NO: 111028 - DNA, 25 bp, Rattus norvegicus
agactctgattagcagtccctgcat

SEQ ID NO: 111029 - DNA, 25 bp, Rattus norvegicus
agactctgattcagatctctctgat

SEQ ID NO: 111030 - DNA, 25 bp, Rattus norvegicus
agactctgattctgatctctctgat

SEQ ID NO: 111031 - DNA, 25 bp, Rattus norvegicus
agactctgcctgaaaactgtataat

SEQ ID NO: 111032 - DNA, 25 bp, Rattus norvegicus
agactctgcctgcagtccagttggt

SEQ ID NO: 111033 - DNA, 25 bp, Rattus norvegicus
agactctgcctggagtccagttggt

SEQ ID NO: 111034 - DNA, 25 bp, Rattus norvegicus
agactctgcctgtaaactgtataat

SEQ ID NO: 111035 - DNA, 25 bp, Rattus norvegicus
agactctgcgagaaatggcgacaca

SEQ ID NO: 111036 - DNA, 25 bp, Rattus norvegicus
agactctgcgagtaatggcgacaca

SEQ ID NO: 111037 - DNA, 25 bp, Rattus norvegicus
agactctgcggcactggcgctgctt

SEQ ID NO: 111038 - DNA, 25 bp, Rattus norvegicus
agactctgcggctctggcgctgctt

SEQ ID NO: 111039 - DNA, 25 bp, Rattus norvegicus
agactctgctctattcggacggtgg

SEQ ID NO: 111040 - DNA, 25 bp, Rattus norvegicus
agactctgctcttttcggacggtgg

SEQ ID NO: 111041 - DNA, 25 bp, Rattus norvegicus
agactctgctggcatcagtgatctt

SEQ ID NO: 111042 - DNA, 25 bp, Rattus norvegicus
agactctgctgggatcagtgatctt

SEQ ID NO: 111043 - DNA, 25 bp, Rattus norvegicus
agactctgctgtacttcccagttag

SEQ ID NO: 111044 - DNA, 25 bp, Rattus norvegicus
agactctgctgttcttcccagttag

SEQ ID NO: 111045 - DNA, 25 bp, Rattus norvegicus
agactctgctttctgcaccaggaat

SEQ ID NO: 111046 - DNA, 25 bp, Rattus norvegicus
agactctgctttgtgcaccaggaat

SEQ ID NO: 111047 - DNA, 25 bp, Rattus norvegicus
agactctggaaaatgttggcgtgat

SEQ ID NO: 111048 - DNA, 25 bp, Rattus norvegicus
agactctggaaattgttggcgtgat

SEQ ID NO: 111049 - DNA, 25 bp, Rattus norvegicus
agactctggcacagattccccggct

SEQ ID NO: 111050 - DNA, 25 bp, Rattus norvegicus
agactctggcactgattccccggct

SEQ ID NO: 111051 - DNA, 25 bp, Rattus norvegicus
agactctggtgacctgtgtgtgtca

SEQ ID NO: 111052 - DNA, 25 bp, Rattus norvegicus
agactctggtgagctgtgtgtgtca

SEQ ID NO: 111053 - DNA, 25 bp, Rattus norvegicus
agactctgtcaaccatttcttccac

SEQ ID NO: 111054 - DNA, 25 bp, Rattus norvegicus
agactctgtcaagcatttcttccac

SEQ ID NO: 111055 - DNA, 25 bp, Rattus norvegicus
agactctgtctccaacgtgaaaaca

SEQ ID NO: 111056 - DNA, 25 bp, Rattus norvegicus
agactctgtctcgaacgtgaaaaca

SEQ ID NO: 111057 - DNA, 25 bp, Rattus norvegicus
agactctgtgcccagggtagctacc

SEQ ID NO: 111058 - DNA, 25 bp, Rattus norvegicus
agactctgtgccgagggtagctacc

SEQ ID NO: 111059 - DNA, 25 bp, Rattus norvegicus
agactctgttatatgctcctcagat

SEQ ID NO: 111060 - DNA, 25 bp, Rattus norvegicus
agactctgttatttgctcctcagat

SEQ ID NO: 111061 - DNA, 25 bp, Rattus norvegicus
agactctgtttgctggctataccga

SEQ ID NO: 111062 - DNA, 25 bp, Rattus norvegicus
agactctgtttggtggctataccga

SEQ ID NO: 111063 - DNA, 25 bp, Rattus norvegicus
agactcttaccaaaagctgctgctt

SEQ ID NO: 111064 - DNA, 25 bp, Rattus norvegicus
agactcttaccaaagaagcccggtt

SEQ ID NO: 111065 - DNA, 25 bp, Rattus norvegicus
agactcttaccataagctgctgctt

SEQ ID NO: 111066 - DNA, 25 bp, Rattus norvegicus
agactcttaccatagaagcccggtt

SEQ ID NO: 111067 - DNA, 25 bp, Rattus norvegicus
agactcttacccaagctcgatgagg

SEQ ID NO: 111068 - DNA, 25 bp, Rattus norvegicus
agactcttaccctagctcgatgagg

SEQ ID NO: 111069 - DNA, 25 bp, Rattus norvegicus
agactcttactaatctgcaggccaa

SEQ ID NO: 111070 - DNA, 25 bp, Rattus norvegicus
agactcttactattctgcaggccaa

SEQ ID NO: 111071 - DNA, 25 bp, Rattus norvegicus
agactcttcattagtgtcttctgcc

SEQ ID NO: 111072 - DNA, 25 bp, Rattus norvegicus
agactcttcatttgtgtcttctgcc

SEQ ID NO: 111073 - DNA, 25 bp, Rattus norvegicus
agactcttcccacgtggaaccaagt

SEQ ID NO: 111074 - DNA, 25 bp, Rattus norvegicus
agactcttcccaggtggaaccaagt

SEQ ID NO: 111075 - DNA, 25 bp, Rattus norvegicus
agactcttccctaggaatcatcgcc

SEQ ID NO: 111076 - DNA, 25 bp, Rattus norvegicus
agactcttcccttggaatcatcgcc

SEQ ID NO: 111077 - DNA, 25 bp, Rattus norvegicus
agactcttcctgaaccagcgaggtt

SEQ ID NO: 111078 - DNA, 25 bp, Rattus norvegicus
agactcttcctgtaccagcgaggtt

SEQ ID NO: 111079 - DNA, 25 bp, Rattus norvegicus
agactcttcgatcggtgtcctctat

SEQ ID NO: 111080 - DNA, 25 bp, Rattus norvegicus
agactcttcgatgggtgtcctctat

SEQ ID NO: 111081 - DNA, 25 bp, Rattus norvegicus
agactcttcgcaattgggacctgaa

SEQ ID NO: 111082 - DNA, 25 bp, Rattus norvegicus
agactcttcgcatttgggacctgaa

SEQ ID NO: 111083 - DNA, 25 bp, Rattus norvegicus
agactcttctttcgagctctcagaa

SEQ ID NO: 111084 - DNA, 25 bp, Rattus norvegicus
agactcttctttggagctctcagaa

SEQ ID NO: 111085 - DNA, 25 bp, Rattus norvegicus
agactcttgcttagcgtccacgatg

SEQ ID NO: 111086 - DNA, 25 bp, Rattus norvegicus
agactcttgctttgcgtccacgatg

SEQ ID NO: 111087 - DNA, 25 bp, Rattus norvegicus
agactcttggagaccgggaaggcca

SEQ ID NO: 111088 - DNA, 25 bp, Rattus norvegicus
agactcttggagtccgggaaggcca

SEQ ID NO: 111089 - DNA, 25 bp, Rattus norvegicus
agactgaaatgaaccttggccccaa

SEQ ID NO: 111090 - DNA, 25 bp, Rattus norvegicus
agactgaaatgatccttggccccaa

SEQ ID NO: 111091 - DNA, 25 bp, Rattus norvegicus
agactgaaccttctgggttgggcta

SEQ ID NO: 111092 - DNA, 25 bp, Rattus norvegicus
agactgaaccttgtgggttgggcta

SEQ ID NO: 111093 - DNA, 25 bp, Rattus norvegicus
agactgaactgccagcatcctctgt

SEQ ID NO: 111094 - DNA, 25 bp, Rattus norvegicus
agactgaactgcgagcatcctctgt

SEQ ID NO: 111095 - DNA, 25 bp, Rattus norvegicus
agactgaactggagcttggcaccct

SEQ ID NO: 111096 - DNA, 25 bp, Rattus norvegicus
agactgaactggtgcttggcaccct

SEQ ID NO: 111097 - DNA, 25 bp, Rattus norvegicus
agactgaagatcactaccccagcga

SEQ ID NO: 111098 - DNA, 25 bp, Rattus norvegicus
agactgaagatctctaccccagcga

SEQ ID NO: 111099 - DNA, 25 bp, Rattus norvegicus
agactgaagtccatctctctcttat

SEQ ID NO: 111100 - DNA, 25 bp, Rattus norvegicus
agactgaagtccttctctctcttat

SEQ ID NO: 111101 - DNA, 25 bp, Rattus norvegicus
agactgaagttcaggctgacctctt

SEQ ID NO: 111102 - DNA, 25 bp, Rattus norvegicus
agactgaagttctggctgacctctt

SEQ ID NO: 111103 - DNA, 25 bp, Rattus norvegicus
agactgaagttgacatctttgcccc

SEQ ID NO: 111104 - DNA, 25 bp, Rattus norvegicus
agactgaagttgtcatctttgcccc

SEQ ID NO: 111105 - DNA, 25 bp, Rattus norvegicus
agactgaatgacacctttggcccag

SEQ ID NO: 111106 - DNA, 25 bp, Rattus norvegicus
agactgaatgactcctttggcccag

SEQ ID NO: 111107 - DNA, 25 bp, Rattus norvegicus
agactgacacccattgtccagagaa

SEQ ID NO: 111108 - DNA, 25 bp, Rattus norvegicus
agactgacaccctttgtccagagaa

SEQ ID NO: 111109 - DNA, 25 bp, Rattus norvegicus
agactgacagtacaggtttgccttt

SEQ ID NO: 111110 - DNA, 25 bp, Rattus norvegicus
agactgacagtagaggtttgccttt

SEQ ID NO: 111111 - DNA, 25 bp, Rattus norvegicus
agactgacatctagctttgacaatc

SEQ ID NO: 111112 - DNA, 25 bp, Rattus norvegicus
agactgacatcttgctttgacaatc

SEQ ID NO: 111113 - DNA, 25 bp, Rattus norvegicus
agactgaccacgctacagctgaaga

SEQ ID NO: 111114 - DNA, 25 bp, Rattus norvegicus
agactgaccacggtacagctgaaga

SEQ ID NO: 111115 - DNA, 25 bp, Rattus norvegicus
agactgaccatgacgctgacgctcg

SEQ ID NO: 111116 - DNA, 25 bp, Rattus norvegicus
agactgaccatgtcgctgacgctcg

SEQ ID NO: 111117 - DNA, 25 bp, Rattus norvegicus
agactgaccattctctcatctgtta

SEQ ID NO: 111118 - DNA, 25 bp, Rattus norvegicus
agactgaccattgtctcatctgtta

SEQ ID NO: 111119 - DNA, 25 bp, Rattus norvegicus
agactgacccttagcctttcttttg

SEQ ID NO: 111120 - DNA, 25 bp, Rattus norvegicus
agactgaccctttgcctttcttttg

SEQ ID NO: 111121 - DNA, 25 bp, Rattus norvegicus
agactgaccttcagtctggcagtga

SEQ ID NO: 111122 - DNA, 25 bp, Rattus norvegicus
agactgaccttctgtctggcagtga

SEQ ID NO: 111123 - DNA, 25 bp, Rattus norvegicus
agactgacgtggaccagacttcctt

SEQ ID NO: 111124 - DNA, 25 bp, Rattus norvegicus
agactgacgtggtccagacttcctt

SEQ ID NO: 111125 - DNA, 25 bp, Rattus norvegicus
agactgactattcccgtttttgttg

SEQ ID NO: 111126 - DNA, 25 bp, Rattus norvegicus
agactgactattgccgtttttgttg

SEQ ID NO: 111127 - DNA, 25 bp, Rattus norvegicus
agactgactgccacatcttcaaggc

SEQ ID NO: 111128 - DNA, 25 bp, Rattus norvegicus
agactgactgcctcatcttcaaggc

SEQ ID NO: 111129 - DNA, 25 bp, Rattus norvegicus
agactgactgctcaattccctgctg

SEQ ID NO: 111130 - DNA, 25 bp, Rattus norvegicus
agactgactgctgaattccctgctg

SEQ ID NO: 111131 - DNA, 25 bp, Rattus norvegicus
agactgagaagcctccgccgtcctg

SEQ ID NO: 111132 - DNA, 25 bp, Rattus norvegicus
agactgagaagcgtccgccgtcctg

SEQ ID NO: 111133 - DNA, 25 bp, Rattus norvegicus
agactgagcaatcgcacaggcgtca

SEQ ID NO: 111134 - DNA, 25 bp, Rattus norvegicus
agactgagcaatggcacaggcgtca

SEQ ID NO: 111135 - DNA, 25 bp, Rattus norvegicus
agactgagcattcgtagtgcccacc

SEQ ID NO: 111136 - DNA, 25 bp, Rattus norvegicus
agactgagcattggtagtgcccacc

SEQ ID NO: 111137 - DNA, 25 bp, Rattus norvegicus
agactgagcctcacttgggtatttc

SEQ ID NO: 111138 - DNA, 25 bp, Rattus norvegicus
agactgagcctctcttgggtatttc

SEQ ID NO: 111139 - DNA, 25 bp, Rattus norvegicus
agactgagcgctatgtcctgtacat

SEQ ID NO: 111140 - DNA, 25 bp, Rattus norvegicus
agactgagcgctttgtcctgtacat

SEQ ID NO: 111141 - DNA, 25 bp, Rattus norvegicus
agactgagtgcaactgtccatccct

SEQ ID NO: 111142 - DNA, 25 bp, Rattus norvegicus
agactgagtgcacaagaacgacctt

SEQ ID NO: 111143 - DNA, 25 bp, Rattus norvegicus
agactgagtgcagaagaacgacctt

SEQ ID NO: 111144 - DNA, 25 bp, Rattus norvegicus
agactgagtgcatctgtccatccct

SEQ ID NO: 111145 - DNA, 25 bp, Rattus norvegicus
agactgagttgtacttctaaggaaa

SEQ ID NO: 111146 - DNA, 25 bp, Rattus norvegicus
agactgagttgttcttctaaggaaa

SEQ ID NO: 111147 - DNA, 25 bp, Rattus norvegicus
agactgataattacatttcccagaa

SEQ ID NO: 111148 - DNA, 25 bp, Rattus norvegicus
agactgataatttcatttcccagaa

SEQ ID NO: 111149 - DNA, 25 bp, Rattus norvegicus
agactgatctggactctactgtgct

SEQ ID NO: 111150 - DNA, 25 bp, Rattus norvegicus
agactgatctggtctctactgtgct

SEQ ID NO: 111151 - DNA, 25 bp, Rattus norvegicus
agactgatgagtccaagctcctggt

SEQ ID NO: 111152 - DNA, 25 bp, Rattus norvegicus
agactgatgagtgcaagctcctggt

SEQ ID NO: 111153 - DNA, 25 bp, Rattus norvegicus
agactgatgctcatgttgggcaccg

SEQ ID NO: 111154 - DNA, 25 bp, Rattus norvegicus
agactgatgctcttgttgggcaccg

SEQ ID NO: 111155 - DNA, 25 bp, Rattus norvegicus
agactgatggaccagaacctgaagt

SEQ ID NO: 111156 - DNA, 25 bp, Rattus norvegicus
agactgatggacgagaacctgaagt

SEQ ID NO: 111157 - DNA, 25 bp, Rattus norvegicus
agactgatgggtcccagttactgac

SEQ ID NO: 111158 - DNA, 25 bp, Rattus norvegicus
agactgatgggtgccagttactgac

SEQ ID NO: 111159 - DNA, 25 bp, Rattus norvegicus
agactgatgtagacctcggacccat

SEQ ID NO: 111160 - DNA, 25 bp, Rattus norvegicus
agactgatgtagtcctcggacccat

SEQ ID NO: 111161 - DNA, 25 bp, Rattus norvegicus
agactgattcagaaactccaccgca

SEQ ID NO: 111162 - DNA, 25 bp, Rattus norvegicus
agactgattcagtaactccaccgca

SEQ ID NO: 111163 - DNA, 25 bp, Rattus norvegicus
agactgatttgcatactcgtgtata

SEQ ID NO: 111164 - DNA, 25 bp, Rattus norvegicus
agactgatttgcttactcgtgtata

SEQ ID NO: 111165 - DNA, 25 bp, Rattus norvegicus
agactgcaccggcaaactgctgagt

SEQ ID NO: 111166 - DNA, 25 bp, Rattus norvegicus
agactgcaccgggaaactgctgagt

SEQ ID NO: 111167 - DNA, 25 bp, Rattus norvegicus
agactgcagtcaacctcattccttc

SEQ ID NO: 111168 - DNA, 25 bp, Rattus norvegicus
agactgcagtcatcctcattccttc

SEQ ID NO: 111169 - DNA, 25 bp, Rattus norvegicus
agactgcagtccacctggcatgcga

SEQ ID NO: 111170 - DNA, 25 bp, Rattus norvegicus
agactgcagtcctcctggcatgcga

SEQ ID NO: 111171 - DNA, 25 bp, Rattus norvegicus
agactgcagtgcaaacgccttcagg

SEQ ID NO: 111172 - DNA, 25 bp, Rattus norvegicus
agactgcagtgctaacgccttcagg

SEQ ID NO: 111173 - DNA, 25 bp, Rattus norvegicus
agactgcatcagaaactgcccacaa

SEQ ID NO: 111174 - DNA, 25 bp, Rattus norvegicus
agactgcatcagtaactgcccacaa

SEQ ID NO: 111175 - DNA, 25 bp, Rattus norvegicus
agactgcattgcaactaagtgaaga

SEQ ID NO: 111176 - DNA, 25 bp, Rattus norvegicus
agactgcattgctactaagtgaaga

SEQ ID NO: 111177 - DNA, 25 bp, Rattus norvegicus
agactgccaggacgagtttctccct

SEQ ID NO: 111178 - DNA, 25 bp, Rattus norvegicus
agactgccaggaggagtttctccct

SEQ ID NO: 111179 - DNA, 25 bp, Rattus norvegicus
agactgccatacagactctttcttg

SEQ ID NO: 111180 - DNA, 25 bp, Rattus norvegicus
agactgccatactgactctttcttg

SEQ ID NO: 111181 - DNA, 25 bp, Rattus norvegicus
agactgcccagcaggccagccagag

SEQ ID NO: 111182 - DNA, 25 bp, Rattus norvegicus
agactgcccagctggccagccagag

SEQ ID NO: 111183 - DNA, 25 bp, Rattus norvegicus
agactgcccagtctgaggccaacag

SEQ ID NO: 111184 - DNA, 25 bp, Rattus norvegicus
agactgcccagtgtgaggccaacag

SEQ ID NO: 111185 - DNA, 25 bp, Rattus norvegicus
agactgccccaaacactttgaggga

SEQ ID NO: 111186 - DNA, 25 bp, Rattus norvegicus
agactgccccaatcactttgaggga

SEQ ID NO: 111187 - DNA, 25 bp, Rattus norvegicus
agactgccccatcgttattcgggta

SEQ ID NO: 111188 - DNA, 25 bp, Rattus norvegicus
agactgccccatggttattcgggta

SEQ ID NO: 111189 - DNA, 25 bp, Rattus norvegicus
agactgcccgggatccgtttgagca

SEQ ID NO: 111190 - DNA, 25 bp, Rattus norvegicus
agactgcccgggttccgtttgagca

SEQ ID NO: 111191 - DNA, 25 bp, Rattus norvegicus
agactgccctggacatgcagattat

SEQ ID NO: 111192 - DNA, 25 bp, Rattus norvegicus
agactgccctggtcatgcagattat

SEQ ID NO: 111193 - DNA, 25 bp, Rattus norvegicus
agactgccgatgctcttgggaccaa

SEQ ID NO: 111194 - DNA, 25 bp, Rattus norvegicus
agactgccgatggtcttgggaccaa

SEQ ID NO: 111195 - DNA, 25 bp, Rattus norvegicus
agactgcctattaagtgtgttttac

SEQ ID NO: 111196 - DNA, 25 bp, Rattus norvegicus
agactgcctatttagtgtgttttac

SEQ ID NO: 111197 - DNA, 25 bp, Rattus norvegicus
agactgcctcctcagtcagtttggc

SEQ ID NO: 111198 - DNA, 25 bp, Rattus norvegicus
agactgcctcctgagtcagtttggc

SEQ ID NO: 111199 - DNA, 25 bp, Rattus norvegicus
agactgcctgagatctggtgcctgc

SEQ ID NO: 111200 - DNA, 25 bp, Rattus norvegicus
agactgcctgagttctggtgcctgc

SEQ ID NO: 111201 - DNA, 25 bp, Rattus norvegicus
agactgcctgccagcattcagatgt

SEQ ID NO: 111202 - DNA, 25 bp, Rattus norvegicus
agactgcctgcctgcattcagatgt

SEQ ID NO: 111203 - DNA, 25 bp, Rattus norvegicus
agactgccttgtagtagacgctcca

SEQ ID NO: 111204 - DNA, 25 bp, Rattus norvegicus
agactgccttgttgtagacgctcca

SEQ ID NO: 111205 - DNA, 25 bp, Rattus norvegicus
agactgcgagacagaaccgccgcta

SEQ ID NO: 111206 - DNA, 25 bp, Rattus norvegicus
agactgcgagactgaaccgccgcta

SEQ ID NO: 111207 - DNA, 25 bp, Rattus norvegicus
agactgcgcctaagaccggattgta

SEQ ID NO: 111208 - DNA, 25 bp, Rattus norvegicus
agactgcgcctatgaccggattgta

SEQ ID NO: 111209 - DNA, 25 bp, Rattus norvegicus
agactgcgtattcaccgagatcgta

SEQ ID NO: 111210 - DNA, 25 bp, Rattus norvegicus
agactgcgtattgaccgagatcgta

SEQ ID NO: 111211 - DNA, 25 bp, Rattus norvegicus
agactgcgtttcagtgagtgtagct

SEQ ID NO: 111212 - DNA, 25 bp, Rattus norvegicus
agactgcgtttctgtgagtgtagct

SEQ ID NO: 111213 - DNA, 25 bp, Rattus norvegicus
agactgctcaatctgcctttcagta

SEQ ID NO: 111214 - DNA, 25 bp, Rattus norvegicus
agactgctcaatgtgcctttcagta

SEQ ID NO: 111215 - DNA, 25 bp, Rattus norvegicus
agactgctctgcacacagtgtggaa

SEQ ID NO: 111216 - DNA, 25 bp, Rattus norvegicus
agactgctctgctcacagtgtggaa

SEQ ID NO: 111217 - DNA, 25 bp, Rattus norvegicus
agactgctgacaaatgtgcactccc

SEQ ID NO: 111218 - DNA, 25 bp, Rattus norvegicus
agactgctgacatatgtgcactccc

SEQ ID NO: 111219 - DNA, 25 bp, Rattus norvegicus
agactgctgatcacggactggacat

SEQ ID NO: 111220 - DNA, 25 bp, Rattus norvegicus
agactgctgatctcggactggacat

SEQ ID NO: 111221 - DNA, 25 bp, Rattus norvegicus
agactgctgcctccaacacatacat

SEQ ID NO: 111222 - DNA, 25 bp, Rattus norvegicus
agactgctgcctgcaacacatacat

SEQ ID NO: 111223 - DNA, 25 bp, Rattus norvegicus
agactgctgctgctcgaagctgaac

SEQ ID NO: 111224 - DNA, 25 bp, Rattus norvegicus
agactgctgctggtcgaagctgaac

SEQ ID NO: 111225 - DNA, 25 bp, Rattus norvegicus
agactgctggaaaggcgctcaggca

SEQ ID NO: 111226 - DNA, 25 bp, Rattus norvegicus
agactgctggaatggcgctcaggca

SEQ ID NO: 111227 - DNA, 25 bp, Rattus norvegicus
agactgctggacacacggagctgct

SEQ ID NO: 111228 - DNA, 25 bp, Rattus norvegicus
agactgctggactcacggagctgct

SEQ ID NO: 111229 - DNA, 25 bp, Rattus norvegicus
agactgctggtcatgatgggcctga

SEQ ID NO: 111230 - DNA, 25 bp, Rattus norvegicus
agactgctggtcttgatgggcctga

SEQ ID NO: 111231 - DNA, 25 bp, Rattus norvegicus
agactgcttctcagtgaatcttcac

SEQ ID NO: 111232 - DNA, 25 bp, Rattus norvegicus
agactgcttctctgtgaatcttcac

SEQ ID NO: 111233 - DNA, 25 bp, Rattus norvegicus
agactgcttctgatgacgtcacggg

SEQ ID NO: 111234 - DNA, 25 bp, Rattus norvegicus
agactgcttctgcaaaaccgtcgtc

SEQ ID NO: 111235 - DNA, 25 bp, Rattus norvegicus
agactgcttctggaaaaccgtcgtc

SEQ ID NO: 111236 - DNA, 25 bp, Rattus norvegicus
agactgcttctgttgacgtcacggg

SEQ ID NO: 111237 - DNA, 25 bp, Rattus norvegicus
agactgcttgctccgtttcgtttgt

SEQ ID NO: 111238 - DNA, 25 bp, Rattus norvegicus
agactgcttgctgcgtttcgtttgt

SEQ ID NO: 111239 - DNA, 25 bp, Rattus norvegicus
agactgcttggcatggttttgctct

SEQ ID NO: 111240 - DNA, 25 bp, Rattus norvegicus
agactgcttggcttggttttgctct

SEQ ID NO: 111241 - DNA, 25 bp, Rattus norvegicus
agactgctttggagacccgtttgat

SEQ ID NO: 111242 - DNA, 25 bp, Rattus norvegicus
agactgctttggtgacccgtttgat

SEQ ID NO: 111243 - DNA, 25 bp, Rattus norvegicus
agactggaatttacctctgctacct

SEQ ID NO: 111244 - DNA, 25 bp, Rattus norvegicus
agactggaattttcctctgctacct

SEQ ID NO: 111245 - DNA, 25 bp, Rattus norvegicus
agactggactagatgctttcccgtc

SEQ ID NO: 111246 - DNA, 25 bp, Rattus norvegicus
agactggactagttgctttcccgtc

SEQ ID NO: 111247 - DNA, 25 bp, Rattus norvegicus
agactggactcaagccatcactgtt

SEQ ID NO: 111248 - DNA, 25 bp, Rattus norvegicus
agactggactcatgccatcactgtt

SEQ ID NO: 111249 - DNA, 25 bp, Rattus norvegicus
agactggagaaaagctacttttatt

SEQ ID NO: 111250 - DNA, 25 bp, Rattus norvegicus
agactggagaaatgctacttttatt

SEQ ID NO: 111251 - DNA, 25 bp, Rattus norvegicus
agactggagactcggaatttcttcc

SEQ ID NO: 111252 - DNA, 25 bp, Rattus norvegicus
agactggagactgggaatttcttcc

SEQ ID NO: 111253 - DNA, 25 bp, Rattus norvegicus
agactggaggctacgccagcttgga

SEQ ID NO: 111254 - DNA, 25 bp, Rattus norvegicus
agactggaggcttcgccagcttgga

SEQ ID NO: 111255 - DNA, 25 bp, Rattus norvegicus
agactggaggttactgctctttgat

SEQ ID NO: 111256 - DNA, 25 bp, Rattus norvegicus
agactggaggtttctgctctttgat

SEQ ID NO: 111257 - DNA, 25 bp, Rattus norvegicus
agactggagtgccttgagcccaact

SEQ ID NO: 111258 - DNA, 25 bp, Rattus norvegicus
agactggagtgcgttgagcccaact

SEQ ID NO: 111259 - DNA, 25 bp, Rattus norvegicus
agactggagttcaagacgacatgaa

SEQ ID NO: 111260 - DNA, 25 bp, Rattus norvegicus
agactggagttctagacgacatgaa

SEQ ID NO: 111261 - DNA, 25 bp, Rattus norvegicus
agactggcagatcttctctttgatg

SEQ ID NO: 111262 - DNA, 25 bp, Rattus norvegicus
agactggcagatgttctctttgatg

SEQ ID NO: 111263 - DNA, 25 bp, Rattus norvegicus
agactggcatttccttggtgttggc

SEQ ID NO: 111264 - DNA, 25 bp, Rattus norvegicus
agactggcatttgcttggtgttggc

SEQ ID NO: 111265 - DNA, 25 bp, Rattus norvegicus
agactggcgggcatgtggctactct

SEQ ID NO: 111266 - DNA, 25 bp, Rattus norvegicus
agactggcgggcttgtggctactct

SEQ ID NO: 111267 - DNA, 25 bp, Rattus norvegicus
agactggctcgaagtacctcatcaa

SEQ ID NO: 111268 - DNA, 25 bp, Rattus norvegicus
agactggctcgatgtacctcatcaa

SEQ ID NO: 111269 - DNA, 25 bp, Rattus norvegicus
agactgggacgcactatattgccta

SEQ ID NO: 111270 - DNA, 25 bp, Rattus norvegicus
agactgggacgctctatattgccta

SEQ ID NO: 111271 - DNA, 25 bp, Rattus norvegicus
agactgggagttaattccagcatcc

SEQ ID NO: 111272 - DNA, 25 bp, Rattus norvegicus
agactgggagtttattccagcatcc

SEQ ID NO: 111273 - DNA, 25 bp, Rattus norvegicus
agactgggcagcacgttcgcacggc

SEQ ID NO: 111274 - DNA, 25 bp, Rattus norvegicus
agactgggcagctcgttcgcacggc

SEQ ID NO: 111275 - DNA, 25 bp, Rattus norvegicus
agactgggcatcatgaccccgatat

SEQ ID NO: 111276 - DNA, 25 bp, Rattus norvegicus
agactgggcatcttgaccccgatat

SEQ ID NO: 111277 - DNA, 25 bp, Rattus norvegicus
agactgggccatatgagagcccgtc

SEQ ID NO: 111278 - DNA, 25 bp, Rattus norvegicus
agactgggccatttgagagcccgtc

SEQ ID NO: 111279 - DNA, 25 bp, Rattus norvegicus
agactgggcctgagtcctgtgcaga

SEQ ID NO: 111280 - DNA, 25 bp, Rattus norvegicus
agactgggcctgtgtcctgtgcaga

SEQ ID NO: 111281 - DNA, 25 bp, Rattus norvegicus
agactgggcggtcctgattaccaca

SEQ ID NO: 111282 - DNA, 25 bp, Rattus norvegicus
agactgggcggtgctgattaccaca

SEQ ID NO: 111283 - DNA, 25 bp, Rattus norvegicus
agactgggctccacctgtccatgag

SEQ ID NO: 111284 - DNA, 25 bp, Rattus norvegicus
agactgggctccctgctttgatcac

SEQ ID NO: 111285 - DNA, 25 bp, Rattus norvegicus
agactgggctcccttcccagggtgc

SEQ ID NO: 111286 - DNA, 25 bp, Rattus norvegicus
agactgggctccgtgctttgatcac

SEQ ID NO: 111287 - DNA, 25 bp, Rattus norvegicus
agactgggctccgttcccagggtgc

SEQ ID NO: 111288 - DNA, 25 bp, Rattus norvegicus
agactgggctcctcctgtccatgag

SEQ ID NO: 111289 - DNA, 25 bp, Rattus norvegicus
agactgggctctctggttccagagt

SEQ ID NO: 111290 - DNA, 25 bp, Rattus norvegicus
agactgggctctcttgttagctggc

SEQ ID NO: 111291 - DNA, 25 bp, Rattus norvegicus
agactgggctctgtggttccagagt

SEQ ID NO: 111292 - DNA, 25 bp, Rattus norvegicus
agactgggctctgttgttagctggc

SEQ ID NO: 111293 - DNA, 25 bp, Rattus norvegicus
agactgggtcagagaatggccgtcc

SEQ ID NO: 111294 - DNA, 25 bp, Rattus norvegicus
agactgggtcagtgaatggccgtcc

SEQ ID NO: 111295 - DNA, 25 bp, Rattus norvegicus
agactgggtctcacagcctctgtgt

SEQ ID NO: 111296 - DNA, 25 bp, Rattus norvegicus
agactgggtctctcagcctctgtgt

SEQ ID NO: 111297 - DNA, 25 bp, Rattus norvegicus
agactggtcaggagagaactatgcc

SEQ ID NO: 111298 - DNA, 25 bp, Rattus norvegicus
agactggtcaggtgagaactatgcc

SEQ ID NO: 111299 - DNA, 25 bp, Rattus norvegicus
agactggtccacaggcattcagcaa

SEQ ID NO: 111300 - DNA, 25 bp, Rattus norvegicus
agactggtccactggcattcagcaa

SEQ ID NO: 111301 - DNA, 25 bp, Rattus norvegicus
agactggtccgactcaacgcctagt

SEQ ID NO: 111302 - DNA, 25 bp, Rattus norvegicus
agactggtccgagtcaacgcctagt

SEQ ID NO: 111303 - DNA, 25 bp, Rattus norvegicus
agactggtctgacccaggccttgtc

SEQ ID NO: 111304 - DNA, 25 bp, Rattus norvegicus
agactggtctgagccaggccttgtc

SEQ ID NO: 111305 - DNA, 25 bp, Rattus norvegicus
agactggtgtcaccctctcaaggag

SEQ ID NO: 111306 - DNA, 25 bp, Rattus norvegicus
agactggtgtcagcctctcaaggag

SEQ ID NO: 111307 - DNA, 25 bp, Rattus norvegicus
agactggtgtttactatgtcctttt

SEQ ID NO: 111308 - DNA, 25 bp, Rattus norvegicus
agactggtgttttctatgtcctttt

SEQ ID NO: 111309 - DNA, 25 bp, Rattus norvegicus
agactggttctgagatattctaaac

SEQ ID NO: 111310 - DNA, 25 bp, Rattus norvegicus
agactggttctgtgatattctaaac

SEQ ID NO: 111311 - DNA, 25 bp, Rattus norvegicus
agactggttggcatagctctgcaat

SEQ ID NO: 111312 - DNA, 25 bp, Rattus norvegicus
agactggttggcttagctctgcaat

SEQ ID NO: 111313 - DNA, 25 bp, Rattus norvegicus
agactgtactgcataggatattaaa

SEQ ID NO: 111314 - DNA, 25 bp, Rattus norvegicus
agactgtactgcttaggatattaaa

SEQ ID NO: 111315 - DNA, 25 bp, Rattus norvegicus
agactgtaggctacgggatgctcaa

SEQ ID NO: 111316 - DNA, 25 bp, Rattus norvegicus
agactgtaggcttcgggatgctcaa

SEQ ID NO: 111317 - DNA, 25 bp, Rattus norvegicus
agactgtatcataagtgccctttag

SEQ ID NO: 111318 - DNA, 25 bp, Rattus norvegicus
agactgtatcattagtgccctttag

SEQ ID NO: 111319 - DNA, 25 bp, Rattus norvegicus
agactgtatctgaaaacctcctgca

SEQ ID NO: 111320 - DNA, 25 bp, Rattus norvegicus
agactgtatctgaggaggcattaac

SEQ ID NO: 111321 - DNA, 25 bp, Rattus norvegicus
agactgtatctgtaaacctcctgca

SEQ ID NO: 111322 - DNA, 25 bp, Rattus norvegicus
agactgtatctgtggaggcattaac

SEQ ID NO: 111323 - DNA, 25 bp, Rattus norvegicus
agactgtatgctagttgtctgtatc

SEQ ID NO: 111324 - DNA, 25 bp, Rattus norvegicus
agactgtatgcttgttgtctgtatc

SEQ ID NO: 111325 - DNA, 25 bp, Rattus norvegicus
agactgtcagtacggctttctattt

SEQ ID NO: 111326 - DNA, 25 bp, Rattus norvegicus
agactgtcagtagggctttctattt

SEQ ID NO: 111327 - DNA, 25 bp, Rattus norvegicus
agactgtcatctaatctgttacata

SEQ ID NO: 111328 - DNA, 25 bp, Rattus norvegicus
agactgtcatcttatctgttacata

SEQ ID NO: 111329 - DNA, 25 bp, Rattus norvegicus
agactgtcattcagtgtcagctgcc

SEQ ID NO: 111330 - DNA, 25 bp, Rattus norvegicus
agactgtcattctgtgtcagctgcc

SEQ ID NO: 111331 - DNA, 25 bp, Rattus norvegicus
agactgtcattgagatgccctgcca

SEQ ID NO: 111332 - DNA, 25 bp, Rattus norvegicus
agactgtcattgtgatgccctgcca

SEQ ID NO: 111333 - DNA, 25 bp, Rattus norvegicus
agactgtccaaacggatggccatca

SEQ ID NO: 111334 - DNA, 25 bp, Rattus norvegicus
agactgtccaaagggatggccatca

SEQ ID NO: 111335 - DNA, 25 bp, Rattus norvegicus
agactgtccagacactaccaccaag

SEQ ID NO: 111336 - DNA, 25 bp, Rattus norvegicus
agactgtccagagactaccaccaag

SEQ ID NO: 111337 - DNA, 25 bp, Rattus norvegicus
agactgtcccacagtaaatgttcac

SEQ ID NO: 111338 - DNA, 25 bp, Rattus norvegicus
agactgtcccactgtaaatgttcac

SEQ ID NO: 111339 - DNA, 25 bp, Rattus norvegicus
agactgtcccggagtgtgaaagcac

SEQ ID NO: 111340 - DNA, 25 bp, Rattus norvegicus
agactgtcccggtgtgtgaaagcac

SEQ ID NO: 111341 - DNA, 25 bp, Rattus norvegicus
agactgtccgttaccaacaatgtgg

SEQ ID NO: 111342 - DNA, 25 bp, Rattus norvegicus
agactgtccgtttccaacaatgtgg

SEQ ID NO: 111343 - DNA, 25 bp, Rattus norvegicus
agactgtcctgtaacctctgtgcgt

SEQ ID NO: 111344 - DNA, 25 bp, Rattus norvegicus
agactgtcctgttacctctgtgcgt

SEQ ID NO: 111345 - DNA, 25 bp, Rattus norvegicus
agactgtcctttattcccagtggga

SEQ ID NO: 111346 - DNA, 25 bp, Rattus norvegicus
agactgtccttttttcccagtggga

SEQ ID NO: 111347 - DNA, 25 bp, Rattus norvegicus
agactgtcgctgctcaagattcgtt

SEQ ID NO: 111348 - DNA, 25 bp, Rattus norvegicus
agactgtcgctggtcaagattcgtt

SEQ ID NO: 111349 - DNA, 25 bp, Rattus norvegicus
agactgtctactccctgtccgggaa

SEQ ID NO: 111350 - DNA, 25 bp, Rattus norvegicus
agactgtctactgcctgtccgggaa

SEQ ID NO: 111351 - DNA, 25 bp, Rattus norvegicus
agactgtctccacgccttattgaga

SEQ ID NO: 111352 - DNA, 25 bp, Rattus norvegicus
agactgtctccaggccttattgaga

SEQ ID NO: 111353 - DNA, 25 bp, Rattus norvegicus
agactgtctccccagagcagagcaa

SEQ ID NO: 111354 - DNA, 25 bp, Rattus norvegicus
agactgtctcccgagagcagagcaa

SEQ ID NO: 111355 - DNA, 25 bp, Rattus norvegicus
agactgtctcttaaacctcagaaaa

SEQ ID NO: 111356 - DNA, 25 bp, Rattus norvegicus
agactgtctctttaacctcagaaaa

SEQ ID NO: 111357 - DNA, 25 bp, Rattus norvegicus
agactgtcttctatacctgtatcaa

SEQ ID NO: 111358 - DNA, 25 bp, Rattus norvegicus
agactgtcttctttacctgtatcaa

SEQ ID NO: 111359 - DNA, 25 bp, Rattus norvegicus
agactgtcttggagtggccttgttc

SEQ ID NO: 111360 - DNA, 25 bp, Rattus norvegicus
agactgtcttggtgtggccttgttc

SEQ ID NO: 111361 - DNA, 25 bp, Rattus norvegicus
agactgtgaaataccttctctaggg

SEQ ID NO: 111362 - DNA, 25 bp, Rattus norvegicus
agactgtgaaattccttctctaggg

SEQ ID NO: 111363 - DNA, 25 bp, Rattus norvegicus
agactgtgaaccattctctcgtgag

SEQ ID NO: 111364 - DNA, 25 bp, Rattus norvegicus
agactgtgaacctttctctcgtgag

SEQ ID NO: 111365 - DNA, 25 bp, Rattus norvegicus
agactgtgacagagttcccttttgt

SEQ ID NO: 111366 - DNA, 25 bp, Rattus norvegicus
agactgtgacagtgttcccttttgt

SEQ ID NO: 111367 - DNA, 25 bp, Rattus norvegicus
agactgtgagcccacacttcaggaa

SEQ ID NO: 111368 - DNA, 25 bp, Rattus norvegicus
agactgtgagccgacacttcaggaa

SEQ ID NO: 111369 - DNA, 25 bp, Rattus norvegicus
agactgtgagctccatcgtgagcag

SEQ ID NO: 111370 - DNA, 25 bp, Rattus norvegicus
agactgtgagctgcatcgtgagcag

SEQ ID NO: 111371 - DNA, 25 bp, Rattus norvegicus
agactgtgatgcctttcagaccagc

SEQ ID NO: 111372 - DNA, 25 bp, Rattus norvegicus
agactgtgatgcgtttcagaccagc

SEQ ID NO: 111373 - DNA, 25 bp, Rattus norvegicus
agactgtgcagaccaaggtgcccat

SEQ ID NO: 111374 - DNA, 25 bp, Rattus norvegicus
agactgtgcagagcaaggtgcccat

SEQ ID NO: 111375 - DNA, 25 bp, Rattus norvegicus
agactgtgcctaagaatgccttgct

SEQ ID NO: 111376 - DNA, 25 bp, Rattus norvegicus
agactgtgcctatgaatgccttgct

SEQ ID NO: 111377 - DNA, 25 bp, Rattus norvegicus
agactgtggagcagccaggtccccg

SEQ ID NO: 111378 - DNA, 25 bp, Rattus norvegicus
agactgtggagctgccaggtccccg

SEQ ID NO: 111379 - DNA, 25 bp, Rattus norvegicus
agactgtggaggacaccactacctg

SEQ ID NO: 111380 - DNA, 25 bp, Rattus norvegicus
agactgtggaggtcaccactacctg

SEQ ID NO: 111381 - DNA, 25 bp, Rattus norvegicus
agactgtggcaacaaacaccctgca

SEQ ID NO: 111382 - DNA, 25 bp, Rattus norvegicus
agactgtggcaagaaacaccctgca

SEQ ID NO: 111383 - DNA, 25 bp, Rattus norvegicus
agactgtggctgctctctgaaggaa

SEQ ID NO: 111384 - DNA, 25 bp, Rattus norvegicus
agactgtggctggtctctgaaggaa

SEQ ID NO: 111385 - DNA, 25 bp, Rattus norvegicus
agactgtggtgacttcgcccatgga

SEQ ID NO: 111386 - DNA, 25 bp, Rattus norvegicus
agactgtggtgagttcgcccatgga

SEQ ID NO: 111387 - DNA, 25 bp, Rattus norvegicus
agactgtgtcctcattcaaattcca

SEQ ID NO: 111388 - DNA, 25 bp, Rattus norvegicus
agactgtgtcctgattcaaattcca

SEQ ID NO: 111389 - DNA, 25 bp, Rattus norvegicus
agactgtgtctgaaggtaaacttat

SEQ ID NO: 111390 - DNA, 25 bp, Rattus norvegicus
agactgtgtctgtaggtaaacttat

SEQ ID NO: 111391 - DNA, 25 bp, Rattus norvegicus
agactgtgtgtgagtgcagcctcca

SEQ ID NO: 111392 - DNA, 25 bp, Rattus norvegicus
agactgtgtgtgtgtgcagcctcca

SEQ ID NO: 111393 - DNA, 25 bp, Rattus norvegicus
agactgtgtgttaccaagacgcacg

SEQ ID NO: 111394 - DNA, 25 bp, Rattus norvegicus
agactgtgtgttcatctactgccaa

SEQ ID NO: 111395 - DNA, 25 bp, Rattus norvegicus
agactgtgtgttgatctactgccaa

SEQ ID NO: 111396 - DNA, 25 bp, Rattus norvegicus
agactgtgtgtttccaagacgcacg

SEQ ID NO: 111397 - DNA, 25 bp, Rattus norvegicus
agactgtgttacagatttccatcat

SEQ ID NO: 111398 - DNA, 25 bp, Rattus norvegicus
agactgtgttactgatttccatcat

SEQ ID NO: 111399 - DNA, 25 bp, Rattus norvegicus
agactgtgtttaactgtccagatgg

SEQ ID NO: 111400 - DNA, 25 bp, Rattus norvegicus
agactgtgtttatctgtccagatgg

SEQ ID NO: 111401 - DNA, 25 bp, Rattus norvegicus
agactgttcagtcacatgtgtcaag

SEQ ID NO: 111402 - DNA, 25 bp, Rattus norvegicus
agactgttcagtgacatgtgtcaag

SEQ ID NO: 111403 - DNA, 25 bp, Rattus norvegicus
agactgttccagctcagtgtgtcat

SEQ ID NO: 111404 - DNA, 25 bp, Rattus norvegicus
agactgttccaggtcagtgtgtcat

SEQ ID NO: 111405 - DNA, 25 bp, Rattus norvegicus
agactgttcccaagtggatcagcca

SEQ ID NO: 111406 - DNA, 25 bp, Rattus norvegicus
agactgttcccatgtggatcagcca

SEQ ID NO: 111407 - DNA, 25 bp, Rattus norvegicus
agactgttctcgatctgctgtagaa

SEQ ID NO: 111408 - DNA, 25 bp, Rattus norvegicus
agactgttctcgttctgctgtagaa

SEQ ID NO: 111409 - DNA, 25 bp, Rattus norvegicus
agactgttctgcaacccagtaggaa

SEQ ID NO: 111410 - DNA, 25 bp, Rattus norvegicus
agactgttctgctacccagtaggaa

SEQ ID NO: 111411 - DNA, 25 bp, Rattus norvegicus
agactgttgcctactggttttcttt

SEQ ID NO: 111412 - DNA, 25 bp, Rattus norvegicus
agactgttgccttctggttttcttt

SEQ ID NO: 111413 - DNA, 25 bp, Rattus norvegicus
agactgttgctgactccaagccaaa

SEQ ID NO: 111414 - DNA, 25 bp, Rattus norvegicus
agactgttgctgatgggtaccatat

SEQ ID NO: 111415 - DNA, 25 bp, Rattus norvegicus
agactgttgctgtctccaagccaaa

SEQ ID NO: 111416 - DNA, 25 bp, Rattus norvegicus
agactgttgctgttgggtaccatat

SEQ ID NO: 111417 - DNA, 25 bp, Rattus norvegicus
agactgttgtgccatactctctaac

SEQ ID NO: 111418 - DNA, 25 bp, Rattus norvegicus
agactgttgtgcgatactctctaac

SEQ ID NO: 111419 - DNA, 25 bp, Rattus norvegicus
agactgttgttactctggttggttg

SEQ ID NO: 111420 - DNA, 25 bp, Rattus norvegicus
agactgttgttagtctggttggttg

SEQ ID NO: 111421 - DNA, 25 bp, Rattus norvegicus
agactgtttcttatcttccagcaca

SEQ ID NO: 111422 - DNA, 25 bp, Rattus norvegicus
agactgtttcttttcttccagcaca

SEQ ID NO: 111423 - DNA, 25 bp, Rattus norvegicus
agacttaactccagctttttcagca

SEQ ID NO: 111424 - DNA, 25 bp, Rattus norvegicus
agacttaactcctgctttttcagca

SEQ ID NO: 111425 - DNA, 25 bp, Rattus norvegicus
agacttaagctccagctccatggct

SEQ ID NO: 111426 - DNA, 25 bp, Rattus norvegicus
agacttaagctcgagctccatggct

SEQ ID NO: 111427 - DNA, 25 bp, Rattus norvegicus
agacttaattaacgaggccatggac

SEQ ID NO: 111428 - DNA, 25 bp, Rattus norvegicus
agacttaattaaggaggccatggac

SEQ ID NO: 111429 - DNA, 25 bp, Rattus norvegicus
agacttaattgaactgctctccctg

SEQ ID NO: 111430 - DNA, 25 bp, Rattus norvegicus
agacttaattgatctgctctccctg

SEQ ID NO: 111431 - DNA, 25 bp, Rattus norvegicus
agacttaatttcatgtttgccccgg

SEQ ID NO: 111432 - DNA, 25 bp, Rattus norvegicus
agacttaatttcttgtttgccccgg

SEQ ID NO: 111433 - DNA, 25 bp, Rattus norvegicus
agacttacacacatggctatttttt

SEQ ID NO: 111434 - DNA, 25 bp, Rattus norvegicus
agacttacacacttggctatttttt

SEQ ID NO: 111435 - DNA, 25 bp, Rattus norvegicus
agacttacagggaatccgaatcgat

SEQ ID NO: 111436 - DNA, 25 bp, Rattus norvegicus
agacttacagggtatccgaatcgat

SEQ ID NO: 111437 - DNA, 25 bp, Rattus norvegicus
agacttaccatcaggatgctggccc

SEQ ID NO: 111438 - DNA, 25 bp, Rattus norvegicus
agacttaccatctggatgctggccc

SEQ ID NO: 111439 - DNA, 25 bp, Rattus norvegicus
agacttaccgctaccatggacatag

SEQ ID NO: 111440 - DNA, 25 bp, Rattus norvegicus
agacttaccgcttccatggacatag

SEQ ID NO: 111441 - DNA, 25 bp, Rattus norvegicus
agacttacctggcagttctggagcc

SEQ ID NO: 111442 - DNA, 25 bp, Rattus norvegicus
agacttacctgggagttctggagcc

SEQ ID NO: 111443 - DNA, 25 bp, Rattus norvegicus
agacttacgagtacctgaccacagg

SEQ ID NO: 111444 - DNA, 25 bp, Rattus norvegicus
agacttacgagttcctgaccacagg

SEQ ID NO: 111445 - DNA, 25 bp, Rattus norvegicus
agacttactctgactgtggacgcag

SEQ ID NO: 111446 - DNA, 25 bp, Rattus norvegicus
agacttactctgtctgtggacgcag

SEQ ID NO: 111447 - DNA, 25 bp, Rattus norvegicus
agacttactggtctggttctgtcca

SEQ ID NO: 111448 - DNA, 25 bp, Rattus norvegicus
agacttactggtgtggttctgtcca

SEQ ID NO: 111449 - DNA, 25 bp, Rattus norvegicus
agacttagacaacagtttaatctcc

SEQ ID NO: 111450 - DNA, 25 bp, Rattus norvegicus
agacttagacaagagtttaatctcc

SEQ ID NO: 111451 - DNA, 25 bp, Rattus norvegicus
agacttagcaaaccaacatctttta

SEQ ID NO: 111452 - DNA, 25 bp, Rattus norvegicus
agacttagcaaagcaacatctttta

SEQ ID NO: 111453 - DNA, 25 bp, Rattus norvegicus
agacttagctagctttccatttaga

SEQ ID NO: 111454 - DNA, 25 bp, Rattus norvegicus
agacttagctaggtttccatttaga

SEQ ID NO: 111455 - DNA, 25 bp, Rattus norvegicus
agacttaggactcatgggttccgcc

SEQ ID NO: 111456 - DNA, 25 bp, Rattus norvegicus
agacttaggactgatgggttccgcc

SEQ ID NO: 111457 - DNA, 25 bp, Rattus norvegicus
agacttatccccagctatgccatgg

SEQ ID NO: 111458 - DNA, 25 bp, Rattus norvegicus
agacttatcccctgctatgccatgg

SEQ ID NO: 111459 - DNA, 25 bp, Rattus norvegicus
agacttattttgcagctcagcgcag

SEQ ID NO: 111460 - DNA, 25 bp, Rattus norvegicus
agacttattttggagctcagcgcag

SEQ ID NO: 111461 - DNA, 25 bp, Rattus norvegicus
agacttcaactacgtctgcctgcat

SEQ ID NO: 111462 - DNA, 25 bp, Rattus norvegicus
agacttcaactaggtctgcctgcat

SEQ ID NO: 111463 - DNA, 25 bp, Rattus norvegicus
agacttcaactcaagacctgccagt

SEQ ID NO: 111464 - DNA, 25 bp, Rattus norvegicus
agacttcaactcattgtgggcggtg

SEQ ID NO: 111465 - DNA, 25 bp, Rattus norvegicus
agacttcaactctagacctgccagt

SEQ ID NO: 111466 - DNA, 25 bp, Rattus norvegicus
agacttcaactctttgtgggcggtg

SEQ ID NO: 111467 - DNA, 25 bp, Rattus norvegicus
agacttcacattcctgtttttgctt

SEQ ID NO: 111468 - DNA, 25 bp, Rattus norvegicus
agacttcacattgctgtttttgctt

SEQ ID NO: 111469 - DNA, 25 bp, Rattus norvegicus
agacttcaccttatcaaagctgtcc

SEQ ID NO: 111470 - DNA, 25 bp, Rattus norvegicus
agacttcaccttttcaaagctgtcc

SEQ ID NO: 111471 - DNA, 25 bp, Rattus norvegicus
agacttcacggtcactctgtctggg

SEQ ID NO: 111472 - DNA, 25 bp, Rattus norvegicus
agacttcacggtgactctgtctggg

SEQ ID NO: 111473 - DNA, 25 bp, Rattus norvegicus
agacttcagaacacctggctgccat

SEQ ID NO: 111474 - DNA, 25 bp, Rattus norvegicus
agacttcagaactcctggctgccat

SEQ ID NO: 111475 - DNA, 25 bp, Rattus norvegicus
agacttcagactcagcctgtgtgtc

SEQ ID NO: 111476 - DNA, 25 bp, Rattus norvegicus
agacttcagactgagcctgtgtgtc

SEQ ID NO: 111477 - DNA, 25 bp, Rattus norvegicus
agacttcagcccacctgaggcaaaa

SEQ ID NO: 111478 - DNA, 25 bp, Rattus norvegicus
agacttcagccctcctgaggcaaaa

SEQ ID NO: 111479 - DNA, 25 bp, Rattus norvegicus
agacttcaggttctatttgctccca

SEQ ID NO: 111480 - DNA, 25 bp, Rattus norvegicus
agacttcaggttgtatttgctccca

SEQ ID NO: 111481 - DNA, 25 bp, Rattus norvegicus
agacttcagtcacctcataactcac

SEQ ID NO: 111482 - DNA, 25 bp, Rattus norvegicus
agacttcagtcagctcataactcac

SEQ ID NO: 111483 - DNA, 25 bp, Rattus norvegicus
agacttcagtgacctcaggtcagca

SEQ ID NO: 111484 - DNA, 25 bp, Rattus norvegicus
agacttcagtgagctcaggtcagca

SEQ ID NO: 111485 - DNA, 25 bp, Rattus norvegicus
agacttcatatactgctggcatcag

SEQ ID NO: 111486 - DNA, 25 bp, Rattus norvegicus
agacttcatatagtgctggcatcag

SEQ ID NO: 111487 - DNA, 25 bp, Rattus norvegicus
agacttcattctaatgtacctgtgt

SEQ ID NO: 111488 - DNA, 25 bp, Rattus norvegicus
agacttcattcttatgtacctgtgt

SEQ ID NO: 111489 - DNA, 25 bp, Rattus norvegicus
agacttccaacaaagacgcagcaga

SEQ ID NO: 111490 - DNA, 25 bp, Rattus norvegicus
agacttccaacatagacgcagcaga

SEQ ID NO: 111491 - DNA, 25 bp, Rattus norvegicus
agacttccagagcttgctgtccctg

SEQ ID NO: 111492 - DNA, 25 bp, Rattus norvegicus
agacttccagaggttgctgtccctg

SEQ ID NO: 111493 - DNA, 25 bp, Rattus norvegicus
agacttccagatctcttgactgtaa

SEQ ID NO: 111494 - DNA, 25 bp, Rattus norvegicus
agacttccagatgtcttgactgtaa

SEQ ID NO: 111495 - DNA, 25 bp, Rattus norvegicus
agacttccaggccttccttgatctt

SEQ ID NO: 111496 - DNA, 25 bp, Rattus norvegicus
agacttccaggcgttccttgatctt

SEQ ID NO: 111497 - DNA, 25 bp, Rattus norvegicus
agacttcccaacatgctaaattgca

SEQ ID NO: 111498 - DNA, 25 bp, Rattus norvegicus
agacttcccaacttgctaaattgca

SEQ ID NO: 111499 - DNA, 25 bp, Rattus norvegicus
agacttcccggaacaattgcagtag

SEQ ID NO: 111500 - DNA, 25 bp, Rattus norvegicus
agacttcccggatcaattgcagtag

SEQ ID NO: 111501 - DNA, 25 bp, Rattus norvegicus
agacttcccttgaggatacgcgtgg

SEQ ID NO: 111502 - DNA, 25 bp, Rattus norvegicus
agacttcccttgtggatacgcgtgg

SEQ ID NO: 111503 - DNA, 25 bp, Rattus norvegicus
agacttccggaacgtgtttgcccag

SEQ ID NO: 111504 - DNA, 25 bp, Rattus norvegicus
agacttccggaaggtgtttgcccag

SEQ ID NO: 111505 - DNA, 25 bp, Rattus norvegicus
agacttcctacacttgtcctgagga

SEQ ID NO: 111506 - DNA, 25 bp, Rattus norvegicus
agacttcctacagttgtcctgagga

SEQ ID NO: 111507 - DNA, 25 bp, Rattus norvegicus
agacttcctcttcatatccaatgta

SEQ ID NO: 111508 - DNA, 25 bp, Rattus norvegicus
agacttcctcttgatatccaatgta

SEQ ID NO: 111509 - DNA, 25 bp, Rattus norvegicus
agacttcctgagaaaacacctccga

SEQ ID NO: 111510 - DNA, 25 bp, Rattus norvegicus
agacttcctgagtaaacacctccga

SEQ ID NO: 111511 - DNA, 25 bp, Rattus norvegicus
agacttcctgctaccattcagtgtg

SEQ ID NO: 111512 - DNA, 25 bp, Rattus norvegicus
agacttcctgcttccattcagtgtg

SEQ ID NO: 111513 - DNA, 25 bp, Rattus norvegicus
agacttcctggactaagccccatgg

SEQ ID NO: 111514 - DNA, 25 bp, Rattus norvegicus
agacttcctggagtaagccccatgg

SEQ ID NO: 111515 - DNA, 25 bp, Rattus norvegicus
agacttcgaacgactgctgctaaca

SEQ ID NO: 111516 - DNA, 25 bp, Rattus norvegicus
agacttcgaacgtctgctgctaaca

SEQ ID NO: 111517 - DNA, 25 bp, Rattus norvegicus
agacttcgacggcaaccatgacttt

SEQ ID NO: 111518 - DNA, 25 bp, Rattus norvegicus
agacttcgacgggaaccatgacttt

SEQ ID NO: 111519 - DNA, 25 bp, Rattus norvegicus
agacttcgcacaacacagaggtcca

SEQ ID NO: 111520 - DNA, 25 bp, Rattus norvegicus
agacttcgcacatcacagaggtcca

SEQ ID NO: 111521 - DNA, 25 bp, Rattus norvegicus
agacttcggtgcctccctattgctt

SEQ ID NO: 111522 - DNA, 25 bp, Rattus norvegicus
agacttcggtgcgtccctattgctt

SEQ ID NO: 111523 - DNA, 25 bp, Rattus norvegicus
agacttcgtgtcatctccttggaaa

SEQ ID NO: 111524 - DNA, 25 bp, Rattus norvegicus
agacttcgtgtcttctccttggaaa

SEQ ID NO: 111525 - DNA, 25 bp, Rattus norvegicus
agacttcgtgtgagctgggcaagta

SEQ ID NO: 111526 - DNA, 25 bp, Rattus norvegicus
agacttcgtgtgtgctgggcaagta

SEQ ID NO: 111527 - DNA, 25 bp, Rattus norvegicus
agacttcgttggaactgtggctggc

SEQ ID NO: 111528 - DNA, 25 bp, Rattus norvegicus
agacttcgttggtactgtggctggc

SEQ ID NO: 111529 - DNA, 25 bp, Rattus norvegicus
agacttctaacaacatatcacccag

SEQ ID NO: 111530 - DNA, 25 bp, Rattus norvegicus
agacttctaacatcatatcacccag

SEQ ID NO: 111531 - DNA, 25 bp, Rattus norvegicus
agacttctaagcagttggtcctccc

SEQ ID NO: 111532 - DNA, 25 bp, Rattus norvegicus
agacttctaagctgttggtcctccc

SEQ ID NO: 111533 - DNA, 25 bp, Rattus norvegicus
agacttctagcaactcctgtagcaa

SEQ ID NO: 111534 - DNA, 25 bp, Rattus norvegicus
agacttctagcatctcctgtagcaa

SEQ ID NO: 111535 - DNA, 25 bp, Rattus norvegicus
agacttctcaggcagcagcacggaa

SEQ ID NO: 111536 - DNA, 25 bp, Rattus norvegicus
agacttctcagggagcagcacggaa

SEQ ID NO: 111537 - DNA, 25 bp, Rattus norvegicus
agacttctcagtaggcttgttgccc

SEQ ID NO: 111538 - DNA, 25 bp, Rattus norvegicus
agacttctcagtcgatctgcagcgc

SEQ ID NO: 111539 - DNA, 25 bp, Rattus norvegicus
agacttctcagtggatctgcagcgc

SEQ ID NO: 111540 - DNA, 25 bp, Rattus norvegicus
agacttctcagttggcttgttgccc

SEQ ID NO: 111541 - DNA, 25 bp, Rattus norvegicus
agacttctctctctgaagagaactt

SEQ ID NO: 111542 - DNA, 25 bp, Rattus norvegicus
agacttctctctgtgaagagaactt

SEQ ID NO: 111543 - DNA, 25 bp, Rattus norvegicus
agacttctcttcattcccagaatta

SEQ ID NO: 111544 - DNA, 25 bp, Rattus norvegicus
agacttctcttcattttgcctcaat

SEQ ID NO: 111545 - DNA, 25 bp, Rattus norvegicus
agacttctcttctttcccagaatta

SEQ ID NO: 111546 - DNA, 25 bp, Rattus norvegicus
agacttctcttctttttgcctcaat

SEQ ID NO: 111547 - DNA, 25 bp, Rattus norvegicus
agacttctgacacgcttcagtcata

SEQ ID NO: 111548 - DNA, 25 bp, Rattus norvegicus
agacttctgacaggcttcagtcata

SEQ ID NO: 111549 - DNA, 25 bp, Rattus norvegicus
agacttctgcctacaccgagtcatt

SEQ ID NO: 111550 - DNA, 25 bp, Rattus norvegicus
agacttctgccttcaccgagtcatt

SEQ ID NO: 111551 - DNA, 25 bp, Rattus norvegicus
agacttctggacacttcggagaacc

SEQ ID NO: 111552 - DNA, 25 bp, Rattus norvegicus
agacttctggactcttcggagaacc

SEQ ID NO: 111553 - DNA, 25 bp, Rattus norvegicus
agacttctgggtctgggtctctgct

SEQ ID NO: 111554 - DNA, 25 bp, Rattus norvegicus
agacttctgggtgtgggtctctgct

SEQ ID NO: 111555 - DNA, 25 bp, Rattus norvegicus
agacttctgttgattcctagctgat

SEQ ID NO: 111556 - DNA, 25 bp, Rattus norvegicus
agacttctgttgtttcctagctgat

SEQ ID NO: 111557 - DNA, 25 bp, Rattus norvegicus
agacttcttagaaccttcacactgt

SEQ ID NO: 111558 - DNA, 25 bp, Rattus norvegicus
agacttcttagatccttcacactgt

SEQ ID NO: 111559 - DNA, 25 bp, Rattus norvegicus
agacttgaacagcaggcgcgttgat

SEQ ID NO: 111560 - DNA, 25 bp, Rattus norvegicus
agacttgaacaggaggcgcgttgat

SEQ ID NO: 111561 - DNA, 25 bp, Rattus norvegicus
agacttgacagcaagctctggagca

SEQ ID NO: 111562 - DNA, 25 bp, Rattus norvegicus
agacttgacagctagctctggagca

SEQ ID NO: 111563 - DNA, 25 bp, Rattus norvegicus
agacttgacttgagtggcggcgtaa

SEQ ID NO: 111564 - DNA, 25 bp, Rattus norvegicus
agacttgacttgtgtggcggcgtaa

SEQ ID NO: 111565 - DNA, 25 bp, Rattus norvegicus
agacttgagactcagggactgccac

SEQ ID NO: 111566 - DNA, 25 bp, Rattus norvegicus
agacttgagactgagggactgccac

SEQ ID NO: 111567 - DNA, 25 bp, Rattus norvegicus
agacttgagcagacctccctttggt

SEQ ID NO: 111568 - DNA, 25 bp, Rattus norvegicus
agacttgagcagcattggccacctt

SEQ ID NO: 111569 - DNA, 25 bp, Rattus norvegicus
agacttgagcaggattggccacctt

SEQ ID NO: 111570 - DNA, 25 bp, Rattus norvegicus
agacttgagcagtcctccctttggt

SEQ ID NO: 111571 - DNA, 25 bp, Rattus norvegicus
agacttgagctcactaaatggccag

SEQ ID NO: 111572 - DNA, 25 bp, Rattus norvegicus
agacttgagctctctaaatggccag

SEQ ID NO: 111573 - DNA, 25 bp, Rattus norvegicus
agacttgagtacctgagatccctaa

SEQ ID NO: 111574 - DNA, 25 bp, Rattus norvegicus
agacttgagtacgtgagatccctaa

SEQ ID NO: 111575 - DNA, 25 bp, Rattus norvegicus
agacttgagttcagatctctagcac

SEQ ID NO: 111576 - DNA, 25 bp, Rattus norvegicus
agacttgagttctgatctctagcac

SEQ ID NO: 111577 - DNA, 25 bp, Rattus norvegicus
agacttgagttgctggactatttac

SEQ ID NO: 111578 - DNA, 25 bp, Rattus norvegicus
agacttgagttggtggactatttac

SEQ ID NO: 111579 - DNA, 25 bp, Rattus norvegicus
agacttgatagcagcctactcctgt

SEQ ID NO: 111580 - DNA, 25 bp, Rattus norvegicus
agacttgatagctgcctactcctgt

SEQ ID NO: 111581 - DNA, 25 bp, Rattus norvegicus
agacttgatcttcactttcccaaga

SEQ ID NO: 111582 - DNA, 25 bp, Rattus norvegicus
agacttgatcttgactttcccaaga

SEQ ID NO: 111583 - DNA, 25 bp, Rattus norvegicus
agacttgatgctccagagaacagag

SEQ ID NO: 111584 - DNA, 25 bp, Rattus norvegicus
agacttgatgctgcagagaacagag

SEQ ID NO: 111585 - DNA, 25 bp, Rattus norvegicus
agacttgattgactgtttttcttgt

SEQ ID NO: 111586 - DNA, 25 bp, Rattus norvegicus
agacttgattgagtgtttttcttgt

SEQ ID NO: 111587 - DNA, 25 bp, Rattus norvegicus
agacttgatttcagtcactcattgt

SEQ ID NO: 111588 - DNA, 25 bp, Rattus norvegicus
agacttgatttctgtcactcattgt

SEQ ID NO: 111589 - DNA, 25 bp, Rattus norvegicus
agacttgcagtcagagatcccggga

SEQ ID NO: 111590 - DNA, 25 bp, Rattus norvegicus
agacttgcagtctgagatcccggga

SEQ ID NO: 111591 - DNA, 25 bp, Rattus norvegicus
agacttgccagaacgtagcggtttc

SEQ ID NO: 111592 - DNA, 25 bp, Rattus norvegicus
agacttgccagatcgtagcggtttc

SEQ ID NO: 111593 - DNA, 25 bp, Rattus norvegicus
agacttgccattaaacctgtgataa

SEQ ID NO: 111594 - DNA, 25 bp, Rattus norvegicus
agacttgccatttaacctgtgataa

SEQ ID NO: 111595 - DNA, 25 bp, Rattus norvegicus
agacttgcctaacgatatctcacct

SEQ ID NO: 111596 - DNA, 25 bp, Rattus norvegicus
agacttgcctaaggatatctcacct

SEQ ID NO: 111597 - DNA, 25 bp, Rattus norvegicus
agacttgcctcaaacttgctttgta

SEQ ID NO: 111598 - DNA, 25 bp, Rattus norvegicus
agacttgcctcatacttgctttgta

SEQ ID NO: 111599 - DNA, 25 bp, Rattus norvegicus
agacttgcctgtagggttgagagca

SEQ ID NO: 111600 - DNA, 25 bp, Rattus norvegicus
agacttgcctgtattctttgtgttc

SEQ ID NO: 111601 - DNA, 25 bp, Rattus norvegicus
agacttgcctgttgggttgagagca

SEQ ID NO: 111602 - DNA, 25 bp, Rattus norvegicus
agacttgcctgttttctttgtgttc

SEQ ID NO: 111603 - DNA, 25 bp, Rattus norvegicus
agacttgccttcactcagtcataga

SEQ ID NO: 111604 - DNA, 25 bp, Rattus norvegicus
agacttgccttccactagggtagtg

SEQ ID NO: 111605 - DNA, 25 bp, Rattus norvegicus
agacttgccttcgactagggtagtg

SEQ ID NO: 111606 - DNA, 25 bp, Rattus norvegicus
agacttgccttctctcagtcataga

SEQ ID NO: 111607 - DNA, 25 bp, Rattus norvegicus
agacttgcctttacttacaaatgtc

SEQ ID NO: 111608 - DNA, 25 bp, Rattus norvegicus
agacttgccttttcttacaaatgtc

SEQ ID NO: 111609 - DNA, 25 bp, Rattus norvegicus
agacttgcgcgcactcacagagagg

SEQ ID NO: 111610 - DNA, 25 bp, Rattus norvegicus
agacttgcgcgctctcacagagagg

SEQ ID NO: 111611 - DNA, 25 bp, Rattus norvegicus
agacttgctggacacttgatcctaa

SEQ ID NO: 111612 - DNA, 25 bp, Rattus norvegicus
agacttgctggagacttgatcctaa

SEQ ID NO: 111613 - DNA, 25 bp, Rattus norvegicus
agacttgctggcctaagatgctgca

SEQ ID NO: 111614 - DNA, 25 bp, Rattus norvegicus
agacttgctggcgtaagatgctgca

SEQ ID NO: 111615 - DNA, 25 bp, Rattus norvegicus
agacttgcttccagcatgataggga

SEQ ID NO: 111616 - DNA, 25 bp, Rattus norvegicus
agacttgcttcctgcatgataggga

SEQ ID NO: 111617 - DNA, 25 bp, Rattus norvegicus
agacttgctttgcattctgcctcaa

SEQ ID NO: 111618 - DNA, 25 bp, Rattus norvegicus
agacttgctttggattctgcctcaa

SEQ ID NO: 111619 - DNA, 25 bp, Rattus norvegicus
agacttggacagatatgtgcacggt

SEQ ID NO: 111620 - DNA, 25 bp, Rattus norvegicus
agacttggacagttatgtgcacggt

SEQ ID NO: 111621 - DNA, 25 bp, Rattus norvegicus
agacttggattcaggcggtagccac

SEQ ID NO: 111622 - DNA, 25 bp, Rattus norvegicus
agacttggattctggcggtagccac

SEQ ID NO: 111623 - DNA, 25 bp, Rattus norvegicus
agacttggatttctgcccagattgt

SEQ ID NO: 111624 - DNA, 25 bp, Rattus norvegicus
agacttggatttgtgcccagattgt

SEQ ID NO: 111625 - DNA, 25 bp, Rattus norvegicus
agacttggcccacctgagcagtgca

SEQ ID NO: 111626 - DNA, 25 bp, Rattus norvegicus
agacttggcccagctgagcagtgca

SEQ ID NO: 111627 - DNA, 25 bp, Rattus norvegicus
agacttggccttatctctgatgcac

SEQ ID NO: 111628 - DNA, 25 bp, Rattus norvegicus
agacttggccttcagtatctgcttc

SEQ ID NO: 111629 - DNA, 25 bp, Rattus norvegicus
agacttggccttgagtatctgcttc

SEQ ID NO: 111630 - DNA, 25 bp, Rattus norvegicus
agacttggccttttctctgatgcac

SEQ ID NO: 111631 - DNA, 25 bp, Rattus norvegicus
agacttggctgccagcgatgactac

SEQ ID NO: 111632 - DNA, 25 bp, Rattus norvegicus
agacttggctgcgagcgatgactac

SEQ ID NO: 111633 - DNA, 25 bp, Rattus norvegicus
agacttggctggagactgtcctgtc

SEQ ID NO: 111634 - DNA, 25 bp, Rattus norvegicus
agacttggctggtgactgtcctgtc

SEQ ID NO: 111635 - DNA, 25 bp, Rattus norvegicus
agacttgggtcacaccgcgctttac

SEQ ID NO: 111636 - DNA, 25 bp, Rattus norvegicus
agacttgggtcagaccgcgctttac

SEQ ID NO: 111637 - DNA, 25 bp, Rattus norvegicus
agacttggtcctaaataagctttgg

SEQ ID NO: 111638 - DNA, 25 bp, Rattus norvegicus
agacttggtccttaataagctttgg

SEQ ID NO: 111639 - DNA, 25 bp, Rattus norvegicus
agacttgtacagatgcagcccttaa

SEQ ID NO: 111640 - DNA, 25 bp, Rattus norvegicus
agacttgtacagttgcagcccttaa

SEQ ID NO: 111641 - DNA, 25 bp, Rattus norvegicus
agacttgtagtgatttctccttcct

SEQ ID NO: 111642 - DNA, 25 bp, Rattus norvegicus
agacttgtagtgttttctccttcct

SEQ ID NO: 111643 - DNA, 25 bp, Rattus norvegicus
agacttgtcattcccggcttcgcaa

SEQ ID NO: 111644 - DNA, 25 bp, Rattus norvegicus
agacttgtcattgccggcttcgcaa

SEQ ID NO: 111645 - DNA, 25 bp, Rattus norvegicus
agacttgtccccagagctgcggaaa

SEQ ID NO: 111646 - DNA, 25 bp, Rattus norvegicus
agacttgtcccctgagctgcggaaa

SEQ ID NO: 111647 - DNA, 25 bp, Rattus norvegicus
agacttgtccgaagccttctggaat

SEQ ID NO: 111648 - DNA, 25 bp, Rattus norvegicus
agacttgtccgatgccttctggaat

SEQ ID NO: 111649 - DNA, 25 bp, Rattus norvegicus
agacttgtctccatgagagtctcaa

SEQ ID NO: 111650 - DNA, 25 bp, Rattus norvegicus
agacttgtctccttgagagtctcaa

SEQ ID NO: 111651 - DNA, 25 bp, Rattus norvegicus
agacttgtctggatttgccctcaaa

SEQ ID NO: 111652 - DNA, 25 bp, Rattus norvegicus
agacttgtctggttttgccctcaaa

SEQ ID NO: 111653 - DNA, 25 bp, Rattus norvegicus
agacttgtctttactgaccaaccat

SEQ ID NO: 111654 - DNA, 25 bp, Rattus norvegicus
agacttgtcttttctgaccaaccat

SEQ ID NO: 111655 - DNA, 25 bp, Rattus norvegicus
agacttgtgactacaaacccagctt

SEQ ID NO: 111656 - DNA, 25 bp, Rattus norvegicus
agacttgtgacttcaaacccagctt

SEQ ID NO: 111657 - DNA, 25 bp, Rattus norvegicus
agacttgtgcggatccttgggaaca

SEQ ID NO: 111658 - DNA, 25 bp, Rattus norvegicus
agacttgtgcggttccttgggaaca

SEQ ID NO: 111659 - DNA, 25 bp, Rattus norvegicus
agacttgttcagaaacgtgcccttc

SEQ ID NO: 111660 - DNA, 25 bp, Rattus norvegicus
agacttgttcagtaacgtgcccttc

SEQ ID NO: 111661 - DNA, 25 bp, Rattus norvegicus
agacttgttcttacagatctaaact

SEQ ID NO: 111662 - DNA, 25 bp, Rattus norvegicus
agacttgttcttacatgctgtgtcc

SEQ ID NO: 111663 - DNA, 25 bp, Rattus norvegicus
agacttgttctttcagatctaaact

SEQ ID NO: 111664 - DNA, 25 bp, Rattus norvegicus
agacttgttctttcatgctgtgtcc

SEQ ID NO: 111665 - DNA, 25 bp, Rattus norvegicus
agactttaacccacgagatcggaca

SEQ ID NO: 111666 - DNA, 25 bp, Rattus norvegicus
agactttaaccctcgagatcggaca

SEQ ID NO: 111667 - DNA, 25 bp, Rattus norvegicus
agactttacagacgcggtgtgcttt

SEQ ID NO: 111668 - DNA, 25 bp, Rattus norvegicus
agactttacagaggcggtgtgcttt

SEQ ID NO: 111669 - DNA, 25 bp, Rattus norvegicus
agactttatcctaataccacgaatg

SEQ ID NO: 111670 - DNA, 25 bp, Rattus norvegicus
agactttatccttataccacgaatg

SEQ ID NO: 111671 - DNA, 25 bp, Rattus norvegicus
agactttatctgagttgtgcatatc

SEQ ID NO: 111672 - DNA, 25 bp, Rattus norvegicus
agactttatctgtgttgtgcatatc

SEQ ID NO: 111673 - DNA, 25 bp, Rattus norvegicus
agactttatttgagcaccgtccttg

SEQ ID NO: 111674 - DNA, 25 bp, Rattus norvegicus
agactttatttgtgcaccgtccttg

SEQ ID NO: 111675 - DNA, 25 bp, Rattus norvegicus
agactttcagagctggactctccaa

SEQ ID NO: 111676 - DNA, 25 bp, Rattus norvegicus
agactttcagaggtggactctccaa

SEQ ID NO: 111677 - DNA, 25 bp, Rattus norvegicus
agactttcagccatctatgtctgac

SEQ ID NO: 111678 - DNA, 25 bp, Rattus norvegicus
agactttcagccttctatgtctgac

SEQ ID NO: 111679 - DNA, 25 bp, Rattus norvegicus
agactttcatttatctgcatgcaat

SEQ ID NO: 111680 - DNA, 25 bp, Rattus norvegicus
agactttcatttttctgcatgcaat

SEQ ID NO: 111681 - DNA, 25 bp, Rattus norvegicus
agactttccaatcgctgtaccaggg

SEQ ID NO: 111682 - DNA, 25 bp, Rattus norvegicus
agactttccaatggctgtaccaggg

SEQ ID NO: 111683 - DNA, 25 bp, Rattus norvegicus
agactttcctcaactttcaagcaac

SEQ ID NO: 111684 - DNA, 25 bp, Rattus norvegicus
agactttcctcatctttcaagcaac

SEQ ID NO: 111685 - DNA, 25 bp, Rattus norvegicus
agactttcctgaagttggccattcc

SEQ ID NO: 111686 - DNA, 25 bp, Rattus norvegicus
agactttcctgatgttggccattcc

SEQ ID NO: 111687 - DNA, 25 bp, Rattus norvegicus
agactttcgggcacgcggtgagcct

SEQ ID NO: 111688 - DNA, 25 bp, Rattus norvegicus
agactttcgggctcgcggtgagcct

SEQ ID NO: 111689 - DNA, 25 bp, Rattus norvegicus
agactttctgctccgacattctgga

SEQ ID NO: 111690 - DNA, 25 bp, Rattus norvegicus
agactttctgctgcgacattctgga

SEQ ID NO: 111691 - DNA, 25 bp, Rattus norvegicus
agactttcttcaaaagcatccccac

SEQ ID NO: 111692 - DNA, 25 bp, Rattus norvegicus
agactttcttcataagcatccccac

SEQ ID NO: 111693 - DNA, 25 bp, Rattus norvegicus
agactttcttccaggtccacattct

SEQ ID NO: 111694 - DNA, 25 bp, Rattus norvegicus
agactttcttcctggtccacattct

SEQ ID NO: 111695 - DNA, 25 bp, Rattus norvegicus
agactttcttttccaccaatcttct

SEQ ID NO: 111696 - DNA, 25 bp, Rattus norvegicus
agactttcttttgcaccaatcttct

SEQ ID NO: 111697 - DNA, 25 bp, Rattus norvegicus
agactttgaactccagtttcgcccg

SEQ ID NO: 111698 - DNA, 25 bp, Rattus norvegicus
agactttgaactgcagtttcgcccg

SEQ ID NO: 111699 - DNA, 25 bp, Rattus norvegicus
agactttgacaaactcttgcttggt

SEQ ID NO: 111700 - DNA, 25 bp, Rattus norvegicus
agactttgacaatctcttgcttggt

SEQ ID NO: 111701 - DNA, 25 bp, Rattus norvegicus
agactttgacacaggtttctccaca

SEQ ID NO: 111702 - DNA, 25 bp, Rattus norvegicus
agactttgacactggtttctccaca

SEQ ID NO: 111703 - DNA, 25 bp, Rattus norvegicus
agactttgcactattactgaccacc

SEQ ID NO: 111704 - DNA, 25 bp, Rattus norvegicus
agactttgcacttttactgaccacc

SEQ ID NO: 111705 - DNA, 25 bp, Rattus norvegicus
agactttgcattctgtgtaggccaa

SEQ ID NO: 111706 - DNA, 25 bp, Rattus norvegicus
agactttgcattgtgtgtaggccaa

SEQ ID NO: 111707 - DNA, 25 bp, Rattus norvegicus
agactttgccagctcctttaagatt

SEQ ID NO: 111708 - DNA, 25 bp, Rattus norvegicus
agactttgccaggtcctttaagatt

SEQ ID NO: 111709 - DNA, 25 bp, Rattus norvegicus
agactttgcctcctgctaatgttct

SEQ ID NO: 111710 - DNA, 25 bp, Rattus norvegicus
agactttgcctcgtgctaatgttct

SEQ ID NO: 111711 - DNA, 25 bp, Rattus norvegicus
agactttgccttacctgatgagttc

SEQ ID NO: 111712 - DNA, 25 bp, Rattus norvegicus
agactttgcctttcctgatgagttc

SEQ ID NO: 111713 - DNA, 25 bp, Rattus norvegicus
agactttggaggactgtggtcatga

SEQ ID NO: 111714 - DNA, 25 bp, Rattus norvegicus
agactttggaggtctgtggtcatga

SEQ ID NO: 111715 - DNA, 25 bp, Rattus norvegicus
agactttggatgagctcctggcggc

SEQ ID NO: 111716 - DNA, 25 bp, Rattus norvegicus
agactttggatgtgctcctggcggc

SEQ ID NO: 111717 - DNA, 25 bp, Rattus norvegicus
agactttggcatattgactggtgat

SEQ ID NO: 111718 - DNA, 25 bp, Rattus norvegicus
agactttggcattttgactggtgat

SEQ ID NO: 111719 - DNA, 25 bp, Rattus norvegicus
agactttggccacccgaggttgctc

SEQ ID NO: 111720 - DNA, 25 bp, Rattus norvegicus
agactttggccagccgaggttgctc

SEQ ID NO: 111721 - DNA, 25 bp, Rattus norvegicus
agactttggcctagctcgagacatt

SEQ ID NO: 111722 - DNA, 25 bp, Rattus norvegicus
agactttggccttgctcgagacatt

SEQ ID NO: 111723 - DNA, 25 bp, Rattus norvegicus
agactttgggctagactgtgatgaa

SEQ ID NO: 111724 - DNA, 25 bp, Rattus norvegicus
agactttgggcttgactgtgatgaa

SEQ ID NO: 111725 - DNA, 25 bp, Rattus norvegicus
agactttggtctccagaaccctggg

SEQ ID NO: 111726 - DNA, 25 bp, Rattus norvegicus
agactttggtctgcagaaccctggg

SEQ ID NO: 111727 - DNA, 25 bp, Rattus norvegicus
agactttgtaacatattcctcttgc

SEQ ID NO: 111728 - DNA, 25 bp, Rattus norvegicus
agactttgtaacttattcctcttgc

SEQ ID NO: 111729 - DNA, 25 bp, Rattus norvegicus
agactttgtgaactggcttctggcc

SEQ ID NO: 111730 - DNA, 25 bp, Rattus norvegicus
agactttgtgaagtggcttctggcc

SEQ ID NO: 111731 - DNA, 25 bp, Rattus norvegicus
agactttgtggcatatttggatggg

SEQ ID NO: 111732 - DNA, 25 bp, Rattus norvegicus
agactttgtggcttatttggatggg

SEQ ID NO: 111733 - DNA, 25 bp, Rattus norvegicus
agactttgtgggaggctttgccttt

SEQ ID NO: 111734 - DNA, 25 bp, Rattus norvegicus
agactttgtgggtggctttgccttt

SEQ ID NO: 111735 - DNA, 25 bp, Rattus norvegicus
agactttgtttccagccctgagaca

SEQ ID NO: 111736 - DNA, 25 bp, Rattus norvegicus
agactttgtttcgagccctgagaca

SEQ ID NO: 111737 - DNA, 25 bp, Rattus norvegicus
agacttttaaagactccagcatgat

SEQ ID NO: 111738 - DNA, 25 bp, Rattus norvegicus
agacttttaaagtctccagcatgat

SEQ ID NO: 111739 - DNA, 25 bp, Rattus norvegicus
agacttttcaagctcagggttcaag

SEQ ID NO: 111740 - DNA, 25 bp, Rattus norvegicus
agacttttcaaggtcagggttcaag

SEQ ID NO: 111741 - DNA, 25 bp, Rattus norvegicus
agacttttcaggaatagcatctaaa

SEQ ID NO: 111742 - DNA, 25 bp, Rattus norvegicus
agacttttcaggtatagcatctaaa

SEQ ID NO: 111743 - DNA, 25 bp, Rattus norvegicus
agacttttcattcctctgattctgt

SEQ ID NO: 111744 - DNA, 25 bp, Rattus norvegicus
agacttttcattgctctgattctgt

SEQ ID NO: 111745 - DNA, 25 bp, Rattus norvegicus
agacttttccccatgacacactgga

SEQ ID NO: 111746 - DNA, 25 bp, Rattus norvegicus
agacttttccccttgacacactgga

SEQ ID NO: 111747 - DNA, 25 bp, Rattus norvegicus
agacttttccctagggcttctaatg

SEQ ID NO: 111748 - DNA, 25 bp, Rattus norvegicus
agacttttccctagtatgcttaaat

SEQ ID NO: 111749 - DNA, 25 bp, Rattus norvegicus
agacttttcccttgggcttctaatg

SEQ ID NO: 111750 - DNA, 25 bp, Rattus norvegicus
agacttttcccttgtatgcttaaat

SEQ ID NO: 111751 - DNA, 25 bp, Rattus norvegicus
agacttttcctcctattctgttggg

SEQ ID NO: 111752 - DNA, 25 bp, Rattus norvegicus
agacttttcctcgtattctgttggg

SEQ ID NO: 111753 - DNA, 25 bp, Rattus norvegicus
agacttttcgtcacaaagcacccat

SEQ ID NO: 111754 - DNA, 25 bp, Rattus norvegicus
agacttttcgtctcaaagcacccat

SEQ ID NO: 111755 - DNA, 25 bp, Rattus norvegicus
agacttttctcgaggttttcacagc

SEQ ID NO: 111756 - DNA, 25 bp, Rattus norvegicus
agacttttctcgtggttttcacagc

SEQ ID NO: 111757 - DNA, 25 bp, Rattus norvegicus
agacttttctgactggaccaatccc

SEQ ID NO: 111758 - DNA, 25 bp, Rattus norvegicus
agacttttctgagtggaccaatccc

SEQ ID NO: 111759 - DNA, 25 bp, Rattus norvegicus
agacttttctgcatccacttatgga

SEQ ID NO: 111760 - DNA, 25 bp, Rattus norvegicus
agacttttctgcttccacttatgga

SEQ ID NO: 111761 - DNA, 25 bp, Rattus norvegicus
agacttttcttcagtctgagctggt

SEQ ID NO: 111762 - DNA, 25 bp, Rattus norvegicus
agacttttcttcagttcctgtcttt

SEQ ID NO: 111763 - DNA, 25 bp, Rattus norvegicus
agacttttcttctgtctgagctggt

SEQ ID NO: 111764 - DNA, 25 bp, Rattus norvegicus
agacttttcttctgttcctgtcttt

SEQ ID NO: 111765 - DNA, 25 bp, Rattus norvegicus
agacttttcttgaaactgccacata

SEQ ID NO: 111766 - DNA, 25 bp, Rattus norvegicus
agacttttcttgtaactgccacata

SEQ ID NO: 111767 - DNA, 25 bp, Rattus norvegicus
agacttttgagcagaacggttacca

SEQ ID NO: 111768 - DNA, 25 bp, Rattus norvegicus
agacttttgagctgaacggttacca

SEQ ID NO: 111769 - DNA, 25 bp, Rattus norvegicus
agacttttgatgctgccttcatgcc

SEQ ID NO: 111770 - DNA, 25 bp, Rattus norvegicus
agacttttgatggtgccttcatgcc

SEQ ID NO: 111771 - DNA, 25 bp, Rattus norvegicus
agacttttgtacatagctccagcct

SEQ ID NO: 111772 - DNA, 25 bp, Rattus norvegicus
agacttttgtacttagctccagcct

SEQ ID NO: 111773 - DNA, 25 bp, Rattus norvegicus
agacttttgtcaacttgctctgctg

SEQ ID NO: 111774 - DNA, 25 bp, Rattus norvegicus
agacttttgtcatcttgctctgctg

SEQ ID NO: 111775 - DNA, 25 bp, Rattus norvegicus
agacttttgtcccaacctctgagag

SEQ ID NO: 111776 - DNA, 25 bp, Rattus norvegicus
agacttttgtccgaacctctgagag

SEQ ID NO: 111777 - DNA, 25 bp, Rattus norvegicus
agactttttcctacagatttataga

SEQ ID NO: 111778 - DNA, 25 bp, Rattus norvegicus
agactttttccttcagatttataga

SEQ ID NO: 111779 - DNA, 25 bp, Rattus norvegicus
agactttttctcatgcactgtttac

SEQ ID NO: 111780 - DNA, 25 bp, Rattus norvegicus
agactttttctcttgcactgtttac

SEQ ID NO: 111781 - DNA, 25 bp, Rattus norvegicus
agacttttttggacttactgctggt

SEQ ID NO: 111782 - DNA, 25 bp, Rattus norvegicus
agacttttttggtcttactgctggt

SEQ ID NO: 111783 - DNA, 25 bp, Rattus norvegicus
agagaaaaacttccacccatctgat

SEQ ID NO: 111784 - DNA, 25 bp, Rattus norvegicus
agagaaaaacttgcacccatctgat

SEQ ID NO: 111785 - DNA, 25 bp, Rattus norvegicus
agagaaaaagacaccccactgggca

SEQ ID NO: 111786 - DNA, 25 bp, Rattus norvegicus
agagaaaaagactccccactgggca

SEQ ID NO: 111787 - DNA, 25 bp, Rattus norvegicus
agagaaaaagctcacctcttcccat

SEQ ID NO: 111788 - DNA, 25 bp, Rattus norvegicus
agagaaaaagctgacctcttcccat

SEQ ID NO: 111789 - DNA, 25 bp, Rattus norvegicus
agagaaaacctcatcccaggatcat

SEQ ID NO: 111790 - DNA, 25 bp, Rattus norvegicus
agagaaaacctcttcccaggatcat

SEQ ID NO: 111791 - DNA, 25 bp, Rattus norvegicus
agagaaaagcacagccttcacaggc

SEQ ID NO: 111792 - DNA, 25 bp, Rattus norvegicus
agagaaaagcactgccttcacaggc

SEQ ID NO: 111793 - DNA, 25 bp, Rattus norvegicus
agagaaaagtctacgtccggctact

SEQ ID NO: 111794 - DNA, 25 bp, Rattus norvegicus
agagaaaagtcttcgtccggctact

SEQ ID NO: 111795 - DNA, 25 bp, Rattus norvegicus
agagaaaattccacgcagggcgctc

SEQ ID NO: 111796 - DNA, 25 bp, Rattus norvegicus
agagaaaattcctcgcagggcgctc

SEQ ID NO: 111797 - DNA, 25 bp, Rattus norvegicus
agagaaacacagctccttcacgcac

SEQ ID NO: 111798 - DNA, 25 bp, Rattus norvegicus
agagaaacacaggtccttcacgcac

SEQ ID NO: 111799 - DNA, 25 bp, Rattus norvegicus
agagaaacatccaccagtgtcacct

SEQ ID NO: 111800 - DNA, 25 bp, Rattus norvegicus
agagaaacatcctccagtgtcacct

SEQ ID NO: 111801 - DNA, 25 bp, Rattus norvegicus
agagaaacatctagcctcatccgtt

SEQ ID NO: 111802 - DNA, 25 bp, Rattus norvegicus
agagaaacatctccacttggctcca

SEQ ID NO: 111803 - DNA, 25 bp, Rattus norvegicus
agagaaacatctgcacttggctcca

SEQ ID NO: 111804 - DNA, 25 bp, Rattus norvegicus
agagaaacatcttgcctcatccgtt

SEQ ID NO: 111805 - DNA, 25 bp, Rattus norvegicus
agagaaacccaacctcttcttcatc

SEQ ID NO: 111806 - DNA, 25 bp, Rattus norvegicus
agagaaacccaagctcttcttcatc

SEQ ID NO: 111807 - DNA, 25 bp, Rattus norvegicus
agagaaacccgtcgcccctatgatc

SEQ ID NO: 111808 - DNA, 25 bp, Rattus norvegicus
agagaaacccgtggcccctatgatc

SEQ ID NO: 111809 - DNA, 25 bp, Rattus norvegicus
agagaaacctaacaccctcacctag

SEQ ID NO: 111810 - DNA, 25 bp, Rattus norvegicus
agagaaacctaagaccctcacctag

SEQ ID NO: 111811 - DNA, 25 bp, Rattus norvegicus
agagaaacctcaagctgttgcctcc

SEQ ID NO: 111812 - DNA, 25 bp, Rattus norvegicus
agagaaacctcatgctgttgcctcc

SEQ ID NO: 111813 - DNA, 25 bp, Rattus norvegicus
agagaaacgatgacttgatgtcccc

SEQ ID NO: 111814 - DNA, 25 bp, Rattus norvegicus
agagaaacgatgtcttgatgtcccc

SEQ ID NO: 111815 - DNA, 25 bp, Rattus norvegicus
agagaaactacaactcccggagtgc

SEQ ID NO: 111816 - DNA, 25 bp, Rattus norvegicus
agagaaactacatctcccggagtgc

SEQ ID NO: 111817 - DNA, 25 bp, Rattus norvegicus
agagaaactaggaggcagcgccgtc

SEQ ID NO: 111818 - DNA, 25 bp, Rattus norvegicus
agagaaactaggtggcagcgccgtc

SEQ ID NO: 111819 - DNA, 25 bp, Rattus norvegicus
agagaaactgacatcctcactgact

SEQ ID NO: 111820 - DNA, 25 bp, Rattus norvegicus
agagaaactgacttcctcactgact

SEQ ID NO: 111821 - DNA, 25 bp, Rattus norvegicus
agagaaactgtacaccgctgagcca

SEQ ID NO: 111822 - DNA, 25 bp, Rattus norvegicus
agagaaactgtagaccgctgagcca

SEQ ID NO: 111823 - DNA, 25 bp, Rattus norvegicus
agagaaagactcagctcggtcccga

SEQ ID NO: 111824 - DNA, 25 bp, Rattus norvegicus
agagaaagactctgctcggtcccga

SEQ ID NO: 111825 - DNA, 25 bp, Rattus norvegicus
agagaaagatctcccttgttcaatg

SEQ ID NO: 111826 - DNA, 25 bp, Rattus norvegicus
agagaaagatctgccttgttcaatg

SEQ ID NO: 111827 - DNA, 25 bp, Rattus norvegicus
agagaaagccatactcccacactta

SEQ ID NO: 111828 - DNA, 25 bp, Rattus norvegicus
agagaaagccattctcccacactta

SEQ ID NO: 111829 - DNA, 25 bp, Rattus norvegicus
agagaaagccttaggtcctacctcg

SEQ ID NO: 111830 - DNA, 25 bp, Rattus norvegicus
agagaaagccttctttgcggtccct

SEQ ID NO: 111831 - DNA, 25 bp, Rattus norvegicus
agagaaagccttgtttgcggtccct

SEQ ID NO: 111832 - DNA, 25 bp, Rattus norvegicus
agagaaagcctttggtcctacctcg

SEQ ID NO: 111833 - DNA, 25 bp, Rattus norvegicus
agagaaaggcctcccgtctgactgg

SEQ ID NO: 111834 - DNA, 25 bp, Rattus norvegicus
agagaaaggcctgccgtctgactgg

SEQ ID NO: 111835 - DNA, 25 bp, Rattus norvegicus
agagaaaggctccagctacggcaac

SEQ ID NO: 111836 - DNA, 25 bp, Rattus norvegicus
agagaaaggctcgagctacggcaac

SEQ ID NO: 111837 - DNA, 25 bp, Rattus norvegicus
agagaaagtcctcgctcgtcaccag

SEQ ID NO: 111838 - DNA, 25 bp, Rattus norvegicus
agagaaagtcctggctcgtcaccag

SEQ ID NO: 111839 - DNA, 25 bp, Rattus norvegicus
agagaaatcccacccttttaagtga

SEQ ID NO: 111840 - DNA, 25 bp, Rattus norvegicus
agagaaatcccagccttttaagtga

SEQ ID NO: 111841 - DNA, 25 bp, Rattus norvegicus
agagaaatctgaccacactggtggc

SEQ ID NO: 111842 - DNA, 25 bp, Rattus norvegicus
agagaaatctgagcacactggtggc

SEQ ID NO: 111843 - DNA, 25 bp, Rattus norvegicus
agagaaatgactctgctctcacact

SEQ ID NO: 111844 - DNA, 25 bp, Rattus norvegicus
agagaaatgactgtgctctcacact

SEQ ID NO: 111845 - DNA, 25 bp, Rattus norvegicus
agagaaattctgcaggaccttaggt

SEQ ID NO: 111846 - DNA, 25 bp, Rattus norvegicus
agagaaattctggaggaccttaggt

SEQ ID NO: 111847 - DNA, 25 bp, Rattus norvegicus
agagaaatttatcttcctttcattt

SEQ ID NO: 111848 - DNA, 25 bp, Rattus norvegicus
agagaaatttatgttcctttcattt

SEQ ID NO: 111849 - DNA, 25 bp, Rattus norvegicus
agagaaatttccatgagctgccctg

SEQ ID NO: 111850 - DNA, 25 bp, Rattus norvegicus
agagaaatttccttgagctgccctg

SEQ ID NO: 111851 - DNA, 25 bp, Rattus norvegicus
agagaacaaacacctgccacatggc

SEQ ID NO: 111852 - DNA, 25 bp, Rattus norvegicus
agagaacaaacagctgccacatggc

SEQ ID NO: 111853 - DNA, 25 bp, Rattus norvegicus
agagaacacagacctccctgactat

SEQ ID NO: 111854 - DNA, 25 bp, Rattus norvegicus
agagaacacagagctccctgactat

SEQ ID NO: 111855 - DNA, 25 bp, Rattus norvegicus
agagaacactatctttgcacccagg

SEQ ID NO: 111856 - DNA, 25 bp, Rattus norvegicus
agagaacactatgtttgcacccagg

SEQ ID NO: 111857 - DNA, 25 bp, Rattus norvegicus
agagaacactttaatttttatccat

SEQ ID NO: 111858 - DNA, 25 bp, Rattus norvegicus
agagaacacttttatttttatccat

SEQ ID NO: 111859 - DNA, 25 bp, Rattus norvegicus
agagaacagctccacttccagaggg

SEQ ID NO: 111860 - DNA, 25 bp, Rattus norvegicus
agagaacagctcgacttccagaggg

SEQ ID NO: 111861 - DNA, 25 bp, Rattus norvegicus
agagaacagtgcacagccgagtccc

SEQ ID NO: 111862 - DNA, 25 bp, Rattus norvegicus
agagaacagtgctcagccgagtccc

SEQ ID NO: 111863 - DNA, 25 bp, Rattus norvegicus
agagaacagtttcccgaggcctgag

SEQ ID NO: 111864 - DNA, 25 bp, Rattus norvegicus
agagaacagtttgccgaggcctgag

SEQ ID NO: 111865 - DNA, 25 bp, Rattus norvegicus
agagaacatcctcggaggcagtggc

SEQ ID NO: 111866 - DNA, 25 bp, Rattus norvegicus
agagaacatcctgggaggcagtggc

SEQ ID NO: 111867 - DNA, 25 bp, Rattus norvegicus
agagaacatgataccctctccttgc

SEQ ID NO: 111868 - DNA, 25 bp, Rattus norvegicus
agagaacatgattccctctccttgc

SEQ ID NO: 111869 - DNA, 25 bp, Rattus norvegicus
agagaacatttgctcctcagggttc

SEQ ID NO: 111870 - DNA, 25 bp, Rattus norvegicus
agagaacatttggtcctcagggttc

SEQ ID NO: 111871 - DNA, 25 bp, Rattus norvegicus
agagaaccacgcctgaggccagaga

SEQ ID NO: 111872 - DNA, 25 bp, Rattus norvegicus
agagaaccacgcgtgaggccagaga

SEQ ID NO: 111873 - DNA, 25 bp, Rattus norvegicus
agagaaccagacattcccagatcgg

SEQ ID NO: 111874 - DNA, 25 bp, Rattus norvegicus
agagaaccagactttcccagatcgg

SEQ ID NO: 111875 - DNA, 25 bp, Rattus norvegicus
agagaaccagtcactgctgcgtatg

SEQ ID NO: 111876 - DNA, 25 bp, Rattus norvegicus
agagaaccagtcagcggcggaaact

SEQ ID NO: 111877 - DNA, 25 bp, Rattus norvegicus
agagaaccagtctctgctgcgtatg

SEQ ID NO: 111878 - DNA, 25 bp, Rattus norvegicus
agagaaccagtctgcggcggaaact

SEQ ID NO: 111879 - DNA, 25 bp, Rattus norvegicus
agagaacccagtatcagaccttttt

SEQ ID NO: 111880 - DNA, 25 bp, Rattus norvegicus
agagaacccagtttcagaccttttt

SEQ ID NO: 111881 - DNA, 25 bp, Rattus norvegicus
agagaaccccagatcttctctatag

SEQ ID NO: 111882 - DNA, 25 bp, Rattus norvegicus
agagaaccccagttcttctctatag

SEQ ID NO: 111883 - DNA, 25 bp, Rattus norvegicus
agagaacccgacaccctgtgaagag

SEQ ID NO: 111884 - DNA, 25 bp, Rattus norvegicus
agagaacccgactccctgtgaagag

SEQ ID NO: 111885 - DNA, 25 bp, Rattus norvegicus
agagaacccgagcagtggccagttt

SEQ ID NO: 111886 - DNA, 25 bp, Rattus norvegicus
agagaacccgaggagtggccagttt

SEQ ID NO: 111887 - DNA, 25 bp, Rattus norvegicus
agagaaccctgactacctaggcctg

SEQ ID NO: 111888 - DNA, 25 bp, Rattus norvegicus
agagaaccctgagtacctaggcctg

SEQ ID NO: 111889 - DNA, 25 bp, Rattus norvegicus
agagaacccttacgccaatgcaggg

SEQ ID NO: 111890 - DNA, 25 bp, Rattus norvegicus
agagaacccttaggccaatgcaggg

SEQ ID NO: 111891 - DNA, 25 bp, Rattus norvegicus
agagaaccctttctttcactgtttg

SEQ ID NO: 111892 - DNA, 25 bp, Rattus norvegicus
agagaaccctttgtttcactgtttg

SEQ ID NO: 111893 - DNA, 25 bp, Rattus norvegicus
agagaacctcggctattccaggagt

SEQ ID NO: 111894 - DNA, 25 bp, Rattus norvegicus
agagaacctcgggtattccaggagt

SEQ ID NO: 111895 - DNA, 25 bp, Rattus norvegicus
agagaacctctcacattcttactgg

SEQ ID NO: 111896 - DNA, 25 bp, Rattus norvegicus
agagaacctctctcattcttactgg

SEQ ID NO: 111897 - DNA, 25 bp, Rattus norvegicus
agagaacctctgataaacagggcaa

SEQ ID NO: 111898 - DNA, 25 bp, Rattus norvegicus
agagaacctctgttaaacagggcaa

SEQ ID NO: 111899 - DNA, 25 bp, Rattus norvegicus
agagaacctcttatgcgtgggtgaa

SEQ ID NO: 111900 - DNA, 25 bp, Rattus norvegicus
agagaacctcttttgcgtgggtgaa

SEQ ID NO: 111901 - DNA, 25 bp, Rattus norvegicus
agagaaccttgccttgccacagtga

SEQ ID NO: 111902 - DNA, 25 bp, Rattus norvegicus
agagaaccttgcgttgccacagtga

SEQ ID NO: 111903 - DNA, 25 bp, Rattus norvegicus
agagaacgacgtccgtgcccgcttt

SEQ ID NO: 111904 - DNA, 25 bp, Rattus norvegicus
agagaacgacgtgcgtgcccgcttt

SEQ ID NO: 111905 - DNA, 25 bp, Rattus norvegicus
agagaacgagtgcaggcctcttgct

SEQ ID NO: 111906 - DNA, 25 bp, Rattus norvegicus
agagaacgagtggaggcctcttgct

SEQ ID NO: 111907 - DNA, 25 bp, Rattus norvegicus
agagaacgccacacacgatggactt

SEQ ID NO: 111908 - DNA, 25 bp, Rattus norvegicus
agagaacgccactcacgatggactt

SEQ ID NO: 111909 - DNA, 25 bp, Rattus norvegicus
agagaactccctatgctctgttgga

SEQ ID NO: 111910 - DNA, 25 bp, Rattus norvegicus
agagaactccctttgctctgttgga

SEQ ID NO: 111911 - DNA, 25 bp, Rattus norvegicus
agagaactctgcctggaagcccaga

SEQ ID NO: 111912 - DNA, 25 bp, Rattus norvegicus
agagaactctgcgtggaagcccaga

SEQ ID NO: 111913 - DNA, 25 bp, Rattus norvegicus
agagaactgcagctcctttaccggg

SEQ ID NO: 111914 - DNA, 25 bp, Rattus norvegicus
agagaactgcaggtcctttaccggg

SEQ ID NO: 111915 - DNA, 25 bp, Rattus norvegicus
agagaactgcatagttgcccctaag

SEQ ID NO: 111916 - DNA, 25 bp, Rattus norvegicus
agagaactgcattgttgcccctaag

SEQ ID NO: 111917 - DNA, 25 bp, Rattus norvegicus
agagaactgcccagctaaggtggga

SEQ ID NO: 111918 - DNA, 25 bp, Rattus norvegicus
agagaactgccctgctaaggtggga

SEQ ID NO: 111919 - DNA, 25 bp, Rattus norvegicus
agagaactgtaaattcctgcctcca

SEQ ID NO: 111920 - DNA, 25 bp, Rattus norvegicus
agagaactgtaatttcctgcctcca

SEQ ID NO: 111921 - DNA, 25 bp, Rattus norvegicus
agagaactgtccagatttgcactag

SEQ ID NO: 111922 - DNA, 25 bp, Rattus norvegicus
agagaactgtcctgatttgcactag

SEQ ID NO: 111923 - DNA, 25 bp, Rattus norvegicus
agagaactgttcctgatctgtgctg

SEQ ID NO: 111924 - DNA, 25 bp, Rattus norvegicus
agagaactgttcgtgatctgtgctg

SEQ ID NO: 111925 - DNA, 25 bp, Rattus norvegicus
agagaacttcgtctgagctgcagcc

SEQ ID NO: 111926 - DNA, 25 bp, Rattus norvegicus
agagaacttcgtgtgagctgcagcc

SEQ ID NO: 111927 - DNA, 25 bp, Rattus norvegicus
agagaactttctctggcatctccaa

SEQ ID NO: 111928 - DNA, 25 bp, Rattus norvegicus
agagaactttctgtggcatctccaa

SEQ ID NO: 111929 - DNA, 25 bp, Rattus norvegicus
agagaactttggatcctcctgactt

SEQ ID NO: 111930 - DNA, 25 bp, Rattus norvegicus
agagaactttggttcctcctgactt

SEQ ID NO: 111931 - DNA, 25 bp, Rattus norvegicus
agagaagaaaacagcgccccggtgt

SEQ ID NO: 111932 - DNA, 25 bp, Rattus norvegicus
agagaagaaaactgcgccccggtgt

SEQ ID NO: 111933 - DNA, 25 bp, Rattus norvegicus
agagaagaaattcgccgtctggaca

SEQ ID NO: 111934 - DNA, 25 bp, Rattus norvegicus
agagaagaaattggccgtctggaca

SEQ ID NO: 111935 - DNA, 25 bp, Rattus norvegicus
agagaagaagccacgatgggttaaa

SEQ ID NO: 111936 - DNA, 25 bp, Rattus norvegicus
agagaagaagcctcgatgggttaaa

SEQ ID NO: 111937 - DNA, 25 bp, Rattus norvegicus
agagaagaccctcccctgtgtagca

SEQ ID NO: 111938 - DNA, 25 bp, Rattus norvegicus
agagaagaccctgccctgtgtagca

SEQ ID NO: 111939 - DNA, 25 bp, Rattus norvegicus
agagaagacctcagccgaagtccaa

SEQ ID NO: 111940 - DNA, 25 bp, Rattus norvegicus
agagaagacctctgccgaagtccaa

SEQ ID NO: 111941 - DNA, 25 bp, Rattus norvegicus
agagaagactagagagcagctggct

SEQ ID NO: 111942 - DNA, 25 bp, Rattus norvegicus
agagaagactagtgagcagctggct

SEQ ID NO: 111943 - DNA, 25 bp, Rattus norvegicus
agagaagactttagtctcctgcctc

SEQ ID NO: 111944 - DNA, 25 bp, Rattus norvegicus
agagaagactttccggaccctctgc

SEQ ID NO: 111945 - DNA, 25 bp, Rattus norvegicus
agagaagactttgcggaccctctgc

SEQ ID NO: 111946 - DNA, 25 bp, Rattus norvegicus
agagaagacttttgtctcctgcctc

SEQ ID NO: 111947 - DNA, 25 bp, Rattus norvegicus
agagaagagacacagcccacccaag

SEQ ID NO: 111948 - DNA, 25 bp, Rattus norvegicus
agagaagagacagagcccacccaag

SEQ ID NO: 111949 - DNA, 25 bp, Rattus norvegicus
agagaagaggatccagcccacccag

SEQ ID NO: 111950 - DNA, 25 bp, Rattus norvegicus
agagaagaggatgcagcccacccag

SEQ ID NO: 111951 - DNA, 25 bp, Rattus norvegicus
agagaagaggcacttccatttccaa

SEQ ID NO: 111952 - DNA, 25 bp, Rattus norvegicus
agagaagaggcagttccatttccaa

SEQ ID NO: 111953 - DNA, 25 bp, Rattus norvegicus
agagaagatctcacacaccaggcgt

SEQ ID NO: 111954 - DNA, 25 bp, Rattus norvegicus
agagaagatctctcacaccaggcgt

SEQ ID NO: 111955 - DNA, 25 bp, Rattus norvegicus
agagaagcacgtcgaatgggttaat

SEQ ID NO: 111956 - DNA, 25 bp, Rattus norvegicus
agagaagcacgtggaatgggttaat

SEQ ID NO: 111957 - DNA, 25 bp, Rattus norvegicus
agagaagcagatctccgatccccag

SEQ ID NO: 111958 - DNA, 25 bp, Rattus norvegicus
agagaagcagatgtccgatccccag

SEQ ID NO: 111959 - DNA, 25 bp, Rattus norvegicus
agagaagcagcaacccgagagcgcc

SEQ ID NO: 111960 - DNA, 25 bp, Rattus norvegicus
agagaagcagcatcccgagagcgcc

SEQ ID NO: 111961 - DNA, 25 bp, Rattus norvegicus
agagaagcagtgcttgtccggctcc

SEQ ID NO: 111962 - DNA, 25 bp, Rattus norvegicus
agagaagcagtggttgtccggctcc

SEQ ID NO: 111963 - DNA, 25 bp, Rattus norvegicus
agagaagcatatcgccccttgaact

SEQ ID NO: 111964 - DNA, 25 bp, Rattus norvegicus
agagaagcatatggccccttgaact

SEQ ID NO: 111965 - DNA, 25 bp, Rattus norvegicus
agagaagccacactcattttccagc

SEQ ID NO: 111966 - DNA, 25 bp, Rattus norvegicus
agagaagccacagtcattttccagc

SEQ ID NO: 111967 - DNA, 25 bp, Rattus norvegicus
agagaagccaccctctgtgcagacc

SEQ ID NO: 111968 - DNA, 25 bp, Rattus norvegicus
agagaagccaccgtctgtgcagacc

SEQ ID NO: 111969 - DNA, 25 bp, Rattus norvegicus
agagaagccagaccacctctcagat

SEQ ID NO: 111970 - DNA, 25 bp, Rattus norvegicus
agagaagccagagcacctctcagat

SEQ ID NO: 111971 - DNA, 25 bp, Rattus norvegicus
agagaagcccagcagtgtccttcag

SEQ ID NO: 111972 - DNA, 25 bp, Rattus norvegicus
agagaagcccaggagtgtccttcag

SEQ ID NO: 111973 - DNA, 25 bp, Rattus norvegicus
agagaagccctgcaatgctgtaaat

SEQ ID NO: 111974 - DNA, 25 bp, Rattus norvegicus
agagaagccctggaatgctgtaaat

SEQ ID NO: 111975 - DNA, 25 bp, Rattus norvegicus
agagaagcccttcttgcaaatgaca

SEQ ID NO: 111976 - DNA, 25 bp, Rattus norvegicus
agagaagcccttgttgcaaatgaca

SEQ ID NO: 111977 - DNA, 25 bp, Rattus norvegicus
agagaagccgggacgcgacaatcgc

SEQ ID NO: 111978 - DNA, 25 bp, Rattus norvegicus
agagaagccgggtcgcgacaatcgc

SEQ ID NO: 111979 - DNA, 25 bp, Rattus norvegicus
agagaagcctacagggcactggccc

SEQ ID NO: 111980 - DNA, 25 bp, Rattus norvegicus
agagaagcctactgggcactggccc

SEQ ID NO: 111981 - DNA, 25 bp, Rattus norvegicus
agagaagcctctaaggaaccccagt

SEQ ID NO: 111982 - DNA, 25 bp, Rattus norvegicus
agagaagcctcttaggaaccccagt

SEQ ID NO: 111983 - DNA, 25 bp, Rattus norvegicus
agagaagccttcactgttttccttc

SEQ ID NO: 111984 - DNA, 25 bp, Rattus norvegicus
agagaagccttctctgttttccttc

SEQ ID NO: 111985 - DNA, 25 bp, Rattus norvegicus
agagaagcgccaacttctgctccag

SEQ ID NO: 111986 - DNA, 25 bp, Rattus norvegicus
agagaagcgccatcttctgctccag

SEQ ID NO: 111987 - DNA, 25 bp, Rattus norvegicus
agagaagctaagaggtccaggcccc

SEQ ID NO: 111988 - DNA, 25 bp, Rattus norvegicus
agagaagctaagtggtccaggcccc

SEQ ID NO: 111989 - DNA, 25 bp, Rattus norvegicus
agagaagctgcaatttatcggattt

SEQ ID NO: 111990 - DNA, 25 bp, Rattus norvegicus
agagaagctgcattttatcggattt

SEQ ID NO: 111991 - DNA, 25 bp, Rattus norvegicus
agagaagctgccagggctgatcgct

SEQ ID NO: 111992 - DNA, 25 bp, Rattus norvegicus
agagaagctgcctgggctgatcgct

SEQ ID NO: 111993 - DNA, 25 bp, Rattus norvegicus
agagaagctgctactctgaccacac

SEQ ID NO: 111994 - DNA, 25 bp, Rattus norvegicus
agagaagctgcttctctgaccacac

SEQ ID NO: 111995 - DNA, 25 bp, Rattus norvegicus
agagaagctttgatcctgaggaaga

SEQ ID NO: 111996 - DNA, 25 bp, Rattus norvegicus
agagaagctttgttcctgaggaaga

SEQ ID NO: 111997 - DNA, 25 bp, Rattus norvegicus
agagaaggacagagctcctaccgca

SEQ ID NO: 111998 - DNA, 25 bp, Rattus norvegicus
agagaaggacagtgctcctaccgca

SEQ ID NO: 111999 - DNA, 25 bp, Rattus norvegicus
agagaaggacgacacgcccttttct

SEQ ID NO: 112000 - DNA, 25 bp, Rattus norvegicus
agagaaggacgacccagatcctcgt

SEQ ID NO: 112001 - DNA, 25 bp, Rattus norvegicus
agagaaggacgagacgcccttttct

SEQ ID NO: 112002 - DNA, 25 bp, Rattus norvegicus
agagaaggacgagccagatcctcgt

SEQ ID NO: 112003 - DNA, 25 bp, Rattus norvegicus
agagaaggacttcctctcaagcgac

SEQ ID NO: 112004 - DNA, 25 bp, Rattus norvegicus
agagaaggacttgctctcaagcgac

SEQ ID NO: 112005 - DNA, 25 bp, Rattus norvegicus
agagaaggaggcatcacacccgtca

SEQ ID NO: 112006 - DNA, 25 bp, Rattus norvegicus
agagaaggaggcttcacacccgtca

SEQ ID NO: 112007 - DNA, 25 bp, Rattus norvegicus
agagaaggatcacgtcctaccgctg

SEQ ID NO: 112008 - DNA, 25 bp, Rattus norvegicus
agagaaggatcaggtcctaccgctg

SEQ ID NO: 112009 - DNA, 25 bp, Rattus norvegicus
agagaaggatgacccctgccaaaac

SEQ ID NO: 112010 - DNA, 25 bp, Rattus norvegicus
agagaaggatgagccctgccaaaac

SEQ ID NO: 112011 - DNA, 25 bp, Rattus norvegicus
agagaaggccttcccagtgaacggt

SEQ ID NO: 112012 - DNA, 25 bp, Rattus norvegicus
agagaaggccttgccagtgaacggt

SEQ ID NO: 112013 - DNA, 25 bp, Rattus norvegicus
agagaaggctttcacggtgcccatc

SEQ ID NO: 112014 - DNA, 25 bp, Rattus norvegicus
agagaaggctttgacggtgcccatc

SEQ ID NO: 112015 - DNA, 25 bp, Rattus norvegicus
agagaagggatcaccacacctgtgt

SEQ ID NO: 112016 - DNA, 25 bp, Rattus norvegicus
agagaagggatctccacacctgtgt

SEQ ID NO: 112017 - DNA, 25 bp, Rattus norvegicus
agagaaggtacacccagttccctgc

SEQ ID NO: 112018 - DNA, 25 bp, Rattus norvegicus
agagaaggtacagccagttccctgc

SEQ ID NO: 112019 - DNA, 25 bp, Rattus norvegicus
agagaaggtagtagctctggagtcc

SEQ ID NO: 112020 - DNA, 25 bp, Rattus norvegicus
agagaaggtagttgctctggagtcc

SEQ ID NO: 112021 - DNA, 25 bp, Rattus norvegicus
agagaaggtcctagtgcggtcaacc

SEQ ID NO: 112022 - DNA, 25 bp, Rattus norvegicus
agagaaggtccttgtgcggtcaacc

SEQ ID NO: 112023 - DNA, 25 bp, Rattus norvegicus
agagaaggtgttccggcccatgtta

SEQ ID NO: 112024 - DNA, 25 bp, Rattus norvegicus
agagaaggtgttgcggcccatgtta

SEQ ID NO: 112025 - DNA, 25 bp, Rattus norvegicus
agagaagtaagcctctccgctgaac

SEQ ID NO: 112026 - DNA, 25 bp, Rattus norvegicus
agagaagtaagcgtctccgctgaac

SEQ ID NO: 112027 - DNA, 25 bp, Rattus norvegicus
agagaagtagcaccaggtccccact

SEQ ID NO: 112028 - DNA, 25 bp, Rattus norvegicus
agagaagtagcagcaggtccccact

SEQ ID NO: 112029 - DNA, 25 bp, Rattus norvegicus
agagaagtatctccacgggagcccc

SEQ ID NO: 112030 - DNA, 25 bp, Rattus norvegicus
agagaagtatctgcacgggagcccc

SEQ ID NO: 112031 - DNA, 25 bp, Rattus norvegicus
agagaagtattacggtctgcagacc

SEQ ID NO: 112032 - DNA, 25 bp, Rattus norvegicus
agagaagtattagggtctgcagacc

SEQ ID NO: 112033 - DNA, 25 bp, Rattus norvegicus
agagaagtcttccagaggccgcctg

SEQ ID NO: 112034 - DNA, 25 bp, Rattus norvegicus
agagaagtcttcgagaggccgcctg

SEQ ID NO: 112035 - DNA, 25 bp, Rattus norvegicus
agagaagtggtcctctggactctcc

SEQ ID NO: 112036 - DNA, 25 bp, Rattus norvegicus
agagaagtggtcgtctggactctcc

SEQ ID NO: 112037 - DNA, 25 bp, Rattus norvegicus
agagaagttctcctgtcatgtgtcc

SEQ ID NO: 112038 - DNA, 25 bp, Rattus norvegicus
agagaagttctcgtgtcatgtgtcc

SEQ ID NO: 112039 - DNA, 25 bp, Rattus norvegicus
agagaagtttgcatgggccattgat

SEQ ID NO: 112040 - DNA, 25 bp, Rattus norvegicus
agagaagtttgcttgggccattgat

SEQ ID NO: 112041 - DNA, 25 bp, Rattus norvegicus
agagaagtttggagcccgaggctta

SEQ ID NO: 112042 - DNA, 25 bp, Rattus norvegicus
agagaagtttggtgcccgaggctta

SEQ ID NO: 112043 - DNA, 25 bp, Rattus norvegicus
agagaataagaaccccaagcccaag

SEQ ID NO: 112044 - DNA, 25 bp, Rattus norvegicus
agagaataagaagcccaagcccaag

SEQ ID NO: 112045 - DNA, 25 bp, Rattus norvegicus
agagaatacttgacccacatcactg

SEQ ID NO: 112046 - DNA, 25 bp, Rattus norvegicus
agagaatacttgtcccacatcactg

SEQ ID NO: 112047 - DNA, 25 bp, Rattus norvegicus
agagaatatgaccttttttgttttg

SEQ ID NO: 112048 - DNA, 25 bp, Rattus norvegicus
agagaatatgacgttttttgttttg

SEQ ID NO: 112049 - DNA, 25 bp, Rattus norvegicus
agagaatcactgaactttgctgtca

SEQ ID NO: 112050 - DNA, 25 bp, Rattus norvegicus
agagaatcactgtactttgctgtca

SEQ ID NO: 112051 - DNA, 25 bp, Rattus norvegicus
agagaatcagccaacatcttcttcc

SEQ ID NO: 112052 - DNA, 25 bp, Rattus norvegicus
agagaatcagcctacatcttcttcc

SEQ ID NO: 112053 - DNA, 25 bp, Rattus norvegicus
agagaatcatcccataaccctaaca

SEQ ID NO: 112054 - DNA, 25 bp, Rattus norvegicus
agagaatcatccgataaccctaaca

SEQ ID NO: 112055 - DNA, 25 bp, Rattus norvegicus
agagaatcattcatctgtcttccac

SEQ ID NO: 112056 - DNA, 25 bp, Rattus norvegicus
agagaatcattcttctgtcttccac

SEQ ID NO: 112057 - DNA, 25 bp, Rattus norvegicus
agagaatccagtctccttggcacag

SEQ ID NO: 112058 - DNA, 25 bp, Rattus norvegicus
agagaatccagtctgacatcccttc

SEQ ID NO: 112059 - DNA, 25 bp, Rattus norvegicus
agagaatccagtgtccttggcacag

SEQ ID NO: 112060 - DNA, 25 bp, Rattus norvegicus
agagaatccagtgtgacatcccttc

SEQ ID NO: 112061 - DNA, 25 bp, Rattus norvegicus
agagaatccatccttggcctggagc

SEQ ID NO: 112062 - DNA, 25 bp, Rattus norvegicus
agagaatccatcgttggcctggagc

SEQ ID NO: 112063 - DNA, 25 bp, Rattus norvegicus
agagaatcccaccaatcgtggtgcc

SEQ ID NO: 112064 - DNA, 25 bp, Rattus norvegicus
agagaatcccacgaatcgtggtgcc

SEQ ID NO: 112065 - DNA, 25 bp, Rattus norvegicus
agagaatcccagactggttccacat

SEQ ID NO: 112066 - DNA, 25 bp, Rattus norvegicus
agagaatcccagagctggtggcgac

SEQ ID NO: 112067 - DNA, 25 bp, Rattus norvegicus
agagaatcccagtctggttccacat

SEQ ID NO: 112068 - DNA, 25 bp, Rattus norvegicus
agagaatcccagtgctggtggcgac

SEQ ID NO: 112069 - DNA, 25 bp, Rattus norvegicus
agagaatccgtactctaccctctgg

SEQ ID NO: 112070 - DNA, 25 bp, Rattus norvegicus
agagaatccgtagtctaccctctgg

SEQ ID NO: 112071 - DNA, 25 bp, Rattus norvegicus
agagaatcctgacgcagagtaccca

SEQ ID NO: 112072 - DNA, 25 bp, Rattus norvegicus
agagaatcctgaggcagagtaccca

SEQ ID NO: 112073 - DNA, 25 bp, Rattus norvegicus
agagaatccttaatcttcagcctgc

SEQ ID NO: 112074 - DNA, 25 bp, Rattus norvegicus
agagaatccttattcttcagcctgc

SEQ ID NO: 112075 - DNA, 25 bp, Rattus norvegicus
agagaatcggagattgctgtgagat

SEQ ID NO: 112076 - DNA, 25 bp, Rattus norvegicus
agagaatcggagtttgctgtgagat

SEQ ID NO: 112077 - DNA, 25 bp, Rattus norvegicus
agagaatcgtctccaaaacatattg

SEQ ID NO: 112078 - DNA, 25 bp, Rattus norvegicus
agagaatcgtctgcaaaacatattg

SEQ ID NO: 112079 - DNA, 25 bp, Rattus norvegicus
agagaatctcttctggagcacctac

SEQ ID NO: 112080 - DNA, 25 bp, Rattus norvegicus
agagaatctcttgtggagcacctac

SEQ ID NO: 112081 - DNA, 25 bp, Rattus norvegicus
agagaatctgttaaaggcacttgaa

SEQ ID NO: 112082 - DNA, 25 bp, Rattus norvegicus
agagaatctgtttaaggcacttgaa

SEQ ID NO: 112083 - DNA, 25 bp, Rattus norvegicus
agagaatcttacatacctccagcca

SEQ ID NO: 112084 - DNA, 25 bp, Rattus norvegicus
agagaatcttacttacctccagcca

SEQ ID NO: 112085 - DNA, 25 bp, Rattus norvegicus
agagaatgacatctccagccgctca

SEQ ID NO: 112086 - DNA, 25 bp, Rattus norvegicus
agagaatgacatgtccagccgctca

SEQ ID NO: 112087 - DNA, 25 bp, Rattus norvegicus
agagaatgatgccttcttccaccca

SEQ ID NO: 112088 - DNA, 25 bp, Rattus norvegicus
agagaatgatgcgttcttccaccca

SEQ ID NO: 112089 - DNA, 25 bp, Rattus norvegicus
agagaatgatgtccacgctccaact

SEQ ID NO: 112090 - DNA, 25 bp, Rattus norvegicus
agagaatgatgtgcacgctccaact

SEQ ID NO: 112091 - DNA, 25 bp, Rattus norvegicus
agagaatgcagaccactccacagag

SEQ ID NO: 112092 - DNA, 25 bp, Rattus norvegicus
agagaatgcagagcactccacagag

SEQ ID NO: 112093 - DNA, 25 bp, Rattus norvegicus
agagaatgccatcctgcttagagcc

SEQ ID NO: 112094 - DNA, 25 bp, Rattus norvegicus
agagaatgccatgctgcttagagcc

SEQ ID NO: 112095 - DNA, 25 bp, Rattus norvegicus
agagaatgccctcggatagccctgc

SEQ ID NO: 112096 - DNA, 25 bp, Rattus norvegicus
agagaatgccctgggatagccctgc

SEQ ID NO: 112097 - DNA, 25 bp, Rattus norvegicus
agagaatgccttcggctggatccca

SEQ ID NO: 112098 - DNA, 25 bp, Rattus norvegicus
agagaatgccttgggctggatccca

SEQ ID NO: 112099 - DNA, 25 bp, Rattus norvegicus
agagaatgcgcacgctgaagcgcaa

SEQ ID NO: 112100 - DNA, 25 bp, Rattus norvegicus
agagaatgcgcaggctgaagcgcaa

SEQ ID NO: 112101 - DNA, 25 bp, Rattus norvegicus
agagaatgctctccctcctgcggaa

SEQ ID NO: 112102 - DNA, 25 bp, Rattus norvegicus
agagaatgctctgcctcctgcggaa

SEQ ID NO: 112103 - DNA, 25 bp, Rattus norvegicus
agagaatggaatctcacctcctcag

SEQ ID NO: 112104 - DNA, 25 bp, Rattus norvegicus
agagaatggaatgtcacctcctcag

SEQ ID NO: 112105 - DNA, 25 bp, Rattus norvegicus
agagaatggcgactcctctcaggcc

SEQ ID NO: 112106 - DNA, 25 bp, Rattus norvegicus
agagaatggcgagtcctctcaggcc

SEQ ID NO: 112107 - DNA, 25 bp, Rattus norvegicus
agagaatgtatcacagaccgcctcc

SEQ ID NO: 112108 - DNA, 25 bp, Rattus norvegicus
agagaatgtatctcagaccgcctcc

SEQ ID NO: 112109 - DNA, 25 bp, Rattus norvegicus
agagaatgtggcatcatccgcctca

SEQ ID NO: 112110 - DNA, 25 bp, Rattus norvegicus
agagaatgtggcttcatccgcctca

SEQ ID NO: 112111 - DNA, 25 bp, Rattus norvegicus
agagaatgttgtctgctgccactgt

SEQ ID NO: 112112 - DNA, 25 bp, Rattus norvegicus
agagaatgttgtgtgctgccactgt

SEQ ID NO: 112113 - DNA, 25 bp, Rattus norvegicus
agagaattagtcactctgccctctc

SEQ ID NO: 112114 - DNA, 25 bp, Rattus norvegicus
agagaattagtctctctgccctctc

SEQ ID NO: 112115 - DNA, 25 bp, Rattus norvegicus
agagaattcgaacagcagcgctatt

SEQ ID NO: 112116 - DNA, 25 bp, Rattus norvegicus
agagaattcgaagagcagcgctatt

SEQ ID NO: 112117 - DNA, 25 bp, Rattus norvegicus
agagaattctctatatgtatatgta

SEQ ID NO: 112118 - DNA, 25 bp, Rattus norvegicus
agagaattctctttatgtatatgta

SEQ ID NO: 112119 - DNA, 25 bp, Rattus norvegicus
agagaattgcacagagctaggcccc

SEQ ID NO: 112120 - DNA, 25 bp, Rattus norvegicus
agagaattgcactgagctaggcccc

SEQ ID NO: 112121 - DNA, 25 bp, Rattus norvegicus
agagaattgcctcgcagggcacctt

SEQ ID NO: 112122 - DNA, 25 bp, Rattus norvegicus
agagaattgcctggcagggcacctt

SEQ ID NO: 112123 - DNA, 25 bp, Rattus norvegicus
agagaattggataccagcagcatcc

SEQ ID NO: 112124 - DNA, 25 bp, Rattus norvegicus
agagaattggattccagcagcatcc

SEQ ID NO: 112125 - DNA, 25 bp, Rattus norvegicus
agagaatttcctaggctcatcctga

SEQ ID NO: 112126 - DNA, 25 bp, Rattus norvegicus
agagaatttccttggctcatcctga

SEQ ID NO: 112127 - DNA, 25 bp, Rattus norvegicus
agagacaaaagcaaggaatccccag

SEQ ID NO: 112128 - DNA, 25 bp, Rattus norvegicus
agagacaaaagctaggaatccccag

SEQ ID NO: 112129 - DNA, 25 bp, Rattus norvegicus
agagacaaatgaagactggcttttt

SEQ ID NO: 112130 - DNA, 25 bp, Rattus norvegicus
agagacaaatgatgactggcttttt

SEQ ID NO: 112131 - DNA, 25 bp, Rattus norvegicus
agagacaaccacagcccagcgagga

SEQ ID NO: 112132 - DNA, 25 bp, Rattus norvegicus
agagacaaccactgcccagcgagga

SEQ ID NO: 112133 - DNA, 25 bp, Rattus norvegicus
agagacaagagaacctgccacagcc

SEQ ID NO: 112134 - DNA, 25 bp, Rattus norvegicus
agagacaagagatcctgccacagcc

SEQ ID NO: 112135 - DNA, 25 bp, Rattus norvegicus
agagacaatatacaccctaggcaag

SEQ ID NO: 112136 - DNA, 25 bp, Rattus norvegicus
agagacaatatagaccctaggcaag

SEQ ID NO: 112137 - DNA, 25 bp, Rattus norvegicus
agagacaatgccaaggacaccctgt

SEQ ID NO: 112138 - DNA, 25 bp, Rattus norvegicus
agagacaatgcctaggacaccctgt

SEQ ID NO: 112139 - DNA, 25 bp, Rattus norvegicus
agagacacactaccagacttgcaag

SEQ ID NO: 112140 - DNA, 25 bp, Rattus norvegicus
agagacacactagcagacttgcaag

SEQ ID NO: 112141 - DNA, 25 bp, Rattus norvegicus
agagacacaggccaggcaccagctg

SEQ ID NO: 112142 - DNA, 25 bp, Rattus norvegicus
agagacacaggcgaggcaccagctg

SEQ ID NO: 112143 - DNA, 25 bp, Rattus norvegicus
agagacacagggaaccagccacctt

SEQ ID NO: 112144 - DNA, 25 bp, Rattus norvegicus
agagacacagggtaccagccacctt

SEQ ID NO: 112145 - DNA, 25 bp, Rattus norvegicus
agagacaccaataacacatacccag

SEQ ID NO: 112146 - DNA, 25 bp, Rattus norvegicus
agagacaccaattacacatacccag

SEQ ID NO: 112147 - DNA, 25 bp, Rattus norvegicus
agagacaccagcatcagtggcctgt

SEQ ID NO: 112148 - DNA, 25 bp, Rattus norvegicus
agagacaccagcttcagtggcctgt

SEQ ID NO: 112149 - DNA, 25 bp, Rattus norvegicus
agagacaccagtccagttttcccca

SEQ ID NO: 112150 - DNA, 25 bp, Rattus norvegicus
agagacaccagtgcagttttcccca

SEQ ID NO: 112151 - DNA, 25 bp, Rattus norvegicus
agagacaccattcttcccctgtgca

SEQ ID NO: 112152 - DNA, 25 bp, Rattus norvegicus
agagacaccattgttcccctgtgca

SEQ ID NO: 112153 - DNA, 25 bp, Rattus norvegicus
agagacacctgcctatggcttcagg

SEQ ID NO: 112154 - DNA, 25 bp, Rattus norvegicus
agagacacctgcgtatggcttcagg

SEQ ID NO: 112155 - DNA, 25 bp, Rattus norvegicus
agagacacgggcatccttgactcca

SEQ ID NO: 112156 - DNA, 25 bp, Rattus norvegicus
agagacacgggcttccttgactcca

SEQ ID NO: 112157 - DNA, 25 bp, Rattus norvegicus
agagacactggacttgccctgagcg

SEQ ID NO: 112158 - DNA, 25 bp, Rattus norvegicus
agagacactggagttgccctgagcg

SEQ ID NO: 112159 - DNA, 25 bp, Rattus norvegicus
agagacactgggacatctcatcctc

SEQ ID NO: 112160 - DNA, 25 bp, Rattus norvegicus
agagacactgggtcatctcatcctc

SEQ ID NO: 112161 - DNA, 25 bp, Rattus norvegicus
agagacagaattactcactcccaca

SEQ ID NO: 112162 - DNA, 25 bp, Rattus norvegicus
agagacagaatttctcactcccaca

SEQ ID NO: 112163 - DNA, 25 bp, Rattus norvegicus
agagacagagcgacgacggcaaaat

SEQ ID NO: 112164 - DNA, 25 bp, Rattus norvegicus
agagacagagcgtcgacggcaaaat

SEQ ID NO: 112165 - DNA, 25 bp, Rattus norvegicus
agagacagcaccctaagcatctttc

SEQ ID NO: 112166 - DNA, 25 bp, Rattus norvegicus
agagacagcaccgtaagcatctttc

SEQ ID NO: 112167 - DNA, 25 bp, Rattus norvegicus
agagacagcactcgcatgctctatg

SEQ ID NO: 112168 - DNA, 25 bp, Rattus norvegicus
agagacagcactggcatgctctatg

SEQ ID NO: 112169 - DNA, 25 bp, Rattus norvegicus
agagacagccgcaggtctcaggtgt

SEQ ID NO: 112170 - DNA, 25 bp, Rattus norvegicus
agagacagccgctggtctcaggtgt

SEQ ID NO: 112171 - DNA, 25 bp, Rattus norvegicus
agagacagcggcacctatgagcagc

SEQ ID NO: 112172 - DNA, 25 bp, Rattus norvegicus
agagacagcggctcctatgagcagc

SEQ ID NO: 112173 - DNA, 25 bp, Rattus norvegicus
agagacagctgaccgggagctactt

SEQ ID NO: 112174 - DNA, 25 bp, Rattus norvegicus
agagacagctgagcgggagctactt

SEQ ID NO: 112175 - DNA, 25 bp, Rattus norvegicus
agagacaggaccctctggctttggc

SEQ ID NO: 112176 - DNA, 25 bp, Rattus norvegicus
agagacaggaccgtctggctttggc

SEQ ID NO: 112177 - DNA, 25 bp, Rattus norvegicus
agagacaggtcgctgagcccatgaa

SEQ ID NO: 112178 - DNA, 25 bp, Rattus norvegicus
agagacaggtcggtgagcccatgaa

SEQ ID NO: 112179 - DNA, 25 bp, Rattus norvegicus
agagacagtactctactacccttga

SEQ ID NO: 112180 - DNA, 25 bp, Rattus norvegicus
agagacagtactgtactacccttga

SEQ ID NO: 112181 - DNA, 25 bp, Rattus norvegicus
agagacagtccccgtgagtgcagcc

SEQ ID NO: 112182 - DNA, 25 bp, Rattus norvegicus
agagacagtcccggtgagtgcagcc

SEQ ID NO: 112183 - DNA, 25 bp, Rattus norvegicus
agagacagtctcaatagccttggta

SEQ ID NO: 112184 - DNA, 25 bp, Rattus norvegicus
agagacagtctctatagccttggta

SEQ ID NO: 112185 - DNA, 25 bp, Rattus norvegicus
agagacagtgtcatcgtcctcatgt

SEQ ID NO: 112186 - DNA, 25 bp, Rattus norvegicus
agagacagtgtcttcgtcctcatgt

SEQ ID NO: 112187 - DNA, 25 bp, Rattus norvegicus
agagacagtttactcccacttacca

SEQ ID NO: 112188 - DNA, 25 bp, Rattus norvegicus
agagacagtttagtcccacttacca

SEQ ID NO: 112189 - DNA, 25 bp, Rattus norvegicus
agagacatacagacactcgggccac

SEQ ID NO: 112190 - DNA, 25 bp, Rattus norvegicus
agagacatacagtcactcgggccac

SEQ ID NO: 112191 - DNA, 25 bp, Rattus norvegicus
agagacatacccagagccgacggcg

SEQ ID NO: 112192 - DNA, 25 bp, Rattus norvegicus
agagacataccctgagccgacggcg

SEQ ID NO: 112193 - DNA, 25 bp, Rattus norvegicus
agagacatatggcttcccatcgcag

SEQ ID NO: 112194 - DNA, 25 bp, Rattus norvegicus
agagacatatgggttcccatcgcag

SEQ ID NO: 112195 - DNA, 25 bp, Rattus norvegicus
agagacatcagaatcactcccactg

SEQ ID NO: 112196 - DNA, 25 bp, Rattus norvegicus
agagacatcagattcactcccactg

SEQ ID NO: 112197 - DNA, 25 bp, Rattus norvegicus
agagacatcctcatccggcacaaag

SEQ ID NO: 112198 - DNA, 25 bp, Rattus norvegicus
agagacatcctcttccggcacaaag

SEQ ID NO: 112199 - DNA, 25 bp, Rattus norvegicus
agagacatcctgctcttgcgtaggt

SEQ ID NO: 112200 - DNA, 25 bp, Rattus norvegicus
agagacatcctggtcttgcgtaggt

SEQ ID NO: 112201 - DNA, 25 bp, Rattus norvegicus
agagacatctggagtctcccttacg

SEQ ID NO: 112202 - DNA, 25 bp, Rattus norvegicus
agagacatctggtgtctcccttacg

SEQ ID NO: 112203 - DNA, 25 bp, Rattus norvegicus
agagacatctttcgtcccctggaca

SEQ ID NO: 112204 - DNA, 25 bp, Rattus norvegicus
agagacatctttggtcccctggaca

SEQ ID NO: 112205 - DNA, 25 bp, Rattus norvegicus
agagacatgagcaccatcaccacca

SEQ ID NO: 112206 - DNA, 25 bp, Rattus norvegicus
agagacatgagctccatcaccacca

SEQ ID NO: 112207 - DNA, 25 bp, Rattus norvegicus
agagacatgttgaccatgcctctcc

SEQ ID NO: 112208 - DNA, 25 bp, Rattus norvegicus
agagacatgttgtccatgcctctcc

SEQ ID NO: 112209 - DNA, 25 bp, Rattus norvegicus
agagacattctgcagtgttctggaa

SEQ ID NO: 112210 - DNA, 25 bp, Rattus norvegicus
agagacattctggagtgttctggaa

SEQ ID NO: 112211 - DNA, 25 bp, Rattus norvegicus
agagacattgccagcaccatttttt

SEQ ID NO: 112212 - DNA, 25 bp, Rattus norvegicus
agagacattgcctgcaccatttttt

SEQ ID NO: 112213 - DNA, 25 bp, Rattus norvegicus
agagacattgtcaatgacagtgtaa

SEQ ID NO: 112214 - DNA, 25 bp, Rattus norvegicus
agagacattgtctatgacagtgtaa

SEQ ID NO: 112215 - DNA, 25 bp, Rattus norvegicus
agagaccaacccaatagcttttaat

SEQ ID NO: 112216 - DNA, 25 bp, Rattus norvegicus
agagaccaaccctatagcttttaat

SEQ ID NO: 112217 - DNA, 25 bp, Rattus norvegicus
agagaccaagtactgaaggaacctt

SEQ ID NO: 112218 - DNA, 25 bp, Rattus norvegicus
agagaccaagtagtgaaggaacctt

SEQ ID NO: 112219 - DNA, 25 bp, Rattus norvegicus
agagaccaatgaccctgtttatttt

SEQ ID NO: 112220 - DNA, 25 bp, Rattus norvegicus
agagaccaatgagcctgtttatttt

SEQ ID NO: 112221 - DNA, 25 bp, Rattus norvegicus
agagaccaccacaggtcagggcact

SEQ ID NO: 112222 - DNA, 25 bp, Rattus norvegicus
agagaccaccactggtcagggcact

SEQ ID NO: 112223 - DNA, 25 bp, Rattus norvegicus
agagaccaccctcttggcaggacaa

SEQ ID NO: 112224 - DNA, 25 bp, Rattus norvegicus
agagaccaccctgttggcaggacaa

SEQ ID NO: 112225 - DNA, 25 bp, Rattus norvegicus
agagaccactggcatctgctggtga

SEQ ID NO: 112226 - DNA, 25 bp, Rattus norvegicus
agagaccactgggatctgctggtga

SEQ ID NO: 112227 - DNA, 25 bp, Rattus norvegicus
agagaccactttaccaacaagcgct

SEQ ID NO: 112228 - DNA, 25 bp, Rattus norvegicus
agagaccactttactacttcatcac

SEQ ID NO: 112229 - DNA, 25 bp, Rattus norvegicus
agagaccacttttccaacaagcgct

SEQ ID NO: 112230 - DNA, 25 bp, Rattus norvegicus
agagaccacttttctacttcatcac

SEQ ID NO: 112231 - DNA, 25 bp, Rattus norvegicus
agagaccagagccatagcccatttt

SEQ ID NO: 112232 - DNA, 25 bp, Rattus norvegicus
agagaccagagcgatagcccatttt

SEQ ID NO: 112233 - DNA, 25 bp, Rattus norvegicus
agagaccagtcacttgcttgtgggc

SEQ ID NO: 112234 - DNA, 25 bp, Rattus norvegicus
agagaccagtcagttgcttgtgggc

SEQ ID NO: 112235 - DNA, 25 bp, Rattus norvegicus
agagaccatccccacagactatagg

SEQ ID NO: 112236 - DNA, 25 bp, Rattus norvegicus
agagaccatcccgacagactatagg

SEQ ID NO: 112237 - DNA, 25 bp, Rattus norvegicus
agagaccatcctatcttgacaaagt

SEQ ID NO: 112238 - DNA, 25 bp, Rattus norvegicus
agagaccatcctttcttgacaaagt

SEQ ID NO: 112239 - DNA, 25 bp, Rattus norvegicus
agagaccatctcaagctccggagac

SEQ ID NO: 112240 - DNA, 25 bp, Rattus norvegicus
agagaccatctctagctccggagac

SEQ ID NO: 112241 - DNA, 25 bp, Rattus norvegicus
agagaccatgagaaagcccatccac

SEQ ID NO: 112242 - DNA, 25 bp, Rattus norvegicus
agagaccatgagtaagcccatccac

SEQ ID NO: 112243 - DNA, 25 bp, Rattus norvegicus
agagaccatgtgattgtatccccag

SEQ ID NO: 112244 - DNA, 25 bp, Rattus norvegicus
agagaccatgtgtttgtatccccag

SEQ ID NO: 112245 - DNA, 25 bp, Rattus norvegicus
agagaccattggagacttcaaccca

SEQ ID NO: 112246 - DNA, 25 bp, Rattus norvegicus
agagaccattggtgacttcaaccca

SEQ ID NO: 112247 - DNA, 25 bp, Rattus norvegicus
agagacccaccaccagggagcagat

SEQ ID NO: 112248 - DNA, 25 bp, Rattus norvegicus
agagacccaccagcagggagcagat

SEQ ID NO: 112249 - DNA, 25 bp, Rattus norvegicus
agagacccagacagcttaagagtgt

SEQ ID NO: 112250 - DNA, 25 bp, Rattus norvegicus
agagacccagactgcttaagagtgt

SEQ ID NO: 112251 - DNA, 25 bp, Rattus norvegicus
agagacccagcaaacgtaccttttg

SEQ ID NO: 112252 - DNA, 25 bp, Rattus norvegicus
agagacccagcatacgtaccttttg

SEQ ID NO: 112253 - DNA, 25 bp, Rattus norvegicus
agagacccagggatctctccaacag

SEQ ID NO: 112254 - DNA, 25 bp, Rattus norvegicus
agagacccagggttctctccaacag

SEQ ID NO: 112255 - DNA, 25 bp, Rattus norvegicus
agagacccagtaagcagctgctcgg

SEQ ID NO: 112256 - DNA, 25 bp, Rattus norvegicus
agagacccagtatgcagctgctcgg

SEQ ID NO: 112257 - DNA, 25 bp, Rattus norvegicus
agagaccccaacaagctggtgttct

SEQ ID NO: 112258 - DNA, 25 bp, Rattus norvegicus
agagaccccaactagctggtgttct

SEQ ID NO: 112259 - DNA, 25 bp, Rattus norvegicus
agagacccgtgaccccactgagact

SEQ ID NO: 112260 - DNA, 25 bp, Rattus norvegicus
agagacccgtgagcccactgagact

SEQ ID NO: 112261 - DNA, 25 bp, Rattus norvegicus
agagaccctaaacctgcaccatttg

SEQ ID NO: 112262 - DNA, 25 bp, Rattus norvegicus
agagaccctaaagctgcaccatttg

SEQ ID NO: 112263 - DNA, 25 bp, Rattus norvegicus
agagaccctacgagatttgtacaac

SEQ ID NO: 112264 - DNA, 25 bp, Rattus norvegicus
agagaccctacgtgatttgtacaac

SEQ ID NO: 112265 - DNA, 25 bp, Rattus norvegicus
agagaccctagacttgggacaaaga

SEQ ID NO: 112266 - DNA, 25 bp, Rattus norvegicus
agagaccctagagttgggacaaaga

SEQ ID NO: 112267 - DNA, 25 bp, Rattus norvegicus
agagaccctcataaatttcacttta

SEQ ID NO: 112268 - DNA, 25 bp, Rattus norvegicus
agagaccctcattaatttcacttta

SEQ ID NO: 112269 - DNA, 25 bp, Rattus norvegicus
agagaccctgatactatatgtgtat

SEQ ID NO: 112270 - DNA, 25 bp, Rattus norvegicus
agagaccctgattctatatgtgtat

SEQ ID NO: 112271 - DNA, 25 bp, Rattus norvegicus
agagaccctgcaaatctcactgtca

SEQ ID NO: 112272 - DNA, 25 bp, Rattus norvegicus
agagaccctgcatatctcactgtca

SEQ ID NO: 112273 - DNA, 25 bp, Rattus norvegicus
agagaccgacagacagatgcctcaa

SEQ ID NO: 112274 - DNA, 25 bp, Rattus norvegicus
agagaccgacagtcagatgcctcaa

SEQ ID NO: 112275 - DNA, 25 bp, Rattus norvegicus
agagaccgaccaaggtggctcgagt

SEQ ID NO: 112276 - DNA, 25 bp, Rattus norvegicus
agagaccgaccactacagaatgcag

SEQ ID NO: 112277 - DNA, 25 bp, Rattus norvegicus
agagaccgaccagtacagaatgcag

SEQ ID NO: 112278 - DNA, 25 bp, Rattus norvegicus
agagaccgaccatggtggctcgagt

SEQ ID NO: 112279 - DNA, 25 bp, Rattus norvegicus
agagaccgccttcatggactagcaa

SEQ ID NO: 112280 - DNA, 25 bp, Rattus norvegicus
agagaccgccttgatggactagcaa

SEQ ID NO: 112281 - DNA, 25 bp, Rattus norvegicus
agagaccggactcaggctttgtgac

SEQ ID NO: 112282 - DNA, 25 bp, Rattus norvegicus
agagaccggactgaggctttgtgac

SEQ ID NO: 112283 - DNA, 25 bp, Rattus norvegicus
agagaccgtagaccagcggaccgcc

SEQ ID NO: 112284 - DNA, 25 bp, Rattus norvegicus
agagaccgtagagcagcggaccgcc

SEQ ID NO: 112285 - DNA, 25 bp, Rattus norvegicus
agagaccgtcagagacttgcccaaa

SEQ ID NO: 112286 - DNA, 25 bp, Rattus norvegicus
agagaccgtcagtgacttgcccaaa

SEQ ID NO: 112287 - DNA, 25 bp, Rattus norvegicus
agagaccgtcggcataacagagaac

SEQ ID NO: 112288 - DNA, 25 bp, Rattus norvegicus
agagaccgtcgggataacagagaac

SEQ ID NO: 112289 - DNA, 25 bp, Rattus norvegicus
agagaccgtctgactcaggttttgc

SEQ ID NO: 112290 - DNA, 25 bp, Rattus norvegicus
agagaccgtctgtctcaggttttgc

SEQ ID NO: 112291 - DNA, 25 bp, Rattus norvegicus
agagaccgtgacctgctcaggtata

SEQ ID NO: 112292 - DNA, 25 bp, Rattus norvegicus
agagaccgtgacgtgctcaggtata

SEQ ID NO: 112293 - DNA, 25 bp, Rattus norvegicus
agagaccgtttgaactccgtcagtt

SEQ ID NO: 112294 - DNA, 25 bp, Rattus norvegicus
agagaccgtttgtactccgtcagtt

SEQ ID NO: 112295 - DNA, 25 bp, Rattus norvegicus
agagacctaattcctcctcttggag

SEQ ID NO: 112296 - DNA, 25 bp, Rattus norvegicus
agagacctaattgctcctcttggag

SEQ ID NO: 112297 - DNA, 25 bp, Rattus norvegicus
agagacctactgactaacttttata

SEQ ID NO: 112298 - DNA, 25 bp, Rattus norvegicus
agagacctactgtctaacttttata

SEQ ID NO: 112299 - DNA, 25 bp, Rattus norvegicus
agagacctatttaccagccttaaat

SEQ ID NO: 112300 - DNA, 25 bp, Rattus norvegicus
agagacctattttccagccttaaat

SEQ ID NO: 112301 - DNA, 25 bp, Rattus norvegicus
agagacctcacaatttctctctgag

SEQ ID NO: 112302 - DNA, 25 bp, Rattus norvegicus
agagacctcacattttctctctgag

SEQ ID NO: 112303 - DNA, 25 bp, Rattus norvegicus
agagacctcagcagggcctgacaga

SEQ ID NO: 112304 - DNA, 25 bp, Rattus norvegicus
agagacctcagctgggcctgacaga

SEQ ID NO: 112305 - DNA, 25 bp, Rattus norvegicus
agagacctcgagagcaggtgtcctg

SEQ ID NO: 112306 - DNA, 25 bp, Rattus norvegicus
agagacctcgagtgcaggtgtcctg

SEQ ID NO: 112307 - DNA, 25 bp, Rattus norvegicus
agagacctcggaactcttccagaag

SEQ ID NO: 112308 - DNA, 25 bp, Rattus norvegicus
agagacctcggatctcttccagaag

SEQ ID NO: 112309 - DNA, 25 bp, Rattus norvegicus
agagacctcttcagcttagactcag

SEQ ID NO: 112310 - DNA, 25 bp, Rattus norvegicus
agagacctcttctgcttagactcag

SEQ ID NO: 112311 - DNA, 25 bp, Rattus norvegicus
agagacctgaccacatgatctacga

SEQ ID NO: 112312 - DNA, 25 bp, Rattus norvegicus
agagacctgaccatctaaagttggg

SEQ ID NO: 112313 - DNA, 25 bp, Rattus norvegicus
agagacctgacctcatgatctacga

SEQ ID NO: 112314 - DNA, 25 bp, Rattus norvegicus
agagacctgaccttctaaagttggg

SEQ ID NO: 112315 - DNA, 25 bp, Rattus norvegicus
agagacctgagaatcccacttgttt

SEQ ID NO: 112316 - DNA, 25 bp, Rattus norvegicus
agagacctgagattcccacttgttt

SEQ ID NO: 112317 - DNA, 25 bp, Rattus norvegicus
agagacctgagcaccgtgacgctca

SEQ ID NO: 112318 - DNA, 25 bp, Rattus norvegicus
agagacctgagctccgtgacgctca

SEQ ID NO: 112319 - DNA, 25 bp, Rattus norvegicus
agagacctgatacgagttcaaggcc

SEQ ID NO: 112320 - DNA, 25 bp, Rattus norvegicus
agagacctgataggagttcaaggcc

SEQ ID NO: 112321 - DNA, 25 bp, Rattus norvegicus
agagacctgcaaccattccctagac

SEQ ID NO: 112322 - DNA, 25 bp, Rattus norvegicus
agagacctgcaagcattccctagac

SEQ ID NO: 112323 - DNA, 25 bp, Rattus norvegicus
agagacctgcctacaagggctgttt

SEQ ID NO: 112324 - DNA, 25 bp, Rattus norvegicus
agagacctgccttcaagggctgttt

SEQ ID NO: 112325 - DNA, 25 bp, Rattus norvegicus
agagacctggaaaagcgggcatcct

SEQ ID NO: 112326 - DNA, 25 bp, Rattus norvegicus
agagacctggaatagcgggcatcct

SEQ ID NO: 112327 - DNA, 25 bp, Rattus norvegicus
agagacctggctaccgggctgattg

SEQ ID NO: 112328 - DNA, 25 bp, Rattus norvegicus
agagacctggctctcacgagttctc

SEQ ID NO: 112329 - DNA, 25 bp, Rattus norvegicus
agagacctggctgtcacgagttctc

SEQ ID NO: 112330 - DNA, 25 bp, Rattus norvegicus
agagacctggcttccgggctgattg

SEQ ID NO: 112331 - DNA, 25 bp, Rattus norvegicus
agagacctggtacacttctggatac

SEQ ID NO: 112332 - DNA, 25 bp, Rattus norvegicus
agagacctggtagacttctggatac

SEQ ID NO: 112333 - DNA, 25 bp, Rattus norvegicus
agagacctggtcacaggcttgcagt

SEQ ID NO: 112334 - DNA, 25 bp, Rattus norvegicus
agagacctggtccacctggagctct

SEQ ID NO: 112335 - DNA, 25 bp, Rattus norvegicus
agagacctggtcgacctggagctct

SEQ ID NO: 112336 - DNA, 25 bp, Rattus norvegicus
agagacctggtctcaggcttgcagt

SEQ ID NO: 112337 - DNA, 25 bp, Rattus norvegicus
agagacctgtagagcatcgcaccaa

SEQ ID NO: 112338 - DNA, 25 bp, Rattus norvegicus
agagacctgtagtgcatcgcaccaa

SEQ ID NO: 112339 - DNA, 25 bp, Rattus norvegicus
agagacctgtttccgatggactacc

SEQ ID NO: 112340 - DNA, 25 bp, Rattus norvegicus
agagacctgtttgcgatggactacc

SEQ ID NO: 112341 - DNA, 25 bp, Rattus norvegicus
agagaccttacaaagctgccttttt

SEQ ID NO: 112342 - DNA, 25 bp, Rattus norvegicus
agagaccttacatagctgccttttt

SEQ ID NO: 112343 - DNA, 25 bp, Rattus norvegicus
agagaccttcctccttggatatacc

SEQ ID NO: 112344 - DNA, 25 bp, Rattus norvegicus
agagaccttcctgcttggatatacc

SEQ ID NO: 112345 - DNA, 25 bp, Rattus norvegicus
agagaccttctcagggtgctaagcc

SEQ ID NO: 112346 - DNA, 25 bp, Rattus norvegicus
agagaccttctcattgctttagtca

SEQ ID NO: 112347 - DNA, 25 bp, Rattus norvegicus
agagaccttctctgggtgctaagcc

SEQ ID NO: 112348 - DNA, 25 bp, Rattus norvegicus
agagaccttctctttgctttagtca

SEQ ID NO: 112349 - DNA, 25 bp, Rattus norvegicus
agagaccttgatacagctgtccact

SEQ ID NO: 112350 - DNA, 25 bp, Rattus norvegicus
agagaccttgattcagctgtccact

SEQ ID NO: 112351 - DNA, 25 bp, Rattus norvegicus
agagaccttgctaccacaaggtgga

SEQ ID NO: 112352 - DNA, 25 bp, Rattus norvegicus
agagaccttgctattattcctctgg

SEQ ID NO: 112353 - DNA, 25 bp, Rattus norvegicus
agagaccttgcttccacaaggtgga

SEQ ID NO: 112354 - DNA, 25 bp, Rattus norvegicus
agagaccttgcttttattcctctgg

SEQ ID NO: 112355 - DNA, 25 bp, Rattus norvegicus
agagaccttggcagattctccagcg

SEQ ID NO: 112356 - DNA, 25 bp, Rattus norvegicus
agagaccttggctgattctccagcg

SEQ ID NO: 112357 - DNA, 25 bp, Rattus norvegicus
agagacgaaaaaaggcttatgaata

SEQ ID NO: 112358 - DNA, 25 bp, Rattus norvegicus
agagacgaaaaatggcttatgaata

SEQ ID NO: 112359 - DNA, 25 bp, Rattus norvegicus
agagacgaagacagcagccgcacct

SEQ ID NO: 112360 - DNA, 25 bp, Rattus norvegicus
agagacgaagactgcagccgcacct

SEQ ID NO: 112361 - DNA, 25 bp, Rattus norvegicus
agagacgaccataccgtaagctgat

SEQ ID NO: 112362 - DNA, 25 bp, Rattus norvegicus
agagacgaccattccgtaagctgat

SEQ ID NO: 112363 - DNA, 25 bp, Rattus norvegicus
agagacgaccgcctcaacgcgttag

SEQ ID NO: 112364 - DNA, 25 bp, Rattus norvegicus
agagacgaccgcgtcaacgcgttag

SEQ ID NO: 112365 - DNA, 25 bp, Rattus norvegicus
agagacgagaataccccgatgggac

SEQ ID NO: 112366 - DNA, 25 bp, Rattus norvegicus
agagacgagaatcctcatcccgtgt

SEQ ID NO: 112367 - DNA, 25 bp, Rattus norvegicus
agagacgagaatgctcatcccgtgt

SEQ ID NO: 112368 - DNA, 25 bp, Rattus norvegicus
agagacgagaattccccgatgggac

SEQ ID NO: 112369 - DNA, 25 bp, Rattus norvegicus
agagacgagccgatggcatctggca

SEQ ID NO: 112370 - DNA, 25 bp, Rattus norvegicus
agagacgagccgttggcatctggca

SEQ ID NO: 112371 - DNA, 25 bp, Rattus norvegicus
agagacgagctgcttcgcacaaggt

SEQ ID NO: 112372 - DNA, 25 bp, Rattus norvegicus
agagacgagctggttcgcacaaggt

SEQ ID NO: 112373 - DNA, 25 bp, Rattus norvegicus
agagacgcacgtacttgtttgttcc

SEQ ID NO: 112374 - DNA, 25 bp, Rattus norvegicus
agagacgcacgttcttgtttgttcc

SEQ ID NO: 112375 - DNA, 25 bp, Rattus norvegicus
agagacgcacttctacgacccttga

SEQ ID NO: 112376 - DNA, 25 bp, Rattus norvegicus
agagacgcacttgtacgacccttga

SEQ ID NO: 112377 - DNA, 25 bp, Rattus norvegicus
agagacgctcacagcattggccgga

SEQ ID NO: 112378 - DNA, 25 bp, Rattus norvegicus
agagacgctcactgcattggccgga

SEQ ID NO: 112379 - DNA, 25 bp, Rattus norvegicus
agagacgctgacatgcaccatgtgg

SEQ ID NO: 112380 - DNA, 25 bp, Rattus norvegicus
agagacgctgacttgcaccatgtgg

SEQ ID NO: 112381 - DNA, 25 bp, Rattus norvegicus
agagacgcttgcctatttcatctac

SEQ ID NO: 112382 - DNA, 25 bp, Rattus norvegicus
agagacgcttgcgtatttcatctac

SEQ ID NO: 112383 - DNA, 25 bp, Rattus norvegicus
agagacgcttggctctacctctgtg

SEQ ID NO: 112384 - DNA, 25 bp, Rattus norvegicus
agagacgcttgggtctacctctgtg

SEQ ID NO: 112385 - DNA, 25 bp, Rattus norvegicus
agagacggacttctccaacctgttt

SEQ ID NO: 112386 - DNA, 25 bp, Rattus norvegicus
agagacggacttgtccaacctgttt

SEQ ID NO: 112387 - DNA, 25 bp, Rattus norvegicus
agagacggctcaaaagttaaggctt

SEQ ID NO: 112388 - DNA, 25 bp, Rattus norvegicus
agagacggctcataagttaaggctt

SEQ ID NO: 112389 - DNA, 25 bp, Rattus norvegicus
agagacggcttcaggtggaccacga

SEQ ID NO: 112390 - DNA, 25 bp, Rattus norvegicus
agagacggcttctggtggaccacga

SEQ ID NO: 112391 - DNA, 25 bp, Rattus norvegicus
agagacgtcaggctcggctacagaa

SEQ ID NO: 112392 - DNA, 25 bp, Rattus norvegicus
agagacgtcagggtcggctacagaa

SEQ ID NO: 112393 - DNA, 25 bp, Rattus norvegicus
agagacgtccctctggtatgaggca

SEQ ID NO: 112394 - DNA, 25 bp, Rattus norvegicus
agagacgtccctgtggtatgaggca

SEQ ID NO: 112395 - DNA, 25 bp, Rattus norvegicus
agagacgtctttcccaaagggcact

SEQ ID NO: 112396 - DNA, 25 bp, Rattus norvegicus
agagacgtctttgccaaagggcact

SEQ ID NO: 112397 - DNA, 25 bp, Rattus norvegicus
agagacgtgcacactgcccgttgtg

SEQ ID NO: 112398 - DNA, 25 bp, Rattus norvegicus
agagacgtgcactctgcccgttgtg

SEQ ID NO: 112399 - DNA, 25 bp, Rattus norvegicus
agagacgtgcgtactgtcagcatta

SEQ ID NO: 112400 - DNA, 25 bp, Rattus norvegicus
agagacgtgcgttctgtcagcatta

SEQ ID NO: 112401 - DNA, 25 bp, Rattus norvegicus
agagacgtggctattgtgatagttc

SEQ ID NO: 112402 - DNA, 25 bp, Rattus norvegicus
agagacgtggcttttgtgatagttc

SEQ ID NO: 112403 - DNA, 25 bp, Rattus norvegicus
agagacgttaacatctgcctggatg

SEQ ID NO: 112404 - DNA, 25 bp, Rattus norvegicus
agagacgttaacttctgcctggatg

SEQ ID NO: 112405 - DNA, 25 bp, Rattus norvegicus
agagacgttcccattgattcctagg

SEQ ID NO: 112406 - DNA, 25 bp, Rattus norvegicus
agagacgttccctttgattcctagg

SEQ ID NO: 112407 - DNA, 25 bp, Rattus norvegicus
agagacgttctgagctggactgctc

SEQ ID NO: 112408 - DNA, 25 bp, Rattus norvegicus
agagacgttctgtgctggactgctc

SEQ ID NO: 112409 - DNA, 25 bp, Rattus norvegicus
agagacgttgtcaaggatccacctt

SEQ ID NO: 112410 - DNA, 25 bp, Rattus norvegicus
agagacgttgtctaggatccacctt

SEQ ID NO: 112411 - DNA, 25 bp, Rattus norvegicus
agagacgttgtgatgatgccactga

SEQ ID NO: 112412 - DNA, 25 bp, Rattus norvegicus
agagacgttgtgttgatgccactga

SEQ ID NO: 112413 - DNA, 25 bp, Rattus norvegicus
agagactacgctactggcttctgct

SEQ ID NO: 112414 - DNA, 25 bp, Rattus norvegicus
agagactacgcttctggcttctgct

SEQ ID NO: 112415 - DNA, 25 bp, Rattus norvegicus
agagactagcatatgccctggctcc

SEQ ID NO: 112416 - DNA, 25 bp, Rattus norvegicus
agagactagcatttgccctggctcc

SEQ ID NO: 112417 - DNA, 25 bp, Rattus norvegicus
agagactagggtctgctcctgcatc

SEQ ID NO: 112418 - DNA, 25 bp, Rattus norvegicus
agagactagggtgtgctcctgcatc

SEQ ID NO: 112419 - DNA, 25 bp, Rattus norvegicus
agagactaggtgctgtcgcttttag

SEQ ID NO: 112420 - DNA, 25 bp, Rattus norvegicus
agagactaggtggtgtcgcttttag

SEQ ID NO: 112421 - DNA, 25 bp, Rattus norvegicus
agagactatagtccccggcagatgg

SEQ ID NO: 112422 - DNA, 25 bp, Rattus norvegicus
agagactatagtgcccggcagatgg

SEQ ID NO: 112423 - DNA, 25 bp, Rattus norvegicus
agagactatctgcacttcttgaagt

SEQ ID NO: 112424 - DNA, 25 bp, Rattus norvegicus
agagactatctggacttcttgaagt

SEQ ID NO: 112425 - DNA, 25 bp, Rattus norvegicus
agagactatgaaatccctggagaat

SEQ ID NO: 112426 - DNA, 25 bp, Rattus norvegicus
agagactatgaattccctggagaat

SEQ ID NO: 112427 - DNA, 25 bp, Rattus norvegicus
agagactcaagcaccggataggcct

SEQ ID NO: 112428 - DNA, 25 bp, Rattus norvegicus
agagactcaagctccggataggcct

SEQ ID NO: 112429 - DNA, 25 bp, Rattus norvegicus
agagactcacaactctttccatggg

SEQ ID NO: 112430 - DNA, 25 bp, Rattus norvegicus
agagactcacaagtctttccatggg

SEQ ID NO: 112431 - DNA, 25 bp, Rattus norvegicus
agagactcagttcatcgctgtcacc

SEQ ID NO: 112432 - DNA, 25 bp, Rattus norvegicus
agagactcagttgatcgctgtcacc

SEQ ID NO: 112433 - DNA, 25 bp, Rattus norvegicus
agagactcatctaggcctgccagga

SEQ ID NO: 112434 - DNA, 25 bp, Rattus norvegicus
agagactcatcttggcctgccagga

SEQ ID NO: 112435 - DNA, 25 bp, Rattus norvegicus
agagactcatgccagtgtgtctgta

SEQ ID NO: 112436 - DNA, 25 bp, Rattus norvegicus
agagactcatgcgagtgtgtctgta

SEQ ID NO: 112437 - DNA, 25 bp, Rattus norvegicus
agagactccaggcttttcgacatga

SEQ ID NO: 112438 - DNA, 25 bp, Rattus norvegicus
agagactccagggttttcgacatga

SEQ ID NO: 112439 - DNA, 25 bp, Rattus norvegicus
agagactcccacctacagagctgtt

SEQ ID NO: 112440 - DNA, 25 bp, Rattus norvegicus
agagactcccacgtacagagctgtt

SEQ ID NO: 112441 - DNA, 25 bp, Rattus norvegicus
agagactcccccaatgaattgaaga

SEQ ID NO: 112442 - DNA, 25 bp, Rattus norvegicus
agagactccccctatgaattgaaga

SEQ ID NO: 112443 - DNA, 25 bp, Rattus norvegicus
agagactccctgattatgccactga

SEQ ID NO: 112444 - DNA, 25 bp, Rattus norvegicus
agagactccctgtttatgccactga

SEQ ID NO: 112445 - DNA, 25 bp, Rattus norvegicus
agagactcctgaccctggctcaagg

SEQ ID NO: 112446 - DNA, 25 bp, Rattus norvegicus
agagactcctgagcctggctcaagg

SEQ ID NO: 112447 - DNA, 25 bp, Rattus norvegicus
agagactcgagtctggcaccgccgt

SEQ ID NO: 112448 - DNA, 25 bp, Rattus norvegicus
agagactcgagtgtggcaccgccgt

SEQ ID NO: 112449 - DNA, 25 bp, Rattus norvegicus
agagactcgtacacacggctacagt

SEQ ID NO: 112450 - DNA, 25 bp, Rattus norvegicus
agagactcgtactcacggctacagt

SEQ ID NO: 112451 - DNA, 25 bp, Rattus norvegicus
agagactctaatcgcttcacattga

SEQ ID NO: 112452 - DNA, 25 bp, Rattus norvegicus
agagactctaatggcttcacattga

SEQ ID NO: 112453 - DNA, 25 bp, Rattus norvegicus
agagactctcatactcagtgccttg

SEQ ID NO: 112454 - DNA, 25 bp, Rattus norvegicus
agagactctcattctcagtgccttg

SEQ ID NO: 112455 - DNA, 25 bp, Rattus norvegicus
agagactctgctcgcccaagcaaga

SEQ ID NO: 112456 - DNA, 25 bp, Rattus norvegicus
agagactctgctggcccaagcaaga

SEQ ID NO: 112457 - DNA, 25 bp, Rattus norvegicus
agagactctgggatcccctgaaatc

SEQ ID NO: 112458 - DNA, 25 bp, Rattus norvegicus
agagactctgggttcccctgaaatc

SEQ ID NO: 112459 - DNA, 25 bp, Rattus norvegicus
agagactctgtacctattttgtatg

SEQ ID NO: 112460 - DNA, 25 bp, Rattus norvegicus
agagactctgtagctattttgtatg

SEQ ID NO: 112461 - DNA, 25 bp, Rattus norvegicus
agagactcttgcattcggagtccgg

SEQ ID NO: 112462 - DNA, 25 bp, Rattus norvegicus
agagactcttgctttcggagtccgg

SEQ ID NO: 112463 - DNA, 25 bp, Rattus norvegicus
agagactcttggcttctagctgcta

SEQ ID NO: 112464 - DNA, 25 bp, Rattus norvegicus
agagactcttgggttctagctgcta

SEQ ID NO: 112465 - DNA, 25 bp, Rattus norvegicus
agagactgaagcaaatcccctggag

SEQ ID NO: 112466 - DNA, 25 bp, Rattus norvegicus
agagactgaagcaccatgccctttg

SEQ ID NO: 112467 - DNA, 25 bp, Rattus norvegicus
agagactgaagctaatcccctggag

SEQ ID NO: 112468 - DNA, 25 bp, Rattus norvegicus
agagactgaagctccatgccctttg

SEQ ID NO: 112469 - DNA, 25 bp, Rattus norvegicus
agagactgacttcatcgctgtcact

SEQ ID NO: 112470 - DNA, 25 bp, Rattus norvegicus
agagactgacttgatcgctgtcact

SEQ ID NO: 112471 - DNA, 25 bp, Rattus norvegicus
agagactgagagagctcgttcccaa

SEQ ID NO: 112472 - DNA, 25 bp, Rattus norvegicus
agagactgagagtgctcgttcccaa

SEQ ID NO: 112473 - DNA, 25 bp, Rattus norvegicus
agagactgatacatagacctaggaa

SEQ ID NO: 112474 - DNA, 25 bp, Rattus norvegicus
agagactgatacttagacctaggaa

SEQ ID NO: 112475 - DNA, 25 bp, Rattus norvegicus
agagactgatctatgctggcaaaca

SEQ ID NO: 112476 - DNA, 25 bp, Rattus norvegicus
agagactgatctctccccgccaata

SEQ ID NO: 112477 - DNA, 25 bp, Rattus norvegicus
agagactgatctgtccccgccaata

SEQ ID NO: 112478 - DNA, 25 bp, Rattus norvegicus
agagactgatctttgctggcaaaca

SEQ ID NO: 112479 - DNA, 25 bp, Rattus norvegicus
agagactgatggaccgggcgaaccc

SEQ ID NO: 112480 - DNA, 25 bp, Rattus norvegicus
agagactgatggtccgggcgaaccc

SEQ ID NO: 112481 - DNA, 25 bp, Rattus norvegicus
agagactgcccgatgtttctaagca

SEQ ID NO: 112482 - DNA, 25 bp, Rattus norvegicus
agagactgcccgttgtttctaagca

SEQ ID NO: 112483 - DNA, 25 bp, Rattus norvegicus
agagactgccctctaccgaaagatg

SEQ ID NO: 112484 - DNA, 25 bp, Rattus norvegicus
agagactgccctctgtgcactaggt

SEQ ID NO: 112485 - DNA, 25 bp, Rattus norvegicus
agagactgccctgtaccgaaagatg

SEQ ID NO: 112486 - DNA, 25 bp, Rattus norvegicus
agagactgccctgtgtgcactaggt

SEQ ID NO: 112487 - DNA, 25 bp, Rattus norvegicus
agagactgcgttcacggcaccatgc

SEQ ID NO: 112488 - DNA, 25 bp, Rattus norvegicus
agagactgcgttgacggcaccatgc

SEQ ID NO: 112489 - DNA, 25 bp, Rattus norvegicus
agagactggatacctctccttggct

SEQ ID NO: 112490 - DNA, 25 bp, Rattus norvegicus
agagactggatagctctccttggct

SEQ ID NO: 112491 - DNA, 25 bp, Rattus norvegicus
agagactggcataggattcccctca

SEQ ID NO: 112492 - DNA, 25 bp, Rattus norvegicus
agagactggcattggattcccctca

SEQ ID NO: 112493 - DNA, 25 bp, Rattus norvegicus
agagactggtaaccctttcttcacg

SEQ ID NO: 112494 - DNA, 25 bp, Rattus norvegicus
agagactggtaagcctttcttcacg

SEQ ID NO: 112495 - DNA, 25 bp, Rattus norvegicus
agagactggtccatctgctggcatc

SEQ ID NO: 112496 - DNA, 25 bp, Rattus norvegicus
agagactggtccttctgctggcatc

SEQ ID NO: 112497 - DNA, 25 bp, Rattus norvegicus
agagactggtgaatgccgggcatct

SEQ ID NO: 112498 - DNA, 25 bp, Rattus norvegicus
agagactggtgattgccgggcatct

SEQ ID NO: 112499 - DNA, 25 bp, Rattus norvegicus
agagactggtggcaagcacccagaa

SEQ ID NO: 112500 - DNA, 25 bp, Rattus norvegicus
agagactggtggcttggtctttcat

SEQ ID NO: 112501 - DNA, 25 bp, Rattus norvegicus
agagactggtgggaagcacccagaa

SEQ ID NO: 112502 - DNA, 25 bp, Rattus norvegicus
agagactggtgggttggtctttcat

SEQ ID NO: 112503 - DNA, 25 bp, Rattus norvegicus
agagactgtacgaggctctgacgcc

SEQ ID NO: 112504 - DNA, 25 bp, Rattus norvegicus
agagactgtacgtggctctgacgcc

SEQ ID NO: 112505 - DNA, 25 bp, Rattus norvegicus
agagactgtattcatcgtggagatc

SEQ ID NO: 112506 - DNA, 25 bp, Rattus norvegicus
agagactgtattgatcgtggagatc

SEQ ID NO: 112507 - DNA, 25 bp, Rattus norvegicus
agagactgtctgctcctttgctgtc

SEQ ID NO: 112508 - DNA, 25 bp, Rattus norvegicus
agagactgtctggtcctttgctgtc

SEQ ID NO: 112509 - DNA, 25 bp, Rattus norvegicus
agagactgtgttacatactcctcca

SEQ ID NO: 112510 - DNA, 25 bp, Rattus norvegicus
agagactgtgtttcatactcctcca

SEQ ID NO: 112511 - DNA, 25 bp, Rattus norvegicus
agagactgttagcaccatccttcct

SEQ ID NO: 112512 - DNA, 25 bp, Rattus norvegicus
agagactgttaggaccatccttcct

SEQ ID NO: 112513 - DNA, 25 bp, Rattus norvegicus
agagactgttatctgcaccagcctc

SEQ ID NO: 112514 - DNA, 25 bp, Rattus norvegicus
agagactgttatgtgcaccagcctc

SEQ ID NO: 112515 - DNA, 25 bp, Rattus norvegicus
agagactgtttgcactttctagaaa

SEQ ID NO: 112516 - DNA, 25 bp, Rattus norvegicus
agagactgtttggactttctagaaa

SEQ ID NO: 112517 - DNA, 25 bp, Rattus norvegicus
agagacttagcactctcactgtgat

SEQ ID NO: 112518 - DNA, 25 bp, Rattus norvegicus
agagacttagcagtctcactgtgat

SEQ ID NO: 112519 - DNA, 25 bp, Rattus norvegicus
agagacttcaggatttgtggacaaa

SEQ ID NO: 112520 - DNA, 25 bp, Rattus norvegicus
agagacttcaggttttgtggacaaa

SEQ ID NO: 112521 - DNA, 25 bp, Rattus norvegicus
agagacttcgatctttgcctgcacc

SEQ ID NO: 112522 - DNA, 25 bp, Rattus norvegicus
agagacttcgatgtttgcctgcacc

SEQ ID NO: 112523 - DNA, 25 bp, Rattus norvegicus
agagacttctggatctgcctgcaca

SEQ ID NO: 112524 - DNA, 25 bp, Rattus norvegicus
agagacttctggcataccactaaga

SEQ ID NO: 112525 - DNA, 25 bp, Rattus norvegicus
agagacttctgggataccactaaga

SEQ ID NO: 112526 - DNA, 25 bp, Rattus norvegicus
agagacttctggttctgcctgcaca

SEQ ID NO: 112527 - DNA, 25 bp, Rattus norvegicus
agagacttgaagctgcctgccggcc

SEQ ID NO: 112528 - DNA, 25 bp, Rattus norvegicus
agagacttgaaggtgcctgccggcc

SEQ ID NO: 112529 - DNA, 25 bp, Rattus norvegicus
agagacttgactacggctcgcgggt

SEQ ID NO: 112530 - DNA, 25 bp, Rattus norvegicus
agagacttgacttcggctcgcgggt

SEQ ID NO: 112531 - DNA, 25 bp, Rattus norvegicus
agagacttggctccaccaccggcgt

SEQ ID NO: 112532 - DNA, 25 bp, Rattus norvegicus
agagacttggctgcaccaccggcgt

SEQ ID NO: 112533 - DNA, 25 bp, Rattus norvegicus
agagacttgggtcacgagctcgcca

SEQ ID NO: 112534 - DNA, 25 bp, Rattus norvegicus
agagacttgggtgacgagctcgcca

SEQ ID NO: 112535 - DNA, 25 bp, Rattus norvegicus
agagacttgtcaatgtaccctgagt

SEQ ID NO: 112536 - DNA, 25 bp, Rattus norvegicus
agagacttgtcattgtaccctgagt

SEQ ID NO: 112537 - DNA, 25 bp, Rattus norvegicus
agagacttgtcccagagacttcctg

SEQ ID NO: 112538 - DNA, 25 bp, Rattus norvegicus
agagacttgtccgagagacttcctg

SEQ ID NO: 112539 - DNA, 25 bp, Rattus norvegicus
agagactttcagatcagcctctgac

SEQ ID NO: 112540 - DNA, 25 bp, Rattus norvegicus
agagactttcagttcagcctctgac

SEQ ID NO: 112541 - DNA, 25 bp, Rattus norvegicus
agagactttcgaacatttgccatct

SEQ ID NO: 112542 - DNA, 25 bp, Rattus norvegicus
agagactttcgatcatttgccatct

SEQ ID NO: 112543 - DNA, 25 bp, Rattus norvegicus
agagactttctgcatgtcctcaatg

SEQ ID NO: 112544 - DNA, 25 bp, Rattus norvegicus
agagactttctggatgtcctcaatg

SEQ ID NO: 112545 - DNA, 25 bp, Rattus norvegicus
agagactttgaacttgggggcccat

SEQ ID NO: 112546 - DNA, 25 bp, Rattus norvegicus
agagactttgaagttgggggcccat

SEQ ID NO: 112547 - DNA, 25 bp, Rattus norvegicus
agagactttgcactgtccagaaaac

SEQ ID NO: 112548 - DNA, 25 bp, Rattus norvegicus
agagactttgcagtgtccagaaaac

SEQ ID NO: 112549 - DNA, 25 bp, Rattus norvegicus
agagactttggaacctttggaacca

SEQ ID NO: 112550 - DNA, 25 bp, Rattus norvegicus
agagactttggatcctttggaacca

SEQ ID NO: 112551 - DNA, 25 bp, Rattus norvegicus
agagactttgtcatgaccctgattt

SEQ ID NO: 112552 - DNA, 25 bp, Rattus norvegicus
agagactttgtcttgaccctgattt

SEQ ID NO: 112553 - DNA, 25 bp, Rattus norvegicus
agagacttttagcacctgggagata

SEQ ID NO: 112554 - DNA, 25 bp, Rattus norvegicus
agagacttttaggacctgggagata

SEQ ID NO: 112555 - DNA, 25 bp, Rattus norvegicus
agagacttttatcctgctctcctgt

SEQ ID NO: 112556 - DNA, 25 bp, Rattus norvegicus
agagacttttatgctgctctcctgt

SEQ ID NO: 112557 - DNA, 25 bp, Rattus norvegicus
agagacttttctacttgcaagttaa

SEQ ID NO: 112558 - DNA, 25 bp, Rattus norvegicus
agagacttttctccacgtgtattag

SEQ ID NO: 112559 - DNA, 25 bp, Rattus norvegicus
agagacttttctgcacgtgtattag

SEQ ID NO: 112560 - DNA, 25 bp, Rattus norvegicus
agagacttttcttcttgcaagttaa

SEQ ID NO: 112561 - DNA, 25 bp, Rattus norvegicus
agagagaaaactccctgtcccttca

SEQ ID NO: 112562 - DNA, 25 bp, Rattus norvegicus
agagagaaaactgcctgtcccttca

SEQ ID NO: 112563 - DNA, 25 bp, Rattus norvegicus
agagagaacaggattcccctgcacc

SEQ ID NO: 112564 - DNA, 25 bp, Rattus norvegicus
agagagaacaggtttcccctgcacc

SEQ ID NO: 112565 - DNA, 25 bp, Rattus norvegicus
agagagaaccacacagcctgctgct

SEQ ID NO: 112566 - DNA, 25 bp, Rattus norvegicus
agagagaaccactcagcctgctgct

SEQ ID NO: 112567 - DNA, 25 bp, Rattus norvegicus
agagagaacctaccactgggtcccc

SEQ ID NO: 112568 - DNA, 25 bp, Rattus norvegicus
agagagaacctagcactgggtcccc

SEQ ID NO: 112569 - DNA, 25 bp, Rattus norvegicus
agagagaaccttcgcttcttctcga

SEQ ID NO: 112570 - DNA, 25 bp, Rattus norvegicus
agagagaaccttggcttcttctcga

SEQ ID NO: 112571 - DNA, 25 bp, Rattus norvegicus
agagagaactgtcctaaccctctgg

SEQ ID NO: 112572 - DNA, 25 bp, Rattus norvegicus
agagagaactgtgctaaccctctgg

SEQ ID NO: 112573 - DNA, 25 bp, Rattus norvegicus
agagagaacttcagtggtgagtcca

SEQ ID NO: 112574 - DNA, 25 bp, Rattus norvegicus
agagagaacttctgtggtgagtcca

SEQ ID NO: 112575 - DNA, 25 bp, Rattus norvegicus
agagagaagccaacggcaccgttac

SEQ ID NO: 112576 - DNA, 25 bp, Rattus norvegicus
agagagaagccatcggcaccgttac

SEQ ID NO: 112577 - DNA, 25 bp, Rattus norvegicus
agagagaagcccactcatggaccgc

SEQ ID NO: 112578 - DNA, 25 bp, Rattus norvegicus
agagagaagccctctcatggaccgc

SEQ ID NO: 112579 - DNA, 25 bp, Rattus norvegicus
agagagaagctgctgccaacaccaa

SEQ ID NO: 112580 - DNA, 25 bp, Rattus norvegicus
agagagaagctggtgccaacaccaa

SEQ ID NO: 112581 - DNA, 25 bp, Rattus norvegicus
agagagaagtcaccagtgtccacca

SEQ ID NO: 112582 - DNA, 25 bp, Rattus norvegicus
agagagaagtcagcagtgtccacca

SEQ ID NO: 112583 - DNA, 25 bp, Rattus norvegicus
agagagaatcagatctgtagccttt

SEQ ID NO: 112584 - DNA, 25 bp, Rattus norvegicus
agagagaatcagttctgtagccttt

SEQ ID NO: 112585 - DNA, 25 bp, Rattus norvegicus
agagagaatccacggcaagtgtcac

SEQ ID NO: 112586 - DNA, 25 bp, Rattus norvegicus
agagagaatccagggcaagtgtcac

SEQ ID NO: 112587 - DNA, 25 bp, Rattus norvegicus
agagagaatgccatcgcagcagccc

SEQ ID NO: 112588 - DNA, 25 bp, Rattus norvegicus
agagagaatgccttcgcagcagccc

SEQ ID NO: 112589 - DNA, 25 bp, Rattus norvegicus
agagagaatgtcaactcctttcctc

SEQ ID NO: 112590 - DNA, 25 bp, Rattus norvegicus
agagagaatgtctactcctttcctc

SEQ ID NO: 112591 - DNA, 25 bp, Rattus norvegicus
agagagacacagatgcagccctcaa

SEQ ID NO: 112592 - DNA, 25 bp, Rattus norvegicus
agagagacacagttgcagccctcaa

SEQ ID NO: 112593 - DNA, 25 bp, Rattus norvegicus
agagagacactaacattgcgcccat

SEQ ID NO: 112594 - DNA, 25 bp, Rattus norvegicus
agagagacactatcattgcgcccat

SEQ ID NO: 112595 - DNA, 25 bp, Rattus norvegicus
agagagacaggtacccatgcacagg

SEQ ID NO: 112596 - DNA, 25 bp, Rattus norvegicus
agagagacaggttcccatgcacagg

SEQ ID NO: 112597 - DNA, 25 bp, Rattus norvegicus
agagagaccagcagtcgagacccca

SEQ ID NO: 112598 - DNA, 25 bp, Rattus norvegicus
agagagaccagctgtcgagacccca

SEQ ID NO: 112599 - DNA, 25 bp, Rattus norvegicus
agagagacccatcagcagagctagt

SEQ ID NO: 112600 - DNA, 25 bp, Rattus norvegicus
agagagacccatctagcctagaccc

SEQ ID NO: 112601 - DNA, 25 bp, Rattus norvegicus
agagagacccatgagcagagctagt

SEQ ID NO: 112602 - DNA, 25 bp, Rattus norvegicus
agagagacccatgtagcctagaccc

SEQ ID NO: 112603 - DNA, 25 bp, Rattus norvegicus
agagagaccctcctgactggactgc

SEQ ID NO: 112604 - DNA, 25 bp, Rattus norvegicus
agagagaccctcgtgactggactgc

SEQ ID NO: 112605 - DNA, 25 bp, Rattus norvegicus
agagagacctagctatatagataga

SEQ ID NO: 112606 - DNA, 25 bp, Rattus norvegicus
agagagacctaggtatatagataga

SEQ ID NO: 112607 - DNA, 25 bp, Rattus norvegicus
agagagacctccaatgctcagcatt

SEQ ID NO: 112608 - DNA, 25 bp, Rattus norvegicus
agagagacctcctatgctcagcatt

SEQ ID NO: 112609 - DNA, 25 bp, Rattus norvegicus
agagagacctctcagttatcttggg

SEQ ID NO: 112610 - DNA, 25 bp, Rattus norvegicus
agagagacctctgagttatcttggg

SEQ ID NO: 112611 - DNA, 25 bp, Rattus norvegicus
agagagaccttaactgaacccctag

SEQ ID NO: 112612 - DNA, 25 bp, Rattus norvegicus
agagagaccttatctgaacccctag

SEQ ID NO: 112613 - DNA, 25 bp, Rattus norvegicus
agagagacgccaactgtgtgaggtg

SEQ ID NO: 112614 - DNA, 25 bp, Rattus norvegicus
agagagacgccatctgtgtgaggtg

SEQ ID NO: 112615 - DNA, 25 bp, Rattus norvegicus
agagagacgtctccatatccatgca

SEQ ID NO: 112616 - DNA, 25 bp, Rattus norvegicus
agagagacgtctgcatatccatgca

SEQ ID NO: 112617 - DNA, 25 bp, Rattus norvegicus
agagagactcctagaaatcccctta

SEQ ID NO: 112618 - DNA, 25 bp, Rattus norvegicus
agagagactccttgaaatcccctta

SEQ ID NO: 112619 - DNA, 25 bp, Rattus norvegicus
agagagactctgatccattacaaca

SEQ ID NO: 112620 - DNA, 25 bp, Rattus norvegicus
agagagactctgttccattacaaca

SEQ ID NO: 112621 - DNA, 25 bp, Rattus norvegicus
agagagactgcccaatacctaagag

SEQ ID NO: 112622 - DNA, 25 bp, Rattus norvegicus
agagagactgccgaatacctaagag

SEQ ID NO: 112623 - DNA, 25 bp, Rattus norvegicus
agagagactgggagtccttatccgt

SEQ ID NO: 112624 - DNA, 25 bp, Rattus norvegicus
agagagactgggtgtccttatccgt

SEQ ID NO: 112625 - DNA, 25 bp, Rattus norvegicus
agagagacttctcaactgcactcct

SEQ ID NO: 112626 - DNA, 25 bp, Rattus norvegicus
agagagacttctgaactgcactcct

SEQ ID NO: 112627 - DNA, 25 bp, Rattus norvegicus
agagagactttcctgccggtggtat

SEQ ID NO: 112628 - DNA, 25 bp, Rattus norvegicus
agagagactttcgtgccggtggtat

SEQ ID NO: 112629 - DNA, 25 bp, Rattus norvegicus
agagagagacatcactgtaacccag

SEQ ID NO: 112630 - DNA, 25 bp, Rattus norvegicus
agagagagacatgactgtaacccag

SEQ ID NO: 112631 - DNA, 25 bp, Rattus norvegicus
agagagagacccatgaaccgcgcag

SEQ ID NO: 112632 - DNA, 25 bp, Rattus norvegicus
agagagagacccttgaaccgcgcag

SEQ ID NO: 112633 - DNA, 25 bp, Rattus norvegicus
agagagagacctacaacttgaatat

SEQ ID NO: 112634 - DNA, 25 bp, Rattus norvegicus
agagagagaccttcaacttgaatat

SEQ ID NO: 112635 - DNA, 25 bp, Rattus norvegicus
agagagagacttcgccagctcgtgt

SEQ ID NO: 112636 - DNA, 25 bp, Rattus norvegicus
agagagagacttctcaacagttgat

SEQ ID NO: 112637 - DNA, 25 bp, Rattus norvegicus
agagagagacttggccagctcgtgt

SEQ ID NO: 112638 - DNA, 25 bp, Rattus norvegicus
agagagagacttgtcaacagttgat

SEQ ID NO: 112639 - DNA, 25 bp, Rattus norvegicus
agagagagatccagggggcacacct

SEQ ID NO: 112640 - DNA, 25 bp, Rattus norvegicus
agagagagatcctgggggcacacct

SEQ ID NO: 112641 - DNA, 25 bp, Rattus norvegicus
agagagagcaacactcctgttcaca

SEQ ID NO: 112642 - DNA, 25 bp, Rattus norvegicus
agagagagcaactctcctgttcaca

SEQ ID NO: 112643 - DNA, 25 bp, Rattus norvegicus
agagagagcgtccttctaccttgga

SEQ ID NO: 112644 - DNA, 25 bp, Rattus norvegicus
agagagagcgtcgttctaccttgga

SEQ ID NO: 112645 - DNA, 25 bp, Rattus norvegicus
agagagagctccatgtgtggcccat

SEQ ID NO: 112646 - DNA, 25 bp, Rattus norvegicus
agagagagctccttgtgtggcccat

SEQ ID NO: 112647 - DNA, 25 bp, Rattus norvegicus
agagagagctggaccacaactggag

SEQ ID NO: 112648 - DNA, 25 bp, Rattus norvegicus
agagagagctggtccacaactggag

SEQ ID NO: 112649 - DNA, 25 bp, Rattus norvegicus
agagagaggcctcatgcttcctgtc

SEQ ID NO: 112650 - DNA, 25 bp, Rattus norvegicus
agagagaggcctgatgcttcctgtc

SEQ ID NO: 112651 - DNA, 25 bp, Rattus norvegicus
agagagaggctaattttggcagctt

SEQ ID NO: 112652 - DNA, 25 bp, Rattus norvegicus
agagagaggctatttttggcagctt

SEQ ID NO: 112653 - DNA, 25 bp, Rattus norvegicus
agagagagtctccacacgtgtccaa

SEQ ID NO: 112654 - DNA, 25 bp, Rattus norvegicus
agagagagtctcgacacgtgtccaa

SEQ ID NO: 112655 - DNA, 25 bp, Rattus norvegicus
agagagagtggcacagtacttgaat

SEQ ID NO: 112656 - DNA, 25 bp, Rattus norvegicus
agagagagtggctcagtacttgaat

SEQ ID NO: 112657 - DNA, 25 bp, Rattus norvegicus
agagagagttccacgagtcggcacg

SEQ ID NO: 112658 - DNA, 25 bp, Rattus norvegicus
agagagagttcctcgagtcggcacg

SEQ ID NO: 112659 - DNA, 25 bp, Rattus norvegicus
agagagagtttaccctggatgccac

SEQ ID NO: 112660 - DNA, 25 bp, Rattus norvegicus
agagagagtttagcctggatgccac

SEQ ID NO: 112661 - DNA, 25 bp, Rattus norvegicus
agagagatatatcacgctgctgacg

SEQ ID NO: 112662 - DNA, 25 bp, Rattus norvegicus
agagagatatatgacgctgctgacg

SEQ ID NO: 112663 - DNA, 25 bp, Rattus norvegicus
agagagatatcgacagcctcgcgca

SEQ ID NO: 112664 - DNA, 25 bp, Rattus norvegicus
agagagatatcgtcagcctcgcgca

SEQ ID NO: 112665 - DNA, 25 bp, Rattus norvegicus
agagagatcctaataatgtccacat

SEQ ID NO: 112666 - DNA, 25 bp, Rattus norvegicus
agagagatcctattaatgtccacat

SEQ ID NO: 112667 - DNA, 25 bp, Rattus norvegicus
agagagatctttcagctctccttca

SEQ ID NO: 112668 - DNA, 25 bp, Rattus norvegicus
agagagatctttgagctctccttca

SEQ ID NO: 112669 - DNA, 25 bp, Rattus norvegicus
agagagatgcacacctgaattcagt

SEQ ID NO: 112670 - DNA, 25 bp, Rattus norvegicus
agagagatgcactcctgaattcagt

SEQ ID NO: 112671 - DNA, 25 bp, Rattus norvegicus
agagagatgctgcttcgtctgctta

SEQ ID NO: 112672 - DNA, 25 bp, Rattus norvegicus
agagagatgctggttcgtctgctta

SEQ ID NO: 112673 - DNA, 25 bp, Rattus norvegicus
agagagattcccacaccaagtttgg

SEQ ID NO: 112674 - DNA, 25 bp, Rattus norvegicus
agagagattccctcaccaagtttgg

SEQ ID NO: 112675 - DNA, 25 bp, Rattus norvegicus
agagagattgcaaggcccctgtcaa

SEQ ID NO: 112676 - DNA, 25 bp, Rattus norvegicus
agagagattgcatggcccctgtcaa

SEQ ID NO: 112677 - DNA, 25 bp, Rattus norvegicus
agagagatttaaatccgccatcggg

SEQ ID NO: 112678 - DNA, 25 bp, Rattus norvegicus
agagagatttaattccgccatcggg

SEQ ID NO: 112679 - DNA, 25 bp, Rattus norvegicus
agagagatttcaacgcacgcagcca

SEQ ID NO: 112680 - DNA, 25 bp, Rattus norvegicus
agagagatttcatcgcacgcagcca

SEQ ID NO: 112681 - DNA, 25 bp, Rattus norvegicus
agagagcaactcctccacgtgatca

SEQ ID NO: 112682 - DNA, 25 bp, Rattus norvegicus
agagagcaactcgtccacgtgatca

SEQ ID NO: 112683 - DNA, 25 bp, Rattus norvegicus
agagagcacagacccacgcacaggc

SEQ ID NO: 112684 - DNA, 25 bp, Rattus norvegicus
agagagcacagagccacgcacaggc

SEQ ID NO: 112685 - DNA, 25 bp, Rattus norvegicus
agagagcacatcaaactctggcctg

SEQ ID NO: 112686 - DNA, 25 bp, Rattus norvegicus
agagagcacatctaactctggcctg

SEQ ID NO: 112687 - DNA, 25 bp, Rattus norvegicus
agagagcacgcgctgctcgcaattt

SEQ ID NO: 112688 - DNA, 25 bp, Rattus norvegicus
agagagcacgcggtgctcgcaattt

SEQ ID NO: 112689 - DNA, 25 bp, Rattus norvegicus
agagagcacgtgagaccactggcat

SEQ ID NO: 112690 - DNA, 25 bp, Rattus norvegicus
agagagcacgtgtgaccactggcat

SEQ ID NO: 112691 - DNA, 25 bp, Rattus norvegicus
agagagcactgccatggtcctcagg

SEQ ID NO: 112692 - DNA, 25 bp, Rattus norvegicus
agagagcactgcctactttccttct

SEQ ID NO: 112693 - DNA, 25 bp, Rattus norvegicus
agagagcactgcgatggtcctcagg

SEQ ID NO: 112694 - DNA, 25 bp, Rattus norvegicus
agagagcactgcgtactttccttct

SEQ ID NO: 112695 - DNA, 25 bp, Rattus norvegicus
agagagcactggctacctttttcca

SEQ ID NO: 112696 - DNA, 25 bp, Rattus norvegicus
agagagcactgggtacctttttcca

SEQ ID NO: 112697 - DNA, 25 bp, Rattus norvegicus
agagagcacttaagacatccccagt

SEQ ID NO: 112698 - DNA, 25 bp, Rattus norvegicus
agagagcacttatgacatccccagt

SEQ ID NO: 112699 - DNA, 25 bp, Rattus norvegicus
agagagcagcttaggcacaccttat

SEQ ID NO: 112700 - DNA, 25 bp, Rattus norvegicus
agagagcagctttggcacaccttat

SEQ ID NO: 112701 - DNA, 25 bp, Rattus norvegicus
agagagcagtctatattttgaacac

SEQ ID NO: 112702 - DNA, 25 bp, Rattus norvegicus
agagagcagtctttattttgaacac

SEQ ID NO: 112703 - DNA, 25 bp, Rattus norvegicus
agagagcatcagaccccaaagccat

SEQ ID NO: 112704 - DNA, 25 bp, Rattus norvegicus
agagagcatcagtccccaaagccat

SEQ ID NO: 112705 - DNA, 25 bp, Rattus norvegicus
agagagcatcatatccacagtgttg

SEQ ID NO: 112706 - DNA, 25 bp, Rattus norvegicus
agagagcatcatttccacagtgttg

SEQ ID NO: 112707 - DNA, 25 bp, Rattus norvegicus
agagagcatcccaagtcttgaggct

SEQ ID NO: 112708 - DNA, 25 bp, Rattus norvegicus
agagagcatccctagtcttgaggct

SEQ ID NO: 112709 - DNA, 25 bp, Rattus norvegicus
agagagcatccgagcagggtgcttc

SEQ ID NO: 112710 - DNA, 25 bp, Rattus norvegicus
agagagcatccgtgcagggtgcttc

SEQ ID NO: 112711 - DNA, 25 bp, Rattus norvegicus
agagagcatctcatttggccttttt

SEQ ID NO: 112712 - DNA, 25 bp, Rattus norvegicus
agagagcatctcttttggccttttt

SEQ ID NO: 112713 - DNA, 25 bp, Rattus norvegicus
agagagcattacatcctttatggat

SEQ ID NO: 112714 - DNA, 25 bp, Rattus norvegicus
agagagcattacttcctttatggat

SEQ ID NO: 112715 - DNA, 25 bp, Rattus norvegicus
agagagccacgcagcttggtcaagt

SEQ ID NO: 112716 - DNA, 25 bp, Rattus norvegicus
agagagccacgctgcttggtcaagt

SEQ ID NO: 112717 - DNA, 25 bp, Rattus norvegicus
agagagccagttccaatatagtcag

SEQ ID NO: 112718 - DNA, 25 bp, Rattus norvegicus
agagagccagttgcaatatagtcag

SEQ ID NO: 112719 - DNA, 25 bp, Rattus norvegicus
agagagccatctcacaccatttgtt

SEQ ID NO: 112720 - DNA, 25 bp, Rattus norvegicus
agagagccatctgacaccatttgtt

SEQ ID NO: 112721 - DNA, 25 bp, Rattus norvegicus
agagagccatttctacttcggtgtg

SEQ ID NO: 112722 - DNA, 25 bp, Rattus norvegicus
agagagccatttgtacttcggtgtg

SEQ ID NO: 112723 - DNA, 25 bp, Rattus norvegicus
agagagcccaggagtcccctacttt

SEQ ID NO: 112724 - DNA, 25 bp, Rattus norvegicus
agagagcccaggtgtcccctacttt

SEQ ID NO: 112725 - DNA, 25 bp, Rattus norvegicus
agagagcccatgagcgtcatctcca

SEQ ID NO: 112726 - DNA, 25 bp, Rattus norvegicus
agagagcccatgtgcgtcatctcca

SEQ ID NO: 112727 - DNA, 25 bp, Rattus norvegicus
agagagccccagctggaatcctgaa

SEQ ID NO: 112728 - DNA, 25 bp, Rattus norvegicus
agagagccccaggtggaatcctgaa

SEQ ID NO: 112729 - DNA, 25 bp, Rattus norvegicus
agagagcccgtcagaatgggcagca

SEQ ID NO: 112730 - DNA, 25 bp, Rattus norvegicus
agagagcccgtctgaatgggcagca

SEQ ID NO: 112731 - DNA, 25 bp, Rattus norvegicus
agagagccctgaaagcctgaacctg

SEQ ID NO: 112732 - DNA, 25 bp, Rattus norvegicus
agagagccctgatagcctgaacctg

SEQ ID NO: 112733 - DNA, 25 bp, Rattus norvegicus
agagagccctggcacgtgtgtccaa

SEQ ID NO: 112734 - DNA, 25 bp, Rattus norvegicus
agagagccctgggacgtgtgtccaa

SEQ ID NO: 112735 - DNA, 25 bp, Rattus norvegicus
agagagccgcctattcgtatttatt

SEQ ID NO: 112736 - DNA, 25 bp, Rattus norvegicus
agagagccgccttttcgtatttatt

SEQ ID NO: 112737 - DNA, 25 bp, Rattus norvegicus
agagagccgctcagcgccgcggcat

SEQ ID NO: 112738 - DNA, 25 bp, Rattus norvegicus
agagagccgctctgcgccgcggcat

SEQ ID NO: 112739 - DNA, 25 bp, Rattus norvegicus
agagagcctaataagccgctggcct

SEQ ID NO: 112740 - DNA, 25 bp, Rattus norvegicus
agagagcctaattagccgctggcct

SEQ ID NO: 112741 - DNA, 25 bp, Rattus norvegicus
agagagcctcaacctaggtcacaaa

SEQ ID NO: 112742 - DNA, 25 bp, Rattus norvegicus
agagagcctcaagctaggtcacaaa

SEQ ID NO: 112743 - DNA, 25 bp, Rattus norvegicus
agagagcctctgagtatgctgtcac

SEQ ID NO: 112744 - DNA, 25 bp, Rattus norvegicus
agagagcctctgtgtatgctgtcac

SEQ ID NO: 112745 - DNA, 25 bp, Rattus norvegicus
agagagcctgcccactggattgcta

SEQ ID NO: 112746 - DNA, 25 bp, Rattus norvegicus
agagagcctgccgactggattgcta

SEQ ID NO: 112747 - DNA, 25 bp, Rattus norvegicus
agagagcctgctattgttgcagaga

SEQ ID NO: 112748 - DNA, 25 bp, Rattus norvegicus
agagagcctgcttttgttgcagaga

SEQ ID NO: 112749 - DNA, 25 bp, Rattus norvegicus
agagagcctggcagatcccggctcc

SEQ ID NO: 112750 - DNA, 25 bp, Rattus norvegicus
agagagcctggccatgtcttccaag

SEQ ID NO: 112751 - DNA, 25 bp, Rattus norvegicus
agagagcctggcgatgtcttccaag

SEQ ID NO: 112752 - DNA, 25 bp, Rattus norvegicus
agagagcctggctgatcccggctcc

SEQ ID NO: 112753 - DNA, 25 bp, Rattus norvegicus
agagagcctgtaatgttcttcagat

SEQ ID NO: 112754 - DNA, 25 bp, Rattus norvegicus
agagagcctgtattgttcttcagat

SEQ ID NO: 112755 - DNA, 25 bp, Rattus norvegicus
agagagcctgtcaaccgggaaagct

SEQ ID NO: 112756 - DNA, 25 bp, Rattus norvegicus
agagagcctgtctaccgggaaagct

SEQ ID NO: 112757 - DNA, 25 bp, Rattus norvegicus
agagagccttggagtccactaactt

SEQ ID NO: 112758 - DNA, 25 bp, Rattus norvegicus
agagagccttggtgtccactaactt

SEQ ID NO: 112759 - DNA, 25 bp, Rattus norvegicus
agagagccttgtaatctccatggaa

SEQ ID NO: 112760 - DNA, 25 bp, Rattus norvegicus
agagagccttgttatctccatggaa

SEQ ID NO: 112761 - DNA, 25 bp, Rattus norvegicus
agagagccttttagctccaaccaga

SEQ ID NO: 112762 - DNA, 25 bp, Rattus norvegicus
agagagcctttttgctccaaccaga

SEQ ID NO: 112763 - DNA, 25 bp, Rattus norvegicus
agagagcgagcaacaggaccctaac

SEQ ID NO: 112764 - DNA, 25 bp, Rattus norvegicus
agagagcgagcatcaggaccctaac

SEQ ID NO: 112765 - DNA, 25 bp, Rattus norvegicus
agagagcgagccaccagtgacctga

SEQ ID NO: 112766 - DNA, 25 bp, Rattus norvegicus
agagagcgagcctccagtgacctga

SEQ ID NO: 112767 - DNA, 25 bp, Rattus norvegicus
agagagcgatccagagggtcccatt

SEQ ID NO: 112768 - DNA, 25 bp, Rattus norvegicus
agagagcgatcctgagggtcccatt

SEQ ID NO: 112769 - DNA, 25 bp, Rattus norvegicus
agagagcgctccagtcagaggactg

SEQ ID NO: 112770 - DNA, 25 bp, Rattus norvegicus
agagagcgctcctgtcagaggactg

SEQ ID NO: 112771 - DNA, 25 bp, Rattus norvegicus
agagagcgctgacgtccacttcaga

SEQ ID NO: 112772 - DNA, 25 bp, Rattus norvegicus
agagagcgctgaggtccacttcaga

SEQ ID NO: 112773 - DNA, 25 bp, Rattus norvegicus
agagagcggtccattgtggcgtccc

SEQ ID NO: 112774 - DNA, 25 bp, Rattus norvegicus
agagagcggtcctttgtggcgtccc

SEQ ID NO: 112775 - DNA, 25 bp, Rattus norvegicus
agagagcggttaccactcaggcttg

SEQ ID NO: 112776 - DNA, 25 bp, Rattus norvegicus
agagagcggttagcactcaggcttg

SEQ ID NO: 112777 - DNA, 25 bp, Rattus norvegicus
agagagctacggcaatccggccgtg

SEQ ID NO: 112778 - DNA, 25 bp, Rattus norvegicus
agagagctacgggaatccggccgtg

SEQ ID NO: 112779 - DNA, 25 bp, Rattus norvegicus
agagagctcaagattcagagtcaga

SEQ ID NO: 112780 - DNA, 25 bp, Rattus norvegicus
agagagctcaagtttcagagtcaga

SEQ ID NO: 112781 - DNA, 25 bp, Rattus norvegicus
agagagctcaatccctaaccaacca

SEQ ID NO: 112782 - DNA, 25 bp, Rattus norvegicus
agagagctcaatgcctaaccaacca

SEQ ID NO: 112783 - DNA, 25 bp, Rattus norvegicus
agagagctccatagggaaattccct

SEQ ID NO: 112784 - DNA, 25 bp, Rattus norvegicus
agagagctccattgggaaattccct

SEQ ID NO: 112785 - DNA, 25 bp, Rattus norvegicus
agagagctcccgagacagtgtggca

SEQ ID NO: 112786 - DNA, 25 bp, Rattus norvegicus
agagagctcccgtgacagtgtggca

SEQ ID NO: 112787 - DNA, 25 bp, Rattus norvegicus
agagagctctacatccagtcacaag

SEQ ID NO: 112788 - DNA, 25 bp, Rattus norvegicus
agagagctctacttccagtcacaag

SEQ ID NO: 112789 - DNA, 25 bp, Rattus norvegicus
agagagctctctagcatattctccc

SEQ ID NO: 112790 - DNA, 25 bp, Rattus norvegicus
agagagctctcttgcatattctccc

SEQ ID NO: 112791 - DNA, 25 bp, Rattus norvegicus
agagagctgatgaacatgaccttaa

SEQ ID NO: 112792 - DNA, 25 bp, Rattus norvegicus
agagagctgatgtacatgaccttaa

SEQ ID NO: 112793 - DNA, 25 bp, Rattus norvegicus
agagagctgcatcggtcacgtgaca

SEQ ID NO: 112794 - DNA, 25 bp, Rattus norvegicus
agagagctgcatgggtcacgtgaca

SEQ ID NO: 112795 - DNA, 25 bp, Rattus norvegicus
agagagctgctcaagtcccttggag

SEQ ID NO: 112796 - DNA, 25 bp, Rattus norvegicus
agagagctgctctagtcccttggag

SEQ ID NO: 112797 - DNA, 25 bp, Rattus norvegicus
agagagctggacctgccccacataa

SEQ ID NO: 112798 - DNA, 25 bp, Rattus norvegicus
agagagctggacgtgccccacataa

SEQ ID NO: 112799 - DNA, 25 bp, Rattus norvegicus
agagagctggccagtaccgctttgc

SEQ ID NO: 112800 - DNA, 25 bp, Rattus norvegicus
agagagctggcctgtaccgctttgc

SEQ ID NO: 112801 - DNA, 25 bp, Rattus norvegicus
agagagctgggcaccagtttcctgt

SEQ ID NO: 112802 - DNA, 25 bp, Rattus norvegicus
agagagctgggctccagtttcctgt

SEQ ID NO: 112803 - DNA, 25 bp, Rattus norvegicus
agagagctgtacactgtctattccc

SEQ ID NO: 112804 - DNA, 25 bp, Rattus norvegicus
agagagctgtactctgtctattccc

SEQ ID NO: 112805 - DNA, 25 bp, Rattus norvegicus
agagagctgttactcactccatggt

SEQ ID NO: 112806 - DNA, 25 bp, Rattus norvegicus
agagagctgttactccagccactgt

SEQ ID NO: 112807 - DNA, 25 bp, Rattus norvegicus
agagagctgttagtcactccatggt

SEQ ID NO: 112808 - DNA, 25 bp, Rattus norvegicus
agagagctgttagtccagccactgt

SEQ ID NO: 112809 - DNA, 25 bp, Rattus norvegicus
agagagcttcgactgtcacccgcgt

SEQ ID NO: 112810 - DNA, 25 bp, Rattus norvegicus
agagagcttcgagtgtcacccgcgt

SEQ ID NO: 112811 - DNA, 25 bp, Rattus norvegicus
agagagcttgccatggagaacaact

SEQ ID NO: 112812 - DNA, 25 bp, Rattus norvegicus
agagagcttgccttggagaacaact

SEQ ID NO: 112813 - DNA, 25 bp, Rattus norvegicus
agagagcttgctagtaaataccagg

SEQ ID NO: 112814 - DNA, 25 bp, Rattus norvegicus
agagagcttgcttgtaaataccagg

SEQ ID NO: 112815 - DNA, 25 bp, Rattus norvegicus
agagagcttgtgactgtgccttgaa

SEQ ID NO: 112816 - DNA, 25 bp, Rattus norvegicus
agagagcttgtgtctgtgccttgaa

SEQ ID NO: 112817 - DNA, 25 bp, Rattus norvegicus
agagagcttttacccatatgtagag

SEQ ID NO: 112818 - DNA, 25 bp, Rattus norvegicus
agagagcttttagccatatgtagag

SEQ ID NO: 112819 - DNA, 25 bp, Rattus norvegicus
agagagcttttcattgtgttatcaa

SEQ ID NO: 112820 - DNA, 25 bp, Rattus norvegicus
agagagcttttctttgtgttatcaa

SEQ ID NO: 112821 - DNA, 25 bp, Rattus norvegicus
agagaggaacgtcctcacgctccga

SEQ ID NO: 112822 - DNA, 25 bp, Rattus norvegicus
agagaggaacgtgctcacgctccga

SEQ ID NO: 112823 - DNA, 25 bp, Rattus norvegicus
agagaggaactcattcttcccaagc

SEQ ID NO: 112824 - DNA, 25 bp, Rattus norvegicus
agagaggaactctttcttcccaagc

SEQ ID NO: 112825 - DNA, 25 bp, Rattus norvegicus
agagaggaagagcacacacccatct

SEQ ID NO: 112826 - DNA, 25 bp, Rattus norvegicus
agagaggaagaggacacacccatct

SEQ ID NO: 112827 - DNA, 25 bp, Rattus norvegicus
agagaggaagcacgccagtccaagc

SEQ ID NO: 112828 - DNA, 25 bp, Rattus norvegicus
agagaggaagcaggccagtccaagc

SEQ ID NO: 112829 - DNA, 25 bp, Rattus norvegicus
agagaggaagctatccgaggcccga

SEQ ID NO: 112830 - DNA, 25 bp, Rattus norvegicus
agagaggaagctttccgaggcccga

SEQ ID NO: 112831 - DNA, 25 bp, Rattus norvegicus
agagaggaagttcgtcctactccca

SEQ ID NO: 112832 - DNA, 25 bp, Rattus norvegicus
agagaggaagttggtcctactccca

SEQ ID NO: 112833 - DNA, 25 bp, Rattus norvegicus
agagaggacatcatcagtggcccac

SEQ ID NO: 112834 - DNA, 25 bp, Rattus norvegicus
agagaggacatcttcagtggcccac

SEQ ID NO: 112835 - DNA, 25 bp, Rattus norvegicus
agagaggacattacagcttgcctac

SEQ ID NO: 112836 - DNA, 25 bp, Rattus norvegicus
agagaggacatttcagcttgcctac

SEQ ID NO: 112837 - DNA, 25 bp, Rattus norvegicus
agagaggaccctagattgccactgt

SEQ ID NO: 112838 - DNA, 25 bp, Rattus norvegicus
agagaggaccctcagtttgactgca

SEQ ID NO: 112839 - DNA, 25 bp, Rattus norvegicus
agagaggaccctgagtttgactgca

SEQ ID NO: 112840 - DNA, 25 bp, Rattus norvegicus
agagaggacccttgattgccactgt

SEQ ID NO: 112841 - DNA, 25 bp, Rattus norvegicus
agagaggacgccagaaacccgaagc

SEQ ID NO: 112842 - DNA, 25 bp, Rattus norvegicus
agagaggacgcctgaaacccgaagc

SEQ ID NO: 112843 - DNA, 25 bp, Rattus norvegicus
agagaggacgtgctttcaccagtct

SEQ ID NO: 112844 - DNA, 25 bp, Rattus norvegicus
agagaggacgtggtttcaccagtct

SEQ ID NO: 112845 - DNA, 25 bp, Rattus norvegicus
agagaggacttactcccaccttcac

SEQ ID NO: 112846 - DNA, 25 bp, Rattus norvegicus
agagaggacttagtcccaccttcac

SEQ ID NO: 112847 - DNA, 25 bp, Rattus norvegicus
agagaggagctcattcttggtttct

SEQ ID NO: 112848 - DNA, 25 bp, Rattus norvegicus
agagaggagctctttcttggtttct

SEQ ID NO: 112849 - DNA, 25 bp, Rattus norvegicus
agagaggaggctaccatggctgccc

SEQ ID NO: 112850 - DNA, 25 bp, Rattus norvegicus
agagaggaggcttccatggctgccc

SEQ ID NO: 112851 - DNA, 25 bp, Rattus norvegicus
agagaggagtgtctccagctccctg

SEQ ID NO: 112852 - DNA, 25 bp, Rattus norvegicus
agagaggagtgtgtccagctccctg

SEQ ID NO: 112853 - DNA, 25 bp, Rattus norvegicus
agagaggatggcactatccccaaca

SEQ ID NO: 112854 - DNA, 25 bp, Rattus norvegicus
agagaggatggctctatccccaaca

SEQ ID NO: 112855 - DNA, 25 bp, Rattus norvegicus
agagaggattccagggctcttcacc

SEQ ID NO: 112856 - DNA, 25 bp, Rattus norvegicus
agagaggattcctgggctcttcacc

SEQ ID NO: 112857 - DNA, 25 bp, Rattus norvegicus
agagaggcaaagctggccctcacac

SEQ ID NO: 112858 - DNA, 25 bp, Rattus norvegicus
agagaggcaaaggtggccctcacac

SEQ ID NO: 112859 - DNA, 25 bp, Rattus norvegicus
agagaggcaacaaccttttctaccc

SEQ ID NO: 112860 - DNA, 25 bp, Rattus norvegicus
agagaggcaacatccttttctaccc

SEQ ID NO: 112861 - DNA, 25 bp, Rattus norvegicus
agagaggcaaggagactcatccctt

SEQ ID NO: 112862 - DNA, 25 bp, Rattus norvegicus
agagaggcaaggtgactcatccctt

SEQ ID NO: 112863 - DNA, 25 bp, Rattus norvegicus
agagaggcacatctgctcctggcaa

SEQ ID NO: 112864 - DNA, 25 bp, Rattus norvegicus
agagaggcacatgtgctcctggcaa

SEQ ID NO: 112865 - DNA, 25 bp, Rattus norvegicus
agagaggcaggcacagagccgccat

SEQ ID NO: 112866 - DNA, 25 bp, Rattus norvegicus
agagaggcaggctcagagccgccat

SEQ ID NO: 112867 - DNA, 25 bp, Rattus norvegicus
agagaggcatcgactctacgtttgg

SEQ ID NO: 112868 - DNA, 25 bp, Rattus norvegicus
agagaggcatcgtctctacgtttgg

SEQ ID NO: 112869 - DNA, 25 bp, Rattus norvegicus
agagaggcatgcagcggactccatc

SEQ ID NO: 112870 - DNA, 25 bp, Rattus norvegicus
agagaggcatgctgcggactccatc

SEQ ID NO: 112871 - DNA, 25 bp, Rattus norvegicus
agagaggccaccattctgtcaaagc

SEQ ID NO: 112872 - DNA, 25 bp, Rattus norvegicus
agagaggccacctttctgtcaaagc

SEQ ID NO: 112873 - DNA, 25 bp, Rattus norvegicus
agagaggcccatctgtctgctcaca

SEQ ID NO: 112874 - DNA, 25 bp, Rattus norvegicus
agagaggcccatgtgtctgctcaca

SEQ ID NO: 112875 - DNA, 25 bp, Rattus norvegicus
agagaggccctcagtagcatagtct

SEQ ID NO: 112876 - DNA, 25 bp, Rattus norvegicus
agagaggccctcattagacatatcc

SEQ ID NO: 112877 - DNA, 25 bp, Rattus norvegicus
agagaggccctctgtagcatagtct

SEQ ID NO: 112878 - DNA, 25 bp, Rattus norvegicus
agagaggccctctttagacatatcc

SEQ ID NO: 112879 - DNA, 25 bp, Rattus norvegicus
agagaggcctcgcactcctgctgtc

SEQ ID NO: 112880 - DNA, 25 bp, Rattus norvegicus
agagaggcctcggactcctgctgtc

SEQ ID NO: 112881 - DNA, 25 bp, Rattus norvegicus
agagaggcgctgaccttgccgtcgc

SEQ ID NO: 112882 - DNA, 25 bp, Rattus norvegicus
agagaggcgctgtccttgccgtcgc

SEQ ID NO: 112883 - DNA, 25 bp, Rattus norvegicus
agagaggctctcaatctagcaccat

SEQ ID NO: 112884 - DNA, 25 bp, Rattus norvegicus
agagaggctctctatctagcaccat

SEQ ID NO: 112885 - DNA, 25 bp, Rattus norvegicus
agagaggctcttcgtcttggacaga

SEQ ID NO: 112886 - DNA, 25 bp, Rattus norvegicus
agagaggctcttggtcttggacaga

SEQ ID NO: 112887 - DNA, 25 bp, Rattus norvegicus
agagaggctgctcgcgtagtccttt

SEQ ID NO: 112888 - DNA, 25 bp, Rattus norvegicus
agagaggctgctggcgtagtccttt

SEQ ID NO: 112889 - DNA, 25 bp, Rattus norvegicus
agagaggcttacatccgatgcatag

SEQ ID NO: 112890 - DNA, 25 bp, Rattus norvegicus
agagaggcttacttccgatgcatag

SEQ ID NO: 112891 - DNA, 25 bp, Rattus norvegicus
agagaggcttatcttgctggagtcc

SEQ ID NO: 112892 - DNA, 25 bp, Rattus norvegicus
agagaggcttatgttgctggagtcc

SEQ ID NO: 112893 - DNA, 25 bp, Rattus norvegicus
agagaggcttctagctcctgggctc

SEQ ID NO: 112894 - DNA, 25 bp, Rattus norvegicus
agagaggcttcttgctcctgggctc

SEQ ID NO: 112895 - DNA, 25 bp, Rattus norvegicus
agagagggaatgctcctttgcttcc

SEQ ID NO: 112896 - DNA, 25 bp, Rattus norvegicus
agagagggaatggtcctttgcttcc

SEQ ID NO: 112897 - DNA, 25 bp, Rattus norvegicus
agagagggcagcagcttgagctcct

SEQ ID NO: 112898 - DNA, 25 bp, Rattus norvegicus
agagagggcagctgcttgagctcct

SEQ ID NO: 112899 - DNA, 25 bp, Rattus norvegicus
agagagggtcctccctgtaatcttg

SEQ ID NO: 112900 - DNA, 25 bp, Rattus norvegicus
agagagggtcctgcctgtaatcttg

SEQ ID NO: 112901 - DNA, 25 bp, Rattus norvegicus
agagagggtcgccaaatccacacgc

SEQ ID NO: 112902 - DNA, 25 bp, Rattus norvegicus
agagagggtcgcgaaatccacacgc

SEQ ID NO: 112903 - DNA, 25 bp, Rattus norvegicus
agagagggtgctactcagcagtttc

SEQ ID NO: 112904 - DNA, 25 bp, Rattus norvegicus
agagagggtgcttctcagcagtttc

SEQ ID NO: 112905 - DNA, 25 bp, Rattus norvegicus
agagaggtatcgcaggtcccaccta

SEQ ID NO: 112906 - DNA, 25 bp, Rattus norvegicus
agagaggtatcggaggtcccaccta

SEQ ID NO: 112907 - DNA, 25 bp, Rattus norvegicus
agagaggtatgtcccatgcttcgtg

SEQ ID NO: 112908 - DNA, 25 bp, Rattus norvegicus
agagaggtatgtgccatgcttcgtg

SEQ ID NO: 112909 - DNA, 25 bp, Rattus norvegicus
agagaggtcacacgagtctcccttg

SEQ ID NO: 112910 - DNA, 25 bp, Rattus norvegicus
agagaggtcacaggagtctcccttg

SEQ ID NO: 112911 - DNA, 25 bp, Rattus norvegicus
agagaggtcaccagtactcaagcag

SEQ ID NO: 112912 - DNA, 25 bp, Rattus norvegicus
agagaggtcacctgtactcaagcag

SEQ ID NO: 112913 - DNA, 25 bp, Rattus norvegicus
agagaggtccagaccgagtttagaa

SEQ ID NO: 112914 - DNA, 25 bp, Rattus norvegicus
agagaggtccagtccgagtttagaa

SEQ ID NO: 112915 - DNA, 25 bp, Rattus norvegicus
agagaggtccataggtttccttgct

SEQ ID NO: 112916 - DNA, 25 bp, Rattus norvegicus
agagaggtccattggtttccttgct

SEQ ID NO: 112917 - DNA, 25 bp, Rattus norvegicus
agagaggtcccaagcaggcatgcct

SEQ ID NO: 112918 - DNA, 25 bp, Rattus norvegicus
agagaggtcccatgcaggcatgcct

SEQ ID NO: 112919 - DNA, 25 bp, Rattus norvegicus
agagaggtgcccagagcacttgctc

SEQ ID NO: 112920 - DNA, 25 bp, Rattus norvegicus
agagaggtgccctgagcacttgctc

SEQ ID NO: 112921 - DNA, 25 bp, Rattus norvegicus
agagaggtgctcaattcggtcttcc

SEQ ID NO: 112922 - DNA, 25 bp, Rattus norvegicus
agagaggtgctctattcggtcttcc

SEQ ID NO: 112923 - DNA, 25 bp, Rattus norvegicus
agagaggttctcactgcagtgctcg

SEQ ID NO: 112924 - DNA, 25 bp, Rattus norvegicus
agagaggttctctctgcagtgctcg

SEQ ID NO: 112925 - DNA, 25 bp, Rattus norvegicus
agagaggttgctactgctggaccat

SEQ ID NO: 112926 - DNA, 25 bp, Rattus norvegicus
agagaggttgctagcgtctagtact

SEQ ID NO: 112927 - DNA, 25 bp, Rattus norvegicus
agagaggttgcttctgctggaccat

SEQ ID NO: 112928 - DNA, 25 bp, Rattus norvegicus
agagaggttgcttgcgtctagtact

SEQ ID NO: 112929 - DNA, 25 bp, Rattus norvegicus
agagaggttttgcttcagaatcaca

SEQ ID NO: 112930 - DNA, 25 bp, Rattus norvegicus
agagaggttttggttcagaatcaca

SEQ ID NO: 112931 - DNA, 25 bp, Rattus norvegicus
agagagtaaaggcacctgccaccaa

SEQ ID NO: 112932 - DNA, 25 bp, Rattus norvegicus
agagagtaaagggacctgccaccaa

SEQ ID NO: 112933 - DNA, 25 bp, Rattus norvegicus
agagagtaccagacagccatctgca

SEQ ID NO: 112934 - DNA, 25 bp, Rattus norvegicus
agagagtaccagtcagccatctgca

SEQ ID NO: 112935 - DNA, 25 bp, Rattus norvegicus
agagagtagccccaatcagtgcaga

SEQ ID NO: 112936 - DNA, 25 bp, Rattus norvegicus
agagagtagcccgaatcagtgcaga

SEQ ID NO: 112937 - DNA, 25 bp, Rattus norvegicus
agagagtagcctcccctacaatggt

SEQ ID NO: 112938 - DNA, 25 bp, Rattus norvegicus
agagagtagcctgccctacaatggt

SEQ ID NO: 112939 - DNA, 25 bp, Rattus norvegicus
agagagtcagatcaaccctgtccag

SEQ ID NO: 112940 - DNA, 25 bp, Rattus norvegicus
agagagtcagatgaaccctgtccag

SEQ ID NO: 112941 - DNA, 25 bp, Rattus norvegicus
agagagtcgcctccaaggcacagag

SEQ ID NO: 112942 - DNA, 25 bp, Rattus norvegicus
agagagtcgcctgcaaggcacagag

SEQ ID NO: 112943 - DNA, 25 bp, Rattus norvegicus
agagagtctccacaagcatgtagct

SEQ ID NO: 112944 - DNA, 25 bp, Rattus norvegicus
agagagtctccagaagcatgtagct

SEQ ID NO: 112945 - DNA, 25 bp, Rattus norvegicus
agagagtctcccacagtcttaaata

SEQ ID NO: 112946 - DNA, 25 bp, Rattus norvegicus
agagagtctccctcagtcttaaata

SEQ ID NO: 112947 - DNA, 25 bp, Rattus norvegicus
agagagtctgaaatggttccgccat

SEQ ID NO: 112948 - DNA, 25 bp, Rattus norvegicus
agagagtctgaattggttccgccat

SEQ ID NO: 112949 - DNA, 25 bp, Rattus norvegicus
agagagtctgccacgcaagcacggg

SEQ ID NO: 112950 - DNA, 25 bp, Rattus norvegicus
agagagtctgcctcgcaagcacggg

SEQ ID NO: 112951 - DNA, 25 bp, Rattus norvegicus
agagagtctgtcaggcgcgtgtatc

SEQ ID NO: 112952 - DNA, 25 bp, Rattus norvegicus
agagagtctgtctggcgcgtgtatc

SEQ ID NO: 112953 - DNA, 25 bp, Rattus norvegicus
agagagtgacccagcagacctgagc

SEQ ID NO: 112954 - DNA, 25 bp, Rattus norvegicus
agagagtgaccctgcagacctgagc

SEQ ID NO: 112955 - DNA, 25 bp, Rattus norvegicus
agagagtgatccatgggaacccctc

SEQ ID NO: 112956 - DNA, 25 bp, Rattus norvegicus
agagagtgatccttgggaacccctc

SEQ ID NO: 112957 - DNA, 25 bp, Rattus norvegicus
agagagtgcactccgtgcaggacca

SEQ ID NO: 112958 - DNA, 25 bp, Rattus norvegicus
agagagtgcactgcgtgcaggacca

SEQ ID NO: 112959 - DNA, 25 bp, Rattus norvegicus
agagagtgcagccatcaaccagatc

SEQ ID NO: 112960 - DNA, 25 bp, Rattus norvegicus
agagagtgcagccattttgtgatct

SEQ ID NO: 112961 - DNA, 25 bp, Rattus norvegicus
agagagtgcagcgatcaaccagatc

SEQ ID NO: 112962 - DNA, 25 bp, Rattus norvegicus
agagagtgcagcgattttgtgatct

SEQ ID NO: 112963 - DNA, 25 bp, Rattus norvegicus
agagagtgcagtccattgtgtcaga

SEQ ID NO: 112964 - DNA, 25 bp, Rattus norvegicus
agagagtgcagtcttcacatgttat

SEQ ID NO: 112965 - DNA, 25 bp, Rattus norvegicus
agagagtgcagtgcattgtgtcaga

SEQ ID NO: 112966 - DNA, 25 bp, Rattus norvegicus
agagagtgcagtgttcacatgttat

SEQ ID NO: 112967 - DNA, 25 bp, Rattus norvegicus
agagagtggaaccaccttccctgac

SEQ ID NO: 112968 - DNA, 25 bp, Rattus norvegicus
agagagtggaacgaccttccctgac

SEQ ID NO: 112969 - DNA, 25 bp, Rattus norvegicus
agagagtggaggacttcaaccgaca

SEQ ID NO: 112970 - DNA, 25 bp, Rattus norvegicus
agagagtggaggtcttcaaccgaca

SEQ ID NO: 112971 - DNA, 25 bp, Rattus norvegicus
agagagtggctgataatgcccagag

SEQ ID NO: 112972 - DNA, 25 bp, Rattus norvegicus
agagagtggctgttaatgcccagag

SEQ ID NO: 112973 - DNA, 25 bp, Rattus norvegicus
agagagtggtacagacttccctatc

SEQ ID NO: 112974 - DNA, 25 bp, Rattus norvegicus
agagagtggtactgacttccctatc

SEQ ID NO: 112975 - DNA, 25 bp, Rattus norvegicus
agagagtgtgatcgtccttcccacc

SEQ ID NO: 112976 - DNA, 25 bp, Rattus norvegicus
agagagtgtgatggtccttcccacc

SEQ ID NO: 112977 - DNA, 25 bp, Rattus norvegicus
agagagtgtggccaagtctttatcc

SEQ ID NO: 112978 - DNA, 25 bp, Rattus norvegicus
agagagtgtggcgaagtctttatcc

SEQ ID NO: 112979 - DNA, 25 bp, Rattus norvegicus
agagagttccagcttcagcttcctt

SEQ ID NO: 112980 - DNA, 25 bp, Rattus norvegicus
agagagttccaggttcagcttcctt

SEQ ID NO: 112981 - DNA, 25 bp, Rattus norvegicus
agagagttccatctttcctggttca

SEQ ID NO: 112982 - DNA, 25 bp, Rattus norvegicus
agagagttccatgtttcctggttca

SEQ ID NO: 112983 - DNA, 25 bp, Rattus norvegicus
agagagttcctcaatctacacgtag

SEQ ID NO: 112984 - DNA, 25 bp, Rattus norvegicus
agagagttcctctatctacacgtag

SEQ ID NO: 112985 - DNA, 25 bp, Rattus norvegicus
agagagttgagtcctagttgccctg

SEQ ID NO: 112986 - DNA, 25 bp, Rattus norvegicus
agagagttgagtgctagttgccctg

SEQ ID NO: 112987 - DNA, 25 bp, Rattus norvegicus
agagagttgcgcatgcacagtccct

SEQ ID NO: 112988 - DNA, 25 bp, Rattus norvegicus
agagagttgcgcttgcacagtccct

SEQ ID NO: 112989 - DNA, 25 bp, Rattus norvegicus
agagagttggatatcccagacccct

SEQ ID NO: 112990 - DNA, 25 bp, Rattus norvegicus
agagagttggatttcccagacccct

SEQ ID NO: 112991 - DNA, 25 bp, Rattus norvegicus
agagagttttgtagcccggcactga

SEQ ID NO: 112992 - DNA, 25 bp, Rattus norvegicus
agagagttttgttgcccggcactga

SEQ ID NO: 112993 - DNA, 25 bp, Rattus norvegicus
agagataaaacaccctgaccacagt

SEQ ID NO: 112994 - DNA, 25 bp, Rattus norvegicus
agagataaaacagcctgaccacagt

SEQ ID NO: 112995 - DNA, 25 bp, Rattus norvegicus
agagataaactaaccctccaacagg

SEQ ID NO: 112996 - DNA, 25 bp, Rattus norvegicus
agagataaactatccctccaacagg

SEQ ID NO: 112997 - DNA, 25 bp, Rattus norvegicus
agagataaacttctccatcctcctt

SEQ ID NO: 112998 - DNA, 25 bp, Rattus norvegicus
agagataaacttgtccatcctcctt

SEQ ID NO: 112999 - DNA, 25 bp, Rattus norvegicus
agagataaagagctgcgctcacccc

SEQ ID NO: 113000 - DNA, 25 bp, Rattus norvegicus
agagataaagaggtgcgctcacccc

SEQ ID NO: 113001 - DNA, 25 bp, Rattus norvegicus
agagataacctcagagccacttcaa

SEQ ID NO: 113002 - DNA, 25 bp, Rattus norvegicus
agagataacctctgagccacttcaa

SEQ ID NO: 113003 - DNA, 25 bp, Rattus norvegicus
agagatacagtcatcgatgtcccca

SEQ ID NO: 113004 - DNA, 25 bp, Rattus norvegicus
agagatacagtcttcgatgtcccca

SEQ ID NO: 113005 - DNA, 25 bp, Rattus norvegicus
agagatacccacaccaatgttctgt

SEQ ID NO: 113006 - DNA, 25 bp, Rattus norvegicus
agagatacccactccaatgttctgt

SEQ ID NO: 113007 - DNA, 25 bp, Rattus norvegicus
agagatacccagacatctatcacac

SEQ ID NO: 113008 - DNA, 25 bp, Rattus norvegicus
agagatacccagtcatctatcacac

SEQ ID NO: 113009 - DNA, 25 bp, Rattus norvegicus
agagatacctgcaaagctgtgcccc

SEQ ID NO: 113010 - DNA, 25 bp, Rattus norvegicus
agagatacctgctaagctgtgcccc

SEQ ID NO: 113011 - DNA, 25 bp, Rattus norvegicus
agagatactcctacgaactgcaaaa

SEQ ID NO: 113012 - DNA, 25 bp, Rattus norvegicus
agagatactccttcgaactgcaaaa

SEQ ID NO: 113013 - DNA, 25 bp, Rattus norvegicus
agagatactgtcagtcttcgtagga

SEQ ID NO: 113014 - DNA, 25 bp, Rattus norvegicus
agagatactgtctgtcttcgtagga

SEQ ID NO: 113015 - DNA, 25 bp, Rattus norvegicus
agagatagacctaagcaggccctcc

SEQ ID NO: 113016 - DNA, 25 bp, Rattus norvegicus
agagatagacctatcccagggtgca

SEQ ID NO: 113017 - DNA, 25 bp, Rattus norvegicus
agagatagaccttagcaggccctcc

SEQ ID NO: 113018 - DNA, 25 bp, Rattus norvegicus
agagatagacctttcccagggtgca

SEQ ID NO: 113019 - DNA, 25 bp, Rattus norvegicus
agagatagccacacacttgccagaa

SEQ ID NO: 113020 - DNA, 25 bp, Rattus norvegicus
agagatagccactcacttgccagaa

SEQ ID NO: 113021 - DNA, 25 bp, Rattus norvegicus
agagatagtccgagaagccatccgc

SEQ ID NO: 113022 - DNA, 25 bp, Rattus norvegicus
agagatagtccgtgaagccatccgc

SEQ ID NO: 113023 - DNA, 25 bp, Rattus norvegicus
agagatagtgtcacttgtcccactt

SEQ ID NO: 113024 - DNA, 25 bp, Rattus norvegicus
agagatagtgtctcttgtcccactt

SEQ ID NO: 113025 - DNA, 25 bp, Rattus norvegicus
agagatagttgtccactgtgtgctg

SEQ ID NO: 113026 - DNA, 25 bp, Rattus norvegicus
agagatagttgtgcactgtgtgctg

SEQ ID NO: 113027 - DNA, 25 bp, Rattus norvegicus
agagatataaacagtcccctgcatt

SEQ ID NO: 113028 - DNA, 25 bp, Rattus norvegicus
agagatataaactgtcccctgcatt

SEQ ID NO: 113029 - DNA, 25 bp, Rattus norvegicus
agagatatataacccctctgtcctg

SEQ ID NO: 113030 - DNA, 25 bp, Rattus norvegicus
agagatatataagccctctgtcctg

SEQ ID NO: 113031 - DNA, 25 bp, Rattus norvegicus
agagatatccacacactttataatt

SEQ ID NO: 113032 - DNA, 25 bp, Rattus norvegicus
agagatatccactcactttataatt

SEQ ID NO: 113033 - DNA, 25 bp, Rattus norvegicus
agagatatctaccaggcaagccttt

SEQ ID NO: 113034 - DNA, 25 bp, Rattus norvegicus
agagatatctacgaggcaagccttt

SEQ ID NO: 113035 - DNA, 25 bp, Rattus norvegicus
agagatatcttcatccagcaccaag

SEQ ID NO: 113036 - DNA, 25 bp, Rattus norvegicus
agagatatcttcttccagcaccaag

SEQ ID NO: 113037 - DNA, 25 bp, Rattus norvegicus
agagatatgtggagtcccttgtatc

SEQ ID NO: 113038 - DNA, 25 bp, Rattus norvegicus
agagatatgtggtgtcccttgtatc

SEQ ID NO: 113039 - DNA, 25 bp, Rattus norvegicus
agagatattcttctgtctggttact

SEQ ID NO: 113040 - DNA, 25 bp, Rattus norvegicus
agagatattcttgtgtctggttact

SEQ ID NO: 113041 - DNA, 25 bp, Rattus norvegicus
agagatattttgcacttttacttag

SEQ ID NO: 113042 - DNA, 25 bp, Rattus norvegicus
agagatattttggacttttacttag

SEQ ID NO: 113043 - DNA, 25 bp, Rattus norvegicus
agagatcaaggcactcctaggcgag

SEQ ID NO: 113044 - DNA, 25 bp, Rattus norvegicus
agagatcaaggctctcctaggcgag

SEQ ID NO: 113045 - DNA, 25 bp, Rattus norvegicus
agagatcaataaccggatcacagag

SEQ ID NO: 113046 - DNA, 25 bp, Rattus norvegicus
agagatcaataagcggatcacagag

SEQ ID NO: 113047 - DNA, 25 bp, Rattus norvegicus
agagatcaatccaggtacacggcac

SEQ ID NO: 113048 - DNA, 25 bp, Rattus norvegicus
agagatcaatcctggtacacggcac

SEQ ID NO: 113049 - DNA, 25 bp, Rattus norvegicus
agagatcaatgccttagagtccaga

SEQ ID NO: 113050 - DNA, 25 bp, Rattus norvegicus
agagatcaatgcgttagagtccaga

SEQ ID NO: 113051 - DNA, 25 bp, Rattus norvegicus
agagatcaatggagggtgcttcctt

SEQ ID NO: 113052 - DNA, 25 bp, Rattus norvegicus
agagatcaatggtgggtgcttcctt

SEQ ID NO: 113053 - DNA, 25 bp, Rattus norvegicus
agagatcacaaccaccctattcctg

SEQ ID NO: 113054 - DNA, 25 bp, Rattus norvegicus
agagatcacaacgaccctattcctg

SEQ ID NO: 113055 - DNA, 25 bp, Rattus norvegicus
agagatcacactcttcagacagcct

SEQ ID NO: 113056 - DNA, 25 bp, Rattus norvegicus
agagatcacactgttcagacagcct

SEQ ID NO: 113057 - DNA, 25 bp, Rattus norvegicus
agagatcacattcctgtaccacagt

SEQ ID NO: 113058 - DNA, 25 bp, Rattus norvegicus
agagatcacattgctgtaccacagt

SEQ ID NO: 113059 - DNA, 25 bp, Rattus norvegicus
agagatcagcaacccaatctgagga

SEQ ID NO: 113060 - DNA, 25 bp, Rattus norvegicus
agagatcagcaagccaatctgagga

SEQ ID NO: 113061 - DNA, 25 bp, Rattus norvegicus
agagatcagctcctctaatgaggct

SEQ ID NO: 113062 - DNA, 25 bp, Rattus norvegicus
agagatcagctcgtctaatgaggct

SEQ ID NO: 113063 - DNA, 25 bp, Rattus norvegicus
agagatcatccaagctgtagccaaa

SEQ ID NO: 113064 - DNA, 25 bp, Rattus norvegicus
agagatcatccatgctgtagccaaa

SEQ ID NO: 113065 - DNA, 25 bp, Rattus norvegicus
agagatcatcttaacagttcctcgg

SEQ ID NO: 113066 - DNA, 25 bp, Rattus norvegicus
agagatcatctttacagttcctcgg

SEQ ID NO: 113067 - DNA, 25 bp, Rattus norvegicus
agagatcattgcatatcagccctac

SEQ ID NO: 113068 - DNA, 25 bp, Rattus norvegicus
agagatcattgcttatcagccctac

SEQ ID NO: 113069 - DNA, 25 bp, Rattus norvegicus
agagatccaaagagcccttcgagca

SEQ ID NO: 113070 - DNA, 25 bp, Rattus norvegicus
agagatccaaagtgcccttcgagca

SEQ ID NO: 113071 - DNA, 25 bp, Rattus norvegicus
agagatccagatccaccgcggaagc

SEQ ID NO: 113072 - DNA, 25 bp, Rattus norvegicus
agagatccagatgcaccgcggaagc

SEQ ID NO: 113073 - DNA, 25 bp, Rattus norvegicus
agagatccagccctgagacactgat

SEQ ID NO: 113074 - DNA, 25 bp, Rattus norvegicus
agagatccagccgtgagacactgat

SEQ ID NO: 113075 - DNA, 25 bp, Rattus norvegicus
agagatccatctcggagaagctggc

SEQ ID NO: 113076 - DNA, 25 bp, Rattus norvegicus
agagatccatctgggagaagctggc

SEQ ID NO: 113077 - DNA, 25 bp, Rattus norvegicus
agagatcccagcacttgctgagatc

SEQ ID NO: 113078 - DNA, 25 bp, Rattus norvegicus
agagatcccagctcttgctgagatc

SEQ ID NO: 113079 - DNA, 25 bp, Rattus norvegicus
agagatcccataatgtaaagtacac

SEQ ID NO: 113080 - DNA, 25 bp, Rattus norvegicus
agagatcccatattgtaaagtacac

SEQ ID NO: 113081 - DNA, 25 bp, Rattus norvegicus
agagatccccagattcggtctgctg

SEQ ID NO: 113082 - DNA, 25 bp, Rattus norvegicus
agagatccccagtttcggtctgctg

SEQ ID NO: 113083 - DNA, 25 bp, Rattus norvegicus
agagatcccgccatttactgtgaca

SEQ ID NO: 113084 - DNA, 25 bp, Rattus norvegicus
agagatcccgccttttactgtgaca

SEQ ID NO: 113085 - DNA, 25 bp, Rattus norvegicus
agagatccctgcagttggaccttca

SEQ ID NO: 113086 - DNA, 25 bp, Rattus norvegicus
agagatccctgctgttggaccttca

SEQ ID NO: 113087 - DNA, 25 bp, Rattus norvegicus
agagatccgaagcttctgatggaca

SEQ ID NO: 113088 - DNA, 25 bp, Rattus norvegicus
agagatccgaaggttctgatggaca

SEQ ID NO: 113089 - DNA, 25 bp, Rattus norvegicus
agagatcctagaatttcacattgaa

SEQ ID NO: 113090 - DNA, 25 bp, Rattus norvegicus
agagatcctagattttcacattgaa

SEQ ID NO: 113091 - DNA, 25 bp, Rattus norvegicus
agagatcctcaactcggtggtggct

SEQ ID NO: 113092 - DNA, 25 bp, Rattus norvegicus
agagatcctcaagtcggtggtggct

SEQ ID NO: 113093 - DNA, 25 bp, Rattus norvegicus
agagatcctgccaggctttgcctgg

SEQ ID NO: 113094 - DNA, 25 bp, Rattus norvegicus
agagatcctgcctggctttgcctgg

SEQ ID NO: 113095 - DNA, 25 bp, Rattus norvegicus
agagatccttttcagtgtcctgtgg

SEQ ID NO: 113096 - DNA, 25 bp, Rattus norvegicus
agagatccttttgagtgtcctgtgg

SEQ ID NO: 113097 - DNA, 25 bp, Rattus norvegicus
agagatcgcggcagcagttctggaa

SEQ ID NO: 113098 - DNA, 25 bp, Rattus norvegicus
agagatcgcggctgcagttctggaa

SEQ ID NO: 113099 - DNA, 25 bp, Rattus norvegicus
agagatcgctctatggttccgtgag

SEQ ID NO: 113100 - DNA, 25 bp, Rattus norvegicus
agagatcgctctttggttccgtgag

SEQ ID NO: 113101 - DNA, 25 bp, Rattus norvegicus
agagatcggtctatggtttaagccc

SEQ ID NO: 113102 - DNA, 25 bp, Rattus norvegicus
agagatcggtctttggtttaagccc

SEQ ID NO: 113103 - DNA, 25 bp, Rattus norvegicus
agagatcgttccattaactccagct

SEQ ID NO: 113104 - DNA, 25 bp, Rattus norvegicus
agagatcgttcctttaactccagct

SEQ ID NO: 113105 - DNA, 25 bp, Rattus norvegicus
agagatctaattccatcgctgcggt

SEQ ID NO: 113106 - DNA, 25 bp, Rattus norvegicus
agagatctaattgcatcgctgcggt

SEQ ID NO: 113107 - DNA, 25 bp, Rattus norvegicus
agagatctacaaccctaagtctttg

SEQ ID NO: 113108 - DNA, 25 bp, Rattus norvegicus
agagatctacaagcctaagtctttg

SEQ ID NO: 113109 - DNA, 25 bp, Rattus norvegicus
agagatctagaaactggtgtatcca

SEQ ID NO: 113110 - DNA, 25 bp, Rattus norvegicus
agagatctagaatctggtgtatcca

SEQ ID NO: 113111 - DNA, 25 bp, Rattus norvegicus
agagatctaggtactgtagcctgag

SEQ ID NO: 113112 - DNA, 25 bp, Rattus norvegicus
agagatctaggttctgtagcctgag

SEQ ID NO: 113113 - DNA, 25 bp, Rattus norvegicus
agagatctatccattcaacagtaag

SEQ ID NO: 113114 - DNA, 25 bp, Rattus norvegicus
agagatctatcctttcaacagtaag

SEQ ID NO: 113115 - DNA, 25 bp, Rattus norvegicus
agagatctatgcagtgctctgcctg

SEQ ID NO: 113116 - DNA, 25 bp, Rattus norvegicus
agagatctatgctgtgctctgcctg

SEQ ID NO: 113117 - DNA, 25 bp, Rattus norvegicus
agagatctccaactgtgctttcaga

SEQ ID NO: 113118 - DNA, 25 bp, Rattus norvegicus
agagatctccaagtgtgctttcaga

SEQ ID NO: 113119 - DNA, 25 bp, Rattus norvegicus
agagatctccctagaggcagctgaa

SEQ ID NO: 113120 - DNA, 25 bp, Rattus norvegicus
agagatctcccttgaggcagctgaa

SEQ ID NO: 113121 - DNA, 25 bp, Rattus norvegicus
agagatctccttcaagttgggccag

SEQ ID NO: 113122 - DNA, 25 bp, Rattus norvegicus
agagatctccttgaagttgggccag

SEQ ID NO: 113123 - DNA, 25 bp, Rattus norvegicus
agagatctcttccaacagtctgttc

SEQ ID NO: 113124 - DNA, 25 bp, Rattus norvegicus
agagatctcttcgaacagtctgttc

SEQ ID NO: 113125 - DNA, 25 bp, Rattus norvegicus
agagatctgcctaactgctggatct

SEQ ID NO: 113126 - DNA, 25 bp, Rattus norvegicus
agagatctgcctacttttgcttcct

SEQ ID NO: 113127 - DNA, 25 bp, Rattus norvegicus
agagatctgccttactgctggatct

SEQ ID NO: 113128 - DNA, 25 bp, Rattus norvegicus
agagatctgccttcttttgcttcct

SEQ ID NO: 113129 - DNA, 25 bp, Rattus norvegicus
agagatctgctgcttctgacttcca

SEQ ID NO: 113130 - DNA, 25 bp, Rattus norvegicus
agagatctgctggttctgacttcca

SEQ ID NO: 113131 - DNA, 25 bp, Rattus norvegicus
agagatctgtccacgtttgcctcta

SEQ ID NO: 113132 - DNA, 25 bp, Rattus norvegicus
agagatctgtcctcgtttgcctcta

SEQ ID NO: 113133 - DNA, 25 bp, Rattus norvegicus
agagatctttgaatggccctgctca

SEQ ID NO: 113134 - DNA, 25 bp, Rattus norvegicus
agagatctttgattggccctgctca

SEQ ID NO: 113135 - DNA, 25 bp, Rattus norvegicus
agagatgaaagcacccgcgagcgca

SEQ ID NO: 113136 - DNA, 25 bp, Rattus norvegicus
agagatgaaagctcccgcgagcgca

SEQ ID NO: 113137 - DNA, 25 bp, Rattus norvegicus
agagatgaaatccttcagggccctg

SEQ ID NO: 113138 - DNA, 25 bp, Rattus norvegicus
agagatgaaatcgttcagggccctg

SEQ ID NO: 113139 - DNA, 25 bp, Rattus norvegicus
agagatgaaccgctctgcctaccag

SEQ ID NO: 113140 - DNA, 25 bp, Rattus norvegicus
agagatgaaccggtctgcctaccag

SEQ ID NO: 113141 - DNA, 25 bp, Rattus norvegicus
agagatgaagccacacctttccatt

SEQ ID NO: 113142 - DNA, 25 bp, Rattus norvegicus
agagatgaagcctcacctttccatt

SEQ ID NO: 113143 - DNA, 25 bp, Rattus norvegicus
agagatgaatgtccgtgctcgcctc

SEQ ID NO: 113144 - DNA, 25 bp, Rattus norvegicus
agagatgaatgtgcgtgctcgcctc

SEQ ID NO: 113145 - DNA, 25 bp, Rattus norvegicus
agagatgacgcaagctcagctcagc

SEQ ID NO: 113146 - DNA, 25 bp, Rattus norvegicus
agagatgacgcatgctcagctcagc

SEQ ID NO: 113147 - DNA, 25 bp, Rattus norvegicus
agagatgacgttcttccccaaggag

SEQ ID NO: 113148 - DNA, 25 bp, Rattus norvegicus
agagatgacgttgttccccaaggag

SEQ ID NO: 113149 - DNA, 25 bp, Rattus norvegicus
agagatgactcccttgtcttaaaga

SEQ ID NO: 113150 - DNA, 25 bp, Rattus norvegicus
agagatgactccgttgtcttaaaga

SEQ ID NO: 113151 - DNA, 25 bp, Rattus norvegicus
agagatgagccactcactctcgcag

SEQ ID NO: 113152 - DNA, 25 bp, Rattus norvegicus
agagatgagccagtcactctcgcag

SEQ ID NO: 113153 - DNA, 25 bp, Rattus norvegicus
agagatgagcccagcttgtgcagtt

SEQ ID NO: 113154 - DNA, 25 bp, Rattus norvegicus
agagatgagccctgcttgtgcagtt

SEQ ID NO: 113155 - DNA, 25 bp, Rattus norvegicus
agagatgagccgcagctccgcagct

SEQ ID NO: 113156 - DNA, 25 bp, Rattus norvegicus
agagatgagccggagctccgcagct

SEQ ID NO: 113157 - DNA, 25 bp, Rattus norvegicus
agagatgaggacacagctgggcttc

SEQ ID NO: 113158 - DNA, 25 bp, Rattus norvegicus
agagatgaggactcagctgggcttc

SEQ ID NO: 113159 - DNA, 25 bp, Rattus norvegicus
agagatgatcgcagtgacttacaca

SEQ ID NO: 113160 - DNA, 25 bp, Rattus norvegicus
agagatgatcgctgtgacttacaca

SEQ ID NO: 113161 - DNA, 25 bp, Rattus norvegicus
agagatgatgtcaacgtcttcgttc

SEQ ID NO: 113162 - DNA, 25 bp, Rattus norvegicus
agagatgatgtctacgtcttcgttc

SEQ ID NO: 113163 - DNA, 25 bp, Rattus norvegicus
agagatgatgttcgcaaccctcctt

SEQ ID NO: 113164 - DNA, 25 bp, Rattus norvegicus
agagatgatgttggcaaccctcctt

SEQ ID NO: 113165 - DNA, 25 bp, Rattus norvegicus
agagatgattgtacccagtaccact

SEQ ID NO: 113166 - DNA, 25 bp, Rattus norvegicus
agagatgattgttcccagtaccact

SEQ ID NO: 113167 - DNA, 25 bp, Rattus norvegicus
agagatgcaaggctgccaaccctga

SEQ ID NO: 113168 - DNA, 25 bp, Rattus norvegicus
agagatgcaagggtgccaaccctga

SEQ ID NO: 113169 - DNA, 25 bp, Rattus norvegicus
agagatgcagacacagaatgggagc

SEQ ID NO: 113170 - DNA, 25 bp, Rattus norvegicus
agagatgcagactcagaatgggagc

SEQ ID NO: 113171 - DNA, 25 bp, Rattus norvegicus
agagatgcagagatgaggtccttct

SEQ ID NO: 113172 - DNA, 25 bp, Rattus norvegicus
agagatgcagagttgaggtccttct

SEQ ID NO: 113173 - DNA, 25 bp, Rattus norvegicus
agagatgccatccagaagcaagcat

SEQ ID NO: 113174 - DNA, 25 bp, Rattus norvegicus
agagatgccatcgagaagcaagcat

SEQ ID NO: 113175 - DNA, 25 bp, Rattus norvegicus
agagatgcccagctcagagtcgaaa

SEQ ID NO: 113176 - DNA, 25 bp, Rattus norvegicus
agagatgcccaggtcagagtcgaaa

SEQ ID NO: 113177 - DNA, 25 bp, Rattus norvegicus
agagatgccccgatcgctacgctgg

SEQ ID NO: 113178 - DNA, 25 bp, Rattus norvegicus
agagatgccccgttcgctacgctgg

SEQ ID NO: 113179 - DNA, 25 bp, Rattus norvegicus
agagatgccctacctgagctgcagg

SEQ ID NO: 113180 - DNA, 25 bp, Rattus norvegicus
agagatgccctagctgagctgcagg

SEQ ID NO: 113181 - DNA, 25 bp, Rattus norvegicus
agagatgccgctacagtcaagccta

SEQ ID NO: 113182 - DNA, 25 bp, Rattus norvegicus
agagatgccgcttcagtcaagccta

SEQ ID NO: 113183 - DNA, 25 bp, Rattus norvegicus
agagatgcctccctcattacaggac

SEQ ID NO: 113184 - DNA, 25 bp, Rattus norvegicus
agagatgcctccgtcattacaggac

SEQ ID NO: 113185 - DNA, 25 bp, Rattus norvegicus
agagatgcgagcctttcagtgttcc

SEQ ID NO: 113186 - DNA, 25 bp, Rattus norvegicus
agagatgcgagcgtttcagtgttcc

SEQ ID NO: 113187 - DNA, 25 bp, Rattus norvegicus
agagatgctacaaaggcccaaggct

SEQ ID NO: 113188 - DNA, 25 bp, Rattus norvegicus
agagatgctacataggcccaaggct

SEQ ID NO: 113189 - DNA, 25 bp, Rattus norvegicus
agagatgctgaaccgcattccgcag

SEQ ID NO: 113190 - DNA, 25 bp, Rattus norvegicus
agagatgctgaagcgcattccgcag

SEQ ID NO: 113191 - DNA, 25 bp, Rattus norvegicus
agagatgctgcgagttcgtccagga

SEQ ID NO: 113192 - DNA, 25 bp, Rattus norvegicus
agagatgctgcgtgttcgtccagga

SEQ ID NO: 113193 - DNA, 25 bp, Rattus norvegicus
agagatgctgttcacctttggctgg

SEQ ID NO: 113194 - DNA, 25 bp, Rattus norvegicus
agagatgctgttgacctttggctgg

SEQ ID NO: 113195 - DNA, 25 bp, Rattus norvegicus
agagatgcttctcctccgtgcagtg

SEQ ID NO: 113196 - DNA, 25 bp, Rattus norvegicus
agagatgcttctcggctattgcaca

SEQ ID NO: 113197 - DNA, 25 bp, Rattus norvegicus
agagatgcttctgctccgtgcagtg

SEQ ID NO: 113198 - DNA, 25 bp, Rattus norvegicus
agagatgcttctgggctattgcaca

SEQ ID NO: 113199 - DNA, 25 bp, Rattus norvegicus
agagatgctttgacctcagacctgc

SEQ ID NO: 113200 - DNA, 25 bp, Rattus norvegicus
agagatgctttgtcctcagacctgc

SEQ ID NO: 113201 - DNA, 25 bp, Rattus norvegicus
agagatggaaccaaccttgctgtcc

SEQ ID NO: 113202 - DNA, 25 bp, Rattus norvegicus
agagatggaacctaccttgctgtcc

SEQ ID NO: 113203 - DNA, 25 bp, Rattus norvegicus
agagatggagttccttgccttcgga

SEQ ID NO: 113204 - DNA, 25 bp, Rattus norvegicus
agagatggagttgcttgccttcgga

SEQ ID NO: 113205 - DNA, 25 bp, Rattus norvegicus
agagatggcaccacagcaaagctgc

SEQ ID NO: 113206 - DNA, 25 bp, Rattus norvegicus
agagatggcacctcagcaaagctgc

SEQ ID NO: 113207 - DNA, 25 bp, Rattus norvegicus
agagatggcattccacctggttgca

SEQ ID NO: 113208 - DNA, 25 bp, Rattus norvegicus
agagatggcattgcacctggttgca

SEQ ID NO: 113209 - DNA, 25 bp, Rattus norvegicus
agagatgggcctagccagagtccat

SEQ ID NO: 113210 - DNA, 25 bp, Rattus norvegicus
agagatgggccttgccagagtccat

SEQ ID NO: 113211 - DNA, 25 bp, Rattus norvegicus
agagatgggctgaaacccatccctt

SEQ ID NO: 113212 - DNA, 25 bp, Rattus norvegicus
agagatgggctgtaacccatccctt

SEQ ID NO: 113213 - DNA, 25 bp, Rattus norvegicus
agagatggtgttatgtccctcagtc

SEQ ID NO: 113214 - DNA, 25 bp, Rattus norvegicus
agagatggtgttttgtccctcagtc

SEQ ID NO: 113215 - DNA, 25 bp, Rattus norvegicus
agagatggttggctttggttcccac

SEQ ID NO: 113216 - DNA, 25 bp, Rattus norvegicus
agagatggttgggtttggttcccac

SEQ ID NO: 113217 - DNA, 25 bp, Rattus norvegicus
agagatgtcatacccttccctaaat

SEQ ID NO: 113218 - DNA, 25 bp, Rattus norvegicus
agagatgtcatagccttccctaaat

SEQ ID NO: 113219 - DNA, 25 bp, Rattus norvegicus
agagatgtcctacaattgtgccaga

SEQ ID NO: 113220 - DNA, 25 bp, Rattus norvegicus
agagatgtcctagaattgtgccaga

SEQ ID NO: 113221 - DNA, 25 bp, Rattus norvegicus
agagatgtctgcagtcaggcttcaa

SEQ ID NO: 113222 - DNA, 25 bp, Rattus norvegicus
agagatgtctgctgtcaggcttcaa

SEQ ID NO: 113223 - DNA, 25 bp, Rattus norvegicus
agagatgtcttgctgcggttttcac

SEQ ID NO: 113224 - DNA, 25 bp, Rattus norvegicus
agagatgtcttggtgcggttttcac

SEQ ID NO: 113225 - DNA, 25 bp, Rattus norvegicus
agagatgtgaataccccaccatgac

SEQ ID NO: 113226 - DNA, 25 bp, Rattus norvegicus
agagatgtgaattccccaccatgac

SEQ ID NO: 113227 - DNA, 25 bp, Rattus norvegicus
agagatgtgacaccttgcatccccg

SEQ ID NO: 113228 - DNA, 25 bp, Rattus norvegicus
agagatgtgacagcttgcatccccg

SEQ ID NO: 113229 - DNA, 25 bp, Rattus norvegicus
agagatgtgctcagcctgaagctgc

SEQ ID NO: 113230 - DNA, 25 bp, Rattus norvegicus
agagatgtgctctgcctgaagctgc

SEQ ID NO: 113231 - DNA, 25 bp, Rattus norvegicus
agagatgtgtccctcaatcctgtgg

SEQ ID NO: 113232 - DNA, 25 bp, Rattus norvegicus
agagatgtgtccgtcaatcctgtgg

SEQ ID NO: 113233 - DNA, 25 bp, Rattus norvegicus
agagatgttgccctgctgaaccgca

SEQ ID NO: 113234 - DNA, 25 bp, Rattus norvegicus
agagatgttgccgtgctgaaccgca
